United States Patent 8,283,114 (GENES OF AN OTITIS MEDIA ISOLATE OF NONTYPEABLE HAEMOPHILUS INFLUENZAE) - sequence listing, part 3

SEQ ID NO: 772 - DNA, 1913428 bp, H. influenzae strain 086-028NP
tatggcaattaaaattggtatcaatggttttggtcgtatcggccgtatcgtattccgtgcagcacaacatcgtgatgacattgaagttgtaggtattaacgacttaatcgacgttgaatacatggcttatatgttgaaatatgattcaactcacggtcgtttcgacggcactgttgaagtgaaagatggtaacttagtggttaatggtaaaactatccgtgtcactgcagaacgtgatccagcaaacttaaactggggtgcaatcggtgttgatatcgctgttgaagcgactggtttattcttaactgatgaaactgctcgtaaacatatcactgcaggcgcaaaaaaagttgtattaactggcccatctaaagatgcaacccctatgttcgttcgtggtgtaaacttcaacgcatacgcaggtcaagatatcgtttctaacgcatcttgtacaacaaactgtttagctcctttagcacgtgttgttcatgaaactttcggtatcaaagatggtttaatgaccactgttcacgcaacgactgcaactcaaaaaactgtggatggtccatcagctaaagactggcgcggcggccgcggtgcatcacaaaacatcattccatcttcaacaggtgcagcgaaagcagtaggtaaagtattacctgcattaaacggtaaattaactggtatggctttccgtgttccaacgccaaacgtatctgttgttgatttaacagttaatcttgaaaaaccagcttcttatgatgcaatcaaacaagcaatcaaagatgcagcggaaggtaaaacgttcaatggcgaattaaaaggcgtattaggttacactgaagatgctgttgtttctactgacttcaacggttgtgctttaacttctgtatttgatgcagaagcaggtatcgcattaacagattctttcgttaaattggtatcttggtacgataacgaaacgggttactcaaacaaagtattagacttagtagctcatatctacaactacaaaggctagttaaaactttgaaaaaattaaccgctcttcagagcggttttttattatctagaatttagtttacgctctaaaaatgaacaagggatcactaaaaataatttaaaacaatcaatattcttctagcttttattcctatttaagattatattagcgcacaactgttcgctcaatgaaatcaaaaaatagggttaatatgaatctcgatctccattttgttcatcgtattcaacaacaagccaagactcgtgcaaatatgaccgcacttcgctataaagaacacggcttgtggcgagacatttcttggaaaaattttcaagagcaactcaatcaactttctcgagcattgcttactcacaatattgacgtacaagataaaatcgccatttttgcccataatatggaacgttggacaatcgctgacattgcaaccttacaaattcgagcaatcacagtgcctatttactcaaccaatacagcccagcaagcagaatttatcctaaatcacgccgatgtaaaaattctcttcgtcggcgatcaagagcaatacgatcaagcattggaaattgctcatcattgtccaaaattacaaaaaattgtggcaatgaaatctacaattcaattacaacaagatcctctttcttgcacttgggaaagttttattgaaacaggttcaaacgcccaacaagatgaactgactcaacgcttaaaccaaaaacaattatcggatttatttacgattatttatacctcaggcacaacgggagagcctaaaggtgtcatgttagattacgctaatctcgcgcatcaattagaaacgcacgatctttcacttaatgtgacagatcaggatatttcactttcttttttaccattctctcatatttttgaacgggcatgggcggcttatattcttcatagaggcgcaatactttgctatttagaagacaccaatcaagtacggtcagctttaacggaaattcgcccaactttaatgtgtgccgtcccacgtttttacgaaaaaatttatgcagccgtgctggataaagttcaaaaagcaccaaaacttcgccaaataatgttccattggacaatttctgtaggacaaaaacattttgatttacgtgcgaataacaaagctattccgttcttattgaagaaacaatttgctttagcggataaattagtactctcaaaacttcgccaattattgggtgggcgtataaaaatgatgccttgcggaggagcaaaattagaaccggctattgggttatttttccacgccattggtatcaacatcaaattaggctatggcatgacagaaacaaccgcaaccgtttcttgctggcatgatttccaatttaacccaaattcaatcggcacactcatgccaaaagcggaagttaaaattggggaaaataatgaaatcctcgtgcgtggcaaaatggtaatgaaaggctattacaagaagccagaagaaacggctcaagccttcacaaaagatggtttcttaaaaactggcgatgcgggagagtttgacgaacaaggaaatttatttattaccgatcgtatcaaagaattaatgaaaacctcaaacggtaaatatatcgcgccacaatatatcgaaagcaaaatcggtaaagataaatttatcgaacaaattgcaatcatcgcagatgcgaaaaaatatgtgtccgcactgattgtgccttgctttgatagtttggaagagtacgctaaacagatcaatattaaatatcatgaccgtttagaattattaaaaaattctgacattctgaaaatgtttgagcaacgtattaatgcggtgcaaaaagaattggctcactttgagcaagtaaagaaattcacgctactctctcaagcattcagcattaaattaggcgaaattacaccaacattaaaattgcgtagaaaagtgattttggaacgttatcgcaagcaaattgaagcaatgtatcattcacaagaagcataaccaaaaggctctcaattgagagcctttcttttctaattattcaggaaacttttcttctaaaatcaatgcaagtccatcttcattattggttgccgtaatcacatttgccgcttgtttaatttcatctggcgcatttcccattgccaccccaagtcctgcgtgttgtagcatatccaaatcattaaaattatcgccaaatgcaatcacttcattggtttgtacgccaaaataatcttccaaaaaacgcaccgcacttcctttggttgcattcttgtgcattacctctaaaaaattagcgtgggaacggcaaatacttaaatgtggaaattttttctttaaaagaacttcaatctcaatgatttcttctgcttccccaataatttgaattttatgtggcgaacttgtcgctacttcatcaaaaggatgaatctcaattttggtcacgctgcattcataaatcacccatttattttctacgtcacgagcatggcaatcattatttgtataataattcacgccaagcaaaggatgttccgccaaaacggtattaatctctaaaatatcttttggatcgatttgtacgctataaattggttcgagattttggttcaaaataagcgcgccactaaatgcaacaagcacattattcgtttcaagctgtttccaataaggcaaaatacctagaggagaacgcgccgaaattggcacaaaaggaatgccattcgccgttaaacgcttaattaccgcaacagttcgaggggaaatggtatgttgagaggttaataaggtgccatcaaaatcactaaatactgctttatacatcattactccgaataaagattatttctctgctaaataaggatcatcaaagcctaatccttgcataatttgggtttctaaactttccatttcttccgcttcatcgtcttcaatatgatcataaccgagtaaatgtaaacaaccatgcacgaccatatgcgcccaatgcgccattaatggtttctcttgttctgcagcttctcgctccacgacttgacgacaaataacgagatcccctaacaatggcaactccacctcatcggggcattcaaatggaaatgaaagcacgttagtcgggcgatcctttccacgataagttaaatttaattcatggctttcggcttcatccacaatacgcaccgtcatttcgacttcattcccttctggttgaacagcacctgttgcccactgcacaatctgctcttctgttggcaaaccctctatattttctgtggcaatttgcaaatcaaccaatacacttcccattctattctcctaaattcttttcaatttctaaccgcacttttgcacttattgaatacatataacaaacgggtgggcttatgaccacttttgtatgtataaaaatgaggggaattatacaataataaacccaccaatcccctaaatttagattacataatttatgtttaccgctaatttactctatttttaacatacaaagagacaaatcacgctatttccttaatcaacacaaaacctcaaatctctcgctcttagttggggttaattgtgaagtcgttgatgcccactataaatatttccttttccttccctagcaaaaccaattaaagtcaaattatgtttctctgccattgttactgctaaatccgttgcggcggaaatcgtgactaacatttccaccccgcaagccactgttttttgcaccatttcataactcgctcgactggaggctaaaataaaacctctaggcttacccgattttgcgtgccaaccaagcaatttatctaacgcaacgtggcgacctacatcttcgtaaatagctaacatatttccatataaatcgaaaaatgcacaagcatgggtagcaccagttttacatccaagtaattgatttttttgaagatcaataagacaactatctagcaaatttaaatcaaattgaaaagtacagtctaattttggaaaagttttatatacttgattcaattgttctgtaccacaaataccacagcctgtacgccccgtaagattacgacgatgctcttttaatgccataaatttacggctggaaagttcaatttgcacttcaataccattgcaaacttctacaacatcaatgccataaatatcttctggtttatcaataattccctctgttatagaaaagcctaaagcaaaatcctctaaattgtttggggaacacatcataactgcgtgagaaatcccgttatatactaaagaaactggcatctcaacagccagtatgtcctctttttgttgcaaaagtgcggtcaatttttctgtattttttgtctttctaaaaaagttgatagtttgtcgaatccagcactgcatttattaccagtccattagttaaatgtaaaaagtctgttaaattatttttatatttatgatctagatcacaatatttgttgaagctaatgtcatttgattatggatttatcgttaaaaaatcgttactctagccatccaataaatcaacgtttttacgatgatttatatactagagagtgttattttaacgaaatcaacataatctagctactaaacgaattttattactatctataatatctcaacaacttgttgttgaaaggagtgattatgcaggtctcaagaagaaaattcttcaagatctgtgcaggaggtatggcgggaacgtcagctgcaatgttgggctttgctccagcaaacgtattagctgcgccacgcgaatataaattattacgcgcgtttgaatcccgtaacacctgtacatattgcgctgtaagttgcggtatgttgttatatagcacaggcaaaccttacaattcattaagcagccatactggcacaaatactcgttcaaaactctttcatattgagggtgatccagatcatccagtcagtcgtggtgcgctttgcccgaaaggtgctggctcactcgattatgtcaatagtgaaagccgttctttatatcctcaatatcgtgcgccaggttctgataaatgggaacgaatttcttggaaagatgccattaaacgtattgctcgtttaatgaaagatgaccgagatgccaactttgttgaaaaagattcaaatggaaaaacggttaatcgttgggcaacgacaggaattatgactgcatcagcaatgagcaatgaagctgcgttattaacacaaaagtggattagaatgctcggtatggtgccagtatgtaaccaagcgaatacttgacacggaccaacggtagcaagtcttgctccatcatttggtcgcggtgccatgacaaataactgggttgatattaaaaatgccaacttaatcatcgttcaaggcggtaaccctgcagaagcccatcctgttggcttccgttgggcaattgaagcgaagaaaaacggtgcgaaaatcatcgttattgatccgcgttttaaccgtacagcatccgttgctgatcttcatgcgccaattcgttctggttctgatattacgttcttaatgggcgtgatccgttacctattggaaacaaaccaaattcaacacgaatatgttaaacactataccaacgcatcattcttaattgatgaaggtttcaaatttgaagatggtttatttgtagggtataacgaagaaaaacgtaactacgataaatctaaatggaactaccaatttgatgaaaatggtcacgctaaacgtgatatgacattacaacatcctcgttgtgtcattaacatcttaaaagagcacgtttctcgttataccccagaaatggttgaacgtattacaggcgtaaaacaaaaactcttcttacaaatctgtgaagaaattggtaaaacctctgtgccaaataaaacgatgacgcatctatatgcattaggttttacagagcattcaatcggtacacaaaatattcgctcaatggcgataatccagttacttttaggtaatatggggatgccaggtggcggtattaacgcattacgtggacactccaatgtgcaaggtacgacagatatgggcttattgccaatgtctttaccaggttatatgcgtttgccaaacgatagagatacctcttacgatcaatacattaacgcaattacaccaaaagatatcgttccaaaccaagtgaactattatcgtcatacttcaaaattctttgttagtatgatgaaaactttctacggagataatgccactaaggaaaatggctggggattcgatttcttaccaaaagcagatcgcctatatgatccaattactcacgttaaattgatgaatgaaggcaaattacacggttggattttacaaggttttaacgtattaaattcactaccaaataaaaataaaacgttatctggtatgagtaaactgaaatacttagtcgttatggatccattacaaactgaatcatcagaattttggaaaaattttggtgagtcaaatgatgtaaatcctgcagaaattcaaacagaagttttccgtttaccaactacttgtttcgcagaagaagaaggatcaatcgttaattctggtcgctggactcaatggcactggaaaggttgcgatcaaccgggagaagccttacctgatgttgatattctttctatgctacgcgaagaaatgcacgaactttataaaaaagagggtggacaaggaattgaatcttttgaagcgatgacttggaattatgctcaaccacactcaccaagtgcggttgaattagccaaagaattaaatggttatgcgcttgaagatctttatgatccaaacggtaacttgatgtacaagaaaggtcaattactcaatggatttgcacatttacgtgatgatggtacaacaacatcaggtaactggttatatgttggtcaatggactgaaaaaggcaaccaaactgctaatcgcgataattcagatccatcgggtttaggttgtactattggctggggctttgcatggcctgcaaaccgccgcgtactttatagccgtgcatcattagatatcaatggtaatccttgggataaaaaccgccaattaatcaaatggaacggtaaaaactggaactggtttgatattgctgactacggtacgcaaccaccaggttctgatactgggccgttcattatgtccgcagaaggcgtaggacgtttatttgccgttgataaaattgcaaatggcccaatgccagaacactatgaaccagttgaaagcccaattgatacaaacccatttcatccaaatgtagtaaccgatccaactttacgtatctataaagaagatcgtgaatttattggttcaaataaagagtatccatttgtagcaacaacttatcgtttaaccgagcatttccacagctggactgcacaatctgcattaaatatcatcgcacaaccacaacaatttgtggaaattggcgaaaaattagcggcagaaaaaggcatccaaaaaggcgatatggtaaaaattacttctcgtcgtggctatattaaagcggtcgccgtggttacaaaacgtcttaaagatctcgaaattgatggacgtgtcgtacaccatataggtcttccaattcactggaatatgaaggcattaaatggcaaaggtaaccgtggattctctacgaataccttaacaccatcttggggtgaggcaatcacgcaaacaccagaatacaaaacattcttggtaaatattgaaaaagttggggaggcataatatggctggaactgctcaaggcgttcaaacgcaagacgttattaaaatctccgcaacatctggtttaacaccagcaccacaagcgagagatcataaagttgaagtcgcaaaattaattgatgtttcaacttgtataggatgtaaagcctgtcaagtgggttgttcagagtggaatgatattcgctctgatatcaatgcacaatgtgttggggtttatgacaatccagttgatcttgatgcaaaagcatggacggtgatgcgttttaacgaagttgaagaaaacgatcgtttagaatggctgattcgtaaagatggctgtatgcactgcacagaacctggttgtttaaaggcttgtcctgcacccggtgcaatcattcaatatgctaacggtattgtagatttccaatccgataaatgtattggttgtggttattgtattgcaggctgtccattcaatattccacgaatgaatcctgaagacaatcgtgtatacaaatgtactctttgtgtggatcgtgtttctgtgggacaagagccagcttgcgtgaaaacctgtccaacaggtgctattcgtttcggctctaaagaagaaatgaaaatttacgcagaacaacgcgtggcagatttaaaatcccgtggttatgaaaacgcaggactttacgatcctccaggtgtaggcggtacacacgtaatgtatgtgttgcatcacgcagataaacctgagctttacaatggtcttccaaaagatcctcaaattgatttgagtgtgaccttatggaaagatgtattgaaaccagtcgctgcagttgcaatgggtggtctagctctagcagaagttgcgcactacttaaccgttggcccaaatgtagaagaagatgtggaagatcatcatcacgaatttgaagaaaataaaccatccaagggggaaaataatgagtaaaattgaaattagcaacgatactcgcgttatccgccatagaaccccagcacgtatcagtcactggatgttggttatttgcttttttatgacgatgttcactggtgttgcatttttcttccctgactttgcttggctcacagaaattttgggtacaccacaaattgcacgcgccattcatccatttacagggattttaatgttcttcgctttcatctacttagcgttattgtactgggatcacaatattccagaaaaaaacgatattcgctgggcaaaaggtgttattgaagttcttaaagggaatgaacacgcggttgctgataatggcaaatataaccttggtcaaaaaatgctcttttggacattaaacttggcaatggtaacgttattagtcactggcatcattatgtggcgtcaatatttttcacattacttctcaatcccagtattgcgaattgctattttactccactctgcaagtgcttttatgttattcactggtatcttagtgcatatatatatggcattttgggttaaaggatcaattcgtggtattgttgaaggttgggtaaccgttcgttgggcgaaaaaacaccacccaagatggtatcgtgaagaagttttatcaaaacttgaggaagatttactcaacgagcaatctggcaaagtaggtaaaaccaaagtcttatttaaaggatttggcaaataagctgaaatcctgaaaaagaaaaagtgcggttaaaattgaccgcactttttattataaaagtgagagaatatgagtatcaaaatcttatctgaatcagaaattaaacaagtagcaaattcatatcaagccccagcggttttatttgccaatcctaaaaatctttaccaacgcagagcgaaacgtttaagagacttagcacaaaatcatcctctatctgattatttattatttgctgcagacatagttgaaagccaactttccacgttagaaaaaaatcctttaccgccacaacagcttgaacagttaaatgctatcgagccactaaatgccaaaacctttaagagagacagtatctggcgtgaatacttaactgaaattcttgatgaaataaagcccaaagctaacgagcaaattgctgcaacaattgaatttcttgaaaaagcctcttctgctgaattagaggaaatggcaaataagctcttagcacaagaatttaatttagtcagcagtgataaagccgtctttatttgggctgcactttctctttattggttacaagcagctcaacaaattccccataatagccaagttgaaaacgctgaaaatttacatcactgccctgtttgtggttctttacctgttgcaagtattgtacagattggtacatcacaaggtttacgctacttacattgtaatttatgtgaaagtgaatggaatttggtacgcgcacaatgcaccaattgtaatagtcatgacaaacttgaaatgtggtcattaaatgaagaacttgcgcttgttcgtgccgaaacctgtggtagctgtgaaagttacttgaaaatgatgttccaagaaaaagatccttacgtagaacctgtagccgatgatttggcttctattttcttagacattgaaatggaagaaaaaggtttcgcacgcagcggattaaatccatttatttttccagcagaagacgcataaaaatatagcctaggataaacatcctaggctatatcatttgtatctataaataacaggccattactacggcattttctcgtccaccgctgggctttggataataattttttcgaatatcgacttcattaaaaccaattttttcatacaagaaacgagcagggttagactctctaacttctagccataaggtctgtacacctttttctttcaatcgagcgattaactcattcaacaataatttccccaatccattaccttgatgagagggtacaatagcaatattaaacaaagtcgcttcatctaatacggtttggcaaatagcaaaaccgataatctgattattctctattaattttaaattgagataacgctcaccttgattattttttaacgtaccaaatgaccaaggcaccagatgtgcttgctgttcgatttcatacaatcgctcgaaatcacaggcttcaatttgagaaataatagacataattaaggctgctgaatttgttgccacaacgctcgtttggcttgatgattagattgaaattgctgccaacttggcgagcgataaacctgctcagcctgcttgcaaaatggcaaagtgcggtcaatttggtcgttattttctgatagtaaccagtaacgaataggctgcttacattccatatgctggatttgatcgtaattcaaacataaacaattttcttttttaagattaaggcttaacagcacatcagccaacaaaggcgagctactgatattttcattggaaacagtgataaagcgaatattctctgccacactaattcctactgaaccttgcagtacctcggggcgatataattcccactgggaaatgcccatttcttgtaaaagaagatcgcgtctgttcataagtgaatttttaaaaacgttgcttgaaaaatagtgttaatttcttttattaatctttgctaaaatggtgcgtaattttaaccaataacccacaggattcaaagcgtgatttctctagaaagccaagttttagaacgccatctttcattttttgatggtaaatcggtattatttgctggcggtatttctgataattttcctcaaacattagcctctaaatgctcatcaatccaaatttggagttgctattttgactatgcaagaacacaaagtgcggtcaatttttccgttgaatttcaaggtcaagccgatttaatcgtttattattggactaaaaacaaacaagaagtcaatttccaactgattcaactattagctcaagcatctattggtcaagaaatattaattattggtgaaaaccgttgtggcgtgcgttcagtagaaaaaacattagcaccctatggagaaatagcaaaaattgactctgctcgtcgttgcggtttatatcatttttcactccaaaataaaccgcactttgaacttaaaaatttctggaaaacctaccaacatcctacgatacaagacttaactatatatagtttacctggtgtatttagtgcagcggaattagatacgggcacagaactgttactttcaaccattgataataaaataaaaggaaaagtactcgatcttggctgtggggcgggagtaattggctctgtgataaaaaaaagctctactaacgcacaaattaccatgactgatattcatgcgatggcgttagaatcagcgcataaaacactttctgaaaatcaattacaaggcgaggtttacgccagtgatgtcttttctgatatagaaggaaaatttgatttgatcatttcaaatccaccattccatgatggtattgatactgcctaccgagcagtgacagaactcatcactcaagcaaaatggcacctcaatcaaggtggagaattacgcattgtcgccaatgcatttttgccttatcccgaattacttagacaacatttcggtgattacgaaattcttgctcaaacaggaaaatttaaagtgtattcagtgaaaaattagaaacaaaaaaatccccatcgcaataatggggatttttctatttattacttatggatttcaccgcactttattcatccatatatcctaaactacgcaatgcacgttcatcatctgcccaacctgacttcactttcacccaaagttcgaggtgaactttgttatcaaataaacgttccatatcagcacgcgcttccataccaatagttttaattttttgaccgcccgcaccaattaccatttttttctgaccttcacgttcaacgagaattaagccattgatttcataagtgccacgttcattcactttaaattgttcaatttcaacagtaacagagtaaggcaattcttcaccggtaaaacgcattaatttttcacggattatttccgatgccataaaacgttgcgagcggtctgtgacataatcttctgggaaatgatgcacaccttcgcgtaaagattggcgtacaattttctctaattcatgaacattattaccacgctgtgcagaaattggcacaatgtgagcaaagttaaatttactgctaagatctgtaataaacggcaataaatcatctttatttttgatgttatctactttgttaatagctaacacaactggtgcttttgcattacgtagtttgtttagcaccatctcatcatctgcattccagtgtgtaccatctacgacaaaaataattaaatcaacatcgccaatagcactacttgcggcacggttcattaagcggttaatcgcccgtttttcttcaatatgaagccccggtgtatccacgtagatttcttgatacgcaccttcagttttaatcccaacaatgcggtgacgggtggtttgtgctttacgcgatgtaattgaaattttttgtcctaaaattttatttaagagcgttgatttacccacatttgggcgacctacgatagcaataaagccgcaataggttttgtcgaattgttcggtcatttgatgtccagttcttttaaaatttgttctgctgccgcttgttcagctttacgacggctagatccttttgccacaaaagtgcggtcaattttccccgcacttttcactttgcattcaacagtgaaaatttggcaatgggcttccccttgaatattgaccacttcataagttggcaatggcaaatgtttgccttgtaaatattcttgtaaacgcgttttcgcatctttttgattatcgcctggtttaatttctgccaataactgttgataccaatttcgtatcacttgggtcgtcacagccaatccctgatccaaagacattgcgccaataatcgcttctacacaatcggcaagaatagattcacggcgaaaaccaccgttctttagctcgccagaaccaagcgacatataatcgcctaattcaaattggcgcgctaaaatcgctaaagtgggttcgcgtaccaaagtagcacgcatacggctcagttctccttcattacaacgtggaaactgatgataaagtgcttcagcgatagtgaaattaagaatggaatcgcctaggaattctaggcgttcattatgttgagttgccgcacttcggtgcgtaagtgcctgctttaagagcgcaatatcattaaaacaatagccgattttacgctcaagtcgatctaaatgattcatcttattttattgctgtaaagaagcgatcaaaacggaaacctgttggccattcattcgcttctttttctaagctcatccaaatataagtggctttccccacaatatttttttcaggcacaaagccccaaaaacgactgtcatcgctgtgatcgcgatgatcccccatcacaaaatactgcccctctggcacaagccattctgcagtttgcattccctcttgtgggaaaaattcaaggtctgaataacgacgatactcaccaattaacacgttatgtgttacatcgcctttttcagtcaattctaattcattcggaaaagcaggatttgttggattttgtgtatattcaaacgccttggtttcgcaatcaacttcacaaggtttaccatctttgccatatacaatttttaatgttttttgttccacatcaaaaatgatgcgatctccgccctttccaacaatacgcttaatataatccacaccagacatattatcttttgaacttaacgctaaattttctgcaaaagccgctcgagtagccccaagaccagtacgaattaacgcttgttgtggtgctttaaacacaatcacatcgccacgttgtggtttttcgccctcaataatggtgttttggaaaatcggatctttcacaccataagcatatttattcacaactaaaaaatcgccaacgcgtaaagtggactccattgagccagagggaatttgaaacggttcaaacaaaaaagaacgaaccaaaaataccactgcaagcacaggaaaaagtgaagacaaaaattctgaagcctcagaaatcggttcaattttggctttttcttcctcacttaaggttttaccagaacgttgttctgcacgtgccacttgacgatgacgttttggcagcaccacaaaacgatgataacaccataatacgccagaaagtgcggtcaaaattagtaacaaaatactaaaagtatttggcaactgaaaataatctaaaactttccacacaccaaagccgacagccaataaaatcacaaaaaataaatttgacataattttccttatttatcttttcctacgtgtaaaattgctaaaaacgcctcttgcggcacttctacgttacctaaagacttcatacgttttttcccttctttctgcttctgtaagagttttttcttacggctcacgtcaccaccataacattttgctaatacgtttttacgtaattgtttcaccgtagaacgagcaataatatggtttccaatcgctgcttgaatagcgatatcaaattgctgacgaggaattaactcacgcattttttcaaccaattcacggccacgatattgtgaattatctttatgaacgattaaagccaacgcatctactcgttcgctgttaatcataatatccacgcgaaccatatctgccgcttggaaacgtttaaaaccgtaatctaacgaagcataaccacgcgaggttgattttaaacgatcaaagaaatctaaaaccacttcgcccattggaatttcataagtcagcgcaatctgattaccgtgatataccatattggtttgcacgccacgtttttcaacgcaaagggtaataacgttacctaaatattcttgcggcaccagcatattacattctgcgattggctcgcgaatttcagcaatattattaagtggaggcaattttgcaggactatccacataaacaacctcgccattcgttaattgcacttcgtaaattaccgttggggcagttgtgataagatctaaatcatactcacgctctagacgctcttgaatgatttccatatgcagaagtccaaggaaaccacaacggaaaccaaaaccaagtgcggtcgaagtttctggttcatagaaaagtgatgcatcgtttaaacttaatttaccaagcgcatcacgaaacgcttcataatcatcagaacttacaggaaaaagcccagcataaacctgtggttttacttttttaaagcctggtaatacttcagttgcagaattatgttgatgggttaaggtatcgcccactggcgcacctagaatatctttaatcgcacaaacaacccaacccacttcgccacattctaaaacagtcgtatcttcttgttttggcgtaaaaatccctaaacgatctacgttgtaagtttgccctgtggacatcactttaattttatcgcctttacgtaataccccatttttaatacgcactaaagataccacgcccaaatagttatcgaaccaagaatcaataatcaatgcttgtaatggcgcattaggatcgccttctggtgcgggaatttttgccacgatttcttctaatacatcttcgatacccacacccgttttagctgagcatcgaaccgcttccatcgcatcaattccaacaatatcttcaatttcttccgctacacgttcaggatctgcggcaggcaagtcgattttattcaaaatcggcactacttctaaatccatttcgattgcggtataacagtttgctagagtttgggcttcgactccttgtcctgcatccacaactaacaatgccccttcacaagcagcaagagagcgagacacttcataggaaaagtccacgtgtcctggggtatcgataaagtttaattgataagtttcgccatctttggctttataatttaaagtcacactttgtgctttgatggtaattccacgctcacgctcaagatccattgaatctagcacttgcgcttccatttcacgatccgaaagtccaccacaagtttgaatcaaacggtcagaaagtgtcgatttaccgtggtcaatatgggcaataatagaaaagttgcgaatattcttcataaaagatagtttttctcaaaaatcattaaatttaactggcggattgtacctgaaaagtgcggaaatcgctagagatgaaaaggaaaagtgcggtcaaattttcaaacttttagataaaacaaaaccccgaataacttcggggtttcttttttttcattcaaactgaaattataggctttcagtgaaagtacgagtgataacgtcgcgttgttgttctggtgttaaagagttgaaacgtactgcgtaaccagaaacacggatagttaattgtggatatttatctgggttatttaccgcatcttctaaagtttcacgacgtaatacgttcacgtttaaatgttggccaccttcaacttttacagttggtgctacgtttactggtaattcacggtattcgatttgacctaattcgctcactgcaacaacttggtcttcagcgaattcgccttttgcacataagcaacgcacttcatttttttcgctgtctaataaccagaatgaattaagcaaattgtcatttgccgcttgagtaatttgaatacctttaatcataatagcctcctaattggcacgaaaataataataaaactgtacaaattttatcaaatcattttaaaatctcaaattattttagatttatttgataaagagcaggttatttttttaattaatttttataaatttgatctaaattaaaatttattaatttttaaataaaacttatatcaataatttaacattaatttaactttttattgaatgagtgtttttgtttataatgaataaaaacttattaataggatagaataatgaaaaactggacagacgttatcggaaaagaaaaagaacaaccttactttcaacacgctctacaacaagttcatcttgcaagagcaaacgggaaaacaatttatccaccacaagaagaggtatttaatgcattcaaatataccgcttttgaagatgtaaaagtggtaattttaggtcaagatccttatcacggtgcaaaccaagcgcacggcttggctttttcagtaaaacctgaagtagccattcccccttccctattaaatatgtataaagaactcacacaagatatttcgggatttcaaatgccatcaaatggttatttagtcaaatgggcagagcaaggggtattgctacttaacacagtgcttaccgtggaacgaggtatggcacattcacacgccaatttaggttgggaaaggtttacagataaagttattgcagtgcttaatgaacatcgtgaaaaactggtgtttttactttggggcagtcacgcacaaaaaaaaggacaaattattgaccgcactcgtcaccttgttttaacggctccgcacccttccccactttcagcccatcgaggtttttttggctgtcatcatttttccaaaacaaattcatatttggaaagtaatggaatgaaaccaattgattggcaaatctaaaccatatatctctaaaaaataaccgcactttaatctctcaaagtgcggttgaatatttcagcattttaattagccgtgataacgccctacgcctaattcatcttctttacgtgtgcgattcatcacttcttgtggcgattgtgcaatacgtaatcccatttcatcttcagtacgcaccacttcgccacgtaacgaattagtataaacatcagtaatttttacatccacaaacttaccgatcatttctggagaaccttggaaattaacaatacgatttgtttcagtgcgtcctgttaattccataatatccttcttcgatggcccttcaactaacacgcgctgctctgtgccaagcatacgacgactaaattgtgcggcttgttgattaatacgctcttgtagcacataaagacgctgtttcttttcatcttccgtcacatcatctggcatatctgcagcaggcgtacctggtcgggcagaatacacaaaactgaagctcatatcaaagttcacttgtgcaatcaaattcatagtctgctcaaaatcttccgcagtttcccctgggaaaccaacaataaagtcagagctgatttgaatatctggacgcactgcacgaagtttacgaataatagatttatattctaatgcggtatgaccacgtttcatcatcgttaatacacggtcagatcctgcttgcactggaagatgcaagaaactcactaattcaggcgtgtcacgatacacatcaatgatatcatttgtaaattctattggatgactggttgtgaaacgtaaacggtcaataccatcaattgatgcgacaagacgaagcagttcagcaaagctacaaatttgaccatcgtgcgttggcccacgataggcattcacgttttgaccaagcaaattaacctctcgcacaccttgttccgcaagttgcgcaatttcaaataacacatcatctacaggacgactaacttcttccccacgagtataaggcacaacacagaaagtacagtatttattacagccttccataatggaaacaaatgcagttgggccttctgcgcgaggttcaggtaagcggtcaaatttctcaatttcagggaaactcacatcaaccacagaacttttaccaccacgaatttgattaatcatttcaggcagacgatgcaaagtttgtgggccaaaaataatatccacataaggcgcgcgatgacgaatatgctccccttcttgagaagccacacagccgcccacgccaatcactaaatttggattatttttctttaattctttccaacgcccaagttgatgaaacactttttcttgtgctttttcacgaatagaacaggtattcaataataatacgtctgcttcttcaggtgcttccgtgagttctaatccgtgagtgcttaataaaagatcggccattttagatgaatcatattcattcatctgacagccccaagttttaatatgtaatttttgagtcattttctacaatatcgttaggtgttataaataattagtcgaataaagcggtcggctattctacagacttacgataattctggctagtgaatattcggtgaaagacactaaacaggatattttgataagctagaaaggcttgtaaatcattaaaaaataagatattcataaatatactcaagatataatgcagtatgaggtaaatattagttcataaaattaaaggaaatactagcttatcgcgattacaacgatgtgtatattcaaggtaaaccaaaaggattaaatagagctcactttttaggaaagcgcaagcatatatttataatcaactactttgtctactacaccgtcaaaatagcagttaaattaaaaaaagatcagcctataaccagcctaaactcattaataatttccaccatgccataccgatagttagatggataattaaactaccaaaagcaatgatcgcaccagtaatccaccaagattttatatcattataacctgcaccgaatgcaattggacctggtccgcctccgtagtgagttactgaaccaccataagaattagcaaagactaagcctagagcaagcaattcagtaggagcacctgttacatgtccgactgttgcaaatacgggtaccattgcagctacatatgcaccgcctgatgcaaataaataacgtacagagacacttaaggtaagaatcactattaacgccatcataccatgtccctcaaactgaagtatggtacttaaggtgtttgctaaccatttgaaaaagccagatttttcaagcaagccagacatgccgatgataccaccataccatactagggtattccatgcgcctttgctttttaagatatcgtcccaggtgacgatacttaatacaatacaaagcaccattacaatgattgcaacaatggtagcattgatatgaagtgaattagagaaaatccagccgaataatgcaattacgaataacacgctgagtgctttttcacgaaaagacattggacctaattcttctaagccttttttcgcaatggctttattatccacttttttcaattctggtggagatacccaataacaaattaacggaattaagaataagcagagtaagccgggtacggatgcagctaagaaccatttgatccaagtggtttcaaaaccaagaattggtgccattaatgaaagagctaaggcattaggagccattgcggttaagaaaatataagaggtagttttaaccaccatatatacgttcatcatcaaataacgccctgcttttttcgggcttttttctggatctgaaccaagagcaaccactacgctattaatgattggaaagataatcccacctgaacgcgcggtgttagagggcgttgctggcgagagtaaaaggtctaagaacatggtaacataacctaagcgtagggttgtgctacccattgcgccgatcatatgataggcgatacgtttacctagacctgtgattacaaatgctgaactcaaagtgaatgcggtaaaaataagccatgttgtgccagatttataaccatccaacatattgccgactttaaccaattctttcgccccttcagtattaccgatgataacgccagaaaccgcaattgcagccaataagataacgggctcgccataaggtttaagcacaagcccaacgatagtggcgatataaacaccaagtaatcgccaagctatcaaagaaagcccatcaggagcaggtagtaagaaagtgatcaatgggatagccattaaaatcaccagttttgtatttttggataatgccatattaattacctctaaatgataaaaagaaaattgttagtgctaataaatcagcactaccgcccgaacttaaattacgttcaatgcaggcggtatcaaatttcattaatgcttgtgtcagtgctgttttatctgtcacaagatgttgatctgtaagcagatcctgtgctgtttgctgtatgaaatgtaatcccgctaaaccacctcgatgaaccacgttagtgtcggagttaattgccattaaattcaacaacaaaatcagtaaacgatgttcccattctaactgatggtactcatcaaattgtggcaacaacgtttgaatgagattaaaaccattttctgcttcgccacggacacctgttaagccatatttttggaataaacgcactccagccgtactaggcaagtgttcaggataatttttcagttcatccgttaaaccttgagtaaattgtgcaacaagtgagcagattaatttaacatcaaaatctaccgcactttgaaccaaacttttttgtgccaataatcgtccaattgccgtacacactaaaccaaaagaaaaaatagcacctttgtgggtgtttacgccatcagtaactttaaacattgctttttctgctaataaacctaaaggacgaatttcagcgagaatttgattttcagacaaatgcgcggtcatcatgcctttgagaacaaactgcgtaaaaaaaggttttaaactaatcgcactttgctcaaaagtatgtaggttcatatctttgtgcgaaccgttattgatggcatccactaaaccaggttttggcgataagcgagcctcttgtattaatgccagataaacttgttcaccaatatgttctgcgaaatcatgcttctgtgcgagagattgaattttatctacaatctcatcaatctcgtgcttgcgggttctcgcacagatttttgcattttctccgcacactaaacaagttcttggagaaagatcaaaatctgtacgactcagtagattgcctttagcattaaacacatctaaatcccacaaacgagcaagaggaatgctttcttccaattcaatcatcagcacttttagcgtacgagcatctatcggtaatacaaaataggcttcatgccccgtttctaacggacggattatttcttttactgctgtaatgtttaactgagtaaaaagtgcggtcagattttctagagcttttctaaaaacataatccaacaaagcatttttttttactccacccacagcagttaaagtgatgcaaagtaaggtttgtccatattgtgttataagctgttgttgtaaaattgcacgttcctctcgagcattaagtaatgcttcaagtgaaatttctgaaccctttgtagagaatgtcgtaaaaaaatgctgcaaaatttgaccgctcttttgtataaaaataaattttcttaacgctttccatttatagggtgttggcgaaagctgaaagagctaattgagtccctttcaactctttgggtttctttcctgataatcatgggaagacaagagttaattttggctattgaaagtagatcgcttgtaatgctgattctagtctttaacttgatacaccgtatcaatcaccgaaccatcacgataacgaacaacagccacaggtttattagtaaactcaatttcttttggtttaccagtaatgctgtaagcacgttcacaaagttgttcaatagtaaacaatggaatgtctgttttgcttaaagcttcaatcaaatctggacgtttaggatttactgctacaccatgatcggtaacgagaatatcgacgttttcaccaggtgttacacaggtaatcacgttttccaccacggttggaatacgaccacgaactaatggtgccacaatgattgctacttgtgcagaagctgcggtatcacaatgaccaccagatgcaccgcgaatcacaccgtcagagccagtcaatacattcacgttaaatttagtgtcgatttctaaagcagaaagaatcaccatatctaaacgttcaacagatgcgcctttggaactgtaattcgcatattggttagcggagacttcaatatgatttgggttacgggcaagtgattcagctgcaacagaatcaaagctttgtacatctaataattttttaataagaccagtctcatgtaatgccaccatacttgcagtaattccgccaagtgcgaaatctgcagtgatattttcacgacgcattttttcttctagaaagcgtgtaacagctaatgctgcccccccagaaccagtttgtaatgagaagccatctttaaaataaccactggcaaaaattacttctgcacatttacgcgcaatgagtaattcgcgtggattggtagtcattcgggttgcaccaccaccaatttttttcgggtcaccgactgcttcaacttgcacgattaaatctacttgatcttgagctatgctgattgggtagtgcgggtattcaacaaattcctctgtgagcaacacaacttggtcagcatattcagcatcgacacgcgcatagcctagagagccgcatttactttttccagtaaatccattggcattaccgaatgtgtcacagcaaggcacgcctaaaaaagcaacgtcaatttttaattcgccagattttactaagtgaacacgtccaccatgagaatgaatatttacaggttcattcaataaaccacgagagatttgctctgcaagttcaccgcgtaaaccagaagaatagattttggtgaccacgccatttttgatatattcgacaatcgggaagtggctatcaattaaagatgaagatgcaagggtcagatttttgaaacccatttcggcaattttattcatcaccatattcaccacaaaatctccgccccgaaaagcatgatgaaatgaaacagtcataccatcttttaagccagagcgtttaatcgcttcttctagagaggtacaaagtttgcgatctttcgctgtacgagaaagggattcagatttaggcaccgcctgatagactgagcgatcagcgtgatatttttcaatacgttgttctcttgttgtcatctttttatctccctttactcttcacgaatacctgatttcgcacgttctaatacaagttttgcgcgatcaataatcggtgcgtcaatcattttaccgtttaacgaaacaacaccagccccttgtcgttcagcttctgctgccgcttcaataatgcgttttgcctgctccacgtctttttgtgtcggtgcaaataagttgtgtaacaattcaatttggcgtgggttgattaaggatttaccgtcaaaaccaagctgtttaattaacgcagcctcttttaagaagccttcttcattgttcgcgttagaatatacggtatcaaaagcctgaatgccagccgcacgtgccgcttgtaaaatagaacaacgagcaaaaagcagttcaatcccctctggtgaacgctcggtttttaagttacgtacgtaatcctctgcacccaatgcgataccaattaaacgtttagaagcgaaagcgatttggttggcttgagtgatacctaatggcgattcgatggctgctagcattttagtcgaacctgcttctcgaccgcaggctttctcaatctcagtaatggcgtgatccatatccaacacatcttgcgcgctttcagtttttggcatacgtaccacatccacacccgcacgcactaccgaattcaaatccaataaaccaaattcagaatctagcggattaacacgaactacggtctcaatttctttataaagcggatgttgaagtgcatgagcgactaataaacgagcagaatctttttctttgagcgcaaccgcatcttctaagtcaaacataatggaatctggtttataaataaagctattactcaacatggcggcatttgagcccggcacaaataacatacttcttcttaatttcatagcacagcctcccagttaatcgtttcatcagttgcacgcattgcagcagcttttactcgagcttgtaacacgcaatctaacgcccctttgtcttctacaatgacttgtgctgctgtaatgcctagttttgctaatacttcacgaactgtcgcttcaatttgttcaccaaattgttttgctactgagctattgatttcaatatcgagtgaatcaaaaggttgaacccgtacttgaacatcactggattccagtgtccctgcaacggctacttttgttattttcatagattttccttccgtatattgatgaataaaaatgtatttaaaaacgaccgcacttttgtaaataatttaacgtagtcataggcacaaactctgcgagttgagcccaatttttttcagccaaatgctttcgtactgtagaagcagaaataatgtggttgcttgctgtttttctaggtatctcgataacatttatttttggtgcattcatttcggcatccattaaccaataatgcatttggcgattatattcggcagtgatgggacaatttagctcagtaccaacaaagcgatgtgttattcccaaagcttgagcaatatgtaaacggaataacttcagatcaatctcaaaataactttcatctgtaattaattgatcttttaggaaataatttggaaatgttgcacgagaaataatatagtcagagccagaatgaagagtgatattggataaatcgaaaataccttgttgaatcatttcaaatcgttcagtgtaagaaaattgcgatgcgtcttcaccgacaataaataaatgcagatgatcacattgttgtaatgcttgctcaattaaataacgatgacctaaggtaaatggattcgcgttcattacaatcgagccaattcgattaccatccacacgcattttctcccataatgagcattgtttttgtaaacgcgtagcactattttctaacaatactacataaggattggcatcagagatgatataaaaaccacaagatttgaacaacgttgcatattcgggttttgtataaataaaaaggtgtgggcgttttagcgtgtaagctaaatcaaccaattcagtaattaattgcaaggcaacaccgctaccacgcaaagactcatcaatcgcaacacattttatgatattgcctgctaaaccgccacagacaacgatttgttcgttatcattatagccaacaacaaaatactcgatttgttcatctaatttaagcgcattttgatgtaaaaatgtctgaatgagggaaagttttttttgttcagtagaaattcgctcaaattgcatcgactctccaaaaaagaagaaaacataacatcactaccaagttagtagtatagagctattataagcgatgagcaaattacgatacaagataagctcatatttttcccaactttataatctaatattatcttaacactgcattatacattgaataatttataggcaatattggcggttattctgagttgtaaaaataaaccgcacttttgttgcaagcaaaaagtgcggtttaatttagcagaattttaaattatttcactaatccgccactggcttgtaaatcagcgtgataagaagaacgaacaaatggcccacaagccgcatgttcaaagcccatttcattggctttatcacggaattcatcaaattcagttggcggcacataacgggcaacaggcaaatgatggcggctaggttgaagatattgacccaacgtgagcatagtcacaccgttatcacgtaaatcttgcatcacttgcaaaatttcctcgttggtttcgcctaacccaaccattaaaccagatttggttgggatatttgggaatatttctttgaattcacgcaataatttaagtgaccattcgtaatccgcacctggacgaatttctttatataagcgcggtacgttttctaaattatggttaaagacatctggcggattatcttttaatttctctaaagcctgtgtaatgcgaccacgaaaatcaggcactaaaatttcaatcttaatgttaggattaagctcgcgcacagcttttacacattcagaaaaatgaccagcaccacgatcaggcaagtcatcacgatccaccgatgtgattaccacatatttaagtttcatatcttgaatcgtttctgccaatttttgtggctcttcaggatcaggcggtaatggtttaccgtgagccacatcacagaatgggcaacggcgcgtacaaattgcacctaaaatcataaaagtggctgtgccatgattaaaacattcgtgtaaatttggacaagacgcttcctcacaaacagaatgtaatccgtgacggcgcattccatttttaatgctttcaattttagctgaacttgctggaagtttaattttcatccattctggtttttttaataactcttgattaggatcgatattttttacgggaataattgaggtttttgccgcatcgcgatattttacaccgcgttccattttgaaaggcgtagacatagtattttcctaaataaaaatgcccaaattgggcatttagtttttataaaatgttataaagttgttatattatagcctaaaagatcggcgaagtgtttaattaattttgctgaaacattatcgcaatcagcttcatcttgattaacaaaatccgctaactgacacatttcaagccctgcatacccacaaggattaatataatggaaaggattaagatccatattaatattcaatgccaacccgtgaaaagagcaaccacgacgaatacgtaatccaagagaacaaatcttttttccatccacataaacacctggcgcatcaggctttggatagctttcaatgccatattcagccaaagttttaaccaccgtttgttcaagtgcggtaactaattgacgcacatttaagtttttatggcgtttaatgtcaataagcacatacatcacttgctgaccgggtgcgtgataggtaatttgcccaccacgatccgattgcaccacagggatttcactacgttgtaaaagatgctctggtttacctgcttgcccttgggtaaaaacaggataatgttgtactaaccaaatttcgtcttgcgtttcagcatttcgagtatcagtaaaatcctgcattttgtgccaaatttcttgataatcttgcaatcctaactgacgaacgataagggaattgttcatactaaataaccattttcacgccttcaactttagccagttctttatagagtgtttctacctgatcaaagttttcagcaataatatcaattgaaactgaattataagtgcctttactactgcgcttttcttttggaatataatcgcctttaatatatttttgcaccacttgtataagatcttgtgctaacccttctcgattaattcccgcaactttaaaagtcatttttgctggaaattccattaattccttgagttttgcataatcgttttctattgtcattttctttcctaaaaataaaataaatcaaaaagtgcggtcaattttcaacttgtttttatgagaataaccctttcacagtcaatactaaccaatcccatagtttaccaaaaatacccgcttctcccacatcattcatcacttgtaaattggcacttgcaatatccttaccatccagttgataaaccactttaccaatcacttgaccttttgctaatggtgcttgtaaatttttatctgctaattcataacgagctttaacctcactttgtttacctttaggtatcgtaataaagtgatccattaaagcaccaagttttactgaatttttatcgccataataaaccctttgttctgaaatttctttaccagcctctaaagttttaaatgtttcgaaattagcaaaaccccattgtaaaagtttcttactttctacttcacgacctttgtaagttggcacacccattactacagaaattaaacgcatattgtttgatgtagtcgctgaagcgactaagttatatcctgcttggctagtatgccctgtcttcattccatcaacattgatagttttatcccataatagtccattacggttagcttgtttgattttattaaatgtaaagtctttttcggagtaaattttatattcttcaggtaaatcacgaataatatgcgcaccaataattgccatatcacgcgcggaagaatattgatttggatcgtctaaaccatggggcgtggtgaaatttgtatttttcaaaccaaattgttgaacatatttattcattgtttctacaaagttcggtacattgccagaaatatgttcagctaatgcaacagtcgcatcattaccagaaacaacaatcacacctcgatttaaatctgctacagatacttgtgtatttaaatctaaaaacatttttgatgaatcagggaaattacgcccccacgcactttcaccaatggtaaccatatcggtattatggattttgccttgttttaatgcgacaccaactacataacttgtcatcattttagtcagtgatgctggatattgacgttgatctggattaagtgcggtcaaaattgcacctgaattataatccatcaatacatacgtttgagccgtaatttgtggtggagttacgccaaactgcatatcctctgcagataccgaaaaagcactaagtgccacaaaacttgataaaaatgcgatttttgttgttcttttcaacatagtgtgttcctacaattaatttttatacgtataaacaattaatggcttattatttgccattttttgtaatttagttctcacttgtgccatttttgttttgtcatcaaaaggcccaatataaatttcatatttatttcctgagcgatttacttcagtctgaatattcgctaacgcaagctgcgtaattaatttatttgcttggctatgagaggttaattcaagcattttcaaacagtaaaattcggttccttttagagcatttattgacttagatgcgttatcaaaaagcgtgttagattttaatactaaacgatcggcagcttcctgagtttttgcttgtttagccagtgtttttgtggctgcacctgataaattcccatttttagcaacgtgcaacgcctcaattcttacctgccctatgccgcgggaaattaagccaatttcttttgccgcagcgtgtgaaagatcaattaaacgtttatcactaaaaggcccacgatcattaatacgtacgataactttacgattgttatgtaaatttgtcactaaagcataagaatttattggcaatgttttatgtgctgcagtaaattgttttgagttataaacatcgccacttgctgtttttcgcccatcaaatttaagatgataataacttgctaaaccttctttaatataagatttggcttcattcccacttttagtggtataagtttgcccttttactgaataagtccttggtgcaggcatttgagttgcgatagaaagattatcccctcgaataccatacattttttgcgtatcagcctgcgcaggaaaagctacgcttatcataaatagcaaaagtgcggtcaaatttaacccagtttttaatttcataaaatactaacgcttttcatttattctttctttaagaaagaaaaaaatgaaattagctccttttcataaattgacttttatgcgtatgaatagacatcagtaaaccaaaacttgccataatcgcaacataagaggtaccaccataactaaataaaggtaatggcacacccacaacaggcaaaattccgcttaccattccaatattcacaaatacataaacaaagaaaattaatgttgttgcaccagcaagaatacgcccaaaagaagtttgagcatttacggcaatcattaaacctcgcacaataataaacaagtaaatcgccattaaaatcaaaaaaccaatcattccgtgctcttcacccattaccgcaaaaataaaatctgtatgaggttcgggcaaaaattctaattgtgattgagtcccctgcatccagccttttccgcttaatccaccagaaccaatcgcaatctttgattgtaaaatatgatagccagcaccgagaggatctttttctgggtccaataatgtgagaacgcgagtgcgttgataatcgtgcattagatataaccacatgatcggaataaatccagctaagccaatcactgcagctaaaataagccaccagctcattcctgctaaaaacacgacaaataaacctgacgcactgaccaaaattgctgtgcctaaatcaggctgaatcgccacaagcaatgttggcagtagaatcattgcaatcgctataaatgtttcacttaatttaggtggaagcggacgattacctaaatacaccgccaccattaatggcacagcaagttttacaatttcagagggttgaaaacgaataaatcccagatcaagccaacgctgcgcacctttacttgtcgtgccaatagcatctactaagatcaacaacacaaaaccaattaaataaagataaggtgcgatgcgttggtaaaatcttggtggaaattgagccattaacaacataacaataaatccaagtaaaacctgaataattcggttattaaacatcatttcactggcacctgatgcactatataacaccagcataccataagccgttattgcaagaagtccgataaacagccaaaaatcaatatgcaaacgttgccaaacacgcaaccaaaaagggattttatcttccatttatttgttcgctctcttgtgacaaatcttttttttgctgaataggtacattatatttttcaacttgtggtaaacgctgatttaaatagtaatccatcactttacgcgctaacggtgcggcattacttgaaccaccacctgcattttctaaaatcactgtcacaaccaatctagggttttcataaggcgcatatgcggtaaaccatgcgtgatcatgcaattcttttttcaatcccaccgcattgtatttttcattttcttttaaactaaacacttgagcagtaccagattttcctgcaacacgataattggcatctgcaaaggcttttcgcccagttccatttgcagcattaacaacattgtacataccgcgtttcgctgcctcccaagccgtcactttaggtgtactaatatcaggataaattaacggatcttcataaggctctagaactgccccctcaattgctttcatcaaatgcggcgtatttactttgccattattgaccaatatcgtcgttgcttttgctacttgtagtggtgttgccgtccaataaccttgaccaatcccaaccgaaatcgtatcgccttgtacccaagggcgtttatagcgtttttgtttccattctcgagttggcatattggcagccgtttcttcttgaatttcaatccccgttggcataccaaaaccaaaatccttcatccaattagaaagacgatcaatacccatattataagccacttgataaaaataagtatcagaggattcagtaatcgctttattcaaatccgtatctccgtggcctgtttttttccaatcacgaaaacgttttgtggagttaggtaatacccaatatcccggatcaaaaatcgttgtgtttggtgtaatcacattttcagtttgtgcggctactgcaataaaaggtttgactgttgaagcgggcggatacgcaccttgtgtcgcacgactataaagcggacgagcaggatcatttaataaacgtttataatcttcggaggaaataccatcaacaaataaattattgtcataacttggtgtagataccatcgctaatacactactatctttaggatcaagcacaactacagcaccttttagtcccgataaaagttcagtaatataacgctgtaatgctaaatcaatagttaaatgaatactttttcccgccacagcaggtcggctacgcaaagtacggattactttgccgcgattattaatttctacttcttcaaaacccgtggtaccttgcagtatatcctcgtaataacgttcaatacccaattttccaatatcgttcgtccccgcataattcgcaaatttatcctctcgtttcaaacgttctacatctttatcattcattttacctacatagcccaaaatatgcgccattgtttcgccatataaataatggcgtttgaaataaggacgtacctctaaactcgggtattggtagccatttaccgcaaagcgtgaaatttgttcttctgttaaattcggctttaataaaatcggtgtataacgcgttccgcggagacgttcttttttaaaatgttcaatatcgttatccgtcaatcccacaatgtagcgtaattcatctaaagtgcggtctaaattttcagttttttccggcacaatgtataaaccaaaaaaagtaagattttcggctaataatttaccgtaacgatcatagattaagccacgcgttggcggtaaaggtaataatttaattcggttaccattagaacgcgttcggtaagtatcgaaattaacaatctgtagctgataaatattggtgaataaaacacctgttagtagcaaaatccccaaaaaagccactaacgttcggcgtgcaaaaaggttacgctccgcttttttatcgcggaacggctcatgagttggcgtattgaaaaatttttttaaattcatctggctaaaaataaggatgtattattctcgatgataaggatgattagtagtgagcgaccacgcgcgatacaaactttcagccactacaacacgaacaagtgggtgaggtaatgtcaatggcgaaagcgaccaactttgctctgcagcggctttacattctggcgaaagcccctcaggcccaccaatcaacaaacaaacatcgcaaccatcatttttccacgcttctaattgctcggctagctgcggtgtcgtccaaggtttaccaggaatatctaacgtcacaactttgccttttccacaggcagctaacatcgccttaccttcttgctctaaaatacgtttaatatcagcattttttccacgcttacctgctgggatttcaatcagttcaaaaggcatatcttttgggaaacggcgttgatattcctcaaaacccgttgtaacccaagaaggcatttttgttccaacagcaattaacgtgattttcacaagtcatccttatctaaaaagtgcggttatttttcaccgcactttactaatatttacgcccaaagtttctctaattgatacatttcacgggcgtcacgttgcatgatatgtacgatagcttgaccaagatccactacaatccaatctgcagtatttttaccctcttcaccaaaagtttcaaaacctgcttttttacattctgtaattaaattatctgccattgcagaaacttggcggctcgatgtacccgtgcaaataatcatattatccgtaatcgatgattttccacgtacatcaaaatgtacaatatctgttccctttaacccatctaaggtttccatcaaaaattcaactaacgccattttgttctcacttagcaataaaagtgcggaattctatcattgaataccctcttgcgcaaaatccacgcaaaaaataagcgcgaaattaaccgcgctttttatgtctaaattgaaattatttttactatgctgcccataataacactgccaataactgtggcgacattattcgcaagaacatcactaacggatacacagtggcataagaaagtgctgcagcaccgttatcttctttaatttcattagcaaatgctaaagcgggaggatccgtcattgaacctgcaagtaaaccacagattgtaaggtaattcagtttgccatatagacgagccaaaataccggtaatcattaatggaataaaggtgataaaaataccgtatcccatccattcaagtcccgaaccattcactaaagtatcaaagaaacttccgcctgattttaaaccgaccacagccaagaaaagaacaatcccaatttcgcgtaacgccaagttagcactaggcggcataaaccagtaaagtttaccaatcgtgccaattctcgctaagattaacgcaaccaccaatggcccgccagcaagccctaattttaacgcaacagggaaacctggaatatagaatggaatcgaaccaacgagtactcctaaaccaatgccgataaacacaggtaacatttgcacttgaagcaatttttgttgtgcattaccaatgactgaaatagcctgatttagtacatcactgcgtccgaccatatgtagcacatcgccaaattgcagtgtggtatttcccgttggaactaactcaatccctgcacgatttaaacgtgaaatcacaaccccatatttttgatgaatgcctaaggcacggatctttttgcctaatactttttcattcgttaccaccacacgctcagaacgaatttcgccactataggcaacagttggtgcatcaacttcgtatccgataattaaacgcattttggcaagcgaattatcatcgcccactaattgcaaaatatcgttgatacgaatttcagtacttgcctttggaacaatttccatatcatcgcgttttaaacgtgaacatacgacttcttcatcactaaatccaggaatttgaattaacgtcagaccatctaaattttggttcgtcacttttaaagaaatattatgtaaactttctttatcttgactgctctccgcattaaaacgtgccgcttcatcgtccactttgactttaaaaaataagcggattaaccacattgcaagcaaaataccgcaaatcccgaatggataagccattgcataagacacccccatagtcacagtggtttgaggcacccctaattctgctaaaatttgctgccctgcccccaacgctggcgtattagtaacagcaccagaataaatacctaaggcaatatccagtggaacatccgcaattttatgtacaagaaccacggcaattgaccccagcacaataatcaaaatggcaaaggcatttagctttaaaccagattttcgtaaagaagaaaaaaagcccggccccacctgaataccaatagtataaacaaataaaattaaaccaaattcttgcacaaaatgcagcgtatgcgcatccagtttcaagccatattgattagtgaaatgggcaacaataatgccgccaaacagcacgccaccaatgccaagcccaaccccgcggatcttccaatgcccgatccataagccgattacggcgacgagggcaagaaggctaatcgtgatcgcaatatcactcatattgaccccttaaaaatgaaatttaactcctttggattatatccaagttactttttgaaaaccttaaccaaactcaaaaaatgatacgttcgtcacattttttcttgcgaaattgagcatagactctacaataccgaaaatttttgacccttttacaaaaagtgcggttatttttcaccgcacttttatctcggatggaatatttatggattacagccaagaagccattacttctcttatttggattttacaaacgctagccatcacctcagtcgtctttagttttggcatttttcttttggtgcgttttactcaatggggaagacaattttggatgtttgcaggtggttatctttcgcctaaacgtagcattaaacctatcttattctttctacttattgttgcaatgacgctacttagcgtacgtatcagccttgtacattctgagtggtacaaaaatatgtacacatcattgcaagaatttaatgaacatgtattttggcaacaaatgggcttgttctgtgtcattgccgcaagttctgtttcagcagcattagtaagctattatttagagcaacgtttcgtcatcaactggattgaatggcttaacgaacagcttgttgataaatggatggcacatcgtgcctattacaaaacacaatatttatcagaaaatcttgataaccccgatcaacgtattcaacaagatgtgcaatcttatgtaaaaaccacgctttctttaagcactggtgtcattgatgcggtaacctctatgatctcttatacgattttattatggggattagcaggtccaatgatggtacttggcgtggaaattccgcatatgatggtatttttagtgtttggttatgtcatcttcacaaccctcatcgcattttggctcggtcgtccattaatatccttgaattttattaatgaactcctaaacgcaaactatcgttattctttaattcgaataaaagaatatgccgaaagcattgctttttatgcgggcgaaaaagtcgaaaaaaatcagctttatcagcagttcaatgccgtcattcataatatgtggattattgtatttagaacactaaaattttcaggatttaacttagtcgtaagccaaatttccgtggtttttccattgttaattcaagttggacgttactttgaaaaacaaataaaacttggcgatctaatgcaaaccttacaagtatttggtcagttacacgcaaatctttccttcttccgcaatacttatgataattttgcaagctataaagcaacgctagatcgtttaactgggttctgttatgccattgaaaaagcaaataataaatcacaaacacagatccacaatcatccaacagatgtgattttcaaaaatttaagtattcaaaatccattaggtcatacactaattaaacatctaaacattaccttaccgcaaggaacaagtttgcttattcaaggaaaatctggagcaggaaaaaccacgcttttacgcaccattgcggggctttggagctatgccgagggggaaataaattgccctacgcacaatcagcttttcttgtcacaaaagccgtatgtgccacaaggaaatttaatgtcagcattagcttatccaaataacgctgacaatatttcacatacgcaagcggtagaaatattaaataaagtgcaactaggacatttggctgaacaattagaaaaagaacaagactggacgcgtattctttctcttggcgaacaacagcgtctggcgtttgcacgattaattctacacaaaccagcagtggcatttttagatgaagccacagctagtatggatgaaggtttagaattttcgatgtatcaattgttacaacaagaactaccacaaacgacaatcatcagtgtgggacaccgttcaacccttaaaaccttacatcaacaacaattaattctacaagacaaagggcaatggcaagtgctataaaaaacgctaaaaaacactgtaatcgcaacgctttttttgatacatttagtgcaattttttgtatgtttgacaaagtcattttctattttttgtcaaacaaaactaactttcattttaaacggtataattatgttatttaaaaaaattcgtgggttgttttcaaacgatctttctattgatttaggcacagctaatactttaatttatgtcaaaagacaaggtattgtacttgatgaaccctctgttgttgcgattcgtcaagatcgcgtaggcacattaaaaagcattgcagctgtgggtaaagaagctaaattaatgttaggtcgtactcccaaaagtattgtagcaattcgtccgatgaaagatggcgttattgcagacttttttgtgacagaaaaaatgttgcaatactttatcaaacaagttcatagcggtaattttatgcgtccaagcccgcgtgtattagtatgtgtgccagctggtgcaacacaagtagaacgccgcgcaattaaagaatcagcaatcggtgctggtgcgcgtgaagtatatttaattgaagaaccaatggcagctgcaattggggctaaattacccgtttctactgcagttggttctatggtaattgatatcggtggtggtacgacagaagtggctgtaatttccttaaatggtatcgtatattcttcttccgtgcgtatcggtggtgaccgtttcgacgaggcgattatttcttatgttcgccgcacttttggctcggttatcggagaacctaccgccgaacgcatcaaacaagaaattggttctgcttatattcaagaaggtgacgaaattaaagaaatggaagtacacggacataatttagccgaaggtgcgccacgttcatttactttaacatcacgtgatgtcctagaagccattcaacaaccattaaacggtattgtagcagcggttcgaaccgcacttgaagaatgccaaccagaacacgcagcagacattttcgaacgtggtatggtattaactggtggcggtgctttattacgtaatattgatattttactttctaaagaatctggtgtccctgttatcatcgcagaagatccattaacctgtgttgctcgtggtggtggcgaagcattagaaatgatcgatatgcacggcggcgatatttttagtgatgaaatttaattagaatatgaacaaaaagtgcggttaaaaataaccgcacttttcctttcatttttttcattcaacaagagaaagtttaatgaaacccattttcggcaaagcccctcccctaggtattcgtctgcttatcgctatctttgcatctattgccttaattttagctgatggacgtaatagctcaataacgaaagcacgtagtgcaatggaaacagcaataggcggtttatattatcttgcaaatagccctagaagcatcttagatggcatttcagaaaatcttgttgataccaataaattacaaattgaaaacaaagtactacgccaacagcttttggaaaaaaatgcagatttacttttacttgatcaactcaaagttgaaaatcagcgattacgtcttttattaaattctccgttaagaaccgatgaatacaaaaaaattgccgaagttcttactgcagaaacagatatttatcgccaacaaattgttattaatcaaggcaaaaaagacggtgcttatgtaggtcagcctgtcattgatgaaaaaggcgtcattggacaaattatttccgtgggcgaaaatactagccgagtactgctactcacagacgtaacacactcaattccagtgcaagttctacgaaatgatgttcgtgttattgcgagtgggactgggcataccgatgaactaagcctcgataacgtgcctcgttccgttgatatagaaaaaggcgatcttctcgtaacctctgggcttggtggacgttttcttgaaggctatcccgtagctgttgtacaaagcgtttcgcgtgatagctctaattactttgcaatagttaaagctaaacctttagctttattagaacgtttacgttatgtacttttactttggccaagtaacctagatatatcaaaagtaaaatcaatgtcgccagaagaagttcgcaatctggtgcaaaaacgtttagaaagccaagctaatgaagcaaattatagagtgaaaaaaacacccttaacagaaaaagactttctagaaaatgaagaaaaaaccattattgaaccagatattccaacagattttcttcaaaatgaagaagatcttcccatagaacagcaagaagaaaggatagaagactaatgcaaacacgatttattttacaatggttcactattttaagcttctttgttattgcctttgtattagaacttgcaccttggccagttggtttccaaatgctaaagcctgcgtggcttgtacttgtattactttattgggtattagctattcccaataaagtaagtataggctggtcatttttactcggattaacttgggatttaatattaggctctacattaggcgttcacgctctcgtactttctacgagcatgtacatcattgccaaaaactatttaattctgcgaaatttatcactttggttccaaagtttattggttgtacttttcgtcttcattataagattacttattttcttagttgaattttcactccatactgccttttttcattggcaagccatcttaggcgcattcgcttctggtttactatggccgtgggtatttttattaatgcgcaaaatacgcagaaaagttaaattacattaaaaaagagagataactctctcttttttatgatttatgaatgtttcaaacacctaattcaatggcttattgctatccagtaaagaatcacattcccaaccgatatactctcccgaaaattgttcagccaatttttcaaaacgttctacttgttcaaaaatttcgctattttctaatgaaatttcttgctctaattttaccaagaaataaggttcgtcatcttcattaaactgaatcgcttgtgcagaatattgtaatgtcgtgaaagaataatcccctaaactaagctcatccataaaagggaacattttctgctcttcatcaaaatgaaaactatgctctactaaataggtatcacttaaattacgacctttactttttaataaatcaagcaattcttccgttgcatttaacttaatctccaatggagaagcgagcaaaaagtcaaaataagtatcccaaattaaatccttttgcacattaatatctttaacaaaatcaatttgctgtaaagtttctacaataagattttcgtgcttacaataaaaatgtatttttatttgagaattacaaataaaatgccccgcaaaaaatacatttggaagtgcggttagttgtgtcaaaattttaaatacacggttaattaacttatcgtattcaacttctgagggtaaacccgtttcatcatcagcctgataatcaatagtaaactgcactattttatcgagacctttaccgtgatatttttcaacatcttcaatatttgcggtaaacacggcaggcataccattcacagtagaacgataattctgccaatttgccatatccatttcgctttcctatttaaattcagcccaaatcggtgcgtgatcagacggtttttccattgctcgaatatctaatgcaatgcccacatcgacacatcgttcagctaatttttggcttatcaaaatatgatcaattcgtaaacctcgattatcatcaaaacctttagaacggtaatcaaaccacgagaatttatcatttgctgttgggttcagcttacgaaaactatcttctaatccataatcatacaaacgttgataccacgctctttcttcaggtaagaaagaacatttacctgtgcgtaaccaacgtttacgattttcatctccgataccaatatctaaatcacttgggctaatattcatatcgcccataattaaaatcggattagatctgtcgtgttctttttctaaatactgttgaagatctgcataaaatttctctttagctggaaatttagtctcgtgcgcacggctttccccctgtgggaaatagccattaatgacggtcaataaaccaaattcagtttccagatcagccataataatgcgtttttgtgcatcttcattgtcagttggaaaaccacgacgaatcactttaggttcttgtttagtcaataatgctactccataatgacctttctgaccatgatgaaatacgtgataacctaagttttctgtaatttcatagggaaaagcctcgtcagcaactttaatttcctgtaagccaatcacatctggctgatatttttcaataatggcttcaagttgatgtgggcgagcacgtaacccatttatattgaaagaaataaatttcatttttgttcctattaaagagtgaaattggctttattatacagagatttctattttgataaaaacggctttgtcagataaacctgaatttgctcaaatactgtaggcttaatccaaaattgaccttgagaaggtaaacaagtgaccgaaataaaatcatttagataatcaaattccaattgagtagcgtgcaaataagtgcggtcaattttttctgtgtttttaccataaagcccatcgcctaaaatcgggctacctaaacttttcatcgcaacacgtaattgatgcgttttccccgtttgtggttttaaaataaataaacgtaaattaggttcacagcttacacttgcaaaacgtgtaattgctggattttctttggtttgacaaagtttccatgcaccctctcgggatttcttcatatccccgataatcaaaccttgtttctttttaggcttttggttacttaatgccagatacgttttatgtattttatgttcagaaaaaagtcgtgaaaattcagccgcactttcagcatttaacgccagaattaacaaacctgaagttactttatctaagcgatgaaccaaccatactttaggcacattcagttgttttgcaacaagttctgttaagccttgctcttcttgatctttatgaacgctaataccctcagacttgttgataataataaaatcgctatgttgataaacaacctcgatttccatcagatttgctcctttttgtaaattttatttttaccgagaacaatatcttttaccgaactaagtaattcctgttgaatatgtgagagttttggtttttcgtttaattgaaatgctaacggacgacaaagttccattgctttcacgcctaatctagcagtgagtaatcccacaccaattccttgagcgatacgtgtagataattttgctgtcacatcttgagaaagccaatccattccaatatcttgtgccacttcggttgctccagcaaaagcgatattgaccaataccattcttaacaatctaatacgtgaaaaataccctaattcaatcccataaatttcagcaatcttattcattaatcgaagattgcgccacgcgataaaaaacatatccactacagcaagtggactaatcgcgacaatcacagctgattcagctgccattttactaatcaattttttagcttgtgcatcaaaagaagacaaaacatgacgactgaataaatgagcaatttcttgcgccgaataagcttcatttaattggtgttgccattgaattaccgctggagaatcattttccaaacctaaagattctgcaatatctaagcaaagaattttacttttttctgcgttatgaacggaaaaaacatcgccattttttaccgcactttctaaccaaatctgctgactttgttgttgccattgctcacgtttttttaaacgaactaaacgtcgccactcgccaataatctctttaatccccaataaaatgataatcaaactgactaaagcaaaagcaagataaatccattgatgttgttgatagctatcccaaatccactgcatggattgtgcaaccgtcgccaagccaaataaaagtgcggtaaattttaataaagtttttctaaaactggattttggtttcaatgcttgttcaagttgagcatcaagtaactctccatccaacgcttcatctagctttgcttccatattatggaattcttgcttgggctgatagtgttcttcctctacattaactgaatgttcaaaaatttgtttttccattgcctattccaaaaaataaccccactaaatagtggggtcataaagtcaaaattcaatcattattcatcacttgaaaagatagaaagtaatcttaataaactcaagaataaattgtagattgaaacatagatgttcacggttgcgcgaatgtaatttgtttctccaccgtgaataatattactggtttcatacaaaatggtcattgttgagaacactacaaataatgcactaattgcgaccgataacgcaggaatttggaagaagaaactcgccaccataccaagcaataacacaataaataatgcgaacattgcgcttgataaaaatgacatatcttttttcgtagtcaatacataagcggaacacgcaaaaaatacgatagcagttcctgcgaatgcaagcataatcaaatcttccattccacgtgccacatacatatttaaaattggcccgatggtgtatcccataaatccagtgaaagcaaaggccgccaaaataccagcagggcgatcagctaatttattggttaagaaaagtaagccataaaaacccactagtaacacaataatatttggataaggcaagtttaagctcattgaaataaacgcaacaaccgctgaaaaagccattgttaatcccagtaaaaaatacgtgttacgcaacactttatgtgtgctgagtaacgattctttttgagcatccacaataagacgtgattgcataaaagctccttgtaaaataaataaaaagtcttctgtaaagtaagggctagggataaaaaagtcaatggtattaatggaattaatttcatcaaaatgaataaattatcatcatctaaagttaaatcatcaaatttctatttacatcaataaaatattcattatactacgcccatcaatcacggaggaatggtcgagtggttgaaggcaccggtcttgaaaaccggcgagggtttacgccctcctagggttcgaatccctattcctccgccatcagaattaagaaatccctaagtcacacggcttagggatttttactttgtattacgttatttggtcaatccattcactagtgaaataacagtctgaatatcgctatcaaacaattttccttctttcacaaattttacttttcccgttttgtctaacacgataattgcactatctttagaatttaatccccaagcattttttaccgcacttttatcatctaacacaacttgactatgtggattttcctgtttgcctttttgtgcactattttttacaaacatacctgtaccaacaatcgcatcatccgcattaataatagtggttgtttggtattttacaggattaaaatgggatgcttttatcgcatcaatcatcgactgatttttctcttttgcagccgttctacccgctaaatgatgaacaacacgcactttacccgctaattccgcagaaccccaaggttgaaacgcagtatcttttcctgaaagcacaatttcaccgtactccgttacttgcactgctggtaaagattgctctaattgcaaattgtgtgcccaagttgaactactaaacattacgccacaaactaaggcaagaatttgttttttcatacattttcctcaaaaatttatcaaaaactttcacgctttggcgaaagacatctttttgctatactcgtgcgcctattatatgtaatcaagaaggaaaacccaatggatcaaatgcctaattgcccaaaatgtcaaagtgaatacgtttaccacgattcaattaattttgtttgccctgattgcggtaatgaatgggataataatgaaattcaagaatcagatgacgatcaactaatcgtaaaagacagcaatgggaatttgcttgcagaaggcgacaatgtacttttgattaaagatttaaaattaaaaggttcatcagaagtattgaaaaaaggtacaaaattcaaaaacatccgcttagtaaatggcgatcataatgtcgattgcggcaaaatcatgttgaaatctgagtttttgaaaaaggcttaatcgaaaaaacgcggtctaaatagaccgcactttgcactttaaagaaataaatttatttaataatctcaatcacttctctgactaatcgtccaatttcatcccaatttttggattgaatcaattttttctccacaaaccaagagcctccacaagcaacaatattaggaatagcaagataatcccttatgttatgaagccctataccaccagtcggcattatctgtaattgagcataaggaccgagcaatgctttaatcattttcactccgcctgaagcctctgcagggaaaaattttaccgccgaaattcccatttctaatgcaatttcaattgccataggattattcacccctggtgttattggaaaatttaaatcttgacataatttcacaatttttggattaaatcctggtgttaccacaaaatccgccccactacttttagctaaaactacttgttccgcagttaaaactgtaccggcagcaattaaaaagtcaggtctatttgcacgcaacaaacggatcgcatctgccgctgcttcagagcgaaaagtaatctctgccacaggtaaaccatttttagccaacgtatctgctagcggcaaaatatcgtctgcattatccaacgcaattacaggcacaattttgagttcacgaagtttttcaataatttgttgagttgtgtatgacataattttccctatttaaaataattttttgcattgttgaaacaaatatcttcaatcattttacccagtaatgaaatgtcatttggagcttcacctttttcaacccatccaccaatcatttcacacaaaatacggcggaaatactcatggcgagtgtaagataaaaaactacgtgaatcagttagcattccaacaaattgactgagtaaccctaattgagaaagctgttgtaactgacgttccattccgtctttttgatcgttaaaccaccatccagaaccaaactgtattttccctgcaataccatcgccttgaaagtttccgatcatactagcgatcatttcattatctcgaggatttaagcaatataaaatagttttaggcagttgattttccttatccattgcatctaacaaacgagagaggggatatgcataagttcgatcaccaatggaatcaaagccactatctgcaccgagtaaagcaaacattcgactattattgttacgtattgcaccaatatgcatttgcattacccagtgacgtttacaatattccgaagccaaccagactaaaattgcagtactaaattgagcaacttcttcttccaagagcggttgattttgcaaacgtttttgtaaaatactattcaatactgattcatctggaatagctgaaaaacggacaatttccataccatgatcagcagatttacaaccttgagcatcaaaatattcgagacgttttaacaacgctttttttaaatctgcaaacgtataaatatctacatctgcaatttcacttaactgtacaaggtagtcattaaattgtggcaactcaattttgaatactttatcaggtcgccaacttggtacaacatcaatatcaaaactttcatcattcttgattgcttgatgatattgcaaagaatcaatgggatcatctgttgtccccactaatttcacgttcattttctgcataatgcctcgcgcagaaaattcaggttgttgcaacatttcattacattgatgccaaattttttccgcattttgcggattaaataacatattggttataccaaaaggacggcgtaattctaaatgtgtccagtgataaattggattaccaatacaaagggggactgttttcgcccaagccaaatatttttgatagttagtagccttccctgtaatcaattcttctggtactccagctgtacgcaaagctcgccatttgtagtgatcaccctctagccaaatttcagctaaatcattaaattgacgattttccgccacttctcttggatttaaatgacagtgataatcaaaaataggtttatttttggcataatcatgatagagaatttttgctgtatccgttgaaagaaggaaattttcatccataaattgcttcattttgccctcctatactccactatacgcagaaaaaccgccatcaacaggtaaaactacgccattgacaaaagcagaataattttcatctattaagaaaagtaatgcaccgagcaattcttctgactcaccaaaacgtcccattggtgtgttagtgaggattttatttgctctatctgttggttttccttcagtatcaaataataaagtgcggttttgattactaactaaaaatcctggtgcgatagcattacaacgaataccaacttttgagaaatatacagcaagccattgagtaaaattactgattgcagcttttgcaccagagtaagcaggtatctttgtaagtggtgtaaaggcattcatactggaaatattaataatatttgccccttgtttaccaagcatatcttttgaaaaaacttgggttggtaataatgaacctaagtaattgagattaaatacaaattctataccagatttatctaaatcaaagaatgttcttgtcgtttcatttaaatcaaattgatggaactcattatctgttgtcgcttttggattattcccaccagcaccattaattaaaatatcacaagtgccaaaatcaatagctatttgatcacgcacttctttaatattttcaagttctaacacattagttttataagcttttgcttttccacctgattggttaatttcttttgctgctttgtctgctgcctcgaaattcaaatctaacaaggcaatattagctttagtatacgctaactgcttagctagaaatgaacatagcactccgccagcccccgtgattataattagtttattttctaagttatggtttgctgcaatattcatagtaaactccattaattaaattcagattgaagatgagacgttgcgactttatctataatcgcacctttatattgaatgatgatgccagcaatacgattgccttgctgacaacaagtttcgagaggtttatttcgtaaataaccgttcagaaatccagcattaaaagaatcaccagcagaggttgtatctaccacatttaaaataggttcagtcatcacttgcccatattgagataaatacctatctgaaaaaatagcaccattcttaccgcacttcacaatcacttttggtataccaattttatgtaatcgttctaaagtatccctagatgttttatctttccataatgcttgttcatcatcaaaagtcaccaaagctatattaacactaggtaaagctgcaaataacaatcttgggcttcttctaatgaatcccaaagtgcagggcgataattactatcaaaaacaatttctgcgccttttttagctaaagaagataattgctcaattaaaaaagtgcggtcatttttcggtaagattgctaatgaaataccacttaaataaatcacatcaacttgctgaagttctgcaataaccttagcaaaatccggatgttgaaccatataatgtgctgcagattgattacgccaataaaggaacgtgcgttcgccttgagcatctaattggattagataaagacctggttgatgctgttcatcctgtaaaacccaatttgtttggatgccatcagcttgccaatatttaagcatttgtttacttaaattatcagttcctaatgcagagacataatgaacttgaatctcttttgatgaacttactcgactaagataagttgcagaatttaaggtatcaccaccataactttgccacatttccgcaaagggtttcccattgagttcaatcatacactcgccgataaatgctatttttttcatgatgcaacttcctaataaatcaagataaccaattcattggaacaattacaatttcaggaaaaaatacgatcaacatcataataattgcgtacacaaataagaatggagcaattcctttggataatgctcctatccctaattttgatatccctgagcctacatacaaaactgttcccacaggcggtgttattaatcctatagataaattaatcaccatcatgattccaaaatacgcaatatcaatattatatgctcttaacactggtaataagactggaacaaaaattaataccgcaggaattaaatccattacacatccaacaagtaataaaaatagcattataataaacattaaaattgtcggactatcagttaatcctttaatcgtttggactaattctgttggaatttgagcaactgtaatcgcaaaagcagatatcattgctgatgcagcaacaaacattaccattgatgttgttttgatggtgccaatgaagacgtcttttaatttagaaaatgttaagcctttataagcaatacttactatgccagcataaattgcagcaacaactcccgcttctgttggagtaaaaatccctcctcttaatcccacaataataatgataggtaataataaaggccaaaatgcttttttaaaagcaacccatctttctttgccagtttgttttctttctagacttgtatcattatttctatacaaaattttccaagtaacccataatccaacgaccattaataagcctggtacagttccccccataaataatttagtgatggatgctccagcagtaataccgtaaatgatcataggaatgcttggaggaataacaactgaaataatacctgcagcacaaattaatcctgtggaacgagcaccatcatattttttagaaatcatcataggaattagtattgcacctaacgcggccgtatccgctaccgcagaaccagataaccctgcaaatatcaacccagaaatgatcgcaacataacctaaaccacctttaatatgaccaaccatacttgttgcaaaattaatgattcgctcagaaattccaccatgcttcattatttctccagtaagcataaagaaaggaatagccatcaaaggaaaattattcgttcccatcacaaagttttctgtaattaattgcgtatcaaacatatcaagatgatatagcataatactcgcactcaacagcattgatagtgctacaggtacaccaagaaataacaataagaataaactacacaaaaataatagtaacattataagctcctatttatcagaggattctttataatctttaatcatgctaaacatgacaataaaaaagtaagatacggcagatataacagcagctaaatataaaaaagatgaagatatacctgtagctggcatttgttgagtataggtcaaagacatcagttgtaatgcaccataagctataaaaatcattgcaatcagaacgcatatatttgcaactattaagactatttttctatactgctcaggtaacgcagaaataataatttcaacagtaagatgagctttatccttggcaacaaggataatcccaaagaaaatcatatatacaaaacaaatcctagaaaactcttcagaaaatgcaattccagaatcaaagaagtacctcaagacagaattaaaaaacacgagagaaatcataataactaatgctaagatagaaagatattctaatgctttgtctaaatactttgctattttcataaaacaagctccttctttatcccccatgagcaatttataaaattgaacataggggatcttattaattatttagcttcgttaattttttggactacatccttagcccaatcatattttttataaaaactatcataaagcaccttagatgcattcaccatgtcatttttaaatgcttcacttggtacgataatttcatttccatgtttagctagataatctttaacttctaattctgttttaattgctaattcccactctttctcttgatacaatttagctgctttttcaaaaataatttgatcttcttttggaattttattccaagtttttaagctaatttgtaataatcctggagagaaaatatggttactttggataatatatttttgtacttcatataacccagagtctttaattaacatatacggattttcttgaccatcaattaccttttgttctaatgcagtaaaaacttcactgagcggcatgctttgtggatttatattcattgctttagcccaatcaacaaaaagtgaattcagcggaactcttaaacgtaaacctttaaaatcgtcaaatttctctaattttttattagatgaaataacacgaaatccattcataccataggcaagtaatttaattccatacttctccattttttgaccaattttatttgcgattggagattccaatacttttttagcctcttgattatccttaaataaataaggccattcccaaactccaaaaataggatctacattttgcaataataaacctgtaatacctgcttctatagtgccattacgtaatccatttacaatttgatcttcaccgccaagttgattattaggataaagtctaatctcatatctatgatttgtttcattttcaattgttttcttaaaatattcctgtaatgcaatatgtgatggatgtatatcagaattataatgtcctaacttaataattgtttttccaaatgcactgctactaaacaatatacttgaagcaagtaataatttacctaagcttttaattgacttcataactttctccttattgattatgttttttagaaaactgcattaatttttaaataattttctggatgatcagataaatcagaaataaaactaggaatttcttcaaatttgatacacttagtaatgatatgagatgcattaattttattagtagcaagcatatccaatgcctcctcaaattcccccttgcttgttctagaaccataaatattcaattctttaaaggtaattaaatttgttggtaatggagtttctgtttttggccatcctgttaaagcaattcttcctgcaaaggaggtataatgcagagtatttttgatagaaatattagcaccagatgcctccataacaacttctgccatacgaccacttgtaatttccttaattcttttaatgtcatcctccttatgcggatttacaatatgttcaattcccaaggattttgcatactcaagacgttgttctaatatatcaactaaaattgggattgctccatattgaaccgctgctaatgctgccattaatccaattgcaccagctccaataattactatgtgttcccctgattttaaagttgttctatgtaaagcatgtaaagctattgttaaaggttcagctaaaggtaattgatgaatcggtaggttatctgggactttagttaaaagatgagcgggatgtctaattacctcttgcatacctccatcaatatgaacaccaattacctttaatgattcacaacaattggttctaccaattgaacaaggatagcattgaccacaaaaaacataaggatcaacaattactcggtctccaaccctcaccctatccggcataccaattccactttcaattactctccctacaatttcatgcccaagtattcttggataagttactaatggattagttcctctatatgcaccaatatcagaaccacaaatccccattgattctacctgaataagtacatcattatcacttttctcgggataaggcacttctttaacaactacattgtttggtttttctaagcatattgctttgattcgctccttcatttttagactccttatatgccattgacagaataaaattacttgttatgtttaactatgatatgattatgaaacataaaaactctttttggaataccaaatatctatttttgtgagccgtatcacaaaaataaaaaattggaataccaatttaaggaaaaatatggaaaatatagtaaatagaacatatacccgaatcggtcaattgctaaaacaagatatttctcaaggaatttatagcattggagacaaactccctacagaacgagaaatttctgaaaaatttggtgtaagtagaactattgttagagaagcaatggttatgttagaagtagaaaaattagtagaggtaaaaaaagggtcaggcgtttatgtagtaagaacccccgaatcaatacatatggaacattcagatttaccagatgtaggtccatttgaacttttacaagctagacaactattagaaagtagtattgctgaattcgcagcgttacaagcgactaaaaaagatattttaaatttaaaacaaatactgaatcgagagaaagaattacttactcagaatcaagatgactatagtgcagacaaagattttcatttggcacttgcagaaattacacaaaatgatgtgttagtcaaattacaagaacaattgtggcaatatcgctttaatagtgcgatgtgggcacaattacattctcgtattttacaaaatgattatcatcatttatggatagaagatcatcaaacaattttatctgctattcaaaagaaaaatgctaatgaagctagaaaagctatgtggcaacacttagaaaatgtaaaagtaaaattatttgaattatctgatgtagaagatccacattttgatggatacctattcaatacaaatccagttgttgtaggtatctaaatacttgtaataacataggagttaaaaatggaacaagcatggcgttggtatggaccaaaagatcctgtttctttatctgatattcgtcaagcaggcgcaactggtatagtcactgcacttcaccatattcctaacggtgaagtgtggagtatcgaagaaattaaaaaacgcaaaactgaaatagagaatgctggtttaagctggtcagtagtggaaagtgtaccagttcatgaagagattaaaactcagactggaaattatcaaaaatggattaataactataaacaaactcttcgcaatcttgctcaatgcggaattgacactgtttgttacaattttatgcctgttttagactggactcgtactgatctcgcttatgaattaccagatggttctaaagcattgcgctttgatcatatcgctttcgcagcatttgaacttcatattttaaaacgtcctgatgcagaaaaagcctataatcaagaagaacaagttgcagcaagaacctattatgacaagatgtcagagcaagatataacgcaattaacgcgtaatattattgcgggcttacccggtgcagaagaaggttatactcttgatgaatttcaaactcaattagatcgctataaagatatttcacccgaaaaattccgtacgcatttggcttattttttaaatgagatcgtacctgttgcccaagaagtaggaatcaaaatggcgattcatccagatgatcctccacgcccaatcttaggcttaccgcgcatagtttcaactattgaagatatgcaatggtttgtagaaactcaaccattaccagcaaatggttttacaatgtgtacgggttcttatggcgtacgctccgataatgatctcgtaaaaatgacagaacaatttgcagatcgtatttacttcgcacatttacgttctactcaacgtgaagataatccactaaccttccatgaagcagctcatctagaaggagacgtagatatgtttaatgtggtaaaagccttattaaatgaagaatatcgtcgattaaatcaaggagaaacgcgtttaatcccaatgcgcccagatcatgggcatcaaatgttggatgacttacgtaaaaaaaccaaccctggctactctgccattggtcggttaaaaggtctagctgaatttcgcggtttagagatggcactaaaaaaagtgtatttcaataagtaaaagaaaaagtgcggtcataaaaaacattatttttatcgaccgcacttccaatttattttatcaatcttctcattcgaatattgatcatttcgaccacaacagagaatcccattgcaaaatagatgtaacctttcgggatgtgaatatctaaactttctgcaattaaactaattccaactaaaaccaagaaggctaaagctagaattttcaaggttggatgcgtatctacgaaagcgccgattggttttgctgcaaacatcatcacgccaacggcaataataatcgccaaaatcatcacaggaaggtggcttgccatacctactgctgtaatcacagaatctaaagaaaaaacaatatctagcactgcaatttgaattaatacgccaaaataactcactttgtttttgctttcagaattatggtgttcttgatgatttattgcctctttaatttccccaaagctttttataatcaggaataaacctccgattaataaaatcaaatcacgcccagaaattgcttgattaaacagagtaaataatggtgcagtaagtttcataatccaagcaagtgacattaaaagtaaaattcttgtcagcattgctaaaccaagtccaataatacgaccagactggcgttggctttcaggtaaacgcccaactaggatactaataaaaataatattatcgacccctaaaatgatctccaaagcagtaagtgtcgcaagtgatacccaggcttcaggatcggtaatccattcaaacataatttttcctataatagagttaaatagatccgaaagttcggatcataatgactttatgatgaaaagcaatcgttatttacatttaagagataattgattaatcgtttttgagcgtttcaaaaatcgtttcagcaagtttaagggaaattcccggtacagaggctatttcatctaaggtcgcctttttcacaccttgtaaaccgccaagatatttcagtaaagcctgacgacgtttagcgcccacaccttcaatagtttctaaaccactttgtgtaaaggctttttgacgttttttacggtgtccgcttattgcgtgattatgactttcatcacggatgtgttgaatcaaatgcaatgccaaactatcatcaggcaaatgaatttcgcggtcttgtttgctgatgatcagtacttcctgcccagctcgacgatccacaccttttgccacgccaattaagtgcggtctatttttatcccattttacttgaagatgttggaacacgttcagcgcacgatttaattgcccttttccaccatcaataaaaataatatcaggaattttatcttcttctaaatcacgctcataacgtttctgcaacgcttgttccattgctgcataatcatccccaccagtaatgccttcaatattaaaacgacgataatcagatttcagtgggccttcttgattaaagacaacacaagatgctaccgtttgatttcccatcgtgtggcttatatcgaaacactccatacgcttaatttcagggagatttaacagatcacacaacgcttgataacgctctgacattcgtgaagattgtttaagttgtacatttaaagccgctttagcattaacttgtgcgagctgtaagtatttactcttatcgccttttacactttcttgaatcgtcacttttctgcctgcttgctccgtaagaagttgctcaagctctgatttttcagctaattgacgatcgacaataatactatttgggatacttcgcccttgatgaccttgtaaataaaattgccccacaaaagtttcggtaagttccgataaatccgtattggcagggacttttgggaaataactgcgattgcctagcacttttccttgacgaataaacatcacttgtacacaggctaaaccgtgttggtaagcgatggacataatatccatatcatctaaacgttcattggatacaaattgtttttcaataaccgaacgcaccgcctgaatttgatcgcgataacgagccgcctgttcaaaatctaaatttctgcttgcctgctccattttcccgattaaataatctaacacctgttgatctttgccttgtaaaaataaacgggctaattcaacttgttgattatattcttcatcggaaacatatccctgtacacaaggcgcagaacaacgcccaatttgatattgtaaacaaggacgagagcggttggaataaacggaattttcacattgtcgaacagggaaaagtttttgtaaaagcgataaggtttcacgcacggcgcctgcgtgaggataagggccgaaatattcacccgcaaattttttagacccacgataggacgtgattcttggatggcgttctttggttaataaaataaatggataggatttatcatcacgcaataatacgttatagcgaggctgataaagcttgataaaattatgctctagcagtaaagcttccgtttcagatgaagttagcatggtgtcaatatgatgaattgatgctaccaacgcctctgtttttttactactcagatttttacgaaaatagcttgaaagacgtttttttagatcctttgctttcccaacataaataacctgatctttatcgtcatacatacgataaacaccaggttcgtgagagacatccgctaagaactttttagcatcaaacattttaattcgccgctaaaattgcccgcactttttccaaatcttcagcagtatccacccccactgcaggcacttctttcgcaagctctacgtgaatgcgttcgccgttatataacacacgaagctgctcaagtttttctagattttcaagttgagtcggagcccattgcacatattgttttatgaaccccgcacgatatgcgtaaatgccaatatgacgtaagtaagcgtccgcaagctgtactttctgaacatcctgtaaattcataaactgatcacgatcgtaaggaataaccgaacgggaaaaatatagcacatagccgtctttatccgtcaaaactttcactgcatttggattgaataattcctcagcatcatgaatttttaccgcaagacttgccatattgacattaaattttgctaaattatctgccacttgtcgcacgataacgggaggaatcaaaggctcatcgccttgaatattgacaatgatttcattgtcaggaatcgctaatttttctacaacttccgctaaacgttctgtaccagaattatgattaaccgaagtcatgcacacttccgcgccaaaatttttggcaacatcagccacattttcattatcggtggcaataatcactcggttcgccccagactgcagcgctttctcaaatacatgttgaatcattggcttacctgcaatatcggcaagcggttttccaggtaaacgacttgatgcaaaacgagcggggataataacggtaaatgacataatttattccttattctttaatatttcagctttctcggtaagcaatcaaaacaactggagataaatcctttcagccatttctatattgcgccacaagtttgtctattttgtcccaaaagtgcggtaaattttcacattgtttttcagcctcaataatctctgcatctacagggacataccaccaattatcgttggcaaaagattggcattttacggcatctttttccgtcataaagagcggttgattttcagcaagtttttctaattgagaggcttcaaaatgttgatgatcttgaaatgcttgagttcgttctaattgaatccctaacttttctaacatagtaaaaaaacgctgtggattgccaatccctgcaatggcaacaccagattgaaattcctttaattggcgtttttcattggtttttaaattaattgcgaaatggggtacaagatacataactgcatctgaatactgattttttccaccattagtgatcacaaaatctacggattttaatcgacttggtaattcacgcaatgggcctgcaggcaatacaaaaccatttcccaatgcgcgctcagcgtccattacgacaatttccaaatcacgctgtaatttataatgctgtaaaccatcgtcagaaacaataatatcgcactctgcttggcttaagagtaattcaatcgcttgctggcgattcggggaaatcacgactggcgcattggtgcgtttagcgatcaatactggctcatcgccaccttcaatcggacgcgtattttcagtgacgaataacggataagttttagatttactgccgtaaccacgagaaatcacacctacgcgcaaacctcgtttttttaattcttccacaagccacaccaccacgggcgttttgccatttccaccaacagacaaatttcccacaattatcactggttttggtgcgcgataagaagattttatccccaaacaaaataaggcgtgacgcagttggctaatcaaccaaaacaataaagaaaaaggcgataagagccaaataagtttggaattggaataccagaagggcatagaaaatcctttctaataagtgcggataaaataacgcgagtttttcaactcgcgttttcaataattaataaattagccactaaactgcatactgtatagctgtttataagcaccattttgttcaagcaatgctttatggttgcctcgctcacgaatttctccgtgatcaatcacaagaatttcatccgcattttcaatggttgataaacgatgggcgattacgataacagtacgatctttcttcaattcatctaatgcagattgaatggcgcgttctgattccgtatctagtgcagatgtagcttcatctaaaattaatactggcgaattacgcaataaagcgcgagcaatcgctaaacgctggcgttgcccaccagataggctcgcaccattttcgccaattaccgtatcaaaaccttgcggtaatttttcgataaactctaaagcataagccgcttttgctgcagcaataatttcttcgcgagaatacttatcctgcgcggcataagcaatattattcgcaatggtatcgttaaataaatgaacttgttgagaaaccacagcacagttctcacgcaaattagataaacgataatcttggatatttacgccatccagtaaaatctcgccttgctcaatatcgtaaaaacgtgtcactaaattagcaatggttgatttgcccgatccagaacgtcccactaaagcaacggtttttcctgcaggcacgctaaaagaaatattatttaatgcaagttcctcttttccctgatatgcaaaactcacatttttaaattctaacgcacctttcgcaggttctgctttataagtgccgttatctttttctggttctaaatctaaaatggcaaatagcgtttgacatgctgccattccacgttggaattgagagtttacattcgttaaggattttaatgggcgcatcattgccaacatagatgaaaaaactaccgtaaaagaacccgcacttagattatcttccgcaattaatggcgtggtagctaaaaacaatacagcaactaaagcaagagaagcaataatctgcacaacagggtcggaaatggaatctgcagtaaccattttcatacctttacgacgcatgttgttactcactttattaaaacgctcttcctcgacaaactgaccaccaaaagaaatcacgactttatgtcctttcagcatttgctccgtcgtcgccgtcaattcccccattgaatcttgtaaatttttactcaacttacggaaaatttttgaaacgatagtgatcaacactgcaataattggtccgataacaaataaaacaagggttaattcccagcttgtataaaacatcactgccaatagcgaaataatatatgctccttctcgcacaatggtaatcaaagatcctgaagaagaacttgcaatcatctcagaatcataagtgatacgagaaagtaatttccccgttgaatttctgtcaaagaaactcactggcataaacattaaatgtttaaataaacggcgacgcattgtcatgacaactttgcctgatacccacgccaagcaataattagaaataaagttagtcacgccacgtaaaataatcattcccacaacaacaaaagccattattttcaaaaatgaatggtttgccttgccaaaaccatcgtccaacaacggttttaacaaataaatcaagcctgaatcagccaatgcattaaaaactaacgcaatacctgaagcaataagccctgctttaaaaggtttaatcattggccacaaacgtttaaaagtttgtaaggttgaaaaatcattttcttgtaatttttgctcttgcataatcgctatctaatagtaaaaattgcacgcattgtaccttttattcctttgataatccaattacacgcgcataccaaggggaaaattttgtgcgagcttgctggatttctaatcggtcttgaaaaaaatttacccgcacttgccccgaaacagcggtattttctaccgcacttttatagcgatgaagcctttccataaccgaataatgagggaatttccacggattccaacgcccactagaaataatcgctacatctggtctaacctgagaaagcaagtattcacttgtcgatgttttactcccatgatgccccacttgcaacacatcgattttgcctaaagtgcgggcaaaaatttgctcattttttgcttcagcatcgccagttagcaaaacgctattctttccatcatcgactaaaatcacacaagaatggggattatcagctcgtgtcgcaacgttgtgaggagaaagtatttgaaaatgcaacccttgccaatgccaatcacgcccagcagtacaaaaagtgcggtaattttccccatagtttttccgtgaaggggtaatcaattccacattgggatacgcctttaaaattgtcgaagcaccacctgcgtgatcgttatcgtcgtggcttaaaatcaatttttccaaaacaatcccttctctttgtaaataaggcaaaatttccaactcagccatacttccacctcgccaagaagaacccgtatcataaagaatccctttgccatttttcacaatcagcgttgccaagccctgccccacatctaaagtatctacctgccaagttggcttgctcaattgtttaaacaacaaaatcataaaacacataagaataatgccgaaagaacatcgcaaaacgttgattcgatcagtttttagcaaaggtttactgagattcaatgtaaaaaatcttggtcgtttaattttccaagttgatgatgaaacctctggttctcgataaatactccaaataattaacataaaaattcctgcacaaagtgcggttaaaaccaatgctaaattaaatgaaacattaaaccaattcccttgaaaaacagaaattaacccagtaattccttcggctaacttgtttgctagttgccaagaaaacattgtgccgttagtaaaaacggcaaataaaattaatggcacaagcaaaaaactataaattggaaccgccataagattggctaaaaatccacttaacgataagccattaaatagaaaaagttgcaaaggcgtaaaaaagagcaataacccaaattgcaaatgaaataaactaaaaatccaccgcacttttggagaaaaagggcgatttttccattgaaaaagtgaaaaaggcacataacgataccagaggagcaaacacccaaccgctccacaagaaagccaaaaactgaccgaaagcggcattaatggatcgcagaaaagcaagaatccgacaaccaacgtaaaaagctgaatgggcgaataatgtcgcctcattatttgaataaataaaacgaaaacaagtgctgaaatggcacgaaaagttggcacactaaaaccagccaaatacgcataaattaaagcaaataaaacaccaaaaactaaaggaaaataaggatgaataaaacgggtggggcaaaagacttgcacaacacgcgccaagcaaaatccaattcccatagccaacccaatatgtaagccagaaatagcaataagatgcgcagtattggtttgttggtaaattgaccaagtggttttatctaaccaagcccgttcgccaaaagctaaggcaatcaataaaccttgtaaggacaacccttctgtttgtttttttacttgttgcaatttttctgcacgcaatgatgaaacatccgcaattttcaccgcactttttaccgttccaacagccgtaattccttttgaaaaataccattgttgccgatcaaacccaccaaaatttaatcgcgcagaaaggggacgtaaagaaatttcagcttgccaaatttccgataattgaggcacctctttcgctttccaatttaagaaaattcgttgttcttgcaaattattctccaatgttgctgtggcgataagcgtttgataatcctgttggtgcaaaatttcttgaatcttaaaagttaccacttgattttgagcggtaatattttgagcttgttgtgataaactcaaagccgaataatgaaaatagccaagagaggcaacaaaaaaagcaaggctaactaagaaatttctacgcaagaaaataaaaagaaaaatcaaaacaagcgcaataacgagagcaacttgccaaggcaatagcaacggttgcggtagaaataacaacgttaaatccgcgacaattaacaagacagctaaagttattaagtttaatttcatttttataaaaaattaattccagtctctctaagactaggctagttttatttaaatatgcaaacggttgcttcaaattttgcgatccatatcgtaaaaataaatttttcaggaaaatttacttgctaaaacaaacaacttctgatatttataccgcccgcaaaaattgggttcctaaaatagcagtcaggaacaaactaaaataacaagacaggaagtcgtgaagtccacgcttaattctgtatgtattaggagtgagagatgtcaaaagcatcattgagcttgctagatttagcaggcgttaagccttatcaaatgaaaaaagatgaagaatatatgaatgaagagcaaattcttcatttcagaaaaattcttaatgcttggcacgagcaaatcgtggaagaagcttctcgcaccgttgcacatatgcaggatgaagtaaccaatttccccgatcctgcagaccgagcaactcaagaagaggaatttagtctagaattacgtaatcgagatcgcgaacgtaaactaatgaaaaaaatcgaagcaaccttgaagaaacttgataccgatgattttggttactgcgattgttgtggtgaagaaatcggcattcgccgtttagaagcgcgcccaacagcagatctttgcattgattgcaaaactttagctgaaatccgcgaaaaacaagtcgctggttaattcattctattgaaaaatacaaaagtgcggttaaaattagccgcacttttttgcatttaaaaatgcaggaaaatccacttgcctttttctttacaagaaaagagccaagtcatttatttccaacaacaaaacggagtaaattattcttacttatatcaaaaatttgtttggcaagaagacaaaaaaatcaaaagaggttgccaaaacaagtgctcattctaaacgagttgagcgttctaatagccaaatgccaaaagcgcgagcaaaaaaatcggaacaaacacgtcgctatgataaaaatgtgattaaagcggctcaatttgatatttctccgagtgattttagccgtaatgctctcaatgtagtggaaaaactgcaacgtcaaggtttcgaggcttatatcgtcggtggatgtatccgtgatttattgctcggtaaaaaaccaaaagattttgatgttgcaacaaatgctcgcccagagcaaatccaaaacatttttcaacgccaatgtcgtttagtgggtcgccgtttccgcttagcacatattatgtttggtcgagatattattgaagtcgccactttccgtgctaatcacagtgatgctcgcaatgaaaatcaagcgaaacagagcaatgaaggcatgttactgcgcgataatgtttacggtacgatcgaacaagatgcagcacgccgtgattttacggtcaatgcactgtattacaatccgcaagataatacgttacgagattatttcgagggcattaaggatctcaaagcaggcaagctacgcttaattggcgatcctgttacacgttatcaagaagatcctgtgcgcatgctacgctcaattcgttttatggcaaaacttgatatgttccttgaaaaaccaagtgaacagccaattcgtgaacttgcacctttattaaaaaatattccaccagctcgcttatttgacgaaagtttaaaattattgcaggcaggacaaggggtaaaaacctatcggttattacgccaatatagtttatttgaacaacttttccctgcattaagcgcatattttacagagaaagaagatagctttgcagaacgtatgatcgttaccgcccttagttcgacagatgaacgtgttgcggataaacttcgtattaatcctgcattcttatttgcagcatttttctggtatccattgcgcgaaaaagtggaaattttaaaaaatgaaggtggtttaaataatcatgatgcttatgctttagcaggcaatgaagttttagacttattctgccgtgctttggctgcaccacgtcgtcatactgcggtcattcgtgacatttggttcttacaattgcaattattaaaacgtactggctcagcaccaatgcgtaccatggaacatccaaaattccgtgctggctttgatttactggctatgcgtgcagaaattgaaggtggcgaaaccattgaattagccaaatggtggcacgaatatcaatttagtaatggtgaacagcgcgaacagttgatacacgagcaacaacgcttacatcctaaaccaaagaaaaaatactaccgtccacgccgtcgtaaaataacacgttcagcagagtaaggggagatatgattactgcatatattgctctaggtagcaatttaaacacaccagtagaacaattacatgctgcgcttaaagcgataagtcagttaccaaacacgcatttagtaacgacgagctctttttataaaagcaaaccgctcggcccacaagatcaacccgattatgtgaatgccgttgcaaaaattgaaaccgaacttagtccgctcaagctattagatgaattacaacgtattgaaaacgagcaaggtcgagtgcgtttacgtcgctggggcgaacgcacgttagatttagatattttgctctacggcaatgaaattattcaaaacgaacgcttaataattccccattatgatatgcataaccgtgagtttgtcattgtgccgttgtttgaaatcgcatcggatttagttttaccaaatagtcaaatcataacagagctggtcaagcaatttgctgaccacaaaatgataaaattaaatccctagaaatttcaccgcacttttatgaacctcaaaagtgcggtagaatcagcccacatttttcttcattcatgacccgttatggaaagcttaactcaatatatccctgatgaattttctatgcttcgcttcggcaaaaaattcgcagaaattcttttaaaattgcataccgaaaaagcaattatggtttatcttaacggtgatcttggggcaggaaaaacaacgctaacgcgcggaatgttgcaaggcatcggtcatcaaggtaatgtaaaaagcccaacttatacgctggttgaagaatacaatattgcaggcaaaatgatttatcattttgatttatatcgtctagcagatcctgaagagctcgaatttatgggcattagagattattttaatacagatagcatctgcttaattgaatggtcagaaaaaggtcaaggcatattgccagaagctgatattttagtgaatattgattattacgatgatgcacgaaatattgaattaatcgcacaaacaaatttgggtaaaaatattataagcgcattttctaattaacttatttatgaaaactaaaattttattttttctttttttctcgacatttagcttttctatttttgcagcacctattacgattgcgattgacccaggtcatgggggaaaagatcctggtgcaatcagccgaaatttaggtatttatgaaaaaaatgttaccctttcaattgcaaaagaattaaaagccttattagataaagatccacattttcgtggcgtattaacacgtaaaagtgattattatatttccgtgcctgaacgttcagaaatcgcacgtaaatttaaagcgaattatcttatttccattcatgcggattcatctgaatcgcctgatcgtcgcggggcttctgtttgggtattgtcaaaccgtcgagccaatgatgaaatgggtcaatggctagaagacgatgaaaaacgctcggaattacttggtggcgcgggaaaggtgctttcacacaataatgacaaatatcttgaccagactgtacttgatctgcaattcggacatagccaacgtactggctatgtgttaggcgaacatattttgcaccattttgcgaaaataacaaccttgagtcgtagtacaccacaacatgcaagtctgggtgttctacgttcgccagatattccttctgtgttggtagaaactggatttctttccaattcagaagaagaaaaaaaacttaattcccaaacttatcgtcgccgcattgcttatatgatttatgaaggcttagttgcattccgtagcggtaaaaccaacactttagttaaagacaatttagtgcaaaacatcaaacaaaacgatataaaaaaatcagggaaaaataaccgcacttcagaacaaaatataaatgaagataatattaaagacagtggcattcgccatattgtaaaaaaaggagaaagtttaggtagcttatcaaataaatatcacgtaaaagtctctgatattattaaattaaatcaattaaagagaaaaacactttggctaaatgaaagtattaaaatccctgataatgtcgagataaaaaataaatcattaacaattaaagaaaatgattttcataaaaaacaaaatagctcagtaaataatactaataaagatttaaaaaaagagaaaaatacacaaactaataatcaaaaaaatataattccgctctatcataaagtaacaaaaaaccaaacactttatgctatttcgagggaatataacattccagtaaatatactattgagcctaaatccacatttaaaaaatggcaaagttattacaggacaaaaaataaaattaagagaaaaataaatgcctattaaaattctttccccacaacttgctaaccaaattgctgctggagaagtggtagaacgccctgcatcagtggtaaaagaattagtggaaaatagccttgatgcaggtgcaaataaaatccaaattgatatcgaaaatggtggggcaaatttaatccgcattcgtgacaatggctgtggtattccaaaagaagaattaagcctcgctttagcacgacatgctacgagtaaaatagccgatcttgacgatctcgaagcgattttaagtttaggttttcgtggcgaggcattagctagtatcagttccgtatcacgcctaacccttacttctcgtaccgaagaacaaactgaagcgtggcaagtttatgcgcaaggtcgtgatatggaaaccacaatcaaaccagcatcacatcctgtcggcacaacagttgaagttgccaatctttttttcaacacgccagcccgccgaaaatttttgcgcacagataaaacagaatttgctcatattgatgaagtcattcgtcgcattgctttaacaaaattcaatacggcatttacattaacgcataatgggaaaattatccgtcaataccgtcctgccgaagcaatcaatcaacaactaaaacgtgtcgccgcgatttgtggggatgattttgtcaaaaatgccttacgaattgattggaaacacgatgatttacatttatcaggttgggtggcgacaccaaattttagccgaactcaaaatgatttaagttattgctatattaatggccgaatggttcgagataaagtgatcagccatgcgattcgacaagcctatgctcaatatttaccaaccgatgcttatcctgcgtttgtgttgtttattgatttaaacccgcacgatgtagatgtcaatgttcatccaaccaaacatgaagtacgctttcatcaacaacgcctcattcatgattttatttacgaaggcataagttatgcactaaacaatcaagaacagcttaattggcacacagaccaaagtgcggtagaaaatcacgaagaaaatacagtgcgtgagccccaaccgaattatagcattcgtcctaatcgtgcagctgcggggcaaaatagctttgcgccaaaatattatgaaaaaccacagcaaaatcaaccgcacttttctaacacaccagtgttgccaaatcatgtaagtactggttatcgagattaccgttctgatgcaccgagtaaaactgagcaacgtttatatgctgaattgttacgcacgttaccgcctacagcgcaaaaggatatatcggatacagcacaacaaaatatttcagatacagctaaaatcatctcaactgaaataattgagtgctcatcacatctgcgtaccctttcacttattgaaaatcgcgcgctcttattacaacagaaccaagatttctttttgctttcattggaaaaattacaacgcttgcaatggcaattggctttacaacaaatacagattgaacaacaaccattgttgattccaatcgtatttcgtttaacagaggcacaatttcaagcatggcaacaatattcagataacttcaaaaaaattggctttgaatttatcgaaaatcaagcacaattacgcttaaccttaaataaagtgccaaatgtgttacgcacacaaaatctacaaaaatgcctgatggcaatgctgactagagatgaaaattcatcaccatttttaaccgcactttgcgcacaattagaatgtaaaacctttgacgctttagcggacgcactcaatttattaagcgatacagaacgtttactcacgcaaacgaatcgcacggcattcacccaattactcaaacctgttaattggcagcctttattagacgaaatttagattcttcatgaaaccaaccgcaatttttttaatgggccctacggcctcaggcaaaacggatttagctattcaactacgaagctcgcttccagttgaagtgattagtgtagattcagcgctcatttataaaggaatggatattggcacagcgaaaccatcaaaagaagaacttgctcttgcgcctcaccgtttgattgatattttagatccatcagaaagctattccgcaatgaatttccgcgatgatgcgctacgcgaaatggcggatattaccgcacaaggcaaaatcccgttactagtgggtggtacgatgttgtattacaaagccttaattgaagggctttctcccttgccttctgctgatgaaaatattcgtgccgagcttgaacaaaaagcagctcaacaaggttgggcagcattgcatacagaactcgccaaaatcgatcccatttctgccgcccgaattaatcccagtgattctcaacgaatcaatcgtgctttagaggttttttatatcacgggaaaatcactcacagagctgactgaagaaaaaggcgaagccttgccttatgattttgtgcaatttgcaattgcgccgcaagatcgccatgttttgcatgaacgcatcgaacaacgctttcataaaatgattgaactaggctttcaagcagaagtggaaaaactttatgcacgtggcgatttaaatattaatctgccgtcaattcgctgtgtaggctaccgtcagatgtgggaatatttgcaaggcgattacgatcacgaggaaatgattttccgtggtatttgtgcaacgcgccaacttgcaaaacgccagctcacttggctgcgcggctggaaaacaccaatacaatggctagatagtttgcaacctcaacaagcgaaagaaaccgtattacgtcacttagattcctatcaaaaaggttagaaaaaatgaccgcactttctgccctcattgaacaaaaattacaatctcttggcacaatcctgtgccaatcttttccagagctttccccagaaaaaattcacgaagctattcaacaaaattcaaatcatccagaactgcctgtttatcaattaggctatgccatagcaatgtctgactttgtggaaaaagtcttgcaaaaatacccgcacttagtgaaacaatggtgggaaaaatccccctgttttgcagattgcactgcctatattgaacgtttgaatagagagttagccaatgtacatgacgaaactgcactctatcaaacattacgtcaattccgtaacattgaaatggcaaaattaagtttttgtcaaagtttgaatcttgcgactgttgaggaaatttttgttcagctttcacaacttgcagagagtttaattatcgctgcccgcgattggctttatcatcaagcctgtgcggagataggcacaccaatggatgaacaaggcaatccgcagcagctttatatcctaggaatggggaaactaggcggctttgaactaaatttttcctcggatattgatttaattttcacttatccatcacaaggggaaacatctattgaaaatacgaatgctcgacgttctgtggataatggaaaattttttacacgtttagggcaacgccttatttctgccttagatgaatttacctctgatggttttgtgtatcgaaccgatatgcgcttgcgcccatttggtgacagcggcgcgcttgttctcagctttgcagcaatggaacaatattatcaagatcaaggtcgagattgggaacgctatgcaatgattaaagggcgagtattgggcgtacaaacaaaggatcccaacgtatctaaattgcaaaaaatgttacgcccctttgtgtatcgtcgctatattgactttagtgtgattcaatctttacgtgaaatgaaaggcaaaattgagcgagaagtacgccgtcgtggtttgaaagataatattaaactaggtgctggtggtattcgtgaagtcgaatttatcgtacaagtttttcaactcattcgaggcgggcgagaaatcaatctgcaacaacattcactcttaaagatcttgcctgaaattaccaaactaggattaattaccgaacaacaattccacgatttacgtgaaagttatatttttttacgccgcgtagaaaacattctacaagccattaacgatcaacaaacgcaaacactaccaaccgatgaaatagatcaaattcgtttagtcaaggcatgtaaaactttcacctgtttaaatgaaaataatcaaaccattgaaaaacattatccaatagaaaattgggacgatttttaccgcactttacaacaaaaacaagaaaaagtgcgggcagtatttactcaattaatcggtgatgaacaagatgagccttcacaaactgatagccaatggcaagattttttagaagcagattttgaggatattgaacaaacattattagagagtggtgtatcagaaaataatattgatgaagttttagaaaagcttgctcaattcaaagacggcctaaatcacagagtgattgggtcgcgtgggcgtgatgttttgagtcatttgatgccaacagtacttgcactcatttttgaacaagaaaattaccgcactttgctcccccgaatactgaacattattgaaaaaatttcgagtcgcacgacttatttagaattattattggaaaatcctcgcgcacttcagcaagttattgaactttgtgcacagtctcaacttatttcagaacaattggctcgctatcctattttattagatgaattgcttaatacggaagcactacgtcatccattgccatttacccaatatcctgcagagttacaccaatatttgcttcgtttaccccctgatgatgaagaacagattatcgatgctttacgtcaatttaaacaagcaaccctattaaaagtggcagcggcagatattttaggcgcattaccagtaatgaaagtaagcgatcatttaacctatcttgctgaatccattattgaagtggttgtgaatctagcttggaaacaagtgtcttctagatttggcgtgcctgaacatttacaaaataatgaaaaaggatttttagttattggttatggaaaacttggtggtattgaactcggttataaatccgatttagacctcgtatttttgtacgatgccgtagaaaatcaaacaacaggtggcaagaaagtgattgatagcaatcaattttacctacgcttggcacaaaagattgtgagtattttcagcataaatacttccgctggcgtactttatgaggcagatatgcgcctgcgcccttctggcgatgctggcttaattggctgctctctttctgcattttcccattatcaattgaatgacgcttggacatgggaaaaacaagcacttgtgcgcgctcgtccagtatttggcgaatcatctcttaaagctaaatttgagcatatccgccaacaagtgctttctgcatcacgagatattgaacaattaaaacaagatgttgttgagatgcggaaaaaaatgtttgcccatttatctcactcaaaacacagtgaatttaaccttaaaacagatcgcggtggcattacagatatagaatttattgctcaatatttaatgcttgccaatgccccgaaaaaaccacaactaacaaaatggtcagacaatgttcgtattttcgatgatatagcagaggctaaaattattagccaaacagactgcgacacattaaaacaatgttatgttgatttacgcaatgctattcaccatttaaatttgataggcaaatcccccgttgtggatgaaactgaatttgtcaaagagcggtcatttattcaagcattttgggataggttatttgtatcctaaaatatggcttgtggacgtttcaaaaatagccttcatcacaaatcttcttgaaacctcgcaaaaactaaatattcaatcctatttttaatgaaccaaatctaacatttcctgtgcattggctagagctaattctgtgatttcacttccgcccaagagtcttgccaaggctggtacacgttcagcttgtgaaagtgcggtcatttttgtttcagttttattatcaacagtaaatttttctacattgaactgatgatggccatgacaagcaacctgtggcaagtgcgttacgcataatacttggcagcgttcacttaattgacgtaaaagttttccgacaacacttgctgtttttccgctaatgcccacgtccacttcatcgaaaattaacgttggaatagccgattgatcagaagttaaaacttgaatcgctaaagaaatacgagaaagctcaccaccagaggcaattttagctaatggctgcggttgttgtcctaaattactacgcaaagtgaaaatcacattatccgcaccatttgcactcactttatctaaatccgtattcaactctacataaaattcagcgttttccattgcaagttgttttatcgactgtgtgacattttgcgctaagcgggttgcagattgctgacgacttgctgttaatgctgtagccgttgcttgcatttgttcaaatgctcgtttttcttgctcaatcaacatctcttcactttcagaaaaatccaaaagtgcggttaattccgcttttaattttttgtgctgttctacaagatcttcaggtttaacttgatgtttacgagcaagttgtaaagcctgactaattcgctgttcgatttcctgtaaaagttgaggatcctgctcgatattacttgataaattttgcacttcactggttgcttcttgcacttgaatcaacgcatcattcaacatattttgcacttcagcatattgcggatcaagttcagctaattcatcaatatattgtgtcgcacgataaagcaaactatcgatatttacggtgtcattttcacttaaaatttgcagggccgattgagaaagttgggttagctgttcgctgctagataaacgacgttgttcatcttctaattccaaatattcatttggtcgaaggttaaattcatctaactcatccacttgatactgtaaaagttgtttacgtgcttcattttccgccactttttgttgaaaggttttaacttgattttgaagatttttccatgtctgataatcttcacgcattttcacaagtaattcaggatgagcggcaaaattatcaactaactgaagctgatagtcattttttaacaataattgagaagcgtgttgcccattaatatgaacgagatattgagcaatttcttttaattgagaagcggatactggtgtactattaataaaagccttagaacgtccgtctgcattaattatacgacgtaaaatacattcagttggattatctggatcctgtaattcttgctcactcaaccagtgataagcaggattttgcgattctagttggaaagttgcacaaatttccgcacgctcttgcccttcacgcaccattgaggtttctactctttgtccgaaacataaacctaaagcatcaatggcgatagattttccagcaccagtttcccctgttataacagacattcctttcgccaattcaatatcaagctgacgaacaatcgcaaaattattgatagtaagttgagtaagcatagcaaaatcctttaactgtatatttaatatgatataactgatttaatttacagtaaaggattttttacagtattttgtcaaatctatttcaatcgaaaatttttaccataatcaaaatgattttaaccaacctaatttgctacttaacacattgtaataattataatttttcagatgaagcaatcggagtttatgctcgcttttttgaatatgcaccacatcatctggggtaaaaggtaaggtaatttgactatcacagcccacttctaattgagaggtattatgttcagcaaaacgaatcgatattttactatccccatcaacaacaagagggcgagaagttaatttatgtggaaacattggcactaatgcaatggcattaaggtttggtgtcaaaataggtccaccagcggaaagagaataagccgtagaacctgttggagtagaaacaattaatccatcagaacgttgagaaaatgcaaacttatcattgatatatacgtgaaagtcaatcatatgtgcaattttggcgggatgaataaccgcttcatttaccgcattgctggttgatacgatttcacttgctcgttcgatttttgcttccaataaaaaacgttcttccacaaaaaattcgccacgttctaaacaagcttcaagctgggaataggcatttttcgggtcaatatccgttaaaaatcccaaattaccacgattaataccaatcaatggaatatcatattttgctaatacccgagcgcgccctagcatattgccgtctccaccaatcacaatggctaattgggctcggtggcctatttcttctaacgtagcaagatgttcaaaaggtaactcaagtgttatggcgacttctttttccaccaacacttgataaccacgttccattaaccaatgaaataagtttttgtgcatttgtaagttaatatcattgcgaggcttacctacaagagcaatggttttaaaggaacgatataaatgattcataaaatgaccgcacttgaatttaacattttcgtcattatatcgttttttgctacactatgcccaattacgattaatcaattttgttttacggagaaaaaaatgtcagaacaagaacaaaaagttgaaatcccagaagtagaaaatcaagaagaagtcgttgtggaagaagcacaacaagcagatccttctcaagaatttgatcctttagaagaagcaattgctcgcgtgcaagagcttgaagagcagctaaaaactcaaatagaagaagcggcaaacaaagaacaggatattttacttcgctctcgtgctgaaattgaaaatcttcgtcgtcgtactgaacaagacgtagaaaaagcacataaattcgctttggaaaaattttcaaaagacattttgaatactatcgataacctagagcgtgcgcttgccactccagcaaataaagaagatgaaagcgtaaaagccttatttgacggtgtagaactaaccttaaaagaattagtttcaaccgttgggcgttttggcgtggaagctgtgggagttgtcggtgaagcctttaatcctgatttacatcaagccatttcaatgcaaccagctgaaggctttgaaaccaatcaaattagcgtcgtattgcaaaaaggctacaccttaagtggtcgagtcattcgcccagcgatggtaatggtggcggcttaatttatattttgtctaaagagcggtcggtttttcgaccgttttttctttttcctgaataacaacataaactttacggataatttccctaaaatcttcgctcgttgtagcccaatctagaagatctacgcgccacggtaaatctgattcagaaaaagcttcctttaatctgtcacgagctaaaaaatctaaaggctcctcagagataatcgcaaggtcaagatcggaatatttttttgcttttccctttacacgagaaccgaaagcccatacggtataatcaggtacgaattgttgtaaaatagttttcacaatcgccaattcttcagattttatatcaagctgtgcaaaactagtcatattgatttctctgacgtaattgttccaataggaaacaactttctattaaaaaatcatcaatttgtgcataaacagccatggctttttcctgatcataagtatgtgatgtaatattacgcatatcacgataaacaacccattttgacatatcttcaatcaaaccaaatctcaatgcttctcgcaaaatatccttaaatccataagccccaatatcatcggtattaattgcatcttgttgaagttggcgtttcatcatttttaaacttaactcataaacaaattcaaatttctgaattgcacctgcaattaaggtatcttgtacaatagagggttgcatatcaaaccaatttctgtctgaaatttgtactacggtttgctctaacgaataaaatgcagcgtctaatacatttaaatttagcttatcagtcatcatttttacctctgttaaatactcatctattttaccatagactattttttctcaaaacctataaccccaaaagtaaacattgtgatattgatcacaaaatcaaaaatatttgagaaaagctctcaacaacttaatgtgatatttttctaataaaatcaatctttaacaaaattatcttacgacaaaaaggtctaaaacactacatattgtgtgttgattatctttttagatctatatatagtgcaatccgcatttcaaaaacactatatattggagctatatcatgagtaactttggggtcatcaagcgcgatggttctcgtgcggagtttgagattcaacgtatcattaatgccattaaaaaagccgcaagtgcggtcaatatttccgatgaattttattgccaccaaattgggcaagaagtagggaatgaaattttcacccgtcatcaaggcgagattgatattaatcagattcaaaaagtcgttgaagataaattgatggcaagtcgttatcctgagattgctcgtgcgtatatcgaatatcgtcatgatcgtgatttagcgcgagaaaaacgtagccagctaacaaaagaaattgaaggtttgattgaacaaagcaacgtagaattacttaatgaaaacgccaataaagacgcgaaagtgattccaacgcaacgtgatttgcttgctggaattgtggcaaaacattatgccaagcaccatattcttccacgcgatgtggtagaggctcacgaaaaaggtgaaattcattatcacgatttagattacgcgccgttctttccaatgtttaactgtatgttagttgatttagaagggatgctttctcgtggtttcaaaatgggcaatgcggaaatcgaaccccctaaatctatcggcaccgcaacggcagtgacagcacaaattatcgcccaagttgccagccatatttacggcggcacaaccattaatcgtattgatgaagtgctttccccttatgtgcaaatcagttacgaaaaacatctcaaacatgcccaagaatggaacgtgcctgatgttgaaggttatgccaaagcattgattgaaaaagaatgtttcgatgccttccaatccttagaatatgaagttaatacactacatacttcaaatgggcaaacaccatttgtgacctttggttttggtttaggtacaagctggcaatcccgcttaattcagcaagctattttaaaaaatcggattcgtggactcggaaaaaatcataaaacgcctgtatttccaaaacttgttttcaccatcaaaaaaggtttgaaccaaaataaaggcgatccgaattacgatatcaaacaactcgcattagaatgcgcatcaaaacgtatgtatccagatattctcaattacgatcaagttgtcaaagtcacaggctcttttaaagccccaatgggatgtcgtagctttttaggtgcatacgaagaaaatagtcatgaaattcacgatgggcgtaataatcttggcgtagtgagtttgaatttaccgcgtatcgcgttggagtccaaaaacgaagaagatttctaccgcactttagatgaacgtttggctattgcgaaaaaagcattaatgacgcgtgttgcccgccttgagaataccaaagctcgcgttgctcccattctttatatggaaggtgcatgcggagtgcggttaaaagcggatgaaaatgtggcacaaattttcaaaaatggacgagcctctatttcgctcggctatatcggtattcatgaaaccattaatgcgctatataaaaaagggcatatttttgatgatgaacaattacgcgaaaaaggcattgcgattgttcgccaccttagcgaggcagtaaaacgctggcaaaaagaaactggctatgccttcagcctttactccacgccaagcgaaaacttatgcgaccgcttctgccgtctagataccaaaaaatttggcgtgattgaaggcatcacggataagggctactacacgaacagttaccacttagatgtagaaaagaaagtgaatccttacgacaaactggattttgaaatgtcatatcccccactcgccagcggcggttttatttgctacggcgaatatccaaatattcaacacaacttaaaagcattggaagatgtgtgggattatagctacgatcgcgtaccttactacggcacaaacacaccgattgacgaatgttatgaatgtggtttcactggcgagtttgaatgtaccagcagaggttttgtttgcccaaaatgtggcaatcacgacagcacaaaagtgtctgtcactcgccgcgtctgtggctatctaggcagccctgatgcccgcccatttaatgcgggaaaacaggaagaagtgaagagaagagttaaacacctttgatttaactccctagcaaaagcacgcattttttaatgcgtgctttttgttaccaactttggcattccccaaaatctccgctaaaataaccgcactttttcttatcttctaggaaagcaatatgtcagatattctcaataacctcattcatcttcttaaacttgaaaaaattgatgatttaatctttcgtggtgaaagccaagatttaggttttcgtcaagtatttggcgggcaagtagtggcacaggcgttatctgcagcaatgcaggtggcgccagaagatcgcattttacattcttgtcatgcctattttcttgccccaggagacagccaatatccgattatttacgatgtggaaaccttgcgtgaagggcgtaatttttctgcattacgcgtaaaagccattcaacataaaaataccatttgtcatgtaaccacttctttccaagtgctggaaaaaggttttgaacatcaaaattcaatgccaaatgttggcgcgcctgaagactttacagatgaaaatgtgatgctacaaaaagtggctcaaaccttgccagaaccactcaatgaaaaatttgcggcagagcgtccatttgaggtacgtaccaaatatttgaataacccatttaacgggacaaaattgccagccgagcaatattcttggtttaaaaccaatggtgaaacgccgcttgatataaaaattcagcaatgtttattggcttatttttccgattttcactgtattttgaccgcacttcatccgcacgaaaaaggctttttacaaaaaggaatgaaagtggcaaccattgatcatagtatttggttccatcgtccgtttgatttaaatcactggcatttgcacgcaattgaaagcaataatgcttttggagggcgaggcttagctcgcgggcaaattttctcgcaagatggtcaattaatcgcgacaacacaacaagaaggtttgatccgttttaatgaataagagagaaaaaatgaccgcacttattacacaattttggcaacaggttgaaaccgagcaaaccttgaaatcttatattaagaaatgatgaaaaaataaaaagactaagttctattacattctgaacttagtctttttaatgaaattaatttaacgtttaaatttattgcttacgccaagttgttccattcggcccatcttctaatacgatgcccatagcgataagctcattacgcgcagcatcagcagtagcccaatctttagcagcgcgggcctcattgcgttgtttaatcagtgcttcaatttttgccacttcatcatcgtcagaacctgcttgtaagaatttttctggatcttgttgaagtaatcctaaaatcgcccccaattcacgcaaacgcgcggcaagtccattggctttctcagcatcctctgtttttaacttgttaatttcacgcgccatttcgaataaaacagaaagtgcatttggcgtattaaaatcatcgtccattgcttcacggaaggtttccacaaaattttctccgccaaaaacaaccgcactttgatccgttccacgtaaagccgtgtataaacgttccaacgcaccttgcgctaaattcaagttttcttcgctgtaatttagctggctacgataatgtgccgttaataagaaataacgtacagcttctgcattgtaatggtttaatacatcacgaattgtgaagaaattgccgagagatttcgacattttttctttatccaccataatcatgccagaatggatccaataattcacatattggccaccatgcgcacagcaagattgtgcaatttcattttcgtggtgtgggaacattaaatcagagccaccaccgtgaatatcaaaatgttcgccaagctgtttgcagttcatagccgaacattcaatatgccagccaggacgacctgcaccccaaggggaagcccaacttggttcgttttctttcgacattttccaaagcacgaaatccattggatttttcttgatttcattgatttcaatacgtgcaccagcttgtaattgctcaagatcttgacgggataatttgccgtattctttgaagctttctacatcaaacatcacatcgccattatctgcaacataagcatgtccacgtttaatcaatttttccacaatttcaataatttcaggaatatgatgggttgcgcgaggctcaaaatcagggcgtaatacattaagtgcatcaaaatctttatacatttcctgcaccatacgatccactagctgatcgcaggtttctttgttttctaatgcacgtttgatgattttgtcatctacgtccgtaatattgcgcacataagttaaatcgtaacccaaagaacgtaaataacgggcaatcacatcaaaacacacaaaagtgcgtccatgaccgatatggcacaaatcataaacagtgacgccacaaacatacattcccactttattttcgtggataggtttaaagatttctttttctctcgttaaggtattgaaaatttttagcatttttaagctcgtaaaatgaaataaaaacaaaccgcacttttatagcacttttacctcgattgtggaataatacgacccttaattttttagagggaaaacaaaatggttacattacacacaaattttggcgacattaaaattaaattggattttgataaagctccagttacagcagaaaatttcttaaattactgcaaagaaggtttttataataacacaatttttcatcgtgttattgatggctttatgattcaaggtggcggtatggaaagcggtatgcatgaaaaagcaaccaaagcaccaatccaaaatgaagcgaacaatcgtttaagcaacaaacgtggaaccattgcaatggcacgcacgtcagatccacattcagcgaccgcacaatttttcattaacgtggcagacaatgatttcttaaattatcgttcaaaagaaatgtttggtcgagaagtcgttcaagaatggggctatgcggtatttggtgaagtggttgaagggatggatgttgttgataaaatcaaaaaagtgaaaacaggcaacaaaggctttcatcaagatgttcctactgaagatgtagtgattacattggtttctattgagtaacaaatgagcataaaacaacatcgccctaaagttggagaaattctagaatgtgattatggtcaattttcgcatacctgtcacgttgatggacatattccacctgaaatggttaaaaaacgtttagttgttgttttgaatgcgaaactgaacgggcttattttagttgcaccaatttcatctacaattaatttagatggtataaaaaatggctatcatattgaaatagattcagaattaataaaagcaacaagcttttatgataaaaggactcgctggattaaatctgaattaattcaatcagtaagtcgtctccgtctgtatcatatttatgataaaggaactaaaattactcaatatttgccaagggatgttgtaacaaaagttcaaagagctatcataaaagcaatcaatgcaagctcattacttgacaagtagatagaatacagtatagacttccgagcgtaacgccttagagcgatcatcatcgaaagatgagtttttaaacgccattgagcgatgaatcccctgattagcgataatcaggggattttttatagaatttagataaagatatttatgcacttcttcgacactcacacgcatcttgattatctccaacaatttactggggaaccgttgtcacaacttattgataatgctaagcaagccgatgtgcaaaaaatactggttgtggcggtgaaagaagctgattttaaaacaatccaaaatatgaccgcactttttcctgataatttgtgctatgggcttgggctccatcctctttatattcaagaacacgccgaaaatgatttgattctgttagaacaagccttaaaaaatcgtgatgcaaattgcacggcagtggcagaaattggtttagaacgcgcaattcctgatttgctcaccgatgaactttgggcaaagcaatgtcatttttttgaaagccaactttatttggcaaagcaatttaatttacccgtcaatattcacagtcgaaaaactcatgatcaaatttttacttttttaaaacgtattccattatctaaacttggcgtggtacacggtttttcaggaagttacgatcaagcaaaacgctttgttgatttaggctataaaatcggagttggcggcactatcacttatgaacgagccaataaaactcgtcaagcaatcgcgaagttgccgcttgatgccttagtgttggaaacagacagtccagatatgcctgtatttggttttcaaggccaacctaatcgaccagaacgtattgtggaaagttttaaagccctttgcaccttaagaaatgaacctgctgaattgattaaaaaacttacatggaaaaatgcttgccagattttttcttgatccacgtcacattactgaaattattttgaattaaattgcagtcttcaatggcttaaaatccatggtcacatcgggcaattatgcctcttattatttagcgcttttgccttccgaaaatggcgaaactattgataactgggtgcttccacttggtactcaaggcttaacttttgaagctgatagctggaatagcttaggtatgcgtagcaatgtttcttgctttatgcgcatgaccgatatgccattagatcgtagctggcgtgtagcgtggaactctcccctaattacatgtatgccgtggcaactggagcaaagatgaaagcgtattattgcgcgggccttatacatcattagtggatttatttgaatcggcattacctgatattttaatgctcgaattttctacgccaagagcgggagaattaagttcgttattagaaagtgaaatattaagacaaaaatgtattttaggcttaggcgtcatcaatcctcgttctgatgaagtggaaactgtaacacaaattgttcagcgcgcagaaaaagccttaaattaccttccaccagagcaaatatcaaaatttcagacaaaaaaattgccccattaaggggcaatcttatcaacgctctaaagttacttatagctttaagcaacgattaaatatgttggttaatgaagttagccaattgagtttttggtaatgcaccaacttgagttgcaacaacttgaccatttttaatcaataataatgttgggatactacgaacaccaaattgtgctggcgttgcttggttgtcatccacattcattttcacaattttaactttacctgcaaattcaggtgcaagttcatctaacactggtgcaatcattttgcaaggaccacaccaaggtgcccaaaagtctaataaaacggggatatctgaattaactacaacactttcaaaatctgcgtcattaatgtgtaatacttcgctcattttgttttccttattttgtgaatggattccctatataagggctttttttaaacttacaagtgcggtgcagaataacaccgttttaaaaaatgtaaactaatcgttttaattgccaaaagctaagacggcaaaacaatattttcacacactttacccgatttcaatttataaacatttgataaagtcacatccgcaatattggttagtgcttcttcggttaaaaatgcttggtggcctgttagcaatacattatggcaagaagataaacggcggaaaatatcatcttgaatgacttcgttagacttatcttcaaagaacaaatctcgttcattctcatacacatccatacctaacgccccgattttacgctgttttaacgcatcaattgcagcctgagtatcaatcaaagagccacgactcgtattaacgatcatcacaccatctttcatttttgcaaaagcctcgcgatttaataaatgatagttttctggcgttgctgggcaatgaagcgtaatgacatgagatttagcataaagctcatctaattcaacatattgtccaccaagctcttccaccagtggatttttaaaaggatcgtacgccaaaatattcatgccaaaacctttcaaaattcgcatcactgcgatcccgatttttcctgttccgattacgccgactgtgcgtccgtacatattgaaaccaattaacccctcaagagagaaattcgcttctcgggtacgctgataagcacgatgaattcgacggttcagagtcatcatcaaaccgatggtatgttccgccaccgcttcaggcgaataagctggaacgcggacgacttggatgcctaattcttgagctgcttttaaatcaacattattgaaaccggcacagcgcaaagccacaattttcacaccaagtgcggctaatttttctaatacttttcggctaccattatcattcacgaaaatgcatactacttcgcaatgctctgccaaacgcacagtgctctcgttcagcataaaatcaaaaaattctaaatcgaaattatatttcgcattaatgagctcaatatattttctgtcataacttttagtgctatagattgcaattttcatggtttgctccaattattttaagtttgcaaaagcctgtaataagtccgctttaatatcttctacatcttcaataccgactgaaaaacgcaacaaggtattagtaatcccacgagctacacgctcgggttctggaatatccatatgagtttgagtggcaggataagtaataaaactttctgtgccgcctagactttctgcaaaagtaatcaatttgatggattttaagaatgtattaacccaagcttcatcttgcaaacggaaagacaacatcccacctttatttggataaagcaccgattccacttgtggttgagcttttaaaaattccgcaatggcttgtgcattttcttgatggcgtttcatacgcaaagaaagggtcttcataccacgaatagtcagccaagaatcaaaaggagaaagcaccgcccctgcaccattttgaatataagcaatgcgatcacaaagttcttgccctttcgcaacaattaaaccaacaagtgcatcattatgcccagcaatatatttagttccgctgtgaattaccacatccgcacctaaatctaatggacgagaaagcacaggcgttaaaaacgtattatccacgatcaacattaagttatgttttttcgcaagttttgcaatttcaaccacatcacattcttccattaaaggattcgatggggtttcaataaaaatcgctttcgtatttgggttaatggcagcctcaattgctgaagcagatgctgtattaacataaacaggttttacactattgttatttttataagaaaaatctaataatcgataagtaccaccatacacatcgctagaaacaatccattcatctggggcggtaaaaagcgtcatcaaaacttgaattgcagccataccagaagaaaacgcaaaaccacgatctccattctctaatttagctatcgtttcttctaatactgtgcgagttggatttttggtacgtgtgtaatcaaatcccgtactttcaccgataccacaatgaccataagccgtagaaagaaaaattggtgcagaaaccgcgcccgtacgctcatcactgcgattgccagcttgagctaataaagtatcaatagcatattgttgtgtcataacatcctctaaaaataatgaaaaaattgaccgcactttacgtgttaaaaaacgtttagcattttggcacaaaggaaaaagtgataaaagtagaaattagaaaattacataaaatttcatttttccatcattttctgtgatttatttgaacaaaatgaactttttttaaacggttagacaatttttttaaatctgtaattgacagttatctgaatttccgtaaaatgcgcaccactaacagcgaatgcgggaatagctcagttggtagagcacgaccttgccaaggtcggggtcgcgagttcgagcctcgtttcccgctccaattcgtggcgtgttagcaaagcggttatgcactggattgcaaatccatgtagctcggttcgactccgggacacgcctccataatacgcaaatgttagttgtctatgtgcccgagtggtggaatcggtagacacaagggatttaaaatccctcgcctttcgaggcgtgccagttcaagtctggcttcgggcaccatctaattccaaaccaataatcagtacctagtccaatacttaactttaatttttaattatcgttaggtgaggaattatggacttctcttctgtttctaaaaaaccttatattattactgtcgcttgtactaaaggcggttctgcaaaaagtacaaatgctgccaatattggggcgttctgcgctgaccacggtttaagaactcttcttattgatactgatactcaaccaaccttaagctcttattatgctttaactgaagaagctcccggtggtatttatgagtttttaacccgtcgtgatattgaaccttcccatatcatttcaaaaacatccattcctaatttggatttaattcaatcaaatgacccatcaaacaatgtaagtcaaactctacgtaatgcccctgatggtgcaattcgatttagtcacttaattaaaaacattgataattatgatgttattgtggttgatactcgaggtactagagacattactgtcgatatgtctgtcttagcagctgacatcctattctgccctattcttccacacattctttctgcgaaagaatttatccgtggaactatcggaatgtatcaagatttagaaacctttgaatcatttggcttcaaattaccacctctcaaagctatcgcaaattgcgttgataatactaatgacgtgaaatttgtactcaatcaattgcatgtcctatttgaaaccaattttgatgaaagcaaaaccttccttgatttttcaatccctgcgcatgtggcatatagagaagctgcaacttattcattgccagtttatcgccatagccaagctgaatatcctgttatcaaagaactgtgttgcttgttactccctcaatttaaaacactttttgataaaccaatgaaaaaggaaggctaatatgactgataaacttattgcttctattgaagcggaaagtgcggtcattggtgctctcattattgataatgacaaatttgatgagatcgcaactttactgcgctctgatgatttttatgtctcagctcataaagtattgtttgaaggtgttagccatctattaacacaaggaaaacccgctgatattttaactttggagcagtatttcaaagataaaaaactgattgatcagatagggggattagcatacttagctgacattattcacaataccccttctgcatctaatatcactgcgtatgctgagattatttctcgttatagcaaacaacgtcgttttttgactctgggccagtttattgtaactgaaatgcaatcttcaaaagatgagattgaattaacttcttttgaggaaagtgttgataagcaatataccaatattgtcatcgaacaagagacggatggtgttgctgatcttaatgcaagtttcgagcgaatcctttctcgcatggaaacgtcctctattaatgccgatccagttagtggaacaccaacaggcattattgaattagatagagcaacaacaggcggtcaaccaggagaacttatcattattgcagctcgtccagcaatgggtaaaacaacctttgcacaaacgattgccgcaagtacgttagataaatttcctgacagccctatccaattttacagtcaagaaatgccagctgatcaactattagaacgttttatggcaatgcgctctcgcgtcagcttgcaatctattcgtcaagcgactgagcttgaagaggaagaatggactcgccttgctaatgcaatggggacaattaaaaaagactggaaagatcgtttgttaattgatgatgaagcttctttaacacctcatcgtttacgcgccaaagtacgtaaaaacactcgtctatacggcaaacctaaagcgattttcattgattatatccaactaatgagaactggaaataaaactgaaaatcgcaatttagaacttgccgaaatatccaatgatttaaagaaattagccaaagaaactggatgcccaatttatgcattatctcaactaaaccgaggtttagaaaatcgagctaataagcgtccaatcaatgccgacttacgtgactccggctctcttgaacaagatgctgatgtcatcattcatctttatagagatgaaatctataaccctgacacagaagataaaggcattgcggaaatcatcattggtaaacagcgtaatggcccgttagccacagtaaaaacactgtttcaaggtcaatacagcatttttgagaatttaacgacacaggatagatattatgaataatccatttattgctaaaaataaaaaacaacaaagtcaattagacgcgattgcgaaaggattaaatgttcaacctattaataatcagtctgctgcttatcaaacaacaacagcaacacattatcctgcgcaatctaaatacattaccgttacgttagataaattacgcccttatgaacacaaccctcgtaagacacgtaatcctaactttgaaatgattaaagagtcaattcgtcgtcgtggtcttgatcataaaccaaatatcactcaacgacctggcgaacctttttatatcatcgctgacggtgggaatactcgtattcaagcattaaaagaactgtttacagagactcaagatcaacgtttttggtctattgaatgcttatataaaccctggaaaggtgaaagtgctgatagtgtagaagcggaattagatttgcttattggtcatttaattgaaaatgatacacgtgcagatttaacctttattgagaaagcgttgggaattcagcaagcgaaagaatactacgagaaaaagttaggaaaatccctttctgctcgcgagctttcaagtgagttagaaaaagatgggtatatcattcaattttcaatgattgcgaagatgggacgttgcattgagtatctttatccttatatcccggatgtactttttaacggtttaggtaatgcgccaattgataaattgcttgcgattcgtaataacgccttagccatttggcaaaattatcaatttgaattggaagtgtcctttgatgaaatttggggacacagcctagctcgttgtaatgatgaccaaccgtttcatatcaaagtattccaagaccatctcattgatgaaatgtcatccatgttaggtgatcgtgtaagttatgaagtcctttaccttgaaattgatctcgatgagcaaaaattcaagaaaatggcgcaaaaacaacacgaaatacaacaaagcgtacaagaaagcatccaagatgttcaagcgtttaatacgccacagccacaagaaaccgcattagacacattatctcaacctagcgtagtcaatactccaaaaatgactacccctgaaaaaaaatcaatacctgcgccagtattaaagcaagcaagtgttgaaatttctccttcatttgagaatgaagcagatgataaaacagaggatgaagagtttgatgaaactaatgctagttcagatggcctttcttttgattttgctaaaaatttaactcaacaatttggtattactccaggcatgagcattcaggagcaacgccaacaacgtgcagaagaaaatggattaggctttgcttgcgtaggccgtcaaccagttgatgatatttggaaaatttatcctggtcgtcagcataaagtagaagcttattcactagcactcgacattgcggaaagtgttggattaactgactacattgaacatgtagtaaaagagcctgttgattacacttaccgcgtaaaaccattagataaagatgtgagcggtgtagcacagatgtgttatgacttcttaaatttattacaaacagatgtgcacccacagacatctttcaccttattaccggaatatttactcaatactcaagaaattgatgataccacgctagttaaattattccgtttaattcgcctcgttcgctatattcgttcagaaggagatgcataatgagcatgttcagcaatttaaaccaagtggtattgaatgagattttggttaatttacaagaaggcaatatcaatgtttgccggaactatggtttctcaaaacaagaattgcaagaaattgaaaaactcagcacagaggaagtttatgaactggctaacaccaaagctccctttgccaaagttgaaattaatcacgatgcattttggcgattagtggctcgagtacgcatgtcgtcacaagaacgtcgccttattgatcgcgcattaatgttaggtgcatccatccaaatgctcaattcctacttcggcttaaccacttcaaaagtatctgctcgtcgtagcctacttggaaaacaagaaccaatgggacgtaagccagctgcaaccgaagaggaagaaaaattaatttgggacttatggcaagagcataaaggtgatgttcaaacaattgaatcaacagaaggactagagctgttaattttaattgcggaagaaaccggtattaatttaactgaaatttggaaacttgttagccgctggaatgcagcttaaaaaacataacgcccaacctagtgcgttacgttaagttgggcgttattcatatcgttagtaaggaacttgggaaagttcattggctattgtaaagatgtttaagcacattgcaacaataaaaatgaaatattctcagagagaattaaattatggaaacaaaattacaagagcatgggttgctcttttttggcaaccagcatgaaacagttccaacccgtttgctatttgatccttatttaacatcaagagcaaaattggcatggcaacttataaaatacaaagcaagagaatttcaatcaggcatgttcccatcatacgaagtgcttgcaaaattactttcagataaaccttatgatgaagcagaactctcgcgtaagctagttagccaaacgttgttattacttagattaactcgttggctaacactttgtgaaactgtacgtaatgagcaaggtcaagtattgggtaatttttacatccttcatgatgaacctatgccaatcattgatacgattcaattaaaccatgattacatcgcactccttgaaaaatccattcagcatcgagataactttgtgcgaggtgtagcaaaccatattgtagaaaacctgctctcagataatactcagtggcattatatttctcacattgactggatgcgagctcgccttcaagactatcaaaaacgtccaaaaatggatatttcagagcaagaagaatcaacatttattcaagaaaacttactaagttccaataaggaactcagtgaaaaaacaggggaactcagtaaaaatcaccttagttccaaaatggaactcagtaaaatcaagcagagttccaaaaaggaactcagtacccaaaatgatgataagtcattgatttcaggcttagttccaaaagggaactcaggtttttcacagtacagtacaggtactagtatttatataaatacgtactgtactggtaatgcggatgaaattgactggccgactaatattcagttttcatcattggaaaaaacagcaattatgcaagcaatgcgtggacttgatttaggaatctgtaaagcgattttatttgagctagaacagcgtgtggcaaaaggtgaagtgaaaaaaccacaaggctatgtagtgacattaatccaacgtgcacaccgtggtgaatttaaaccatatttgtatgaacaatttttggctacacaagcgcaatcattatcatcaaaaaatcggttatcacaacatgatgaaactagcttagttaataatgtgaaagccgatagcacaataaaaccaatgcgagtgcaatctgaagaagagcgaaaagcgagagctgatcgcattcgacaatttaaggcttcaatttgcaattgaataagctgtataaaaagtgaatagtgtagaagggttctacaaagtacaaaatttaaccactgtaaagggactttacaaagtacaaattttaaccagtgtgcggggactgcacagtgaacaaaaattaaccactgtgctagggttgcacagtgaacaaaaattaaccactgtgctagggttgcacagtgaacaaaaattaaccactgtgctagggttgcacagtgaacaaaaattaaccactgtccaggggctggacaaagtacaaattttaaccaaatgataaaaggtgacataacatgacaacaacatacaaccaacagcttgggccgttacgcagtgagattacatttacgcttcatactcagtatgcaacacgtctttggaatggtcgtgacttagttaaaaatgaagccggggaagtcgttacatcatcaattctcagtattcctaatgctctatctctattgagtcaaattcagcaagctgccgaacaagatgatccttatgctgatgattatcttcttcgttttgaacaaaaagtattagggtttcgtaaagaaatgcaagatatgacctggagaatggttaatctctacagtgagaaaattcctgaaaactttcaaattgagcgttgtgccaatattgctccgattcaataccctatttttgtgaatactcagctgggttatcaattattgtatcttttggctgactttgattcgttagctcgtacagtgatgaccgcttcacatattgcattacttacaaaagatgatgcgtatgattggttagaatccggagctaaattaattcgtcgtgcatttggtgtgcttgagaattacagaaattccggtattacacgccaagatgcgcttgaaaataacgctcgctatcaagctgctgtaaaacgtatgaaatataccttaacgcctgacgtgctttccggtacaacacgtgcaacatttgctccaacaattaaaaaatcatcacttgctgaatcagatgataatggctctgttgaagtccaaattacagcaaataaaactgaataatggagattgggattatggataacgtgctcattccttctgatatgtataaacaattaggacgcacaaccccacttaatgactcgctgaaacagttattcagtgagttagactcagtgcaacagtatgaattactagctgaatcccttgctacagtccgtgaagctttaatgttgcagcagaatgaaatgttgcagaacgttcgtaaaagtgaacttagtgtattacctattcacatgatccgagataaagcttcatcatccggtgggacgtttttacgctggcgcagttttcaagcctctaagactggtgatgctgtgttaaatccggtatttaataatcctcagttatcttcagacttacgacaaaaacttgtctcagctgagaaagaacgcattttgattaatctgcaggtctccgtactaaattttatgatgagacaggtatcaagtgcggtagataaaattaaagagatagaagatcatttataacattcacatttgtgaacgttggatcttctagtttgtaatcggctaatttatatagtttgtgatcggctcactaaaaggccttttaaaggtaaggggacaagccccttaccttaacgaaaaaaagcctttgcctttcgtggttgtgttaaaaaatctctgtgttttttactgaatttacccttaaggattagatgtaaaaaatgcacaatcttgacagttaattttgtgatttaggagaaatcaatatggctggaattaataaagtaattatcgtgggacatttaggtaatgatcctgaaatgcgaagcatgccgaatggtgaagcagttgcaaatatcagtgtagcaactagcgaagcttggacggataaaaacaccggtgaacgtcgtgaagtgactgaatggcatcgaatcgttttttatcgcaaattagctgaaatttgcggccaatatctcaagaaaggagcgcaagtttatattgaaggacgcttgcgtactcgtaaatggcaagatcaaaacgggcaagatcgttataccacggaaatccaaggtgatgtaatgcaaatgttaggtactcgccctcaaagtgcagatggtgcaaataattctcagccaatgccacaacaagatgcatcggcaaatgcttttgatgattcaataccattctgaactcaatataattaaggttaatcgtgatgaaaaaaataatttttgttttatctgccgtcgctgctttaagtggttgtgctgaattaaactcattgaatgatgcggttggtaatgttgcaggtcaactcagcagtgttcttggcggggggaatagttcctctagttcttccggtgtggcttacactcaaagttctcgttctcatcgctataacgtagaggattcaattacatcatctaaaaatattgactctctttacgtaaaaattaaacgtaatttaaaattcaaaacacgggaggaagcattaagtggattatccgggtatgagcgtcaacgttacgaatcgcttttagatgaagaaggacatgctcatgaagcgactcctggggtctattatcacatggcaaatagctatgttggcggtcgaaaaattgacataacgcttgcaaaagaggatggcaaggttagaatttcctggattgcatcctcaaatgaatctgattttgctcaatttgttaaatcagaagtgataaaagcaattaaataatacgacaacataaacatagtgtaggtaatcaatacctcattctcctttgccccaaccttagtggggctttttttatttcaggtgtttttaaatttcgataccgataataatgattattttgtatgatagataacgaaacaaatttgttttttgagatccatccaaacttttccttttcctcatattgtttaatatctcaaacgtttaccccttggctacaaggggtatttttctcctgtaattgcaaaaaataaattaagtggctcaaaatgaagtgaagataatgggcttgcatactttgacagaattttagctttctctttatggtttctaaccaaaataggaaactcctttacaccatttgcaagcaaccaaagcgttcttgtcataccatcattaagactacagcttatttctccatctttaatatgaacatttacatctgcaagtggaactggagaatccatacttttagcaaatccgttttcagcatgatgaaacttataatcttttctccatgttgactcatcgcccgcacatgtatttttatctacctcatacggtgatcgctgccataaagaaagaaacttttgagcatctacgatgacaatcatgttctcttgattagccatattttcaatatgctgtggataacgcatatacacgactttctgctctctcgttttcattctaaaaataatatatctatctcgacctgaatatctaagcgtatcaaccatcactccaattgatgaaggggtcagttttatcatgatttactcctcagtttaaaaagaattcctaattgtggtttatcttattacatcgaaaatatctctcaaatatcaatgagagaaaacatcatgaaattatttttatgtgaaaaaccatcacaaggcaatgatattgcaaaagtattaggtgcgacaaagcgtggtgagggttgtttatcaacacctgacggtcagcttacagttacctggggaattggtcatctagtagagcaatttaatcctgaagaatatgatcctgcctttaaaaagtgggcatttgagaccttgccaattatcccgggtaaatgggggctttcacctaaaaaagaaacaaaaaaacagttcaatgtcgtcatgaaacttatcaaacaagctaaacttgttgtcattgcaaccgatattgatagagagggcgaaactatagcaagagaattgctggatttggcaggatttcgagggcaaataaaacgcctttggttgtctgcactagatgataccagtattcgcaaagccttgggcgcacttaaaaataatgaggagacactacctctttactatgcgggacttgcacgtagtcgagctgattggcttattggtatgaatttctctcgtctctataccttattagcgcaacaacaagggtatcaagggaaacctttaagtgttggtcgggtacaaactccaacattaagcttggttgttaatcgtgaccgtgagataaaaaacttcattcctaagcaacattttgctttgcaagtaatgctttctgatggaaatcagcattttgctacgcaatatgttattccggagcaatattgtgatcctgatggactttgtttgtctgcccaagttatacaagcagcaaatcagcaaattcgccaatttggccaagcgaaagtggaatcagttgaaactaaacgtgaaagacaaaatgccccactttgctttgcattaagtgacttacaatcagaagctaaccgcctttatggactgggtgcgcaaagagtattggatatagctcaatcactttatgagactcacaaagcgacaacctatcctagaacagattgtggttatttaccggagtctcagtttgcagaagcgcctcaaattatccaatgtttgttgcaatccgataatcgattacacccccttgcaggtatgttaaaccttaatcaaaaatcacgagtttggaatgataaaaaaattactgctcaccatggcattattccgactatgattaaagctgatattagcaaaatgtctgatgaagaattaaagctctatgatctcatacgtcgtcgttatttagctcaattcttacctgtttctgaaacagataagacacaaattattttgaagtgcggtcaacatatattaagtgcacgtgggaatgtgcttattgctccaggttggaaaattctatttggcaaatcacttgatgaagatgatgacgcacctcaagccttgccgacgttaaagcaaggacaaatctgtcagatttctgattcagaaataaaaaccttacaaacatcaccacctaatcacttcacggaaggtacattgctcaccgcaatgaaaaatgcagctcgctttgtaactgatgagcgtttaaaacaacgcttacgagaaactgaagggcttggaacagaagctactcgggcgggaacgattcaaggtttgattgataaaggtttcttgaaaaagaaaggtaaatcactattagcgacagatgaagcaatgacgctaattgataatttacctcagatgttaaaagatccgggtttaaccgcactttgggagcaagcgctcaatcaaattgctgaaagaacgctttcgctagaagtgtttatgcaaaaacaagaagtctttgtgcggcatttgatggctgattgccttaaaaagggaatgagtttggggaatattgaaattcgtaaatgccctaagtgcggtgcaccaatgattaaaagaaatggtaaaaatggggctttttttgggtgttctgcttatccaaattgccaacatattgaaaatattgatagcaagaagaatactaaaagtacaaaaaatttaaagaaaaagtcgagtaaaagtgtgagtgagcaaatttcatctttacgaagcttattgaactaggatttaagcgcctgtgaatggcgagccctcaaaaatagtgctatactaaagccttcgtaagaccgttcgtgaattgtcggttatcaattcacactagccaaaaatgattccagcacgctgaaaggaatttctcacattgattaacgctccttgtgaggtgtgccacctagttaatcagagtaatgatggagtaacgccccaatttactctcgacttttcaaatcgctggccattgcggatttttaaagtgtattgcaaagtgcattttgaaaattcgcaatggcttgctactttttccttaccggagcccaccggtgaaacaatgggtgccctttgtgtcaatttgatgccacagatataaccgattgatggccacaaagtaatcggataaggcgagccgtaaaaatccgtatatggtaacgaacgtatcagtatttttatgaatcaaattagtttggcctacttaatttttatttaatcaatctatagtcaaaactataaggtcattcaggaaactgggtgaccttttcttttgactaaaatatctccaaatagaatttttaattttttatacatttaaggtttgctttagattttaataacaacagtttttaaggtgctgtgaaaacagcctttaagaagttgcacgattcttgagaagcaacgccttgccttagcgcaagtagaatcatagccaaaattttttccagcacactgaaaggagaatctacgaataattcgtaggtgtgccaccttaaactacccttaacctaaaataagattacttattctagtttaatcacaatttaacccttggcgggaaacatttttcccgtgttgggtaaggatgtttctccgcttttttactacttaggagaaacattatgtctactcaaaacgcacaaccaaaatatttcaatcttcatacttctggcattggttatttaagcgatattcgcgaaatcaagccgaaaaaaggagatgcattttgggcttgtcgaattgctgctcttacaggttcttccgattctccggaatatcgtttttttgatatgaacgtatccggtgaagaaactgtaaatttaatcaaacgctgtcaagaagctgttgaagctaagaaaaaagtcttggtttcctttgtaatgagtgatttgtggtatgacacattcacttattcaaaagatagcgaatatcacaaaaaaggtgatactggcgtgtcgattaaaggacgactctatcgtattaactttattaaagttgatggtgagttgaaatatcaagcaaaacgccaagatgagcaagggaatgactaacctataaactgatgaaagccaacaacaaaatttgttggctttttctttaccctgaaggggaaactccccttatgggtggtttctccttttttatttctatttgaggagaaacctatgaatacttacgctaaattttgccctaatgtttttgttgctaaatgtccggatgctcaccaaaaaggtgacgttatcatcttaaccagtaaatacggtaaagagactgaagtggagattcataatctcgtaaaaacctctgaggatgcgtatttttattccttcacccggtgtgatggagtgaatagtcaagttcgtgcagaacaaaaagctgagcgttatcaaaacgcagctaataatgcattaaaacgcagtgaacaatattgtgaagctgctaatgaaggccgtgaatttcttagcttgggagaaccaattaaaattggtcatcatagcgaaaaacgccatagagccttgattgaacgtaatgcaagacgcatggataagtctattgaagaaatgcgtaaagcagaaagttatgacggtaaaatcgcttattgggaacagatggcagggaaaattgatttatccatgccggaaagtcttgagttcttcaagtttgaattggaaaaagccaaagaaaaacaccaagagcttaaagataaacctgaattgcgaacacatgctttttctctcacttatgctaaaaaagcagtcaatgagcttgagaaaaaagtaaaattagccgaattactttgggcgtaaatttaacttttgaaaacataaattggagaaatatatgttttactatgtaaatagtggattagagctaattactttaacaacgcaagagtttataagtgagtttctaggaaaggcaactacccctaaagggattgagccaaatcatttctatgatcctcaaaccaagctagtttatgcatggtactctggcaaatgtgtagcaacttctgagtaccaatatacacctcaagaagcagaagctttacttgttgaattggcattggaaaatgctagtaataatggggatggatcaattatgttccaaccttcgccaacaaaagaagcactaattgctgatatgagtaattatttggaatattgtatagatgatgaatctgagcacgatttagaatttgcagcaaaaattaaacagattatcgacagtttaaaaacttctgattaataacattaactttaatgtgcgataagcattcttttcgcaccttacccataggggatatatcccttatgggcgatattccctattttagaaggaatatcgaatgtttaaattaaacgagcaacaacaagctattttagaacaggcacaggttattttaactaaagtgatggaagaaaagcccttttaccaaggtgcacaggaatttactgagccatcaatagctaaactctattttcaaaccattataggtaatgaggaaagagaaaatttcgtggtacttttcttggatagaatccacagattgattaaatctgaggtgatgtttcaaggatctgtttcagaaacttctgtgtcaattcgggagattattcgacaagcattaaagctaaatgcatcagcaattatcattgggcacaatcatccaactggaaatgttgagcctagtgatgctgataaatatataaccaagagattaaaggaagcttgtgaattaatggatattaaattacttgatcactttatcgtttctggttcagcatctttttgctttactgataatcatcttatttagctaacaacctttcacccattgggggataacaccctcaatggcagtgttatcccctttactttttacattttaaaaatttaggagaaacacttatgtgtaaggaaaatcgtattttagaacttggaaaaatcttcgtctctcgtcgtatcttagcggaattaactaccgaaaagatcaatgaggtcatctcgtggcatcaaaatggctgcattatcatgctggggaataaagattggattgaaaaaccgccacatccgctttcagaaattgttatgaatttctatcaagcagataatggtaaagacaccattcaactctctacttcagtagatgatgacgggaatcgaacaactaagatttctttttctgatgaaagtgaagatgagcaaagaggacactttgattgggatatatatcaatcaaaaagaacaccacttaagttaggggatgtttcgtgtactatctgcgctaaacagttattgggaatgccaaccattcatcgcttaattgaaaaacaattaggttatgattggggtgctacctgcgttgaagattggattgaaaacgatcatgccgtagagaaggataaacgcattgtgagccagcattttattgatggcgaaagtgtttttgtcatcactgaagcagatcgtagttctacaacgattatgctcggatatgaatattaatctatttaccttgaaagcctatctactttatgtagataggcttttcctttttaggatatgataaataaaactctttttaacagtataacgatgccttatttaacttcttcacaaactgaatgcctaaaatggttagctcttatcacgatgattatcgatcacattggtgtggctttttcaaatgcttacccagccctatcctggtgtcgggtgataggtcgattttcctacgtggcgtttggatttatcatcgcgcttaatttatctcgagataaagtaaactttaaaagttatttcacttggatgatagcaaccgcatttttatctgaaatcagttttacgcttttcgagcctaattatgaccgtttaaatgtcctatttcagtttttgtctgtaatcggggtaatatgggtatataaaaaccgtcaagacttaaatagctgggtcatgttttttggattgggcttttttattattctttccgcactctctgattatggtttacctgggcttttatattgcattggttgttacctattcttgcaaacaaaagatactcaatttcgtcttattacgatgctaacctgtgtattgctcgcacttttcgtcaatcacagttttattgataatttcggggaaactattgttgaaacaatcagtgttgttactgttgtggtcggtacaatgatatttattcttcaccctaaaggccttcgtcaatgtaatatctcaatctctcgaatgcctaagcttttcttttatcttttttacccggtgcacttaacaattattattggcattaaatatatttttctcagctaatttttctatctttacttcaagaagaataaattattcaaattcaggtgagagttatccatattaaggcattatttaaataccttaattggagcctcatcatgaaaaaatttctattaaccacttttgcattggttgtgctttcaggttgtgcacataaacaacaaacagccgatgagcaacaagcactagaaaatccaaatattcaacaaggtcagcatcaagttttacaaccggaagatcgaattgttcgtccggatatttacacagactatcagcctgaacgtacagaagtgttacgtgaaggtcgatacactttaattaatttctctccagaagaaggtcaaaaataccttctagaccaaagtgtcactgtcaacatgttaggtaaaaagaaacgagccttaacggcaaccgttgagcagggattacgcacgacgttaaaagatacaggcctttcactttgtcatggttttggtcagaatgaaccaacactttctacgctttattcccgtccattaccaaaagtacattatcaatttggcccgatggctttacgtgatgcccttcaaatgttagcagggccggcttatgaaattactatcaatgacgtttctcgtaccgtttgttttaaattacgcccagctgtaccggaacgtgctacaggggaaaagccgaaagtagaaaccacaacaacgacaacaactacaacagaaatcatcgaggaataagcaatgaatcatgtcaaaaaaatatcctatgtggcgatgatattagggatgttttctactgctgtatttgctgaagtcactgcggctaatacacttgctactcaatccctcaatcaacaaaacttggtgacaaataaattaaatcaacaagagttattagctaagtctcaagagtggggtttaactgagcaagaatggcaacgctaccaagagcttaatcaaggtgctcgtggtatatggtcgccaggtcttgaccctttaacctcgcttggtgtggagtctcgaaatgagcaggaaagagagcgttatgctcgactactggcaaaaaaaatgcacgaccgcatggagagagagctgcagttccaacgcacttatgatcgcgtatttgctgaaatgtatccaaatgagcaaccatttaaggttgaacctcatatttcagagcggtttggacgggtgatttattttactcgcctagaaaattgtgacaaatgtgaagcgaatgctgatcgtgtactgcaatatgtgaatgataaaacgcctatagatatttattttgttggcgtgaataataatgagcaaatctataattgggcgaaaaaacataacatcgacccaaataaagtgaatagaaaattaattacccttaatcatgataatggagcctggttacagtatgcagatggcaaaatgcctgctgcattccaaattcaacaggatgggcaatggcaacaaatcgtctattaaaaatcgtatttagcttaatcggtcttggcgttgcgactcactccgttgcatttaatggctttggaactgatattgatggctatattaaagatgcatctaatcgctaccaggtcgatgaagcgatgctacgtgggttagtaaaaattgaagatgggtggtatggaaatgtttccccaaccggggcaaccggtgtggggcaatttacccggggcacctggaattggcttgcaacaactgatgaggggcgagccttaggtatgactcaaatcactcgttacaatcgtgatacacctttcgaccctagaaaaaacaatcaacttaacactctagcaaccgcacttttagctagatggcatattaatcagttttttgagcgaggcataaaaccatcccatgaaaatttatatcttgctcataatatcggtatagatggtttacatcgagcgctacaaggtagagcaacacgtgaagatattctaaatatgaagcgtaacgggatgaaaaaaggaatgtcggtacaaggctttcttgtttatcaaagtgagcgttttaatgtcagtaaacaaatagctaacttccagcgcccttcagtatcaccacgttatcaaattgagaataaaccattaccagccaatttacattgggtttctccaacagaaaccgctatgcgttgggttgagccagcgtcaaatcaaacaaatcaacaagctattcgttggcaaaatccaaccaattaatacgagaacagaattatgcagtataaatcctttttcctctctttggtctgcttaggagcagtagttcaggcgcaagctgaattaaaagttattggtgattttggcggagaaagtgcagtccgtttttatgaagcattacaaccggatgaatcaatggttcaagcctaccctaatagcgttccttcaacattgaccgaagcggatattttacctgttatctcacatagaatgacaccgggccaaatacaaccagtcagaatgaatcttcctggaatgttgcctatttttcttattggaacagataacttatctaaaaattggctacacgctaattataattaccttaaaaaaattggtgcaatgggacttgtagtaagcgttaaaacaacaaacgaattaagcgagttacgccaattagcaccggatttaaccttaatgccaacgccaggggatgacttagcttcaagattaaatcttgctcactaccctgctttattgacttcagaaggattgtcgcaatgagtcaaaaacatgtattagaaggtttacttagaccgcctgttgaattttttccagctgccgtccatggtacttgtgctttggtttgttgcggtgcgccttggtcgctcgcattaaatcctcttattggatatggattaggggccgctttcgcaggtatgggggttatgcgttttcgtcaaggcatggaaattgtacgctatcaccgaaatttacgcagactccctcactatgctttgaccagtcgtcaaattccagtaagtaaaaaagccttgttcttaggacgaggctttgaatgggaaccaaagcatacgcaacgtctttatgactgtttctctgcaaatgggcaaatttattggaaaaatgggaagtggtttaaagccgctcgtgattatgaaaaagtgcatgataattggttatctagactcacttcaatggactctccattaaatccagtcagaccgctaccgccagttggcggcattccagtgatgcatggtgtggagccgaatgaacgcgatattatgcttccgttaggcgaccgtggcggtcataccttagtatttggtacaactggcgtagggaaaacgcgttttgctgaagtgcttgttacacaagatatacatcgaggtaaaacacctgaagagcgtgaagtggttgtcttttttgatccgaaaggcgacccggatatgttaaaacgaatgtatgcagaagcaaaacgtgcggggcgtgaaaatgaattttatgtattccatttagggcatccggaaatttctgctcgatataacccagttggtcgcttcggtcgaatttctgaagtggcaggacgtatttctgggcaattaagtggtgcgggaaatagtgcagcatttaaagagtttgcgtggcgttttgtgaatattgtctcccgtgcattggttgaaatgggaaaacgcccggactatgtgcaaatctcgcgttttgtgcaaaatattgatgcacttttcttagattacgccaaacttcattttgatgccgtagataagaaaatatggccaacgttggcttcggttgcggctaacttagatgtaaaaaatttaccgttctcgatgaaagatagaccgctgattgctgttattaaccaatatattttagagaataagatttttgacccggtacttgaagggttatcaagtgcggtacgttacgataaaacctattttgataaaattgtggcatcgcttttaccgttacttgaaaaactcactacaggtaaaactgcagagcttctctcgcctgattacactgatattcatgatgagcgccctatctttgattgggaatctattattcgtaaaagagggattgtttacgttggattagatgcattatccgatgcgaccgtagctgcagctgtgggtaatagtatgtttgctgatttggtatcaatggctggtcatatttataaatttggcgtagatgaggggttgccagatgcatttaaaactaaaagcaaaccgcctaaaatcaaccttcattgcgatgagttcaatgaattgatgggggatgaatttatcccgctgatcaataaaggtcgtggtgcgggaatgcaggtaacagcctatactcaaacactttcagatattgaagctcgtattggaagtaaggcaaaaacgggacaaacaacaggtaacttcaatacacttttaatgttccgggtaaaagagccggccactgcagagtttttaacgcgtcagctcaacgatgtcacaatttatcaaagcatggtgacatcaagtacgacagataacagcaatccggatgatggcaaggcgtttacttctaatactggtgaacgtatttctgaaaaaatggtgccaatgctatcgccagcacatattacaaatttaccaaaaggacaggcatttgctcttcttgaagggagtacgctttataaattaagaatgcctttacctgcggttgataaagatgatgtgatgccggaatcacttcaagaattgacggcttatatgcgcaaaaactaccatatttctccaaattggtggcaatctgcattttctgattatgcgccaagtcaagatatagcaaccgcttttcagtcaatgtcattaaatcgagcgccttcacacgcaggagaagaaatgcttttcggggatgttgaagctccagttgctgaagatatggaagatgaagatattgatcagaatgatgatacagatgaggatgattttgatgacacagataattaatcagccggatatgaacttgcttgatattccggatatgagcgtagatttcaattcagtcactagctgttcttgtgggctggaaaacgctgatgaattacttaattactttttaccttatttggaagattggaataatcagcgttataccacacatgaatttgcgaaaaagtatgcaaataaaggcatctcactttggacggctaatgatgtaaaaaaatctgaaaatggcatccaggcaattcaaatttttttagacggtgaagtaaaaggttatcttttctttcactgtaaattatctccagcgggaacattacagtaatggcagaacaacaagtcaaaaaaaagaaaaagggtcttttttactacattaatgcggtattagccgccttattgggttccctgattttgagcattattcttgaatggttaggtattgcatttttatggcctgaagaaggtcatttacacagtcaaaaaatgatgctaactgagcttggatggctttctgatagtctaacgagaggtcttttctatcattctccaaaagagctggctgaaggtcttattttgtcattacatgaatggctttttgtgaaaacaggtgtaaaagattggttagccaaccctcgtgagcatagtggcgtaggtttgtgggtgtatcattatgggcgagcgtatattgagtcagtgatttatgtttttatcacctttgttattcgacttgtagtgattgtttttacttccccactctttttgttagccgcatttgcgggctttactgaagggttaatgatgcgtgaccgtcgtaaatttggtgcgggcagagagtctagttttctttatcatcatgcacgtcgattaattggcccgattatgttgtcggcatgggtattgtatctttctatcccaatttctatttacccgaatataattttggtgccagctgcatttctatttggactatccatctgtgtaacggcagcgagctttaaaaaatacctttaatattcctctatgttgtcattatgggtgcttatttttccaagaataagcgcccttttttatcactaaaaactgttttgaatttaaaaagagtttctcattaaatttccctctcttctttggcactctttgcttggaatctgtttcaagtaaggagttctccgtgactaaaaatattttcagtttatctctagcaatagggttattgtttggcgctataagtgctcaagcaacagagcaagagcatttagcgcaagcaattaaacagttggatgcagcaaaactctcattacagcgagcagctgcaagtgcaaaggtttctgcgaaaagtcgtgaatattttgattacgcttcagcacatcaagatattgctacggtacaggcagggattaagcaatatattaacccttcccgggcaatccctagaaatcctaaagctattcgtaacttaaaagaagattatctcaatcttcggagtcaatagcagatgagtaacgctaatttcccttctgtttcaccattagacagtttttatactgtaagtggtttagacccgctaaaactgaaaatcatgctggccattattttggttgtcgtattactgcttgcgtatatgtgggcaactaatcatggctacaaaggcatggtgaacgacggtgatatttggtcattctttaaactgattctatggggcgcagcattaattatatgtgttgtcagcttttttatttaacaaaccataaggacatctcatgaagttgattaaatccttctttcagaatgtttcaagtcgttttcttgcggtagtaactttactttggttatccgttgaaaatgcgtttgctacaggcggtggtaatggtatcaatgcctctaaaatccctgattttaaaatcccaggcgtagatagcaataccaaagacccgatggaaatcatctatcttgttgctaaatcattggcaaccttgtgtgcaattttatttgcagcatggtcaatcatgacagtggttaaggcattaattaaaacctataacgcagcgactgacgaaaatgacaaaaaaggatggggcccatttattatcgctcttattcttggtttcattttaattttcttcagcctctggttggtgaaattggctatcggtctgttttaattatctctgtgaggtcaagatgtcaagcgataaagaacaaacaatcccctttcttcctactcgattaaatcgtgaatcgagtgtgtatggcgggttatctgtaagtgaatttatgttggctgcagcaatgggatttatcttgggtgcagtgcttggcctcctttgttgttttgccttaggctttgatttttggttgttaattccgtctctcgccatgttgttttgcattctttctgtggtgattggcaaagtgattattgcgcgccttaaacgaggtaagccggaagcctacttgaatcgaatgattgaggttaaattagatggaatattaggggggaatcgctttatctcccgtcaaggcacttggtctattcgccgagttaaaaaataagagagtttattatgagtaacttaaaagggattgttcatcaaaaaaatcgcgaaatcatgaccgggcgaattgctatcggtgcattgcttgtgatttgtttggtgctatgtgccattatttttaccgcaccaagtcgattaatgatttataacccaccggatttacgtgcgggaagtcaacgcccttggtgggaagtgccaaaatcaaccgtttatgcctttgcttatcaaaccttccagcagttaaaccgctggatggagaatggcgaggaagaatacaaattaaatattgaaagaaataaagcctttattacgccaagttgccaagaatttttgaagaaagactactatgaccgtttatctaacggtgaattacgtgaacgtgcacgtggtgtttatgaaattgtgggacgtggatttaaagacagtagcgttattgtgcatagtccagatagctggacggttaatcttgatttaagtgtagatgagtatttcaaagatgaaccagtaaaacgtgttttaacccgcttcccggtcaatatcgtgcgcatggaaacagatttacagaacaatccttggggattgggatttaactgctacagctcaattccattacgtttagaagcaaaagaatttagagaaggggataaccaataatgaaaaaactcactttgttactaagcgcggcttttatcttttcaccaatgacggcatctgccgatgtgttaatgaaatgggcgcgcaaaccgttacctattgacttacaaatcgaaaaagaacgtattctattcgtagataaaaatgtaaaagtaggttatccacctgaattagatagcaagcttcgcattcaatcaactggcggtgcggtttatttaaaagcaactgcagatttcccaaaaacacgcttgcagcttatggatgttgcaactggagaaataatcttacttgatgtgcaagcgaagcattctgttgccaatgcaagtgagccaattcgctttgtttatgaaaataaagttgaaaaacaaacaactgcttatggccaagatgcaaatgcatataacgaaccaatgccaaatgcgcgtccggcactccccgctccagctgcattaacacgttatgccgcacaaatgttttatgcgcctttacgttcagttgagcctttggaaggtgtgcgccaagtttcacatcgccttcctacaccgcttaaaacgctcttacctgcattgcctgtgcgagctactccattactcagctggcaacttgatgagtatgttgtcactgcggttcgcttgcaaaaccaggggcaatctcgcattgatttagatcctcgagagcttcaaggtcgattctatgcagcaacatttcagcataattggcttggggggcatgatacacctgaagataccacaacgttatatcttgtgacagaaggttcacctaatcattctgttatccctcagtcaaattcatataaaccgaaaaaattgaaaaaagtcaccacaacagtgacaactcaaacaaaataaggagcgaacaatgcaaatgaaagcaaataaagcgttctatgttattggtgggattaccgctcttgtcgtgacgctgatggctggatttcttttctccggtagtagttcaacaaatacagcagaaaccaagaaagaagatactttagatatctcttttaaagatttatcaccggaagaattacgagcaatggggattgagggtgacacatctaaagatacggtaagaacacttataggtaaagtgaaagagcataataagcgatttgatgaagtgattttacaaaatgaacgcttggtaaaagagaatgagcagttaaaaaatcaagcaaacaatacggattatcaaattcaacaggcggtacaagcagaaacaggggcgttaattaatgagattaatgcgttaaaagatcaggttgtacaagctggtaatcaagttgtagggaatggaaatgcccaggcaaatcccaatgctcctctaccaataaacggagcaacaactggccctcaggttgaaactcgagggggaattaattgggtgaaccctagtgatatgccaactacagacagacaagggaatgctctacaaggtattggtgtaaatggtgcaggaatcggttttcccaaaaccttcgataacaatgtgaatgacatccgaaaatctaatgatgggttgcaatctagtacaggtaataatgcaatatttaataccgctacaccatttttcacaattgcagctaactctactttaactaattctgttgctatgactgcgcttgttgggcgtgtgccgattgacaataaggtaaccgagccttatccgtttaaattgcttattggtcgagataacttaattgcaaatggcattgaactgccggatattgaaggcgcaattgtctctggaacagcaagcggtgactggacgctatcttgtgttcgtggtgatgtgaaaagcttaacttttgtgtttagcgatggccgcattgtttcaacagacaattctgacgataaaattggctggttatctgatccacatggtgtgccttgcattcctggagaacgcagaacaaatgctccggaatatctaacgaccaacttcttcttaacgggggcttcagcagctgcacaaggcttatcatcttctcaatcaacaacagtggttgatggcggtgcagtaattggtgcggtaacgggtaataacggtaagtatattcttggtcaagcgttaggtggcggtttgagagaaacagcagactggttccgtcagcgttatggccaaatgtttgatgcggtatatgttccaccgggtaaagaagtggctgtacacatcgaaaaacaaattgatattgattatgaccgcatgtctcgaaaagtgaaatacggacaagcctcaagacaatctaacttggattaaggagcaataatgaaagttttaatgatgatgggcgtgattttagccgcaagcagtgttttgactggctgctcaacttctcaaggtgatttattgccaacaggcgatgcaacaatgaaagatatttggaatcgaggcggtaatgatagcaatattacatcttatcggacaccgaatggccgtcttattgatgcaccaaattacgtttcatctcgtgaacaacaaacttatacccgtacagcagaaaacgaggtgaaaaatcttttccctcgtttaccaaaccctgatttagtgatgtatgtttatccgcacttaactgattcctcagagcaaatgcctgtaccaggttattcttcagtaattccattttatggacgtgtgcaatatgcccaaccgggtgagcgtacaagaatgtactagatgaggtaagaaacgatggcattattccaagacgtgttagaggctttcttccctgctaaaaaaggtgataagcctcaacctaaaaaggaacctatcctaacatccattgcaccggaagaagcacagcaggatgataccaataacgtagaagagacgattgaaatcactcctgttatgcgtaatagaaaaatgaccagagagcaacatgttaaaatgctttatgggcgcgatccctcttttatctccaatcttccttatgcggaatatttggaagaagaaggcgtaatgctttttgatgatgctaaaagtgcaggtgcggtatttgatattaagcctataggaactgagggaagaagcagcgactatcttaatcgcgttcgcacattggttaaagatgccttacaggatagtttcgatgaacttgataccaacccttacgttgtacaattctattgccaggatgacaaggatttaagcggttatgttgagaatctgagacagtacattaaaaccacttcacctgaagcgagcggtagtgagtttacagaacagtggcttggtgaaatggagcgtcacttaaaagcagtaggtaaaccaggtgggctttttgttgatgaccgggtaacaaatacggcatgggctggaaaagtgcgtaaaacacgcatggttatttatcgttatgctggaaataatgagacagatacaatcgagaaattaaatacagcttgtgatcgtgttcaaagtgcttttatcacagctggattaaccatggaacgccaaaatgaaacacaaattcatcgttggttattagaatggtttaatccaaatccatcacgctattttaacggactcgatgataaagcttgctatgatcttttatcactctctaaggatgaatctgctctaccattacaagaccaagattttagtgaaaatctcttttttacgccaccggaaagtaaaaatggctattggtattttaatgagcaacctcacgaagtcattgtagttgataatattcgtaagcagccggatgttggccacatgacaggcgaagtcactcgaggtcgtaatattaatgcactatttgatttattgccggaatcaaccattatggctatcactgtagtcattcatcctcaagataaattacaggcgcatttagacaaattaagtagtcgagctgtcggtaataactatgagtctatctatttaaaacaagatgccctcacagtaacggaatatttaaaagacggacacaagctttatcaagctggcatggttttctatgtaagagggaaagacgatcaagagctacgcattcgctcaagagaattaagaacggttttactcagtaataatttagtgccggtaaaagaaggcaacgaagttgcgcctcttaatagctatttacgctggctaccgatgaattttaatcctcaattagatgcaaaatctcgtttttataccaaatattattgggtgcaacacattgcgaatatgttacctgtatttggccgtgagaccggaacgggacacccaggaatcacctattttaaccgcggtggaagcccattagattttgacccactaaaccctaaagaccggactaaaaatgcgcataagctcattttaggccctacaggttcaggtaaatcggcaacattaaccgcacaaatggcacaactgatggcggtgcaccgtcctcgcttgtttattgtagaagcaggtaactcttttggattgttttcagattatgcggagcgttacggtttaacggttaaccgggtatctcttgagccaagtagtaacatcgctttaccgctcttctctgaagcgcatcgtttattggaaatggatatcgatcttgaagttcaagatgatgacgataatgaagatgaaggcgaggaacaacgagacttacttgcggaaatggaattaaccgctcgcttaatgatcaccgggggagaagcgaaggaagatgagaaaatgagccgtgctgaccgctcggctattcgccaggctattttattagctgcagagaaaacttcacaagagaccccacctcgtcaagttttaaccggggatgtaaaagccgcacttgaggagttaagtcgtcgccaagatattcgcccggaacgtgcatctcgtcttgcagatatggccgaagcaatggatattttctgcactggggtaaatggtcgattctttaaccgtgaaggggaaatttggcctgaagctgatattacacttgtcgatttggcgatgtttgcacgtgatggctatgaagctgaattagcgatttcgtatatttccctaattaaccatatcaactcattaggtgaaaaatatcaacacagtttccgccctatcgtgaacattacggatgagtcgcatatcattaccgtaaatccacttctagctaagttcctggttaaaggttctaaaatgtggcgtaaattgggtatttggttatggttagctacacagaatatggctgacttccctgatgaatctgataaattactcagcatggttgaatggtgggaattacttaacctttctaatgatgaagtcgaacaggtaaaccgtttccgtcgtttatccgaagctcagaaaatgatgttgttatctgcgaaaaaagcagataagaaatatactgaaggtgtggtgctcgcaaccaatatggaagccttattccgtgttgttccacctagtctttacttagcactagggatgactgaaaaacacgagaaagcacaacgtaaacaattaatgatggaacataactgtactgagttagatgcggcattgatggttgctaaagacttagacaaaaaacgggggattgcagtcaatgacgaacttaactcaatcgcagcctaatcctaatatgacttttcatcgtatttttgacattgggcctcgcatccaatcacttgcttttacctctgatgaggtgaaagcctacgtgctgcatttcattgcaaaaattaagacaaaaattggttcaaactgccaattaagcgcatttcctcagcgtgtatttactcaatcaagttggaaagtacacgctaaaggagataaaggtgaagtgcatttattatttaatatctccgggcgtttccaattacctgtgttttcttccgaaaactggccagctagacttaatgtggaattaaccgatcacgttgatgcatattggttaattcaatatttgctttggaaattagctgcaatttgggaatcccctgctgacttatccccagtttttggggataagactgtgggtaatgaataaggagtcctgatgtctcaaggtaaaaagccacaatcaagaggatggcttaaaaatgtactccgttttattgctatccttttatttttatttttagcccttactgcaattggcatctttgcaactcaatatcttcagaatgttgatattcgtgcttggtttattaaaacgcagtggatatggtttgcagtacgattattactatatggtgcgattatgttgatggtctattccatttctcgtcgccaaccatcttctatgccggcaaaagcaaaatggttaattgcgatgattttaatttttgctgaagcgattacacagattactttagcttagggggaaatatgacattctcagttgacagttatcttgaatatttcctgactctacttggttggttgcttaataacggagtttttgcgttatttgttggaacagggttatggcttcttccgcttatcggaatgatctttaaaatttggcgtgacgtagctaaacaaggggatgatgaaggtgagaaaggggatttattaatccgctggctcacaatcgaactccttccagcaatgcttatcgttgttttgacattagcccctcttatcccggtatcattgaataaccttgaatacaatgaacgttcatctattcaatgtggctataaagttcctgcttccccggataaatcaggctatgcgccatttacgacaacatttggagacagacaagcccgaattcctatttggtggatgttgatgcacaaagtggataaaggtctaacttatggtatgactgcagtattgccttgccagcgtgatttacgtcaggttagatttgaagtgcaacatcaaaaaatcactaacccagcattattaactgaagtgcagcaatttgtgcaacaatgctatatcccggctcgtcaaaaattacaaacaagccaacttgccttgagtccggcacaaatccgcgaaacatcctggttaggtggtaaattgcttattaataacagcgagctctaccctcgttttagggctcagcaacctattagcacgttcccttatgatgcaaatcgagatgcggcattacctaattcgggaaaaggtggtttcccaagttgtgatcaatggtgggatgaaagtggagctggattaaaatctcgcttacttacagatatgcgtcaaaacttatctgcccaggtgagtgatttctttaactctatcgacaaccaagatgaagctttattgagaacacttttacgctctgaaaacatagatgtttcaaaagggaaaatgtatcaaggttacggtggtagcgtggatgctggattttggaatgcggttactcgactcacctcaactgtaggaacggctgttggaagtttggctatattcccaggcctagatgcaatgcgacaagccctaccaatggttcaagcctttatgattatggctgtaattattttaattccaattattacgattttaagtggctttgctattaaaactgtaatgacattaagcttcgtatattttgcactcattacaaccacattttggtgggagttagcaagatggcttgattcatacctaatagaaattatgtatagttctccatctcataatatgctaaacatccactttttagaaaatgcagaagatgacattatttctaactttgtgatggggagtttatttataattttacctggtttatggtttggagcaatgacctgggctggaattcgagtgggtggcgagcttagcgctgccattgcgaaaggaactgaatcatcccaaaaatcaggggggcaatttggagataaaattagtaaaaaaatataacgtataaaaaaagtccatctgttagacagatggacttttttatttacgaaaataattaatcgtcatcatctccgtaaacttttactccgttaatataatagccaaacccctgaaaaccataatcccactttccttcttctgatgaatcatcatttgcaagtaattctgacaacaaagatgtatcacttactggctcttcatctaaatattcaatgtttttagaaggcttggttttggaaattataactccggccaaaattggactcgcagcaagagcagcagctgtcacaacagctttacgaggctttcctgggagaaatgacaaagtgcggtcaattttcttaaaaaattgtccgacagtatggccaaacttttgagcgtccatattctctctcctattaaaatactctgacttactctcattgtactcttattattcttttattaaaacctcgttttaagcaggaaaaatgtgatttttgcgatccacgtcgcaaattttactaattggggtctgacgctcagtggaacgaaaactcacgttaagcaacgttttctgcctctgacgcctcttttaatggtctcagatgtcctttggtcaccagttctgccagcgtgaaggaataatggccgagcatattgatatgtccgtggcaaagcggggagaggcgtgcgatatcttcatcattcagtgtttcaccctgcgcccggagatgatccagggctgcctgcatataaatagtgttccataacacgacggcgttagtgaccagccccagtgtgcccagttgatcttcctgaccgtcggtatatcgttttcttatctcacctttttgaccgtgacagatggctctggcaacggcatggcgactttctccccgattaagctgggtcagaatgcgccggcggtaatcttcatcatcaatataattaagcagatacagcgttttgttgatgcgccccacttcaatgattgcctgagtcagtccggaaggacgttcacttttcagcaatgaacggaccagcactgaaacctgtactttgcccagcttcagggagccagcggtccggatcatttcgtcccactgaaggactatttttcggggatctgattgccctctggcaatatcattcagcacgccatagtcggcatcatggtccattcgccagaaaaccgaagcaccggcatcagccaggcgtggagaaaactggtatcccagcagccagaaaaggccaaagacaagttcgctggcacctgctgtatcggtcataatttcggttggattcagcccggtctcctgttccagaagaccttccagcacaaagatagagtccctcagcgtccccggtataacgatgccatgaaagccggaatactgatcggacacaaagttgtaccaggtgatccctctgttattaccaaagtatttgcggttcggtccggcattgattgttctgactggcgtaacaaagcgcattccatctgcagatgccacttctcctccaccccatatctgtgccagtggcagcgttgcctgaaaatcaaccagtctggcattagcgctggtgatagtttcagcccgcagatagttcgcttttgtccagttcagccggtgtcgggtcagtgcaggaacatttgatctgatcagtggttccagaccgatattgcaggcttcagccatcagcacggcgctgatgctgacgggcagatcatcaactctggcactggcttcactagcatggaaaaactcatcagcaaatccggtatgggcgttaatttcgagcagcaactccgttaaatccaccggagggagtagatcactgatcattttgctcagtcgtttcagactgtccggctcatcaagactggcgaggggagaaattgtcaaccggggcttcgggccagaaacatcgagttcgacagcctcattttcgcaaagacgtgcagcaacctgtctgtaacgactatcaagctgatgacccagagattttattgcttcctgcgggtctgtcgggtgccccaaagaacgataaaccttaatccggtttgcctgccagtcagcaccctgtagtaatcttgcacgaggatctccccaccggttactgccggtaacgtagacatccctccgcctcagactatcctgcagtttactgagaaagcagagcgtgtatcccctgcgggtgatatgtttttccttgttaatcaccagccgtttccatgaccgactgataatttccgttggtgcgtcgtcaaaaaactgccgccgtgagctgaactcccggctgaggtagtcacaggcattcagagtggtaaccccggcaggtgcggatgaaaatttaacggtattcagcagatggggcaggaaacgacgaacgcgcccgtactgctccaccatttcttcatgaaaattatcgtctgagggccgggcaatttcacggacaagcgtgatgatttcagccagcttttgccttgggatgtagctgaacacctcagcacgaatcgattcgtccggtgtttcttctttcagcaggtacgaacatgcgctggcgagcgccaatgcagatttatccagatccttcagcgagcggagccgttttttctgcccaatctttctggcgtcacggatgataacggccagcatggcgtccagaacgtccaatgcatcatccagcgccagcgtttcccatgcaaggacaaaggcaaccagaaccgccatccttttctgcggtgacatcctggcaatattgaacaccgaagtcataccagcataacgtgcgagatttttcaggcgcacagccgggagtgtactcaggttttcagcatgcaggccaaaatcgttcagagttttccagcgttcaattgcttcattaaacgccggaccactgatggtcacagggccctttttcagtgattccagtaaagacaggcggctgcaatcagttggccccagcagcatctccagctgtgaacgctgttcggctgacggtatcagtgccagtttgttccacaggcgcaacgtcgccttttcccttacctctgaaatcaaccgggtcagcgtagtggctccggggagaataatacgatgttgcataagccaccctgtcgccagatcgaaaagcaggccaggacgttcgttgcttatccagctccgggtatataaaagacgggtaaggcgaaatgtccagggccaggcaaattcacgatactgatagtgctgacgtatcagcgctgcatgctcacggcgggtattttccctctgaccgtattctgcaagaacggtgatatcacgaatcccgagctgtctggcggtaaaatgccggacgccggaaggaatatgattcatatcggtgaggaaggtgcccagaaaacggacacatccaatttgcagggcaatgcccagacggttgtgatcacctctgctttttccgataaattccttgtctgcttcatcaaggtgaaaatatcgtgccagctgaagctcatccggttcaccggtgaatctgccatagctttcagtctgctcagtggtcagaaagtcaacgggcatatcggcctccctgcctgacgggcatttagtaacatttttccaaccgtacgaaatgttataaattatcggacatcgtaaaactgttacattaatatgtctattaaatcgtaaatttgtaataatagacatgagttgtccgatattcgatttaaggtacatttttatgcgactttttggttacgctcgggtctcaaccagtcagcagtctcttgatcttcaggtcagagcactcaaagacgcaggtgtgaaagcaaaccgtatatttaccgataaggcatccggcagttcaacagaccgggaagggctggatttgctgaggatgaaggtggaggaaggtgatgtcattctggttaagaagctcgaccgtcttggccgcgacactgccgatatgatccaactgataaaggaatttgacgctcagggcgtggcagtccggttcattgatgacgggatcagtaccgacggtgatatggggcaaatggtggtcaccatcctgtcggctgtggcacaggctgaacgccggaggatcctagaacgcacgaatgagggccgacaggaagcaaagctgaaaggaatcaaatttggccgcaggcgtaccgtggacaggaacgtcgtgctgacgcttcatcagaagggcactggtgcaacggaaattgctcatcagctcagtattgcccgctccacggtttataaaattcttgaagacgaaagggctaattttactgatttatctatcccctcaatgtaccttaacactgcaatataaaaataaaccgtaccaggaggagatatgaaagctcgttttaaagaatggcttattagtttaaatgaaatagcaatgaatgaattaggaattgatgaaatgcttactcatcttgatgatgaactgaacatcattaacggaaatgaatgtgaacaggagattttaaataatttaatacaaatctttaaaaatagtgaataccactaaaaaaataagcgggaaaatcccgcttattttatctctatttacgcttatgaagctttcatactgcgacgttcaaagttttgagttgcactacccgctttacagctcaccgtatccattttactgccattggtgatataaagcattggctcttcaatactgttactattgtgtggttgcacaaattgaatcgtgtaacttgtgccattatttctcatttctaatgagctagtaataaatcctgaaccagtagctacataagaatcctgattagcaaaaacttgttttaccggatttttaaaagaaacctggccataagtgaattcataatctgaaccattttttgttacagacaccgggcttccgttctctgctgtacaagaaaaaatattattagctgcaaaagctggcgttgcaaacatagctaccgctccaatagtgagtaattttttcataaaaatatcctttatttattttcctaaaatgtaatctgcttcttggttacgacgtttagcatttacaccattattattgttttgacgatttcttactgcatttgctagtgcgttcatatcgcctgattgcgcagatgcctgggctgcagcaatcacatcttttgttaatgagccatagttataggcataagatgttaatgcggcttgggcatttggcggtaacttatcccatgttgaagatgatacgttatttctcgctctatttgcaaattcttgtgttcgacgtgctaaatcacgctctgcgtcagcgcgactaactacagtatctttcgttactttgacaattgtaccatccgcttttgtgatagtatctgaaccatatccagtgcgataagcattgacatcccaatatgctttatcactaaacccttcaaattttttcaacaaccctgtagcttgatcaagtgcagtccctttaattgctggaactgatgaataagaagtgttacctctactatttccggatgtaccgccagtcccggtgtaagacagggagtttgacatctgaggcacttctaaagtgacattgttacgaggaatattgatattgtcagcatctgccaattcagcagcattgctattcgtaccattagctaaatcgctaatccgtttatctacactgtcacgtgtaacatttccggttccagtgttatattcacgtagctctttattttgtaggattgcaactgcggaattcccggtaagtgatttttgtagatcaatctccattctaatttgacctatttctcggtcaattaaagtgaggatcttttctaactcttcttgagcatctttattgttggccacatttggctcacgcatacccgttaaaacagctcgacgtgcaagaagcattttctccattgttttagctacagcaatttcactggctaaacgctgccctaatacttgagcatcgggatcttctcgtaaagactcaattaagccacgagttacaggaactgttgtagaacttaattctgcaagtacttcaacggaaggagtgctcatgttaagcgctttttgtaattgagttaccgtcttaatattttctttttcaatttcaggtgttaaaccaacaccagctcgagagctactagcagtaccacaatctgttttacaagtagttaattgcttctcaccgatcacattcgttaaccaatctgtcatatctttaggattatcccaagtttgacaaagtaatccgctacaactactaccggagattcgacctgattctaatacattacgcttgttttgcatgttgtagccagcttttgcaacatcctcaacaattttgattggttcttgtccttggccaccgcgttttttacccccgacccactctttaccttccttaccttgagattcctcaagtctctttttagctcgagtagcatctggttcagttgaagtaatgtctttaaaggattccatatccgaactttgagaccaacgaccatttaaagttgcgtctgcaagcttcttagacatttcttcacagctggtttttaagctattaaaatcaattttaccttgatataaaccattcgtaagaatatcgtataactgaggatttgctcgttgaataaccattgcaggtaaactcgccacagctcctgtggctgattcgataacgttactataaagatctttaaatccttcagttaaaccatttaactgatttttaatactcgtcttaatgtcaaaattaccgcacatcaagttagctttccaaccaatcccaaattcagctgcaggaatcgtacctcgactcgggggagccatataacctacaccgcccccaatttgataaaacaccatatcagacaaaatagaatcggctttattaaatccaaacggattactattagaagctgatactggcatggttgaggataagattgcgcacgatatagcaatataagatgctttcagtgcatgatttaatttcatactcaattcctttattaattagaccaatcaatactatacaaaaatgtttgtccgcgttttttacagcacttgtaagggcgccataatgcccaggcataactaccattttcagatagcatacttggcgggttatcagggaaaatagcacaagactgtgaagtaaccgggtgaagctgttgccatttatgtgtcttttcatccccttctttcactggagggggaaaccactcaccattcgattgattatcttttttcgcaatcggtatatatacatgtggttggaaagtatttgtcacaacatccgctactcgatgcgctgttacagctgaagctttatagtcatgaacttgtgttactgtacccgctcgtggataaatatttccccaagtgtctccatttgctctaatttctctcatacctggaataagcgcttcaggataaaccatttccggaacaccaaatcgccacgctaaaaagtccaaaccactcaagtaataaggcacaaaaggcgttgtctgacttttgcagtaataccctgtactattaagcatttgactaatcgctccctgcggatgaccgattacatcaacatttttaaatgttgcttgcgtatagtctttgtgtggtgattgataatctccaccttttaccccattgctaaggaaattcatttccacccaaggattttgagcctgatggttataacttgaaaccactacctcgggaatatagtgttttattttcgtagatgtccggattttacagccgaattttgtacaaaatagccaaaaacaagtaccaacgaccttataatctaaacaacttgtcgaagcgcttgatgccataatcgatgcagtgtttaaagaagattgaccggactccgaagcttgtcctgaaatactggtcaacgcaattgcaatacaaagcccggataatgtcatttttttcaatttcatcttgtcccctcttttgtaatctctcgttgccataaacttaatgcctgagcaatattggtttcaccatatatgacactatcctcttttcccggatattgaaataaaactgcaggcaccttcttgattccattttgccaaccacttataaggccctgataagaacgctttaattgctcttcagactgtttccattcagcagactgaaaaatctgagatgcttgctgagctgctacactaggattcgcactcaatcgctgactaatcaaattttcccattgctcaacttgatcaagtaaatacacctggcttgcaagctctgcgtgaagaattggataatcttgtgttgaataaacagtaattatgggattaggcccctgggcgaacactgatagtggtaacaaaccgaaaagaaacagtgatttttttatagacataaccatcccttacgatgaaattggatagttgaaacattaacgaaatgacaggggggaatatataaaaaattctttttgattttgagataaattctccatttccaaaaaacaatttttaatagagattcgacagccttattaagtatgattggacttgataagtcgctgtgcaaacagctcttataagttgcacgattcttgagaagcaacgccttgccttagtgcaagtagaatcatagccaaaatgttatccagcattctgaaaggatactctacgcaatcgtaggaatgccaccttaaagaccttccgagggaaaatgattcccttcgggcatgtcatttttccaaggaattttttatttcacattaggagaatgactatgtcctcatccactcaattggaacactatgatgttccatcaagtaaccctcttgaaactccaacattttcatttcgtgtgggaaaacacttgggccgttttttcgttgcagctaaaaacaaagcaaccgataaatacaaacaagtgacatctggtatcaatcaaagcattgaagacgaagaagctcgtcggctttgcgaattacaaatgatgctagatagccaagcggaagaatatgaggcaattattgatgatgtgcaaagaacgtggttaaaacgaacaacgttatttagcattttatttttgattgtcggtattgttggtacagtgggtactctttactaccttatgcattaacattgcataagctattcattttcaaccctaaggggaatttttacccttagaggtaaaggtttcccttgctgtaggagaaaacttatgaaagtgacattacataacagttgtttagcttatttagccaaacataatgactcagaatctctaatagaggaagttcgcactcaagcattaaatgcctgggaaaatcgaggaaaagatgtatcttctactcgtattatggtgaatatccctagtcaatacggacagaaatatcacttctttacagtttcgccatacgcaaaccgtaaagatttgttaagtgtaagggggtaaacatgattaagcgtttactcaagcttgttagttccaattgggacaaaaaaacaatgctgctggtttctgaagattttcgtaaaatcggcacttacatcttaggtattgcgtttgtcgcaatgtttgttcagaatgacaatattccgctacttcttgccattatcattatgatatttggcggaatagcttggttctgtggtgtgttgttagctaaatattgcaacaacttaatggagacagacggagcgtaacgtatgaatattacgttaaactggaatgggttcctctttgcaattgtctttgtactgttttttatgggaacagttgcttttattggtgtgcgatcattaaaacgtcaacaagagcaaaaagcacaaagcaaaaaaacacattccattggtgttaattcataactgaattaatacctgcaacctttacaacaaaccttgatcatgccattggcgtgttcaaggttttcttttacccgactgggagcaatttcccattcggggggttgttccctttttttattggagaacaaccatgaaaaaaagaactcaacctgccaaagatttataccaacaaattacagaccaaattctcgaagcattagaacaaggtgtgatgccatggcaaaaaccttgggatagtggatggccacaaatggctattccatgcaacggtgaaagtggtcgtcaatactccgggatcaacgtacttctgctttggatgagcgctattagaaaaaactttactcaacgcaagtgggtaacttttcaaggagcaaatcatctaggtggccaagtccgaacaggtgagaaaagtacagttattattttctataaacaaaatatgtttgaagaaaaagacgatagcggaaacattgtacttgatgaaaacggtgatccgaaaatgaagtcatctgtatttattcgtggtcatcacgtgtttaatattgaacagtgtgaaggcttagaaaaatactatgaagaatatcctgaaccagaaaaatcttctgaaatgcaagctcgtccggatttagatgtattacccaataaaatgggtatgcagctgtataacaaagcacaagatcgtgcttgttatatgccgagaaaagattgcattgtgatgccggatttcaaaaaattcaatacagctgatgactactatgcaactctactgcatgaatgcggtcacgccaccgggcataaagaccggttaaatcgtgacggtgtagctaaatttgataaatttggttctgaacaatatgcatttgaagaattaatagctgaactcacaagcgcctttacctgtgcgcacgtgaatgtttgcaataatatttcacaaaatgcagcgtatattgaacattggattaacgcattaaaagccgataaaaaagctattttccgagcatcttctcaagcacgtgaagcaacacaattcttgttaaatgctctcgaattaacatcgaatgaagaagcaaaattagcggcttagcctctattaaaccattctaacgttttttgttagagctctcataaaccaccctttggggagtaatcctcaaaggggattgctcccgttattttaggagtaatctatggatttcgagaaaaaatttaccgcactttttaaatcgatagcaccacaatatcgacgctcagaagtgttttacgactttattacaatctttgccctggaattctatctcattatatatggtgcacaagcagatgaatcgttgagacaacgttatcagacagctggcgagcattataatgaagatgaaaaacaagctctcagtcgccttttcaacattattgttgaggctttggagcataaaacctatgatttcctaggatcagtgttcatgtcgttggatttaggtgatcaatataaagctcaatatttcacacctagtcacattgcacacttaatggcagccgtaactctatcagattgtcatagtttaattaaaaaacgtggctttttgacattgcaagagccaacttgtgggtcaggcgtaatgattattgaggcttataattatttgcgtgaagaggactttaaccctcagcaacaaatgtgggctcaagcaagagatttggattttactgcagcattaatgtgttatatacaaatgacactcttgcatataccgggagaagtcattattggtaacacccttaaagatgaggtgaattaccatttatacacacctgctcacataatgggaaattggaacaaaaaattggagagtgcagattcctatactgaagcagaatatcaagttattgaacctgaaccagtagaagaacccccgcttgacattgattgggaaaatgagccaatgttttactaacataaacacccttatctaaacagataagggtgtttacatatttaacaatgtacgcattggcgtaaataaggagattttaaacatttacacaaaactgacaaaatagtgcttgcaaatgaactgtatattatataatatacaatcatagccaagagataaggctataccctcaaaaactttaaccagaccccaccaatcggcaggggcagaaaaaggaaacaaattatgtactatgtaacaaacgatcttgcgattgacaaaaatacttatactagacttgatttaggcgatgatgacgtgattttatgcgcaggcagacaagctgatgatgcagatacaatcattatattttttgagacaaacgcagaccctatttatatcggttgggctagtgtggacaccggtgatgtagagattacttatgatgattgggataattactttgccggtatcagacaagatgatgttattgacgagattaatatcctattagatggcattaaaatttatgacaatatgacaggccattttccgatttacgcgaatgatcacaacaacgttgtcggtgagcataaagtttactttaaaactgatgaggcatatcctgatccaagcattgataatgcaaatagagaggatggatatgtaacttataaggcgggcgctattactgaaatgggtcgtaaatgttatgtttattgggattttgttgcgtatgatgatgacggaaacgagattgattctgattattttgattatcagaacactgattgcattatcaaatattattaacaacaagccacgtaagtggctttaattagagcttttaaaatggcaaaaacagcagtacacctatcaaaaaccgcattgcaatatgtgacagaccgtacaccacagggtgaacaaaaaggattgtcggctcatattaataatgcatttgagcagttagcacatttgacgcgcgcagaaaagccggaactatcaaaatcggagtgggttgagttatacaatgtctatgcgggcagtgatttaactcgacttgtaatgccgtttgatttggcagatgacttacgcacacactacggcactttaccgcaagatttgaccgcactttacaacaaattagcggggatgacacaggcgcaacaatttgctgtgcttgatgccgtccgagtgtattgggcgagcggcgaagatgggaattaaaaacaagccgataacaagaccatgcccgcagtgcggcagaaattatcaatatcggcgggcaagtgggcgtacttttgagctttgcgaatattgtcgcaatcttgattgtgtagtttgtggtaaaaaagtaccgccggaacgtgggcggaaaaatacttgctgtgcggagtgcgaaaaattgaagatacacaatatccaaaatgcgcactacgccaaacggatagcggaagaccctgagttaaataaacgcaaccacgccaaagcccgcgaaaaccgaaaagcagacccggaacgaatgcacgaacatttggaagcacaaagggaaaggcattatagacgtgtgcaagatccgaattatctagccactcggaaagtttatcaggctcaacgatggcaggataaaaaagatgagatactggctcaacggcgcgaattttgggatagtttaagcgatgttgagaaagcggagcgacttgagcgcaatcaagcaatacaacgtaaacataaagccaaaaaacgtgaccagttgaaattagatccgcaaaagtgggcggaatatcaagagtatcaacgcacaaagcggcgcgaacatagacagagaaaggcgcttaatgaattaatggtcggcacaaaggagttattaaatgttaccaacaaagacaaatagttttgatattgtcgccgttaaaagcatgacaatccaagatttaaaggcggaattagccaaaacactaagcattacggcggaatatctcatgtatattgcggcaatatggcgggagttagagtcgcgtggagaggacttgagcgagttacgccatggcgtgatgacttatatcccgttaatcgcaacaaatcaacttgacgcgcggcttgttgtcaattatgccgggcaaaaaacgctgttatccagcatggcaaaattaccattaagagagcaacaaaaactggccgaaaaaggcactttggatgttgttattttgggtgacgataatcaacagctaattaaagaagttaaaatatccgacctcacagcagcccaagtttatcaaaccatcggtgatggcaaaataaaaacaccagaacagcagtatcaaatcctgttagtccgcaataaagtgcggtcaaaatcaaagccgaaaaagacttaccgactaacgcaaaatttaaaaatagatggtaaaaatttagtgattgccggaaaacatgcggtatccattgagattttgaaaaaatatttagaggataacaatgagctatagcaagttaagcaacaccaggaaaaagactatcagtgttaatgctaataaatacactaaggataactatagacagatacttttacgcctaaagccagatgtagcagatatgtttgattcaatctgtgaaaaggaaaaattatcaagggcggaaatgctaaaaaaacttctagaaacttattcaatataacaaaacaaacaaaaatggcagagttgagccctgccatttttgtttataattctcagaaatacttagctgtttttttctactcttcagacattaaattttccctattataaataccttttagtctcgccaccgttgatttagataaatcatatcgtttcattactgttgaaatagaatcaccagctttaaaatccgcataaatctttttacgtattttatctgtcactttaggtgggcggccgcctaatgcatttttatgacctgaagcaagttttgttcgcttcccttcctgagtacgctcgacaataaaacttctttccaattcagcaaaaatacctaacaattgaattaaggccatccccataggattgttttgggttcgggtatctattccttgttgtattgcaacaaaaccaatatttttattcttaaatagttcaagtgtattcaaacactgagcaaggctccttcctaggcggtcaagcttagttactgcaacaacatcaccctctcggacataatccagtagttcatccaattgtgctttatttttctcagctttaccggaatgcttccctgaaaaaattttcttacagccgtattcttttaatacttgaatctgttcacttagatcctgctgttgagttgatactcgagcaaatcctattaatgccatcttatctcttaaaattatttaaaaatgttattaaatgactgttggttatttcttttagctaaatttataccagcttttaaaccctctctaaatggagtgcttccaagcggcgtcaatggttgaataggtgctaaaggtagcaatgcggatgctcccataatcattctataaccttcttcaaagcctttttgataatcatagtccataattaactcctttattaaaaattcaaaacattaaatttatatcctaaatatgcaaaaattatcgctagcaatataaattccactaaaaaatactttgcgataccgatcttctttgtaagaaaacaaacagcagagataacagcggtcattcccatataaatacttaaaagttcaactatttcagctccattaaattcaagctgtttaagtaaaattgcaggagcaagaaaaaaagcaaataaccccagcataagcatgttggcagacacaaaaaccttgaaagaaacacttttaaactgcatttttactcctttgttcaaaattcaaagttttcttaatttatcttttaaatcatctagattcattctattagggttcttttcggtatctagtaaatagagtccaaaaccgcaccataagattaaaaacgttattacataaaacatttgtatcctcacttatcaaaacttaatagttaatctctttaatggctaacactttgtatttcagataaccatattcaatatgcggtaaatgatgaatcatacataaatcacctattttttgttgagaaataggaattaaagcccctttccatacatctgtttgatatggttcggctgctatcactataccttgttcatccgttcttaactttgtgaaatcctgtcctttgtcctcaagttcaatttcatagcctttcataaatactcctttgttcaaaattcaacacttagaaaaatcagattctttttgttcccatttttcccatagagtgaaaacgacccctatttttcttgatcgatttacaacctgccccaacgattttgttagagtgtaatcatcagatatgtaatctgtacctattactgttacctctttaaaaggtaaatcaatacctttttccaatttcatttcacataaataaatgattagctttaatttatctatgtttgctaatcgaatttcattgtctgctagacaataatttaggcgaactgtgattttttccattttttgctccttgtatgtgcaaaacttaagatttatcaattttgcttttaagctcaataatcttcttttctaaaagataaactctaatccacaaagaaattatgcaaagccacaatgccactaaactgaatatttctaccatcgtttttctcctttgttcaaaactttatactttttagactatttgttaatcctagtctaaaaactcatactttacccgttttcagactatctaaaaacatctatcaaagtttttagacagaatactcgctcaaaataaaaatacagcaataaattgatttagaatcagagataaattcttctaccaaaaaatagtaattctcttagaatctccaaaaaactactaaaacagagccatgttaaatgtctttttaaaattactaccattctttttaataagcttaatggttgaagcaaatatcagagaaccgcacatcgggggaatctgtcatgtagaagccgaatatttttaccctggagtgtgggaaaaatatggagaaagtgaattaatctgtaactattggaaatttctaggagacgaagatcggcaagtattagagtcgcaactatcaggtgatgagtcagatggtgaatatggtgattacgatagcttaaatgaaatggatagtgaataaggagaaagcgctataatgcctttgataatcatggttagggctgaaaatttcgactgatttctacttttcttaatctaaaatgacaaagaccaccgaaatggtggtctttgtcactaaatatataggatgggaaaattaagacattaagacattaagacaaatgcttaatctgtgcaacctatcagcgtggttaatagtatgatagaatcataccgttgtcaatagtcaatcaacatctaaaccatgaatttaagtattactaattttatcacatctttttctagagagcggatttctgtttatcaaaactacattcattcttctgaacctaatctatctcctgctgatattagcttgaaatcactaaaattatatttgtggaatattcagatttcatcagcactttttgaagtaataaacttatatgaagttacgttaagaaacaaaatctttgctgtagtgaatagtgaatttagcgattcaattaatgattactacttcaagaagcgcttaagctccttctttagagataagttgaatgaattgggagcttcaactatcagtgcaccaatgatcgtatctagattaaacttcgctttttggaccgaagtattgaataaacatttctattattctggtagtgtaggtaagtctgggcatccactataccctcgcttatataatttcaatagttccttgttttcaataaataggaagctaactagagaagattataacaagctaacccaaaaactaatcaaaattaatgatgaggtgaatgaattaagaaatagaatttgtcatcacgagcctattttcaagtctaaactaagagctatttatataaagatgctatttgttctcagatgtttggatacgaatgtctataaattggcaaaagaaattgaacgcgtaaataaattactaaaaaaatttgaagatgagataaatccctaaaaggaaaaagcaaatatgctactctagataaaattgatggctaataactaataagtagaaagaacaatggggagtaaagctccccattgttctttctagccgctgcctagaaattctctacttactcattataagccggccgagtagcactctgaggatccctactatatttaacgaccgaggggatatttacccagtcaaaaacatatactaaaaaacgtattaattaacatgaattatcagtaagatagtataacatttccgctctaattgtgtggtgtgagggactatcttctctgggtattgtccttcttttggaaaacattgtcaaacttatgtatcaataatcggtcttctccccacctaacatccagttaactcccttcattaatgcagattattcattgagtacttttatcaattattatgtccttgatgaaccacccaaaaagctaaaaggttaaaggaatctctaacgggattaagggtcaaaggtaacctttcctaatggaaaggtcttacctaaaaaggccaaaaggcttttttttcaaaaggctaaaaatggcatcaatatcattgattaaacattattaacggaattctaaaacgaataagattaagataaaattttacaacttgaaagataacgtttatgtgaataaacgtaaattatgaatgattatagaaattagtaaggtgatggaaaataaggagaactaatggttataagtacaggattaaaatgtgagttatgcggacatcgctacagaataagggttggagttgggtttgattcttatcagaaacactattttgattgttctaattgcaatattaatatagtctttgctataaggactaagcctccaagagctgatgtagaagccgtagaaaattgctctcttttttcgggagagcctaatattgaactcgaagtcttaaattttcacccaaattgtgcatttaataaacatgatttacataatcctttttgttttcctacattaatttcggggcctctaataattccacatatgaggtatataccaggtagaatgcaaagttttgataatcaatttgatataccaaatgcaccacacaaatggtctttgattaaaggaatgataactaatatccaagataacaaaaaagcttcaaattttgttttgcaatacactaaacatagaaacaaggatatgaacccatcatcatctaattttatgcgcgataaagaaattatagtttataaatcaggtagtgtttatagtgaatttcatatcattcatgaattttttgattcccttttttaccctatgttagaaaacattgtagaaccgataattaatacgattaaaaatattcctgaaagcaagctttctagttttattaggtattggcagagtgagttaaaacaagaaaatcaatatcgctatttaaatacattctctgaatattttcgccatagagatcacttcggtcaaatagtaatgtattctagaatcggacataatgttgatgatttaatagtgtcatctaatgggtttgagcagataaagctatattatggagatgcctatgaagcgctaacttcaaatatgactattattgcttgtttgaataatatcatggacggtagagagtttgatgaatttaagtcaatgaagctatcaaaatacctagaaataaataaagcaaataaatcaaatccatttaaattaactcctatattttcggtctttgcagaaaatgatattgaatcttctattcgaaatggttctcatcatgcgtcaatatggcgtgatggtgaaaaaataatgtataaaagtggagggactggagctgaacattgcattccatacactcgatatctggattattgtaacaggttgaccattaaattagccgctttatttataatagaatgctaccttagtgaatacgttaatgattcaaaaagttttgtagtaaattaagaataagtaagagtatcaatctatccatgcttggtagctactctttctagcgatattaagcttgtattaatatttattcttgaatcaaagtcatttatttattgagattaactcataaatcggtagcattttgcaaaaatttatgggttatttttttatgttttcatcaattttttatcgattaaaagggaaaaaacaagattcctttactattccagttctagattcccataaccattcaatgtcaaagattgatagtgagggatggataactccgttctctgcgtcagaattactcaattctgaattacgccaaaaatacttaaatttactttggcaacaagtatcaatgacgcaagatatgtttaatgagctctataaaaaacctatcgagcgctacgctgaaatggttcaattactacctgcctcagaatcacatcatcactcacatttaggtggtatgcttgatcatggcctagaagttctttcatttgcagctaaattacgacaaagttatgtattgccacaaaatgctgctccggaagaacaatctaagcaacgtgatgcttggactgctgctgttatttatgctgcattggttcatgacattggtaaagttattgttgatatagatatacaattaaaagatggttctcgttggtttccttggttaggagtgccaactcaaccttataaattcaaatatattaaagggcgagattatgatcttcacccggttatgggtagttttcttgcaaactatttaattcctaaagaagcatttgcatggttagcagaatacccggaagctttttcagctttaatgtatgccatggctgatcataaagataaagctggtttattatctgaaatagtacaaaaagcagaccaaaacagtgtaactcttgcactaggtggagacgtatcaaaactgactcagaaacctataacatcatttgcaaaacagctagtcatggctttacgtcatttactgcaacataaatttaaaattaatacacctaaaggcccatctgatggttggcttacagaggatgcgctatggttaatgagcaaacccactgcagaccaaattcgagcttatttattggagcaagggatatcagctccagcagacaatcctaaattatttagtgaaatgcaatcgctggggattattgaaagtacaaatgatggtacagcaatttggcattgtcgaattaaagctgattcaggctggtgcccacctaaagcattttctttactcagaattaaaccggaagtagcttgggaaaatcttaatgacagacctggtatatttttaggtcgagtcgatattgaaaatgaagaacaattaaattcaggtgaagatactaaagaagaaaattcagtgattatggaatctgaaatgccacttcctgcaataacaggtacactgaataaaccggatttatctgaaaatacatcctctcaaaacactcaaatcaatacccaaaactcagaaaccgagacggatatgactgatttggtaatgaatttattttcacctgtagaagaatctcaagactctactgataaaaaaccatctcaagaaagtgaaataaataaaatcgcctctaccccatctatagcaacggatgatgatacaaaggaaactgaggctgtctcaggagagatttttgttgaatggctaaaatctggaattatcgggaataccctaactattaataattcaaatgctaaattacatatagtcaaaggcaaacttttccttgtaacacctggaatctttcagctatttttcaatagtaagggcattactaactttactaaaaaagatatcgaaaatttgcaatatagtttccaagaccttaaattacacaagaaataccgtcaatcaaacaatgatagtattaatttttggcgctgtaaggttattggcccaagaagaacctctcaattgattgggtatttgattgataaaaccgactattttttcggtaatagaattccaattgataatttgcatttatcacttattgaggaaaatgaaagtgaatagaaccacatttgatatgttacttagtaattttttttataccgtcatttacgtatagatactattaaaagctatgaaaaagcaattagacaattacagaaaaattgtagtattcaatatcctgatgaaatatcagactcattaatactccaatggagaaagagagttgttggacaatctatcattgaagtgacttggaacagctatattcgtcagctaaagactattttcaaatttggaattgaaaaacaactcctcccatttacaaagaaccctttcgatggtttgttcattagagaaggaaagaagaaaaggaaagtatatacttcttcagatttaaaaaaacttagctttggaattactgaatcaaagcatcttccttctattcttcgcccattatggtttactaaaactataattatgactttccgctatacggcaattcgacgctctcagttaaataaattaagaattaaagatgtagatttgctaaatcaagttattcatattccatctgagataaataaaaatcacgagtatcatatacttcctatatcaactacactttatccttatctaaagaaattattaactgaactaagtaaattgaatcagcctgtagaatctcaactatttaacattaatttattttcaaatgcagttaaacgaaagggagagaaaatgaccaatgaccaggtgagctatatcttcaaagttatttcaaaatatacaggaattattagctccccacacagatttaggcatacagcagcaacaaatctaatgaaaaaacctgaaaacctatatatagccaaacaattactaggacataaagatgtcaaagttacattgagttatattgaagataatattgattcaataagagaatatacagaattactttagataggtatgcaaggagcatctaagggtgttccttgcaaaataaatttaaaccgctcattctcagcttattcatccttataaaaatatttttaaaattaatacattcaggctttacaaactagtatttttgtgtaagatctaacctatccacagagcgttagtgggtagatcatggtgtattggctaggtacacggaattggtctaaacaaatagttttcaaacttaaatgatgtacacaagggatttaaaatccctcgcctttcgaggcgtgccagttcaagtctggcttcgggcaccatttaaaataccaatccaaagattttaaaatttactttaaaatcatctaattgggtcgttagctcagtcggtagagcagcggacttttaatccgttggtcgaaggttcgaatccttcacgacccaccacttaaaaataaagtaatcaccgaaaaggtatttttttattgcctaaatttaatactactttttcaaatcactgtcttattgataaatagctattctttctattaatgtaaaattaattagttaatatatccttatttttttatctctataccctattttctaaaaataaaatagcacctgaaaatcagatgctatccaaaacacaataaaaatttaccgcactttatgacttcaataagtaagcccgtagttgtgcaaaatcattatccatttcatctgaaagcaatggtagctgattatgtttatccagtgtttcaggtaatggaagctgaataccaagaatacgttctacggattctttaaatttcgcaggatgcgccgtacacaagaagattcctgtttcactcgctttaagttgctctttcaacacctgataagctatcgcaccgtgaggttcacataaataacctttcgactgcatcgcttttaaggtatcttctgtttcgctatcacttagcatccccgaacctaaatcagttaaatcccaaccatttcgtttaaacaattcttccactctcggccaattgtttgggcgacttacatccattgcattagaaagggttgcaactgtcgttttaggatcccaattacccgatttcaaataacgtggcacagtatcatttgcgtttgttgaggcgacaaagcgttttatcggcaagcctaaggtttttgcaattaatcccgccgttaagttaccaaaattaccacttggcacagaaaccacgacattatcacgtttttcttttggcaattgtgcgacagcctcaaagtaataacaaacttgagctaataaacggctgatattaatagaatttgcagagttcagcccgatagcttggcgcaattcaacatcatcaaaggcttgcttaaccaaagcctgacacgcatcgaaatcagcgttaatcgcaacagtacgaatattcccacctaaagtacagaatagcttttcttgtaatgggctaattttgccttttggataaaggataactacattaatattttctaatccataaaacgcatgtgctacagcggctccagtatcgcctgaggttgccgttaaaatagtaattttgccatcgccacgtaccgcagcaagtgcctgtgccataaaacgcccaccaaaatctttaaatgctagcgttggaccgtgaaataattcaagtgcataaatattatcttccactttttctaacggtgcagtgaaagtaaacgcattttttaccattgcatctaacgttgcttgtggtaactcgccatcaattaatgcacctagaattttttgactacgctcaacaagaggcaattcaagtaattcattaatgttattaagtttaggaataacttctggaaagaatagaccttgatcccacccaagaccttgacgaacagcctgagaaaaagtgacttgttcttctgggtgtttgatattgtataaattcatatttaatccgtttttaatctgatttcatctatttaaattaacttatttaatttctcttgtgccttcgttatcaactttacatacatgcacaaaaccttcattattttgtaaataatggctttctaaataacttgaaagtttaattgcagtttgtaaatcaggggcaatagagaaaatagttggccctgagcctgaaatacctgtggcaagtgcgcctaagtctcgagtagcttgttttacttcagcaaaattaggtaacagagattcacgataaggctcggcaatgacatctttcatcataatcgcggcaagattttcctgatgggtatggcaagcatgcacaaagccacctaaatgacgaccatgggcaatcacgttttgtcgagtatagcttttcggtaaaattgcacgagcttcagcagtagaaacttcaatccctggataggctaacacccaataccaattatcaaaaaatggcaatttttgacaaatattgccgagcgattgcaccataaattgcacaccgccaagatagcaaggtgcgacgttatcataatggattgaaccagaaatacgaccttccaattctcccatcatttcaagcaattccattttcgaaaaaggttcattatgaaactgatttaatgccactaatgcagcaacaatagaacaagcactagagcctaaaccagagccaataggcatatttttttcgagcgttaaacgtaaaggtttaacatttgctccgcgtaattttaattgctcgctaaatagcacataagcttggtaaacaatatttttttgtggttctttcggtaatttacgaacaaaatagcccgcactttctaactcaaaaccacttgaaatagattctatttgaaccacatcgcctaacaaagaaccatcaataggagagatcgcagcacctaaagtatcgaaacctacgctaatattcgcgctagatgcaggagcgtaaattcttaacattggaaatccttattaatgttgtaatgttcttaaaatatctgcaaagatacctgccgcagtaactgcattacctgcgccataaccacgtaataaaagtggaatcggttgataataacgagtataaaatgccaaggcattttcaccatctttcactttataaagtggattattcagatctaccgcaacgatggatactttgcattttccttcactaatttttccaacataacgcaatactttgccttctgctttagctgtggcaacgcgagttttaaactccttgtcaagctgtggcaacattgccataaactcatctgcagattttccttcagagaagcctttcggcaatacaccttcaacttcaacatctgaaagttcaagttcaattcccgcttcacgagcaagaattaataatttgcgcgctacatcttgtccagaaagatcatctcgaggatctggctcagtaaagcctttttcacgcgcaagtgcggttacttctgaaagagaaagtccttcttccaacttaccaaaaataaaggaaagcgagccagataaaatcccttcaaaatattcaagctcatcacctgctgcaagtaagttttggagattttcaataactggcaagcccgcacctacattggtttcatataaaaatttatgctggcttgcttgggcattttggcgtaactcattgtaataaactaattctcgtgtattcgcttttttgtttggcgtaaccacatggaaaccttcttttaacgcacgagcataaagccctgctacagattcggctgaagtacaatctacaaatactggattcaccacatgatgtaatttaatgaaagaaagcaatacatcaaaatctgatggctgagtcgcattttctaaatcgtttttccaatcctctaaatttaatccattttcatcaagcaacatacggttggaattcgcaatagcacaaactcgaatttcaacattcttctttgctagatactccttttgacgctttacctgctctattaattctccgcctactccaccaacgcccactaaaaacatatccacgacttttttattattgaaaagcgcctgatgggtagccttcaccgcttcaatggctttattttgcggcacaaccgcagaaattgaacgttcgctagatccttgtgcaatcgccacaatgctaatgtttgcctgcgctaatgccgagaagaaacgagcagcaatgcctttcgcttgcttcattccatcgcccacaacagaaataatggataaatctttaatcacttcaattgattctaattgatgttcatttaattcattagcaaactccgtttctagtacggttttcgctacttctgcagatttcacaggcacacagaaactaatactatattcagacgaagactgagtaattaaaataactgaaatgcctgcgcctgacatggctgaaaatacgcgagatgccatgcctaccataccttgcataccggggcctgacacattaaacatcgccaaattgtctaagttagtgatacctttaacttgcaaactttctgatttcacattgccatcaataatcgaacctggcgcagaaggatttcctgtatttttaatgacacaaggaatattttgtggcaacaatggcccaatcgtacgaggatgaatcactttcgcaccgaaataagagagttccatcgcttcacgataagaaagcgttggtaataaacgtgcatcaggcactaaacgcggatcgcaagtataaacgccgtccacatcggtccaaatttcgcatacacttgcgcctaaacaagcggctaaacaggcggcagaatagtctgagccattacgaccgagcaataccaactcgcctttttcattacccgcagtaaaacctgccatcagcaccactttatcttttgcgatatttgctgcatcaacacgttttgttgattcttcaatttcaacagaagattcaagataaccgccttttgccaataattgtttgacaggatccacaatatgtacgctatagccacgcgcttcaaaccaagctttcatcattgcaatagaaagtttttccccacggcaatcaatggtcgctttaactgcatcttctacttttcctgcctgacgaatttcttctaataatcctttgatttgagcaaattcagcatcaataagtgccttggtgccatttaagtcgaattgattattttcggcatgtaagccattgatgatgttatagaaaatttcgattgcttcgttgaaatgcgtatcggttgattgatttaatgcagctttttcagaaagggcgacgagatggttggttattttggctggtgcagataaaacacctgcagcctgctcttctaaatgagcttgttcgatcaatttcgccgcttgggaaaaacgttccggatttgcaagcgaagtgccgccaaatttaagtacgcgcataattggttctcctagatattgtgtttttaaatttataaaaaaacccgctattcagttgaatcgcgggttttctgtatcttgtttttgctgcactaacccgcgccattaatcataataatggtcatcataatggcggtaatcgtgctaatgattacggataaagtgcggttatttttcattgtgttttatcttgaaaaatgaatgcgtaaagaaataccgaaatttcccgagcttgtcaaacagaaagtgacaaatttttcagaaattttcttagtcaataaatttcgtgtaaactaaccgcacttttttataaaggaaaacctatgaatatccagcataatctcaacctaattcagcaaaaaattgaaacggcttgtaaagaagaaaatcgcaatcaaaataccgtaaaattacttgccgtatctaagaccaaacctatttccgagattctttcagcttatcaagcgggacaaacggcttttggggaaaattacgtgcaagagggggtagaaaagatccaatattttgaatcgcaaggagttaaccttgaatggcattttatcggcccattacaatcgaataaaacccgtctcgttgcagaacattttgattggatgcaaacgcttgatcgagcaaaaattgcagatcgtttaaatgaacaacgaccgaccaacaaggctccattgaatgtattaattcagattaatatcagcgatgaagaaagtaaatcaggtattcaacctgaggaaatgctaacactagcaaaacacatcgaaaatttaccgcacttatgcctacgtggcttaatggcaatacccgcaccaaccgataaaatcgctgaacaagaagccgtgttcagaaaaatgtcagacctatttgaacaactgaaacaagccttacccaatcaacaaattgatacactttctatgggaatgacggatgatatgccgagcgcaataaaatgcggttctacaatggtacgcattggcactgcgatttttggtgcgagaaattattcaacatcacaaaataaataatcatggaataaggctcgaatttaaaacaagccttatttcttaatgaaatttaaatgccagtactctcgccacattttgagcggtagaaattaaattttgttcgccttgtttgagaatatccgataaatcgccaagttggtgaataatagggaacaccgcatcaataccgtgatcaaacaccacatcataatcttcacgcaaacaccctgcgatggcgatcactggcttattgaactgttttgccgtacgtgccacaccaattggcgttttacccataatactttgtgcatctattcgcccttcacccgtaatcactacatcagcatcttttacatggtcaattaaatgtaaccgctctaacacaatttgtatgcctgctttcagttgtacgcttggtaataatagcaagccaccacccataccaccagcagcacctgcgccagcctgatcacgaatttgtttaccgcaatcgcgttcggcaatttcagcaaaatgcgaaagtgcagcatcaagttgtttcaccatttcaggcgttgcgcctttttgtggtccaaaaatggcagatgcaccacattcaccacagagcggattattcacatcgcacgctacttcaatgtgaacttgttgcaaacgtggatctaattgttgaacgtcaatcttcacaatatttgctagctctgctccaccaaaaccgataggcttatcttgcgaatctaaacattgcatccctagagcttgcaacattcctacaccaccatcgttggttgcgctaccgccaatgccaagaatgaaactctctacgcctaaatctaatgccaatttaatcaactcccctgtgccgtaactggtggtaagcaagggattgcgtttttcaggcggaacaagatgtaaaccagaagctgctgccatttcgataatcgcggtttttccatctcccgataaaccgaagaaacttttcactttgtcacccaaaggcgcggtgacttcacattcaatgagcttgccttgcgtggcatccacaagggattgaactgtaccttcgcccccatctgccattggcaattttacatagtccgcatcggggaatacacgtttgaagcctgtttcaatggcggtagcgacttcaagtgcggtcaaactttctttaaaagaatcaggtgcaatcacaaatttcataacaactcctagaatttaaatacgccaaaaattaaggtagaaacgatggtcatcatcaaaccgaccgcactttcataaggaataagttttaaacgttctttgatatccatattcacactaccgcctgtggcatggaagaaagaaccatgtggcatatgatcaaatacggtcgcccctgcatgaatcattgctgcaccagcaagactgctaactccaagttctaacaaggtactactgaacacattggatgccaccgcagtacctgccgtggtagaagctgtcgctaaagacatcaacacccctgaaattggtgcaagaatgtatgatggcaaacctgaatgttccaaaccttgaatcaatacttcttttaaaccagaattagcaatgatgccagcaagcgcgcctgtaccaagtaacataattgccacgggtgtcattttactcaatccattgatagcataactatttatattgcgaagtttgcccatacaaagcgcaccaatcaaaccacctaacggcaatgcaattaatggatcaactttaatatcaaacaatggacgaagtgccaatagcaaaattgccactaaaggtgcgacaagtgcggtcagaaatgaaggtaaattttgcgtttcaagcacgattacctctttgtcagtcactttagaacctttgttgattaagcgttttgctaagaagtaggtgagaatcaaaccaaatagcgcgggaattataccagccatcatcactgaagtgagtggcaaatgaaaagtatctgctgccgcaatggcatttgggtttggcgacataatattaccagctttaccaccgccaatcatggcgagcaaaattgcagctttcgataaatcgctgcgacgcgataacgctaaagcaattggtgaaacagtaatcactgccacatccacgaacacacccaccgcagttaaaatcatcgtcgctagtgccaaggcgagtaaagctcgagtttcacccaatttattagtaatggtttccgcgatggaatttgctgcacccgattcaatcagcacgcctgccaacacaccagcagctaagatacgcataactgcagtagtaataccctgtgcgccaccgatcattaggctcactgtttgcgataaatccgcaccaccaattaaccctccaaccaaagctcccaccaacataccataagctggtgagacttttttcaaaatgaggaagatagcaacgattaacgccaccaacgcacctattgctgagactgttgtcattttttctctcctataaaaattaaaaccaaggagattatttctgttttataggggaaatgctttattagagcaaacaaaaagtgcggttaaaaatcatcaaactttgtaaagttatacaacctcaatgttctaacaacgttccgagatagagcgttaatttatcatctatcttattgaaaaataaaccagttatttgctctattttgttcaatcgataacgcaaagtattcgggtgaacaaataatttttccgcagtgagataaagatcacaatttgataaaaaatattgttgaagggttttataaagtgtcgcattttcttctgagaaaaggggagaaaggggttttatcaattcgttcccttgccaagaatgggataatccagcaagtaacacaggcaatcgatgctcatcaaacacataaatacccttgcgtggatgatgttttaatccataagaaagcgtgctttgcgcactttgaaaagacaagggaagctgctcaaaaagcggtagatttagacaagcgcctacagcaattttataatcttgttttgaataatctgcaggtaaaagcgttttcatttgagcagaaagtacggtggagttttgccaagtctttaagaccacaacctgatcaagggacaaaattgccacatcctgtgcaaattcagactgttccaaataattgatcagatgctgtaaattatccagggctggattaagtaacttaatcaatacaaccacacgagatttatttaaatcaaaagaaaaaaatttcgcctgctgttccatctttttccaattcaaattgcaatgtaataattgcaaaataaattcttctttgtaacgacgatgccagctttcttgttcgagtaaagcctgttgttccacaataagttctgcggtcattttcactagttcggcatattgtttcacctgagttggctcaccagaaatccccaccactccaatatttttgcctaaataatgaatcggtaaattaatccctggttgcgcttcaaaattccatttttgtgccaacgcttgatcaatctctaccacacgattttcccgcaacgccaacaccgctcctgtgtgccgttgattcaaacgcgttgaatttcccgacgcaatgatcacaccgtcgtgatccattacatttacagagtgatgaatgatcttcattgcacgtttaacaatttttttggcagtgtatttgtcaagttgcatatttgtaataaagaagataaatgaagataaaatattgagaaaaagaaagttagtcaaatattgttttatctgcaagaaaagacgggagactattctcccgcactgcgtttttatcgctataatgttttattctgaacttgaacatatcccataattaatgccaaaatccctagtggaaaaatgagatctattacagaaccatcatttccccaaatcaagaatagctttgatgaaaataagtaaaatcggtaagacaataggaatactcacgacatagcccgtaatggctaatgcccattcttcctttttcttacctagaaatttgataaaactgaacgccattttttcagcaactgggcagattgaagtttcaccatgtaaaggttctcgaataatgctacttacaaaggaagaagtcgctttatttggttttcctggacggatacaaattgtgagcaggcgaacacagagaccatcaacaaaaccttttcttgtatagtcattaataagtaattcactcattgctttttgtgcaccataagtcgattgtggcgttacagcagtagaatcctgaataatttctggtaaatcaccaccaaatacagcaagtgaactagaaaaaataaaacgaattttagtatcagattcatcaaaatatgagaaagtggcgacattccatatttgtccactaacaaattttgatcacataatttgcgacaaaaatcttgttgaatctgcacagaatggcattagagaattaaatattaatttaactatcgtataaataaattaatataaatgatctgcaccccaaaactaaacaaataagcttactcattaaggtgcaaatcaaagtgcggttcgtttttatattatttttggctacatacagcaataaaatgtaatttatgttcaggatcattaaaggttttgaacattcttttaaattgctcacgattttccgctttcatcgcattacggatgatttttaacgtaccgaaaattccttcatcataaatcattccttttggagaaagtaatgtcatctcaccagagaaagtatcaacatatctaaagccactttcttggaatatgcctttccatccatctttcgttaatggcgtgacagtcacattaatcgctttgcgcatattttctagaatagtttgatgatcattccccaccagcataacatcgtgagtaagcaataaaccattgggttttaacactcgaaaatattctgcaatggcttttttcttcgcttccacgggtaacattgtgagcatcgcttcattgatgacaatatcaaaactttcatcctcgaaaggcaacttcatcgcattcgcacgctgtacatgaattttttcttgcaagccatttgcttcaatatttgcttgtgcttttgctaacgcattttcatctaaatcaacaccttcaatatgacaaccaaattgtttcgccaatccaattgcagtcgtccccatattacaggcaacctctaacacttttttatcttggctaaaatcgccattagcaattaaccaatctgtcgcttttttaccgcctggacgcaaacgcgttttacccaaacgtgcaagaaaattatgccctacttcatcttttgccatttttatctcctagtaattaacttggtttttatattatagataaaaatgataactattaaaatgatagattaaataaattaaggcggaataattgttccgcctttttctcttatttcttcaatgcttttttcaattcaatttattcctttgaagataacaaaacttacataccgaaacgctttactcaatatgtaaaaacattggtagaaggcgcaaatcagtatattggtgctggaaatatgtataacggcgacgtagaagatttgaataaaccgcatctttatatgatgtctcaaatggaaaaaccgacaactaaagctgagttgaaatcagcattacaaggctatttaattcaaaatgaatatcaagatatgaataacaatgataaattgattgatgaaacttatgattgcactgagttgtttaatgcactttgtgatgtattaacaagattaggctatatccagcctgtaaacctataatctatgtatggttcgtttaatgtaccgttttgtttttcatctaaatatcaatttaaattgagaactatttgcatttaaataaaattaggcatagaatagccacaattcaggctgaactgaataatttgcactcaacataaggagcttttcaatgcaatttaaacatttcaaacttgctacccttgcggcagcacttgctttttctgctaatagttttgctgatattaccgtttataatggtcagcacaaagaagccgctacggctgtggcaaaagcctttgaacaggaaacaggcattaaagttacgctaaatagcgggaaaagtgagcaacttgcaggtcaattaaaagaagaaggcgataaaacaccagccgatgttttctatactgaacaaacagcgacttttgccgatctttctgaagcagggcttttagcaccaatttcagaacaaaccattcaacaaaccgcacaaaaaggcgtaccacttgcaccgaaaaaagactggattgcattaagtggccgttctcgcgtagtggtttacgatcacactaaattatctgaaaaagatatggaaaaatcagtgcttgattatgcaacaccaaaatggaaaggcaaaatcggttatgtatcaacttctggcgcgttcttagagcaagttgttgcgttaagcaaaatgaaaggggacaaagttgcgcttaattggttaaaaggtttaaaagagaacggaaaactttacgctaaaaatagtgtggcattacaagcggttgaaaatggcgaagtacctgctgcgttaatcaataactattattggtataacctagcaaaagaaaaaggcgtggaaaacctaaaaagccgtctttattttgttcgccaccaagatccaggtgcgttagttagctattcaggtgcagcagtattgaaagcttctaaaaatcaagctgaagcacaaaaatttgttgatttcttagcgagtaaaaaaggtcaagaggcattagtggcagcgcgtgcagaatatccgttacgtgctgatgtggtttcgccatttaatcttgaaccttatgaaaaattagaagcaccagtggtgtccgcaacaacagctcaagataaagaacatgcgatcaaattaattgaagaagctggattgaaataatccaaatattgcgtgcgtgtatttgaaaaaattcacgcacgcgtttacaattctctaacaaaattaaccgcttgcgtgcgtgaactgaaaggttcacattcctaaaaggatttaactttgcctcgcagaccgccattctggctcactttacttatcatcttaatcgggcttccgttatgtttgccgtttctgtatgtcattttgcgtgcgacagaagtgggattaacgcgaagtgttgagctattgtttcgccctcgaatggctgaattattaagcaatacaatgcttttaatggtttgtgtaactatcggtgctatttcacttggcacgctttgtgcttttttacttgaacgttatcgctttttcggtaaagctttttttgaagtggcgatgacgttacccctttgtattcccgcctttgtaagttgttttacttggatcagcctcacattccgcgttgaaggtttttggggaacaattggtattatgacattaagttcatttcctttggcttatttgcccgtttccgctatattaaaaagacttgatcgttctcttgaagaagtaagcctttcgctgggtaaaagccctgtgtataccttttggtatgttattttcccgcaacttaaacccgccattggtagtagtatcttactgattgctttacatatgttgatcgaatttggtgcagtgtcaattttaaattatcaaacctttaccactgccattttccaagaatatgaaatgtcttttaacaacagcactgctgcattattatccgccgttttaatggcgatttgtatacttattgtttttggggaaattttctttcgtggaaaacaaaccctttaccacagtggaaaaggtgttacgcgtccttatctcgtaaaaacactttcctttggaaaacaatgtttaaccttcggatttttctctagcatattcattttaagcattggcgtgcctgtgattatgttaatttactggcttatcgtggggacttcacttgaaagtgcgggcgatttttcagaatttttatcggcattcagcaattcatttatcatttcaggcttaggcgcattgcttaccgtaatgtgcgccttgccattagtttgggcagctgttcgttaccgtagttatttaacgatttggatcgaccgcttgccatatctattacacgctgtgccaggcttagtcattgccttatcattagtctatttttccatccattacgctaacgacctatatcaaaccttttttgtgattatcattgcctactttatgctctatttgccaatggcacaaactacattaagagcgtctttagagcaactttccgatcaaattgaaaaagtcggacaaagtcttgggcgaagccctttctatatttttcgcaccttgacgctaccagccatattaccaggtgtggccgccgcatttgctttggtttttttgaatttaatgaaagagcttaccgcgacgcttttgctcacatcaaatgatattaaaaccttatccattgctgtgtgggaacataccagcgatgcgcaatatgctgccgccaccccttatgcgttaatgctcgttcttttttcgggtattcctgtatttttattgaaaaaatatgcgtttaaataaaatgataaataatccgttattaaccgttaaaaatctcaataaattttttaatgaacaacaagttctgcacgatatttcattcagcttacaacgcggagaaatcctctttttacttggtgcttcaggctgtggcaaaactacattattacgtgccattgcaggatttgaacaccccaatactggcgaaatttggctaaaagagcggttaatttttggcgagaattttaatcttccaacgcaacaacgtcatctcggttatgtggtgcaagagggcgtactttttcctcacttaaatgtctatcgcaacattgcttacggattaggcaacggcaaaggaaaaaatagcgaagaaaaaacgcggattgaacaaataatgcaactaacgggtatttttgaactggcggatcgctttccacatcaactttcaggcggacaacaacaacgcgtagcattggcgcgtgctttagcccctaatccagaactgattttattagacgagcctttcagtgccttagacgagcatcttcgccaacaaattcgccaagagatgctccaagcacttcgccaaagcggtgcttccgcaattttcgttactcacgaccgtgatgaatccttacgctacgctgataaaatcgccattattcagcaaggtaaaattttacaaatcgatacgccacgcaccctttattggtcgcctaatcatcttgaaacagcaaaatttatgggggaaagtattgttttgcctgcaaatctactcgatgaaaataccgctcaatgccaattaggcaatattcctataaaaaataaatcaatctcacaaaatcaaggtaggattttgcttcgtccagaacaatttagcctgtttaaaacatcagaaaatccaaccgcactttttaatggacaaataaaacaaattgaatttaaaggaaaaattacctccattcaaattgaaattaatggctacgcaatatggattgagaacgttatttctcccgatttatctattggcgataatttgcctgtttatttacatagaaaagggcttttttacgcttaacaataaagccttatcttcacgataaggcttatttttaaacaatatattcggaaaaaatttgttcaagatgtgatattaaacagtctgcgcctaaaatattttcccctttccacgcctgttgcaaaatctctggagaaaattgctggcttgccaattcagctaacggcaaataactgatatgccaaggctcccgccccactttcttattggactgcatattcataaaaggcaaagcaaaatcaaagtgcggtaaattttcggcaagaaattcactcaattcaaagaagtagccgcctttttcatattcccaaggctccagttgtaaagattgcccttgtggcaaaagatcaggatcaaaaatatccacttccgttccccaatgatgacggctcgcccccggcaatgcagaccaacgtaaaatcgcctgacatttttgccagtcatctaattggttcaaatctaatgcctttcctgcatcatcgtgtacttttcgctcgcccttaaatttactgttccaaataagtttttggcgttcaaaatcacgaaaactgctcgcaggctgtaaattaaagccattttttgccgcactttgttgcaaagcttgaaatgcttgcatagcttgtgtttgcaaaaaatgatttgatgaatgagttgtgggtaaattgactaaatgctcacgagactttcctgtaagcatttctagggttaatttcattttagctatccaataaattcactaacattttgtgataaatttcaccgcacttgccaagatcttctatactgacacattcattgactttatgaatggttgaatttaacggaccaaattccactacttctgcgcccatcaatgcaataaaacgaccgtctgacgtgccaccacctgtttcagcctttggcgttatgcctatggtttcctcaatagcggaggttatcgaatctaataatttacctggttttgttaaaaagggtttgcctgataaattccattcaatacgatatttcaaattgtgtttttctagcatttcagcgactttttgcttaatgatttcatccgtgacttctgtgcaataacgcaaattaaactgaatatataattcagcaggaattacattattacttcccgtacccgcgtgaatgttagcaatttgtaggcttgttggcgggaaaaattcattgcctttatcccattggtaagtcgttaattcttgcaagaatggggctgctttatggattgggttttcagctaaatgcggataggctacgtgtccttgaatacctttaatatagagatttcctgtaattgagccgcggcgaccatttttgacaacatcgcctaagtttttagcactcgatggctctccaaccatacaataagtaattttttcatcacgcgccattaacgtctcaaccacgcgtatagttccatcttttgcggcagcctcttcatcagaggtaatcaataatgcaatggtgcctttatgattaggatttgcttttacgtattcttctgccgccacaatcattgctgcaagggagcctttcatatccgccgcaccacgcccataaagcatgccatcaataatctccgcagaaaacggcggagacgaccattgattttcatcgccagtaggcacaacatccgtatgacctgcaaaagcaataactggctcgctcgttccgtgttttgcccacaaattcaacgtgtcattaaaaggcatccattcaatttgaaaacctagcttttctaaacgttcggcaataatttgctgacagccttcgtcattcgggctaatagacgggcgacgaattaaatcttgtgccaacgaaaccactttttctctcataaaaactcctaagaaaataaccgcactttaagcaaaaacagcctgatattccttttcattaaagccaattaatgccttttcatcttgtaaaataattgggcgtttaattaaagttggattctcagccaacacggaaagtgcggtggttttatcaagggaatttttaacttgctcatccaaattacgccaagttgtactgcgtttattcactaacacatcccagccaaattgagtttccgcttgggttaaaaaattcaaatctaacccatcaacacggtagtcgtgaagtttgtgttcgatattgtgatccgccagccatttcaacgctttcttcactgtatcgcaatttttaatgccgtaaactgtaatcatatttcacctaaaaaagaaaaatcctcaatctaatcagactgaggattttaacccttatactacttcatctcaaatgaattaacctaacaacttattgatacgtttaataaacgcagctggattttccaaagatccgcgctctgctaacatagcttgttcaagcaacagttccacccaatcagcaaattcagtttcatctgcaatatcagccacttttttcactaaatagtgttctggattcagttcaaatgtgtattttacttctggtacaggttgccctgcggctgcaaacaatttcgccatttgggtcgtcatttgatcgttatccgtagaaaccaccgctggtgtatccgttaaattgtgagttaaacgcaccgttttcacacgttcgccaagcaagtttttcacacgctcaataaaactaccaaaggctttatcttgttgtttttgtgtttcagattctttatccgctaaatcgcctaaatccaaatctgctttcgtgatactttgtaattgtttaccgtcaaattcagttaaatagcttaacatccattcatcaatacgatcggaaagtaataaaacctcaatgccttttttattgaataattccaagtgtgggctatttttcgctgcaacataactatccgctgtaatgtaatagatagctttttgcccctctttcatacgcaagatgtaatcttctaaagagacagtttgctcactaccatcattatgtgtcgaagcaaaacgcaataactttgcgatagtttctttgttagcaaaatcttctgcagggccttcttttaagactaaaccaaactctttccagaatttaagatatttttctgcatcatcttttgctaatttttctagcatttgtaatgaacgcttagttaatgctttgcgtagtgcagccgtaattttgttatcctgtaaaatttcacgagatacatttaatggcaagtcattactatcgattaaaccacgcataaaacgtagataattcggcataaattgctcagcatcatccataataaatacacgttgaacataaagttttaagccgtgtttatgttcgcgattaaataaatcccaaggtgctttagctggtacataaagcaaactagtatatgcttgatttccttccactttgttatgcgcccaagtcacaggatcaacaaaatcatggcttaagtgtttgtaaaacgctttgtattcctcatcggaaacatcatttttagaacgcgtccaaagggcatcagatttattgattttttcccatttttcgccgcactctttgccctcatcatcgtattctttcgtcagcatttccactggcaagccaatatggtcagaatatttaccaataatttcacgcaaacgccattcatttaaaaattctttttcatcttcacgtaaatgtaaaatcacatctgtaccacgagattttttctcaatatccgccacagaatattcgccttcgcccgcagattcccaaagcacagctttatccgcctcttcgccagccgctctagtttttacagtcactttatctgccacaataaaagcagaataaaaacccacaccaaactgcccaataagctggctattttttgcttgatcttggccaagtgcggttaaaaattcttttgttcctgattttgcaatcgtccccaaatgatcgatgacttgctcacgagtcataccaatgccgttatcgctaattgtgatagtgcctttatccgcatcaaagctaacacgcacacgcaagtcgccatcgccttcatataaagcagggttggaaagtgctttaaagcgtaatttatctgccgcatcagaagcattagaaatcaattcacgtaagaaaatttctttgttagagtacaaagaatgaatcattaattggagtagttgtttgacttcagattggaagccgcgagtttcttgattttgtgacataattttttccttcataaagataaaaattgaacgtcacagatataagaataaaaagaaagatttcaagggaaatttaagaggaaaagtgcggtaaaaaacacaaggaatttaaaccgcactttaaataaaaaatttcttatttccccttgatcgctataaatttatatatataatgaattctgttttagatactagatagtaatttaatagtaatgaaacttggctagtgcattcccccactcctttcgcactagccatttttttgggaattttgtaccatatcccgactttttccaatcaacgatccattatgaataatctcgaacttgaacaactcattaatcaaaaactttcttctgataaaatcaatgactatgcacccaacggcttacaagtcgaaggtaaaacagaaatcaaaaaaatcattactggcgtaacggcgagtcaggctttaattgattacgcaatcagccaaaatgctgatgctattttagttcatcatggctatttttggaaaagtgaaaccccttgtatccgaggaatgaaaggcaagcgaattaaagcccttttagtgaacgacattaatttatatggctatcatttgccattagatgtgcacccagaattaggtaacaatgcacaattagccaaactgctcgacattgaaaatttacaaccattagaaaaaggcactgtgagtattcctgtttggggcgaattaaaagaaccgatgacaggtaaagactttgcagaaaaaatagaaaaagtgttaaatcgaaaaccgttaatttgcattgaaaacggaccgcacttaatccgaaaaattggcatctgcactggtggcggacaaggttatattgatcttgctgcagaacaaggctgcgacgcatttattacaggggaagtgtcagaacaaacaatccattctgcccgtgagcaaggattgcatttcttctctgcaggtcatcacgcaacagaacgctatggcatcaaggcattaggcgaatggttggcgaaagaatatggctttgacgtagaatttaaagatatagataatccagcataaaatacaaaagtgcggtaaaaatatttcttttttaccgcacgctttcttctctataagatcctacaatcataactaataacaattagcttcctttaataaaagaaaaaattgaatgcccattaaaaataagcaacaatacccaaaaaatttcataatattaagtgggaacaaatatggagcattctgttcataacaaactggtttcttttatttggagtattgcagacgattgtctgcgcgatgtgtatgtgcgcggtaaatatcgtgatgtgattttaccgatgtttgtgcttcgtcgtttggatactttacttgagccaagcaaagatgccgtattggaagaaatgcgttttcaaaaagaagaattggcattcaccgaattggatgaccttccccttaaaaaaattaccggtcatgttttttataacacctcaaaatggacattaaaatccctctatcaaaccgccagcaatacgccgcagtatatgctggccaattttgaagaatatcttgatggtttcagcaccaacattcatgaaatcatcaactgcttcaagctgcgtgaacaaatccgccatatgtcccataaaaatgttttgctgagcgtgttggaaaaatttgtatcgccctatatcaatcttacccctaaagaacaacaagaccctgagggcaacaaattaccagcgctgaccaatctgggcatgggctatgtatttgaagaactgattcgtaaatttaacgaagaaaataacgaagaagctggcgaacactttaccccacgcgaagtgatcgagctgatgacgcatttagtctttgatccgctcaaagaccaaattccggccattattacgatttacgacccagcttgcggcagcggtggcatgctgaccgagtcgcaaaactttattgagcaaaaatatccgctatctgaatcacaaggcgagcgttccatctttttgtttggtaaagaaaccaatgatgaaacctatgccatttgtaaatctgacatgatgattaaaggtgataatcccgaaaacatcaaagtcggctcaacccttgctacagatagcttccaaggtaatcactttgactttatgctttccaacccgccatatggcaaaagctggagcaaagatcaagcctatatcaaagacggcaatgaggttatcgacagtcgctttaaagttaccttaccagattactggggcaatgtagaaacccttgatgctaccccacgctccagcgatggacagctgctattcctaatggaaatggtcagcaaaatgaaatcgccgaatgacaacaaaatcggcagccgagtggcctccgtgcataacggctcaagcctgtttaccggcgatgcaggttcaggagaaagcaacattcgtcgccatattattgaaaaagatttgctcgaagccatcgtacagctgcctaacaacctgttttataacacaggtattaccacttatatttggttgctgtccaacaacaaacctgaagcacgcaaaggcaaagttcagctcattgatgccagcctcttattccgcaaattgcgtaaaaaccttggcgataaaaactgcgaatttgtacctgaacatatcgccgaaattacccaaaactatcttgatttcactgccaaagcgcgcgaaaccgacagccaaaatgaagcagtcggcctggcttcgcagatttttgacaatcaagatttcggctattacaaagtcaccatcgaacgcccggatcgccgttctgcccaatttaccgccgaaaatatctcgcctttacggtttgacaaggctttgtttgagccgatgcaatatctttatcggcaatatggcgaacaaatttacaacgccggatttttagcccaaaccgagcaagaaattaccgcttggtgcgaagcgcagggcatagccttaaacaacaaaaacaagaccaagctgctggacgtcaaaacctgggaaaaagccgccgcactttttcagacggcatcaaccttgctcgaacatttcggcgaacaacaatttgacgatttcaaccaattcaaacaagccgtggaatgccgtctgaaagccgaaaaaatccccctttctgccacagagaaaaaggccgttttcaatgccgtaagttggtacgacgaaaattcagccaaagtgattgccaaaacactcaagctcaaaccaaacgaattggacgccctttgccaacgctaccaatgccaagccgacgagctggcagactttggctattacgccaccggcaaagcaggcgaatatatcctatatgaaacgagcagcgacttgcgcgacagcgaatccataccgctcaaacaaaatatccacgactatttcaaagccgaagtgcaagcgcacatcagcgaagcatggctgaatatggaaagcgtaaaaatcggctatgaaatcagcttcaacaaatacttctaccgccacaaaccattacgcagccttgcagaagttgcccaagatattttggcgttagaaaaacaggctgacggcttgattagtgaaattctagaggcttaataaaaaacaaactattaagcaagttttaataggtcttaagtaaggaaattcaaaatatataacacattgaaaaataatgaattttaccttttaagcaagatttggcatgaaataagcaaggaataataatgacagaaccgctttctaaaattaacggcattatcacaaaaaattatttagagatgcagccggaaaaccaatattttgagcgcaaaggactaggagaaaaagacatcaagccaactaaaatagctgaagaattagttggaatgctcaatgctgatggcggagttttggcttttggtgtggcagataatggcgaaatccaagacttgaatagccttggcgataaattagatgattatcggaaattggttttcgattttattgcaccgccttgtcggattggactggaagaaattctggttgatggaaaattagttttcttattccacgtagagcaagatttagagcgtatttattgtcgcaaagacaatgaaaatgtgttcttacgtgtagcagatagtaatcgaggccctctcaccagagaacaaatcaaaaatcttgaatatgataaaaatatccgtctatttgaagatgaaatagttcctgattttaatgaagaagatttagatcaagaattattagagctatataaaaagaaagttaattttacctccgataatatcttagatttattatacaagcgaaatttattaaccaaaaaggaaggttgttatcagtttaaaaaatcagccattttactcttttctaccatgccggaacgttacattccttcagcatcagtccgctatgttcgttatgaaggtacagtagcgaaagtcggtactgagcataatgtgataaaagaccaacgttttgaaaataatattccaaagctaattgaggagctgacctattttttaagagcctctttaagggattattactttcttgatgtcaatcagggaaaatttatcaaagtaccggaatatcctgaagaagcttggttagaaggtgttgtaaatgcgctttgtcatcgttcttacaatgttcaaggtaatgttatttatattaaacatttcgacgatcgtcttgaaattagtaatagtggccctctccctgctcaagtcaccattgaaaatattaaaacggaacgattcgctcggaatccacgtatagcacgagttttagaggatcttgggtatgtccgtcagcttaatgaaggcgtttcccgtatttatgagtcaatggaaaaatcattattggcaaagcctgaatatagagaacaaaacaacaatgtttatctaacattgcgcaaccgtgttaccgcacatgaaaaaacggtatctacagccactatgctgcagattgaaaaagaatggacaaactacaacgacacccaaaaagccattttgctttatctatttacaaatggtacggcgatattgtcagaattagttgactatacaaaaatcaatcagaattcgatccgagcgtatttaaatgcctttattcagcaaggtattattgaaagacaaagtgtaaaacagcgtgaccccaatgccaaatatgcttttagaaaagattaagcaaggtttatcgcttgctaagcaaggaaattgacaatgcttaacttgctgaaaaataatgatttttatcttttaagcaagatttggcatgaaataagcaagtttttttatagttaaacggacaacaaattgcatcaataagagcggtcatattttaaggattttttgcaaatgagacgatacgagcgttacaaagattcaggtgtggattggctaggggaggtaccgagccattgggagttaaaacgcttgaaacaattatttgttgaaaaaaaacataagcaaagcctgtctcttaattgtggagccattagttttggtaaagttattgaaaaatcggatgataaagtaacagaggcaacaaaacgttcatatcaagaggtgttaaaaggcgagtttttaataaatcctttaaacttaaattatgacctaattagtttgagaattgctttatcagaaatagacgttgttgtaagtgccggttacattgttttaaaagaaaaacaaataattaataaaaaatacttttcgtatttattacatagatacgatgttgcatatatgaaattattaggttcaggtgtaagacaaacgattaactatgggcatatttcagacagtattttggttattccacctctctccgaacaacaaaaaatcgcgcaattcctagacgataaaaccgctaaaatcgatcaggcggtggatttggcggaaaagcagattgccctgttgaaagagcacaagcagatcctgattcaaaatgccgtaacccgaggcttaaaccctgatgtgccgttaaaagattccggcgtggaatggatagggcaagtgccggagcattgggatgtgcaacgttcaaaattcattttcaagaaaatagaaagaaaagtgaatgaggaagaccaaattgttacttgttttagggatgggcaagtaactctgagagctaatcgaagaactgaaggatttacaaatgcgctaaaagaacacggctaccaaggaattagaaaaggtgatttagttattcacgctatggatgcttttgcaggggcaattggtatttctgattcagatggtaaagcaacaccagtttattccgtttgtttgcctcatgataaacaaaaaatcgatgtctatttttacgcttattacttaagaaatcttgcattatcaggatttattagctccttagctaaaggaattagagagcgttcaacagattttcgctattctgattttgcagaattattactacctattcctccatatttagaacagcaaaaaattgccgactacctagataaacaaacctctaaaattgatcgagcaatcgcattaaaaacagcccatattgaaaagctgaaagaatataaaagcgtgttgattaacgatgtggtgaccggcaaggtgcgggtataggtgtgaaaagtgcggtcaaaaaatccgatggattttgaatatcggcgcgacaacttgggcgtaatgaataaatttaaaaaattcacaaaagggtgaaaaatggtttcaggaactaaggaaaaagatttagaaattgccatcgaaaaagccttaactggcacttggcgtgaaaacatggaaaataagctgggcgagccgaaggctgaatacctgccgcgccatcatggttttaaactggcattttcacaggattttgatgcgcagtttgccatcgacacacgtctgttttggcaattcctgcaaaccagccaagaggcagaacttgcccgttttcaacaactcaacccaaacgactggcagcgtaaaattttggagcgattagaccgccaaataaagaaaaacggcgtgttgcacctgctgaaaaaaggcttggatattgatagcgcccattttgatttgctctaccccgttccgcttgccagcagcggcgaaaaggtcaagcagcgttttgaacagaatttgtttagctgtatgcgtcaagtgccttattctgcctcaagcaatgaaacggtggatatggtgctgtttgccaatggcttgccgattattgcccttgagctgaaaaaccattggacaggtcagacagccattgatgcgcaaaaacaatacctcaaccgtgatttaagccaaacgttgttccatttcgggcgttgtttggcgcattttgccttagatacggaagaagcttatatgaccaccaaattggcggggcctgctacgtttttcttgccgtttaacttgggcaacaactgcggtaagggtaatccgcccaatcccaatggacaccgcacggcgtatttatggcaagaggtgttcggcaaagcaagccttgccaacattattcagcattttatgcgcttagacggttcaaccaaagatccgttggataaacgtaccctctttttccctcgctatcaccaattagatgtggtccgccgtttgattgctgatgtcagtgaacatggcgtgggtaaacgttatttgattcaacattctgccggttcgggcaagtctaattccattacttggctggcgtatcagttgattgaggcatatccgcgcaatgaaaaggcggcaaacggtagagaggcagaccgcccgatttttgattcggtgattgtcgtaaccgaccgtcgtttgttggataagcaactgcgcgacaatatcaaagatttttcagaagttaaaaacattgttgcgccggcgttgagttcggcagagttgcgccaatcgcttgagcagggcaaaaaaatcattattaccacgattcaaaaattcccgtttattgtcgatggcattgctgatttaggcgacaaacaatttgcggtgattattgatgaggcacacagctcacaatcaggttcggcacacgacaatatgaaccgggccatcggcaaaacggaagaccttgatgctgaagatgtgcaagatttgattttacaaaccatgcaatcccgcaaaatgcacggcaatgcgtcgtattttgctttcaccgccacaccgaaaaacagcactttggaaaaattcggcgaaaaacaggcggatggcaagtttaagccgttccacctttattctatgaagcaggcgattgaagaaggctttattttggatgtaatcgccaattacaccacctataaaagtttttatgagatcactaagtcgattgaagataatccggagtttgatagtaaaaaggctcaaagccgtctgaaagcctatgtggagcgttcgcaacaaacgattgatactaaagcggagataatgctggatcattttatttaccaagttttcaaccgtaaaaaactcaaaggcaaagccaagggaatggtggtaacgcaaaatattgaaaccgccatccgctattttcaggcgttaaaacatttgctggccgggcggggtaatccgtttaaaattgcgattgcgttttcaggcagtaaagtggttgacggtgtcgaatacaccgaagcggaaatgaacggctttgcagaaagcgaaaccaaagagtatttcgatcaagatgaatatcgtttgctggtggtcgccaataaatatctgaccggtttcgatcagccgaaattgtgtgccatgtatgtggataagaaactctccggcgtgctttgcgtgcaggctttatctcgtttgaatcgcagtgcgaataagttgagtaaacgcacggaagatttgtttgtattggacttttttaacagcgttgaagatattcagcaggcatttgagccgttttatacttctacttcgttgtcgcaggcaaccgatgtcaatgtcttgcatgatttgaaagaccggttggatgaaaccggcgtgtacgaacaagcggaggtcaacgattttactgaaggctattttgccaataaagacgcacagcaattaagcagtatgattgatgtggctgtccaacgttttgatgatgaattggaattggatttggatcgaaatgaaaaagttgattttaaaatcaaggcaaaacagtttttaaaaatttacgggcaaatggcctccatcatcaattttgaaaatatcgcttgggaaaagctctattggttcctcaaattcttagtacccaaattaaaagtacaagacccgatggatgaatttgatgaaattttagatgcagtggatttaagctcttacggcttggcgcgcaccaagctgaattacagcattaaattagatgatgaagaaacagagcttgacccgcaaaaccccaatccgcgcggtacgcatggtgaagataaagaaaaagatccgattgatgaaattattcgtgtatttaacgaaagatggtttcaagattggagcgcaacgccggatgagcaacgggtaaaatttatcaatattaccgagcgcatccgcagccataaagactttgagcagaaatatcaaaataacccggatattcatacccgtgaattggctttccaagccattttgcgcgatgtgatgagcgaacgccatagggatgaattagagctatacaaactttttgccaaagatgccgcatttagaaccgcttggacgcaaagtttgcaacgggctttggctggatagaaaagattgcctgaaaaattaacgttcggctctccttttctatctaaattaatatcatcgtaaacattaattaattttttcacatacttaaaagagaaaattaaatatagtttccataacagcaacgtcgttaattagaataatttataaattagctataattcataaaacacaaaagtgcggtaaaaatatttcttttttaaccgcacttttatcttctgaaattatcgtttaaacattccgcctaaaccgcctaagcctccgcccattaagccttgcattccacgcatcattttagccatgccgcctttacgcattttcttcatcatacgttgcatttcatcgaattgtttaagtaatttattgacatcttgcacttgagtgccagaacctaatgcaatacgacgacggcgagatcctttgataatatctgggttggcacgttcttttagggtcatggagttaatgatcgcttccattttgacaaacattttgtcatccacttgatttttaacgtgctcaggcaaattttttgcacctggtaatttctcaagcatagacatcatgccacccatttttttcatttcgatcagctgttcgcggaaatcatctaaagtgaaatcatcgcctttcttgaatttctgcgccattttttccgctttttcacgatcaacagaacgttcaagatcctcaatcaatgaaagcacatcgcccatgcccaaaatacgggaagcaacacgatcaggatggaacggctcaagtgcctccgttttctcacccacacccaagaatttaattggtttacctgtgatttgacgaatcgataacgccgcaccaccgcgcgcatcaccgtccactttcgtcaaaataacccctgtaagaggcaatgcttcattaaaggcttttgctgtatttgccgcatcttgaccagtcatcgcatcaacagtgaaaagggtttcgattggatttaatgcagcatggacttgcttgatttcgtccatcatttctgtatcaacgtgtaggcgacctgccgtatccacaatcaacacatcgtagaatttcagttttgcatcagcaagtgcctctttagcaatatcaacggggttttgtttaacatccgatggaaaaaaatccacgccaacggattgagccaaggtttcaagttgcttaatcgcagcagggcgatatacgtcagcagacaccactaacactttctttttatggcgttcacgcaagaattttgccaatttacccacgctggtggttttacccgcaccttgtaaacctgccattaagataactgctggtggttgggttgcaagatttaaactttcattggcttcgcccatggctttttcaagctcacgctgaacgatttttaagaactcttgccctggcgttaaacttttattgacttcttccccaagcgcgctttcttttacttttgcgataaattcacgcaccacaggcaaggcaacatcggcttcaagtaatgccatacgcacttcgcgcaaggtttctttaatattatcttccgttaaacggccttttcctgtgatattacgtaaggttttggaaaggcgatccgataaattctcaaacatggctaacaatcctgtttttcttaaaaaattgtgctgattataccgaaatttaggcgtttttcatcatttcaaatgaaaatggatttttgagtaggcaatttcatgaagaaagcataggagataaggaaaaagaatgattatttagccaatttcaggtattattctgcccactcttggctatttgagcagctatttgatttagcaaaatcaaataacaggtaaaaagtgcggtgaaaaatgaccgcactttttgttgattaacgaacaaaaggattttcccttggatagcattccccttagtactttatttattattcttattatctgtttagttttatcagcctatttttctggttctgaaactggactactctccctcaataaatatcgtcttcgttttctatctgaacaaggcaataaaggcgcgaaaaaagcggaaaaactgctagaaaagccagatactttgttaagttttattcttatttttaataaccttgtgaatatcagcgcatctgcaattgcaacagtaattggtatgcgtttatatggcgatgctggcgtggcgattgcaacgggtttgctcactttcgtaatgcttgtattttctgaaatattccccaaaacggtggctgcaatgcacgcagaaaaagtgagttttttttcaagtcatattttaacttcattgcttaaaatcttttatccgctcgtttggttaatgaatatttttactaaatccttgatgcaaatagtagggttaaaacttgatatgcaaaaacaagtaattagtagtgaagaactgcgtagtattgtgtcagaagcaggcgaagcaacaccaaatgaacaacatccacaaatgttgctgtctattttggatatggagacagtcactgttgatgacattatggttccccgcaacgaaatcggcggtataaatattgatgatgattggcgagctattatgcgccagctcaatcatgctgcacataaccgcgtggtgctttacaaaggcagccttgatgaacaagtgcttggcattttgcgcgtgcgtgaagcattccgcttactgcttgaaaaaaatgaatttaccaaagaaaccttaattcgtgccgcagatgaagtgtatttcattcctgaaagcacgccattaaaaacgcaacttgcaaatttccgtacaaataaagagcgaattggcttagttgtagatgaatacggcgatattaaagggcttgtgacgttggaagatattttggaagaaattgttggggattttaccacttccaccgccccaagcattgacaaagaagtaattcaacagtctgatggttcaatgattatcgatggctccgctaatctacgcgatctcaacaaaatgtttaactgggaattagatacagaagatgctcgtacttttaatggtttaatcttagaacacttagaggaaatacccgatgaaggcacgatttgcgaaattgatggtttgctaatcactattcttgaagtgggcgataatatgataaaacaggcgaaagtcgtcaaactttaatcataaaaaactccgccaaattgaaccgcacttttgacttggatcataagtgcggttctttttttgcgcattttttagaaaagatttttataattctttctaggtatattttgatagagaagaaagatatggaacacgaatatcaacgggcggtgactcgcgtgtgcgtacaaacggcactgctcttgttacaacatggggcagaaagtaccgtggtggtgcaaatggcacagcgtttaggcgtagcacttggcgtagaaagtgtagaatgtgcgcttacggcaaatgcagttgtgctgacgaccttatcagataatcattgcattactaccgcacgaaaaaatacagataaaggcattaatatgcaaatggttactgatgttcaacgcattgtgattgccgttgagcatcatttgtatgagttagagatcgtacaaagaaaactggatcaattaaaaccgcttaaatataaccgatggttagttgtattcatgattggcttatcttgtgcagcattcgcccatttatctggcggagactggataatttgtagcattacctttgtggcagccgccattgccatgtttgtgcgacaagaattttctaaacggcactataatccccttatcgtcttttccatcacctctttcgtcgcctctctgatttctggcgtgagcttaaaatataacttaggtaacgatcctcaaattgctttagcgtctagtgtgttattacttgtgccagggtttcctctgattaattctttggcggatatattaaaaggttatgtgaatatgggattaggccgttggacgattgcgactgttctcacttttggcgcatgtcttggtattgtattcgctttaagcctattacatattacaacttgggggcattaaaatgttatcagacatcacaatatttatcttgaaattactcgatgatatgctatgtgctgcgattccagcggtgggctttgctttagtatttaatgtgccgcccaaagccttaaaatattgtgcaattttagccgcacttgggcatgttacacgcacattattactgcatattaatatgcctattgtatttgctacattctttgccacttgtgtgattggatttttaggcgtgcatctttcccatcgttatttagcccatcccaaagccttcaccgttgccgcaattatccccatgatccccggtgttcatgcttataaagcaatgatttcaatggtacaaattcatcattttggcttttctgatgctttatttgaacagatgattagctcctttattaataccagttttatcctaggcgcaatagtatttggattagctttaccaggcttattgttttatcgacaaaaacctgtggtgtaacactaaaaacagtgcaacaaaaaagccgacatttgtcggctttctactattcttgtgattttttcttgaggtattcataaagctcatctttaatccgtaatttttcttttttcaaataacgatttccattttgtaatcaattcattatttaatgtttggcgcgcttgattattcacataacgaatgtattccacaaaaagttgatcctcttctttacgatcaaaagaggatagaattaattgattaagattattttcttgagaaaacttaaaatgtgaggcaatttgctgaacagtttcattttcaactttagctctcgctttcacaaaatcagattgatttaaaaaagccactaattgagcggatgaagtaagaatttttgtaaattcatgatacgcagaatctgtcgccttacgctcaatttttaccatatcaacggcatcagcatcaccactaactaaatggggcgtggattctaatacaaagtgcggtcaatttttctttatttttatacgttggcttttaaactggtttatttgaagaaagcacgctagaataagattgttttcatttcaacgaaaaaagtaaggaaattctatgatcgatccaaatttactccgtaataatttagcagaagtcgcagaaaaattaaaagtaaaacgcaactttatgcttgatacggaaaaactcaccgcgttagaagatcagcgcaaaaacttacaagtcactaccgaaaacttacaagcggaacgtaatgctcgttccaaagccattggtgctgctaaagtgcgtggtgaagatatcgcaccattattggcagaaatggatgatatgggcaatcaattgactgaagcaaaagcacaattagatgcggtacttgcagaaatcaatcaaattgcattaagtattccaaatctacccgcagacgaagtgccattaggcaaagatgacacagaaaataaagaaatcttacgttggggtacaccgcatacatttgattttgaagtgaaagatcatatcactttgggtgaagaagcaaatggcttagattttgctgctggggctaaattagctggtgcgcgttttgccgtaatgaaaggtcaaatcgctaaaatgcaccgcgcattggcacaattcatgttagatcttcatactgaacaacacggctatttagaaacctatgtgccttatttagtaaatcacgcaacactttatggtacagggcaattaccaaaattcggggaagatttattccatactttagccttagaaggcgaacaaccttacgcattaattccaaccgcagaagtgcccgtcactaatttagtgcgtgatgtaattattgatgaagcagaattaccaataaaaatgaccgcacatacgccatgtttccgttctgaagctggctcttacggtcgtgatactcgtggtttaattcgtatgcaccaatttgataaagtagaaatggtacaaatcgttgatccagataaatcaatggaagcacttgaagaattaacaggtcatgcggaaaaagtattgcaattattaaatttaccataccgtaaagttttactttgcacaggcgatatgggctttggttcttgcaaaacttacgatttagaagtttggctgcctgcacaaaatacttatcgagaaatttcttcttgctcaaatatgtgggatttccaagctcgccgtatgcaagctcgctgtaaagcaaaaggcgataagaaaactcgcttagtgcacacattaaatggttcaggcttagcggttggtcgtactttagtggctgtacttgaaaactatcaaaatgccgatggttcaattaccgtgccagaagagctacgtccatatatgggcggattagacgttatcggaaaataatccttctagaagataaaaaagcgtggattttaaaatttccacgcttttttattatcaaagccttacaataactgttttaaattttttggcattcaagccaattaggaactttattctattataaaattatatctataacatagaaaatttatctttcaattgacatcaatatccagagcattactctaaaaaacatatcaaagtatctaaattgttataatattagttcactttacgattaaacaatagtaagaagcaattttaataagttagatattccacgtataaaacagtataattccatcaatagatcataaaccaacaggagtattttatgaaattatatggtttaattggtgcgtgttcatttgttccacatgtggcattagagtgggtaaaaatacgtgaaaatgctgattatgaatttgaacctgtcactcgtgagttaattaaatcacctgaatttttatcattgaatccacgcggggcagtacctgtattagttgatggcgatttagttctttcgcagaaccaagcgattttgcactatttagatgaactttatcctaattcaaaattatttggtagcaaaaccgtacgtgataaagccaaagcagctcgctggttagcattttttaattccgatgtgcataaatcatttgtgcctctgttccgtttgccaaactatgcaaaagataacgaaacacttgcacacactattcgccaacaagcagtagagcaaattttagatcaacttgcagtcgcaaatgagcatttagaaagtcacatttattttggagaagatatttccgttgcagatgcctatctttacattatgctcaattggtgtcgagcagtgggtatagatttcagccacttaacacaactttcggcttttatgcaacgtgttgagactgatcaagctgtcgaaaatgtgagaaaaagtgaagaactaaaagtataaacaggaagtttctacaaaaattgcccgtttttaaccgtttgtatcacgttaagtttaaatttaagtgagtaatttcgcttcttacccaacacagctaaccaattgattctactatgattaaactggttaatccaatgtcgcaatgttctactgtcaagttgaaaatgtttactgatgagtgaataatttttaccattttgaatataaaattcgatgacttgttgtttgaaaagagtgttgtatttggctataaaaaatctgcatcttacaattaatttatataagtaaaaatatcttgcttttatcatcgttaaacttagaataaatataaataattatcattaagatttaagggtatatatgaatattttaattaataaacgtatctttttattagttacccttgtaggtattcaactaaatgtaaccgcaaaacaaaattcttctaattctaatagagaggagttattacctattattgtgaacactaatgatgatagtaataaactacctggtcgttcagtattaaaacagaaaaatatcgaacaacaacaagctgataatgcagcaaacttaattaatatcttaccaggtgtgaatatggctggcggatttcgtcctggtgggcaaacattaaatattaatggaatgggtgacgctgaagatgttagagtgcagttagatggggctacaaaaagttttgaaaaataccaacagggttctatttttattgagcctgaattattaagaagagtaacagtagacaaaggaaattattctcctcaatatggtaatggtggttttgctggaacagtaaaatttgaaactaaggctgctagggatttcttgcaagaaaaccagaaaataggtggttttttaaagtatggaaataatagcaataataaccaaaaaacttatagtactgcactagttttacaaaatgaacaaaaaaatattgatttattattatttggttctgtaagaaatgctggcgattataaaagacccgataatagcaaaattcttttttcaaaaaataatcaaaaaaccggattaataaaagtaaattggcaaatttcacccgagcatttactcacattatcgagtgtttatggtattcataaaggctgggagcctttcgcagcaaaaagagatatcctacctaaaccaagttcgggtgatataatgcgttatggtgctgatattgcttggaaacgtaaactggtttatcgagatcaaaaagataaaaattacacattaaaatacaactatctacctgaaaataacccatggattaacttatctactcagttcagctacagtaaaaccacacaaaatgatactcgccccgaaaaagcccctcctgtatttctgggtacactcggtaatcaaagctggataacttattcagatcttacttttgatataaataacacaagtacttttaatatcaaaagtactcggcatgaactactatttggtttgcaatggttaaaaaacacaagaaatactttaatgtacgataaaagtaaagtgaaaaaagaggactataattatggctattttcaaccttattatatgccttctggacgtcaatatacacaggcactttatttacaagatcaaataacatggaagaatataatttttagcacaggagtgcgttatgaccatatcaataatatagggcagaaaaattttgcaccacaatataatgatatatctgtggggcagaattatagtcagaaaaattataatggctggtcttattatttaggtcttaagtatgatgtaaaccattatttaagtttatttacaaattttagtagaacttggcgtgcacctgttattgatgaacaatatgagacgcaatataagcaatcttctgggcctgtaacagcaacctctttaaatttagaaaaagaaatgattaatcaaacgagagtgggtggaattattactctcaatcatctatttcaggaaaatgatgtttttcaatttagaactacttatttttacaatcgcggcaagaatgaaatatttaaaaccagaggagttaattgtgtaggcaatgctgcagataccaatcatgtttgtcctaaaatcattggaaattatcgtaatttgccaggttatgttattcaaggtgcagagttagaagcttattaccaatctacttatttatttggtgagataacatattcttatgtaaaaggaaaacgtgacacctcaccaagaaacccatggggtaaaacctcaacatggattgcagaaataccccctagaaaagcaactactgctttaggttttaatattcccaaatataattttacagctggctggcgtgctgagtttgtaagaagacaagatcgatcaccattatctggtgaccctgaagcaaaatattggtcattgccagcttcaagaggatatagcctacataacctattcctttcttggagccctgcaaaaattaaaggtatgaatattaagattacagtggataatttattcaatcgagcatacaacccttatctaggcgaattggcttctggaacaggtagaaatatcaaatttagcctatctcagaaattttagaataaatagcccgattgaatctaatcgggctttatcataactataattaagcaaaacctaactataatgtccattatacaagattaatcataaatatacttttttgaaaaaaatttacagaaaatttatcttaatataggagatatattaagataaatacatcattaaagaatgtagagataataggtataatcccctatactaattttagtattctttgaagagcaaatttaaataataaatccaaaataaatacaatatctgaaattatagatgagtattaaaattatattttatctttaccctattactattcataatagaaactaaactcacctaaaaatttaaatataatttaatgtctagtctaacaacaaagccaacgcatatttattcttgtttttctttctttccgattaatatcattagttttcacaaatatcactattcaaaacgacaccttatgtcttactaacttttctaatataagaatatcattagaataaactattaagaagaaagttaaagctccagtattatgtaacaagttattaataatttgatataacttttcatataaaagcaatgtacctttataacataattacaatgtatcctgttataaatttatagcaatgtcctaaatagtaaagagtacgaacaaaatacatataggttattaattactttaaaaatattagaatatatttatagatttaggaataattacatttatctatcaaagtatggttaatctagagaaattttttacagcaatacaacaaccttacaaagaattcaaatattctgatttttaggaaaaaacaaaaaccctagtttttcaactggggttattttttctttatctaatttttttaattttaattctgtttttacttaatttaattttatctgtcttagatagatttatatttagatttttatttggtaacccggcggtgccctactctcacatggggaaaccccacactaccatcggcattacagcgtttcacttctgagttcggtatggtctcaggtgggtccaccgcactatcgccgccaggataattctttgataactcgtcttctcttttatctctcgtctcttttatctctcgttactcagtctttcctctacctttcactcgttcttattggtcacaagctgaactcaattttctttctattaagtcttctatacttacttttctttgtttagtcttttacttcggtttccgctctacttttatttgcttcgcttttcatctcttacttcacttagctcccaaaaacacttgagcgttgtatagttaagcctctcgggcaattagtatctgttagctcaatgtatcactacacttacacacctgacctatctacgtcgtagtctacaacaacccttactgacttaaagtcagggatgactcatctcttggcaagtttcgtgcttagatgctttcagcacttatctcttccgcatttagctacccagcaatgcctctggcgagacaactggaacaccagtgatgcgtccactccggtcctctcgtactaggagcagccccaatcaatcatccaacgcccacggcagatagggaccgaactgtctcacgacgttctaaacccagctcgcgtaccactttaaatggcgaacagccatacccttgggacctacttcagccccaggatgtgatgagccgacatcgaggtgccaaacaccgccgtcgatatgaactcttgggcggtatcagcctgttatccccggagtaccttttatccgttgagcgatggcccttccattcagaaccaccggatcactatgacctactttcgtacctgctcgacttgtctgtctcgcagttaagcttgcttataccattgcactaacctcacgatgtccgaccgtgattagcaaaccttcgtgctcctccgttacgctttgggaggagaccgccccagtcaaactacccaccagacactgtccgagaccacgtttcgtcatcttcgttagaacatcaaacgttaaagggtggtatttcaaggtcgcctccacaatgactggcgtcactgcttcaaaggctcccacctatcctacacatcaaaattcaatgttcagtgtcaagctatagtaaaggttcacggggtctttccgtctagccgcgggtacaccgcatcttcacggcgatttcaatttcactgagtctcgggtggagacagcctggccatcattatgccattcgtgcaggtcggaacttacccgacaaggaatttcgctaccttaggaccgttatagttacggccgccgtttactggggcttcgatcaggtgcttctcttgcgatgacaccatcaattaaccttccagcaccgggcaggcatcacaccctatacgtccactttcgtgtttgcagagtgctgtgtttttaataaacagttgcagccagctggtatcttcgaccggttcaaccttcgcccgctagggactacaatctacgccggcgcaccttctcccgaagttacggtgctattttgcctagttccttcacccgagttctctcaagcgcctgagtattctctacctgaccacctgtgtcggttttcagtacggtttagtaaagcctttcgcttagtggcttttcctggaagtgtggtatcagttacttcagctccgtagagcctcgtcatcatctctctgtgttaaggaagtccggatttgcctaaacttcccacctaccaacttaaacgcacatatccaacagtgcgataacctaacctactccgtccccacatcgcagctttaccaagtacaggaatattaacctgtttcccatcgactacgcttttcagcctcgccttaggagccgactcaccctgccccgattaacgttggacaggaacccttggtcttccggcgaacgggtttttcacccgttttatcgttacttatgtcagcattcgcacttgtgatacgtccagctaacctctcgattaaccttcatccgcttacacaacgctcccctacccaacaggcgtatcactaataatccttacttcaaaaataccccgactcaacgttcgggttgcttgaacaacctttcatgccgcttcgcgccattctagcttgttaatcgtaaggcgtattagtgatacgcctgatgccgcagcttcggtgctatatttcagccccgttacatcttccgcgcaggccgactcgactagtgagctattacgctttctttaaatgatggctgcttctaagccaacatcctagctgtctaagccttcccacttcgtttcccacttaatatagacttggggaccttagctggcggtctgggttgtttccctctccacgacggacgttagcacccgccgtgtgtctcctgagtatcactctttggtattcgtagtttgcatcgggttggtaatccgggatggacccctagccgaaacagtgctctacccccaaaggtgtcacctcaaggctctacctaaatagatttcggggagaaccagctatctcccggtttgattggcctttcacccccagccacaagtcatccgctaatttttcaacattagtcggttcggtcctccagttagtgttacccaaccttcaacctgcccatggctagatcaccgggtttcgggtctataccttgcaactagacgcccagttaagactcggtttcccttcggctcccctattcggttaacctcgctacaaaatataagtcgctgacccattatacaaaaggtacgcagtcaccccatcacttaatcccactgcttcttttgggtggtttgactcgcttcgctcctcttaccattgtttaagtgcggttgcttttcatcaccttccaatcggattaagtgatggggctcccactgcttgtacgtacaaggtttcaggttctatttcactcccctcaccggggttcttttcgcctttccttcacagtactggttcactatcggtcaatcaggagtatttagccttggaggatggtccccccttcttcaaacaggatatcacgtgtcccgccctacttctcgttagcttagtaccacaatatggtttttagatacgggattatcaccctctttgattgtgcttcccaacacattctcctcactatactgctatcacttactggctctttcgctttcgctcgccgctactgacgaaatctcggttgatttcttttcctcggggtacttagatgtttcagttctcccggtttgcctcaacaagctatgaattcacttgttgatagtagattcttcatctactgggtttccccattcggatatcttggattaaacgcctcttatcgactcatccaagcttttcgcagattagcacgtccttcttcgcctctgattgccaaggcatccaccttgtacgcttagtcacttaactatacaacctcaaatgttttcaatcactttacgttttcacttcaaagtgcggtcaatttgatgcgtatttttattcaactaaacacttgattgcttttgttcaatcaagatttttttacaaaacaggtttgtttttagagtttccttttcagttctctctttcactttcctgtcttgcctactcagactttctctcgaaaatctcttgttttcagcttgtttccaattttttaaagaacagtaagacaatctaataaagttatctttaattggcgtccccacggggattcgaaccccggttaccgccgtgaaagggcgatgtcctaggcctctagacgatggggacatcaattaaagatactctattttctttttatcttttaacgtttatttttcaacgttgctttcgcttcgtttttaatcttgtctacaactatcagccaatctgtgtgagcactcgctgtctctcgtcttcagtaaggaggtgatccaaccgcaggttcccctacggttaccttgttacgacttcaccccagtcatgaatcataccgtggtaaacgccctccaaaaggttaagctatctacttctggtacaacccactcccatggtgtgacgggcggtgtgtacaaggcccgggaacgtattcaccgcgacattctgattcgcgattactagcgattccgacttcatggagtcgagttgcagactccaatccggacttagacgtactttatgagattcgctccacctcgcagcttcgcttccctctgtatacgccattgtagcacgtgtgtagccctactcgtaagggccatgatgacttgacgtcatccccaccttcctccagtttatcactggcagtctcctttgagttcccgaccaagtcgctggcaacaaaggataagggttgcgctcgttgcgggacttaacccaacatttcacaacacgagctgacgacagccatgcagcacctgtctctaagttcccgaaggcacaagctcatctctgagctcttcttaggatgtcaagagtaggtaaggttcttcgcgttgcatcgaattaaaccacatgctccaccgcttgtgcgggcccccgtcaattcatttgagttttaaccttgcggccgtactccccaggcggtcgatttatcacgttagctacgggcgccagagttaaaccccaacccccaaatcgacagcgtttacagcgtggactaccagggtatctaatcctgtttgctccccacgctttcgcacatgagcgtcagtacattcccaaggggctgccttcgccttcggtattcctccacatctctacgcatttcaccgctacacgtggaattctacccctccctaaagtactctagttacccagtctgaaatgcaattcccaggttaagcccggggctttcacacctcacttaaataaccgcctgcgtgccctttacgcccagttattccgattaacgctcgcaccctccgtattaccgcggctgctggcacggagttagccggtgcttcttctgtatttaacgtcaatttgatgtgctattaacacatcaaccttcctcaataccgaaagaactttacaacccgaaggccttcttcattcacgcggcatggctgcgtcagggttccccccattgcgcaatattccccactgctgcctcccgtaggagtctggaccgtgtctcagttccagtgtggctggtcatcctctcagaccagctagagatcgcaggcttggtaggcatttaccccaccaactacctaatcccacttgggctcatcctatggcatgcggcctctcagtcccgcactttcatcttccgataatacgcggtattagcgacagtttcccgtcgttatccccctccataagccagattcccaagcattactcacccgtccgccactcgtcagcaagaaagcaagcttcctcctgctaccgttcgacttgcatgtgttaagcctgccgccagcgttcaatctgagccatgatcaaactcttcaattcaagttcaatcgctcaataaactacttagctataaatagaaacactacttaaaaaagtaatgatgaattttcagttaagcacctattaagacttcaaaattaaaaaatatttttaaaacaagtcaatcaacaagtgcccacacagattgtctgatatattgttaaagagcaaaataaagtggtcggcgagataggatttgaacctacgacccactggtcccaaaccagttgcgctaccaagctgcgctactcgccgtcagatcttataaagataagatggggtggctaatgggattcgaacccacgacaactggaatcacaatccagggctctaccaactgagctatagccaccattaaaagttgttattgcactgacctggcgcgctcgacaagattcgaacttgcgacctttggctccggaggccaacgctctatccaactgagctacgaacgcgttactgcgtcgtcgttgcgggggcgtatattaatgatttcataaaaccttgtctagcactttttgaaaaaaaatgtttgagcgatagttttttattcagtttgtttaaaattcactattttttcgactatttttacaacttggcaaatcattatatatgttgaatcatccaacaattatgaatttgtttattacgttcaaaatctaacggtaaggttttatgcgaaatttctaccgcacttaaacctaattcttccaacgcaactaaattcattttgaatccacgtttattattcgagaaaacaattgtgccattattcgacaaaactcgttttagattgcgcattaatttcacatgatctcgttgcacatcccaactgtcttccatacgtttagaatttgaaaacgtcggtggatccacaaatatcaaatcaaattgacgatcacatttttctaaccattgaaggcaatctgcttgaattaatttatgttgtttaccttcaatatcattcaaaataagattttgctccgcccaattaagataagtattggacatatcaacggtcgttgtcgatttagcgccaccaagtgccgcatgaacagttgcagaaccagtataagcaaataaatttaagaaatctttaccttttgccaacgctccaatcatttttcttgttaaacggtgatctaaaaataagcccgtgtctaaataatctgtcaaatttacccaaagctgcgcgccatattcattcacataaaagtattcgcctttattggctaatttctcatattggttagtacctttttgtttctgacgaactttgaggatcaacttattcgtttctacacctgtaacgtgcaaagttgcagtaaccgcatctaacaaacgctgacgcgctttattttcatcaatatttttcggtgctgcatattcttgcacaacaatgtaatctgcataacgatcaacggctaaattatattctggcaaatcggcatcatataaacgataagcgtctaatccttgttgctttgcccatttactaattttcttaatatttttttgtaatcgattagcaaaatcggttgcaacctccgaagtgcggttaaattctagttcattttcagcggtaatttcgtcagattttcgttctgaaacttgataattcttctgcacacaatctaatgggccatttttggctttaaactgtcggctggcacgcattctcaaacaatcaagtaatgtggattcgctactaaaaacagaaacattccaaccacaaaattcttttttaagtctttgcccaaatacagaatagagcgcgatcaatgctggggttgtgcctaagcgttccccataaggtggattacagataaccgtaccgacttcatttaaacgaggatttttcaacgctgcaacatcaccttgctgccatttaattaaatgtgaaacacctgcattttgtgcattcttttgcgccttttttaatacgcggtgatcgaggtcaaatccataaaagtgcggttgaatttcacgttgtttttcttctgctaattcaatcgcttcattttttactttttcccaagccgattgattatgcgctttccaaaaatcaaatccccaatgtaaacgataaagttgcggtgcaattttggcttccatttgtgccgcctcaattaaaagcgtgccagagccacacattggatctactaatggagaacccacttgccaacctgaacgcagaacaattgccgcagctagagtttcacgtaaaggagcttgacctgcatcttcacgatagcctcgtaaatgtaatgcttccccacttaaatctaaagaaatcactaaattttcacgattcaaataagcatggatacgcacgtccggctgaattttatctacatcgggacgagctttaccttgacgttcaaagtaatcgacaattccatctttaacgcgcatcgcaccaaattgagtatgacgaatttcttggttggttccattaaaatcgacaaagaatgtaactctttcatcaaatagccctaaccaattaaagcctgaaacagccgcataaagatccaaatcactgtaaattttagtttcaatcaaaggaaataaaatgcgtgaagcaaggcgtgaccaaagtaaagtgcggtataaagtttcgtcatctgcttgataatgaacgccaccttgaaccacttttgcctcttgcgcaccaagttcagtgagttcaacttttaataattcttcaaagccacgagaagtcgttgcaaataattgtttcatttaggtaccgattttgaaaattttgagggattatagcatagaaaaagatgatctaattgagatcatcatagcgagttaaactgtaaaaagaaaagccctgattttctaaatcagggcttcaaaatttgctggttgcgggggccggatttgaaccgacggccttcgggttatgagcccgacgagctaccaagctgctccaccccgcgtctgatgaggcgtactatactcgcttaaaatttaattgcaagaattaaacaaaactttatcaattgtttgttaataaaatgttcaatgtgtagttttattaagcaatttcactaaataacactggttgttttctgtaaattttgatagcgtatgcgaccttatttctgcttactttaggattgaaaatgtcggtgtgtaaaccattttggttcaaaactttttctatctcaattattaccgcacttttggtgtcttgtacctctaacataaaaaacattcagattcccaccaccttaaatggtagtgatcctcaacaattcggtgcaaaatataccaatcgaacttatcagcaagcagcgcttgtgcctgtatccaacatagaaaaccaaagtgcggtaataaatcaaggcgattttttaacacagctttccaatataaaaaattattcgagtaaactttccaccaatttttacgacaattatgaaaagattacaaattgggttctttctggggcaaatattaatgaactcactcaatttaatatccatccgcaaattatgcgtggatttgatgggtatcaaaatgtactgatgacaggctattattcgcctatactttatgctcgtcataccccacaaggtcaatttaaaaatccaatttatcgtatgcctgtaaaaaaacgtctaagtcgagcacaaatttatgcgggcgcattaacgggaaaaagattagagttagcatatagcgattcaatgttagaaaactttttacttggtgtacaaggcagtggctatgtagattttggcgatggtaatcttaactattttgcttacgcaggacaaaatggttacccttacacggctatcgggcgtttattagtagaagatggcgaaattccaaaagaaaaaatgtctattcaagcaattcgagaatggggtaatcgtaatccctctcgtgtacaaagcttgttagaacgcaatgaagcttatgtattctttaaaaatgatccaagtggcaaagtgaaaggctctgcgggcgttcctcttgtagcaatggcttcagtggcatcagatcgcaatattatcccgtctggttctgtgcttttagtcgaagtacccgacattgataataacggaaactggattggcacacacaaattacacttaatggttgcacttgatgtaggcggtgcagtgaaaggtcatcactttgacttatatcgtggtatcggtgctagagcaggacatattgcagggctttcaaaacactacggtagagtatgggtattacggtaatggctagaatagataattacgaacaacgctttggtggcattgggcgactttatacgcctgatggcttagcgcgcttacgccaagcgcatatttgcgtaataggcattggtggcgtgggttcttgggtcgtggaggccttagcacgttcaggtatttgcgaactcacattaattgatatggatgatatttgcgtcacaaatatcaatcgccaacttcctgcgatgagcggcacaatcggcaaattaaaaactgaagtcatgtcagagcgagtaaaattaattaacccagaatgtaccgtcaatattattgatgattttatctcgccagagaatcaatcggattatctcaaccgaggctatgactacgtcattgatgccattgacaatgtgaaaactaaagcgtcgctgattgcttattgtaaacgtaacaaaattaatgtgattactattggcggtgctggcggtcaaactgatccaacccaaattcaaattgccgatctcagtaaaactattcaggatccgctgctcgccaaagtgcggtcagttttacgcaaggattacaattttagccaaaatccaaagcgcaaatttagtatcgatgcggtattttcaacacaacctttaatattcccacaaatgactgaaggctgttctacttctgccacaatgaattgcgcaaacggatttggtgcagccacgatgattacggcaacctttggtttttttgccgtttctcgtgtaatagataaattactaaagaaaaaatcttaatcacctcttgaaaatgcacattgaccataaatgtgcattttttattgaatgaaacctattgactttgaaaatgaaaaattttccctctttttactataaaatcgttgcaatttatataaaaaggcgtactcttttttccctttgagaattactaccaacaagtaaggaaacataaatatgaaaaaacttttaaaaattagtgccgtttctgccgcacttttaagtgcgccaatgatggcgaatgccgatgtattagcatcagtaaaacctttaggctttattgtttcatctattgcagatggcgtaactggtacacaagtccttgttcctgcaggcgcctctccgcatgattacaatttgaaattatctgatattcaaaaagtaaaatctgcagatttagttgtatggattggtgaagacattgattcattcttagacaaaccaattagccaaattgaacgtaaaaaagtgattaccattgccgatcttgcggatgtaaaacctttattaagtaaagctcaccacgagcatttccatgaagatggcgatcatgaccataagcacaaacacaaacatgatcataaacacgaccacgaccatgatcataaacacgagcataaacacgatcacgaacatcatgatcacgatcatcacgagggtttaacaacaaactggcacgtttggtattctccagctatcagcaaaattgttgcacaaaaagtagcggataaattaactgcacaattcccagataaaaaagcgttaattgcacaaaatctttcagattttaaccgcactttggcagaacaaagtgaaaaaattacggcacaacttgcaaatgttaaagataaaggtttctacgttttccacgatgcttatggttatttcaacgatgcttatggtttaaaacaaacgggttactttaccatcaatccattagtggcaccgggtgcaaaaactttagcgcacattaaagaagaaattgatgaacataaagtaaattgcttattcgcagagcctcaatttacgccaaaagtgattgagtctttagcgaaaaatactaaagtcaatgtaggacaactcgacccaattggcgataaagttactttaggtaaaaattcttatgcaacattcttgcaatctactgcagatagctacatggaatgtttagctaaataaatctttctaaaaacaatgaccgcacataaaagtgcggtcattttctttgctaaatttgatatttagttttatctccaatatcaaaatgcaaaggcattcgccatttttgtatcgctaaaactaaaagtaatacgccagaaataatagaaaaaatgcgtagtgcaataagattatttaacacccacgaaaaccacaagcaagccacaaatatcggctgtaaatttagcaaaggcacgcggaaacaaaaatattctttaaaacacaagccacctaaagtaagtaacgcaccgccaagagccaacgcaggataatgattaatataaaaaagtaatcctatccaagtagcaaattgaaaaagcaatcgaaaagattttaagtaaatgtgtaacgaagaggcacaacaggttgccgcaattaatataaatgtgagtgataaatctggataccaactcactgtaagaacagccaacgccgctatcacaaaaccagttcggtaaataataacagtcagataatctaaaaaatccatcggtgatttaatatgtggatcagccattgtataaatgttcctttttatgaattacaaattaaaaataaatatagcctaaaagtcagaaataaaaagtacagtcaatttagaaacaggttctaaattaaccgcacttttattatttcagttttagcttatcaagaattttttgatgaatgccaccaaaactgccgttagacatcactaaaatatgatccgtaggttgagcctctgcaacaatcatatccactaatcgatctaaatttgcattccaataagcaggttgtacacattggtttgcaatatctgccacttcccaagaaagttgttcaggttgaagcataaacacggcatcagctcgaccaagtgcaggcgcgatgtcatctttgtgaacacccattttcattgtgttagaacgaggttcaagcactgcaagaatacgaacaccaccaactttatctcgtaaagcggttagcgtagcaagaatagcttctggatgatgagcaaaatcatcataaaccgtaatgccattaacttcacctttcacttctaaacgacgtttagcattcacaaaagatcccaacgctttgcacgcatcttcaatagcaacgccagtatgatgagccgcagcgatcgccattaacgcattatgcatattatgttgtcccactacattccattttacttctgccactttttctccatgatggaagacagcaaaatgtgaagcatcatttgtaatacgttcagcaaaccactcgttatctttgcctaaaaattgctgttgagaccaacatcccaatgccaaagtttcttttgcactttgttcactcgccgaacttaataccaagccactggctgggatagttcgaatcatatgatgaaattggcgttggatcgctttgagatcatcaaaaatatctgcatggtcaaaactaatgttatttacgataagtgtacgaggattgtaatggacaaatttcgaacgtttatcaaagaaagctgtatcatattcatcagcttcaataacaaaataagggctatctcctaaacgagctgaaatgccaaaattacccgcaattcctccgattaaaaaacctggttttaagccattttgttctaagatccacgttagcatacctgttgtggttgtttttccatgcgtacctgaaatcgccaatacccaacgatctcgcaataaatgatcatgtaaccattgagggccagatgtatatttcaaattattttccaacacatattctacgcaaggattaccacgtttcatcgcattaccaacaattaccatatcaggcgcaggttgtaattgtgcaacatcataatttggaataatctcgataccttgctcttctaaaaaagtgttcattggagggtaaacattagtatcggaacccgttacgtgatagcccatttgtttagcaatcatcgccacaccgcccataaatgtgccacaaatacctaagatatgaatatgtttcattgtatttctctgttgattaaggaaaacgaaaaatatgataaaacaacttctatgaactttcaaaagaaaagaccatcataccaaactatatgatctataattaacgccactgaactattatttaaccacttcaataggaataaacaatgaaatttaagcgataaaacaatttcagaagcacaatagctcactatttacaaagaaaataatcagccgttctatgtagcaaatcttcctgcattacaatttggaaaaagtattcaagtcgatattattgggacttcaattcattttgctgacggtacccaaattggtttagtttcagaacaaaaataatcctataaaaaatgcctgtgtaaaacaggcatttttttatccgcacttttaagcaattcgctcaaaaccagctttcaaatctgcaattagttcatccacattttcaaaaccaatatgcacacgaattaatgaacctgtaagattacgtttaatatttggacgaatatgtgcaatttcttctggttgattacaaagaattagagactcaaatcctccccatgaataagccatagcgaacagttgaaaatgatccataaattttgatacttgctctgaagttaatcgctgggttaattcaaaagaaaataaaccactgcttccactaaaatcacgtaaaaagaattcatgaccagggcaacttggtaaagctggatggtacacagtttttacttctggttgctcactcaaccattttgccactttaatactgctttcctgatgttgttttaatcgtacccccaatgtacggataccacgagcagtcgtataagcagaatctgcatcaaccatttgccccattaaataggaatgttctctaagttgatcccaagttcgcgcattcgcaacggcagtaccaatcataatatctgaatgacccactaaatatttcgtacccgcctgaatagaaatatcaatatcatgctctaacgctttaaatagaacacctgccgaccaagtattatcaatcataatcacaatattagggttcacctttcttgcagccttcacaatagtcggaatatcgggaatttccattgtaatagaactcggtgcttctaagaaaagtacttttgtattcggttgaataagcgttgcaatatccgcaccaataagaggatcgtaataagttatatcgatctgcatttttttcagcacaatattacagaaatattgggttggctcgtaagctgcaccactcattaacacatggtcgccagttttaacaaaagaaagaatcgaattagttactgctgctgtaccacaaggataaagataacaacctgcccccccctccatttcgcacattaaatcttgtaaagcaaaatgtgttagcgtccctcttctgccataaaataattcgccttttgctctacgttgagtagcgtgttttttatcttcaatactgtcaaatagtaatgaagaagctcgctgtaaaacagggtttaccgatccttgtgaaaaacgtttttgacgccctgcatggacaaatgttgttgagagattgtgttgttgcatatttccaccttattttagataagattaattgctttaatagataaaatcgagtataaaatgtcggcgtttcaaatagaatcgcaccgctattttgtgtggcaaaactttaacttaactttatataggaattatgactatggtattagtaacccgtcaagcaccagattttacttcatctgctgtattaagcaatggcgaaatcgttgataacttcaactttaaaaaacacattgctggaaaagctgcagtaatctttttctacccattagactttacctttgtttgcccttctgagttaatcgcatttgaccaccgttatgaagaattcaaaaaacgtggcgtagaagtagttggtgtttctatcgactctcaattcactcacaatgcatggcgtaacaccccaactgaaaatggtggtatcggtcaagttaaatatgcattagcggcagacgtaaaacacgaaattgctcaagcatacggtattgaacatccagaagcaggcgttgcattacgcgcttcattcttaatcgacaaaaatggcgttgttcgtcaccaagtagtaaacgatcttccattaggtcgtaatatcgatgaaatgttacgtatggttgatgcattacaattccatgaagatcacggtgaagtttgccctgctcaatgggaaaaaggtaaagaagggatgaaagataaccctgaaggtgttgcaaaatacttaaaacaaaacgctgataaactttaatccgtaattatttacaagaaagccacataatgtggctttttttatattcttagatactttagaataggcatatctctaacaccaagagcggttcatttctatgaaattcaatatcccaattttcctaacgatctttcgagtcattttgattccttttttcgtgattgcattttatttacccattgaatcatctcctttcatcacaacactgattttttttattgcaggtgtcactgactggctagatggctatctagctcgtaaatggaaacagaccacgcgctttggtgcatttcttgatcctgttgctgataaagtaatggtagtggctgcactagttttaattgtcgaacatcaacatacattttggataaccattcctgccattattatgatttctcgtgaaattatcatctccgcattacgtgaatggatggcagagcttggggaacgtagcaaagtcgcagtctcttggtggggaaaatggaaaaccacagcgcaaatgttagcactaggcggattattatggcgttataacaactatatggaaatagcagcaattatcttactttatatcgccgctattttaactatatggtcaatgatccaatatttacaagtagcaaaaggaagcttgctagataatattcaattataaatttaaataaaacacagttattttttatgataaccatctatatttgagttatttttaatcaaataaaatattttttatttttttcgtttgacagcaatatataaatccgtaaaatacgccccgttgtcacgtagcagtgctgattagtgataaatgcgggaatagctcagttggtagagcacgaccttgccaaggtcggggtcgcgagttcgagcctcgtttcccgctccaatttgcccgagtggtggaatcggtagacacaagggatttaaaatccctcgcctttcgaggcgtgccagttcaagtctggcttcgggcaccatttaaacaccaatcaaaagatttgaaaatttattttaaaatcatctaattgggtcgttagctcagtcggtagagcagcggacttttaatccgttggtcgaaggttcgaatccttcacgacccaccactttaaaaataaagtaagcaccgaaaggtgtttttttattatctaaatctctgaaactcatataaaaaatccccgactcaaagaatcagggacttttacaatcaaacgtctttaattaacgctcattccaacgtttaatagactcacgaatcacttctttcgcttcttctacatcgccccaatgggtcactttcgttgagccaggtttcttaagcgctttatagttattgaaatggaactcaatttgtttaattaagtttgccggtaaatctgctaatgaattgtaggcatttcctgtatcacgatcatctgcaggaacacaaacgattttatcatccacttcgccatcatcaacaaatttcatgacaccaattactttagcctcaaggaatacacctgttgctaatggttggcgagtgattaataacacatctaactcatcgccatcttcatctaaagtttgtggaatgaaaccatagttagttggttttgcaaaaattgctggctcaacacgatctaactggaatgccgcaactttacggttccattcgattttatggcagctaccttctggaatttcatttactacattgataatgccagcatctacatcgcctggcgttaaaatttgattaaaatcagccattttgtttccttcattttatcaagttaaaaaacgtgacaagtatagcagtttttctgctgactcgcagtctcatttgtagagaaaatcagcaaatagattatttcataactattcataattttgaccgcactttatcctaaataaaactcacgcaaacgtttacttctcatttttatgatgtaaaatagcgcaccttattacttccaattttttacttaacttcaaggaacactatgccaactttagaaaaaacatttgaactcaaacaacgtggttcaactgttcgtcaagaaattatcgcgggtttaaccacgttcttagcaatggtttattctgtcatcgtggtacccaatatgctgggtgctgcaggttttcctgcggaatctgtctttattgccacctgtttagttgcaggattaggctctatcttaatcggcttatgggcaaatgcaccaatggcaattggttgtgcaatttctcttactgcttttacagcatttagcttagtgattggtcaaaaggtcgccattcccgttgcgctaggcgcagtattcttaatgggggttgtgtttaccttaatttctaccacaggtatccgtgcatggatcttgcgtaatttaccatccaatatcgctcacggagcaggcattggtatcggactctttttacttttaattgccgcaaacggtgttggtttagtcgtcagcaaccaagctggcttaccagtaaaattaggcgatttcacttcattcccagtcatgatgtccttgattggcttagcgttaattattggtcttgaaaaaatgaaaattaaaggcggcattttatgggtaattatcgctattactatcgtaggtttaatttttgatccaaatgtaaaatttggcggagagattttcaaaatgccaacctttggtgaaaattctctcttcttacaattagactttatgggcgcactacaacccgcaatcttgcctgtggtatttgctttggtgatgactgccgtatttgatgcaacgggcactattcgcgcagttgcaggtcaagcagacttgcttgataaagatggtcaaattatcaatggcggtaaagccttaacttcagactcaatcagtagcttattctcaggcttattcggtacagcaccagctgccgtttatattgagtcagcagcagggacagcagcaggcggtaaaacaggtattactgctatcgttgttggtgtgttattcctattaatgcttttcttccaaccattagctttcttagtgccaggctacgcaactgctccagcattaatgtatgttggtttattaatgttaagcaatgtaagcaaattagatttcgatgatttcgttggtgcgatgagcggattaatctgcgcagtgtttatcgtacttaccgctaacatcgtaacaggtattatgttaggttttgcggcattagtaattggaagaatcgtgagtggcgatattaaacgcttaaatgtaggtactgtgattattgcaatcgtacttgttgcattctatgcaggcggttgggcgatttagtaacagaaataagaaaagggaaaatccttccccttaattttaatcacaaaagtgcggtgaaattttaccgcactttttttatacgcagtactactctttcttcaataagaaaataccgtgatgaagttcacagtttttaaaattcaagtgaaaaaataaacgtgaaattcaccgcacttttctttataattgcgtgaattttccttacatcgaaacacgattatgtcaaatccctcttgtatcatcatcgccatcacaggtgcatctgcatcaggcaaaagttctatcgcttccactgttcacaaagagctctgtaatgaactaggctgccaagaaattggtatcattactgaagacagttactataaagatcaaagtcatttagaaatgactgagcgggtaaaaacgaattacgatcatccaaactctatggatcgcgatttacttatccaacatttaaaaaatctaaaaaatggcagtgcagtagatgtgcctgtttatagctatgtagaacatactcgcaccaacgaaacaacgcatttcacaccaaaacgaatcgtaattttagaagggattttattgctcacagacgaaagagtacgccaattagccgatatttctgtattcgtagacacaccacttgatatttgtttcatccgccgtttacaacgtgatatggaagaacgtggtcgctctctacaatcagtgattgatcaatatcgtgcaaccgtgcgtccaatgttcttacaatttattgagccatctaaacaatatgcggatattgtcattcctcgtggtggtaaaaaccgtattgcaatcaatatgttaaaagctcaaatccttcatttattgaatcaaaaataggaaatcttatgcgtctttgcgatactgatattgaacgctatctcgatgatggcattatttctttaacaccacgtccaaataatgacaaaatcaatggtgcgacaattgatgttcgcttaggtaattctttccgtgtatttcgtgaacactctgcacctttcattgatttaagtggcccgaaagaagaagtatccgcccagcttgaatcagtaatgagcgatgaaattcttattccagagggggaagcatttttcttacatcctggtactttagccttagcaaccacgcttgaatccgtgaaattgccagccaatattatcggttggttagatggccgttcttctttagcccgtttaggcttaatggtacacgtcaccgcacaccgaattgacccaggttgggaaggaaaaatcgtgctggaattttataattcagggaaattaccattagcattacgcccaaatatggtaattggtgcgttaagttttgaagtattaagtggcgaagcaaaacgaccatacagtagccgcaaagatgcaaaatataaaaatcaacaaagtgcagtagccagtcgtattgacgaagacaaggaataatcaatgaaaaagttcgcgcttatcgtagggatcgtcgctttggcgatcttttcttttttatatattcaactttaccgcgtgcaaagtgctattaatgaacaactggcacaacaaaacattgccgttcagtcaatcaatttatcattattttctcccgcactttcccttgaaaatctaaaaactacgcaattttcagctcaaaaaattgaagctaaatttagttttttgcctcttttgtatggaaacgcagcacttcattcactgaatattcaacagctcaaattaactcaaaacacacaaaatcctgccaatgtatcgatagaggtttcgcctttttcgttaaaacagcttttatcaaaaaaagtaatattaaatggcgaaaaccatattcgcattgaatttaataagcctatttatggaaaaacaaaaactttccatttttctttccataaagcgaatttagacttctcaacatcagaatcaaccccacttcaatttgtagatgcaagcctaaataatcagcctatcggttatattgaaagccacacagcccaccaacaaatagtgacttatataaaaccacaatgcgataacgattgtttagccgtattgaaatatcaacaaatagacaatcaaagtgcggtaaatttttcgggtaaatatttccctgttcaacgcttattcgcactattaaatttgccagaaattttaagtggacacgccgattttgatcttgatttcagcttttcatcttccgcgcttattcaaggtaaattaaattttttagcgcaaaatggcgaaattcttggtgtgaatctattggatatggtagcgcaatatttcccgattaattacaacaatgatctgttacaaaacaaagaattaaacactcgctttgaacaattttacttgcaattatttctccaacaaaatcaactcattgctgaaaaaatcgaattaaaaacgcccgcacttttggggcaaggaaaaggcatcattgatttaaatcgaatggaatgcaatgtggatattaatttaaattctacggatcaacgctatcaaaatttgacacttccaatcaatttttttggtaactgcaattctccacaatacaaaattaattttacgaagaaattccgccatcaattaattgatgcgattaaagaaaagttacgttaatgtcgttatatttaaaagctgaaaaaatccaatcatggcgcgtgcttattatggcttgcgcaggatttatttttaatactacagaatttgtacccgttgcaatgttaagcgatattgcacaaagttttgatatgcaaactgctgatactggtttaatgatgacagtttatgcttggacggtgctaattatgtctttaccagcgatgcttgccacgggcaatatggaacgtaaaagtctgcttattaagcttttcattatatttattgttgggcatattttattggtcattgcatggaatttctggatattacttctcgctcgaatgtgtattgcattagcccattcggtgttttggtcaattactgcctcacttgtgatgcgcatctcacctaaacacaagaaaactcaagcattaggaatgctcgctattggcaccgcacttgccaccatcttaggcttaccgattgggagaatcgtcggacagcttgtcggttggcgagtcacttttggcattattgcggtactggcattatccatcatgtttttaattattcgattattgccaaatttacccagtaaaaatgctggctctattgcaagtttacccttgcttgcgaaacgcccattattactttggctttacgtaacaacggcaatcgtcatttcagcacattttactgcttatacttatatcgaaccatttatgattgatgtcgggcatttagatccaaattttgccacggctgtattattagtttttggtttctcaggcattgcagcaagcctattatttaacagattataccgatttgctcccacaaaatttattgttgtttcgatgagtttattgatgttctctctattgctcctgttattttcaactgaagcaataatagcaatgttcagccttgtgtttatttgggggattggcatttcttgtatcggactatctctacaaatgcgcgtactaaaacttgcgccagatgcaaccgatgttgccacagctatttactcgggcattttcaatgcaggaattggcgcaggcgcattatttggaaaccttgcgacaacctatttaggattaaatgaaattggttatacaggcgcagcattaggtttaatcggtttcatcatttttattacaacgcacttaaaatatcgccatacctttcttctgcaaaacaataaaaaaataaccgcactttagttctccaaaaagagttttaaaagtgcggttaaatctgtctaagttttatttatcttgcgtttaacgttttgctttcttaataaacttcatcaaacgtttacgtttacgcaattgattcggagtgagtttatttttgcgtcctgcaaatgggtttgagccttcttggaaaagcagacgaatcggtgaaccaataatttttaagctcttacgataataattagataaataacgtttataagaatctggtagtttatccatttggttaccgtgaactactataatcggcggattataaccacctgggtgagcatattttaatttaatgcgacgaccgccaatcatcggcggttggtgctcatccgttgccatttgcaaaatacgagttaaaagcgaagtcgtcattttttgagtggcacaagcataggcttctttaatcgaatcaaaaagattacctacaccacttccgtgcaaggctgaaataaaatgcacccgagcaaaatcaataaaatctaaacgacgatcaagctcagatttcacacgatctttcacatcttgatctaaaccatcccatttattcacgacgatcaccaaagaacgccctgcatttaaaataaagccgagcaaagataaatcctgatcagaaatattctctctcgcgtcaatagtcagcaatacaacattagcatcttgaatcgcttgcaaggttttaatcacagagaatttttccactgccaaatgcactttaccacgcttacgcacaccagccgtatcaatcaaggtatattgctgtccatcacgctccattggaatataaatactgtcacgtgtcgtacctggcatatcaaaaaccactacacgatcttcgcctaaaatacgattggttaaagtagatttacccacatttggacgacctacaatggctattttgatatttttatcttgttcttcttcaagttcttcgtctaacgcatcatcaattaatgccgtatcttcttctgaatcaaaatcgaattcttgttcccattcgtcttgttcttcctcagaagtgcggtcattttcatcggcgttttccattttttccgcaaaaggcgcaagtacttgttccattaattgagtaacaccacgaccttgtgaggctgcaatttgctcaatttctcctaaacctaactgataaaattcagcacaatgagaatccgcatcaataccatcggttttatttgccaccaccacagtaattttgttttgacgttggcgtaaataattagcaataccaatatcagctgccgttaaacctgctcgcgcatccacaaggaaaagaacaatgtcggcttcatcaatagcaagcaaagattgctccgccattttttcttctacgccctcttccgttccatcaataccgccagtatcaataacaataaaatcatagccagcaatatgtgcgtgaccatattttctatcacgagttaaacctggaaaatcagcgactaacgcatctctcgtacgagtaaggcgattaaataatgtggattttcccacattcgggcgaccaacaagggcgacgactggagttgccataaaaaatctcttattttgtcaaaaatggcggctattatatcggaagttaaaggattggtaaaaaatcatttcataaagaaaagaaaaagccacaggatacaatcctatggctttctaaatactgtttatttatctacaacttaacgttataataatctcgctttcaaggatccaacttgaaagcgagtgttgcgctttttcgcaacgtttgaagaggataagaaaatgattaagatcattatccttgttgtcgttttattattagcgagccagaccgcttactaataagacaacatactagggagtaaccgctccctagttcttcaaatattaaaagtttactttgtttttgtcaaggatgaataaatttcagatacaaaaaaagcacccttaggtgctatctttatttatcttaattggcggaatggacgggactcgaacccgcgaccccctgcgtgacaggcaggtattctaaccagctgaactaccactccgagataagatattaattttaaattggcggaatggacgggactcgaacccgcgaccccctgcgtgacaggcaggtattctaaccagctgaactaccactccgctaagtggtgcgtatcttaatgatgaacacaaatctcgtcaatctttttttattaaattttacttacctgattaaattccacacgattaatgcacattattattgccaaagcgtttttcccaaaggcaattatttccactttttttattcatcatctttaagaattctaaatgcgcttgtaactcatcattagtaggttgaagtaatttcaaattgtgcgaaaaatctaccgcactttttatttcttccgccgttttttcttgcataacatggataacttcagactcaacagattcttcatcgaataaatttgtttgccctcccgtcatcatcaaataaacatccgccaagatctcggcatccagtaacgcaccgtgcaaagtacgtttgctattatcaatacctaaacgctcacaaagtgcatccaaattattgcgttttccaagatacatctgacgcgccatttgtagcgtatctgtcaccaaacaaatatcgtcagttttcacattaaggttaagtttacgaaattcataatccataaatccaacgtcaaagggggcattgtgaataagcaattccgcaccattaatataatccaaaaaatcttgggctacgtctttgaattctggtttatccgctaacatttcatcagtaataccatgaactttaatcgcatcaggatcaacagggcgatctggcttaatataaatatggaaattattacctgtgtaacgacgatttattaattcaactgcaccaatttcaataatgcagtgtccttcataatgcgcgccaagctgattcatacctgtagtttcagtatctaatacaatttggcgattgggattaatcatttgttcaacctctctctttccattaaaatacttgccattctacacaacaacctttttgttatgcaaaaacagattgaaatttttactgatggatcttgcttaggtaatccaggggcgggtggaattggtgccgtattgcgttataaacaacatgaaaaaatgctctccaaaggctatttcaaaaccaccaataatcgaatggaattacgcgctgtcattgaagcattaaatacattaaaagaaccttgtttaatcacgctttatagtgatagccaatatatgaaaaatggcataacaaaatggatctttaactggaaaaaaaataattggaaagcaagttctggaaagcctgtaaaaaaccaagatttatggatagccttagatgaatccatccaacgtcataaaattaattggcaatgggtaaaaggtcatgcaggacacagagaaaatgaaatttgcgatgaattagcaaaaaaaggagcagaaaatccgacattggaagatatggggtacatagaagaataatacaactgatataacatcatatttttcgatacctaaaaatatttaatacttaaacctaaaaaagaacaaaaaacaatcaaattcatttaaaaaagtgtgatcttgatgagatttcaagaaaattaaaattttggagtattgacataaaaatttttttttgcgaagatgtggctcgtcgctcgcctattattttgtttggtgattagacaattctattggaaaaaagttcaatcatagatagtaacaaccataaggaatacaaattatgaaaaaaacacttgcagcattaatcgttggtgcattcgcagcttcagcagcaaacgcagctgttgtttataacaacgaagggactaacgtagaattaggtggtcgtttaagcattatcgcagaacaaagtaatagcactataaaggatcaaaaacagcaacacggtgcattacgcaatcaaagttcacgtttccacattaaagcaactcataacttcggtgatggtttctatgcacaaggttatttagaaactcgtttagtttcagctcaatctggaaccgagtcagataacttcggtcatattataaccaaatatgcttatgtcactttaggaaataaagcattgggtgaagtaaaacttggtcgtgcgaaaactattgctgatggcataacaagcgcagaagataaagaatatggtgttctcaacaatagcaaatatattcctactaatggtaataccgttggctacacttttaaaggtatcgatggtttagtattaggtgctaattatttattagcacaagagcgtcataagtatactactgctgctggtactcgtgctgttactgttgcaggagaagtttatccacaaaaaatcagcaatggcgttcaggttggtgcaaaatatgatgcaaacaacattattgcaggtattgcttatggtcgtacaaattatagagaagatattgttgacccagatttaggtaaaaaacaacaagtaaacggtgcgctttcaactttaggctatcgttttagtgatttaggcttattagtgtctctagatagtggctatgcaaaaactaaaaactataaagataaacacgaaaaaagctatttcgtatctccaggtttccaatatgaattaatggaagatactaatgtctatggcaacttcaaatatgaacgcgattctgtagatcaaggtaaaaaaacacgtgaacaagcagtgttattcggtgtagatcataaacttcacaaacaagtattaacctatattgaaggtgcttacgctagaactagaacaactgagcaagctaaaggcgtaaaaactgaaaaagaaaaatcagtgggtgtaggtttacgcgtttacttctaatcatttgttagaaatacattattaaaagcaaggcgaatcgaaagattcgctttttttgcttaaaatcaagttaaaaaatgattaagttaaaagtgtataaatatttaggctattttataagtaacaaaatattaataaaaaatctgtgacatatatcacagatttttaaatcaattagctatttaagtatttactattaattctctttccactttccgtttactactgtgccgattacttggtaatttggcgtaaacactgctaagtttgctatcttacctttttctaccgaacctaaacgatcatctataccaattgctcgtgcaggataaaggttactcattctaatggcttcagcaagaggaatttcaacatattctaccgcatttttaatggattccatcattgtgattgatgcccctgcaatcgtgccattagcatcatagcaacgcccatctttgatataaattgtttttcccacaaaggtaaaattttctagttctggcggtgcgcctgccgctgcaatagagtcagtcacaatacaaagtttgtcgcctttgatttttttatcaatgcgaacattgccataattgatatgcacaccatccacgataatgccagtgtaaacatcagaatctaatactgcgcccactacgcccatttcacgtccagaactaattggcgacattgcattatgtaagtgggttgcaaatgttgcgcctttgtggaatgcggctttagccacttcataagtggcattagaatgacctacagagacaataatgcccgctttcacaaaatcaggcgtatagttaatggttgggttttctgcggcaatggttatttttgtaatcacatcgccattttcacagagaaaatctttcatttcaggcgtaatttcacgaatatattcggggcggtgtacgccttttttctcaatgctgagataaggcccttcaatatgtaaaccaagtgcttggtttttatgcttgtttaaatattcacgcataatttttaccgcactttttatattttcatcaggcgcggtaataaaagtgggaaggaaacttgtacaacctgattttaagttagtttcctgcataatttccaaggtttcaacgctagtttggtcgttaaacatcacgccaccacagccatttaattgcagatcaataaaaccagccgttaaattattaccttgtaaatcaatggttttgatacctgtttctaattcagcttgggggatcactgcttcaatagtttcgctatcaattactaccgcataatctcgtagaatttcgtatttagtgtagatcacactgttggttaatgcgtatttcatattctgttcctaatatcaacatcagtttaacatagcaactatattgctcttaaacgtaaggacaatttgccctatgattgtttgtgattatagggcgaatgtaattcgcccctacataaagatgaagaatagatctctatttatcctgataatccgtaccagcaaccgagccttctaattcagtaaaatatttcacggttttcacttttaactcttgttgagcagcttcatcacaaacaagcacgaaatgacggtgcatttgtaatgcactgactgtccataaatggttaatactgccttcaacggcagcttgcactgccagtgctttttgatgtcctgttgctaaaatcatcacttcttctgcatctaataatgtaccgacaccaatggttaaagcatatttcggcacttgagtaacatcgttattaaagaagcgtgaatttgcaattaatgtatcttgcgttagcgttttaatacgggtgcgagaacttaatgaagaagcaggttcattaaatgcgatatgtccatctacgccaaccccccccataaacagatgaattttgccgtaggatttaattttttcttcataacgatggcattctgcattatggtcatcggtattgccgttaagaatattgatattttcaggtaaaatatcgatatgattgaaaaaattgttatacataaagctgtggtaactttcagggtgttcctctggtaaagccacatattcatccatattgaaagtcactacgtgtttgaaactcactttgcctgcttgataaagtcgaatcagttcttgataagtttttagtggtgtaccaccagtaggtaaccccaatacaaaaggacgctcggcggtaggtttaaaatcgttgatacgattgatgatatgttgtgcagcccaacaactgacttgttgttctgtttgtaatggaataaaacgcatattagccttcctttattattgaccgtaatgatcctattcatatcgtaggctggactttagcccaccattcaccaaaggatcattataagtgcggtaattttctatcttgtttttaaaaagaaattcttttgctccaataatttacgacaaagcaatagaagttgcccccttccgcccttcgggcaccttcccccgtaaacaggggaaggaaagtgcttgctgacttgctgttctgtttgtaacggaataacagaggaaagcaagtgcttgctgacttgttgttctgtttgtaacggaataaacagaggaaggtaagttttttctaatttaaatatttatgacaaaaatttcgctttcaagtcttttgcttttgcaacctgttctgctgttgcttttgatgtcattggttcacggcaataacctgcatccaccccttctaatttaagcaattctttgatggttaaatataaaccgttcgctaaaatgccttcgattaaatcgttggttacgtgttggatttctaacgcttcggctaatttacccgctttggttaattcaaaaatttgacgagcacgaacgccgtttacgttgaaagttgaaccgattgcaccatccacaccaagtgaggctgccggtaacatcatttcatcaaaacctgcccaaattaagtggtttggataagcttttttcaaacgttctaataagtagaaatcacctgctgtgaattttacccctaatactttcgggtttttgtaaagttcaccgaattgttcaatgcccatattcacgccagttaagaacgggattgagtacacaatcatattgttgcccgtttcagcgatgatggtgtcgtaataatgtttaatttcagggaagctaaatttgtaatagaatggcgtcactgcagataagcagtcgtagcctaattctgttgcatatttacctaattccactgcttcttttaagtttacgctgcccacttgagcaattagtgcgatttgatcttttgcttcatcttttgcaatgcggaagatttcttttttctcttccgttgaaagcataaagttttcgcctgttgaaccgcccacatataagccatcaactttcattttgtcgatattatggcggataatttggcgtaaacctttttcattaatggtgccatcttcattaaatgacactaataatgcactgaaaataccttttaaatcacgcataagttttctcctattttatacgttgttcaagaattacattgagagttttttgtttagtttgagcggcaatttcttcttcgccctgcactaacaaagcataaattaaatctaatacaaaaagctgtgcaattttggtgccaatagaatcgccttgtaacttgccttgtttattaccatttaccaaaacataatcagcatattctgtcacgggggaacgcaaactatgcgtcaatgccactgttgttgcaccattttgttttgcgattttgatggtatgtgccgtttcagcagaataaccagaatggcttaaaccaattgccacatcagaagaggtcaataatgccgcctgcatatacataaaatgattattacctgaagcatccacttgaaaaccaatacgcatcagcttatttttagcatcttcagccgttacgccagatgaacccacaccaaataaaaaaatacggcgtgcttttttaagtactttaacgacttcttcaagctgttttaaatcaagtaaattaatcgtttcttccattacattagcaaccgccgtttgcaatttttgtgcaatagtgagcgaatcatcacttggcataatttctgtttcaagtatgctttcatcttgattatctttcgtcgcaagttcaatagaaagctctagtttgaactcgctgaaacctttaaaaccaatggttcgacaaaaacggacgagcgtagcttctccaacttgcaaatgtttagcgatttctgaaagggagcattgagagactaaatcaggcgaacgcaaaatcgtatcggcaatttttttctctgatttagttaaactctggtaaagtgagccaattttgtttaacacatttcccaatttagccataaattgttccttcaggcttatccagtaaaacatcttttacccaataagctgcgccaattaaacctgcatcttgtccaaatttagcggtttcaatttcacaacaatatatcgaaggaaaatcttgtaaatatttttcaaccaaagataaatatccctcagctaatcccacactgccaccaatcgcgattttttgaatatctaaactaatcactaaatcagcaattaaattagcaatggctttcgcagaacgctcgacaagtgcggtcgctttttcatcattttttctaaaacgctcaaacacttcttttggatcgcacggatcttcccattgggaagaaactgcttcaattgctcgccctgaagcaatcgcttcgacacaacctcgacgaccacaaccacagatcgcaccatttggatcagctaatgtatgaccaatatgccctgcaataccacgagaacctgtctgcaaaatttggttcagcacaatccctccgccaactcctgttgaaacggtaataaaaacaaaatttgatacctgttcaaaattttgcaattgatattccgcataagtcgcagcttgtgcatcatttaataaaccaatcggtttatccgtatgttttgcaatactcgctttaagtggaaattccgccaagccacctaagtttttcggatttaatgcacttaaaataccattattgataatccccgtagatgctaccgctacataatcaaactgcccttcataatcagcaagcaatttgcctaacgcttggtgcattccctccacgacattttcacgtggtgtatgaatttgctgacgttgctcaatttcgccattttttacaatcgccgctgcaatttttgtcccaccaatatctagtgctaaacaacgcataacttatccttatagtgtaaagtcttttctcacacgtcttacgactatcttgcagatttcactgaattagcaaaccaactcacaatatgttcaagacgagttaaggctgaacctacagtcacgcaatctgcaccaatttcaattgccacttttgccaattctggtgtgttataacgcccctcagccatcacaaaacaacccgctgattttaaatctttcactaattgataatctggttcttctggcactgcgccacctgtataacccgacatcgtactgccgacaatatcaaaaccaagcgctttacaatacaagccttcttctaaattagaacaatctgccattgccaaacagcccatttcgtggatttttttcaccgcactttcaatatccacaggacgtgggcggctcgtgccatctactgcaataatatccgcacctgcattggctagatcttcaatatcttgtaaaaacggcgtaatacgcacgggactatcaggcaaatcacgttttacaattccgataatcggaacattcacaaaaggacgggttgctttaaggttatcaacaccctcaatacgtaagccagaagcgccgcccataactgaagcctgagccatagcagaaacgatttcaggtttatccattgggccatcatcgacaggttggcaagaagaaatgagaccatattgaatttgagaaagtacttcttgataagataatttagacatataacacccctcatttaaatctgaataaatcactttaaaattaatttaatccacacaaaacaatcttttataagttgtaatatgcttatattttcatcatttaaccttattatatgaaaaagaaatgccattttaaagaatatttttgaagtgttttttcataaatgtgatcaacttctcatttttgaaataaaactcgtaaaactattttaaatttgtttttttactcttagaattgctctcgaatcctatttttggggagaaaacatacattttttgcctaaattgattctcatattacggggttaatatatgcccctttccaacataagttcacacaggagcgaatatgatgaaattgacaaaacttttccttgccacagccatttctttaggcgtatcttctgctgttcttgccgctgattatgacttgaaattcggtatgaatgctggaacttcatcaaatgaatataaagcggcagaaatgtttgccaaagaagtcaaagaaaaatcacagggtaaaattgaaatttcactttatccaagttcacaattaggtgatgaccgagcaatgttaaaacaattaaaagacggttctcttgacttcacctttgcagaatctgctcgcttccagttgttttaccctgaagcagcagtatttgccttaccttatgttattagcaactacaatgttgcacaaaaagccttattcgatacagaatttggtaaagatttaattaaaaaaatggacaaagatcttggtgttactttactttcccaagcttataacggtactcgccaaacgacttcaaaccgtgcaatcaacagtattgcagatatgaaaggcttaaaacttcgtgtaccaaatgctgcaacaaacttagcctatgctaaatatgttggtgcatcgccaacaccaatggcattttctgaagtttatcttgcattacaaacgaatgccgtcgatggtcaagaaaacccgttagcagcagtgcaagcacaaaaattctatgaagtgcaaaagttcttagcaatgactaaccacattttgaatgaccaactttatttagtaagcaacgagacttataaagaactccctgaagatcttcaaaaagtcgtaaaagatgctgccgaaaatgcagcaaaatatcacactaaattattcgtagatggggaaaaagatttagtcacattctttgaaaaacaaggtgtgaaaattacacatcctgatcttgtcccatttaaagcatcaatgaagccatattatgctgagtttgtaaaacaaacgggtcaaaaaggtgaagcagctttaaaacaaattgaagcaatcaatccataatccctctttagtgtgccgtaatggcacactacattcccttattcttcatcaagcggagtgaagtatgaaatatattaataagcttgaagaatggctgggtggcacattatttattgccattttcggtattcttatcgctcaaattctttcacgccaagtttttcattctccgttaatttggagcgaagaactcgccaagctcttatttgtttacgtgggtatgttaggtatcagcgttgctgtaagaaaacaagaacacgtatttattgattttttaactaatctgatgcccgaaaaaatcagaaaatttaccaatacttttgtacaattattagtctttgtatgtattttcttgtttattcatttcggtattcgtacttttaatgacgcatcattccctattgatgccttagggggcatttctgaaaaatggattttcgctgcactacctgttatcgcaatattaatgatgtttcgctttatccaagcgcaaaccataaactttaagacagggaaaagctatttacctgcgactttctttatcataagtgcggtcattttatttgcaattttatttttcgcgccagattggttcaaagtattgcgaattagcaattatataaagctcggttcaagttcagtctatattgccttactcgtttggctcatcattatgtttatcggtgtccctgtaggttggtccttatttattgctaccctactttatttttctatgacacgttggaacgtcgtaaatgccgcaactgaaaaattagtctatagcctagacagctttccattacttgccgtgccgttttatattttaacgggtattctaatgaatactggtgggattaccgaacgtatttttaatttcgctaaatccttactcggtcattacacaggaggaatgggacacgttaatatcggcgcaagtttattattttcaggtatgtcaggatccgcattagctgatgcaggcggtttaggtcagcttgagattaaagcaatgcgtgatgctggttatgacgatgatatttgcggaggaattactgctgcttcttgtattattgggccattagttccaccaagtattgcaatgattatttacggtgtcatcgccaatgaatctatcgcaaaactctttattgcaggttttattcccggtgtattaattactttagctttaatggcaatgaattatcgcattgcaaaaaaacgaggttatccacgtacaccaaaagccacaagagaacaactttgcagcagctttaaacaatctttttgggcaatcttaacgccattattaattatcggcggtattttttcaggcttattcagtccaacagaatctgccattgttgcagcagcatactctataattattggtaaatttgtgtataaagaattaaccttaaaaaccttatttaatagttgcatagaagcaatggcaattacaggcgtggtcgccttaatgattatgaccgtgactttctttggcgatatgattgcccgtgaacaagtcgcaatgcgtgttgctgatgtgtttgttgccgttgccgattcgcctttaaccgtattggtaatgatcaatgcactgttactttttcttggaatgttcattgatgccctagcattacaatttttagtattaccaatgcttattcctatcgcaatgcaattcaatattgacttaatcttctttggtgtaatgaccacattaaatatgatgattggtattcttaccccaccaatgggaatggctctctttgttgttgctcgtgtaggaaatatgtcagtttccacggtaaccaaaggcgtattaccgttcttgattcccgttttcgttacattagtattaatcacgattttcccacaaatcatcacatttgtgccaaatctattgataccataataaaaagtgcggttgaaaaacattaaattttttaaccgcacttttatctttctcgtaagttacatctgccgtaccttacaatacaaaaaggtgcaataactgcactttatcaacgcctattcaatgccgtttaatgaatagaaaactgtaaacacaactcaaaatggggtttattatgaaactaaccaaaacagcattatgcaccgcactttttgccacctttactttttcagcgaacgcacaaacttatcctgatttgccagtgggaatcaaaggaggaacaggtgcattaattggcgacaccgtttatgtgggattaggctctggtggcgataaattctataccttagacctaaaagatccttcagcacaatggaaagaaattgctacatttccgggtggcgaacgtaatcaacctgttgcagctgcggtagatggcaaactttatgtattcggtggtttacaaaaaaatgaaaaaggcgaacttcaactcgttaatgatgcttatcgctataacccaagcgataatacttggatgaaacttcctactcgttctcctcgcggtttagtaggatcaagtggtgcatctcacggagataaagtttatattttaggcggctctaacctctctatatttaatggcttcttccaagacaacgttgcagcaggagaagataaagggaaaaaagatgaaatcgttgcagcttacttcgatcaacgtccagaagattatttctttacaacagaattattgagctatgaaccctcaaccaacaaatggcgcaatgaaggtcgcattccattctctggtcgtgctggtgctgcctttacaattcaaggtaatgatctagtggttgtcaatggcgaaattaaacctggacttcgcaccgctgaaacccatcaaggtaaattcactgctaaaggtgtgcaatggaaaaacttacctgacttacctgcgccaaaaggcaaatcacaagatggtttagctggtgcacttgcaggctatagtaacggttattatttagtcactggtggcgcaaattttccaggttcaatcaaacaattcaaagaaggaaaacttcacgcacataaaggtttaagcaaagcttggcataacgaagtttatactttaaataatggtaaatggagcatcgttggggaattaccaatgaatattggctatggtttttctgtatcttacaataataaagttttactgattggcggcgaaactgatggaggtaaggctttaactagcgtcaaagcaatcagctatgatggtaaaaaattaaccgtcgaataatttatcacagaataatgcataaaatttataataatcaaaagcggcgaaatctatcgccgctttatacaaaataaaagtaattaaagcaaaattaacacaaattttgaccgcactttaaatgcgctataaagagctggcatttttattaataagatttagcgatgttatttattccaccaccactactctgtttattcattgccatagcaatgtattttttgccaaagattgctagttattctgtccatttttcagtgattgtttttgttatttccctttcatttttgattgctttaagcagcgttatgcaattctttatatgtaaaacctccattaatcctcgtgactttaaaggcacaacaaaattagtttccacaggcatatttcgatttagccgtaacccaatgtatttaagtttgctgttaattttgcttgcttggacgctttggttaggtaatagtttagcttggttaggcgtaattgtctttatactagttatgaaccactgtcaaatagcccgagaagaagcctatttggaaaataaatttggcgatgaatatcgtcgttacaaacaaaaagtaagacgttggctataaaaaacaccttcacgaggaaggtgtttttatcaaattaaactctattttttcggtgcctgcataaagcggaagaaatcactatctggttttaaaatcattatattgtcagaatttgcaaaactcgcttcataggcttttaagctacgcacaaaagtaaagaattgtggttcttgagcaaaagcatctgaatataattttgctgcagctgcatcgcctgaacctcgtaattcttgtgcagttttatttgcattagcaagaattaacgtcactttgcgatctacatcagcttgaataaatgctgctttttctttcccttgagaacgatgttcacgcgccactgcatcacgttctgcacgcatacgttggtaaatcgaagaagagacttcatctggtaaattaatttgttttacacgcacatcgatcacttcaatacctaattctgccgtactgtcttgtcctgaacttaaagctttttttgccccttccattaattctccacgtgtaccagaaacaatatctttaatcgtgcgtgaaccaatttcagaacgtaaacggtcgtttactttacgacttaataaatttgcagcttgagcataatcgccaccgccagtagatgtgtagaatcgaccaaaatcactgattttccatttcacataagaatccactagcaaatcttttttctcaacagtaacaaaacgtgttgcagagccatctaaagtacgaatacgcgcatctaaaactttgatgctatcaattaaaggcactttaaaatgcaagcctggttcatatacaaccactttgttatcagcatcacgctgtactttgttaaatcgtaacataatgccacgggtaccttccgttacaacgacgatactagaataaaccactgccgcaatcacgaaaataacaggtaataaaaatctacgcattagttaaatctcccttgacgaatcggcgcaacggtagtcggctgaggctgataagaattttgacgttctggtgcagtaaaagcaggcgaagaattgaccgcacttggcgcacttgttaccgattttttgcccataatttgctctagcggtaacacagttaaattattaccattattgccatcaagcattacttttggggtatttgccatcactttttccatcgtctgaatatataaacgctcacgcagtaaatctggtgcagccttaaattctggcaacaagcgttgcaaacgttccacttcaccttttgcatctaacacgatacgatctttataagctgttgcttcttcaagaatacgttgtgcatcaccgcgtgcaatcggttctttctcacgcgcataggcttccgcttcacgaataaaacgttgttcatcttcctgcgctttaattgcatcatcaaacgcatcttttacttcttcaggtggacgagcagattggaagttcacatcaataacctcaagtcccatatcataggatttgataatttcattcaaagctttccaagtattttcacgcacgacagagcgacctgtggttaaaatatcattcatagacatatgcccaataacataacgtaatgcactatctgtcgcttgattcaaactatcatctgcatttgttacgctaaaaagatattttgcaggatcttgcacgcgatattgcacggtcatttccacttttaccatattttcatcttgagtcagcattgcaccttgtgtacgcaactcttttacttgctccacatttactggcaatactttatctacaaatgttggtttccagttcaaaccgggttgaacaatagaatgtaactcgccaaaacgaagcaccacaccgcgttcagcctctttaatggtgtaaaaaccgcttacgccccaaataattgcaccaatcgctacagcaagtggaataactttgccaaaatgaaatggcgtattgccttgagaactgccattattttgaccgctctttttatttccaccacctaattttttaagcagattattaaaaatctcctcaatatctggcggagattgctcttgatttccacgattttgattgttattccatccattattattggatgaatttcccggctgttggtcgttgctttgccctggtttactccaaggatcgcgatctgaaccgttctgtgacatttcattctccatttgtcaaaaaattgttaagagtttagctaaataaatggggcacgtctatgaaaatataaggctttttaggcaataaaaaatccttgattttatataaggatttttttgattaattcacttcataaagaacatatttttcaagttcttttatctgtaaactttctctattccattcataaaagtgcggtaatttttcttgatgattgacaaaagcggctaaataaataggaagttcatcagtaaaccacaactgcccctgcggacaataatctgaaaaaattttttgttgttcaggaaaatgacgaacattggataattttacgatcccaaatccttgagatttcaataccgcctctcgcaaacaccaacaacgataaaaagcgttcaaagaatcctgctgatgatgaaaccaatcaatttcttcttttggtgcaatatgctccatcaacgctgtaaaatttcttattttaggaaattcaatatcaattcccaccgcacttttttcttcttttctaatatctaatattaccgccacccaatcaccagaatggctaatattaaaatctattcgctcatcaagaaaataaggtctgccactttcagtacgatgaatttgagataaaagtgcggtggattttcctgctatttttagaagttggaaaagtaataaatgcgcaagccgacgacactgatgacgctgaaaaacacgggagctatccgtttcaatttgatatagattttctggaatcagttcatcgggtaaggattccaaagaaaaaggttgatttatattgccgtaggcgatgtaggttgtcataaaataaaagcaccattcaaaggtgcttttatattaaaaggatttagtttgtgtgtaaattagcgaatcactaattccgccacagaaacaccgaccaagcaagcaacaacaaccccaattaaacctggcaccataaaactgtggttaaaataatatttaccaatttttgttgtacccgttacgtcaaagtttactgttgcaatatctgacggataatttggaatgaagaaataggcataagttgcaggcattaaaccaactaagattggtgcaggaatacctaagccaatacccacaggtaataacattacggctgttgctgcttggctattaattacgacagaaactgcaaataatgccaatgcgaatgtccaagggtaagtttgcaccatatcagtaatcgcggctttaaattctggcattgcatatttgaagtaagtgtcgctcatccacgcaataccataaattgcaatcgctgctaccatacctgacttaaataccacaccattttgtacgatttgaggattcgttttcgttgcaagtaaaatcacaccaccaaaacaaagcatcatcatttgaatgataagtgacattgaaattgcttttccgctaccgatagtgcgaatttcaggaatcatcgcaatcgcaacaatcacaactaaagcaagtaaaaataggtaaacagatttttttgccccttgcggaagggtttcattcaatgttgtactggtagtatttaaaatacgttcgcgccatactggatcttgtaaacgacgttgatattcaggatcttgttctaactctttaccacgacgcatactgtataaagaaagcgcaatcgtacccgctaaagtagcaggaacggttacacaaataatatctaataaactaatatgctcaaaagcgggcattgctgtaattttacctagataaaatacaacagctgcagaaagtgggcttgatgtgatggctaattgcgatgctaccgaagacgctgccattggacgttctggacgaattttgtttttcaatgcaacatcgccgatgattggcataattgtgtaaacagagtgaccagtaccaagcataaaggttaataaatagacgactaatgggccgagtaaagtgacacgttttggatttttacggagaatgcgttcagcaatttgtaacataaatttcaaaccgccagctgcttcaagtacggatgcgcaagtcaccaccgcaagaatgataagcataacatcaatcggtgctttccccactggcatacgaaatacgaaaacctcgatagcaagaccgataccagaaacaacacctaatccgataccgccgtaacggctaccgatataaagcattaatagtaaaaataaaaattctaagtaaagcataaacacctcaaaaatgaaaaactatgcaaataatacttctttttaggcatataactaaataattttttaaaatttaaaccaagattttaagtaaaagataatttagatcaatgtttatgaaagggaaaaataaaaagtgcggtaattttaaagaggattattagaaaaaaattaggcgacttaaaacgtcgcccaacttaaaattattgattgttttgcacgtaatcaatcgcagattgaacagtggtaattttttcagcttcttcatcaggaatttcaatatcaaattcttcttctaaagccattactaattcaactgtgtctaatgaatctgcacctaaatcttcaacaaaagaagcttcaggtttaacatcttcttctttaacacctaattgttcaacgatgatttttttcacgcgttcttcaatactcatttgtttttcctatttgttagttttaactcataaaagagctgttagtgtatgtattttttagtaacttgcaactattttatggtctggtcgcaccacaaaataggcaatgtgaacacacacatcaaatatagttacgtacctttgcatacgctcaaggcgtaaccaagttacattgcgagcgggattttagcattatctaaaatctttggctatgattttattgcttagaacccccccccccataaatcaatgtcaaagtttagcttaagtataagccaccattcacgtgtaacgttgtacccgtgatataacctgcatcatcagaagctaagaaagcaacggctttagctatgtcttttgcttcgcctaaacgtccagctggaacattagataagatccccgctttttgttcatccgtaagcacttctgtcatatctgttgcaataaaacctggtgcaaccacatttacagtaacaccacgtgcagctacttctttcgctaaagatttagaaaaaccaaccacacccgcttttgccgcacaatagttagtttgtcctggattacccgttgaaccaaccactgaaccaatattgatgatacgaccaaaacgttttttcatcattgaacgtaacatggctttagaaagatgatacacagaagttaagttagtttgcataatatcaaaccattcctcatctttcatacgcatcaataaattatcgcgagtaatacctgcgttattcacgagaatatcaatatcgccaaaatcatttttaatttgctcaagtaaagtttcgatagattctttatccgttacgtttaaaactaaacctttacctttatcccctaaataagccgagatcgcctctgcacccttttcagaggttgcggtaccaattacaaatgcaccttttgaactaagttcttctgcaatcgcacgaccgataccacggctagcccctgtcactaaagcaattttaccttgcattttttcttccttttacttacgctaaaaattcttctaccgcattgaatgatgcaacatcatttacagatattgcttgtaaatcacccacaatgcgtttggttaaaccatttaatactttacctggccccacttcaacaagcgctaaaacaccatcttgcgccattttttcaactgtttcagtccaacgaactggactatataactgacgaacaagtgcggtacgaatttcggtgccttcagtttcagctttcacatcaacgttatttaataccgatattgttggtgtattaatttgaatattctcaagtgttaccgctaattgctcggctgcaggtttcattaatgcacagtgagaaggtacgctcacagctaacggcaatgcacgtttcgcccctgcttctttacataatgcagccgcacgctcaactgcagctttcgcacccgcaataactacttgacccggtgagttaaagttcaccgcagatacgacttcgccttcctctgcttgtttgcaagcattaataattgcttcattatctaaaccaatgattgcatacattgcgccagtgccttcaggcacagcttgttgcattaattttccgcgcaattccactaatttaatcgcatcttggaaatccaacaccccagcacaaaccaaggcagaatactcacccaagctatggcctgccatcacttctggttttaattgaggaaatttttcttgccatacgcgataaatagcgactgaagcagctaaaagtgcgggctgagtttgccaagttttattaagttcttcagctggaccttgttgaacaagataccataaatcataaccaagcgcatcagatgcttgtttaaatgtttcaataacgattggatattcagtggcaagatcagcaagcataccgacagtttgggagccttgacctgggaagaccattgcgaattttttcattatgttttgtcctattgttttttaattgaaaattcttcttcggtaattaaaatcgggtttcgccgatggcgacttactttttctttgcttcgccaaagaaaaagtaagcaaaaagaagggaacccaatttgttctttatccgatttaaagtgcggtcaaaactcaaaatattttttgttcttaaaatgaatttaaaattaaccgcactttttaaataatgctctgataaattcggggccccatataaatcgcctttgcgactttcaatttttaggcaatttgcgtctgtttgagcgtagcgagttcagcaaattgccgttaagaaaattgaaacaaagcaaagaacagcgatttaactggggcgtgttttctttgcctactttcttttacacgagtaaaagaaagtaggtcgccgtcaggcgaacccctgacatttaacacaaaaagtgcggtcaatttttaccgcactttaaaatcatcaataattatatcaaatcaactaaaatctcactaacgctgaaccccaagtccaaccaccgccaaaggcttctaataatagtaactgcccacgttgaatacgaccatctcgaatagcctcatctaaagcgacaggaacagttgctgcactgttgttagcgtatttatctaacgttaccaccacttgcgacatatccatttctaattttttagctgttgctgtaataatacgtaaatttgcttggtgtggcacaagccagtctaaatcttttttatctaaattatttgctaaaagtgtttcttccaccacatttgaaagttcacgaactgccaatttgaacgtttcgttaccttgcatctcgatatagccagatttttctataccacgttctggctgagctaaaacaagggcattatttttatctgctgaagcgtgtaaatgggtggagataattccttcttgttcactcgcttctaaaattacagcacccgcaccatcaccaaatagcacaacagtgctgcgatctgtttcatctaatttacgagaattgagatccgagcctatcactaaggcttttttcactttgcctgcacgaataaattgatcagctacgctcaaagcatagacaaagcctgtgcaagctgccgccaaatcaaaagaaatcgcatcatcaatatttaataaaccttgcacttggcaagccgcacttggataagcatgtgagtgacttgtagttgcaacaataatcagttcaatatcttgaggattaatttgagcagcttcgatcgcattttttgccgcttcaaatcccattgttgcaacagtttcatcttccgctgcgatacgacgttcacggataccagaacgagtgacaatccattcatctgatgtatcaaccattttttctaaatccgcatttgtgcgaatatggctcggcagatagctaccggtggataaaattctactattcatactcaataagataagcgattaaaaaggaaaaaatctatggactatcgccaagtaagagataagaccacaccggattattttccgatgttaatggaatgcagatagtaatacggggaccaacgtccccgcccatcacatctaacaccaaggttagacggttcaagtgaacacctataagtaaaaaattacttattgatcactttacgaccacgataataaccgtctgcagttacgtggtggcgtaagtgagtttcaccgcttgctttatctactgatacagcagcagttgttaaagcatcgtgtgaacgacgcatatcacgacgtgaacgagattttttgttttgttgaacagccattggctatactcctaaatttaatttacttttgctttaaattagctaatacagcgaacgggttcggtttttttgccaattcttcaggcaattcgccaaaaacctgttcctgcgcggacacttcacagtgttcagatgaatgcattgggacaagcggcaaagctaaaattagctcatcttccaccgtgccaattaaatctatttcgccaaactcattgaactcgattggctcataaatttcgggcaagtcatcagcctgatcccaattagccactggactataagtaaactcacattccaatgtttgtttgtaaggttcgttacaacgctgacattcaagatcgacatcaatctgtactttacctttcatcaccactaatttttgtggatcaacataaaacgataatgttacctgtgcatcgctgagcacgtttaccactgattccgccaaacgctcaagctgatttgccgaataataaccaacataatcaagccgtctttgagcatcttttactggatcaacggttaggggtagttttaccttttgcatagggcgtgaatattacctgttgttgcgaagatagtcaaagggaaatcacattttttattggataactcaataaaggaaattatccgctaactaaaaaggttggaactataacaaaaattgctataatcacgcctctttttttaacaaggaaagataatgatgacttcaaattcttattggcaacgcttaaaagtggcatttcaatatgtcatgccacaaatttatttaactcaaattgctggctggtttgctaaacaaaaatggggcaaaataacacattttgtaattaaagcttttgcgaaaaaatacaacattgatatgagcattgcgcaaaaaggacaattttctgattacgcaagttttaatgaattttttattcgtccgttaaaagaaaacgcacgtccaattaatcaaaatccaaccgcactttgtttaccagcagacgggcgcattagtgagtgcggtcatattgacgataatcttttattgcaagctaaggggcattttttcagtctagaagacttattggcagaagataaagaattagtggaaacctttaaaaatggtgaatttgtaactacttatctttctcctcgtgattatcaccgagtacatatgccgtgcgatgctacgctacgcaaaatgatttatgtgccgggtgatttattctctgtgaacccatttttagcccaatatgtacccaatttatttgcacgtaatgaacgtgtgatttgtgtatttgatactgaatttggcacaatggtacaaattttagtgggtgcaaccatcactgcaagtattggcacaacttgggcaggcgtaattaatccaccacgccacaacgaagtgaaaacttggacttatgaaggcgaaagtgcggtcaaattattgaaaggtcaagaaatgggttggttccaacttggttcaacagtaattaatttattccaagccaatcaagtgcgtttggctgatcatttaagcgtaaatgaacctgttcgcatgggcgaaatcttggcatataaaaaataaacaggatttatttccataaatgacagaaacaaatcctgaaagtagatatttctcacttctttaaaggcagtataaccttactgcctttttcttctttcatttgaacaattaacgcattgttacaaattcctctgaacctgttggatgaattgccaccgtattgtcaaaatcagcttttgttgcgcccattttgattgctactgcaaatccttgaatcatttcatctacaccgaaaccaataccatgtaaacccataactttttcatctttacccacacaaactaatttcattttgcacggttggcgatgttgagttaccgcagtgtacatcgctgtgaaagaagatttatatactttaacattttctgcgccgtactgctcaatcgcttgcggttcagttaaacctacagtgccgataggcggatggctaaatacaacggttggaactaaactgtaatctaaatattcagtcggtttattattaaataaacgctctgaaaggcggcgacctgctgcaactgcaactggtgttaattcaataccgttttcgataatatcgcctaccgcataaatgcctttcacattagtattttgatatttatctactttgacatagccgtgttcatttgtttctacacctgcattttctaagccaattttatctgtcgttggaacacgacctgccgcccaaataacgcaatctacggtaacatcagattgaccatcacattttacagtaagtgaaccatctgcattttttacaatttcagatggggtagaattggtatgtaattgaattccatcttgcgcaagcacttccactaatgtttctacgattaatggatcctgattacgcattggcgcatggcgacgcactaataaatgtgtttccacgcctaagctgtttaatacgccagaaagttcaacagcaatatagcctgcaccaataacaacagcacgttttggtaattcggttaatgcaaagaaaccatccgaatcaatgccgtattcttgtcctttaatatttggacgatatgggcggccaccagttgcgattaaaatatgatctgcggttacttgctcttttgtaccatcagcaagtgttacttcaatagtatgggcatcgacaaattttccgaaaccattaattacatcaatattatttttcgctaatacattattataagatgtatggatacgactaatataggcttggcgactttcaatcagttttgaaaaatcaaattttttcacttcaacatcaaaaccataatctggcgcataattgttgattgcttctgcaatatgcgcgccataaaacattacttttttaggtacgcaacctacatttacacaagtgcctccaagatgttttgcttcaatgattgcacatttttttccatagcttgctgctcgatttagagacgcaataccgccactgccaccgccaatagcaatataatcataatgtttagtcatagtttgatcctttttgaactcaaaaattttccgtattttgcctaatttttataaagaatgctataaattgatttaattggttttatgaatattttttattcttttgaacagatgattagtttgaaataattttatgtgaagcctagtatgtagaatgaaatagcgtgatagaaaaagaggaagattgttcaatcttcctcactgtagatatgtgattaattagaatattggttaatcgcagccgcaacttcttgatcttgataaatattgttcacaatatcattaaaagtttgagatagcactttatgaatttcatcattgtccgcattaaatacgccctcttgtgaacgcgtgacattaaatgatttattatacgaacctttcgcaccttgtacataaactgtcgcttgaattttagtattaagtttataacgaagattaccttgttctacttgcgtaccaaattcatgcacatctacagttacccacgcatttgaaccatttaattgcccaattctaaagcctttactaattaaattttgctgcatcacttgctgaaataattgtgtaacacttggggatgcatttaatttaatcagttccccgtgtttcgtataactcgcaatctcttgtattgtgcggctatcttttgttgtaacagatacaacggcagttcgattaacattcattgaagcacttggcacaggcggtgtaaatgctaatatatttgattgtgcttggcagcctgcaagaaataatgtagcagctagaatacctactgatgataatgttttaattttgtttactaatgccataatttccccataaatcaattagaattgtgctattcttacaaacttccttattaatgtatagcgtttcattttagtttttgtggagaacttatagtgtcaattcaacaaattattgagcaaaaaattcaaaaaaaatttcaaccgcactttttagcaatagaaaatgaaagccatttacatcactctaatcgaggttctgaatcacattttaaatgcgttattgtcagcgcagactttaaaaatattcgaaaagtacaacgtcatcagcgtatttatcaattattgaactaagaattaaatcatagtattcacgcattagcattacatttattcactccagaagaatggaaagcacaaaatgaaactgtaccgcactcaacaaaatgtgcaggtattgggcgttaattttgttataaaaatgtaacatttttgatatatcgcaaaaagttctaacaaaaaaccctctgtttaagtagcgaaaaacagagattttcgctagaatgaggcgtttaatttagtccaaattcgatttctcggtaaaattattaactgtgaaatcaatccatttgagttttttattttgtgacattaatgtttttttagcggtttgtcacactcaaacgtgagattgcttctagggtatttttactatattagcaattgtatttttaaccttgaaaagtagtgcaaatagtatgattacaattaagaaaggtttggatctcccaatcgcgggaaaaccagcacaagtaatccatagcggcaacgctgtgaatcaagttgcgattctaggtgaggagtatgtggggatgcgtccttcaatgaaggtacgcgaaggcgatgttgtgaaaaaaggtcaagtactttttgaagacaaaaaaaatcctggtgtaatttttacagcccctgcaagcggtaccatcactgcaatcaatcgtggcgaaaaacgggtattacaatctgttgttattaatgtagaaggtgatgaaaaaatcacttttgcaaaatatagcacagaacaattgaatacactttcttctgaacaagtaaaacaaaacttgatagaatctggcttatggacggcattacgtactcgtccatttagtaaagttccatccattgaaagtgaagcatcttctatttttgtaaacgcgatggataccaatccattagcagccgatccctctgtcgtattaaaagaatattcgcaagacttcactaacggtttaaccgtattaagtcgtctattcccttcaaaaccattacacttatgtaaagcgggcgattctaatattcccactgctgatcttgaaaatttacagattcatgattttactggtgttcatccagctggtcttgtagggacgcatattcactttattgatcctgtcggtattcaaaaaactgtatggcatatcaattatcaagatgtgatcgctgtaggtaaattatttacaacaggcgaactttattcagaacgagtaatttctcttgcaggtcctcaagtgaaagaacctcgtttagtacgtacaataatcggtgctaatctttctcaattaacccaaaatgaattaagtgcgggtaaaaatcgtgtaatttctggctcagttctttgtggtcaaatagcaaaagattcacatgattatttaggtcgctatgctctgcaagtatcagtaatcgctgaaggtaatgaaaaagaattttttggttggattatgccacaagccaataaatattctgtgactcgtaccgtattaggccacttcagtaaaaaattgtttaattttactacttcagaaaatggtggcgaacgtgcaatggtgccaatcggtagctatgagcgcgtaatgccgttggacattttacctacattattattacgtgatttaatcgtgggcgatactgatggcgctcaagagttaggttgtctggaattagacgaagaagacttggcgttatgttctttcgtttgtccaggcaaatatgaatacggttcaatcttgcgtcaagtcttagataagattgagaaggaaggttaaaaatgggtttgaaaaatctttttgaaaaaatggaacccgcgtttttacccggtggtaaatacagcaagctttatccgatctttgaatcgatttataccttgctttatacacctggtacggtaacgcacaaaaacactcacgttcgtgatgcgttagattcaaaacgtatgatgattacggttttccttgcgttgttccctgcgattttctatgggatgtacaatgtgggtaaccaagcgattccagcgttaaatcaattaggcaatttagatcaactaattgctaacgattggcactatgctcttgcaagttcattaggtttagatttaactgccaatgcaacttggggctctaaaatggctcttggagcaattttctttttaccaatttacttagtggtatttaccgtttgtactatttgggaattgttattctctgtggttcgtggtcacgaagtaaatgaaggaatgttcgtttcaaccattttatttgccttgatcgttccaccaacattgccactatggcaagccgcattaggtattacttttggtatcattgttgcaaaagaaatttttggtggcgtaggtcgtaactttatgaaccctgcacttgctggtcgtgcgttcttattcttcgcatatccagctcaaatttcaggcgatacggtttggactgccgcagatggtttctctggtgcaaccgcactttcacagtggtcacaaggtggtcaaggtgcattgcaacataccgtaacaggcgctccaattacttggatggatgcttttgttggtaacttacctggttcaatgggggaagtttctacccttgcaattttaattggcggtgctgttattgtattcactcgcattgcagcttggcgcattattgctggtgtgatgattggcatgattgcaacctcaaccttgtttaacctaattggctcagagactaaccctatgttctcaatgccttggcattggcactttgttttaggtgggtttgcattgggtatggtatttatggcgaccgatcctgtttcagcatcttttactaatactggtaaatggtggtacggtgcattaattggcgtaatggctgtattaattcgtactgtaaacccagcctatccagaaggaatgatgttagcgattttatttgcaaacttatttgcaccgattttcgactacatcgttgttcaagcaaatatcaaacgtcggagagcaagaacaaatggctaagtttaataaagacagcgtaggcggcacaatccttgttgtgctactactgagtttagtttgttccattattgttgctggttccgcagtaatgttaaagcctgcacaagaagaacaaaaattgcttgataaacaaaaaaatattttaaatgtagctggtcttttacaagcaaatacgaatgtaaaagaaacttatgcaaaatttattgagccgcgtttcgttgatttagcaacgggtgaatacacacaacaagcagatgatagccaacaagcaattcctgctgatgcggataaagcacgtattcgttctcgtagcaaaacaactgaagtttatcttgtaaaagatgaacagggtcaaactcaacaagttattttaccaatttatggcactggcttgtggtcagtgatgtatggcttagtatctgttcaaccagatggtaatactattaatggaatcacttactatcaacacggagaaacaccgggattgggcggagaaattgaaaatccaaactgggcaagtctatttaaaggtaaaaaattatttgatgagcaacatcaacctgccattcgtattgtaaaaggtcaagctccacaagatgaacatagcattgatggtttatctggtgcaactttaacaggtaatggtgttcaaggtacctttaattattggttcagcaaagatggctttggtccatatcttgaaaaacttcattcaggagcaaactaatgtctggaaaaacaagttataaagatctgttgttagcgccaattgctaaaaacaaccctattgcattgcaaatcttagggatttgttctgcattagctgtaacaacaaaattagaaactgcttttgttatggcgattgcagttaccttagtaactggattatcaaacttatttgtttccctaatccgcaattatatccctaacagcattcgtattattgtacagctcgcaatcatcgcttcgcttgttatcgtagtggatcaaattctaaaagcctatgcttatggtttatctaaacaactttcagtattcgttggtttgattattactaactgtatcgtaatggggcgtgctgaagcatttgcgatgaaatcccctccagttgaaagttttgtagatggtatcggaaatggcttaggttatggttcgatgttaattatcgtagcatttttccgtgaacttatcggttcaggtaaattatttggtatgactattttcgaaactattcaaaatggtggctggtatcaagcaaatggtttattcctacttgcaccaagtgcattctttatcatcggatttgtgatctggggattaagaacttggaaaccagaacaacaggagaagtaatcaatggaacattatattagcctatttgttaaggcagtcttcattgaaaatatggcactttctttcttcttaggaatgtgtactttcttagcggtatctaaaaaggtgtccactgcgtttggtcttgggattgcggtaactttcgttcttggtatcgcagtgccagtaaaccaattaatttatgcaaatgtactaaaagaaaatgctttaattgaaggtgtagatttatcattcttaaacttcatcactttcattggggttattgctggtttagtgcaaattcttgaaatggtgttagataaatttatgccatctctttataacgcattagggattttcttacctttaatcgcagtaaactgtgcgatctttggtggggtatctttcatggttcaacgtgattacaatttccctgaatctatcgtgtatggtttcggctcaggtttaggttggatgttagcgattgtagcgcttgctggcttaacggaaaaaatgaaatacgctgatattcctgctggattaaaaggtttaggtattacctttatctctgttggtttaatggcactaggctttatgtctttctctggtattcaattataaggagtgtaatcaatgagcgattcagtaattcttgcactcggtattgccgcattcacggttattgtattagtgttagtggcaatcatcttatttgcgaaatcaaaattagtcgattctggtgatattactatcgacatcaatgacgatcctgaaaaagcgatcacattacctgcaggtggcaaattattaggggctttagcaagtaaaggtattttcgtgtcttctgcttgcggtggcggtggctcttgtggtcaatgtattgttaaagtgaaaaatggcggtggagaaattcttccaaccgaactttctcacattaacaaacgtgaagcaaaagaaggttatcgtctagcttgtcaagttaatgtaaaaggtaatatggaagttgaacttccagaagaaatcttcggcgtgaaaaaatgggaatgtactgttatttctaacgataacaaagcaacttttattaaagaacttaaattagcgatccctgaaggcgaggaagtgcctttccgcgcaggtggttatatccaaatcgaagctgagccacatgtggtgaactataaagatttcgatattcctgaagaataccacgaagactgggataaatacgatttatggcgttatgtctctaaagtggacgagcatattatccgtgcttactcaatggcttcataccctgaagagaaaggtatcattatgcttaacgttcgtattgcgactccaccaccacgccaacctgatgcgcctccaggtcaaatgtcttcttacatttggtcattaaaagcaggagataaagtcacaatttctggtccatttggtgaattcttcgcgaaagaaactaatgcagaaatggtatttatcggtggtggtgcgggtatggctccaatgcgttcacatatcttcgaccaattaaaacgtttacattctaaacgtaaaatgtcgttctggtatggtgcacgttctaaacgtgaaatattctatcaagaagactttgaccaattacaagctgaaaatccaaactttgtatggcacgtggcactttcagatgcattgcctgaagataattggactggctatacaggctttattcacaatgtactttatgaaaactacttgaaaaatcatgaagcaccagaagactgtgaatactatatgtgtgggcctccagtgatgaatgcagctgtaattaaaatgttgaaagatcttggtgttgaagatgaaaacattttattagatgactttggtggctgattttagttaatcaattcatcataaaagctgaccgcactttgtgataaagtgcggtcaaaatttaagatgtttttaaaaattttctatgattacaggtaagttttgttgagtttgccagtaattcacaaatttaggaaatccagatgaaaaaattaataagcggtatcatagcggtagcaatggcattaagtcttgctgcttgtcaaaaagaaacaaaagttatctctttaagcggtaaaacaatggggacaacttatcatgttaaataccttgatgatggttcaataaaagcaacatctgaaaagacgcatgaagaaattgaagcaatcttaaaagatgtgaatgcgaaaatgtccacttacaaaaaagattcggaattgagccgcttcaatcaaaatacccaagtgaacacaccgattgagatttcagcagattttgccaaagtattagctgaagcgattcgtttaaataaagtgaccgaaggcgcgttggatgtaactgttggtccagttgtaaatttatggggatttggtcctgaaaaacgccccgaaaaacaacctacaccagaacaattagctgaacgccaagcctgggttggcattgataaaattgcccttgatatgagtggtgcaaaaccgacattaagcaaagcacttcctcaagtttacgtagatttatcgtcaattgctaaaggttttggcgttgatcaggtggctgaaaagttagaacaactaaatgctcagaattacatggttgaaatcggcggtgaaattcgtgcgaaaggaaaaaatattgaaggtaaaccttggcagattgccattgaaaaaccaactacaacaggcgaaagagcggctgaagctgtcattggattaaacaatatgggaatggcaagttctggcgattaccgtatttactttgaagaaaatggcaaacgctttgctcatgaaattgatccgaaaacaggttatccaattcagcatcatttagcctcaattacggtacttgcaccaacctcaatgactgcagatggcttatctacagggttatttgtgctgggggaagacaaggcgttagaagtggctgagaaaaataatcttgccgtttatttaatcattagaacagataatggttttgttaccaaatcatcctctgctttcaaaaaattaacagaaacaaaagaatagttatgcaaactttattttttactttaatcgctttcgtcgcaattatattgttgatgtctatcggctttattatcaaaaaacaaagtttaaaaggcagctgcggtggtttatctagccttggtattgacaaagcttgtgattgtgataaaccttgcgacacgcttcaatcaaaattagatgcaggcgatgaacaagcaaaagctgaatatgagcaaaaatttgcgaaaaaagatgataactcgcaattttatgaagtgaaataacttgctcaaaactgaccgcactttatgtgcaaaataaaattaacggcaaaattattttgccgttttctaattcaatgaccaatgtgcttcgccttaaccgaagttacgggagaactatgttaatttcaaatacttataatcaacactttcctcaactgacgcaagaacagcttgcgagaaatgcgacaaaaaaagtgatttgtggtatgtctggtggcgtggattcttctgtgtcagcttttattcttcaacagcaaggctatcaagtggaaggcctgtttatgaaaaactgggaagaagatgacgatactgattattgtactgccgcagctgatcttgcagatgctcaagcagtatgcgataaattagggatcaaactacataaaattaattttgcggcagaatattgggataatgtctttgagcattttttaactgaatataaagcaggacgcacgccgaacccagatattctatgtaataaagaaattaaatttaaagcatttttagaatatgcagctgaagatctcggtgcagattatattgcaacagggcattatgtacgtagagcgggagataatgaaaatgcaaaactattacgtggtttagatgccaataaagatcaaagttattttctttatactttaagccataaacaagtggggcaaagtttattccccgttggtgaaatcgagaagcccattgttcgcgctattgctgaagatcttggcttaattacggcgaagaaaaaagattctaccggtatttgttttattggtgagcgtaaatttaaggatttcttagcacgctatttaccagctcaaccaggtaatattcgcactgtagatgatgaaattattggtcgtcatgatggattaatgtatcacacattgggacaacgcaaaggattgggcattggtggtctaaaaaatgcgggagatgaagcttggtatgtagtagataaagatgtagaaaataatgaacttattgtcgcgcaaggtcacgatcatcctcgtttattttcaaaaggattgattgctagccaattacattgggttgatcgcgaaccaattcgagagtcattacgttgcacggtgaaaacacgttatcgccaacaagatattccttgtgtgattgaaccaattgatgatgaaactattcgagtgatttttgatgaacctcaatcagcagtaaccccagggcaatctgccgtattttaccttggcgaagtttgtttgggtggcggtattatcgcagaaagaatataaaacaaagatgactaaaagcgcgtaaaatgcgcttttaaactatttattcaaaccaaatgacactcgccattcgtcccgtttgattgtccctgcgataagaaaagaacttttctttttcgttgaatgtacagtgatttccaccataaatttgcgtaatacctagattgtttaatcgctgagttgcaatttgataaagattactcaagtatttaccttcttcgattgcatcaggttgaaaggcgagtttggctttttcatctactgcaacaaacttttctacaacatcaatcccaacttgaaaggcctttggacctattgcagggccaaaccacgcaataatatcttcaggtttagcttgaaaatatttcactgtttcttctagtacgccatcgcataaaccacgccagccagcatgtgttgcagccacttcattgccagatgttgtagtgaatagaactggcaaacagtctgcagtcataacaacgcaaacttgattgggaacatttgtataaactgcatccgcttcaagattttgtcctgaataaggtaattgaagtactcgagtgctgtgtgtttgcgttaaaaatataggtttttgtggcaagccaaatttttcgactaataaagtgcggttagtttttaccgcacttttatcatcaccgacatgatcgcctaagttgaaactcaaataaggcgctaagctcacgcccccttcacgagtagtggtaaaggcatgaatattctttggaacattccaatttgggttaattgcttgcatattaataatctaactcatcttgatgtttgagatagtcggctttgagtgcattaagcaattcaacaaagtcatctggtaatggtgcataccattccataatttcccctgtgattggatgagctaagcgtaacatgaccgcatgtaaagcttggcgtttgaaattacgcaatacttccataaagtcttcactcgcatttttgggtggacgagggcgtccgccataggtttgatcgcctagcaatggatgggcaatatgtgccatatgaacgcggatttgatgcgtgcgccccgtttctaaacgtaaacgtaaacgggtgtagttacggtaattttccataatacgataatgagtaacagctggttttcccattggatgaacagccattaaagtacgtttggttgcatgacgagccataggttgatctactgtgccgcctttagtcataatgcctgaagcgactgcttcatattcgcgcgtaattttgcgtttttgtaagtctcgcactaacttagtttgtgctggaatggttttagcaacaaccattagacctgttgtatctttatctaatcgatgcacaattcctgctctcggtacttctgatatcggtggataatgatagagtaacgcattgagtacagttccatttggattgccagcaccggggtgtaccacaagatcttttggtttgttaatcacaataatatcatcatcttcatacacaatattcaatggaatattttctgcttcaaaacgtgtttcatcttccacttcaacaataatctctattctctctcctccaaacactttctcacgcggaatattagtaatgcggtcgttaagttttacgagatcggcttcaatccatgtttttaatcgggaacgagaatattcagggaacaactctgcaagtgtttggtctaaacgttgtcccatttgttctggctgcacttcagccgaaagggtaatttgtggcataaatagctctcaaaaattttaaaagttggcttattgattaatgttctatacaatagcggacaattgtatcttatttattggttttcgtaaaaattaaggaaaaaacaatgcgtaaaataaaatctttggcattgcttgccgtggcagcattggttattggatgttcaagtggttcaaaagatgttgaacaagcatcggtaaatgaattatacacaaaaggtacaacatcattacaagaaggtagttactctgaagccattcgctatttaaaagcgacgactgagcgttttccaggtagcgtttatcaagaacaagcaatgttagatttaatttatgcaaattataaaactcaagattatacgcaagtattattgatggtagatagctttttacatcaatttccacaaagcccaaatcaagcctatgcggtatatatggctggcttaactaatgcagcaacaggcgataatttcattcaagatttttttggaattgaccgtgctacacgtgaaacaacctctatgcgtaccgctttttctaatttccaaaacttagttcgtgtattccctaatagcccttatgctcaagatgctttagcgcgtatggcttatattaaagatgcactggctcgtcacgaattagagattgcaaaattctatgcaaaacgtaaagcgtgggtagcagttgcaaatcgtgtggtaggaatgttaaaacaatatcctgatactaaagcaacttatgaaggattatttctgatgcaggaagcttatgaaaaaatgggtttaaccgcattagcaaatgatactcaaaaaattattgatgcgaataaagataaaacttttgcaccaattgaaaaaccaaacgagccagacttaaaagtgccagcagtaaaatagcaataactgcagaaaaatcgaatactctctgcacctaaaagttgaataaaatttaaactaattaaggtgcagatttttttattttttatcaactgaaaatgcttcaccatagttcgcacaaataatctgagcagcattataaagcgttgtatcaggtgttaaacttaacgtatgtttcttttgctttttaggtgctgcccgcaaaccctgtccccaaaattcatcatagaaatcagttcgtacttgagttaaatgataatttgcacaattcaagatcttatactgacgaacagaacgtgcataacgtttaggctcaggataaacatacaatcccttatctaaattcaccactgcatcaaaatgtacaatttgtggctcttggttatccacccagatcgattcactatcgatgtaataattcacattctttaccaaacgtatatatccgcttcgtacatcagtcggcggtgccagcttcacatcattttgtttagccttttggatttgagcagaacaggcagtaagtaacccaagtgataatgttaaaataatttttttcattatttactccttatgttagctgacatttattctagaattttacagtgtgcccataaccttctaggattgttttaatatgctctaaggattctttagttggcggtaatacatcttcaagctcataatctaacccaagggttttccatttatgtgcacctaatcgatgataaggaagaagctcaactttttcaatattggtcataccttcaataaactgacctaataaatgcacatcgtgatcgctatcagtataaccaggaaccacaacataacgaatccaggtatgttgattacgtttttgcaaatattttgcaaattcaagggtacgtttattgggtaccccaataagattttgatgaacttgatcattaagctcttttaaatcgagtaaaacaagatctgttacatctaataattcatcaataatatgattataatgacgtacaaaaccatttgtatccaagcaagtattaatcccttccgctttacaagctcggaaccaatcgcgtacaaactctgcttgtaacacagcctcgccaccagatgccgtaacaccaccgccagtagcattcataaaatggcgataagtcacgacttctttcattaaatcttcgacactgatttctttccccccttcaagatcccaagtatcacgattgtggcaatatttgcagcgcatcaagcagccttgcataaataaaataaaacgaatacctggcccatctacagtgccacaggattcaaaagagtgaattcgtccaagaactgacatacataaatttcctaaaattagatatagctaaattttaccaaatatttagtctataaaaaatgagcctgatttaaatcaggctcattatgttcccaccaaagtgcggtcaaaaataaaaatgtttttacattgactctgtgaaagttctagtaattacgtcttgttgttgctctttagttaaagagttaaaacgtactgcgtaaccagatacacggatagtcaattgtggatatttatccggattttccattgcatctaacaacatttcacggtttaacacgttcacatttaagtgttggccaccttcaaccgttgcttcgtggtggaagtaaccatccattaagccagcaaggttgcgacgttgtgcttcggcatctttacctaacgcatttggtacgattgagaaggtataagaaataccatctttcgcgtaagcaaatggaagtttagctacagaagttaatgatgctaccgcacctttttggtcacgtccgtgcattgggttcgcacctggtccgaatggtgcaccagcacgacggccatctggggtgttgcccgttttcttaccataaactacgttagaagtaatggttaatacagattgtgtaggcactgcattgcggtaagttttaagtttttgaattttcttcatgaaacgttcaactaagtcacaagcgatgtcatcaacacggttatcgttattaccatattgtggatattcaccttcaatttcaaagtcgattgctacgttagttgcaacaacattgccatctttatctttgatgtcgccacgaactggtttaacttttgcatatttgattgctgaaagtgagtcagccgcaacagaaagacctgcgataccacaagccatggtacggtatacatcacgatcatgtaatgccattaatgcggcttcgtatgaatatttatcgtgcatatagtggattacgtttaaggcagtcacatattgtttagccaaccaatccataaagctatccatacgagtcattactgtatcgaaatctaatacttcatcagtaattggtgcagttttcgggcctacttgcatacctaatttttcatcaataccgccgttgattgcgtataacaatgttttcgctaagtttgcacgtgcaccgaagaattgcatttgtttacccacaatcattggtgatacacaacatgcgattgcgtagtcatcattgttgaagtctggacgcattaaatcatcgttttcgtattgaactgatgaggtatcaatcgatacttttgcacagaaacgtttgaagttttcaggtaattgttcagaccaaagaatggttaagtttggctctggggaagtacccatgttgtaaagggtgtgtaaaatacggaatgtatttttggttactaatgtacgaccatctaaacccatacctgcgatggtttcagttgcccacattgggtcgcctgagaataattgatcgtattcaggtgtacgtaagaaacgaaccatacgaagtttcataactaagtggtcaactaattcttgcgcttcagtttcagtaatttttcctgcttttaaatcacgctcaatgtacacgtcaataaaggttgcggtacgaccgaatgacattgcagcaccattttgtgattttattgcagcaagataagcaaagtacatccattgaatggcttcttgagcattagttgctgggttagaaatatcataaccatagcttgctgccatttgttttaattgacctaatgcacggtgttgttctgcgatttcttcacgtaaacgaattgttgcttcaagatttacgccatcttctaaatctttttgtaaagaagagaattgtgcatatttatctttcattaagaaatctacaccataaagtgctacacgacggtagtcaccgatgatacgaccacgaccataagcatctggaagaccagttaataccccagatttacggcaacgtaaaatatctggcgtgtaaacatcgaatacaccttggttatgtgttttacggtattcagtgaagatttttttcacttttggatcaagttcacgaccataaactttacaagaaccttccaccattttgataccaccgaatggcataatggcacgttttaaaggttcatcagtttgaagaccaacgattttttctaaatctttgttaatgtaaccgggtgcgtgagagataatggtagatggtgtatgttcatcaaaatctaatggcgcgtgagtacggttttcaattttaattccttccattacagattcccaaagcttggttgttgcttcggttggacctgctaagaaagagtcatcgccttcataaggggtatagtttttttggataaagtcacgtacattgacattttcttgccaatcgccaccagcaaaaccagcccacgccaatttttgcatttcattaagttctgacatagtcatttcctttgttaattaataaataagtaaatctttaatgcgttttggttaaataacgttggaatacaccaatacaaattgccccgccgacaatatttcccaacgttacagggattaaattcttcacgatgaaatggtacaaatctaaatctgcgtatttcatcggatcaacgccgatttgttgccaaaattcaggtgtactaaaatgtgcggtaataattcccatcggaatcataaacatattagccacacagtgttcaaatcctgatgcaacaaacaaaccaatcggcataatcataataaatgctttgtctgtaacagtcttaccagaataagacatccaaaccgccacacacaccataatgttacataaaatacctaggttaaaagcttcaaaccaagtgtgatgaattttatgttgggcggttgcaagaattgttaaaccccattgaccatttgctgccattgtttgtccactaaaccaaataacagccgcaataaataaaccaccaacgaagttgcccaaatatactacgatccaatttcgaatcatttgtgtcgtggtgattctaccgcctacacgggcgactaaagttaaagtagaagaagtgaataattcagatcctaaaatcaccaccataattacgcccaaggagaatactaacccacctactaacttggttaatccccaaggtgcgcctgcactagcagtttgtgttgtcgtgtaaaatacaaaggctaaggcaatacaagcaccagcactaataccagacataaacgataaaaatggacgtttatttgctttataagttgctgtattttctgcataatccgttgcttcaacaggtgtgagcgcaacagaagatagtttttgattttctgatgccataatcaaactccaactattgacattgaaaaaattgatgaaaatttaatacttttaacaagtttacgactacaaatacttctataattggtgctattttactctcctcccctttcattgcaaagaaaagcaaaaattatttcaacaaactttgatattttgcaaggtttgtttaattaaagacaaaattcccatattaatattcgctcaatttcatacattcagagtaagtaaagcacttaatttgaaacttgttttattcgcgtaataccgtgaattcccccagataatcatccacttttccaaaaccttgattattcacaacaggcaaattcataattttttcaaacgaaccagattaagtgtatagacttgctattttgagtaattaatagcattattttgatctttttgaagaaaaaggcgatctttgtcataaaataatgatttaagtgcggttaaaattttggttaattttaagtgcacttctttatacaggagcagattatgtattatggtttagatattggtggcacgaaaatagagcttgccgtattcaatgaagaattagaaaaattatattctgaacgggtgccaacacctaaaaccgactatgaagaatggcttaacacgattgtggatttagtgaatcgtgctgatgaaaagtttggtgaagtgggcaccgtaggtttgggcgtacctggttttgttaatcaacaaactggattagccgaaattaccaatattcgtgtggcagataataaaccgattttacgcgatttgtctgtgcgtttaggccgtgaagtgcgggcagaaaatgatgcaaattgttttgcattatctgaagcgtgggatacggaaaatcagcaatatccgactgtacttggtttaattcttggaactggttttggtggcggctttgtcttaaatggtaaagttcattcaggtcaagtgggaatggcgggagagcttggtcatttacaactaaattatcatgccttgaaattattgggatgggataacgcccctatttatcaatgtggttgtggcaacaaggcttgtttggataattatttgtctggtcgcggttttgaaatgctttatcgagatttgaaaggcgaaacattatctgctcgtgaaattattgatttgttctatcaaggcaatgaaagtgcggtagattttgtgaatctttttgttgagttggcggcgatttctattggcaatatcattacggcatttgatcctcatatgattgtactcggcggtggattatctaattttgattacctttatgaggctttaccaaaagcattaccgcctcacttgatgcggacagcaaaagttccaccaattaaaaaagcgaaacacggcgattctggtggtgtgcgtggcgcggcagcgttgtttttaaccaaataattcaacaaactagtggggcgtattcaaataatatgccctttgtttttgaaaaatatttagaatattctaaatttattagattttttcttttttgtttttcttttctttagagaaattattaaaaaatctcgccttttcattgaaaaaccatacaatcaaattatttatcgcttgagggatgattatggactttgaattttcaaaaatgttagaagaagtgctaacttggatagtcgcacaccttgacgggcctttatgggatgtcacaattattattttgcttgggactggtctattttttaccattacaacaggatttgtgcagttccgtttattcccagcaagtcttcgtgaaatgtggtttggtcgtgcggtggagggtagttcgttaacacctttccaagcatttacgacaggtcttgcgagccgcgttggtgtgggtaacattggtggggttgcaacggcaatcgccttgggaggcgaaggcgcagtgttttggatgtgggtaacggcatttattggtatgtcgagtgctttcgctgaatctacccttgctcaattatttaaaattcaagataaagatggatcattccgcggtggccctgcttattatattgttcaaggtttaaaatcacgttgtatggcagtggcttttgcacttgcattaatttttacatttggttttgcctttaattctgtgcaggcaaactctattgttgaagcaacgagtaatgcgtggaattggaaaggggaatatgtcggtatttcattagtaatttttaccgcacttattattttcggtggcgttaagcgtattgcgattatttcgagcaaccttgtaccaatgatggcacttttctatttgattatagcagtaattattcttggcatgcatattgatatgatcccttccgtgattcatcgtattgttcaaagtgcatttagttttgatgctgccgctggcggaatgtttggtgcattggtatcgaaagcaatgatgatggggattaaacgtggtttattctcaaacgaagcggggatgggatctgcgcctaattcggctgcagcagctcacgttaagcatccagttagccaaggtttagtgcaaatgctcggtgtgtttgttgatacaatgatcgtttgtacttgtactgccgttattattttgctttcgaataattatggtagcgaaacgctcaaaagtatctcacttacgcaaaatgctttgcaataccacataggtgaatttggggtgcatttcctggcgtttatcttattgttattcgcttattcttctattattggtaactatgcttatgcggaaagcaatatccgttttataaaaaataaaccttggtttgtatttttgttccgtttaatggtgctatttttcgtgtatttcggtgcggttcgctctggcaatgtggtgtggaatttcgcagatacggtgatggctgtcatggcaatcattaacttgatcgcaattttgatgttgtcgccaatcgtatggaaattaatgaaggattatcaacgccagcttaaagaaggaaaaacgccagagtttaaaattgatgaataccctgaattacgtaagaaaatatttgattcccgcatttggaaataaagataaaatggctagaaagagattatctacctttccaaagagttagattattatttaaagaaattttttgatattgtttcaggcttggttcttctagttcagactgaataaactattgccggcactttttaccgccctcgtgccggctatcccaaactgctttgaaaactgaccgctctttagcttacttcaaaaattccgcatgataggcaatatgctcgccaataaaactggcgatgaagtaatagctgtgatcatagcctttatggaagcgcacatcgacaggctgacttgccactcgacaggtttcgataaaatcttcggtacgcaattgtgtaggcaaaaactcatcttccaagccctgctcaatgcgcataccttgcactttatagccttgttgaatgagcgagctggcatcatattgctgccatttttcacgatcttcccctaaataggtagaaaaggctttttctccccaaggcacctggcttggcgataaaataggcgaaaaggcagaaacactttgataacgttcccgatttcgcagtgccaataccaatgcaccgtgtccgcccattgaatgtcccataatggaacgtttgccgttagtagggaaatttgcttcaatcaaatcaggcaattcattcaagatataatcatacatttgataattcgtcgcccaaggctgctcggtcgcattaagataaaagcccgctccctgccctaaatcgtaagccgcatcattcggcacttgctctccgcgagggctagtatcgggggcaaccacaatcacttgatgttctgcggcataacgttgaaagcctgatttggtaatgaaattttgttctgtacaagttaagccagaaagccaataaatcacgccaagcggtcgattttctggattatttggcaaatagacggcaaatttcatttcgcattgcaacatttgggcattatgcgcccaaacttgctgtgaaccgccaaaaatttgatgttgttcaatcagtttcataacgtaccttagtaatgaataactgtgcggatcgatttaccttcgtgcattaactcaaaggcttcattaatttgatcaagtggcattgtgtgagtcacaaacggttctaactggatgtcgcctttcattgaatcttccaccatttgcggaagttcagagcgacctttcacgccaccaaatgccgagcctttccaaacacggcctgttaccaattggaacggacgcgttgaaatttcttgtcctgcacccgctacgccgatgataatggattgtccccagccacggtgagcactttctaatgcttgacgcattacgtttacattaccgatacattcaaaggtatggtcaatgccccatttattaatatctaacaacacatctttgatcggcttatcgtaatcattagggtttaaacaatccgttgcaccaaactgttttgccaactcaaattttgcaggattggtatcaatggcgataatacggccggctttggcttgacgtgcaccttgcactaccgctaaaccaatcgcacccaagccaaacacggcaacagagtcgccttcttgcacttttgccgtattatgtaccgcaccaatacctgtggtaacgccacagccaagtaaacatacttgttcgtggttggcttctgggttgattttcgccagtgaaacttctgcaacaactgagtattcactgaaagtcgaacagcccatatagtgatagatcggctgaccttgataagaaaaacgtgtcgtgcaatcaggcattaagcctttaccttgcgtgtcacgcactgagacgcataggttggttttaccctagcgacaaaactcacattcgccacattcagcagtataaagaggaatgacgtgatcgcccggttttacgcttaacacaccttcgccaaccgcaacaaccacacccgcaccttcgtgtcctagcaccacagggaataccccttcaggatcgcttcctgataacgtaaacgcatcagtatggcaaacgcccgtgtgcgtgttacgaattaacacttcgcctttgcgaggcatttctacgtcgatttccacaatttgtaagggttgatttggggcgaatgctaccgccgcacgagatttgatggttgagttgatttgtttaatttccattgtttttcctcttaatccattgacaaagttgccttacgtaagcaagatagcaacagtttacactttagagttcactctaaagcaagtgtttttttaccatttttgtttaaagggaataaaaagtgacttacaccaccgctaaagctgctgaaaaaataggcatttccgcctacaccttacgcttttatgacaaagaaggcttgttacctaatgtcggacgtgatgaatacggtaatcgccgttttaccgacaaggatttgcaatggttgagtttattacaatgcttgaaaaatacaggaatgagcttaaaagacatcaaacgctttgcagaatgtaccatcattggcgacgatactattgaagaacgcctttccttatttgaaaatcaaacaaaaaatgtaaagtgtcaaattgccgaattaaaacgttatttagatttgcttgaatacaaattagcgttttaccaaaaagcgaaagcactaggctcggtaaaagctgtgaatttaccgcaaattcctgaaacgagctaaaaggataaaagtgctcacatcacagaattagaagaaaaatacaatttttagagatagataaattttaacttttttattacatcaataagttaaaaatcaggttttgtgatcaagatcaggataacataaaaataatctcctatagctattgttctaaatggctaaaaagagtatattccgagccaaattttttcttttttacagaacggagtttattatgtttggtttatcccccgctcaactgattattttattagtcgttattttattgatttttggcacgaaaaaattaagaaatgctggctcagatcttggtgcagcagtgaaaggtttcaaaaaggcgatgaaagaagatgaaaaagtaaaagatgcggaatttaagtctatagataatgaaacagcgtctgcaaaaaaagaaaatataaaagagaaagagcaggcttaatccgtgtttgatattggtttttcagaacttattttactaatggttttgggattggttgtattaggcccgaaacgtttgcctatagcaattcgcactgtaatggattgggtaaaaacaattcgtggtttagctgctaacgttcaaaatgagttgaaacaagagctaaaattgcaagaattacaagatagtattaaaaaagcggaatcccttaacttgcaagccctttcaccagaattgagtaaaacggtggaagaattaaaagctcaagcagataagatgaaagcggagctagaagataaagcagctcaagctggtacaacggtggaagatcaaatcaaagaaatcaaaaatgcggctgaaaatgcagaaaaacctcaaaatgcaatctcagttgaggaggctgcagaaactttatctgaagcagaaaaaacacctacagatttgaccgcacttgaaactcacgagaaagtagaactgaacacacatttatctagctattatcctcctgatgatattgaaatcgctccagcgtcaaaatctcaatcttcaaaaactaaatcatagcgagtttttatgagtaatgtggatgaatctcaacctttaattacgcaccttgttgaactaagaaaccgtttattacgctgtgtgatttgtgtagtgttggtttttgttgctttggtgtatttttccaatgatatttatcattttgttgctgcacctttaacggctgttatgccaaaaggcgcaacaatgattgcaaccaatattcaaactcctttctttacgccaattaaattaactgcgattgttgcaatttttatttctgtcccttatttgctttatcaaatttgggcttttattgcacctgctttatatcagcacgaaaaacggatgatttatccgttgttattttccagtacgattttattttattgcggtgttgcttttgcttactatgtcgtctttcctcttgtattcagcttctttacacaaacagccccagaaggcgttaccatcgcaacagatattagtagttatttagattttgctttagcgttatttttagcttttggcgtttgttttgaagtgccaattgcgattattctactttgctggactggtattaccactgtaaaggctctttccgaaaaacgcccttatattattgttgcagcattttttattggaatgcttttaacgcctcctgatgttttttcacaaactttgcttgccataccgatgtgcttgctgtttgagctcggtctattggtcgctcgattttatcaaccaaaagacgacgaaagtgcggttaaaaataatgatgaatcagaaaaaacacaatgatgaacttaattgttaatagtatgggagctttgcccccgtttttattatattgatataaccctaattttgttttttcataaaacatattttcgtagtgatttactagaaatatgatttgtagtctgctctatatttttattgaaaatatcattacctgatggttttctgtcgttttttattttttatctaataaatacgatattttttagataatttctttactttttccttttctttaaatttcctttataaaaatggttgcaagattaaattagccattgcatattgtctatgcgcttcacgaggcgtatacaataaaaaatacaatacacacaacatcaacaaagagggaaattcattatgtcaaaagttgcttccttagacgcatttttaacaaaagttgctcaacgcgatggttatcaacctgaatttttacaagcggttcgcgaggtattcacatcaatttggccttttttagaagccaatcctaaatatcgttcagaagcattattagaacgtttagttgagcctgaacgtgcatttcaattccgtgtggcgtggactgacgataaagggcaagtgcaagtaaacagagcatttcgtgtacaatttaatagtgccataggcccatttaaagggggaatgcgtttccatccatcagtaaatttatctatcttaaaattcttaggttttgagcaaatctttaaaaatgctttaacaacattgcctatgggcggagcaaaaggcggttcagattttgatcctaaaggcaaatctgatgctgaagttatgcgtttttgccaagcattaatggctgaactttatcgtcacgtaggagctgatacagatgttcccgcaggcgatataggtgttggtgggcgcgaagttggctatttagctggctatatgaaaaaattatcaaaccaatcagcctgtgttttcactggtcgcggtctttctttcggtggtagtttaattcgtccggaagcaacgggatatggattaatttattttgctcaagcaatgcttgctgaaaaaggcgatagttttgcaggtaaagtagtttcagtttctggttctggtaatgtagcacaatatgctattgaaaaagcattatctcttggtgcaaaagtagtaacttgttctgattcatcaggttatgtttatgatccaaatggatttactactgaaaaattagccgcacttttagaaattaaaaatgtaaaacgtggtcgtgtgaaagattatgcagaactgtttggtttgcaatattttgaaggtaaacgcccttgggaagtgcaagttgatattgcgcttccttgtgcaactcaaaatgaattagaactttctgatgcacaacgtttaattaaaaatggtgtgaaattagtggctgaaggtgcgaatatgccaacaacaattgaagcaacagaagcattattagctgcagatgtattatttggcccgggtaaagctgccaacgctggtggtgttgctacttctggtttagaaatggcacaaagttcacaacgtttatattggacagcagaagaagtggacgctcaattacatcgcattatgttagatattcacgcaaactgtaaaaaatacggcacaattgaaggtcaagaaaacattaactatgttgttggggcaaatgtagcaggctttgttaaggtggctgatgcaatgttagcccaaggcgtttattaacaaataaaaaagttaaactaaataaccgcactgtaataaagtgcggttattttttaggatgaaatttgaatataagaaaggcgacattttgtcgccttagatattatttattttgaattgttttcgtcacaatgattaatatcactgcatttgccgtaaagatacacgttatgcgtttttaattttatgccgtatttttcactgatttcacgctgacgttgttcaataatattatccgtaaattcaaatactttaccgcaatcttcacaaataatatgatcgtgatgttctgttggagcaagctcaaaaacggatttatttccctcaaaattatgacggattacaatatgtgcttcatcaaattgattaagcacacgataaactgtggctaatccaatttcacaaccttgttccagcaaaattttataaacatcttctgcagaaaaatgttcatttttatgattttgcattaaagcgagaatagttaagcgaggctctgtaatttttaatcccacttttttgagtaatttaatattttcttcagacataatttttcttcctattatgcacaacatactaagccaattcagctaagcacatttcatcataaatttgtttacaccatttttctacacgctctgcggtaagctctggttggcgatcttcatcaatacataatccgatgaaagtgccatcttccaataaggctttcgaagcttcaaaattatagccttctgttggccaatttcctaccacaattgcaccgtgtggctctataatatcgcgcacagttccgatagcatcacagaaataatctgcataatcttcttgatcgccacaaccgaaaatacctacaagtttatctgtaaaatcgatttcttcgagtgttgggaaaaagtcatcccagtctgcttgtgcttcgccgtaataccaagttggaataccgaaaagcaagaaatcgtatgcttcaatatcttctttgctacttttggcaatatcacgaatatcaattaaatcactacctaattgtttttggatttgttttgcgatgttttcagtgtttccagtatcactaccataaaaaagaccaactattgccatttttatttccttttttatattaaatttaatctatcgattataaggcttatccaaatttggcgaactatatcataaaagcattctcacttaaactacttaattcttatttagaaatcgtttaattgcacgaataacaaaatcaggtttttcggcgtgaacccagtgtccactgccattaatcgtaaaggcagttgcattaggaaattgttctagaattttttcgctattttctatttttatataagaggaatttccacccttaataaaaagagttggcgtaaatacacgtactttttcccaatccataatattggcataattgttaaaaagtgcggtaagattaaaacgaaaacaatcagctgaattaacatcaaaagatttcaacataaattgtacaacgtcttcatcattaatttcttgttttaaaatcggtttggcttgctgacgattttcaggctttgcattttttaccgcaaataggccattaaaaacatctttatgaccaaatccctcataaagcataggggacatatcaattacgattaatttttcgactaattctgggcaaagtgcggtgattttcatggcggtttttccccccatagaatgaccaattaatatcactttggataaatttaagtggcggattactgcgataacatcttcagccatcagttgataattcattttttccgaatgaaaactatggccgtgattgcgtaaatcaatacgtaaaatactgtaatgttcactaaaagctctcgcgataacgccgagattatccatatcgccgaataaaccgtgaataaaaattaaaacaggtgtattaatcgtttgttttacttgatgaaattgataattgagtaatgattttgccataatttttacgtgagaatttgtaaagaagtcgttataattgaaaaaaattttagcaaacagagagataaaaatgaagatcattgaagtagatgaagaattataccaatatattgcgagccaaacccgctctattggggaaagtgcttcggatattttacgccgtttgcttagtttacctgtgcatacttcaagtgttgatgatttagttcttacttcagcagaaactaacaaatccgcagatcaaaagccagaacaggctattaatgtgaaagaagtaaatatcaaaacaacaaaaaagcaatcaataaccgcaattaatcagatagtagaaaaagtccaaactttattaaattcaactgaatttcaagaagaaagtaaggcggtggtgcgtttcttagcgattttacgtgtgctttatcgtacaaatcctgaaagttttgcgcaagcaacggaatctttacaaggacgtactcgagtttactttgcacgtgacgaagcgacattattaatggctggcaatcatacaaaaccaaaacaaattccagatacgccttattgggttattaccaatacaaatagtggacgaaaaatgttgatgctagaaggtgcaatgcaatctatggaattacctgaaacattgattgatgaagtgcgatcatatttcacggtaaattaataatgtatccttggcaaaattttgctattcaacctgatttctcagataaaatcgctttacgtactacgcagagcgatgcgcttacttggatagaattaactacaaagattaaccaaacggtggcttttttacaaaaaaaaggcgtaaatgcggaaagtgcggttgcttttgtgggaaaaaattcagagaaaattttatttttatatctggcgacaattcagcttggcgcaaaagttttaggcatcaatcctgcttttccacaagaaaaaattgcagaattatgtgagttttatcaaattgatttttgtttttatgataaagatttgctgaatttgcaagaaattgatgcttttacacaaaaagctaatttttttcgtcctgcgacgatgacgctaacctctggttctacaggcttaccaaaagcagttgtgcataatgtccaagcgcatttggataatgcaaaaggggtatgtaacttaatgaagtttgattgtaatcaatcttggttactttcattacccttatatcacgtttcaggacaaggtattgtttggcgttggttatattgtggtgcacaattacatttcccaaaagatgatttttatgcttcattattagaaacgacccacgtttctcttgtgccaacgcaattacaacgtttgttagattatttacaggaaaattcgattatttcattttctacacgtcatattttacttggtggtacgcatattcctgctgaactcacgaaaaaaatagtgaaatatggtattgaaacttattctggctacggaatgacggaaatggcttcgacagtttttgccaaaaaatctgatgaaaaacaaggtgtggggcaaccgctcttaggcagagaatatcgcttagtaaatgatgaagtttggctgaaaggtgcgggtttggcgatgggttattggaaggatcgacaaattgtttcattaacgaataaccaaggttggcttccgacaaaagataaaggtgtttggcaagagggcgaacttgttattatcggacgacttgataatatgtttatttctggtggcgaaaatattcagccagaagaaattgaacaagtgattattcaacattcttcagttaatcaagtgtttgttttaccacaaaaaaacaaagaatttggtcagcgtcctgtcgctttagtggattttaatgaatcctttagcaaaagtgcggttgaaaatttaatgttttttttacaagataaactcgcacgttttaaacaacctattgcatattatcctttaccactgatgcttgggaaaggcattaagatctcacgtaaacagcttgccgattggctggcaaagcaagataagataaattaattttaccatttagattaggaaaaaataatgattaggaaacttatgaaaacacctccattttttaccgtactttttgcctcggcaatgtttacccttagtgtttcacaaggggcattaggggcaaattcaacaaatgtattaccaacggagcaatcgcttaaagccgatttggctaacgctcaaaaaatgagtgagggggaagcaaaaaatacgttgttagcagaattacaaacatcaattgatttattgcagcaaattcaagctcaacaaaaaatcaatgatgcattgcaaacaacattaagccattcagagagtgaaattagaaagaataatgcagaaattcaagcattaaaaaaacaacaagaaacagcaacaagtactgattataatgcacagtcacaggacgatttacaaaatagtctcgctaagttaaatgatcaattacaagatacgcaaaacgcattaggcgcggcaaatgcacaattggcagggcaaaattctatttctgaacgagctcaagcggcattaacggaaaatgttgtacgcactcagcaaattaatcaacaattggccaataatgatattggtagcgcattacgaaaacaatatcagattgaattacaactgattgatttaaagaatagttataatcaaaatttattaaaaaataatgatcagctttctttactttatcaaagtcgttacgacctattgaatttacgtttgcaggtgcaacaacaaaatattattgcgattcaagaagtcattaatcaaaaaaatcttcagcaatcacaaaatcaactagaacaagctcagcagcaacagcaaaaaactgtgcaaaatgattacattcaaaaagaacttgatcgcaatgcacagcttggtcagtatctattacaacaaacagaaaaagcgaattcattaactcaagatgagttaagaatgcggaatattttagatagcctcactcaaactcaacatactattgatgaacaaattagtgcattacaaggcacgttagttctttcacgtattatccagcaacaaaaacaaaaattaccgactaacttaaatattcaaggtttatcaaaacaaattgccgatttgcgtgtgcatatttttgacattactcaaaaacgcaatgaactttatgatctaaataactatattaataaagttgaaagtgaagatggaaaacaatttactgaggcagaaagaacgcaggttaaaacgctattaactgagcgtcgaaaaatgacatctgatctgattaaatctttaaataatcaattaaatctcgcgatttctttggaattaacgcagcagcaaattacacaaatcagtgatcaaattcaatctaaattagagcagcaaagtttttgggtgaaaagtaataatcccattaatttagattggataaaaatgctgccaagagctttaattgaacagtttaatggtatgttgaaaaaattaggttttccaactaattatgacaatttaccttatttacttatgtatttcttagggttatttattgtaggtggtgcaatttttaaatttaaaaatcgtattaaacaacaattaaacaaaattaatcgtgaaatacatcgcttagatacagatagtcagtggagtactccacttgccctgttattaactgcgtttttaacgctttctagtacactttggtttttagccgtttgccaaatgatcggcttctttttcttcaaaaatccagaagaattttggcattggtcatttagtatggcaggttattggtggttctttacattttggatttcattgttccgtccaaatggtatttttgttaatcattttgaatcttcaaaagagaatgcacaacgttttcgtggtgttatccaacgcattattattgtgattgtattgcttttaaatacttctgtgtttagcaatgtcactgatgcaggtttagctaatgatgtgttaggtcaaattaatactattacagctctaattttctgtgcggcgattattgctcctcgctttaatcgagtacttcgctcttatgaacctgaaacaaataaacatcattggttaataagaattgtacaaattggtttaagattaattcctgtgggactaatcgtacttattgttttaggctattattacactgctttaaatttaattgagcattttattcattcttatattgcttggtgtgtatggtggttagtacgtaatacgatttaccgtggtattacggtttcttctcgtcgtttagcacatcgccgtttagcagaaaaacgtcgtcaaaaagcacttgaaaataattatgaaaatatttcctctgatgatgtggttgcagtgggagagccagaggaaggtttagcgttaaatgatgtgcgtagccaattattacgttttgtagatctctttatttggacagcattattggggattttctactatgtatggtcagatttagtcacagtagtgagctatttacgtgaaattacactttggcaacaaaccacgacaaccgatgctggcactgtaatagaaagcattactttatttaatcttcttgttgctttggttatcctaggaattacttatgtgttggttcgtaatatttcaggtattttggaagtattaattttctctcgcgtgaatctttcacaaggtacgccttatacgattacgacattgctcacttatatttttatcgccattggtggtgcgtgggcatttgcaaccttaggaatgtcttggtcaaaattacaatggttatttgccgcactttccgttggtcttggttttggtatgcaagaaatttttgcaaactttgtgtcgggcattattttgctatttgaacgcccaatccgagttggcgatgtcgtaaccattaatggagtgagcggtactgtagcgaaaattcgtattcgtgcaattacattaattgattttgatcgcaaagaaattattgtgccaaataaatcttttgtgacaggtcaagtaaccaattgggcattatctagcacgatgacacgtttagtgattagtgttggtgttgcttatggttctgatttaacactcgttcgtcaattattacttcaagcagctgatgaacagccgactgttttacgcgatcctaaaccatctgcttattttttaacttttggtgcaagtactttggatcacgaattacgtgtttatgtagaacaagttggagatcgtaccagtactacagatgctattaatcgccgtattaatgaattatttgcagaacataatattgatattgcctttaatcaattagatgtatttatcaaaaataatgacactggcgaagaaattccctttgttgatgtaaaaaaataaggggaaattatggcaggtaatacaattggacaactttttcgtgtgacgacctttggggagtcacatgggattgcattaggctgtatcgttgatggggtaccgccaaatcttgaattatctgagcaagatattcagccagatttagatcgtcgtaaacctgggacatcacgatataccacgccgcgtcgtgaagacgatgaagttcaaattttatctggtgtgtttgaaggaaaaactacaggcacaagtattgggatgatcattaaaaatgctgatcagcgttctcaagattatggcgagattaaagatcgttttcgccctggtcatgcagactttacctatcagcaaaaatatggcatccgtgattaccgtggcggtgggcgttcttcagcgcgtgaaacagcgatgcgagttgcagcgggagcgattgcaaaaaaatatttacgcgaacattttggtattgaagtccgtggttttttaagtcaaatcggtcatgtgaaaatttcgccacagatcatcggagaaattgattgggaaaaggtaaacagcaatccattcttttgccctgatgaaagtgcggtagaaaaattcgatgaattgatccgtgaacttaaaaaagaaggagattctattggtgcaaaacttactgttattgcagaaaatgtacctgtaggattgggcgagccagtatttgaccgtttagatgcagatcttgctcacgcattaatgggaattaatgcagtaaaaggcgtcgaaattggtgatggttttgcagtggttgaacaacgtggttcggaacatcgtgatgaaatgacacctaatggctttgaaagtaatcacgcaggcggcattttaggcggaattagttcaggacagccaattatcgccacgattgcgttaaaaccaacttcaagtattacaatttctggtcgttcaattaatcttaatggcgagccagtagaagttgtgacaaaaggtcgtcacgatccttgtgtgggtattcgtgctgtacccatcgcagaagccatgatggcgattgtcttattagatcatctattacgttttaaggcgcagtgtaaataatcttagtataagatgggagtctgtgcctagggtaggtataccctaggttagtttgatgttacccctttgggataagtggaaagttccccaaaggggaactattttttctaaccgtgggtatacttacccacggcaaaacctaagatatgcttacccatagcaaaactttagaatgaataaaattttattaaaaacaaccataatttttaccgcacttttctctctgaacgttgttgcgtctcctctagattggcaaaaagtgaaacgtcctattccaagtgacgatgggaaagcaaaacctattggtagctataccaatgggtgtattattggggcgcaagcactaccgccgaaaggagacggttaccaagttattcgtatgaatcgcaatcgttattatggtcatccaaatatgattcagtatattgaacgtttggggcagcgagctaaagctgctgggttaccaactatgttagtgggtgatattgccatgccgggtggcgggcggtttttaacgggtcatgctagccatcagatgggattagatgcggatatttggttaagaatgggcgaaatgtcagacgccgatgcgctgaattctgatggtaaaggtttattagttgtagatagaaaggcgcaacgagtggatgaacgagtatggaatagcaatcatgcgacgttaatcaagttagccgcacaagatccaaatgtgacgcgtatttttgttaatcctgcgattaaggtaaaattatgtcaaaccgctggcaatgatcgcggttggctacacaaagttcgtccttggtatggacacaactctcattttcatgttcgtttaacttgccccgcagatgcatcttattgtgaaaatcaagcgcctgtgcctgctggtgatggttgtggagacgaattatattcttggtttgaaccgccaaaaccaggtgcttcagtgagcaaacctaaagttacaccgcctgagccgtttttgtgccaacaaattttaaattccccgaatcggagtgaatggttagaatagcattaaggtaaatcaatatggatatcggcattgatcttttagcaatattgttttgtgttggttttgtcgcatcatttatcgatgcaattgctggcggtggtggattaattactattccagcgttgcttatgactggcatgccaccagcaatggcgttaggcaccaacaaattgcaagctatgggcggtgcattatccgcaagcctttatttcttgcgaaaaagagcggtcaatttacgcgatatttggtttattttgatttgggttttcttaggttcagccctaggtacattattaattcaatcaattgacgtggcgattttcaaaaaaatgctgccttttttgattttagctattggtctatattttttatttacccctaaattaggtgatgaagatcgaaaacagcgtttaagttacatgttatttggtcttttagttagcccatttttaggtttttatgatggcttctttggaccagggactggctcaatcatgagtttagcctgtgttactttgctaggatttaatctcccgaaagcgacggcacatgcaaaagtgatgaacttcacttcgaaccttgcttcttttgcgcttttcttattgggtggacaaattctttggaaagtgggtttcgtgatgatggctgggagcattttaggtgcaaatttaggtgccaaaatggtgatgacgaaaggtaaaaccttgattcgaccgatggttgttatcatgtcttttatgatgacggctaaaatgatttacgatcagggttggtttcatttttaattcggaaagcgcgcaaaagtgcggttaaaattaattacattttattatgtcggataatcaacaaaatttacgtttgacggcgagagtgggctatgaagcgcacttttcatggtcgtatttaaagcctcaatattgggggatttggcttggtattttctttttattgttgttagcatttgtgccttttcgtctgcgcgataaatttgcgggaaaattaggtatttggattgggcataaagcaaagaaacagcgtacgcgtgcacaaactaacttgcaatattgtttccctcattggactgaacaacaacgtgagcaagtgattgataaaatgtttacggttgttacacaagttatgtttggaattggtgagattgcaatccgttcaaagaaacatttgcaaaaacgaagcgaatttatcggtcttgaacatatcgaacaggcaaaagctgaaggaaagaatattattcttatggtgccacatggctgggcgattgatgcgtctggcattattttgcacactcaaggcatgccaatgacttctatgtataatccacaccgtaatccattggtgaattggctttggacgattgcacgccaacgtttcggcggaaaaatgcacgcacgccaaaatggtattaaaccttttttaaatcatgttcgtaaaggcgaaatgggttattacttaccagatgaagattttggggtggaacaaagcgtatttgttgatttctttgggacttataaagcgacattgccagggttaaataaaatggcaaaactttctaaagccgttgttattccaatgtttcctcgttataacgctgaaacgggcaaatatgaaatggaaattcatcctgcaatgaatttaagtgatgatcctgaacaatcagcccgagcaatgaacgaagaaatagaatcttttgttacaccatctccagagcaatatgtttggattttgcaattattgcgtacaaggaaagatggtgaggatctttacgattaaaaatagggtttgaaagtcatattctcgaaaacggatattcaataaggtaaataagaaatggaagaaaaaattcggctgacgcaatacagccatggtgcaggttgaggctgtaaaatttcgcctaaggtgttagggacaattttacattcagaactggaaaaattttatgatccaaatttgctcgttggcaatgaaactgcagacgatgcggcggtgtatgatcttggtaatggaactgcaattatcagtaccacagacttttttatgccgattgtagatgatccttttgattttggacgaattgccgcgaccaatgccattagtgacatttttgctatgggcggtaagccgattatgggaatcgctattttaggttttccaaccaatgtattacctgcagaagttgcacagaaaattgttgatggtggtcgttttgcttgccatcaagcgggtattgctttggcgggtggacattccattgattcgcctgaacctatttttggtttagccgtgacaggtgtgattgacactgaaaaagtaaaacgtaatgcttctgcaaaatcaggttgtaagctttatatgacaaaaccgcttggtattggtattttgacgacggcggagaaaaaaggaaaacttaagccagaacatcaaggtttagccactgccgctatgtgccaaatgaattctattggcagtcaattttcccaagtggatggcgtcacagcaatgacggatgtcactggatttggtttacttggccatttaattgaaatctgtgaaggttcaaatctaagtgcggtagttttttcggacaaaattaaaaccttggacggagtaaaagattatattgctcaaggttgcgtacccggtggaacagggcgtaattttgaaagttatggacataaagttggcgcattaacggaagaacaaaaagcgattttgtgcgatcctcaaacatcaggtggtttattagtggctgttgagcctaatagcgttcaaactataattgaaatagccaaagatactggcattgatttatatgaagtgggtaaattgaaacctaaatcagaatccgatatcgttgttgaagtaaaataaggaattttaatcgatcatcctaatgattaattaaattaccatgatccacatagcaaaaaaccttggaatatcccaaggttttttagattatcattaaatataatggaattatgcgcctaaacgctctttaatacgagctgatttacctgaacgttcacgtaagtagtaaagtttagctttacgtaccgcacctttacgtttaactgcgatagaatctacagctggagagtgagtttggaatacacgctcaacgcctacgccgttagatactttacgcaaagtaaatgctgagtgcaagccacggttacgaattgcaataaccacgccttcgaatgcttgcaaacgacgtttgctaccttcaactacccatactttaacttctaaagtatcacctgggcggaagctaggtacgttttgttttaattgttcttgttcaagttgtttgataatgttagacattgtttgatcctttattgatcctagatgtaactgaaactaactgttatgctcggcttgcgcctcttttaacagcttacgttgttcgtcagtcagagctaggccttctaagagctcagggcgtcggaaccacgttctctgtagcgattgttttaatcgccatttccgaatttcttcgtgatgtcccgacatcagcacgggtggtacagttaatccttctaacacttccggtctggtgtaatgcgggcaatctaataaaccatctgcaaaagaatcttcttctgcggaggcttgtttgcctaatacaccaggaataaaacgtgcaacagcatcaattaatgtcattgccggcaattccccaccagttagaacgtaatcgccgattgaccattcttcatcaatttcagtttgaatcaaccgttcatcaatcccttcgtaacgtccacatactaaaatcaatttctgattttgagcaagctcggttacgccgtcttgatcaagtttacgtccttgtggcgaaaggtaaatcacctttgcgccttctcctgccgctgcttttgcagtatgaatcgcatcccgtaaaggttgcaccatcatcagcattcctgggccaccaccataagggcgatcgtccacagttttatgcttgtcgaatgtaaaatttcttggattccaacattcaactttcagaagattatgttttacggctctacctgtaaccccaaattccgtaatcgctttaaacatttcggggaataatgaaattacccctatccacataaaaagcctactacattacgtttgtgcatacttgagattagaaaccagcgtcccaatccacttcaattgtttttgtggtgagatcgactcttttaactacttgttcatacaaaaacggaattaaccgctcttgttttccaaaagcatctttggtattggctttaaccactaatacatcattagaacccgtttccatcatttctgttactgttcccattgtataaccttctaagtttacgactgtacaaccgattaaatcgtgccagtaataatcgccctcttctagttctgggaaaacagataaatctacaccaatttcaacattcgctaaaatttgtgcagtttcacggtcatcaacgccttttaatttaacgatgatttcgtgattatgataacgccagttttctaattcaattgattgccattcacctttgatttttaaaaaccaaggttgataatcaaaaatgctttcagcttgttctgttgatgaataaatacgcaaccacccacgaataccgtaggttgagcctaatttgcccacaacttcaatatgttgttgttccatatttttcacctatcttagtttgagaactaaatcaaaaagcaaaattatgctgctttttgtgcttcttttaccaagctcgcaacacgatcagaaagtgaagcaccttgagcaacccagtgatttacacgctcaagattaatgcgaagacgttctgcattaccttgtgcaattggattgaagaaacctacacgttcaatgaagcgaccgtcacgaggtgaacgactgtcagcgactacgatttgataaaatgggcgttttttagctccgccacgagataaacgaatggttaccataaccttcctctaaatgtttaattactaaaagaatattctcaaattcgaaagtgatttgagaatatagcttacttttttctctgtatatatagacaaaaagcctgcgaattttatacttttcaagcaaaattgcaagttttgtatgcataaagtaggttgtattccttttaattatcattcacaatttattttgttttgcgatataatacgaggcatccagctgttttaggtcaaatttacgcgtatagcggtattttagcttgataaaatatcagttaaatgaggtttattatgaaaattagttttcattctgtgttaattggattagcatcatttattggtgttcaacaaggtgtaatagctagtccatcttctcatcaatcaatatccactgaatcagctgaggctttgaagcaacaattttcaatggctttagctaaacaagacaaacaacaaattacaaatttacaaaaaaaacttaccgcacttttttctttacctccccaatttcttgataatcagatccaaataagcgaaaaaatcctcactcgcatttttaaaacagataaaaatctcacgcctaaatttcttgattacttatactttgagccaataaatactgttgatgctaatttaattcaggaaatgaagaaaaacttactggtgtcttttttagcaaatgatcaggcaaaaatttatattcgtcaaacagataattcagagcaatttgttcagactttaatggagcggggagcaaaagcagatcaaattatattactgtctttgaatgccaaaggtatatttcaaaaaattattgaacaaatacgtcaagattttccgaatcagactattttttcgattactgaaaatcgtattagtttgattactccttcttcagaaattaagtctcgccttgctttagcaaatatgatgttcaatcgccaatttaaaggtgtggaagttgatgatttctcgtatttagatcaacctcgagaaaatttacagcacaataatgatgcaattcgttacaaaacctttcaagcaatgctagaaggtttaaattaatcccttaccaataggagtttttatgcttttatccaaaaaatcagctacctttgcactcagtgcatttgcgatgcttttcactagtgtagctcttgccaaagaggcaccacaagctcacaaagctgtggaattaagtattttgcacatcaatgatcaccattcttatttagaaccgcacgaaacacggattaatttaaatggtcagcaaaccaaagtggatattggtggtttttctgctgtcaatgcaaaacttaacaaattgcgtaaaaaatacaaaaatccattggtactgcatgcaggcgatgccattactggtacgctttacttcacgctgtttggtggttctgcagatgcagctgtgatgaacgcaggtaattttcattattttactttaggtaatcatgaatttgacgcaggtaatgaagggttattaaaactgcttgaaccattaaaaatccctgtgctttcagctaatgtgattcctgataaaagttcaattttgtataacaaatggaaaccttacgatattttcactgtggatggagaaaaaattgccattatcggtttagataccgtgaataaaacagtgaattcctcttctccgggtaaggatgtgaagttttatgatgaaattgctactgcacaaattatggcaaatgcgctaaaacagcaaggaattaataaaattatcctactttcacacgcaggtagtgaaaaaaatatcgaaattgctcaaaaagtaaatgatattgatgtgatcgttactggcgattcacattatttatacggaaatgatgaattacgtagtttaaaacttccagtaatctatgaatatccacttgaatttaaaaatccaaatggagagcctgtatttgtaatggaaggctgggcttattctgccgtggtgggggatttaggtgttaaattcagtcctgaaggtatagcgtctattactcgtaaaattcctcacgtgttaatgagttctcataaacttcaagtgaaaaattcggaaggtaaatgggctgaattaactggcgatgaacgtaaaaaagcacttgatactttaaaatcaatgaaaagtatttcacttgatgatcacgatgcaaaaaccgataagcttattgctaaatataaaagtgaaaaagatcgcttagcacaagaaattgtgggcgttatcactggttctgcaatgccaggtggttcagcaaaccgtatcccaaataaagcaggatctaatccagaaggttctattgcaacgcgttttattgcagaaacaatgtataacgaactcaaaacagtggatttaactattcaaaatgctggcggtgtacgcgcagatattttaccgggcaatgtaacctttaacgatgcttatactttcttacctttcgggaatacgttatatacctataaaatggaaggttcgttagtgaaacaagtgcttgaagatgcgatgcaatttgctttggttgatggctctacaggcgcattcccttatggtgcaggtattcgttatgaagcgaatgaaacaccaaatgcggaaggtaaacgtttagtgagtgttgaagtcttgaataaacaaacccaacaatgggaaccgattgatgataacaaacgttatcttgtcggaacaaatgcttatgttgcaggcggtaaagacggttataaaacctttggtaaattatttaacgatccaaaatatgaaggcgttgatacctacttgcctgatgcagaaagtttcataaaatttatgaaaaaacatccgcactttgaggcttacacttcatcaaatgtgaaatttaatgcttcaactgatgcattacctaaaaaataaaattgaaaaataggctaaaaatagcgcgtatttaacgcgctatttttgttattagtcctaggtttgaagacttcatagatgattaagaattttaactattccatatttagatgctttctcgtggaaaataaattccctataaaggttgaaaaatagggtgatttattgcgataatctaccccattttttgggagatctttctatcttctgcatttttacgcagtttattttcattagaaatgatcgaattttatttcacttttaatttaattagataaaaaacaatggcggaaaaacgtaatatttttttagtaggaccaatgggtgcaggtaaaagtactatcggtcgtcaattagcacaacagcttaatatggattttattgattccgatgcagtgattgaagaacgtacgggcgcggatattagctggatttttgatttggaaggcgaagacggcttccgaaaacgtgaagaacgcattattaacgaactcacacaaatgcaaggtattgtactttcaactggtgggggagcagtgctttctaaggaaaaccgtaattatttatcagcacgtggtattgtaatttatttagaaacaacggtggaaaaacaattccaacgcactcaacgtgataaaaaacgtccattgctccaagatgcagagaatcctcgtcaagtattggaagatttagcaaaaattcgcaatccgctttatgaagaaattgcggacatcactttgccaactgatgaacaaaatgccaaagtaatggtaaatcaaattgttgatttaattgataatatgaatggattaaatggtgcgctttaaacacacctaaggataaattatgttgtgcgtcaatgtggaattgcaagagcgtcgctatcctattttaattggtagcggattgttacaagatgaacgtagttacccgattaaacgtggggatcgcgtgatgattgtaacgaatcccacggttgcacagttttatcttgatacagtcatctatgcgttggaaaaacgtggttgcgtagtcgatcatgttttattgccagatggcgaaaaatacaaaacacttgaatctttaaacttaattttcaccgcacttttgcaagataatcatgggcgagataccacgattattgcattgggcggcggcgtaattggcgatgttgctggctttgtggcggcaagttatcagcgcggtgtgcgtttaattcaaatgccaaccacattgctttcacaagtggattcttcagtgggcggtaaaacggcggttaatcatgaattaggcaaaaatatgattggcgcgttctatcagccatcaatggttattattgatacgctcacgcttaatacgcttcctaaacgtgaagtaaacgcggggcttgccgaagttatcaaatatggtgccattttagattacgaattttttgaatggctagagcaacatattgatgaacttgtcgctttgcatcctgaggcgcttcaacattgtatttctcgttgttgccaaattaaagcagatgttgttgcgagagatgaaacagaaaaaggcgatcgtgcattgcttaatcttggacatacttttggacatgccattgaaactcacttaggttatggaaactggcttcatggtgaagctgtttcgacgggaatgatgatggcagcggtgctttcggaagaacttggagatatttctattgcagatgtgtctcgccttgaaaaattacttgctcgtgccaatttgcccaccgtatcaccggatacgatgcagccagaagactatttaccgcatatgatgcgtgataaaaaagttctatcgggtaaattgcgtctggtgttactcaaatctctaggccaagcttatgtggcgaatgataccgatcataccctcgtgttaaacgcaattcgtcgttgtactcaaacggattaagatgttacgtccgaaaaaacaatctttaaaacctaagttaaaacaccgtccatttttaaaatgggcggggggaaaatttcgtttaacggacgagataaataaagcctttccaaacaaaaaaaactgcttaattgagccatttgtgggtgctggagcgatatttctgaattctaattttgaacgctatattttggcagatatcaaccctgatttaatcaatctattcaatattgttaaagaaaatgtagagggttatattgaagattgtaagccgattttcttcgctgatgatgccaatacacccgattattactatgctaaacgtcgccaattcaatgcatcaacagatcctttcgaacgttcgattatttttttatatttgaaccgttttgggtttaacggattatgccgttataacagcaagaatgaatttaatgtgccttttggagcttacaaaactcattattttccagaagatgaattacgttatttcgctcataaagcgcaaagtgcggtatttttatgctgtgattttcaaaaaacttttgaatttgccgataaggattcggtgatttattgtgatccaccttatgctccgctacaacaagagactaattttactggttatgcagggaatgagtttggactagtgcagcaacgtgctttggcagatttagcgaaatctatacaaaaagaaaaacaaatttcgatattgatctcgaatcacgatactaaatttacgcgtgaaatttataacggtgctaaatttaaacgggtaaaagtccaacgttctattagccaaaacccagaaaaacgcgtaaaagtgaaagaattgattgcgatatttggtgctcgtaaataataaaaatagcccttactttatactaaaagtaccaaaatcgtaattttaaaaccacaataaaataatatattgtgtattaccatttatctcttacagtacctatatacttttttgatactaacccaaaatactcacaagtctgtaattttacctgtaatccttttgttttatcagaatgattatctagaaaactcatccaatcatcagaataattattatcctatagtagaatgtaaattattttaataacgccttatttgtactgtggataattcatcaaaatttaagcctgttatgctttattctttagtgtataacaaataggataaaaatggaaaaagcaaaaccatccaagcaaagaaattttaatcactgtcaaggagtacattattgaatttggtaataaaccgttaggtttaaaagatactacacccaaatgccactgccctatttgtgctcaagttttatttgagaaaaatgttaatacagtgccatcctctaatagcaatttttctaattacccaaaaagcgaattctgccccataaaattaaactaaagcaatttataccaatcatattttccattatcaccaaataaaacgcatggactgaattaaaaaattcattcagaaaaaattggcaaaaatattatcgtcaaattagtttttcggcaaaaaacttataacctattgaatttattatattagctaatcaacaaaaaatttgggaatacaataaacttgaagagtatcaaattccttatattctattaacattagcagactgtcctaaccaaaaaggaacatataaaaataaacgtcactgctggtttagattttggtttgatgcttcaattcaaagatatgaagatatttggaataatagttctttaccagtattgtggacaacctattattacctatcagggaaacaaagaaaaccttcagaaataaatctaaaaaacatgaattatttcatcatggataaaactttcttagaacaagaaatattacttccccaatttattattcaaaatatagaacggtggtttaaaacacacaattttgtatagacaagtcagcacctaatactatttcatgacgaagatcgcctttttctttaaaaaggcaaaaataatgccattaatcaaccatgccagtaatgtcgccaccaataaatctattgggtaatgcatgcctaatcgcacacggctaatcaacatcaataagccccacactgcaatacccaccaccagcaattttgctttaaaagaacggttacccaataattgggtaaagccaacagcaagcattagccaagttgccgcaaaaatcgtatgtccagaagggaacgaataccccgtttcattctcataatgatgaactaaccaagctggtgtgatagcatccatcgaataaaaattcttagctatttcagcacgcaaagtgcggtcatttttataaaagttttcaggcgttgaatgagtttgctcagctagataaacggtaaacggacgaggttcttcaaataatgcttttgcccctgtttttgccgcttgagttgcaataactgaaatccccatcacaattacgcctaatagccattgttttggatttttaaataaaaacgcaaacaaaagcgtaaataacacacaggtaatcaacgcataaggtacgctacccgtttcagtgagcaaataaagccaataatcagcttgagttaattggctattaccatgccattgataggaaataccccaaataaaaaatggtacaagacaaagtaataacgtatataatgacagccttttgaacatgctcgccccttgataataaaaaataacgcgcgcattctaacagaaatgactacgaataaggatcactttatggcaaaaattcagctagttgcgcaagccaatttacccactgaatacggtattttcaaaatggtgggatttgaattcccagatacaaaaaaagaacatgtagccttagtgatgggcgatatttctaatgctgatgaacctgtattagcacgtatccattctgaatgtttaactggcgatgcgcttcacagcttaaaatgcgattgtgggttccaactggcgacagcattaaaacaaattcaagaagaaggtcgcggagtcttaatttatcatcgtgaagaaggtcgcggaattggtttgattaataaaatccgtgcttattctttacaagataaaggaatggataccattgaagctaatcttgctttaggtttcaaagcggatgaacgcaactttgaagtctgtgccgatatgtttgagctacttggtgtaaaaaaagttcgcttaatgaccaacaacccagaaaaagtagaaaccatgaaaaaagcaggtatcaacgtggttgaacgagtaccgcttaatgtaggcgaaaaccgctacaacacaaaatatcttgatacaaaagcgaaaaaaatggggcattacattgtgcataacaatgacgaacaacatttaatgacctgtccacattgccaggaagagattatttaacaaataagatatgttaaaaaagccatactgttatattgaacagtatggcttttttatttaaactttatgttatggaataatcaaaagattttttagcatattgctaaaaacgagaaaccccgtctcgtattccaaagagcggggcttatcaggagtaagtaaaatgaaaaaaattgcctttttcattttcttgattatctgttgtttagttagctgttccggaacagttatctaagataatcgcaaggggacgatgtaggagttgtccccaatgcctccaatcttaaagaattctttccttgattgcaagggcaattattgactttgaacctttctccacaaatctttactgtaaatgacaccgacagaatttacttgagcacccattatactcggtgcaagataaacaggcgtactatattgaaaaatgggtaacactaaatgctcttgttgaactatcccttttaattttgcgtaattttctaaccgcacttttccggatgtcgtcgtcattgcactttcaaataaacgatcaaattccgcatttttatagccatttttgttatctgggctttttgaatagaataaatttagaaatgctgcaggatcattaaaatcagcacaccagccagaacgaattaattgaaaatcgccttttgtgcgggccgtttgcaattcttgccagctcatcccttgattttcaactcgtaataaatcagattgtgataattgatgatttaatcgcattgcaatggtttgattcagagatgaatcatcataacgaatacgtaatttcaatggacgagtttcactaatttgattttgggaaaagagctgttctgcaacaactggctcccaaacagattcttgctcacctagcatagattttggcaaaaaagtattgttaggataaagatgagcaatatctgcaaccaaattattggtagaaatcatcgaaacaatcgcttttcttaccgcacttttttgtaacacaggatcggaaagattaaactcatagaagtaagtacaaagttgcggataatcttggatattctgatcgacttttttcggattcattacaacatcaaaatcagacaaatctgcatctgctgcaattttttgatacttcacttgctgaaatatcactttttctttcgcccaataataaggattggtagttaaaatatgctgattttcagcctgactttgtaactgatatgcgccattactgataaatatttcagtcgatttagcatagtgaggcaaaagactgacatgtgccagcatagaaggtaaatatggcgatgctttatctaattcgatgcgtaaagtgcggtcattttcagcaaacaatcctagggattcaacaggtaacgctttttccaatactgccttcgcatttttcagattcataaaagccaaataatttttaagtgggctttcagattgagaaagtgtttgccaagattgtacaaaatctgatgcagtgataggctcgccatttgaccatttagcattttcacgcaaagtgaaaatccaagttttattgtcttcggtttgccaattttctgctacagctggaacaagattactttgcacatcataagccgttaatccttcaaaaagatctcgtaataattgagtttgttcttcgctttgtgcttgccaaggttgcaaagtcaaatcgctataaacgccacgttttaattcaactcggttagattctaattgagtatttttttgtgtctcaatttgtggcgaaataggcttaggactatccaatttatcacaagccaccaccgtaaaaataatagaaaaaataaccgcacttcgttggcacaaggcgaacaaattattcattttcggttttaatccaaaataagaagaaccaaaacttaatacaaatcaacgcaacaataacactacgccctattacacttggcgtgaaataaaaaccaattagtagcattgtggtagcaaaagtcaaaataaaaattttggtatttttctttaatgatcgattttcatgaaaggacttgagatgtttttgataaatacttgtgcctaaaaaccattgttctaagcgttttgaaccttttgtgaagaaaaataaagtaagtaataaaaaaggcgtggtaggcaaaagaggaagaaaaatcccaatgatgccaattgcaagtgaaagaaaacctaaaataatgtaaataattttcataatgttcctaataaaaaagaaaatgcaaactattattactgattttttagatttttcaaccttgatattatagaatttgccgtcacataaaaaaacagttttcaaaaaaggaacatttatgtctatgtcaaatccattacttcacattcaaggcctaccgccattttcacaaatcaagccagaacacattcaaccagctgttgaaaaattaattcaagattgtcgcaatacgatagaacaagtgttaaaacaaccgcactttacttgggaaaatttcattttgcctttaacggaaactaatgatcggttaaatcgtgcttggtcgcccgtttctcatctcaattcagtaaaaaatagcactgaattacgtgaagcctatcaaacgtgcttaccgttactttctgaatacagcacttggattggtcagcataaagggctttataatgcttatttagcgttaaaaaatagtgctgaatttgccgattattcgattgcacaaaagaaagccattgaaaattcactgcgtgattttgaactttcaggtatcgggctttccgaagagaaacaacaacgttatggcgaaattgtggcacgcttatcggaattaaattcacaattcagcaataatgtattagatgccacaatgggttgggaaaaactcattgaaaacgaagctgaacttgctggcttacccgaatccgcactgcaagcagcacaacaatctgccgaaagtaaaggattaaaaggttatcgttttacgttagaaatcccaagttatttgcctgtgatgacttactgcgaaaatcgtgcattgcgtgaagaaatgtaccgtgcttatgcaacacgcgcctctgaacaaggccctaatgcgggcaaatgggacaacagtaaagttatggaagaaattcttacattacgcgtggaattggcgaaattactcggttttaatacttacaccgaactctcacttgccacaaaaatggcagaaaacccacaacaagtgcttgatttcttagatcatcttgccgaacgtgccaaaccacaaggcgaaaaagaactgcaagaattgaaaaattactgcgaaaaagaatttggtgtcacggaacttgcaccttgggatattggtttttacagcgaaaaacaaaaacaacatttatacgccattaatgatgaagaacttcgcccatattttctagaaaatcgcgtgatttcaggattgtttaaattaattaaacgcattttcaatattcgtgcagtggaacgcaaaggcgtggatacttggcataaagatgtgcgtttctttgatttaatcgatgaaaatgatcaactccgaggcagtttctatcttgatttatatgcgcgcgaacataaacgtggcggtgcgtggatggatgattgtatcggacgtaagcgtaaactggatggcagcattgaaacgcctgtggcttatttaacttgcaacttcaacgcccctatagggaataaaccagcgttatttactcacaatgaagtcaccacgctattccacgaatttgggcacggaatccatcatatgctcacgcaaattgatgtatccgatgtggcgggtataaatggcgtgccttgggatgctgtggaattaccaagtcaatttatggaaaactggtgctgggaagaagaggctttggcgtttatttcagggcattacgaaacaggcgagccgttgccaaaagaaaaactcacgcaattattaaaagcgaaaaatttccaagctgcaatgtttatcttacgtcagcttgaatttgggatttttgatttccgcttgcatcacacctttgatgcggaaaaaaccaatcaaattttggatacacttaaatcagtgaaatcacaagttgccgtcataaaaggcgtagattgggcaagaacgccacacagcttcagccatatttttgcagggggctacgccgcaggttattacagctatttatgggctgaagtattatcagcagacgcttattcacgctttgaagaagaaggtattttcaacccaatcaccggcaaatcattcttagatgaaattctcacgcgtggtggctcagaagaaccaatggaactcttcaaacgcttccgtggccgtgaaccgcaattagatgcgttgttaagacataaaggaattatgaactaatacgtcaaactatagggcatgcacaacatgccctttctcaaatatttttctcgacataaaaacatagtaaattttaaccgcactttatccaaacaaaacctacaaacgagacattatttttacaaatagctgtaagataaacgcatagaaattcacgcagaatagactaatttcctgtataatttttcacatatctattcaactcattacacaaaatattctgaggattttatggctgctgcaattcaacaacgtgccgaacttcaacgtcgtatttggcaaattgctaatgatgtgcgaggctcagtcgatggctgggatttcaaacaatatgtacttggcacacttttttaccgttttattagcgaaaattttgccaattacattgaagcaggcgatgaaagcgtaaattatgcccaattacctgatgaaatcattaccccagacattaaaacagatgccattaaaacgaaaggctactttatttacccaagccaattatttaagaatgttgcggctaatgctggcaacaatcctaatttgaatactgatttaaaacagatttttactgatattgaaaactcagcgacgggctttccgtctgaacaagatattaaaggcttatttgccgattttgataccaccagcaatcgcttaggcaataccgtaaaagataaaaacgaccgcttaacggctgttttgaaaggcgtggctgaacttgattttggcaaatttgaagataaccacattgatttatttggcgatgcatacgaatatcttatttctaactatgctgccaatgcaggcaaatctggtggtgaattttttaccccacaaagtgtttccaaactcattgctcaaattgcaatgcacgggcaaacctcggtcaataaaatttatgatcccgcagcaggttctggctcacttttgcttcaagccaaaaaacaatttgatgaacatattattgaagaaggctttttcgggcaggaaattaaccataccacatataaccttgcccgtatgaatatgtttttgcataacatcaactacgacaaatttgatattgctttaggcaacaccttaatggaaccacaatttggcgatgataaacctttcgatgccatcgtttctaacccaccttactccgtgaaatgggctggctccgacaatccaacactgattaacgatgaacgatttgcccccgcaggcgtgcttgcaccaaaatccaaagcggattttgcctttattttacacgcattaagctatctttcaggcaaaggcagggcggcgattgtctccttcccaggcattttttatcgtggcggtgcggagcaaaaaattcgtcaatatttggtggataataattttgtggaaaccgtgattgcccttgcacctaatctattctacggcaccagtattgccgtaaatattttggttttgtccaagcacaaaccaaatacccaaactcaatttatcgatgccagcggtttatttaaatctgccaccaataacaacattttagaagaggaacatattgagcaaattctcaaactgtttgccaataaagaagatgtgccgcatttggcaaaatccgtatcctttgaagaaatcgcccaaaatgaccacaaccttgcagtaagttcgtatgtggaacaaaaagatacccgagaagtaattaatattgatgaactcaatgctcaaattcgtgaaactgttaccaatattgaccgcttgcgtgccgagattgataagattgttgcagaaattgaggggtaaaatgtagggtgggcttcagcccaccatttacgataacaggtggtgggctaaagcccaccctacgaggaacaataaaaaaacaccatgaaaaacaaccgcacttttttagaaaaattattggatgggtctgaggttgagtggaagcctttagatgaagttgccaatatcgtcaataatgcaagaaaaccagtcaaatcatcctcacgagtgtcagggaatattccatattatggtgctaataatatccaagattatgtcgaaggatatactcacgagggcgaatttgtattaattgctgaagatggttctgctagtctagaaaattactctattcaatgggctgtaggtaaattttgggcaaataaccacgtccatgtagtaaatggcaaagaaaaattaaataatcgttttttataccattatttaactaatatgaatttcattccattcttagctggaaaggaacgtgcaaaattaacaaaagctaaactgcaacaaattccaatccccatccccccactctccgtccaaacagaaatcgtaaaaattttggacgcattgacagcacttaccagcgagcttaccagcgagcttatactacgtcagaagcagtatgaatactatcgggaaaaattgttaagtgaagaagaacttgggaaggttgggtttgagtggaaaacaattgatgaaatctcaaagaaaatttcttcaggcggaacgcctacaacatcaaataatggctattatgacaacggtactattccatggttaagaactcaagaagtagattttaaagaaatttgggataccaacataaaaattactgaagatgctctaaataattctagtgcaaaatggattcccgcaaattgtgtaattgtagcaatgtatggagcaactgtaggcaaaactgctattaataaaattccactaacaactaatcaagcatgtgctaatatcgagattaatgataagttagcttgttatcgctatattttccattatttaactagtaaatatgaatacattaaatcattaggaagtggctctcagaccaatattaatgctcaaattatcaaaaaactcaaagttccagttcctccaatcgaagaacaataccgcatcgtttcaatcttagacaaatttgaaaccttaaccaattccatcaccgaaggcttgcctttagcgattgaacaaagccaaaagcggtatgaatattaccgagaattattattgaatttccctagcagagaataatatgactaaaagtttagacaaaattgcaaaacaattaagagattctgataaaaaggttaatctaatttacgcctttaatggaagtggaaaaacccgtttatcaaaagtctttaagaatcttattgcacctaaagaaaatcatgacaatgaagaagatctaacacgaagaaaaattctttatttcaatgcctttaccgaagatttattctattgggataatgatctacttaatgacacagaaccaaaattaaagattcaaccaaattcttttattcgctggttgattagagatcaaggggatgaaggtaaagtaattggaaaatttcatcattattgtgatgaaaaacttatgcctaaatttgatatagaaaataatcaaattacattcagttttgcacgtggagatgatacgcctgaagaaaatataaaactatcgaagggggaagaaagtaattttatttggagtatttttcatacgttaattgaacaagttgttgcagaattaaatatctcagagcctagtgaacgcactactaatgaatttgatgaacttaaatatatctttattgatgatccagtaagttcattggatgaaaatcatcttattcaattagctgttgatttagcagaattagtcaaagatagtcccgatactataaaatttattatcaccacacacaatcctttattttataacgttttatacaatgaacttggagcaaaaaatggttatattctaagaaaagatgaaaataagaatgaaaacgaaagatttgatcttgaggtgaaacaaggtggttcaaacaagagtttctcctatcatctttttctaaaaaatctacttgaagaagttaaatctaaagatattcaaaaatatcatttcatgttactgagaaatttatatgaaaaaactgctaactttcttggttattcaggatggtcaaatctattacccaatgatgatgcaagacaaagctattacactcgtataatcaattttactagtcactctacgttatcaaatgagataatcgctgaaccaacagatgccgaaaagaagattgttaaatatttacttgaacatctaattaataattatggtttctatatagaagaaaatattaaagagccacaaactgataatataacagagtaaatatgaacgacttaatcatctacaacaccgatgacggcaaatctcacgttgctttattggttgtcgaaaatgaggcttggctgactcaaaatcagcttgcggaactttttgacacctctgtaccaaatataaccactcatataaaaaacatattacaagacaaagagttagatgagttttcagttattaaggattacttaataactgcccaagatagcaaacaatatcaagtaaaacattattcccttgatatgattctcgccatcggctttcgtgtgcgcagccctcgtggtgtacagtttcgtcgttgggcgaatacgcaattacgtacttatttagataaaggttttctattagataaagagcggttgaaaaatcctcaaggtcgatttgatcattttgatgaattactggaacaaattcgcgaaattcgagccagtgaattgcggttttatcaaaaagtacgagagttatttaaattatccagtgactacgataaaacagataaagtcactcaaatgttttttgcagaaacacaaaataagttgatttatgccattacacaacaaaccgccgcagagcttatttgtacgcgtgcaaatgccaaattgcctaatatgggtcttacctcttggaaaggtgctgttgtacgtaaaggcgatattattaccgctaaaaactatttaactcatgatgaattagattctttgaatcgtttagtgatgatctttttagaaagtgctgaattacgcgttaaaaatcgtcaagatctcacattaaatttctggcgtaataatgtcgataatttaattgaatttaacggttttccgttgcttatcggtaatggaacccgaaccgtaaaacaaatggaaacctttaccaaagaacaatatgccttatttgatcaggtcagaaaacaacaaaaacgcatacaagctgataatgaagatttagaaattttagaaaactggcagaaagatctgaaaaagcaaaagcattaaggaactacttatgacccaatacaaaactatcgctgaatccaataattttatcgttttagatcaatataataaatttgtggaagaacctaatgctggttaccaaacggaagggagccttgagcgtgagtttattcgtgatttacaggctcaaggctatgagtatttacaagggcttaataatcacgatgaactgattaaaaacttacgtgttcaattacaacggttgaataatgttattttctccgatgcagaatggcaacgttttttagaggaatatttggataaaccgagcgataatctgattgagaaaacccgcaaaattcacgatgattatatttatgattttgtgttcgataacggacgcattcagaatatctatttgctagataagaaaaatcttgccaataattctctgcaagtcatcaatcaatttgagcaaacaggcagctatgataatcgttatgatgtgacaattttggtgaatggtttaccccttgtgcatattgaactgaaaaaacgtggcgtggcgattcgtgaagcctttaaccaaattcaccgttacagcaaagaaagtttcaataaagaaaattctctctttaaatatattcagatttttgtcatttctaatggcacggatactcgctattttgctaatacgactaaacgcaataagaatagctacgacttcacaatgaattgggcaacggcaaaaaatactctgattaaagatttaaaggattttaccgcaactttcttgcaaaagaatactttgctcaatgtgttggtaaattactgcgtgtttgatgtttccgacactctattgattatgcgtccgtatcaaattgccgccactgagcgtattttatggaaaatcaaaagttcatatcacgccaaaaattggagcaacaaagaaagtggtggctatatttggcataccacaggctcaggcaaaaccctcaccagttttaaagcatctcgtcttgcgactgaacttgattttattgataaagtcttttttgtggtcgatcgtaaagacttagactaccaaacgatgaaagaatatcagcgtttttcgcctgatagcgtgaatgggtcggaaagtaccgctgggcttaaacgcaatattgaaaaagatgataacaaaattatcgtaaccaccattcaaaaattgaataatttaatgaaaagtgaagaaaacctgtctatttatcaaaaacaggtggtctttattttcgatgaagcacatcgctcccaatttggcgaagcacaaaaaaatctaaaacgtaaattcaaaaaattctatcaatttggttttactggcacacctattttccctgaaaacgcattaggtgcggaaacgacaacaagtgtgttcggtacggaattgcattcttatgtgattaccgatgctattcgtgatgacaaagtactgaaattcaaggtcgattacaacgatgtccgcccacaatttaaagccttagaaacagaaaaagatcctgaaaaattaaccgcacttgagcagaaacaagcctttttacaccctgagcgtattaaagaaatctcgcaatatttgcttaacaattttaaacaaaaaacccaccgcttgaatgccacaggtaaaggctttaatgcaatgtttgcggtaagcagtgtggaagcagcaaaacgttattacgaaaccttacaaaatttacaggcagagcaggagcatccgttaaaaattgcaacaatcttttcgtttgccgccaatgaagaacaagatgcaattggcgatattccagatgagacctttgaacccactgctctaaacagtacggcaaaagaatttttaacaaaagccattgatgattacaatcactactttggcacgaattatggcgtagatagtcaatcattccaaaattactatcgcgatcttgccaaacgtgtgaaaaatcaggaagtggatttactgattgtagtcggaatgttcttaacaggctttgatgcccctacgttgaatactcttttcgtggacaaaaacttgcgttatcacggattaatgcaggctttttctcgcaccaaccgcatttatgacacaactaaaacctttgggaatatcgtcactttccgcgatttggaacaaaataccattgatgcaatcacgctatttggcgatgacaataccaaaaatatggttttagagaaaagctacgaaacctattttaatggtgatgaaaatcaacgtggttatttagaggttgttcaagagctacaaaatcgctttcctaatccaacagaaatcgaaacagagcaagataaaaaagagtttgtaaaattatttggcgaatatctacgtgtcgaaaatattttgcagaattacgatgagtttgcagcattgcaagccttacaagcggtcgatttaaatgatccgattgcaatggagaaattcaagcaagtacattatgtgaatgatgaacaaattgcagaaatgctgaaagtacccactttaccagtaagagcggagcaagattatcgttcaacttataatgatattcgcgattggctacgccaaagaaaagaagggaatgataaagataattcgccgataaattgggacgatgtcgtatttgaagtggatttattaaaatctcaagaaatcaatttggattatattcttgcgttaattttcgagcatcataagaaaaaccaagacaaagaggtgttaattgatgaaatccgccgcacagttcgttcaagtttaggtaaccgtgctaaagagagcttgattgtcgattttatcaaccaaacaaatttagatgatattcccgataaagcgactttaattgactcattcttcctatttgctcaagcagaacagcgaaaagaagcagaatccttaattcaagaagaaaatttgaatgtcgatgcagcaaaacgctatatcagcacttcattaaaacgcgaatatgccagtgaaaacggcacagcgttaaatgaagtattgccaaaaatgagtccacttactccacaatatctcactaaaaagcagacaattttccaaaaaattgctgcatttgtagagaaatttaaaggggttggtggaaagatttaaatttaatatatcaacaattagacatcttattaagacataaaggcattatgaattaataatacaaaacgtaatgatcaatatttaactagtcgtgataataaaaacagctccaatttatacttggagctgtttttatatcgataaacttattttttacgtgctaaaattcgatttgcacactctgctgcagctgttaagccacctgccatcataataatatctttaatcactaaacgaccaactccagataaataagggaaaccataggctggcgttggtaaatctccacctagattaggcacccaagcctcgggcgttgtgattaaaaatgacagcgtgactattgacatgccaaatgtcagtaggcctcctgctaaacctgccgttgcattccaaataccagctaaagtaagaataccaacagtaacaataattgctccaataatgtaagaagccgtataggtgccattttctttatgccattcgatgttttttgcaaccatctttccttcaggatttttgtgtagtgtatattccatcactaactctcctttatcattcggcactaaatttggccctttttcatacatatagctaaaaaatgggctatttgatacaaagtgggcaattccatctgcctcatattgacaaactttcaaaccaccgatccatgccattacaataaaaatagcaatacggataaaattaataaattgacgctgcattggtgcaacaattctcgcgacaaattcaacaaatgtattaaatactgacatataaatttccacataaaagtaaataaaattgagagcctaattctactcgctttaatattaaaaagcaaaatcaattccctttaatataaaggtaaataacggagaaatttgaaaagttttactaattaaaataaaatttgattttcccattttaagcctatttattatctttaaatcacatttaaataatctttacacaactaccttatgatattaaaatttacaaaatttaagcaaatcctccacatcttctaaccaaagatttccaatttcatcaatcaattctccacaattaaaaacatcagaatttttagccgcactttctaaagtatccgctaattgacgtaaatgatttaaccctaccgatgccgctgcgcctttaattttatgggcggtatcttctgtttctttcatattatcttttgataattgagccagataatttggcatagtttgtttgaataaagataaattttctaaaatttgtttttttccaagtgtttctatcagcgctaaatcaaactgttctgaaagctcattatcatcattcatttctataatagattcgctttcatctgcaaaaaattgctgtagacaatggtgtaaatccttaattgaaatgggtttacgtaatacgccatccatgcccatttctaaatattcttgctcgctttgcataacattcgcggtaaaagcaatcattggcggtaaaaaatcataaataccgttttcatagttctctcgcaaatattgggcaatttcaaaaccactcatatctggtaatttaatatcgagcaatagaatgtcgtaaacatttttctcaaataaagtaatcgcctgcttgccatttgtcgcaacatcaacatgatgcccaagtttttctaaaatagtttttgcaaccataatattgagatcaacatcttccactaaaagaatattcaaggatggtatatttttcttaacagattctttttcagaaatttcctgagcgtggagagtaagatggaaagtcgcgccttttcctcgctcactttcaactgttaaatccccttccattaactgagcgagatttttagaaatagccaacccaataccgctacccgcactttgctgacggctttctttcacttgataatacatttcaaaaatatgtttttgttcttcaggtgaaatccccattcctgtatctttcacaataaaatggtaacaatcctgatttctcataattttaagaataatatttccctgatccgtaaacttcaccgcattactaattaagttccacaaaatttggctcaagcgaacacgatcaagattcaaccaattaggcaaattaggttcaagctctaaagaaaaaataagatttttttctttggcgaggaaactagcaaaattataaatatcgtttaataaggcggggaaatctgttggctggcgatttaattcaattcggctggcatcaattttttccaaatcaataatatcgctaaaaatatagcctaaactgaccgcacttatgttgatagtttttaaataattacgctggagatcatccaattcatcatcaagtaaaatttgactaagcccgacaatcccattcaatggcgtgcgaaattcatggcttattgtggcaagtaaggtacttttatcacggctatttttttctaacttttccaatgcttgggataattttttctgagcagcaattcgctcggcgacctcattttccaatcgattaaccgagctagaaagatcaagacgagaatgttcaagtttttctactaataaagtgaaaaaataaataacaaaaggcgcagtgagtaagccaaaagttacagaacgaaaaatatctacccaagatatctgatgaacaataaatagactaaataaaatctgagtacaaagggctaaaaccgcgagaatcatcacgcctaaaagagaaaaacgaagacgcccaagacgaataacccaatccacataactctgagcaaaatatttgaaatttttcatcaaatctcctaaaacattattatcgttataaaaaaacctgtgcatataggctttattatatccataaagtaaaagagattgttattactatgtgtgcgtaagaaatgaaaaacttaatctttattaattatctgtttgactaaaatttgtaattcaggaataacttgctcttcaaaccaaggattctttgttgcccaaagctgattacgtggggaagggtgcacgagaggcataaagtgcggtaagaattgacgataatttttaacagtgttagttacattatctttattttcgggtaaataatatttctgtgcatattgcccaataagaatagtgagctgaatattaggtagattccctaaaatcattggatgccatctttctgcaaaaccttgacgaggtggtaaatcacccgatttaccttttccaggataatagaaatccatgggaagaaccgcaaatatcccagaattataaaaataatcgtaatctactcccaaccattctcgcagacgatcaccgcttttatcattccaatacaaacgagattgctcagcttttaacccaggagcttgaccaacaatattaattcgagctgttttaggcgccgaaaataaagggaaaattccacgttctgtaaaatctttattttgaggatcagcgataatacttgaagttatttcgtctaaatttttaagcataatgaaggagattagaaatgaatatataaagtctatttgaaaaatatgaaaaatcaaaactctaaatgatgtaaataggtatatttattaaaactatattgtaggcaatacaaaactaaaaacttgatattgaaatacaatctctattttctactttaatccttttcatgaaataatgagtaaattcccaaaagctaaaaccccatatctttcgacacggggttcttctgtttttatttaacttagataagcatttgataacctggcggtgccctactctcacatggggaaaccccacactaccatcggcattacagcgtttcacttctgagttcggtatggtctcaggtgggtccaccgcactatcgccgccaggataattctttgataactcgtcttctcttttatctctcgtctcttttatctctcgttactcagtctttcctctacctttcactcgttcttattggccacaagctgaactcaattttctctctattaagtcttctatatttacttttctttgtttagtcttttacttcggtttccgctctacttttatttgcttcgcttttcatctcttacttcacttagctcccaaaaacacttgagcgttgtatagttaagcctctcgggcaattagtatctgttagctcaatgtatcactacacttacacacctgacctatctacgtcgtagtctacaacaacccttactgacttaaagtcagggatgactcatctcttggcaagtttcgtgcttagatgctttcagcacttatctcttccgcatttagctacccagcaatgcctctggcgagacaactggaacaccagtgatgcgtccactccggtcctctcgtactaggagcagccccaatcaatcatccaacgcccacggcagatagggaccgaactgtctcacgacgttctaaacccagctcgcgtaccactttaaatggcgaacagccatacccttgggacctacttcagccccaggatgtgatgagccgacatcgaggtgccaaacaccgccgtcgatatgaactcttgggcggtatcagcctgttatccccggagtaccttttatccgttgagcgatggcccttccattcagaaccaccggatcactatgacctactttcgtacctgctcgacttgtctgtctcgcagttaagcttgcttataccattgcactaacctcacgatgtccgaccgtgattagcaaaccttcgtgctcctccgttacgctttgggaggagaccgccccagtcaaactacccaccagacactgtccgagaccacgtttcgtcatcttcgttagaacatcaaacgttaaagggtggtatttcaaggtcgcctccacaatgactggcgtcactgcttcaaaggctcccacctatcctacacatcaaaattcaatgttcagtgtcaagctatagtaaaggttcacggggtctttccgtctagccgcgggtacaccgcatcttcacggcgatttcaatttcactgagtctcgggtggagacagcctggccatcattatgccattcgtgcaggtcggaacttacccgacaaggaatttcgctaccttaggaccgttatagttacggccgccgtttactggggcttcgatcaggtgcttctcttgcgatgacaccatcaattaaccttccagcaccgggcaggcatcacaccctatacgtccactttcgtgtttgcagagtgctgtgtttttaataaacagttgcagccagctggtatcttcgaccggttcaaccttcgcccgctagggactacaatctacgccggcgcaccttctcccgaagttacggtgctattttgcctagttccttcacccgagttctctcaagcgcctgagtattctctacctgaccacctgtgtcggttttcagtacggtttagtaaagcctttcgcttagtggcttttcctggaagtgtggtatcagttacttcagctccgtagagcctcgtcatcatctctctgtgttaaggaagtccggatttgcctaaacttcccacctaccaacttaaacgcacatatccaacagtgcgataacctaacctactccgtccccacatcgcagctttaccaagtacaggaatattaacctgtttcccatcgactacgcttttcagcctcgccttaggagccgactcaccctgccccgattaacgttggacaggaacccttggtcttccggcgaacgggtttttcacccgttttatcgttacttatgtcagcattcgcacttgtgatacgtccagctaacctctcgattaaccttcatccgcttacacaacgctcccctacccaacaggcgtatcactaataatccttacttcaaaaataccccgactcaacgttcgggttgcttgaacaacctttcatgccgcttcgcgccattctagcttgttaatcgtaaggcgtattagtgatacgcctgatgccgcagcttcggtgctatatttcagccccgttacatcttccgcgcaggccgactcgactagtgagctattacgctttctttaaatgatggctgcttctaagccaacatcctagctgtctaagccttcccacttcgtttcccacttaatatagacttggggaccttagctggcggtctgggttgtttccctctccacgacggacgttagcacccgccgtgtgtctcctgagtatcactctttggtattcgtagtttgcatcgggttggtaatccgggatggacccctagccgaaacagtgctctacccccaaaggtgtcacctcaaggctctacctaaatagatttcggggagaaccagctatctcccggtttgattggcctttcacccccagccacaagtcatccgctaatttttcaacattagtcggttcggtcctccagttagtgttacccaaccttcaacctgcccatggctagatcaccgggtttcgggtctataccttgcaactagacgcccagttaagactcggtttcccttcggctcccctattcggttaacctcgctacaaaatataagtcgctgacccattatacaaaaggtacgcagtcaccccatcacttaatcccactgcttcttttgggtggtttgactcgcttcgctcctcttaccattgtttaagtgcggttgcttttcatcaccttccaatcggattaagtgatggggctcccactgcttgtacgtacaaggtttcaggttctatttcactcccctcaccggggttcttttcgcctttccttcacagtactggttcactatcggtcaatcaggagtatttagccttggaggatggtccccccttcttcaaacaggatatcacgtgtcccgccctacttctcgttagcttagtaccacaatatggtttttagatacgggattatcaccctctttgattgtgcttcccaacacattctcctcactatactgctatcacttactggctctttcgctttcgctcgccgctactgacgaaatctcggttgatttcttttcctcggggtacttagatgtttcagttctcccggtttgcctcaacaagctatgaattcacttgttgatagtagattcttcatctactgggtttccccattcggatatcttggattaaacgcctcttatcgactcatccaagcttttcgcagattagcacgtccttcttcgcctctgattgccaaggcatccaccttgtacgcttagtcacttaactatacaacctcaaatgttttcaatcactttacgttttcacttcaaagtgcggtcaatttgatgcgtatttttattcaactaaacacttgattgcttttgttcaatcaagatttttttacaaaacaggtttgtttttagagtttccttttcagttctctctttcactttcctgtcttgcctactcagactttctctcgaaaatctcttgttttcagcttgtttccaattttttaaagaacagtaagacaatctaataaagttatctttaattggcgtccccacggggattcgaaccccggttaccgccgtgaaagggcgatgtcctaggcctctagacgatggggacatcaattaaagatactctattttctttttatcttttaacgtttatttttcaacgttgctttcgcttcgtttttaatcttgtctacaactatcagccaatctgtgtgagcactcgctgtctctcgtcttcagtaaggaggtgatccaaccgcaggttcccctacggttaccttgttacgacttcaccccagtcatgaatcataccgtggtaaacgccctccaaaaggttaagctatctacttctggtacaacccactcccatggtgtgacgggcggtgtgtacaaggcccgggaacgtattcaccgcgacattctgattcgcgattactagcgattccgacttcatggagtcgagttgcagactccaatccggacttagacgtactttatgagattcgctccacctcgcagcttcgcttccctctgtatacgccattgtagcacgtgtgtagccctactcgtaagagccatgatgacttgacgtcatccccaccttcctccagtttatcactggcagtctcctttgagttcccgaccaagtcgctggcaacaaaggataagggttgcgctcgttgcgggacttaacccaacatttcacaacacgagctgacgacagccatgcagcacctgtctctaagttcccgaaggcacaagctcatctctgagctcttcttaggatgtcaagagtaggtaaggttcttcgcgttgcatcgaattaaaccacatgctccaccgcttgtgcgggcccccgtcaattcatttgagttttaaccttgcggccgtactccccaggcggtcgatttatcacgttagctacgggcgccagagttaaaccccaacccccaaatcgacagcgtttacagcgtggactaccagggtatctaatcctgtttgctccccacgctttcgcacatgagcgtcagtacattcccaaggggctgccttcgccttcggtattcctccacatctctacgcatttcaccgctacacgtggaattctacccctccctaaagtactctagttacccagtctgaaatgcaattcctaggttaagcccagggctttcacacctcacttaaataaccgcctgcgtgccctttacgcccagttattccgattaacgctcgcaccctccgtattaccgcggctgctggcacggagttagccggtgcttcttctgtatttaacgtcaatttgatgtgctattatcacatcaaccttcctcaataccgaaagaactttacaacccgaaggccttcttcattcacgcggcatggctgcgtcagggttccccccattgcgcaatattccccactgctgcctcccgtaggagtctggaccgtgtctcagttccagtgtggctggtcatcctctcagaccagctagagatcgcaggcttggtaggcatttaccccaccaactacctaatcccacttgggctcatcctatggcatgcggcctctcagtcccgcactttcatcttccgataatacgcggtattagcgacagtttcccgtcgttatccccctccataagccagattcccaagcattactcacccgtccgccactcgtcagcaagaaagcaagctttctcctgctaccgttcgacttgcatgtgttaagcctgccgccagcgttcaatctgagccatgatcaaactcttcaattcaagttcaatcgctcaataaactgcttagctatacataaaacactacttaaaaaagtaatgatgaattttcagttaagcacctattaagacttcaaaattaaaaaatatttttaaaacaagtcaatcaacaagtgcccacacagattgtctgatatattgttaaagagcaaaaaataacgacgcacttggaaacttaaaaaacttcacaacagtgcgtcgttatgtgcggtgcattatagggattttcaaatcccttgcaagtacttttttgtaaaaatatttaaaaaaatgatcttttgatggaaatataaacattttattaaaaagtgcggttagaatagtcaaacttttattgctattatttcttacgtaatgaaacttctccaccattaaatatctgaattttattgccacataatacttttaaatgaccacgttcatctatgccttgttcaatacctgaaataacgccttgctcagtaagcacctttacttcactatttgaaaacgcattatatgattgccatgcttgttgaaattcctcatcaataccattttgctcaaagatatttaaacgtgtatataaatgttgtataagtttgggtaataaggtttgtcggtctacatcaggatcaatttcacacacttccgcataaggctgactaatttctgtttgttttgacaacgacgcattaatacctacgccaatcactaaattgagcatgccatttttatgattagcaatttcaactaaaatgccacctaactttctttcatcaaacaaaatatcatttggccatttcacttgtacatttagcacttccgcaatcgccaaaccgatgactaaacttaacccctcaattgattttttaggatcaaacgtccaataaaaactaaacatgatttgcccagcaaaaggcgataaccattggcgaccacgccgaccgcgccctgcagtttgatattcagccacacaaagatcacctttttttaaggaaggaatattttgtagtatccactcatttgtagaggaaattatcggctgataatggatgccataaggaaaaagtgcggttgatatttgctgaggatttaataaaggaagcattggcactaagcgataatcttgtccatcaacgagaatatccaaaccaatttcacgtaattgttgaatatcttcctctagatttttagaaaatttttccaattcagaccgcacttttgtctgacaatccgctaaatatgtcaataacgtaaaattcatcattcattccttatggcaaatagtatgaaaatcatagcataaatcctaaaatttcgttttcaaaataaagtgaaatctgtataatctcgtcgcaatattttttaacttcaacttagcgagaatattgcaatgtcattacgcattaaacaagaagcccttacttttgacgatgttctactcgtcccagctcactcaacagtgcttccaaatactgccaacctttcaactcaacttaccaaagaaattcgcctaaatattccaatgctttcagcagcaatggataccgtaactgaaaccaaacttgcgatctctttagcacaagaaggcggtattggctttattcataaaaatatgacgatcgaacgccaagcagatcgtgttcgtaaagtaaaaaaattcgaaagtggtatcgtttctgaaccagtaactgttttaccaaatttaacgcttgccgaacttgctgaaatggtgaagaaaaacggatttgcgggctaccctgttgtagatgaggaaaataacttaatcggtatcattactggccgtgatacacgtttcgtaaaagatttaagcaaaacagtttcacaagtaatgacgaaaaaagaagacttggtgaccgtaaaagaaggggcgagtcgcgaagaaattttggaattaatgcatcaacaccgtgttgaaaaagtattagtggttaatgatagtttcaaacttaaaggtatgattaccgttaaagacttccaaaaagcagaacaaaaaccaaatgcgtgtaaagatgaatttggtcgtttacgtgtcggtgcggctgtaggtgcaggcccaggtaacgaagaacgtattgatgcattagtaaaagctggggtggatgtgttgttaatcgactcttctcacggtcactcagaaggcgtattacaacgtgttcgtgaaactcgtgcaaagtatccaaatttgcctatcgttgcaggtaacgtagcaacggctgaaggcgcaattgcattagcagacgcaggcgcaagtgcggtaaaagtaggtattggtcctggttcaatttgtacaactcgtattgtaactggcgtaggtgttccacaaatcacggctatcgcagatgcagcagcagcattaaaagatcgtggcattccagttattgctgacggtggtatccgtttctctggtgatattgcaaaagccatcgctgcaggcgcaagctgtgtaatggttggttctatgtttgcgggtactgaagaagcaccaggtgaaatcgaactttatcaaggtcgtgcatttaaatcttaccgtggtatgggctcattaggtgcgatggctaaaggctcttcagaccgttatttccaatcggataacgcggcagataaactcgtaccggaaggtattgaaggtcgtattccatataaaggttacttaaaagaaatcatccaccaacaaatgggtggcttacgttcttgcatgggcttaactggctgcgcaactattgatgaactacgcaccaaagcggaatttgttcgcattagcggtgcaggcattaaagaaagccacgttcatgatgttgctattactaaagaagcaccgaactatcgtatgggctaatctttaaggtgggctttagcctgccttttgctgtttaaagtgcggttggtttttgcaaagttttaaataatatgaaccgcttacactatcaataataagagcattataaatgacaaatatccacaatcacaaaatcctaatcctcgacttcggttcacaatatactcaactgattgcgcgtcgtgtgcgtgaaatcggtgtgtactgtgaactttgggcttgggatgtaaccgaacaacaaatccgtgaatttgctccaacgggtatcattctttctggcagccctgaaagcacaactgaagaaaacagccctcgtgcacctgaatatgtgtttaatgctagtgtaccagtattaggcatttgctatggaatgcaaactatggcgatgcaacttggcggtttaaccgaaacttctgaccaccgagagttcggctatgcttcagtttctcttgaaaattccaccgcactttttgcaaatttaaacgataattcgaccgcttctgagccgaagttagacgtttggatgagccacggcgataaagtaacgcgcttaccagaaaacttcaaagtaactggcacaacgccaacctgcccaattgctgcaatgtcggatgaaaatcgtcgtttctacggcgtacaattccaccctgaagtaacgcatactaaaaaaggcttggaattattaaccaacttcgtagtaaacatctgtggttgcgaaaccaaatggacagcagaaaacattatcgaagatgccgttgctcgcattaaagagcaagtaggcgatgatgaagtgattttaggtttatctggtggtgtggactcttctgtggttgcattacttttacaccgtgctatcggcaaaaacttacactgcgtatttgtggataacggtttactccgcttacacgaaggcgatcaagtcatggaaatgtttggcgataaattcggtttaaatattacccgtgttgatgctgaaagccgtttcttaggcgaacttgcaggcgtatctgatcctgaagcaaaacgtaaaattatcggtaaagtatttgttgatgtatttgatgatgaatcgaaaaaactcactaatgtgaaatggttagcacaaggtacgatttaccctgatgtcatcgaatctgcagccagcaaaacaggcaaagcccacgtcattaaatcacaccataacgtaggtggcttaccagactatatgaaacttggcttggttgaaccattacgtgaattgtttaaagatgaagtacgtaaaatcggtttggcattaggcttgccagctgaaatgatcaaccgccatccattccctggccctggtttaggcgtgcgagtattaggcgaagtgaaaaaagaatactgtgatttattacgccgtgcggatgcgatctttatcgaagaattacgcaacagcggttggtatgaaaaaaccagccaagcattcagtgtgttcctgcctgtgaaatctgttggagtgatgggcgatggtcgtaaatacgattgggttatttccctacgcgcagtagaaacaatcgattttatgaccgcacattgggcacatttgccttatgatttattaggcaaagtgtctaaccgcatcattaacgaagtgaacggcatttcccgcgtcgtgtacgacatcagcggaaaaccaccagcgacaatcgagtgggaatagaaaatctctatttcagataatttctaattatttcagtaactttaataagtgcggttaatttttaccgcactttatttttgtttaaaagcccttctatgccaatcacaatgagacttaaccaaataggcacataagtaaaatagtcgcttgtggttatttgattatccagcacaaagacagctattaaaaaaagcagtatgggttcaatataactcaacaccgcaaaaatactaactggaatttgttggctggattttaagttggctgaaagcgaaatcgcactcacaataccaagtgctggtagcaataaccaataacgatattcttgcgtaaccaaagaaagcgtatcgctttgagaaagaatataaataaaacaaggaatcgaaattaaaataatatccaatgtaattccttgtagagcagggattttcatcaatttacggcttagataataaaatggataaaccgtacaaacccacaaacttgtccatgaaaaactttgagtgtgccataattcatgtgcaacaccgcaggcagccagtaaaagcgcgattttctgaataaatgataaacgttcttttaaccaagcccatcctaaaacagccataatcagcggaaaaagaaaatatcccatcgcaatatttatcccttcaccatttagcggagcccacataaagagccagaattgacttcccgcatctaatgtccccagtaaaaataaaacccaacgcgtccaactttttcctaacgttgtcgtgataagagacaaaagagagcggcaaccaatagtcgggaataaaattaaaagtaacccaaagatcatggtcagcatacgccacgcaaaaacatccgttccgctaagtggttggagccatatactaaataaatacaatatgccaaataaacattgtgaaaaaatgcacaataatacaccttgagtaactactttcattttgaacctcatctcatcaatgtgattattataaaatcccaagacaataaaaaatctcaactttattttttattgtgataatatttttctcgatagttacatttttgagaaattatcttatgcaaacactggataaattagatcgtcatattttgaatgtattacaacaagatgccatgattccgttaaaagaactgtcagagaaagtgaatagttccgttgcaacctgtcaacgacgtgtgcaatcattaactgattcaggcgttattacaaaacgagttgcagttgtttccccaaaagccgttgggcgtacgattagcgtatttgtcatggtcgaaatggataatcaacattcttattatcaagagcaatttgaacggaaaatgcgtcaagaagacgaagtggtaagctgttacgaaatctcaggggactatgattttatgttgctactccatgcaaaagatatggaaagctatcacgcattcacacgccgagtattgacgggtgaatttcatgtaagaacttataaaagtttatttgtaatgaattttaccaaagcagatagtggaattatcttatagaacaagtgcggtaaatttttaccgcactttgtgtatgattaacttagttttgtcgtctgttttaagaataaataaccaagtattgccgaaacagttgatccaagtagaatacctaaacgagaaagagtattgacactttcccccgcattagcatcaaacgcaaggcttgctaagaacattgacatcgtaaaaccgattccacataaaaccgcaacagcaaaaatttgtttaaaattaattccatctggtaatttagctaatcccaatttaacagaaagataactaaatccaaatataccgactggtttaccaataattaaaccgcttgctatagccaataataatggcgacgaaatcatattcacatctatgccagcaaaactcacaccagcattggcaaatgcgaaaagtggtaaaataacgaaagatgaccaagaggataaaatatgctcgaaatcatctaatgggcgttctccttttttacctttcaatggaatgctaaaaccaataataacgcctgctaaagtagcatgcacaccagactttaatacggaagcccataaaattgcacctacgaccatataagcgcaaagtgcggaaactttgaaacgatttagtaatatcagcacaataattgccacggcagaaaaaattagtgcttgtacactcaatccgtgcgagaaaaataatgcaataacaactatcgcaccgaggtcatcaataatagcaagggcaagtaaaaatattttcagtggaagtggcacttgtttactcaataacgccataattcccagtgcaaaagcaatgtctgttgccattggaattgcccagccattagctaaacttggatcttgtttagcgataaaccaataaactacagccggtataaccattccgccaatagctgcaatagcagggaaaatagcttgctgataggtagaaagcgcgccttcaaataattcttttttgacttccattcccactaatacaaaaaacaccgccataaaaccatcgttaatccagtgaattaaggttttattaattgagaaactaccaatttgtaaacttacaggcaaatttaaaaaatcattatattggttgcttaacggcgaattagccagcaacatcgcaacaacagctgaaaaaagcaataatataccgccagcagattctaatttaaaaaaacgttggatcagttttatcacataaacccctttaaaaatacatagcaaaaaattcacaaaggaagcatcctagcatattttcgaagttaaaggaaaaagtgcggtagattttgtcgggatttttagcgaattgtcgataaaatgccatatattgtgacaaaattcacatttttaattttacgcaatagagattttatctactttgtagtagaatgcggaccttttatttttagaatcaaaaactatgttttcacgcaaagatattattattttaggaatgatgatcttcgccttatttttaggtgcgggtaatatcatttttccgcctatggaaggattttcctcaggacaacattggacgagtgcttccttaggctttgttttaactggcgttttaatgccatttattacgcttgttgtggtagcgattttaggtcgtggcgaagaacttactaaagatttaccaaaatgggctggcacaggtttcctcgttatactttatttaaccattggctctacctttgcaatgccccgcatcactaatgttgcttatgaaatggcgtggttgcctttaggcttaacagaaaataatgcgaatgttcgttttgtattctcactaatttttaacttaatcgcgatgggctttatgattagcccaaatacgatcatttcaagcgtgggtaaatttatgacaccagctttattagtgttacttattgctgtggcaattaccgtatttatttcgcctttatctgaaattcaagcaccaagtaatgcttatgaaaatagccattctttattaatcggcttaaccagtggttatcaaaccatggatgtacttgcagccatcgctttcggtggaattgtcgcccgagcattatcagcgaaaaatgtgacaaaaaccaaagatattgtgaaatacaccatttcagccggatttgtttctgtcattttactcgccagtttatatttttcgcttttctatctaggtgcaactagtgctgcagttgcagaaggggcaacgaatggtggacaaattttctctcgttatgtaaatgtcttattcggttcagctgggacttggattatggcgggtattattgtattagcgagcttaacaacacttgttggtgtaactagcgcatctgctgattatttttcaaaattctctgtgcgtttttcttatccattctgggccgcactttttaccgcaatgacaatcactgtttcacaatatggtttaacggatctacttcgcataacgatcccagctttgttattaatttacccagtagctattgtgcttgttttattgcaattcttacgaaaaaaacttccatcaataaaatttacatacaatagtacattgctcgttacggtttgttttagtttatgtgacagcttaaataacgttaaaatgttaccagaaagcatcaattcattattgaaacacttccctctttcatctgaaggaatggcttggttggttccgactttagtaatgttagttgcaagcatttttattggaaaagcattgcataaaacccattcttaatctcacaaagtgttttatttatcagccctgtgccgtaaaactccgtccttcagggcggagatataaggcacagggctgataaatttctaaccgcactttttcaaaaattaaattaatttaacaggtacttttacgactaattttttaattttttctgtttttccattcactacacagcaaggcttgtgcggttcataaggatagaatacagcgaacatttttggtttcattgtgacggtgaatttatcatcaatatctgcacaaagttgataatcatccgcttcgttgtaatcttcatacttagataaattcggataggttgcgcccacttcgatattttccgtgccacgaataagcacttgtacatctaagtattcatgatgtaattctgcttttttactgcttggttctgcagtttctggttccattacgttcatataaatttgatcgttaatatcatggcgaccattctctaacgcattcaaatctaacgtatttaaataatcacatacttcagcaatcacttttggcaaaccaactttaaaatttgggttggttaaactgctaataatcatagaattttccttatagtggataaaagttacactatgataccaagtcggttaaatgaaataaagccaccgattacatcatctctcttgattaatccaattagctcttgtagtaccgagtgaaagagagcaaatatttgccaacttattgacgcataaagtctaaacaatgaaattacggcattaacacaagcattttcagaaaaaatattatcaagaggcttatgaggacctgtaaaatgaaaaataacaagagaaatatcaagagtattaattgaaatcatatgaactaattgtaatgttgaatagcgtttagcaaaataaagttgaagatcattttgccacgattcagaaatatctcctgtatgtaaaataaaaacagagagattttcattgtgcattaataaagatttcagtgtgatttctacataaggaagataattagcatcactagccatcattacattatatttcatataaaagaacctaatttcagagagaacaatcaatttttaggaggaaaatactgtcgaaacaatgataagaagttggtaatgtgaaataaagttagccattaaagccaaacatcctgtataatgcacgggctttattttctacattagcgtgcggctatcaaaagaaatttttaaacgcccaaagtgcggtcattttttcgaaagatttcttttgctagtcgcaatctgggaaataaggcattgtttttaatataaattttaaggaaaacattgtgaatccaattgttaaacaatttaaatacggtcagcataccgttactctagaaactggcgcgattgcacgtcaagcaacggctgcggttatggcaagcatggacgataccacggtattcgtgactgttgttgctaaaaaagatgtgaaagaaggtcaagacttcttcccattaaccgtaaactaccaagagcgtacttatgcagcgggtaaaatcccaggtggtttcttcaagcgtgaaggtcgtccatctgaaggcgaaactttaattgcacgtttaattgaccgtccaattcgtccattattcccagaaggtttcttcaatgaaatccaagttgtggcaactgtggtttctgtaaacccacaaatcagccctgacttagtggcaatgatcggtgcttctgcagcattaaccttatctggcgtgcctttcaatggtcctatcggtgcagcgcgtgttggttttatcgacaaccaattcgtattaaacccaactatggctgaacaaaaacaaagccgtttggacttagtggttgcaggtactgacaaagccgtattaatggttgaatctgaagctgatattttaactgaagaacaaatgttagcggcagtcgtattcggtcatcaacaacaacaagttgtgattgaagcagtcaaagaatttgcaaaagaagcgggcaaaccacgttgggattgggttgctccacaaccaaacacagatttaatcaacaaagtaaaagcgattgctgaagcacgtttaggcgatgcataccgcattactgaaaaacaagctcgttacgaacagatcgatgcgattaaagcggatgtaattgcgcaaatcacagctgaagatgaagaaatcagcgaaagtaaaatcgtggatatttttaccgcacttgaaagccaaatcgtgcgtggtcgtatcattgcaggcgaaccacgtattgatggtcgtaccgttgatactgttcgtgcattagatatttgcactggtgtattaccacgtactcacggttctgcgatttttactcgtggcgaaacgcaagcattagctgttgcaaccttaggtaccgaacgtgatgcacaaatcattgatgaattaacgggtgaacgtcaagatcacttcttattccattataatttccctccatattctgtaggcgaaacaggtatgatcggctcgccaaaacgtcgtgagatcggtcacggtcgtttagcaaaacgtggtgtagcggctgttatgccaagccttgcagaattcccgtatgttgtgcgtgtagtatctgaaatcactgaatctaacggttcttcttctatggcatctgtatgtggtgcgtctttagcattaatggatgcaggcgttccaatcaaagctgctgttgcaggtatcgcaatgggtttagtgaaagaagaagagaaattcgtggtgctttcagatatcttaggtgatgaagaccatttaggcgatatggactttaaagtagctggtacacgcgaaggtgtaaccgcccttcaaatggatatcaaaattgaaggtatcacccctgaaattatgcaaattgcattaaaccaagcgaaaagtgcacgtatgcacattcttggtgtcatggaacaagcaatcccagctccacgtgcggatatttcagattacgcaccgcgcatctatacaatgaaaatcgatcctaagaaaatcaaagatgtgattggtaaaggtggtgcaacaatccgttcactaactgaagaaactggtacatcaattgatattgatgacgatggtacagtgaaaattgctgcagtagatagcaatgcagcgaaaaacgtaatgggacgtattgaggaaatcgttgcagaagttgaagctggcgcaatttacaaaggtaaagtcactcgtcttgctgattttggtgcattcgtcgcaatcgttggaaataaagaaggtttggttcatatttctcaaattgctgaagagcgtgtagaaaaagttagcgattaccttcaagtgggtcaagaagtaaacgtaaaagttgttgaaatcgatcgtcaaggtcgtattcgtttaacaatgaaagacttggctccaaaacaagaaactgaaattaaccaagaagatcctgtcgaagaacaggaataatcttggaatatagaatcaaaacttggtagcattcgctgccaagttttgttgttttccaacttttaggcataaagaaagcaaatgcggtgttttcgcttatctcgccattttatagtctatttatttagcttatgtgcgatcttactccttgctggctgtgttcagtctaggggcggttttgtgtctaaaaatcatgtcgtgttggctgaacaaaacccgaatactcactttgaacaagaagtgatgatcgtgcgattaagccaagtactactggttggaaaaatgagtaatgaagaacgtgcatcgctacattttgaacgtggcgtactctatgattctcttggattatggggacttgctcgttatgatcttactcaagcccttgcattacagccgaaaatggcatctgtgtacaattacttagggctttatttattgcttgaagaagattatgacggcgcattggatgctttcaatacggtgtttgaattagattcaggttatgactatacccaccttaatcgtggtttaaatttttattatgtagggcactaccatcttgctcagcaagatttcttacagttctaccaagccgataaaaaagatccctatcgtgtcttatggctatatttgaacgaacaaaaattaaaaccacaagaagcccaaacaaaccttgttgaacgagcaaaagggctatcagaggacttctggggtacacacatcgttcaatattacttaggacacatctctgtagaagaattacaacaacgtgcaagtgaatttgccgaaaattcacaacaatatgctgaaattctcacagaaacctatttttatctagcaaaacaaaaactcaatgtagggctagtagatgaagcagcagctttatttaaactagccatggcaaatcaggtttataactttgttgagtatcgttttgccgcgtttgaactcatgaaattaaaaccggttcaaacagaagacgaaaaagaagagaaaagtgcggtaacaaaagcgattgttttctaaaaatcaatccaaaacttaccgctctttgcagtagaacgaatagaaaaattcattcgctctgctcaacttaataaaccgaaagcccgttgagctttccttatttatattcgagtattttaatgactgacaaaattacttttaatgacttaggcttacctgagttcatcttaaaagctgtttctgacttaggttttgaaaccccttctccaattcaacaagcttgtatcccacatttgctcaatggcaatgatgtgctaggtatggcacaaacgggtagtggtaaaaccgctgcttttgcactgcctttattagcgcaaatcgatccaagtgaaaaacatccacaaatgttagtgatggcgcctacacgcgaacttgctattcaagttgccgatgcgtgtgaacaatttgttaaatatgcacacggcactcgcattgttaccttatatggtggccaacgttatgacatccaacttcgtgcattaaaacaaggcgcacaagtggttgtgggtacaccaggccgtattcttgaccatattcgtcgcagaacattaaatctttctgaacttcgttttatcgtattagatgaagccgatgaaatgctacgcatgggtttcattgatgatgtagaaaccgtcatggcagaattaccagaaaatcatcaaactgcgttattctctgcaacaatgcctgaaccgatccgtcgtattacgaaacgttttatgaatgatccacaagaagtgaagatcaaagtgaataacgaaaatgccccagatatcgaccaaagttgttggtatgtacacggcgtgcgtaaaaacgaagctcttcttcgtttcttagaagtggaagattttgatgcagcgattatttttgctcgcactaaaactggtactttagacattacagaactacttgaaaaaaatggtttccgttctgccgcacttaatggcgatatgacacaacaattacgcgaacaaaccctcgatcgcttacgtaacggcagtttagatattgttgtggcaaccgatgtggctgcacgcggtattgatattgaacgtatcagccttgtggtgaactacgacattccgcttgatgcagaatcttatgtacaccgaattgggcgtactggtcgtgctggtcgttctggtcgtgctttattatttgttgaacctcgcgagcgtcgtttacttcgtaatattgaacacctaatgaaaaaaggtatcaatgaagtagaattgccaaatcatcttgtgttacaagaatgccgccgcaaaaaatttgtcgccaaaattacgaaacaactcgagcatcacgatttagaacaatatcgtagtttattagaagacttattcacagccgatcaggatcaagaagatattgctgcagcaatgttgatgctgcttcaaggcaaacaaaaattaattcttccacctgatccgccaatggaaaaacgtcgtcgtgaacgtaatgatcgcggtgatcgccgtgaaaatccacgttcagctgaacgtcgtggcgaacgtaaaggctatggaaatccacaaccaatggatttatatcgtatcgaagtcggtcgtgcagatggtgtagaagttcgccatatcgttggtgcgattgctaacgaaggcgatattaacagccgttatattggtcatattaaactttatgatgactacactaccgttgaattgccacaaggtatgccgaaagaattattgcaacaattcgctaaaacacgcgtattgaataaacaaatgcaaatgtctttcttaggtgcagtaaaatccgataattcccgtggcagcgatgattttaacggtaaacgtaaaggtcgtggtggcgatttccgtggagagcgcggacgtgaacgaggcaatgataatcgtggcaatcgtaaatttaatgaaaaaagtaaccgcacttttagcgacaaaccacgccgtgatcgtagatcatcattctaaaaataaatcgtctgatattttacatacacttagccccttgaacctcaaggggctttttattgcctatagtgaaagttttggctacaatcccataacttttttatataggaaaaatcattgaaaggtctttttttacgtattattactgctctagcgttattattttgggctattgatatggtgttcccatggcaatttttacgtcatactgaagaaaatcattatactgcaattcaagctaggggatcactttatgtaggaacaataaataaccagatttcttattttattaataaagatagcgaacgaggctttgaatatgaattagccaaagcatttgctgatactttaggcgtagaactcgaaatgaaaattttcgataatcaagagcagttatttgatgaacttgataaacacaatattgatttagctgccgcccaccttttataccatcctaaaaatgcagaacgtttccaaataggtcctgcatatcattctgcttcatggcaattagcttatcgaaaaaatgaaaatcgtcctaaaaatttaggtaacgtaaagaaagatatttatatctcaaataatttagcattagaagaaacgctaaaagaattacaaaaacaatatccacaattaacttggaaaagaaatcaagcacttactcaagaagaactattactacaactggctgaaggcaaaattccttacgttattgcaaattctattgatattgctgcaattcaacaaatcaaaccagaattagccattgcctttgatattactgatgaagcaaacgttcactggtatttacccaatagcccctaccgcgatctacaaacggctttactcaattttatgaataatgccgaagaaacgggacttttagataatttaaaagaaaaatatttaggacatatttcacaatttgattacgtggatacgcgctcttatatgaacgcaattgaaaataccctgccacaattctcaccgctctttgaaaaatacaaaggtgaattagattggcgactactcgcagcagtggcttatcaagaatctcattggaatcctgacgcaacatcgccaactggagtacgtggcataatgatgctcaccaaaaataccgcacaacatatgaaaatcagtgatagaacagatcctgaacaaagtattaaagctggttcagaatatttacactggttgattagtcagcttcctgaaagcattgaaaaggaagaaagaatttggtttgccttagttgcctataacataggactcggtcacttaattgatgcacgccgtttaactcaaaatcttggaggaaatccagataattggctcaatgtgaaaaaaaatctgcctttattagcagaaaaacgctattattcccaactgaaatacggctatgcaagaggctatgaagcctatcaatatgtagaaaatattcgccgctatatgaatagcatcgtaaattatcatcgagtccaagaaaatcaaacaacgaatgataatgccaacaacgaaagtgcggttaaaaatttagaagaaataaaagaaaataaggattaataaaatgttaaaacgtaaaacttttcttaaaaagaaagctaatttacaacaaagttctttatcacgtaatctacgtttaagacgtttaaaacaccgcaaacaacaacaattttcgagacattcattacaatttgtcgtacaagaaatttgttgctaagtaatctatttttcttatcaaaataaagaaaaaataaccgcacttttttatgtaatttatatcattaaagtgcgatctttgttttacaataatcgtaaaatatagtgtgaaattttatagattaatcaatattttattctaattttatccctaagtttccaattttcacaccgactagaccaatcgagacgggatcaaaataatcccctaaaaatttgaacaattcatttaactctgtaaaagaacgctgaatttttatttgatcctccactttacgcacaaattcatagcgtatgttattttcttcaaaataagctgttagagttaaataaatcgtttcaaagaaatggcttttggccccctcctctccgggatcactaatacgcacattccacgtattattaagtagaatttgaggctgttttgacatattttactccttgctatttttaacctaagaaaaacccgattataaagtttctgtaatcaaaaaaatttataatcgggcttttcaaatattttccctgggtgtttcgccttacgttggtaactgcctttccctttacgttttttctcaacacgctgacgaaataatttatcgcctagcaatgccatcactgcattatcttttatcacgcctcgagtgtgcaaataaacggtttcattttcaaccgcacttttttgtttctttctcataaattttccttaaaaaagccgcggaaggatttccacggctggtgtactatacatgcaaacgtttaaattacaaaatctcaagtacagtttctggcggacgcccgattttagctttatcgccattaataacaattgggcgttcaataagtgctgaatgttcactcatcgctttaaataattctgcttgagaaagatctaaattatctaaatttaagcttttatatagttcatctttcgtgcgcatcatttggcgaacatcatcaattcctaattttttggcaatgctttgtaattcattaacggaatactgcttttgcaaatacagttcaataatcggctgaatacctttattttctaataatgctagcgtttcacggctttttgagcaatgtgggttgtgataaataataacagacataggatttcctcttagtagctataaacactgtaaattttaacttataatggcaaaaaaatacttataggaaaagaaattatgctagaaatgttaaaaagctggtactctcgccgtttaagtgatcctcaagcgatgggactattagcaatattattatttggctttatctccatttatttttttggagatttaattgcgcctttgttgattgctctagtactatcctatttacttgaaatgccaatcaattttttaaatcaatatttaaaatgcccaagaatgttagcgacaattcttattttcggtagttttattggtctagcagcagttttctttttggtattggtgccaatgttgtggaatcaaactatttccttattaagtgatttgcccgctatgtttaataaatctaatgaatggctactcaatttacccaaaaattatcctgaacttattgattattcaatggttgattctattttcaattctgtgcgagaaaaaatccttggttttggcgaatctgctgtaaaactttctttagcctctattatgaacttggtttctttagggatttatgcctttttagtgccattaatgatgttttttatgttgaaagataaatcagaacttttacaaggggtaagtcgattcttaccaaaaaatagaaatctcgcatttaaagtatggaaagaaatgcaacagcaaatttctaattacattcacggaaaattattagaaatactgattgtcactttaatcacttatattattttcttaattttcgggctaaattatccactcttattggcttttgcggtgggtctttcagttctcgtcccctatattggcgcagttattgtcacgattcctgttgcattggttgctttattccagtttggaatcagcccaacattttggtacatcattattgcttttgctgtaagccaacttttagatggaaatctccttgtgccttatttattttctgaagccgtcaatttacatccactaattattatcatttcagtattaatttttggcggtttatggggattttggggtgtattctttgccattcctttagccactttagtaaaggccgtaataaatgccttacctcaagattaaataatctttgaattttaagtactttatttaattagagatttatataaataaaaaatagttaatcgtaaattttcgattaactatttttttaatttattctaaaagtaaatcaactaaggtaattcatcaatttctttatctactttaggtgggatcatatgttcacgacgtaaaccaacatcgtatgcaatggcgatggcaacaaaaatcgaggaataagtaccaaatccaatacctacgagtaaagcaagtgaaaagttatgaatggaaggaccaccaaagaagaacaatgccatcacgacaactaatgtagtaaccgaagtaatgatagttcttgataaagtttgcgttaaagaaatatcaataatatcaatcgtatccaatcgtctaatttttcggaaattttcacgaactcggtcaaataccacaatactatcgttgatggagtaacccaccacagataaaatcgctgcgacaaaagtaagatcaatttcaatttgtaatgcagagaatacccctagcgtaataattacgtcgtgcgcaagagaagcgatactgccaaagcctaaacgccattcaaaacgtgaccccacataaataagcaccattgctaatgtcgctaaagtcgcatataccgcaccttgtgctaattcttcaccaacatttgggccaacgaactcaatactgcgaatttgaatgtctttatctacattctgtagcatacttttgacgtgttcaccaatggtagaatcattattacttgcaggtaaacgaatcatcacatcctgaaccgatcctgtggtttgaacaactggactttcaattccattttcgtgaagtttactacgaatttgttcaaggttagcggactgcgagaagtgagtatcaaataccactccaccagtaaaatctaagccccagttaaatcctttggtaataataaaaaatagagaaattaccattaaaagtgcggataatatataaccccatttacgcactttcataaattcagtcaatgggaacgggagctttatcccattgatttcacggataaaatgtccgtctttatcttttgtaaaaagtttcatcatttcccgcctaaattaataattttttaagttgtttgccgccgtaaagggcattaactaatgcgcgagttccagtaatcgcggtaaacatagaaatcgcaacaccaagtgaaagcgtaatcgcaaaaccttgaattgggcctgttcctaccgcgtatagaataattgcggttaagattgtggttaagttagcatcaaaaatagaagtaaatgcaccgttataaccttcattaatggcttgctgaattgaacgaccattacgaatttcttctttaatacgttcaaaaatcaatacattcgcatctactgacatacctaaagttaaaacgatacccgcaatacccggcattgaaagtgtcgcaccgggtaaaatagacattaatcccacaagtaatacgatattaataacaagtgcaaaacttgcaatcacaccaaacattttgtagtaaaacaacataaaggcaataacagcaactaatccccaaagactcgcattaatcccttgctctacgttttgtgcacctaatgatgggccaattgtgcgttcttcaacaatttgaattggtgcaattaatgcgccagatttcaacaaggtagaaagattatgtgcttcggcaatactatcaacaccagtaatttggaaattagaaccaaaacgaccttgaattgttgcaacattaataacttcttcatgcttttctaaaatggttttgccattttcatcttttttgccattatctttatattcaacataaagcgttgccattggttttttgtaatattttttagtggtctgagacataatctcgccaccttcgctatccaaggttacactcacttgcggcgtgcttgaatgctgatctaaaccagagcttgaattaatgatatgctccccacctaatacggcacgtttaaataatgcaacaggatgcccttggcgatcatatttaacttccgaatcagctggtaacatattacgagaaatagcatcagctgtaacattttgatttacgatacgaaactcaagtgttgccgttgcccctaaaatttcttttgcgcgtgcagtgtcttgaacacctggtaattcaatcacaatacgttcagcaccttgacgttgaattaccgcttctgcaacacctaattcagcaacacgtttacgtaaaatcgttaagttttgctcaatggctaagtcgcgtgcttcatttaatgctgcagtagatagccctaaattaatactatcagcatcaggctcagtaatgtctaatgttggatgtaattggcgaataattcgctcagctttagcacgctggctcacattagctaaggttatcaacgtaccaaaatgctctgtatttttaatggcagtatattgaattttttctttgcgaagttcgccacgcaaactgtcttgtaattgctcttggcgttttacaagtgcggcattcatatcgacttccatcaaaaaacgaaccccaccgcgtaagtctaatccccatttcataggattcgcaccaaacatacttaaccaagctggagtggctggagcaagatttaatgcggtggtgtaattattgccaagacgttcagcaattttatctttagcaagaagttgatcatcggtattagtaaaacgagctagaattgagccattctcaagcacgatagatttggttggaagattattggttttaagcacatcttgaacttgtccaagcacgctagtatttgcttcttgaccgcgcgtaccggaaatttgcaccgcaggatcttcaccataaatatttggaagagaatataaaatcccgatggccacaataaaaataaccatcaaattcttccataatggataacggtttaacatagttttccttttcttttctaacgcacagagccacaatgcgtggctctggaaaataatttaacgttactcttaaagtgattttaatgaacctttaggaagaacgctcacaatgtagttacgattaatcgtaatttctgtcgtgtcgtttaacgcaatcacgatgctatcactaccttcggttactttagtaattttgcctattaaaccaccagcagttaaaacttcagtaccttttgcaagctcagacatcaattttttgtgttctttattgcgtttagcttgcgggcgataaatcataaagtagaaaattaaaccaaagatcacgaaaataaatagcgtggacattggactttgtgcttccattgtgttttccttattaatttaagttaaaaattttgcgtaaaataccataaattgcttcattgggaaaggcgaactaagcccaatatcctacgttatggcgattaattttattttttcaagataacgataaattctttttccgaagcgtaatattgctcgactaaagcaacagaattttcttcggcaaaaatagaaaaattttccaccgcactttcaaggtttaagatcaacattagctcatcatttttattcaaattttttaaggcttttttggcacttaaaagaggaatggggcatcgaagtgcggttaaattgagctgatatttcattctttaacttgacgacgagcactcatgcgcttgcccatttcagtcaaaatatccgcacttaagcattcacgccccatttcaaataacggctcttctaacgcaatatgacgatcataaccttgaataaagcgttcaattaaatattcatcaatattttgacgttgttcagaaataagctcttctaactgcacagataatgcattccaattttcatgcaaatattcgtgctgtttttctaattcatcaatggaagtttgtgcttgcggagccactttgactaattgagggaaaaaatctgattcttcatcatcgtgatgtaacggtgcggcacgattgaaataagttaaaatttgctcaacatcatttaacacagcctgagtatagccgtgtttttctagataatcaggcaaaatgcttaactgacgacaaaaacgttttactttactatgacaagcataaagcatttcaataggttcattccatgtggcgaattgttgaggttcaagaatttgcataaggtttcctttgttaaaaagtgcggtcaaaaaacgcttcatttttctaccgcactttcatcaattatgagttatccgctaattgtaatggtggaacaggtttgcccatgcgagcatagaattccaccacaaaatcatcaaaacgatcatcttcaatcgcttgacgaatttccgccattaaacgttgataatagcgtaaattgtgaatggtatttaagcgtgcacctaaaatttcaccgcatttatctaaatgatataaatacgctttggtgtagtttttacaggtgtagcaatcacattcaggatctaacgggctggtatcatcacgatattttgcattacggattttgacaatgccgtctgtcacaaataaatggccattacgtgcgttacgggttggcattacgcagtcaaacatatcaatgccacgacgcacgccttccactaaatcttctggtttacccacgcccattaaataacgtggtttgtcagctgggatttgtgggcagatgtattctaaaatgcggtgcatatcttcttttggttcgcctaccgctaaaccgcccaccgcataaccgtcaaaaccaatattgactaagccttctaatgagactttacgtaattcttcaaatacaccgccttggataataccaaatagggcatttttattgcctaattcatcaaagcgatcgtggctgcgttttgcccaacgaagtgacatttccatagattttttcgcataatcgaaagtcgctgggtaaggcgtacattcatcaaaaatcatgacgatatcagaacccaaatcatattgaatttccatggatttttcaggcgaaaggaagattcgctcaccgttaattgggttttggaattttacgccttcttcggtaattttacgtaatttacctaaactgaatacttggaaaccgccactgtcagtcaaaatcggacgatgccattgcataaaatcgtgcaaatcaccgtgtttacgcataatttcttgacctggacgaagccataaatggaaggtgttacccagtaaaatttctgcacctgtcgcacgcacttcttctggtgtcatgccttttaccgtgccataagtacccactggcataaacgcaggggtttctacactgaacgtgccttgtggacgttcaaacaccaagcgaccacgacgagcattgccgcttgttttatctaattcatacttcatttttgctccaacgaataaacagttcgaagatttttttgaacaaaaaagcctgttaaaaaatacaggctttgtgatatcatattttcaatgctctttgagcagaggcggatctactaagatagtccgccagttgccgctgtcgggctatttcgtagatcctgagtttgttaatcatactaaggataaaaatatgactaaatttatgattaagttggtcatcattattctactttgcctgttattgaaaagtagcactggctattagtagttgatgccgacaagagatggttaccgccatctcttgttctttattgtaggtgctgactaattacaagtcaaacaacttattccaactctctcacattagaatttttattaataaacatcgcatcgccataactaaagaaacgatatttttcttgcactgcatgcttatacgcattcatggtatttttataaccagcaaaagctgaaactaacataatcaaagtgctttcaggtaagtggaaattagtaattaagcaatccaccactcggaattttttccctggataaataaaaatagaggtatcagaaaaataaggctcaattaaatctggattgccaaattcttccgcagaaagtgccgcactttcaatagaacgaacagaagtagttcccactgcaattacacgtttgcccgctttctttgttgcgataatcgcattgcaaacttcttgagaaacttctacgtattctgcatgcatcacatgatcttcaatattttccacacgaacaggctggaatgttcctgcgcctacatgtaatgtaacaaattcaaaattcacaccctttgctttgagtttttcaagtaaatttttatcaaaatgcaaaccagccgttggtgctgctaccgcacctggtactttactataaaccgtttgataacattctttatcggcttcttcatctggacgatcgatataaggcggtaatggcatatgcccaatggtttgcaacacatctaaaagagcggttgatttatcacttaattccacttcaaacaacgagctatgacgagctttcattactgctttaatgccattattttcgcctaatttatcttcccctaaaaataattcagccccttctttaggggatttcgatgaacgaatatgcgctaagaaacgatgttcatctaacattctctcaactaaaacttcaatttttccaccactggctttacgcccaaacattcttgcaggaataacgtgcgtattattaaaaatcaataaatcgccttgatcaattaaatctaatacatcagaaaaagtgcggtgaaaaatttctccgttttcaccatttaactgtaataaacgacaagaaacacgatcagttttaggataacgagcaattaattcatcgggtaaatcaaagttaaagtctgaaacacgcataataaaatttaggttaaataaaataggcggtaagtctagtttgaattgaaaatgatctcaagaaaaaaactttcctcggggaagataaaataaccagcaattatgctggttatttgggattaattataaatttgcttttttagttgcttttacgtttacatcacaatttttaacgatgatgttatcgctagatttacctttttgaattaaatttacaggcacaacagaatcaaatttatctaacgttaagccactatctacattccaaacataatccccagaaacgaaacttgtaaagtcattttgtgatttatcacgagtaaaatctttcgcaataatgccatcgcccacacttaccattgcggcaactggttcttggttttcaaattgatacacagcagtcaccgtttgtttattgcaggaatatacaactgttttatcagttattgttggaagtgtttgcatttcagctatttgcgcagatgattttgtcatttcaggtgcatcctttgcacaagcagataatacgactacagcagcaaatgtgggtaaaattttagttaaattcattattaaatcctcttaattaatccctatatagggtgctacttagatacctttaataaaataaagttccattattggaataaaaaaggtgggatttgatctgccccaccttgtttatcaataaacgataaaattatgttgatttttaccaacgataccccaatttcacgcccacattttgctgtttgccgagttgtgaaccttgagattttgagataaaagcggaaagttggaaatgtaaaatttctgcctttaatcccacttctttttgccaataacgcccaaatgattgttgcaacatcgtgctatttacagtggtttgtacgttagcgtttgaaacatcaacataattaacgaagaaataaggcttaacgctgatattatctgtcggggtaaacgtataatcaactcgaatgccagcattatagcgattaaatgcaaggctcggtgtttgcactttcacgtcttcagattgataattttcacgttcaataaaatatcgattaacacccaaataaggctgaatacccaattgccctaaacggaactgataacttgcattcacaccataatttatcgcttttcgatgaatttttcggctttgttcttcagccattttactcgcactaattcccgcgcccacgtttacaccaaattgtaaatcgccccattgatattgggcgaaacccgacatcatcgttaatgtcgcgtgatttttaacctgttcgtcaaaggtattatctgaacggctatgcgagaaaaccgccccaattcgtccattatctaaggctttttgcaccccaatttgacgcaagttcgttttctgctgataagcacggaacgcatcagaatcatagcgtcttttatcctgtgcgatatttgtccacacagcagattgtgcttgatctacaaaaagacgatccaattcatcttgaacggaaagcatactatttactgttgcagacaactccgataacgcactatttgagtaacggctgatcaagtctttttgtttgccttgtttctcttgagcttgacgttcttttcccacttgcggttgggcattaataacctcaagtgcggcttttaatacgtctaactggctttgatcaggcgggggatcagaaaacaccgctctcaatgctctttttgaccgcgctttttttgtttttgccttacttttttgtgttttagcattcggttcagcttgtttggcttctaatgcgtttaacaggctttgagcaggcagggtatcaggcaacaccgctcttcttaaccgcacttttgccttacttgtttgtgtttcagcagtcggttcaacttgtttggcttctaatgtttgttctgcttgctctgctcttactaaatcattgtgcaattcctgctcttttattggattatgcaagcggaattcgccattattcttcactaatacataacgtaatgcacccgcatcaacgtggtcattttctaacgtgaatgtgagtttgtctgataacggttgattatctttgctttcaaccaaagttaattgctcaagggtttcgggttctttgcctgtgttgcgaacagataatatgtaatcgccctcagcgtcattggataattttaatttatcgcttttatagccaaataaagatgaagtaaattggaatgtgccttgcccgctcaatttaccatttactgtcaatgtgttgaaacgatgttctgccgatgttggcgtcgtttccgtctctaatgaacggcgacgacggcgtggcgtattgtttggactagctgaataagctgaatttaacgtaacagtactgttatttagtgttaaattctgcaatgtggtatcgctaggcattgtccaagtcgcattttccaacgtcactgttgtgcctttgtcgccctgaatttggtgcgaaagatggctgttttttaaataaaattgagcagaattcgttaaatgcacattaccgttcaagtttgcattatccaccgttgcagttgaattgtcggaaagtcggatattgcctatttgggtagcattgttgcttaatgtaaattggctgtgatttgttaaagtgacattgccattaagttttgctaaacctttaacattcgccgttgcattatcagttaaattaatagagccattgatttgtgttgttggtatagaattaataacttttgtgtcggttaaattctctgttttacaagtcgttaagcctgtccaatctgaacgcgtgcaaatggtattttgttgatttggcacaacaccaaatgtggcgttggcgttattgctgattgtccaatttccctcaattgaagaaacattgcgagaaaccaccgcacttccgcctttaatttggaagttttcagctttaaatgtgcggttgatccaatcgtcatcaataaccacttcgccttgaggtcgcccaagctcgtttgggcgatttaaatgattgtaagcgtgtggcgttgggcgaccactaaacactaaagtgccgccttcttgagtaatatcgccttttaagtttgtgccacctgaaagtagtaaagtacgatcttctgtggttggtttataaataaggtttaatcgtccattgtgtttattttcatctgtttcgccaaaccaaccgttgtaggcaatttctttgctgtaattaagtttattaatattatttccattaggtagaacaatgctttcgttcccagtaatagtgacattagcgacttcagttgtattatggttcacaatcatcgccccctcgtccgtattttggatacgtttaaaggttaatgaatgcccattaagatctaagcgaccaccacgaaagccgaaataaaatttatcggtatcaaattgtttatcatcgtttaattggacagtccctctgccgctaaccaatccgatttcactaaaggcttgttttttatgttgatcgtcctcttgttgttctaagattactttaccatcgccaacgctaattgagcctaagtttttaccttttgcttgaatatgtaacgttcctttaccaattttagaaaggcgatcattttctacgccattgactttccaaattacggtgctttcatcactgatagatatccccgcccctttccacgtttcattatgggtaggcgaaactataaaatctccctcaaaatacaaaccgcctgcaccttgatcgatattattactaaaagttagcaccccttttccgtaatcaataaaataaaggttttcgccgtgacttaatgcgggagaataattgtttacaccaccattagtatagacaggctccgtgcctttcatagataaattgtaattagcaagtttgactttataaattttaccagctccagatgtaatagtgcctgacccatcattttttgaatgaaatgtgtagtgctgattttgttgatttttaggagttctgaaatcaaatatggtcgttttaagattagcagagaaaatttcatcaaaataatttttacggactagctgaaaagtattctctctacctaaggatgggtttccagtacgcaatacaccatttataagccattttttctcggtagcatcataaataaacataggtgacccactgtctccaaatgatcctgctgtcggcataggtccataatcatttcctttacgtacatcgccacttaaactaacatctccatttcctgcaccagtttgcatatgggtattccccgcaataagatatccataagcttcagctacttgagttcctttatcttgttcatttctccaatattgatcaccagaaccaatccgcacacgcatcgggtatttttctttgtctgcataggtctgtcccttcatacttcctgtcatatcaaaaggagaactttcagttacaaatttatgtaaacgaggcatatggtaatccccattataatgatgcttctgatcaggtttataattattacgtttaactatttgataagtaaaacgatgttgatcgggattttgtccttccgcaccaaaatcagcattagtgtatcccccattgtgagcaacacttacaatatattgatcgcctactaatgcagcataaccactacgagcaacagatgcaaaatcaatcatcggagcttttgtcattgatttgccgaccaactccccttttttgttgtaaacctcaatatctttcgcaccgactgcaaacttccctttattctcagcaaaatcacgataatattggtagtcaatcccaaaataagtgtgacctgcccacgcttgcgatactatccctaatgaaatgcaagcggttaaaaaattcagacgaaatacagtttttttcataatgtttatttaattaagtaatttttcgtattaaaaaatacgtggttaaacgactattgaacaataaaagtgcggtgattttctaagggatttcagctaaaaaaacgaactaaaggcacaaaagaaaataaagcagtaaaactatatagtaattaagccaaaatttctaggtttttgcttaatacttagtgggtaatcttatcttgcgatggattaatattatatgtaatttatacagataactaaaattaaaacaatatcactaataaaataaccgcactttatgtgagttttctctgaaagtgcggttattttttctaaggtttttctaaaatcggtttaaggaagcgagcggtgtgggaactttctactttggcaacttgctctggtgtacccgtcgcaataatttgtccgccgccactgcctccctctgggccaagatcgacaatccagtctgcggttttaatcacatcaagattgtgttcaatgacgacgatagtatttccttgatcgcgtaatcgatgcaatacttcaagtaattgcttaatgtcagcgaaatgcaaaccagtcgtcggttcatctagaatatacaaagttttacccgtatcacgtttagaaagttccgttgctagtttcacgcgttgtgcttcgccgcctgaaagtgttgtggaagattgacctaatcgaatataggataatcccacatccatcaaggtttgtaattttcttgcaatcattggaatcgcatcaaaaaactcgcgagcttcttccaccgtcatatctaaaacttgatgaatcgttttgcctttgtaacgaatttctaaggtttcgcgattatagcgtttgcctttacattggtcgcaaggaacataaacatcgggtaaaaaatgcatttcaactttgagtacaccgtcgccctgacaggcttcacagcgtccacctcgtacgttaaaactaaaacgtcctggattataaccacgagcacgtgcctctggcacccctgcaaaaagttcacgaatcggagtaaataaacctgtataagtggctggatttgaacgtggcgtacgtccaattgggctttggttaatatcaataactttatcgaaatgctctaatccctcgatagattgataaggtgcgtaatccgtcttttccgctctatttaacgcattttgcgcaagtggaaataaggtgtcattaataagtgtggattttcccgaaccagatacaccagttacgcaagtaaacaaaccaacgggaatatctaaattcacatttcttaagttattacctgatgcacctttaagtttgagccattttttcttatcaagtgcggtgcgttttttcgggatttcgattttatctgcgcccgataaaaattttcccgtgatggaatttggattgagcataatttcatcggcatttccttgtgcaataacttgtccgccatgcacgccagcaccaggcccaatatcaataatatggtcagctgcacgaatcgcgtcttcatcgtgctccacgacaattaccgtattaccaagattacgcaaatgaattaacgtattaagtaagcgttcattatcacgttggtgcaagccaatagagggttcatctaatacatacattacgccaacaagtcccgcaccaatttgactcgcaaggcgaatacgttgcgcctccccacctgaaagagtttcagcagaacgagaaagagaaagataattcaaaccaacattgactaaaaactgcaaacgctcgcggatttctttaagaattttttccgcaatttgtgctttttgaccagtgagagaaagtgcggtaaaaaattcaagggtttcgccaatgcttttttccgcaattatcggcaaattggtttttccaatatacacattacgtgcttcgggtcgcaaacgagatccgccacagtctatacaaggtcgattactaatatttttcgctaattcttcacgcaccgacattgattccgtttctttatatcggcgagccatattattcaaaataccttcaaaaggatgcttgcgaataaccacatcgccacgatcattcatatattggaattcaatttcctctttgcctgagccatgcataatgatatgttgaatcttctttggcaaagattcatagggcgcttcaacatcaaaatgataatgtttcgccaatgaggtgagcatttgataataatagaaattacgacgatcccaaccttttaccgcaccaccagcaagagaaatagtcggattttgcaccacacgatcttcatcaaaatattgctgcacacccaagccatcacaagttgggcaagcacctgcaggattgttaaaggaaaataaacgaggctctaattctggcacagaataaccacaatgcggacaggcaaaatttgctgaaaaaattaattcttccgctttcggattatccatatctgccacaatcgcagtgccacctgaaagctctaatgcggtttcaaaagattcggctaaacgtgttgctaaatctgaccgcactttaaaacgatcaaccactacttcaatagtatgttttttctgtaagtctaattttggcggatcagataaatcgcaaatttcgccatcaatacgcgcacgaatataaccttgcgcagcaatattttctaaaatcttgagatgttcgccttttcgatttttgacaactggcgcaagtaacatcatcttactgtcttctggcaaacttaatactttatccaccatttgactaattgtttgtgccgttaatggaacattatgatcgggacaacgcggctcccctactcgtgcaaacaataaacgtaaataatcgtaaatttccgtaattgttcccactgtagaacgtggattgtgtgaggtagatttttgttcaatggaaattgcaggggaaagcccttcaatagaatccacatcaggcttttccattaaagacaaaaattgacgcgcatacgccgaaagagattcaacatagcggcgttgcccttccgcataaagtgtatcaaaggctaaagaggattttcccgaacctgaaagcccagtaatcaccacaagtttattgcgtggaatagttaaattaatatttttcagattatgggttctagccccgcgaatatcgatattttccataaaataactcaaaagtatgaaataaatgtaaattttgcgatcattatcgcatattttaatatctgtgcaaatatccagttaaaatatatagatcttttaaaaaatttcaggcaaaataaccgcacttttttagataaaaaatgaggttttttatggctggaattaataaagtcattattgtaggtcatttaggtaatgatcctgaaattcgtactatgccaaacggcgatgccgttgcaaatatcagcgtagcaaccagtgaaagctggaacgaccgtaatactggcgaacgccgtgaagtaacagaatggcaccgcattgtattctatcgtcgtcaagcagagatttgcggcgaatatttacgtaaaggttctcaagtatatgtggagggtcgtttaaaaacgcgtaaatggcaagatcaaaacggtcaagatcgttacgccacagaaattcaaggcgatgtaatgcaaatgcttggtggacgtaatcaaaacgcaagtggttctggtaatgatatgggcggtacgccacaatcttcttaccaagctcgtcaaactaacaatggtaatagttatcaatcatctcgcccagctccacaacaatctgcaccacaggctgaaccaccaatggatggatttgatgacgatattccgttctaaatgacatagattgaaaagtaaatgataaaaatcagagagaagctgaataaaagagagcttctctttttattttactaattaaaaggactaaatctatgattatagatttagtccttaattttatagctttagttttagggaagattaattgctaccatttatcttccatatcacattttattgaagagtaaaactaatttgcacacttaaactcgaagggaatcctgcgggtcttgttccaacagagcgagatacgttaatagcgtctaatgccgccttatctaaactttcatcgcctgaggattttgtaaccttagcaccacttaatgaaccatcagctcctacattaaaagatacactcacttttccttgtttgcgcattatcttcgctcgagttggataacgtttatggctttcaatttcacggcggattgcagaacggtaagccgctatttcactcgtatccgttccacttcctgctacctgtgcattgctattagctgcacttgttgtacttgctttatcatttacgttggcacttgaatcaatattttcatcgccttttggtagctctttattgattggtttcttttgtggtttaacctcttttttaggtttattcttcggcttttcttttggttttggcttttccttttctggttctttgatttttttcggttcaggttttattgttggatcttctacaatttcttgtttttctggttctggctctttttgtacattttctggctcaggctctggctctttttgtacatcttctggctctggagcaggttcttccaacaccatgccctgtaatagttccatagaaatacttgtagatatatcgccttgtgcgctatttgcactatcacttggctcattccaattccataagataaatcctataataataccgtgtgcgatcaaagaaataagcaaacccaatagcgaacgttttgtttgctgcataattattccttacggcgtagttggtacagattgggaaggagtagattcttgagaattttcacccgcactttttcccttatctttcatagaaacaattgccacatttttgatttcatttttagaaagcatatctgtaatcgtcacaaaatcttggaaagaggcttcggcatcaatttttaaagttactttctgatctttattccattgagcaatttctgcctctagagcttcttgagaaataggtttatcattaaaatagagttgtttatccgctgtcactgtcaataatttagctagctcgtcagatttaaatgcgaccgctgtactagcttttggtacatttacttgaattttaccttgagagataaaagatgcagtaataagcaccacagtaagtagcaccaacataatatcaatgaaagggataatgttgatttcatcgaattttttcacgaattattccttatctttttgttcgcttaatactttccattttaaacgattaacttcaactttacgccccaaaccgttataaaacaccatagagggaatagccactagaatacctaatgcagttgcttttaatgctaaagataagtgcaacataattacacttggatcaatgtcgccaccgccgtgaccgatttgatagaaagttaataaaatcccgataactgtaccaagtaatccaacataaggcgcatttgcaccgatggtagaaatcactgtcatattacggtttaaatcaatatctaatgcatgaatagtagaataatgtgccacgcttacctttcttaaaaaaagataacgttcaattaccatcgcaagcataataatgctcatcagtaataataaaccgatgataaaataatcactgtactgttgtaaaaaatcaaaaagttgtaccattttttttccttgttatttgagaaatttttttgagaatataattgagaatgaatttcaatcactcggggaattctagcaaaggctgaataatgcgtaaaccttgaatttaaaaatttctgaattttttaccgcactttatgtggaaaagtgcggttattttttgaaatattatagggaacgaagataatcaatgatcatttgatgatggtcttttatcttaaatttatcaaatacttgcataatagttccgctttcattgattaaaaaactaattcgatgaataccgtcgtaagttctccccataaattttttttcgccccatacgccaaattgctccgcaacttgatgatcaggatcagaaagcaatgtgaaattaagtgcttttttctcaataaattgagctaattttttcggggcatcaggactaataccaagtacaactaagcctagtgcatctaattcagatttactgtcgcgcaatccgcaggcttgtgtggtacagcctggagtgagagcctttggataaaaataaattaaaacttttttaccacgaaaatcacttaaagaaacaaatttttcttgttgatttaataaggtaaaagcaggtgcttgattaccaacagataatggattcataaaaaactcctttaatgaaaaaaaatttgcaaattaacgttattttagcgactataacaagtgaaaccaaataataaaattaaaaaccgacggaggttatatgtcagcgcaaaatcctttattttcgggtagcatagttgcccttgttacgccaatgaatcattatggcgaagtcgatttttcctgtttagaaaaattagtagaacatcacattgaagctggttctaatgcgcttgtttctgtgggtacaacgggagaatccgccacgctaagtattgaagaaaatgtaaaagtcattgaaaagactgttgaatttgccaaaggacgtattcctattattgcgggagcgggtgcaaatgcgacgagtgaagcaattacaatgaccaaattattacgagacagtggtgtagcaggatgtttatctgttgtgccttattataataaaccaacccaagagggaatgtatcaacattttaaagccattgcggaatgtactgatttaccacagattctttataatgttcctagtcgcacaggcagtgatatgaaaccagaaacagttgctcgtttagctgaaattgaaaatattgtaggcattaaggaagcaacgggagatgttagccgaatagttaaaattaagcagcttgcaggtaagaattttattgttttaagtggcaatgatacaacaggcttagaagcaataaaattaggtgctgaaggagtaatatcagtaacaaataacattgcagcaaaagatatggctgatatgtgccgttatgcacttgcgggagattttgataaagcggaagaaattaatgctcgtttaatgcgtttacatcacgacctgttcattgaatctaatccaattccagtgaagtgggcagcttatcgcttaggcttaattaaatcgccacatttacgcttgccacttacaacacttagtgaagaaattcaaccaaaagtagaagatgcgctaaaaatcgcaggattgttataaaaataaaggggtaagtaattacccctcacttttatgtattatagatcagtaaaatgatcaaaaagtgcggtcagaatttatcaaattttcaatttagttaaggttaatatatgaaaaaaataatattgaatttagtaacggctattattctagctggttgttcgtctaatcctgaaaccttaaaagcaaccaacgattcatttcaaaaatctgagacgagcattccccatttttcccctttggctactggaggtgtacagttaccaaaagctgatgatgcctattcattacctaatattgaagtgaaaaaaggggaagatattgatattcgcccaccattaatccctctcgctattattcaaaattcaataacaaaatttgatggcgaacgttcgttgattgtctatccaaaacaacaggcaaaactatataatcttcagcaagttaagcgtttattgaaagatgagggtatttcatcaacaacagatggttcgattttaacaactgattgggcaaaaacagaacgaattggcgataaatctatagaaataaaatatcaaatagaacaagttatgacagctgatgtaagtgtgcttaccgtatctattttacatatgcgccgagatggtattatttttacaccaaatgtatcagataaacaatattatacttcggaacgtttaaatcgcattgttttaacactcactaccgcgtataacaaacaattacaggatttataaagtactttaattcaatagggcgtgtcatataataatttctctaaaataataaatatttaaacatgagacatagatcatccttttgaaaattactctgatatttatctttaaaacacttgaaaatctaacataagaacactattttgttattaactagaatttaaatcacgcaacaaagaggtaaatgctatgacacttaatattaccagtaaacaaatggacatcactcctgcaattcgtgaacacttggaggaaagacttgcgaagttaggtaagtggcaaacgcagttaattagcccacattttgttttaaacaaagtacctaatggatttagtgtcgaagcctctattggcacacccttaggcaatttattagccagtgcaacttcagatgatatgtataaagcaattaatgaagtggaagaaaaattagaacgtcagcttaataaacttcaacataaaagtgaatctcgccgagctgatgaacgtttaaaggattcttttgaaaactaaatactgtagataaaatctaatctggcagtcttattgtaaaatgatatgtctgtcagattaattttagatgaaacaattaaatcactaaaaattgatgatatttaataaaatattaataatattttattaaatatagattaatttaacctatcgtgcaaggcgatgtaaacttcagtacattcacgcttatccactacaagaacataaacgacaactttatcttcaataacttcataaacttaaacaatgccctacagagcgaaattttattttataaaacacaccaaaaaatccagaaaaccgatcggcaaatacgtatgaatttcctaagcgtttgattaattttttcttaaattgcttttaataaaaatagagactaatgaaagatacagattaaatttatattttttaacgagatagatattatttgacgggattaatggcggtgagaaagggatttgaacccttgatgcagtttcccacatacacgctttccaggcgtgctccttcaaccactcggacatctcaccgtaaaaggttcgcaaactataaagatttactctggtttagtcaagttttttactctaaaaaataaaaatctttaaaagattagttaaaaaataggcaataaaagctattgagctaattcagagttagaagatactaataatttagtaagatgtaaccttgataattattaaaacagttgatttttaataaataccatatattaatttatcttttattctctttcttaatctttttattttaattaaaaaagggattttctcaaaatgatcataccaagatgatggtatatcaataattttatccatttcttttaaaagtaaatttcctatatgacaatttaagtgactgcattttttgtgccaaaatttatttggaccacaataatgagaaataactattggcatttttacgtgtaataaatttttctttttaatcaaacctcgatccgttggtgtaaaattaaatctattattaataaattttacttttcctttacagataccatttagaatatcttgatcttggtatttcataacattattgtatttattcatccaatttattgatttttggaaaatattttcttctttccatttatttaaattaattaataatatacctgcattaaaataagaatatccttctaaaccaatggattttttataagcttcattttttacatcaataaaagtatctcgacatcctgccaaataatagttcattatatctatattccaaagttcttgaagtgaagagtttgttaatgtgtccacatcaatataaatagctttttctatattctttatatatttagttaaatttagtctagcgtaagtcgctaaagatatgtaatctattgtttttggaaagttttgaaaatctgcctcactgacaggcaagaaaaatactttacaaaaatatgcagttgctaaattatttattattgtcttattttcctgatttattttcatatcaagaatataaaaatttattttttcaggtgtatttttaataatgctaaaaatacttacagctaaataaggtgcataatggttgtcagatgaaaatataatatttattgtctgtctgtctgtctgtctgtctgtctgtctgtctgtcataaaattatcttctgattaacgtgtaaattattattttttattaatagattaaatacttttattaactttataatttattttttaaaatattcaatgcctttgctcgatgagaaatttttttcttctcagctgtttctaattcagcaaatgtgcaaccttgttctggactaaagaataaactgtcataaccaaaaccattttcgcctttttcttcaaaaccaatcacgccacaacactcgccttcggctataattggcgatggatctgttggatgctgtaaaaacacgatacagctcacaaatttagcttggcgttgatcttttgcaacatgagcaagctctgccaataatttctcacggtttttagcatcattgccctcttcaccagcataacgagcagaatacagacctggtgcgccattaagtgcggaaaccaccaagcctgaatcatccgcaatagcaggtaaacctgatttttctgatgcataacgtgcttttaataacgcattctcaacgaaagttaagcctgtttcttctgggctttcaatgcctaaatctgtttgcgcaatcacttcaaagccaaaatcagataggacatcagccatttctttcactttgcctttattgcctgtagcaagtacgattttttgtttcataattagtccttttattgatgataagctgccgttaaatcagcccagttttgctcggtaaattgaatattcattcgtccaacttctttttcaaaggaacgttttaaacggttcagattttgtgctttccaaaaatcccctgattttttaccgcacttatcaaaatcaatcaaccaacatttttgctcttgttcagcttgttgaagcaaaatattgtgtgcattcaagtcagtatgacaaatctgtaaatcatgtagttttcgaatcaaacgaccaatttgcctccaagtttcttttggcaatgtttgtgtttgtaaaagtgcggttaaatcctgcgcgttttcgattttctcagtcaaaatatccgcttgatagcaaatacctaacttgcctttttgaatacgtgcggcaatgggtttaggcacaggtaaacccgcttcatacaaacgttgcaacaaatgaaactcagcaaaactacgggtagtttcaagagcagaaaaacgataacgatctttgttcagtttaccccaaagtccaccgcgataataatgacgcaacgcacaatttacgccaaaccaatcttccgtttgcaagaaataagtagtgcctcgaccttttgcacttcctatcactcgttcttgtttttgccaaaattccgcttggaaaaactcggttgcttgctcaaaagtgcggtcaaaattaaagataaaatattggttatcttgttggaattggtgcattagaacgttgttatgaatagaaaatggggtcattctactttaaaataggcacaaattaaatgataaaggaacgtcaatgccattttttaccgaagctccaaaatctctttgtattctccgattgtctgctgtaggcgatgtttgccacgccttagcggtggttcagcacattcaggcatattatccacaaacagaaatgacttggattgtaggcaaaactgaaatgggtttgctttcgggcattcctaatatcacgctcattccttacgataaaaaagcgggatggaaaggcgttttattattctggaaacaattaaaaaataaacaatttgatgcactattaaatatgcaaacagcatttcgtgcatcaatcctttctttaggaattaaagcaaaattcaaaattggatttggagaaaaacgttctcgcgaaggacaatggttatttgtaaatcgtcgtattacagatcctttttcccctcacgtattggatggatttatggctttcgctgaatatatcggcgtaccaaaatcagaaccgaaatgggaattagctatctcacaagatgatgataaatttgccgatcaatttattgatttttctcgtaaaaatttattgatttccccttgttctagcaaagcagaaaaagattggctaattgaacgttatgcagaaattgccaatattgcccatcagcataatatcaatgtgattttctgcagttcgccagcgaaacgtgaattagaaatagtcgaaaaaattaccgcactttgccatttcacgccaaccaatattgcaggaaaaacaaacctaaaacagcttaccgctttaatttctaaggtcgatctggtactttcgccagattctggccctgcccatattgcgacaacacaaggtacacccgttattggcttgtatgcctatcacaatcctttgcgtactgcaccttataataatttagataacgtggtatcagtatatgaagaaaatgcccaaaaagaatttggcaaaccgtcttctgaactaccttgggcaaccaaactaaaagggaaaaatttgatggcagagattcaagtcgaacccgtcattgaacaaatgaaaaaattgggattattttgaacaaataatctgtatctcaaaacttagatggttttaatatagccaacttgaaagttgtttttggaaagtaagaactttagttttttttaagttaaaaatcaataacttgttgtcaaaataattatatttagtcataaaaatctataccttaatctcttgcttatttagtccaatttttgcaggtacagattgaaatccaaaattagtttgaattttacgcaattaaatgcaaatgattataaataaacctattgattattataatcatcattattatcatcgccattctcctatttttaattattacaataaggaaaacagatgcgattttctaaactttcccttgcaattacaacaaccttagtgacagcaaatgcactagcgcaatccgttgaattagactctatcaacgttattgcgacacgagatccaagtaggtttacttatacgccacaaaaacaatctaaagatagtcttctttccaaacaagctactagtgttgcagctgcgttggaagacattccaaatgttgatgttagaggcggttcgagaagcattgctcaaaaacctaatatccgagggttaagtgataatcgtgttgtgcaagtcattgatggcgtaagacaaaattttgatttagcacatagaggttcttattttcttccaatgtcactcatccaagaaattgaagtaatcaaagggccaagtagctccttatggggtagtggtgcattgggtggtgttgtggcaatgcgtacgccaaatgctttagacttattgaaaaataatgacaaattcggagttaaaattcgccaaggttatcaaactgctaataatttatcggaaaaggatgtttctgtatttgcggcaaatgacaaattcgatgttcttattagtggtttctataataatgcggataatttacgcattggtaaaggcaacaagctgaataatacagcctataaacagtttgggggcttagcaaaatttggttggcaaatcaatgatgcgaaccgtgtggaattatcccaccgcgaaactcgttttaaacaaacagcaccaggcaataatgaggcgaaaaacgaacttactaatgaacaaattatagaaaaaatcaatgagtaccacaacccactcaacaattttccaccgaaagccaaaccatcactagaagagttttactctggagtaagagcacgtcttggcggtgttagttatttaagtgatcaacaaattcctgatcaaagcacggtatttaactattatttaacgcctgataatccttatctaaatacgcatattgcgctatacaacaataagactattgagaaagaacagcgtaaagtcagtggagtgaaagatcagactaaattgactacccgaggtataaatttacgtaactcttccgaattatctcacatttcctttgtttatggggtggattatatgcgagataaaatcagtactgaacgaggcacaaacgataaagatgcgaagtttcgagcggaaccctataatgcaaattcaaacactacaggcgtttatttaattgcccatattccactatttggggaaaaattgctactttcgccaagtgtacgttatgaccactacgatacctcaagtaaaaccgtaaaatataaggataatcatttatcgcctgcaacaaaattaacttggaaagtgaccaattggttagattttactgccaaatataatgaagccttccgagctccatctatgcaagaacggtttgtaagcggcgctcactttggtacaagtactcgggtaggagatattatcaatagctttgtggcaaacccaaatttacgccctgaaacagcgaaaaataaagaaattaccgcaaatctacattttgatagcctgtttaaacaaggcgataaattcaaaattgaagcgacttatttccgcaatgatgtgaaagatttaattaacttaaagagacttgatgatccaaatgcaaatggagcattgtcacgaacaaattcccagtatcaaaacatagctaatgcccgtttaagcggtattgaattgcaagcccaataccaaacagaacgtttaacgctatttactaactatggcagcaccaaaggtagagataaagatagcggcgaagctttatcaaacattgccgcaagcaaaatcggcgtaggggcagattatgctttagtaaaagacaaattcacggtgggagcgacaataacccattacgctgcccaacatcgagtgcctaaagatcacgctgttacctacccaagttatatactgaccgatcttcgtgctacctatgcgccattaaaaggcgaatggaaaaacctgcgtttagattttgcactggaaaacttgtttgatagaaaatatcaaccagcatttagtttaatggaaggcactggtcgtaatgcgaaaattagtgcggtttatagcttctaaatttactttggaaaaacgccctaaagctgttttccctcaatttttgtaattttatcaattaataggacataaggaatgaaaatgagacctcgttattctgttattgcaagtgcggtcagtttaggctttgttttgagtaaatcagtgatggcattaggtcagccagatactggatcattgaaccgtgaactagaacaacgtcgaattcaaccagaagccaaacctagtggcgaattatttaatcaagcagcaaaatcgccttataccgcacagtataaacaagagctaaaatttccacttacgcaagtacagattttagatcgaaacaatcaggaagtagtcacagacgagcttgcacatattttaaaaaattatgtaggaaaagaagtatcgctgtcagatttaagtaatttggcaaatgagatcagcgaattttatcgtaataataattatttagtggcaaaagcgattttaccaccgcaggaaattgagcaaggtacggtaaaaattctgttactcaaaggtaatgtgggcgaaatacgcttgcaaaatcacagtgcattaagcaataaatttgtatcccgtctctctaatacaacagtgaatacgtccgagtttattttgaaagatgagttagaaaaatttgctttaacaataaatgatgttccaggggtaaatgcaggcttgcaactctccgcaggcaaaaaagtcggcgaagcgaatttactgattaagattaacgatgcaaaacgtttttctagttatgtttcagtagataaccaaggcaacaagtatacggggcgttaccgtttggctgctgggacaaaggtaaataatttgactggctggggcgatgaattgaaattggatttactgagttctaatcaggctaatttaaaaaatgctcgtatagattattcctctttaattgatggttattctacccgttttggtgtaactgctaactatctccactacaaattaggtggtaattttaaatcattgcaatctcaagggcattcccataacttaggggcttatttgttgcatccaacaatccgtacgccaaattttcgtttaagtactaaagtgagctttaatcatcaaaaccttacggatgaacaacaagcggttacagtgaaacaaaaacggaaaataaatagtttaactgtagggattgacggttcttggaatcttattaaagatgggacaacttatttttcattgtctaccttgttcggtaatttagcgaatcaaactaatgaaaaaaaacataatgcaaaagaggattttcaaccacaatcgcattttacggtatataactaccgcttgtctcacgagcaaattttaccaaaatcttttgctttcaatattggtataaacggtcagtttgccgataaaacccttgaaagctcacagaaaatgttgcttggtggtttgtctggagtacgtggacatcaagctggtgcggcttctgtggatgaagggcatttgatacaaacagaattcaaacattatttaccagtcttttcccaaagtgtgctagttagttcattgttctatgactatggtttcgggaaatattataaaaatagccaatctctcgcacaaagcgtgaaaaatagcgtgaaattacaaagcgttggtgcaggactttctttttcagatgctggcagctatgccatcaacgtcagtgtcgccaaaccgcttgataacaatattgataatgccgataaacaccaattttggctttctatgattaaaactttctaaggaggtatgctatgtataaattaaatgtaatttctcttatcattttgaccacttacactggtgcgacatatgcctctacacagggtttgccacaagagggtttgccacaagaggatacagtcgtttttgggaatgtcactattgataaaactactgcagataaaatgacgattactcaaagtagccctacaactcaaataaattggaagagttttgacatcggtcaaaataaagaagtggaatttaaacagcctagcccaaacgctgtggcatataaccgtgtaactggcggcaatgctagtcaaattcaagggaaattgacggcaaacggtaaagtttatttagcaaaccctaatggggttattattaccaaaggggcagaaattaatgtagctggtttacttgcaacaactaaagatttagagcaaatcagtgaaaatggcaatggcaatggcaatagctatcaatttacccgtaaaacaaaagatggtcaggagctaaaagaaggtaaagttctcaatgaagggaaaattaaggcgaaagatttcgtggtacttaatggcgatgaagttatcaataaagaggaaattaacgttacaaatggcaaagtatatttatcctcaggcgataattttacatttaccttattaccagatagcggtataagtgtggcattagaagataatgcagtacggggtattgttaaaaatgaagggattattaaagcagaggacattacgctaaatgcaaaagggcgtaaagaagcattagatagcttggttatgaataatggtgtgttagaagcaactaaagttagcaataaaaacggcaaggttgtgttatctgctgatgaaattaagttagatgataaaagtaatattaaaggggatatggttagttttgtggctgatgttacctcaaataaggaacttaaagacaatataaaaatcacttctcaaactggctcaaaagttacctcgcctaaaatcgattttaaaggcaaaagtgttaatatcaatggtaactttgggcgtgacgatagtaaagcacactataacgatgagcataaaacattaaaaacagaagttaatattgacgtgccagacgatgaaaatattcgtattgcgaatattgaagatgaagataaagatagtacgggttcatttatacaaacagatgcgttaagttcattactagctaataatggaaaagtaactcttaaaggaaataacgttaatatttcaggacgtattcatatagattcctttagaggctcagattcgctattaaagctaactaacaaaggtcatattaagatcaataatgcggatattcattcaaaaggtcgtttattttttataaccagtttgcagaatgaggaagattttaaatcaaatattaccattactgacagcaaaataaatcttggtaacggagctatgggattggggcgtagtgtcaatgaaagcgactacgataacaaatatcagaaaacggaaggatcacaacgcaaaaagtttaatgttaagatgagtaacgtagaatttaatcaggttgatgatgtgattttagcaggtggatttgaaaaagttaatttagataaaatcgttgccacaggacaaacgaatttttacattgatgggggggtatcccgtaatagaacaaatggtgagccttggaaatatgaatacggtgtgttagatttagacaaacgtacgcagttatcggagttagatcaaggcagacgccgttggggatattactatgatttagagttagatatgaatagagcctatttgtatcgttttgatctgtttgccgctaaaaatacaaggcgatcaactattaaaggcacagaaattaatatttctaacagtaatattaatctgaaaaatggatttgtacatttactggcagaaaaaattaaattagataatagcaagattgatattacttttgataaagataattcacaagatactttagctcaaacaaaccgtttaggaatgaatggtaaagtgtcaatgataaactcacatattaaaatcgtaggcgatgagaaaagtggtatatctccaactgggacttatgctacgatgtttttaatcggggaattaataggggaaaaaagttctatttttgtgaaatctcatcagggttacacctttaaaactgatggcgatacaaaaattgcaggtaaaaacagcaaagaggacttgaaaattaccgcaattaacactggtggaagagcagcggaagaagttctaattaatggggcgttgggttcagctgataatgatgctaatatcgccaatatggcatttactattggtgattcagcgaataccaaaacaaccattgaaaatgccgacatcactgccttagcaccaaacggtgggacagcttatttaagctccaaagatgtagaaattgaggtaaaaccaaattcagatttcacattctttgaacttcctcgtgagaaaaaccttaatcaaacaaaaattaacggcgcttctaccaaactcagtgaacgtggttttgctagactttatgacaaaattaacggtgtgcgagccagcaacttgtctgctgagcaattgaatgttacggactcaagcgaaaaaatcattaatacaaatttagtgagtagcttagatgttgaaaaacttgtttctgttgcagtttgtgatgcaggtaaaggttgcgaagaacaacaattcggcgataaaggtaataatactaaagtgagtgttggagagttagaagctgaacaataactattcagaacacaaggtaaaagcataaagccaatctgacagacatcaattaaattgcatgcctgtcagatttattaatagccactgttgctatattattttaaacatccacgtataaccaatacgccaacatttcgagcttgcgcgacggcttttggtttactcagtttaatttttaatccttgaagttgataacgtgactcaagcaaatccgccacttcataagccactcgctcaatcaacaagaaagatttactttccacataatcaataatcgcttggctcacttcagcataattcaaacaatatacaacatcatccgtttctgccgcttgtttacaatcccacgccatttccaaatcaaacacaagtttttgttttatttgctgttcccaatcatatacaccgatttgtgcaaaaacagtcaattcctcaataaaaacacgatccataagatttcctctaaaattattgtaggcgtatgctatcaattttgggtagaataacgaacagtttttcttgctggagtgcaaaatgagccttttcgcccttttttatatgctttttgcctatcttttaggctcaatttccagtgcgattttaatttgtcgcattgcaggcttgcctgatcctcgtcaaaatggctcacacaaccctggggcgacaaatgtgttgcgcattggaaatcgtaagtctgccttggcggtgcttatttttgatatgttaaaagggatgattcctgtatgggcagggtattatttaggtttaacccaatttgaattgggaatggtcgcacttggtgcttgtttagggcatattttcccaattttctttcaatttaaaggtggcaaaggtgttgcaactgcctttggggcaatcgcaccgatttcttgggctgttgcaggttcaatgtttggtacgtggatctttgtttttcttgttagtggctattcttcattaagtgcagttatttctgcattacttgtgcctttttatgtgtggtggtttaaacctgaatttacttttcctgttgcactggtatgttgcctattaatttatcgtcatcacgataacattcaacgcttatggcgtggtcaagaagataaagtttgggctaaatttaaaaagaaataaaaattttaccgcacttttctaaatttccactggagtttcctgtgtatactaaaggttccgtttccacccgtattgcgaaatatttatttatcattcttatcgttgctggtgtgattagttctctaagtttggcaattatgagcagtaataaatatgatgccgaagccattaatatttcaggttctttgcgtatgcaaagttatcgcttactttatgaaatgcaagaacaaccagaaagcgtggaaacgaacttacgccgttatcatataagccttcattcatctgctttactagaagttcaaaatcaatttttcacaccgaatgtattaaaacattcctatcaaaacattttgcaacgttggacgaacatggaaaaatatgcacgccaacaggatgtaaaaaactatagtaagcagcttactaactatgttgcagatgttgattattttgtgtttgaattacaacgttttagtgagcagaaatggattttaggcgtttcagtattaggttttgcgatgttgttaattttgctgatggtgtcttatgtgatttggtacacaaaccgagaagttgtgaaacctttgcatttaatgacaaaagccagtatgcaagtgcaaatgcgtcaattcaatcatattccacttgacacaaggaaacaaaatgaacttggcacactggctcgcgtatttacacaaatgtccacagaactgggacagctttattcgcgtttagaagaagcggtaaacgaaaaaacgcaaaagttgcgtcaaactaaccgcactttaagcactctttatcaaagtgctcaacttctgaatacaaacacaattaacgataaaattttaaatcaagttttgcattacatttttattagcgaccatttgaacttcgttaaagtggaagtgatgggggctgaacattgggatattacattgggtaagcaagatgctaataatgaactacaaatcgaaaccctttctgtggataacgaagaattaggtgtactgtcttggcaagcaggattaccttgtccagatccccgaattatgcaaaatttagcgcaaatgcttgctcgtgcgctttatttccataaaaatttacgtcagaaagaacagattttattaatggaagaacgctcaattattgcgcgagagttgcacgattctttggctcaagtcttatcatttttacaaattcaacttactttgctcaaacataacctgaagaaagaagacgaacaatcaaaagaaaagagtttggcaattattgccaattttgaacaagccctttctggtggttatgcacagttacgtgagcttttagccactttccgtttaactatacaagaagcgaatttacagcttgcactaaaacaagtgattgattcattacgctcacaaacaacaatgcaaatgaatgtgaattgtcaattaccatcgcaaagtttgaaccctcaacagctggttcacgttctgcaaattgtacgtgaagccaccaccaatgcgatcaaacattctcaaggcacggtaattgaaattagcgcaagaattaatgcggaaggcgagtatgaaattttagttgaagatgatggggttggcattccaaaccttgaggagcctgaagggcattacggcttgaatattatggcggaacgttgccgtcagcttaatgcacaattgcatattcatcgccgagaacaaggcggcacacaagtcaaaattaccttgccacatacattatattaggacatcaaaatgcaaaatttacaaccttttcacactttccacattcagtctaatgctcgtgaaattattgaagcacatagtatcgaacagctacaacaagtgtgggcgaattctaaatcagaaaatttacccgtactttttttaggtcaaggcagtaatgttctgtttctggatgattttaatggcgtggtggttttaaatcgtttaatggggattacgcacgaacaagatgcaaattttcactatcttcacgtcaatggcggcgaaaattggcataaattggtggaatggtctattaataatggtatttatggcttagaaaatctggctttaattcctggctgtgcaggatctgcgcctattcaaaatatcggtgcttatggcgttgaatttaaagatgtgtgcgattatgtggatgtacttaatttaaacacgaatgaaacctttagactcgacacagaacaatgtgaatttggttatcgtgaaagtacttttaaacatcgttatcagcaaggttacgtgattacagcggttggattaaagcttaaaaaagattggcagcctattctaaaatatggttcgcttgtagacttcgatccaaaaactatcacggctaaacaaatttttgatgaagtctgtcatatccgtcaaagtaaattacctgatccaaatgaaacgggtaatgcagggagtttctttaaaaatccagttgtcagttcagaacattttgaggaaatcaaaaaacatcacaaaaatctaccgcactttccacaagcagatggctcagtgaaattagcggcaggctggctgattgatcaatgtaatcttaaaggttttcaaataggaggggctgcggttcataaaaaacaagcattagtgttaattaacaaaagtggggcaacaggacaagacgtagttaaacttgcccatcacgttcgccaaactgttgcagaaaaattcggtgtatatttgcaacctgaagtaagatttatcagtgcaactggcgaagtaaatagcgagcaaattatcacgtaattttataataattgaactttcaattgataaaatctgtcttattgacaaattagttcaataagatagcttattgtgctataactaagtacattgattggcaaaagccaaaataaagaagggaaacgatggataaagaaacacaaatgatgttagttcctcaaggcagtatcgaaggttatattcgtgcagcaaatgaatatccgatgctgaccgcagaggaagaaaaggaattggcagaacgtttgtattatcacgaggatttagatgcagcgaaaaaactcattttgtcgcatcttcgtttcgtgatccatgttgcacgtggctattctggctatggtttgccacaagctgacttaatccaagagggcaatatcggtttaatgaaagcggtcaaacgttttaaccctgaagttggtgtacgcttggtgtcattcgccgtgcattggattaaagctgagatccacgaatatgttcttcgtaactggcgtatcgtaaaagtcgcaaccacgaaagctcaacgtaaattatttttcaacctacgtaaaactaaacaacgtttaggttggttcaatgaaaatgaagttgatatggtcgcaaatgaattgggtgtttccaaagaagatgtgatcgaaatggagtctcgaatgagcggtgcggatgtcggttttgatttacctactgatgatgcagaaacagagacctattctccagccctttatttggaagataaaagttctaatttcgcagcagagcttgaaaatgaaaactttgaaagccaagcaaccgagcaattaggtgcagcgttacaaagtctagatgcacgtagtcaggatattatcaaagctcgttggttagatgataacaaagccacattgcacgatttggcagcaaaatataatgtctctgcggaacgtattcgtcaattagaaactaatgcactgaaaaaattaaaaagtgcggtgaatttttaaataatttagaaaaagaaaacctgctgattagcaggttttttatttctcatttaaccgtaatttcaaatcttcagcagtttggcaggtcttaatcttatcaaacacttggttcgcctcgtcatattccttattcaaataacgtaaccactgtttaattcgtgccacatggtaaaaaccgctgtcatattcattttcgacattagcatatttttgcaagattttttgaatctcataccaaggcattctggatgctgccctagcaactgcactcgcacaggcgtaccagaagaagtaaagccctgattttttaattcagggcataaacgataaaatactttttcagggagaaattgatcaactacgcgaacaaattctgttatacataaatcgtagtcattcacttcggtgagaagttggcgtacaaagggatctagaaccccttgcataggcgcaagaataacacgcactatttccagccttttgctttacaaattaaatcgtaagcggcttgaatctgttgagttttttcttttgccatttccatcatttctggcggtaaacctttcgccacaagtttatctggatgatgttcattcattaaacgacgataagcacgcttaaccgtgctttgctcgtcggactcagtcacacccaatactttataggcatcatttaaagttgggccagaagcatgttggtaaccaccactattttgttgttgatattggtagccaccttgatatgcaccttgttgatattgctgataaaaaccgccttgagtaaaagctcgagcagccatttccatcgcaatcatttgttcaaattgcatacgagaaagcccaagttcttcagcgatcacataaagcacttctttctcattttcgtgaagttctgaatcggcaaaagccgcttgaacttgcacttgtaagaacattcgcaataaatcagcacgttgcccacaaccaatgcgaaattcacggataacttgacgaatcgggaaatcagattctttaccacgacgaaacgcatcttgcgctaatttacgcccagcatcatccagtttaagctgaatcattaattgattagctaattgaatatcttcttctgttacacgccctttcgatttacttaaatgtcctaacaccgcaaaggtggtttgcataaacaagtcttgacgtgttgttttctttttaaagaaactagaacttaccgagccaagctcatacaattttttatctgcaatagagcctaaaatgagaccagcaatcgcaccaaaaaatccaccaactttccaacctaaaaatacgcctataattttcccaataaatcccattctttcccctgttaagtcaaagtgcggttatttttataatgttatttataatgatgataaaaatttatttctcaagttttatacgccaaattcggcacgataagcacgcatttctggcaaatggctactgtatcgaggatcttgttcgataaattgcatcaaatcatctaaatcaatgattgatagcacttggcattgataatcacgttctacttcttgaattgcagaaagctcgccttttcctcgttccttacggtttagagcgatcaataccgccgcaagctctgccttatttgcactgattaattccatagattcacgaattgcagtgccagccgtaatcacgtcatccacaagcaaaatttttccttgcaatgggctaccaattaaattgccgccctctccgtgatctttcacttctttgcgattaaaacacacgggtttatcaataccataacgattaaataacgccaccgaaactgaagtgccaattggaatgcctttgtaagcagggccaaaaaccacatcaaaatctaccgcacttgcttgaattgccgcagcatagaactcgcctaaacgcgctaaatctgcccccgtattgaacaaacctgcattaaagaaatacggacttttacgccccgatttcaaagtaaactcgccgaatttcaatacatttcggcttaaagcaaattcgataaaatcgcgtttatattgttccattttttaactcctataaactgtgtttataagcctaacgcttcgcgttgagcgataaaaatttgattacagccttgtttcgctaaatctaataatgttaataattcttcatggctaaatggctcgccttctgcagtgccttgcacctcaatcattcgaccatcttccatcatcacaacattcatatcggtttccgctgcagaatcttccacatattccaaatcacaaacagcttgaccatcaacaatccctacagaaattgccgaaactagccctttaattggattagtttttaacgtgccattctcaattaaaccattgatcgcatcacataatgcgactgcagcaccagtaatggatgcagttcgtgtgccgccatccgcttgaataacatcacaatctaaagtaatcgcacgttcacccagtgctttaagatccaccatggcgcgcaaagagcgggcaattaagcgttgaatttccattgtgcgtccaccttgtttacctttagccgcctcacgttgcatacgactatgtgttgaacgtggcaacattccatattcagccgttacccaaccttgcccttgtccttttaagaaacgtggcacagcatcttccactgttgcagtacaaagcactttggtgtccccaaattcaacaagcacagaaccttcagcatgcttggtgtagttacgggtaattttaatttggcggggttgattattttctcgattatttggacgcataattattccttgatatgatttcgaacgatgtaataaaaaagcgcactattctagcacgctttagtttttatttttgttaaaattcgctaagatattgattattgataataaaaaagcaaggtaaataaccttgctttattaatttggtggagataatcgggatcgaaccgacgacctcttgaatgccattcaagcgctctcccaactgagctatatccccataaaagacagcgacatgataaaatttgactatgtggctgtcaatacgattttattatgcgtttgttatccgattaaatattaagcgttttgtgcatgaataaaatcaatagcgcgctgaatacgcacaagtacgcgatctctgccgataccgactagggtaacatccattgatggcgattgaccagaacctgtcacagcgacacgtaatggcatgccaactttacccatgcccacttctagttcagcagctgtttgctcaatggcttcgtgaatagaatgtaaattccagctagaaagtgcggttaatttttctttcacttttgcaagcgcttcagcagcattgcctttgaaatgttttttcgctgcggcttcatcaaaggtttcaaactcttcaaagaagtagcggcttgaacttgccatttcttttaaggttttgcaacgttccgcaagcatggagacaatatcagttaatgcaggaccattgcttgtatcaatgctttgatctttgtaatgccattcaagatgtttagccacatattctggcggtaattcgcggatataatgttgattcaaccattgtaatttttcggtattaaatgcgctagctgatttgctaacgtgatctaattcgaaatagttgatcatttcttcgcgactaaaaatttcttggtcgccatgtccccagcctaaacgaacaagatagttaattaaagcttcgggtaagtaaccatcatcacgatattgcattacgctcactgcgccatgtcgtttagagagtttttgaccatcatcgccattaatcatagaaacgtgtgcataggttggaattggggcaccaatcgcttttaaaatgttaatttgacgaggcgtgttgttgatatgatcttcgccacgtacaacatgtgtgatacccatgtcccagtcatctacaactacacagaagttataagttggagaaccgtctgtgcggcgaataataagatcatcaagctcactgttgctgatttcaatacggccacgtacggcatcatcaaatactaccgagccttcagttggatttttaaaacgtacaacatggggttcatcaggtgaatggttgtgatcgtgtaagcagtgacggtcataacgtggtttttctttattttgttcttgagtatgacgaagttcttctaagtgttctttagtacaataacaacgatatgctaagccttgttcaatcatttcatcgatcacttggttataacgatcaaagcgtttagtttggtaataagggccatgctcccacggaagatttaaccattccatgccttcaataatggcagccgttgcttctggtgttgaacgctctaaatcagtgtcttcaattcgtaatacaaattcgccgttattatgttttgcgtataaccaagaataaagtgcggtacgtgcgccacctacatgtaaataacctgtagggctaggagcaaaacgagtacgcacttttacatttggatctaaattaaaaggagcatctagtttcatctttataacctatcttcaataaaatattagtcgttattctactacgacttgtttgacttctaaataaaaaagcggattttatgcttatttttacgacaattaaacaaaatttaataaaaaggtattgactgaaaatgcattctccctataatgccaacccacaacattaagggcgattagctcagttgggagagcacctcccttacaaggagggggtcactggttcgagaccggtatcgcccaccacttctctaaaaagtgttcttaatgttactaagtttgaccaagcgggcgattagctcagttgggagagcacctcccttacaaggagggggtcactggttcgagaccggtatcgcccaccacttttctaaagtgtcctttccgctcaaactttccctttatatttaaacgctttctagtgggcgattagctcagttgggagagcacctcccttacaaggagggggtcactggttcgagaccggtatcgcccaccacttaaaagtgtttaaataaaccgaaaatttaaggttttgccttaatattatcgggcgattagctcagttgggagagcacctcccttacaaggagggggtcactggttcgagaccggtatcgcccaccactttattttcaaattatccaaataattttcttttcccgttcaatccattacgtttacgtgataaagtgcgcaggcattgtcatatctaattttaaactgtttatatatcatagggaaaatttatgatcgcttatattttcttagctttattcacgattgcggcagtgatttttattgtaaactcccattatcgttggacttatttctttgctattacgctttttacttttttatttggcggcatgcttatggtttccagccaatggcaacgtgctttaaatttttcatcagtgctttttgtagtgctgatgttatttcatcgtttaaaaattcattattacaaacagcctttgttaatttcagatttctttcttgtggtggattggcgaaattgggaaaccttaattcattataaaggtgcgttgtttggcgttattgggctactggcgttattaggttatgcgatttttggttttaatgatgtcgagtctttaggggtattgggtaacagcattggtgctttattgtttatcgttagctttagcttgatgtggcattattctaaaaatccaagtgcggtgcaagtttggttagattctttgcctgatgatggtcgtgatgtgtttttaaatttaccaatgtcttgtcgcggtatttttttcaaagtgccaaattttgatggcaatagccaaaattttattgaaaaaatgaccgcactttcatctgatacaaacaacctatctgaaacaaaacccgatattgttgtaacattaatggaatccacgctgaaccctcatcaatttgcttttagtcagcaatctattccaccactttccatgtttgagtctcaaagtgatacagtatttgcttcgccgttgcgtgtacatacttttgctggtgcaacgtggaaatcagaatttgcttttttagccggtgtaccttcaaccgattttggtgcgttagcaagtggcgttttttattctgttgtaccgcacttgcaatcaggtttagtgaaaaatctaaaagcacaaggatatttttgtgttgctttgtcgccttttacaaaaggtaattacaatgcgaaatccgcttatgatcatttcggttttgatttaatgttacagccgcaagatcttggttatcctgcgcctattagtaaaaatctttgggatattagtagtgaagaaatgatgaagtacacccgaatgattttagaaaagcagcatcctgcactagaaaatgtagatcagccaatgtttgtttatgtattgactatgcgagaacatggcccatacgaattgggcatggaaaatatatttaatcttcaaatgcctaatttaggggctaaaagtatttctgcattgaatgactatactcaacgtattgttgcattaaatgatgcgattgaaggaatgaataactatttacaagaacgtaaaaagccttttgtgctaggttatttcggtgatcaccaagtggcatttgataatgctatccctccgaagaaaggggattatgcacagcccgattatgtgacgcaatttgttgtaagaagtaattatgcaagtcaatttaagcaagaacaaaagtttttagatcttgcttttgctggaggcgtcttgatgaatgtagctggattatcagcagaagatgaatttatgaaagcgaatatggcaatgtgtaaactaagtcacggaaaattagaagattcttctgatattcagctactcaatgattatcgccattatttatatcaaacattggcgattgccagataattttcttagatcgagcattattgctcgatctgctcgccaatttcatctaaggttgaagctaattgtgcaccaactaataccacaagccaacttatttgaatccacaataacataattggtaaagttgccattgcaccgtaaattaattgataagagggaaaagtgacgacataccaagtaaatgcttgtttaccaagagtgaaaaaaatcgcggcaagaaatgcaccgtaagctgaatgcttaattttcacttttttattcggtacaaccgtataaataagcgtaaaaataaaccaagtaaataaaaaaggcacaaaactgagcaattttaagcctaatgataaatgttccgattgctcaaacattattttaatatacgaactaatcccaatactcacgccaataataagtgggccaagtgtcaaaatcatccaataaatcgcaaaagaagaaagcggagagcgagattgactattgtgccaaatactatttagtgttcggtcgatgttattaattagcatcaaggcaacggcaattaaactcacaattcccaccgcactcattttctttgagtttgatacaaattgatcgatatattcgcccaccatatcactcgctgatggtgcaaaattagtaaaaatcatttcttttaattctcccgtcacttcattgaatacaggaaaagcagagaaaatagaaaaaataaccataactaaaggaactattgctaacattgtgctataagtcaatgcaccagcgacttgattaagtttattttctgaaaaacgtttccaaaataataatccaaaattttttaatgaaatcatagaaatcccccacaacaatgtttaaattttttaccataaccacatacacaaggttgtttcattgtcggtaatgatacggtcggatcaacaaaataccaacggttttcaatttttacaaaaattgaccgttcttgatgggctagttctccctcttcgccttgaaaaatcgccttaaattctaccgcactttgagtttttgtaaggctttccgtttttagaatttctaatcctagccacgtagtgttgtccgcccattcttgcaataacctaggctttaataaagtttgttggcttggcgcagttgttacaacaatatagggaatattttttaacacataagccgtataacgtgaacgcataagttgctctgccgtttcgggaaatgcttgtctcaaatgaaatttgccacaacaatctgcgtaatgatgactagattgacatggacaattttctaaagaaagtgcggttgaaatttctgacatatttatccctgttgtttgaatttcgatatttgcgatcgaattgagcgtttaaaggcttcagctaatacttcaatctctaatgctgcatctaattcagcttcattttcgggcgcagataacaagcgatttaaatgacgaattgttatttgcggataaggacgggcgagtaattttagttcatccttttgcttaattgttcctgtttcaataatacgaacataccatccactaagcccagtttgataaacaatatcgcgagtatcttcgttttccgtgttttttgataaacgctcacaaggtttacgtggttgagatacttctaaaatggttgagccgatttgataacgatcgccaatacatacattgtcttcattcaagcctgacacgacaaaattttctccgtatatcgcagtatccatataagaaaaatctttatttaataaagtatttaattcattaaaagaatctgccgacataaaaaagagagctttatctacaccaccgtgatgtttttttaaaccaacatcgtttccttccgcaccaagagaatgaatttttaccgatggcacaacttttttacgaatcgcgctttcatactggcttccatcggaaaaggttagggtttcaacttgtcccacttttataactaaaatttttgcattcattttatttttcgcttgttctagaaaaaatttacgtggaattataaccgaaaacgtttaactttttgaccgcacttctttttttacttattattcgttatcagaaaaacaaaaaagaaataataaaaatgtttgaaagagaaaaaaattttctaaaaatattttatttcttttcttgaaaataagatttttcctaagggcgaaatcatcacgttcaatgataataaggagatttattatgtcagacgtattccacctaaacctcactaaagcacaacttaaaggtgcaacactcgctattgttcctggcgatcctgcgcgtagtgagcgtattgcgaaacaacttgataatccagagtttcttacaagcacgcgtgaatttacatcgtggttaggttatatcaatggtcagcctattgttgtatgttctacgggtattggtggcccatcaacatcaatttgtgtggaagaacttgctcaacttggtgttcgcactttcttacgtattggcacaacgggggcaattcaaccgcacattaatgtaggcgatgttcttatcacaactgctgctgttcgcttagatggtgcaagctgtcattttgtaccattagaatatccagctgtggcaaactttgaatgtacaaccgcactttataatgcagcgaaagcaaaaggtattgagccttatgtaggtgtaaccgtatcatctgatacattctatccaggtcaagaacgttacgatacttatagtggtaaagtatatcgtgattaccaaggtttgcttaaacaatggcaagatttgaatgtcatgaattacgaaatggaatcttcaacattgtttactatgtgtagcgcattaggtttgcgtgcaggaatggttgcaggcgtgattgtaaaccgcactcaacaagaaattccaaatgaagcaacgataaaacaaacagaagaaaaagcggtgtctgttgtgatcgcagctgcacaagcgttgttaagttaaattaatatttatttgaaacaataaaactttattttattctgcaccttaattagatttattttctaacgaagtaaggtgcagatttttttattaataaactgcgatcttctgatcaatttaatcaaagtagtctatttacttgttggcattgaaacctaaacttgatataagttctaaataaactacttctaaaggctaaataacctaaaatatttacgactaaaattagatttctgttaaatctacatttttagtctcttttgaggctaataatgccaagaaagtcattaatgcattgattgctaaataaattcctacgcccattacaccgaatgacgcgttaatttttaaagaaatcattgctgcaattgttgcaccaataattgatgctaaattatacgcaagagaggcacctgaataacggacttctgttgggaataattctggtaatagcgcagccattggaccaaatgtcattcccataatcgccataccaatcactaaaaatgcaaatacgctaactggagtgccattttctaagaataacggcattgctaaaccaagcacgccgatagcaatagtcacccaaatcaaccatttacgacgaccgattttatctgcataaaaaccggaaatactgataaaaataccaaatacaatggcactaattaataacaagccagtaaatgtatttgctgggattcctaaaccaagcgcataacctgcttcagaaagctttggcacggttcgagaatatgcctgtgcaaaagccgtcataatgtaaaacaaagaataagttgccaccataataaatgtaccaatgatcattggttttaagtgtttggtaaacacaacactcactggtgcattcaattttttgcctttttgctctgcttccacaaatacgtggctttcgtgcaaagttaagcgaacatataaaccaactgcaactaataaaatggaagatacaaatggaatacgccacgcccattcaacaagtgcattatgaccaagtaaatagctagctaagaagaacgttccattagcgacaaataaaccaattggtgcgcctaattgaggaaaagtaccgtaccaagctcgttttccttctggtgcattttctgttgcgactaacgctgcacctccccattctccaccaagtccaattccttgacctacgcgacatacacaaagcaaaatcggcgcccagataccaatttgagcataattaggaagtaaaccaattactaccgttgaaccacccattaaaacaagagaggcaaccaaggtttttttacgaccaattttatcgccaaagtgaccgaataatgccgaaccaataggacgcgcaaaaaatgctaaagcaagcgtagaaagagaaagtaaatcattagaaagcggatcatcgctatgaaagaattgcgtattgaaaactaatacagcggcagccgcatagatataataatcaaaaaattcgattgccgtaccgaccatcgaggctaacgccactttcatcggattattacgaagttgtgtagacattgtgtttccttagaagtttattataaagagaaaggattgaatcctagcattttaactaaggtctaacaatttttaatatgcaattttctatttttttagagaaatattttgagttttctaaatgtgagttatgtccagcgcagggaattgtcactaaatcaatttgattttctttggctaatacttggaacttatgatctctttcgccacaaaaataaaaaaatggcaaagaacttaaccgcactttttcactaaaatcaggttgtttggatagacttgtcgccagcagcattttgccaatattttccccacaatttgattttcgtttttcaaccaactgtaatctttcttctgcagtcaaatgagaaaacacaggttgttgataccaatcattcaacactttttctggtggttcttgtataaaacgttgcgcccaagcaaaatcctgctgaaaacgagcctgcttttcttcgtcagtttttaaacctagattcgctccttctaaaataacgccttgcaaattagatcgttccacctgagctttcagcgcataatacaaagcgatccttccacctagagaatacccaacaagaaaatagggttcatttttcaccgcacttttaatttgcttagccaaatactcagccgtttcttcaaaatttgtgacttcaatatctctagcttgcccgtgaaaaggcaaatctagcgcaatacaattaaagtgcggtagattttcaatgactttttgccagtcattttttgtaccaagaagtccgtgaagaaaaatgatgtttatcattgaagggattattgatagaaataataaaatatggcggactaaagcccgcctacagaatatttaagcaccaatcacggcgtgactaatttgatcgattaagcgtttatacaaactactaccatcactcggattcgttttaatttcaattaacgttgccttgcgacgactataagcctgtttaacaacggaattgagatccgcccaagtataaggatgagcgtatttgagatcgaacattgccgcgatttgagaaaaatcgccattatgcggtaatcgatagaactgatctttgacttgttcatccacaggtaacatatcaaaaatcgcaccaccattattattgatcacaaagattagcgttggttgcgtaacatttttgaataatgcgaaagaatttagatcatataaagtggacgtatcgccaatcaccgcaacaacaggtttatttgaaccaatacctattccagcagcagtagccaacaaaccatcaattccactcgcaccacgattggtataaacgggataactttcgggtaattgcgttagcgcatcaaccagacgaacaagtaaactattacctaaaaataaaacaccgttataaggtaaaagtgttggtaaacgtaatgctagcgaggcttccgttaaatttccgcccacttgctgttcaataaaggtcgcacagaacttagataaagctaacggctcaagcaaccaaggcttttggcgtaaaggtggatgcgcacgtaaccaatgatgcgctttagcattgaatcttgtcaatgaatgatggtaaggatctagtgctttaccgctttgttcaactagccaaaattcccctttaaacgcctgcaagaattgattaatgcgtttactaataaaacgcgcgccaaattgaatcacaatatcagcttgtagaagtttttcacgaacagtttggtttgctagccaaatatcttcataaggcgtcgttggaacaacaccagattgaatatccgtcagtaacacccagcccatagcacttgcccaagaattaatgcccatcgcttgttctgcaggtaattgaccaaccacaacgacaccacgtttggtacgccaatgatcccaattttcatgcattaatacttcgttttgttggacttctacatttatccaagacttgttttgaattaaccagcgttgtaacggctgtagccaactatgggaatttacttcctcatcagttgcatcataaagtggctcggtaaatggcacattaatatgaacaacgccaccttgttgtttttgttggaaagctgcctgttcaagtagagaaatcaaccactgcgcagaataatcagcgttcggtttaggtaaattaacatttgcaactggatactgaccaaacatattttgttgcaaaatagcttgatttgcaccgcactcccaaagttctggtggacgatcagcagttaaaacaaataaattcacaccggtttggcgcgcttcaataattgctggataaaggtttgcagtcgccgtgcctgatgtcacaataatggcaacaggtgattgagttgccttagcaataccaagtgcaaaaaaacctaaaccgcgttcatcaaaatgcgtatgacaagtgactgaacctgcattttgcaaacgtacggcttctagagttaaaggtgtcgaacgcgaacctggcgcgatacaaacgtgagaaacgccttggcgcaccaaggtttctaaaatcactttcgaccaacaacgattaaacacgcttaccgacattttttttctccgttatcatttttcttctgcaaacaaggaaattaaccctgctgctttacgttcaatttctttccattcttccaatggctgcgagcctgccacaatgcccgcgccagcaaatacacgaatacgatgaccttcaataaaagcagaacgaatcgccacacaaaactctgaacatacatcgctcatcacgcccaatgttcccgcataccagcctcgatcaaaggtttcgatttctgacaaaatcattttggcttgttgctgtggcaaaccagatactgcagctgtaggatgaatcgcttttaatatatttacatctgcataatgtgcggtcaaatttgcgcgaattttacgaatcaaatgttgtactttacgtaacggtttcaattccacattgcttacatcaaaactttctacttgcttacgtaaattctgcgaaatatcttctacgaccaaccaattttcttttaaatttttctcatcatttaacaaccaattggcttgagattgcgtttcttcctcactttcagaaaccgatgctgtccccgccaaagcttcggttagcaacaaattatactcacgagcaaataggcgttctggcgtagaaccaacaaaaaccgaatgagaattttcagcccataaaaaatgataacaaccttgattttgtttttcgctttctgctaaaaaatcgtacgcattaatcgcttgctttaaatgaaaagtggtttcattggctaacacaatttttgtcagctctccacttttaatttccaccaaagcctgatttacccaatcacaccaagttctttcattagctcgaggctctgtatgcaaaggaatttgttttggtaacgcagaaagtgcggtgagattttcaaaagttttgaggtgggctaaagtatcattcgcactttgctcatctttcacaaaaaaggataccaacgtgcctttattatcctgttcaacaagcattttaggtaatacaaattgtgcagtgccttgaaattgcaaaccgcctaccagtggaaaaccactttcttcaataaactcttgcgctaaatttaactgtgaaaatgactgcactgccccaagcgcagccagtgctttttcttcatcacgaaaatgtaaataaaattgaggatacgcagattgacctttcagccacgccaacaaatcgaccttgtccagtttcacctgaaaacggacaagttcattcgttgattgctgtaaatatgcgtgaatttgcgattttaactcccctattgcctgcgctaaataactcattagattttgttttaaatacacaaaaaattagccgtattctaccgcagattgttaatgacaaaaaatttttttacaaaatcttttcaatattaaaaattcagcgtaaattaaccgcacttttctcgaaaaatttattagaaacaaaaggatttcactatgcgattattcccaaaatccgacaaattagaacacgtatgttatgacattcgcgggcctgtgcataaagaagcactacgcttagaagaagaaggcaataaaattttaaaacttaatatcggcaacccagcccctttcggttttgaagcaccagatgaaattttagtggatgtgctacgtaatttgccatcagctcaaggctactgtgattcaaaagggttatattctgctcgtaaagccattgttcaatattaccaatcaaaagggattctcggcgcgaccgtcaatgatgtgtatattggtaacggcgtatctgagcttatcacaatggctatgcaagcactgctcaatgatggcgatgaagtactcgtgccgatgcctgattatccgctttggactgctgcggtaaccctttctggcggtaaagcagtgcattatctctgtgatgaagaagcaaattggtttcccgctattgatgatattaaagcaaaggtgaatgcgaaaactaaagcgattgttatcatcaacccgaacaacccaacgggtgctgtgtatagcaaagaattattacaagaaatagtggaaatcgcgcgtcaaaataatttgattatcttcgcagacgaaatctacgacaaaattttatatgatggcgcggtgcatcatcacattgccgcactagctcctgatttattaaccgttacgctgaatgggttatcaaaagcttatcgagttgcaggcttccgccaaggctggatgattttaaacggtccaaaacataatgcgaaaggttatattgaaggcttggatatgctggcatcaatgcgtttatgtgccaacgtaccaatgcaacatgcaattcaaaccgcacttggtggctatcaaagtattaatgaatttattttaccgggcggtcgattacttgagcaacgaaacaaagcctatgatctcatcactcaaatacccggcattacttgcgtgaaaccaatgggggcgatgtatatgttcccgaaaattgatgtgaaaaaattcaatattcgcagtgatgaaaaaatggtgctggatttactccgccaagaaaaagtgctacttgtgcacggtaaaggatttaattggcattcgccagatcacttccgtgttgttactcttccttatgtaaatcaacttgaggaagccattacaaaattagcaagatttttgtctgattaccgtcaataatgaatgctttgacaacattacaaaggggactgaatgtcccctttttatcgatataaatatattgcactttccttttgcactactataatagtgcaaatttattttagaggcattttatgacacaacaaagatccccttctctcttaggcggtgcgatgatcatcgctggtacagctattggtgcaggcatgctggctaacccaacttcaacggctggtgtatggtttattggttcgattctcgctttaatttatacttggttttgtatgaccacatcaggattaatgatcctagaagctaatctgcattatccaacaggttcaagttttgacaccatcgttaaagatttattaggaaaaagttggaatattatcaacggcctttctgttgctttcgtcttatatgttttgacttatgcctacataacctcaggcggaggcattacacaaaatctgctcagccaagcattcagttctgctgaaagtgcggtagatattggaagaacttcaggatctttaattttctgccttattcttgcagcctttgtatggctttcaaccaaagcagtggatcgtttcacaaccgtgttaattgtcgggatggtggttgcttttttcctttctactactggtttattaagctctgtaaaaacagcagttttattcaataccgttgctgaaagtgagcaagcatatttaccttatttattgaccgcacttccagtttgtctcgtgtcgtttggtttccacggaaatgtccctagtctcgtcaaatattacgatcgtgatggtcgtcgcgtgatgaaatcgatctttattggtacgggcttagcattagtgatttacatcttatggcagctcgctgtacaaggtaatttaccacgcactgaatttgcaccagtcattgaaaaaggcggcgatgtttctgcattattagaggctttacataaatatattgaagtggaatacctttccatcgcattaaatttctttgcttatatggcaatttctacttcattcttaggcgtcactttagggttatttgattatattgcggatctatttaaatttgacgatagcttattaggcagaacaaaaacaacacttgttacttttttaccgccattattgctaagcctgcaatttccttatggatttgtgattgccattggttacgctggattggcggcaacaatttgggctgcaattgtccccgcacttcttgccaaagcaagccgtcaaaaattcccacaagcaagttataaagtatacggcggaaattttatgattggttttgtaatgctatttggcatattaaatattgtggcgcaaattggggcaaacttaggttggtttgcaagttttactgggtaagttttaaaaaataaatttaaattattaaatagcgatctgcactttaactgtgggttatgtagtccaactaattcgtgcagatcagcccctcaattattttactttttattagttacaaacaattttaactgcaagtccgccttgagatgtttcgcgatacttggcgttcatatctttacctgtttcgtacattgtttcaatcactttatctaagcttactcttggattggtggtgcggcgtaaagccatacgcgatgcattgatcgctttaactgaagcaattgcattgcgttcgatacaaggtacttgaacttgaccgccgacagggtcgcaagttaatcctaaattatgctccattgcaatttcagctgcgatgcatacttgtagtggattgccacccaaaatttcagctagtcccgcagcagccattgaacaggctacacccacttcgccttgacaacccacttctgcaccagaaatagaagcgttcatcttataaagtgaaccaatcatccctgcggctaataaatagcgttcaatgatttcaggtgttaatggcgagatgaatttttcatagtaagctaataccgctggaataatcccgcacgcaccgttagttggtgccgtaaccacgcgcccgcccgctgcattttcttcattgacagcaagcgcaaacatattgacccagtcgattacgcgcattggatcgttagataaattcgtatttgcttgcaacgcacgataaagtgaagctgcacgacgtggtactcttaatgggccgggtaaaataccctctgtgtgaataccgtgttcaatacaagcctgcatcgttttccagacattctctagatgagcactaacagcctctttgccattcaatgcgatttcattttccaacatcacagtggaaagcattaagccgttatcactacaatgtttcaaaatatcttcggcatttttgtaaggataaggcacttggactgtgtttttttcttctttgccaaaatgggcttcatcgacaataaaaccacccccaatcgaataataggtttggcgataaagctctgtgcgattttcatcaagagcggtaattgtcatgccattttcgtgcaattttaaaaaagtgcggtggaaaatgagattattttcaaaatcaaattttactatcttttgaccgacattaatgggtaaaagcgcagtttgtttcactttctcgatgaaacctgaaatcatatcgatgtccacattatgtggtaaataacccgctaatcccataatgatggcgatatctgtactgtgacctctccctgtcatcgaaagagagccatacacatccacatgaatttcagctgtttgttcaaactgatttcgtttaattaagtcgtctataaattgtttacccgctttcatcggaccgaccgtgtgggaactggatggtccaattcccactttaaacatatcaaatacgctaatcataaatttctcaaaattcgttaaaaattaaaagcgattataataatccataaacaactgcagaaatagcaattagtcccataattgttacaaatacattactgaaacgtccgctgtagcgtttcattgctgggattttgcgaatcgcatacattggcataatgaataaaatcatcgcaatgattgggccgccaagagattcaattaagcctaagatacttggattaataatcgcaacgccccataaggttaataagaagaaaagtgcggtcgcataattgagttttttacgatttacagattcgcctttcattttcaaatataagccttctaatccttcacgtgcccccatatagtgaccgaagaatgaacttgtaatcgctaagaatgcaacaagcgggccaaaataagagatatatggattatcaaatttatttgctaagaaagacaagatactaatattctgttcttttgctgccactaattcttcaggtgttagtgttaatacacagctaaatacgaagaacattacgaagaataataaaatcgttgaagcgcctttttctgtatggctgatatggcgttctgcaccctcaaacgttttgtattcacggaattgtgagcaagtgaacgatgaagtcgctggcgaatggttaaatgaaaatactaatacgggaatggttagccataaagtggttaagaaaccacctgttgttggaaattcatataatacggcactattccattcaggaattaagtaaatagaaagaacaaataaaattaagactaacggataaacaagccattctgtgatttttaacatcactttttcattaaataacatcacggaaatcaataccgcaattaatacaaaagagagaatgactcgatttggtgatgccataccaagttgatttacaatgaaagaatctacggtgttcgtgataccgttaccgtaaatcaacagaatagggaaaatcgcgaaaaaataaagtaaggtaataagtttacccgctgttttaccaaagtgttcttccactacttcagtaatatcgctgccaggattttttgatgaaagtacaaagtaggctaagccacggtgagcaaaataagtcattggcccgacgataattgccattaaaactaacggccaaaatccacccatccctgcgttaatcggcaagaacaatacgcccgcgccaaccgccgtaccgaaaaggtttaacatccacgttgcatcaaatttgttccatttgagtttttctgttgatttcatagtttgctccaaagcataaattacttaaatttgtcaatttgtagagcaaaatccgctccaactaaatttgagtattatgttatgccaataaatagagaatctcaaagagcaaattctaaaattgtgatcaagttaaaatttttttataaaaagtgcggtaattttcagcgacaaaaaaatcggtgcgatgacgacaccgattgcgtataaaaataaatgaaattagaaccgcacttttttcaatcttaaggcgttcatcaatacggaaattgagctcaacgccatagcagcaccagcgattatagggctaagaaaaccgaaagcggcaaggggtatgccgagaatattgtaaatcaaagcaaaaaatagattttgtttgatatttttcaaggttgctcttgcaataaaaagcgcatccacaagttgattcaccgaatgttgcataagcgttgcagaggctgtttgttctgcaatatctgaacctgatttcatcgcaaaactgacgtttgcagaagctaaagcaggcgcatcatttattccatcgcctaccattgcgacaatatgaccttgagctttcagcttttggatttgttccgccttatctctaggactgagtccaccaaaggctttcttaatgccgagctgttttgctatgtaatcaacgacagattgttgatcgccactcataattacgacatcaatattttgctgttgtaagcgttgaatggcgtgcaagctatcgttttttaaagtatccgtcagtgcaaatgcaccgatgggttcatcatttatggatactgcgacaatgctcgcaatttgccaaatatcctctaaatttttaggcaagattaaaccgcaataatcaggtttaccgacttttattgttcccacttgttctaattcggcttgaatgccttgacccacttccatctttgaaaaaagtgcggtgggaatttctaacattttttgttctgctgcttgcacaatagcttttgcaattgggtggttagcttgtcgttcaactgctgctgcaaaacgatacaaatcgtcttcagaatacaccgcactttgtggctgccataaagcagagatttcaagctctccttttgttaatgtgccagttttatcaagtacaacggtatccacgtgggcggtttcctccattgcagccgcatctttaaaccatacgccagcattgactgctttacctaaaccaaccattatggctgctggtgtggctaatcccaaggcacaagggcaagcaatcacaagcacggataccgcgtgaattagtgaagacacactatcattcgtcagaatataagtgagtgcgaaagtaacaagtgaaatcactaaaacgacaggaacaaacacggaagcaactttgtcagcaaatcgagcaatgggtgcttttgaaccttgtgcatctgataatgcattcatcatatcgccaagtaaggtttggctaccaagctgatttgcttgatagataatagaaccttctgttaccatcgcccccgctaatacttttccacctttctgtttttcttctggacgagactcgcccgttaaatggctttcatcacaccatccatttccactttcaattatgccgtctgccgcaatacgttcgccttgattcgcacgaatgatttcgccgatattgacttggtcaagagcaatttcagtccatttttcattacgtaaaacagtgacttttttcggtgtcagttgcaagagcatactcaagctatttaagctatgctttttagtgcgatcttcaagaaattttccaagactgacaaaaccaattaccattacagaagcttcaaaatacacatgccccattgcatgatcggcgtggtaaaacaacatgaaagcagaataaagataaatagtgagcgttcctgtgctgacaaggacatccatattggcaagtccaccacgaatactaccgattgctccgcaataaaatggaatggctaaccaaagttgcacaatgcttgctaatgcaaattgccaaatcggcggtaacattaagtgatgggagccacctatcataccaagcattccaatcagaaatggaatattgattatccaaagtatgattaatcgccaagggattgatgtattttcttctattggtaattcattggcttgtttgatatgagcagaaaaacctgttttatggataatctcgataatttgagtttcgcttgcttgcgtagcgtcaaatacaacttgtgcttcttcgacggcaaaattcactcccgcttgttgcacaaatggttttttatttaaaactttttcaatgcgattggcacaagattggcaggtcatcccaccaatctgaattgaaatttttttactctgtggcgtcaaatccagcatcttcaatgacctcaatcaactgtgcaacattgactcgattttcatcaaaagtaatatttgctttaccctctaattgcacatcagcagattgtacgccatctaattcagttaaaacttgagtaagactttttacgcaacagccgcaatgtatgccttttatgtttaatgtgatagttttcatttttactccttgttagttgttttattgatgaatgcgattggcacaagattggcaggtcatcccaccaatctgaattgaaattttttactctgtggcgtcaaatccagcatcttcaatgacctcaatcagctgtgcaacattgactcgattttcatcaaaagtaatatttgctttaccctctaattgcacatcagcagattgtacaccatctaattcagttaaaacttgagtaagactttttacgcaacagccgcaatgtatgccttttatgtttaatgtgatagttttcatttttactccttgttagttgttttattgatgaatgtgattggcacaagattggcaggccatcccaccaatctgaattgaaattttttactctgtggcgtcaaatccagcatcttcaatgacctcaatcagctgtgcaacattgactcgattttcatcaaaagtaatatttgctttaccctctaattgcacatcagcagattgtacaccatctaattcagttaaaacttgagtaagactttttacgcaacagccgcaatgtatgccttttatgtttaatgtgatagttttcatttttactccttgttagttgttttattgattgttaaactataaacctttacataaggttaaggtcaagaagttttttatgaatattagtgaagccgcaaaattagtaggtttatctacaaaacaaatccgtgattatgaaaaaatggggttaattaaacccgctgttcgcagtttgtcaggctatcgaaattatggagaaagtgatttagaaaggttgcattttattcgacactcacgcaatgttggattttcgttacatcaaatcgcacaattattagcactacaagataatcctaagcgtagctgccgagaagtgaaagtgctaactgctcaacatattgcgacattaaatcaacaaatagaacagttacaaaaaatggtacaaaaattgcagcactggcacgacagttgtcaaggcaatggcaaccctgaatgttcaattttgaatggcttgaacggataagtgaaaagtgcggttaatattcccaactttctggatcgacgcctaattcacgcataagcactttggcatcttcgggaatttcatcattacgctctttcattaaatctgcatcagtgggcaaaggctgccctgtgaatgcgtgtaagaacgcttcacaaagcaattcactgttagttgcgtgacgtaaacttttcaattggcggcgagtgcgttcattcgtcaaaatttccagtactttaatgggaatggatactgtaatttttttgacttgctcactttttttgccatgttctgcataagggctgatatattttccgtcccaatccgccataatttcccttagagcttatcgataaccttacaaattgtccgtattctaattaaaaatcaaataaataacaatctagacggctaaacttccaaaataagttctaaaaaagtgcgatgatttttatattaaatgctaataaaagctagacagcgtagggttttagtggtaatttatgcgccattcaaagggtgcaagcccaccattcgaataatcaattcttattaattccaacatttattcattatgcatttaacagaacttaaaaatacgcctgtttctgatcttgtgaaactcggcgaggagcagatgggcttagaaaatttagcgcgtttgcgtaaacaagatattgtctttgcaatcttaaaacagcacgccaaaagtggcgaagatattttcggcggtggcgtgctagaaattttaccagatggttttggtttccttcgttctgccgacagttcctaccttgcaggccctgatgatatttatgtttccccaagtcaaatccgtcgttttaatcttcaaactggggataaaatcgaaggcaaaattcgtccaccaaaagaaggcgaacgttattttgcacttttaaaagttgatcaagttaatgacgacaaaccagaagtttctcgtagcaaaatcttatttgaaaacttaacaccattacatgctaactctcgtttaagaatggagcgaggcaatggatcaacagaagatttaaccgcccgtattttagatttagcctcgccaattggtaaaggccaacgtgggttaatcgtagcaccaccaaaagcgggtaaaacaatgttgttgcaaaatattgcgcaaagtatcacgcataattaccccgatgtggaacttatcgtattattgattgatgaacgcccagaagaagtgacagaaatgcaacgttccgtaaaaggcgaagtcattgcgtctacttttgatgaacccgcaactcgtcacgttcaagtggcagaaatggtaatcgaaaaagcgaaacgttctgtagaacataaaaaagatgtggtcattttgcttgattctattactcgtttagcgcgcgcttacaatacagtcactccagcttcaggtaaaattttgtctggtggtgtggatgctaatgcgttgcatcgtccaaaacgtttctttggagctgcacgtaatgtggaagaaggcggcagtttaacgattattgcaacagcactagttgatactggttcgaaaatggatgaagtaatttttgaggaatttaaaggtacgggtaatatggaattgcacctttctcgtaaaattgcagaaagacgcgtattcccagccattgactttaaacgctctggtactcgtaaagaagacttactcacaacagcggacgaattacaaaaaatgtggattcttcgtaagattcttaatccaatggatgaagtggatgcaatggaattcttgattgataagctgatgatggcgaaaaccaacgaagagttttttgaagtgatgaaacgttcgtaaaaacaaccgcacttctatgaagaacaagggaaaaatattatgttttcccctttttaatatccgtaatatttgacgagataaataatgatagccgataagttcataaaaggggcaaaaggtataaattcttttttctttttatgaataagcgaaaaacatattccaagcactgaggctaataataaaaagtgcggtaaggtttctaaatgaataaaacttcctaatgccattgctagccaataatctccccgtccaaaggcttcttttctataataacattttgcaatccaatagattgcgtagaaaacaataaaaaaactagccgcactttttatgctttcagataacgttagcaatgaaaagttattgtctgcgccaaataaaccgagagtaagtaaccataaacagggtgtcgtagaaataagttgatagtgccaatcaagataactgattgtccaaagaataataagtgtgagtccgatccatacagtaaaaatagaatctttgaaggcaatttgtaaaaatataaatccaaccccaatactaaaaaaatacctcaaaatatgaccgcactttttttgttgaatagaggcaaagtgcggttgaaatggagaactgttttgtggaaataattcaacgtaagtcgcataaatctcttgctgcaaatgcgtaataaaaccagataggtagaaccacaatgcgatccctaagatgccgcctaataaaaacattgtgaagtaaatcattgaataactgatcccatattaaagataggtaaatacattcccatcataataatcccaatcagactgccgatgattaccatcattaatggttctagcatttgtgagagtaagtcaatttgatgattaagtttttcttggtaattatctgcgatatgctctagcatcaaagcgagttttccgctttgttcgccaatttgtagcatttgttgtgcttccatcgggaaaagatcgctacttacgctattagaaaacgcatagccttgagaaacccattgcaaaattgaccgcacttctttatctaataccatatcgtttacaagcgttttcttggtttgccaagtttgtgtgcgaggaagaaaactgtctagtgcctgattaagcggtacgccggcctgcaacataatttgtaaactttgactaaagttcactaaacgtgaaagcttttgaattgtgccaaaaataggcgtgatagaaataagttgatttttcttttgatgaaaccaagtctggcgttttagatagaaataataaaatagaaaaaaactcaaaacgaaaaatagcaaaatgccaatattttgcttaaggaaattagatattgagagcaatattgcggttattgttggtaactccgcattattgccactgtacatttcagcaaattgaggcgcgataaaaagcagtaatgcgagtgtcaataatagagaaattcccaataccattgagggatataacataattttctgtaatttgcgttgtaaagccaaagattgactacggtgcgtggctatttttttacaaactacggcaagttttcctgtcatttctcccacttgaatcagttgaatttcttgttgtgtgagatattttccttgttgttcaatggcttgtgagaatgctaagccagattcaatggattgaagcagtcgttcaagccatttgttgagcataatttgagtacaattttgttgcaaaatttgtaggctgttttttaacggaattacggactgtagcaatgtcgctaattgattgagtaattcactgatttctgaatttttgggttttgccccaaattgccagttttgttgtaatttgatgtgagtaagcccgcggcttattaactgaaagtgcgcttgttgtttcgtatccgcaataattgagcctttttgtttctgatttaatgcgttactaccttgataataaaagagttttttagtcatgagtttttacctaacacacgttcaatttctttctcatctgttatgccttggctaactttttccaaaccactctctcgtaaattctcaaaatccgtttgatagccattctgttgccaatgtagaaattgatacacgccgattcgccctcgataaccttgatggcaatcacaagaatttattaaatttccaccgcactttggacagatttttcgtacaagacgctgtgcaatgacgagtagtaaactgttttcaatttcatgttgttgaataccgagttgttgtaagcgagaaatggcagatattgcatcattggtatgtaaagttgaaagcaccaaatgtcccgtttgagcggcacgtagtgcaatccttgcactttcttcatctcgaatttcacctagcataatgatgtcgggatcttgacgtaaaaaagcacgcaatagacggctaaaatctaatccaatctgcggattaatttggctttgaataataccatcaagttcaatttcaatgggatcttcagcggtcataatatgtttatcaggcgtatttagccactgaagtgcggtgtaaagcgagatacttttcccacttcctgtggggccggttactaaaattaatccttgtggctggctaagtgagcgttgaaatgcttgttgctgattttcggtcatacccagttcagcaaagctaagttctacaggtttattttgttgcgctcgcaacacgattttttcgccccaatgggttggtaaggttgaaaggcgaaaatcaagaatatcggaaaaagtggttttaaattgaaatcgtccatcttgtggaagtcgattttcactaatatctaatttagccagtaattttaagcgtgaaataatacgattggcgaatattttgcttattaagggttgtggttgtaaaacaccatcaattctaaaccgcacttgaaactgatcagccaaggtttctaaatgaatatcagaggcatttttttgtaaggcagattcaaaaatctgattaagtaagcggataacaggttcatcatcttcttgttcaaaatgggtttcttgatgttgatagaatttaacttgctcttccacttgcatttggtgcggagtaagttgttgtaacagttctttgagttggctgctttctaacaaaattggttcgacaggttttcctgttataaacgcaatggtttcacaagctgaaagattggagagagaatcaacccctagccaaagacgattattttcttctttaagtggcaaagcaaaataccgcaagagcaaggattgttgctgctgattgcgttcccataaatctggcgagatcgtaaagatctcgccattttgagcggttacacgctgagtatgaagtaaagcatagctcgtcattgtgtgacacttccgcaaaaatttgctggaaataaagaggcatccgttcctttgcaagttgttgtccaagttacacctgttgcagcattacctgtagcttgcaaaatatattccatatttgccaatgtgccatccccttttactgttattgcaccgttgcttgttgtcactgattttacatagccttttgctgtggttatatctgctgcaataccattttttccacccgtacagtttgttgtttcatttgtgctatatacacataattccacatcagccttataaggcgctgacgcttgcagtaattcagataccgctgcttttttagtataattttgataagagggaattgcgatagtggctaaaatagcaataattgcaatcacaatcattagctctattaatgtaaacccttttttcaaggtttgctgtgttgttagtttcattcattttccttttattaagcctttgttagcgacgacattgtgaaaaggaaaaatttgtttgtaaaattgaccgcactttttctgcgatcctgatcgcaaaaaaaggaaaaaagtatgcaaaaactaaaagatattgaacaaggtatattggattgtcggcaaattcagtcacctcacttcgataaacgcccaaatccacaggatatttccttattggttattcattatattagtctgccgccagaacaatttggcggcggatatgtggatgatttttttcaaggaaaattagatcctaagattcatccttattttgcagaaatttatcaaatgcgtgtttcagcacattgtttgatcgaacgaaatgggcgaattacgcaatatgtcaattttaatgatcgcgcttggcacgcaggcgtatctaattttcaaggacgagaaaaatgtaatgattttgccattggaattgagctggaggggagtaatgaacagccttttaccgacgctcaatatttttcattgcaagagcttactaacgtaataatgaaaagttacccgaagattacaaaagatcgaattgttggacattgcgatatttcgccaggacgtaagatcgatcctggtcaatattttgattgggaacgttatttatccagtgtaaaacaaactgtataaaaattaaacatcaaattttgatgtattctgtgtattataaatgcgttcactcttttaattctaactagttgaattaaaaggaataaatttaaatctgaaattttattaaaaaagttaatttgagttatacaacattatagattttctcaaccacaattttatccacagaaatattgaataactcaaagagatgataaaaagatcttttgtgaataaaactgttttaaaaattgtatttttttaccgcactttcttccattttgaatgtgaaaagtgcggtttatttttgtttaagatcttttggttgtaaataactcaatttattttgaagtttgatgtgataaggatctttgcctgtttttacgagatcaattcacaatcagaaatccgttattcacaatgttatccacaacataggtacttttcgtcatataaacaaaataagaatattttgttgtctagaagtttcccctctccgtaaaattgtgtatttttaaccgcactttaggttcaaacccaatgtgcagttatttttattgattttcctcttttcgctttttgctcttttttttaaaatatgatactttttcgccgtcaataagacatcaaacacaaatcaatatgaacgacgaacagcaaaattcaaaccaacctgaaaatacgaaaaaaccttttttccaatctttattcggtcgcttttttcaaggcgaattaaaaaatcgtgaagaacttgtggaagtgattcgcgattcagaacaaaacgatctaattgatcaaaatacgcgtgaaatgattgaaggcgtgatggaaattgcggaacttcgtgttcgtgatattatgattcctcgttcacaaattatttttattgaagatcaacaagatttaaatacttgtttaaacacaattattgaatccgcacattctcgttttcctgtgattgccgatgccgatgaccgcgataatatcgtgggcattttgcacgcaaaagatttattaaaatttttacgtgaagatgccgaagcatttgatttatcttcattattgcgccccgtcgtgattgtgccagaaagcaaaagagtggatcgtatgttaaaagattttcgctctgagcgtttccatatggccattgtggtggatgaatttggtgcagtgtcggggcttgttactattgaagatattttggaacaaattgttggcgatattgaagatgaatttgatgaagaagagattgcggatattcgtcagctttctcgtcatacttatgcagtgcgtgcgctcaccgatattgatgatttcaatgggcaatttaatacggattttgatgatgaagaagtagataccattggcggtctgattatgcagacttttggttatttaccaaaacgtggggaagaaattattttgaaaaatcttcaatttaaagtgacttctgcagatagtcgtcgattaattcaacttcgcgtgacagtgccagatgaacatttggcagaaatgaataatgtagatgaaaaatctgaataggattttattatcaattaaatttatgaataaatatttaacttattttattgcttttatatcgggtttagtcggtgtttttgccttttcgccatttgattattggcctttagcctatgtgtctttactcggtttactttatgtcgctaaaaatcctaaaaaatccaccgcacttttatccactttcttgtgggcgatgggatttttctgctttggagtaagttggcttaatgttagtatccatcaatttggtggcgcgtcgttaggagtgagttatttccttgtcggtttgcttgcggcttatcttgcgctatatccaatgctctttacctatttagttcagcgtttcaaagtgcaaagtgcggtaatttttgccgtgatttggacattgacagaatttttacggggttggatttttactggttttccttggcttcagtttggttatacacaaattgacagcccattttatggtctcgccccgatttttggggtaacaggattgacattctttaccctttgggcaagtgcggtcatttttaatctcgtttcatctttgtttaaaacgaaaaattttaaattagttttagcgaatgctttgttattgattattgtagggggattaagtgcttattcatcgcgaattcactttgtaaaatctgttgaaaataaggcaatttcagtcacgcttgcgcaaggcaatattgaacaaaatcttaaatgggatcctaattatttctattctactttggcaatttatcaaaaattaatcgcagaaaatcttggtaaaaccgatttaattattttgcctgaatcagccttaccaacccttgaaaatgcaattacaccattttttgaaaaattagagcatgctgctaaagaaactaaaacggagattatgattggaacggtattccaagatacaaaatctggtaagttattaaattcaattatgactactggaaacccagattttccttatcaaccagatacgccaaatcgttataataaacatcatctcgtgcctttcggggaatatgttccgctagaaagtattttgcgaccgcttaattcagtgtttaatttaccaatgtcagcatttcaaagtggagaggctgttcaaccctctttaatcgcaaaaaaacgtgctttttcgccagcaatttgttatgaaattattttcggcgagcaagtgcgacaaaatttgaaacaagatacggattatttgctcaccttatctaatgatgcgtggtttggcgattctattgggccttggcaacatttacagatggcaagaatgcgcgctttagaattaggcaaaccgcttattcgtgcaacaaatacggggatttcagtttttgttgatgcgcaaggtaaggtattagcacaagccccgcaatttattgaaacaactttgacttataaaattgcacctgcggaaggcaaaaccccttattctgtgttaggaaatatgcctttgtatgctttatctttattgtttttactcttgcacagtatgatggcgtttattcgtcgtaagatgaatatcttataaaaacaccagttaaaatgaccgcactttttcattcatataaataaacattatgcgcataccaagaatttatcatccaatatcccttgaaaatcaaactcaatgttatctttcagaagacgctgcaaatcacgttgctcgagtgttaagaatgacagaaggcgaacagcttgaactctttgatggttctaatcatatttatccagcaaaaattattgagtcaaataaaaagtccgtaaaagtagagattttggggcgtgagcttgcggataaagaatcccatttaaaaatccatttaggacaagtgatttctcgcggagaacgaatggaatttactattcaaaaatccgtagaattaggggtaaatgtgattacgccattatggtcagaacgctgtggcgtaaaacttgacactgagcggatggataaaaaaatccaacaatggcaaaaaattgcgattgcagcttgtgagcaatgcggtcgtaatagcgtgccagagattcgtccactgatgaaattacaagattggtgtgcagaaaatgatggtgcattgaaattgaatttacatccacgcgcgcactattctattaaaaccttaccgactattcctgctgggggtgttcgcttattaattggctcggaaggtggattatcagcacaagaaattgcccaaactgaacagcaaggatttactgaaattttattaggaaaacgtgttttacgcactgaaactgcatcacttgcagcgataagtgcattgcaaatttgttttggggacttaggcgaatgatggaattacaaggaaaatttttgatcgcaatgccacatttagacgattattttaatcgcacggtggtgtttatgtgtgagcataatgaacagggttcaatgggtttggtaattaatcagccgacagatttaagcattgcggaactttattcaaaactcaattttatgatgaaaaatgaccgcacttttggtaatgaaatggtggttgcgggtgggcctgtgcatacagaaagagggtttattttacataagaatacgcttaatgcttttcaacatacttacaaagtcacaaaggaactttcaatgacaacctccgctgatgtggtggaaacgctaggttcaacttttgcacctgaaaaatatcttgttgcgctaggatgttcaagctggggggctggtcagttagaaaaagaaatcagagataatgcgtggttggtggtgtcatctaacgatcaaattttatttgatatgccctatgaagatcgttatgctgcagccaatcagttacttggtattcatccttataattttgcgttagcgcaagtggggcatagttaatgggaattaccgctctggcttttgattttggcactaaaagtatcggttgtgccataggacaaagtattactggcacagcacaagccttgcccgcttttaaggcgcaagatggcatcccaaattgggaagcgatcgaaaaatgtttgaaagaatggaaaccagatgttgtcattgttggtcttcctttaaatatggacggaacagaacaagatctcactctacgtgctcgtaaatttgcaaatcgtttacaaggtcgttttggcgttaatgttcatttacaagatgaacgattaaccaccacgcaagctcgtagtgagatttttgaacgtggtggttttaaagcattaaaaaaaggcaaaatcgatggagtgtcagcttgtttaattttagagagctggtttgaatacgctgaatattagattcacattgtaaaaataaacttcattttagaatgattaaagcgcgattttataatcttgctttttcgccaccaaattcatctaataaattttcggtgagtttggctaaaataccagtcatcagtacaaaatctgcatcgaaacgctgtgcaaaatcttctttcagaatatcatcatttttttcccgtacagtatctgcaaattttaaacgtttgattgtgcaatcttcgttaaaaacgaaagttaaggtatcttcccattctaaggctaatttacttactacttttttgccatcttgcagaagagcgagaatttcttcattttctaaaggttgttttttgcaacggataacgctgtcttcctgactgccacgaagctcggcttcttctaatgcaagtaaccaatgcggcaaattatcttgaaggatccaattggttaaaatcgtgctaggttcattagcaaaggctaaaggcacgacagggagcgaacctaaggatttacgcagtaatgcgagcgcatcttccgcgcgtttacttgatgcggcatcaatatgaataagattattttccatatcaatccatagtgccgtatgctgatttttactaaatgcacgaggtaataaattcatcacgacatcatcttttaatgtttgtttttctacctttttaagtttgcgattttctttttttcaaggctttcaatgcgttcatcaagttcacgtttgaccacatttgccggcaagattttttcttcttttttggcgattaatagaatttgttttccaacagaaaaatagagtaaatcagaacctcgtaatggggctgaccagccaaatttactttgatcttgagcaccgcagggatggaattgacaatcttctagttgagtttgtagttgtgtaagatcccaatctagcggtttagtcagtctataagtcattaaatttttgaaccaaaaattaactttataactcataacatttcaccatgtacaattttatcattaaatcaataatttacttatttcaaaacaccatttataattcatagtatatcatcatatttcaattttttagtaaccataatggtaacttatcacaatcaagctagatttcttggttactaaaaaatatattaatacctatttttatatacataaacagatgtcttatggctaaaaaagtaaaaccacttgttgacactgaaatcaagaaagcaaaagcatcaaacaaaccatatacattgactgatggttatggactatttctaatcatttcaccaacaggttcaaaatcttggcggtttaattactatcgacctataacaaagaaacgagcaaaaatttctttaggcctatatccagcaattacactatcaaaagcaagggagttgagagaacaatatcgtcaattactagctaataagattgatccgcaagaatacataaaacagcatgaattactgcaattacaacgacaaaacaatacattttttgccatatcaactcaatggaaacaaaaaaaagtttctgaaatcaagtctgtaacacttaaaagccgatggagaacgctagaaaaatatgcatttccatatttaggcgataaccctattgctgaaattacaccacaacagttacatgatacagttataccattatttgaacgaggagtttctcacactgggaagcttgttattgcattagttaatgaaatcatgaattttgctgttaacaaaggtattattgagtttaataaatgcatcaatgtatcaaaggcttttaatgtaaacagaacaacacatcatccaactattagacctgaaaaactacctgaattcatgtctgcgttacgtcattcacatattgaccttatggtgaaatatcttattgaattctcccttttgactatcacccgtccaagtgaagctgcaaatgcacaatggaatgaaattgattttgagaaatcgctatggaatatccctgctgaacgcatgaaaatgaaaaaagctttcaccattccattatcactacaagtgcttaaaatacttaataagctaaaaaacatttcaggccgtagtcgttttatttttcaaagccaacgttatcctgaaagaccattacattcaagctctgccaatgcagcaattaaacgcgttggttataaagatcaattaacatcacatgggctacgttctatcgcaagcacctatcttagcgagacatttaccgaaatgaatctggaaattcttgaagcttgcctttctcatcaaagcaaaaatcaagttcgtaacgcctacaatcgctcaacctatcttgaacaacgaaaaccattaatgaatgcttggggagattttgttgaagaatgtatgaaaaaaagtatctaaaaataaagggaatcaatactgattccctttatttacctaacctttcttcagtaactctaccatttctctcagtagctttatttcattatctttttgctctactagcttattcaacaaaccttctttttcttccaataattgctgacaatgtgataacgataattttagtttttcaatctcaatcaatagagatttctcattgtctccctgaaatgacgaactaaaatgagaattctcattgaattgaacgaagacatttcgttcaccagaattaatcaattcaacaatatctatatctaaaatctgtgcaatttgctctagcttatccagatgtaatttcgtttcaccacgttcaatttttgcatagccattcaatgacatactcattctttcagccatctcttcttgtgaccaatgctttgtttcacgtagttttctgatcttttcatgtacgttcattcttatacccataaataggttaattttttacaacaaactgtgtgctaactatacatcgattgttggtagaacgcaaaatctctcttagataaaatttacaaatacaactatactggggatatttatgcttaaatctatacttaaaccaataggacatatactaaaacttctaataaaaactgctttattcttactttcattattattcatactaatgctaattatcggattcgttgataacaaaaaaattccaaccgaatttattgtttttgggattctaggtatttgttacatttgctacacatttaattcttgggcaaataagcctgaagtctgtccagtctgtaaatcaggcaaaattgaattggattcaattaaagaaattgaccgctggctgggaaaaactaaagtgcgtgaaagaatggcatctggaaaaacacgagaacgatatattcaatgcacgaaagtaaaaaaacgatatacatattgttgccaaaatcctaattgcaagcatacatatactaaaatacgggaagaagaattataggtgtaactatgttttcaaccgctataattgaaaaaattaattattacatctattgtcttgttgaccctagaaatcaaaatatcttctatattggtaaaggtattggcaatagagtttttcaacatgcacaaggtgcattaacttgcaaaactaatgaaaatgataaaatatcactaatcaatgatatacataaagatggacttgaacccttatactatattttaagacataatatcaaggaggaaaaacaagcacttgaatatgaggctttagcgatcgatttattatccattgttaaacctaatcaacaaccattaaccaatattcaaggtggcacacattcttctgaaaaaggtttaatgtcattatcagaactaaaacatatatatgacccacaagaattaaaaacagatttacctgttgttttaatcacaattaataaaaactataaaaaattaaaacaacaaataaaatcaggcgaaattgataaatcgcaaattgaaaaagaaatttacgaacgcactcgcggctattggaaaacgggttcacgccgtgaaaaagccaaatatgctattgcagtttatcgtggctggacattagcagcctacgaaatttcatactggattgaagcacctattgagcgtcaaggtcgttggggttttatcggtaaacttgtgccgaaagattctccaatttatcaagaacttgttaataaattaacctattcatcaaataatgattacaaggcgccacaaaatccaataacttatcgtaattgttaatatttactttaatggaatcttaaaatgaataaatttttaattacatctatatttctaataacaaatattacatatgcaggaatccgtactattgaacttccgccagaacaatccggttcaatagctatgaaatgtggagactatatttattttggtgaaaaacgttcatcttacgatgtctgcatgataacaggcttgttaaaaacatatgaaaaaggtcaatgtattactcatgatgaatacaaacttttaaacaaagcatgtagcactaaacccgacaatgttccacaagcctacaaaatgagagattcatcttactatgttgaatactcaccagaaactgatggttttgtaccaatgagtagtgaaaactaaaatcgtcataaagagctcaaaaatgagctcttttttcattttatgtattacatataggttttatcattctaatcaactaaatgcatctagacatcatttagaattattctggcttacattaaatacctatatacatttatcaagtacagtgaacttaaaatgatgaaaaaatttccaaattttaaaccgcattctgacacggaaactgaagaattaattagcttactatttagaaaactcgatattgatgaactaatctttctgctacgtgttttacaacgtgatatccgtgcaaaatatacactcacaaaaataattaaaaaaaatatcaatttaaagttagattcataaattcctgtgttaagctcctaaaaagtatgtacgaaataggagataattatgaaaatacaagataacgtcggctattacttcacaattcaagatcttcaagatcgtttacgtgtaagtcgttcaactattctgcgattaattgaatcgaaaaaattaacatctatcaaatttggacgacaagttcgtattcctgaatcttagattctaagttaccttgaaacttgtaaagtataaaaaaataagccaccaaaaacatggtggcttttatttactatcttttatatcgtttaaaacacatcttcgcactgccttctgatattgataaacaggttgctatttctcgccattttagaccttgtgttcttaactatactattttctcatatttactttttaagtcattttgtgatttcacccatccgaattcttctgaccaacgattcaatgagcttacactaatactaaattgttctgctatttgctttaacgacatattaggtttattagctccaaattgattaaacaactctttcttgataatttgttgcttttcccatcgttttcgagaacgatttgactgaatttgttgaaacgatgattcagaaaatctttcccaaatccaacgagatgaacttctagcaattccttttaactccctgtatggtaatggtggattatgattctgatttaataactctaatgaagataataaatactgattaaattgttctaattgtttacctgaacatttaaacttcagaacctcacgataaccaatttttttgatctgattaaataaagaacaattccgaccttcaatatcttcattatcatttagataaaatacaggtttatttgataaatcaacaaaatcagctaaataatccagagtatatttaggtacattaaatacaaatgttctccaaaaatttgagtttggatttttagtgaatacaccaacatagtgttgatctgctcctaacttatcaatataagctcgttgtatctttttaaaataacttattggcttaaatcgagcattctttgtgttacaaataggtacctccaacgcatagatataatgacatcgaccgtttaatctattttgtaccactatattgggacttggaagtcctaacaattcccaatccattgcagaattttcccgatctagatctaacaccataaatttaataaacagatcattaaactgaatatacttatgagttaatgcaacatctttagggtataactgcaccccattatcaaaattatctgtctactttatccgttctgctaagctttgattaaaatcatctaatgtatatgctgattccatatttacctctttatatatgattgaatttatgtggtagacatatctatctaatatgccttaactgagattaatacaaaaaaagtattttttaacttaatatgattattttttagacacttaaaacatgaaaaagaatcgaatgcctaaatcttaagcaaaaaatatagatttgtaacaaaatatcatcccatatcagatattaataatttaaaagtaatataaaataatatctaattaaattagatctcaataacttgatgataaaaatattgtttaaggcatattacaaattgaatagataaaatttagagattttttggatacatcggatactttttgatgtattgtatatactagagataatgttacatataatcagtgaacaagtaataaacagctacaatgtacacacctaaaaatagtaaccaatttggtaaccaattatcaaaacatgaaagaagattgattatatttacaatggttagagatgatctatttaatttttgaaccacatcgtaacacttccttcaatatagggtagaatgtgcggtattatagcccataaaagtaggaaaaacgatgcaacacaaattgattgcctttattggtggcggcaatatggcacaagctattattcttggattattgaaacaaggttatcctgccgagcaaattattgtgaatgatccaaatgaagaaaaaagagcattttttgccaatcttggcgtggcaacttcagaaaataatgtggaaagtgcaatcaaagctgaggttgtgttgcttgcggtaaaacctcaaatgatggctgatgtttgtttgccactaagtgcggtggatttttccgataaattgttaatttccattgctgcaggtatttcaactgaacgcttgaacgcattaattccaagcgtaaaatcgatagtacgcgtcatgccaaatacacccgcattagtgggggaaggcatggcggggttatttgcaccgaaaaatacgagtgaaaattaccgcacttttgcacaagatttattgggagcagtgggaagaacggtttgggtggatgatgaaactcaaatgcacgcagtcaccgctgcttcaggaagtagcccagcctatttctttttaatgctggaagcgatgcagcaagccttaatcaaaatgaatatagatgaaaaaacagcacgtgaattagtccagcaatctatgcttggtgcagcaaaaatggtgaccgaaaatccgcaaattgcactttcaactttgcgtgaaaatgttacctcgaaaggtggcactactgcggcagcgttagcagtatttgacgcacaacattttaatcaaacaatagagcaagctatgcaggcttgtttgtctcgttcacaagaaatggaaactttattctgatgcaagttcgtcctttttattggctcgcactgagctttctaggttactactgcgcttatggcgtatttttgcctttctttcccgcatggttaaaatcacaacaatatggggaggaaatgattggtttggttatcggcagtgcttatattttccgatttgcgggcggattatttttttcatcgctgattaaaaaagccaatcatattattatttccttacgcctattggcgttagcatcggcaattattatggcggctatgagtttagttgcgcataatttttggttgttgtttattgctatcggtttgtatgcttctgtgaattcagcaggaatgccgattggggattcgttggcatccacttggcaacgccaaatcggcttggattacggcaaagtccgtttgattggttctgctgcttttattcttggtgtagtagtatttggtggcatgattggctgggttggcgagcaaaatatcgtgtggattttaaccgcacttttatctttctataccatcattcagcttttaaaaccgaccattcccccaaaagatgaaatacctgaaggtggcgttcaaaatgatgttggttttattgctttactgaaaaatccgatgacattacgagtcatggttgcagtagggctgattcaaggctctcatgcggcttattatgtttacagcacgatttattggacaagtattgggatctccgtttctcaaactagcttactttggggcattggcgtattagcggaaattgtattatttttcttctctcgtcgtttatttcaaaatatttctatcagcgtactgctttatatttctgcgcttgcgtgcatcggacgctgggctgtaataggatatattgacgatttctggttgatattcttattgcaacttatacacagtttaacctatgccgtttgccattatgcgattgttcgctatatcaccacgcaaccgcaaagccatattgcgaagttacaaggtttgtataatggtttatccaatggtgtgctcattgctattttcactgcgattgctggcatgatttatccaacgtcgccagcgatgacatttgtatttatgagtatcattgcagctgcagcattttttgtgattccacgcaagttaaatgcctttttgattgttcagcataaataggacgtatcgctttccttttaaaaaagtaatatgaaaaatcttgcgctcattgatttgtttcttaacgaatattggattgaaaaagggctttcagaaaatactgttcaatcttatcgtttggatttaaccgcactttgtgattggttggataaaaacgacttgtctttggaaactttagatgctgttgatttgcaaggttttctaggagagcgtttggagaaaggttacaaagccacgagcaccgcacgaatgttaagtgcaatgcgtaaacttttccaatatttatatcgggaaaaatatcgagtggatgatccaagtgcggtgctaagttcgcctaaattacccagtcgcttgccaaaatatttaaccgagcaacaagtgtcagatttgctcaatacgccagatgttaaagtccctttggaattgcgtgataaagcaatgttagagttgctttatgcgacggggcttcgtgtaacagagttagtttcgcttacgattgaaaacatgagcgtgcaacaaggcgtggtgcgagtgattggtaaagggaacaaggaacgtattgtgccaatgggggaagaagctgcttattgggttcgtcaatttatgctttatggtcgtcctgtgctattaaatgggcagagttctgatgttgtgtttccaagtcagcgcgcacagcaaatgactcgtcaaactttctggcatcgtgtaaaacattatgccattctcgcggatattgatgctgatgcactttcccctcacgttcttcgccatgcttttgccacccatttagtaaatcacggtgcggatttacgcgtggtgcaaatgttgttgggtcatacagatttatctacaacacagatttatactcacgtggcaaaagaaagattgaaacgattgcatgaaagatttcatcctagaggataatttcggggtaaatttttatagttttaaagattgattgtggatttcttattgattaattaatttgacacgcatcacaaattttgaataaaaaattagacagctcaagcatattttgctatcttgcgaagaatttcgacatttgttctatcgaaaagtaattttggattctaaaatgaaaaaaatcacgcttttttttaccgcacttttatgcttattttcaacttctgttttagccgaacctaattcaatacctaaacaatgtgaacaactatttaaagaaacagagaatttgattgcccaagcagaaaaacaacctggaacccacattcaagtaaataaaatcaaaagtaaactaaaccaaagcaaacaacaaattcttcaaatggaattagcgactcagttaaaaagttgtgaagtgggtttagcaaaattaagtaacttgaaaagttatagtgagtaattaaaaaagccttattgagtacaataaggcttttttagtggttaaatttatctagtctgataatttctgcaaaccaaaatgacgataagtttgcgatgttgcaatacggccacgcggcgttctttgtagaaacccctgttgaatcaaataaggctctaaaacatcttcaatggtatcacgttcttcgccaattgcagcagcaagattatctagccccacagggccaccatcaaaacgctcaataactgcagacaacaactttctatctaaataatcaaatccagcatcgtctacatctagcattgaaagcgcttgttttgccacatttatagaaataataccgccattacgtacatctgcataatcacgcacacgtcgtaataaacggtttgcaattcgaggcgtgcctcgtgaacgacgagccacctcaaaagcggcttgttgttctaattcaagatttaaacagtccgcacttcttgcaacgatagatgttaaatcttctacagaatagaattccaaacgttgcacaataccaaaacgatcacgcaatggagaagtcaaagaacccgctctagtggtcgcaccaaccaaagtaaaagggggcaaatctaatttaatggaacgagcagcgggtccttcgccaatcataatatccaactgatagtcttccattgctggataaaggacttcttcaatagcaggggaaagtcgatggatttcatcaataaataacacatcatgcggttcaagattggttagcattgcggctaaatctcccgctttttctaatacaggccctgatgtcgtacgaatattcacgcccatttcatttgccacaatattagcaagcgttgtttttcccaaacctggagggccaaaaatcaataaatgatctaaggcatcttgacgtagtttggctgccttgatgaaaatatccatctgctcgcgtacttgcggctgcccaacataatctgctaatagtttaggacgaatagcacggtcgataacatcttcatcaaccttagcttgcccgctaataattctatctgcttcaatcatatttttcctacaatgcggcttttaatgcttcacgaataacttgttcactggttaattcaggtttagcaacgcgttttaccattttttctgcttctgcaggtttataacctaaagcaatcaaggctgaaattgcttcatcagatgaactttccgagtgggattcaatagatggggataatggaatatgcgtactttctacaaagaaatcactttgttttatgcctttaaatttacctttgagttcaactaacaaacgttcagctgtttttttgccaacacctggaattttagtgagtttagaaagttcttctctctctattgcgtaagcaaattgttcgaccgacatggcggataaaatcgctaaggctaatttaggcccaaccccatttgttttaattaattcacgaaataaagtgcggtctgttttctgggcaaatccaaagagtaagtgagcatcttcccgaacaacaagatgggtgaataaagtagtttcttgtccaatttctggtaaatcatagaaactcgtcatcggcaaaagcaattcatagcctacgccttgcacattgagtaaaatttctggaggttgtttttctaaaagaatgccttgtaagcgaccgatcataattcttccgaatgataaaaaaattaacgcatagaataaaataaaactggacgaacatccagttaaatttttaatctaaagcgtcctcggctatatctggtctttaaaagtgcggtcattttttcttgcgtttctgtcattttcacagaattggcaatatgtaaagaatgttgaatagaatgagcgtgtgtaatcgcaatagccaacgcatccgcggcatcggcttgaggtttatctgataacttcaaaatacgagtcaccatttcttgcacttgtactttatcagcagaaccaatgcccacaaccgtttgttttactaaacgtgcggcatattcaaaaacaggtaaatcattatttaccgctgcaacaatcgccgtgccgcgagcctgcccaagtttcaatgctgaatccgcattcttcgccataaacacttgctcaatcgcaaacatattaggttgaaattgcgtgatgatttcagttactccagcataaatgcgtttcaaacgggtgggtaaatcttcaacttgagtacgaattgcgccactaccgagatattctaaatgtctccctgtttggcgaatcacaccgtaacccgttacgcgagagccggggtcaatacctaaaataatgctcataatttctataaaaaataggtaattaaattacccatttattgcattattaaagttgagatgccacttcgtcacagatttctccgttgtgatatacgttttgtacgtcatcacaatcttccaacatatcaattaaacgaagtaattttggtgcagtttcaatatcaagatcgacggttgttgatggaatcatcgttacttcagcttcttgtactttaaaaccagctgcttcaatgccatcgcgcactgaacctaaatcttcccaagcagtatagatttcaaatgaaccatcatcttgtggttgaatatcatcagcacccgcttcgattgccgcttcagttaaggcatcttcatccgcttctgcgattaagattaaaccttttttgctaaataaataacccacagaaccttctgttcccaagttaccaccacatttagtaaaacttgggcgtacttgtgagatcgtacggtttgcattatcacttaaacattccaccataaccgctgtaccgcctgggccataaccttcatagattttggtttccatattggtatcatcgccaccacctacgccacgatcaatagcacggttgatagtatcgcgcgtcatattgttgctaagtgctttatctactgctgcacgtaaacgcgggttagcactcacatcgccaccaccaattttagctgcggtaacaagttcacgaattaatttagtaaaaattttaccgcgttgtgcatcttgtgctgctttgcggtgtttaatattagcccacttactatgacctgccattttatttccttctatttatctttaagaatatattttctaattgcttccgcattattggaagattttgtcatttggattgcttgttcaggggaaacccattgatatgccaaatgctcactcaatactggaataaattctttttccgcctcacacaaaaacaaatgttctttgcagtgagtaatattcggtgcgtatttatagcggaaatgtggaaaaatttcaaattctatgctctcattgcaatcaaaaagcgcggtggaattttccgaaatttctaaccgcacttcttcccatagctcacgaattgctgttttttttggtgtctcaccactttcaatggtgccagtaacagactgccaaaaatcaggatcatcttggcgttggagcattaaaactcggtttgtatttttagcgtaaattacaacaagaacagattgattatttttgtattgcatcattaaaaatgcggtcaaatctgaccgcacttcattcctaatattccaaacttattctgctttaacgacagaaattgccaactcttccaatgcttgcggatttacaaaactcggggcttccgtcattaagcacgctgctgccgtggttttcgggaaggcaattacatcacgaatgttttctgttccagttaaaagcatggttaaacggtctaaaccgaatgctaaaccagcatgcggtggagtaccgaattttaatgcatctaataagaaaccgaatttctcgcgttgttgttcttcgtcaataccaagaatacggaacacagtttgttgcattttcggatcaaaaatacgcacagaaccaccacccacttcgtagccgttgatgaccatatcgtaagcattggctaccgcacttgttggatcagcctctaattgctctgggctgaaatcttttggtgaagtgaatggatggtgcattgctgcaagattaccttcttcatcacgttcaaacattgggaaatcaatgacccaaagcggttgccattcgtctaaacgagttaagccaagatcacaacctaatttcaaacgtaacgcacccattgcatcagtggtcgtttgccatttgtctgcaccgaagaataaaatatcgccagtttgtgcattcacacgttctgctaacgctttccatacctcttcatttaagaatttcgcaatcggactttgcacgccttcaagaccagcattaatatcgtttacttttgcccaagccaaaccttttgcaccgtagatgcctacaaattgtgtatattcatcaatttgtttacgagtaatttctgcaccatttggtactcgaatgactgcaacacggccatttggattgtttgctggctcattaaatactttaaattcaacatctttgacaatatctgctacatctaccatttctaatggattacgcaaatctggcttatccgaaccaaaacgacgcattgcttcttgccaagtcatcactgggaacttacctaaatctacaccaatggtatcaagccataagtcgtgcaccatacgttccataatttcgcggacttctggcgcagttaggaaagaagtttccacatcgatttgagtaaactcaggctgacggtctgctcgcaaatcttcatcacggaaacattttacgatttgataatagcggtcaaaaccagacatcattaaaagctgtttgaaaagctgtggtgattgcggcaatgcatagaatttgcctttatgcacacggcttggcactaaatagtcgcgcgcgccttctggcgttgctttggtaagcattggagtttcaatatcaaggaaaccattatcatccataaagcgacgcacaaagctggtgatttttgcacgggttttcaaacgctgcgccatttcaggacgacgtaaatctaaataacggtattttaaacgttgttcttcggtgttattttggttgaagtctaatggtaaaacatcagaagcattgtagatgcgtaattctttcgctaacacttccacttcgcccgtagccatatttttattgatttggttttcaggacgcgcaatcacttcacctttaatttgaatacagaattcattacgtaacccagcagccgctgtcaatgcatcttgatatttaggatcaaaacaaacttgcacaatgccatcacgatcgcgcatatcaataaaaatcaagccacctaaatcacgacggcgatgaacccaaccgcttaatgttacgtcttgtccgatattgttacggtttaatgctccgcaataatgtgtacgcatcatttcaaaatcctttgtactcttttaattatgctcaaaaatctgtcgcaattatagcggaaaaccaagagagataaaaaggttatttatgctgacaaatcaatcaaaaaagcaaagaaaagtaataaatgttcaaaataaaggcttttttgtgccatatcatcagattttttgttatattatgcggcttgttgagattaaattacgttaaggataaccacatgttatttatcaatattacttttgcctgtattttagcgatccgtttttacagtctgtctatttcaattcgtcatgaaaaagcactcattgcaaagggtgcaatacagtatggtaaacgcaattccacactgttgtccattgcccatgttgcattttattttgcggcgatcattgaggctaataagcaaaacctgtcatttaatagcacttcacaaatagggttggcgattttaatttttgctattgcaatgctattttatgtgatttatgagctaaaagagatttggacagtaaaaatttatattttaccagaacatcaaattaatcgctctttcttgtttaaatacgtacgtcacccaaattatttcttaaacattattcccgaattaattggtttatcgcttttctgtcaggctaaatataccgcattggttggactacctatttatttgcttatcttagccgtgcgtattaaacaagaagagagtgccatgtcgcatttatttcctaaatcataatttataaatttcttctagaataacgactctttctctctgcctttaacacattatggtaaaagatactctattttctacccccattgctaaattgggggatttcatctttgacgagaacgttgctgaagtctttccagatatgattcaacgttccgtgcctggctattccaacattattacggcaatcggtatgctggcagaacgtttcgtcacggctgatagtaacgtttatgatctaggttgctcacgaggagctgccacactttctgcacgtcgaaatattcatcaacccaacgtaaaaattattggtatcgataattctcaaccgatggttgaacgttgtcgccaacatattgcggcatatcatagtgaggtacctgtagaaattctctgtgacgatattcgccacgttgaaattaaaaatgcctcaatggtcattctcaacttcaccttgcaatttttaccgcctgaagatcgcgtggcattgctcacgaagatttatgaaggattaaatccaaatggcgtattagtactttctgaaaaattccgttttgaagatactaaaattgatcatttactcattgacttgcaccaccaattcaagcgagccaatggttatagcgaattagaagtgagccaaaaacgcaccgcacttgaaaatgtgatgcgtacagattctattgagacacacaaagtgcggttaaaaaacgtaggattttcacaagtagaactttggttccaatgctttaattttggctcgatgattgcggttaaataaaacaacggtaatttgatcttcttgcttgcatacagcaattgaaatgattagtatatacttattaaatacatagtatatacgagagggtaaatatgcttactaaagtgtttcaaagtggtaacagccaagctgttcggatcccgatggactttcgttttgacgtcgataccgtagaaattttccgaaaggaaaatggggatgtggtattacgcccagtttctaaaaaaacagatgattttcttgcgttatttgaaggatttgatgagacctttattcaagcacttgaagcgcgtgatgatttaccgcctcaggagcgagaaaatttatgatttatatgttagacaccaatatcattatttatttaatgaaaaatcgccccaaaattattgccgaacgagtatcacaattattgcctaatgatcgcttagttatgagctttattacttatgctgaacttattaaaggcgcctttggtagtcaaaattatgagcaatcaatacgagcaatagaattacttactgaacgagtgaatgtactatatcccaatgaacaaatctgtttacattatggcaaatgggcaaatacactcaaaaaacaagggcgacctatcggaaataatgatctatggatcgcttgtcacgcattgagtttaaatgccgttcttattacacataatgtaaaagaatttcagcgaattacagatcttcagtggcaagattggacaaaatagataattctgattttttattttacttatgacataatctgtttaactcaactaaaaaaggacaaaccaatgcaaattttacacactatgttacgcgtgggcgatttagatcgttcaatcaaattttatcaagatgttttaggtatgcgtttattacgcaccagtgaaaatccagaatacaaatatacgctggcttttttaggttacgaagatggcgaaagtgcggcagaaattgaattaacatacaactggggcgtagataaatatgaacatggcacagcatatggacatatcgctatcggcgtagatgatatttatgccacttgtgaagccgttcgcgcgagcggtggtaacgttactcgcgaagcagggccagtgaaaggtggatcaaccgtcattgcttttgttgaagatccagatggttataaaattgaatttatcgaaaacaaaagtactaaatctggtttaggcaactaaagtgcggtcaatttttattgtatttttaataacgtagggattcctacgttattttatttttaagagatagattatgtccgattctcaagaaatcccttatcacaaccaattaaaaaatcgctttcgtggctatttccccgtcattattgatgttgaaactgcaggttttgatgcaaaaaaagatgcgttactcgaactagccgccatcacattaaaaatggatgaaaacggttatttgcatcctgatcagaaatgccattttcatatcaagccttttgaaggcgcaaatattaatccagaatccttgaaatttaatggtattgatattcacaatccactacgtggcgcggtgtctgaacttgatgcaatcacgggattatttcaaatggtgcgtcgaggacaaaaagatgcagattgccaacgttctatcattgtggcgcacaatgccacttttgaccaaagttttgtgatggctgccgctgaacgtactggcgtaaagcgtaatcccttccacccttttggcatgtttgataccgcaagtttagcaggattgatgtttggtcagactgttctcgttaaagcctgtcaagccgcaaaaattccttttgatggtaaacaagcccattcagcgttatatgataccgaacgcacggcgaaattattctgctatatggtcaatcatttaaaagatttaggtggtttcccacatattgcttctgaactagaacaggaaaaaacaactgaaaaagagaccgcactttaagaaaaataaaaaactggttgcaatcgttttatttttccagtagtttaaaagcaattcttatttggagataaaaaatgaacattatccgtcgtcaccatcatcaccattcaactgaataatctttcaggtttttggtgtgcttggaagatttcttccgagctgacaggataataaaaatcttacccctcggaaggcaactttcgaggggttttgttttatttacgatataggaggcattaatttagcgttattctttattcaataaaaattttaaagtaaagtatttatcatttaatttacaaggaaaaacacaatgttatcaaaccctgttgttatctcaatcatcgttttgctggcacttagtttgctacgcatcaacgttattatcgcactggtgattgctgcgcttaccgcaggatttatcggtgatttaggtttaactaaaaccatcgaaacctttacaggcggcttaggtggcggtgctgaagtcgcaatgaactatgcaatacttggagcgttcgccattgctatttctaaatcaggaattactgatttaatcgcttataaaatcatcacaaaaatgaataaaacaccaactgctggcaatttaacttggtttaaatatttcatttttgcggtattggcattgtttgccatctcctctcaaaacttacttccagtgcatattgcttttattccaatcgttgtaccaccactactttcaatctttaaccgtttaaaaattgaccgccgtgcagtagcttgcgtacttacatttggtttaactgctacctatatattattaccagtaggctttggaaaaatctttattgaaagtattttagttaaaaacattaatcaagctggcgcaaccttaggtttacaaacaaatgtagcacaagtttctttagcaatgttgttacctgttattggaatgattttaggcttactcacagccatatttattacctaccgtaaaccacgtgaatacaatatcaatgttgaagaggcaacaactaaagatattgaagctcacattgctaatattaaaccaaaacaaattgttgcaagtttaatcgcgattgtcgcgaccttcgcaacacaattagtcacaagttcaactatcattggcggtttaattggcttaattattttcgtactatgtggcattttcaaactaaaagaaagcaacgatatttttcaacaaggcttgcgcttaatggcaatgattggctttgtaatgattgctgcttcaggttttgcaaatgtgattaatgccaccactggcgtaacagatttagtacaaagcctaagttctggtgttgtgcaaagtaaaggtattgccgcattattaatgcttgtcgttggtttattaattacaatgggtattggctcatcattctctacagtaccgattattacatcaatttacgtaccactctgtttatcttttggtttttctccattagcgacaatttctattgtaggcgtagcagcggctttaggagatgcaggttcgcccgcatcagactcaacattaggcccaacatctggcttgaatatggatggcaaacacgatcacatttgggattctgttgtacctacctttattcactataatattccattattggtattcggctggattgcagcaatgtacctttaacgattataatcccccacttgggggatttttttatgactgttcaacaacttatccaacgcttagatcaaaaagttcaacaactttatcaagctcatttatccaaacgagaagaaaaaatcttcgccaaatttgaccgcactttatttagtgaaaatggacaaaatgtttccttttatctaaaagaaatcaatcaaacgctagatagaataaagacattagagtctaacgattctaatcactataattttctagctgagcgtttactcgcccaatgttccgttctttcggaagctttagttcgcaaaaatactcatctaactgaatcccaaacaacaacgaaacaaaccattcaaaaatctcaacatagcattcataaattaccaccaagagaacgcctagaaaaatattacgaagcacgagaacaattgaataatctttatcgacagcataaagatttagcacaagctgaaaaaaataatgatgagaaaatacgttatgctcaacttgcagaagtttataaaaaacgccagcaaaaatgccaagatgcaatcgatcttttagaagaatatttggtgtttaaagaagaagtggaaaaccgtgaaaatacggaaaacaaatgattagaaataaaaaactaattcttccgaattagttagctcgtaaaaattgatggcggaggaatagggattcgaaccctaggagggcgtaaaccctcgccggttttcaagaccggtgccttcaaccactcgaccattcctccgtgatttaacgagcgtgaataatacgttctctaataaaaaccgtcaagtagaaataatctcatttttatcaagtgattatttttaccacagcttataaaaaatgcctttcctatttatgaacggaaaggcatttttgttgaatgaatttcagtgctttttattactacaatatatcgcagaaattaaccgcacttttgtcatctaaacaattattttacgcgagagacgtattcgccagagcgggtatcaactctgataacttcgccgatttggacgaaaagcggcacttttacaactgcgcctgtgcttaatgttgcaggtttaccgccagtgcctgcggtatcgcctttaagacctgggtctgtatcgacgatttctaattcaacaaagtttggtggcgtaacagtaattggtgcgccattccataaagtcacgatacaatctgcttggtctaataaccatttttctgcatcgcctacggcttttgcatctgcagagtactgttcaaatgtttctgggtgcataaagtaccagaatgcatcgtctttgtatgaataagttaagttaagatccataacatcagctgcttcaaccgaagtgccagatttaaagtttacgtctaatactttgcctgaaattaatttacgaatacgagtacgagtgaatgcctgacctttgcctggttttacaaattcattttcaacgatgacacaaggctcgccgtcttgcataaattttagacctggtttgaaatcactggtagtatatgtagccatatttgaaatatcctaaaaatgagagatggtttgaaaagtgcgtattttaccccaagaacccgtcattagagaagaacaaaattggctcacaattctaaaaaatgccatttcagatcctaaattattactaaaagccttaaatttaccagaagatgattttgagcaatccattgctgcgcggaaacttttttcgctccgcgtgccacaacctttcattgataaaatagaaaaaggtaatccgcaagatccccttttcttgcaagtgatgtgttctgatttagagtttgtgcaagcggagggatttagtacggatcccttagaagaaaaaaatgccaatgcggtgccaaatattcttcataaatatagaaatcgcttgctctttatggcaaaaggcggttgtgcggtgaattgtcgttattgctttcgccgacattttccttacgatgaaaacccaggaaataaaaaaagctggcaactggcgttagattacattgcggcacattctgaaatagaagaagtgattttttcaggtggcgatcctttaatggcgaaagatcacgaattagcgtggttaataaaacatttggaaaatataccgcacttacaacgtttgcgtattcacacccgtttgcctgttgtgattccgcaacggattactgatgaattttgcactttattagcagaaactcgtttgcaaacagttatggtgacacacattaatcacccgaatgaaattgatcaaatttttgctcatgcgatgcaaaaattaaacgccgtgaatgtcacgcttttgaatcaatctgttttgctaaaaggcgtgaatgatgatgcgcaaattctaaaaatattgagcgataaactttttcaaacaggcattttgccttattacttgcatttgctggataaagttcaaggggcgagccattttttgattagcgatattgaagctatgcaaatctataaaaccttgcaatctctgacttctggctatcttgttcctaaacttgcacgagaaattgcgggcgagccaaataagactttatacgcagaataagatccgataaaatacacataattttttcgccacacttttgagcttctcaattttgtggctaattaatataaataagaacaagcatcagaggcaatccagtgaattctatggataaaaatcaacaatcatctcaaaatgaattggatttagggcttaatcaagagccaattacaccaaagaaaacaattcagccaagttcgtcaattttaggtaaagcaaaagggttatttgccaaaaaaaatcacgtgcaaactaactttcagcaacgtaaagaacctacttttggcgattcatcaacgcaagaaaatgatcctttaattccgagtgaaaatttgaaaaaagtgcaaaagcctgttcttcaaacttcttccacagaagaaaatatttctgcggttgatgaagaaatcagtgctgaaaataacgcggatgaacccgtcgaaaaggctgaaaaacctattttagctcaaccagaaaaatggaaaatattacaagtattgccagcaaaacatcgccgtttatttatggctatttttgtgttggttattttattgattattttcttcgcattaaaaccaagttctgacaccgttgagtcttttactcaatctaacagcaatgaagttcctgtgcagttccaatcgttagatcaaagtcagccactggaaaccacgattttagataatcctcctgcacaaaatcaaatggctgtagaacaagctaaccaatctgaatttgcaccaaaagcagaggaagcggcgaataatacgacggctcaaaacccattagtagaaaatgcgccaatgcaacaaaatgttgttcaatctccaagtcaaatgccaaatgaaatggctgcggcatctgttatgcctatgcaaccagctcaagcggaacagccaaaagcaactgtgccagttcagccgatgaaaaaagcggtagagccacaagttgcgcataaagatactgtgaaaaaagaagtgaaagtggcggagaatgcacaggctccatcaaaagcaacggaacaaaacgtcgctaaaacagcaggaaacgcaccgattgttgaagccaaacctgttcaagtaaaaaaagaaaagaaagttcaaatcgttgatgcaaaacctgtgagtaaatctgcagcctctcgtctttctgcgaaaacattaactgtgccgaaaggtgtttcgctgatgcaagtcttccgtgataatcaacttaatatttccgatgtaaacgcaatgagcaaagcagcaggggcgggcaatgttttaagtagctttaaatctggcgataaagtaacggtatctgtgaataatcaagggcgagtaaatgaaatgcgtttatccaatggtgcgcgttttgtgcgtcagtctgatggttcttatcaatataaaaaataattttttgggcgagtaatcgccttttttctttttaagttattttctcaaggtaggatttatgttgaaaaaaacatctcttatttttaccgcacttttactggctggctgtgcgcaaaatgcgaatgtgacaacacctcaaacgcaaaaaatgcaagtagaaaaagtggataaagccttacaaaaaggcgaagctgaccgatatttatgtcaagatgataaagttgttcgtgttgtacacgccacgcataaaaaatacaaaaaaaatttgcattatgttaccgtcacttttcaaggcgtatcagaaaaactaaccttaatgatttctgaacgtggtaaaaattacgccaatattcgttggatgtggcaagagcgtgatgattttagtacgctaaaaacgaatctcggcgaaattttagcaacgcaatgtgtctcacaaacaagtgaacgcttatctggacaataatcgtgcaaagcgaacttcaacgtggttttgttttgcatcgtcgcccttatagtgaaacgagcttattggtagatttattcactgaagaaagtgggcgtttaaccgtgattgcaaaaggggcgcgtgcaaagcgttcatcttggaaatcggttttgcaacctttcacacctttattgttgcgttggacgggaaaaagcacattgaaaaccctcactaaagctgaacctgccgcaattacactgcctttacaacaaattgccctttatagtggattttatgtaaatgaattactcactcgtgttattgagtctgaaactccaaatcctgcgctttttcaacattatttaaaatgcttaactggcttggcaacggaaactaacgttgagccaacgttgcgtctttttgaatttcaacttttacaaatgctcggttacggcgtggattttctgcattgtgcggggtctggcgagccagtggatttctcaatgacataccgttatcgtgaggaaaaaggtttcgttgcgtctttagtgaaagataatctcacgttttacggcagagatttgttagcctttgaagccctcgatttttccgatgatgcggtacgtcaagcagcaaaacgcttcactcgtattgcgctgaaaccttatcttggcgataaaccgctaaaaagccgagagttattcactcaaaatattttacttttaaaataatggttcttctttataccccaaagcaaaaaacaaacaatgttcaaaccattacggctgatattcttgatttagattatcaaggtttaggcgtggcgaaaattaatggtaaaacttggtttattgaaaatgcgcttccgcacgaaaaagtggaatgtcgtattttggaagataaacgccaatatgggcatgctacggcaaaaaaatggcgagtaaaaagttctgaacgtttagaacctaaatgtgctcattttatgcgttgtggtggttgccaaggacagcatattcctattgaaatgcagaggaaagcgaaacaatccgcattgtttaagcggttaagtaaattacagtcagaaccgatttcatttcaacctatgatttgtggcgatgcttgggcgtatcgtcgtcgtgtgcgtttgagtttatggtttaatccaaacacaaaacaaatcgacatgggctttcgtcagaaaaataccaacgatttaatacccgttcaatcttgcgaagtagcagaacctgcaattaattatttactgcctaaattaaccgcacttttagaaaaattttccacaccgaaacagcttgggcatattgaattggtggctgccgataatggcgtcgcaatgttgttacgttacacgaaaaaccttgcggaaattgaccgcactttattgctcaaatttgctgaacaagaaaaattaatgctgtttttacaaagcgacaaaggcattgaacaaatctatggcgatgcgccttattatcaattttctgatggcataaaattacattttgatattcgtgattttattcaagtaaatagtgcattaaatgaacgtatgatcaatacagcgttggattggcttgaattgagccaacaagattgcgtgttagatttattttgcggcatgggaaattttacgcttcctcttgccaaacgcgtgaaaagtgcggtaggaattgaaggcgtttttgaaatggtacaaaaagcggcgcaaaatgccgcaagaaaccaaatcaaaaatattgaatttttccaagccgatcttgaccaatcctttgttgaacaaccttgggctaatcagtcgttcaataaaattttgcttgatcctccacgcagtggcgcagctttcgcgttaaatgctttgtgcgagctgaaagcagagaaaattttatatgtgtcttgtaatcctgcaacattagtgcgtgatgcggaaattttatgtgattttggctacaagattgaaaaaagtgcggtgatagatatgttccctcatacggggcatttggaatcgataaccttattcactacaaaataactcggttattcggtacaatatccacccaaaataaaagcgacaggaagttgcttgctcttcatcaacaagggggtattatggttgctgttcgtggttctcatttgttaaatccgcagaattttgtgattgaacaatggtgcactggcttaaaactagcagaacaaacagaaaaaagtttgatcgatgcgtggtattacgcacgtgatttaatgaatgcctatcccgatgaaatgaagaatgcgaccttaatgctgcagtctggcgtggaaatggtagaaattttgcacgaacttaatatggatgcggaaacattgcttactgccatgttgtttcctattgttgcaaataaattaacagactgggaaagtctaaaagaaaaatttggtgcgaaaattactaaattacttaaaggcgtgttggagatggataatattcgccaacttaatgccagtcattccgctaacgctctgcaagtggataatgttcgccgtatgttgttggcaatggtggacgatttccgctgcgtgatcatcaaacttgccgaacgtattactttcttgcgtgatgcagagtatcgttgtgcagaggaagacaaagtccttgccgtcaaagaatgttcttatatttatgcccctcttgccaatcgtcttggaattggtcagctgaaatgggagttagaagattactgcttccgttatcttcatcctgaacaatatcgcgctattgctaaattattgcaggaacgtcgtcttgatcgtgaacattacattgctgatttcgtcagtgagttgagcagttatttacgtgaaaatatcaagcaagtggaagtctatggccgtccgaaacatatttacagcatttggcgcaaaatgcagaaaaagaatcttgagttcagcggtttatatgatgtaagagcggtcagaattatcgtgcaaaaattgcaagattgttacaccgcacttgggattgtgcatactcaatttaaacacttacccaaagaatttgacgattatgtcgcgaacccgaaaccgaacggttatcaatctattcatactgttgttttaggtaaaggtggcaagccaattgaagtacaaattcgaacccaacaaatgcatgatgatgcagagttaggtatggcggcacactggaaatataaagaaggcaatacaggcagtatgtctgcctatgaagaaaaaattgcgtggttgcgtaaattgttagcttggcaagatgatattacggattcaggcgaagtgctggcagagttgcgtagccaagtgtttgatgaccgtgtatatgtgtttacgccaaagggcgaagtggtggatttgccaacgggatctacaccattagattttgcttacgccattcatagtgaaattggtcatcgctgtatcggggcaaaagttgcggggcgtattgtgccatttacctatcagctacaaatgggtgatcaaattgatattattacccagaaaaatccgaacccgagccgtgactggctaaacccaaatttaggatttactcacaccgcaaaatctcgagccaaaattcaagcgtggtttaaaaaacaagatcgcgataaaaatattccagcgggtaaagaattactcgataatgaactcgcgcttttgaatttaagtattaagcaagtggaaccttatgcgttaccacgctataacttgaaaaatttggacgatctttatgcgggcattggcagtggtgatattcgtttaaataacttaatcaatttcttgcaaagtaaattgattaaagtgactgctgaagaagcagatcaagagattttacgtcatgttgctaacaaaagtgcggtcaattctcagcagaaatctgaaaagaacaatggctatgtgattgtggagggtgtggacaatcttatgcatcatattgcgcgttgctgccagccgataccaggcgatgcgattgttggctatattacaatgggacgtggtatttctattcaccgagcggattgtgaacaattcttagatttgcaagcggctcatccagaacgcgtagtggaatcaatttggggcgaaaattacgcaagtggtttccatattaatatccgtattgtggcaggcgatcgcaatggcttattgcgtgatattacgacggttctagcaaatgaaaaaattagcgtattaggggtctcaagccgtgctgataccaaaaaacagcttgctactattgatatggaaattgaacttcataatgttgaaagtttgagtaaaatattggctcgattagcaaaattagatgatgttatcgaagcgaagcgtttataaaaataggaaaatttatgtataaaacgacggggctaacccatttaatcaattccacgaaatattcattacaaggcttaaaaagtgcgtttaaaaatgaaacggcttttcgccacgaatgttttttagcctgcattttaattcctcttactttctttttaggcgaaacaaaaattgaaattatattgatgatttcttctgttttgcttgtgatggcgttagaacttttaaacagtgcggtagaggcagttgttgatcgcattggtacagaacgccacgaactttcaggacgtgcgaaagatcaaggctctgcatcggtatttattgccctttgtattgtcggtatcgtttggggcggaattttattcttctaaccctccaaaagtgcggtaagtttttaccgcatttttgatttatccaatcacgtcaaaattatttataaaaataaggaaaaatatgaccgcacttttaaaaattggtctggtgtctgtttctgatcgcgcatcagcaggcgtatatcaagatcaaggtatcccagaattacaggcttggttagaacaagcgttagtagatcctttccatttggaaacaagattaatccctgatgaacaaccgattattgaacaaaccttaaaagagctggtggatgaacaaggttgccatttagtgctgacaactggtggaactgggccagcaaaacgcgatgtaacgcctgatgcaacccttgcggtagcagatcgagaaatgccaggttttggcgaacaaatgcgtcaagtgagtttgcattttgtgcctaccgcaattttatcccgccaagtgggtgtaattcgtaaggaaagcttgattttaaatcttcctggtcagcctaaagcgattaaagaaaccttggaaggcgtgaaagataaagagggaaatgtgcttgtaaaaggcatttttagcgcagtgccttattgtttgcaactgattaacggcttatatattgataccaagcctgaaatcatcgaaagtttccgtcctaaatccgcaagacgcgaaaatctggagaaatagcatgaaaaaaatcgaagcaatgattaaaccctttaaattagacgatgtgcgagaaagtctttcagatattggtatttcaggtatgacaatcacggaagtacgcggatttggtcgccaaaaaggtcatacagaactttatcgtggtgcggaatatatggtggattttctgccgaaagtgaaattggaagtagtggttcctgatgaacttgtggatcaatgtattgaagcgattgttgaaacggcacaaacaggcaaaatcggtgacggcaaaatttttgtttatcacgttgagcgagcgatccgcattcgcacgggcgaagaaaacgaggatgcgatttagtgcaaaataatttaaatttacaccgcactttgcttggcattgctgcggtgattattatcttagctggcgtaaaattggcggcagaaatcgtggtgccattcttgctatcactctttatcgcgataatttgttcgccgataattaaggcgatgacccaacgccgcgtcccgcattggttagccattactttgctttttgtcttgatttctttggtatttttcttcttagtcgggttgattaacagcacggcaagagaatttacccaatctattccacaatataaagttttgctttcacaacgtgtgagtgatttaactggattgttgcaacgtttcaatctgcctttcacgctttcgcgtgaaaccatccaagaaaattttgacccaagcatcattatgaattttgtaagccgagtattgctgaatttctctggtgtagtgagtaatgtgtttgttttagtgttggttgtgatttttatgcttgccgaagcaccaacgatgaaacataaatttgcaatggtaattagttcaacccctcatgatgcagccaaagaagaacgccatattgatcgcgttttgcaaggcgtaattggttatcttggcatcaaaagcatcacgagtttactgactggcgtcggagtgtttattttgttggaagcctgtggggttcaatatgccattttgtgggcaaccttgagtttcttgctgaattatattcccaatataggttctatcatcgcggctattccgattattgtgcaagccttattactgaatggttttggcattggctttggcgtagcaatcggtgttattgcgattaatatggttgtcggtaacattattgaacctaaaatgatggggcaacgattagggctttcaaccttagtggtgttcctttcattattgttttggggatggctgcttggaacagtgggaatgctactgtctgttcctttgacgatggcattaaaaattgccttggagtccagtcccaatacagcgaaatatgcctgtctattaggagatgtcgaagatttcaaatagattttagagataaaagtgcggtgaattttcaccgcatttttttatgataagtcttgcggatcgacgtccaaaattaaccgcactaggctgtttttttcaagttcggcttgttgatattctcttaatgctttttgcaacgtcattcttgacggatgttgcaataataactgccagcgatattgccccgcttttttgctgaacggtgcaggcattgggccaagcatttgtaatcccgtaatttgcttcgattgaaaaaaatctgcaatttggcttaagcaattttctgcaagatcagaatgtcgagcctgtgctttgaataacgcctgaaaagtaaaaggcggcaatcccattgaatggcgtaattgtaaggtttcttttgcaaaagcttggtagccatttgccaataaagtggtaagcaaaggatgatcaggataatgtgtttgtagcacaacttcaccttgtttatcggcacgtcctgcacgtccagcaacttgaatataaagttgagctaaacgttcttctgcacgaaaatccagtgaaaataatgcactatctacattcactaaggcaacgagagtaacattcggaaaatgatgtcctttcgcgagcatttgtgtgccaatcaaaatttggcttttgccttgttgaatatcttctaaataaccttccaattttcctttacgtgccgtgctatcgcggtcgattcgcgctacagaataatgaggaaatagcgttttcaaggtttcttctaattgttctgtgcctagaccagtagtaactaaatgggtagaaccgcaatcgccacattggcgaggaatagttttttgtgcgccacaataatgacaacgcaatacattttgatgctgatgataggtataaggtttttcacaatgagggcattgtgcgatccaaccacattcatggcaaagcaatacgggtgcaaagccacgacgatttaagaaaagcaacacttgattgcctttttcgagatgggctttcattcgttccaacaagggttttgataacccgttttgtatattttgatttttcaaatcaataacgaaatgacgaagtgcggtagaatttcccgctctttttgataaaactaaatgttggtatttgccgttttgtacattattaatactttctaaacttggcgtggcggagcccattaataccgcaatatttagtttttgagccagcacaatcgccaagtctcgcgcatggtaacgccaactgtcttgttgtttgtaagacgaatcgtgttcctcgtccaaaataattgcaccaagattagaaaattgcgtgaacaatgccgatctcgtgccaatcacaatggcactttgtccagagcgggcgcgatcccatacataaagccgttgcgtatcggttaaattagaatgcagtacatcaatttctacattaaaacgtgctttaaaacgttgcaccgtttgaggtgttagcccgatttcgggtacaagcactaatacttgcttacccgattttaaaatttcttcaatatactgcagataaatttctgttttacctgaaccagtcacgccatcgagcagccatacattgaaaccagaatggaagagcagttggctgaaggctaaggcttgctgcttatttaaggttaaacgattttcagcattgactattgggttattgcctaatctttgttgccagcttaggggatttgtttggatagtaatttcttcaataaaccctttggcttttaaggcagaccaaatggcagaggaaaaattattattgcctttttcaagatcagtttcagataagcattgtagggcttcagcttgctttttcgagcgttttaattcgccttgttcaagggcatttttccccgcatccgtaattcgccaaaaagtgcggtcattttttaccgcactttcgccgttacgcaatttcacaggcaaggcttgaaataacacatcgcctaatcccgcttgataataatttgctgcccagtgaagccaatcccaataaatgggcgtaaaaagtggggctaaatccaatggttgaagaatagccttgagtttatcctctggcacgtccgattttgtcggaaaatcagccacaatggcgacacgtttttgagtgccaaaaggcacaagaacacgcataccgatttgtaatgaaacatcatcggggacgaaataatcaaataagcgaggaagcggcacagccagtgccactcggacaattttcataatcaaccttgggaaaaaatttgccctattatacgagaaaaattggtataatcgccgccaatttttttcacgaacaagatttttatgacacaaacttttgccgatcaaaaacgtaaaaccgttgaaaccgcagaatttaccgaagatggccgctataagcgcaaagtccgtagttttgttctccgcacaggtcgtttgagcgaatttcaaagaaatatgatgaatgataactggggaacacttggtttagattatcaaacggaaccttttgattttgctaagatttatggcaatgataatccaattgtattagaaattggctttggaatgggaaaatcgcttgtggatatggcttttgctaatcctgacaaaaattaccttggcattgaagttcatactcctggcgttggtgcttgtattgcttatgcagtggaaaaaggcgtaacgaatttacgcgtgatttgccacgatgcaacggaaattttacgagacagtattgctgatggtgcgcttggcggtttgcagttatttttccccgatccttggcataaagcaaaacatcataaacgtcgtattgttcaaccgcactttgtgacacaagttatacaaaaattaggtaaaaatggttttatccatatggcgacagactgggaaaattatgcagagcaaatgctagaagtattaagcgcaaacaccgatttagtgaacacctcgaaaaatggcgattatattccaagaccagattttagacctttaactaaatttgaagccagaggttacaaacttggacatggtgtttgggatttatattttgtgaagaaataagcggattttaactaaacccaatacctaatttatgaatttaatataaaatacacgtttgaatataaccttaataggagaaataaaatgtctaaatcttacaatcaacgccaacgcaaaaaacttcatcttgcggaatttcaagaactgggttttcttgtaaatttccaatttgcagaaggcactgcgattgaaactgtagatgaaatcgttgatcgttttattaacgaagtgatccaaccaaatggtctagcttatgaaggtagcgggtatttacattgggaaggtttagtttgcctagaaaaaattggcaaatgcgatgaaagccaccgtgaaactgtgaaaaaatggttagaaacaaatggtttgcaacaaattgaagtaagcgaattatttgatatttggtgggaatatccagcaaaagctgaataatctaaattgaaagcagcataacaaaaattgctatgctgttttgttttaatcccttgcaaaattcattaaaccttaaattttttgatctataacaaataaagttcaaataattgacaaactacctattttgggttgttctcattcattcatcgtaaacacataatccttcatctacagaagcattcagaaatattttaaagacattatgaccgttgaaaatttacctcgcagacaatttttacgcggtaaattttcaacattgagctgtttagaaaataatcaaaaacagaattttgtgggtattagaccgccttggtctgtggaaaattctatttttgtagcacaatgtacgcgctgtggcgactgtctttctgtctgtgaaaccaatattttggtaaaggacgatgctggttttcctgaagtgcgctttgataatggcgaatgtactttttgtgggaaatgtgtagatgcctgtaaacagcctattttttatcctcgtgaccagttaccttggtcacataaaatcgacattggcgtagcttgtttaacattgcaccgtattgaatgccgaacttgccaagataattgtccagctaatgcgattcgtttcaaattacaaatgggtggcgtagcacaacctttagttaatttcgatgcttgtaatggctgtggggcttgtgtacaaggctgccctgtgaatgcaataacaatgaacgatctaaaacaaaatgaataatacaaatttaatattagaaaatgcgagggattggcacgttgttggattgatcgtgcaaggtaatccaaaaaaattatcagcaattcaaaccgcacttttagcgattgagcatactgaaattccgacttttgatgaaaaacttggaaaatttgtggtggtaatgcaatcgaacgatcagcatctcttgcttgaaaaaatggaaagtgtgaaagatatcgacggtgtgattaatgtatcgttggtgtatcacgagcaagatgaacaaaataaataattttaaaatcaaacgtttaacgtgggggaaaacgcgatgaatttaagtcgtcgagactttatgaaagccaatgcggctatggcagccgcaacggcagcggggctaaccatcccagtcaaaaatgtggttgcggctgaatccgaaattaaatgggataaagcagtatgtcgtttctgtggtactggttgtgcagtattagttggtactaaagatggacgtgttgtggcatctcaaggcgatcctgatgcagaagtaaaccgtggtttaaactgtattaaaggttacttcttgccaaaaattatgtacggtaaagaccgtttaacgcagccgcttttacgtatgacaaacggaaaatttgataagaacggcgattttgcgccagtttcttgggattttgcgttcaaaacaatggctgaaaaattcaaagaagcgttcaaaaagaacggtcaaaatgcagtaggtatgtttagttctggtcagtctaccatttgggaaggctatgcgaagaacaaactttggaaagcaggttttcgttctaacaacgtagacccgaatgcgcgtcactgtatggcatctgcagcggttgcatttatgcgtacttttggtatggatgaaccaatgggttgttatgatgatattgaacaggcagatgcttttgttctttggggctcaaatatggcggaaatgcacccaattttgtggtcgcgtattactgatcgccgtatttctaatcctgatgttcgtgttactgtgctttctacttacgaacatcgtagttttgaacttgccgatcacggtttgatatttacaccgcaaactgatttggcaattatgaactacatcatcaattatcttattcaaaataatgcgattaattgggattttgttaataaacataccaaatttaaacgcggagaaacgaatattggctatggtttacgtccagagcatccattagaaaaagacacgaatcgtgcaacagctgggaaaatgcacgattcttcttttgaagaattaaagcaacttgtatcagaatatacagtggaaaaagtatcgaaaatgtctgggttagataaagtccagttagaaactttagcgaaactttatgctgatccaacgaagaaagtggtttcctactggacaatgggctttaaccaacatacacgtggtgtgtgggtaaaccaattaatctacaatattcatttacttactggaaaaatttcaatcccaggttgtgggccattttcattaactggtcagccttctgcttgtggtacggcgcgtgaagtaggttcattccctcatcgtttacctgccgacttagtggtaactaatcctaaacaccgtgaaacagcggaacgtatttggaaattaccaaaggggacggtttctgaaaaagtggggttacacacaattgcacaagaccgtgcaatgaatgatggcgaaatgaatgtgttatggcaaatgtgtaacaataatatgcaagcaggaccaaacattaatcaagagcgtttgccaggctggcgtaaagaaggcaacttcgtgattgtttcagatccttacccaactgtatccgcactttctgctgacttaattcttccaacggcaatgtgggtggaaaaagaaggggcttacggcaatgcagaacgtcgtacccaattctggcgtcagcaagtcaaagcaccgggcgaagcaaaatcagacttatggcaattaatggagttcgcaaaatacttcacgacggatgaaatgtggacagaagacttacttacacaaatgcctgaatatagaggtaaaactttatatgaagtgcttttcaaaaatggtcaagtagataaattcccattgagcgaacttgctgaaggccaattaaacgatgaatcagaatattttggttactacgttcacaaaggtttatttgaagaatacgctgaatttggtcgcggtcacggtcacgatttagctccatttgatatgtatcataaagcgcatggtttacgttggccagttgtggagggtaaagaaaccttatggcgttaccgtgaaggctatgatccgtatgttaaagaaggggaaggcgtggctttctacggttatcctgataagaaagcgattattcttgcggtgccttatgaaccaccagctgagtcacccgataatgaatacgatttatggttatcaacaggtcgtgttcttgaacattggcatacggggacaatgacacgccgtgtaccagaattgcatcgagcatttccaaataatttagtatggatgcacccattagatgcacaagctcgtggtttacgtcatggcgataaaattaagatttcatctcgtcgaggcgaaatgatttcttatttagatactcgcggacgtaataaaccacctcgtggcttagtatttaccactttctttgatgcaggtcagcttgcaaatagcttaacactagatgcgacagacccaatttcaaaagaaaccgacttcaaaaaatgtgcggtaaaagtggaaaaggctgcgtaaaaaccatgtaaaaatcaaccgcactttatttctcccatcaataaaagaggaagatgaaagtgcggttaaaatctaaaaagaaaatgaagaaacccgcccttaatcctgaacgtagaaaatttcttaaagaagcaacccgtactgcgggtggtttagctggcgttgggattttgttgggattgcagcaaaatcaaagtcttgcgcgcgaaggtgtgccattacgccctccatttgctttgcaagatgcgaaagcgttttctgccgcttgtattcgttgcggacaatgtgttcaagcctgtccttatgacatgctgcatttagcctctttattatcgccagtagaagcgggaacgccgtattttattgcgcgtgataaaccttgtgaaatgtgtcctgatattccttgtgcaaaagcctgtcctagtggtgcattagatcgtcaagcaacagatattaatgaatcgcgtatggggctgtcagtactgttagatcacgaaacttgcttaaattatcaaggattacgttgtgatgtttgttatcgagtttgtccattaatcgataaagcgattacattggaaacacaacataatccacgttctgataagcatgccttatttattccaacagtacattctgatgcctgcacgggatgtggaaaatgtgagcaagcttgtgtgttagaagaagcagcgattaagattttaccaatggatctggcaaaaggtatgttaggtaaacattatcgtttaggttgggaagaaaaagcgaaagctggccattctcttgcacctaaagatatgatttcattgccaactcgaacaccagaagggacaactgtaattcctgaaccagcagaacccgtgctcgcaccaattttagggggcggaaaataatggcaaatgcaccaaaatttgcagggaaagaggctcgagaaaaatggggctggtggtatgcaaaccgctttttgttttggcgtcgattaagccaacttagcattcttgcgatgtttttgagtggcccttattttggcgtgtggattttaaaaggtaattatagtggtagtttattactcgatactattccactaagtgatcctctaattaccgctgaaagcttggctgcaagacatttaccagatgctctcactttaattggtgctgcaattattgtgttattttacgcagtacttggtagtaaagtgttttgtggttgggtatgcccactaaatgttgtgactgactgtgcagcgtggcttcgccgtaagttaggcattcgccaaacagcaaaaatttcgcgcggtttacgttatggtattcttgtgcttattttactaggcagtagtgtcagcggaatgttgctttgggagtgggttaatccagtggctgctcttggtcgcgcctttgtatttggttttggtgcaacaggctggttattacttgttatttttctttttgatttattgattgctgaacacggctggtgtggacatctttgcccaattggtgctgcttatggtgtgattggtgcaaaaagtttaatccgtattaaagtgattgatcgtgctaaatgcgataattgtatggattgttacaatgtttgtcccgaagcccaagtgttacgttcgcctttacacggaaaaaaagacgaaagcctactagtgctttccaaagattgcatcagctgcggacgttgtattgacgtttgcgctgaaaaagtttttaaattttcgaccagattcgatcattcaggggagtgattaatatgactaaacaggtatctaaaattttagcgggattatttaccgcactttttgctggctcactgatggcatctgatgcaccagcagtgggaaaagatttaactcaagcggcagaaaatattccacccgcatttcataatgcaccgcgtcaaggcgaattacccgcattgaactatgtaaatcagcctccaatggttccacatagtgtggcaaactatcaagtgacaaaaaatgtaaatcaatgtttaaattgccacagcccagaaaattctcgtttgagcggtgcaactcgaatcagcccaactcactttatggatcgtgatggaaaagtaggttcaagttcatcgccacgtcgttatttctgtttacaatgtcacgtttctcaagcaaacgtagatcctattgttccaaatgatttcaaaccgatgaaaggttacggaaactaatttaagaggtctatatgtctgagaaaaaaccaaatatcttaaagcgtttctggcaatggtttagaaaaccaagccgtatggcgataggtacaattattatcttatcggctattggcggtattctttcttgggttggttttaactatggtttagaaaaaaccaacactgaacagttctgtgcaagctgccatatgcaagatgcttatccagaatatttacatagcgtgcattatcaaactcgtactggtgtgggggcaagttgtccagattgtcacgtaccacacgaatttggtgcaaaaatgaaacgtaaaattattgcagctaaagaagtatatgcgcactatactggaaaagtggataccttagaaaaattcaatgcgcatcgtttagaaatggctcaaaatgaatgggcgcgtatgaaagctaacgattctaaagaatgtcgtaattgccataatgtagatcgtatgaacttcaatgatcaacgttctgtggcggcacgtatgcaccaaaaaatgaaaactgaaggtaaaacttgtatcgactgtcacaaaggtattgcacaccaattacctgatatgagtggcgttgagtcaggcttcaaagacgagaagtgattttctaaaaataggctgaaaaaataccgcacttttttcagcctattataaatttgggtagtttataaaaaaatctgcactttaattcgctgatttattcagcctttaaggtgcagattaattatattttctaaagtgcggttaatttttagattatttttagcctaagattttatctaactcttggctaacttcttctactttttgtgtaccgtctaaacggaaatattgagtattccccgctttcgcttctgcttggtaataatcaattaatgggctagtttgtttatgatatacggctaaacgatctaatacagtttctggtttatcgtctgcacgaataattaaatcttcgcctgttacatcatctttaccttccacttttggtggattataaacgatgtggtaagaacggccagacgcttggtgtacgcgacggccactcatacgttcaacaatcacttcgtctggcacatcaaattctaaaacaaagtcaattttaacacctgaatctttcagtgcatccgcttgtggaatagtacgagggaaaccatctaacaagaaaccatttgtgcagtcagcttgagcaatacgatcttttacaagggcaacggttaattcatctggcactaatttaccttcatccattaatgctttagcttgtttgccaagttcagtccccgctttgattgcagcacggaacatatcaccagttgaaatttgcgggataccaaatttgttcataataaattgtgcttgagtgcctttacctgcacccggtgcacctaaaagaataattttcataaaaaatctccattaatacaaaacgtgattaagatactgataaagcatagtgcggtcaaattttttataatttttaccgcacttttatactgagctggtcttattattttcttgcttcaaaggtgctacccaaaataaacaaagcatgccgggaatcgctaaaaataaacaaaaccaaaaatactgataataccccactgctcccacaacataaccagaaagtatacctaaaactttacttggcaaagctgaaaggcttgtaaaaagtgcaagctgtgttgcagtataaagaggattactctcacgtgccataaaagccacaaaagctgcggtaccaagtccaacgccgatatattctgcggcaatcacaacacctagtttccataactcggcagatgtaataacatcaaaatgaccgaaagcagacaaccaaataaacccaccaattgttaccatttgtacaagcccaaatagccacaatgcacggttaatacccagttttagcattatcataccaccagcaagcccagataaaatgcttgaccaaagtgcgttactttttacaacaatagcaatatcctctttgctaaatcccatgtcataaataaatttggtttgtaacgttgtggcaaaagaatccccgaacttatacaaaaacaaaaatagtaaaaaaccgatagcctgaatgacgcccttacgctggaaaaattcttgtaatggaatccaaaatgcttgatagaacggctgattagtttgctgcacgttgattttcggctcttttgctaaaaataatgtcatgaagatgcctgctaacatacaaagtgcggtccataaaaagacggtttcccaaggataaatcgccgccaaatatagcgataatccccctggaattaatcccgcaattcgataagcattaatatgaatagtgtttcctaaacctaattcatgatcactcaaaatttcacgacgatacgcatccaacacgatatcttgtgtagctgaaaaaaaggcgataagcaacgcaatatttgctactgtacccagttgtgtgagcggatcaaacaggctaatgatgtaaagtaaaatcaataatgccacttgtgaaagcaacatccagctacgacgacgccctaaaaaactcgggaaataacgatctaataatggtgcccacaaaaatttcaatccataaggcaacatcacacccgttactgcaccaataagctcaattgaaagatgtttatctgtcagccaaacaggcaacatttgcgacaatacaaataatggcaaaccagaattaaaacctgtgaaggcgcaaattaacatcttgcgcgtaaaaatttgagaagaaagggaatttgacataaagtgcggttaattttagttgtattttagaaatttcgcctttcaattaaaggatttttgtaaaaattaggggatttttaatcattcccctaatgtttagcattcttcttcctaaaaaagaaaaacaaatattagagaatattaatctctatacccttttggattatttttctgccagttccacgtgtcttgcatcattttttcaagaccacgttctgccacccaaccaagctcttttgcagctaaactaggatcagaatagcaagtagcaatatcgccagcgcggcgttctacaagtttatatgcaattgtaatattgttggctttttcaaaggcttttaccatatctaatacggaataaccatggcccgtaccaaggttataaatatgtaagccagcgtcattttcatgacgttgaagcgcttttaaatgccccacagctaaatccactacatgaatataatcacgcacacctgttccatcatgagtgtcgtaatcactaccaaatacagaaagttgtgctaatttaccgatagcaacttggctaatataaggtaataaattatttggaataccatttggatcttcaccaatcaagccactttcatgcgccccaactggattaaaataacgcaagatagtcatgctaaattttggttccgcttttgctgtatcgcataaaatctgctcaaccatatatttagatgtaccataaggattggttgtaccgccgacctcacaatcctctgtaattggaataatttttggatcgccgtaaaccgttgcagatgagctaaatacaaagttccaaacacccgcttttttcatttcttgaattaatacaagggtgccagcgacattgttcatgtaatattctgtcggcttttgaacactttcccctacggcttttaaccctgcaaagtgaataaccgagttaatctcattttctgcaaaaattttttgtaacaaagcacgatctaaaatatcgccttcataaaactttgcttctttgcctgtaatttgttttacacgctcaagggattttggcgatgaattgcaaagattatctaataccaccacctctttgccagcatttaataattctacaactgtgtgagaaccgatataaccggcgccacctgtcactaaaatggccataatgatttccttgttaattattgagactaaaaaattatatcactattttgtgtggtaagaatggtgattttcaataaaataaaaaacctgttgctaaaaagtattgttgtagcgagtgagataacctctcatatttagggctatgtccattagttgtgtgatataaggttatctaatcccattttcttgattttaaggcgtgttttatatcattaggtaaacgtaatatatcccagaacaaccgaaaaatcagattttggtaaattcttggtttggaatatataccaatttttttatatacaaacttcggcggaattaaaatatcttgtgtgtaatttttcttttcttctggaataaaagcaattgggttattcagtggtgataaaggaaaataattacatagaggactttctggcgaaatgcaataaatatttactccataatgtttttgtaaaaaataaagtgcatttaaatcatattccatagaatggatatcgctttgacttttattttgtgaaaaagaaggtaataatttaataatattttctttttgatgatgaaatgcgtaaggattccctttttcttgataaaaatcaatacctgttaaataaagatctttataacccattgcagtcgccactgcacacatataaacgcctgatgtaatcctcttattctcatataattcgtgatattgtaaatgagcattaaaagctcgtagttttttcaaatagcaatgaccaagatcaatttgtggcagtaatttttctaaatgctggattttctttaatgttgaatcccctaaattcagaaaagatgctaagataatatcagcatattcatatttatattcattatttttaattaattgcataaacgtatagtattgttcaaaaattacagaacaattaaaaaataccttttttattttcttgccaagaaaataatgatcttcaaaataaaattgattgcaacggaaaacatcataatctttaggtaataaactatagtcaattgattttaaacttgttccattacctgcaataatgacagactttgattgattgattgattgattgattgattgattgattgattgattgattgattgattgattgattgattgattgacatattgtaccgttcattgaataaaatagaagttatccctaaaaaataataaacattatatagatttatagaactttttactaaacgttgattataccttcctaaaattattatctaatatcagttgtactatctccgttgtatcttagcaagaaaaatttaaaaatgcttttcttgttccattcggatagaaacctaatcgcttgttttttctaccaaacaagcgtagacttaccaacaatttttagtcggggtgccgaaaggctgagatgatacccgtgaacctgaaacagttagcactgacgtaggaaactaatatgccaaaaaatccattttcttttcattccatttcttatcctttcttttttattacgcattccctttaatcattgaggcgagcaatggtgcgtattcaagatttgagtcttgcctttaatgggcaaacgttatttgagcatcttaatttaaccctgttgccgaacgaatgggtgagcttattgggcagttcaggcgtgggaaaatcgacacttttgcgactactggcgggcattgaaacgcaaggtgtggtgcaggggaaaatcctatttgaaccgaaaattcgtattgcgtggttgcctcaaaaagagaccctttatccgtggttgtcaattgtcgataacgtgcagttgcaagcggtcttatttgggcgaaaatctgcaaaaaccactgaaaaagctaaaatgttgcttgaaaaagtgggaatggcagcacattggcacaagccttgttcgcagctttcgggcgggcaaaaacagcgggttgccttggcacgcaccttaatgcaagaggcggatttgattttgcttgatgagcctttttccgctcttgatgccatcagtcgccatcaacttcaagatttagcctttgaactgctagaagataaatcagtgctgctcgtgacccacgatccgcaagaggcattacggctaagtcagcgtatttttgtgttgcgttcgcctgaatctcatcaaacagcattatcggcggtgattctgcccgaaggtaacgcccctcgtgagttgcatcaagccaatttatgggcgttgcagcaacaattattgcaggaattagggggcgaacaatgaaaattcgcctacttaaaccgcttttaattgttggcgtgttgttgatgatctggcaaatggtcgcaaccttgggcagcttcccacactacatttttccctcaccgcaagctgtagggcagcagttattcacacacgctgaactgctttggcagcatacgcaagtcacgttgttagaaatttgcttagggctgttgttaggctttctatttgggttgatttcggcgttgttgctctcattttctcgtcaaatttctgccgtcttattgccgattttggtcatttcgcaagcgattcccgtgtttgctattgcgccgttgttggtgttgtggtttggctatggaatggcatccaaaattgtgatgtcggtgctgattatctacttccccgtcacggcagcttgttatgatggactacgcaacaccccacaagcgtggctcgatttggcgaaaacctttaacatttcccccttgcgtttattgcttaaagtgcgattacctgcggctttgcctgcttttgcttcgggcttgcgaattgccgtttcggtcgccccgattggtgcggtggtaggtgaatgggtcggttcatctgaaggcttggggtatttgatgattcacgccaatgcccgaatgcaagtcgatttaatgtttgccgccttactgattttagtgtcaatttcactctgtttatatttcagcattgattggctattacaccgttttatttggtctgtttaacttttcattaaaggagaaaaaatgaagacaatcatccgttatttcagctttgtaatggggctaatgctcacgcttcctagctttgcaaaagagaaaatcagcgtaatgctagattggtatgtaaaccccgatcatgcagccatcattgtggctcaacaaaaaggcttttttgaaaaaaataacttggaggttgaaattatcgaacctgctgatcctgcattaccgccgaaattagcggcggcaggaaaagttgatttagccgtgagttatcagcctcagctttatcaacaagtggcagaaggcttacctttagtacgagtggggtcactgatttcaaatccattaaatagcgtagtggtactaaaaaagagcaatttggaaacccttgctgatttaaaaggtaaaaaagtggggtattctgtcagcggttttgaagatggattgcttgacaccatgcttcattctattggtttaagcaataaagatgtggaattagtgaatgtaaattggtcgctttcgccttctcttttaactggacaagtggatgctgtgattggtgcatttcgtaattttgaactcaatcagcttgctttagaaaagcaagaaggcgtcgcattcttccctgagcaatatggcgtgcctgcttatgatgaattgattttagttgccaataaaaacagcgtaacagataaaaaaacatccgcctttttgaccgcacttgaacaagccacaagctatctgcaagctcaccccaatgaagcgtggcaagcctttgtcagctataaaccgaacgaactcaacacgccattaaatcaactggcgtggaaagacacgctccccttcttagccaataaacctcgtcaattagacgctaaacgttatcaacaaatggcagaatttatgcaacaaaaaggcttaattccaaaagccttagcgttgaaagaatatgcggtagaaattgaataaggaaaaaagatgattgaacaactcattcaacaagcccagccttattggcaacaatatattgaacacgaatttgtgcaacagctcgcaaaaggtacgctgccaaaagcttgttttcagcattatttaaagcaagattatctctatctttttcattacagccgagcttttgccttgggcgtgtataaagcaaaaaatttcgctgaaatggaaatacctcgcaaaaccttagagatactctgccaagaaattcaactacatttaaattattgccgtgagtggggaattagtgagcaagagatttttgctactcaagaaagtcccgcttgtattgcttatacccgctatttgcttgattgcggcatgacgggcagtttggctgagctttatgcagctgtgactccttgtgctttgggttatgctcaagttgctcgttacattactcagcattatcctcgcttaccgaacaacccttatcaaacgtggattgacacttatgcgagcgaggaatttcaacaagccgcccaagaaaccgttgattttcttaccgcactttgtaaaccgctaaactcaagccagcttaccgagattcaacagatttttaccaccgccactagaatggaaattgcgttttggcaaatggggttggatttggcttaggtttagtctcagactaatgactttatttttccacaaacggataaatttattgtgattatataacccctctttgagaaagaggggggaaggaaaattatcttgttctaattttgctataagctaatgctataacaaaaaatgcagcttgcagaagaatgatacaagcacctgttgaggcatcaaaatgatagctcaatattacgccaattaggcttgatgcaatggaacttgcaatagcaacccataacattttatcaaaagatttggtaagcgtaagtgcggtaattcctggtgcaattaacattgccaccaccaaaataacacctaccacttgcatcgtgcttacaatggttaaagcaagtaatattagcaagccataatgtaaaacttttggagaaagtcctgcaacacgggcgtgacttggatcaaaacaataaagcagaaagtctttacgtttgaaaacaatcaaacaaaaaattatcgcagaaatgaccgcactttgaatcagctcttgatgacttacacccaacacattaccaaacaaaatatgggttaaatgctgttctgtttgaattttggtaaacataaccaaaccaatagcaaacattccagaaaatacaatacccattgctgtatcttcttttatacggctattttctttcaaatatcccacaccaagcgaacaaaaaatacctgagaaaaatgcaccaatggctaaaggaattcctgccaaataagcaagtacaataccaggtaatacagcgtgagaaattgcatcacccattaatgaccaacctttcaagactaaatagcaagaaagtaacgcacagataatcgaaacaatcaatgcggtcaataaggcattttgcataaactcaaattgtagcggttctaaaagccaatcaaacattttctaccgcctttttattacgagttaataagccatattttggtgaaaataagaaagcgactaaaaacaataatgtttgcaatgtcacaatcacaccgcctgtggcaccatctaaataatagctaatataaacaccaacaaaacttgtcaccgctcctaaaataatggcgatgattgacaaggttttgaatttatccgtcagtaaatatgctgttgcaccaggggtaataaccatcgcaatcactaaaatcgcccccacagtttgtaatgcagcgaccacacaagcacttaataaagtaaaaaataaaactttataaaataatggcgaaagccctaccgttcttgcttgtgtttcatcgaaaaaaatcagtagtaaatctttccaaaataataaaagtaatactaaacaaacaccgataataattgcgacttggtaaatatcgtcatcggcaatgcctaaaatattacctaaaatgatattttgcacatttactgcggttggatttaaagaaacgattaacaaacctaatgcaaagaaagtactgaaaataaaacctatcacagcatcttctttcagtttagaaatggatttaatccaaagaatggaaagtgcggctaaaattccggcaaaaaatgcaccaagtgcgtaaggcaacgcaaaagcataggcaattgcaacaccgggcacgacagaatgggaaagcgcatcgccaattagagaccagcctttaagcattaaatatgaagacaaaaaagcacaaatgccacccactgcggtactcaaaatcatcgccttgagcatataatcataggaaaaaggttcgagcaataaatctaacattacctaatccctcttatttttaaccgcacttttataaggacaatcttcaaaatgacaattttgtgttgttggcgcaggtggatcttgcttagtttcgccatagaatacaacggctttttcatcatctgttaagacagtaacagaacgtttatcttcatcattatgtaaattttcgcccaataatttaatatgacgtaataccccaccaaatacaatttccaaattatgttggttaaaggtgttttctgtttttcctgcggcgataactgtgcgattaatcattaccacttgatcacaaaaatcaggaacagaacctaagttatgggttgaaacaagaataagatgaccttcttctcgaagctgttgaagaagatcaacaatggcattttcagttttcacatcaacgccagtaaaaggttcatctaataaaataatgggactttgttgtgctaaagcgcgggctaaaaacacgcgttttttctgcccgccagataactcgccaatttgacgatgcgcaagatgttcaatatttactcgctgcatcgcctcttgaactttttgtttatcaatcgctttggggatacgaagaaaattcatatacccataacgtcccatcatcacgacatcatacactgatactggaaattgccagtccacttcttctgattgtggtacataagcaaccaaattacgtttcagtgcttgggaaattggcaaatcacaaagtttaatttcgccttgttgtggctttacaagccccattatgcttttaaataatgtggacttgccacttccattcacgccaactaacgcacaaatagttccactattgagtgagaacgtcatattgtgaatagcagtatgaccattgttgtaacgaacagttacatcattaacccaaattgatgtcgagaaagagtccattattttccgaatcctttaacaatggttgatacagtgacgttaagcaaatcaatataagttggcacagggccgtttttcgcagaaagtgaatcaacgtacaatacgccaccgtattttgcaccactttctttagctacttgttgtgcaggtttcgctgaaattgtactttcactaaacacaactggaatattgtttttacgaactaaatcaatcactttacgcacttgttgtggtgtgccttgttgttctgcattgattggccataaataaccttcttttaagttgtaatctttcgccaaataactgaaagcaccttcacttgttacaagccagcgttgcgcttctggaatttgtgctaattttgcacgaagcggttcatcaagttgtttaattttttgagcatagtcagcggcatttttttcatacacagctgcattttgtggatcgtatttcactaacgcattcttaatattttcaatataaattaaagcattagatggcgacatccaagcgtgtggattaggcgcatctttatacgggccttcataaatagataatggttgaataccttctgttactaccacagcaggtttatctttaacattttggaagaaacgctcaaaccaacgttccaaatttaagccgttccataaaattaaatcggcagattgtgcttttacaatgtcttttggcgttggttcatattcgtgaatttcagcacctggtttggtaatagattccactgttgctgcattgcctgccacattttgcgcaatatcttgaatcacggtaaaagtggttacgactttaaattttgcgttagcttgcattgcaaataaaccaagtgcaagtgcggtcataattttgaatgaatttcgcataagatgtccttatttaaaaaagatagattgaatgcctgaataatcgttcaacagcacaacaattattcatcggaaataatagtactactttttatgttgttttggaatggaaatgattatcaaaataataggtttatttataattatttcgtacaaaatgtattgcttttatgaaaaaagcataaaacaaagaattttcttaatcatacaagcaataaaggtattttctgtcattagaatgactttttatcaaattaagtctagaatattgaaattattatagatttaccatttgaggataagatatgaaaaaagcattttggttagtattaagttcagcaatagtcttggctgcttgtgatgataaacctaaaatgacggagcaaactaaaacaactgaccaagcgaaaatggctgcagaacaacctgatcaaaagcccgtattgatcaattataaacaaattgccttagacaaatcccagcaagcgattgatacagcgaaagtcgctcaagacaaatcagttcaagctaatgaagccgtgaaagtagcaatgcaaaaacaacaagaggctgaaattgcgctaagtcaaggtggcgaagaggctgaaaaattgtctaaacaaaaaatggacgaatctaatgcagctgcagaattagctttaaaattgtcggaagaatccaaagctgcttctgcactttcaatccaactttccaaagaagcggaagatgcggctaataaggcgaatcaacaagctcaagctgagaaatagcgtaagatttattcttctaatttctatttaaatcaactaaaaaacgcgagataaaacaactcttatctcgcgttttttgtgtttatgaacattatcttgataatttctgaattagcgtattaaatcccacttcatcatagccatcttcatattgagcttctccagctacatcacgaattgttcttccatttaatgctgtgcagccgaatttttctaatttgcttttagtaaaactagaacgatacgcagaggaagtgttatttaaactaattacgccaatagttgcatttttgcataggtgtttattaatgaaaacgagattataaccagattctcgaatgtagcccgttttattcactgccgcatcaaagatttcatcacgcactaacttattagtatttttaatataaagtttatgtttcccagcttgaatataagttgcactaagattagataaaagtttaatgtccgatttatttaatgaatatttagcgagtttaaccaaatccatcgggctggaaatattgtagctagataaccctgaactatcgtgaaaacgagtagaatacataccaagttgatgggctttttcgttcattttattaataaattggcgacgacttattcccgctgcacgagaaagcgcgtgggcagcatagttatcagaatggacaagcattgctttcaataattcgttacaagagataggaatatttttaggtaattttgttcctgtacctttaattcgatccgtatcctcttttgtgattgcgattcgacaattaggatttttattattctctaaaaatacattagccgtcattaattttgttacagaggcaataggctgaatactatcaggcgcatagctttccaatactcgattatgggtaaaatcatacacaacataagactgtgccagcaaaaaagaaggacacaaagataaaataaataaagcttttttaaacattattggacaccttaaaaaatgagctcacattttaccgcactttttacgctgtaattggaaatatttgcgatctagatcgcaaaaaagtgcggtaagattttccatcgtttttcaattccgctagattatgcaatgacaaatctgtacaatcgccgttcattttttaattgcgaatttttcgttgtgagtttttgataaaacacctgcacaacgctatcgccacaatgtgtaataacgaggctaaaatgtcagaattattgtctgtgcaatcagatgcacccgctaaaaaaattaatctaatggatttaacgcgccaacaaatgcgcgaattttttaaagaactcggcgaaaaaccattccgagcagatcagttagtaaaatggatttatcattttggcgaagataacttcgacaatatgacaaacattaataaaaaattacgtgaaaaacttaaagcggttgcagaaattaaagccccagaagttgccgttgaacagcgttcagccgatggcacgataaaatgggcaatgcaagtgggcgagcagcaagttgaaactgtgtatattcccgaagcagatcgcgcgacgctttgtgtatcttcccaagttggctgtgccttagcttgtacattttgttcaacagcacaacaaggatttaatcgcaatttaacggtttcagaaattatcggtcaagtatggcgagcctctaaaattattggtaactttggcgtaactggcgttagacccattacaaatgtggtaatgatgggaatgggcgaacccttattaaatgtcgcaaacgttgttcctgcaatggaaattatgttagatgactttgcttacggtttatcaaaacgtcgtgtcactttatcaacttctggggttgtgccagcactagataatttgagcaaaatgatcgatgtggcactggcaatttcattacatgcaccaaatgatgaattacgtgatgaaattgtgccaatcaacaaaaaatataatatcaaaaccttgattgactcagtaaatcgttatttaaatgtatcaaatgcaaaccacggcaaagtgacgattgagtatgtgatgctcgatcatgtaaatgatggcattgaacacgctcatcaacttgcagaagtattaaaaaatacaccttgtaaaattaatttaattccgtggaatccgttcccagaggcaccttatgcaaaaagctcgaatacgcgtatcgaccgcttccaaaaaacattaatggaatatggctttaccgtgattatccgtaaaacccgtggcgatgatattgatgcggcttgcggacagctagctggagatgtgatcgatcgtactaaacgtacggcaatgaaacgccaatttggacaaaatattggggtaacagaagttaattaatattctaggcatgtgaattaatcaagttcacatgccctatgttttcatacaaattaaagcatattaaatatttcgactgcccctgttaaaaggagaaaaatgcaaacaataagtaaacaactaagtgcggttattttccctttcattttttctgcctgcgtttcacaatctgcgtctagcttagatcatcaagctgccgccaaagcgcgagtggaactcgctttgagctatcttcagcaaaataatcctcaactggctaaaatcaatttagacaaagcacttcaacacgataaaaattactatctcgtacattcagcacttgcacattattatcaacaacaagggcaaatagaaaatgcctttcgtgagtatgaaatagccgtaaaacttaatcataaacaaggcgatgtacataataattttggtacgtttctatgtagtcaaaagaaatttgagcaagcccagcaacaatttgaattagcccttaattcgccgaattattatcatcaagcagatacatttgaaaatatcgcgctttgtgcttattccgcgaaaaaaatggatatttatcagcaaacattagaaaaattacgtcaaatcaatggaaaacgtgcggaaaaattcaatagtctaaaataaagcattgccaaatcaagtattggactttaaaatttagcccttatttaccgcctaattatttgattaactttatgaatccaactactgagcaagtgctttctcctggtgagatttttcgtcaaacacgcgaagccttaaatctttctcttgaagatgtcgctaaagaaatcacgctacgcccttctatattagagcaacttgaaaataatgaatttattcaaaaatcaacgccttctatatttgtcaaaggttatgttcgcagctatgcaaaattcttacgtttgccagattctgtgtgggaaaatattgtttttgctgaaaccgaaaaaaatgatttagggaaaaatgcacgttcaacccgtgccgttaatcaatattcttctcacaatcgttggatcgggcgtttaaccgcaatagtattcgtgatggtaattggtatgactgggctttggtggtggcaaagttatcaacaaaatactcaagaacgcgatgatttagtgcaaagctatgttgcctctaccgaaaacaatcagcccaccaccgctcttgtgacaacagaagaaactaataaatctgcaccagaaacagcagcaccagtctcacaaccagtagaaataacaaataatctgttaccagaaatagcacaagaaaatagcgtttcacaacccaaaaacgatgaaaaatcagtttcagacattcaaagtgcggtcgaaaatccaagtatttctccaacgttacctatagcaaaaggcgatttagtgattgaaatactagcaaatagcagttggattagtgtaaaagataacgctcgccacgtattagcacaaaaagaatataaacaaggcgaaatattaacctttaatggcaatgaattttcattaattgtaggcgcaccaagcaatgtgcgtatcacttacaaaggcgagaattatcctctcaaagtggatggtcgcgtagcaaaattcaagctttcacaaccttaggaaaaataatgtcagcttttcagccaactattaagcgtcgtgaatcgacaaaaatttatgtgggaaatgtaccaattggtggggatgcaccgattgccgtgcaatcaatgacaaatactcgcaccactgatgtggaagcgacagttgctcaaattaaatcattagaacgtgttggtgcagatattgttcgtgtatctgttccaacaatggatgctgcggaagcatttaaacaaattaaacaacaagtgaatgtcccgctcgtagcagatattcattttgactatcgtattgcgttaaaagtcgcagaatatggagtggattgtttacgtatcaatcctggcaacattggtcgtgaagatcgcgtccgtgccgttgttgattgtgcgcaagacaaaaatattccgattcgtattggtgtaaatgcaggctctttagaaaaagatttgcaagaaaaatatggcgaaccaacgccagaagccttgttagaatccgcattgcgtcatgtagaaattctagatcgtcttaacttcgatcagtttaaagtgagcgtaaaagcctccgatgtattcttagcggttgaatcttatcgtttactggctaaagcaattaaacagcctttacatttaggcattacagaagcaggtggcgcacgcgctggcgcagtaaaatctgcggtgggtttaggaatgttattagctgagggcattggtgatacactgcgcatctctttggcggcagatcccatagaggaaatcaaagtcggttttgatattttgaaatctttacggattcgttcaagaggaattaactttattgcttgcccaacctgttctcgccaagaatttgatgtaatcggtacagtaaatgcgctagaacaacgccttgaagatattattacaccaatggatgtatctattatcggttgtgtagtgaatggtcctggcgaggcactcatctccgatctcggcgtaacgggcggtaacaaaaaaagcggttattatcttgacggcgaacgccaaaaagagcgttttgataacgaagatatagtgaaccaattagaagcaaaaattcgtgcgaaagtcgcacgacaagatccaaaaaacagaattatttaaggaaagcgcgtggcaaaaacaattcaagcaattcgtggtatgaacgattgcgccccaacagaatctccattatggcaatggattgaagcacaagtacgcaatgtattaaatagttatggctattcggaagtgcgtatgccaattgtagaaagtacgccattgtttgcgcgtgcaatcggcgaagtaactgatgttgtctcaaaagaaatgtacaccttttgggataacgatgaacaattaaccttacgccctgaaggcacagcaggttgtgtgcgagcagccattgaacacggttggatctataataatgaacaacgcttatggtatatcgggccaatgttccgtcacgaacgtccacaaaaagggcgttaccgtcaattccatcaagtaggtgttgaggtattcggtattgcgaatccagaaatcgatgccgaattaatcatgcttacctatcgtttatggaaagcgttaggtatcgatcaacatgttacacttcaacttaactcaattggttctttagaagctcgagcaaattatcgttcagctttagttggattcttagaaaaccatcaagatttaatgagcgatgaagaaaaagagcgtttagtaagaaatccgcttcgtattttggatacaaaaaatccagaattacaaaaagtattagataacgcgcctaaattacttgattatttagatgatgaaagccgtgcgcattttgaacaattatgttcattattagatgctgttggtattcaatatgaaattaatcctaaactcgttcgtggtttagattattacaacaaaactgtatttgaatgggtaacctccgctcttggtgcacaaggtaccgtgtgtggtggcggtcgttatgacggtttagtggaacaacttggcggacacgcaacgccaagtatcggatttgcgatgggattagagcgtttagtcttgttggtacaagaagttaatccaaatgttcctacgaaaagtgcggtggatatttatgttgtttatcaaggcgaaggcgcaacattagtcgcttttgaattagcggaaaaagtacgctcggaattaccgcacttaaataccatgttgcactgctctggcggtaattttaaaaaacaatttaaacgtgcagataaatctggtgcaacattggcattagttatcggcgaaagcgaagtacaaaataaacaagtcgttgttaaacacttacaaggtggcacagatcagcaaaccttagatttagtgaatataatcgactatcttcaaactcaattttaatttaaaaggggaaaaacatggcttattccattgaagaagaacaagagattaaccagttaaaagactggtggaaagagaatggcaaaacaattattgtcgcttttatcttaggtgtgggtggtatgtttggatggcgttattggcaatcgcaccaagcagaacaaatcgctcaagcttctgcacaatacgatactttaattaattctgtgcaacaagacgaacaggctaaaaaagcaaatatagaacaatttgtgcaagcgaatagcaaaactgcatacgctgtatttgctttgttagatgaagcgaaaaaagccactcaaaaacaagatttttcagcagcagaagcaaatttaaaccaagcattaacccaatctcaagatgaagtattaacatctattgttgcattacgtctcagtgcagtacaatttcaattgggtcaattagacaatgctttaaccaccttaaaccaagtgaaaggcgaaagttttaatgctcgcaaagcgattttaacgggcgatatccaagttgcaaaaggagataaagttgcggcgaaaaacagctttgagcaagcacaacaaagtggtagccaattagaacaacaaatggcaaaaatgaaattaaacaacctttaaaaaataatacccgcatcaaagtgcgggtattttttcaatcaaatttctgattattcaaattcatccagccattttaataaaatagcctcaagaattgattcatttgatttattcggatcgtcatcaaaatcttcaagttcacaaatccatttatgtaaatcagtaaaacgaactgtttttggatctaaatctggattacgatcgtaaagttcttctgcaattaattgggcgtctgtccatttcattagtgagccgcctcatttgcgtgattaaggttatattttggaatttctaccacaagatcttcatttcccacgacgcattgacaagataaacggctatccatttctaatccccaagccttatctagcatatcttcttcttgatcactcgtttcatttaaagaatcaaacccctcacgaacaatcacgtggcaagttgtacaagcacaagaaccatcacaagcgtgatgaatttctactcccgcattgtgagcaacttctaataagttatctcctgttgcagcatcaacgaccataccttcaggacaaaaatcttcattaggtaaaaaaatcacttttggcataatactttcctcaaaattatttaatatctgactgcagttttacggattttcaatgtctgacagatttttacctgtcaaagctttattaattgatgcattcattcggcgagcagcaaattcttgggtagcagtgtctaaggctttaattccttgcgcaattgcatcgcgatctgaaccttgttttacatccattaattgttttaacacagtttcaatatgatgaaattcatctgtgctaagcaattcagccccatctgcttgtagtgcaacaatcacgctttcaataacacgatctgcttccacacgctgctctgccaattcacgtgcttgtaaatcttcttgtgcattatcaaaagaagatttaatcattgcggttacttcttcatcagttaatccataagatggtttaatttgtattgaagcctgtacttttgtcgatttttccatcgctgtaacgcttaataaaccatctgcatccacttgataagtcactctaatatgggctgcccccgccgccattggcggaatacctcgtagagtaaagcgtcctaaagaacgacaatcatcgactagctctcgttcgccttgtagcacatgaacactcattgccgtttgcccatctttaaaagtagtaaactcttgcgcacgagccacaggaattgttgtattacgtggaataattttttccactaatccgcccatcgtctcaatgcctaaggaaagcgggacaacatcaagtaataacatatcagaatcagttttattcccgactaaaatatctgcttgaattgcagcaccaagtgccacaactttatcaggatcgattgaggttaatggtgttttaccaaaaaactcgccaacttgttctcttacataaggcacgcgagttgaaccaccaaccattactacggcttgtacttcttcggattccacattggcatctttcaatgcccgacgacaagttagcaatgaacgttttacaagcggataaattaattcattgaattgttcccgcgaaatctctactgaaaaatcttgccaagaaataaccgcacttttttcattagtcaaggtaattttagcttggttggcaagggttattagctcacgctgttgatttgctgtttgtggttttagcttagtttgttctattacccaatctgcaattaaatgatcaaaatcatctccacctaatgcagtgtctccccccgttgctaaaacttcaaagataccttttgataaacgtaaaattgaaatatcaaatgtgccaccgcctaaatcataaaccgcaataatgccttcttgcccactatccaatccataagcaagtgcagctgcagtaggttcattcaataaacgtaatacatttagcccagctaaacgcgcagcatctttagtgctttgacgttgagcatcatcgaaataagctggaactgtaatcacaaccccagaaagctcacctccaaggcgttgttctgcaatgtgatttaagcgcgataaaatatctgaagacacttcaattggacttttaggcccctgtgccgtaataattaaaggtaatccattttcactcgccacaaattcataaggcaaactagaataacgagactgaacatcaggaaggctgcgaccaattaagcgttttactgaaatcaccgtattttttggatcaagtgaggcttgctcaaaggcttctaaaccaactttcttctcttcaacgccataatgaacaactgacggcacaagactgcgttcttgttcatcattaagaatcacggattgcccactacgcacggatgcaaccaaagaattggttgttcccaaatcaatcccaacggctaaacgatgttgatgcggtgccgcagcttgtcctggttctgcaatttgtaataatgccatatgctatttttctactagttatgcgacggaatacgccaaatcaaatttatttttttctgcaaagtttgcttggtaatgggtttcaatattgacttcctgtttttgacgttcatcaattgctatttttctgtcttggtttaaatcaggcgtaaatacaaaaacttggttaccatctaattgttttacatcatcttgccaatttttccaaaatagcccttgataaaaggcctctacatcgccattcaatgcccaagctaaaaattctgtgtaagtaaaatttaaattatgccaagtaagatcttttgatgaatagtaataaatttttccaatattattgcctaacgaaccaccatttaacgcaaaataaccaccaatcacatcatctgcaactaataaatattttggtttttcgcctgactcactaaaagatttactgaaattccaatccatcaagccacgcggtaatttaaaacttccagaacctaaaatacgtaaccaaccataatgaattaaaattccacctgtttcatagattactgcacccattggcgaggatgttggcatttgcatagtaaaaagctcacgctccgcactggattgatcttttttaattacttcacaatgattgcgagcgttatcaatccattgggaaagggttatccaagcagaatgttctggactagtgagctgttcaagagtttgcatagtgttatttattcacatctcgtaggggcaaattacatttgcccccagatttaatctaattcaaaaattcgttcttccacacgttcaatttcttcagaaagtttatgggtaaaacgtaatttatcacagtattgagatgctctcgcccattgttgagatttcaaactctcaaaaagtgcggtcaataatgattgagtttcttgtttaatttctttcgcaaaaacatttaatgctctttcatcttgctggctttcaacatcttctaattgttcgcgccattgtaattgttgcattaaaaacgccacatcttgcgtgcttttttgttcaagatctaactgctcaccagtattaagagcaatgatcgcttcagctcgcaaaattgggtcttttaacgtttttaaggcatcattcacttcggtagatttttgcatcgcaacacgttgctctaaagcactacttgagacaaaattatctggatgtagggccttttgtaattttaaataacgtgcatttagtactttttcatccagctgaaaatcaactggcaaatcaaaaatttgaaaaggattgaacatcagattattaccttaaacgtggaaactttcgccacaaccacaagattcttttacatttggattattatatttaaagccttcatttaggccttcttttacataatccagctcaatgccattgagataaacgagactttttggatcgacaataatattaacaccgtgctgctcaaaaacttgatcttcggaatttaaaacatctacaaactcaagtacataagctaagcctgaacaacctgatgttttcacacctaaacgtaatccaatacctttaccacgattatccaaaaaggctttcactcgctgagctgctttttctgttaatgtaatacccatctatcccccaaacaccgctaaaaatgcggtcaaaattgaccgcactttttcacatgattagccttgttttgctttataatcagcaattgctgctttaattgcatcttctgctaaaatagagcaatgcactttcactggcggcaattctaattcttcagcaatttggctatttttaattgccccagcttcttctaaagatttaccttttacccactcagtaattaatgaactagatgcaatcgcagaaccacagccgtaagttttgaattttgcatcttcaataatgccattatcatctaccttgatttgtagttgcataacatcaccacaagctggcgcaccgaccattccagtaccaacattgctatcttttttatccaatgatcccacattacgtggattttcataatgatcaattactttttcgctataagccattttaactttccttttttcaattctagtaaatgccattgtcagataatggcaactaaatattagtgagctgaccactcaatggtatttaaatcaataccttctttaaacatatcccataatggcgataatgcacgaagtttttctaccgcacccttcattaaattaattgtgtaatcaatttcttcttcagtagtataacgacctaatgtgaaacgaattgaactgtgcgccaattcatcatttaagccaagtgcgcgcaatacataagatggctctaagctagcagatgtacaagcagaaccagaagagacagcaatatcgcgcaacgccatcattaaggactctccctcaacatagttaaaactaatatttaaattgctatctaaacgatgttccattgaaccatttacataagtttcttcaatatcttttaagccattatataaacgatcacgaagtgcttttaaacgcggcatttctgatgccatttcttcttttgcaattcgatatgcctctcccattcctacgatttgatgaacaggtaatgtacctgaacgcatgccacgttcgtgaccaccaccatgaataatcgcctctaaacgtatgcgaggtttacgacgaacatacaatgcgccaacaccttttggcccgtaaagtttatggctagacatcgacattaaatcaacagctaattcttccaaattaatttcaactttaccaacactttgagttgcatccacatggaaaattgttttatttgcacgacaaagttcgccaatagctttaatatcttgtaacacaccaatttcattattagcgtgcataattgaagctagaattgtatctggacgaagcgcagctttgaatttttctaaatcaattaaaccatcagcttctggagacaaataagtgacttcaaaaccttctctttctaattgacggcaagtatctaacactgctttatgttcagttttacaggtaataatgtgtttacctttagtttgatagaaatgcgccgcacctttaattgcgaggttgtcagattctgtcgcaccagaagtaaagacaatttcacgagaatctgagccaatgagatcagcgatttgattacgcgcaatatcaacagcttcttctgcttgccaaccaaatttatgtgagcgagaggctggattgccaaatgtgccatcgatggttagaaacgccatcatttttttcgcaacacgttcatcgactggacaggtcgctgcgtagtctaaataaataggtaatttcattttcactcctaaattatgctaaatataaccgcacttttttattaaaaaatatactgcttatcctttttattgattaactaataaattactaaaatcacgatgagattgacgttttacattacgcttatttaccagctctgctaacgtaatctcatttaaaaaactttcaatacgtaaacttaaatcttcccaaagttcgtgagttaaacattccacaccatttttacaattttcacgccccagacatttcgttacgtgaatattttcatttactgccgcaataatcattcctacagaaatttgttcacttggtagccctaactgataaccacctcctggcccgcgaacacttttgactaaaccgtctttacgtaatttagcaaaaagttgctctaaataagataaggaaatatgttggcgttcagaaatatccgcaaggcttacaggcccgccatctgcatttaaagcaatatctaaaacggctgtaactgcataacgacctttcgatgtaagtttcataaagaatccctaaaaattaattgcgcaatacttacatatctgactaatttagtcaattattctcttttgttaaatcaattcgtttttcaaccgcacttagcataccatttaaaatatttaattcgtttttctctaattttgcacgatagtataaacgctttaatttacgcataactccttgattttgaataaatccaagagactgatatatacgttctgtgtagtcaaaaaaataagctaactgatctgttgttggatagtttttctctattaaagaaagtgaatttttcttattattttgaactaagaaagccatacgcaattcataacttaccagttgcacagccattgctaaatttaaagaagaataatcaggattcgctggaatattcaagtgataatgacatttcagcagttcttcattggttaatccaatacgctcacgaccaaacacaatagctatcttgcctttatacgctacaactttctccgcgcattctcgaggctcgatcaatgtattttgtaaatgacgtaagcgagcacttgttccaattaccaaagagcaatcatcgacggcttcatcaaaactatcgacaaccctagcattttttacaatattttctgcgccagctgaaagggcataagattgttcatcaacagatttaggtgaaacaagacaaagctgggtcaatcccatcgttttcattgctctagccgcagaaccaatattaccactgtgcgaagtttcaattaaaacaatacgaatattttccaacataatgatgcccgactaaaatttaagggtattctaccacaataaccgctaaaaatagtcaagaatttaagcaaattaaagaaacttaaaatattagagatgaataataaaaatggtgggttgtgagagactcgaactctcgactgacggattaagagtccgctactctaccaactgagctaacaacccaactggacaactaaatcagagagtggtgggtcgtgaaggattcgaaccttcgaccaacggattaaaagtccgctgctctaccgactgagctaacgacccactgtactaatggatttatgataacgcatttgctctagaatcgaaagaataaattcattcgttcaagctaattggttaaattacaaacgatgaaaacaaaacagaatccaataaaaaatggatcctgtttttcaagtattagaaatactaagaattagtacgctaacactgcacgacggtttttagaatatgcagcttcatcatgacctaatactgcaggtttttcttcaccgtaagatactgtgcctaatttaccagcatcaacacctttaccagctaaataacctttaactgcatctgcacgacgttggcctaatgcgatgttgtattctggtgtaccacgttcatcagtgttaccttctactaatactttagcagctggcgttgcatttaaatatgcagcgtgcgcatctaagatttgaacgtattcaccagtaatgtcatatttatcaaaaccgaaataaacggtattgtaacgttgttgaagatcagcaacagagtaaccgccaaaagtttgagcagcaccattgcctgcagcatcgttgttagatgaactacaagctgctaatgcagctacagaacctgcaactaataatgatttaacaaatttgttcattagatttctcctaaatgagttttttatttagttaagtatggagaccaagctggaaatttaacttgaccatcacttcctggaaggctcgccttaaagcgaccatctgcagaaaccaattgtagcacctttcctaagccctgtgtagaactataaataatcataattccatttggagagaggcttggactttcgcctagaaaagatgtactaagtacctctgaaacgcccgttgtgagatcttgtttaactacattattgttaccattaatcatcacaagtgtttttccatctgcactaatttgcgcgctgccgcgaccacccactgctgttgcactacctccgcttgcatccattcgataaacttgtggcgaaccacttctatcggatgtaaataaaattgaatttccgtctggcgaccacgctggttcagtattattacccgcaccactcgtcaattgagtaggtgtaccgccatttgctcccataacgtaaatattcagaacaccatcacgagaagaagcaaaagctaaacgagaaccatctggcgaaaaggctggtgcgccattatgcccttgaaaagatgccactactttacgtgcgccagaatttaaatcctgtacaacaagttgtgattttttattttcaaacgatacataagccaaacgctggccgtctggagaccaagctggagacataattggttgggcactacgattgacgataaattgattatagccatcataatctgctacacgaacttcataaggttgcgaaccgccatttttttgcacaacataagcgatacgagttctaaaggcaccacggatcgcagttaatttttcaaaaacttcatcactcacagtatgcgctccatagcgtaaccatttatttgtcactgtatagctattttgcattaatacagcccctggcgtacctgatgcaccaaccgtatcaattaattgataagtaatactataaccattacccgatggaaccacttgtccaattacaattgcgtcaattccaatattcgaccaagcctcaggatttacctctgctgctgaagttgggcgttgaggcatttgagacaccgcaataggattaaacttaccactgttacgtaaatcatctgcaactattttgctaatatcttctggtgcagaaccaacaaatggcacgacagcaatagggcgcgcaccatcaaccccttcatcaatgacaatgcgtacttcatcgccagcgaatgcattgcttccaacagcaagtacaatcgcaaatacgctcactaaacgttttaataatttcattttgttacctttaaaatttaacaataaatttttctaaagaattatcgaatatcaaagtcaataattggtgatttatatttttcataaatttcatctgatggcgcagctggaacttttttcgttctagccaccgcacttaatgcagctgaacaaatatcatcagagcctgaaattttttgataccccaagattgtgccatctcgacctaattgaattttaatacgacaaacctttcctgcaaaatttggatcttttaagaaacgacgttgaatctctttcttaattacacctgcgtattgatccccaaccttaccaccatcgccagagccaagtgcagcaccgctaccttgagttccacctttatttgtgtttccccctttagatgcactaccgccaccaacatctccgccgttaaagaaatcatctaggcttgcttgatctgctttacgttttgcttccgcagcagcttttgcctcagcagcggctttcgctttagcttctgcatcagcttttgcttttgcctcagctgctgctttcgcttttgcctccgcttcagcctttgcttttgcctcagctgctgctttcgcttttgcctccgcttcagcctttgctttagcttcagcagcggcttttgccttagcttccgcttctagtttcgccttagtttctgcctcttgttttgctttttgagcagcaatttctgctgctttcgctttagcctcttcttcagcttgttttgccgcagcagctaaacgtttagcctctgcatctgcttttaattttgcagcttcagccgcttgtttagccctagcctcttcagcttgcttctgtttttccaacgcttcttgacgagcttgctcttgttgtttttttatttcttgctgacgttgctgttcttgctgacgttttaactcttcttgtcgttgaacttcttgttgatgcttaatctcttcttgtcgttgaacttcttgttgatgcttaatctcttcttgattaggctcaggtggtttttcttccacaacaggttctgggcgtttttgtttatccgcttgcccttttttttgttgttgaatacgcccccattcctgagcagccgtaccagtatcaacaatcactgcccctattacatctccttcaccttctccaccacccataatttcaacggtgtgataaagcgaacttaaaatcaataagccaaacaagataaagtgcaaaaggatagaaatagcaaaagcattgattcctttcttttgtcgattattttgcacgtgttacctacttagctaaatgggatttgtcattaaacctacagatttaatgcctgcaagatgaagtaaattcaatgccttaatcacttcttcataaggcacttctttagctccgcctactaaaaatagtgtattattatccttatcaaattcctgtctagataattgagtaaccatttcttctgttaaaccttcttgacgttctccgccaatagaaatcgcatattttccaatgcctgccacttcaagaatgacgggcactttatcttcattagaaacctcttggctttgcacagaatcaggcaattcaacttgaacgctttgactaataataggggcggttgccataaaaattaacactaaaactaaaagcacatctaaaaaaggcacaatattaatttcagatttaattgctttacgctgacgacgagccatatattcctctaaaattttaacttatttttaccgcactttttcttcaaagtgcggtcaattttccctatttttagtgaggggctttaccaaaggcttgacggtgtaaaatcgtcgtaaattcatcaataaaattaccgtaatcttgttcaatggcattcactcgtaagcttaaacggttataagccattactgcaggaattgcggcaaataaaccaatcgcagtggcaatcaacgcttcggcgatacctggtgctaccatctgtaacgttgcttgttttgcaccacttaatgccataaaagcgtgcataattccccaaacagtgccgaataaaccaatataagggctaacagatgccactgtggctaaaaatggaactcggttttccaaactttcaatctcacggttcatcgcaagattcatcgcacgcattgtgcctttaataatcgcttcaggtgcgtctggatttacttgttttaaacgtgaaaattctttaaatcccacgcaaaaaatttgttcgctgcccgttaatccatcgcgacgattagatagcccttcataaagtttatttaaatcttctcctgaccagaaacgatcttcaaacgtacgcgcttcttttaaggcattcgttaaaatacggctacgttgaataataattgcccaagatatgattgagaaagaaatcaaaatcacaattaccagttgcacaacaatacttgcttttagaaaaagatctaaaaaattcaattctgcagtcattgcatactccgaaaaattattttaagtgatgaaacgccgctttaacttctttgggaaacgccacaggtttcatcttgcctagatcaacacaggctaccttaacagtagcctttgataacatcagggtgttgcgcatcagtctctgttcaaaaaggattgtagccccttttacttctgaaacctctgtttccaccataagtaaatcatccaattttgctgccacgcaataatcaatggcgagcgttttgacaacaaatgcgagttgttgttcctctagtaaggtttgttgcgtaaaatttaatgtacgcaaatattctgttcttgctcgttcaaaaaaatgcaaatagcgagcgtgatacactacgccacctgcatcagtatcttcataatacacacgaacaggaaaagaaaagcaattatccaacatattctcacccaattggtcgcaataaaccctgtattctagaaccagtttttgggataagcaagctatctatgaaaaactcaataagattttattcattttaaaacatctaaaatttttaccgcacttttagtctgactagcaaaagataaggtaatgacaaatcatttttaacctttctcattgagcaaaatctattcaaaacataaccgttctttaaaaatagcctctatgtaatcttaagccaccagtatttttattcttgatatttagtgtttctatgcgacaatctttgcggttatttactttaaaaatatgttttactaaatggattacgaaaatcaaattgccaatattttctcactaaatggcgaattaagccaaaatatcaaaggttttcgtcctcgagctgaacaacttgaaatggcacatgctgtaggtaaagcaattcaaaataaatcttctcttgttattgaagctggaacgggtacaggaaaaacctttgcatatctcgcgccagctttagtttttggtaaaaaaaccattatttctacaggatctaaaaatcttcaagatcagctttttaatcgagatcttcctgctattaaaaaagcccttaatttcacgggaaaaattgcgttgctaaaaggtcgggcaaactatctttgtttagagcgtttagatcaagtgattgctcaaggtgtgcttggagataagtctgttttagctgaattaagtaaagtacgaaaatggaataatagtactaaaacaggcgatttcacagaatgtatcgagcttgcagaagatagcccaattattcctcaactgacgagtacagctgaaagttgtttaggcaccgattgccctaattattcagaatgttatgtagcaagtgcgcgtaaaaaagcattaaatgctgatttggttgtagttaatcatcatttattttttgctgatatggctgtgaaagaaagtggttttggcgaacttattccaaatgcagaagtgattatttttgacgaagctcatcagctgccagatattgccagtcagtattttggtcaatctttaacatcacgccagctttttgatttatgcaaggatattaatattgtctatcgcacagaacttaaagatatgcagcagcttggcacaacatctgataccttactgaaagtggtacaagattttcgtttattactgggtaatgggagtaatgttcgaggaaattggcgtgagctttacaagcaaagtgcggtgaaaaaatcctttgaattattacaagagaaaatagattttttagctgaggtaattaaattagcacttggtcgttcccaaactttagacagtatttttgagcgtgttgagtccattaaaatccaactcaaacgtttatctgaaacaaatattgtgggttattgttattggtatgaaggaaatggtcgccagtttggtttacatattacgccattgacggtagccgataaatttggtgctcagctcgaagcgaaagaagccgcttggatattcacatctgcgacattagaagtggggggaacttttaatcatttctgccaacgtttaggcattgaaaatgcgacacaaaaaattttatatagtccctttaattattctgagcagtctttgctttgtgtgcctcgatatttgccgaatactaatcaagtgaatacattaaattcactaggcgaaatgttattacccgtgattgaagcaaacaaagggcgttgctttgttctttgcacttcttattcaatgatgcgtggtttagctgaatatttccgtgaaaaaagtcatctttcgattttattacaaggcgaaacctcaaaaggcaaattactcgaacaatttataaaagaaacgcatagcgttttggtggcaacttctagcttttgggaaggtgtagatgtacgcggagatgcactttctttagtgattattgataaacttccctttaccgcaccagatgaacctttgttgaaagctcgcattgaggattgtcgtttacaaggtggcgatccattcaatgatattcaaattcctgaagcggtaattaccttgaaacaaggcgttggacgtttaattcgtgatgttacagatcgtggcgttgtgattatttgtgataatcgattagtgatgcgcaattatggcgaaacttttttgaaaagtttacctaactcaagtcgtacccgtgatctcaacaaagtgatacaattcttacaaaataagtaaacgagaataagaatgcaaaatttaactttattggcgttggacacctctactgaagcctgttctgtcgctttattgtatcgtggtgagaaaacacatattaatgaacttgcccaacgtacacacactaaacgaattttacctatgatcgatgaaattttggtaaattcgggtttaggtttaaatcaagttaatgctttagcttttgggcgtgggcctggtagttttactggtgttcgtgttggtgctgggattgcacaaggtttagcgtttggtgcggatttgcctgtcattccaatttcaaatttaaccgcaatggctcaggcagcatttgaattacatcaagcagaaaatgttgttgccgcaattgatgcgagaatgaatgaagtctatttttctcaagtagtgagagaaaaagtgcggtcagattttggagaagtttttcaatggcgagaaatcattagagaacaagtttgttctccagaacaagcgattaaccagcttcaaaatgataacgcatttagagtcgggacaggttgggctgcttattctcaatttactaaaaaaaatctaactggctcagatatagcattacctaatgccttatatatgttagaacttgcgcgagtagaatttttgcaaaaacacacaattccagctttagaaattgaaccgatttatttgcgaaacgaggttacttggaaaaaattaccagggcgtgaataagtttaaataactggaggatagaaaatgaaaggaaaaatcaccttattttttaccgcactttgcttgggattaacgggctgtattgcaccaccaaaagggttagaaaaagagcgattctcaattaattcctatcgcgagatttctcctcaggatttgacctgtcattgtaaaacagttcgacttggaggaaaaattatcaatactaccgttttagcaaatcaaacaaaaattgaagtgttaagtttacccgtatcatcaatttcaggtaaaccatttgttgaattgcaatccgatggtcgctttatcgtgtatttcaacggttttgttgagcctgaaaatttaaaagaacgttatattactgtaggtggtcaattagctggaacagagaaaggcaaaatagaacaagctgattatacttatcctgttgttcaagcggataaataccgtatttggacactcagtaccatctatgagtatccaacagatgattgggatgaagatgatgattggggattttttagatggagatatcgcccttggtatgttcagcctgaaattcgctattatttgaattaatgataaaatcttaaagattttccaacaaattaggataaaaaatggaaaaaatttggtttcaaaattatccagaaggttctgaaaaatttctagatacctcaaaatatgaatctattttggatatgttcgacaaagcagtgcgcgaacatccagatcgccccgcttacattaatatggggcaagtacttactttccgtaaattagaagagcgcagtcgtgcatttgccgcatatttgcaaaatgaatttaaacttcaacgtggagatcgcgtggcattgatgatgccaaatttattgcaatatcctatcgcactttttggtattttacgggctggcttaattgcagtaaatgtcaatcctctttatactccgagagaattagagctccagttgcaagatagtggtgcggtagcgattgtcgtggtatcaaattttgcttctaccttggaaaaagtcgttttcaataccaatgttaaacacgttattcttacccgaatgggcgatcaactttcttttggtaaacgtactttagtcaatttcgtcgtaaaatatgtgaaaaaactcgtgccgaaatataaattaccgcacgcagtaacattccgtgaagtattgagtattggtaaatatcgccaatatgttcgtccagaaatatcgcgtgaggatttagcctttttacaatatactggcggtacaactggcgtggcgaaaggtgcaatgctgacacacggaaatattataaccaatgtcttccaagctaaatggattgcagagccatttattggcgatcattctcgcactcgttcagctattttagccttgcctctttatcacgtatttgccttaacggtaaactgcttattatttttagagttaggtatcacggcgattttaattactaatccgagagatattgaaggatttgtgaaagagttgaaaaaataccgttttgaagcaatcactggtgtaaataccttatttaatgccttgttaaataatgaaaatttcaaagaagttgatttttctgcgttgaaactttctgtgggtggcggtatggctattcaacaatcagtggcaacacgttggcacgaattgacgggctgtaacatcattgaaggttatggaatgacggagtgttcgccattaatcgccgcttgtccaattaatgttgtgaaacataatggcactattggtgtgccagtgccaaatacggatataaaaatcattaaagatgatggctctgatgcaaaaattggcgaagctggcgaattatgggtgaaaggcgatcaagtaatgcgaggttattggcaacgacctgaagcaacgagtgaagtgttaaaagacggttggatggcaactggcgatattgtcattatggatgaatcatatagcttacgcattgtggatcgtaaaaaagatataattttggtttctggctttaatgtctatccaaatgaaattgaagatgtcgttatgctgaattacaaagtgtctgaggctgtggcaattggtattcctcacgcagtttctggcgaaacgataaaaatctttgtggtgaaaaaggacgatagtttaactcgtgatgaacttcgcaaccattgtcgtcaatatctcacaggctataaagtgccaaaagaaattgagttccgagacgaactgccaaaaaccaatgttggcaagattttacgtcgggttttacgcgatgaagagatcgcaaaacgtccaaaacattaatgtcaaaatgggatagcaatatcccatttttgttctttttaaataaaaaatcactatgataaaagaatgtcaaaatccaccgcactttagagtcatttcagataatgctgcactattggaaatttgtaatttggctcagatgaaaagtgcggttgccctagatacagaatttatgcgtgtttccacttattttcctaagttgggattaatccagctttatgatgacgagcgcgtctctttaattgatcctttagcgattacggatttttctccttttgtcgcattgttatccaaccctaaggtattaaaaatcttacattcttgtagtgaagatttattggttttcttacaagaatttgatcagcttccacgcccaatgattgatacacaaattatggcgcgctttcttgggcttggcacatcagcaggattggcaaaattagcacaacaatatttaaatatagaaatcgataaaggcgcaactcgcaccaattggatcaaacgccccctttctgatattcaacttcaatatgccgcaggcgatgtttggtatttgttaccgctttatcatattcttgaaaaagagttagcgaaaacaccttgggaacaagcagtaagagatgattgcgaactggctcttgctaaaacacataaattacaagagcgagattcagaaaaagcttatttagatattccaaatgcttggaaattaaatccatttgaattgtctcgtttaagaattttggctcagtggcgacaaaacgtcgcaatagagcgtgatttagcactttcttatattgtgaaatccgataatctttggaaagtggcaaaaaataatccacgtaatacatctgaaatgttagaaatgggattaactgaaaatgaagtacgcgtgcgtggtaaaaagattttacaattgcttgctcaagcaagacgcgtttcgcctaatgattacccaaaacctattgaacgtatttctgaagatcctcgttataaaaaaacaattcgattgttacaagaaaaagtgaatagcttaacaccagcaggtttaacccctgaaatccttgcgagtaaacgcactttggatgaattaattaaatgggtttggaaatatgattgttctcaagacaaactccccgagctgctgattggatggcgtaaacctattgctgaaaagttagtggatatacttaaataaatataaaaaagcgttgagcaaatagctcaacgcttttagtttttactcgtagagttttttcacttgttcaggtgtcatcactcgttgatatttactaaattcttttgccatatagtaagcaccaaaatttgttaagtgatcttgatccccatacaagtattttccttctgccataacactatcttttggtaaatactgttgagcatctacccaataaacattaggaatatctttgactaaatcatgaataattttgttactcgcatcaatatcgcccatacgatgaattggcgttaaatatttttcaagtccataattttctaataagtaaccacgcagtggagaacggcttactgagctattattagcaaaaacatatacgggcttttgcatcgctagttgtttcactgtgtttttaaaacgtgctttaaaatctggctctatgaaagtttcgggtctaaagcgaggtactggctgtccgcccattctcaagtcataaaatgctgaaataaatatcgctttatattgagaatctttctgccatacagattggcaattaggatctaattgatattgttcattcacaataaagctacattcaaatttatctttgaaaatatctgctttccagccttctttatttcccacatagtttagaaaagcttctaaatgtgaagaatgagaatcgcctaaaataatgaccttagcaggataatgattttcattagaaacaggaattgattgttcaatgtgttctttttcagctcgtattgtttgtcttttataaagattaaatcctaagagtaaaagagaaggaataaaataaatataaagaaaactttgtttaaagtttagtttcgattttctaattggttgttcgattaaataataacttagaactgaaaaaattattgttaatattattactatagcgatagattgattattaatttgtttttcgcccgttatataataagcaaacgcaataaaaatccaatggtataaataaagggaataagagatttttccaataaatactatcactttattggataaacataatttaataatgttattttgtgatgtggtatgaataattaatgctgtaaaaatacaagggagaattaaagtaatacctggaatatatgcaatatcattattcattaaaaataagcaggaaaataatagtaatgtacttaatattgcaataacattgcttgcttgcttgcttgcttgcttgcttgctgaaagattatgataaattgccaacaaagatcctacaagtaattcaggaaatcttaggttggagagataataaatattaggctgatgcaatacttctttgtaaaaattagctggaataaaagaggtggcaagtaaaataaaaaataaaattagcgttataataaataatactttaatttctctaaactttttataagctaaaatgaggattagtggaaaaataagatagtattgttcttctacggctaatgaccaaatatgtaatacagggttttcatttgcacttaaatcaaaataaccttgtgttaatcctagatagaaattagataggaatgcaatagctaattcaatggtttttcttaatttattgaaatcattataaataaaaataacagacgcaatgaaagacactaatgccatcactgtaataaaagcaggataaattcgtttaatacgtcgagtataaaattgtttaagcgaaaaagaattctgttgaatttctgtgataataatacccgtaatcagaaaaccagaaataacaaagaaaatatccaccccaagaaaaccgcctgataaccagttttcattaagatgataaataatgactgaaataacagcaattgcgcgtagtccatcaatttctggacgatatttaatagatgacataatattcctttaataaaaatataaaccgcactttgttctatgagtcaaaagtgcggtaattttttgtgtgtttttatacgttgaatcggaaatgcattacatcgccatcttgcacgatgtaatctttgccttctaaacgccatttacctgcttcttttgcaccgttttcaccgttgaattggataaagtcttcataagcgataacttctgctcggataaagcctttttcaaagtcagtgtggattacagctgctgcttttggtgcggttgcaccgactgaaactgtccaagctcgtacttcttttacgccagcagtgaaataagtttgaagatttaaaagtgcataaccagcacgaattactcggttcaatcctggttcttcaatgcctaaatcttgtaaaaactcgactttttcttcatcgtcaagttctgcaatttcagattcaatcgcagcacatactggaacgaccactgccccttctttttcagcaatttcacgaacgcaatctaagtatggattattttcaaaaccatcttcatttacgtttgcgatatacattgttggttttaacgttaagaagttgtaactcttgattgcttgcaattcttctttatctaacccaacagaacgaatcattccagcattttcaagcacaggaaggattttttccataacggaaagttcaaatttagcttctttatcgccaccttttgcacgtttttgtaaacgttggattgctcgttcacagctgtctaagtctgctaaagctaattcagtgttgatagtttcaatatcatcaagcggatcaattttccctgcaacgtgtacaatgtcatcgttttcaaaacaacgcactacgtgacctatcgcatcggtttcacgaatattagcgaggaatttattacccaagccctcgcctttacttgctcccgcaactaagcctgcgatgtccacgaattccatcgtagtaggtaatatgcgttcaggcttaacgatttctgccaatgcgtctaaacgtggatctggcattggcacgacacccgtatttggttcgatagtacagaatggatagtttgcggcttcaatgccagctttagtgagtgcgttaaaaagagtagatttgcccacatttggcaatcccacaataccacatttgaatcccataatttttccttattttgagtaaaacggttgtaaaactaaccgcacttttaaattttaaaactgtttaaacgattggtcgctttgatcattccatctttgaaaattatttctacacaatcagttgcctcatctaacactttttcaagtgcatcgcgatctgctggagatggtttatttaaaacataacctgccactaaatcacgatgaccaggatgcccaatgccaatacgtaaacggtagaaattattgttattgcctaattgagccacaatatcttttaagccgttatgcccaccatgtccaccgccttgtttgagtttcgctgtgccagcaggcaaatctagttcatcgtgaataaccaaaatttcttcaggtttaatacggtaaaaacttgccaacgcgccaactgctttaccgcttaaattcataaaagttgttggcactaaaaggcgtacttcttttccattcactaaagtgcgggcagtttttccgaagaatttactttctggatttagtgaaacgttaaaacgacgagccaagcgttcaataagccattcgcctgcattatggcgtgtatcggcatatttttcgccaggattgcctaaaccaacaatgagttttatttctgacatttttatttgatgatgtaaaaatttgatgatgtaaaaaatagtggcgtattgtagcgaaaaagccttaaattctcaatctataaggcggaaacaaagaggtaatttattgctcgtgatttatcattaaaagtcaccgcacttttccgttataatggctaaaattttttaacaaagaagtaaaaatgaatcagattaacattgaaatcgcttatgcttttcccgaacgttattatttgaaatcttttcaagttgatgaaggaatcaccgtgcaaacggcgattacgcaatcagggattttaagccaatttccagagattgatttgagcacaaataaaattgggattttcagtcgtccaataaaattgactgatgtattaaaagagggcgatcgtattgaaatttatcgtccattacttgctgatccgaaagaaattcgccgtaaacgtgcagcagagcaagctgcagccaaagacaaagaaaaaggagcttaaaaatgaccgcactttcatccgttgatttttgtttacctgaacatatcacgccagaaatttttctacgtgattattggcagaaaaagccacttgtgattcgtaacggtttgcctgaaattgttgggcagtttgagccacaagatattattgaacttgcacaaaatgaagatgtcaccgctcgtttagtgaagacattttctgatgatgattggaaagttttttttagccctttgagcgaaaaggatttccaaaaattgccagaaaaatggtcggtgttggttcaaaacttggagcaatggtcgcctgaattaggacaactttggaacaaatttggctttattcctcaatggcaacgtgatgatattatggtgtcttacgcaccgaaaggtggctctgtcggcaagcattatgatgagtatgatgtatttttagtgcaaggctatggccatcgtcgttggcaagtgggtaaatggtgtgatgcaagcactgaatttaaacccaatcaatcgatccgaatttttgatgatatgggcgaattagtcattgatgaagtaatgaatccaggggatattctctatattccagcccgtatggcgcattatggcgtggctgaagatgattgtttaaccttttcttttggcttgcgttatccaaatttaagcaatttgattgatggcataagcaaaggtttttgtcatcaagatcctgatttgaatttaagcgagtttgatttaccgctacgtttaagccagtctgaacaacgtacaggtaaacttgcagatgaaaatattcaagcgatgaaacagcttttattagataaattggctcattcagaagcttttgatacgttgtttaagcaagccgtagcaagtgcggtaagttctcgtcgttatgagttattagtctctgatgaaatgtgtgatcctgatgaagtgcggtcaattttagaagaagatggcgcattcctttctcaagacaacaattgtaaattgctttacaccgaaaatccgttgcgaatttatgcgaacggcgaatggttagatgaacttaatataattgagagcgaagtattaaaacgcttgtctgacggcgaaagtttagattgggcgtttttatctgatttagccaataaaacagaagatcccgaaacctcaatggatttgctgttagattcaatttgtaactgggttgatgatggttgggcgttaattgaataatatgtcagacaatatttattccgtctctcaactaaattctgccgcacgtcagatgttggagggtaatttttcccaaatttggctaacgggggaaatttccaattttacccaacctgtgtctgggcattggtatttaacgctgaaagatgaaaatgcacaggtgcgttgtgcaatgtttcgtatgaaaaatttgcgtgtagcttttcgtccacaaaatggaatgcaagtgcttgtgcgtgccaatgtgagtttatatgagcctcgcggcgattatcaacttattattgattctatgcacccagcaggcgagggattattgcaacagcaatttgaagcgttaaaaatgaagttggctgcggaaggattgtttgctcaaaatcttaagaaaactctaccgcactttagtaaagcagtggggattataacttcttctacaggtgcggcattgcaagatattttgcatattctggcacgccgtgatccaagtttaaaagtcgtcatttatcccactgcggttcaaggcaaagaggcaactgcagaaattgtgcaaatgattgaacttgctaatgcgcgacaagaagtagatgtattaattgtggggcgtggtggtggttcattagaagatctttggtgttttaatgaagaagaagtggcgcgagcgatttttcgttcaaccttacctattatcagtgcggtgggacacgaaacagatgtgacgattgccgattttgttgcagatcttcgtgcgccgaccccttctgctgcggctgaattagttagtcgtaatcaagatgaattattgcaacaacttcgccatcaacagcaacgtttagatatggcatttgatcgtttatttacgcgaaaaagccagcgtttgaaacagcttgccttacgattgcaaaatcaacatccacagaatcagctacgtgctcaacaagcgaaaaatgaacagcttacacatcgcttgcaacttgcaatattgcgtcagtttgaaaatacacaacaaaaattcaccgcactttctgttcgtttaaaacaaaatccattgccatatcgcatacaacgttatcaacaaggcttagagcagttaaaagtgcggttaaatttttgcgtaaatcgccaagtgacggaacgtcaaaataaactggcaacattatgcggaaaactggatggcttaagcccattaaaagtcttggcgagaggttattccattgcggaaaatccgcaaggtaaagccattgttagcgtgaaagatgtcaatcaaggggacttcattacaactcaagtggctgatggaaaaattgtgagtaaggttttgtaagatgcttattttgtaaaaatggagtgaaatactgtttcacttacttctaaaaaagaatgctatgactgttgaataaataatcatggcattttgtttttttgtgactcacttcaaactctcaacaaaaagtggaaaccttctattttttttgtagtcttttaagcgtatgattttgcgtgcagttttggagaaaacagatgtcagaaattcaacattttagccaacaagatatagaaatattgggcgaacaaactttgtatgaaggttttttcacgcttaaacgaatccaatttaaacataaactttttgctggggggcaaagtggcgtcgtaacccgagaattactgattaaaggcgcagcctcagcggttatcgcttatgatccaaaagaagattcggtgattttagtcgaacaagttcgtattggtgcggcttatcatccagaatctaatcgttcgccttggttactcgaactaattgcaggtatggtggaaaaaggcgaaaagccagaagaagttgctttgcgtgagagtgaagaagaagcagggattcaagtcaaaaatttaacacattgcttaagtgtgtgggatagcccaggtggcatcgtggagcggattcatttatttgcaggcgaagtggatagcacacaagcgaaaggcattcacggtttggctgaagaaaatgaagacattaaagtgcacgtagtaaaacgtgaacaggcgtatcaatggatgtgcgaggggaaaattgataatggcattgcagtgattggattgcagtggcttcaattaaattatgctcagttacaacaaagttggaaacgtagttagggggcattaatgaaaaatacgtttgtttatcaggcggaaaagcctgttataaagttattacaaattaccgatccccatttatttaaagatgaaagtgcggaattattgggggtaaatacacaagcaagttttgctcaagtattaaaggaaattcagcaagaaaataaccaatttgatgtgattcttgccacaggcgaccttgtgcaggatagtagcgatgaaggttacattcgttttgtagaaatgatgaaacctttcaataaacctgtgttttggattccaggaaatcacgactttcagcctaaaatggcagaatttttaaatcagccaccaatgaacgcagcaaaacatcttctattgggcgagcattggcaagccttattgttggatagccaagtttatggtgtaccacacggacaactaagccagcatcaactcgatttattaaaagaaaccttagaaaaaaatccagaacgctataccttggttgtattacaccatcatttattaccaactaattccgcatggcttgatcaacataaccttcgtaattctcacgaattggcagaagtgcttgcgccttttagtaatgtgaaagctattttatatgggcatattcatcaagaagtaaatagtgaatggaatggttatcaagtgatggcaacgccagcgacttgtattcaatttaaacctgattgccagtatttttctcttgatacgttacagcctggttggcgtgaaattgagttatactcagatggttcaattcgtacggaagtaaagcgtattcagcaagcggaatttttaccgaatatgcaagaagaaggatattaaattttgtggacgttttaaaaatcactttcatagtaagcatttttaaaacgtccactattctaacccaacaaaagtgcggtcaaatttttaattgtttttaacgattcgccagttcaaaaatcatcgcttctgcttggcaactaaaagtgaaagaggcatttaattgaacaccgttttcaactgccacgatttcgcttttaatttcgcaaggatcgctttctatatcgcgcgctttcttcgttaatcgttcaagtgcggcattggcatctgcttctgtgctataaacttgatgtacttctacgctacagtcagagccatcaataatcgtgcctacatcaacacagctgcaagttaaggattcttctgctttgcattttacggtcattttcttttccttatatgaatattttttcgcattttatcatttttcttttttcccataaatgacaaaaattgaacaaaacaatccattaaatgcaaaaaactcctgctaactgatcgtagctctaataaaaatagttgcactcaatagattctggtttataattgcccaaatttttatttataacaaagggttccaaatgaaaaaatttaatcaatctctattagcaactgcaatgttgttggctgcaggtggtgcaaatgcggcagcgtttcaattggcggaagtttctacttctgggcttggtcgtgcctatgcgggtgaagcggcgattgcagataatgcttctgtggtggcaactaacccagctttgatgagtttatttaaaacggcacagttttccacaggtggcgtttatgttgattctagaattaatatgaatggtgatgtaaattcttatgctacaataacatcagcaagtagtggagtgagaacaataaagcacggctcagcttcacagcgtaatgttgttcccggtgcttttgtgccaaatctttatttcgttgcaccagtgaatgataaattcgcgctgggtgcaggaatgaatgtcaatttcggtctaaaaagtgaatatgacgatagttatgatgctggtgtgtttggtggaaaaactgacttgagtgctatcaacttaaatttaagtggtgcttatcgagtaacagaaggcttgagcctaggtttaggggtaaatgcggtttatgctaacgcccaagttgaacggaatgctggtattattgtggagactattgataaccaagtaaacacagcactctcagcactgcaagaaccattcagagatcttaagaagcatttgccctctaaagacaaatctgttgtgtcattacaagatagagcagcttggggctttggctggaatgcaggtgtaatgtatcaatttaatgaagctaacagaattggtttagcctatcattctaaagtggacattgattttactgaccgcactgccactagtttagaagcaaatgttatcaaggcaggtaaaaaaggtgatttaacctttacattgccagattacttagaactttctggtttccatcaattaactgacaaacttgcagtgcattatagttataaatatacccattggagtcgtttaacaaaattacatgccagcttcgaagatggtaagaaagcttttgagaaagaattgcaatacagtaataactctcgtgttgcattaggggcaagttataatctttatgaaaaattaaccttacgtgcaggtattgcttacgatcaagccgcatctcgtcatcagcgtagtgctgcaattccagataccgatcgcacttggtatagtttaggggcaacctataaattcacgccgaatttatctgttgatcttggctatgcttacttaaaaggcaaaaaagttcactttaaagaagtaaaaacaataggtgaaccacgtgcattgacatttaatacaactgcaaattacacttctcaagcacacgcaaatctttacggcttaaacttaaattatagtttctaatccgttaaaaaatttagcataataaagcacacttccacaccaagtgtgcttttcttttataaaacaaggcgaaaaatgaccgcactttattacacttattacccctcgccagtgggacggcttttgattttatctgacggcgaaagcattacacatattgattttgaaaaagagcaatatgcgcctaatccaaaatggctcaagcaagatgaattgcctgtttttcaaaaagtgcggttagcttttgaacgatattttaatggggaagttgagcgatttgcagacattcccttaaaaccagaaggcaccgcatttcaacaagccatttggcaagccttgcgagaaattgcttatggcgagctttcaacttatggcgagctggcgttacggattaataatcctaaagctgttcgtgccgtgggcggtgcggtaggcagtaatcccattagtattattattccttgtcatcgcattttaggtaaagatcgtactttaactggttttggcggtggcttagaggcaaaacgttttttattgcagttagagaaaattccctatattgataaaggcactgaaaacactaagcctcgcttttttaagaaatatcacgaatgattccacaaactcttgaacaattactttcccaagcgcaatcaattgctggcttaacttttggggagttagctgatgaactgcatattcctgttccgattgatttaaaacgtgataaaggctgggtgggcatgttattagagcgtgctttaggcgcaacggcagggagtaaagctgaacaggatttctctcatttaggtgttgaacttaaaacattgccgattaatgcggagggttaccctcttgaaaccacctttgtgagccttgccccgttggtacaaaattcagggattaaatgggaaaattcccacgttcgccataaactttcttgtgtactttggatacccattgaaggcagccgtcatattccattacgtgaacgccatatcggtgcgccaattttctggaagccaaccgctgagcaagaacgtcaattaaaacaagattgggaagaattgatggatttaattgtacttggcaaattggagcaaattaccgctcgaattggtgaagtgatgcaacttcgcccgaagggcgcaaatagtcgtgctgtgacaaaaggcattggcaaaaatggcgaaattatagataccttgcctttaggtttttatctaagaaaagaattcaccgctcaaattttgaaagcgtttttagatgtaaagccgctttaacttgattttaatattcgtcaaaaacacggaaaaaaccgaccgcactttttagctcattgccataaaaaattaaagggatccgatttcgttcccaaggtggtacgcttaattcttgccagattttttttatatcttctcttgggcgtttcggatgatgtttcactttgcccgaatagccaaaacgaatagaaataggcaagttcgttttttccagcgtaacagagtaatcctgccagtagaaaatcagattatgttcattttcgtgaacagtgagattgcctaaatcatcgggtaaatttagcatgttttgttctaattttagggtgcatttggttagatcagaaaacggcttagttaaatataaactatcttgataacgtcgaataactttatttacaagctgaaattgaggatttgcctcttcttttgcaaaaatgacatcattaataagctgtgtaagctggcgtttacttggcatttcaagttggtttttggcaagccacatacgcaaaagtgcggtctgttttgcgagagaatattggcgaaattggagcagtttaaattggtttttaatttgacaatgttctgtaaaaatttcgctcaataaatcattaattaactgttgttgctcaaaacaatgttgtgcggaacgttgtacggctaaatcaaaatgcgcccagcgttcacgtaattttggcaaaatttcattgcgtaagaaattacgatcgtatcgattatcctcattactttcatctgtaacccagttgagcttttcttgttgcgcataatcttctaactgtgggcgagtaaaacctaacaaagggcgaaaaattggcattccgaataatacactttgttgttgcattgcgcttaagccttgtagcccactgccacgttttagggctaagaaaaatgtttctgtttgatcgtttagatgatgcgctgtaactaacatttcttgtatttgaagatgtttttttatggcttgatagcgtgcttcacgcgcccctgcttcaatgccattggttttatctacttgtactcgctcgataatcaatggaatttgaaattgatcgcacaagttttggcagtgtttagcccaactatctgcattggggcttaagccgtgatgaatgtggattgctcgtaccgataaaggcggtaagtgcggttgtttttgacaaagttttgcaaataaagaaagaagtacagtggaatctaaaccaccactcaaggcgataagaaacccttgagcggtggctttttggagttgtttttcaatgtctgaaagtaaatccattaggcaactttttcagctttatagttactgcttggattaagaatttcaaaacgtgcagcaatggtttgtaactcgtaagaacccagttcaaaggtggttttcattgtgttttctcctttgttgtatatttagatcaaaaaagagcggcaaaaatcaccgctcttttagaaagttagttagcaataaccataagacattaaacgttcatagcgtctatttaataattcttctttgcttagttcatcgagttcagctaaatcttcttttaaacgaagttttaagttttcagctattttcgcataattgcgatgtgcgccacccaaaggttcttgcataatgctgtcgataagatttaattcttttaaacggcttgcagttaatcccattacttctgctgctgttgatgccttttccgcacttttccaaagaatagaagcgcagccttctggagaaataacagaataagttgaatactgtaacatattcactttatcgcccacgccaatagctaatgcaccgcccgaaccaccttcgccgataacggtacaaataacaggaacggtaagctgtgccatttcgcgtaagttacgggcgatagcttccgcttgaccacgttcttctgcgccaatacctggataagcccctggtgtgtcaataaatgtgataattggcaatttaaaacgttcagccatttccattaaacgtaacgctttacgatagccttcaggtgcgggcataccaaaattgcgttgtactttttcttttacagaacgacctttttgatgaccgataaccatcactggacgaccatctaaacgcgccaagccaccaacaatcgctttatcatcagcaaaagcgcgatcccctgcaagttcttcaaattccgtaaaaatatgttcgatataatctaatgtataaggacgatttggatgacgcgccatacgtgaaacttgccaagcatcgaggttagcaaaggtttttttagtgagttcgttacttttcttttgtaagcgtttgatttcatcagttaaatcaactttatcatctgatgctgctcgtaatgcttcaatttttgcttctaattcagcaatcggcaattcaaaatctaaatattcttggttcattttgttatcctaaaaagaccgtaaaaatcgaccgcactttatcaagaattaaactgtggcgcaaatggttttcactggttgggcaagcttataatcgctcttttttgaagagtgataagacaaataaaaacgcagaacaaatcacaacagaaggcccagcagcagtatcataaaaggctgataatattaatccacctataatcgataacatactcataataatcgcccagcccaccatagattctggcgttctcgcaaagcgacgagcggttgccgcaggaatgattaataaggatgtgataattaatgcaccgacaaatttcatactcaaggcaatcgtcaatgcggttaatatcattaaaataaaacgcatttttttgatattaatgccttcaacttgtgcgagttctggcgatacggtggtggaaagtaaggattgccaaaagtaaattaatgttgaaagcacaattattacgccaatcccgatataaattaaatccgtataattaattgcgagtaaatccccaaataaataattcattaaatctacccgtacattccgtaataatcctactgtcacaacgccaagagataaacagctatgggcgataatgccgagcaaggtatcaatagaaaattgcgtattgctttctaaccacaccattgcgatagcaagaattaaggtaagcaccacaatcgcaatgtaaggattgacttgtaagaaaatacctaatgctacaccgagcaaggcagaatgagaaagggtgtcgccaaaataagccattttacgccacaccacaaatacgccaagtggcgcggtaataagcgaaagcacaatgcctgttaaaagggcaggaaataaaatttcaaacattatttatccttattttgacaatgcactgctgatgaattacaaccgcacacatcgccgtgcaaggtgtgatgatgattgtgatgatgggtataaaagccgacattttgtgcgatctgatttccccataaacgcataaatgttggatcatttgagagaacatcgggcgtacctgcacaacaaatatgttggttaatacacaatacttctttactatccgccatcacaatatgtaaatcgtgtgataccatcaatacggcacaatttaatttttgttgggtttgatgaattagctgataaagctcagcttgaccagtaatgtctacgccttgagtgggttcgtctagcacaagtaaattcggtttatttaaaattgcacgcgtcaataatacacgttgcatttcgccaccagaaagtttttgcatattgcttttgcgtaaatgtgaaatcgaaagttgctcaagtgcggtggatatttcttgggttttaatgcctttttttagcgaaagaaatcgctcaaccgtaataggcaaactatgatccaaatggattttttgtggtacataaccaatgcgaacatttttactataaatgacttcgccagaagtgggcatttgtagttttaataaggtttttaacaacgtagatttgccaccaccatttggccccacaatggtaataatagaattgggatagatatttaaattaatatcttgcagagcggttttttgtgcgaaaaccacattgatattttttaattgaatgagcggttgtgggttttgctcgttgcgaatggctgtgatattcataaaatcgccgtgttttcaacaatggttggggaaaataacgcatttttatagaattctcaagattttctatccaatgtcgaatatttaagcatttgaataatgctttttccataggaatgaattttctttataatctgtagtctgaatgctgaaaacttttttattttagggatgccagtgcaacacgtaaaattagctcgagatagacgaaaaaaacgcacatatataaaagtaggcgtgttttttgttgctattctgcttattttgacaggcattttacttacaataaaagacaaatctgaagaaaatcccatattttccacctctgacagtggggaatatcacgagttaaatacatcgccaaataaaaattccaccgcacttcaacctgatgaagatgccacctcttatgatgatgaactgcaagcaaaagatgatgaagttgatgaagtaaaactatcttcagatgatctcggtactttacctcaacacgcacaagacgcactcaatggtttattagacgcggccgatcaagccataagaattactgatcaatttagctatacggtaaccgaaggggatacgttaaaagatgttttagttttatctggtttagatgattcatcagtacaaccgttgattaagcttgatcccgaattagcccacttaaaagcaggtcagcaattttactggattttaaataaaaatgataacttggaatatttaaattggctggtttctgaaaaagaagaacgtatttatgaacgtctcgaagatgggaaatttaaacgccaagttattgaaaagaaaagtatttggcgaaaagaagtattaaaaggcgagattcaaaattctttaaatagtagtttaagagaacaaggtcttgatacgcgacaaattagccaacttagtaacgccttacaatggcaagtgagtttacgaaaactaaaaaaaggcactcaatttgccattttagtttctcgtgaatatttaggcgataaacttacaggtcaaggtaatgttgaagcgttacgtatttcatctggtggtaaaaattattatgcagtgcaagcggcaaatggtcgttattataatcagcaaggggaaactttaggcaaaggttttgctcgttatccattgcagcgacaagcgcgagtttcctccccttttaatccaaatcgtcgccatccagtaacaggacgtgttcgtccccataaaggcgtggatttctctgtttctcaaggcacaccagttattgcaccagcagatggtacagttgaaaaggtcgcttatcaggctggcggtgctgggcgttatgttatgttgcgtcacgggcgtgaatatcaaactgtttatatgcacttgagcaaatccttagtaaaagcagggcaaaccgttaaaaaaggcgaacgtattgcgctttctggtaacacgggcatttctacggggccgcatttacattatgaatttcgtattaacggtcgagcagtgaatcctcttactgttaaattacccggtactagcagtggtatgacttcagctgaacggaaacaattccttgttcgtgttcgtgaagctgaaaaaatgttaaaaccttagcgatataaagtgcggtcaaaaatggtcgcatttttaccttatgtaaaataatatttacactttgttgtaaagaaattatcatagccatatcttaattatctccattccctgaatatgacgatttctaaatttaatccacaaaaacctttcgagtgttttattgtacaaagtgaagcgatgaaaagtgcggtagaaaacgcgaaacgttttgctatgtttgatgtgcctttgttaattcaaggcgaaacggggacaggaaaggatttgttagcgaaagcctgccattatcagagtttacgtcgtgataaaaaatttatcgcagtaaattgtgctgggttgcctgatgaagatgccgaaagtgaaatgtttggtcgaaaagttggcgacagcgaaaccattggtttttttgaatacgcaaatgagggtacagttttactcgatggtattgctgaactttcattgggtttgcaggctaaattattgcgttttttaacggatggatctttccgtcgagtaggcgaagaaaaggaacattatgcaaatgtacgtgtgatttgcacatcacaggttccactccatttgcttgttgagcaaggtaaagtacgtgctgatttatttcatcgcttaaatgttcttactcttaatgtgccgccattacgcgaacgcatgactgatattgagccactggcacaaggttttttacaggaaatcagcgaagaattaaaaattgcaaaaccaactttcgataaagattttcttctttatttgcagaaatatgactggaaagggaatgttcgtgagctttataacaccctttatcgtgcctgctctctggtacaagataatcatttgactatcgaaagtttaaatcttgctccgccacaaagtgcagtaatttctttggatgaatttggaaataaaaccttagatgaaatcatcggttcttatgaggcacaagttctaaaattattttatgcagaatatccaagcacgagaaaattggctcaacgtttaggcgtttcccatactgcgattgcgaataaattgaaacaatatggaattggaaaataattttccgatttgaaatggaaaaagtgcggttgaaatttcctaagaattttcaaccgcacttaataaatattgattgtccattaatggtgttgtgattactctgcttgagtttccacgttttcaactgcttctgttggagtggtatgatggttattattgtgatgcgaaactgaacgagcaggcacaaccgttgaaattgcgtgtttatataccatttggttcactgtgttttttaataaaatcacgaattgatcgaatgattcaatctgaccttgaagtttaattccgtttacaaggtaaattgatacaggaatgcgttcacgacgaagcgcatttaaataaggatcttgtaaagattgtccttttgccattttgctatcctttgttgtcgttattatgaaatttgttgatagaaacgagttgtctccgtgtgcaagtgtagcaataaacagaaatattgtctatttgctttcccgcaacttttgcaaaattgctttcatttgatgatctagtgacgcattgaaacgtagtgtttcgccatttttagggtgttcaaaccgaattgaaaaagcgtgcaaaaacaaacgatttaatcctaattcattcatttgtttatcaaaatctttatcgccgtatttatcatctaatgcaataggatgcccagcatattgtgtatgcacacggatttgatgggttcgccctgtgactggtgaagccttcacaagcgtagcatttatatagcgttcttcaatgctaaagcgagtttcagatggttttccttgctcgctgacacgcacaatacgctctccgctagataattcatttttcaaaagaggggcttgaataacttttatatgggattgccattgcccacgtactaacgctaaataatctttttgaacggttttgacgcgaagttgttcgtgcaaattgcgtaatgctgaacgttttttggcaattaataaaatgcctgatgtatcgcgatctaaacgatgaaccagttctaaaaagcgtgcttctgggcgtaatgctcgtaaggcttcaatcacaccaaaatttaaaccacttccgccgtgcaccgcgattcctgagggtttatttaaaataatcaagcaatcatcttcaaacaaaatttggttttcaagtgcggcaactttattgagattttttgaaatcggcgcatcatttttttctgcgacacgcacaggtggaatgcgtacaacatcgcctgtttgcagtttatattctggtttaattctgcctttgtttactcgcacttcgcctttacgcacaatgcgataaattaaacttttaggtacgcctttgagttttgctaataaataattatcaattcgttgtccactttcatcttcactaattgtcagcatttttacggatgaattaatgattttttcattttgttttgtcattttttttccttttgaaaatcggtgcaaatcatatcataaaggcactataaacgtaatatgaacatcactctatgaacgcaaattcgccttgctaattaatcgttttctatggataatagaacgtctttttgcgcctaagaatttgcgtaaaaaaggataagttttgttggtaaaaactcaatgcagcactcggcataagacattgataatcaacatttttcttaaaataaattagccgcttgcaacgcgtgcggaatatcgcgttgttttatcaagcgaatatttatgcttaataacgttatcaatgcacccagcaacatacagtcgtgagattgactggcgcgagaaacacgaggtcgataatgaagcaaagtgcggtttattttgaggttttttaaatatttaataagagaattgacaatgaaaagaatgttaatcaatgcgactcaaaaagaagagttgcgtgtcgcgcttgtcgatggacaacgcctttttgatttggacattgaaagtccaggacacgaacaaaaaaaagcgaatatctacaaaggaaaaattactcgcgttgagccaagcttagaagcggcttttgtggattatggtgcagaacgtcacggttttttacctttaaaagaaattgcccgtgaatattttcctgatgattatgtttttcaaggtcgtccgaatattcgcgatattttgaccgaaggacaggaagttatcgttcaagttaataaagaagaaagaggaaacaaaggtgcagccttaactacttttgtttctcttgctggcagttatttggtgcttatgccgaataatccacgggcaggaggaatttctcgccgtattgagggcgatgaacgtactgaactaaaagaagcattaagttcattagatgtgcctgaaggtgtaggcttaatcgtccgtactgctggtgtgggaaaatcgccagaagaattacaatgggatttaaaagtattattacatcattgggaagcgatcaaacaagcttcacaaagtcgtccagctccatttttaattcatcaagaaagcgatgtgattgtacgcgctattcgcgattatttgcgtcgtgatattggtgagatcctgattgatagcccaaaaatttttgagaaagcgaaagagcatatcaaacttgtgcgtcctgatttcatcaatcgcgtgaaactttatcaaggcgaagtgccacttttcagtcactatcaaattgaatctcaaattgaatccgcattccaacgtgaagtgcgtttaccttctggcggttcaatcgttattgatgtaactgaagcattaaccgccattgatattaactccgcacgttctactcgtggtggcgatattgaagaaaccgcattaaataccaaccttgaagcggcagatgaaatcgcgcgtcaattacgcttacgtgacttaggtggattagttgtcattgatttcattgatatgacaccaattcgccatcaacgtgaagtagaaaatcgtattcgtgatgcggttcgtccagatcgtgcccgtattcaaattagccgaatttctcgttttggtttgttagaaatgtcacgtcagcgtttaagcccatcattgggcgaatcttcgcaccatatttgccctcgttgtcaaggaacaggcaaagtgcgtgataatgaatctctttctttatctattttacgtttgctggaagaagaagcattaaaagagaacaccaagcaagtacataccattgtgccagtacaaattgcctcttatcttcttaacgaaaaacgcaaagcaatcagtaatattgaaaagcgtcataatgtcgatattattgttgccccaaatgaagcaatggaaacaccgcactttagtgttttccgtttacgtgatggcgaagaagtaaatgaattaagctataacttagcgaaaattcactgcgctcaagatgaaaatactgaagaatcactgctttctcgtaatgtggaaacaacagctgttattgaacaaccagcggttgaaagtgcagtagttgcactttctatttcagaagcagccccaacgccagttgagcgtaaatcaaatgaaccctctttgttagctaaaattattgcgaaaattaaaggtttatttgcgactaaatctgaagaaaacaaaccgaaaaataaccgcacttcgcgcaatcctaatcgtaatcaacgccgttcacaggatcgtcgttcttctcgtcgtccacgttctgaaaataacgaaacagaaagaaccgaagaacaggttcgtaatgtccgtgagcgtaatcaacgccgtccgcgccgtaacttagtggaagaaagtatcgctgaaagtgcggtaaattctacacctgtttttgaggctaaagaagaaagaactgagcctgtaactcaacgccgccaacgccgtgatttacgtaaacgcgtgcgcgttgaagataatgaaacagttgttgaaaataacttcagcacgactgaaaaaatgccagaagtggatgtaattacggttcaaaataatgatgaaaaacccgttcatcagaaccaacgttctgaacgtcaagagcgtcagcgtcgtactccacgtcatttacgtgcagcgaataatcagcgtcgtcgccgtaatcaagagccaaaatcgccaatgccattatttgctgcggtggtttcgcctgaattggcaagtggcaaggcttggattgattattcaacggtaaatctgccaaaagaaaatcatttcttatctgtggatgaattgcttgagcaagagaaaactaaaaaagggtttatcacgccagcaatgggaattgtcgttgaagaaaaatcccctgatgtaaaacctgcattagattttattactcaaccagctaatgaatcggtacagaaaaaagtacaagaatctttagaccgtttaagttcatataaacctcaagaagttgttgaatctattgatccagcaattaatgtagatgaacctgaaacgctcgagaaagtatcaaaatttgtccgcacttatgaatttaatggacgtttaggtacaatttcttcagtaccccatacaaaagcggagatgactttagcgaaagcaaatgatgaaatgccagaggctttcccaattagggcttggcaggattctcgttattatttctatggaaaaggtgcggcaggacatcattgtgcaattagccacgtttattctgaaccaacccgcgcaaaatcagaataatcaaaaataaaaatagaattgacgtaaccaaaattacgtcaattctttttattttataaatacagtttgattgaaagcataaaaaaccaatcagtcaaattttgctgttattttatgctttaattaaaacatttttacttatattataaaacagagtaagttgggcatgttgctaccagcggttacacaaaagatgaatttacaacaaaacttacatttaagactaacaatatgccaataggcggagatgtgaaggcggatcaggaaacatcaggttctagaagcataaaacgcattggctttggttttattggtggtattggctatgacattacaccgaatattaccttagacttagattatcgttataacgattggggacgcttagaaaacgtgcgttttaaaactcacgaagcctctttcggtgtacgttaccgtttttaattaaacaaatttagttttctatttaagcggtcaaattcttctcattatttgcaaaatgagggaaaaatttgaccgcttgttttttcttgaaaagaagcgtaaacttcatgcaatttttagtcggggtgccgaaaggctgagatgatacccgtgaacctgaaacagttagcactgacgtaggaaactaatatgccacatattcaacctttctctatcacgattttatcctgtttatttttccaattttctacattttattacatccgctaattgctcacagtgaatagcgggcatttttgtttattttatattcaatacaaggaatgcttatgcaatcaatttatctctccaaaatccgtgagcagaatccgctcattcataacatcaccaacattgtggcagcaaattttagtgccaatggcttgttggcattaggagcttcgcctttgatgtcggcgaatatcgaagaaatgcaggaagtaccgaaaatcagtcaagtattggtcattaatattggtacgctgattggtaaagatcgggaggcaatgttgcaggcaggaaaaacggcaaatgaggttggaattcctgtagtgttagatcctgttggtgtgggggcaacgagctatcgccgtgagaccattcgccaattgctggcagaagtaaaattcgcacttattcgtggtaatgcaggtgaactggctgccattgcaggcgagacgtggcaggcaaaaggtgtagatgcagggcaaggcgaagtggatttaaaagccgttgccgagaaagtggctcaacgctatggctgtacggtgttgattagcggggcggtggatattgtcagcgatggcacacaaactgcgaccgttcacaacggcacgtcattgttcccgaaagttacggcttcgggctgtttattgagtgccgtgtgtgcggcttttttagcggtaagtgaaggaaattatttttctgcgacattagaagcctgtgtagcatacaccattgcaggcgagtgtgcggcgcaaggcttaaccacacaagtgggacagttccaaatccgtttgttggacgagcttgctgccctttcccctgaaaccattggacaaagagggcgcatcaatgagtaatgtgaaacaagttttaaccatcgcagggtcagacagtggcggtggtgcaggcattcaagcggatcttaaaaccttccaaatgcgcggcgtgtttggtacatccgtaattacagctgttactgcacaaaacacacttggcgtatttgatattcaccctattccactgaaaacaattcaagcgcaactggaagcggtcaaaaatgatttccagattgcaagttgcaaaattggtatgttgggcaatgcagaaattattgaatgcgtggcagattttcttgctgataaacctttcggcacgctggtgctagatcctgtaatgattgccaaaggtggtgcacccttattgcaacagcaagcggtaagtgcattaagccaaaaattgctgccgttggcggacgtgattacaccgaacattcccgaagcggaagcattaacggggattgcgattgtggacgacatcagtattcaacaagccgcaaaagcgttgcaaaaacaaggagcgaagaatgttattattaagggcggacattcgctcaattcgcaaagtgagctgtgccaagattgggttttacttgcagatggtcgtcattttactttgcaaagcccccgtttcaacacgccgcatacacacggtacgggctgtaccttttctgcctgtttaaccgcagagttggcgaaaggcgaaccgttgcaaagtgcggtaaaaacagcgaaagattttattaccgctgcgatttctcacccattgaatattgggcaaggacacgggccgacaaatcattgggcttacagtcgcctttaaggattgaaagatgaaaaatattcaaaaaatcttaccgctttactttgtggcaggcacgcaagattgccgtcatttgggcgagaacttgtcggaaaatttattattcgtgctaaaacaagcgttagaaggcggaattacctgctttcaatttcgggataaaggcaaattttcgttagaacatacgccctcagcacagaaggcactggcgatgagttgtcgtgatttgtgccgtgaatatggcgtaccgtttattgtagacgacaacgttgatttggcgttggaaattgaggcagatggcattcacgttgggcaaagcgatatgcctgtgcaagagattcgagctaaaacagataaaccgctaattattggttggtcggtgaatcgtttagacgaggcaaaaattggggaaaatttagcggaaattgattattttggaattggcccgatttttccaacgcaatcgaaagagaatccgaaaccaacactaggaatggcgtttattcaaactttgcgaaatgtgggcataactaaaccgcttgtggcaattggtggggtgaaattagctcacgttaaaaccttacgagaatttggggcggatggtgtggcagtgattactgcaattacgcacgccgataatgtgcaagccgcaacaaaagcattacgggaggcaagtgatgaatacgcaaaatagtttaaagcaagtagcaacagcgacgatggtcggcacggcgattgagtatttcgataactacatttacgcaatagcagcggtattggtatttaaccatcaattcttccatgtagcagatccactttcagggcagattgcggcactttccactttagcacttacttttattgctcgccctttgggagcaatattgttcgggcatttcggtgaccgtttcgggcggaaaaatacttttgtgatgagcttgctgttgatgggcgtttccactgtggttatcggtttgttgccaacctatgacagcatcggtatttgggcgacaattttgctctgtttatgccgtattgggcaaggtatcggtttaggcggagagtggggcggtgcagcgttagttgcggtcgaaaatgctccagaaggtaaacgaggttggtatggtactttcccacaactgggagccccgcttggcttgttgttggcaaatggcgtattcttaggcattacggcaattttcgggcaagaagctatgactgaatgggcgtggcggataccgtttttatcttccgttatcttagtggcaattggcttatatgttcgcctaaaactgactgaagccccgattttccttgcggcactcaataaaccgcagccaaaacgcttaccaatgttggaagttgtcactacttatttcaagccgtttttcttggggatgttaatttgtattgcaggctatgtgctgttctacattatgattgcctttagccaaatttacgccaaatctgccccaacggtttcagaggcaggatacgcaatgggattaggactttccccgcaaatttttaccgctttattgatggcaagtgcggtttctttggctattaccatcgccgtttcgggcaaatatatcgacaaaattggtcgccgtatttggctcatttggacaaccgttggcgttgcgatttttggtttatccttgccgttatttctcgaaaacggtacaactaccagtctgttttggtttttattcatcggtatggggttaattggaatgggctatggaccattagcgagttttttacctgaactcttccctactcacgcccgctattcaggtgcttctttaacctataatattgcaggtttattcggggcaagtgttgcagcaatcattgccttaccgctgaatgctcactacggcttaaaaggtgtggggatttatttaaccctaaacgctgtgttgagcttggttggattatggtttatttcagaaacgaaagataaattactatcctaagatttgaggaattaaatacaatctattaagcggttaaattttacataaaattctactaagaatttaaccgcactttcctttacaagccaaatattttctctacaataccccacctaacgatttaccttgagtaaatccctgacctgaaatcagacaaaagagaatattatgacaacccaattcaaaccagaattactttcccctgcaggctctcttaaaaatatgcgctatgcgtttgcttatggtgcagatgcggtttatgcaggacaacctcgttatagcttacgtgtacgcaataatgaatttaatcacgccaatttgaaaatcgggatcgatgaagcccattcccttggcaaaaaattctatgtagtggtaaacattgcaccccataattccaaactcaaaacttttattaaagatttacaacctgtcatcgatatgaaaccagatgctttaattatgtctgacccaggcttaattatgttggtgcgtgaaaatttccctaatattgatattcatctttctgtgcaagccaatgcggtaaactgggcaacagtgaaattctggaaacaaatgggattaactcgtgtgattttatcgcgcgaactttcaatagatgaaattgctgaaattcgccaacaaatgccagatattgaactcgaaattttcgtacatggtgcgttgtgcatggcgtattctggccgttgcttactttctggctatatcaacaaacgcgatccaaatcaaggcacttgcaccaatgcttgccgttgggaatacaaaatggaagaaggcacgacggatgaagtaggcaacatcgtgccgaaaatcgatcctgctcaacaaatcgaagtgaaaaatgtagcaccaaccttaggcgatggcacagtaacagataaagtcttcctttataccgaatcacaaaagcctgacgaacaaatgacagcgtttgaagatgaacacggcacctactttatgaattcaaaagatctacgtgccgtacaacatgtggaaaaactgaccgcacttggtgtgcattctttaaaaatcgaaggccgtactaaatcattttattattgtgcaagaacggctcaagtttaccgcaaagccattgatgatgcagccgcaggcaaaccatttgatgaaagcttaatggatacgttagaatcccttgcgcatcgtggttataccgaaggtttcttacgtcgccatacgcacgatgaataccaaaactacgaatatggctattctatttctgatcgtcagcaatttgtcggtgaatttacgggcaaacgtaacgaacaaggtatggctgaagtagcagtaaaaaacaaattcttacttggcgacaatgtagaaatgatgacaccacaaggcaatattaatttcaaaattgaaaaaatgctaaatcgtaaaaatgaaacggttgatgcagcactaggtgatgggcattttgtattcttaaatgtaccacaagatattaacttaaattacgctttattaatgcgtaatttagttaataccaatacaagaaacccacattgctagtgtgatataaaacagaatttaaatcatacctaattaaacattactgttacttggcttgcgtcgtttgccgatatttttcgtatccttatgacgcaattttacttttttctttgcctctgtttttttcttttcttcacgtttttttttaatgcgtgccttttgttttttgctgacagatttcacttcgccatcttttggtggcttagtgcgaggttctaaacctgctaaaatgcgcgcctttaaaatttcctcagtataacgtttgattttacctagcaacttgtaatcatgcgcttcgacaaaagagactgccgtgccttttttgccagctcgcgcggtacgtccaattcgatgcaaataagtatccgcactatagggcaaatcaaaattcatcacgtggcttacatcatcaatatcaataccacgcgcagccacatctgttgcaaccaataccgtcacaatacctgatttcaatttatcaatggcattgttacgttgagtttgtgccatttcgccttctaaatatgcggaacgaatgcctcgtttacgcaatgtttcagaaacttcacgcgcatcttcacgacggcgaacaaatacaattccacgggttactttttcagtttcaataaaacgcgcgagcaatttgattttatgttcattgctgtctgcgtgataataccattggttgattttttttctttcacggcgacttggttccgcatctactttcacaggatcattcaacaaacgctccgcaaaatcgaccaataactctccttctaaggttgcagaaaacaacaaagtttgtttccgccaacgggtttcagctgcaattttttccgcatcttgcccaaatcccatttgtaacattctatcggcttcatcaaaaatcagcatttcaacggaacggcaatcaaaattttcttccttaatgtattgcaataaacgacctggcgtagccaccaccaaatcttgattggtattgaatacatcaccatgattttgatacgccacaccacctgtaattgtcgcaatatttaaatgggtgaactgcgctaattcttccgcttgttcagccacttgcattgccagttctcgggttggtgttaatatcaaaatacacggtggccctggtttacggcgtggataatccaataaatgttgtagcgcaggtaataaaaaagcagcggttttccctgttcccgttggtgcagagcctaatacatcacgctcttccattgcggcaggaatggcttccatctgaatagctgttgggcgggaataaccttttttctcaagtgcctttaaaagttctggagaaagatcgaattgttcaaattgggataaattcattattgtgcggttctttgttaaaatcgtcgaggattatacctgaaagtgcggtcaatttacgaaaaatttatgagcggatttacctttaaacaattccatatcaatcaagattcttgtgccatgaaagtcggcactgatggcattttgttaggtgcttgggctgatgtaaagcattgtaaaaatattttagatatgggcagtggcacaggattattgactttaatgttagcacaacgaactgaagaaaactgtcaaattcaagcggttgagttggatcccattgcagcaaaacaagcacaagaaaacatcaataattcagtgtggaaaaatcgcattcaacttactcaagcggatatacaacattttttacaaaccactgaacaaacctttgatttaattgtggcaaatccaccttattttgaacaaggtatcgcttgtaaaaatgaagaacgagaattggctcgttataccaagcaaagccacttaaattggttagaatgggctgcaacacgcttgtcggaaaatgggaaaataagttttgttttgccttatgatgcaggcaaaacgctcacaaaatccaccgcacttttttgcataaaacagacgaatgtcatcactaaaataggaaaaacgccccagagaatgttgcttacctttgccaaacaacccgaagttttaatgcaagatcaattggtaatttatgatgcggataatcaatacactgaagcgtttattgaattgactaaagacttttatttgaaattttaaaggggaaatcgtttcccctttaatcatacactatctaaaatacccttgcaacgtgaaagcacgcggtttcttcaccaataagcaaatgccaccgtgatgttctgttccgctcactcgggctaattcttcactatctacaacgtgataagccttcttgttttcggctaaataactcaatacctcgccaattttgtgtgacatttgcacggttgcccacaatcgaacaatactttcaggacgctctgcaaataaagctaaacaggcattttcaccgtaaaccttcatttcttccgcacggtttttcttaattttttcaggcgcacgaggagaaagcgcaccagttttcttttctttcgttttataaaccgtacccgtactttttattgtcacttgaaccttaggttgttctgtatttttatttgatggtgcgcgagataaagaaagttgcttaattctagtttctttcacttcttgtttatcacgaggaaaacgagatttttcgtttctatttccattaaatttatcattaaagtgcggtcgattttggcttggtttttctctgtatttttcacctactgagcgttcttgaaaggttttgcctgcggattgaaaagacggtttgcgtttgtcgttcatagggtttccctgagtaaaaatggctgttttttagccaaaaaatgctaaaatttgtgagcattataacgaaaaaaagccttttttctattaataagcacgtgaaatattgtaaactaacgcactagtctttaatcacgagatggattatgttaatcaataaaaccaaacgagctgaacaaaatttaaataatttgccattccttgctttgcaagctgagcaaattgaatttttgggtagctcggctgaatttaaaactcaaattattgaattaatcagaaacgcaaaaaaacgtatttatgtcaccgcactttattggcaaaaagacgaagcgggacaggaaattctcgatgaaatttatcgcgtgaagcaagaaaatccacacttggatgtaaaaattctcatagattggcatcgtgcacaacgcaatttattaggggcggaaaaatctgccactaatgcagactggtattgcgagcaacgccaaacttatcagttacctgatgatccgaatatgttctttggcgtgccaattaatacgcgagaagtttttggtgtattgcatgtcaaaggctttgtatttgatgatacggtgctttatagcggtgcaagtattaataatgtctatcttcatcaatttgaaaaatatcgttacgaccgctatcaaaaaatcactcatgccgaattagctgattcaatggtaaatttcatcaatgattacttgttagatttcagtgcagtttatccacttgatgtgaccaaccgccctcgtactaaagagatccgcggtaatattcgagcttatcgtaaagaccttgctcaaaatggagaatattcattaaaaagtgcggtgaaattaccgaatgttttaagcgtatcgccactgtttggcttaggcgcatcgggcaacgaattaaatcaagtaattgaagatttattcttacaagtacaagaaaaattggtgatttgtacgccatattttaatttcccacgcacattgcaacataaaatagcaacattattggaaagcggtaaacaagtagaaattattgttggcgataaagtcgcaaacgatttttacattccaccagaacaaccattcaaaatggcgggggcattaccttatctttatgaaagtaatcttcgccgtttctgtgaaaaatttgagactcaaattgaaaatggtcagcttgtggtgcgtttatggcgtgatggcgataatacctaccacttaaaaggtgtgtgggtagatgaccgttatattttattgacgggcaataatcttaaccctcgagcatggcgtttggatgcagaaaatggcttattaatttacgatccacaacaacagcttttagcccaagtggaaaaagagcaaaaccaaattcgccaacatacaaaagtattaaaacattactctgaattagaagaattgaatcaatacccagaaccagtgcaaaaacttttgaaaaaatttgcacgaattaaagcagataaattggtgaaaatgattttgtaattataagaaaagttttatgtttttttcttaaattcgcttccagtattaatctgataaattttgtggcaatcgttctaaaatggctttccaataggttgaagaacgtaaattatgtttacggatgcaatccactactgcatctgcatttccctcaagacaaatttgttgcatttctaaataaaattgctttgttaattcacggtgttttttttctttaaaaaataacaaccctattcgctgataaacaccttttaaactattgaaaattaaacgataaaagggtttgttggcaacaacagtaaattgacgaaataattggtaatcaaattctgtgtaatcttgtgctgtgttttgtaattgctctaattcagcaaaaagtgcggttgatttttgaggggaattttttactgcttcataaatgtaagattccgacattttactacgtaaagagagcatattatcaataattaagggcgcggactgcatatccaaagcaattagggtttcaataatattcggccctgcagcatcccaaatattatttactttggtgggtttgccgtgctgaattgttagccaaccatcacgagccaaacgttgtaaaacttcacgtagggtggtgcgagttacaccaatcttatcggctaaatcacgttctgatggcaaattactgcccgaaggaaaaacatcttgccaaatactctttacaatatattcctctgctaaagctgctggactttgggcttttaaaatgtcgttattgttttgcattacaattaaaaatcagataaaaatcaaaaaaaatgcaattttataaaaaaattacttggtttttattatcctttaaagggggatatattacaatgttcgcgtgataaaaataatggagttcactatgacaaacattcaggcttttatgaaaaactttcttggggcaagtccagaatggtacaaacttgccattgtggtttttcttattataaatccaattgttttcttttttattagtccttttattgcgggttggttactggttgcagaatttattttcacattggcaatggcattaaaatgctaccctcttcaaccaggtggtctattagcaattgaagctattattattggaatgacaaatgccaaacacgtcaaagcagaaattatggcaaactttgaagtgatcttgctactgatatttatggtggcaggtattttctttatgaaacaattactgctttatgtatttactaaattacttgtcaaaattcgttctaaaattgcactttctattgccttttgttttagtgctgcttttttatcggcttttctcgatgctttaacggttgttgctgttatcattagtgtcgcaatgggattttatggtgtgtatcacaaagttgcatcaggcaataatttaattgatgcggttgatatttcagacgatagaaaaattattgaacaacagcacgaaatcttagaaaaattccgtgcattcttacgtagtttaatgatgcatgcgggtgtaggaactgcactcggtggtgtaatgaccgttgttggagaaccacaaaacttaattattgcagaacaagcaaaatggaactttatggaatttttcctccgtatggcacccgtgactattcctgtgtttatctgcggattactcacttgtttcttggtcgaaaaattcaaattatttggttatggcgagaaattaccagacgaagtgtggaaagtcttatcagacttagatcgcactaattcagaaaaaatgtctaaacaagataaaattaaattaggtatgcaagcgttaatcgcaatttggttaattcttggattagcattccatcttgccgcagtcggtttaattggtttaagtatcatcatttttgctacgtctttcactggtgtgacggatgaacatactatcggtaaagcctttcaggaatctttaccctttactgcattgctcgttgtattcttttctgttgttgcagtaattattgatcaaaaacttttttcaccaattattcacttcgttctttctgcggaagaaaatacacaacttgctttattctatttgtttaatggcttgctttcttctatttctgataatgtatttgttgcaacggtttatattaatgaagctaaagctgcactgacaaatggagtaattgcaccgcatcaatttgaattgctttctgttgccattaatacaggtacaaacttaccatcagttgcaacaccaaatgggcaagctgctttcttattcttattgacttcatcaatttcgccattaattcgcctttcttatggcagaatggtttatatggctttaccttacacgattgtactttcaatcattggtttactggctattgaatttattttaccagctgccacaatttggttagcaagtttaggtttaattttgccaatttaaggagaaaaaatgctcgcgctattaaaacaattttccgaaaaacgttttgtgtggtttttattggctttttcaagtttagccttagaatccaccgcactttacttccaatatggaatgggcttacaaccttgtgtgctctgtgtttatgaacgtttagcaatgattggcttatttgtagcgggcattattgcattacttcaacctcttgctttcatacttcgattaatcgccttggctttaggtttattcagcagtattaagggcttattgatttcatttcgtcatcttgatttgcaaatgaatccagctccttggaaacaatgtgagtttattccaaattttcccgagactttaccatttcatcaatggtttccatttatatttaacccaactggctcttgtaatgaaagccaatggtcattatttggtttaacgatggtgcaatggctagtggttattttttcactatatgtggttattctcacattattgttaatcgcacaagtgattaaaacacggaaacaaagaagattatttaactaaaaaaatacggtgaaatttcaccgttttttttattacattaaaatcaaccgcactttattcaacggtaactgattttgctaagttacgaggttgatctacatcagtgcctttaattaaagccacataataagaaagtaattgcattggaatggtataaaaaatcggtgcaacaatatcattgacttttggcatcgtgatgattttcattccttcacttggcgtaaatcctgcttctttatcggcaaatacgtataattgaccaccacgagctcgcacttcctcaatgttcgattttactttttctaataattcattatttggtgcaacgacaatcactggcatatcagcatcaattaacgctaatggcccgtgtttcaattctcctgccgcataggcctcagcgtgaatataagaaatctctttcaatttcaaagaagcctctaccgcaattggataaaacgcaccacggcctaagaaaagcgcatgatgtttttcagcaaaatcctctgctaaagcttcaatttctctatcaaaggctaacgctttttcaatttcagcaggtaaagattgcattgctttaataatttcacgttctttttctacagaaatatgacctttaactttaccaagtgccgttaccagcattaataatgcagcgagctgtgtcgtaaatgcttttgtcgatgccaccccaacttcaacaccagcacgagtcataaatgcaagatctgattcgcgtacgagcgaagagccagcaacattacaaattgttaatgctgccatgtagcccttttctttcgctaaacgaagtgcagctaaagtatcggctgtttcgccagattgagaaagggtaatcaataagctatttggacgggtaacaaatttgcgataacgaaattctgatgcaatttcaacatcacagctcacgccagctaaagattcaaaccaataacgcgccaccatacctgcattataagatgtaccacaagcaacaatttgaatatgctcaactttttctaaaatgccttttgcaccattaccgattgaatcaacaatcacattttcgtgattaatacgcccttccattgtattaataagtgcagttggctgttcgtaaatttctttctgcataaaatgacggaatttacctttctctgcagcgtcattttcaagattagactcgtgaatttcacgtttagccttattaccgtgagtatcataaatatcaactgtacgacgtgtaatttctgcaatatctccttcttctaaaaagataaaacggcgagtaacacttaaaagcgcaagttgatctgaagctaagaaattttcaccgatacctaagccaatcacaagtggactaccagaacgagctgccactaaatgttcaggatgacggctgtccattaccaccataccatatgcgcccgtgagttgttttaccgatttctgcacagcctctaaaagggaatccgtgctacgcatttcccattcaacgaggtgagcgatcacttcagtatctgtttgtgataaaaagacataaccacgagattttaataattcgcgaagttcttcgtgattttcaataataccgttatgtactacagcaaaagtacctgatgaatgcggatgcgcattagtttctgatggttcgccgtgagttgcccagcgagtatgtgcaattcccgttccaccaattaatggtttttctgatacggcttcatctaaagctttaactttgcctaaacaacgaatacgttgtaattcattttgtttattgattactgcaacaccagctgaatcataaccacgatattctaaacgatgtaaaccattaattaagatttccgctacatctcgttgcgctactgcaccgacaataccacacataagttttccttatttatcctattactaagtttgtttttacatttgccacgcgtttacacaataaaaaaaaccctgcgcaatcgacagggcttcatttcattgatgttatcaattatttgattgcatcttttaatgctttaccagatacaaatgctggcactttagatgctgcgatttggatttcagcaccagtttgtgggttacgaccagtacgagcagcacgttcatttactttaaatgtaccgaagccgattaattgtacaggctcaccttcttttaggctcgcagtaattgcatctaaagtcgcttctaacgctgctttagcttgttttttgtttaactctgcagcgtttgcaattgcatcaattaaatctgttttgttcataaatttgtaccttctgttaaataaaaagtttgattctttaaaagtatctttgcgaatttgtcgcaaaaactgtgcaaaggataatctaacttgagatgaattaaaagcatgatttataaaaattgtgacaaatctcacgttattgatgaaattctataccaatgttagatataccctcagtccgaatttcattttttaaagctaaaattaattcaatatcacgtttttcacattctttaagcaaacgataaacttgccattgcacatcaagttctgtttgaatatcttcattttcttttagtttactttctgaccaatctcgtccagtttctgtttccaataatgcccttactgttcccaacgaaattaggcttatttccaccgctttttctaaggtttcgcccgcaataatggcgtgtaaaatttcagctaaagcctgacaggcatctaacgctggcacaacaccaaaactatcataatcattcacatcaggaataatgctttctaatttctccaactgattttcaaagttgattttgacatctttaattgttaaatattcccacaccaaattgagaatattttgatacgttttggtttcaacgctaagctcgttcatttgacagaacaatttaaaatttggtgccatacgttcacataaagcagccataaaagtaagatgttgccaactgtctaagttttctaagcgtttatgaatcggatttcgcatcttatttccttaattcgtaagagttggaatatttattaatcgcatttatgttccgctttacaaagttcaagcgtcacatgaattaatttgcgagcgatagtacccgttggcggtaattctggcaagggttgatcataagaaaaccattgtgcatcatgaatttcactttcctgcaatgttatttctccgctttcataatcagccagaaaaccgaccatttgagaatttggaaatgcccaaggttggctaccgaaataacgaagattttttattgaaatccctgtttcttcaaaaacctctctctgcaccgcttgttcaaatgtttcccctacttcgacaaaacctgcaagcgtcgtgtatattcctccgttaggactataatgtcgcttatgatttgccaatagaatttcgtgaccacgacgaaccgcaacaataattgatgggcaaatcacaggataagtttgatacccacagtgaatacattgcactgcaagttcatcttgagtttgttgtgttttatgaccgcactttccacaaaatttatgggttttcagaaaatgattaatttccacacctcggcttaatatatggaattcatcctctggcagtgaaagcaagttacgcaaactcacatattctcgttcatcactttcttgctcagccacaagccacaacggatgatttttccattctccaatttgcattgcctgtaatccttccaaatcgatatctttagcgataccaaaaggcaattcattattcactaaatacagattagaaccttgtgtaagcaaccaataaccaaaatcatcttgttgaagtattttcattttttctccataaaaataaccgcactttcaaaagtgcggtcattataaatcttcttttataactcactaataataagaatgttcgccacgttgatgctcagttatatcttttgcaccttttaattcattcgggaataagctaacaagttgtttttctacgccatcttttaacgtaacatccaccattgaacaaccgttacagccaccaccaaattgtaaaactgcgtaaccatcttcagtaatttcaattaaggttatacgtccaccgtgatttgcaagctgtgggttaatttgagtttgaattacatattcaacacgttcaatcaatggcgcatcatcagccaccttacgcattttggcattcggtgcttttaaggtcagttgcgcaccaagctcttcggtaacataatcaatttctgcttcttctaagaaaggcaaactcacttcatcaataaatgcagaaaaagtattatatttcatttcaatatcgctttcttccacggcattcggggggcaataagatacgccacattccgcattaggcgtacccggattaacgacgaaaatacgaatattcgttccttcttcttgggtgtctaaaagttttcgaaaatgcgcttgtgcggcatcagaaatagcgatttgctgggttgcttgttccataattatgtcctaaatacttgagagaaagtatcgggaataatacgcttatcgcgcttttttttccagtgctttatattaagctcgtgccagcccccacacttgaatctcctccacacctaattttcgcaacaattttgagatttcattgagtgtagaaccagtagtaatcacatcatccaccaacgcaacacggcgataaggaaattcatttttcgaaacaacaagagaaaaggcattttttaaattctgacgacgatcttttgcactcaaaccacgttgagtataggtgtgtttcacacgctttacgatattgctcaaattaggaatatccagccagcgacttaattgccgagataataaatctgcctgattataaccccgtcgccactgacgaaaatgatataaaggcactggaatgattgcttctggcaatttaagttgatgcgttcgtttagcatcacgcaccgcaagatataaaagccgagctaaagtgcggtcaatccaaaattgattttgaaatttaaaacggtgaatcaatatcgaaagaggttcaatataatgcccaataatgaccatcttatcccaacttggttcttgtttaagacaattaccacaatgctgcgcataatattgcaattccgcaccacaatgaccgcaataaggaaaagatttaatttgtttttggcaacctgaacatagcccattttttgcaatatgaagattgccacgacagtggatacagcgaaaattaaaaaaattcatcgtctaaaaaagttattttttccccgcacttttttgtttcaacgcctctaacgtttctcctgcttttaaaatatgcggcgtgacgaaaatcacgagctcacgtttttgatgtcgttcactttctttgctaaataatcgtttaataacgggtatatcgccaagcaatggcactttatcttcgcttttcgtgattgtgtcgtgaaatacgccgccaagcacaatggtttccccatctttggcaaaaacctgagtattaatttcttgcttatcaatagaaaccacctcattttgtccataagcgacacgagaaccaggggaattttgacttaccaataaatcaagtaagatattgttatctttagaaatatgtggcgtcacttccaaaccaagtactgcctcacgaaattccacagattgcgtatcgttacgagtattactcacgatgtaaggaatttctgtcccctgtttaatgctcgcacttttcttattggtagtgagtaagcgaggacttgcaataatttctacattattttcacgctccaacgcactcaattctaaatcaagcaatcgcccattaattttcgcgacttgtaatgctatagagccagcaggtgtcgtcgttgtcgcaaaatttacattaagattatccgcaatattttcaaagctattgcctgtaaggctgcccgcaactcgtcttgcattttcagttggattaaaaatcccccaccgaacgccaagttctttcaaactctcatccgtaattgtcacaattcgcgcttcaatagcgatctgttcaataggcttatccatttcagcaatcagttttttgatattttgcacaaaacgaggttcatcctgaataaccagcaaattactgcgatcatcaaaggtaatgctccccgcagaagaaagcaaagatccacttcctgttgttaaggatttcattaattcagaggctttagcaaaatgaagttttaccgtgtggctgactaagtgcggttcatttgtcgtaagatttcctgcaacttgacctttgccagattgactgccgtttaaataataaaccccatcatctttattcaaagtaagatgcttactttttgcgattatttttagcaaacgtggcatatcaatattgtttaatttcaaagaaatattgccttctaacctctcacccatcactaaattcacatcttgttgaaaagctaattgctccagtgtttgagctaaaggtgcttgcgataaacgaataaaaaaacattcgttatctgttttaggattagcaaaaacgattaatggcaaacaaaaacacactaaaaaataaccgcactttaaaaaatatttcttcataatcttcctttaaaaacttaattttttccattcactactatcacattgctctccgagcttacgcataaattgaacattgttttggttgattttttctacaatatagccctcttgagccacatcaacgccctctaaaacgctgtaaatttgcaaaccttgatcttgcaacaaggcaaaggctttatctttagaaatcactacgcccaccaattttaaagcgttcaaaggaatttcagccgcttggcgattttcatccgctccgcatagattattaggtacatctgaggaaattatttctgtctgctccattactgtttgtgcgttatcaaactgagaacggttacgctgtgttttatcgaaaggatcttgtccccaactgcaattcataaaaaataatataatcaggaaaaaccaatgtttcattttgtttccttatctagctgaaaaatgatctcggtttgcaatgggttgtcttcgggtttgataaactgcaagcgactcactgaaagctgtgacgaattagccaaaagtgcggttaaaaatgtcttcgttttctcaaaatgacctgtaagctgtaaatgcaaaataggcttttgccccatttcccaacgtaaatgctgagataaaccgttacgcgcagctaaacgttgaatttgtttattcaaaggaataatttgtgcagccagttctggagaaagttttcgactttccgactgctgctgtaaagaagttaaaattttctgttgatgcaacaattctgaacgtttcaccgctaactcattttcaatttcatggaaacgtgaactcccctcgatataatctaaaacggggcgaaaaatcaccgcacttaatagcaataaaaaggttaaaccgtgcacataaaaaggctgacttagccattttccaaaaggagtaaaaggatcgttaaaaaaagctttcatttttccgccccttgttccacatcaaagtgaaaaaacaatgtatcttgttcaggttgaacctgacttaatttcacattgggaaaatgtttctttaaaaattgatgaatcagttcaaattctgtttgatcttgcgcgttaccttccaaacttaagttattggcatcttgtttaaatttattcagttctccttgttgaaaaggtaattcacttagctgttgtaaactcttttttacttgctcgttgggaatagatgtcaaaacttcaccaactttcaccgcactgcgtaactgatcaatttgcatggtagttttgtgaagttgctgattaagttgttcaaaagatgtttgctgcgcttgcaaattttgtttctgttgttcaatcaaattgctaaaagccaacattaaattaatagcaagcaagataaataaagcgatataaaaagctaaacgacgtaaacgcttttgatgttgataagtacgccaaggcaataaattcatcgacatttaaccacccactttttgttgatgtaaatctttttgccatagcgcgttgccaagcgcaataaaagggagttctgtttctactcgctgccagttttcgggtaatggtgtatgacttgagggaatttgataaacaaaaacttgttcaagttgtccttcaaaacgttcggtaaattgttcataaagtgcggtcaaattttcgtgagattgtaaaatttgcgattgctgcgatctttcacagatcgccaaacaatagtcatcttcttgaaataaaaataaggtattttctgaccgcacttgttcattcaacaaatactgaaatgcacgcaaaatagcatttgacgcaacatccaatacattaattttaaatggctgaaaatcttgcaaataagtttgagcagtacttttacgaattgcagtaacgtctaatcgaaaaccttgctttaacgaggtagaacgataatcaaaccataattcatttaaagaaataggcagctctttttcaatcacaaatttacattgttgatgacattcttgcgcatttaacacttgtggcaacattaatactttcgaccaagttaagtgagcgggaatgcttgccacaaactgtaaaggaaaggttttcccttgatattgtgtttttagctgttgtaaaaaacgatttttaaaatcacgatcattaacaaaaatttgataactttgtggctgttcaagatcatcaaaccacacaaaatcaaaataaccctgcttacgatgaatgccgatttgtaaagtgcggtaatttttcagggagaattgcatattctttcctattctttaaaggctgaatcttttatacttaacaactaaatcataggtctcttgacaagaatattcattaaccaagcgagaattttacgatgcggatcgcaaaattaatattaaacaccctattaactttatgtattttaggtttagtggctggcggaatgttgtatttccacctaaaatcggaattgccctcagtagaaacattaagaaccgttgaattacaacaaccaatgcagatttatacggctgacggtaaattaattggcgaagtgggcgagcaacgccgtattccagtgaaattagccgatgtgccacaacgcttaattgacgcatttttagcaacggaagacaatcgtttttacgatcatcacggattagaccctatcggcattgctcgtgcattgtttgtcgcagtgagtaatggcggtgcatcacaaggtgcaagtacgattactcaacaattagcgcgtaactttttcttaaccccagaaaaaaccattattcgtaaagcccgtgaagcggtgcttgcggtagaaattgaaaataccctcaacaaacaagaaatcttagagctttatttaaacaaaatctttttaggctatcgttcttatggtgttgcagcagcggcacaaacctatttcggtaaagcattgaatgaattgaccttatctgaaatggcgattattgctggtttacctaaagcaccttcaacaatgaatccgctttattcgctaaaacgttcagaagaacgtcgcaatgtggtgctaagccgtatgttagatgaaaaatacatcagcaaagaagaatatgatgctgcattgaaagagccgattgtggcgagttatcacggcgcaaaatttgaatttcgtgctgattatgtcactgaaatggtgcgtcaagaaatggtgcgtcgttttggcgaagaaaatgcttacaccagtggttataaagtatttaccactgtactttcaaaagaccaagctgaagcccaaaaagctgtgcgtaataacttgattgattatgatatgcgtcacggttatcgcagtggcgcgccattatggcaaaaaaatgaagccgcttgggacaatgatcgcattgtcggttttctacgcaagctacctgattcagagccatttattcctgcggcagtgattgaaattgcaaaaggcggtgctgatatattgctcgcttctggggaaaaaatgaccttatcaaccaatgcaatgcgttggacaggcagaagcaatcctgtgaaagtcggcgagcaaatttggattcgtcagcgtgctaatggggaatggcaattaggacaaattcccgcagcaaattcagcattagtttctcttaattcagataatggcgcgattgaagcagtggtgggcggatttagttatgaacaaagtaaattcaatcgagccacacagtctttagttcaagtgggttcttctattaaaccatttatttacgcggcagcattagaaaaaggcttaacgctttctagtgtattacaagacagcccgatttctattcaaaaaccgggacaaaaaatgtggcaaccgaaaaactcgcctgatcgttatgatggcccgatgcgtttacgcgtaggattaggtcaatccaaaaatatgattgctattcgtgcgatccaaacagcaggtattgatttcacagcagaatttttacaacgttttggttttaaacgtgatcaatattttgctagcgaagccttagcacttggcgcagcctctttcacaccattagaaatggcgcgagcttatgcggtgtttgataatggcggtttcctcattgaaccttatatcattgaaaaaattcaagataacacgggtaaagacttatttattgcaaaccctaaaattgcttgcattgaatgtaatgatatacctgtaatttatggcgaaaccaaagacaaaatcaacggctttgccaatattcctttaggcgagagtgccttaaaaccaacagatgacagcaccaatggcgaagaattagatcaacaacctgaaactgtgcctgaactgccagaattacaatcaaatttcaccgcacttaaagaagatgcgattgatttaatggctgctgcaaaaaatgcctcgtcgaaaatagaatatgcgccacgtgtcattagtggcgaacttgcttttctcattcgtagtgccttaaatacggcaatttatggcgaacaaggtttagactggaaaggcaccagctggcgcattgcacaaagtattaaacgtagcgatataggcggtaaaacaggtactaccaacagttcaaaagtggcttggtatgcgggatttggtgcaaacttagtcactacaacttatgttgggtttgatgataacaaacgagtacttgggcgtggagaagcgggtgcgaaaacagccatgccagcttggatcacttatatgaaaatggctttgagtgataaacctgaacgtaaattgccactgccgccaaaaattgtggaaaaaaacattgatactttgacaggtttgctttctccaaacggtgggcgcaaagaatattttattgtgggaacagaaccgacacgtacctatctttcggaaatgcaagagcgtggttattacgttcctacagagttacagcaacgcttaaataatgaaggcaatacgccagcgacgcaaccacaagaactcttctaaaaatgaccgcactttagtgtgaaatcgggcgagtcaattggctcgccttcgttataaaacaaaggatatattatgctgagttatcgtcactcatttcacgcaggcaatcatgctgatgtcttaaaacatatcgtcttaatgcttattttggaaaaccttaaacttaaagaaaaaggctttttttatttggatacgcactctggtgtaggtcgttatcgtttatcttcaaacgaatcaaaaaaaacgggggaatataaagaaggtattggacgcttgtgggatcaaacagacttacccgaagatgttgcccgttatgtaaaaatgatcaaaaaactcaattatggtggcaaagaactacgttattatgctggctcaccgttaattgctgcagaattgttgcgcccacaagatcgcgcactattgaccgagcttcatcctagcgattatccaattcttcgcaataattttagcgacgacaaaaatgtcaccgtaaaatgtgacaatggttttcaacaagtcaaagcaacgcttccgccaaaagaacgccggggcttagtactcatcgatccgccttatgaattaaaagatgattatgatctcgttgttaaagccattgaagagggctataaacgttttgccactggcacttatgcgatttggtatcctgttgtattacgccaacaaactaaacgtatttttaagggtttagaagcaacgggaattagaaaaattctaagaattgagctcgctgttcgcccagatagcgatcaacgaggaatgactgcgagcggtatggtggtaattaatccaccttggacattagaaacccaaatgaaagaaattttgccttatctcacaaaaacattagttccagaaggtactggaagctggactgtcgaatggattacccctgaataaccgtctcttcccattctaaacaccactaaatttcaccgcacttgacttcaaaagtgcggtgaaattttctgagattttaaatccccaaaatcattaaccctactgttcccaaaagcccattttttcgctagaatgcacgcaatttttgacttaataaaggataacattatgtttggaaaaggcggtttaggcggcttgatgaaacaagcccaacaaatgcaagaaaaaatgcaaaaaatgcaggaagaaatcgcacaactagaagtaacgggtgaatctggtgcaggtttagtgaaaatcacgattaatggtgcacataactgccgccgtattgacattgatccttctttaatggaagacgataaagaaatgttagaagatttaatcgcagctgcttttaacgatgcggtgcgtcgtgcagaagaattacaaaaagaaaaaatggcatcagttaccgctggaatgccattaccaccaggaatgaagtttccgttttaatcgaacacttgtcttcccctgcttgcgagggaaggtgtcgcaaagcgacggaagggggttccccctaagtcttcggtattcccccgtaaatagagggagcggaaagtagccttatatttcatctcaaattatgcaaagcagtccacttttagaacaccttattgaaaacttacgttgtcttccaggcgtagggcctaaatctgcgcaacgtatggcttatcatcttttacagcgtaatcgtagcggtggaatgaatttagctcgagcactcacagaagctatgtctaaaattggtcattgttcacaatgtcgagactttacggaagaagacacttgcaacatttgcaataatccacgccgtcaaaattcaggtttgctttgtgtcgttgaaatgcccgcagatattcaagcgattgagcaaacggggcaattttcaggacgttattttgttttaatgggacatttgtctccacttgatggtattgggcctcgtgaaattggcttagatttactgcaaaaacgcttagtagaagaatctttccacgaagtgattcttgcaacaaatccaacagtggagggcgatgcgacggcaaactacattgctgaaatgtgccgccaacataatatcaaagtgagtcgtatcgctcacggtatccctgtcggtggtgaactagaaactgtggacggcacaacgcttactcactcttttctaggtcgtcgtcaaatcgactaatcttctcataccattatgcgtttatttatcgccgaaaaaccaagcctagctcgtgctattgcagatgtgctacccaaaccccatcaacgtggggatggttttattaaatgtggcgataatgatgtggtaacttggtgtgtagggcatttgctcgagcaagcagaacccgatgcctatgatcctaaattcaaacaatggcgtttagaacatctccctatcattcctgaaaaatggcaacttttaccgcgaaaagaagtaaaaaaacaactttctgtggtagaaaaactaatccatcaagcggatacacttgttaatgcaggagacccagatagagaaggacaattacttgtagatgaagtcttcagttatgccaatttatctgccgaaaaacgcgataaaattttacgctgcttgattagcgacctaaatccaagtgcggtagaaaaagcggttaaaaaattacaacccaaccgtaattttattcctcttgccacatccgcactcgcacgagctcgtgccgattggctttatggcattaatatgaccagagcttataccattcgaggtagacaaactggctatgatggcgtgctttctgttggacgagtgcaaacccctgtgctaggtttaattgtacgtcgagatttagaaattgagcatttccagcccaaagacttctttgaagtacaggcttgggttaatccagagagcaaagaagaaaaaactccagaaaaatcaaccgcacttttcagtgccttatggcaacctagcaaagcttgcgaggattaccaagatgatgacggcagggtgctctctaaaggattagcagaaaacgttgtaaaacgtattacaaatcaaccagcagaagtcaccgaatacaaagacgttcgtgaaaaagaaacggcgcccttgccttattcactttctgcgttacaaattgatgcagcaaagcgattcggtatgtccgctcaagccgtattagatgcatgccaacgcctgtatgaaactcatcgtttaattacttatccgcgttctgattgtcgctatttacccgaagaacattttgccgaacgccacaatgtattaaatgcaatttcaacccattgtgaagcttatcaacgcttaccaaatgtcatttcaactgaacagagaaatcgctgttggaatgataaaaaagtagaggctcaccacgcaatcattcctactgccaaaaatcgtccagtaaatctaacacaagaagaacgtaatatttacagccttatcgctcgccaatatttaatgcaattttgtcctgacgcagaatatcgtaaaagtaaaatcacattaaatatcgctggcggtacttttatagcccaagcgcgaaatttacaaacggctgggtggaaagaattgttaggcaaagaagacgacacagaaaatcaagaacccttattaccaatagtaaagaaaggtcaaattttgcattgtgaacgaggagaagtgatgagtaaaaaaactcagccgccaaagcctttcaccgatgcaaccttgctttcagcaatgacgggcattgcgcgatttgtgcaggataaagaactcaaaaaaatcctgcgagaaaccgatggattgggtacagaggctactcgtgctggcatcattgaattactttttaaacgcagttttttaactaaaaaagggcgaaatattcacagtacagaaactggaagaattttaattcaggcattaccagatattgccacccaaccagatatgacggctcattgggaatcgcaactcacagacattagtcaaaaacaagcaacctatcaacaatttatgcataacttgaatcaaatgttacctgatttagtccgttttgtagatcttaatgcattaagacaattaagccgcattaaaatgattaaatccgatagagtgaaacctaaaagtgcggtaaaaaaatcgagtaaatcaaacggtgaaactgattaaagttaaaccaattaatattttttttatgcaaagcacttgcgagaaaattgaattttctataacattcacgaccagttttcttgcaaaattgcaaattagagagaaaaaatgtatcaagttcttttatttatttatgttgttgttgcgattgccttgatcgggtttattctcgttcaacaaggtaaaggagcgaacgctggtgcatcttttggtggtggcgcatcaggtacaatgtttggctctgctggtgcaggtaactttttaacacgtactagcgcgattttagcaaccgcattttttgttattgctcttgttttaggtaatatgaattcacataaaggcaatgttcaaaaaggtacttttgacgatttatcacaagctgcagagcaagttcagcaacaacaagcagctccagcgaaagacaataaaaatagcgacatcccacaataaaataggattagcataaaaattaaagctctggtggtggaattggtagacacgctatcttgagggggtagtgaccacaggtcgtgcgagttcaagtctcgcccagagcaccaaattaaaaatatacagcactaaaagcattacaaagccttgattctactgaaatcaaggcttttttattccctatactccactataaaatactatcgaaccttagaatcttagtaatagacttaataatatattcacgctaaggcaaaaaaatctattactaaaacagcatagagacttgtaaatactaggattaacgcctagtttgttatattactaagtagggctattttatggcatacttaacaaatccgctttctgacgcccaaattaaaaaagcaaaactgaaagaaaaagattgctcctacttttacaaacgattcacgaatacatccataactaaaaggactaagccctgtagattacagagcttagtccttgatttcatagtctaactttttcaatgaaaattattttttacattcaaagtgcggtattattccgcattgtttttcgatttaataatggcgtaaaccacacctgttgataaagcaccaatcgcaattgcaccaagatatttcaacggctcagatacaaatggaatgacaaataatccgccgtgcggagcttgtaaggtaatatttaatcccattgaaatcgcaccagccaccgcaccaccaatcacagagctaataatgactcgaattggatctgctgccacaaatggtaatgcaccttcagaaataaaacataaaccaagaacaaatgatgctttccccgcatcgcgttggctaacggtaaatttattgcgagcaatccaagtcgcaactgtcataccaattggaggaaccatacctgcggccattgccgcagccattggtgtataaacttgggaggcaatcaatccaacagaaaaagtgtacgctgctttatttactggtccgcccatatcgatacacatcattgcgccgataattacgcctaacacaatcgcattcacttcgcccattgaagtaagccaattacttagctctttcataatttcagccactggtggattgatgaggtaaatcatcgtcaaaccaacaatcatcgaacccaagagcggtaaaattaaaatcggttttaatgaagtcaggcttgctggcaatcgaataatcacatttagccctttcaccacatagccggctaagaaacctgcaataataccgccaagaatccctgcacccgcttcacttgccagcatccctgcaatcaaaccaactgcaagtcctggacgatcagcgatagaaaatgcaacgtaaccagcaaacacggcaatcattaacttgaacgccacaccactaccgatattaatcaacatattaggaagatcttgaaaaactcctgtattttcaattacattaaaactgaacataaaggaaatcgcgatcaacaatccaccagcaaccactaacggtaacatatgagaaacaccagtcattaagtgtttgtacacaccttttttctcacggctttcttctttcgttcccgcattatttccaccatcaaaaattttggcttctttaaatgccttatcaaattcttgctcagttttcttcaaggctaatcctgttgaagtgcggtatattggtttacctttaaatttatctaaaggcacgtcaatatctgctgcaacaaataccaaatcagccgccgcgacttcttctgcagtaatttcattgccagccccaacttgaccacgggtttcaacttttacattccaaccttgttttttcgcataggcttcaatcgcttcggctgacataaacgtatgtgcaacgccagttggacaagccgttaccgcaacaatattttttacaccagaaacacctgtaaaactcaccgcacttttcggtgcaacataatcagccccattcgctaaggcatttgccaatgttacttcaggagaaatcatggcgatagcttcgccgataataaagacttttttaccaactaacgcagggttatttggtaatacagaaccaaatacaagaacaagatctgcttcggctggtgtttctacaatagagacatttgctttttgtgcagctgctcgaaaaacttcatgtaataaataggctttcgcatcgcctacattagctgattgggttaaaaataacttcatactatccttcaatcatcgttatttgtactttttctaaaatggggtcaagtaaactcaaatcactcacaccgacgttactctgagataccgcaaaagcggacacagccgtagcaaaagctaaggtttctgttttcgataaacctttttcaaaaccatagattaagcctgctaccattgaatcccctgctccaacggtactcacgacattttcacattttgctggttcggctttaagcacgccttcattattaatccataaagaaccttttgcgcccattgaaataatcacgttttcaatgccttccgctttgagttgctgtgcagcggcaataatttcttcaagactatttaatgaatgaccaacccaagcctcaagttctcgatgattgggttttactagccaaggtttcgcttttaatccagcggtaagcgcagcattgctactatcaagcaccactttaacgccagcttgatgaagctgatttaaccaatcagcaaacaattcaggagacacacctcgaggtaaactgccacaaactgcgacaatgtcataatctaaacaataagccaaagaatccgtcacaaattgttgccaaatttgtgggcttatttgatatcccaagaaatttaaatctgtcacatccgcttcagtctcggtaatttttacattgatacgtgttttgccattaacacggtggaatttatctttcaaaccgtgctgattaaacatttgctcgaaatcagctgaattatccttgcccaagaaaccgcctactgcaacattaacgcctaaatcttttagtacttttgcgacattaatgccttttccagcagggaataagcccaatgtttctaccgtatttacttcgccaagttgaatacgatttaaacgcccaactaaatcataggcggcatttaaggtaatggttacgacgcttgccatactattcccctaaacccgattcgatcacagcgctgattccgtcaatagcttgttgcgcttcttcgcccgtcgcaacaaaacgtaaacgagtccctttgactacgcctaatgctacaattttcatcaaacttttagcactgactaattgagaattacgatcaaggttttgaactgctacggaagcattatatttcttcacttcatttaccaatattgcacttggacgagcatgcaaaccttgctcgtttttaatcacaaatacggcttcaatggcatttgccggcaaattatcatcttctgttaccgcaggtgtgtgaatttgatcgcccataatctcaatggtatcgggttcagacggtggcactaccgaaacattctcgcccaagccattggctatcgctttgcccaatgattcaattgcttgttttgcatcttccccctctgccacaaaacgtaaacgatgtccttgtgttacaccaagcgcaacaatcttcatcaaactttttgcgctgacgacttcactttcacgagtaagattttgcatggttattttagaagtgaattttttcacttcattaaccaaatttgcacttgggcgtgcatgtaagccgtgttcattacgaatcgtaaaggttcctacaacagcaccttctacagattgagtttcaacatcactcgatgaacccaaaagtgcggtcaaaatttctgttgaatttccattgagcaaggttgtttggacatcgtcatctaataaacgcgccaaagttggattaatttgatcaccgacggctgaaacggttatcacgccttttacggccttgccattgtggctaaaaatcgttttggcacgactaaatgctaaggcatttttcacatttcctacgacagagtccgttacccataaccctttgccaagtggtaatgccgcattatttatcacttcagaaataaagcgattttctaccgcactttgcacctgtaattgccccgcattaatcgcaactaaagttaataaactttgggtatttacatctaaactgatattggcagcaggaatttcaaatggatcaattgtctcgcccattaaaatcgcgcaaaattcagccacatcagttatttttgctaattttgctgcagtatcttcatcgctcaatacatgggttagttggcgtaataaggacaaatgctcatcagatcgcgccgcaataccaatcacgacataagcaatatttccttcgccccattctatgccttgaggaaattgaaacacttgcacgcccgttttctttaccatcaaacgagtatccaaggtgccatgaggaatagcgatgccattgcctaaaaaggttgaggtttgcagctcgcgcgctaacattccttgcaagtaaccattttcaacattgcctgcttgaaccaatgcggacgctgccatttcgatcgcttgttgtttatcaattgcattagcatttaaatgaatgttgctttccgaaagttctaacattcttgctccttaataatttaaaaagaaagctgcggatgaaacaaatcgaccagcagcttattgaaaaacaattatttagatgtacaggctttcagcagcgcttcactaccttgcacaatatattcatcattttctccgcgcgcttcgcctttttgtaaatcacgcatcgcatcataaataccttgagccatactttgcgaatccactttttcccaacaatttgcgctcaaacgtttaaggttcgcttgcaatgcttccgcatgtaacacgccgctataataggcatatacatcagaatcatggccgccagtgtaaagtttatcctgaatttgtttcactggaactaaaatacggcctaaataccagtcattcgcaccacttgcaaaattatctacaaagaaattttcattcacgcgacctttatatgtcgccacagtcgcttcataagcagctgcataagatttttgatcgattttatctttatctaaatcaatcacttttttatcgttccccataaatggaatatggttagtaaccgatgaccaagaagaacaacctgccaatattaacgtaaaaaataaaacagagatttttttaaacatagtcatacctgattaaagttaataaaacgccgccattatactgtctgaaggggattaagcaaggaagcctgtaaggcttatctaggcaaatgttaatttcgtataaaatcagtaaaatcagaccattgctcaatacgaaaagcgcgaatatctcgtaccgactgagaaatccacgccaactgttttagtgcattcattgcctgaaagagattcgccatatcttcattcatgttggtatataaacttccttgtgttctaacaaaaccaaattttgctaaaactgcgccaatgtctgtataagcctcttgaacgccctttggatgataatcttgagtgtcttttacaactaaatcaaaagcaatcgcgtacataattttccttattcagcttcgggatcttcaagtaggtaagataagcgataaatgtctttttctccagattgtaacaatgtgatatttaccaacacatcaccatctggcaaaaattccgcaacctcgccaaccacataaggcacgccaaattgcccgaattgcttaatacagcctgttggaatttgttgtcttagttccatatttaacctcaaattttttatggttttataacataattttgtagagaaatggataaaaatttaccgcacttctactcctgctcttttactaaagacaccaaaatctgatcgattttaaagttttccgtatcaatcacttcaaacttgtattttccgtaaaccacagaatcggtttttttcgggattttacgtaacatatacatcataaaaccactgatagtttcgtagttttcttcatcgggaaaataagcaatatctaatactcgagttacctcttttaatggcgttgcgccatcaatcagccacgagttttcatcacggctcacaatatattcttcttcgttagaaaccaattcccccataacaatactcatcacatcatttagcgtaacaatacccaccacaagagcatattcattcacaataatcgcaaaatcttcgccagtagatttaaacaattccaacacttcgtaaagagaaagcgtatcaggcacaaataaggctttacggagtagtttaggatctgtgagcaccacattttcattctgcaaatacatagttagcaaagtatgggattcgatataacctaagattttgtcgaggccattgtcacaaatcacaattttagaatgagaatcacgagaaagcgtatccatcacttcttggcgagaaaaagtgcggtctaaatatacgatgttttcacgggttgtcattgtggaagttaccgtacgggcttgcatatcgaaaatattttcgatcaaataatgctcttgagtttttaatacaccagcttctgcgcctgcttcaactacggcgaaaatatcttcagaggtcatgccatcttcacgcacagtagaaatgcgaaataagcggaaaaatacattagcaatagtatcaaaaaaccacacaagcggtttaaacacatacatactaaaattcataatacccacaacgctcaacgccaccatttcaggataagtaatagcaatacgttttggaataagatcagcaaataaaataaacaaacaagtcactaatataaaagcgattgtagaggcggttggctcaatccaacttccttcaaaagaacgatttaaaatatctgcaatgtaaggacttagtgcactttcgccaattcccccacccaaaatcgccaccatattcaacaaaatttgaaccaccgtaataaaacgaccaggatgctcttgtaatttaagcacttgaagcgcacgcacgtcgcctttatttgcaagagattgcaattttaacttacgagaactcgccagagaaatttcagcagaagaaacaactgcactacttaaaattaaagccacaattgccaaaatagtatgaaataattccataatcattactcaaaaatataaaagaaaacgaccgcactttgcgaccgtttgggatattacttatcgctgtcaaaccagccgcgaataaattggatagacaaaaataatgtcgccagcaaaaatacatataaaatccacgaaacaatcggattgcttggtgtatcatcagcagtaatttctttaattgaggttgcattgcgatattcatccatcatcgtaatacgccaaccatagtatttaatttgcacaagtttgttgtcattacccaaagcctgcgcttcagcctgtaaattggccgatccaaatttgaaatagaacgggaaaccccaacgtgtatcttcattgcgatacaccataattttgccatcgtcattttgcgtattgatgtaatatacatcgcgtgttgggccatcagctggattcgattttgtgattgggccatctttatcaacacgtttaacttctacgccagtaacacgcgtcacatcataatgagggaacacataattcaccacagaaaacataaaaccgtggaataaaaaaacaacaataaataagaaatatttaaaaaactttcgcatatttttcccttgtcagaactgtacatttattctacacgaattttaaataaacgctcgaaattttgtgtagtgatttgagcaaacgcctctgcagaaacgccctttaaggttgccacgtattcacatacttctctcgtatacgctggttgattttcttttcctctgtaaggcactggcgcaagataaggcgaatccgtttccaccaataagcgatccattggcacataacgaataacctcacgaatcgcttcggcatttttaaaggttacaatgccagaacaagaaatgtaaaatcctaaatccaacgcttttttcgcaaattccatggtttccgtaaaacaatgaataacgccaccgcacttttcagcatgatgttcgcgtaacattgcaatggtgtcatcgcctgcagaacgtgtatgaataattacaggcttatctaattggtttgcaatatcgatttggctaccaaacaccgcttgttgtgccgctttattgtccgcactgtaataataatctaagccaatttcgccaatcgcaatcacttttggatcttgcgataaacgcaataagcgttctgcgtcataaggttcctcttcaaaatcgaggggatggacaccgcaagcaagcgagacattattaaattcccgtaaagagtcataagcctgctcaaaacggcttaaggttacaccaatcgcgagcaaatgtttcacatcacgcgcacgtgctttttccaccacatccgagatatttttatgtaaattttcataatccaacgcatctaaatggcagtgggagtcaacaatgaacataattatttttccttatgcctaaggcttgaacaccatagacgatatatctttaatttattgcgtttcaaatacttctgtgactaatcgcgtcaagccatctaatagcattaattcaagattcacaccattaattgtaagcaaatctgaccgcactttttgcataattttaatggcttgtaataaaccaagggcagtttgctcatcgctgaattgttcgatgccacggccaagatcagccacttgtcgatgactatcaatttcaagtttatgttttaaacaatcagaaagaaaagccaaaatccaatccacttgctgaacatagcgttctttatcaaacaacggaagcaattccaatggcgaacgtcggcgatagaacacccaaaattgacgtaagaagtttttacgctgttcaatcagcccttgttgtaaagtttctaatgctaaaagcggacgcccaagattcatcgcaagtgcggtcaaaatttcctgattttcagccgcactttctgatttcaaccaatcaacagccatttgttcattaggcacagacagattccacacttggcatcgactgtaaatggttgctaataaacttgctgaactatccgtctgaagtaaaaaataagtatttgaacgaggctcttccaatgttttcaataacgcattggcagcggcttccgttaaacgttccgctccttgcacatacaccactttattaccattttgttgtgcgtgctgcgcaacaatttcattaatgtcgcgtacttgatcgacgccaatatccttaccgtcaatggggcttaattcgtgataatctggatggctatgggcttgcattaaatgacaagaatggcattgaccacaaggtttatcgccttgagctacacacattattttctgtgcaagtgcattaaataaactctctacgcctaaaccagaatcagctttaatcagcacagcatgatgccccaacccttcgtcaaaggtttgagcaatttgatgataaattggcattagccaagggtaaagtgcggtcatttttcctgaaatttttgtaaataacgagggcaattatacacattttcaaactggcttgacaaaatagcaaaaagcaaacgtttacttttaataaataagaaataaatagaaaaaatttgaaccaaatggtatttttttgttcagttttatactagaattcacgccccatttatttttacttgacaaaggaaaatttattatgaaactcgaagcaagcaagcaagcaagcaagcaagcaagcaagcaagcaagcaagcaagcaagcaagcaagcaagcaagcaagcaagcaagcaagcaagcaagcaagcaagcaagcaagcaagcaagcagaagtttaaaaaatcatttattataagtctatttttttctattctttatacctctccgcttttggctgttgttgattatacttatgacaattctaaattaacaaatgagcaaattgaacgattaaaaaaactccgcgatagaaatagtgaatattggaaaaaggaaacttatctcctgaaaagtcccccctcaaactttccagacattccagtattattccctaaagattcttccgttccattcgaaaacatcgataactcaaaagcgatttctttttatgatcaaaaatatactgaagattaccttgttggttttgcccaaggtttcggggttgcaaaaagaaatggggatacagaagagccggtacgaaaatattttaaggaatgtctaaatactgggaactataacaatgacaattgtaaggctaatccattagcttccagcgtatccataaaaagcgatattttcaccccacggccaacaataaaaaatagccatatcaacagcgaaattttggctgtcggtaattatacagaattgatgttagctgcccaaccttctgcttcttcgtgggcagagcatctctattccgatccaggattatctcttactgttcaagataactcacacgttatcggacaaacgattgatttgggattcttacaattaacaaattctctttgggagccacgttggaattctaatatcgattatttagtaacagaaaatgctgaaattcgttttaatactaaaaatgaaagtttactcgtagaaggttattatgccggcggagctcgttttcgttttgcttacgatctaaaagataaagcccctgaaacaccagttttaacttttgaacaaaatataaccggcacctccgacatcatcttcgaaaatccaatagacgatttaaaaagcctagacggacatcaaattgtcaaagtaaatggcaccgcagataaaaatgcatttagactttctggtaaataccgaaaagggatttatacgctctctttacaacaacgcctagagggcttttttaccaaattgcaagaacgcgatgatattgcgatttatgcacaacaggctcaagccgccaataccttattcgctttgcgtttaaacgacaaaaacagcgatatttttgaccgcactttgccgcgcaaaggcttgtggttgcgtgtgattgacggacactccagccaatgggtgcaaggcaaaacggcacctctagaaggctatcgaaaaggtgtgcaactcggtggcgaagtattcacatggcaaaacgaaagtaatcaattttccgttggcttaatgggtggacaagcagaacaacgcagcactttccgcaatccagatacagataatcttacaacgggaaatatgaaaggcttgggcgcaggcgtttacgccacttggcatcaacttcaggacaaacagacaggtgcgtatgttgatagctgggcacaatatcaacgcttccgccaccgcattaacactgaagatggcacagaacgctttacttcaaaaggtatcaccgcctcaattgaagcaggttacaatgctttattagcagaacacttaacggggaaaggaactcaaattcgtttttacctacaaccacaggcacaattgacttatttgggggtaaacggaaaattcagcgatagcgaaaattcccaagtgaatctacttggctcccgccaattacaaagccgagtgggcgttcaagctaaagcgcaatttttactcaataaaaatatcgtcattcagcctttcgccgctgtgaacacgctttaccacagcaaaccgttcggcgtggaaatagacggagagcgtcgagtaataaacaacaaaaccgcgattgaaagccaatttggtatagcagtgaaaatcaaatctcacttaactttacaagccacattcaatcgccaaacaggcaaacatcaccacgctaaacaaggtgcactgaatttacagtggacgttttaagtttagtagtaacaaaaaatcggcaggaaaattttctgccgatttttttattctgaaagtgcggtcatttttcgtttgatttccaccaattttttaccgaattttcaattccagccaatgtagggtgggcgtaagcccacgcgtattattaataacattctttttttcgtgggcttacgcccaccctacgagcttaaccttataagcgacattcaatcgccaaacaggcaaacatcgccacgctaaacaaggcgcgctgaatttacagtggacgttttaagttaagttgtaacaaaataaaatcggcaggaaattctctgccgattttttattttaaaagtgcggtcatttttcgtttgatttccaccaattttttaccgaattttcaattccagccaatgtagggtgggcgtaagccacgcgtaattattaataacattctttttttcctgggcttacgcccaccctacaaggttaaccttacaagcaacattcaatcgccaaacaggcaaacatcaccacgctaaacaaggcgcgttgaatttacagtggacgttttaagtttagtagtaacaaaaaaatcggcaggaaaatcttctgccgattttttattctgaaagtgcggtcatttttcgttttatttccaccaattttttaccgctatttcgatatcagccaatgtagggtgggcgtaagcccacgcgtattattaataatattcttttttttcgtgggcttacgcccaccctacgagcttaaccttacaagctacattcaatcgccaaacaggcaaacatcatcacgctaaacaaggtgcgctgaatttacagtggacgttttaagttaagttgtaacaaaaaaatcggcaggaaattttctgccgattttttattttaaaagtgcggtcatttttcgtttgatttccaccaattttttaccgctctttcgatatcagcttgaacaagttcaatactctgctcagcattaattacgactgcttttggattctcttttactaacgctaaatagcgtgctcgagtgcgatggaaaaaatctaaatccatttgctcaatacgatctaattcaccacgtccacgagctcgcgctaaaccgacaattggatctatatccaaataaattgtgagatctggctcaaaatcacctaatacggtttctttcaaagtaagcataaaatgcggatctaattgacgtccgccaccttgatacgcctgagatgacatatcgtgacgatcgcccaccacccatttcccttgcattaacgcaggtttaattatgttatccaccaactgaatacgagccgcataaagcattaataactctgctttatctgtcacgggttcttcggtttcatgtttgatgagatgacgtaatttctcagccagtggcgttccacccggttcgcgtgtaaacacgacatcttgaataccaagttcatgcaagacttgcacaacagactgatgagcggagcttttccccgcaccttctaagccctcaatgacaataaactttcctttcatattttcttccgcacttttatttggcatttttctggctgcgataccagcgtaaatattcttgcaccgctttgttatgttcattcaaatttcgggtaaatttatgcccaccagaaccatctgccacaaaataatagaaatctgttttttcaggttttgcaacagcctgtaacgaactttcacttggcatagcaataggcgttggcggcaatccatcaatcacataagtattataaggcgttggggtttctaaatcttttttacgaatattaccgctgtaattctcacccataccataaattaccgttggatccgtttgtaatttcatttttgcttttaagcggttgataaatacagaggctacttttgccctctcattagcaatacccgtttctttttccacgatagaagccaaaatcaacatttcataagggttcgccaaaggtaaatcctcgtcgcgctcgttccaagccttatttaacgcctttttcattcgctcagccgatcgcttaagtagctctaagtctgtggatttaggcgtataattataagtatcaggataaagccaaccttccacattttttagttcaagattttgaccaatatcaggcaagtcaagtaatgtgaaaatttcttcgttactcttatctttcaaggtttgcaccaagtgcggtgcattttcaagatcttttcgccaatctttaaaggtttttccttcaatccattttacattgaactgcacttctttaccggaattgagcaaatccagtaaatcttgcacagttttaacattctcaagagaataagtccctgcttttattttatttagctcaggtttcaacttaagcaaataaggcaataatttcccatcatcaattaacttttcttgctcaaaaagtgcggctaattttaaacctgttgtgccacgttcaatagttaaaagttgatctgcctgcacatttactggtgtttttacaaattcagtcattttgtaataagcaaaactcgccacgcccgctaaaataaaaattaaaagtaaaatcgcaattaaaaatttcttcataagctataagaaagagaaaataaaaaacaacaaaaggggcaattaagcccctttatttttgatactttgttatttattaaaatactgaatattcgctcttttacgcaatgctttaacccaatcgttcgtcgcatcttgtaattgagtatttactaaacgttcatatgctttttgtgtgtaggcttctgctgtaagatcgccatcacgtacgccagttacttccaaaatatgccaaccaaactcagttttaaatggtgcagaaatcacaccttgtttacttttcatgacggtttgcgcaaactgtggtgcataagtttctgggaacgcataacctaaactaccgccattcgcacccgataaataatctttagaatattttaaagccgcatcagcaaaagttgttttacctgcaataatatcagaacgaattttagctaattgtttttttgcttgagcatcatttaacaatggattaagttttaacaaaatgtgacgcacttcgtattctttacctgtaactttttgtgcagtgccttgtgattttgcctcatccaacattttttgaccaagtgcaaccacttcttcacgcgttacatcaatactttcttgaatagctttgttacgtacagcccccatcaccatttgattggcaatttgctgacggaatgtatttaatgaaatgccttgataatctaacgcatccaaaaattgaccataagttaagccatttctagctgcagtgtcttccacaacacgatcgatttcacgaggatcaattttcacaccagattcttgaatcgctttttgcactaaaagatcatcaataattttatcaagtgcactttggcgatcgccttttttacccatattggcacgaacttggctttctaaaataggaataccatctactgtcgcgacaacacgttcctccgcttgtgccatagaagtaaaagcaacacaacctaaagtagccaataaaaaagattttagaataaattttttcattttcatctcatcaaaaaagagtccataacgttggttagagtaacaattctattgaaggttcacaatagataagatttatttccctagaatagcaacttcgtaacagccatcttgtttttcagtacgaacttgtacaagttcatcacggcttgttggcacatttttacctacgtaatcagcacgaatgggtaattcacgatggccacgatcaacaaaaatcactaattcaatttttgcagcacgaccaaaatcagtaagcgcatccattgccgctcgaatggttcgaccagtaaacaacacatcatcaaccaaaatgacggttttatcttgaatattcaaatattgtgatgaaccactataaactggcattttatcttcctgatcaaccaaagttaaatcatctcgataaaaggtaatatccagttccattgaaggtaaatttataccacttaactcttcaactcgacgttgtaataattctgcaatttccgcgccacggcgtttaattccaacaataacaagatcatctaaggtttgatgtttttcaataatttcgtgagaaatacgcgaaattgtgcgaagaaaacgatcatgatcaataataattttttccatttttcccagctttatcaatagtatttcaatgcacaaagtataaagaaaatacgcctaaaaagcgacggcatttgcaccatgtttcttgttcgttatactatccaaaacattccatcaaaggaaataaaattatgcactactctattcaagattttattcaactcatcgcccaacttcgcaatccaaatggcggatgcccttgggatttaaaacaaaattatgaatccatgattccttgtttaacggaagaaacttacgaagtaatcgaagccattgagaaaaaagacataccaaatttacgtgaagaattaggggatttattgttgcaagtcgttttcttcagccagcttgcaacggaagataaatactttacttttgacgatgtgttacaagatatcgctgaaaaaattgtacgccgtcatcctcacgtgtttggtgatgcaaaagcgggggacgaaacagaagccctttcccgttggaacgaaatgaaagccaaagaaaaacaaggtaaaagtgaagaaacctctattttagataatgtgcctcgtgctttgccttctcttacgcgagcggcaaaattacaaaaacgttgttcaaaagtagggtttgattgggaagaaatttcacccgtatttgacaaagtgcgggaagaattagaagaagttcaagctgaaattaaccgcacttcgattgaacaaaataaagtggaagaggaaatcggcgatttattgttcgcaaccgtcaatcttgctcgccacttaaaatgtgatcctgaagatgcattgcggaaagcaaatttaaaatttgaacgtcgttttcgagcagtagagcaagcggttcaacaacaaggtaagcaagtgaataatgtgccacttattgaattagatttgttatgggatgaagtgaaaaaacaagaaaactaattgagaagtgcggtaaaaatttctctcattttttaccgcactttcttcgttaaagttgctgaatatccagtgccatttggtctagcatttcataacgtttacgatacatagaacgttttttacttgcgatatcttctaattgtttgcgttcaatatgcaaaggtaattgccaatagttatggcgatattctccttggttttcttgccaaaattcatcgtaattaaacaaaatcttactgcgagcagaaagacggtattttccttgtgctttgtgcggaatgcccactaactcacattgccatttttcagcaagcattttgaacgcattaaccaacataaacattggtcgcataccgtgtaatgctttcgtagcctgtttcacaagttcttgtgcattgtcgcttgaggggccttgaattgaggcgataagcaatttattcgggcttaaaaaagtgaaagacgcatcatatactcgttcgttattttgattgcgaatattaatagaaaaatatccttcaaagggatcgatatgattaatactcaacgataaacgcaaatcctcagttaattgggttagcacgatatgttgttgatctaataattgttggcaaagcgaacgtcccattttttcttctgccaaacgtaaattctccgtaatcgccgttaaacgttctgaagcagaaaaacgtttatcgcaaaaggtcgtcagaattgtattagtacgataataatcttgtgtaaataaagactgccattgcgtttctgtattaaggaaatccactaattgatgacattgcttttgatataaccatttatagccataatagcgtaatttttcccgcacttgtttaagaaaagggcgatccttagaataaggatacatttgaacgtaagtggggaaaataaaatgatttttcgtggacataactcaatattttgtgaaatttaataaaatttttcgttattttagccattatcacttcatttgccaaaattcttttttgtttaaaacccactttataactcagattttgttataatcttttccttgaattcctttttccctaccccaatatttacccaaattatcggaacgaaattataagagagaccaattatggcgaagaatacccaacgtacaatgcccgtattgccattacgcgatgttgtcgtttttccttatatggtgatgccactttttgtagggcgcgtaaaatcaattaatgcccttgaagaagcgatgaacgatgacaaacagattcttttggtatcccaaagagaagctgatttggaagaacctacccctgaagatttatttgatgtgggtaccattgctaacattattcagttattaaaattacctgatggcacagtaaaagtgctagttgaaggtcaaaatcgcgcgaaaattaacagtcttgaagacggcgaaaagtgcttttccgcccaaattacccctatcgaaaccacttatggcgatgaacaagagttagtggtggcaaaaagtgcggtactttctgagtttgaaaattatcttaccctcaacaaaaaagtgcctacagatattctcaatgcccttcaacgtattgatgatgttgatcgcttagctgacacaatggctgcccatctccctgtaagcattcgccataaacaaaatgcgttagaactcgctaatgtgcaagaacgtttagaatatttgcttggtatgatggaatcagaggctgatattctccaagtggaaaaacggattcgcggtcgtgtaaaaaaacaaatggagaaaagccagcgtaactattatttgaacgagcaaattaaagccattcgtaaagaaatggatggtggcgaaaatgaagataccattgatgaagttgaacaactgcatcaaaaggtggaagcggcaggcatgccagctgatgtgcgtgacaaagtagaaaatgaattacaaaaacttaaaatgatgtctgccatgtcttctgaagcaacggtaatacgcagttatattgaatggatgatccaagtgccttggcatcaacgttctaaagtgaaaaaagacattgttaaagcacagcaagttttagataccgatcactatggtttagatcgcgtaaaagaacgcattcttgaatatttagcagtacaagcgcgtttaaacaaagtgaaaggcccgattctttgtttagttggccctccaggtgtaggtaaaacttctcttggtcagtctattgccaatgctactggtcgtaaatatgtacgtatggcattaggcggcgtgcgtgatgaagcagaaatccgtggtcaccgtaaaacctatattggtgcattgccaggtaaattaattcaaaagatggcaaaagtgggcgtaaaaaatccattattcttgcttgatgaaatcgacaaaatggcatccgatatgcgaggtgatcctgcatcagcgttgcttgaagtattagatcccgagcaaaacaccacgtttaacgatcactatttagaagtggattatgatctttctgatgtgatgtttgtggcaacatcaaactctatgaatattccaggcccattattggatcgtatggaagttattcgtctttctggttatacagaagatgaaaaacttaatatcgcaatgcgccatttattagcaaaacaaattgaacgtaatggtttgaagaaaggcgaacttaccgtaaaagaaagtgcaattttagatattatccgctattacacacgtgaagcgggcgtacgtggattagaacgtgaaatttcaaaaatctgccgtaaagccgtgaaaaatttattagtaaatccaaaacttaaatctatcacggtaaattcagataatctgcacgattatcttggcgtaaaacgttttgaatttggtaaagctgacacgcaaaaccgtattggcgaagtaactggtttagcttggacagaagtgggcggcgatttactcactattgaaactgcctctgttgtgggcaaaggaaaactttctttcactggttcattaggcgatgtgatgaaagaatccattcaagcggcaatgaccgttgtgcgtgctcgtgcggataaactgggtatcaatgctgaattccacgaaaaacgtgacattcacattcacgtgccagatggtgcaacaccaaaagatggcccaagtgcaggtattgcaatgtgtactgcattaatttcttgtttaacaggtaatcctgtgcgtgctgatgtggcaatgacaggagaaatcagtttacgtggtaaagtattaccaatcggtggattaaaagaaaaacttcttgcggcacatcgtggcggaattaaaaccgtattaattccaaaagagaacgttaaagatcttgaaaaaattccagaaaacgtaaaacaaaatcttgcaattcatgcggtagaaaccattgatgaagtgcttggttttgcattggaaaatccaccagagggcattgagtttgttaaagtgaaggctaaacctaaagcaccacgccgtaaagtgacgagtaaatcagaaagagcggtcaattaattgaatgttttagggcttgtgaaaacaagcccttttattgattttagagatgataatttcatctttacacaaggttaatttatacttttccaaattgaaaacttgttaataacacaatgctaaaacttcccccactttccctttatatacacattccttggtgcgttcaaaaatgcccttattgtgattttaattcgcacgcacaaaaaggcgatataccagaacaagactatatttatcatcttctgcaagatttgcaggctgatttgcaacgctttaaagattctattcaacaacgaaaactccattcaatttttattggtggcggtacaccaagtttgttctcggcagaaagcattgcgtatctcttaaaagaaataaaaaaacagattgattttgaagataatattgaaatcacattagaagctaatcctggcacggtagaagctgaacgttttaaaggttatgtatccgcaggcattatgcgaatttctatgggaattcaaagtttcaatgatgataaattacaacgtcttgggcggattcataatgcagcagaggcaaaaagtgcggtcaatttagcgaaagtttctgggctaaaaagtttcaatttagatttaatgcacggtttgcctaaccaaacgttggaagaagccttagatgatcttcgtcaagcaattgagctatctcctccccatatttcttggtatcagctgactattgaaccaaatacgatgtttgcttatcgcccacctaaattaccagatgatgacgcactttgggacatttttgagcaaggtcaccaacttttaacgatggcaggctaccagcaatatgaaacgtctgcttacgcaaaagcgggttttcaatgtaaacataatttgaattattggcgatttggggattatttagccattggctgtggcgcacacgggaaattgacgtttccgactggcgagattactcgcttttctaaaaccaagcacccgaaaggttatttgcgtggcgaatatctttacgaagaaaaaaacgtgccagaaattgaccgcccttttgagttttttatgaatcgctttcgtttgttagaagcggttcccaaacaagaatttgaagattacacaggcttgtcgcaaagtgcggtgaaaaatcaaattgattttgccattcaacaaaactatattgtggaaaacgctgattcttggcaaatcactgagcacggcaagttatttctcaatgaactattggaattatttttaactgaagaatagcctaatcgtgaaatagtctagtcgtgaaagaacattgcttgagaaaaacgcccgctaaaaaattatacttgtttattagataggctcgtaataaagtaacgcaatcgtttacttattgaaataaggaaaagaaatgaatcaattagaaatgaaaaaactcgccgcacaagctgcattagaatatgtaacagctgacacaattgttggcgtgggcagtggctccacagtgaactgctttattgaagctttgggtacaatcaaaaataaaattcaaggcgtagttgcggcttcaaaagcatcagaagaattattacgtaaacaagggatcgaagtatttaatgcaaatgatgtctctagcttagatatttatgtggatggtgcagatgaaatcaatccacaaaaaatgatgattaaaggcggcggtgcggcacttactcgtgaaaaaatcgttgcggcattagcgaaaaaatttatttgtattgtagattctagtaaacaagtagatgtgttaggttcgactttcccattgccagttgaagttattccaatggctcgttcacaagtgggcagaaaattagtcgcacttggtggcgcacctgagtatcgtgaaggcgtggttacagataatggcaatgtgattttagatgtacacaacttcagtattttaaatccagttgaaatggaaaaagaattaaacaatgttgcaggtgtcgtcactaatgggatattcgcattgcgtggcgcagatgttgtaatcgtcggcacgcctgaaggtgccaaaattattgactaattcataataaaaatcataaggaagcaaatatgacaaacaaagtttcactcgacaaatcaaaaattaaatttgtattgtttgaaggtgtgcatcaaagcgcacttgatacgctccacgcggcaggctatagcaatattgattactataaaaaagcactggatggtgatgaattaaaagaagccattaaagatgcacattttatcggattacgttctcgcacccatttaaccgcagaaatgattgaagccgcacccaaattaatcgcagtaggctgtttctgtattggcaccaaccaagtggatttaaatgcagcaaaagcacgtggtattcctgtatttaatgcgccattctcaaacactcgttccgtcgcagaacttgtattaggcgagattttattacttatgcgtaatgtgccacaggctaatgccgaagtacatcgtggtgtttggaataaatccgcgactggctcttatgaagtgcggggtaaaaaattaggcattattggttacggccacattggttcacaattaagtattattgccgaatcattaggcatggatgtgtatttctatgatattgaaaataaacttccgctcggtaatgcaaaacaggttcgtagccttgaagaattactcagttcttgcgatgtggtttcattacatgtgccagaactgccctccaccaaaaacttaatgaacgcaacgcgtatcgcacaattaaaacaaggggcaattttgatcaatgctgcgcgtggcactgtggtagatattgatgctctcgctcaagccttaaaagacgggaaacttcagggtgccgcaattgatgtattccccgttgaacctgcttcaattaatgaagaatttgtctcgccattacgcgaatttgataatgtgattttaacgccacatattggcggctcaacagcggaagcacaagaaaatatcggttttgaagtggcaggcaaatttgttaaatattcagataatggctcaaccctttcttcggtaaacttcccagaagtctctttaccagagcacgagggaacaaaacgcttattgcatattcatgaaaatcgccctggtatattgaacaaactgaaccaaattttcgtcgaagccaacctcaatattgccgcacaatatttacaaactgacccgaaaattggttacgttgtcgttgatgtagaaacgaatgatgcatcaccattactgacaaaattgaaggaaattgatggcacaattcgtgctagagtactttactaaatagaaaaaagatcagggtaatgcctgatcttttttgctttcttattcagtaatcgaataaggtaactgcactcgctctaacagtatttcattactcggcaatctaaattgttgctctgaatccatgtcattattcatcacaacttgcaaccataaaataccgtctaaattgaccgcacttgtaatcgtgccagtcttacgccaattggcttcaagctgcatttcgatttcactgccaatttccacttcctgctgagtttgcgctttaaaaataaacattgcacgtttgtttgccccacgatatttcgcacgtgccacggtttcttgcccaatataacagcctttggtaaaagaaattgcttgctcaacggcctgtaaatttagtgcttgtgggataaattcattttgtgtttgcggacttaaatttggcaatcctgcttgaatatcggctacttcccaaattttttcatcgccattaaaattcacgggtaattcagtttcatttaataaaattgaacgctgtccatcaatttccaatgaaaagtgcggtgtaatttttccacatttttcacctattacgccgatgatttgccaatcacgtaaatcaaaactaactttggaaaataccgcatattttttcaaagcatccagagcgcttggcaaaatatctttcttaacgagcaaaaagacttgttcactacttactttaaacaaacggtaaattgcattcattttaccttttgggtcgcagtgagctgtaagcgtcgttgcgccactcgctaatcgcacaacatcagaagttaattgcccttgcaaatatttttctacatccgcaccctgtacttcaatcagttgatattgagtaagagaaataaattgagacattctgctttcctattctaaattctgaatttgctcacgcatttgttcgataagcacttttaattccaccgcagaagccgtgatatccgcattaatggatttagacgcaagggtattggattcacgattcaattcttgcatcataaaatctaatttacgaccaactgcaccgccttttttcaaaatattcgtggtttctttcacgtgcatttgtaaacgatcgagttcttccgccacatcaacacgttgagcgagtaaaatcatttcttgttccacacgctgtggatcaagattaagttgagcatcttcaaaacgttgcaataaccgttcacgctgccattgtaaaactgctggcatttgtgatcgcactttatccgcttctactgcaatggcatctaagcgttgttgaataatatcgttcagtttttccccttcacgaccacgcattgcaataaaatcggtcagtaaatcatcaaaggctgtcaataaatcttgactaatcgcatctaaatcttgctcttgcgcttccaccacccccggataacgcaacacgtctgtcaaattaatttcaccttctccagcttgagttttaatccattgcaaagattgaatgacttgattcgcaagttctttatttaaattcaattcagcatttgtttgtttttttgtttcaatacgcaaagaacattcaattttcccgcgagtaagactttgacgaagtttctcacgcaacgtgttttctaatccgcgaaattgctcgggtaaacggaaaaagttttctaaataacgttgattgacggaacgaatttcccataccgcatcgccccaatcttttttcacttcaaggcgtgcaaaagcggtcatactgtaaatcataagctctcctattttgtcttagctttgtcttagttgattcgctaagtattgtaacgagatgaacacagaaagggaaaagaaaattaacacaataaaaatctagaaaattatacctcttaagtaaacatttttgataaattttaacgatagtaaaaatgtactaaaaacacaatttttttcaaaaaaattgctttttttaattttaaagtgtatttttaaggcaatataaaatctaataacatttgagcgagcatatacaatatgaattttatctgcacttaccatcatcaccacacctgattatctttcaggcgtgattgtatgtttggaagataataaaatatcttccgagtgtaataaaaatcagtgtaaaagcaataaataccccctcggaaggcaattttcgaggggttttcttttatctcaactttaaaataggaaaaacattatgacaaacacaacaatgcaaccaaaccgccttcgtattgctttgcaaaaaaaagggcgtttaagccaggattgtgccatattacttaaacaatgtggcgtgaaaattaattggaatgaacaacgtttaatcgcttatgcggaaaatttgccgattgaaattcttcgcgtacgtgatgatgatattcctggattgatttttgatggcgtagtggatcttgggattattggcgaaaatgtgttagaagaggaagagcttggtcgccgtgcagcaaatgaaacagttacatacaaaaaacttcgccaacttgattttggtgattgtcgtctatcacttgcggttgatcgcgattgtcattatgagaatgtgaaagatcttgctaataggcgtattgcaacttcttacccgcatttgctcaaacgttatatgaatgagaatggggtgtcgtttaaaagttgtttattaaatggttcagtagaagtcgcacctagtgcgggtattgcttatgcgatttgcgatttagtatcatcaggggcaacgcttgaagcaaatggcttaaaagaagtggacgtgatttatcgttctaaagcttgtttaattcagcgtgctgaaccgcttgaatcaactaaacaagctcttgtggataaactactcactcgtattcaaggtgtacagcaggcagcagaaagtaaatatattatgctccacgctccgaaagaaaaacttgaaaaaatcactgcgcttttacctggcgttgaaaatccgaccattttaccattagccagtgatacaactcgggtagcaatgcacgtagtgagccaagaaaatttattttgggaaacaatggaacagttaaaagaggcaggagctagttcaattttagtgttaccaattgagaagatgatggagtaaatgtagtgcgagctttgactcgccatttaaataatcaatatctcaaaatggtgggttatcatccattttacggatacaaaggaaaataaacaatgcaaacaattatttggaatcatttatcagaaactgaaaaacgcaaagtcattatgcgtccagtccaacaaaatggggaaaacattcagcaggcagttaatgccattcgtgaaaatgtggcatacaatggcgatcgggcgttatttgaactctgtgaaaaatttgatggcgtgaagttagataaactcattgtttcggcagatgaaattcaagcggcaagcagtcggatttctgtaaaacttcgcaatgcgattgagcaagccaaaacgaacattgaagcctttcacaaagcacagcaaaatcaggaaattgacctagagatccaagaaggcgtgcgttgccaagttgtgactcgtccaatttcttgtgtagggctttatattccgggtggttcagcaccgctgttttccaccgtattgatgttagctattcctgctaaaattgcaggttgtaaaaaaatcgtgctttgttcaccgccaccgatctcagatgaaattctctacactgctcatctttgcggtgtggaaactatctacgctataggtggtgctcaagcagtttttgcgatggctcaaggcacggaaagtgtggcgaaagtagataaaattttcggacctggaaacgcatttgtgacagaagcaaaacgtcaggtagcacaaaatagtacggcgattgatatgccagcgggaccttcagaagtgttagtaattgcagatgaatcggcagatcctgaatttgtggcaagcgatttactctctcaagcggaacatggggcagatagccaagtgattttggtggcgacctgtgaaactctggcaaaagagaccgcacttgcgattgaacgccaacttgctctattacctcgtgctgaaaccgctcgaaaagcgttaaaccacagccgtatttttatagcagaaagccttgaacaagcggtagaaattagcaatgaatatgcccctgaacatttaattgtgcaaacaaaaaacgcccgtaaattattaccatatttagataacgcaggctcaattttcttaggtgcatattcgcctgaaagtatgggcgattatgccagtggcacaaaccacgttttgcctacttatggttacaccaaaacttattctagtctaggattagctgattttagtaagcgaatgacagtacaagaactcacaccaaaaggttttaaaaaccttgctgaaacggtggaagtgatggcagaagctgagcaattggcagcacataaaatggcagtaagtgtaagattggcgaaactcaatatctaagatattaattgtagatctaagcacgacacgtaagcagtcaaattttcatacaacaatacgaaatatgtatgaatgattacaattcgcacattttacaatggaagaaaacaataatgacaatcacaactttatcccgacaaaatatacaagccttaacgccatatcaatccgctcgaaaactcggcggcaatggtacgatttggctgaatgcaaatgaatatccaacctcgcctgaatttcagctttcgggtaaggatttaaaccgctaccccgaacctcagcctcaaagagtggtacaggcttatgcgaattatgcgggcgtttcaactgaaaatgtactcgttactcgtggcggtgatgaaggcattgaattgataatccacactttttgcgaacccaaacaagatgccattttattctgtcctccgacttacggaatgtatgcagtgagtgctgaaacggcaggtgtgctaagtaagagcgtgcctttaactgacgattttcagcttaatttgccagaaatcaaaaatcatcttaatgatgtaaaagtagtctttgtatgcagcccaaataatccgacaggtaatttgctcaagcaatcagatatactcgatcttttgcaaatcacggcaggcaaagcgattgtggtggtggacgaagcctatattgagttctgtcctgaagcaagcgttattaatttgcttaaaaattacccgcacttagcaattatccgcacgctctctaaagcctttgctttagctggattgcgttgtggttttgtgttagcaaaccctgagctaattgacatcttaagtaaggtaatcgctccatatcctatccctgtgccgagtgctgatcttgcggaacaagcgttaagacctgcgaacatcgccactgttcaagctctcacacaagaacttctttccaatcgtcaatggcttgctaaagctcttttagttttacatcaagtggaaaaagtgtatgaaagtgaagctaattatctgttgatcaaatgtcaaaacgggcaagctgtgtttaaggcattgtgggaacaaggaattattttaagagaccagaataagacattgcatttacaaaattgtattcgcattactgtgggaacaaggaatgagtgtgagaaagttgttgaagcaattaaggaggtaaaatgaaccacctcctatttaagtcacagagcgattcgagattatttagttttatactgtttgtataaagcaaatgataaacctcataccattcatataacatacacggagaaaaatatgcaacctactctttttatcgaccgagacggcacattaattgatgaaccaaaaactgatttccaaattgacagtttagagaaactaaaattagaaccgaaagtgattcccgcactcctcagactgaaagcgaaataccgttttgtgatagtttctaatcaagatgggcttggtacggatgcttttccgcaaacaaattttgataagccccacaatgtaatgatggcattatttgaatctcagggcattacctttgatgaagtactcatttgcccgcataagcccgaagaaaattgtctatgtcgcaaaccaaaaattaagttgcttgatcactatattcgtaaaaatttattcgatattgaccgctcttttgtcattggtgaccgagagaccgatgtgcaattagcagaaaatctaggtattcgagctattcaatacgatccacagaaaatgaattgggatctgattgcagaaaaattgttgggggaaacggtcacaaactgtggcaaacgtccgccacgttttgcagaagtaattcgtcaaactaaagagaccgatattaaagtgcagatttggctagatgaagctggtgtaaatgaaatcaaaactggcgttggtttttttgaccatatgctcgatcaaatcgccacacacggtgggtttagaatgaacgtgcagtgtaaaggcgatttatggattgacgaacatcacacggtggaggacaccgctctcgcccttggacaagcactgaaacaagccattggtgacaaacgtggtattgcccgtttcggctttgtgcttccaatggacgaatgtaaagcagaatgtgctttagatttatcgggcagaccttggatcaaattcaatgcctgctttaaacgcgataaagtgggcgattttagtacggaactcactgaacatttctttcaatctttggcattttcaatgcttgccacgattcatttaaatgtcacgggtaataacgatcatcataaaatagagagcttatttaaagcctttgggagaacattaagacaggcgattcggattgaaggaaatgaaatgccaagttcaaaaggagttttatagttgaaagagcggttaatttttgtcgtatttttgcaaaattcgaccgattgtaaaaggataaaaaaatgacaaacatcacgattatagacacaggttgtgccaacctttcttctgtaaaattcgcctttgaccgattaggttacaataccgagatcacttttgatctcaataaaatcaaatctgccgataagctgattttacctggcgtaggcactgcaaatgcagcaatgtataatttacaagaacgtcaattgatcgaaaccattcaaaatctaactcaaccagtgctaggaatttgtttgggtatgcagttaatgaccgaattttccgaagagggtaatgtgccgaccttaaacctaataagcggaaaaactaatcgaattcccgatacgggtttaccgttacctcaaatgggatggaatcgcgtgcaatttgtaaaaaactgtccgttatttgatggtattgtgcaaaatagtcacttctattttgtgcatagttatgcagttagcccgaatgaacattcggtggcaataagcaattatggtgtgaatttttctgctgcgatagcgaaagagaatttttacggtgtacaatttcatcccgaacgttcgggtaaaaatggtgcgttgttgctaaaaaattttgtggaaaaagtaccgttttaatcactagatcatatagtcatacaggatcaaacacaatgaaacaatctattattatccctgctcttgatcttatcaatggtcaagttgtgcggttacaccaaggcgattatgccaagcaaactacctattctgacaatccaattaagcaatttgataattatgtacgtcaaggagcaaaacaactacatctagtcgatttaacgggagcgaaaaatccccagtcaagacaaaccgcacttattggaaaaatcgttgaagcaacacaatgtaaagtacaagtgggaggaggcattcgtacagagcaagatgtggcagatttattggctgtgggtgcgaatcgcgtggtgattggttcaaccgccgtaactcatcgttcaatggtgaaaaactggttcatcaaatatggtgcggaaaaatttgttctagcattagacgtgaatattaatgcaagcggtcagaaaatcgttgcgattagcggttggcaggaagaaagtggtgtactattagaaacgttgatcgaagatttccaaaccgttggcttacaacaagttttatgtaccgatatttcacgcgatggcaccttgacaggttcaaatattggactttatcaagaaatttgtgagaaatatccacctattcagtttcaatcttctggagggattggttcactggctgatattgaggctctaaaaggcacaggtgtgtcaggtgtaattgtaggtcgcgctttattagaaggaaaatttacgctttcggaggcaatcaaatgttggcaaaacggataattccttgtttggatgtacgtgatggacaggtggtaaaaggggtacaattccgtaaccacgaaattattggcgatattgtgccacttgctcaacgctatgcgcaagaaggagctgatgaattggtattttatgatattacggcttcatcagacggtcgtaccgtggataaaagttgggtagaacgaatcgctcaggtaattgatattccgttttgcgtagcaggtgggattaaaaccattgaagatgcggaaaaattgtttgcatttggggcggataaaatttcgattaattcccctgctctcgctgatccaacgctcatttctcgcttagcagatcgttttggcgtacaagcgattgtagtaggtattgatagttggtttgaacaggaaacaggtaagtattgggtaaaccaatatacaggcgatgaaacacgtacccgacaaactcattggcagttgttagattgggtaaaagaagtacaacaatgcggtgcaggagaaatcgtgctaaatatgatgaatcaagatggtttacgaaacgggtacgatttagcccagctcaagctggtgcgaggagtatgtagagtacctctaattgcatctggcggtgcgggtaaaatggtacattttcgtgatgcttttattgaagcaaaagtagatggggcattagctgccagcgtattccataaacagattattgaaattggcgagttaaaatcctaccttgtgcaatcagccatcgagattcggagtgaataatgaatattactaaaatagactggcaaaaagttaatggtcttcttcctgttattattcaaaatataagtactcgtgaggtactaatgcttggctatatgaatgaagaagcccttacaaaaaccatcaaagaacgtaaagtaactttcttctctcgtaccaaacaacgattatggacaaaaggagaaatctcgggcaattttttaaatgtggaagaaatgagcttagattgcgataacgacactttgctcattttagttgatcccattggggcaacttgccacacaggtgaatacagctgcttccatcaatttacctctccacaatcagagaacaagaagcaacaatttgcaaattgggcgtggtttataaaattagaacaacatttaaaagaaaagaaaaatgcagatccttctaattcttatactgcaacattacacgcaaaaggtaccaaaaaaatcgcccaaaaagtgggggaagaaggtgtggaaactgccttggctgcggtcgcacaagataaagcggaagtcatttctgaagctacagatttggtctatcacttaaccgtattattacacaatcaagatcttcagtggtacgaaattatcgcaaaactacaagaacgccatcaagggattggattacatccagaaggaggaaataaataagaaaattgtcaggcaatattaagtgagcaattagaagatttgtttgggcaattcaatatcatcgtaaaatacagtgaaactatggtaattaaatgtattgataaacaacaaaatttaggaaatatcattttattccttcttcttaagcaacaatatagcaaggaagatagtaaaaaattcacaatttataaattttatttacagactgtaaattatacaatacaattatcgtaaattttttattacatcataaggaaacaaaaatgaacaaaactgtaggcagcacacttcttgttgctggtacgatgattggcgcgggaatgttggctatgccactcacttccgctggcattggcttcggctttactttagtcttgttattggggctttgggcattattaacttttagcgcacttttattcgttgaactctatcaaactgcggaaagtgatgcaggtatcggcacacttgcagaacaatattttggtaaaacaggacgcattattgccacagccgtgctaattattttcttatacgcattaattgccgcttatatcagcggtggcggttcactactaaaagatttattaccagaaagttttggcgataaagttagcgtcttattatttaccgtgattttcggttcatttattgtcatcggcacacatagcgtagataaaattaatcgcgtgttatttttcgttatgcttgctgcctttgccgtggtgttaagcttaatgttgccagaaatcaaatttgataacttaatggcgacgccaattgataaggctttaattatctctgcaagccctgtatttttcacggcgtttggtttccacggttccattccaagtttaaataaatacttagatggcaatgtaaaagcattgcgcttctctattttggtcggctctgccataacactttgtgcttatattctatggcaactatccacgcacggcttgcttacacaaaatgaatttttacaaatcttaaaagaagatgcgactttaaatggcttagtaaaagcaaccttcgccatcactggaagcaatgtgatcgcaagtgcggtaaaattattttctacattagcacttatcacttctttcttaggtgtgggattaggattgttagaatgtattgaagatttactaaaacgttcatttaacgttacagcaggcagaatttcacttggtttactgacttttattccaccacttgtttttgcattattttacccagaaggttttattttagcactaggctacgcaggtcaaatgtttgcattctacgccgtagtattgccagttagccttgtttggaaagctcgtcgtgcccacgctaatttgccatacaaagtgtggggaggaaatctgactttaattatcgtattggtattaggcgtgatcattacatccattccatttgcgattcgtgcgggttatttaccctttgttgtaggttaaaaacaaactaaaaatttaccgcactttttatctaaaaaagagtaaatattatcctaattaatttagataaaaatttcagacaaaacttatcattaatctcatacaacaaaaaggctaagttctaaaattatagaacttagcccttaaactaaatgaagttcacttcatctatattatactttcaattatcgtcttgttttcaatagtttttcagtgagttcataagctcgaagttttgctaactctttagaaagttttgcaacaagtaagtcgtgatctgcatcagatccgcgagatactatattttcttctgctttacgttttgcttcgtgaatacgatctgcatctaattcactacctcgaatagcaatatctgctaatactgtcacaatatttggttgaacttctaaaaaaccaccagaaacatagataacttcttcattcccatctttaagagtaaatttaacaatcccaggcttaattgctgttagcaatggcgtatgtccgggcaaaataccaagctccccttccacaccagttacctgaatttgttttacttcaccttcaaagattttctgctctgcgcttactattgttaaattaaatgtcgccattttgttctccttcaaatgacttgaagtgattacatatttttggctttttctaacacttcatcgattgaaccaaccatatagaacgcttgttcaggaatatggtcatattcgccatctaagatacctttgaagccacggatggtgtcttttaatgtcacgtatttacctggtgaacctgtgaagacttctgcaacaaagaatggttgtgataagaaacgttcaattttacgtgcacgtgctaccactagtttatcttcttcagataattcatccataccaagaattgcgataatatctttcaattctttataacgttgtaaaataccttgtacaccacgagcaacatcataatgttcttgaccaacaacaagcgggtctaactgacgtgaagttgaatctaatggatcaactgcagggtaaatacctaaagatgcgatttgacgacttaatacaacagttgagtctaaatgtgcgaaagttgttgctggagatgggtcagttaagtcatccgctggtacgtacaccgcttgcacagaagtgatagaacctgttttggttgaagtgatacgttcttgtaacacacccatttcttctgccaatgtcggttggtaacctaccgcggatggcatacgacctaataacgcagatacttccgtaccagcaagggtataacgatagatattatccacaaagaataatacatctcgaccttcatcacggaatttttcagccatagttaaaccagtcaatgcaacacgtaaacggttacctggtggctcgttcatttgaccataaaccaaagatactttatctaatacgttagaatctttcatttcatgatagaagtcattaccttcacgagtacgttcgcctacacccgcaaatacagagtaacctgaatgctcaatcgcaatattacgaatcaactccatcatatttacggttttacctacacctgcaccgccgaataaaccaactttaccaccttttgcgaatggacaaattaagtcgatcactttgataccagtttctaataattccgtactgtttgattgttcttcatagctcggtgccgaacggtggatagcccaacgctcttcttcaccaattgctccttgttcgtcaattggttcgcccaacacattcataatacgaccaagtgtttttgtgcctactggtacttgaattgggttatttgtgttttctacttttaagccacgttttaaaccatcagatgtacccaatgcaatacaacgaactactccgccacctaattgttgttgcacctcaagtgttaaacctgattcaacttttaatgcatcgtaaacttttggcaccgcatcttgtggaaattcaacatcaatcaccgcaccgatgatttgtacaatttttcctgctgacattaccgttcctcttttcttaaatcgccgccgcaccggctacgatttcattcaattcatttgtgatacttgcttgacgagctttgttgtacaccaaccgcagatcattaattaaattacctgcattatccgttgctgctttcattgctaccattcgagccgcttgttctgaagctaaattatctacaaccgcttgataaatttgggactctaaataacgaactaaaaggctatctaaaagtgcctttggttctggctcataaagataatcccaagtctgttgtctttcatttaaatgatcgtctttagattctggtaaaggaactaactgttgcacaacaggtttttgcgacatcgtattaacaaatttattgtatgcaatataaactgcatcaatttcaccattacgataagcatcaaacattgtatttgccacaccaattaactcttctagagcgggcgtatcgcctaaaccagaaagctgacctttgatattaaatccaaaggaacggaaaaaactaatcccttttgaacctattaagcccaaatctgtagaaatattttgttctttccaattttttatttggttaagtgtggttttgaataaattaacatttaacccaccacacatcccacgatctgttgaaataaccaagataccgattttcttcacttcgcactcaactaagaacggatgtttataaccgatacttgccttagacacatgactaataacgttacggatagtttcagaatacggacgagatgcagccatacgatcctgcgttttacgcattttcgaggttgccaccatttccattgccttagtgattttttgtgtactttgtacactggcaattttggtttttatctcttttgcacctgccatcttatctctccgttactaccaagcactattcgctttaaaaccatctaaaatactttttaacgtatctttgatttcatcattatagttaccggttttattaagctcttgcataaattcagcgtgattacggttagaataatctaaaagtgcggtctcaaaacttgcaatttttgataattccacgtcatccaaataaccaaattcaacagcaaacaatataaccgcttgttctgcaacagataatggcgcgaattgtttttgttttaataattcagttactttttcaccgtgagaaagttgcttacgagtcgcatcatctagatctgatgcaaactgtgcaaacgctgctaattcacgatattgagctagtgcagtacgaataccacccgctaatttcttaataactttagtttgcgctgaaccaccaacacgagataccgaaatacctgggtttaccgcaggacgaatacctgagttaaacaagttagattctaagaaaatctgaccatcggtaatagaaattacgttggttggaacaaacgcagatacgtcaccagcttgggtttcaataatcggaagtgcggttaaagaacctgttttcccttttacttcgcctttagtgaatttttctacataatcttcatttacacgagaagcacgttctagtaaacgagaatgtaaatagaacacatcacctggataggcttcacgacctggtggacgacgtaataataatgaaatttgacgataagctacggcttgttttgataaatcatcataaacaattaacgcatcttcgccgcgatcacggaaatattcccccatcgcacaaccagcataaggggctaaatattgtaacgctgctgattcagatgcagatgcagctaccacgatagtatttgcaagcgcaccatgttcttctaatttacgcacgacgtttgcaatagtagaggctttttgaccaatcgcaacatagatacatttaatacctgaattacgttgattaataatagcgtcaattgctaacgcagttttacccgtttgacggtcaccgatgattaactcacgctgaccacgaccaatcggtaccatggaatcgacagctttataaccagtttgaacaggttgatcaacagaacgacgatcgataacacctggcgcaatcacttctactggtgagaaatcatcattttcaatttcgcctttaccatcgattggctgaccaagcgtattaactacacgacctaataaaccactaccaactggtacttcaagaatacgacctgtacattgaacttccataccttccgctaaatctgcgtaaggtcccataactacagcaccaacagaatcgcgttcaaggttaagtgccatcgcataacgattacctggtaaggcgatcatttcaccttgcatcacatcgcttaaaccgtggatgcgaataataccatcgcttacagaaacaattgtccctgtattacgcgcttcactgaccacgtcgaattgagcgatgcgttttttaatcaattcactaatttcagttgaatttagttgcatcttgtattcctcttataattgcaactcgtttgcgagacgagtaagttgcccacggctacttccgtcaatcacaaagtcttcagtacgaacaatcacaccagcaataagtgcgttatccacgttgcaatttaatttcactttgcgagctaatcttttttccattgcagctgcaattttttcgatttgtgttgcattcaatggttgcgcagatgttacttcaacttctgcaatagcttggtgttcctctacgtgatgtttaaattcttcaaacaccgcaggaatagcactcaaacgcttattttcagccattaaccgaataagattttgcccatattgatccaattgttcgccacaaatagaaattactgtatcagctaatttctgtgcagaaagagaactacttaagtaagcttttaccgtttcatcttcagctacggcagcagcaaaacctaacatttcagtccatttttcgaccgcactttgttcaatggcaaagtcgaatgcagcttttgcataagggcgagctattgtagttaattctgacataagctaagcctcttataactctgcaactaatttatcaataatgtcattgtttgccgcttcatcaatagaacgacccacaattttctcagcaccagctactgccaatgaagctactttaagacgtaattcttcttgaacacgtttacgttctgcttctacttcagcataaccttgtgcaataatttttgcttttagttcttcggcttctgccttcacttcgtctaatacttcattgcgacgtttattcgcagcatctaaaatgtcttgagcttgtaattttgcagctgaaagttcttgttcaacaagatttttcgtatctgcttgctcttttttagctgcttcagctgacgctaaagcgttcgcaatttggctttgacgtgtttcaatcgcattaataattggtggccaaacaaacttcatgcaaaaccacacaaaaagtgcgaatgctataagttgaccaatcaatgttgcatttaaattcacaacgtcctccttactatgcttgttttacgttgataagcaaataaggtgattagtttaataaaccgatgaatgggtttgcgaaaatgaaaagtaatgaaataccaacagcaatcattgcaatcgcatctaaaagaccagctacgataaacattttagtttgtaagctagatgctaattctggttggcgagctgatgattctaagaatttaccacctagaatagcaaagccaattgcagtacctaatgcagcaaatgcaagaagaattgatgcaccgatgattgtcgctgtaattacagtttccataattttctccaatagaagttaagttttagccctagagctggttaataaaaaacgattaatgatctgctttgttataagcaatacttaaataaacaaccgtcaacatcataaagatgaaagcctgcaaggtaataaccaaaatatggaaaatagcccaagcaagatgtaacggaatccctaatgctgcaatggccatattagcggaatacattacagcgataagaataaagatcaactcccctgcatacatgttaccgaacaaacggaaagcaagtgaaattggtttagccaataaagtcaccgtttcaagaataaaattaacaggaataaacgcccaatgattgaatggatgaagcgtatattctttaactaaacctttgaatcctttagattttattgtataaaaaagaattaaaaagaaaacacaaatggacatacccaaagttgcgctaatatctgctgtcggcactgcacgaagataatgaataccgaacaaacctgcaaattgaggtaagaaatcaacaggaattaagtcgatagcattcatgatgaatacccaacagaaaattgttaatgcaagtggcgcaactacgttacgtggaccatgaaaattttctttcacgattccattaacccattccacaacaatttcaactaagcattgcatttttcctggaacgccagttgttgcttttttccctactcgagaaaaaacaaataggaaaataaccgcagcaagaatagaaaagaacaacgtatctatatgaacattccaaaatccatcccctgttttgagaaaggataaatggtggctaatgtattccgatgttgtttgtccagacataatcgatcctttgttctgaagaagaataacccaaagttaaattttattgagaataagtggaataatattattcagcactaatgccaataaaaaaccaacaaaaaacgcaataaaattgataacgaataaccatttgatggcaataatgataaaaaccatcgttaaaataaactttattgcttcagcacgataaagtgcggtcagttttgttgaaaaattttgttttctgtaaaaaatgataaatataaatgtacaaaaaggcaaaaaggcacttaaaaaaccgtagctaaaatctaccgcactttggcgttgccatccataaataagcaaataaaaaactacaagcaaaagactctcaataataatagcttttctgtagttttttttagcgtgagataaaatgcgcgacatcacttttacaaaataattttagcccgccgattatacctttgctggctttagattcaacttaaaaacacataaaaagtgttatataaatcacacttttagaaaataatttatctatttgttactttttaacgtaaaacgattaaatgtcgttcgcctataagttcaggaacagataattcaatcactttttgaatagtatattttttattcaattcattaatttcatcttcctgataaatcccttttaatgcataaaaatatccattttcttttggtaaatgatggcaccaatctgtcatatcttttagtgaagcaaaagcacggcttaatacaccatcaaatttatcttcaggttgatattcttctactcgacttaaaacgggggttacattagttagtctaagctcacgtatagcatttcgaataaaactaatacgcttacctaagctatcaaggaggacaaattgtttggaaggattaataattgccaaaggtaaaccaggcaaaccaggccctgtaccgacatcaataaaacgatcaccttgtaaataaggacttacaacaagactatctaaaatatgtttaactaacatttcttgcggatcacgaactgacgtcaaattataagctttattccatttattgagtaaattgaccagattaatcaactgctgaatttgttgatcacttatttttatatttgcttgcgcaagtaaactgactaatttggctttcatatttattatctctttgaaaaattacgctattttacttaaaagtgcggtaaatttccttaatgtttttagtaatttgatgaattatttaccgaatcaatgtccagttttacaccataaattgaatgcacctccgcataattcatttcaaaggctttaattgcttctgttcaagaaccaaagaatgaatgttcgctaaaaaataagtttgttctgcttcaggaatggaaaatggcattaacttgagtaaatcttgatgaatagctaaaacttgtggaaaaatgaccgcactttgcatttcttcgagcatttctgaataaagcgaagaaacacaacctcctcgttctatccgacctaagctgcaagcaatgtgtagcagcataaaatccacttgaggcgtattcacatcagcttgccagtaatgagctaatcgatctcgtaaacgaaataccacatcaataatagattgatttatttgcctgcgagttttccaacgttctagttgcttaaataaccgcatttgtttttgttagttcaaaatttgttcgctaatttaccgcactttactgaaataaaacagtgcatagatcacagttttgtagcaaaatggtaaaaaaatttgtaaggatgtaaaaatgttagattacgagatcttcaatccatatgaaggattgatttttgatatggatggaactttaattgatacaatgcccgtgcatgcgcaggcttggacaatggtgggaaagaaatttggctatgaatttgattttcaaattatgtataacttcggcggggcgacggttcgaactatcgcgggggaaatgatgaaagcggcgaatatgccactagatcgaattgaggatgtgctggctgcaaaacgtgagttgtcttatcaacttattccgacccaatcaaagttattgccaacctttgaaattgttaaatccttccatcagaaaaagccgattgctttaggttctggctcacaccgtaaaattattgatatgttgatggataaactggctatcgcaccttactttaatgccattgtcagtgcagatgatgtaaaagaacataaaccacatccagaaacttttttacgctgtgcggagttaattcaagcaaatccaagtcgttgtatcgtatttgaagatgcggatttaggcgtgcaagcaggattaagtgcgggaatggatgtgtttgatgttcgcacacgagaaattatttcgccaagataatggatattttttcattttttagtgctgatttttggcaggctaatagcttatgctttatgtttatcagcgcgtttttgagtgcaacagtattaccaggtaattcagaagttatatttgttgcgcttgctgtacctaaattaatgttaggttctttatttaacgcagatatattagctctaatattgattgcaaccgctggaaatagcttaggaagtttaaccacttacggaattggacgatggatgccaaaattcgatcccaaaaattaccgcactttatgggcaataaatcagctacggcgttatggggcgattgttttacttttgagctggctgcctgtagttggcgatttattttgtgccatagctggttggttaagattaaattttgtaacgagtagtctctttatctttctgggaaaaatggttcgttatgttgcgttattgtttttgagtacaccattcttattataaaatgagcaagaaaaaaccccacaataaatgtggggcaaataacctaaggaaccaattttattaaaacaactgcaagttgcttgttctataagacaatgaaccttactataaagttcattaaaatttgtaaaaaataaatatttattcaattatttcttaaccaactgatttataaggaaaatttatgccattacttgatagttttaaagtggatcacacaaaaatgaacgcacctgcagtacgcattgcaaaaacgatgtgcacgccaaaaggcgataatattactgtttttgatttacgtttttgtattccaaacaaagaaattctttccccaaaaggcattcatacacttgaacatttatttgctggatttatgcgcgatcatttaaatggcgatagcatagaaattattgatatttctccgatgggatgtcgcacgggattttatatgtctttgattggcacaccaaatgaacaggaagtgtctgaggcttggttagcttcaatgcaagatgttttaggtgtacaagatcaagcttctattcccgaattaaatatctatcaatgcggaagctatacggaacattccttagaagatgcacacgaaattgccaaaaatgttatcgcacgcggtataggtgtaaataaaaatgaagatttgtcactcgataattccttattaaaataggaagacgcttgattaacctaaaaaagttagtagtaaaaaacgcattttatgatctacaccccaaaaattgactaaataaccaactaaggtgtagattttttatgaccaaatacaacactcttttcaaacaacaagtcatcgaatttgatcttcaaaatggtaaaaatcgttcacttacccgcaggtattttcaacttgcctaaataacactaaaacgttggattaaccaattaatcatagttaaatcaatagattatccgtacttagtaagaagcaaaattacttacctgaatttaaacttaacataatacaagcggttaaaaatgggcaattttctgcagaagccgcatatttacattttggcattaccaattcaggcgttgttaatcaatggctgcaagcctttgaaaaacaaggtataaacggcttaatcctcaaacctaaaagtcgtccaatcatgaaaccgaaataccctaagatgccacctaaaccgaaaacatgaggggaagaactagaattggaaaatttactacgtgcggagaacgcaattctaaaaaagttgcaagaactcaaccaacaaaaaagacttgaagacgcaaaacccaattttacattccgaccaaggttggctgtatcaaatggtcggttatcaggcgattttacgagagaatagcattcagcagaatatgtcaaggaaaggaaattatttagataacaatgcgatggaaaacttctttggacgattaaaaactgaatgttattacgacaaacgatttgagacgttcaaacaactgaaaaaacaactcatgagtatattcattattacaaccatgatcacattcagggaaactaaaagggctgagccctgtgaatgacagaactcagtccttgaactaaatcaatctaactttttgggggaagataaatcccaacttgcggtcaattaatagcttgaattgattaacacttcttcgccatagccgcctaaagttggcattggttgataagtagagtttgcggcacgcattaaacgaataccacgaacacctgcttctttagctgctagtacatcatcatcgctgtcgccatagtgaatactcactttatgtgaaatgattgcaggcgttttgttatattttgttgtacgttcacggctgcccataaattcaactgggtgcatattcttaatattgaacgttttttctaaaattggggttacaccatccactttgccagcagtacggccagtgaaaaagtaaacttggtcgccacgtgcttggtgcatattaattaaatctatggcaatttgtttaggaatagaatatttatcgcaacctgcatttacttcattccagaaatcttggtttttcaaataatcgtgtttacctggtgagaatttttgttgtccgtggtaaaagcaagggctactgaaaagcacggtatcatcaatatcaaagcttacattaattggtgctttaccttctaaactttgtttgatttgatcaacactaatccaatgaattgcttgctcttgtaacatttcacgagcattagtgccagattgagtataaggttctgttttgcctgccatcgctggaactgcagctgcagttaaaagtgcgatgacagataattttatgccgtttttcattgcctttcctcacaaacgttgatttaaaaaccgctcagatcatacatttttttagcttatattcaataattggcaatcgtttgccatctcaaaatatgatcaacttcacattttttatttatgagtgaagaataaatctacaatataaatttccctcttgaatttaatcaatttgtcgccatataacgaacaacttttcactttataaaggacagaacaatgacaacgattgtaagcgtacgtcgcaatgggcaagtcgtcgtaggcggtgatggacaagtttctttaggcaataccgtaatgaaaggtaatgctcgtaaagtacgccgtttatataatggtaaggtacttgctggttttgcgggtggaacggcagatgcatttacactttttgaattatttgaacgtaaacttgaaatgcatcaagggcatttgctaaaaagtgcggtggaattagcgaaagattggcgtacagatcgtgcacttcgtaagttagaagcgatgttaattgtggcggatgaaaaagaaagtttaatcatcacgggtattggcgatgtggttcagcccgaagaagatcaaattttagcaatcggatcgggtggtaactatgcgttgtctgcagcacgtgcgttggtggaaaacaccgaactttctgctcgtgaaattgttgaaaaatctttgaaaattgcgggtgatgtttgcgtgttcacaaataccaatttcactattgaagaattaccgaattaaggaaaaagctatgtctgaaatgactcctcgcgaaatagtttctgaattagatcaacatattattggtcaagccgatgcaaaacgtgctgtggcgattgcgttgcgtaaccgttggcgtcgtatgcagcttcaagaacctctgcgtcacgaagtaaccccaaaaaatatcctgatgattggcccaactggtgtgggtaaaactgaaattgcgcgccgtttagcaaaattagctaatgcgccatttatcaaagtggaagcaacgaaatttaccgaagtgggttacgtggggaaagaggtggattccattattcgtgatttaacggatagtgcgatgaaacttgttcgccaacaagaaattgcgaagaacagagcaagagctgaagacgcggctgaagagcgtattttggatgctttacttcctccagcaaaaaatcagtggggcgaagttgaaaaccatgatagtcacagcagtactcgccaagcgttccgtaaaaaattacgtgaaggtcaattagatgataaagaaatcgaaattgatgtgtctgctggcgtgtctatgggggttgaaattatggctcctccaggcatggaagaaatgacaaatcaactgcaatcattgttccaaaatttgggttcagacaaaacgaaaaaacgcaaaatgaaaattaaagatgcgttgaaaacgttgattgatgatgaagcagcgaaattaattaaccctgaagaacttaaacaaaaagccattgatgctgtggaacaaaatggtatcgtctttatcgatgaaatcgacaaaatttgtaagaaaggtgaatacagtggtgctgatgtatcgcgtgaaggtgtgcaacgtgatttacttccgttagtggaaggctcgacagttagcaccaagcacggaatggttaaaactgatcatatcttatttattgcatctggtgcattccaagttgctcgtccttcagatttaatccctgaactacaagggcgtttgccgattcgtgttgaacttaccgcattaagtgcggcggatttcgagcgcattttaacagaacctcacgcctctttaaccgaacaatataaagccttgatggcaacagaaggggtgaatattgaatttacaacagaggcggttaagaaaattgctgaggctgcattccgagtgaatgaaaaaacggaaaatatcggtgcacgtcgtttacatacggtaatggaacgtttgatggataaaatttctttcagcgcaagcgatatgaatggtcaaacggtcaatattgatgcggcttatgttgcggatgcacttggcgaagtggttgaaaatgaagatttgagccgttttattctttaaagataaaaattttacatataaaagtgcggtaaatttttaccgcacttttttgttttctaaattgagaaactaattagtttttaatttactccaatatttttcataaatatcaacagcttctcctacatcgccttgcataattcctttttctacttcttccgctggtggaaataattttggatcattagcaacttccgcgcttagcaatgttttcgccccattatttggcatagaaaagcccatgcgttcgataacaatttttgcattttcagggcgaagtaaaaagtcgatgaacttatacgccccttccacgttttgagcggaattcggaatagcataattatccatccagaaaattgcgccttcttttggatacacaaattgaagagattgattttctttctgcgctaaataagctgaaccattccaaatcataccaattgcaacttcgccttgtacgtaagggacttcaggagaatcagagttaaaagtcgctacatttggtaacagtttttctaaacgctcataagctgttttgatgtcttcttcattggtggtatttggcgatttaccatccagtaataatgctacgtggaacacttcacgcgcatcactggtcatgagaactttgcctttaaattcaggtttccataaatccgcccagctagtgatggttttaggatcaatctcatccgcattaacttcaataccagttaagccgtaaacgtaaggtaatgaatatttattttctgggtcgaattctttatttaataaatgtttagggatttgatgaatattggtcaatttactttgatcaatcggttgaagcatcttttccttaatcattttatttatgtagtaacttgatggaaacaccaaatcatagctagaaccagtattctgagtaagtttaagtttcgcatacatttcttcgttactttcaaaggtagaataaattacctcgatgccagtttctttagagaactgtgcgactaaatcagaaggcacatagtctgtccagttatagacgtaaagtttgttattggcaaaagcggaagccgcaaaaagtgcggtggtggaaaggaaaagatttttgagtgagtgagcaaagaattttttcaatttattgacctccgagggttatcgttcatcataaaacacgcaaattttgcgtgcgcgcagtatagcattttttctaaaaggtttgacatatttccctttcggggtaagattttgccagttttttcctaagggattttttatgcttaattttgcctatcaagaacacgttcgctcttattatttcgactctcgtaaccaagattttcaattcccgccgctcactcaaattgaacatgctgatgtatgtgtgatcggggctggattttttggtttatctgcagcattagaactggcggagaaaggaaaaaaagtcattgtcttagagggtgcaagagtaggctttggtgcttctggtcgcagtggtgggcaggcaattaatggctttgaagaaggcattgatgaatacgttaaacaagttggcgaagataaagcacataaactttggaatatgtcattagagaccattgatattattgatgaacgtattgaaaaatatagcattcaatgcgactggaaaaaaggctatgccacattagcattaaatgaacgccgaatggatgacttaattgaaatggaaaaagaaagtcataaaaattttggctatcagaatatgcaactttgggataaaactaaattaaaacagcacttaggcagtgatatttatgtgggggggctatttgatagtaattcagggcatttgcatccacttaattattgcttaggtttagcgaaagcttgtgtcgatctgggtgttcagatttttgaacaatctcctgtcgtggatatggttgagaaaaatggttgcattgaggttaaaacagctaaaagtgcggttatttctcaagacgttattttagccaccaatgcttatattgatgcgctcccgaaatctattcatcacggcattaatcgtaaaatattacctgtggaaagttttattatcgccacagagccgttaagccaagcggttgctgattctgtcattaataatggcatgtcggtgtgtgataacaatttattattagactattatcgtttaagtgctgacaatcgcttgctttttggtagtgattctagctcagaaaaagatatggtcgcgattatgcggaaaaatatgttgtgtgtattcccgcaacttgaaaatgtaaaaatcgattatggctgggctggcccgattgatatgaccttaaactcaacgccacattttggtcgtatttctccgcatatttattttgctcatggttattctggtcacggtgttgctttgactggtcttgcggggcgaattgtagcggaggcgattttgggtgacgatgaacgtttatctatttttgaaggactgaaagtcccttctgtttatggtggtcgaattatcaaagatcttgcgacaaagattggtgtgcggtattacaagtttttagataaataccgttaaaatacaacaatgtttttctaaagcattgccatcaaaattgactaaaataattaaattttgtatggatataaattctaaatcagttaaaaaatttaccgcactttaaagcagaattaaaataatattttttgctacaatttgtgttttccattaagagagaaatatgtcagaaaatttgttacttttcagcttgttagctgttgttattatattgattttattacttattctacgccagcaaaaatatacacatcttcatcaagaattatcgaaaacgactcaagattataatcagcttgccagtaaatttgatgaactgagtagcattaaaaaccagtttgaacaacaaacaattaaagtacagactgaaaatcaaggactgcaatatcgtttaactgaacgtgatgaacaaatacatcatctcacacaagaacgacaaaatttgactgaaaaattgaccgcactttctcaagaattaacggggttacaaacaaccttaacagagaaagaaaaatatttttccgcacaacaacagaactttgaacaatctaagctgcagttgagtgtggaatttcaaaacctagcaaatcgtattttggatgaaaaaagtcgatcatttagtcaatcaaatcaaacggcattggaaaccttgctcaagcctttccgtgagcaaattgaaggtttccaaaaacgggtcaatgaaattcactccgaatccgtgaaaggcaatgctggattggaagcggaaattaaaaaagtgctggaaattggtctgaatatgtcgcaagaggcgagtaatttaacttctgcgctgaaaggcgaaaagaaaacgttaggcaactggggcgaagtgcaattagaacgagcattgcaactggcaggacttgaagaaaatgtacattaccgtgctcaagctcattttaaagatgaacaaggcgggcgtaattaccctgattttgtgttgaatttacctgatgaaaaacacttaattatcgacagcaaaatgtcgctcgtggcttacgaaagtgcggtgaattctgaggatgattttgaacgagagcgtttactcaaagagcatatttccgcattaaaaacccatattaacgatctgcataaaaaagattacagcaatctgattggcatgcgtagtccgaattttgttcttatgtttattgcggtggaacctgcgtatattgaggctttaaaagctgatcctgccttatttaattacggttatgaacgcaatgtaattatggtttctcacactacgctaatgccgattttacgcaccgtggcaaacctctggcgtatcgaacgtggtaatgctgaagccaaagaaattgctgaaaaagcgggcgaaatctataaccaaatttgcttggtggcagaacgtttaagtaaactcggcaatacgctttccactgtcagcaaccaatacaacagcaccgtcaccgcacttgttggccaacaaggtttagttggcaaagtagaacgatttaaaaccctttccgcaaaagccaataaaacaatgcccgatgtggacttattgaataatcagctggatttggctagattgaatgtcttaaatcaagaaaatcttcaataatttattctccgattgaatgtaaatttggtcggagaattttttatcctatctagaaattttgtgatcaatatcccaaatttgaaatttcttagttgtttttctatttttgttctttatatttatcttatcgaaacgtttcgataaaggtggaaagaggaaatatatgaaaaaaacaatgttattaaatgcacaactttctcgttgtatcgcttctgttggtcacacagaaagtttgacgatttgcgatgcgggacttccaattccgttaagtgtggaacgtatcgatctcgcattaactgcgggtgtaccaagttttctacaaacgttgaatgtagtaacgaatgaaatgtatgttgaacgcgttgttattgcagaagaaattaaagaaaaaaatccagaaatattgaccgcacttttaacacaacttcaacaacttgaaagccatcagggtaatcaaatacaagtggaatttgtatcgcacgaaacttttaaaaaattcaccctcgaaagtaaagctattgttcgtactggcgaatgttcaccttatgccaatgtgattttatattctggcgtgccattttaatcagggtgaaattatggaaactttactcaaaattagtggtgttgataagtcatttccaggtgtgaaagccttgaataatgcctgtttatctgtttacgctggacgcgtaatggcattgatgggggaaaatggggcgggtaaatcgactttgatgaaggtgcttactggtatttattctaaagatgcaggcacaattgagtatcttaatcgatcagttaatttcaatggacctaaagcctcacaggaagctggcattagtattattcaccaagaactgaatttggtcggtaatctcacgattgcagaaaacattttccttggtcgtgaatttaaaacctcgtggggagcgattaactggcagaaaatgcaccaagaagcagacaagctacttgcgcgtttgggggtaactcacagcagtaaacagctttgcgctgaactttctattggtgagcaacaaatggtggagatagccaaagccttaagttttgaatccaaagttatcattatggatgaaccaaccgatgcgctcacagatacggagaccgaagccctattcaatgtgattcgtgaactcaaagcagaaaatcgtggcattgtttatatctctcatcgtttaaaagaaattttccaaatttgtgatgatgtgacggttttacgcgatggtcaatttatcggtgaacgcattgtggcagaaattacagaagatgatttaattgaaatgatggttggtcgtcgtcttgatgaacaatatccgcatttatcacaagaaaaaggcgaatgtgtattggatgtgaaaaatgtgagcggaagcggtattgatgatgtttccttcaaattgcatgccggtgaaattgttggtgtctcgggcttaatgggtgcgggtagaacggaactcggcaagctactttacggtgctttgccaaaaacggcgggaaaagtgcggttaaaaaatcaagagattgagaatctcagtccgcaagatggtttggataatggtattgtatatatttctgaagatcgtaaaggtgatggcttggttttaggaatgtcagtaaaagaaaatatgtcgctcacatcgctcgatcatttttcacaaaaaggcagtattcgtcatcaagcggaaaaaatgacagtagatgactttattctgatgtttaacattaaaacacctaatcgtgatcaacaagtaggtttgctatctggtggaaatcaacaaaaagtggcaattgctcgtggattaatgactcgcccaaatgtgttgattttagatgaaccaactcgtggcgtagatgttggcgcgaagaaagaaatttatcagttgattaacgaatttaagaaagagggcttgagtattttaatgatctcatctgatatgccagaagtgcttggtatgagcgatagagtgttggtaatgcgtgaaggtaaaattagtgcagaattttctcgcaaagacgcaactcaagaaaaattattagcagcagctattggtaaataagagtaggtaagtatgatgaaaaatgaaacatctaattttcaaataggaagatttttgattgaacagcgttcttttattgcgttgattattcttatcgcgattgtatcaatgattaatcctgatttttttagcgtagataatattttgaatattttacgccaaacttcggttaatgcgattattgcagtgggtatgactttcgttattttaattgcaggtatagatctttctgttggatctgtattggcattgacaggtgcaatcgccgcttcaatggtgagtatcgaattgcctatttttttagtcattcctgtggttttattgattggaacacttcttggtggcataagtggtgtaattgtggcaaaagggaaagttcaggcttttattgctaccttggttaccatgaccttactgcgtggtataacaatggtttatacagatggtcgtcctattacgacaggtttttcggataatgctgatctatttgctagcattggtacaggctatgttttaggtatcccagtaccaatttggattatgagtatcgtgtttgcggttgcttggtatattttaaaacacacaccaatcggtcgctatatttatgctttaggtggaaatgaggcagcgacccaactttctggtattaacgtcaataaaatcaaagtatttgtttttgcggtgagtggatttctttctgcgctggcgggtttaattgtaacttcacgtttatcttccgctcaacccactgctggcgtatcttatgaattagatgcaattgccgccgtggtagtcggtggaaccagtttgatgggggggaaaggtcgtgtaatgggaactctcatcggtgcattaatcatcggatttttaaacaatgcattaaatttattagatatttcatcttactatcaaatgatagcaaaagcgttggttattttggttgctgttttagccgataactatcttggtacaaaaaaactgtaactcactttaaggagaaactatgaaaaaactaaccgcacttacttctgctgtattattaggtttggctgtttctggctctgcttctgcacaagacacaatcgctttggcagtatctacattagataacccattttttgtaacgttaaaagatggcgcacagaaaaaagcggatgaattaggttataagttagtggtgcttgattcacaaaatgaccctgctaaagaattagctaatgtcgaagatttaactgtgcgtggtgcaaaaatattattgatcaatccaactgattctgaagcagttggcaacgcagtggcgattgcaaaccgtaagcatattccagtaattacattagatcgtggcgcagctaaaggaaacgtagtgagccatattgcatctgacaatatcgcaggtggtaaaatggcaggtgattttatcgcacagaaattaggcgataatgccaaggtgattcaacttgaaggtattgcaggaacatctgcggcacgcgaacgaggtgagggtttcaaacaagctattgatgctcataaattcaatgtgcttgccagtcagccagcagattttgatcgaacaaaaggtttgaatgtaacggaaaatttgttggcatctaaaggtgatgttcaagcaatttttgcgcaaaatgatgaaatggcattaggtgcattacgtgcggtgaaagccgcaaataaaaaagtccttatcgtaggttttgatggtaccgatgatggtgttaaagcggtaaaaagtggcaaaatggcagcaactatcgcacaacaacccgagcttattggttcattaggtgttgttaccgctgataaaatcttaaagggcgaaaaagttgaagcgaaaattccagtagatttgaaagtaataagtgaataatctatctactaaataagctcgttatatcacattatggggcaaattatatttgtcccattgtgtagaaagaaaaaatataacaatacaggataaaataatgaaaaaaaccctcacggttctcggtagtatcaatgctgatcacgttatttctgtgccttactttgctaaacccggtgaaacgctaacaggtcaaaattatcaaattgcctatggtggcaaaggtgccaatcaagcagtggcagccgctcgtttaggtgcaaaggtagcgttcattagttgcattggatcagatagcataggcaaaacaatgaaaaatgcgtttgagcaagaaggaattgatacaacccatattaataccgtttcacaggaaatgacaggaatggcatttattcaagtcgccaagtctagtgagaacagtattgtgttggctagcggtgcaaatgcacatttgggtgagatggtcgttcgtcaaagtgaggcgcaaattgcacaatcggattgcttgttaatgcaattagaaaccccactttctggtgtggagctggctgctcaaatcgctaagaaaaatggtgttaaggttgtgctaaatcctgctccagcgcagattttatcggacgaattattgagtttgattgatattattacaccaaatgaaacagaagctgaaatcctgacgggggtagcggtagccgacgagcaaagtgcggtgaaagctgcgagtgtttttcacgataaaggcattgaaaccgtaatgattacccttggcgcgaaaggtgtgtttgtcagtcgaaaaggtaaaagccgcatcattaagggcttttgtgtgcaagcaatagatactaccgcagctggtgatacatttaatggcggttttgttacggctttattggaagaaaaatcctttgatgaagccattcgttttggtcaagctgccgctgcgattagtgtgacgaaaaaaggggctcaatcctctattccaacgcgtcaagaaactttggaatttcttgaacacgcttaaagtgcggtgaatttttagggtgtttttatggcgacaatgaaagatattgcacgactggcgcaagtttcgacttctacagtttcacatgtcattaatggatcgcgttttgttagcgatgaaattcgtgagaaagtgatgcgtattgtcgctgaactgaattacaccccttcagctgttgcacgaagccttaaggtgcgcgaaaccaaaactatcgggctacttgtcaccgcaacaaataatcccttctttgcggaagtgatggctggcgtggagcaatattgtcagaaaaatcaatataatcttattattgctacaacgggtggagatgccaaacgcctacaacaaaatctgcaaactctaatgcacaaacaagtggatggtttgcttttgatgtgtggtgatagccgttttcaggctgatatagagttagccatttcgctgccactggttgtgatggactggtggtttactgagttaaatgcagataaaatactcgaaaattcagcacttggtggctatttggcgacaaaagcattaattgatgcaggacatcgtaaaattggcattattacgggaaatctcaaaaaatctgtcgcacaaaatcgtttgcaaggttataaaaatgcgctgtcggaagcaaaaattgcgttaaatcctcattggattgtcgaaagtcattttgactttgaaggcggtgtacttggcatacaatctttacttactcaatcttcacgtccaacagcagttttttgttgtagtgacaccattgctgtcggtgcataccaagctattcagcaacaaggcttacgtattccgcaagatctttcaattatgggctatgatgacattgaattggctcgttatctctcgcctcctctctccaccatttgccaaccgaaagctgaacttggcaaactcgctgttgaaacactattgcaacgaattaaaaatcctaatgaaaattacctcactttggtgttagaaccgacttgtgtgttaagagagtctatttacagtttcaaataaaattagaataactcaatttccttattgctattttcaaaaaaactgctattttcttgcggtttttttgtttatttaacccactgtttaatttaggaataaaatcttatgaaagaaaacaaacctgttgatccttatgcgaaatataacgaacaatcgaatattatcgcgaaaataatttttgctagtcgctggttgcaagtgccgatttatttgggcttgattgtcacccttgcaatctactcttataaatttatcaaaggattatgggagttagtgattaatgtaaatgatatggattccaacacaattatgttaggcgtgttgaatttgattgatgtcgtgatgatcgccaacttacttgtgatggtgactatcggtggctatgaaatctttgtatctaaattgcgtacacgtaatcaccccgatcaacctgaatggatgagccacgtaaatgccaccgtgttgaaagttaaactttctatgtctattatcggcatttcatctatccatatgttgcaaacttttgtgaatgcaagcaatatgccagaaaaaacgatgatgtggcaattattgttgcacttgggctttttagtgtcggcaattgctttagcttatacggacaaaattttgtatagcacaagccataaaacacattaaaaatttaccgcacttttaaccccgttcaaattgaacggggttttatatatcatatagttacaatttaattttttagtatgatacgccgtttagaataggaaagcttaaataaaatactaagatgttaatcaagtagaaattaatcttctaaatctagaggctcttgcgaaagtataattcctgtcagatctgcgtaaatataatcttctgggaaaaaggttacgccaccaaaattcactggaatatcactctcgccagcactgctttcatctgcactgactggaattggcgcaagggcatgaataccaatatcgaggttttctaattgctgaatttggcgtactgcaccatatacaataatgccttcccaaccattatcaacggcaagttgagccaattctgcatcaatcaaaccacggcgtaccgcaccaccgccatcaatgacaagcactcgaccttcgccgttttcttctaatacttcagcaattaatccattactttcaaagcattttactgtagtgactttaccgtaaaaatgacttacgccaccaaagcttgaaaaaattggctccacgacatccacttgttctgcataaagatcgcaaagttctgaagtatcaataaacataactttcccctatcgattgttgaaattttgtttgctttagtatatgccgatttagccgataagcaagcctaaactaaacaagatattgattaataacgaaatcatagacatttgagccaacattggacgcaattcacttggctgctgactacgataaacaaagatcgcgtgtttagctaacaatggcattgctaatacaaataaataatttgtccaagaagtggccgtggccgttgccaccgcaaatgccaaataacatagagccgccacacttaataaaatacaatgataaacacgccctttatatgcacctaaacgaacggctagggtatttttgctagctttcgcatcctgttcaatatcacgtaaattattgatatttaataccgcacttgccaataagccagaaccaatagcaggcaaaataatgtggctagcaatactgtgagtttgcaaataataagtgccgccaacgccaagcaaaccaaaaaatactaatacagaaatatcgcctaatcccatatagccataaggttttgccccaacagtgtaagtaatggcagcaacaatagctaaaattccaagcccagcgaaagcgaataaatctgagagattttcataagcgattccaatcaagaaacttcctgaaagaaaacttgccatcaccattagaattaatccccatttcagttcttttgctgaaattgcgcctttttgaatgccacgtaatggcccaatacgttcttcagtatctgaacctttttgatgatccccataatcattggcaaaattagaaagcacctgcaataaaattgtcgtgagtaaacaaagcaccattacaagcccattaaaaccttgtggattcgcccaataacctaatgccgaacccgtgaaaatcgatgccaacgctaagggcaaagttttcggtcgagccgtttcccaccacattttcaatttttcatttatcattttttttgaccgcacttttgattacaataagccgcgtattctacactaagacacccaatttatgaatgatttaaccttatcgcctatcgccattatccacacgccttataaagaaaaattctccgtaccacgccaacctaagttagttgaagacggagtaggcattgtagaactcttaccgccttataattcgcctgaagccgtgagaggattagaacaattcagtcatctttggttaatttttcaattcgaccaaatccaacaagggaaatggcaacccaccgtacgccctcctcggttaggcggtaatcaacgaattggagtgtttgcttcacgcgcaacgcaccgcccaaatcctcttggtttatccaaagtcgaattacgtcaagtagaatgcatcaacggtaacatttttctccatttaggtgcggtggatttagtggatggcacgcccattttcgatatcaaaccctatattgcctatgcggatagtgagccaaatgcacaatcgagctttgctcaagaaaaaccaccagtaaaactgactgttgaatttaccgagcaagccaaaagtgcggtaaaaaaacgagaagaaaaacgaccgcacttaagtcgttttattcgccaagtgctagagcaagatcctcgcccagcctatcaacaaggtaaaccgagtgatcgtatttatggaacaagtttgtacgaatttaatgtgaaatggcgaattaaagcgggtacggtaaattgtgtagaagtgattgaaatagaaaaagacaaatagatgtaatatgtaaataaggcagggaatccctgccttagttaatttaaatgccttattttaggaaaaactgccctttagttaatttatatattgtcattaaaaccaataagccaatcattacatttgagaaaacaaaggcaaaaatagacacgccttgtaaaacattgccatgatagaaagcggtagcactgtttgccatagacgctaatccgaatgagaatgtccataagccaatgttaagtcctttttccacaatccaagggaataatcgcaataagaaaaataattgcaaaaatccatatccccaaaggattttagctaacgtatccacctcgcagtgattgatcgataaataagcagatacacacacaaacgcaggtgctaaaacaatccctattgtggctctaaattgtggctcaagagatgaaatacgtaaatgttgtaataatacaggttcaaaaataatccaagcaatcattcctgcgccaaagaataagtaggctaaatcatggtagccaagtaatgctaatgaacttgcgctggtaaaattagcagctaccgcaggcaaataaaacggaggatgagtagatttttgctcaaatacaccaccttgccataattcactgacacgtaatgttgagaaaagtaattgaccaatcgttccaatccaaattaaaacttcagcaattaaaggattccaacgataaagaatatcgcctaccaacatagttgtaataggaatcaatgcaataaaggaaaaacgaactgggctatgatactctgcacgaacttcctcaaagtaataacgaagtttatacgcatacattaaaataaataaaatccagaccacacttgctacaatgccaagaacatcacttaccattcgcgcagcaggaaataagttttctaaatgaaaccaagctaaagataaggctgctaaaccaagaggaataccgaaatatcctgttggaagaggaaaaggctttgttatattcatagtatgatccttattttgaaaaatatgagcaaagtgtaacataactatcaacaacagacttttctaaaagtctcaaatttttgtgaatttctatgaagaaacatacttgttgttctggcataaaacctctacccattttcataaaaataaaaaacccgaactttcattcgggttttctcatacagggaattaattattccgcatcatctgccatgttaagcatttcagctaagttcgcacttgcatcatctgcagtcataacaaattcatcagcgatagcagcttcatcttcttcagataatttcgctacgacatcatcaactaaacgatgtttgtgacgattttgatgatacgcaaaacctgtacccgcaggaattaatcgacctactattacgttctctttcaagccacgtaattcatcacgtttacctgccactgctgcttcggtaagaacacgagtagtttcttggaacgatgcggcagagatgaaggattcagtcgcaagagacgctttggtgatacccaataattcacgttcaaattcaactggtggtttaccttctgcttcacgttggcgattaacaattttcacgcgagccacttcgacttgttctccctcaaggaattctgagtcgtaagctttagtaattaccgctttacgtaacatttgacgaacgataacttcgatatgtttatcgttgatttttaccccttgtaagcggtaaacatcttgcacttcgttcacgatgtattcagttactgcacgcacgccacgtaaacgtaaaatgtcgtgtggtgtttcagcaccatcagaaattacatcgccacgttgtaccatttcgccttcaaatacgttgagctgacgccattttggaatcatttcttcgtaagtttcgccttccgcaggagtaattaataaacggcgtttacctttggtttctttaccgaaagacacgataccagaaatttcagccaagatagctggttcttttggtttacgtgcttcaaataaatctgcaacgcgcggtagaccaccagtaatatctttagtacccacagattcttgtggaatacgtgctaatggttcccctactttcactgctgcgccatcgtctaaacttacaattgctttaccaggtaagaagtattgtgcaagaacatcagtttcaggtaagaaaatatcgttgccatttgcatcaactaatttaatagttggacgtaaatctttacccgcagttgcacgttcacccacatcttgaaccacgattgatgataaacctgttaattcatctgtttgacgcgtcacagttaaaccatcaataatgtctacaaatttcacaaaaccagatacttcagagacaactggcattgtatgtggatcccaatttgcgatagtttcgcctgcagtgacttcttgaccgtcacctttgcttaataccgcaccataaggcactttataatgttctttagtacgaccaaatgcatcagtaatagttaattccgtgttacgagaagttaatactagtttgctttcatcgttagtcacgaattttgcattcattaaatgcactgtaccagtgtttttaacttgcacactagattctttcgctgccgcagatgccgcaccaccaatatggaacgtacgcattgttagctgtgtacccggctcaccgatagattgagcggcaataacccccaccgcttcgccttggttgattaaatgaccacgcgcaagatcacgaccataacatttcgcacacacgccaaagtcagtatcacaagttacaacagaacgtacttttacgctatctacagagtttgcatccaacacatcacagagtttttcatctaataaggtgttacgcggaattaatacttcttctgcacccggttttaaaatatcttctgcagcaacacgacctaatactaattcacgaagtggcactttttcatctccaccttcaattaatggggtcatgactaagccttcgtgcgtaccacagtcatcttctacaatcactaagtcttgtgccacatcaactaaacgacgagttaagtaacctgagttcgctgtttttaatgcggtatccgccaaacctttacgagcaccgtgggttgaaataaagtactgtaatacgttcaaaccttcacggaagtttgctgtaattggggtttcaatgatcgagccatctggacgagccatcaaaccacgcatacctgctaactgacgaatctgcgctgcagaaccacgcgcaccagaatcagccatcataaagatactgttaaaggacgcttgtttttcaggattaccttcacgattgatgacttcttcttgagataagttttccatcatcgctttcgctacgcgctcattcgcggcagcccaaatatcgattactttattatagcgttcgcctgccgtcacaagacctgattggaattgttcttggatctcagctacttcttcttccgctgcagaaataatttcgtatttcttcgctggaatttccatatcatcaataccaactgatgaaccagaacgtgccgcatacgcaaaaccggtatacataatttggtcagcaaacattaccgcttcttttaaacctaaacgacgatatgcttcgttaatcagtttagaaatggcttttttacctaatgtttggttgaacaatgaataaggcatgcctttcggcgcgatcatccataagattgcacgaccgatagttgtatcagtcagcgtggttttcgcatcaaattcgcccgcttcatttttcacatattcagtaatacgtactttcacacgagaatgtaattctgcttcgcctgtacgatatgctttttcagcttcgcgaggatcttgcaataacataccttcgcctttaccgttcactttttcgcgggtcatatagtaaagacctaataccacgtcttgtgatggaacgataataggatcaccgtttgctggagaaagcacgttattggtggacatcatcaacgcacgagcttctaattgcgcttcaagggttaatggaacatgtaccgccatttggtcaccatcgaagtctgcgttaaacgccgcacaaacgagtgggtgtaattgaatcgctttaccttcgattaagatcggttcaaacgcttggatacccaaacggtgaagtgttggcgcacggttcaatagaattgggtgttcacgaataacttctgcaagaatatcccaaacgatcgcctcttcacgctcaaccattttcttagccgctttgattgtcgtagcataaccacggctttctaatttcgcatagataaacggacggaataattccaatgccattttcttcggtaaaccacattggtgtaagtgcaagtatgggccaacagtgattacagaacgaccagagtaatcaacacgtttacctaataaattttgacggaaacgaccttgtttacctttgatcatatccgctaatgattttaatggacgacggttagaacccgtaattgcacgaccgcgacgaccattatctaataaggcatcaacagattcttgtaacatacgtttttcgttgcgcacaataatatctggcgcaattaaatctaataaacgttttaaacgattgttacggttgattacacgacgatataaatcgttcagatctgaagtcgcaaaacgaccgccatcaagtggtactaatgggcgtaaatctggtggaagaactggcaataccgtcatcaccatccattctggtttattaccagattgaacaaatgcttctaataattttaagcgtttagtgatttttttacgtttagtttcagagttagtttcttgtaattcttcacgtaatttttcacattcagcttcaagatccataccttttaagagatcttgaatcgcttcggcacccattttcgcttcaaattcatcttgccagcgatcttcagcgtcaaggtattgttcttctgttaataattgaccgcgctctaagtccgtcatacctggttcggtcacgatgtacatttcaaaataaagtacacgttcgatatcgcgcaatggcatatctaaaagtaaaccgatacgagacggcaatgattttaagaaccaaatatgtgcaactggcgatgcaagttcaatatgacccatacgttcacgacgaactttagtttgagtgacttcaacaccacatttttcacaaatcacaccacggtgttttaaacgtttatatttaccacataaacattcgtaatcttttacaggcccgaagatacgcgcacagaaaagaccatcacgttcaggtttgaacgtacggtagttaatggtttcaggtttcttcacttcaccaaatgaccaagaacggatcatatctggggaagctaacccaattttaatcacatcaaaatcttcactggtttttgattgtgcttttaaaaacttaactaagtctttcacaaatgttctcctgtcggagttaaaggtttaaagtgcggttaaaaatttcggagaattttgaccgcacttcggcgatttattgtttcgtcattttttctcttcgctccccctgtttacggggggagctgccgcaggctgaggggggaatttcccccttccgcccttcgggcaccttcccccacaagcaggggaaggcaagaatgaaattactcttcgtctaactcgatatttaaaccaagtgagcggatttctttcataattacgttgaaagattccggtgtgcctggctccatatgttggttgccacttacgatatttttatacatcttcgtacgaccattcacatcatcggatttcacagttagcatttcttgtaaggtgtaggctgcaccatatgcttcaagtgcccatacctccatctcaccgaaacgctgaccaccaaattgtgctttaccacccagtggctgttgtgtaacaaggctataagaacctgttgaacgagcgtgcattttatcatcaactaagtggttcaattttagcatgtacatataacccacggttactggacgttcaaatttctcgccagtacgaccatcgtaaagggttatttgacctgaagttggtaatccaccaagttttaatagctctttgatttccgcttcgtctgcaccatcgaacactggcgttgcaactggtaagcccttacgtaaatttcccgctaaacgcaatacttcttcatcagtaaaagtgcttaaatccactttttgtgaaccattacctaataaatcgtatgctttttggatatagctacgtaatttttccacttcttgtttttgtttaagcattgcattgatttgatcaccaataccttttgcagctaaacctaagtgagtttcaaggatctgaccgatgttcatacgagacggtacgcccagtgggtttaatacgatttcaactggctgaccattttcatcgtatggcatatcttcaactgggttaattttcgagataacacctttgttaccgtgacgacccgccattttatcccccggctggatttgacgtttcactgcaaggtaaactttcacaacttttaatacgcccggtgcaagatcatcgcctttaatgattttcttacgtttcacttcaagtttatgttcaaactctttacgaagttcttcgtattgctcagcaagctgttctaattggttttgtttttcttcatctgcaatggtttgttctaaccatttagtgcgatctactttatctaattgtgctgcatccgcaccactagaaataagaagattacgcacacgagcaaataaaccagcttctaaaatctctaactcttcagttaaatcttttttcgcttcacgaagttgcatttcttcgatttctaatgcacgtttatctttttctacgccatcacgagtgaagacttgaacatcaataaccgtacctgatgtaccatttggcacgcgtaatgaagaatctttcacatcggaagctttttccccaaagattgcacgtaacaatttttcttctggggttaattgagtttcgcctttaggggttactttacctactaagatgtcgccacctttaacctcagcaccgacataaacgataccagattcatcaagtttgcttaacgctgattcacctacgtttggaatatccgcagtaatttcttctgcacctaacttagtatcacgcgcaacacaagataattcttgaatatggatcgtagtgaaacggtcttgttgaacaacacgttcagaaactaacattgagtcttcgaagttatagccgttccaaggcatgaacgccacgcgaatattttgacctaatgcaagttcccctaaatcagttgaaggaccatctgctaatacttcgccacgattaattggatcgcctaaattcacacaaggaatttggttaatacaagtattttggttagagcgggtgtatttaattaaattataaatatcaataccagcttcacctgcaatggtttcatcttcatttactttaatcacaatacgagacgcatcaacgtactgaacggtaccaccacgttttgcaacaaccgcaacacctgagtcaagtgcgattggtttttccatacctgtaccaactaatggtttatccgcacgtaatgttggaactgcttgacgttgcatgttcgcacccatcaacgcacggttcgcatcgtcatgctcaaggaatggaattaatgcagccgcaacagataccacttgttgtgtcgaaacatccatatagtgaatatcttcaggtttatataaaccagattcaccacgttcaccacgagcagtaacgaaagcatcagtaaaacggttattttcgtctaagtttgagtttgcctgtgcaatgatgtagtttgcttcatcaattacagataagtattcaatttcttcagtaacttgaccatcaaccactttacgatatggtgtttctaagaaaccataatcattagtacgtgcaaaagcagaaagtgagttgatcaaaccgatgtttggaccttcaggggtttcaatcggacataaacgaccatagtgagtattatgtacgtcacgcacttcaaagcctgcacgctcacgcgttaaaccgcctggacctaatgcagaaatacgacgtttgtgtgtcacttctgacaatgggttgttttgatccataaattgcgaaagctgtgaagaaccaaagaattcttttactgccgcagaaatcggtttcgggttaattaagtcttgtggcgtgatcgcatctaaatcgcctaaagatagacgttctttgaccgctctttcaacacgcactaaaccgatacggaattggttttcagccatttcgcccacgctacggatacgacggttacccaaatggtcaatatcgtctacttcgccacgaccattacggatgtcgatcaatttacgcattaccgcaataatatcttcattgcttaaaatacccgcaccttccccttctggaaaagctaaagaacggttgaacttcatacgacctactgtagataaatcataacgttctgcagagaagaataaattattgaataacgcttctgaagattctggtgttggtggctcgcccggacgcatcatacgataaatttcgtaaagcgcactagttttgtcataagttggatcgacacgtagcgtttcagaaatatatggaccgtaatctaaatcattagtaaataaagtttcgatcgtggtgtaaccagcttgtgctaattttgcgagggtttctaacgaaatttcgccatttgcaggacaaataatttcgccagactctaaatcaacataatctttcgacgcaactttacctaaaatatattcagaaggcacaaccacttgtgagatattatctttttctaatgctttaatgtgacgagcagtgatgcgacgaccacgttcaacatacactttgccatttgcttcaatatcaaaagaagccgtttcaccacgtaaacgttctggcactaaagtcattaacaatttatcgccagcgatttcaaaggtaattttatcaaagaataagtttaagatttcttcagtggtgtagcctaatgcacgaagaatgattgttgccggtaatttacggcgacggtcaatgcgcgcaaataagttatcttttggatcgaattcaaaatctaaccaagaaccacggtaaggaataatgcgtgcgttataaagcactttacctgaagaatgggttttacctttgtcagaatcaaagaatacacctggactacggtgtaattgtgaaacgataacacgctcggtaccattaattacaaaagtaccgttatcagtcattaatgggatttcccccatataaacttcattttctttaatatctttaactgcgcgtgaagaagattctttatcgtagctcactaaacgtaattttacacgtaagcctgctgcataagttgagccacgaatttggcactcacgtacatcaaactctggctcttctaaacgataatctacatattgtaattctgtatagccattattgcttacaataggaaatacagaacggaatgccgcttctaaaccttgctgaccttcaggatctttttgaataaatttatcaaaagaatccaactgaatggttaataaataaggaacatttaaaacttgcggacgtttaccgaaatctttacgaattcgttttttttcagaataggagtaacccattggttttcctctgctaactgttcagtgacctagccacaaactaactgtgacgtgaatgaccgttaaaatgaccgcactctgaaccttacttctatagtggggtgacaactcaaattacatagaacgacaacttgagcaaaacaacgacaaataacggtgaatttgtcattgtgtggatgtgctttctatcaaaaacacggttaaattaagcaataaaaggtcaagattgattaaaaatcaatctaaatctttgctaattttaaggcggtaaattttaaatgaatgcagctttctcgtcaagtttaaaacttatatagaaattttatgaaacaaaaaaaccgcactttcaaaaagtgcggtttaaaatctatcaattctttaaattataaagaagcttgatcaacagcaacacctgcacccatagtggtagagatgcttactttcttgatgaaaatacctttagcagtagttggttttgctttatttaaagcagccaataatgcttgaagattttcttttaattgaacttcagagaagtttgctttaccgatagtggtgtggatgataccgtttttatcattacgataacggatctgaccagatttagcatttttaactgcttcagcaacgtttggtgttacagtaccaactttagggtttggcattaaaccacgtgggcctaatacttgacctaattgaccaacaacacgcattgcatcaggagaagcgataacaacatcaaagttcatttcgccttttttgatttgctctgctaaatcttccatacctactaaatcagcaccagcttctttagctgcatctgcgttagcaccttgagtgaacacagctacacgtacttcacgaccagtaccgtgtggtaatacagttgcaccacgaacgttttggtcagatttacgaggatcgatacctaagtttactgcaacatcaacactttcaacgaatttagccgttgcgaattgttttaataccgcaatcgcttcgttaatttcgtatgctttagtagaatctacgccagctttgattgctttcatttttttagtcaatttagccatcgtattattcctccaccactaagcccattgaacgagcagtaccagcgattgatttcattttcgtttcgatagtcgcaccagtcatatctgctgctttagtttcagcgatttgacgaacttgatctaaagttactttacccactttatctttgttcggtttaccagaaccagatttgatacctgcagcttttttcaataatactgctgctggtggagttttagtgacgaaagtaaatgaacggtctgcatatacagtgataacaactggaattggtaaacctttttctaagctctcagtacgagcgttgaatgctttacagaattccataatgttcacaccttgctgacctaatgcaggaccaactggtggtgatgggttagccataccagctgcaacttgcaacttaacataggcttggactttttttgccattttagttttcctctaattgggtaataacgctattaaatagctccccgataatttttagtgcaagattcattgcaccacacaaaaatatgagccacaaacggctcataatgggcgcggattatataaaaagtgcggttgtttttcaagcacttcttaaatccgatagaagatattatagtgcatcaccaattaatactgaatctaacgcaatttcaatcatatcattgaatgttaattgacgttcttctgccgtggtttgttcgtgagtacgaatatggtcagacacggtacaaatcgttaatgcttttgcaccatattctgcagccacaccataaattccagcagcttccatttccacacctaaaatgccgtatttttccattacatcgaacatttccacatcgggtgtatagaataaatccgccgagaataaattacctacacgaacgactttaccttttgcttttgcagcttgaacagcggcttgtgccatatcaaagtcagcaatagctgcaaagtcgttatctttgaaacgaatacggtttacttttgaatcagtacatgcacctaaaccgataatcacatcgcgcactttcacgtccatacgaacagtgccacaagaacctacacggataatttttttcacgccatattcagtgattaattctttcgcgtaaatagagcaagatggaatccccataccgtgccccataatagaaattttacgacctttataagttccagtaaaaccaagcatattacgaacattcgttacttcaacaacatcttgtaaaaaagtttctgcaatatattttgcacgaagtggatcgccaggcattaaaacaacatcagcaaatgcaccttcaggcgcgttaatatgtggagtcataatttttccttatttttaataatgaataaaaatgaataaagtgcggtcattttttaccgcactttttaattgattaagataaattaaagtgctgcagcacctaagccgataaataaaccagcaatagttgcactcattaagttagcgagagtaccagcgataacggctttgatacctaaacgagcaacatcactacgacggcttggtgccataccacctaaaccaccaattaagattgcaattgagctgaagttagcaaaaccacaaagtgcgaaagtaataatcgctttggttttttcagttaatacaattgcagaatctggttgtaaatattttgcaaattcaagataacccacaaattcattaaccgctaatttcatcccgatcatttgtcctgcaatacctgcttcagcaccatcagttacaccgattaagtatgctaatggtttaaaaattaaaccaaagatagattgtaaggttaagtcgccatagccgaaccatccgcctacgccacttaaaataccattaattaatgcaattaaaccaacgaatgcgattaacattgcacctacgtttaacgcaagttgcatacctgcactcgcaccgcccgccattgcttcaagtacgttagttggtttttctgaatcattgtcttctggttgtttatctgtgaattgttcggtttgtgggaacattaatttcgcaaataataaacctgctggtgccgccataaatgacgcagcgattaagtatgtcaatggcacgcccattccagcataacctgccattactgaacccgcaatagacgctgtaccacccaccataatggcaaataattcagattgggtcatatttttaatgtaagggcgaacaactaatggtgcttcagtttgaccgacgaagatattcgccgccgctgacattgattccgcttttgacgtacccaatgctttttgtaatgcgccacctaatactttaatcacgacttgcataatgccgagatagtaaagcacagaaattaagccagagaagaacacgataatcggtaatactttcactgcaaaaatgaaaccggatggtttacttggatctgccaatccgccgaaaacgaaattaatcccgtcattaccataggcaataacattggataccatatccgcagcggcacccaacgcttgtttacctgctggcacatataaaataagggcggcaaatcctacttggattgctaacgcccctactacggttcgaatactaatcgctttacgattattagaaagtaacacggcaatagcgattaatacgaccattcccaaaatgctgcttaacacactcatttgattcccctagattagttaagttaataaaattcggcttattctacttgttttcttatgaaaagtcggcgaattttcaccgcactttttgtaaacgtctataaaatagtcaaaatcttgttaattccacattgacgcgcataagcagatagcgcattagtttcttccacacttgggatatacgctgataacccagcttcatcacgtacgcctttgctatgcacgcagataatttttaatgccacatcaggataatttcgtagtagttgagcaactttgcccaccaaatgttcagcatcaaaaaaatgctttaaaaaaaccaaccgcacttcttccactttatttaatggcaataaggcagctaaattttgcaaattccgctccagtttatcgttttttatatgcaaacgctctagtatcacttgctgtgatacaatacctgcttgatttttccgatcaaaacaaagtgtttgcaagccaatgccctcgcctttgagatcaaataaaaatttgtcagtgacatcaattaacgaacaaacacgatcaaactcaaaaaagccactactatccaaataacaagtcaatccttgcgaacgtaaagccttaaagagtggcacaagttttttgtgatgaatagtgggttctccaccagaaaccgttacaccgcgaataaatggaactgcctccataacctgttcatacaaatactgcaaactgaccaatttcgcactttccgtataacgaggtatggtttccggattatggcaatacaagcaatttagcttgcaaccttgcagaaaaatactcgaacgattgccttgtccctctacatttgaaaaaggaataatccgatgcaacggcacaaaaatctcagaaagtgcggtcatttttctaattatttttcagcgatcacatctttttcattgcgtaattggcgatcaaacacattggcacattcatccgtacccgagccataccaagttgtatcgcgtaatgcaacttcgcctttacggtatttttcaacttcgcttttcttcactagataacctgtaactcgaattaaatctgtatttttcaaataggtggtaatgtagcgatagcctaaggaaaatgcgccatcaataatatccaccactgcatcgcagtgatctacataggtttgatcaaaggcgaataaatcccctgtaccagatgggaaatatttatggaacggtgcagattgtttcaaatgtgcaagtaacgttggttcttcgcctacacgaatacggtgagccggtgcgttacgcttgtcttcttcgtggttacttgcgcccacttgtgcgtgtaataaataacgattgccagtacgttcggcataaactccttcgtgcgcatcagtaatttctttcaatttatccataatcgcagtggcaatttcatcgccacgaacgctcttaccaaaggtttcatttaagccttcacattgcaataagtggtttgctgcatctgccaagcccacaattgcgaacatccccgtaaaattagtgcgtttgataaatccctctttttcgaggaatgaactgttaaagaaattactttcttccactacaaatttgtggcgtttatccatggttgaaagagcacatttcgccacacgcggtaataattcattcagcatttcatccgcacttttacaggtgcgagcaattgtccctagacgtaaacgcgttaaggtgtaggcgccgccacattcaggcagtgcgttatagcaacttgctacgccgtattcttcgcctagatcggaaatatagtaagcatcgttggcaaaagatggtttagaaaccaacaaacaggcttttgctgcaagttcagcaaaatcacggcttgttttcgatttgtcataacgaatagtcatattcggtgttggcgcttcaagctcaatcacggcgcgtaaaatcaagcgacctgctttcgtatcataaggcccaatattggcatgacagaatgagtcaggcacagttttatcaatatgatttaagaaacgtttaatttttatgtaatctttttcttcatcagtaatgaacggttcgagcaacacatcaagacgcccaacataaacaggataagtcgtaatggatggcacgcgggagtaaagaatcaataatccatcaagtgcctcatcaagatcttttggaggcggcaactctaaaaattcgcagcccttttggatatacacattgtaatcaggcaggatataacgaggacgataaatcgcgtagccttcacataaatcacaaatcatctgattctgtaaaaagccccattcttcatcggtatagccaagtaaatcgcgaggatcaaataaacgctcggcaatattgcctaatgtcattaatttttgatgataagtcagattattggctttaaccgtatcgagaatatcttgaagtgaagctaacataacgtcccctttgaaaatggtttcgtattgtacgcaatggtaacaaaatagacaattttgaaaacgtgaggaagatcacagttttagaaaataaacattatgcaaacggttactcaaaataaatatgtttttgatataaatgaactgacaaaattatttctgtttttgcatctttccttttatgataaaacggaatataaaaggtaataaatatgaagaaaaaagtacgcgttatacctcgcacatcttgggctgccacatcattatggaccgcgcaatataaaaccatttcaatcttactttttgctctttctattttaggtattggagatgggcttattgtattatcaggtttaggatcgacaccttggactgtactttcacaaggtatagcaatacagacaaattttgatattggctggtcatcttttttaattagttgcgcagtaatgttggtatggaaacctctcaaattacgccttgggcttgggacattattaaatattatcgttattgctctatttctagggatcacaacaaaaatactgacgccgccaaccgcacttttttcacgaatgatcttctgtctgatcggtatattactctatggttttggaactgcgttatatctcacttgtcacttaggtgcaggccctcgagacggattaatggttggtatttgccaacgttttcatttaagcatcaacgtggtacgctcaagccttgaaatctcggtttgtttacttggttttttacttggtggtgtcgttggcttgggtactgtccttttcgccaccagcataggcagcgttgttcaattcttcttaaatattattgctcgtttgccacatattccgtatgaaaagtgatatttcagctaacgcattgtctattgaaattaactctaaattcatttgagtctcttttcccgcgggtgggcaaaatgcaagatgcttatcgacatcattaatcggtttccagcgtctcggctgagaagaacgactatttggataaaatccgatagtcggaatattaaacgcactgctcaaatgcaatggcccagtagatcctgcaataaataaatccgcacaagctaaagaatgagcaaaatccactaaacctttattcttatcgtaaatggctacgcgtaaatcattcacaagatttgctaattcataggctttttctctttcgccaggccctgctgtcagcacaatattgcaatcaaactcagccaataagcctttaattaaatccgcatattgcgctaaagaaagattcgtagctgaaccaccagaaccactatgcacaaagatccattttttatttgcggaaagccctaaactctcttgtaaaaaaacgcgctggttttccaccgcacttttctcaaagattaaataaggcggtttaggttcaacaactggcatattatgcttttgcaaaaaagtgcggactaaatcttgattgtattccgcttctgatttttctgaacgagaacgacgttgtgttagacggtgattataaagaatttgaacccatttagtcgcaggtgcaaggcgatatttaattccacttttccaagcgagttttccattatgggtattggaaaagaaactaatcatgccatcaaactgctgcgctttgatttcctgcacaagacgtttgaaatccgttttgtcattttttttgctatcaataataacatcatcaataaatggacaaatttccgctaaaggcgcagtgtaactcggcacaagtgcggttaattttagctctggatttgaggctttcaacattgcaaaagcaggccatgcttgcataaaatcgcctaatttatcgttacgaataactaagatcttttccataatttctccgctaaaataaaaaaaccgcacttgaaagtgcggccgtattttatgttatttttgtggattataaaacatcaacacaatttaagtcttcgaaagattgctctaagcgtttagacattgattcttccattttacgtaaccaaacacgtgggtcgtagtattttttgtttggtgcatctgggccttcagggttacctaattgaccttgaagataagcttcatttgctttatagaaattcaaaataccattccaagacgcccattgcgtatcagtatcaatgttcattttgattgcaccgtagccaattgcttcgcggatttcttcgcggctagaacctgaaccaccgtggaagacgaagttaattggttttgcaggaagattgcgttctttagaaacgaactcttgtgatgcacctaaaatagatggttttaattttacattacctggtttgtaaacaccatgtacgttaccgaatgcagcagcaacggtaaagttagggcttactggatgcaattgatcgtaaacataaagcacatcagacggttgtgtatataaacgtgattcatcaacatcagagttatctacgccgtcttcttcgccaccagtaatgccaatttcgatttcaagggtcatccccattttatccatacgagcaagatattcacggcagattgccatattttcttccattgactcttcagataaatcgatcatatgtgaagagaaaagtggacgacccgtttcggcaaaatgtttttcgcctgcatctaataaaccgtcgatccaaggtaataattttttcgctgcgtgatcagtatgaagaataacaggcacaccgtattctttcgctaaagtatgaacctgtttcgctccagcaatcgcccctaaaacatctggacgagtaccactcgttggtttgatacctttacctgcatagaacgctgcgccaccatttgaaaattggataatcactggtgcttttacacgtgcagcagtttctaacacggcattaacggagtctgaacccacacagtttacggcaggaatagcaaagttatgctctttagcataagcaaaaactttttgcacatcttcgcctgttacaacaccgggtttcacgatatctaataatttagccatacttgtgtttcctttttatgtttagcgggataagcccacaatttgaagaatttgtattgatgatggcatttttgatgccaccatcaatatgttatagaggaaaagtgcggttagtttttcgcacgtttttcaagaatttctactgcaggtaatactttgccttctacaaactctaagaatgcaccaccacccgttgaaatgtaagaaatcttatcagcaataccaaataaatcgatagccgctaaggtatcgccgccgccagcaatagagaatgcatcgctgtttgcaatggcgtgagaaatgatttcagtccctttacggaagtgagggaactcaaacacaccaactgggccattccacaaaacggtttttgcatttttgataatttcagccaattgttctgctgatttatcgccaatatcaaaaatagattcatcatctttcacttcatttaccgctttttctgttgctgctgccgtttcagagaactctaaacctacacgcacatcaactggaactggaatatctgtatttgcggctaattctttcgcaactggcattaaatcagcttcatataaagatttacctacattgtgaccagctgccgcgatgaaagtatttgcaatgccaccgcccacaataatttggtcagcgatttttgaaagagaatttaatacttctaatttagttgaaactttagaaccgcctacgatcgcgaccattggacgagcaggttcttttaatgctttacctaatgcatctaattcagcggctaataatgggcctgcacaagcgatcggtgcaaattctgcaacgccgtaagttgatgcttgcgcgcggtgcgctgtaccaaaggcatccattacaaatacatcgcaaagtgcggcatattttttacctaattctggatcatttttcttttcgcctttgtttatgcgtacgttttctaaaacaacgatttcgccatctttaacatccacaccatttaaataatcttgttctaaacgcacattaaagcctgcgttttttaagtaatcaacaactggttgtaaagaatcttctggtgtgaattctccttcagttggacgacctaagtgagaggtaaccatcacttttgcacctttttctaaggctaattttaaagtaggaatggtcgcacgaatacgcgcatctgaggtcactttgccatcttttactggcacattaagatctgcacggataaatacacgtttacccgctaaatctaaatcggtcattttgattactgacataatctatcctcttgttaagttaaaattaaaattgaaaacttttcgtattatacctacttcgtgctaggttgtaacgatttagatcaaagaaattcttatttgctttggcaattcattacctgccattttttatcataacaaataaataattcatttcgactagccctcaaatacgcattttttaattgtggattatgttgcttcatccaaccaaaaagttcatctcgacttaatttttgattcggtaattttaatgcgttaaataattcctgctccttagcaaaatattgctgggcagaatcaaaggcgcaactaccgtgtttttcccattcgccttgcaataatttctcgcccggagaaatcgccaaatattgtgctaataaaccttttggcaaggcgggtaaatcgcctttgcaaaaacgaggatgatctgaaacagcgcgagcatttgcattttgtggccatagcccatgtacaacccaaccaaaagtgcggttatttccacattgatattgagaggaataaggcaactgatcgccatatttttcacgctgaatatcacaaaatccaggcgaccaagataatgccaacatataataatcgaccggtgcctttgcgttttgcccaatatgatcattgcgcataatcacatcatagtttgcaaaaacatctggattttttaccgcacttttttcaatatccgtccgctttgtctcaaattgaggctcgaatttaggttcaaatttaggctcagatacttttgtttgcttcgtctgctcaattacgggcgaggatgattgatgtttagttttggttgtatcggtaaaatattgccaaattgctaatataacgagaacaataagagaaagaatggaagtaagttttttcataaattttgtttagtttttgtcaatcaagtttttgtcggctataattcgccgctttcaactttctattaaggatcacaatggcattattcatcactagcaaatgtaccaactgcgatatgtgcttgcctgaatgcccaaacgaagccatttccattggcgatgagatttatgtgatcgatcctatactttgcacggaatgtgtcggccattacgacaccccaacctgccaaaaagtttgcccaatcactaactgtattaagcccgatcctgaacatcaagaaaccgaagaacagctttgggaacgctttgtaatgattcatcattcggataaattgtagaaaataacttcccttacttgtgggggaagatgcccgaaggacggaagggggctttctatatctcccctcaaccttcggcagctcccctgcaaacagaggaagaaaagtgttttctctagggaaaaatcaaatattaccccgccaccactggtaaatatccccattgaattaaaaatggaatgagcataatcacgacgccaattaataacgcaaacaccaaagcgaaattaccgccagaaacacgatatggcaatgttggattttcaatacgtgtacgccatgccaagctaattggtaaaattaagcaatagaacgcacacaacaaacctgcgtaacttaatgctgtaataaatccttcaggataaaacaatgcaaatacaagtggcggtaaaaatgcggctacagttaatacaaagcgattatttggcaaatgatagcgtttgaataaatcacctaagccttcaaatacaccaagcattacgcctaagaatgaagtaattaaagcaagtgatgagaacacacgtacaacctctcccataaaatgagaacctgtaatttcacgtgttgcattcactaagccatttagcgttgggtcagcttgtaaaatatgcacaaattcactttgacttaatacaccatgagttgctaactgccatacaaggtaagcagctaatggaatcgcagtaccaatcaaaatggcacgacgaaatttatcaacacttccacctaagtagctattcacactcgccattataacgtggaaaccgaaagaagtaaaaaatattggtgccgcagaaaccacaaaagcataatccaaaggcaatgccattaaattatctgttgccactttgggaagcatcataaacagtacaaaagcaaaagcgactaacttaccaataaataacacgcgagttaaaccatccacgcctttcgttcctacaaccacgaaagaacctaatacaacagtaaagataataatcgccgttttaagtgagattgcgtccattccaaaagccgttggcaagcctgaaagtaaagatccaccaccagtaatataagcggctgaaagtgcataaagtaaaactaacaaactcaacgtggcgaaaattcgcccaggaaccccaaaatatttttcagcgagcgtggcgacaccatcatccaactgatccgctgtttgatacacttctacaaacaacaatccgctgtaaaccaacaaagcccacaagccaacgagcaataacagggtataaccaaagcccatacccgctgatgtaagcggcatagcaagcatacctgctccaatggttgtgcctgcaataatcagcgcactcccaaaagttttgttttttagcataaaattgtccttataatgttgtgtttaaaaactaatttaaatttgaccgcacttttctttatagtgtaaacggcaaacagaaagataagaatcattgcccccaatttgaatttgtgcaccttctttaatgacctcgccctgatcatttaaacgcaaaacaaaattagccttgcggccacaataacaaattgtttttaattcttcgagttgatccgcccaagccagtaaatatttacttccttcaaaaagttccgcttggaaatctgtacgcaagccataacaaagcacagggattttgagtttatcaacaacatcactcaactggtaaacttgttgtttgctaagaaattgagcttcatccaccaacacgcaatgcactttttctttttttaagtgctcattgatttcatcaaacaaattggtttccgagcgaaataaaaaggcatcttgcgaaatgccaatacgcgatgtgacttttcccacgccaaaacgatcatcaatcgcagccgtataaactaatgtgctcatatcacgctcacgatagttataggaagattgtagcaacgtcgttgattttccagcgttcattgtggagtaatagaagtagagtttcgccattttttctcctaaattgccggtaattccgtcattgcccaacgaggtttaacatcaatagccagatcgctatgctgaccttgttttaaacgtaaaaaacctgtgtaagcaatcattgcgccattatctgtacaaaattgaggttgaggataaaacacttcgccacctaaattttgcattaagtgcgcaagcgtttctcggagttttttatttgcactcactcctcccgcaatcactaaacgtttatagccagtttcttttaatgcgcgcttacatttaatggcaagagtatccaccaccgcatcttggaaagcataagcaatatccgatttagtttgttctgtcagttcgccctcgtttttaattgcttgattaactgtatttgcggcaaatgtttttaaaccagaaaaactaaaatcaaggcctgcacgatctgtcattggacgtggaaatataaagcgatttggcgtgcctttttccgctaaacgagaaagtgccgcgccgcctggataatctaatccaagtaattttgctgttttatcaaaggcttcgccagcagcatcatcaatagattctcctatcacttcatattttcctacaccatcgacacgcactaattgagtgtggccacccgataccaacagagcaacaaaaggaaagtgcggtgaattttcatcaagcattggcgcaagtaaatgcccttccatatgatgaacaccaatcgctggcacattccaagcataggctaaagaacgtgcaatcgtagcaccaacaagcaatgcgccgacaagcccagggccactagtataagcaataccatcaatatcgcttgcggttaaattggcttcctctaatgccgctttaataagaggcgctgttttccgaatatgatcacgtgatgctaattcaggaaccacaccaccataatctgcatgcagggcaatttgagtataaagttgattagcaattaaccctttttcttcatcataaatcgccacgcccgtttcatcacaggaagtttcaatgcctaagattttcattgattttcttaatttattacctaaaatgttgcgcgattttaccctgtttaagcggttttaaccagttgaaaccacaaatattaaggttaattggcattctatcctttactttttccctaaaaatagattagaattgcgtcctttattaaatttgtcatttacacacaggtgctttggcaaaaataaaattttaaattgcaattaaattaaactcattgaggtgattggcttatgcctgtaattaaagtacgtgaaaacgaatcatttgacgtagctttacgtcgtttcaaacgctcttgcgaaaaagcgggaatcttagctgaagtacgcgctcgcgaattttacgaaaaaccaactacaattcgtaaacgtgaaaatgcaacacttgcaaaacgtcacgcaaaacgcaacgctcgcgaaaacgcgcgcaatacccgtttatactaatttatagtattttctgactcgagttaagacaaaccgtgaatcctttggactcacggttttgttactttaagcacaataaaaatctacgccaaaaacgaccgcactttcacaccacgatcacggaggctcgacaatgaaaggttctattccacgcccctttattgatgatttgctgacaaagtccgatattgtcgatgtgattaacacgcgcgtaaaactaaaaaaagctggccgcgattatcaagcctgctgccctttccatcacgaaaaaacaccatccttcacagttagccaaaagaaacagttttatcattgctttggttgtggtgcacatggtaatgcgatttcctttttaatggattatgacaaacttgaatttatagaggcgattgaagaacttgcagcaatggcagggcttgaaataccttacgaaaaacgcgctaatcacagcggaaaacctcaagctaattaccaaaccaaacgaaatctctatgaattaatgcaagagattgccacgttttatcaaaaccaattaccattaaatactcaagcacaagaatatttacaacaacgtgggctttcacctgaaattattgagcgtttccaaattgggtttgtgccgaatgcaatggatactgtactgcgtaaatttggtgttaatcgtgaagaacaacaaaaactcattgaattaggcatgctttctcgaaatgatcgtggcaatatttacgataaattccgaaatcgcatcatgtttccgattcgtgataaacgtggtcgcacagtggcttttggtgggcgtgtattaacagatgaaaaaccgaaatatctgaattcgccagaaaccattacttatcataaaggtaaggagctttatggtttgtatgaagccttacaaaccaacgatgaacccaaacaattacttgttgttgaaggttatatggacgtggtggcattagcacaatttggcgtggattatgcggtcgcttctttaggtacgtccacgacatcagaacaaattcaacttatttttcgttcgaccgaacaggttgtttgttgttacgatggtgaccgtgcaggacgtgatgctgcttggcgagcactagaaaatgcgttgccttacttagaagatggcagacaactcaaatttattttcttgccagatggagaagatcctgatacttacattcgtcaatacggcaaagaaaaatttgaagaatacatcgaaagtgcgcaatctttaagcgagtttatgtttgcacatttaagtcctcaggttgatttttccactaaagaagggcgcggaaaattagttgcgctagctgcgccgttaattcaccaaattccaggagaaatgcttcgcttatcgctacgcaatatgcttgctcaaaaacttgggatttttgatcaaactcagctggaaaatcttattcccaaacaattagaacaagccaatacacaacaaaaagtcactcataataagatcaagaagacaccaatgcgaatggtcatttcattgcttctgcaaaatcctgagttagtaaaacgtatgtctgaaagcggcgtgcaagcattacgtgcagaagcagggtttgaaattctggaaaaattgaccgcactttgtcgccaacgagagggcattactacggggcaaattttggaatacttccgcaatacatcttacagtaatccccttgaaatactggcaacttgggatcatttattagacgaatccgacataatcaacgcattttctcaaaattaccgtcgcttaaatattcaagctattgagcgcgatattgaaatgcttattgctaaagaacgaacagagggtctcactaatgaagaaaaaacggtacttgtacatcttttagctggtaaagaacagcagaaaaaacagttagtgaatccgctataacaatggtagaatctcaagttcataaaaaaatcttatcttctcaatcacatcaagcaaaacgagtataaaaatggaaaaaaatcaacaatctacggctgaacaatattcagaacaaattgagcaattgatggagctaggtcgtacacaagggtatttaacttttgctgaaatcaatgacttattgcccgaagatgctattgatcctgaatattacgacaaattgctacaaacgttgcaaaatgatgcaggtatccctgtattagatgaagcaccagaaagcgatgatatgatgttgagtgataccatccctgatgaagatgcagtggaagaagcaactcaaattctttcaaatgtagaatctgaaatcggtcgaacaacggatcccgtacgcatgtatatgcgcgaaatgggaacggtggatcttcttactcgtgaagatgaaattagcattgcaaaacgtattgaaggagggattgatgaagttcaaacctctatcgcagcctatcctgaagcattaaatggattactaaaaaactatgatgatgtagaaaaaggtaatttccgtttgaccgatttaattacgggttttgttgatccaaatgccgaaatagaagaacacaacggacttgatgaagacttttctgacgaagatgatgaagaagaatctagtaatgcagatgtggaagacaatgaatcagaatctacatcagattcaagcgactctgataacagtattgatcctgaagttgctcgcgaaaaatttcagcaattaagagaacagcactctaaaacccttgctgttattgaaaaacacggtcgctctggaaaacgtgcccaagatcaaattgcactacttggcgaaatttttaaacaattccgtttagtaccaaaacaatttgatttactcgttctatcaatgaaagaaatgatgaaacgtgtgcgctaccaagaacgtcagctacaaaaaatattagtggatatagcaggaatgccaaaggatgattttgaaaaaattattaccgctaatggcagtaacagtgaatgggtagcaaaagcattaaaatctagcaaaccttgggctaaacgtttaattaaatatgaagatcgtatttatgaagccttaaacaatctagcgataacagaagaaaatactaaacttaccattactcaaatgcgtgacatttgcgatgcagtcgcacgaggcgaacaaaaagcacgtcgagctaaaaaagaaatggttgaagctaacttgcgtttagtaatttccatcgcgaaaaaatacacaaatcgaggtttacaattcttagatttaattcaagaagggaatatcggtttaatgaaagcggtagataaatttgaatatcgacgtggctacaaattctctacatatgctacttggtggattcgtcaagcaatcactcgctctattgcggatcaagcgcgtacaatccgtattcctgtgcatatgattgaaacaatcaataaacttaatcgtatttctcgccagttactacaagaaatgggacgtgaagcaacaccagaagaattggcagaacgtatgggaatgccagaagataaaatccgtaaagtactgaaaattgcaaaagagccgatttcgatggaaacacctattggcgatgacgatgattcacatttaggcgattttattgaagattcaaccttagaacttcctcttgattctgccacagcacaaagtttaaaagttgcaactcacgaagtgctagaaggcttgacgccacgtgaagcaaaagtattacgtatgcgttttggcattgatatgaataccgaccatacgcttgaagaagtgggtaaacaattcgatgtaacacgcgaacgtattcgtcaaattgaagcaaaagcattacgtaaattacgtcatcctagccgttctgaaacactgagaagttttttagatgaatagagagaaacataaaagagaaaaatcgatctaatcttaaaaaaatcagatacatttgtttaaggactaaattctataatccgcagaatttagtccttttacttttacttttacttaaagcaccgcattaatatgcattcaaatttcaactattttagttagataagccattaacatttaacaatggcaacaaatattggttatttaaaacattttaatcataaaaaaatctgcacccaattagctggtttatttattcagctttaaggcacagattaaagtgcggtaaattttcttgatatttggcgtaaattatttatttaatttcgctttgtaagttggattcattaagttttctacagaaagaatgtcatccaattgttcttctgttaataaacctttttctaacacaacttcacgtacgcctttacctgtttgcgcacagattttacccactaagtcgccgttgtggtgaccaataaatggatttaagtaagtcacgataccgattgaattaaacacgtagttttcacaaatttctttgtttacagtgatgccatccacgcatttatcgcgtaagttcacacaagcattggttaagatgtcgatagattcgaacattgcttgaccaatcactggttccattacgtttaattgtaattgaccagcttcagatgcgaaagtcacagtggtatcgttaccaattactttaaagcacacttggtttaccacctctggaacaactgggtttacttttgctggcataatagaagaacctgcttgtaattcaggaagattaatttcttttaaacctgcacgagggccagaagaaagtaaacgtaagtcattacatactttagaaagtttcactgcagtacgttttaatgcaccgtgaaccatgacataagcaccacagtcagatgttgcttcaattaagttttctgctggtacacaagctaatccagtcacttcagcaaggtgttttacaactaattctgtatagccttgtggcgtatttaaaccagtaccgattgcagtcgcaccaaggtttacttcaagtaataaacctgctgtacgttttaagttacgcacttcttcttcaagtaatacggagaaagctttgaattcttgaccaacagtcattggcaccgcatcttgcaattgggtacgacccatttttaagatatttgcaaactcttttgctttattatcaaaaccgtcgtgtaaatattgaattttatcgatcaattttaagatgctgttatacactgcaatacggaaaccagtaggatacgcatcgttggttgattggcttgcattaacgtgatccatcggattaatcacgttatattcgccttttttatgaccaattttttcaagggcaagattagcaaccacttcattagtattcatattgacagacgtacctgcaccaccttgatatacatctgatgggaattgatctaagcattttccagtggtaaggatttcatcacaagctgctacaatcgcttttgcaatatcacttggaattgcacctaattcgccattggctaaagccgttgctttttttaccattaccataccacgtacaaactcaggcacgtcagaaatggttacgttagaaatattgaaattttctaccgctcttaatgtatgaatcccccagtatgcttctgcaggcacatcacgttcgccaagtaaatctacttcttttctaaattgagtcattttaatcacctttttgggttagttaatttatcgtcattatagaaatttcaagaagaaaaaacttgatgaagatcacattttcaaaaaatgctctcaagacatattttcatttttcggattagtttttttagggaaaaatgttctatctatcaatcttacacagatttcaatagcctaccaattttctcaaataatttctgaatttgctctgcacgacacccgagtacccgcaccattaaaccatattcattgagttgtgatatgcctatcagtagatctttttcttccgtactttgttgctgcaaggcttgcacctgttgtttgatttccgcattatttttcgccaaatttagataagtcagcgaaccttgatgggaataattttccatctgactcaaagcggtaagattcattttagacggcagccactggatacaatcactgacaagcggtcgttttttgccatcgtctttcaaagtataaatcttcaaatgggaagaaaactggcggaaggcaaaacgttcatcattcaacacccgcccaatcgccacgatttcaccgtaaatcagctcgctttgttcgcccatttcaatctgggtttgctgcttaaaaacggaatctttatgtaacaccaacggatgcggcaaatagaataaacgactgttttccgcaagcaaaatatgggttgtttgcatcgcactgtcgccttcattcatcgcctgcacccgagtaaatgcctgcgtatttaaagaaagtgcggtcaattttgccaacgaaatatcaatctctaacagatcgcccgccagcaccccaggggaggaggacatctgcatcgcattcaagccattcgcccacgcatcatcgtaacttggcaacgttatcactttaaacggtggcgtcgcaaagtattcagcaagctgggttttaccgctggaggaaagtttggtggaaagggataatttgctgttcatagattttgtaggggctaattacattagccccgatatttcaccaataattgggcaaatgtaatttgcccctacgattaacgaaccaaagatgcaggttcttccacattcttcaacaacgcatatttttcgatccaaccgatcacgccatccagattttcttttttcatcaggttagtgaaaataaacggctgaccgttacgcatacgacgagcatcacgttccatgacgcttaagtcaacaccaacgaatggagcaagatcagttttgttgatcacaagtaaatctgaacgagtgatacccggcccacctttacgagggattttttccccttgagccacgtcaatcacgaaaattgtcacgtctgccaaatcagggctaaaagtcgctgaaaggttatcgccacctgattcaatgaacacgatttccacatcagggaaacgagtcaccatttcgtccacggcttctaaattcatcgaggcatcttcacgaattgctgtgtgcgggcaaccgcccgtttccacgcccataattcgctctggtggaagcaaactatttttcgttaaaaattccgcatcttcttgggtgtaaatatcgttagtaatgactgctacgctatattttgacgctatttcacgagtgagtttttcaattaacgcggttttgcctgcgccaacaggacctgctacgccaattttaatgtagttacgcataatgttccttttgtttatcatcgtagcaactgtgttgctcatgggtgtaggggcaagttacatttgcccctatatatcaacgaatgttcaagggcaaatgtgatttgcccctacaagtaaaatctcaataaaaaataaccgcacttacgacatataaagtcgcgtataaagcacttcgtgttgcatagcccgaatatcattcgccagcgttgccgcaccaagccattcttcgtcagggtcaaagcttaattccaccgcttgtacgagcgagccacgcaagtcaaacagaatatcttgcccatccatttggctgagaggaattagcttcacgccgttagtgatcgcaccgactgctgcgttgtagtagaacgcatagagcgtatcggctttgcttaaacccatggcttgagcaaccattgcaaacactatcgggaaatagccctgcacgcgtttttctgcaatcgcttgctggtaagctgtgagcaacgtatgtgtttcatagcgaataaaaattttcaacaatcgtacgccgagtttgaaactcccttcacgactttcgcgtgccactttggtggcggaaagttgccaatccagttcgcacaagcggtcaaaattcccctcacacattgcatcgaaggcaagagaaagatacgccccgtcgttgtaaatccagttttgtaaaagctgggtttgcacatattcttctagggtcgctttgctttctaccacacgttgctggacgaaggtttccaagccattggaatggttaaatccaccaatcggcaaggtgggatcgaccaagtgcaacaacgcacctaaatccgttaaagagcggtttaatgtttgtgccaatgtccatctccgtgatgatgatagccatgatgatcatgcgaatggctatgagaatgtccatgcccttgtgcagaatttgctcttaacgcttggcttaaacggcgttctgctttttgcggatgaaatcccgcagcttgcagccattcaaacatcggcttatcgtaaggtaatgttacttcatcgccatctaaaaaaagcggcgaatgtttgttgccgatttcataacaagctcgagccatttcaggcaaggttttcggcgacagcacaatcacgtcactcggtaaaatttcaatcgcaatcactaattcatcgctgataaacactacatcatcgtgtttcaagcgttgcccctcttttagcaagcgaaatgctacttcacgccccgtatttgtagttttacgcaaaatattgcgttcgctttcataccactgcaatgccacgcgttcaatgggctgtgtggtaattttgccctctgcttgaagtgcggttaaatttcccaagatattttctataatagggagaattgggttaattattttcatctttcctctataaatccactttcttctcttcgaaagaaaaactacagctacaatgatttcttatttatcaagtaagaggcgtatcgtacacgcctttttacactaattcgtctatgaaaacagtcctttagaataggaaatatcgctgacccaatggtacgctatccactggttcacaggtaattaactctccatccactcgaacttcataacgttcagcatcaacagtaatgtttggtgttacatcattatgaaccagatcttttttacctacgttgcggcagcctttcacagcaatggtttctttgtgtaaaccgaatttttcacgaatatcggctttttcagcggcttgtgaaacaaaaaataccgctgtttgtgccgttgctaagccttgtgcaccgtacattggacggtagaatacaggttgtggcgttggaattgaggcatttgggtcgcccattttggcgtagctaataaaaccttttttaatgacgacttcaggttttaccccaaagaacatcggtttccataacacgatatctgcgattttacccacttctaacgagccaatatgctccgcaataccatgtgcaattgctgggttgatagtatatttcgcaatgtagcgtttaatacggaagttatcgtttccttcattacctagctcaccacgttgcattttcatcttatctgcagtttgccatgtacgaataacgacttctccaatacgtcccattgcttgagagtctgaactcataatggagaagacgcccatatcatgcaaaatatcttctgctgcaatggtttcagggcggatacggctatcggcaaaagctacgtcttccggcacgcgtttatctaagtgatggcaaaccatcaacatatccaaatgttcatcaatggtgtttttggtaaacggacgagtcgggttggttgaagcaggtaatacgtttgaatacatcgctgctttaatgatgtcaggtgcatgaccaccacctgcgccctccgtatggaaagtatgaatgacacgtccatcaatcgctttcatcgtgtcttccaaaaagccactttcatttagcgtgtctgtgtgaatggccacttgaatatccatttcatctgctacttttaaggcagaatcaatcacggcaggcgttgcaccccagtcttcgtggatttttaaacctaatgcacccgcttcaatttgctcacgcagaggatctagggttgaacagttgcctttaccaaaaaatccgacgtttacaggcaaggcttctgccgcttgaaacatacgttccatataccatgcgccaggggtacaagtggttgcgtgcgtaccatcagcagggccagtcccaccgccaattaacgtggtaacgccactttcaatcgcatgttgtgcttgttgcggacaaataaagtgaatgtgggtatcaataccgccagcggttgcaattaaatgtgcaccgttatgaacttctgtgctagcaccgataatcatgtttggcgtgacgttatccatggtgtcagggttacctgcttgtccaatgcccacaatacgcccatcacgaataccaatatctgctttgataatgcctaatttagcatcaatgatcatcacgttggtaatcacaaaatccaatacattcggattgtcgcgagttgccgtaccgctttgagccataccatcacgcacgcttttaccgccaccaaatttacactcatcacctttggtcaataaatcttgttcaatggttgcccataaattggtatcgcctaaacggactttatcgccaacggttgggccataagttgctacatattgtgctcttgaaattgttaatgccattctgccctaccttataatttgccatcaatttgattatggaaaccataaatgatttggttaccaccaaaagcaactaattctactgatttcacttcacctggttcaaaacgcaccgcattgcctgatggcacatttaagcgcattccacgcgccaaagtgcggtcaaatttaagggcattattggtttcaaaaaaatggtaatgcgagccaacttgaattgggcggtcgcctgaatttgttacttcgatttttacggtttttctgccgacattagcgagaatatcgccttcggctaattggtattcgcctgggatcatatctttgttccttgtagggtgggctttagcccaccattgatatttttattttggtgggctaaagcccaccctacggttatctgattggattatgcacggtaacaagtttcgtgccatcggggaaagtagcttcaatctggacttcatgaaccatttctgccacaccttccatgacatcatcaacagttaaaagtgttgcgccatattgcatcacttccgctacactcattccgtctcttgcagcctcttgtaaatggctcgcaatataagcaatggtttctggataatttaatttaacgccgcgtgctttgcgttttgccgcaagttcgcccgcgaggaaaagcatcagtttttcttgttctctggaagttaagtgcatattttcattccttaatttattatacgaaagtcagcgaattttacgtaaaaaatctaaaataggaaaaatattttgtcagaattttttgtaagccccttgaaagaaaaaaaatcctccttatatagaaaccgcacttacaaattcttaagaaggaaattaatcatgaatattcgtcctttacacgatcgtgtaattattaaacgtgaagaagtcgaaacccgttcagctggcggtatcgtattaaccggttcagcagcgactaaatcaacccgcgcgaaagtattagctgtgggtaaaggtcgtattttagaaaatggcaccgttcaacctttagatgttaaagttggcgataccgtaattttcaacgacggttacggcgtgaaagcagaaaaaattgatggtgaagaagtgttaatcatttctgaaaacgatattttggcgattgtggaataatttaaattaaggaaaaaagaaaatggcagcaaaagacgtaaaatttggtaacgatgcacgcgtaaaaatgcttaaaggcgtgaatgtattagcggatgcagtaaaagtaacccttggcccgaaaggtcgtaatgtaattttagataaatcatttggcgcaccaactatcactaaagatggtgtgtctgttgctcgtgaaatcgaattagaagataaattcgaaaacatgggggcacaaatggtgaaagaagtggcatctaaagcaaatgatgctgcaggtgacggtacaactactgcaactgtacttgcgcaagctatcgtaaatgaaggcttgaaagcagtagctgcaggtatgaatccaatggatttaaaacgtggtattgataaagcagtaagtgcggttgtttctgaacttaaaaatttatctaaaccttgtgaaacagcaaaagaaattgaacaagtaggtaccatttctgcaaactctgacagcattgtgggtcaattaatctcacaagcgatggaaaaagtgggcaaggaaggggtaattactgttgaagatggtacgggtcttgaagatgaattagatgtggttgaaggcatgcaattcgaccgtggttacctttctccatatttcatcaacaaaccagaaactgcaacggttgaattagataatccatatcttcttcttgtagataaaaaaatctctaacattcgtgaattacttcctgtgttagaaggtgtagcgaaagcaggtaaaccgttattaatcatcgctgaagatgtggaaggcgaagcacttgcaaccttagtagtaaacactatgcgcggtatcgtgaaagttgcagcagtgaaagcaccaggttttggtgatcgtcgtaaagcgatgttacaagatattgcaattttaacagcgggtactgtgatttctgaagaaattggtatggagcttgaaaaagcaacattggaagatttaggtcaagcaaaacgcgttgttatcaataaagataacacaaccattattgatggtatcggcgatgaagcacaaatcaaaggtcgtgtggctcaaattcgtcagcaaatcgaagaatcaacttctgactacgacaaagaaaaactccaagaacgcgttgctaaattagctggcggcgtggctgtaatcaaagtgggcgcagcaactgaagttgaaatgaaagagaaaaaagaccgtgtagatgacgcattacatgcaactcgtgctgcggttgaagaaggtatcgttgccggtggtggcgttgcattagttcgcgcagcagcgaaagttgcagcaagcctaaaaggtgacaacgaagaacaaaatgtgggtatcaaacttgcattacgtgcgatggaagcacctttacgtcaaatcgtcactaactcaggcgaagaagcatctgttgtggcaagtgcggttaaaaatggagaaggaaactttggttataacgcaggtacagaacaatacggcgatatgatcgaaatgggtatcttagatccaactaaagtcactcgttctgcattgcaattcgcagcttctgtagcaggcttaatgattaccactgaatgtatggtaactgatcttccaaaagatgataaagccgatttaggtgctgctggaatgggcggtatgggtggaatgatgtaattcgcttatacgagtaaaaaatctatcccaacagaaaatttgagctctatatgacttagggctcaaatctactaaaataagggatattttttattaccctattctaaatttatatatgataaaaataaaaaaacccagttttaaactgggttttattttatctattggataaattattctgcaacaacgattacatctaatgttgcaaatacttcaccgtgaagttggaaacgaacatcgtggtcaccaagagtacggattggaccgtttggtaaacgaacttcacttttcgcaattttaacgcctgctgcagttactgcttctgccacatcacgagtggtgattgcgccgaataaacgaccttcatcacctgctttagatgcgatagtcacagaacctaatgcagtaacttctgctgcacgagcttgagccgctgcaagatttgctgccgctgtcgcttctaattctgcacgacgtgcttcaaagtgttcaatgttagctttagttgccataactgctttaccttgtgggattaagaagttacgtgcaaaacctgatttaacatttacttgatcgcccacttgacctaagtgagcaattttatctaaaagaattacttgcattaccgtgtctccttaattactgatgattgtcagtgtatggaagtaacgctaaatagcgagcgcgtttgattgcacgagctaattgacgttggtacttcgcacgagtaccggtaatacggctaggtacaattttgccgctttctgaaatatagttctttaatgtagcgatatctttgtaatcgatttcaacaacattttccgctgtgaaacggcagaacttacgacgacggaaataacgtgccatttggctagtctcctaatctataaattcgatttgctcggcatgtaaaactaattggcataacccactttgggttttatgtgaggtaataaatcccaccaccaaaattttactaccgaccgtaatgctttgagttttttctatcaattgattaccactaatttgaactggcatttttaaccaagcttgacgtgtaaaaccactctcaatctgatcagaacgatgttctaacaaaaacttgcaatgctcaattccactagggctttttaatcgctttggtaactgagaaacgactcccataaccgaaaaacgattatcaattttcaaattactcttcagcatcctcaaaatcgttgttttcaacttcagctaaaggtttacgttcttctttagccgctttcattggggacgcttctgttacggcgtgcttagtatggataacaagactgcgtaatacagcatcgttataacggaaagtcgtttctagctcgtcgatgacttgttgaggcgcttctacattcataagcacatagtgtgctttgtgtaatttattaattgggtacgctaattgacgacgaccccaatcttctaggcgatgaacttgaccaccagcttcttttacagaaccggtgtaacgttcgatcatacctggtacttgctcgctttggtccggatgaaccataaacacgatttcgtagtgacgcattactgctccttacgggttaatcagcctttgacgtagatcagccaccaatctgcaaaggcaaggaacgaaaaattcaatgtggctaagggttgcggattataccgatttttttacgttccgcaaccagtttgagttctttttgagcaaaaaagaagaccgatatatatcggtctatctcacatattctgcaattaacggctgcggaaaataatacgtcctttacttaaatcataaggcgtcatttctacggtcactttatccccagtcaaaatacgaatatagtttttacgcattttcccggaaatatgtgcagtaaccacgtgaccgttttccaactccacgcggaacatagtattcggtaaagtctctaaaattgtgccttgcatctcaatgcaatcttctttcgccattgtatcctctaaaaataatcgattttttatccgcactttaggcggaaaagttaagaaaaacgggcggattatagccgtttttagctttctgcgaaagaaaaaataatattgttcataaaaaactcaattcgacataactgaaaaatgatttacaaaatcaaaacaccccctataatcaacataaataaccccattactaggtagatacaaatgaataaaacattactaagtaataataatcacccaaatatttcattaacctgtcaaaaatttcaatacggtggaggtatggaacgatatcttattgatattgttaatggattatctcaggctaacattacacctaaaatttactctgccaagtttgatactgcattacctgaatataatctaattatatccaattaagattaatctttcttttgttcctaaaaaatggagaacctcgtttctttcctatttttcaaataaatataaagaaacatcagaaatctctctgacaacctcttacaccctatctgacgtggtcatttgtggtggaaatcataaaggatatttacaagcatcaaagaaaaagcccagcatatcagatcgatttaaaatcatgggtgaacaaaaatccttaaatcagtccaaatatgtcatcgctcattctgcattaatgaaaaaagaactcgttgagttatatcatgtctctgaaaacaaaattgatgtgatttatccccctattaatacagataaattcacacaaatcaatgaagaagaaagagtaaagctcagagaaaagttaggtttcaaaaaagatgaaatcatttacctattcccttctactggccatacgcgaaaaggtttcgatattttgaaaaaatattttgaaaaaactcagttacctattcgcttagtggtcgcaggaacgcctgtagaagaaaatcctaaaatttcttcacttggtttttgcaaaaatatgcctgaattatatcaagcggcagatttcactattatggcatctcaatatgaaccatttgggcttgttggactagaatctatattatctggtacgccagttattttttctgaaaacatgggatgcctagaagtattaaaaaacgaatttggctatacattttctagagaaaacataagtactttagatgaggcaattcaaaaatcagtaaaacaagcatctgaacagctacaccgtattctcaatccaatggattgtattcgttataatccaagtttgagtcatcatattaaagctatactggaactcatcgctaaatgatattacccatgacagttacactaaaatttacaaaagaaatacaggctctataataaccgcacttttcttattaaatagtacttatgaattcaaaaaaacacttaggccatacggcgcgtaaacgctttggtcaaaactttttacatgatacttctgtaattcaaggtatcgtggcggcgatttacccacaacccaatcaattcttagtggaaattggtccgggacttggcgcattaacagagcctgttggtgaacttgtcgatcatctgactgtggtagagcttgaccgagaccttgcggaacgtttacgtcaccatccatttttacatcaaaagctcaccgttattgaaacagatgcgatgcaatttgattttgatgagctttatacaacagagaatttagcagaaaaagggcaaaaattacgtgtatttggtaacttgccttataacatttctacgccattaatgttccacttatttaagtatcatgatgtgattcaagatatgcacttcatgctgcaaaaagaagtggttaaacgcttatgcgcagggccaaatagcaaagcttatggtcgcttaaccattatggcgcaatatttctgccaagtgatgcctgtacttgaagtacctccttctgcattcaaaccagcaccgaaagtggattcagccgttgtgcgtttaattccgcataaagaattgccgcaccctgtaaaagatttatattggttgaaccgtgtttgctcccaagcgttcaatcaacgccgcaaaacattgcgtaatgcactttcaacactattttcacctgaaaatctgaccgcacttggtattgatttaaatgcacgtgcagaaaatttggctatcgcagattatgcgcgcttagcgaactggctggcagataatccaccagcagatgttaataacgatgaaatattagattcagaagagtaaaaataataaaaggtgtaatccttgttacaccttggctttctacataaaacggacaatttctttaccttgcatttctttaatacgttgttgttctttccatttttttctatttaaagctcgtataatattttcttttatccgagttaaacgctgtttcaatgtctttttcttacggatttttggacgtttttctcgttctttttccaatccacttgttaatacacttttactttgattcgcttggagttcttgaatacaaattgctggattaagttgatagacaatataattatcaacatcaactaatttattaaaaataagttcatcaactgcaacaatttcatcagaaggaatattctttaaatattcaattacatatttagccgcaccttgagaaataatataaccagccgtcccccagtgagtcgattttaaaatatcaaagttcctagaataaaaaggtggaattttagtttgtttctcaagtttaactggctgtaaaaaagtttctaaacgaataataaaaatatcattaaaatcaaaacgtgtttttaaccattcatcttgtgccaaaaacacttccgcattctcgccaagaattacatcatcttcaaaaattgtgagatattccaaattttcattcacacacttattccataataagaaatggctaattaaacagcctttttctcctttagtaagtattctagattcctctatattatgtaatatggagattgattgattgattgattgattgattgattgattgattgattgattgattgattgataagtgtacgcattaaagaaactaaatgaaagtttttttgattcaaattgcttagtaatatgtttgcgacgttcagttgcattttccatactaatgacaatattttcaatagcactcatatttaaataaaaatggaaataactaaattttttgcattctactatacgaaaagaataaatcaacaataaaagtctgtgttaaaattctcaaaatttatttataaaagaacggtcaaaaatggcaacctatttcgttggtgatttacaaggctgttatgatgaattacagcttttattagaacgtgtgaacttcaatccaacgcaagataaactttatcttgtgggagatcttgtggctcgtggggataaatcacttgaatgccttcgtttcgtaaaatcacttggcgattcggcacaaaccgtgctaggcaatcatgatttacacttaattgcgactgcactgggtattaaaaaagtaaaaccgcgtgatcgtgttgatgctatttttaatgcgcccgattttgatgaactgattcattggttacgccatcagccattacttgtacataataaaaagttaaacttcctgatggtgcatgcaggtatttcgcctgattggaatttggaaactgcgaaatcttgtgcggctgaagtggaacagattttacaaaatggggattttcattatctcattgaaaatatgtattccgaacaacctgatcgctggtcgcctgatttacagggcttagcgcgtcatcgttacattattaatgcttttactcgaatgcgtttttgctatttagatcatcgcttggattttgcctgtaaatcccctttaaaatatgcacctacagagctcacgccttggtttaatttaggtaatccactttataaacaaattcccattgtctttggacattgggcaagtttagtggatgagcctaccccaaaaggtgtttatgccctagatactggttgtgtgtggaataatcgaatgactatgttacgctgggaagacaagcagatcttcacacaaagtgcggtcaaaaattacagtgatttttaaggaaacgctatgctctcgctcactgctgaatcttgtgaactgttcaatattcctttctatcaattcgcccaaatgaaaaaattctgcccagaagatattccagcgattaaagcggattacaaattacattgggataattggaaagcgataattcaatctgtttcagcacaactcggtacgccttttgcgaaaccgcatattgaaagctggaccaatggttggcaggtacgggcgcatttcttcgcttattttaaatacgagtttaaccaaaattctgccgcaatcttttctgtgctattaaatcgtcgccgactaagagtgtgtttagattggcattgctatcgtgcagatcgctcacaaattaatgtgcaacaatataatcagtggcttgatcaatttgatttcaaacaatttgctgattttgagatttggcgagaggatgaaagtgaatatgatgattttcgccaagtgaaggtcatttctgaaaaaaatctgatcttacgttcagatgaggatttttggtgcattgggaaaagtattgaaaaagccgagttaaatcaaatagatcccattttatttattacacacaccattcaacaattacaaccgctttacgatcgctgccatcaataaagtatacccttagtataaataattgagctctacattatgtagagcccaatatttcagcaaattaataaactatccaaatttatggcaacagtttaaagtgcggtaattcttattgatgtttttaactacacatcataagtagttgatgctgtattaccgccacgaccagtccagttggtgtggaaaaactcgccacgaggtttatctgtgcgttcataagtatgagcaccgaagtagtcgcgttgtgcttgcaataagtttgctggtaaacgtgctgaagtatagccatctaagaaagtaatcgcagacgccatacaaggcattgggatacccacttcgatagattttgccaccactttacgccagtcacttaatgcgttttctaaaatgcctttgaagtagctatctgaacctaagaaaacaagatttggatttgcttcataagcatcgcgaatattacctaagaaacggctacgaatgatacaaccttcacgccataacaacgcagttgcaccatagttaatatcccaaccaaattgttcagaggcttcacgaatcagcataaagccttgtgcgtaagaaataatttttgacgctaataatgctttacgtaccgcttcaatccatacttttttgtcgccttcaactggtgtaatagttttgccgaataattgattagccgcaacacgttgatctttaaaggaagacacgcagcgtgcaaaaacggattcagtgattaaagttaatggaataccaaaatctaacgcattgatacctgtccatttacctgtccctttttgacccgcagtatccaagattttttcgactaaaggttctccacttgcatctttatagccaagaatgtcagtggtgatatcgattaaatagctatcaagttcagtatttttccattctgcgaagatggcttgcatttcgtcatagctcaagcctaaaccttcttttaagaattggtaagcttcacagattaattgcatatcgccatattcgataccgttgtgaaccattttcacaaagtggccagcgccttcaccgccaacccagtcacagcaaggttcgccttgttctgttttagctgagattgcttggaaaattggtttcacatattgccatgcttcttgattaccacctggcatgatagatggtccatgacgtgcaccttcttcaccgccagaaactcccgaaccgataaagcgaatgcctttttcagccaatgcttttacacgacgatttgtatccggatagtttgagttaccaccatcaataatgatgtcgccttcttctaagtgcggtagtaacgcatcaatgaattgatccaccacatcacccgcgcgcaccattaacatcactttacgtggtttttctaatttagaagctaaatcttctaaagagtatgcgccaataatattcgtgccttttgctgcaccttgtaaaaattcatccacttttgaagtggtacggttatatgccaccactttaaagccatgatcattcatatttaaaatgaggttttgccccattacggctaagccgataacaccgatgtcgccttttactgacattgttttctcctgttggattactaaatctttgtttatgatgagggctaatataattagcccctacatgtttgtctatgatgtagataaattgtaggagggtattacattcgcccttttaatctacatataattgatcttgttcccataaaataggattattttgaatatattcataaatctgcaaataggatttttcatcacgaataatatgttcataataatttcgctgccaaacatcaaaaatttcactattttttcttgcccaagatgttacacctgctttaaatccacgaactattgagccaattgtttgagatgttcccttttgtggcaactgcgttactctcgattgtaggggcaaattacatttgccctttacctgttcaataatttcaataataccgtgtaaatgatttggcataatcacaaattcatcaattcgtacttgtggaaagaacattggaatattttcccaacactgttttacgtaattccctaaatcatttaattgcatttgttgattaatgatatgcccaaatagacattctttatttttacaacaaatggtgatgaaataaaatccttcagaacgataattataatgttttaaacgaatcgagcttcgatgatgaatacctgcattatatttcgtagtcatacattccgctgtaattgtttttatagggcaaatgtaatttgcccctacaagcgatcaattttgccaacactgcaggcaactcctactttaccaatatccccttattcttcgtcgtaaccgccccaaaaactgcggcgataatcacacaacctaaaaagaaataaatcaccgaaatttggttgatggcataaccaaaaataatccctgctgccaaaagccgttgtataaccctcgattgacgaacaccacttttgctttcaatggtgaacatttctaaatagagaatgtagaaatgttcaagggtgacaagtgcaagttaaaatatgagctaaaatttccattagagcagccttgccgcggctttatccaaataccactccgtcaccccattttttgctttgatttttgcagcgggataaggcaagttttctgctggggtagttttaatttcttttaaaatatctgctttgctttcacccgttaccaaataggtaatgcgtttggcttgttcaatgagtttagctgttttagaaatgcgaatttgaccgctttcagggtgttttgcaatgacagctaggttttcatcatcaaaattggtttgatgtgggaagagagaagcggtatgaccatctgttcccatacctaaaataatccaatcaaaaataccgtttggaatgaccgcacttaattcttcttcaaagcgttttaactcaaagtgcggttcattttcgccacaaattcgatggatattttctgctggaatttgaatatgatcgaataaaagtttttgtacttcgccatagttactttcaggatcagatggcggaaccatacgatcatctccccaccaaaaatgcagatttttccagttaatttgttcagcataaggcaatttggctaaggttttaaatagcaacttaggtgttgatccaccagaaagagaaatatgtacaggacgatttaactgactgtaaatcacaaattcttgcgcgattttttcgactgcgtgttgagcagttgggaaagtgatggtattcattgctgttccgtttatgatgtcgtaagtaaatatacccacggctaattacgtgatagtagttccattttgggaaacggtaattctaccccaaaggggtagtactcttgctagcctagggtaaacctaccctaggtcatcatcgttacacttttttcttcatcaatccacttggtttacgccaaaccttgccttgttttgcgattaatttatcggctgccacaggcccccaagtgccggcttcatattcgtgaatacgaccaccattcgctttgtaatctaaaatcggctgaacaaatttccatgcagcgtgaacagcatcagtacgcgcaaacaaggttgcatcgcctttcatcgcatccaacaataaacgttcataagcggttaatacttgcgtgcctgctaaatctgcataacggaaatccattgatacttctttcgcctcaaaacctgcacctggttttttcaaaccaaaacgcattgaaatagcttcatcaggttgaatacgaataatcaatttattctctggtgcattttggctgaatacaggatgtggcgtagttttaaaatggatcacaatttcagtcacacgagctggtaagcgtttacccgtacgaacatagaacggcacgccagcccaacgccagttttcaatttcacaacgcaatgagatgtaggtttcagtacgagaatctgcaggcacacctttttcttctagatagcctttttccattttgccgttaatttcagccgcagtgtattgacccaaaacaaggttattctccatatcctccgaagttaatggacgcaaactatgcatcacttttgccacttcatcacgcattgaattcgcgttaataatcgctggcggctccattgcaaccatagcaaggacttgtaataaatggttttggaacatatctcgcattgcgccagaaccatcataatagcccccgcgctcttccacgccaatagattctgcaccagtaatttctacataatcaatgaaattacggttccaaagcggttcaaaccaaccatttgaaaaacgtaatacgagcaagttttgaacggtttctttacctaaataatggtcgatacgataaatttggtgttcttcaaagaaacggtggatttgtacgtctaatgcttgcgctgttttttcatcgtaaccaaaaggtttttcaacgataatacgtttccagccatattcttccgtatttaaaccatgtgcagccaaacactcaggaatcacgccataaagacttggcggagtggacatatagtaaagggtgttaccacaggtttgatatttatcgtgaagttcgtctaaacgtggaacaagtttgccgtaatcttgagcatccgaagtattcactgcttggtaataaagatgagagcagaaagcatctaaagtgtcaggtgttgtttcttcattatgaattaacgcctcacgcatttttttgcggaaagtttcatcgttcaagtcagaacgtgcaacaccaagaacggaaaagttttcactcaaacgcccgattttgtagagattataaagggctggaatgagtttacgatgagttaagtcaccagacgcgccaaaaatgacgatacaattattatcagtttgcataattattccttattcggcttccgagtaatgtcgaaaataatgccgtattctagagaaaaaaaccaatcgaaccaatcaattaaattgaaagacagaacgccaatcgaacgattgatcgcccaccataacaaaatgcggattaatcaatgtttcgcgttggttataggttaaaggctcaaaatgagagtcaaaaatggcaccgtgagtttcattcagcaacacttctgcgccagcggtatcccattcgcctgtttgtcctaaacgaacataacaatctactgcaccttcagccaccaaaccgctttttaagctacttgaaccaaccacaacaaattcacaagtaaaatccttcggcaaaatcgaccgcactttttcttgtgaagtggttgcacctaccgcaattcgtaaagggcggtcaaaattcgtcgtgtttttagtgagtttttttacctgatccagttgttttttaaacgctccgaaatcacgcattgcataataagttattgataaaattggcgcatgaataatgcttaacacgggtttatttttacgaactaaggttatcaacacagaaaattgatcggtacgattaataaattgttgtgtgccatcaagaggatcaatcaaccaatattctttccaatttttacgttcttcaaaggaaatatggcaattttcttccgaaagaacagggacattagggaaaagtgcggtcaatttttcggttaaaaattggctcacaaaaagatccgcttccgtcacaggcgtgttgtcttctttcaattcaacatgaacctgtttttgataaaactgttgcaaatgcttacccgcttggtaagcaatcagcaatacttggttaagtaaatgttcgtttagcgtcagcataaaattattctcttgtttttggcagcaaccaaggcattacaaatagagcataaaaaaccattccgcatgtgcttattaacccgagggacaatcccccttcggtcaaccagccccaaaaggaagtgtcttgttcgccgagtaataacaaataaaaataagatgccatattgcaataaacaaatgaaatgatcgatgaaactaatacaatcgaagcaatgttataacgtgtgtaacggaattttgcggctaaaagtgcggttaaaaatgcgggaattgtggcgagaagaaatgctgtgagagcatagctagaaaaaggaacgataacgccacttgagtcatcatcgaaccaaatcaaaagtgcggtgacgactatctgtaaaatcagaggaaaaaaaataagtgtttttaagtaagatttcatagtgaaaaataggttatccagaagataacctattctaaaataaatttaaggattaatcagatttttttcgcacgtaatacgcgagatgcaaaaatcacaatgcccacgataaatacgattaaaccgaaccactcgccaattgtatcccagttttcaagatttaaggataatggcgcttcagaaccaccagtggtaacagaagccgcaataatgaatgctaaaatgacacccattaaactttcgcctacaattaaacctgcagagaaaagcgtaccgaaacgttctgctttagctgacacttctttgttaccaagttttgcaatatggcgagccataatccacgctaggaatgcaccaacaatcacaggcgtattaattgatggtggtaagtaaataccaatccccacagcaataactggcaagctaaagactttgttgctgacttttttcaaaaatgcatcaatcgtaattaacacagcacctaaacccacaccagttaagatgtaagtccattccaatttatttgtgaaaataccttgagaaatggcggtcattaacgttgcttgtggtgcagataaggcttgtgaaggatccatatctggacgtggcaatgcaccactgaaaccatacgcgtgatataagatttctaatactggcgcaataacaagtgcaccgacaaagcagccgataattaatgcaacttgttgtcgccaaggtgttgcttcaactaataaacccgtttttaaatcttgtagattatcattagaaatacaagctgtagtgattacgatagatgccgtaaacaatgtaagtgcggttaaaaatttctgaccatctacagtttcaaataagcccgaggcattaccgattgacaccaatactaatgaaatcacgataacagaaataattccgataccagaaattgggcttgaagatgaacccactaaacctgccatataaccagaagcagctgccacaaagaagccgataaataccgctaagaaagtacaaactaccactaataaaatggaaagctcaggcgaaattggtgccgccgcaataaagtgatgtaatgaaataacaattaacgcaaccgtcgcaattaagatataaatcattgtttttggagaaaggtcaatatcaatacgatgttctgatgcctcttgcccacctttcagcatacggaaagaatgaaccatcccttcaatcattggtttcattaaaatcagcaatgtccaaatcgcagcaataccaattgtacccacaccaatataacgcactttggttttccaaacagtcatcgcagaatcaattaaacttgcatccgcggcaatatcttctgacattgtgaaatatggcactgccacaccccaagtcaaaataacaccgattaacatcgcaataccgccgacaataccaattaaataaccagcaccgagtaaggcaagtgaaaagcccattggtaattggaacgccgcttttcctgtttgaatccaagcactaccatcagccatcacgcgtaaaccgttagttaaaaatgccactaatcccgctaaaacaccaccgtaagcaatatctttcacaccgctgtcgccatctgcatgattacctgctttcaaaatttctgcagcagctaccccttcaggataaggtaaattactatttaccaccattgcacggcgtaatggaatagtgaataacacgcccaatgtaccaccagctgcacaaatcaacatcgtttgccagaatggaaaatcttgccagtagcccatcattaataaaccaggcaagacgaagatcacagaagaaagcgtacctgctgaagatgcttgagtttgcaccatattattttcaagaatgctagaatctttgaaaaatttgagtactgccatagaaatgacggccgctggaatagatgacgcaaatgtcacccccacttttagaccgagatacacattggatgcagtgaaaattaccgtaatcaatgcaccgagaataattcctcgaacggtcaattcttttaagttttcgttatgcataaattgttccttgagcttaaaaaaagaaaaccactcaaccttgtcaaaaatttgactatttttcaagtttttttaacataaaatttgttttattgaaaaatgtttaaattaacctgtttttattttttttcatttaataaaaatcctattaaagaataaaatttttaataacagttcattagcatactttgtggtactattttgtcgaatcaaaataaggagaaaataatggcagaaaaagaagtcagattagataaatggttgtgggctgcccgattttacaaaacacggagcattgctaaagcgatgattgaaagtggtaaagtgcattacaacaatcaacgtgcgaaagtaagtaaaattgtggaagtgggcgcaatgttaaaacttcgccagggaaacgaagaaaaagaaataaaaattatcgccttaagcgatcaacgccgaggtgcgccagaagcacaattactctatcaagaaaccgaaagtagcgtgaaaaaaagagaagaaatcgcgtgggcaagaaaaaataattccctttcaatgccccatcctgatcgtcgcccaaataaaaaagagcggagagatttattgaaatttaaacaccaagataaatttgaataaaaatttcaccgcactttctatgttcttaaggtttaatatctcgcaaaattggattttgcattgaaatcaaggtttcagtggattgaatttcatcaattaactgaatcttggtcgccaaaacggaatgtaattctgcaattgtgtgtgtcatcacctttaagaaaatcgagtaattgcccgttgtataataggcctcgactacttcatcaaaactttctagctttttgatcactttttcataatcttttgcgctttttagaataatgccgataaaacaacatacatcatagcctaatttacgttcatcaataattacttttgtgcctttaataatgcccgattgacgcattttttcgacccgaacgtgaatcgttcctggactaacaccaaaatttttagccatttctgcgtatggtgttctcgcatctttagtgagtacacgtaatattttttgatctaaactatcaatgttgtgcataaaacttcctcctttagattttatttaattttttcacaatgaattagatgatatttaaccaagaaaagaaagtaaataaaatacttgaaataaaatcattatttactgaataatactcaaaaatattactcctcgttaaaaaaggttatcaaaatgaaaaagacatttattttacaacaacaagaaatcagctttgtgaagaacacttttacccaaaatcttattgagcaacttggcattattgaagtgcaaggcccaattttgagccaagtgggtaacggaatgcaagataacttatcaggcattgaaaaagccgtacaggttaatgtgaaatgtattccaaatgccatatttgaagttgtgcattctcttgcgaaatggaaacgccatacattagctcgtttcaactttaaagaagacgaaggcttgtttgttcatatgaaagcattgcgtcccgatgaagattctcttgatccaacgcactctgtttatgtagatcaatgggactgggaaaaagtgattcctgaaggtcgtcgtaattttgcatacttaaaagaaacggtaaattctatttatcgtgctattcgtttaacagaattagccgtagaagcacgttttgatattccttccattcttccaaaacagattacctttgtgcatagcgaagatttagtaaaacgctatccagatttaagcagtaaagagcgtgaaaacgcaatttgtaaagaatacggtgcagtattcttaatcgggattggcggcaaactttcagatggcaaacctcatgatggtcgtgcacctgactatgatgactggacaacagaatctgaaaatggctacaaaggcttaaatggcgacattttggtatggaacgaccaattaggcaaagcctttgaactatcctcaatgggtatccgcgtagatgaaagtgcattacgtttacaagttggcttaacaggcgatgaagaccgtttaaaaatggattggcaccaagatttattaaacgggaaattgccattaactatcggcggtggtatcggtcaatctcgcttagcgatgcttttacttcgtaaaaaacatatcggtgaagtgcaatcaagcgtatggccaaaagaaatgttagaagaattttcaaacattctttaaaatcaattaagtagataacaaaagtgcggtaaaaattgatctgaccccaaaaagttagactgttatttaaaggattgttttcgatattgtatcggactcagcccttttaattttagttgaatccgtcggtggttatagtaatccaaataatccctgacggcatcaactatctcttctctgctgttaaattccctaccataaaaacattctgtttttaatcgcccaaagaaactttccatcgcggcattgtccaagcaattcccttttctcgacatactttgagaaatcctatttttcgctaataagcgttgatagctaagcatttgataatggattccttggtctgaatgtaatatcaaattcgcatttctctgtaattttttcaccgcttgtaacaacatttcttgcactaacatgccatttgggcgacgacttaatctataaggataatgcactctcaaactttggactgtttctgccgtttagcttcgtccctcttgattatttcgtccaacttttttagaaaagcaacctctgcttctcactcaaggatgcgtaggcgtaaacgttcttctgttttgggtggtggagacattttagcgtatttgggtttcatacttgggcgacctttaggtttgggatggcacccatttataccgtttttccgaaaggctttcaaccattgactaaggggttccactactcgcaataccaaagtaaagtgccgcattttccatcgaaaatctgccaaagagaatggtttaaacacccactaaaattccaatgaaaagacgcataaattacctattatttctgaaaacttgagatggtttaccgtgaaatacagcaaaatgcgatgaaaaagtgcagttgaaagataacatataagagattcgtaagtcgtacggagaatttgtatagagtaatttgtacggatgattaaaaattaattcctttatttattttatcgtacaaagagttctgtttttgttatagtatcggtaatttaaatctaaggaatattatttatgaaaacatctatttatcaattaaagtggggaacctttaatcttattgaaggggattttattagccaatatgctgcactttatggcgaatggtcagatgtagaagtccaattttttttggaaaacctaaattcttcaagtaatgtcattgaagttggttcgaatattggaatgcacgcagttcctattgcaaagacaataagtggggggggggggaaattattttgttttgaacctcaaagagtaatttttcagacactttgtgcgaatttgtcgcttaatcaattaacaaatgttcatgcctataatttgggggttggtgaaaatgaacagttgattgagattccctcatcaaattatgatactgcttggaattatggaagtttttcattagataaagggtttagtaccgagggtaattttataggtgtagaatctaaggaattgatacatgttatttctttagataaacacccagaagttaatcgattggaagatatagatctattaaaaattgatgctgaaggatttgagctaaatgttttaaatggtgcaaagaatctcatagagagacataagcctataatttttgtagaagctcatattcatcactctaatgagttgatatcctatttagataagattggttataagtgttattggtttatttctgaacgttatcaaaaaaataactactttaagcaggagaaatctcttggtggaatggactttaatttagcttgtttccataagagtaaacaatcaacattaccagaggaactacggacaacaccaaataatttattaactgaaataccaatagtaagtaacagatttgatctgcccccaaaaagttagactgttatttaaaggattgttttcgatattgtatcggactcagtccttttaattttagttgaatccgtcggtgattatagtaacccaaataatccctgacggcatcaactatctcctctctactgttaaattcccaaccataaaaacattccgtttttaatcgcccaaagaaactttccatcgctgcattgtccaagcaattcccttttctcgacatactttgaatgatgccatgttcagccaagattcgacgatatgattcacacctggcaaataggcatgaacacgtcggtagccataatcaggatgattggctttgatgcgtttaatggcctttttcagcggctcatccttatctcgtttaatctgaagtttagcaaaaaacgtactacgcgctaaccgtgcaaagcctaaaagccattttaacggatagcgtgttcttaacctttggataatttctgttgctcggcttcttcctgaagtctgagccttctcaactcctttaggtaggctacctccgcttcaagctgtaaaattctcaaacgtaaacggtcttcttcagttttgggtggcggtggcattctggcatatttgggtttcattggcggtcgtcctgatggtttacggggaatcagtccatttatgccacttttttcaaaccgtttcaaccatgtcccgactaaggcgttggaaggaatattgtaaaaacgagccgcttctctaatactcatttttccattcaaaataggttggagagcctgtaatttaaattcgattgtgtagtgtttacccataaaaaatctgcccctcaattgttggtttggttagtccaacttttggggtgcagatcaattttcaccgcacttttttgttagataagaaacttaaagaatcgttaatagctgggcaaaatcatcaaacacccaatctggattggattcagtgatagggatattgtaattgtagccgtaagttaaaccaacaactgcacagcccgcagcgtgagccgcgataatatcatttttagaatcgcccacgaaaagcacttggcgtggttcaaaaccaaattttccgcataaataataaagtggagctggatgtggcttaatggcaggtaaggattgaccgcccaacatttcactaaataaatgatcaatgccaaatgctgccaacacaggttgaacatgtcttgtgggtttattggtaacaactgctaggacatagcctttttctttcaaggtttctaaagtttcttttacatttggatacaagcggctgacattacataaattctcgccataataaaaattaaaacgttctgttacttgcttaacctctgtttcagttagcacttttcctgtttgttttttcgcccaatctaacgctcgagcaattaatacaggcgcgccattaccgatccaagttaaaactaattcttctggcgctttcggtaaattaaattcagccaaggcagaatttacggataacgctaaatcaggcaagctatttaccaaggtgccgtctaaatcaaagccaataagtttaaattgtgtgttcattgtttttctctgttctattacgatcgtattttattaaaataacagttatgcgctaacacttgctaactgtgtacgtatttggtcaataacttgtttataatctggcttaccaaaaattgcagaacctgccacgaacatatctgcacccgccgcggcaatttctgcgatgttatcaaccttcacgccaccatctacttcaagacgaatgtcataaccactttcatcaatgatcttacgagcctgttgtaatttcttcaatgttgctggaataaaagattgtccgccaaatccaggattcactgacattaataaaaccacatccactttatccaaaacataatctaaatagctcaacggcgtcgcaggattaaaaactaatccagatttacaaccacaatcgcgaataagctgcaaagagcggtcaatatgttcgctagattctgggtgaaaagtgatgtagttcgcacccgctttagcaaaatcgggaataatgcgatcgatcggttttaccattaaatgcacatctatcggtgcggtaatgccataatcacgtaaagcttgacatactgcaggcccaaaagtgagattaggtacataatgattatccataacatcaaaatgaataacatccgcgcctgcattaagtacgttttgtacgtcatcgccaagacgtgcaagatcggcagaaagaattgatggggcgataagataaggtttcataaaggttctccgttgagaaaatgagtgcatttagtttactcacttaagttcaaaaaaccaatagtaatccttatatgaaataacaagataaacaaagaaagggcactttggtgccctttcagtcatgaattgaatataaatagacgaaaatttacacgtctaaatttgctcttaacgcattcagctcaatgaactcacgacgtggctcaacttcatctcccattaaggtcgtgaagagttgatctgctgcaacagcatccttaatagaaactttcaacatacgacgtgaatttggatccattgtggtttcccaaagttgatctgcattcatttccccaagtcctttataacgttgtacttcaagacctttacgagattctttcactagccattcaacggcttgttcaaaactacgcactggttgtactttttcaccacgtgtgacataagcgccttcttctaataaaccattgagttgtttattaagagaaacaatttttgcgtattcattgccgtgaacaaaatcaaaattcaagaaataatcggtatcaataccgtgtttgcgaacagtaatcaccgcttcatacacttggcgttccgcattaaattgtgtacgcactgaatattgatgcgcttctgtttcttttgcagtcagttgttcaacaaaagatttaccccaattttcaaccgcactttcctctttcatcatttcaatagaaattggcgactgataaattaatccttgcaatacaggcactgggtaatgacggtttaaacgaccgataagtttttgtacgctgttatattctgccaccaatttttcaaatacaagggcattcattgctggtgcatttgcgctgatatgtaattctgcgccatctaaagcaagggttaattcatattgctccatttcatccgcatctttaatgtagcgttcttgttttccttttttcactttgtaaagtggcggctgagcaatgtaaacataaccacgctcaatcagctcaggcatttgacgatagaaaaacgttaaaagcaacgtacgaatgtgagaaccatccacatcagcatcagtcatgataataatatgatgatagcgtaatttatctgggttatattcatcacgaccaatgccgcagcctaaagcagtaattaatgtgcccacttcttgggaagacaacattttgtcgaaacgtgctttttctacgtttaagattttacctttcaatggcaaaattgcttgagttttacgatcacgaccaacttttgcagaaccaccagcggagtccccctccaccaagtaaagttcagaaagcgcaggatctttttcttggcagtctgcaagtttacccggtaaacctgcaatatctaatgcccctttacggcgcgtcatttcacgcgctttacgtgcggcttcgcgcgcacgagcagccataataatttgatttacaatgatttttgcatctgcaggattttctaataaatattcctgcattttttcattcatcgctgattccaccgcacttttaacttctgaagacacgagtttgtctttcgtttgcgatgagaattttggatcaggcactttaacggaaataatcgccaccaaaccttcacgcgcatcatcgcctgaagtcgccactttttcttttttcagcatgccttcgttttccatatagctatttaagctacgggttaaagccccacggaaaccagctaggtgagtaccgccatcacgttgaggaatgttattggtaaagcagtacacgttttcatttacaccatcattccattgcaatgcaacttctacgccaataccatctttctcagcggtaaaataaaatggctttggatgaattgggtttttatttttgttcaaatattctacgaatgcttgaataccgccttcgtaatggaaatgatcttcagatccatcacgtttatcgattaaacgaatagatacgccagaattcaagaaagaaagctcgcgtaagcgttttgctaagattttgtaatcaaaggttgtgatagcaaaaatatctgagcttggccagaaacgaaccgttgtccccgttgcctctgtttcgccaatcactgttaatggcgattgaggctcccctaaatgataaaactgctcgtgaacgtgaccttgacgacgaatggttaattgtaacttatcagaaagcgcattcaccactgatacgcccacgccgtgtaaaccgcccgatactttataagagttatcgtcaaatttaccgcctgcgtgaagcacagtcataatcacttctgctgcagaaacgccttcttcaggatgaatatccacaggaatcccgcgcccatcatcttgcaccgatacagaattatcatcgtgaattgtcacgataatatcggaacaatggccagcgagggcttcatcaatggcattatccaccacttcaaataccatatggtgcaaaccagtaccgtcatcggtatcgccgatatacataccaggacgtttacgcaccgcatcaaggccttttaatactttaatgctcgatgcaccatagttatcattggtcgtttctgacataatttatctcattcttttgtaaataaaaattgggcgagattatagcaaaaaatcgccgttttggcgatgcttttcgggaaaggaaagcgataaaaaaagggcgaataatttcgccctataacttgttattttttccaattttttagcgcatcagcaaaggcattgcccatcgcattattacctcttgaactacgcgcctctcgctgcgtatttccacgaggtcttgcggataaagtgcggtcagatttaccgtcatttttgaccgcactttcatctaatcgcatcgtcaatgcaatgcgtttacgcagcacatccacttctaacactttgacttttacaatgttgcctgtttttaccacttggaggggatcttccacgaatttatcgcttaatgatgaaatatgcactaaaccatcttgatgaacaccaatatccacaaatgcgccaaaattagttacattagtcactgttccttctaaaatcattccagattttaaatccgttatttcttccacgccctcagcaaatacagcggttttgaactcgccacgtggatcacgccctggtttttccaactctttgaaaatatcttggacggtcggtaaaccaaattgctcatcaatgaattgttttgcatcaagctgacgtaccacacccgcattacccattaaatcttgaatagattgcgcggtagcttgcaaaattttttcgaccacaggataagcctctgggtgaacacctgaagcatcaagtggatttttcccgcctgcaatacgcataaaacctgcacattgttcaaaggcttttggccctaaacgaggcacttttttcaattctctacggctttcaaaacgaccattttcatcacgatattccacaatgttttgcgctaaggttttagtcatcccagccacacgagcaagcaatggcgcggatgctgtattcaaatccacacctaccgcgtttacacaatcttccaccaccgcatcaagtttacgtgcaagttggctttggtttacatcgtgctgatattgccctacaccaatggctttgggttcgattttcactaattctgccaatggatcttgtaaacgacgcgcaattgataccgcaccacgtaaagatacatctaaattagggaattcatttgcggcaaattcagaagcagaataaacggatgcacctgcttcgctcactacaacggtttgaggtttattttctttaatttctttaatcacttctttcgcaaagcgttcggtttcacgagaagccgtaccattaccaatggcaattaattctacgttatgtttgcggattaagctgaaaatcgccacttgcgcttcagcttcacgccccgtgtgtggataaatggtggtggtatctaataatttacctgtgttatccaccaccgcaactttaacccctgtacgcaagcctgggtccaagcccatagtgctttttgcgccagcgggggcagccattaaaagtgcggtcagatttcgagcgaaaacatcaatggcctcttcttccgctttttcacgtaaactcgccattaattctgtttctaaatgcaacgaaactttgattttccatgtccacgcaatcacttgctcacgccatttatccgcaggctggctagtgaaacgtacatctaaataatcacgaataatctcttcacaataactttggcgacttccctcttctgcatcaggatccgcatttaagctaagttgtaaaatgccttcattacgcccacggaacatggctaatgcacggtgagaaggcacatttttcaataattcttgatgatcgaaataatcttggaattttgccccttccgtttctttgccttcgatcactttggatacgataacggcatttttcgctaaataatcacgaactttcgctaataaacctgcatcttcagcaaaacgttccattaaaatatagcgtgcaccatcaagggctactttggtgtctgtcacgcctttatcagcatccacaaaggaaagtgcggttgattctggatcattttttggctcattccaaagtaaattagccaatggctcaagaccagcttcaatggcaatttgccctttggtgcgacgtttaggtttgtacggcaaatataaatcttctaattcggttttgctttgtgtcgcatgaattttgtcacgcaattcatcggtcaattttccttgctcttcaatagatttcaagatggtttgacgacgttcttctaattcacgtaaataaattaaacgggtttcaaaatggcgaagctgggtgtcatctaagccccctgtggcttctttacgataacgggcgataaatggaatggtgttgccatcatctaataattgaatggcagcaagaatttgttggggttgaacggttaattctgccgcaataatttggctaatttgttgatttaacattgtcgtacttctttattataaaaaaacaaagatagaatactggttttagtgggctggctcaaatataattcaaaaaactttcttttatttttattatggcaaaatcaaattatattacccgtcaaggctggcttgtgcttgaccaagaactcaagtttttgtggaaagaagaacgcccaaaagtcactcaagccgtttcagatgcagctgcgctaggcgatcgtagcgaaaatgccgaatatatttatggtaaacgtcgtttacgtgaaattgatcgccgcgtgcgttttttaactaaaagattggaagtgctacaaattgtcgattacaacccaaagcaagagggaaaagttttcttcggtgcgtgggtggaattagaaaatgaagaaggtgaaattaagcaataccgtatcgtcggttgtgatgaatttgcccctgcgaaaaattggatatccattgattccccagttgctcgagctttaatcggaaaaacattagacgacgaagtgcgggtagaaacgccatcaggatttattaccctttatataaataaaatttggtatgaaaaataacttggaagaataaaagatagcaaatacctaagcacaaagagaaaactaataggctagatataaactatcttacttgcctctttccttattcgctgcaaaatcagcaccttttgcaagcattctcaactgcaaaatcacacgagctttaagttgctcacgctcagctttactcatatctaaagcattcgcccctgcagtgaatacgattgttacgatgccttccgcttgaacataagcaacatattgcgaatattgatgtttgtaggaaatatattctgctaactcatcaacaaaatgcttaatttcgcgtgctgccgcagtacgaaaagcttgagaagtgcctgaactttcgcgtaataacaagcgaaaaacgttcgtgctattagtaataaattcaaaaaatgtatccacagaaacagaaataacactaccgcccgcatcaatacgtttacgcgcttgacgcattaattggcgcaacatcaaacctgcttcatccaccatttctaagccaagttcatccatatcactaaaatggcgatagaaagaggtaggcgcaataccagcctcgcgcgccacttctcgtaaacttaaattagaaaaacttttttctgcgctaagttgattaaatgctgcatccactaaagcgcgacgagtcttttctttttgaacagcacgaacaccagccattatttcaacccatctagaatagatttaacttcatcgctgaccgcacttgccacacgctcataacgattacgtaatggcgaaccaggacgataaaccaacgcaatggtgcgtgatggctctggcgaataacaaggaatatatttcacacctttgcgcgtaccttcattcagtaccgctaattcaggcataaaagtgataccagcattcgctgccaccatattgcgcaaagtttcaagactagttgcttggaaatgggaattttcttttgcaccagcagtgaagcaataatctagcgcttgattacgcaaacaatgaccatcatcaagcattaacatttcttgaccatttaattggttcattggaagtttactttcttgagcccaaggatgatgctctgatacggcgagtaacattttctcgttgaaaataggtacttcaataaaagcctcagtttctggaacagtggcaacgatagcacaatctaaacgccccgtttccaattgttctaataattgatgcgtttgcgcttcataaagaaacacttctaaatcagggaatgccgcttttaacattggcacaatataagggagcaaataaggaccaaccgttggaattaaaccgatgtgtaatggcccggtcatttctttaccttgattactcgccatttctttcaataattttacttctcgaagaactgtacgagcctgatcaaccaataacatcccagattgagtaaacaacactttacggctagtacgttctaacaaaataataccaagctcatcttctaacttacgaatttgcccacttaatgttggttgactcacattacaagaatcggcagcacggcggaaatgtttatattcagataaggcaacaagatattctagatcacggatattcatgagattttccctatagaaaaattcaattaaaagaatagaattaattgattatgactatatcataattttccctataatacagcacgtaaaatttaaattaacaaccaataggagaaaaaacaatgtctagtatggaaggaaaaaaagtccctcaagtgacattccgcactcgtcagggtgataaatgggttgatgtaactacctcagagttatttgataacaaaacagtgatcgtgttctcattaccgggcgcattcactccaacttgctcatcatcacacttaccacgttacaacgaattagcgccagtattcaaaaaatacggtgtagacgatattcttgttgtatctgtaaatgatactttcgtaatgaacgcatggaaagaagatgaaaaatctgaaaacatcactttcattccagatggtaatggtgaatttaccgaaggcatgggtatgttagttggtaaagaagatttaggcttcggtaaacgttcatggcgttattctatgcttgtgaaaaacggcgtagttgaaaaaatgtttatcgaaccaaacgaaccaggcgatccgttcaaagtatccgatgctgacactatgttgaaataccttgcaccacaacaccaagtgcaagagtctatttcaatctttacaaaacctggctgtcctttctgtgcaaaagcaaaacaacttttacacgataaaggcttaagctttgaagaaatcatattaggtcacgatgcaacaatcgtgagcgtacgtgcagtttcaggtcgtgctactgttccacaagtgtttatcggtggtaaacacattggcggtagcgacgatttggaaaaatactttgcataagcaggcaagtatttagctgattattatttgagaatgtaatttaaagggcgcattaagcgcccttttcatttgtacgaatttattgcaaaaatcaataatggggcggtggcgtttcttcagattgacttgcaatgttagacggttgaaagtcttttaatttatttgccatataacgcaattggacttgcattttatcaatatcaaattgctgttgaactaaagcgtgatttaattcatctaataactgttcctgaaatgcaattttcatttcaagttcttcgatgcgattttctaacatttgttgaatttgcataaattttctctaaattctaaaaaaaagttgagaatagatagaaagccatttaatctattcctcgtattattccattcattataaaggattaacttatatgttaaaaattcaaaaattatctatcgcagcattaatggtaagtgcggtaatttctggtcaagtttttgcagaagataacacattcgatgaaaaagcggcatcttatgcagtaggtacgctcatgggcagtcaaatgaaagatcttgttgattcccacaaagaagttattaaatatgataatgcgcgtattttagatggcttaaaagatgctttagaaggcaaagtggatgttcgtaaagatgaaaaaatccaaaaaaccttagaatctattgaagcaaaattagtggctgcatcaaaagcaaaagcagaagcgattgctaaacaagcaaaagaagaaggcgataaattccgtgctgaatttgctaaagggaaagatgtaaaaacgacgcaatctggtttaatgtataaaattgaaagtgcaggtaaaggcgatacaatcaaatcaacggatacggttaaagtacattacacgggtaaattaccaaatggaaaagtatttgatagctctgtcgagcgcggacaacctgtagaattccaacttgatcaagtaattaaaggctggactgaaggtcttcaattagtgaaaaaaggcggaaaaattcaattagttattgcacctgaattaggctatggcgaacaaggtgctggcgcatctattccaccaaattcaacattaatttttgatgtggaagtattagacgtcaatccgaaatctgaaaaataacggataagtttaatagcgcgcgttctttaacgcgtgctttttattataaaaaacgagcggaatttttaccgcacttttaacctaacgctatgacattaaacgataaatatcctttcactgatgaagatcaagctatcataaattcctacaaagcagtcgttgatggtgtcagcgcactgattggcgagcactgcgaaatagtgcttcattctctggaaaatattgaacattctgctatttgtattgccaacggacataacactaatcgacaagttggttcgccaattactgatcttgccttacgttcgctacgaaatatgcaaagcgaaagtgtttcaaaaccttattttacacgagcaaaaggcagcgtactgatgaaatcagttactatcgctattcgtaataaaactcaacgtattattggtttgctttgcatcaatatcaatttagatgtacccatgtctcaatttttgcaatgctttatgccaacggagcatacgaatgaaacatcttcagtgaactttgcgaattcagtggaagacttggttgcgcagactattgaaaaaacaatagaagaagtcaatgcggatcgcgctgttgccaataatactaaaaaccgacaaatcgtcctttctctttacgaaaaaggtatttttgatattaaagatgcgattaatttagtcgctgaacgtttagatatttcccgacatacggtttacctgtacatccgtcaaatcaaacaagagcaagaataatgcgctatgttatcgccgtcaaaagccctatttacggaaagcaaggggcatttttagcttatcaatttgcaaatgccttaatcaaaaaaggacacgaaatctcacagatttttttcttccaagatggagtgagtaacggaaatgcattagtgtatccagccaatgatgaagttaatttacaaaaacattggcaaatgttttccatcacccacaatgttcctttacatttatgtgttgcagcatctcaacgacgaggtgttgttgataacttaactacaccaactacagctcactacaatcttgcagaaggatttataattgcaggtcttggagaatttatagcagcaagtttaaacgcagatcgagtaataaccctatgaagatagcctttttatttcgcacatctccacatggcacatccatttcacgagaaggcttagatgcaattcttgccgcgacagctttttgtgaacccaatgatattgggatattttttatcgatgatggcgtattaaatcttatcgataaccaacaacccgaaatcattcaacaaaaagatttcattagagcctttaaattattagatttatatgatgtagaacaacgctttatctgcacagcgtctttgcagaaatttaaattagataatagagaacttatcctatcttgtgaaaaaattgaccgctctttattgctagaaaagcttaatcaagcagaaaaattgtttactttctaaggaatattatgctttatacattttctcaatcagattatcccaaaactgaactagatgactatttttcatatattacagaaaaagatgcggtagtactatggcaagacggtgtgttattggcaataaaatatcctgattattttgccaaatgtaaagggaattgcatgatattaaaacaagatattttagcaagaaatctcaccgcacttttacctcaaagtagcaagataaaattaatatcaatagaagaacttgttggaatcactgaaaattatttaccacagctatcactataaaaatcaaataatttagtaaatactcaagcaaagtatcagatatagaataaaaaaatgcggagaattttctccgcacttttctttttacttcttctgtcttttatctttaagacattcaagagttcatcaattatttgatgattttcgcaacaacgccagcacctactgtacggccaccttcacggattgcgaaacgtaaaccttgatccatcgcgattgggtggattaagcttactgtcatcttgatgttatcgcctggcattaccatttccacgccttctggtaattcgatagtaccagtcacgtctgttgtacggaaatagaattgtggacggtaacctttgaagaatggagtatgacgaccaccttcatcttttgataatacgtacacttctgattcgaagtcagtgtgtggtgtgattgaacctggtttcgctaatacttgaccacgttcgatttcttcacgtttggtaccacgtaataatgcaccgatgttttcacctgcacgaccttcgtcaagtaatttacggaacatttcaacaccagttacagtagttttcgctgtatctttgataccgacgatttctacttcatcacctgtacggatgataccacgttctacacgacctgttactacagtaccacgacctgagattgagaacacatcttcgattggaagaaggaacggttggtcaatcgcacgttctggttctggaatataagtatctaagtgacctgctaattctaggattttttcttcccattctgctacgccgttcaatgcttgtaatgctgaaccacgtacgattggcgtgtcgtcacctgggaagtcatattgagatagaagttcacgcacttccatttctactaattctaataactcttcatcatctaccatatcgcatttgtttaagaatacgatgatgtatggtacacctacttggcgacctaataagatgtgttcacgagtttgtggcataggaccatctgttgctgctactactaaaatagcaccatccatttgtgccgcaccagtaatcatatttttaacatagtcggcgtgtcccggacagtctacgtgtgcgtagtggcgagtcggtgtatcgtattcaacgtgtgaagtgttgatggtaataccacgcgctttttcttctggtgcgttatcaatttggtcaaatgcacgcgctgcaccaccgtaatgttttgctaatacggttgtaattgctgctgttaaagttgttttaccgtggtcaacgtggccgattgtacccacgtttacgtgcggttttgtacgttcaaatttttctttagacattgaaatagtccctctaaatagacacggttatcgatgggtaaattaaaccacattaaccaataaatttatttgctgattgatataaggatgaggaattataagactggtgctgataggcggatttgaaccgccgacctcacccttaccaagggtgcactctaccaactgagctatatcagcgtctggagcgggcagcgggaatcgaacccgcatcattagcttggaaggctaaggtaatagccattatacgatgcccgcaagtcctaaattcgtctgtcccatcaggatccatctaaaagatggtggagggagaaggattcgaaccttcgaaggctgagccaacagatttacagtctgccccctttggccgctcgggaacccctccacactaaatgaatacttgatacgaaagaatggtgccgactatcggaatcgaactgatgacctactgattacaagtcagttgctctacctactgagctaagtcggcgtgtcgtaagcaagtgaggcgtattatatggaaaaaactttaactgacaagtattttttataaaaaagtttatttttttgattattcgtttaaatcacaatcaaaaaagtgattttttaatcaaattagtgcacatttaatgaaaaatgaatgctaaatttttatttatagcgtatatttttctccaattgtctatttgactcaataatatctcaatgaatctaaccccttttttaagttttaaccgcaaacaatgggcagaattgcgtaaatctgtccccctaaaacttacagaacaagatcttaaaccgcttttaggttttaatgaagagctatctttggatgaagtcagtatgatttatttaccattagctcgtttaattaattattacattgacgaaaaccttcgcagacaagctgttttacaccgttttttagggcgtaataaaacaaaagtaccttatatcattagcattgcaggtagcgtagcggtagggaaaagcacttcagcacgaatactccaatcacttctttcccattggccagcggagcgcaaagtagatcttataactactgatggttttttatatccattagaaaaactaaaaaaagatcatcttttacacaaaaaaggtttccctatttcttatgatacgcccaaacttattcattttttagctgatgtgaaatctggcaaaactgaggtggaagcaccaatctattcgcatttaacctatgatattattcctgataaatttaatgtgataaataaacctgacattcttattttagagggcttgaatgtacttcaaacaggtaataataaaaccaatcaaacattcgtatcagattttgttgatttctctatttatgttgatgcagaagaaaaattattgaaagaatggtatatcaaacggtttctgaaattccgcgaaagcgcattcaacgatcctaattcttactttaaacattatgccaatttatcgaaagaagaatccattaccaccgctagtaaaatttgggatgaaattaacgggttaaaccttaatcaaaatattcttccaactcgtgagcgagcaaatctaattctaaaaaaaggtcacaatcaccaagtagaattaataaaattaagaaaataaaaattcgcacgtaaaaacgtgcgaatcttagtcaatgcctaactcaaaatcagttattgataaaaatatcgtaaaaaattaccgcactttttatctaaatttgacttcttgtacaatgcgttttgccgtcgagattggtaattgcccaataaaagtaatttcttttcctccgatgacctcgctataaatcgtataagccccttgtttccaagtattttctggtaggtcattagagcttacattagagacaaacaacgtaaaagtaaataagccatcactatataatgcgctatctatgatttcattttctaatatttcttgagtatatcgaattaaagaaaaaccttgtggcaaccaacctgcagaccaagttatatctgaactttgttcatttttactttctttcaataaagggggcaatgataccttgttaatataatccgttaatcctctcaatctgtcatcgatgtaaagtgttacaactctaaattgatcaagtagcttgccttcgcgatcaagcatatcactgcgtaataacaagccattttcttcatcgataaacaccaaatattgataccgaaaatcatctttaggaacaattctaatcgtatcagcgaaacgcccagcaacgcgatctttacctaattttacgaaatcataatcagaagaaagcttatcaaaatttgcacgcacaaccgcaggcatcgcatcaactatattgccactattaagcgtaaatgcttgagcatttggctgaaaataactgactaaattatcacgttgaataatttcttgctggcgaccatctaaagtaactaattgtgcgtaggttttgttatcttgtttgatatgtcgataacgaaatgaatccatatttgctggagtagtttgcacaaaggcaatttcataattgagattatccaatgcttgtgtcattttatctaaagactgcttcgcagaaagctcttcagcagaagcaatgctacttaatagcaaagaaagagaaagtgcggtaaattttaatgcgatttttttcatagaaatctaaaggataaaaattcaccacactaaataacaattaggtggtgaatcaataatctgaacaaaggaaaccaatttatcttacttgactgctagcatcagagtgcatacgacgttgcaattcatagttttgcaacattgcaccaatacgacgactttttttctcaagctgatctgaagtcaatgtatctttacttggcgcattatagctaacctcttgaaccgcattattaaatggcaaggtttgcaatactggagcctcaggtaaattagacgcttcgtttttactattgaaagattgaacaccaagtactgccactaaacatacaccagcagcaacagcaacttgcgtcattggcgcaaaaaatgcctttaatttttgcataaatgcagaattatgtgcatcttctggttcaggttgagacaccgcaatgacatcgactttcttcacgtcttctaactcaatcaaatctgccattttagcggtaaaatccccccctaaaaagaccgcactttctttacgcattactgaacgaacggtatgaaatgaatgccaagacgcttgtaattcttcgtctcttaataaagcatctgtcaagtcagttttgacttgttcgccatccatataggctgaaagctgctctttttgcatagtaaactccaatttttattcgctctacattagaggttgaattttattttcgatcatttcccttgctcggaagattcgggaacgaaccgtaccaacaggacaatccataatttctgcaatctcttcgtaacttaaaccttctagctctcgtaacgtaatcgcggtttttaaatcttctggtaagttatgaatagtatcaaaaacaattctttctaactcactagacaacatttcattttcgggtgtatccacatcccgcaagtgcgtacccacatcataattttcagcatcttctgccaaaatatcttcatttggtggacggcgaccttgagccgttaaataattttttgccgtattaacggcaattcgataaagccatgtatagaaagcactttcgccacgaaaagattcaattgagcgataagcttttataaaggattcttgcaccacatcaggaatatcgttacgtgatacatagcgagtcaaaagccccgccactttattctgataacgcgaaaccaacaaattgaaggctttcttatccccttgctgcactctttctaccaaagcctgatctgttagctgttcagccatatttctcctatgccaatatctaacacgccttaatattcaagacagcaagctcttgctgcaatctcagacacaggtgtgtgaaaaaagttcatacgtatcttaataattttaattagttgtgattttttgtacgttttggatatactctaccatagattgaatttctgaatctgatgatttaccacgattaaaaaaccaagaaaacagctgcagatctgtacttgctaataaacgaataaatatatcttttttgtcatctgttaattcatcaaaatgcttcaaataaaaaggcattatgattttatctaactctaacattcctcggcgacaatcccattcaatgcgaagtttattatatttttccattttatttccctaaaattgagggctgattatagcttaaaaaatagtaataaaaaaagtcagcatttctgctaactttcattctttaaatattatttattctttaataaatcacggatttcagtaagcaatgtttctgcctttggtgcagtttttttctcctctggttttcttaccttattgattactttgatcatcataaagattgcaaaagcaataataataaaatcaatcacattttgaataaacaaaccataatttaaagtaacagcaggaacatcgccttgtgcttgtgctaatacaaatttcatgtctttgaaatcaataccaccagttaaaatccccaacacgggcgtaaaaatatcactaacaagtgaacttacgatcttgccaaatgcgctaccaataatcacaccgatagccatatctacgacattgccacgcattgcaaattcgcgaaattctttaataaaattcataataatgttccccttcaaaaattacataaaaagagcgactattataataaatcactctgaaaagtaaaaaaactaaataaagaatgcgcttggttggaataatttctcaatttctggcacatttttcttatcacttaaataaatcactatatgatcgccttcttcaataatcacttgacgacgagcaataattacatcattccctcgtaataaagcaccaataatggttcccatcggcaaacgcaactcaccaatttttcgccctactatatttgaagtattcacattaccgtgtgcaacaatttcaatggcttcggcaatgccatgtcgtaatgttgccacattttttacatcgcctttacgcacgtgacctaacaaagcagaaatcgttacttgttgtggagaaaccgcaatatcaatcgtgcctccctgaataagattaatataagcaatccgttgaatcagtaccattgcttttttcgcacctaaacgcttggctaacaaagctgacataatattcgcttcatcgtcgctacttaatgaaagaaatacatccacactttcaatatgttcttcaaaaagcaagttttggtctgaggcatctccattaaatactaacgtttttggcaacttttctgctaaggcttgcgctctgtttgaatctcgttcaataagctttacagtacaagaattttccaaacgttttgctacgccaaaagcaacatttcctccaccaacaatcattactcgcttataaggtttctccaaacgttgtaactctcccattaccgccttaatatgttcagtagcgcaaataaacgtgatttcatcgccagcttctacaatggttgagccttgtggacgaatcggtttgccattacgtaaaatagacataatacgacaatcaatatgtggcatatgttcgcgaaatgcggaaagtgcatatccaaccaaagcccccccataataagctttcactacaacaatactaatacgattattggcaaaatgggcaacttgtaatgcgcctggataagcaattaaacgcgtaatttcatcagtgacaagattttcaggcgaaattaaatgatcaataggtatattttcattgttgaacaacttgtctttttcacgtaaatattctgaattacggatacgtgcaattcgcgttggcgtattaaataatgtatagcccatttggcaagcgaccatattgatttcatcggaggctgtcacggcaaccattaaatcggcatctgccgcgcctgcgtcacgaagcacttttggagatgatggagagccttgtaccacacgcaaatcgtgcttttcttgcaatgtttgtaactgaggagattcattatccactaaggtaatatcgttatcttcactgactaagttttctgcaagcgtcgttcctacctgacctgcacccaaaatgatgattttcattatcgctctcctttatgctcgtttaagcaatttagcataatagaacccatcgccactatttggttgcggaatgaattgaaaacccaccgcacttttatcatcactaacaggtaatggcaataactccgcatctgcgtgagcatttaaaaatgcttggatttgttcgcaattttcttctggcaatacagaacaagtcgcataaagcaaaacaccgtttggcttcagtttttcccaaagtgcactcaggattttcttctgtaattcgacaagctgagcgatatcggtttctttgcgtaaccattttatatcggggtggcgtcgaattacccctgtagcagaacaaggtgcatcaagtaaaattcggtcaaatttcaccgcacttttaccaatttcagctaaccattcgtcaggtttactcgcatcgccgcaaaccactatcgcttgctgatttaaacgtgcaagattttcttctactcgttttaagcgatgagattctacatctaatgcaatcacattagcttgaggtgccagttctaaaatatgggtcgtcttaccaccgggtgcagcgcaagcatcaaggatccattcctcatttttaggctcaagcaacattgccgcccattgcgcactcaaatcttgtaccgttacagcaccttcttcaaagtgcggtaatttttgcaccgcaatcggtatatctaaacatagcgcattaggatggtgacttgtttttgcagaaataccttgttcctcaagtaaagtgcggtaagtttcgagggcatttttttgtgaattcacacgtagccacattggtggtttctgattgttcgcctcaatgatctcacgccaattcggataggctttttttaatttattcacgaaccattcaggatgaagcgtttgccaatttttatcgataattgccaaaatttcatcttgttcacgtaaaaatctacgcaaaaccgcattcactaatcctctaaaactatcagattttaatgattttgttgcgttcacaacttcatcaactgccgcatgagcaggcactcgcatataaagcaattggtataaccctacaagtaacaggcaatgaacaatgcgagttttacctttaagcggcttatccacaagacgtttgataatttgctctaagcgaggcaatactcgacacacgccaaaacaaatttcttgtagcaagggcaaatcttgggcttttacagaaagttgcacttctggaattaacgccgacaaggatttaccttcatccaatgcttgcaaaattaagtttgctgcaatagccctggtcgaaagtgcggtcatttttactgaattttttactttgatagttttagaagaaaattttttcattatgcaagcaccttaccaatagtaaaccattctgcacggccatttaataaatcttgtgcagacataggctttttacctgcaggttgtaattgcaataagtttaagacgccatcgacagtcgcaatttgaatgccatttttatccgcacttaaaatagttcccgctggtttatcttgatgaggcaacacttccgcttgatacacttttaaagtttgtgcattgccatccttgtcttctgttgaaaaataggcaattggccaaggattaaaagcgcggatattacgctcaagttgcattgcaggaagtgaccaatctaattgtgcctcttctttggaaagtttttctgcataattactttggctgccatcttgtttttccgctataaatttactgttttcaagattatctaaaacatcgattaatactgatggagcaagctctgccagtttgttataaagactcgttgaagtttcagtcggtaaaatatcacaatagactttatgtaacatatcgcctgtatctaaaccttcatccatttgcataatggttacacccgtttgtacatcgccagcccaaattgaacgctgaattggtgctgcacctcgccaacgtggaagaatagaaccatgcacattcaaacaacctaaacgaggggcatctaatacagctttcggtaaaattaatccataagcgacaacaaccattacatctgcatttaacgcttttaattcagactgtgcttcttctttacgtaaggatttaggttgataaacgggaatgttattttgctcagcaagttgcttgacaggacttgcttgcaatttcttaccgcgaccagctggtttatcagattgcgtataaacagcgatcacgttatgttgagaatttagaatggcttgtaaatgctgtgcagcaaaatctggcgtacccgcaaaaataatattaagtgatttcataatgtcctacgttatggtaattgataggaaaaaggaagtagggtgggcttaagcccaccgttttttgaaatgattgctgggctaaagcccaccctacgttttagcttttcgcaatctgcttcttgtatttaatcaacttttctttaatacgttggcgtttaagtggagaaagataatcaacaaataaaattccattaagatgatcgatctcgtgctgaatacagatcgcaagcaaaccatccgcatctaaagtaaattctttaccatcacgatctaacgctctcactgtcactttttctttacgaggaaccaacgcacggaaccctggaatggataaacacccctcttcaattcccgtttcgccttctgaagccaaaatttcagggttaatcaaaacaaactgattctgtttatcgccttcaacatcaatagtaataatacgttgcaaaatatccacctgaggtgcagctaaaccaatacctttctcttgatacatcgtatcaaacatatcatcaacaattttacgaattgcatcattaacttcagtaacaggctcacagacaacctttaagtgatcatcaggataaattaatacattaagtgcggtcataatttctcttgtttttaagggtagaattttagcgggattatagcacagctaagaaagaatgtgtagaaaagccccaaatggggcttagattaatattcgaatttgggagacttttttaattccctctaagacagatgtaaaataacctgcagcatatttgatttgatcttaggatatggaactaataacttaccaaaattctttcttagctaatccatttaataaagaaatatctgatagtccttgaataatttgagacttagttacaccattaccatcattgcgcaaaagaagctcgattcctaatttatcatcatctgttaaataaaattttccgagtctataatcaatatttattttattcacttttcttaatgaaaagcggttctcatcatcgtcatacatgataaaaaattgaatatcacctccatcatggggaacaactacaacattcgtaccttgtaatctaaacaccaaaaaattatcttgtattacattaatagaataaccttcttccttaagaatatctacgatttcagatacagaatattgattatcaatacctttaatttctcctttatcagaaaataaagaattaaagaaattactcataaattccccctccatttggatttcgtgttgccgtaatagatgatttatcacgcatttgtgcactgagatctgtagaataagagaattgatccattgaattggttaaatcatactggtacttattaccagagctatcttgatatattttcttaccattttcaaaaattgggataagcatacacttttctcctgctttaagttcattataatgagagtaaattgattattttttattctatcttagtaaataaggtactggtgtaaggacaagaggtatccccgtctctgcccagtattgctattgagtaatcggtaaacacaaatactgttttactaattttttgaaatttaaagatagaaaaacccccagcctttcgactgggggttcttatcttttattctactctgctttattctatttatgtatttgctaacctggcggtgccctactctcacatggggaaaccccacactaccatcggcattacagcgtttcacttctgagttcggtatggtctcaggtgggtccaccgcactatcgccgccaagataattctttgataactcgtcttctcttttatctctcgtctcttttatctctcgttactcagtctttactctacctttcactcgttcttattggccacaagctgaactcaattttctctctattaagtcttctatatttacttttctttgtttagtcttttacttcggtttccgctctacttttatttgcttcgcttttcatctcttacttcacttagctcccaaaaacacttgagcgttgtatagttaagcctctcgggcaattagtatctgttagctcaatgtatcactacacttacacacctgacctatctacgtcgtagtctacaacaacccttactgacttaaagtcagggatgactcatctcttggcaagtttcgtgcttagatgctttcagcacttatctcttccgcatttagctacccagcaatgcctctggcgagacaactggaacaccagtgatgcgtccactccggtcctctcgtactaggagcagccccaatcaatcatccaacgcccacggcagatagggaccgaactgtctcacgacgttctaaacccagctcgcgtaccactttaaatggcgaacagccatacccttgggacctacttcagccccaggatgtgatgagccgacatcgaggtgccaaacaccgccgtcgatatgaactcttgggcggtatcagcctgttatccccggagtaccttttatccgttgagcgatggcccttccattcagaaccaccggatcactatgacctactttcgtacctgctcgacttgtctgtctcgcagttaagcttgcttataccattgcactaacctcacgatgtccgaccgtgattagcaaaccttcgtgctcctccgttacgctttgggaggagaccgccccagtcaaactacccaccagacactgtccgagaccacgtttcgtcatcttcgttagaacatcaaacgttaaagggtggtatttcaaggtcgcctccacaatgactggcgtcactgcttcaaaggctcccacctatcctacacatcaaaattcaatgttcagtgtcaagctatagtaaaggttcacggggtctttccgtctagccgcgggtacaccgcatcttcacggcgatttcaatttcactgagtctcgggtggagacagcctggccatcattatgccattcgtgcaggtcggaacttacccgacaaggaatttcgctaccttaggaccgttatagttacggccgccgtttactggggcttcgatcaggtgcttctcttgcgatgacaccatcaattaaccttccagcaccgggcaggcatcacaccctatacgtccactttcgtgtttgcagagtgctgtgtttttaataaacagttgcagccagctggtatcttcgaccggttcaaccttcgcccgctagggactacaatctacgccggcgcaccttctcccgaagttacggtgctattttgcctagttccttcacccgagttctctcaagcgcctgagtattctctacctgaccacctgtgtcggttttcagtacggtttagtaaagcctttcgcttagtggcttttcctggaagtgtggtatcagttacttcagctccgtagagcctcgtcatcatctctctgtgttaaggaagtccggatttgcctaaacttcccacctaccaacttaaacgcacatatccaacagtgcgataacctaacctactccgtccccacatcgcagctttaccaagtacaggaatattaacctgtttcccatcgactacgcttttcagcctcgccttaggagccgactcaccctgccccgattaacgttggacaggaacccttggtcttccggcgaacgggtttttcacccgttttatcgttacttatgtcagcattcgcacttgtgatacgtccagctaacctctcgattaaccttcatccgcttacacaacgctcccctacccaacaggcgtatcactaataatccttacttcaaaaataccccgactcaacgttcgggttgcttgaacaacctttcatgccgcttcgcgccattctagcttgttaatcgtaaggcgtattagtgatacgcctgatgccgcagcttcggtgctatatttcagccccgttacatcttccgcgcaggccgactcgactagtgagctattacgctttctttaaatgatggctgcttctaagccaacatcctagctgtctaagccttcccacttcgtttcccacttaatatagacttggggaccttagctggcggtctgggttgtttccctctccacgacggacgttagcacccgccgtgtgtctcctgagtatcactctttggtattcgtagtttgcatcgggttggtaatccgggatggacccctagccgaaacagtgctctacccccaaaggtgtcacctcaaggctctacctaaatagatttcggggagaaccagctatctcccggtttgattggcctttcacccccagccacaagtcatccgctaatttttcaacattagtcggttcggtcctccagttagtgttacccaaccttcaacctgcccatggctagatcaccgggtttcgggtctataccttgcaactagacgcccagttaagactcggtttcccttcggctcccctattcggttaacctcgctacaaaatataagtcgctgacccattatacaaaaggtacgcagtcaccccatcacttaatcccactgcttcttttgggtggtttgactcgcttcgctcctcttaccattgtttaagtgcggttgcttttcatcaccttccaatcggattaagtgatggggctcccactgcttgtacgtacaaggtttcaggttctatttcactcccctcaccggggttcttttcgcctttccttcacagtactggttcactatcggtcaatcaggagtatttagccttggaggatggtccccccttcttcaacaggatatcacgtgtcccgccctacttctcgttagcttagtaccacaatatggtttttagatacgggattatcaccctctttgattgtgcttcccaacacattctcctcactatactgctatcacttactggctctttcgctttcgctcgccgctactgacgaaatctcggttgatttcttttcctcggggtacttagatgtttcagttctcccggtttgcctcaacaagctatgaattcacttgttgatagtagattcttcatctactgggtttccccattcggatatcttggattaaacgcctcttatcgactcatccaagcttttcgcagattagcacgtccttcttcgcctctgattgccaaggcatccaccttgtacgcttagtcacttaactatacaacctcaaatgttttcaatcactttacgttttcacttcaaagtgcggtcaatttgatgcgtatttttattcaactaaacacttgattgcttttgttcaatcaagattttatgcaaaacaggttttgtttttagagttcccttttcagttccctcctctcactttcctatcttgcctactcagactttctctcgaaaatctcttgttttcagcttgtttccaattttttaaagaacagttgataaaacttttcagttatcatcgttaaataaactaaaactaaaacaaaattaaatttaaaattaaacttaaaataacctaatatttaaaatagcttcatcactaccttaatactttattaatttgtctttttctaatttatttaacgatgataagtggtggagataagcgggatcgaaccgctgacctcctgcgtgcaaggcaggcgctctcccagctgagctatatccccatttcatcataatttaataactaattatttaccttttagttattatttatttacactacacctttcgcttcactcactctcagagtggtgggtctgagtggacttgaaccaccgacctcacccttatcaggggtgcgctctaaccacctgagctacagacccaagggtaatgttttcttctgctcatttgtctacaactatcagccaatctgtgtgagcactcgctgtctctcgtctttggtaaggaggtgatccaaccgcaggttcccctacggttaccttgttacgacttcaccccagtcatgaatcataccgtggtaaacgccctccaaaaggttaagctatctacttctggtacaacccactcccatggtgtgacgggcggtgtgtacaaggcccgggaacgtattcaccgcgacattctgattcgcgattactagcgattccgacttcatggagtcgagttgcagactccaatccggacttagacgtactttatgagattcgctccacctcgcagcttcgcttccctctgtatacgccattgtagcacgtgtgtagccctactcgtaagggccatgatgacttgacgtcatccccaccttcctccagtttatcactggcagtctcctttgagttcccgaccaagtcgctggcaacaaaggataagggttgcgctcgttgcgggacttaacccaacatttcacaacacgagctgacgacagccatgcagcacctgtctctaagttcccgaaggcacaagctcatctctgagctcttcttaggatgtcaagagtaggtaaggttcttcgcgttgcatcgaattaaaccacatgctccaccgcttgtgcgggcccccgtcaattcatttgagttttaaccttgcggccgtactccccaggcggtcgatttatcacgttagctacgggcgccagagttaaaccccaacccccaaatcgacagcgtttacagcgtggactaccagggtatctaatcctgtttgctccccacgctttcgcacatgagcgtcagtacattcccaaggggctgccttcgccttcggtattcctccacatctctacgcatttcaccgctacacgtggaattctacccctccctaaagtactctagttacccagtctgaaatgcaattcccaggttaagcccggggctttcacacctcacttaaataaccgcctgcgtgccctttacgcccagttattccgattaacgctcgcaccctccgtattaccgcggctgctggcacggagttagccggtgcttcttctgtatttaacgtcaatttgatgtgctattaacacatcaaccttcctcaataccgaaagaactttacaacccgaaggccttcttcattcacgcggcatggctgcgtcagggttccccccattgcgcaatattccccactgctgcctcccgtaggagtctggaccgtgtctcagttccagtgtggctggtcatcctctcagaccagctagagatcgcaggcttggtaggcatttaccccaccaactacctaatcccacttgggctcatcctatggcatgcggcctctcagtcccgcactttcatcttccgataatacgcggtattagcgacagtttcccgtcgttatccccctccataagccagattcccaagcattactcacccgtccgccactcgtcagcaagaaagcaagctttctcctgctaccgttcgacttgcatgtgttaagcctgccgccagcgttcaatctgagccatgatcaaactcttcaattcaagttcaatcgctcaataaactacttagctataaataaaacactacttaaaaaagtaatgatgaattttcagttaagcacctattaagacttcaaaattaaaaaatatttttaaaacaagtcaatcaacaagtgcccacacagattgtctgatatattgttaaagagcaaaaaataacgacgcacttggaaacttaaaaaacttcacaacagtgcgtcgttgtgtgcggtgcattatagggattttcaaatcccttgcaagtactttttgcaaaaaattatttgaatgaacaaattttattcatcatctaattttctatagccttttaagccattttttctcaaaacttcgtttaatttcttcaataaacgctctttttcagcttgacttaacatctgactatttttattttgcaaagcacatactaatttccaataaaaatcaagcgtagcaccactgccacttttctttaattccaccaatgcattttctgcgccaatctctcttagcatcgcaacatttgtaataccaacttttattaaagctctttcatgtttaatcgttaaattgggtaaatcctttaatcgattcaattttcttaacgtacattctagcttccgctcaagaatctgcttaatagaaagaataatcaattttctacacaatctattactacgtaaaatctgatcagaaagtgcataatattgtgaaagcacaaaccgtttattcaattcattcgttgtaaaaggttcacaacctaatttagttaattgaattgcgagaacaccctcaccgcgtaaataaagttttttattttgccaaatagcaaacattgtctcttccttgtgaaacaaaccgtaaccagtaaaaagatttttaaaggaaacatttcctactaactgatctaacaaggagcaaacgctatctatatgctcatcctttatattcatattaaacctccaatgaataattattttaaaagagtcagtagaagtacttctgatttcatttatatcatgaaatttttactacacctaaatataaatgtcagatttgtgagccagatcgtaaatttaaaatttatttttatctaaacgattggtttatatataaatatactatatttaaaactttttctgagattatttttgtatataatttaatctaattctctgttaaaaacttttattttaagccttccccatcctctttactgaaatatataccccatatttttttattaatataaatatttttcttgacctgtacatcaatacagatataatcacaaaaatttgaacattcaaacaggattttaattatggcaactcaagaagaaaaacaaaaagccctagcggctgcactagggcaaatcgaaaaacaatttggtaaaggctcaattatgaaattaggcgataccaaaacgttggatgtagagtctatttctactggatcacttgggttagatgttgcgcttgggattggtggtttgcctatgggtcgaattgtagaaattttcgggcctgaatcatcgggtaaaacaacattaactctttccgtcattgctcaagcgcaaaaagcaggaaaaacctgtgcatttattgatgcagaacacgcacttgatcctatttatgcagcaaaacttggtgtagatgtaaaagaactttttgtttctcaaccagataatggggaacaggcacttgaaatctgtgatgcattagttcgctcaggtgcaattgatgtaattattgtggactccgttgccgcactgacaccaaaagctgaaattgaaggcgatatgggcgattctcatatgggtctgcaagcacgtttaatgtctcaagctttgcgtaaactcacaggtcaaattaaaaatgcaaactgtctagttgtgtttattaaccaaatccgtatgaaaataggcgtgatgtttggtaatcctgaaaccaccacaggcggtaatgcattaaaattctattcttctgttcgcttagatattcgccgtacaggttctgtaaaagatggcgaaaatattattggaaatgaaactcgcgtaaaagtagtgaaaaacaaattagcggcaccgttccgccaagtggatttccaaattctctatggagaaggcatttcaaaagcaggagaattattagaacttggtgtaaaacacaaacttgtagaaaaatcaggcgcatggtattcctataatggcgaaaaaattggtcaaggaaaggctaattcaatgaaatggcttaacgaaaatatagagaaatcagatgaattagaagctcgtttacgtgctgaattagtggccaatccagaacaagccttaatggcggatattgaacaatctgaaaataatactgaatcagaaagtgattttgaataaagaaaattacaaatgccaaaagtgcggttaaaaatgaccgcactttatatcgattcaataaaatgaaggaataaatccttgtcatctcttgcttttaattacatagttaatcttctttcccgcagagaatatagtgaattcgagctccgcaataaaatgcaggaaaagaacttttcggaagaagaaattgatgatgcattatctttatgccaagcaaaaaattggcaaagcgatcgtcgtttttcagaaaattatctaaattcacgctcacaaaaaggttgtggtgtaggaagaattcgacaagaattacgccaattaaaaggtgtgtcttctgatattattgatgaagttttaatggaatcagaaattgattggtatgaaatggctgagaacttgttacgtaaaaaattcccaaattataacgaacagcaaacgtctaaaatgaaacaaaaaatttggcaatatatgctatcacacggatttcgtagcgatgaatttgctgatttaattgggcaaaaccaaagtgaatgggattaagataaaagttgagaacaaattttatatatccaaatgcctaacacagtcatagctaaacatccgaataaatgcatcattaatacacaaaatccatttaaccacttgtcattaaaaaataattccacaacttcggaagaaaaagacgaaaatgtggttagcgatcctaaaaaacccgtaattaaaaataaccgccattcagaactaatttgtggaaattgccaaaaaaacccaagtaatacaccaataattaaacaaccaagcaaattagcgattaaagtcccaaaagcaaatgaggaaaataaaggattaaataacaatcctatagcccaacgcaatgacgcgcctaatattgcaccataacttatgaataataatgcctgcattaataatctaatccaaatagggttcgcaaataacgagcgactgattcttctttatttgagccaataacttctaactctggacaagccatttttaaacgaatatcagcatctttcataatgcaacctgttccagcccaagaaagcatttctacatcattcattccatcaccaaaagcaatacagtcttttaactgatactcgcgtgattcgagtaaatgttttaatgcatccccttttgaaacattcttattcattacttccaaacaagctaatgctgaataaacaattgtcgttacgtcaccaaacttatctcgtaaataagtttctactgcaactaaatcctctggagttttaccaataaaaaagactttttctgtcccacgtccatgatgtttagaaaaatcgacaacgttataatcgaatccagattctttatggaactgacgcattgcaggaatatctttattagtaaaccaaccttcatcttgatagctattcatgcatactttggaagtatcaaatggcgttttgtaaagctcaagaactaattcttcaggcaaactattgctataaagcaaattaccctgtaaatcccgtacacgagcaccgtttgatgtaatcataaccgcacgttccgcaccaatttttccaagaatggatgacacatcggtatgattgcgtcctgttgccaaaataatatctacgcctttttgctctaatgctctcagcgtatcaatggtaagatcacccactaaatgttcaggtgttaaaagcgtgccatctaaatcagacaccattgctcgaaaaggtaaattcataaaaacctcaaaaaataaactatgtttatcatatcactaaatatacaaatggtacttgctgaagatcaatatattaaaaactgcaataaaaataaccgcacttttattaagtatagatagacacattcctcttcatcaaaaataaactaaaacatattttcgtttaaattcatctactattagaaatcaaacaaataacaataaagagttagattatttttattaaattctaataatactaaaaatctcgcaataaaattctacatactggcattaccagttgaaaaacgacaacaaatttcattttacctctcttataatgcaactgttcgaacaacaagcagtatctcgaatgatgtatgtttattccccaatgtatagtcaaaacacaaggagattattatggctttcaatatgaaaaatagacatttacttagtcttgttcatcacacagaacgtgaaattaaatatctcttagatctctcccgagatttgaaacgagccaaatatgccggcacagaacaacaaaaattaaaaggcaaaaatatcgcgctcatctttgaaaaaacctccacccgcacacgctgtgcatttgaagtcgccgcttatgatcaaggcgcacaagtcacctacatcgaccctaattcctctcaaattggccacaaagaaagtatgaaagataccgcccgcgtattaggcagaatgtatgatggtattgaatatcgtggctttaaacaaagtatcgttcaagaactggctgattatgctggagtgccagtattcaatggtttaaccgatgaattccacccaacacaaatgcttgccgacgtacttaccatgattgaacattgcgacaaaccattaagtgaaattagctatgtatatattggggatgctcgcaataacatgggtaattcacttttattaattggtgcaaaattaggtatggatgttcgtatttgtggacctaaagcattattaccagaagcaaatcttgtggaaatgtgcgaaaaatttgcgaaagaaagtggagctcgtattactgtaactgaagatatcgacaaagcggtgaaaggcgtagattttatccatactgatgtgtgggtttcaatgggtgaaccattagaaacctggggcgaacgcattaaattattacttccttatcaagtcacacctgaattaatgaaacgcactggtaatccaaaagtgaaatttatgcactgcctacctgccttccataacagcgaaaccaaagttggtcgtcaaattgctgaaaaatatcctgaattagctaatggtattgaagtaactgaagaggtatttgaatcgccaatgaacattgcatttgaacaagcagaaaaccgtatgcacacaattaaagcggtaatggtagcaagtttggcataaggagaacgtatgagaatagtgattgcattaggcggtaatgcattattacgacgcggagaaccaatgacagccgaaaatcaacgacaaaatgttcgcattgcttgtgagcaaattgctaagatttggccaaataatgaattagtgatagcacacggtaatggcccacaagtgggtttgctcgccttacaaggtgctgcctatactgatgtgccaacctatcctttagatgtattgggagcagaaacagctggaatgattggttatatgattcaacaagaactcggtaatttagttccatttgaagtgccatttgcaacgttattatctcaagtagaagttgatatcaacgacccagctttcaaaaatccaactaagccaataggtcctgtttatacaaaagaagaagctgaacgtttggcaaaagaaaaaaattggtctatcgcacaagatggtgataaatatcgtcgcgttgtgccaagcccattaccaaaacgtatttttgaaattcgtccggtcaaatggttgcttgaaaaaggcagtatcgtaatttgtgcggggggcggtggcattccaacctattatgatgaacaccataatttacaaggtgttgaagccgttatcgacaaagatttatgttcagctttacttgcagaaaatcttgacgctgatttattcatcatcgcaactgatgtttccgcaactttcgtagattggggtaaacctaatcaaaaagcaatttcagttgcctcacctgaagccatttcagaacttggtttcgcttcaggttccatggggccgaaagtacaagccgcgatcaactttgcgaaacaaacaggaaaagatgcagtaataggatctttatctgatattgtggacattgtgaaaggcaaagctggtactcgtattacgaaaaaagctgaaggcatatcctattatgcttaaataataaaggaactttgggaagccattctcaaggtaaaaagtgcggttggtttaaccaatgttttaccaaccgcactttaaacgttaaacataaggaactcgctatggatgcgtccaaaaagaagaaaacgtttaatttcccatcagcgtttacaattttatttgcaatcttaattctcgctgttggattaacctgggttattccatccggttcatattcaaaattaacatataactctactgataatgtttttgtcgtcaaagcttatggcgttgatgataaaacttatcccgccacaacagacactcttgataatctcaatatcaaaattaaactctccaacttcaccgaaggcgtgatcaaaaaaccaatcgctattcctggcacttatcaacgtgtagaacaacaccataaaggcattgaagatatcaccaaaagtatggtagaaggtaccattgaagccgttgatgttatggtctttatctttgtattaggtggtatgattggtgtcattaaccgtactggttcttttaatgctggtttgatggctctcgtgaagaaaaccaaaggcaatgagttttttattgtattctgcgtatccgtcttaatggtgttaggcggcacaacctgtggtatcgaagaagaagcagtggcattttacccgattctggtgccagtattcttggctctgggatatgatgcgatagtctgcgtaggggctatattccttgctgcatctatgggaactgcattctctacaattaacccattctccgttgttatcgcatcaaatgcggctggtattcaatttactgaaggtattggtttccgtgctctaggtttagttttaggggcaacttgcgtaatcgcatatctttattggtactgtaaaaaaatcaaagctgacccaagcttttcttatacttacgacgatcgcgaagaattccgtcaacgttatatgaaaaactttgatccaaacacaactatcccattctcagctcgtcgcaaattaatcttaacgcttttctgcatctcattccctattatgatttggggtgtaatggttggcggatggtggttccctcaaatggctgcatctttccttgccattactatcatcattatgtttattagtggcttgtctgaaaaagatgttgtggaatctttcactgaaggtgcatcagaattagtaggcgtatccttaatcatcggtcttgctcgtggcgtgaacttagtgctcgaacaaggtatgatttctgacactatccttgattatatgtctaatgtggttagtggtatgccgggtagcgtatttatcttaggccaattagtcgtatttattttcctaggtttaatagtgccgtcttcttctggcttagccgtactttcaatgccaattatggcgccacttgctgactcagtgggtattccacgcgatatcgtggtttcagcttacaactggggacaatatgcaatgctattcttggcaccgacaggattagttttggtgacactccaaatgttgcatattccatttgatagatgggttaaattcgtcatgccaatgattggatgcttattgctaattggttccattttattggtagtacaagtatctttatatagtgtttaattagtcaaaaatacctatcttaattctaggcttggcattaaaaccttaaaatcagaagttactctaaaaacggtcaaatcaacaactgaattgcctttataaaatcatcataatgattgctcctaaaataaaaagaagcacgcatagaatgatgcgtacttaatgtagggtgggctaaagcccaccaaaatatcacgattgtttgttggtgggctaaagcccactctacaactactaatcaacaatcaacggctcgcattataggaaacaagcaggtttaaatacagaaaataataagaatagtttttatttcttgatttttatcaaaaatcaatctttattgttgtgagaaaatgcttcctcgtataatatatttgagaattattattatttttttataggattaaatatgaccaattttagattaaacgtgcttgcctattccgttatgcttgggctaacggcaagtgttgcttatgcagagccaaccaaccaaccaaccaaccaaccaaccaaccaaccaaccaaccaaccaaccaaccaaccaaccaaaatagtaatgcttctgaacaactagaacaaataaatgtatctggctctaccgaaaatactgatacgaaaactccgccaaaaattgccgaaactgtaaaaacggctaaaacgctagaaagagaacaagcaaacaacattaaagacatcgttaaatacgagactggcgttactgttgttgaagctgggcgttttggtcaaagcggttttgcgattagaggggtagatgaaaatcgtgttgcaattacggttgatggcgttgctcaagcagaaacattatcttcccaaggttttaaagacctgtttgaaggatatggtaattttaataacacgcgtaatggaattgaaattgaaactttatctgatgccaaaattaccaaaggtgcagattctctcatgtctggtagtggtgcattgggtggctccgtcatctataaaactaaagatgcaagagatcttctgcttaacaaaaactacgcgtttaaatataaaactggttttaccagcgagaatgatgaaagattaaattctattacttttgcaggaaaagcaagtatattcgatgtacttgctgtcggcacttggcgtaatggtcatgaaatcaaaaattatgattacaaatctgcagacgacattctaggaaaactcagagaaaagaccgatccttataataaaaaagaccgcagtcttttattgaaaattggtacaaatcttggtgaaaataatcgcattgccgtagcctatgatagaagacgggttgaaaataaaggtctagacaaatcttactcattacatggatgcacgaaatatgtttgtgatgataatgaaatagatactcgccatactcatgatgaaagcattagaaccagtaaatctatagcatttgaaaatacaaatataaacccactttgggataccctaaaactctcttatacagatcaaagtattactcaacgagcaagaagtgacgaacattgtgatggtgaacggtgtcctggggtacaaaaccccataggactacattataacaacgataataaacttgttgataaaaataataatcctgtaacctataaattagaaaatcgttctgtaacatactattcttacattgatgaatctatctttaatcgatacagtaactttaaagaagaagttcctgtagaactcgctaaggaatggaaacttaaagaatatggtggaaaatattatattgactcgcctcgctgctttaaaaatcacggtgatgctaatcacgaggggatgtgtagactaagatctgatgtaaaagaggaaaaggaaacattagtagctaataacatcacttatgatttaaaaaaggagtattttattaactcaaggctcacgaatagtgataatttattatcttgtgatggaattaactgtgataaaggtacaattcaaggtttcgaagctgatggaacgcctaaggatttaccaataaaaataatcccaaaagaaggtaaaaaatttgcacttattgaaaaaatttcagatcaaaatggctacaatattggcccagagaaagcatctcgttttctagtacctaattcacctggttataatagaaacatttggaaaaaacgtgaccttgatactcgtactcaacaaattaatttggatttaacaaaacattttgaactaggaaaaagccaacatgatttatcttatggtttagtttggagtaaaacaacaaaatcaatgataaataaagaagggttaaaagttaatagtggaaaatggtggattgattatccaaaagactgtgaatctagtacatcagatttatgtacaaaaaatagtacagcatcatttcttattcctgtagaaacaaaagatggttctctctattttaaagatgaatttagagtaaatgatcgtcttggcttagatatcggttatcgatatgacaaagtcaaatacaaaaccaattatcaaccgggtataacgccaaaaatccctgatgatatgttagttaatttatttataaaagaaccttttgtaaaaaacacacggagtctaaaccctaatgatccaaatgaaattaatcgacgaaaaaatgcagaagctaatattaattatatttctcaacccaaaaaatttaatgcgagttcttatgctttaagcacaaaattcgatccattggattggttacaagttcaagcaaaatatagcaaaggtttcagagcaccaacagctgatgaattatacttcacattcaagcacccagaatttactgttcttccaggctctaaattaaaacctgaaattgcaaaaactaaggaattatcattaactttacatgatgatgaaatcggttttatttctggtggatatttcatcacaaattataataattttattgattttagttatctaggaacaaaatcatttggttctcaagcaactaagcatgaattatatcaatctgttaatttagataatgctaaagtgacaggatttgaattgaaaaccaaatttacattaggaaaatggatatcatggttgaagaatgttgattttggttaccaattaactaaacaaaaaggtaaagcaagcgataaccgcccacttaatgctattcagccaatgacacaagtgatgagtttagcctatacgcatcctgataatctgtttggggcaaatttatatcttactcatgtttcccaaaaagaagcgagtgacacatataacatttattcaaaagatgctacagcaggagataaagaatatgttcaaaataaacatattaaatggcgtagtaaagcttacacagtgacagattttactttcttcgtgaaacctatgaagaatttaactttacgagcgggtgtttacaatttatttgacaaaaaatatatgacttgggattctgctcgttcaattcgtatgtttggtacaagtaatttgattaatcaagaaacaggtgcaggtattaatcgtttctatgctccaggcaaaaactatagaatgtcagttcagtttgaattctaacctgttgtaaaaataaaatacgagcatttcctgtttagattgagtttgacactcatatactaaacaggaaatgctcattttttattgtgatttgtcagatgaggtttgatcttctacatttgtagtcagattggcttcttatttaaaagattgataattttattggaatatagattgttaataactaagtataaatcataatcaattttactaaatacccacataacttgtttcagaattttctttaaatctttattgaagatgggatcgtgatgacaaattctgtttcttatgttcactcttaaattctttgtgacttttataataaataatatatccttatctttatttgagttttcaaaagaaattattctataagcatacaaaagaggcattctgtgaagctcacgagaattccacaagaaaaacttcttcaaaaaattcccaaaagtgaaaatgtaaactagatatgatttttccatcagtcgcatttctacctaattcttcaactttttctcttaatttaggactttgtctaagtatttgtctctgtctgataccataatgatcatacgaatctattgatctataaatagcatttcttaatgaaatctcatatatattacataattcaagaaaatagcccgctatttcagaattccattcatataaagcaaccatgttatcattaatactttctgaagttttatttttcacatagtttttgtatgtagataatctttccttactaagtgctttttctaaaacaagaaattgcgttgctgataacatataatcctacttatcacttgacatttgaattatttaaccatagactccgccccgacgatagggaacgttggtcactgatagcattatcatccccccctacaatattgagacaaggccacctaaaaggtggcttttgtcatttttaattcctgaaaagcatcgttttcaactaaatcaataatgctacgcaatccataaaaatccagcttttatgctggattttgtttttagcttaggcataatagcaataacttttcatccctaaaaaggattataaatatgaaaaatatgttactgctcagtagctcaaaatacaagaacacaggttatcttgaacacaccctaccttggttacaaaatttcttggctgattatcgtggtaaaacaattgcttttgtaccttatgctggggtaagccgcacttttgatgaatatgaaaaaactgtgcaaaatgcactttccgatttagggatgaatattgtttccgttcatcatggtaaacagcatcgggatattattgaacaagcagatgtcatctctattggcggtggaaatacattttgtttgttaaaacagctttatgaacacaatttgattgatatcattcgtgaaaaagtaaataacggtacgccttattttggttggagtgctggggcaaatgtagctggcgcatctattatgacaactaatgatatgccgattacttatcctccttcatttcaagcattacaactttttcctcatcaaattaatccgcactttatttcaggtaaaatgcaaggccacaatggtgaaagccgagaagaacgtttggcagaatttttactcgttaatccaaccgcacttgtatatgcattacctgaaggttctgcgcttcatatacaaaatgaaatggcaactgtattgggcgaaaatcctattttgtgcttcagtgaaaatatggaatgtggcacatttgatatcaatacaactttttcttattaacttaaagggaacatataatggaattatttaaatccatcgttgcagtgattggcattattgccacaatttattttctgattaaaaaagccgaaacccgaaccgttttgattggtgtcggtttaataatgtccattctaacgcttaatccaatgggtgcattagatgcttttgccaaaagcatgacatctggcggattaattatggctatctgttctagtatgggttttgcttatgtaatgaaatacactcaatgtgatactcatctagtgcatttacttaccaaaccattaagcggattaaaattcttcttaattccaattgcaacagtcattacctttttcatcaatattgctattccttctgctgctggttgtgctgctgcggttggcgcaacattaattcccgttttaaaaagtgcgggtgttcgaccagctactgctggtgcagctattttagcagggacttttggatcaatgatgagtccgggttcttctcactcagcaatgattagtgaaatgtcaggattaactatcactcaagtaaacctttcacatgctccatataacatgattgcgggagcaataggtgctgttgttttaaccattcttgcgcttgtttttaaagattatggtgaacaacatcgccaagcttatcttgcagaacaaaaagaaagtgaaattaaagttgttgaaggcgtcaatgtactttatgcccttgcaccattaataccattagttattttagtgattggtggaacatcattacaacaagtaccgggtcttgaatggactaaaatgggcgttcctcaagcgatgctaattggtgcaatttacggcattatcgtcactcgtatttccccagtaaaaatcactgaagaatttttcaatggtatgggaaattcttatgcaaacgtacttggtattatcattgcagccagtgtatttgtggcaggattaaaatctacgggcgcagtggatgctgcaatttctttcttaaaagaatccaacgaatttgtacgttggggtgcaacaattggaccattcttaatgggcttaattacaggctctggcgatgcagcagcgattgcctttaacactgccgtcacgccacatgctgtagaactcggctacacccatataaatcttggtatggcagcagccattgctggtgcaattggtcgtacagcttcaccaattgcaggcgtaactattgtttgtgcaggccttgcgatggtaagcccagtagaaatggtaaaacgtaccgcaccaggcatgatacttgctgttttattcttagcattatttatgttgtagaaatagtaaaaaattgaccgcactttatttaagtgcggtctgtttttatagacttttaaaagaagaaaaaaatgaacttagatttaaatcaacttgttaaatggcgtcgtgaatttcatcgttttccagaaattggctggagtgaattttggacaacttctcgcattgcggattacttggaagacttagattgttttgaaatttttcttggcaaacaaattataaatccagactttgttcgtggacgaaaacaagccgtagtagataaaggcttagctaatgcaaaagcctatggagccaatgaaaaatggctcgaaaaaatggaagggtacactggttgtgtggcattatttgattcaggtaaaccagggaaaactattgcattacgttttgacatagactgtgtgaatgtaacggaaactcgctcaccagagcatattccaaataaagaaggttttgcctcaattaacgatggttttatgcatgcttgtggacatgattcacacattacaataggtttaggtgttgcattatggatcgctcagaacaaagataaactcactggaaaagtaaaaattgtatttcaaccagcagaagaaggtgttcgtggtgcagctgccattgcacaaagtggcataattgatgatgcagattattttgcttcttcacacattagtttttgcgcaaatacaggcactgttattgctaatccaagaaattttctttccactacaaaaattgatattcgctataaaggtaaacctgcgcacgcaggtgctgcgccccatttaggtcgtaatgctttattagctgcagcgcatacagtcactcaacttcatggtattgcacgccatggtgaaggcatgacaagaattaatgtgggtgtgctaaaagcgggtgaaggacgaaatgtcattccatcctctgctgaattacaattagaagtgcggggagaaaataaagcaattaatgaatacatgactgaacaagtcatgcaaatagccaaaggtatctccataagttttgatgtcgcatatgaaactgaaattgtaggtgaagcagtggatatgaataacgatgttgaacttataaaactcatcgaagaaatatctcttaaacaaccacaaataaataacgtaaattcagattatgctttcaatgcaagtgaagatgcgactattttaggtagacgtgtacaagaacatggaggcaaagctatttacttcattcttggcgcagatcgcacagcaggtcatcacgaagctgaatttgattttgatgaaaatcaattacttactggggttaatatttatacttccttagtacagaaattattatcttaattaaataaaaatatttttactcctttcttttaagaatccgctatttttcttagaataaaggcaatatttacccaccttataaggaaaactcaatgattaatagacgtcattttattcaaattggagcaactagcatcctagcgttaagtgcaaaccgttttgcgatggcaaaaggaaagagcgatgttgatttacgcattgtggcaacaacagatgttcatagcttcttgaccgattttgactattataaagatgcaccaaccgataaattcggttttactcgtgcagcaagccttattcgtcaagcacgtgctgaagtgaaaaatagtgtattagtagataacggtgacctaattcaaggtaatccaattgcagactatcaagctgcacaaggctataaagagggtaaatctaaccctgcggtcgattgtttaaatgcgatgaattatgaagtgggtacattaggtaaccacgaatttaactatggtctcaattatcttgcagatgccatcaaacaagctaaattccaaattgtgaatgcgaacgtagtaaaagcggggacagaagaaccttatttcacaccttatgtcattcaagaaaaatctgtggtggataataatggcaaaacacataaattaaaaattggttacatcggctttgtgccaccgcaaattatggtttgggataaagcgaaccttcaaggtaaagtggaaacccatgatattgtaaaaacagcgcaaaaatatgtccctgaaatgaagaaaaaaggggctgatattatcgttgcattagctcacacaggcccatctgatgaaccttatcaagaaggtgctgaaaactcagcattctatctagctgatgtaccacatattgacgccgttatttttggtcactcacaccgtttattcccaaataaagaatttgcgaaatcaccaaatgcagacatcgtaaatggtaccgtaaaaggcgtaccagaaagtatggctggttactgggcaaataatatcagcgtggtggatttaggcttaacagaacacaaaggcaaatggattgttacctctggaaaagcagtacttcgtccaatctatgatgctaaaaataaaaaagtgcttgcagaaaatgacccagaaattaccgcacttttaaaaccagttcacgaagctacacgtaagtttgtttctcaacctattggtaaagccacagacaatatgtacagctatcttgcattagtgcaagatgatccaaccatccaaatagtgaaccaagcacaaaaagcgtatgtagaaaaagttgcaccaaatgttgcagcaatggctggcttacctattttaagtgcaggagcgccatttaaagctggtggtcgtaaaaatgaccctacaggttataccgaagtaaataaaggtgaattaactttccgtaatgcggcagacttatatctctatccaaatacattagtcgttgttaaagcaacaggcgaacaattaaaagaatggttagaatgtagtgctggtatgtttaaacaaattgaccctacaagtgataaaccacaatcattaatcgactgggaaggtttccgcacttataactttgatgtgattgatggtgtcaattatgaatatgatctaactaaacctgcacgttatgatggtgaatgtaaattgattaacccagaatcgcatcgtgtagtgaatctcacttatcaaggcaaaccggttgatccaaaagcagaattcttgattgcaacgaataactatcgtgcttacggtaataaattcccaggcactggcgatcaacatattgtttacgcatcaccagatgaaaaccgtcaaattttagctgattacattaaagtaaccagtgaaaaagaaggttctgtaaaccctagcgcggataaaaactggcgttttgtgcctatctcaggtaacgataaattagatgtccgttttgaaacctcaccaagcgaacaagcagctcaattcatcaaagaaaaagcacagtatccaatgaaacaagtgggtacagatgaagttggatttgctgtataccaaattgatttatctaagtaataattagaaaaataaaatgccgcctaaatatctaaaatttagatggcattttttcttctaaagtgcggtcaaatttttaagtattttcatgaatctatcttctttcttttacaaattgcattcgcttttcaacccttctattgctttacattcttcttcattatgttcattttcggtaacaatagactgcaaaaaagctttaatttctaataattgagatattttattttctacttgaataagctgattaagtactaattgatctgcttgataatgatctttcgtactaaatctaatacgattgagttcccgaatattctctaaagagaagcccaacattcgacattttttaataaagtttaattgctctatactctcttcatcataaaatcgataaccattagccaatcgcttaggtggaggtaatactccttgtttctcatagtagcgaatagtttcaatattagtatgtgtagatttacttaattcattaattttcattatttcctcaagcaattttttactttaatgagaatgatcattcggcaatgaattgtcatcgctactatataaggatttaatagcttgaaaaactgtagaaataccgctttgtaatacaaaaatgcttaagataccactagcaactacatcaacccactgccaatttaaccaccaagcacttattcctgcaataatagcaacaaccgaaccaaataaatctactaaaacatgcaaatatgctgcacgaatattcaaattatggcgattactttttagcattataaaagctaccaacaaattaatcccaaaccctagtaaagctacacctaacattggcaaagcggctatttctatcggagcctgccaacgtgttacagcctcaataaaaatccaaatagcgacccaaactaatgaaattccattgattaaagctaaccatttttgccattttagacttaaaaataacccaatccatgctaaaaaaatagataaactatcatttgccatatgcccagcatcagccatcaaagtaaggctgttaaaccaatatccccctagaaattcaacaaccatataaaaggtaataattgcaaaactgatgcctaataccattttatttttagaaatttgactatgagggcaagatgcatgctgctgatattctttaggagtataattttttactagagaaacttctttcattttatttccttaactatttgatttgaaagaagcataaaacctgtagtaactacaaagtcaaatcataaaacttacatttaataaaattaattatttaaaaaaagctaaattatagagatttcaataaaaattcatttttatctgtggataactcataaataatctgtcataaaactgtttttactcacttgataactttgagaaaaaataaagttgttaataactttccattttacacacaagatttttaaagaaaatgatcgcattttcacaagatctttagatcctataacaccagtttccgtaaggatctaataagtttactcacaattacaaaggatcttaatagtaacaataataagatctttatatataaaaaaagagatcttatttactaatacaaacctgatctttcaaaggatcaatagatccattctttttttgtcaggtgttttaaatttctgtagaataacgccaattttttgatccgaataaatagagatagatatgttttacactgaaacttatgatgtgattgtgatcggtggtggccatgcgggtacagaagctgcgcttgcaccagctcgaatgggattaaaaacccttttattaacacataatgtagatactttagggcaaatgtcttgtaatcctgcaattggtgggatcggtaaaggtcatttagtaaaagaagtagatgctatgggtggtttgatggcgcatgctgcagataaagcaggaattcaatttcgtactttaaatagtagtaaaggtccagcagtacgtgctactcgagctcaagctgacagagttttatatcgtcaagctgttcgtacagcattagaaaatcaacctaatttagatattttccaacaagaagcgacagatattctaattgagcaagatcgagttacaggcgttagcacaaaaatgggattaatttttcgtgctaaatcagtggtattaactgcaggtactttcttagccggtaaaattcatattggtttggaaaattatgaaggtggtcgtgctggagatcctgcttctgtaaatctttcatatcgattaagagatctcggattacgtgtagatcgccttaaaacaggtacaccaccacgtattgatgcacgcacgatcaattttgatattttagctaaacagcatggtgatgcggtgttacctgtattttcttttatgggatcggtatctgatcacccgcaacaaattccttgttatattactcacaccaatgaacaaactcatgaagtaatccgtaataatttggatcgtagtccaatgtatactggtgtaattgaagggatcggtccacgttattgcccatctattgaagataaagtgatgcgttttgcggatcgtaattcacatcaaatctatttggaaccagaaggattaaccagtaacgaagtgtatccaaatgggatttctaccagtttgccgtttgacgtacaaatgggcattgtgaattccatgaaaggtttggaaaaagctcgcatcattaaaccgggttatgccattgaatatgattattttgatccacgtgatttaaaaccaacgttagaaacaaaagctatttcaggtttattcttcgcaggccaaattaacggtacaaccggttatgaagaagcagcggcacaaggcttattggcggggattaacgcaggtctttatgtacaagagaaagaggcatggtatccacgtcgtgatcaatcttatactggagtattggttgatgacctttgtacgctcggtacgaaagaaccgtatcgtgtattcacttctcgtgctgaataccgtttgttattacgtgaagacaatgcagatattcgtttaacgccaattgcccatgaattaggtttgattgatgaggctcgctgggcacgctttaatcaaaaaatggaaaagattgagcaagaacgccagcgcttacgcagcatttggctgcatccgcgttctgaatatttagaagaagccaataaagtgcttggcagtccacttgtgcgtgaagccagcggtgaagatttattacgccgtccagaaatgacctacgatattttgacttctttaacgccatacaagcccgcaatagaagatagagaagccgtagaacaagtggaaattgctattaagtatcaaggctatattgagcatcaacaagaagaaattgaaaaacaaaaacgccatgaaaatacggctattcctgctaattttgattatagtaaagtgtctggattatctaatgaagtacgtgcgaagttagaacaacatcgtccggtttccattggacaagcgagccgaatttcaggtataacgcctgctgctatttcaattattctggttaatttgaaaaaacaaggcatgctaaaacgtggggaataaagttttttattaaaaaacaaaagtgcggtaaattttaatctagttttaagcctagagtatattgtttaattattgacaataaagcgtaaaactattaaaattcgccgtctatttctatatggaagtagattttttgaacaacattctattattgaataacatttaaactggagcttttttaatggcaactatcaaccagctagtacgcaaaccgcgtgtgaaaaaggttgtaaaaagcaacgttcctgcattagaggcttgcccgcagaaacgtggtgtatgtactcgtgtatatactacaactcctaaaaaaccaaactcagcgttacgtaaagtatgtcgtatccgcttaactaacggttttgaagtaacttcttatattggtggtgaaggtcacaaccttcaagagcacagtgttgtattaatccgtggtggtcgtgttaaagacttaccgggtgtgcgttaccacacagtacgcggtgcattagactgtgcaggcgttaaagatcgtaaacaaggtcgttctaaatacggcgttaaacgtcctaaagcttaatggttctccgttaagtaaggccaaacgtctaaattagcaaaacaatttaaaccataaactccagtcaaaagcgctttgcgctgcaaattttctcaatgagaaatattgctgatgggttttggatatcctgaagattaaaatacggagaaattcgcaatgccacgtcgtcgtagtgttgaagcacgcaagattcttccagatccgaagttcggttcagaattacttgcaaaatttattaatgtaatcatggtagacggtaaaaaatccgttgctgaatcaatcgtttatggtgctttagaaactttagcacaacgcacaggtaaagagcctttagaagcgtttgaagttgcacttgaaaacgtacgtccaactgttgaggttaaatctcgtcgtgttggtggttctacttaccaagtaccagttgaagtgcgtccagtacgtcgtaacgcattaggtatgcgttggatcgttgaagcagcacgtaaacgtggtgacaaatcaatggctttacgccttgcaaacgaattatctgatgcttcagataataaaggtgcagcagttaaaaaacgtgaagacgttcaccgcatggctgaagctaacaaagcatttgctcactaccgttggtaataagtttttgaatttaaagggcttcatcattgatgaagccttacccttatataaactgatattaaataaacaaggttataataatggctcgtacaacccctattgaaagatatcgtaatatcggtatcagtgcgcacattgatgcgggtaaaaccactactactgagcgtatcttattctatactggtgttagccacaaaatcggtgaagtgcacgatggtgcagcaacgatggactggatggaacaagaacaagagcgtggtattaccattacctctgcggcaacaactgcattctggtctggtatgtcacaacaattcccacaacatcgtatcaatgttatcgatactccgggacacgtggactttactgttgaagtagaacgttctatgcgtgttcttgatggcgcagtaatggtttactgtgcggttggtggtgttcaaccacaatctgaaaccgtatggcgtcaagctaacaagtatgaagttccacgtattgcgttcgtaaataaaatggaccgtactggtgcgaacttcttacgtgttgttgaacaattaaaaacccgcttaggtgctaatgcggttccacttcaacttccaattggtgcagaagaaaacttcactggtgtagttgatttgatcaaaatgaaagcgatcaactggaatgaagcagaccaaggtatgactttcacttatgaagaagtgcctgcaaatatgcaagcagactgtgaagaatggcgtcaaaatcttgttgaagcggcagctgaagcgtcagaagaattaatggaaaaatacttaggtggcgaagacttaactgaagaagaaattaagtcagcattacgtcagcgcgtattagcaaatgaaattattttggtaacctgtggttctgcgttcaaaaacaaaggtgttcaagcaatgcttgacgcagttgttgaatacttaccagcaccaactgatatccctgcaattaaaggtatcaacccagatgaaactgaaggtgagcgtcatgcaagtgatgaagaaccattctcttcattagcatttaaaattgcaactgacccatttgtaggtaacttaacattcttccgtgtatattctggtgttattaattctggagatacagtattgaattctgtacgtcaaaaacgtgaacgttttggtcgtatcgtacagatgcacgctaataaacgtgaagaaattaaagaagttcgtgcaggtgatatcgcagcagctatcggcttaaaagatgtaactactggtgatacattatgtgcaattgaagcaccaatcatccttgagcgtatggaattcccagagccagtaatctctgttgcggtagaaccaaaaactaaagctgaccaagaaaaaatgggcttagcattaggtcgtttagcacaagaagacccttcattccgtgttcacactgatgaagaatctggcgaaaccattatttctggtatgggtgagttgcacttagatatcattgttgatcgtatgaaacgtgagttcaaagtggaagctaatattggtaaaccacaagtatcataccgtgaaactatccgtactcgtgttaatgatgtcgaaggtaaacatgctaaacaatctggtggtcgcggtcaatatggtcatgttgttatcgacttatacccattagatccagaaggccctggttatgaatttgtaaacgaaatcaaaggtggtgtaattcctggtgaatacattccagccgttgataaaggtattcaagaacaacttaaatctggtccattagctggttacccagtagttgatcttggtgtacgtttacacttcggttcataccatgatgtggattcatctgagttagcatttaaacttgctgcgtctttagcatttaaagcagcattctcaaaagcaaacccagtattacttgagccaattatgaaagttgaagttgaaactccacctgaatatgttggtgatgtaattggtgatttaagccgtcgtcgtgctatggttaacggtcaagaagcgaacgagtttgttgttaagatcgatgctgaagttccactttctgagatgttcggttatgcaacagatttacgttcacaaactcaaggtcgtgcatcatactcaatggaaccgttaaaatatgctgaagctccaacaagtgtggcagctgcagtaattgaagcgcgtaaaaaataatttttgtaaaccagcggtgtaaaatatgattgttttataccgcacttcttaggaaacattagcaatgtctaaagaaaaatttgaacgtacaaaaccgcacgtaaacgtgggtacaatcggccacgttgaccacggtaaaacaactttaacagcagcaatcacaaccgtattagcaaaacactacggtggtgcagcgcgtgcatttgaccaaattgataacgcgccagaagaaaaagcgcgtggtattaccatcaacacttcacacgttgaatacgatacaccgactcgccactacgcacacgtagactgtccgggacacgccgactatgttaaaaatatgattactggtgcggctcaaatggatggtgctattttagtagtagcagcaacagatggtcctatgccacaaactcgtgaacacatcttattaggtcgccaagtaggtgttccatacatcatcgtattcttaaacaaatgcgacatggtagatgacgaagagttattagaattagtagaaatggaagttcgtgaacttctatctcaatatgacttcccaggtgacgatacaccaatcgtacgtggttcagcattacaagcgttaaacggcgtagcagaatgggaagaaaaaatccttgagttagcaaaccacttagatacttatattccagaaccagaacgtgcgattgaccaaccgttccttcttccaatcgaagatgtgttctcaatctcaggtcgtggtactgtagtaacaggtcgtgtagaacgtggtatcatccgtacaggtgatgaagtagaaatcgtcggtatcaaagatacagcgaaaactactgtaactggtgttgaaatgttccgtaaattacttgacgaaggtcgtgcaggtgaaaacatcggtgcattattacgtggtaccaaacgtgaagaaatcgaacgtggtcaagtattagcgaaaccaggttcaatcacaccacacactgacttcgaatcagaagtgtacgtattatcaaaagatgaaggtggtcgtcatactccattcttcaaaggttaccgtccacaattctatttccgtacaacagacgtgactggtactatcgaattaccagaaggcgtggaaatggtaatgccaggggataacatcaagatgacagtaagcttaatccacccaatcgcgatggatcaaggcttacgtttcgcaatccgtgaaggtggccgtacagtaggtgcaggcgttgttgcgaaaatcatcaaataatagatgaactcttgaatgtcttaaagataaaagacagaagaagtaaaaagaaaagtgcggagaaaattctccgcatttttttattctatatttgataattcgtttaaatatttattaagttaatagattttagataataagtcatttatttgattcctagaacaataaatacattgctccttataaatgacacttctataatttttaattaattggcattaatcaaataaactactatgttatgtccactcaaatttcacttacgctattttttccataagaaattacgtcaaacatacagaatttcccacaaaagtttagaatttatctgcctaatcataggcatggcttgcctgacttggtttacgaaaaaatatactccatatgttggaggaagtggtattccacaagtgattgcatcaattaatcttcctcatagtagctataaaaccaaattagttgaattcagccaaactatttggaaaattcctcttacctttttggctatgcttatcggtgtatcagttgggcgtattagctactggttttattcttgtcgcgattcaaggaaacagcccttattttccacgttatcaaggggcaacatcggtttcttgtctctatctttggcttgcaatttgtggggtgggttatggcattctaggtggcatatttggacgattattagcaaaaggtatcgcaggattatcacctgaaaaatggcgtggctgggttcgccaacatcctatttatattgctttattattgggtttagtgcttgccgcactgttggagtggaaatgacaggcgcgcaactcgttctcatttggctcttgatttccagcattattgcatccataatctcgcgccaatttagtcctaaaccattttaccactttgctgcaggccgttttcgccagcaaatgcaagctcgtcaagccgaagaattacgcagcaaaaccaaacaagagaaataaaaatgcctcaaaatctaccgcacttttaccgcggccgtttttctgttgcgccaatgttagattggacaacacgccattgtcgttattttcatcgccaattttcaaagcacgcattactttacaccgaaatggtcactgcgcctgcgattatccatgccaaatacgatcacttggattttgatttacaagaaaatcccgttgcgttacagctgggaggaagtgatcctgaacaactcaaatattgtgcaaaacttgctgaggaacgaggttatcacgaaattaatcttaatgtaggatgcccttctgatcgcgtacaaaatggaatgtttggcgcctgcttaatggcgaaagcagatttggtggccgactgtgtagaacaaatgcaaagtgcggtcaaaattccagtcacagtgaaaacacgtattggtattgatgaattagacagctatgaatttttatgtgattttattgagaaggttcaaggaaaaggttgccaagagtttattatccatgcacgaaaagcttggctttcagggttaagtcccaaagaaaatcgagaaattccaccattagattatgctcgagtgtatcaactaaaacgtgattttccacatctaactatcgcaattaatggcggcataaaaaccattgaagaaatgaaacaacatttgcaatatgtggacggcgtgatggttgggcgagaggcctatcaaaatccaagtttacttgggcaaattgaccaagccttatttgatcctaacgctgcaattgttaccgctcatgaagcggtacagtcaatgcttccttatattgaacaacaacttaaccaaggaatacaccttaatcatatcgtccgccatatgctaggcgcattccaaaattgcaaaggtgcccgtcaatggcgacgctatttaagtgaaaatgcgtttaaacaaggtgcgggagttgaagtaattgaaaccgccttaagctttgtagaacactaatcacaaaataagccgcaaaagtgcggcttatttttcagctgtttttcttacgcaatacgcatttgaaaaatcaccaattcagcttggcaacagaaagtgaaatctgcctttaataaatagccatcatccagttttgtaatttcagattgaatttcacaaggttcactttctacatcacgcgctttctgagtaaaaaatgcgagtgcttcttgcgcttgttcttcactgtcataaatatattcaataacctgactacaatcacgattatcgaaaagtgatttcatatcaaatgtgttacaacctacacattcaatcggtttttcagtttgaattgccataatattatcccttttattcagattattttgcagcaacaaaacctacagcttcatacactttcgccaaggtttcttgtgcttttgcacgagctttttccgcaccttgtcgtaagatattatctaataaagtttcatcattgcgatattgatggaaacgttcttgtaaaccagcaagtaaagttgagacttcatccgctactgcagtttttaaatgtccgtacattttaccttcaaattctttttcaagatcagcaattggcttatccgtaaccgcagaaagaatatctaaaagattagatacccccgctttattttgcacatcataacgaacaacaggcggctcatctgaatccgttacggcacgtttaattttcttcgccacagattttggatcttctaaaagtgtcactacattgttgcggttatcatctgattttgacattttcttttcgggatcttgcaatgacataatacgcgcgcctgcttttccaatgaaaatttcaggaatagtgaaaatattgccataaagcgcattaaagcggtttgcaatatcacgcgtaatttctaagtgttgtttttggtcatcgccaacaggcacgctttttgcttgataaagtaaaatatccgccgccattaacacagggtaatcaaacaaacccacgttaatattttctgcataacgcgctgatttatctttaaattgagtcattcggctcatttcaccgaaataggtgtaacagtttaacacccagcttaattgcgtgtgttctggaacgtgagattgaacaaaaatagtacttttatttggatcaattccgcacgctaaataaagtgcaagcacatcaagcgttgctttacgaagggcaacaggatcttgacgaacagtgatcgcatgtaaatcaactacgcaaaaaatacattcataatcttcttgcattttcacccagttgcgcaacgcacccaaataatttccgatagttaattcaccagaaggctgcacgccactaaaaacaattggttttgccataatcaatccttaataccttaaaactgttcacacatcatatcagaaactctaggcttttttaatgttcgagttcaaaagctaggttaaaaatgctatatttaacggaaacgttttcctaatatttactaatgaaaaactaccacgatattgttcttgcccttgctggcgtgtgccaatcagcaaaattggttcatcaacttgcaacagaaagtcgagcagattcagatacatttttaaccgcacttaatagccttttcattacccaaccacaacgaattgaagatgtttttggtggcgaagttcgtcatttaaaattaggtctagaaaccttaattcaccagctcaacgcgcaaggcgatcaaaatttaactcgctattggctaagccttttagcattagaaggaaaattatcgaaaaactccgatgccaaacaaacattgggcaatcgaatttctcgcctaaaagaacaagaaattcattacgctcgcgatagtgaaacaatgttatctattatggcaaatatttacagcgatattattagcccattgggtaaaaaaattcacatcctaggctcgcctgattatttgcgacaagaactcgtgcaaaataaaatccgtgcagttttacttgcaggcattcgctctgccgtgctgtggaaacaaatgggcggaacaaaatggcaaattttatttttccgcagaaaattacttgccaccgcaaaacagatttattcttctatttattaatacaattctggagtaaacatttatgcaactctctacactgaccgcactttcccctcttgatggtcgttatcaagataaagtaacgccattacgtgctatttttagcgaattcgggttaatgaaattccgtgtagttgtggaagttcgttggttacaaaaattagcttcaacggcagatattaccgaagtaccgccattttctacgcaagcaaatgcttttttagatggaattgtggctaattttaatgaggccgatgctgcgcgtattaaagaaattgaacgcacaactaatcacgatgtgaaagccgttgagtattttctgaaagagaaaattcaaaacgaagtggaactagtgaacgtttctgaatttattcacttcgcttgcacctcagaagacattaacaatctctctcacgcattaatgttaagcaccgctcgtgacgaagtgattttaccagaatggcaaaaactgattgatgaaatcactcgtcttgcagaagaatataaaacgattccattactttctcgcacacatggccagccagcttcaccaagcaccgtgggcaaagaaatggcgaatgtcgtttatcgcctaaaacgtcaatttaaacaactccaaaatgcggagatcttaggtaaaatcaatggtgcagtaggtaactacaatgcgcatttatcggcatatcctaatattgattggcataaattcagcgaagaatttgtcacttcattaggtattcaatggaatccttataccacacaaattgagccgcacgattacatcgctgaattttttgatgctgtagttcgctttaataccattatcattgattttgatcgtgatttatggggatacattgcattaaatcactttaaacaacgaactatagcaggcgaaattggttcttctaccatgccacataaagtcaatccaattgattttgaaaactcagagggcaatctaggattagccaatgcagtgatgacccatttaggtcaaaaattaccaatttctcgctggcagcgtgacttaacagattcaaccgtattacgtaatttaggcgtaggattaggttattgtttgatcgcttatgcttcaacacgcaaaggcatgagtaaacttgaagtaaatcaaccgcacttattagaagaactcaatcaaaactgggaagttttggctgaaccaattcaaaccgtaatgcgtcgctacggaatagaaaaaccttacgaaaaattaaaagaattaacgcgaggtaaacgagtgacagaacaggctatgcgtgaatttattgataagttggatattccacaagaagaaaaattacgtttacaaaaattaacacccgctacttatattggggctgcagtggaattagtagagaagctatcataggaatttggctctttttccaacaatattctttacaagaacatagcttttctctataatcctgcgcctgtgttagtcaatctaacaaatttctggttggtgcttgacctattcaagccccatccaagaccgtaggggagtaatcttaattatcctacgtagatggtgaacagaataagaatttttcttgcttctgggcgccgaagtcatcctaatcttaggattaggtaaattaattccgagtaatcggagtgtattcaggagctaaaagccaatggcattaaatcttcaagacaaacaagcaattgttgctgaagtaaatgaagcagccaaaggtgcactttcagcagtaatcgcggattctcgcggtgtaactgttgagaaaatgactgaattacgtaaatcagcacgtgaagctggcgttacaatgcgtgtagttcgtaatactttattacgtcgcgcagttgaaggcacagattacgaatgcttaaaagatacgtttgtaggtccaacacttatcgcgttctctaacgaacacccgggcgaagctgctcgtttgttcaaagagtttgctaaagcaaacgataagtttgaaattaaaggtgcagcctttgaaggtaaaatccaagatgttgaattcttggcaacattaccaacttacgaagaagcgattgcacgtttaatgggcacaatgaaagaagctgcagcaggcaaacttgctcgcaccttcgcggcattacgcgacaaattacaagaagcagcttaatcattaagcgtttcttacttcatctaactttatttattttaggaattgattgttatgtcattaactaacgaacaaatcattgaagcgattgcttcaaaaactgtaactgaaatcgttgaattaatcgcagcgatggaagaaaaattcggtgtttcagcagcggcagcagtagcagcagctccagcagcaggcggcgcagcggcagcagaagaaaaaactgaattcgacgttgtacttaaatctgcaggtgcgaacaaagtagcagtaattaaagcagtacgtggtgcaactggtttaggcttaaaagaagctaaagatttagttgaatctgctccagctaacttaaaagaaggcgtttctaaagaagaagctgaagcacttaagaaagaattagaagaagcgggtgcagaagtagaagttaaataattctattttaaccactttaaaattcaaaaaaccgatgggaaaccatcggttttttcttatataaaagtttgttatagcttttacttaaaaacttaccatttgctatctttctaagatagaatattacccgtttttattgatgaataaagagaaaatttatgacaaaaaaagcattaagtgcggtaattttagcagctggaaaaggaacgcgcatgtattccgatttacccaaagtgctacatacaatcgctggtaaaccaatggtaaaacacgtgattgatattgcccatcaattaggctcagaaaatattcatttaatctatggtcacggtggggacttaatgcgtacccatcttgcaaatgaacaagtaaactgggtattacaaacagaacaacttggcacagcacatgcagttcaacaagcagctcctttttttaaggataacgaaaacattgttgtactttacggcgatgcaccattaattactaaagaaacattagaaaaattaattgaagcgaaaccagaaaatggcattgcattgcttaccgtaaatttagataacccaacaggctatggacgaattatccgtgaaaatgggaatgttgtagccattgtagaacaaaaagatgcaaatgcagagcaactaaatattaaagaagtcaatactggcgttatggtatctgatggtgcaagtttcaaaaaatggctagctcgtgtaggtaataataatgctcaaggcgaatattacttaacggatcttattgctctcgcaaaccaagataattgccaagttgttgctgtacaagcaacagatgtcatggaagttgaaggcgcaaataatcgcttacaattagccgcacttgaacgttatttccaaaataaacaagcctccaaattattacttgaaggcgtaatgatctacgatcccgctcgttttgacctacgtggaacattagagcatggaaaagatgtggaaatcgatgttaatgttattatcgaaggtaatgttaaactcggtgattgcgtaaaaattggcgcaggttgcgtattgaaaaatgttgttattggcaatgatgtagaaataaaaccctattcagtgctagaggattctatagtaggagaaaaagccgcaattggcccattttctcgtttacgcccaggtgcagaactcgcagctgaaacgcatgtcggtaactttgtagaaattaaaaaatctaccgttggtaaaggttctaaagtaaatcatctaacttatgttggcgattcagaaatcggctcaaattgtaatattggagcgggtgtcataacctgcaactacgatggtgcaaataaatttaaaacgatcatcggtgatgatgtgtttgtgggatctgatacacaattagtcgcgccagtgaaagtcgcaaatggcgcaactattggtgctgggactacaattacacgtgatgttggcgaaaatgaattagtgattacaagagttgctcaacgacatattcaaggttggcaacgaccaataaagaaaaaatagaataaaaaatcctacgtattatcgtaggatttttttataaaccaattttacaaatcgtaattaaaatcacataaaaaatgaccgcacttaatgttaataatttatttgctagtttaggtttatgttgatgaagacggtatagcattctagctgtaacagctagaataaagggataaacccaaaaaagcgttgaaaataaattgatttgccagcttgatagatagggatttttactaaatgctgtagaaattaataatgccattggacacaataatataggcgaacaaaaggcagcaagaccccaagcaaatggactaaatttagttggtaaagattgttttttcatattttaaataattaaaaataaatagatacaagaaagaaatataataaatatgttgaatagtaaagaatattttaatgaaagtaacaatgtagaaatggcgcacccgaaaggattcgaacctttgaccgctcggttcgtagccgagtactctatccagctgagctacgggtgcgtagatgatgctttaattattcataaccactttaataagatagagccgttttaaaaatggcgcacccgagaggattcgaacctctgaccgctcggttcgtagccgagtactctatccagctgagctacgggtgcagaataaataaaacaaacaatggcggtgagagagggattcgaaccctcgatggagcttttaaccccatactcccttagcaggggagcgccttcagcctgctcggccatctcaccacaatcagtgtgagcggtataatacgttttttagaaaatatgtcaaaccattttttgaaaaacacctttgtttgaatattttatctacacattaaatctatttttgagtgaaaagctactaattatttaaaaattctaatattttaaagattgtttcctttcttaatttgtcctgttcaaatagaatttcgtgtttagcattgaatacaacttcacatctagcattcggaaaaagtacggttaatttttcaagattgttgttatctactattttttctttttcggcttgtaaaattaggattggaatttcaatcttaggaataactttcggcaagcgtttaattgcgttcaaacacaaatgtacccaacggaatgttggcccgccaagattaattgctggatttttacgatttacacgattcatccatttcattctggttttacagaaagttaattcattgtattccaagtgggcttgttgataaggccctttaccaaaaacataacgctcgccttgtcctaaaatattcattagggcaataatcagttcatctctaatgggatgttttaaaagaataccgtaaaaaggcgaagaaagtaccgctttattaatgtgatgatcataatttgccaaataataggttgcaatcaatgcgcccatcgaatgagcaagcaaatgctgcgttgaatagctgaaaagtgcggttactttttcgatgattttcgccatatcatcaacatagaaacgaaattcgtctaaatgccctttttgaggaataatacgctgtgaatagccttgaccgcgatgatcaaatagcaatacatcataaccttgatgataaaaatcataagcgagctctgaccatttcaacatattttctgcacgaccatttactaaaatcatcaattttctgaccgcactttcaggttgaatcaaatgacgataagctaattttatatttcgtttaccagaaagatattgggtaggaaattgctcaaaaaaaggcaataattctgcaagagcaaattgatgaaaataaggttctctgatcataattttttaatgaaaagggcgtagtaaatacgccctttgtagtgaaagtaaacttacgccaccaattgttttaagatacggcgaactggctctgccgcaccccataataattggtcacccacggtaaaagctgccaaatattcaggccccatagccaatttacgtaaacgccccactggcacgcttaatgtacctgttactttcgctggcgttaattcacgtaatgtggtttctttgtcatttggaattacttttacccattcattatgtgatgcaataatttgttcgatttcttctaatggtaagtcttttttcaatttaatggtaaacgcttggctgtggcaacgtaatgcaccgatacgcacacataaaccatcaacaggaattggattgtcgcttaaacctaaaattttgttggtttctgcataacctttccattcttctttagtttgccctgtttcaggaagaagtttgtcaatccaagggattaagctaccgcccaatgccgcgccaaagttatctgttgggaagttatcagcacgcatttttgccgtcactttacgttcaatatctaaaatagatgaagcagggtcttttaattcacttgaaactgcttgttctaataaacccatttgtgaaagtaattcacgcatattttttgcgccagcacctgaagccgcttggtaagttgccacagaaatccattccaccaaatctttttcaaatagaccgccgatagccataagcattaagcttacagtacagttaccgcccacgaaagttttaatgccttttttcaaaccttcagaaatcacgtgttggtttactggatcaagcacaataattgcatcatctttcatacgcaacgcagaagcggcatcaacccaataaccatcccagcctgttgcttttaattttggatagacttcattggtgtaatcgccaccttggcaagtcacgataatgtctaattttttaagttcttcaatatcgaatgcacttttcaggtcgcctgcatccttgccaccaaaaacaggtgctttttgacctgcttgtgaagttgtaaaaaatacgggattaagatttgcaaaatcattttcctgcgacatacgatccattaatacggaacccaccatcccgcgccagccgataaagcctacatttttcattgttgtttccttagtttgttgtgcttgaatagcattattaattacaagatagcgttagcaaaatcaagtatttttaatgaaaattgatcttttgtgaaagaaattaaataaaaaataaaaaagtgtggttaatttaaaagaaaatttaatttaatcactctttttctagttatctacttcaacacttattacgccatcttctgctttaagtaaagcatacgcatctttcaacattgtggaatcaatggaaaagcaacgaatttgtaaccgcacttctccactactttgatctttgacttgtatatgttcaatacgatactgattatttactaacaattgggtaactttccctatgctttccgcatcattgacaagaatattgaatttcgtccgacgacgttgtgatttacgatgaacccaacgttgaaccaacggacttaatcgaatagacaccaaaatcatcacagtggcgatgaccgcatcaaacacgaaacccgccccagcagcaataccgatccccgcagaagcccaaataatcgccgcagtggttaaacctgaaatcgcatcatttttcttatgcaaaatcacaccagcacctaaaaaaccgatgccactaatcacttgagccgcaagacgcattggatctgtacgaatattttctgaaacttgtgcataatgctctgcggcttgaattgaaacaatggttagcacacaagtggtaacggcaataatggcacaagtttttacacccacaggtttacgtttaagttcacgttctaagccaataacactgccaagcaccatcgctaatagcattttgctaaaaataattaagtgatcaggattgaaaagtgcggttaaaagtaaagatgaattttccatagtgataaaaataagtcagacatactcgtctattctacatcacttagcttaaaatctttacccttccaagcctttaatttatcgcctttcttgcgaaaattgagtaaaatcttgcgtttgaaattttatagagcgaaaacggttatttttatgcaaaattcaaccccaagcattggctttgtaagccttggttgcccaaaaaacttggcatttgggttcgcttacattatgtgtatccctatccccatgtggatgatttaattccattaatggctgacggtacgctattgccgtatttagacattccattacaacacgccagccctaaaatcttaaaagcaatgaaaagaccaggcagtattgaccgcactttagaacgcattaaacaatggcgtgaaatttgcccagatttaacattgcgctcaacctttattgttggtttccctggcgaaacggaagaagatttccaattattactcgatttcttaaaagaagcccaacttgatcgcgtaggctgtttcaaattcagccctgttgaaggtgcacccgcaacagatatggctgaccaagtaccagaagatgtaaaagaagaacgtttccatcgcttcatgcaattacaacaagaaatttctgcaaaccgtttaaaacaaaaaattggtaaaacccttgatgtattagtggatgaaattgacgaagatggtattattggtcgttcaaaagccgatgcccctgaagtagatgggttagtttacgtagataatttaagcggaatcaatgtcaaagtcggtgacgtgattaaagtaaccatcacaaattctgatgaatatgatttgtggggcagttgttaagtaacaacaatctcaacgaaataaacaaaaaatccatcttcgtattgaagatggatttttttattagccgaacactttttccaagtgtgcttggtagtctgctaagtattgttctacttgcggacttttaaccacatcgttacataagaatgtcggcaggcgagtcaagccgatgaactcgttgagtttgtggaaatgcatatacaaaacatccacgcctttgccttcaaagaaatcgccttcgcgagtaaaggcttcaatcggtgcattccaagtcagtgaaagcatgtgttttttgccttgcaacaagccgcctgtgccatagccctcggttggattaacgctgtgtctgccatcactgtgatataacttgccgtgcccactggttaatacttcgtctatgtattttttcactgtccaaggctcatgcatccaccagctcggcatttgccaaatcacggcatccatccacaagaatttttcgatttcagcttcaacgtcataaccagcatcaattacagtttctttgacattgtgtccaagtgcggtcaaaacttctttcgcttttttgtgaagcgaatggttcaactcgccgtgagaatgaccaaacgccttaccgccgtctaataataaaatattcatctttttgctcctaaataattataaaaaatggggttgccattatgcctttttacgttaatttttaaaagtctatttgtctgccacgttatttctagactataaggaagattacagcccgtagggaataaaccctagttaaacgcgtgggcttaagcccaccctacattggctacattagctggaattgaaagtgcggtaaaaaattggtggaaatcaaacgaaaaatgaccgcacttttaaaataaaaaatcggcagagaatttccctgccgatttttattaacttttcaaaatcgccctcaatctatcaagttggttttgtgttttttcttgtttttgctcggtggtgagttttggtttatcgcgttcccatagcacatcgtcattaggtaattcagctaaaaatcggctgggttctgggcgaactaattctccatattgacgacgctcacgacataaagaaaaagtaagttctttttgtgctcttgtgatacccacataagccaagcggcgttcttcttccacgttgtcttcatcaatgctggtttggtggggtaaaatgccctcctccataccaatcaaataaacataaggaaattccaatcctttagatgcgtgtaatgtcatcagttgaacttgatcgctgtcgtcatcgtcttcgcctcgctccaacatatcgcgtaatgtcaggcgggttaccacttgattaaggttcatcggctcattggtttcatcgccttttaacatatccgcaacccagtcaaataacgtggcgacattcttactttgcatttctgctgctttagggtttgttgcgtattcgtacaaatattcttcataatgaatcgcagataacatagaacgtaccgcacgttctggttcagaacgttgaatttcatcattaagttctacaatccaacggccaaatttttgcaatgaatcataggcttttggtgtaatgcgttgaataagttcaaactcaaaaatagcatcaaacaaactgatgtgtttttcttgagccaactctccaagtttttgtaaggttgcggtgccaatttcacgcttcggtgtattcacaatacgcaggaatgctccgtcatcatcttgatttaccaccaagcgcaaatacgccatcatatctttgatttctgcacgagagaaaaaagaagtaccgcccgaaattttgtaaggaatacggttttgcatcagtactttttcgagtaatcgggattgatgattgcctcgatacaaaatcgcataatctttatatttggttttacggctaaaacgatgggcgatcaactcggcgacaatccgctctgcttcgtgttcttcattttttgcttcgatgacaagcaatttttcccctgtaccaatggttgaaaaaagtttcttatcaaacacgtgctcattgttatcaatcaaaatattggcacaatgcaaaatacgctgggttgaacggtaattttgctctagcttaatcacgttcaaacgaggaaaatcatcgcgtaaacgcaccatattttctggtcgtgcgccacgccacgaataaatagattggtcatcatcgcccaccacagtgaaacaagcacgctcacccactaaaagtttaatcagttcatattgactggtgttggtgtcttgatattcatccaccaacaaataacgaatttttgcctgccattttgaccgcacttcttcattttgcttgaacaataatgtcggcagcataatcaaatcatcaaaatcgagagcgttgtaagctcgaatttgtgtggcgtaacgctcataacattttgcgaaagtttgatatttagcatcacgtgccaaggcaaatgcctgttttggcgaaatcaaatcgttcttccagttagaaatcactgaaattaactcgcgcaataaatccttatcttcttttaacacatcagcggttagctcttttaacaacgcaaattgatcgtgctcatcaaacaaggtcatatttgatttaaagcccaacgctttatattcacgcttaataatgtcaaaaccgagcgtatgaaaagtggaaacaagcaatcctttggattgttctttgccaatggaatgtgccacacgctctttcatctcgcgtgcggctttattcgtaaaagtgacggcggcaatttgtttcggagaatacccgcacttttcaattaaatgggcgattttattaatgattacgcgagttttgcctgaaccagcgccagcaagcacaaggcaagggcctgtcacatattcaacggcttgttgttgttgaggattgagtttcataagaattattgagcccacgcatagggcagtaatacagtgtctaataaaaatgagagaggcaaatctaagattggcaatccccattgttgcgccatttcaagatcataagcaacccctgcataggcggtatatttttctgttggatcgataagtttgaccacggaaccacaaccagataaaacgataagtgcggttaaaaaaataaaggtttttatcatcgtgcttttaacgcattgaatacaggctcaggaactagctcagcgacatctccgccatgtaaataaatttcacgcacaatggtagaagaaacaaacgcccatttttctgctggtgggaaaaacagactatctacgccttttgtgagtaaacgattaagggcggccaattgcagttcatattcaaaatctgttgttgtgcgtacgccgcgaataatggcagaaatattgtgctgtttaatcacatttgccaacaaatcagaaaagccaaacacctccacattggataaatgtgcaacagattgacgaacaagctccacgcgttcctccaacgaaaatagtggctttttacttgggctattcgccaccgccactaaaacacgaggaaaaattaccgcacttctttcaataatgtctaaatgaccgttcgtaatcggatcaaaagtaccaggataaatcacgctcgtcatacattgcgctccaaataaggttttaataaatctaacaaacgctgtaatgcccctcggttttccatcagcacttcatagccagcattgcctaaacgttcgcgggcttcttttgagtttaataaggcttctacggcgcgttctaaggaatctgcggttgaattaacttccaacacaccttgcacttccaccaacattctaaatatctcgggaaaattaaaagtatgcttgccagtaattacaggcattttaaacgcaagaggttccagtggattatgccccccgtgtttcacaaggcttccacccacaaaagcaatatcggaaatgccatacatcaacatcagttcgcccatactatcgcccaaaatcacttgggtattttcatttggtaattcatttgtggaacgacgaataaattgaaatttttcctttttaagtaaatcagccaccacattaaaacgctctggatggcgcggaacgagcaataacaataaattcgggtattttgctaacaaagcgcggtgagattttaaaatgatttcatcttctccattatgcgtgctggcagcaatccatattgggcgatcttgtttccaaagcgttcgcaatgaatcaattttacgtaatagttcatcattcgtattgagatcatatttaatattgcccgtgatattcaatttttcctttggatagcccaaagtggcatagcgttttccactaatgttatcctgcgctgcaatcaagctaatttgcgaccacattgtttgtaagtgcgcttttatttttccgtaacgatgtgcagaacgcgcagataaacgtgcattagcgataacaaatggaatattgcgtaaaaataattgatgaataagattaggccaaagttctgtttccatcacgatacataatttaggttgtacaaaattaataaaacgatggatcgaaaaaggtaaatcaagggggagataataatgaaaaacgctgtctccaaaagtggctttgacgcgctctgaacctgttggcgtaaaagtcgtaaaagtaatggataaatgcggataatcttgttgcaattgacgaaccagcggtatcgcagcaatcacttcccctacggaggctgcgtggataaagattccttgtggtggtggacaaggcacattgccataaaaaccataacgttcagccaaacgctgacgataacgtggagatttaacactgagcaagccaataaaacacaatatcaacggctggcaaattaaaagcaagctggtataaaaaaaacgccacataaatgaaattcggttatacttgaaaaaatttcggctagtatagcaaaaaaaggattgaaaatatgcctacaattagcgttgcgatgattgtaaaaaatgaagcacaagacctcgccaattgcttagacaccgtaaaagattgggtggatgagattatcattctagattctggtagcacagataacactaaagaaattgcgctcagttatggggctaaattctatgaaaatagcgactggcaaggatttggtaaacaacgccaattagcccaacaatatgtaaccagtgattatgtactctggttagatgctgacgaacgcgttacgcccaagttacaacaggctatcttaagtgcggttaaaaatgatcgagaaaataccgtttatgaaattccacgagtgagtgaagtatttgggcgtgaaattcgccattcaggctggtatcccgattatgtagttcgtctctatcgcacaaactatgcgcaatataatgattcacttgtacatgaaaaagtggaatttccagctggcacaaaagtagaaaaattgacaggggatttagagcatttcacttataaaagtattcatcattatctagtgaaatccgcaggttatgccaaagcctgggcagaccaacgccaagctaaaggaaaaaaagccacactttggcaaggaatttcgcacgcgcttggttgttttgtgaagatgtatttgttaaaagcgggttttttagatggcaaacaaggatttttattagcggtgttatcagcgcattcaacctttgtaaaatacgccgatttatgggagcgagatcagcataaacactagcgagttttgcaaggacaatcatttaaatgatcgtccaccagccccatagattgcataaacgcatagcacgtggtttcgccaacaaagacgaaaccacgtttttttaaggcttgagaaagtgctttcgatacttctgttttagttggcacagatcgcaaatcaggcacatcattgacaatcggtttatgattcacaaatgaccaaataaaattactgaaattttcaccgcacttttccattgccaaataagctttcgcatttttgacaatggcttctaacttggctcgatggcgaattaatcctgaattttgcatgcaagcatcaatatcaagtgcggtcatttttgcgatttttttcggatcaaattgatgaaaggctgcacggtaagattcacgttttttcaaaaccgtaatccacgaaagtcccgcttgctgcccttccaaacaaattttttcaaatagcttttggctgtcgaattcaggctttccccattccttgtcatgataatcaatataaataggttgttcgccaacccaagggcatctggttatttgttgcatattaaaacttgacaaaataaaacattttgatatattccgagccaagtggatcgagggtgcttggtcggcgttatagcttcagtgagtttcattgaggcttttcgctttttagggctaagggaaatgtttcagtcctttttgatcaaaattttcccccagtatttttcttccaccttcacaataaaatttctttttaaggatctcaaaggctcgatttggttgattactatctaaaatatgtctcccgataggtcttgccactaaatccgcaacttgcaaccccacagaattaatttgttttggcacaatctttacttgaaaaggcaaggactttttaaatttattttgtccatcacaaatacgtaaaaattccagctctaactctctatcctcattacgtccacggctttccacggcaacaaaagtgattttatcttcttgatgcttttcacaaacaaattcgtatagggtttctaaacaatgtttgagtgaaaaatgataagggtgtgttgtttcattttgtggcgtttttcgcttatcaatcacacaggcagcaagaataaaattagtattttcaataatagatgaaatacgttccataaaaccttcacgctgttcacgagaagtgaaaatattaaaatcgcctttttctttgcggatttcatgctcatgcaatatcaccatatcatgaccaaaataatcaaattttatcttctgtatctgtggaacaatattatttcgataatggtctttataaaaaatacagaatgcaagtacaaacacaggatagtttttatcaattgactgtaaactgtgatctccactttcatcgacatacaccataaaatcgctgtatttattttccattgccaattaccttattttaattgctcataaaccgcgacaaaatctggcattacgcctcgccataaatggaaagaatgtgctgcttgcgcgactaacattccaaagccatcgctaacattggttaaacctaaacttttgcataatgcgataaatggcgtgtctgtgcctttcgcatattgcatatcgtaaaaagctaagcctaattttaaaatttcaacatcaactggagcagttccaccacttaatccagcggaagttgcattaatcactacatcataggtttgtagtggaatcgaatccatagagacagcttgaatattgccgtaaggctgaaatctttcagctaattctttggttttcgaaaaagtgcggttagcaagcacaatgttttgttgagcttgtaaaagtggcaataatacgccttttgttgctccgcctgcccccaagattaatacgtgttgatttggacgaagccaatttaaacgctccaaatccgtcactaaaccaatcccatcggtgttatccgcataaagttttccatcatcgagtttttttagcgtattacaggcttccgccaattttgctcgttggctatattcgtctgccagttgataggcacgttctttaaaaggcgaagtaatattgcaacctttcgcaccctcctcaaaaaatgccaaaagctgttgttcaaaagaatcaagattgcctaattttgcgatgtattccatagtttgatgggtttgcgcggctaactgacgttgaattaatggcgatttactttgcgtaatcggattgccccatacagcataaagatccataaattatccctgtctaaaaagttgatttgtgcgtaagtctcgaatttcagatggattgcgtgcatctcccacaatttcatccaatacaggaaaatctgcaccgaattgtaaccgcacttcatcggcggtacggcaaggtggctctcctgttaggtttgcgctagtcgaagttaatgcaaaacccgtgagttcacataaggctttcacagatgggtgatcgcacaaacgtattgcaatgctatcaaattttcctgtgagaaaatgcgaggtggtggatttagctggcacaatccaagtcgttggacgttcatatttaccttgcagatgagaaagctgttcatcgttaatctgctcaaaatcgacaaaaggacggaaaaaatccaagctaggagcgactaaaatcagccctttttccactggacgttgctttaaatcgagtaatttttttaccgcactttcactttgcggattacagcccaaaccaaacacagcttcagtgggataagcaaccacttgattttgtcgaagggcttcggcgatttgttctctattcatttcattcttttacttttattgctcaaaaatatgacggcaagttttatttgcacactggaaaatttgtttttccccattttcgctttttaacaaagaaagaggaaaatggcacgttgggcaaggcacggaataaggcttggcaggcaaagaaaatttacatttagggaaattatcacagccgtaaaaaatctttccttggcgaccacgacgagaaatcaaatgccccgttttacattcaggacaagtaattttttcctcagattcagattcttcccgcaccacaaaatcgcattcaggataatggctacaaccaataaacatcccaaaactgccttgtttcaactgcaataaattaccgcacttcgggcaaatttcatcaaatgtttttaatactttatgctccgatcgttgcaaaggacgcaaataatcacattcaggataagcagagcaacctaaaaacagcccttttttgccttgtttaatttgcaaaagcgcaccacattgagggcaatattcctgttgtttgctatgatgaaaaaggctttgattcataatctatccttacgcttgaagcatttcttccaattcttcctgtgcagtcatccattccgtttctacatcatctaatgctttcttcacatccacttgttgagccaaaagtgcggtcaatttttctttattttccgcattatataattcagtatctgccagttgattttctatgttcgcaagctcagaagaaaatttattcattttttcttctaattgcgtgatttttttacgtaatggtgcagtttgttggcgtaactctgcttcacggcgtttttgttccttacgattttgaaccgaattttcattatcgcccactttttccgaaactttattttcagatgtgctattttgttcattcagccatttttgatagtcttctaaatcgcctttaaattcttccacttttttatcgtgaactaaataaaattcttccacggtattgcgtaataaatgacgatcgtgcgacaccaccaccaaagaaccttcgtaatctaccaatgcttccgttaatgcttgacgcatatccaaatccaaatggttagtcggttcatcaagtagtaataaattcgggcgttgccaaacaatcaaagccaacaccaaacgagctttttctcctccagaaaaagatttcactgcttgatttactttatcgccgtgaaacgcaaaactgcctaaataatctcgaacttgttgctccgtttgttctggtgcgagtttttgcatatgccacagagcagattcgtctgcgcgtaaagtatctaattgatgctgagcaaaatagccaagctgcacgccttttgccaactgcactgtgcctgaaagtgcggtcagttctcccgctaaaagtttaatcaaggttgattttcctgcaccatttttcccgagtaaaccaatgcgcgaacctggcactaaattcagtttaattttacttaaaatttctaccgcactttctccgctgccataacctgcacttgcctgttcaatcatcactaagggattcggcaaggattgcggtggacgaaatttaaaagtaaaaggattatccacataagctggtgcaatcagctccattctttctagtgctttcatacggctttgtgcctgtttggctttagtggctttggctttaaagcgatcaatatatttttgtaaatgggaaatcttttgttgttgctgacgatacatcgctgtttgttgtgccaatttagtggctcgttgcacttcaaaggaagaataatcgcccgtgtattcgttgagcttctgattttcgatatggaggatttttgtcacaatcggatcgagaaaatcacgatcgtgagaaattaataccaaggtgccttgatattgtactagccaacgctctaaccaaataaccgcatccaaatccaaatggttggttggctcatccagtaataataaatctgatggacaaagcagagcttgtgccaaattcaaacggatccgccaaccgcccgaaaaggctttcactggctgggttgtttcttcttgactaaatcctaaaccattcaataacgaagcggcacgagattgaattgtccacgcatccaaggtttctaattgcccgtgaatacgtgcaatggcgttaccgtcattgcattcatttgcttgttcaagctcttgttgcaaacggcaatattcacgatccccttgaattacataatcaattgcagaaatatccaatgcaggcgtttcttgattcacccaagatacccgccaatttgctggataatttacctcgccgccctctggcgttaattctttttttaataaggcaaaaagcgaagattttccacaaccatttttccccaccaagccgactttttgcttaggattaatggtagcagaagcattttcgagaagctccgtttgccctcgttttaaggacagattactaaatacaatcatttttctacaataggtcttaatttgaggctattttgcaatattttttcttttctcggaacagtctattccgattttatcgattttctagtcaaaaaagccaggtataataaggtgcaataaaaactatttattgagaaaacttaatgaaaatataacaagtcaatatgaaaataatgggtatatcttaggcattttttacccttagaggcacaatcgacagggttttccctaaaggagcgagcaattttaacaacgtttcaagttgaggattcgtttgtcctttttcaatgcgtgcaatcataggttgcttcacaccgcttaaggtttcaagttgtttttgggaaatcccaagttgctggcgagaagtaatcaattctttaattaaggctacacgtaaattactttcgcggatttcttcttcattgaaaatttgctgttcaaactcattccaatttgaacctaatgggctgattttattcatttttcaatctctcttttaattcacttaagcgttgttgggttgtttggattacataatctcgaattttattcagtttaattcgactatctttgctttcattttgagccagcgatagcagatattctttcactggctcaatgtcattttggtctctgtaaaagagaatctcgtacataatttatcctatttacttatttatttcaataactaataagttattgatttttgatgtgtaagcataaatagaaactaaaaatttggcgagatagtcatttcaatctttcgatcgagatcgcaaaaatagcaaaaagaggttgattttcaaggagattttgcacaaatgccgatgtttgaacattagctttgaaagagagagtaaaaggtagatcctttcttaagaaaaagtgcggtaaaaatttaccgcacttttgattttagacaggtttaaaactcaaattgaactgacatcttataatttctacctggtgcgtagaagcggttaatgccttgacctgtcttttgatctataacattacttgtaccaaatgaacgaattgaacgcgcagaatcccaagtgatgtatttacggtttgtaagattatatacgccggctcttatggttaaatttttaattggttgcacatatccaattaaatctagaatagtataagatttactgcgccattttatgctagtgttggtttggtttttatctttcgcataaatatcataagtatcttctggatttttacttgctacgtgggtagtgtagaaattaaatccaaatttttggcttgggtggtcatagcctaagccatacaccatcgttttaggctgaattgcattcataggaatattgccatccattcttcctttttgataggtatatttatagcttaggttaaatccatccataaattttgccattttaccaaggaatacttttgaattaatttctattccttttactaccgcactatctctattaatattttgataaagagaaaatggtaatgtgctacctccgctaactaatttaaaatctttttctcctttaaatattaggtcgataaagtttttatagttggttttaaatagacttgtggagataaaaccccaatcatcattatgtaatgtaaaagcaatttcttttgtttttgctatctctggttttagattagtatttggcaaaatagtgaaatcagggtgtttaaaggtgaaatacatttcatctgaagttggtgctctaaaaccttttgaatattttagttgtaaacgaagaaaactcgttggatcaatcgttgaaacaaaactgtaagaatgtgctttatattttttgttttgtttagcgatatagtcaatattttgttgtacgtttttcttaacttcaggatcatcattattatttttaccacttggtaatggaataaacaatcctttcacaatatcatcaggtaatttcggtgtaacgccgtgtttatattttggttgataatggatattgtcataacgataacccaaatcaaaagataaataatcagttataacaacattatcaaagagatagactgatttttcttttgttttaatgggtaataagaatgaaaatttaggatcaactcgagggcaaaggttagctttccaccccccataagcggttttacaagtgtgaggtttatcatacaacaaactgtaaccaagtgtaggctctgcccaccattgcacatcagaagcatcattaccagcacgattaaccattcgcttcatcgttgtattatatgagctaccatattgtagattatgttcaacacgccaagttttgaagtctttggttaaatctaaatttaattgttgggtgttggtgtctaaatctcgctcttgccagaggcgttctaaataacctggagatgagggaagaatagagtatgttttattattcgcatcctttactctagcgaaatttttgtcatttaatttttttatttcaagttcaaagtcttttttccacgttccagtagtgccatagccataaggatgttcagtttcaaaaattttcatttttgttttatctttacaatcaaatattgaacaatcataccaagttccagaggatctccttaggcctagtttaccttctattactcgatcatcagtatcaataaatttatcgaagtcatagatgttgttatcaatatttttatcttttttttcaaattgaagttctgaaccatctcgacgtgttattttcccatctgttaattttagtcccgcaggatttgcagttccctcacaatatcttacacctgcatcacaatagtcatctgtacgtgcgcgagttttaatacgttgatctgaataagtgatttttaatgtatcccaaaatggcgtttgagagaaattttcatagctaaaggaaatattacgtctctttgttttatcattggtgtgtctagaatcaacctcgagtaaattaggatctgttttttgatattttagtgtataggataaatcttgcccacgagaacgatgttcatataaatctgctgcaagggtaaaacgatgattttctgtagggttaaaagataattttaataatgtactatcttgttcaattttgtatgggtctgctttttctctttttttaccttgagtaaggctatttgcatttttgtaatcatagttttcaagttcgtgtccatttctgcttgttgtaaccactaaggcatcaaactttttataacgtcctgcaagagtaagggtattgaatgattgattattttctgtagcgtatccctttttgtagcttacatagtaatccttgttaaggagataatctctcgcatcttttgttttataaattacagatccacctaaggaaccactaccacttttgattgaatttgccccttttgtaatatttacttcttttaaagtttcaatttctgcaccattacgcgtattattgaagttaccataaccctcaaaaagctctttaaagccttgagaagatagggtttcagcttgacgtaatccatcaatattaatcgctacacggttttcatctacaccacgaatggcaaaaccgctttgcccaaaacgcccagcttcaacaacagtaacgcccgtctcgtatttaacgatgtctttaatattgtttgcttgttctctttccagcgttttagccgtttttaccgtttcagcaatttttggtggtgtttttgtatcactattttcggtagaaccagatacattaatttgctctagttgttcagaaacattaccattttggttggttggttggttggttggttggttggttggttggttggttggttgagctgcataagcaacacctgccgttagcccaagcataacggaataggcaagcacgtttaatctaaaattggtcatatttaatcccataaaaacaaataatactaattctcaaatatattataggagaaagtattctctcacaatactaaaagtgtatttttgatcaaaatcaagaaataaaaactattctcattattttctgtatttaaacgtgcttgtttcctataatgcgagccgttgattgttgatattagtaattgtagggtgggctttagcccaccaacaaacaatcgtgagatattttggtgggctgaagcccaccctacattaagtacgcataattctttctatgcgtacttctttttattttaggagtaatcattatgatgatagataaacgtctaattaacacggtggctgacagcaaaaaatggattggtgtcacggtgttgtggaattgggtggcgttagtagttgtagggtgggctttagcccaccaacaaacaatcgtaagatattttggtgggctgaagcccaccctacattaagtacgcataattctttctatgcgtacttctttttattttaggagtaatcattatgatgatagataaacgcctaattaacacggtggctgacagcaaaaaatggattggcgtcacggtgttgtggaattgggtggcgttagtagttgtaggatgggcttcagcccaccatcaaacagtcgtgagatattttggtgggctgaagcccaccctacattaagtacgtataattctttctatgcgtacttctttttattttaggagtaatcattatgatgatagataaacgcctaattaacacggtggctgacagcaaaaaatggattggcgtcacggtgttgtggaattgggtggcgttagttggcgggattattagtgccgtcgtgttttcttatattttacaggcggcttattttcacaaattgagcctgttaagtgcggtcattttgggcatcgttttgattgcagcattggcattgcgtgcttttgcagggaaaaaatctgtgcaggcgtcttattttgccagcacaaaagtgaagcatgaattgcgtagccttatctatcgtaaattggcttctatgccgcttaaccaagtgaatcaacaatccacctcaagcattattcaagtggcatcagaaggtgtagaacagcttgaaatttactttgggcgttatttaccgcagcttttttatagcttgcttgcaccgcttaccctctttgttttcttgatttttttcagttttaaaactgccgtgattttgttgatttgtgtgccgcttatccctatgtcgatcattgcagtgaataaaattgcgaaaaaactcttggcaaaatattggtcgatttatgtgggattaggcagcagctttttagataacttgcagggtttaattacgctaaaaatctatcaagatgatggttataaagcgaaagcgatggataaagaggctgagcatttccgcaaaattaccatgaaagtgcttactatgcagcttaactcggtttcactgatggatttactcgcttatggtggcgcagctatcgggattttaaccgcactattgcaattccaaaatgcacaactcagcgtgttaggcgtgattttatttattctactttcctccgagttctttattccgcttcgtttgcttggttcattcttccatgtggcgatgaatggcaaagcggcttcagataagattttcacattgttagatacgccagtggaaacccaacaaagtgcggtggattttgaagcaaaaaataacgttcaagtggaaattaaagatctgcatttttcttatagtgaagaaaaatcagcaattacaggtttagatttgagtattttaccaaatcagcttacggtatttgtgggtaaaagtggttgcggtaaatcgaccttagtttcgttgttgatgggttttaatcaagcgcaacaaggtgagattttgtttaatggacaaaacgccctcaatattgaccgcacttctttctatcaaaaagtatcattagtaagccacagcagttatgtgtttaaaggctcgctgcgtgaaaatatgacgatggcgaaaattgatgccacagatgaacaaatttatgcttgtttagaacaagtgaatctcgcccaatttgtacgcgaaaatggcggcttagatatgcagctattaagccgaggtgcgaatttatcgggcggtcaaattcaacgtttagctttagcgcgtgctttgttacacaatgccgagctttatatttttgatgaagcgaccagtaatattgatgtggaaagcgaagaaattattttgcagtttattcaacaatttaaacaacaaaaaaccattgtgatgatttctcaccgtttggcaaatgctgtgaatgcggactgtattaatgtgcttgaccaaggcaaattgattgagcaaggcacacacgaaagcttaatggcaaaacaaggtgcgtatgctgaaatgttccaacaacaaaaagatttagaacaaattagagaggtggcaaatgcgtaaaaatggttttgttgtaatggggcatttgttgaaattagtgactccacttgcacacattatggcgtttaccattactatggggacgctcggtttccttgctgccatctttattatggtgtttggtgcaatggggttagtaaatctcttaaactttgacacccatttaagtttttctggcattttgaccgcacttatcgtattagcggtggctcgtggtgtattgcgttatttagagcaaatgtctgggcattatattgcttttaaattactcgcattattgcgtgacaaagtgttttcttctttgcgtcgtttggcttttgtgaagttgcaagataaacaagcagggcaattagtgtcattagtaaccaatgatattgaattgctcgaagtattttatgcacacaccattgcaccaattatgattgcgttctttacctctgcgattctattgttggtctttgcccatctttcaggttggtttgtagttgtcgcattagccgcttatttaacggtaggtgtgattttaccgattatcaccaccaaattggctcgtgaagatggcagacgctatcgtgaattagtcggcgaaatgaatgatttcttccttgacagcgtgcgtggtatgaaagaaattcagctttttggctatgcacaacaacgtttagcagaaatccaacaacgtagccaaaaaattgataccgcctttgaacgcattaaagaccaagaagcgaaagttcgtgtttatactgaagtggcagtatctgttttcaacatcattatgctgtttactggcttaattttgtttagcttagataaaattgatttcgctgcctttttaatcggcgttattttattaatgtcgagctatgggccagttatcgccttaagtaacctttcaagcaacttattacaaactttggcttctggcgaacgagtattaagtttattagcggaagagccagagttaaaagatgtagaaagtgcggtagatttaaaagatgtttctcgcattgatgtagagaacctaaacttcgcttacggcgaagaacaaattttatcggatgtcagcttatctgtgaaaaaaggcgaaattttaggtattcacggcagaagcggcagcggtaaaagtaccttattgaaattgctgatgcgtttttatgatccaaaatcaggtagcattaaaattaacggcgaaaccttaccgaatatcaacacttgcagtttgcgtgacaatatggcgtacattactcagcaaacctatattttcaacgaaaccattgaagaaaatattcgccttgcgcgccgtgatgcaaccttagaagaaattatggaagcggcgaagaaagcctcaattcatgattttattttgagtttgccacaaggttatcaaacaaaaatgaccgaattgggcggcaatctctctgacggtgaaaaacaacgtatcggtattgcccgagcattcttgcataatgcaccgattatcttgcttgatgagccaaccagtaatttggatagcttaaacgaagcaatgattttgaaatcattactcgatgctaaagctgagaaattgattattctcgtcagccatcgccaatctaccatggctatttgcgatcaggtaattggtatagaaaacggcagaatgtcctaaattaatataagaaaaaatcgcactgttaaaggtgcgatttttttgttggagagaaaaagtgcggtgaaaattccctttggattttatagttcaggttcatttaatacgttaagtaatgctaaacgcttgcgataagttttcagcacgcaatcaatatgtggctgcggcataaaggattgtgaataaatctgctctactttttccttttcttgtgtaatttcaggaattaatttttgaataatcacatttttatttaatccaatattttccccaaactcgacaaaatcatcgccgatatattcaccgtattgagtattaaatcctttggctagtgtggcattaccttcttctcgcgctaacaatggcaaagcaagtagtgttgaattaaatatttcaggatagggcgacaccgacacaaagtcataaattggagcaagttttggatgactgtttttgggataaataaatgaaaaattgcgtaagtgaagatcattatttcctaataaataagcgtaaataattcgacgaaaaatttctcgttgctgagctaaatgattttcagtgtgctgcaaaataaacttagcaatttgttcataactcacatattgctcattatctgcacctatttttccgtacttgtctcgaatattcattgcaccatcaagttgttcttggtgaatctctgtttgttgttcatcacgatcaaaacgctttataacaaaagcaaattccttctgattttgttcgccagcaaaagaaactaaaccattttctggcacatcaaaccctaattctttcataatgcgcatggtggcgtgttcattttcagctaaaaaaggatactcttcgggcgaaggctttaaaatgtaatgtccctgttgatctacgctgtcaaagtgatcatctttgataataagctgtaattttggttgaaaacctgaaatgctcatcccttgctgtttttggggtttcactgtaataaattcttggcgagaaaagggcaattcaggattaaaatgtttattgcctgtaagatagtgtaaaccttttgtgctgtaaccagaatgaacttcattttttttcaatggctttaataaaatacgacaaaaattcattgtttttcttcctgaatttgcactgcgcctaacatattttccccgttattaagtaaaaagcgaaacatatcgctttcatcaattcgttgatgaagtgcatatttgtgttttagccagccttctgggacgagggatgcaaaataagggaataaggtgtcagaatgaaaaggactttgctcaataggaaagctgagagagagcggtattccttgataatcgggattgtaagcaaaatgaaaacctcgatgatcttctctaagtaagccaataaattcgccgtagagaaatactttgcccgagcggactaaatcgcgcatagtgaaacccctaatgttttagcaacaagaaacacggttgtaaatcgaacttggcttggatcttgaaataagcgattcaaggtagaaatagacacgccagtttgcagttctagcatactaagctcaataccaagtgatttacgcttatcattgagcatttttccaaaggctttgagatcggtaatttttcctgcgtaaagctgttgtctttgcgattgctcataggtaatgacagatttctgaagcttttttaattcatcaatttgattttctaattgcgcactaaggttattcatatttgatacttttattttaataaaatattttttatatcatatatgaatatatttgtttttagaatatcttttttgatatttttttgagaaaaaatgatttaattatttaaaaatgacattttaaaatctgctccctgtttagtaagtcatttgttcagctttttggagagcagattaaattaattgaaatgttgtttgtttgagctaaatattcaaaattttataaaggtcatccaaataatgaatagattgaattttacgaattgtgcgggattttcctcgaattaaaatggtttcagtactggctaaattgcctttgcgggagatacctttaagcaaatcgccattggtaatgcctgttgcagtaaatacaagattgtcatcacgcacgagatcttcaagttttaacacttcattcacttttatgcccagtgctgcacagcgttgaatctcattagctgcaatttttttattttcttcggtgtcgccttttacttcattgcgtgggattaaacgagcttgcatatcgccacctaatgctcgaatggctgcagcagctgccacgccttctggcgcaccaccaattccataaagaagatcgacttcagcatcaggtaaacaacacaatacggaacctgccacatcgccatcaggaattgccaatactttcgcgcccaagttatgtatttgtttaattacggcatcgtgacgtggttttgctaataccattacggtaaggtcagaaagggattttcctagcttagatgcgatgcggcgaagattttgttccagtggtaaatttaaatcaatgatgccttttacatttgaacccaccactaatttttccatatacatatcaggtgcttttaaaaaggtatttttgccacctgcagccaagacagaaatagcattagattgccccattgcggtcatacgtgtaccatcaataggatctactgcgatagaaactaattcccctaagccagaaccgactttttcgccaatataaagcattggggcttcatcaatttcgccctctcctataacgatttcagcgtccatatgaatcaaattcagcatataacgcatcgcttttaccgctgcatcgtctgccgcatttttatctcctcgaccaagccacgtgtaagctgctagagcggctgcttctgttactcgtgaaaattcaatggctaatgctcgattcattattattctccttctgcttatttttcaagattatggcaaaaatagcatcattctatcactgagtaatcgtttgcataataaatttttattcaatgctttaaaaaggtaaatttactgggtaaaatacccctaaacttacccatatttaaaaggaaatcattatgtctttagaaattttagaccagcttgaagaaaaaattaaacaagcggtagaaactatccaattacttcaattagaagttgaagaattaaaagagaaaaacgcagaatctcaaagaaatatcgaaaacttacaaactgaaaatgaacagctgaaaaacgaacatcgtaactggcaagagcatattcgttcattacttggtaagtttgataacgtttaatcgtaataaaaggcttagattttctaagcctttttattattaatcatttcaataattttcttttctctttgagaagaaaataaatataggataataaaatgcacatttgtattctttcaggcagcactttaggtggggcggaatatgttgccgagcatttaaacgatgttttagaaactcaaggtttttccaccgcactttttcacggaccaaatttatctgacattgaaaacgagaaaatttggctgattgtcacttcaacgcacggtgcaggcgaattgccagacaatttaaaacccctatttgatgaattagcgaatagccaaaaggatttttcagatgttcgctttgcggtcgttggattaggtagttctgattatgatactttttgctatgcagcggacaaagtggagcaaacacttcaagcaaaaagtgcggtaaaaatttgtgagactttaaaaattgacgtgttaaacgtggatgatcaagaaagttatgctgaagaatggttaccgagttttattgagggattgaaatgatcgccctaattcagcgtgtgtctcaagcaaaagtgaatgtaaagggcgaaacaatagggaaaattggcaaaggtttgttagttttgcttggtgtagaaaaagaagataaccgagaaaaagcggataaactcgctgaaaaagtgcttaattatcgaattttcagtgatgaaaatgacaagatgaatttaaatgttcaacaagcgcagggggaattacttatcgtttcgcaatttacattagcagcggatacgcaaaaaggtttacgcccgagtttttcaaaaggtgcgtccccagcattggctaatgaattatatgaatactttatccaaaagtgcgcagagaaattacctgtttcaacagggcaatttgcagcggatatgcaagtgagcttaacaaatgatgggcctgtgacgttttggttaaatgtataataagaaaatctaagttggcaataagctcactgttttacatttgttttattaaatggtttagttaatggaatattctcgttaaagcgtataaattccatcaattaataatgaaccatatattcaacaaggttggtaagcaaaaaggcggactgaagccctccattgctccctcacccataaatgggcgtctcctttcaccaatggtcacttaataataacgagcaatcgcttattatttcactaataaaaatgcgatgaaattcttttcaaattgcaccgcacttttaagaatataagaatagtaaattattgtcgaattaaaagagcaacggcttcacaagcaatcccctcttgtcttcctgtaaagcctaatttttcggtagtcgttgcttttacattaacttgctcaatatcacataggatatcttcagctattttggcacgcattgcatcaatatgtgggcgcattttaggtgcttgagcgatgatggtaatatcaacattacctattttatatcccttttcttgtacttggcgaaacgcttcacgcagtaaacctcgactatccgcatttttatattgcatatcggtatcggggaaaagttttccaatatcgcctaaagctgcagcccctaagattgcatcagttaatgcgtgtaatgccacatctccatctgagtgcgcaataaagcccgtatgataaggcacttctacaccaccaataattaatggtcgatcttcgccaaaagcgtgaacatcaaagccgtgtccaattctgatcataatttattccttgttaaataaaattctgctaatgctaaatcttctggacgagtcacttttaaattatcgctacgtccagccactaagtgcggtctaaatccagcaagttctatcgctgatgcttcatctgttatattcgcaccttgttgaattcctgtggaaagcgcatctcttaatatatctactgggaaaaactgcggtgtcattgcttgccaaagctggctacgatcttctgtttttacaatacattgctgattgtccgctcgtttaatcgtatctgttactgggattgccaaaatcgcaccttgtttatcttcaatagctaacaatttatcaatatcagcatgttgtaaacaagggcgggcagcatcatgaacaagcacccaggcatttttttccgcaattgcatttaaaccatttaagacagattcagctcgcgttgtgccaccttccactaactgaattttaggatcgagcgatagtgtagaaatataaggatcatctttgcttaccgccaagataattttagatacagcaggataagaaagcatcacatcgagtgtatgttcaagcagtgttttgccaagcagcgttaaatattgtttcggtttatccgcttgcatccgtgaaccaacaccagccgcgggcaagaccgcaataattgaacgagtcattatttactctcttttacaatatgatagaacacttcattttctttcactaagccatgttgcattcgtgcgcgttcttcgatcgcttcaaaaccttttgttaatccttgaatttctgcattaatacgctgattacgttgagatagcttttcattttctgcttgattttccttaattttctcagcattttgacgataatctaaaaaaccgttactgccaaaccaaaaattatattgaaacaatactaatacagaaagaaggattaaaataagaagtcgcatacggatatttattgtgagtaaaattttaacctgtttaccgtgaaaaattaggaaaaacgataaaatgaaagaaagtgcggttaaaaattcttttattttaaccgcacttttttgtataaaaattattttctagagagaggtggaacaaaggttaaacctaaatcccaaggttgctcaatccaagtattttgtggaatatcaattacgtaatcatccactaattccgcacctgcaggttttgcaaatacagtgacaaattttgcattagggtacatttgacgaatcgcacgtgccgtattacccgtatcaactaaatcatctaccacgataaatccttcgccgccatttggcacttgggctgcatgaagaacttgtagttcaccttgattgttatgatcgtgataacttgcgatacaaacggtttcaatatgacgaagacccaattctctagccaatacagccgctggaaacaaaccaccgcgactcaccgcaataatacctttccattgggaagctggaagtaaacgttctgataatctgcgggcatgcatttgaaacatatcccaagttaccacatatttttcgctcataattgcaccttagtttaaatttatcgagaaataaaaaattgcgtaaggataacccgaaatggcgttttatgctattatttcgtaaatattttcagtaaaaaggagcaactatgtctgaaattacaacacttcaaccttcactgttatggaaatggttcgatcaaatttgtgcaatccctcatccttctcattatgaagatacgttagctaactttattgtaaattgggcaaaagaaaagcatttttttgttgaacgcgatgaagtggggaatattctcattcgtaaacccgcgacgaaaggaatggaaaatcacacgcctgttgtgctacaagcccatctagatatggtgccacaggctaatgaaggcaatccacatgattttaccaaagatccaattcaaccttatattgatggagaatgggtgaaagcacgaggtaccacattaggagctgacaatggtatcggtttagcctctactttagcggtgttagaaagcaatgatttagcccatccacctcttgaagtgcttttaacaatgacagaagaaacaggcatggatggcgcaaaaggcttacgtcatagctggttacaatctgaaattttaatcaatacagataccgaagaaattggcgaaatttacattggttgtgcgggcgggattaacgcaaactttgaaattcccgttcaatatgaaaccaatacgtttgagcgcagcgcacaaatcacccttaagggtttacgtggcggccactctggcggcgatatccatacagggcgtgcaaatgcaattaaagtgttagcgcgagtattagcaaaactttctcaaaatcaaccgcactttgctctctctgatattcgtggtggctcaattcgtaatgcaattcctcgagaagcagcagctgtgttagcctttaatggcgatgtaaaaaccatagaaagtgcggtagaaaatctcgcggttgtgcttaaagaagaattagcaattgcagaacctaatttcacactttttgtagaatccgcagaaaaagcccctaccgtattcaccgcacaaagcactcaaacggttattaacgcactcaacgtattaccaaatggcgtaatccgcaatagtgatgtagttaaaaatgttgtagaaagttcattaagcgttggcgtattgaaaacagaaggtaatgttgtaaaaagcactattttagttcgttcattaattgaaagcggtaaatattacgtaactgaaatgctcagctcacttgcaatcttagcaaatgcaaaagtcgagttttctgcaccttatccgggctggcaacctgtaaatgactcaactatcttagacgttactcgcaaacattatgctgaagtgctaggcgagcaacctgtagtgaaagtcattcacgcaggattagaatgtggtcttttaaaagaacattatccaaacattgaaatgatttctgttgggccaacaatccgaaatgctcactcaccagatgaaaaagtggaaatcgcaacagtacaaacctattgggatttattgacaagagtacttgccgatattcctgcgaagtaatctaatattaattaaaagtgcggttaaaatttcttttgttttaaccgctcttttatttttttcgtttcgctcttgggtgcgcctgatcgtacacttctgctagatgttggaaatttaagtgagtataaatttgtgtggtggaaaggttgctatgcccaagcaattcttgcacggcgcgtaaatcagaactggcttccaacatatgcgtcgcaaaagaatgacgtaatttgtgcggattaagatggctatttaagccttgacgaataccccaagtttctaaacgtttttgaatggctcgatgagaaatacgatttccaagctggctaacaaataatgcctcatcttttgggttaaataatgcccgcacttttaaccattcttgaatagcatgcgaagcataacgtccaaacggcacaactcgttctttgttaccttttccaataacgcgtacttcccgcacacgggtattaatgctgtttaaatctaagccttgtaattcagataaacgcaaacctgaactatacattaattccaaaatagcacgatcacgaatatcaataggttctttgctatcgttggcaagcaattgttgaatttgctcgccatccatatttttcggtaaatgccagccttgtttcggtgcagaaatgcctgtggcaggatttacttttaattcgccttgttgcactaaaaaactgagaaatcgacgtaatgcggataaacgcaaagccaagcttttttcttttaagccttgttttttgctttccgctaaaataaagcgcaccacgctaggcgtcacttgtgtccaagaatgaatatcttgttgcgctaagattttgatggtggcatcaagctgatgttgataattagtgattgtgtgaggactcatttggcgttcaatccgcaaataatcccaataacgatttaacgctgttagcatgacaaactcaattcaaataaacgttcttttgggttcaatttaaacccttccgattccaacattgaatattgattttgcgctaattctgccactaaacgattggattgcgtgaaatgcacaaagtcttttgctttagaaatcaacgccgcataaatttctgtttgttgcgcatgttccaacacaaaaatatcggtgatttgccaataacgttgcaattgtaaagaagaaaggcgagggaaaagctgcacaaagccaatagccttttcattttcatccaccgcaataaaaaacaggctttcattaaaacgcatacgattagttaaaaaagctaaggtacgttctggattctctgcttgcccataggcttggcgataggcttcaaaaagaggaagaagcacttcaatattccattgttcagctttgaaaagtttcataattggttattttttattggttccatacaggtaattgtagctttttagctcaagataatcatctttctgtgagaatttttttaattttatgatcttctgcaaagaataggggcgaaattttggtatagtaagcaagttaattttatcaactatggagaaacaaaaatggcacgtcgtcctttagttatgggtaactggaaattaaacggtagcaaagcattcacgaaagaattaatcgagggattaaaagcggaattacatgatgtaacaggttgtgatgtagcaattgccccccccgttatgtatttaggtacggctgaagcagcactttctggttgtggttgcagctgtggcggtaaaagtgtgattcaattaggtgcacaaaacgtagatatcaatgtgaaaggtgcatttactggtgatatttctagcgaaatgttaaaagatttcggtgcaaaatatatcattattggccactctgaacgccgcacttatcataaagaaagcgacgaatttgtggcgaaaaaatttggtgcattaaaagaagctggtttagtgccagtattatgtattggtgaatctgaagcagaaaacgaagcaggcaaaacagaagaagtatgtgcgcgtcaaattgatgcagtcatcaatgcattaggcgtagaagcattcaacggtgcagtgatcgcatacgaaccaatctgggcaattggcacgggtaaatctgcaactccagcacaagcacaagccgttcatgcatttatccgtggtcacatcgcagcgaaatcacaagccgtggcagagcaagtaattattcaatacggcggttctgtaaatgatgcaaatgccgctgaattatttactcagccagacatcgatggtgcattagtgggtggcgcatcattaaaagcccctgcatttgcagtaattgttaaagcagcagctgcagcgaaaaactaattttcagttaattagaataacaacaaaagtgcggtaaatttttaccgcacttttttatatcttatatttttgatgaatgggttagtaagtggtatcaatcggcaattctgctctgcaccatccatcaaatccgccaatcatactaaatacatttttatagccttgttccacgagaaaagtcgctacatttcgactgctcacgccgtgataacaactcacaataataggcgaatcaaaatctgctagttcttcaaattgcaaaaaactttggtttgttaaatgaaaagcacctttaggatgtgaataagcaaagcgcatattatctcgaatatcgactaatattgcgccttgttgcatcatttcccaagcttgctgtggagttatttctttaaatgacatttataaacttccttttgcgtgttgtttgtaaacgccatcaaccataacaagaatcatcgcgataactaaacaaataaaaagtgggtagcttccgctatcaatttgttctccgatcaaaaatgatacgcatagcatcataatagtttcaacataaccaagcagaccgagtaaattcataggaagcatattactggctattacataggcaattaacgcagtaccgctgattaatcctagtaatacaagcagcccccaaataaacggattggtttgttgtactgtcgcgaaatctgtttgtaaagcaaaataaatactgacaggcataaggcttaacatttctaaacaaaaggaggcaagatcggtattttttaatgcttttcggatagaaaaatatgcggtgtaacctaaacagataacaatggcttcccaagaaagaccgccttttagcacaatattagaaattacgcctaatgttgcaatgataacggcaataaatttgaatgttgaaatgcgttctttaaaaaacacgcgacctgccgccaccattacaattggtaaaagtaaataaccaaaagatacacttaatgaactgccattattcggtgcccaaagaaaaagccacatttgaaaacccattaataatccgcaaagtaaatatgacaatgctaagtgcggtcgtttttgaatgcgttttaaacgttcaattaaagctgctttttgtttaaataatgtgacggacaacaggacaaaaggaaaagtaaatatcatccgataaccgaaaatatctgtgccactcaaaggttttagtaacgtagaaaaataatacatatagccaaataaaaacgaggctaataatgaaacgagaatacctttaaacataagaaatccttattttaaaccattatttattctattctaacatcgcccaaaatgcacggactaggggctgttcgagatttcttttttgggtgcaaatacctaattcaaaaggctcaataggtttatcaagattaagtctggaaatttggttattcattgggctgctgtcaattactgcatcaggcaacattgctaatccaaatcctaatcccaccattggcacaattccttcgtgtcctgcaacagtagcataaattttcgggtgtttaatttgtttctcccttaaccattgttcaattcgctgccgtgcgtgaccttcaacgggaaaaataaaaggcatttgctgccaatcaataggtttttcttgcaataattgtgtcgccaaacaagccactcgcggggcaattagggacaaactaatatcatctattttatgaaacactacactagaaggcagattatttggtttccccgcaagcgcgagatcgacttgttgcgcttgaattaattctagtgctaacgctggatcacccgtagtcagttgaatttccactttaggataacgctggcgaaattctttaagtacgtgaggaagatggctataagatgcggttacagaacaaaaaagtttaatttcaccgcaaaattcatcggatttatctttcagttgttgtttaaattgttgccagttttgccattctgttttagcaaattgcaaaaatttctcgccatattcagtaagtttgacttggcgattatcacggataaaaagtgtcttccctaactcgtcttccaatcgttgaatttgacgggaaagggtagagggagacatgtggttttgggtggcagttttggcgaagttttttgtatcactgaggtggatgaatatttgtaggtcggtaaattccataatttcttcttttattttatttaatttcgggtttcgccgatggcgacctactttttctttgctcatgcaaagcaaaagtaggcaaaaagaaaacacgccctgctttgccttatttcctgagaaattgaaaacttgcttaacggaaattttctgaactcgctacgctcaaacagacgaaaatttcctacaagtttccaatttctcaggcggcaaagaagggaactaatttgttctttcttcaatttaaagtgcgggtaaaatttagcgtatttaaaaaaataccagaaaactaaccgcactttttaataacgctctgatatattctgagccccatataaatcgcctttgcgactttcaattttcaggcaatttgcgtttgtttgagcgtagcgagttcagcaaattgccgttaagaaaattgaaacaaagcaaagagctgcgatttaattggggcgtgttttctttgcctactttcttttacacgagtaaaagaaagtaggtcgctcatcgagcgaaatacgatgcaatccacaaaaaaacaacataattgcacaaatcgcaacattacattcccataatatcactttacgcaacaacaaaaaatcctataatcaaaccacaacaaaaaatatgcaaacacaacatcatacaattatcaaccttacacaattaaggacaacaaaatggctaactatttcaacacattaaatttacgtcaaaaattagaccaattaggtcgttgtcgttttatggatcgcgaagaatttgcagatgaagcaaacttcttaaaaggcaaaaaaatcgttatcgtgggctgtggtgcgcaaggtttaaaccaaggtttgaatatgcgtgattctggcttagatattagctatgccttacgtcctgaagcaattgctgaaaaacgtgcgtcattccaacgtgcaactgaaaatggttttaaagtgggtacttatgaagaattgatcccaactgcagatttagtcgtaaacttaacaccagacaaacaacactctaaagtggttgctgatgtgatgcctttaatgaaaaaagactctgcatttggttattcacacggtttcaacattgttgaagttggcgaagaaatccgtaaagacattacggttgtgatggttgcaccaaaatgcccgggtactgaagtacgtgaagaatacaaacgtggtttcggtgtgccaacattaattgcggttcatcctgaaaatgacccgaaaggcgaaggcttggcgatcgcgaaagcttgggctgctgcaacaggcggtcataaagcaggtgttttagaatcttcattcgtggcagaagtaaaatctgacttaatgggtgagcaaactatcctttgcggtatgttacaagcaggttctatcgtatgttatgacaaattagtggctgacggtaaagatcctgcatacgcaggtaaattaatccaatacggttgggaaaccattaccgaagcgttaaaacaaggtggtatcacattaatgatggatcgcctatcaaacagcgcaaaattacgtgcatttgaacttgctgaacaaattaaagaaagccttggtttcttatattacaaacacatggatgacatcatcagcggtcacttctctgcaaccatgatggcagactgggcaaatggcgataaagatttattcgcatggcgtgaagcaacaggtaaaacagcctttgaaaatgcaccaaaatatgatggcaaaattagcgaacaagaatactttgataacggtgtattaatgattgcaatggttaaagctggtgtagaattagcctttgatgcgatggttgcaagcggtatttatgaagaatcagcttactatgaatcacttcatgaattaccattaattgcgaacaccatcgcacgtaaacgcttatacgaaatgaacgtagtaatttcagataccgcagaatatggtaactacttattctctaacgtagcaaccccaattcttgcaaaagaaattatacccaaccttcaaaaaggtgacttgggcgagcctactccagcagtggaaatcgataacatcaccttacgcgatgtaaacgatgcaattcgtaaccaccctgttgaattaatcggtcaagaattacgtggttatatgacagatatgaaacgtattgctgttgcaggttaatgttaaattgaactgaattaaaaaccgactttatcaatataaagtcggttttttcatagataaaattaatcataaaaatgcacgttaattacaacgtgcatttttcttatttaagcatccatcgacatacaaagtaaagttaatggatgaatacaagttacgttagatgacatatcaatttgccatttacaggtttgacattcagatataacgtaatcaaatccaccctcgttaatattatcgaatagatttttaccaatagattgtgaaatttcatagttttctgatttaaaaccgtaagtccccgcaataccacaacattggcttggtaacataatgatttctaaacccggaatttttttcaatacttccaaagtataaggtgcccaaccagctttatctacgtgacaagcggtgtgataagccactcgaagtttaagtggtttcaacggtaatgttttaccttctttgaaaagctgatataaaaatggggttaccatatggatatgcggacggactttggcgttgtcgatacctaaaatatgatggtattcgtcgcgtaaattaagcgagcaacttgatgcctcactaatcacatctattccattttcatctaccatttttccaatgtaatcggtattgaattgtgcaatattacgagcgcgattaggaaaaccgtttaccattaatggtaagccacagcatttttctttttctaataacattaccccaatattcattgcattgaacactttaagaaattctttgccaagctgtggattattataattaacataacaaccgtggaaatatgctacttttcgctcaaatttttgttggtcttgtaacgcatttttcatataccaactacggaacgtgccaaacgcatatttaggtaaagtacgttctttactgattttaagcgttttttccaacataaatttggtggcttttaggcttgtgatggtgtttacaatcggtgctaatggcgtattaattttacccataacatctgtgttacttaaaatcgcatcacgcaatttattcattaacggttttttagactgcgctaagtgattattacgcgcacgtacaattaaatcgccaattttcacatcagacggacaagccacttcacaacgtttacagttggtgcaatatttaagtgcttcatcataaagttctgctgattttaagcgtaaacgctcgccatcaggccctgattgttttggaccaggataaagcggattgttgcgtgaaaccggacaaacagcagtacaagccgtacatttaatacagctttcaaaactttcgtcgatatatttatggctttcaggcgaattaagggattgttttgcactatcaatgagtcgttgaatattattatccatattattccccttatttcgctaagatttcatctgccactgccaaggcagttacaacagccacacccgaaccacaaccaagctcaagggcattaaaaccaccaatcacattaccgacggcatataaattcgttaaaaattgaccgcacttttgcacttggcattgagcattaattgctacgcctgctgattgataaggttgtggatgtgcaaagcgatgaacagtccaagtgaaacgatctttctggttgaaaccttcaacaccgataatatcagattcaaaaacaggttcataaattttatcaaattcggaaataagccctttgctgaagaaacttcctgaagctagtacaaaattatctgcagtgatttcttcattttctagcaaacgagtgttgatacaacgtactttatttccttcaaatgttgcattcaatgcactgtcgccattaatcattaaaccaccaagggattcaaatttatgacgtaattgaatacgttggcgcataccaagtaatgatggtggcagtgttggtaattcaaataatgcaagtttagttgcatcacgaagtgcggtcataaattcttggttttctaaaccaaagcaagcaggtaaaaagaccgcttctgcaccttgtgctgattcaatgatttctttaacaagatcattgaacgcaagtttgtgctctagaagttgagagatatttacactacggaactcacgagcatttttgcgaagttcatctaattgtggaatatttaagaaaccactcgttacttcacaatgttcaaattgtgggtttaacactaaatttgccgctaaaagttgaggttgaaaatcgtgataaccttcaataccaagcactgcaatacgtttatgcggaaaaggttcattaccttgcacagttggcacgctatttggcgaaagccacgcaccgcgtaaactgcctaagcctgttacacgccagtgatttttttccgtagaaccaattaaatcaagatttaattcattggctaaacgttcaaaatcttgtgctttagcaagcactttctctgcacccaataaactataagggtgggcaggtaattcattgcgaagtgcggtaatattttcttttaaattttctactgcgcgattttccccatatgtcgttgatggcatacggcttaataaatctaaagagccagatgcaaaatcaatggccgcttgaccgttgttgataatcacgcaacgtttgccgcattgttgaagggcgatgccacaggttaaacccgccaaaccaccgccaataatggctacatcaaaattcattgctatccgtcccttgttgtgcttgttcatcaagcggtttcacatcatttaaacctaatacactaccatacatccaagaggtaaattcggcttcgcgaatagcttccccccaagcaatcggttcaataccacgccagcgttcttccataaaggcggaaagttgagtagttgattgacgtggtgttgccacttcaaaacgattcattagtcctgcggcacgacacgcacagagttcagcttgacaagttcccattccaactcgggagcgacgacgtaaatcgacgagattatttacatccagttcatcaatagcgtaacgaacttcccccgctgttaccgcttcacattcgcaaaccattgaacgatctaaacgttctttttcaagcaaacgagtagcccgtgaaccgtgacgatatacggcagaataacgaatagtacttggtaatgaaatgactttttgattggtctcttgacgactttcagtagagcctggcaaaggttgctctgcagtcacacaacgtgccgttttattgagttttttacaaacaaggtcagtcgcccattcagccattaaacgataagtcattaacttaccgccagtgatagtaataaagccatctaagccatcacgttctgcgtggtcaagtagcacgataccacgactcacatttcgacctgatggatcatcatcgcttgcaactaatggtcgcaccccagcataagcacgtaatacgcgagtatgacgcaagctaggtgcgagtttttcaccttcacggaaaagaatatccacttcctctggtgttacttccatattatcaatttgatcataaggaatgcggctagatgttgttccgatcacacaaattgtatcgccagggacgagaatatccgcatcagcaggtttacggcagcggttaattacaagtttattaatgcgatgacccattacgagtaatgcgccttttgcagggaacattttaattttgagatcggcatattccgcaatcccttgtccccaaataccaccagcatttacaacaagcggtgcaaaaaattggcgttctctgcgatttttgtgatcgtacacattcacgccaatcacttttccaccttcacgaatcaaattttttacttcgcaataagtgaacatttttgcgccgttttctgtggcgtccatcatattagaggcggttaaacggaatgggtcaatagaaccatctggcacaacaacagcgcccactaaatcagggtttacagaaggctccataattttagctaaatcaggatcaatagcttgtgcatcaattccagattttgcacagctctcaaggaaggttttttgatagtcgagcgaatcttcaggcaaagtgataaataagccttccgtttcatctacgcaatgacgcgcaattttgcgcaaaatgcggttttctttaatacattcttcagcagattcttggtcgttcacggcgtaacgtgcaccactgtgtaataatccgtggttacgtcctgtggctcctgtcgcaatatctcgacgttccaataaaatacaatcaatgccacgaagtgcgcaatcgcgcacaatacctgctcctgttgcgccaccaccgataatgatcacatcagtgctaagtgacgaaagatctccaacatctttatagatactaggcgataatcccattgtttacccccgattcccaaaatgtaagaaaaaataatataaaaagtgtaatcattgtagagaagtgcggcaaaattaacaacattttgagtgtaaaagaaagcgattttgtgatattgatcacaataattttcgcattcgctcaaacggtgtaaagatttgtgaaacacttcacatttttgattttttttactttcttatttttttattttcttttatgattcgcaaatcccttactgtttcaaaagggtaaatttagatgacacataattaaaaagttggagaaaaaattatgtttggaccattcaaacccgctccgcatattgcggaacttccagcggaaaaaattgattccacgtataaacgcttacgttggcaagtgtttgcagggatcttcttcggttatgctgcatattattttgtgcgtgcaaactttgacttagcacaacctggtttaattcaagctggcttgtactcaaaagcggaattaggtgttatcggctcagcggctggtcttgcttacggtttatcaaaattcgttatggcaggtatgtctgaccgttctaaccctcgtgtattcttaccatttggtttattgctctctggtttatgtatgaccttaatgggtttattcccatgggcaacttcaggcattgccattatgtgggtaatgatcttcttaaatggttggttccaaggtatgggttggcctccatgtggtcgtactatggtgcattggtggtctaaatctgaacgcggtactatcgtgtcaatttggaatacggcacataatatcggtggtatggtgcctggtgcaatggtgttattagctagtgcaattttcttcagtactcacggtattgaagcgcaggcgaaagatgtttggcaacaatcattatacttccctggtattgctgcgatgatctttgcaattcctgtgtacttcgtgatgcgtgatactccacaatcttgtggtttaccatcaatcgaaaaatggcgtaatgactacccagatgactataacgaaaaaacttacgaaaacgatttaactgcaaaagaaatcttcgtaacttatgtattaaaaaacaaattgttatggtatatcgcgattgctaatgtgttcgtctatttaatccgctacggtgtattaaaatggtctccagtttacttgagtgaagtgaaacacttcaacatcaaaggtactgcatgggcatacacaatctatgaattagcagcggttccaggtacattattatgtggttgggtatcagataaagtgtttaaaggtaaacgtggtttaactggtttcatctttatgatcttaaccactgcagcggttgttgcgtactggatgaacccagctacaccagaagcagagcttgcaaactactcagcttggtatgaaaacccatatcaattaactgatttcgtattaatgaccttaatcggtttcttaatctacggtcctgtaatgttaatcggtttacatgctcttgagcttgcaccgaaaaaagcagcaggtactgcagcaggtttcactggtttattcggttacttaggtggtactgtatcagcttcagcagttattggttgggcagctcaacattacggatgggacggtggtttctacgtaatgatcggcggtggcgtattagcggtgttattactcttaatcgtaatggttgaagaaggaaaacacaaagcgaaattaggcgatacttacggtactaaataattagcttaaaaaaggcggtgggcaaattgcttagtcgccttttttgtaactaaaatctaaaaactctataaaaatttaccgcactcttaaggagaaaatacttatgaaacttaaaactttagccctttctttattagcagctggtgtactagcaggttgtagcagccattcatcaaatatggcgaatacccaaatgaaatcagacaaaatcattattgctcaccgtggtgctagcggttatttaccagagcatacgttagaatctaaagcacttgcgtttgcacaacaggctgattatttagagcaagatttagcaatgactaaggatggtcgtttagtggttattcacgatcactttttagatggcttgactgatgttgcgaaaaaattcccacatcgtcatcgtaaagatggccgttactatgtcatcgactttaccttaaaagaaattcaaagtttagaaatgacagaaaactttgaaaccaaagatggcaaacaagcgcaagtttatcctaatcgtttccctctttggaaatcacattttagaattcatacctttgaagatgaaattgaatttatccaaggcttagaaaaatccactggcaaaaaagtagggatttatccagaaatcaaagcaccttggttccaccatcaaaatggtaaagatattgctgctgaaacgctcaaagtgttaaaaaaatatggctatgataagaaaaccgatatggtttacttacaaactttcgattttaatgaattaaaacgtatcaaaacggaattacttccacaaatgggaatggatttgaaattagttcaattaattgcttatacagattggaaagaaacacaagaaaaagacccaaagggttattgggtaaactataattacgattggatgtttaaacctggtgcaatggcagaagtggttaaatatgccgatggtgttggcccaggttggtatatgttagttaataaagaagaatccaaacctgataatattgtgtacactccgttggtaaaagaacttgcacaatataatgtggaagtgcatccttacaccgtgcgtaaagatgcactgcccgagtttttcacagacgtaaatcaaatgtatgatgccttattgaataaatcaggggcaacaggtgtatttactgatttcccagatactggcgtggaattcttaaaaggaataaaataatatccctcacaaccgtgggtaaacatacccacggttaactaggtttctatatcgtagaaactaaaaatctactctaacagagtaacatcataatcaatctaggtgttctaacctagaattcaaataaggaggctatttcaaaacactccgtattcttttttaataaattctcttccctttacttagggaaaacactcttcatttcaaccgcacttctaaggagtgatctatggataaatcattaaaagcgaactgtattggcgagtttttaggtacagccttattgattttctttggtgtgggctgcgttgcagcactaaaagtagcaggcgctagttttggcttgtgggaaatcagcattatgtgggggatgggcgttgcacttgcagtatatgcaacagcgggtttatctggcgcacatttaaaccctgcagtaaccattgccctttggaaatttgcttgctttgatggcaaaaaagtaattccttacatcatttcacaaatgctcggcgcattctttgctgccgcattagtttatgccttataccgcaatgtttttatcgattatgaaacagtccacaatattgttcgtggtacacaagaaagtttaagccttgcgggtacattctccacttatcctcatccaagtttaagcattggtggcgcctttgctgtggaattcgtgattactgcaattcttatggcattaattatggcattaactgacgatggaaacggagtacctcgtggtccgcttgccccattattaatcggtatcttgatagccgttattggtggtgctatgggaccattaactggttttgccatgaatccagcacgtgacttcggaccaaaattctttgcttatctcgctggctggggcgaactcgctttaactggcggacgcaaaatcccttattttatcgttccaatggttgcacctgttttaggcgcattagctggtgcatggttatacaaaaaagcaattggcggcaatttaccttgtaattgcggctgcgaataattatttgaaggagtaatactatgacagacaaaaaatacatcattgcattagaccaaggcacaacaagctctcgcgcagtattattagatcataatgcgaatgtggttgaaattgcacaacgtgaatttacccaaatctaccctcgagctggttgggtagaacataacccaatggaaatttgggcaactcaaagctcaaccttaaacgaagtcgttgcaaaagcgggcattacatctgatgaaatcgctgctatcggtatcaccaaccaacgtgaaaccaccattgtatgggaaaaatcaaccggtacacctgtttacaacgcgatcgtttggcaatgccgccgtactgcagacattaccgataaattaaaagccgatggccatgaagaatatattcgtaataccacaggcttagtggttgacccttacttctctggtacaaaagtaaaatggattttggataacgttgaaggcgcacgagaaaaagctgaacgaggcgaattattatttggtaccgttgatacttggcttgtatggaaattgactcaaggccgagtgcacgtaaccgattataccaacgcatctcgtaccatgttatttaacatccatactaaacaatgggatgacaagatgcttgaaatcttgaatattcctcgttcaatattacctgaagtacgtaattcttctgaaatttacggccaaaccaatatcggtggtaaaggtggtgtgcgtattcctgttgcagggattgctggtgaccaacaagccgctctttacggacatctttgcgtacatgcaggccaagccaaaaacacttacggcacaggttgctttatgttactccacacgggtaacaaagctattacatccaaaaatggactactcacaaccattgcttgtaatgcaaaaggcgaaccagaatatgccttagaaggttcagtatttatcgcgggtgcatcaatccaatggctccgtgatgaactcaaaactgttcacgatagttttgactctgaatactttgcacaaaaagtgactgatagtaatggcgtatatgttgttccagctttcacaggcttaggtgcaccatattgggatccatatgcgcgcggtgcgatttttggtctttctcgcggtgcaaactgtaatcatattgttcgagcaaccttacaatctattgcttaccaaacccgtgatgtcttagaggctatgcaatcagattcgggtgaacgattacaatatctccgtgtagatggtggtgcgacaaacaataacttcttaatgcaattccaagctgacattttagatgtaaatgtagagcgcccagttgtgaaagaagtgaccgctctaggtgcagcttatcttgctggtttagcaacaggcttctggaaagatttagacgagcttcgcgataaagcccgtgtagaacgcactttcagcccagacagcgacaatgaaaaacgtgaacgtcgctacaaaggctggaaaaaagcagttaaacgctcattagaatgggcaaaagaagatgaagaataatttataaattaattctcatacaaaaagagcggtcaaaacttcttttattttgaccgctcttttattctgtatctgtataaaaattattttctagagagaggtggaacaaaggttaaacctaaatcccaaggttgctcaatccaagtattttgtggaatatcaattacgtaatcatccactaattccgcacctgcaggttttgcaaatacagtgacaaattttgcattagggtacatttgacgaatcgcacgcgcagtattacccgtatcaactaaatcatctaccacgataaatccttcgccaccatttggcacttgggctgcatgaagaacttgtagttctccctggttgttatgatcgtgataacttgcgatacaaacggtttcaatatgacgaagacccaattcacgagccaatacagccgctggaaataaaccaccgcgactcaccgcaataatacctttccattgagaagctggaagtaaacgttctgataattttcgggcatgcatttgaaacatatcccaagttaccacatatttttcgctcataattgcaccttagtttaaattttgcataaagatgcactacccgcgtttttcacagacgtaaatcaaatgtatgatgcattattgaataaatcaggggcaacaggtgtatttactgatttcccagatacttgcgtggaattcttaaaaggaataaaataatttctattataaccgtaggtaagtttacttacggttattaatgccgtctatgatgaaattatcttttcaattgaaaagtgtttttcagaaagacttactatatccttaatgaataggaacataatatgaaaacaacgttaaaaatgaccgcacttacggctctttctgctcttgtcttagctggctgtggtgcacaccaaatgaaatcagaagaacaagcaaatatgcaattacaacaacaagctgttcttggcttaaactggatgcaagattctggcgaatataaagcattagcttatcaagcgtacaatgcggcaaaagttgcatttgatcacgcaaaagtggcaaaaggtaagaaaaaagcggttgtggctgatttagatgaaactatgttagacaacagcccttatgctggctggcaagttcaaaataacaaaccattcgatggtaaagattggactcgttgggtagacgcacgtcaatctcgtgccgttccgggtgcggtagaatttaataattatgtaaacagccacaaaggtaaagtgttctacgtaacaaaccgcaaagacagctctgaaaaagcaggcactattgatgatatgaaacgcttaggtttcaatggcgtggaagaatctgcattttatttgaaaaaagacaaatcagctaaagcggctcgttttgcagaaattgaaaaacaaggctatgaaatcgtactttatgtaggcgataacttagatgacttcggtaataccgtatatggcaaattaaacgctgaccgccgtgcattcgttgatcaaaaccaaggcaaatttggtaaaactttcatcatgttacctaacgcaaactacggtggctgggaaggcggtttagctgaagggtatttcaaaaaagatacacaaggccaaatcaaagctcgtttagatgcagtacaagcttgggatggtaaataattttccattaaaaaaaccaatttaaatataatttagtttggggctaagctcattttttactggcttagcctttttaatttttcaagttcactcaagtaatcatcattactacagcctgaagttttgctatgatgttgcaagcctttcaaaatagaaatctaattcaatgaagaagaatttttcagtggggaaattgccgtttaaaggaaaaagtgcggttaattttcaccgcacttttaaaccaaaattaaaacccaaaacgttgtcgttggatgaaaccaaagttgtgttattcaataaaccttttgatgtactcacgcaatttaccgacgaacaagggcgcgctaccttaaaagattttatttcaattccaaatgtttatgcggcaggtcgattagatagagacagtgaaggattactgattttaaccaataatggcgaattacaacatcgtttatcagatcccaaatttaaaacagaaaaaacctattgggtgcaagtggaaggtatccctgaagaaaccgatttagcacaactcagaaaaggtgtagaacttaaagatggtatgactaaacaggctcaagtgcggttaatttcagagccaaatttatgggaacgcaatccacctatccgagaacggaaaaatattcccacaagctggttagaaattaaaattagtgaagggcgcaaccgccaagtgcggagaatgactgcgcatattggcttccccaccttacgattagtgagagtgagtatgggctcattatctattgatggattagcaaatggctcatttagattattatcattggatgaaataaaagtattatttcagaccgtcaaattataaaaatagggcaagtatttcgtttgccctaaatttttctcccataaatattgcgcactgagtaaattagcactatccgcaacgcgatgagcttgagcttggtcaatattgaattgctcacttaaccctcaagcggtgcacgctcgaatatctgcaacttggaagttttttctaggctataaatgacgccttcgcgcaatgcaccgtcagaatagcgcatttgttgaatatgaaaaacctcaaacactgcacttaaaatcgctaaaccgggtacaaaaacatccacacggtcttggtttaaaccgttaatatttagctcggtaaaatgcttggcttgtagtgtttgttcaattagagcatttaatcgctcggctgtaatggttccatttggatcgagattagtcgcaatgacttgcgcaacagttttaatcgtccccgatgagccgagcacagattgccaacctaatttgcgatattcaaagcctaaatcttcgattttattgaccgcactttggcgcacgcgttgaaagttttctggggaaatgatgccatcggtaaaaaaattgagtcgcaaaactcacgcatcccatatgtcggctttcagccataagcggcgtgaaatcatcgccgataatcatttctgtcgagccgccaccaatatctataacaagctttctgcctttttctggctgagtatggcatacgccagcgtagatggttttagcttccgtttgcccactaataatattaatgggataggggaaaactttggctgcttgacgtaaaaattcgtcattattcaccgctcttcgtaacgtataagtgccaactacattgacgttttccataggaaaaccttgtaaacgttcggcaaataaggctaagcaattcacgccacgtgtgatagcctcttgattaagcaccgcattttcatctaagccttccgcgagtttaactttttgttttaagcgcgaaagcacttggattgagccgtttacaatacgcgcaacaatcatatgaaagctgtttgagccaagatcaattgcggcaatttcacgtacattgccacgatgtttgggttctaaaatagcgtcattcataacattcctaaaattcaaatttataaagtaaatcaaacacttggtttgtgctagaaacggattgaaaataaagctgtggcattaggcgataacgtaatgtaacttctgctaacccatcaaataaacctacgccatattttatttgtaagcgattggtaatattgccacttactgtaaccttagatttatcgcccacgccagatgtaccaaggtttaagtcttgaataccaaaaacttcgccaatactgcccactaatttaccgctctttgaaatgcctaaaccaattaatgctgcaccaactgatcccgttgaacccacttctccactactttctaacgaacgacctgttaataaataagaaagtgcttgatcttgtggtttgcttggttcactgaaaatagtgacttctgggctatcggctatgccaatcactctcactccagcagtaattttgctgtcttccattgtttcaggattacgaatagcctcaatattcaacgtaggttgtgccgcttgcccagaaaaactaataagccctttacgaatgagtaaatcttgtccgaaagaagcatagcgacctttggttaaattgatttgcccgaataaacctaaattgcctttgtcttgtttcacagaaagtaaaccatcaagattggtttttaagccataggcatcaaggctgacgtctttaccaatattgatgcgtaaatcagagcgaatatccattcctgatttcgtttttgcggcaaattcacgtttaatcagttcttctttgctcttgtgcgggccgtttaaaatcacttcatcttcgctgactggctcagcagtatctggcagactgtcaattttaatacgcgcccaaggaatatccactgttccgcttaaattcaattccttaggattggcttttatcgtgatatctggactgaaacgtagcttcgccatagatggaatatccacgttgaaattatttgcttgtgcattcaattctgtcgtccaatgttcaatattcgcccagtttgcacgtccagttaagtttaagtgactatctactgtttcgattttcccttgcaatgttgaacggttaccattaaagcgtagggcaatatcgccatctgtaatattgactggcatagatttcaatttggtacgaatattacgaatattgaagtcaccatttaataatggtttctctaaattcccgccgaaactcaacttcgagactaccttaccattcactgattcaccgctagtaagtagctgatttgcgatcgacaagtttaatcgttctatcgcaagggttccgccaagttggcgagttttaacaaaatcatttaaacgaatatcgcctacaattctgccttgattatgcaaattgatgtctgtttttaaaaccaaattattattttgaatgtcggcattaagggttaattttggaatatctaatttaaacgtgcggtaatccaatttttgagagaaagctaaatgattgccatctacttttgtgctaaattggaatggtttatccgtaaaccaagccacattaccttgcgcttgcaagtttcctttgaggctatcttgttcgataagtttattcattaaatccaaattaacacgtttgaattggaaagggatattaccttgcttgcctgcattgaatgcttgtgggaaacataattctatatctgtgttttgccagcaatgtgcggcaatattggcttgtgtttgtttgttatcgtaagacaccgcaatagcttggttagattttacatcgccaattggggtttcaaattttgcttgggaaagtgtgcctttccactgttccaaagtgcggtcaaaatggccgttaatttgtaaatttgcagcaacaggctcgccttgagattttaggattaatttgtgattttgttcatcgcctgataaatcaagatcaagtaaatggagtttaatattttcgccataatgaagttgttctgatttaatattcaattttccactcgagagtggggtattgtttatatgaccttttatacttgctttagctaactgaaaaccttgtaaatgtaaattggatgaagttaaatcaagatcaagattaggtgtcgtaatttgaccagaaatcgctactcgcccttttaaatctgaccataaaccacgtaaatttggtgcatctatatctagcacaaaatcagaatgatcatctaatacgccactggctttaagataattttcgccatatctaatctgtaaatcaggcacggttagaagtacattttgattaagcgttgcagaacctttcaagctaattggttttgcagacaatattccatttaaatcagctgtaggcacttccacttgccaaccttgagagtccgcaaaaccgcgagaatgtaatttacccgataatatggcaggcataactggaacaaaaaaaccaatattcattttttctaaatcggcttgaatatcccagtttgcaccatttttccaatttgcattacccacaaattcacttttaccgtctaatgaagctatccccaatttatttacggttatttcataaagtttgccgtcggcattaaagtctacttgagatgcgggaatataattcattcctgccacattgcccttaaattcggcgtgataattcagtaaatcccccgtgagtttaagcgtcacatcattaattttgagtggcgtcattgtgtttacaaaagtgtattgtccttttgccacgtttaatgtgaggtttaagggcattttatcttgtgctaattgcacgttgccattcagttcagcatctaatacgccttttgttttcacagaaagtgcggtggattttttcaatgatcccgaaagcgtaagatccacatcactctctggcagaatttcttttccagcggatttcaacggctccaaatgggattttaaagttaaatctagcggcatatcgccatcgagttgtaatttaccttgtgaagaaagattacccaacgagctttctaccgctaatttttgtaattgcagttggttatcgacggtatccgcctgtgcaattaaactagacatttcaacagattgaagcgtttcgtctttttcattcactgcttgatactgccagtttttgcctgaaatttcaggaatatgtaaatcaaaaggaagaattatgtctgatacattgcctaaaaaagcaggcgttaaagattgctcaatcgcagcccaatctacaggtttattcggctgtttggctttcagctcaggtttaccttcgggcaatttttttgcaatcactgaaatatcgttaatttcagtcggcgcaatagttaagcctttttcattatttaaacttaccgcacttttaaaatttccaagcgtaatattagtctgatcaatgtttacagataaatcttgcaccaccaaattttctgcattgatactaattggcaaggaaatacgcttcattgagccagactttgaattatcaggtgccgatggaggcaataatgcagtattaatcgcaatggtcggtttatttaaggtgaagtctcgtaaacaaacttcacgtgaaagcaaacaaccaaaatcgagctgtaaacgtgcttgtgcaatatgtgtctcaatcccagcggtttgataacgaacattctttaacaccaagccattttgtaatccgccttcaatttgctcaacggaaaaactatcaagcattttatcgacaagttgaattaaacctctttgccccgcatcgaaagaaagcactccagcaacacctaaaacaggtataaaaatgaccgcacttccgatacaaacagccttgcgtacccaatgttttttattaggtttctcaggtaattttggtgaagtttctgatggttgtagttgttctgtcataaattcaccttaaatttctgtaccaagtccaatgtaaaattgaatatttttgctgttatctttatcacgaatgggtgtggcaatatcaaatttaatcgcaccaactggcgatgcccaacgcacaccaacgcctgcaccataacgcaattcttttgccgtgtaattatcggcagctaatccactatctgcaaaagttgccgcccaccaatttggatagacttgatattgatattctaaagaagcggtaagcaatcgcgaaccaccaactaattttccgtttttatttttaggcgcaatttttttatagccgtaaccgcgcacactacgatcgccaccagcaaagaaacgcagtgtaggcggaattttttcaataccttttgtatgtaaatacccgatttcagcacgagcaacgatacgatgattttctgcataagtacgaacccacgcgctagatgcttgcacttttataaaagaagattctgatagccaaattcgtttgcttaaatcaaaagtaattttttgcacatcgccccaagtggcaaaggaaccaccacgtaatcgagtacgagtaaatccaacagttggataaagaagtaaggttttatcagtgatatccgcttgtgtaaaactgtcgtatcgcgtacgaagtccgccaaaatattgccaaccatgcgcattattccaataacgtaacgctgacaacgtaagcactctcgtattggtatcgttctctttttccccttcccaaccgacggcaaaatcatagtaataatttaatggatttttaagcagtggcattcgataagttgcctctagagtttgttttggtgcagagagataaagatttgaacgcaaactatgtccacggctattaatccaaggttttgtccagcctatttgtccgtgaacgccgccatcagtagcaaagcccacaccgagttccatcgcattttttttacgtggataaagaatgatttctatatctaccgttttacttttatgattgatattaggctgaactaatactgagctaaaccaatttgaagatgaaaaatcgctggttaaatccgacaaattattcattaaatacggatcaccagatttgatgttaagaatattatttaagtaatcatcccgaatttgtgaatggctaaaagtaatattgccataatgataacggacaccactatcaaataacattcgccaccatgcttgatgggtttcagggctgatttctaaacgtgaaattttaaagttcccatcaaaatacccacgatttaatgccaagcgtgaaatcgctgttttgtaatcatcgtaagtttggtgctcaaccaaaacgccatctttcggtaagtttttacgcaatgcattaaaattttcatcttgtgcggcttccccctcaatttgcacatcagtccccgcaatttttgttggctcgcctggtgtaacatgagcaatcaataaatcgcgtttgccttgacgctgttttcgttcaaaacgcacggaagattcataataaccaaacacacgcaaaccacgatccacggctttggttaccaaatgttgatagcgttcggagccatccatttcttctttattaatcaaattaacattgagatctgtattacgcacagcacggaaaccacgaatgccttgaacttcaatatcaacagtttgttcagcaaatgcgggaaagcaacttaatgctaaaaaaagtgcggtgagttttagcgattttttcttcattttaaggggttaaaattttctaagtaaattgcactatagtctaccgagaagttcgttaggatccaatattttcagtgcattttgtcggttttttcataaaaaataccgcacttcattgccaaagtgcggtaaatttttgagctgttttaattagtgaccgccgcaaccacagctgccgtgattatgttcgtgattatgttcgtgatgatgaccaccacagccacaaccgtgaccttcttcgtcatcatcgtggctgtgtgcaccgtgaacgtggccgtgagcaatttcttctaacgttgcttcacgcgctgcaacaacttcaaccgtgaaatgtaattcttgccccgctaacatatggtttccatcaactacaacttcatcgccatcgatttcagtaatcaccactggaactgggccaatgtcagtatccgctaagaaacgcataccgacttcaagttcatcaacaccttggaatacatcttttggtacacgttgaaccatattttcgctgtacgcaccataaccttcttcaggttgtacacgtacttcaaatttgtcgccaacttctttaccttcaagtgctttttcaagaccgactactaaattattgtgaccttgtaaatattctagtggttgatttgctggagcttcatctaccaatacgccatcttgtgtgcgaacttggtaagaaatgctcaccactacatttttttctactttcattatgttttccttataaaaatcggttaaaaagccgtatcattgtaacgaaaattattccacgcgcaagactttacggattaatgaacacgaggctcttcttcatcttcatcatcaaaaaattccccatcgtcaccgtattcatcgtcatcggcatttgggtcttcaaaataggtgccccaaccatcataaatgcctttatgtttttctaacaatggaaggatttgtttttgttgtgcatcgataatttcagcttttaattctacttcactgatgatgtcaaaacagaaaattggtttaccgtcatcatctttaaattcttccgcttcggaaacttcatagcccgctttaaacgcatcaaccgcaattttttctaacaaatcaaaatcgtggtgtgcgatgtgatgctcaataatgtaaagcgcatttggatcactgccatcattaagtaaatcttcgataatttcacgggtttctgcttgtaattcagccaattttgacataataaaatccttcaacaagaacaaaagtgcggttattttagtggataaatcaccaaaagtcgcatagaatttcgcacaattattttcgataaaaaagaacccttaaccatgctcgaacaactcccttatttggcattaaaaactccgccaaaaaccaccgcacttttaaaggctgaatgcgcggattttattgtaaaagagcatttaggctatgaaatgtcgggcgatggagagtttgttgcattgtatgtacgaaaaacagattgcaacaccttatttgttggcgaaaaattagctaaatttgctggtgtttctgaacgcaatatgggatatgcagggttgaaagatcgtcgagcggtgacagaacaatggttttgcttgcaaatgccaggaatggaaacgcccgatttcagtcaatttgaattagatggcgtagagattttaacggttactcgacataaccgaaaaattcgcacgggtagccttgaaggaaattatttcgatattttattacgcggtgcagaagaatctgatgagcttaaagtgcggttagattttgtggcaaattttggtttcccaaattattttacggaacaacgttttggtcgggaaggtcataacctcacgcaagcattgcgttgggctcaaggggaaatcaaggtaaaagatcgcaaaaaacgcagtttttatctttccgccgcgcgcagtgaaatttttaatctggttgtggctgcgcgtattgcaaagggcgcaacaaatcaagttttaccaaatgatattgtgcaattagcaggttcgcacagttggttcaaagcggatgaaaaagaagacttaactgtcttgcaagtgcggttagaaaatcaagatattttactcactgctcctttaattggcgaagatattttagcagcaagcgatattgaaaatgaaatcgtaaatcaacattcagctttcgattctttaatgaaacaagaaagaatgaaagcagtgcgtcgcccattgttaatgaaagcaaaagggttttcttgggcatttgagccagaaggcttgcgtttaaaattttatttgccagcaggcagttatgccacggcattagttcgtgagttagtaaattacacagaagaataaggaaatataatgcgaattttagttagtaatgatgatggttttcatgcggaaggcattcaagttttagcaatggaattaagaaaaattgcagaagtcattattgttgcacccgatcgtaatcgaagtgcagcatcaagctcgctcacattggttgagccattgcgcccacgccatttagataatggcgattattgtgtaaatggcacacctgcagattgtgtacatttagcgttaaatggatttttatctggccaagtagatttagtggtatcgggcattaatgcgggttgtaatatgggcgatgatacgatttattcaggcacattagctgcagcccttgagggtcgtcatttaggtttgcccgctattgcagtttcgttagatggtcgtcagcattatgaaacagcagcacgagtggtatgtgatctcattccaaaattacatcatcaattattaaaccctcgtgaaattattaatatcaatgtgcctgatttgctttttgaagaattaaaaggctacaaagtttgtcgcttgggttaccgtgcatcttcagcagaagtgattaagcaaaaagatccgcgtgatgaaaccatttattggattggcccttcagcattacccgaagatgaaagcgaaggaacagatttttatgccgtgaagaatggttatgtgtctatcacaccaattcaagcggatcttaccgcatatcattcattgctttctttgcaaaattggttagagcaggaatttaccaaatagagaaaaatatgaaaattttcggcacgatgtacgataaaacgatggaatggtcaaaacatcgttttgctgttttttggctctcttttgtaagttttatcgaggcgatattttttcctattccgcccgatgtgatgctgatcccaatgtctatgtcaaagccaaaaagtgcggtgaaatttgcattttatacggcaattgcgtctgtaatcggcggaattatcggttatgctattggtttttatgcaacgggctgggtggaaaacattgtgcaacaatggggatatgctgcgcattgggcaaaagccgtcagttggtttgagcaatggggcgtattagttgtgtttgtggcgggttttagcccaattccttacaaggtgtttacgctctgcgctggagtaatgcaaatggcatttttcccttttgttatcaccgcatttgtttcacgtttagcacgtttcttgctagtagcaaaattagctgcatggggcggtgaaaaattcgcagcaaaattgcgaaaatctattgagattattggctggtcagtggttgtactggctataatcgcttactttatactgaaaaactaggatagaaaatgaacaaattaagtcttgttttagtagctggatttcttttggttggatgtgcatcagaaccagttaaagatccagatgcattaccaaatggcattatgcaaccagtagaaggcacaggtgccgttgctggcggtagttttatgccagaaattcaaaaaaatacgataccaacacaaatgaaataaaaatgaaataataacggaacaataaggaataactatgaacaaatcgtttctcttactccctttaagtcttgttgtattatcggcttgtacctctaattctcctgcacctatttctgatgcagatggaaatctttcccctagtgtagtgcaatctgtaaatggcagtaatgtaggtggtgcttggcaacctgaaattcaaaaaaattcattacctacaatgggaaatatggtcacaccacaaccaaattttcaaccgattaatcaacaaccagcaatgccaactaaacctgcacaacctgcatttcaaccctctccgaaaacggtagttagcgcaccgacagtacaaacaaaaacagttaccaaaacaattgctgattgtgtagatggacagcatattaatatcccacgtaatccaaataccaatgcgccagattacagcaaaatttcaaaaggctcttacaaaggcaatacctataaagtaaacaaaggcgatacaatgttcttgattgcttacttagcaggaattgatgtaaaagaattggcagcgttgaataacctatccgaaccttataatttaagtttagggcaagttttaaagatttctaattgtggcacaaaaacggttactacaacggtttctgtaaaacaacctgcagtcacggcatcaacagcaatgccagctaaaccagccgtcacttatactccgggcgcaaacggtactcaaataggatctgacggtactattattggccccattaaatcagaggctggcatatcgtctagtgtatctgtggcaacttcatcaacacaggttacatcatctgtaaataatgcgaatagcacaccgattaatgcaaatgtcgttgcaccaatcgcctcaaatgttgcgtggcaatggccgacttcaggtaatattattcaaggtttctcaagcacagatggcggtaacaaagggattgatattagcggttcacgaggacaagctgtaaaagcggctgcagcagggcgaatagtgtatgctggcaatgctttacgtggttacggtaatttaatcatcatcaaacataatgatgatttcttaagtgcttatgcgcataacgacaaaattcttgttgctgatcaacaagaagtcaaagctggtcaagacatcgccaaaatgggtagctctggtacaaataccgtgaaactccactttgaaattcgctacaaaggcaaatcagtagatccagtgcgttatctaccaaaacgttaagatctctttaaaaagtgcggtaaaaaatctcaacaaatttttaccgcacttttttattaaaaatattctgtgaggagtatcacaaaataaaaaaataatagatgacaatgttaaattttatattattctgataatgcttcgtagttagaagtcagtgttaagttttattaagtatctcttctcttaaaaggagtttaatatgctcaacttgctctctcctaaccaaacttgggttcttgttgatccaagattatctttttattttcccataatttattaatcctttcttattaaccatcaaagtgttttcattttagaaaataattttttatttaaactaagcaaattaatttttggggattttgctatggaaaattttaaacatttacctgaacctttccgcattcgtgttattgaaccagtaaaaagaactactcgtgagtatcgtgaacaagcgatgttaaaatcaggcatgaatccatttttattagatagtgaagatattttcattgacttacttacagatagcggtactggtgccgttacacaagatatgcaagctgcaatgttacgtggcgatgaagcctatagtggcagtcgcagttattatgcgctagctaaagcagtgaaagatatttttggttacgaatatacaatccctactcaccaaggtcgcggtgctgaacaaatttatattccagtattgattgctaaacgtgaacgtgagaaaggtttagatcgcagcaaaatggtggttttctctaactatttctttgataccacacaaggacatagccaaattaatggggcaacggttcgcaatgtttatatcaaagaggcatttgatacaacagcaaaacatccatttaagggtaatttcgatttagaaaaattagaaaaaggcattcaagaggcgggagcacataatgtaccttacattgtatgtaccattacttgtaactctgcgggtggtcagccagtttctattgcaaacttaaaaggcatgtatgaaattgcgcgtaaatacgatattccagtcatcatggattcagctcgttttgcagaaaacgcctattttgttcaacaacgtgaagaagcttataaagactggactattgaacaaattacttacgaaagctatcgctatgctgatggtttagcgatgtccgccaaaaaagatgcgatggtgccaatggggggtattttagcgtttaaagataaatcaatggaggaagtctatcacgaatgtagaacgctttgtgttgtgcaggaagggttccctacttatggtggtttagaaggtggtgcaatggaacgtttggctgttggcttgcatgatggtatgcgccaagaatggctggcttatcgtattgcgcaaattgaatatttggttgcaggcttagaaaaaattggtgtgccttgccaacaaccaggtggccacgcggcgttcgtagatgcgggtaaattattaccacatattccagccgaccaattcccagcacaagcactttcttgcgaactttataaagttgcaggtataagagcggtagaaattggctcatttttattaggacgagatccgaagacgggtaaacaactaccatgtccagcggagcttttacgcttaactataccacgtgcaacttatacgcaaacgcatatggatttcattattgaggcattccaaaaagtgaaagaaaatgcagagaatattaagggtttaacctttacttatgaaccaaaagttctccgccactttacggcacgtttaaaagaagttgaataatatcacgaaaaatgcagttcattttgaactgcatttttttatcaacagctaactcaataatttgttattgataaggatgttctatgaaaaaacaaccttccatctttggtggtgcgtgtattattgctagtgtttgtgttggggcaggaatgcttggtttgccgacatctggcgcgggtgcttggacaatatggtcagtattagtaatttgcttaacaatgatagtcatgacattgtcaggctggttattacttgaggcctactctacttatgatttaagagcttcatttagtactgtaactaaagatatgctcggttcaactgtcaattctattaataatcttgcggtatattttgtcgggggtattttactttatgcttataccactgcatctggcggtatactagaaaaccttattaaaccgtggattgattttggttcatctacattggcaatttgttccactgtatttgtattagttttttccttctttgtttggcactccactcgcattgtagacagaatatctgttttattgattgtatgcatgggttttacttttatttttagtacttatggattagcaactaatattagtttagacactttattagatattggtggaaaggagacaaattatgcaaaatatgcggtaggaatgtttcccgttgcattaacatcttttggctatcatcattctgtttgtacgatgcgagcttactatggggaagaaaaaaaagcaaaatacgctatcttaggtggaacagcaattgctcttacgctttatttactttggattttctctatttttggcaacttaccgcgagatcaatttgctccagtaattgccagtgatggtaatttagatattttacttaacacattaggtggagtaatcgaatctaacacggttaaacaaatgattaatgccttttctatcgccgcaattttatcatcttttattggcgtaggattaggcgtatttgattatttggctgatttctttaaatttgataattgtaaaattggacgaacaaagtcatgggctgtgactttcctacctccactaattatgtcaattttatttccattgggtttcttaaaagctattgggtatgctggtgcggtagctacgatttggacaagtataattcctgctcttcttgcctataaatcccgcaaaataaatacagctgcaacattccgagtgtgtggtggaaatggtttaataatctttattgcattatttggtgtttttgtagctattttccattttcttgcaatgtttggctgcttacctttctttaagttctaaggggaaaatatcaattttaagtgcggtaaaaaatctcaacaaatttttaccgcacttttttatctggctttttcccctttcggcacctaaaatagccgccataaaacctatctttattcagtttcaaagcaggtaattagatgatttccgaagaaaatttccaacagcacacgccaatgatgcaacaatatctaaaactcaaagcagagaatccagatattttgttgttttatcgcatgggggatttttacgagttgttttatgacgatgcgaaaaaagcggcggcattgttggatatttctttgacgaaacgagggcaatctgcaggacagcccattccaatggcaggaatgccttatcacgcggtggaaggttatttagcaaaattagtgcagttaggcgaatctgtggcgatttgtgaacagattggtgatccatctacaagcaaaggacctgtagaacgtcaaattgtgcgaattgttacgcccggtacggtcagtgatgaagcactgttgcctgaacgccaagacaatctgattgctgcggtatatcaagaaaaagaaaaatttggattagccactttagatatgacttctgggcgttttcagctttgtgaacctgcagataaagaaacattgcgtgcggaattgcaacgtattgtgcctgtagaattgctgtattgtgaagaatttaatgaaatggcagccatagaacattgtaaaggattacgccgtcgcccgatttgggaatttgaacttagcactgccattacgttattaaatcgtcaatttggcacaaaagatttacgcgcctttggtgtagaaaaatcccctctcggcttaagtgcggcaggttgtttattgcaatatgcaaaagaaacccaacgtaccgcattacctcatattcaaagcattagcttaattcaaaaccaagactgcattcagttagatgccgccacgcgcagaaatcttgaattaacacaaaatctttcgggtggcacagaaaatacgttagcctctgtcttggataaatgcgttacgccaatgggcagtcgtttgctgaaacgttggattcatcagcctattcgtgatgtggaaaaattaaaacaacgccaacaagcgattgcggaaattctgaattttgatttagtcgatgaactccaaccttatttgcaattagtcggcgatatggaacgtattttagcgcgtgtggctctgcgttcagcgcgtcctcgcgatctcactcgcttacgcacagccttagaacaaattcctgcattacgcacgattgtgcaacaaaaaacatcgccatttttaaccgcacttttcagccaaattgccgatttcagtgagcaatgggatttattgcaacgtgcattgattgaaacgcctccgcttttaattcgggatggtggtgtaattgctgaaggttaccatgcggagttggacgaatggcgtatgctgtctgatggtgcaacgcaatatttggaaaatctcgaaaaacgtgaacgtgaaagtacaggtattgatacgctaaaaatcggttttaatgcagtgcatggttattacattcaaattagccaaggccaagcgcataaagcacccattcattatgtacgtcgccaaaccttgaaaaatgcagagcgttacattattcctgagctcaaagaatatgaagacaaagtactgaaatcgaaaggtgcagcgttagcattagaaaagcagctttacgatgaattgtttgatttattattaccgcacttaggttcattacaactggctagccttgcactctctgaattggatgtgttagtcaatcttgctgagtgcgcagataccctcaattacgttatgccaacattctgtgatgaagtgagtgtgaaaattgaaaatggtcgccatcctgttgtggaacaagtattgaaagatcctttcattgccaatccagtggagttaaatcacaaccgtcatttgttaattatcactgggccaaatatgggtggtaaaagtacttatatgcgtcaaaccgcattaattacattgcttgcgtatatcggtagctttgtgccagcagacagtgcgcgaattgggccgattgatcgtatttttactcgaattggtgcgtctgatgatttagcctcggggcgttcaacctttatggtggaaatgacggaaatggcaaatattcttcaccaagccactgagcaaagtctcgtgcttattgatgaaatcggtcgtggcacatccacttatgatggcttatccttagcttgggcttgtgcggaatggttagccaaaaaaatccgctcgcttacattatttgccacccattattttgaattaaccgcattgccggaacagctagaaggcattgccaatattcatttagatgcccttgagcataacaacagcatcgcctttatgcacgccgtacaagatggcgcagcaagtaaaagttatggtttggcagttgcggctttggcaggcgtgccacaatccgtcattaaactagcaaaacagaaattgacacaattagaaaaaaactcaagctattcagccgaacagcaaattcaagcgttgcgtgaagccaatcacaatcagggcgaattattgtttgaacaagaaacggatgcactaagagaggctattgaaaagctggatcccgatgatttaagccctaaacaagccttggcgtatttgtatcagttaaagaaaatggtggggtaaatattatatcctagcgataaattcaaaggtttatatggattggcggaggggaatgggagttgaacccacccaagaacgctggcgtcctcaacaggatttgaaatcctgccacctcaccggagatgacgcccctccgtggttgaaattgcggtcactttagcgtaaattaatcggcaattcaacgttattttaaacggattcaaaaatgaccgcactttttcaacaacttccttccgttgataaaattctcaaaacatctcaaggtctacaacttattaccgaatttggtcacactgcagtcgtggcaacatgtcgagaattattaacccaagctcgtcaatttataaaaaaaaacaatcaacttcctgaatatttttctaattttgaccgcacttttgtagaaattcattctcgcctacaaaaacaaaaccaagtacaaatcaaagcggtgcataatctgacaggtacggtattgcacacaaatcttgggcgggcactttggtctgaagcagcacaacaagcagcgctttctgtgatgcaaaaaaatgtttcgcttgaatatgatttagataaaggtaagcgtagtcatcgcgataattacatcagtgaattattatgcaaactcacaggtgctgaagctgcctgcatagtgaataacaacgctgctgcggtattgttaatgttagcgacctttgctcaaggtaaagaagtaattatttctcgtggcgaattaattgaaatcggcggtgcatttcgtattccagatattatggaacaagctggatgctatttagtggaagtgggcaccactaatcgtacccatctgaaagattatcgtaatgctatcactgaaaatacggcttttttaatgaaagtgcatagcagcaattatcaaatttgtggttttacctcttcagtttcagaagaagagcttgcggaactaggccgagaaatgaatgtaccagtagtcactgatttaggtagcggcgcattgatagatttaagccaatatggcttaccaaaagaatcaactgtgcaagaaaaagtcgcacaaggtgtgggtttggtctctttctctggcgataaattgcttggtggcgtgcaagcaggcattattgtgggtaaaaaagaatggatcgaacaattacaagcccatcctctcaagcgtgcattacgttgcgataaagtcattttagctggcttagaagccacattacgtttgtatttaaatcctgaaaaattaactgaaaaattaccaactttgtacttactcacgcaaccattaaaacaactcaaaataaatgctatgcgtctcaaagagcggttagaatctcgcttaaattcacaatttgatattcaaattgaagctagccaagcacaaatcggtagtggctcacaaccaatggaaagaatcccttccgtggctgttactattgcagaaaaaacaaacgtaaaactttccgcactttcagctcgttttaaacaactttcccaacctattattgggcgaatggaaaacggaaaaatttggctagatttacgtagccttgcagctattgaaacattattaaatacattggatgaactatgattattgttacttcaggtcacgttgatcacggcaaaacagcattattaaaagcattaactggcacaagtaccgcacatttaccagaagaaaaaaaacgcggaatgaccattgatttggggtatgcctatctgccgttagaaaacaaagtacttggctttattgatgtgccggggcatgaaaaattcttgtcaaatatgctggcaggtttaggtggtgtgcattatgcaatgttaattgtcgctgcggatgaaggggttgcgacgcaaacaaaagaacatttagcgatattacgccaacttcaattccacgaaattattgttattatcacaaaagcagatcgtgcaaattcagcgcaaatagaatcgttaatccaagaaattaaacaaaattatagttttttacgtggtgctaattacttcgttacctcagcagaaacgggacaaggaattaatgaattacgtcattacttagctaatctacctgaattatctgatacccaaaaacctttccgttacgcaatagaccgagtattcaacgtaaaaggggcgggtaccgtcgtgacaggcacagccttttcaggaacagtgaaagtaaacgatgaaatttacctttccactggacagaaagttcgtataaaagcgattcacgcacaaaatacatcaagcgaacaaggtattgcggggcaacgtttagcgttaaatttaaatgctgatttagaccgcacatcaatgaaacgaggtgattggttattgcagaatgagccacttccaccaacagatcgcatcagtgtacaaattttggctgaagtaccattaaatgaaaaccaaccagtgcatatttatcacggtgcaagtcgcactacgggtaaactcactttattacagggaaaaaatgccgcaaaaaatgaccgcactttagctgaaatcatattggattcaccattattcttggcttttggagacaaacttattttacgcagtggcgatacaaaaaccttaattgccggcgcacgagtattggaaattaactcgccaaaacgtcataaacgcactgaagtgcggttaaatttcttagcgaatttagcattggcagagaacgcttcgcaacgtattgcgcttacccttaaacataatgcgacaacagcacgccaattaatgtggacggaacaactgacttccttgcaattagataaagcactcgtcgagcgagacgccgtacgttatcaagattggtgttttaatactaattacatacaagaaaaaacgcagcaaattttaaccgcacttaatacttatcacgagcaacataatgatcaacttggtgtaagcaaagccagattatatcgaatgaccgccttaaaccagcctgaaaacttgatcaatcattttattgatgaaatgttaaaagagggaagattacagcaaactcgaggttggcttcacttacccgaacataaaatccaatttagccaagaagaacaaaaatattggtcaagtgtattcgatgaatttgaaaaagcccaaggtcaagccatttgggtacgtgatatggcaaatgctctcgctattgatgaatcaattatgcgtaattttatgtataaagctgggaaattgggttacctcacgccaatcgtgaaagatagatttttcttaactgaaaccatctatgcttatgcgagactcatcaaacaaatcgcagaagaacaaggaaaagtttccgtaaatgaagtacgtgataaattgaatttcggacgcaaacttaccgttcaactgatggaatattttgaccgaatgggatttttacgtcgcaaaggcaatgaccatattctacgcgataagaatgtttttgatttatgatttaaaaaggaaaaaagtatgaaaaaaacgctcgttgctgcattaattagttctgtcatcttgctcacaggctgccaagataaagatactgaagcaaaaataaaacaactaaatcaaacggtagcacaactcagtgctgaaaataccaaattaaaagagcaaatagaaaaaacagttccagcaattattgtggaaaatgatgaaatatttaatcaatctgaaattattaaacatcctaaatcgaaagaagattaccagcctgaagaaaccaaaattgagtattcaatttcaacaataaaaaccaatattgattggcttaatgatctattgtggaaaaaattgactgaaaatgaagaaacgaaaaatatttctcgcgaacaatttgtagcacgttatcaaaccgcttttgaggaagacaaaaaagaggcaaaagaaacaccatcttttggaatttctcattctatatggacaaattttatcgggcaaaaagaaaaacttgcaacctttgcgattagtttttatgactatgaaggtggtgcgcacggtattgaaggtaatcgctatttcacaattgatctaactacacgccatattttgacattaaatgatttatttaatgaaaaagatttaccgaaagtaaaaacgcttttatgggaacaatataataatagcaataaggaatatgaacctattattgaagccgatagttttaatttatcaaacaatatttacttagattcaaaaggtgtacattttatttatgatgtttatgaaatagccccttacgcagcaggagagcaagatttaatgctacattttgggcaactagaagaattatttaaaccagaatttagacagggtaatgatatttaaatcctttaacttttgaatagcaatcaaaatccctaattacattaaaaatgagagactatagattttgcacttcatctttattataatagtctttcaatgtaatactaaggagaaaaattatggcacttacgaattcctctatcagctttagaacagttgagcaaacaaaatcagaagcttatcaagttattgaacaatatggacttaccccatcacaagtattcaatatgtttttggctcaaattgccaagactcgctctatccctattgatttgaattatcttcgcccaaataaagaaaccctagcagctattgatgaattagatagtggtaacgcagagagcttctttattgaagctagtgaaaattattctgccgaagaatttacaaaacgcattcttaatggtggtcaataatgtcagaagagaagccattaaaagtaagctattcaaaacaatttgtaagagatttaactgatttagctaaacgctcccccaatgtgttaattggctcaaaatacattactgcaatatactgtttattaaatcgtttacctttacccgaaaactaccaagatcacgcattagtaggagagtggaaaggttatcgagattgccatattcaaggcaatttggtactgatttaccaatacgttatacacgatgaatttgatgaattgaaattttctcgtttaaatacacactcacaaaccgctttaaaatagaagtaatcttaaataataatccgcacgtaaaatgtgcggattatttttacataggattaaaattcaaactgaacagacattctgtaatttctgccaggtgcataaaagcggtttaagccttcaccagtttctgtttttactcggttaattgtgccaagatgtcgaacagagcgagcagagtcccaagtgagatattttttgttggttaaattatatacaccagcggtaaatgtaagatttttaattggtttccaataggcaatcgtatcgatcactgtatagcgattattacgccataatccgcgagaatcttttacatctttgccgtttgcttttgtagcaggtatatctgttgcattgtcagtatattgcttttcttttctggcgaccatacttgtccattgagaattaaagctatcttttgctttttttgctgcaacattagtgatatacatatccacgccccatttttggcttggtgcatcatagccaatattgtataccgatgtggttggttgtaaggcattcattggttgaggtttacgagcaatggcttcgtattctggatgttcatctttattcaattccaaaaattctttatattttggatgtaatccattgtctttgattctgcctttttgataggtaaatttatagcctaaatggaaaccttgtagtttttcaaataaatcgcccatctcaagacgtgaagcaatttcgatacctctgactcttgctcgatctcgattttggttttgatggaacggatattttattgcagagccttcttcaataggacgttcgcccacttctactaagtcaataaaattacggtaatcgttttgaaacgcatttaacgtaatataactactgtttttataaaaagtgaacgcgacttcttttgttttggaggtttcagcttttaaatctgtgttaggctgaatggaaaattgtggatgtttaaatgtcatataaatttcatcagaggttggcgcacgaaaaccattggcgtatttaagctgtacacgaagccaatttgtgggatcaagatttaaccctaaattgtaagaatgatgtttatagtcagttttgcgtaataacagggcaagattgtcttcaaaattttttttataacacggtgtgtcgtaagtgcaattttcatatcctggaggtattgagtatttactaccataaacatattcctttgagctaaatttcttaaatagcccagtaattaatccattaggaacaggaatgtttttgtcataactaggcaaatattttacgtggtcataacgataatttaaatctagtcctagccaagaggtaagttgcacattatctccaaaatacaacacattatttttagtggtaacagggattaaataggtatctttacctttattggaattcattaagctacatctgtaagcactatgatcaggtgcaggagtatgctccacaggatatgtgccatctacaggtttgttacagaaaaaattgccagcccaccattgcacattggcaacagtgtagtattgatgattcaccatactttttagtgttttttcataaagtccaccatattttagttggtgttgggtatgccataggtgaaattctttgtctaaatcaagtttaatttgttgggtatgggtgtttaaatcacggtcattaacgaagtctgtgctgtagccatggctttttggaaataaaaatttagcactttcatattgggttaatccataattaccttctgctgattttagtgagatttcaccatattttttgccatttaattctttaatggtaatatttcggtcttcataattatatttgtcattcccattttcatcttttccaacaaaaacctgaaattttttattacaatttaatttttcacaattaattaagaccgaatcaagtgagcctccttctgtatctacatcattactaacatcttcaccctttttgttttgtagttctaagccataattatattttcctgtaaattcttgattgtctttatctttaatcttataaattccaccttcttctactaaatgtagcccttgtggattacgtacaccagcacaagtggattgatgacaatactcatcagagcgtgctttattggtaattttttgtgaggaataacttagtttaatatgatcccaaaaaggggtttgactgaaattttcataactaaattgaatattttttcttttagattgatcattaataactcgctcgccatatttttcctcacatttagtatttttgcattgattgaaaatataagacaaatccataccctttgtttctaaagtggaatcatctaatgccacgctcaagcgatggttttcattaggctgaaagcccaattttattaatgtgctttggcgggtaatttgataaggatcggctttttcacgggtaggaccaaccgcacttaaatccgcctgtttattgggataaattttataatcgtagttttctatttcgtgcccatcacgttttgtatcaacgactaaaatatcaaattttttagaacgtcctgctaatgtaagtgtcttaaggttttgattattcattgtttgatagccacgtttataggaaagataataatctttatctatcagataatctcgagcatctttagtttcaaatataacagagccacccaatgcaccactaccggattttaaggagtcagcacctttggtaatagttgctgttttaacattttcaatttcaatgctattacgagtattattaaaattgccatagccttcaaataattctttaaatccttgagagcttaaggtttcagcttgacgaagcccatcaaccataatacctacacggttttcatcaacccctcgaacagcataaccacttgcgcccgttctacctgtttcaaccaccgtaatacctgtttcatagcgaacgagatcacgagaatcagacgcctgctgtttcgctaattttttggcagaaatttgggtttcacctacctttttctctttcacattaattgtttctgtacttcctgaaacattaatttgttctagttgttcagaaacattactattttggttggttggttggttggttggttggttggttggttggttggttggttggttggttggttggttggttggttggttgggcagcataagctgtgcttgcatttaatgcaaatgcaatagagcaagcaagcaggctgaatttaaagttggtcataggtttccttatttttaatgataataattgtcatatattaaataattcaatttatctaatcaatatcaaaaaaagtataataagtacaaaatctaattgctttatatgagcataaaagaaaatcatttttgaccgcacttttgtttgtaagtcatattttaaaattatcaaaatgcaatttttaatcactcttttatcgactgcgtagatttctttcgttataattgagcgtctttttatttaacaaacgtgttcggtgtggattttgaccgagtgcaaattaattgaggtaacaaatgtcattaaatattgaaacaactcaaggtttagaacgccgcgtagcgattaccgttccaactgaaattgtctctaaagccgttcgtgaagaatttaaacgtgctgcaaaaaatgtgcgcgtagatggtttccgtaaaggtcatgttcctgcccatatcattgaacaacgttttggtgcgtcaattcgtcaagatgtattaaacgatttattaccacgtcatttttttgatgctgttattgcagaaaaaattaatattgcaggtcgtccaacttttgctattgaaacttttgaagaaggtaaagacttagttttcactgcaactttcgaggtttatccagaagttaaattacaaggtttagaaaatatcaaagttgaaaaaccaactgttgaaatcacggaagctgacattgataaaatgatcgatgtgttacgtaaacaacaagctacttgggctgaaagtcaagatgttgtaaaagcagatgatcgtgtcactattgattttgttggctctgtagatggcgaagaatttgaaggtggtaaagctactgactttgtattatttatgggtcaaggtcgtatgattccaggttttgaagaaggaattgttggtcataaagcaggtgagcaatttgatattgatgtgactttcccagcggaataccacgcagaaaacttgaaaggtaaagcagcaaaatttgcgatcactttgaaaaaaatcgaaaatatggtgttgcctgaattaacagatgaatttgttgctaaatttggtcctaatactaagtctgttgctgatttgcgtgcagaaatccgtaaaaatatggaacgtgaattgaaaaatgcgttagtttctcgtgttaaacaacaagtaatcaatggtttaattgaacaaaatccgattgatgtgccagcttctgcagtagaagaagaaattaatgtattacgcaatcaagcagctcaacgttttggcggtaatgcacaacaaactgcacagttaccgcgtgaattatttgaagctgaagcaactcgtcgtgtacaagtgggtttattattctctgaagtgattaaatctaatgaattaaaagctgatgaagaacgcgctaaagcaatgattgcagatattgcatcagcttacgagcagccagcagaagttgtggaatattacagcaaaaacgaagagttaatgaataatattcgcaatgtagtattggaagaacaagctgttgatgcagtacttgcaaaagcacaagtaacagaaaaagtttcttcattcgatgaaattatgaatccacaagcataataagtaatattattatgattgaataaaagtgcggtcgctctttttaataaaagcgatcgcatttttatttgtgggttatttacgataaaataattagcagttttaatgaaaaaggtaagaaaatgagtgtaattcctatggtcgttgaacagacttcgcgtggcgaacgttcgtacgacatttattcccgtttattaaaagaacgtgtgattttcctaagtggagaagtggaagatcgtatggcaaatttaattgtggcacagcttctttttttagaatcggaagatccaactaaagatattaatatttatattaactctccaggcggttctgtgaccgcaggtatggcaatttacgacacaatgcaatttattaagccagatattcgcactctttgtattggtcaggcttgttcaatgggcgcattcttacttgctggcggaaccgctggcaaacgagctgcgttacccaatgcgcgagtgatgatccatcaacctttgggtggtttccgtggtcaagcatcagatattcaaattcacgcacaagaaattttgaaaattaaacacaccttaaatgatcgtttagcattccatactggacaaggtattgagcgtattgagaaagatactgaccgtgataattttatgtcagctgaagaagcacaagcgtatggtttggtggatgaagtcttggttaaacgttaagggtatataatgacagacaaagataaagatttgcactgctctttttgcggaaaggaaaaaggcgaagtagatagattaattgctggcacagacggttatatttgtaatgaatgtattgaactttgtcactcaatgcttgaagaaagtcatgataaaaatttagaggaaagtgcggtagaaaatgaagaaaaattaccaacacctcacgaaattcgcgctcatctagatgattatgttatcggtcaagattatgcgaaaaaagtgctttctgtggcagtttataatcattataaacgcttgcgaactaactatgaaagcaatgatgtagagcttggtaaaagtaatattttacttataggccctacaggtagcggaaaaacgttacttgcgcaaacattagctcgtcgtttaaatgtaccctttgcgatggcagatgcaaccacattaacggaagctggttatgtgggagaagatgtagagaatgtattacagaaacttttgcaaaattgtgaatacgatactgaaaaagcagagaaaggcattatttatattgatgaaattgataaaattagccgtaaatcggaaggcgcatcaattactcgagatgtttcaggagagggggtgcaacaggctttattaaaacttattgaaggtacaatagcttccattccacctcaaggcggtcgtaaacatccacaacaagaaatggtaaaattggatacgtctaaaattctctttatttgcggcggtgcatttgcaggattagataaaattattgataaacgcactcaaaccagtacgagtattggttttaatgccaaagttgaaaaagatgaaaaacaacaatctctttctgaattattccgtcaagttgaacctgatgatttgatgaaatttggtttaattccagaatttatcggacgcttgccaatgattgccccattaagtgaattagacgaagatgcgctgatacaaattctcacaaaaccaaaaaacgcattaattaaacaatatcaagccttatttggattggaaaaagtagaattggatttcacaccagaagcattaaaagcaatggcgaaaaaagcacttgaaagaaaaacgggtgcgcgtggcttacgttctatcgtagaagcagtgttgttagatacaatgtatgatctaccgtctcttgagaatttacaaaaagttatcgttgatgaatcgacaattgtagataatcttgcgccaaaattagaatattagatttaatcgcaaaagtgcggttgttttcgccagattttctatgttgatgcttattttcaataggcaaggcgaaaagaaaatgctacaatcgcacgttcttatggcattattttttacatttccatttaaaacggattcaattctatggcaaccgaaattgttgataaaaagaaaaatacgcaagaagtgatcgttgaaggcaaatctaaaggtttaaatacattcctttgggttttagttgtgatcttttttgctgctgcggcaattgggaatatttatttccaacaaatctattctttaccgattcgtgttattggtatggctattgcattagtcattgcatttattttagcggcaattactaatcaaggaacaaaagcacgtgcgttctttaatgactctcgtacagaagcgcgtaaagtcgtatggccaacccgtgctgaagcgcgtcaaacaacattgatcgttatcggggtaacaatgattgcttctctcttcttttgggcagtagattcgattattgtgacagtgattaatttcttaactgatttgagattctaaaatgactgaagaaacaacagtatcaaaaaaacgttggtatgtattacaagcgttttctggctttgaaagtcgtgtagctctaactttacgtgaatacataaaacaacaacaaatggaagatcaatttggtgaagttttagtgccaactgaagaagtggtggaaaatgtagcaggtaaacgtcgcaaaagtgaacgtaaattttttccaggttatgtacttgtagaaatggaaatgaatgatgaaacttggcatttagtaaaaagtgtgccaagagtgatgggttttatcggtggtacaccagataaacctgcacctatttccaaacgtgaagcggatactattttaaatcgtcttgaacaaaatactgataaacctcgtcatcgtaatgaatatcatccgggagaggaagttcgtgtgactgaagggccatttgctgattttaatggtacagtagaagaagtggattatgaaaaaggtcgcttaaaagtgtctgtatcaatctttggccgtgctacaccagttgagcttgaatttggtcaagttgaaaaaatacactaagaaatgattaaaatataaccgcacttttgtagtgcggttttttgtttttaatgtttgttgaaacagcataaaagagtgtttttatacgcaaaatttgttgttatttcacaaattaggtagaataatcccatatttatgtaaggatcaaaaatgaaaacaaaggtaattttgaccgcacttttgagtgccattgcactaacaggttgtgcaaatcacaacgccacgaaacaagcaagtgagcgtaatgattcccttgaagacttcaatcgaacaatgtggaaatttaactataatgttatagatcgctatgtgctagaacccgctgcaaaaggttggaataactatgtgcctaagccgatttcttctggtcttgctggcatcgcaaataatcttgatgagccagtcagtttcataaaccgattaattgaaggtgaaccgaaaaaagcatttgttcactttaatcgcttttggattaacactgtatttggactaggtggttttattgattttgcgagcgcaagcaaagaattacgcatagataatcaacgtggatttggggaaactttaggtagctacggcgtagatgctggcacttatattgtgctaccgatttataatgcaacaacaccacgccaattaacgggtgcagtggttgatgcggcttatatgtatccattctggcaatgggttggtggtccgtgggcattagtgaaatatggtgtgcaagcagtggatgcccgtgcgaaaaatctcaataatgcagaattgttacgtcaagctcaagatccatatatcacgttccgagaagcttattaccaaaatttacaatttaaagtaaacgatgggaaattagtcgaaagcaaagaatcacttcccgatgacatactaaaagaaattgattaataaacagaaaagtgcggtaaaaattacccaattttttatcaactaaggagaaaatgatgactcaaattattcatactgaaaaagcaccagcagccattggcccttatgttcaagcggttgatcttggcaatctagttttaacctcagggcaaattccagtgaatcctgcaacaggcgaagtgccagctgacatcgttgcacaagcacgccaatctttagaaaacgtgaaagcgattatcgagaaagcaggtttaaccgcagccgatattgtaaaaacaacggttttcgtgaaagatcttaatgattttgctgcggttaatgcagaatacgaacgtttctttaaagaaaataatcatcctaacttccctgctcgttcttgcgtagaagttgcgcgtttaccaaaagatgtgggattagaaattgaagcgattgctgtaagaaaataattttctgtttggtaatccctgcttaaaagtgcggtcataaactcgcatgtttttgaccgcactttttgtttatctgctgataacaaaaattttacattacaccttgaattttttgtgaattttccccacaaaggaaatacttaaccctaactttgagagaacacattatgatgcgaattcttcttttcttggcaaccaatatggctgtaatgctggtattggggattattttaaatgtgactggtattgcaggaaatagcactggcggcattttaattatggctttgctatttggttttgctggttcattaatttccttattcctgtctaaaacgatggcattacgttctgtagatggagaagtgattactcaacctcgtaatcaaactgaacgttggttaattgatactgttagtcgccaagcacagaaagcgggaattccgatgccagacgtggcgatttatcattcacccgatgtgaatgcttttgctacaggtgcaacgaaaagcaattctttagtggcagtgagtacgggattattaaacaacatgacggaggctgaagctgaagctgttttagcgcacgaaatttctcatatttccaatggcgatatggtgacgatggcgttattgcaaggcgtattgaatactttcgtgattttcttatctcgcgttatcgcaacggcggtagcaagttcgcgtaacaataatggagaggaaacgcgcagttcaggtatttatttcttggtttctatggtattggaaatgctctttggtgtgcttgcgagtattatcgcaatgtggttctctcgttaccgagaatttcgtgcagatgctggttccgcaagtttagtaggcaaagaaaaaatgattatggcactgcaacgtttgcaacaacttcacgaaccacaaaatctcgaaggttctttaaatgcctttatgattaatggtaaacgcagtgaactctttatgagccatccaccactcgaaaagcgtattgaagccttacgtaatctttaaaaattataaaaaatcgaccgcactttaatgaggtcgatgttttattttcctcttttcacccaatatttgaacgggggcttttccacttcactttgcagtaatgtgtgatccataaattgacagaaacttggaatatctcttgttgttgcaggatcgtcagcaataatcaaaagtatttctccatcgttaagatgacgaatatttttacgaacaagcatgacaggttctgggcaacgtaatcctaaagtatttagggtttgtgtgacggaaatttcagacatattcttttttcttttgaaaaacagagccatatcataccgcacttacggcaaaatttcgacaaatcccagtcatcagtgatagactagtgtcattgaaattaccttgaaaaaagaaatggcggaatacctcgttcctaaaagtgcggttgtttttgaagaagaaattaagaaaagccgttttattacttatttacagcacaccgaaggtttagaagacgcaagagctttttgggcaaagattaaacaagaacatccaaatgctcggcatcattgttgggctgccgtagcaggcaagccaacagattctctacaacttggtttttctgatgatggcgaacctgctggaacggcaggaaagccaatgttgagtgcattgcaaggtagtcaattaggtgaaatcagtgcggtggtggttcgctattatggcggcattttgcttggaacgggcggattagttcgtgcttacggcaatggcgtacaacaagcgttaaagctgattgaaagcgaaattaaagttgaacgaacccctttcaaacttgattgtgactatggtcagttaaggttggttcaacaactttgtgaaaaatatcaggttgagattttatctcaaggttttcaggcaaatattcatttgattttaggtattagtgaaaaaacaatagaggcgttttcttcagaattaacggaaaagtcttcaggtagattggttattcaacttttagagataggcgaatagttgtgcgtattttatcgattatccgaattattggtattcttgtgatgtgtttttcaggtacgatgctagttcctgcatttgttgctctgatttatggtgatgggggcggcaaggcatttatgcaggcttttatgttgagcttgacagcgggcacattgctttggtggccatgccatcaccataaacaagaattacgatcccgtgatggttttttgattgttgtggctttttggttagttttaggaagcttggcaacattgcctcttttattgttcgattcaccacatttaactattgcttcagccgtatttgaagcattttctggcttaactactactggtgcaacggtaatgacggggctggataatttacctaaatctattttgttttatcgtcagtttttacaatggttaggtggtatggggattatcgtattggctgtggcgataattccgctgttgggaattggtgggacacaattatatcgagcagaatcttcaggccctcttaaagatcaaaaatctttgcctaaaatttcagaagtggcgaaagcgctatggattatttatgcttcattaactgttctttgtgccattgcatattggctatcaggaatgaatctttttgatgccattgggcatagtttttcaacaatttcaaatggcggattttcaacgcacgatgcaagtattggctattttaatcaagcttccatttattgggttacaacaatttttatgctgattggtggtgttaattttagtttacatatttccgcttttcttgcactaggtaaaagaaatatttggcgaaattattggaaagatcccgaatttcgtttttttctaacgatgcaaattatttttattggtattgtatctctatctttatatggttatggtttagtttcagatataaacgaggcagtaacaaaaggtgcattacaattaacatcaatgtcaatgactgctggttatacgatttttgatattgataatcttccgccttttattgggcttttactggtaatttctgcggtaattggtggttgtggtggttcaacaactgggggattaaaagcgatacggacacttatattgtggaaacaaatcgatcgagaactgcatagtttaatccatccaaatttagtacaaccaattcgaataggtaaaaatcgtctagcaccaagaatgatagaaagtatttgggcatttttcattatttttatactggtttattgggggtgtgtttttgctgttattctttgtggaatgaatacttttgatgcgatgggagccgtattcgccacattaacgaatgcaggaccgggacttggttttattcacgaaagttttattggtgttccagaaagtgctaaattagtctttagttttgctatgatctgtggacgtttagaaatgttttcattaatcgtgctgtttattccaagctattggaaaaaataataataattggaaaattattgtatttttgaccgcactttttaataaaatgtttatatttccatcaaaagatcatttttttaaatatttttacaaaaagtacttgcaagggatttgaaaatccctataatgcaccgcacacaacgacgcactgttgtgaagttttttaagtttccaagtgcgtcgttattttttgctctttaacaatatatcagacaatctgtgtgggcacttgttgattgacttgttttaaaaatattttaattttgaagtcttaataggtgcttaactgaaaattcatcattacttttttaagtagtgttttatttatagctaagcagtttattgagcgattgaacttgaattgaagagtttgatcatggctcagattgaacgctggcggcaggcttaacacatgcaagtcgaacggtagcaggagaaagcttgctttcttgctgacgagtggcggacgggtgagtaatgcttgggaatctggcttatggagggggataacgacgggaaactgtcgctaataccgcgtattatcggaagatgaaagtgcgggactgagaggccgcatgccataggatgagcccaagtgggattaggtagttggtggggtaaatgcctaccaagcctgcgatctctagctggtctgagaggatgaccagccacactggaactgagacacggtccagactcctacgggaggcagcagtggggaatattgcgcaatggggggaaccctgacgcagccatgccgcgtgaatgaagaaggccttcgggttgtaaagttctttcggtattgaggaaggttgatgtgttaatagcacatcaaattgacgttaaatacagaagaagcaccggctaactccgtgccagcagccgcggtaatacggagggtgcgagcgttaatcggaataactgggcgtaaagggcacgcaggcggttatttaagtgaggtgtgaaagccccgggcttaacctgggaattgcatttcagactgggtaactagagtactttagggaggggtagaattccacgtgtagcggtgaaatgcgtagagatgtggaggaataccgaaggcgaaggcagccccttgggaatgtactgacgctcatgtgcgaaagcgtggggagcaaacaggattagataccctggtagtccacgctgtaaacgctgtcgatttgggggttggggtttaactctggcgcccgtagctaacgtgataaatcgaccgcctggggagtacggccgcaaggttaaaactcaaatgaattgacgggggcccgcacaagcggtggagcatgtggtttaattcgatgcaacgcgaagaaccttacctactcttgacatcctaagaagagctcagagatgagcttgtgccttcgggaacttagagacaggtgctgcatggctgtcgtcagctcgtgttgtgaaatgttgggttaagtcccgcaacgagcgcaacccttatcctttgttgccagcgacttggtcgggaactcaaaggagactgccagtgataaactggaggaaggtggggatgacgtcaagtcatcatggcccttacgagtagggctacacacgtgctacaatggcgtatacagagggaagcgaagctgcgaggtggagcgaatctcataaagtacgtctaagtccggattggagtctgcaactcgactccatgaagtcggaatcgctagtaatcgcgaatcagaatgtcgcggtgaatacgttcccgggccttgtacacaccgcccgtcacaccatgggagtgggttgtaccagaagtagatagcttaaccttttggagggcgtttaccacggtatgattcatgactggggtgaagtcgtaacaaggtaaccgtaggggaacctgcggttggatcacctccttactgaagacgagagacagcgagtgctcacacagattggctgatagttgtagacaagattaaaaacgaagcgaaagcaacgttgaaaaataaacgttaaaagataaaaagaaaatagagtatctttaattgatgtccccatcgtctagaggcctaggacatcgccctttcacggcggtaaccggggttcgaatccccgtggggacgccaattaaagataactttattagattgtcttactgttctttaaaaaattggaaacaagctgaaaacaagagattttcgagagaaagtctgagtaggcaagacaggaaagtgaaagagagaactgaaaaggaaactctaaaaacaaacctgttttgtaaaaaaatcttgattgaacaaaagcaatcaagtgtttagttgaataaaaatacgcatcaaattgaccgcactttgaagtgaaaacgtaaagtgattgaaaacatttgaggttgtatagttaagtgactaagcgtacaaggtggatgccttggcaatcagaggcgaagaaggacgtgctaatctgcgaaaagcttggatgagtcgataagaggcgtttaatccaagatatccgaatggggaaacccagtagatgaagaatctactatcaacaagtgaattcatagcttgttgaggcaaaccgggagaactgaaacatctaagtaccccgaggaaaagaaatcaaccgagatttcgtcagtagcggcgagcgaaagcgaaagagccagtaagtgatagcagtatagtgaggagaatgtgttgggaagcacaatcaaagagggtgataatcccgtatctaaaaaccatattgtggtactaagctaacgagaagtagggcgggacacgtgatatcctgtttgaagaaggggggaccatcctccaaggctaaatactcctgattgaccgatagtgaaccagtactgtgaaggaaaggcgaaaagaaccccggtgaggggagtgaaatagaacctgaaaccttgtacgtacaagcagtgggagccccatcacttaatccgattggaaggtgatgaaaagcaaccgcacttaaacaatggtaagaggagcgaagcgagtcaaaccacccaaaagaagcagtgggattaagtgatggggtgactgcgtaccttttgtataatgggtcagcgacttatattttgtagcgaggttaaccgaataggggagccgaagggaaaccgagtcttaactgggcgtctagttgcaaggtatagacccgaaacccggtgatctagccatgggcaggttgaaggttgggtaacactaactggaggaccgaaccgactaatgttgaaaaattagcggatgacttgtggctgggggtgaaaggccaatcaaaccgggagatagctggttctccccgaaatctatttaggtagagccttgaggtgacacctttgggggtagagcactgtttcggctaggggtccatcccggattaccaacccgatgcaaactacgaataccaaagagtgatactcaggagacacacggcgggtgctaacgtccgtcgtggagagggaaacaacccagaccgccagctaaggtccccaagtctatattaagtgggaaacgaagtgggaaggcttagacagctaggatgttggcttagaagcagccatcatttaaagaaagcgtaatagctcactagtcgagtcggcctgcgcggaagatgtaacggggctgaaatatagcaccgaagctgcggcatcaggcgtatcactaatacgccttacgattaacaagctagaatggcgcgaagcggcatgaaaggttgttcaagcaacccgaacgttgagtcggggtatttttgaagtaaggattattagtgatacgcctgttgggtaggggagcgttgtgtaagcggatgaaggttaatcgagaggttagctggacgtatcacaagtgcgaatgctgacataagtaacgataaaacgggtgaaaaacccgttcgccggaagaccaagggttcctgtccaacgttaatcggggcagggtgagtcggctcctaaggcgaggctgaaaagcgtagtcgatgggaaacaggttaatattcctgtacttggtaaagctgcgatgtggggacggagtaggttaggttatcgcactgttggatatgtgcgtttaagttggtaggtgggaagtttaggcaaatccggacttccttaacacagagagatgatgacgaggctctacggagctgaagtaactgataccacacttccaggaaaagccactaagcgaaaggctttactaaaccgtactgaaaaccgacacaggtggtcaggtagagaatactcaggcgcttgagagaactcgggtgaaggaactaggcaaaatagcaccgtaacttcgggagaaggtgcgccggcgtagattgtagtccctagcgggcgaaggttgaaccggtcgaagataccagctggctgcaactgtttattaaaaacacagcactctgcaaacacgaaagtggacgtatagggtgtgatgcctgcccggtgctggaaggttaattgatggtgtcatcgcaagagaagcacctgatcgaagccccagtaaacggcggccgtaactataacggtcctaaggtagcgaaattccttgtcgggtaagttccgacctgcacgaatggcataatgatggccaggctgtctccacccgagactcagtgaaattgaaatcgccgtgaagatgcggtgtacccgcggctagacggaaagaccccgtgaacctttactatagcttgacactgaacattgaattttgatgtgtaggataggtgggagcctttgaagcagtgacgccagtcattgtggaggcgaccttgaaataccaccctttaacgtttgatgttctaacgaagatgacgaaacgtggtctcggacagtgtctggtgggtagtttgactggggcggtctcctcccaaagcgtaacggaggagcacgaaggtttgctaatcacggtcggacatcgtgaggttagtgcaatggtataagcaagcttaactgcgagacagacaagtcgagcaggtacgaaagtaggtcatagtgatccggtggttctgaatggaagggccatcgctcaacggataaaaggtactccggggataacaggctgataccgcccaagagttcatatcgacggcggtgtttggcacctcgatgtcggctcatcacatcctggggctgaagtaggtcccaagggtatggctgttcgccatttaaagtggtacgcgagctgggtttagaacgtcgtgagacagttcggtccctatctgccgtgggcgttggatgattgattggggctgctcctagtacgagaggaccggagtggacgcatcactggtgttccagttgtctcgccagaggcattgctgggtagctaaatgcggaagagataagtgctgaaagcatctaagcacgaaacttgccaagagatgagtcatccctgactttaagtcagtaagggttgttgtagactacgacgtagataggtcaggtgtgtaagtgtagtgatacattgagctaacagatactaattgcccgagaggcttaactatacaacgctcaagtgtttttgggagctaagtgaagtaagagatgaaaagcgaagcaaataaaagtagagcggaaaccgaagtaaaagactaaacaaagaaaagtaaatatagaagacttaatagagagaaaattgagttcagcttgtggccaataagaacgagtgaaaggtagagtaaagactgagtaacgagagataaaagagacgagagataaaagagaagacgagttatcaaagaattatcttggcggcgatagtgcggtggacccacctgagaccataccgaactcagaagtgaaacgctgtaatgccgatggtagtgtggggtttccccatgtgagagtagggcaccgccaggttttatttttttagtttattcattgagtaaattaaaaaaataaaaaatttttggcagagatagtgcaatagatccacctgataccataccgaactcagaagtgaaatgttgtaacgctgatggtagtgtggggtttccccatgtgagagtaaggcactgccaatcatcatttttagcggagtggtagttcagctggttagaatacctgcctgtcacgcagggggtcgcgggttcgagtcccgtccattccgccaattcatatcatagtttattgataccaataggggcgtagttcaattggtagagcaccggtctccaaaaccgggtgttgggagttcgagcctctccgcccctgccattaaaaaacctttcattttcaataatttactacattgtaaaaattttcttgtgagaaataatcctattcttgtagtgtaaatgtgacatttattcataaactttattatgtgatcgcatttaaatacgtaggaatataataatttctaataattatttttaaataattttgaccagttttataattttacattagtatacgagtcttaattttgttgtaaggaataaaaatggaagagtccctagaattagaaaaattgccacgaatcattactgatgtattgaaaattgtgctttgtacagcgttgattgcgctagcgattgtgcttattattgcccttgtaaaaataacttatactttatctatgatggtgcttaacacttcgtctgttgtaccttatgatgttgctgaacaagcagtaatgtttttcttatatttcgggtttattggtttgattgtgcagtattttaaaagcggatatcacttccctttacgctattttatttatgctgggatcactgcgatgttgcgtttaatcattgttaatcatgaaagctcggtggataccatcttatttgcaggcgcaattttgattatggtgatcgcactctgtttggtgttatattctaataaactgaaaaatatatagttttagattcaaaacaacaaaaaacgcacttcacttgaagtgcgttttgtctttttagttgagctactcagatttgctttctaaaagtgcggttgaattttcttctgttttttcttccgcactttctggaatgacatcctgaattgccatcactgatttcaaactctcttggcgaacttgttcagctaatgctttatcgcccgcttgttcaaatacataagatgccatcatcaaatcattttgttctaattgttcagggcaagcgatcacgtttttgaatacatctgctgctttaataaattcattgttacgaacatataaataacccaaagcacgattgatacagcatttttgtttttcatccacacgttttgcacgtttttctattagcttgagaagtttactgttatcttctggttgtaaacgtgtaatttgagtacaaagaggtaaactgattgctgtattgtcaccgagttttttcagtatttcaaatgtcaattcagtagctgattcatgatcattacagtcaattaaacgttgaataaggctaattttaagttcaatattgttacggcgatgacgaggttgctgattccaccaagttagtaagccatcaattccttcttcgttcattttctcgtcgagtaaaccattttcggttttagatcgaagatctttgaattcttcatcattgaataaaccgctattcgcaacattgtctaaaattttatctagagcttgataggctttagagcgaagataaatttctaccgcgagttttaatacttctttattgcgacgagccatttctaataagctatctacagaactgcgtgctgcaggtaacttgttttgttgcaataaaatgcgagtacgggcaatttccacgagcaaattatcagagccggctaattctgtcgcttcaattaaatagcgatttgcactaaattcgtcgccacgttgttgagcagcttctgctgctttgatgagatttagtacaggttcagcagaatgtttagcatttttgccaattaatttttctgctttagcgtaatccccttcattcatttttaccaagccttcaagggtttgtttttgcgcttttacacgtttgcgattagaaaaccattgataagagctacgacttaaacgaaagaaacgagtgatgccccattcaaaagcataaattattgctaaagaaataatgaaaaaaatcactaaggtagtgatggacatttctataatacgatttgctgtctcaatgcgcacataaccttgctgaccagaaatataaggccctgctacaagtcctacaagcaatgtcagcattaaaaagagcactctaaacatagacttatccttattgttgtgattcagattgtgttggtttaacagcttctactttaggcattgtatcaatcgccttgtctgcttcaatttccactttttgtagatctaaagctgtacgattaagatatttgtcaagtaatgttaaactttttaattgctctggtacatctacataaatagaagtatcagtcaatccatctactaattttaagaaattttgtgttacttcagcgtttgtatcaaaatagctacgaacccaagaagaaacagcttctagagattgcttataaagttcattttgctgacgaggaactgccataatcgcaagctgtaaacgtagacgaatgttctcacgaagataaatatcttgatttggtgcaagtaattcttttttatttgaattttgttttggcgaaatacgaataaaatgatttaggaaagaggttgcacttttttcaatattttgttgccagtcagtaatgttgttggataatttatcattatttttagatgtttcatcaaaatttacattcaaagcctgtaattcatcgactgtgtttgcaagctgtgacagtttttgcattatcgcattttgatccacacttgaaagcgaaagaagttgttttaaatcttgattgattgcactacgaatttcatttgcttgtgaattattaaccttgacgagggtttcatcagctaattttaataaagaaaccgctgtatcaacatcgttatctaaaacaagtttacgcagggcattatttagtaaaaaatcagcttcggaaaataaccaatcgcttggttgttgtgcgatggcaagctgacttacttgtttcatttgagtttgtaaggatgttatttcccctgttttgcttacaattaattgttccagttgagctatattttcttgtgcagtttttaaactctgttctaattgtgtaagtcgtttattgttattggtgttatttgaggaaagatttgctcccgtttgattttcaagtgcggttaatttctgttgaatttcagctatttgttgctgaccaaaatagtatccagctccaccaatacctagcgcaacaagtattgctaataaactcaatgctgtacccgtttttttcacaatagtttgcggaacagactgcattgtttcagcttgttcaacagctgttttgggcgtatctgtaagttgttcagtgaggtcgttaggttgctcttttgccatatcaattccttaataagtgatattgagtaaggtattttataatactttgcgttgataagaaaaatatcaagctatccactaataatagaaaatatagatttttatatcggcagaattaagctatttacgcaataaaattaggtgctatcctaccactcttaggtaaaaaagtcattttgattgttgataggtaaaacttataatatattttaaaaaaattgtgatttatgtcacatttttttgcatttatactccctaagtggtaaattgttcgccaatttttgttgttctggtagggacaccacgtggaatgtaatctagcacaagcaaaacaatgggttagcgccttggatcaacgccgttttgagcgtgcattacaaggttcaggcgatgcattccaacacgttttagcgattgcacctttacttctacacctaaaccatccgcaacttcccggctatgttattcacgccccctctggcattgcgaatttccttgcttctgattatcaaaaaaaatggctcaccaatgaatacagtattcactatgccgatcataagccatcaacactcaaaagtgcggtaaattttcacgaagttttaccaccaattctaggcgtttatgtaatgggtagctttggctcaataagtcaaacctcttcttcagatcttgatacttggatttgtgtccgtgatggcttgagtccagatgaatatacacttcttactcaaaaagccaagcggattagtgaatgggcaatgcaatttaatgtggaaattaatttttatttgatggatcaacaacgtttccgcaatgaacattatgctgacccactgactattgaaaatagcggctctgcgcaatatatgttattgcttgatgagttctatcgctccgccgtacgcttggctggtaaacctctactttggttgcatttatgggtggaaaatgaaaaagactatgaaaaacaggtggcgcgtttaattactgaaggggaaatagatccaaatgattgggtggatttcggcggtttaggacaattttctgcaaacgaatatttcggtgccagtttatggcatctttataaagggattgattcaccttataaatctgtgctcaaaattttgttgttggaagcctattccaaggaatacccaaacacttgcttaattgcccgcacttttaagcgagatttactttcaggcaataccaatcctgatcaccattttgatccttacattgccattcttgcaaaagtaacccaatatttaaccgcactttctgaatttaaacgtttggattttgtgcaccgttgtttctatgtgaaagcaacggaagattttgcacgttaccaagccaataattggcgtattcgttatatggaaatccttgcgcaagaatggggatggtctgcagaaacggtaaaacatctcaataagcgtccattttggaaaattaaggcagtaaaagaaaaccacgataacataatgaaatttttaatgttgagttatcgtaatttagtggaatttgctcgaaagcatcatattcactcgagcgtcgtgccacaagatatcaacattctttctcgtaaactttatactgcttttgaagaacttcccggcaaagtgtccttactcaacacacagatatctcacaatttatcagaagcacacctgacttttgtggaagttcgtggcaataaacattttaaagatagttggtaccttatcaatcaaccaatacaccatattatgttctccaaagaacgggtgatcgaatacggagaaagcctgaataaattagtttcttgggcttatttcaatcatttactcacagaaaaaaccgaattgtcaatttttagcaagaatgtgactttaagcacattgcaacgctttgtcactaacttacgtcagtcttttccaagcaccatcgccaaacaacctaaaaatagcgatttattgaatcaatgtgaaattcgtagcttgtttattgccataaatctcacgaccgatccaacatccaaagtagaagaagtattaacgggtatttcatcgcgagatttatttagttttggatcgcttgagcaaagccttgtgggcagtattgattttacttatcgtaacgtgtggaacgaaatccgaacgctccattttgaagggcaaaatgccattttgcttgcactaaaagtgctttctaacaaaatttatcgtggcgttaatcgcccagattccatccaagtctattgttatagtgaacgttatcgccaagatttacgtcaattagtgatgggattagtcaatcgatgcgttagcatccaagtcggcgatattcaacaaccttgccaaacgtcacgtttacgcgtagcgggtaaaaactggcaattattttttgaagatcgcggcatcagcttacaagaaatcggaaatgaatcggtctgtaatgacgctgaaagtgcggtggattttgacgaagttttacaaacaccaattgaagatggcgagacaaaccaagaaagtcgtcgctatccaccagaaatggatgccttcgcaagtgaaggattcctacaattcttttttgaagataattctgatcacagcttcaatgtttatattttagatgaatctaatcatctcgaaatctatcgccactgcgatggtgaaaaagatgaaaaagtgcgggagattaatcaactttatcaaaacgccaaacaggaaggcgataaaaatccttacaatatcgttcaacataattttaactaccctcaattttatcaactacaaaatggaaaaaatggcatatccatcgtgccgtttaaattccgccaaatgaataagtaatattttcctgtggttgataggttaccgaaagatatctatacttatttcctcttttactagataaattgtagatatgataacttcgcaaacaccaatcactgtgctaggtgcgggatcttatggaactgcgctggcaattaccttttctcgcaatggttctcccactcacttatgggggcacaatcccgtccatatcgcacaaatgcagacagaacgacaaaattatcgttttttgccggatgtcatctttcctgaggatcttcatttagaaagtaatcttgcacaagcaatggaatattctcaagatattttaatcgtggtgccaagccatgctttcggtgaaattcttataaaaattaaaccgcacttaaaagcccatcaccgattaatttgggcaacaaaaggtctggagcgtaacacagggcgtttactacaaaccgtagttgaagaacaactcggaacgcaatatccactagctgtactttctggcccaacttttgcaaaagaattagcgcaaggtctaccatcagctattacgcttgctgccaataacgagcaattcgcgcgggaatttcagtctcgtattcattgtagtaaaggtttccgagtttatataaattcggatatgactggcgttcaacttggtggtgcaattaaaaatgtgatcgcaattggtgcgggtatttcagacggtatgggatttggcgcaaatgctcgcacagcactgattactcgaggtattgcagaaattacccgcttaggtatctcgctcggtgcaaataccaatacatttatgggaatgtctggattgggcgatttagtgctaacttgcaccgataatcaatcgcgcaatcgacgttttggattaatgctaggtaaaggattagatgcccaaatggctatggaaaatatcgggcaagtcgtagaaggtttttataatacaaaagaagcctatttgcttgcacaaagacaaggtgtggaaatgccgattacagaacaaatttatcaaatgctgttttgtggcaaaaacgcacaagatgtagcaatcagccttttggggcgagcatgtaaaggcgaataaaataaaaggagaaattatgacattagatgtgtggcaacatattcgccaagaagccaaagaacttgctgaaaacgaacctatgcttgctagtttttttcactctacaattttaaagcatcaaaatctgggtggtgcgctaagttatttattggctaacaaattagccaatcctattatgccagctatttctctccgtgaaattattgaggaagcctatcaatctaatccttcgattattgattgcgctgcttgcgatatccaagctgtccgccaccgagatcccgctgtagaattgtggtccactccattgctttatttaaaaggtttccacgcaattcaaagctatcgaattacccattatttatggaatcaaaatcgtaaatcccttgccctttatttacaaaaccaaatttcagtagctttcgatgtagatattcacccagcggcgaaaattggccacggaatcatgttcgaccatgcaacaggtattgttgtgggtgaaacatctgtaatcgaaaatgatgtttcaattttgcaaggggtaacacttggcggtacgggaaaagaatcaggcgatcgtcatcccaaagtacgcgagggtgttatgattggggcgggtgcaaaaattctcggtaatattgaagtgggtaaatacgccaaaattggggcaaactctgttgtgcttaaccccgttcctgaatatgccacagcggctggcgtgccagctcgaattgtaagtcaagataaagcagcaaaacctgctttcgatatgaaccaatattttatcggcattgatgatggaatgaatttaaatatataaggagacaccatgatcaacaaagatacccaactctgcatgtctttatcaggtcgtccgagtaatttcggtactacctttcacaattatttgtacgacaagctagggttaaatttcatttataaagcattcaccacgcaagatattgagcacgccatcaaaggcgttcgcgcattaggcatccgtggttgtgctgtttcaatgccattcaaagaaacttgtatgccatttttagatgaaattcatccgtcagcacaagccattgaatccgtaaataccatcgtgaacgataatggctttttgcgtgcatataacactgattacattgccatcgtaaaattaattgaaaaatatcatttaaataaaaatgctaaagtcattgttcatggcagtggtggtatggcaaaagccgttgtggctgcctttaaaaattcaggttttgagaaattaaaaatttacgcacgcaacgtaaaaacaggtcaatatctcgccgcactttatggctacgcatacattaattctttagaaaaccaacaggcagatattttagtcaatgttacgccaatcggcatgaaagggggcaaggaagaaatggatttagcctttccaaaagcgttcattgataatgctagtgtcgcgtttgatgtagtggctatgcctgttgaaacgccctttattcgttatgctcaagcacgaggaaaacaaactatttctggtgcagaagtgattgtacttcaggctgtagaacaatttgaactttatacgcatcaacgcccaagcgatgaattaatcgctgaagctgcggcgtttgctcgaacaaaattttgaaataaagatatggtacattgtgtttttattaaaatttgttgctctcgatcacatttctgaatattgctcgttgcatctttataacattcatttaacattgaaccctatttaagtgatagctctaacggaggaactttatgggtgagatggcatctttaagaagtcataaaaatggcattatttttattttagatattgtgctgttttttgtgttattaaatgtattaccttttgaaccaaaagctaattctggtttggcattattagcttttatcgcggtgctttggttaagtgaagcattacacgttactattactgcattattagttccacttttggctgtggcattgggattagttagtaccaaacaagctttagttggttttgctgatccgacaatatttttattttttggtggcttttccttggcgacggcattgcatattcaaaaacttgataaattgattgccaataagattatggcactagcacgcggtaatttatttatcgcagttatttatctctttttgattacagcctttctttctatgtggatgagtaacacggcaactgctgcaatgatgttacccctcgccatgggtattttaagccagcttgatcgcgaaaaagatcataacacctatgtgtttgtgctgttagggattgcttacagtgcatcaattggtggtatgggaacccttgtaggaagcccaccaaatgcaattgtagcaagtaatttaaatttaactttttctgattggttatggtatggcttaccaataatgattattttgttgccgttgatgattgggattctttatattattttcaaaccaaaacttcatctcaattttgaacagacctttgaaaatattgaaatgaatcctatgcgtatattgacgtttattattttttcagtcattgctttaacgtggatatttagcggtaaaattaatccgtttatttcaggattactaggattacaaaaaaacattgcaagttttgatagtatcgtagccttattggcggcaattgttatttgttcaacaggcgttgcaagttggaaacaaattcaatcaaataccgattggggcgtattaatgcttttcggtggtggattaacattaagtgcggtgttgaaggattctggtgcaagtaaaattttagcggatagtattgtttttatgattgatggacaacatttctatcttattggtttattagttgcggcgttcattattttcttaactgaatttacttctaatacagcgagtgcggcgttacttgtacctatctttatttctatcgctcaatcattgggtatgccagaaattggtttagcattaattattggtattggtgcatcctgtgcctttatgctaccagtagcgacaccaccaaatgcgattgtatttggctctggtcaagtaaaacaaagtgaaatggtcaaagttggtttcttactgaatttagtctgtgttgtagttattgccactatgggttatatgttctggcttaaataatatagaattgtttacttttaataaatgatgattgaagatcataaatttaaacgtaagaagtacaataaagccatttaaataaatgggttaaagcaaatgaagctttaacccatttttcataaccgttctatacaaatctatttattgtgttcataagcataaagcgtattgctcatcaacattgcaacggtcattggcccaacgccaccagggactggtgtaatgtaagccgctttttcggctgctttatcaaactctacatcgcctactaattttccatctactcggttaattccaacatcaattacgaccgcactttctttgatccaatcgccagaaattaaatttggtttacctaccgcaacgacaagtatatctgcttggcgaacgtgattttccaaatttttagtgaatctatgtgttactgtgacggttgcccctgctaataataattctaaagacattgggcggccaacaatattggatgcgcctacaattactgcgtgcttgccgtgtaaatcaatacccgttgtttctaatagtttcatcacaccataaggtgtacaagcacgtaaagttggaatacgttggcataaccgcccaacattataaggatgaaagccatctacatcttttttaggatcgatacgttcaataatagcttccgcattaatttgttttggcaaggggagttgcaccaaaataccgtcaatatttttatctgcgttaagttggtcaataatcgctaataattcattttgcgtggttgtttcagggaggtcataagatttagagagaataccgacttcctcgcaacttttacgtttattgcccacataaatttgcgaagcaggatcagcaccaacgaggattacagcaagtcctggagcgcgttttccttgttcaatataatgggttattttatctgctaaattagctttaatttgttttgaaagttcagtaccagagatgatttttgcggccattgagctatccttgatattatgtgatgaaaaagaaagcgtttgctattttaacgaacaatgatttttttacaatgaaaaagggggatatttcttaaagtggaataattttgaacaattaagttgaaaaatcaaaaatttcattgactgaaataaaaacaaacttataattgaccgcacttatcggcgagtagcgcagcttggtagcgcaactggtttgggaccagtgggtcgtaggttcaaatcctatctcgccgaccacttctttcgtattttcttgaaatttttataaaagaaatcctttgaatgcgcccttagctcagctggatagagcaacgcccttctaaggcgtgggtcaaaggttcgaatcctttagggcgtgccattcgttgtctgtttaactagatcctgtttagttttttcaaatataagcactttcagtctgttagattttatgctcataatctgcatcatttgagtgaagaagcttaaatacactcttaatgatgcagataaaaacaatattttggctatttaagtattttccaagctctgaagccataaatggcaattactacaaaacagattaatggtaggataaaggagaaatttactgctggaagtcccataacttcgccttggtcaataatcattccttgtagtggtggcattaatgcgccgcctacaatagccattactaaacctgcagctcctaatgtcgattcctcttttaagccatagagggcaataccataaatggtagggaacattaaagacataaaacctgaggttaaaattaggcagtatagaccccatacaccgtcaataaagataactccgagaatacttaaaaaaccaccaatagcaaagagcatcagcataaattctgcttttaaatatttcattaatgccgtgctaataaagcgactgctaataaaaatagccatagcaatgatgttaaagttttgcccctcagctttagtgaagcctaaacgttcagcatattgtacgataaatgtccaacacataatttgaacacccacgtaaaaggcttgtgcgatcacaccctcacgatatttagcttttttagccagtttgcttattgcacttttaaagctaatttgtccactttcttctacttttacagcaggcatttttttcaatccaatgataataaacactgcaaccacgacaaaaccgagtgctatgtaaggatcgcgaatttcagctaaatcatgggtgcgaatactcattttttctgcttcagacagggtgtggaaaatcaaattacctgcagcatcacgtttgtcagattcaagattagttaggactaactgggaagcaacaaacatacctgtaattgaaccaagtggattaaatgattgtgcgaaatttaaacgtcgagtagctgtttgaggatctcccattgcgagaatataaggattggcagtggtttccaaaaaagcgagcccaaaggttaaaatataaagggagactaaaaagaaattaaatatttcatattgcgcagctggccaaaataaaaatgcacctattgcataaagagcaagccccagaagaatccccgctttgtagctatagcgactggcaaataatgccgcaggaatagccattgtgccgtatcctccataaaaagctaattgtaccaatgccgcttctgaggctggaatttccattactgtttgaaataccgcaaccatcggattggtaatgtcgttggcaaatccccaaagagcaaataagctagtaataagcacaaaggggacgatgaatttcttttctaaaactttggcgttcataatgttttcctcatgtaagtgatggggtataacaagatttaggattcttcaatacgtaatccataggtgtggaatttacctaacactacctgcatttgctctttgctgagcagtggaatttctaagcctgtagagagtaatttcaaataccaagacgctaatacttctacttcttgtgcgagccataaggctttatctaggttttctccgcaagtgattaaaccatggtgtgctagtaaaatggctttgctttctttgattcccgttgcgacataactagctaattcgtgactaccaaatgttgcataaggtacacaaggaatatgatctgtgccgcttacggctaccatgtaatgaattgcaggaataggtttttcgagaatggataagcctgcacagtgaatggaatgattgtggacaacggcatttgcttcagggcgagtatgataaacactcaagtgaaattgccattcgcttgatggtaatttattttcttcgtgtttgccatttccatcaacataaacaatattttctgtcttcattaagtgatatggcatacctgtcggggtaatcagcattccatctttataacgaacactaacgtttcccgctgtgccttgatttaaacctaattttgtcatttcaagacaagtatcaatgattttttgtgataattctgctctgttcattttgtagtacctctattgtttataaaatgggagtaaccccttttttaatgataatgttgccatattttgcgatctcaccactgacaacaacagcataagcctgtttagcacgtgtataaaaatcgaagcgttctagactggttaaatttggtgtgaaaccgaccgcactttcaatcgcatttaagtaacgagtttcaacattcggatctaaagaatctccctcaactgctttcatcatcaacagaggggcatcaacataagcgtcaaattcgaataagggagttattgcttcaagtaaaatatctatagatataccatctgcacgtattacatttttatgtagtgaatgtgcgggaaaatgggcgtcagctagaactatctcatcgccatgccccatttcggcgagggtttttagtaattcaggagaaagagctgggtgaataccttttagcattttgttgttccttctagtttgggtaaattcgttttcttgttggttgcatcgcttgctgtgccgcgtttacattttcgtaaatgcctacgcctgcaaaggtaaacattgcggcaccaagtacagtactttcagaaatgtccacaacatcaatcggtaaatttaaggtgtttgcacggatttgattccacaatacattttttgaaccacccccaacacaaattaagcttttagcttggaactgactgacttgatgtagcacggataaaccgtttttgagtttatttgccatatgttgtaatgcgctgacataaatttctccacgagtagcaaacatggaaagtccactgatattaccttgtcctttttggctaaaaataccttcaaaattgaccgctctttttcccgcattaaaagctttttctccctctttgatcattgtggtgtaatagtgatcgctaccataaacatcggaaaataataatttacctaaccattctatgacgccagaacccacccattgtaccgctggattaaagcaattggattgtgcatcaaattcagtggttaagccttgagaaacaaactcaaatctaggttctgcgtgctgggttctagccattaagatttcccaggtgccagaacttaacacaggctgattcagccctgcaccagacccaaacacagcaaattgagtatcatgtccacaagaaatgacaggtacgggatttaatccccatttctgggctaacggtgtacgtaattttccaactttttcacctgcataacgcataggagggaaatggttattacttaaacccagcgatgctaaaatcgatggatcccaattaccgctagtaaggtttgtcatcattgatgttcccgccattgtgtgatctgtagtgaattgaccagttaagcgttgagtgagcattgacgaaataaaaacgaatttagccattttttggaaaacatctggcttgtgtgtttttaaccaatgtaatttaaataaagtattaaaactgtattgaccaatgccgttacgttgataaagagatttgatatctaattgattagatagattttccattactggtatggtccgtgggcatttccatgaaataatcggataaagttgttgatcatttttatcaaaaggtgcgccatccacgccgaaagtggtaacagatattcctacaatatcttttaaatcaatgccttgttgtattaattgattgaaggtttgagttgcacaagagattaatttttgccagatttcttcaatatcccaaatatgataatcagatgattcgattccttgttttgtattattagcaaggtgatgagaggcaagaatttgtcctttttcatttatcgcaatggtgcgtaaatttgttgcaccacagtcaaaaatcaatgcgatagccataaaaactctcctcagtgcagtcaaaaatccttatgtttttgaccgcacttttttataaaaacaaattaggggttatttataaagcggaccaaagttttggcaagctcgataatcttgcccttccttgtcttgaccaaatccattccaagcgctagggcggaaaatatttttctctgatacattatgcatacagactggaatgcgtaacattgaagcaagagtgattagatcagcccccacatgaccgtgagtcgctacacagtgatttgctccccaatttgccatgactgaatacacatcagtaaatgcaccttttccagttaaacgtggaacaaaccatgttgttggccaagtttcattagtacgttgatttaatttattatgtacatcttgaggtaggtcgattgaccatccttcagcaatttgtagaacgggacctagacctttaataaggttaatgcggtgcattgtaaacggtatgccacctttggttaggaattgagaagataaaccgcccccacgaaaatattcgtgaacagcaggacaccaacgcgtattttctaagcaacgttttgcttcttcttcggtgacatcccatgccggttttaaggttggattgccttgagcatcttgatgctctcctgttccatcaagtgcagctgaacctgaattgattaaatgaatgaatccactttcaggtcgccatccagtaacacgctcaaccgaatcttgactccaataagtacgcacatctgcgaaaatttgagctttgccagttaattgatgcccaaataacattcctattgcatttaaactatcattttccgtggcaagaatataaggtggacgcacgccattccagtcataagttgaattgagcatagcctccataaaatctccgtttggcaaatgatcagtccaatgacgctgcccttgaaaacctgctgcaatggcattatggcctaaggcttcttctgcataatttaatgttgctaattttggatttcctaccatcaaatcacgagtgataatggtcattttcacaacattttcccaaagttctgcacgctcttctgcattgcgttgattctctaggctatttacatcaaccccttctttgcaatattgtttaacccaactcaaggctaaatcaacttcttcttgatcataaattttgcggtctaaacggcgtttaatttccatcatatccacatattcattacgcatacctaaatattcttggaagaaagcttgatttacaatagagcctgcaattcccatggaaactgacccaatagataaataggattttcctcgaatacttgcaacagcaagcccagcacgagcaaaacgcaataatttttcttttacatcttcaggaatgtttgtgtcatcagcttcttgaacttctgtaccgtaaatggaaaaggctggtagtcctaattgagaatgaccagcaagggcagcagctaagtaaaccgcgcctgggcgttctgtgccgttaaatccccaaattgctttaggcatgtgaggatccatatcaatggtttctgatccataacaccaacaaggggtaacggtaatggttaatccaacgttttcgcgtttaaatttatccgcacagacggctgcttcagctacaccaccgatagtgctatctgcaactacacattcaacgaaagtaccatctgtatgacgaatatgtgtttgtaataattgagcaacagattgagccatacgcattgtttgggtttcaagagattctcgaactcccattcgacgaccatcaatagttggacgaataccgatttttatgcgatttaattgagtagcaagagccatagttacactcctttgtttgtgcttaagtaagaatgatgaaatcactgcggaacaaattgtgctttcattgaattagagtgtgaaagaaaaatgatgaggaaaatagtaagaaatgaaattttgttgcaaaactgagaagcagatcacaaaaattgaccatatttaaggaaatatatatgaccgatattttaaatttttaataattttcggtcaaaatggtcatatttttttataaaacggtcattatatcgtgtagctcacaatatttttgtaagttatctggaagtggttgatcagaaaaaatcgtattaattttgcttaaatcggtaagttgaatcaaacttttcttttcaaacttagaagaatcaattaacaaataagcacgttctgaagcctctatcatttttcgtttcaaagaggcattcagctcatttgattcccagatattaccgttttgatcaattcctgaacaagaaaacacggaaaaattaatatgtaatcgttgtaataaatactcagataagggaccgtaaaatgcttcatattttgctgaataaactccgccagtgacaatagttttaacattggatttattaactagggcattaatgttaaacattgagttggttactactgtacaaggaatatcgggcattaaataagcaaaataccaacttgttgagcttgcatctaaacctataacggcattttcatatagcaaatccaaggctttttgggcaatatgtcgtttagctgttgcattaatatgttttcgagtttggaaaaatgaacctaaatctttggttttattactcactgctcctccgtgtgttcggtgcaataagcctttgttcgctaatttgttcaaatcgcgacgaatggtttccaccgaaatatcacaatgctgtgcaagttctattacgctggcttttccttgttgatttacccattgtaaaattaattcatcacgataattcatctcttttccctacacggtggatttagtcgagattctagtttacgcttgagtatgttgaaaatccaagaataaattatattgggggtgacgtatatcttcataaaagtgcggtcaattttttgtgagtttcttttcaagagtatgcgagctacaatacgccccaaaattttatcaatgtaaatcagaaagagaattattatgccctttgctattggtcagcgttggttgagtgaaagtgaaaacgctttaggattaggtgttattaccgcattagatcaacgaaccgtcacgatttatttccccgcagcagatgaaacgaggatatatgctgctgcacaagcacctttaagtcgaattgtgtttagcaaaggcgaaacattatcccatcaagctggctggcaaggcgagattttagacgttcaaaatatgaacggtttgttgttttatttagttaaaaccccacaagatgaagatgtcattgtgcaagaacgtgatatttcgccgattatttcttttagccaagcgaaagatcgtttgttttcagcgcaaattgatcgcagcagtcattttgcattgcgttatcgcacgctttgtcatcagcaagcacaatttaaatcgccattgcgtggtttacgcggaacgcgtgcgggtttaattcctcatcagcttcatattgcagctgaagtcggtaatcgagttaatcctcgcgtgttattggctgatgaggttggtttagggaaaaccattgaagcaggaatgattttgcagaatcaactttttgctgagaaagtgcaacgtgttcttattattgtgccagaaacgttgcaacatcaatggctggtggaaatgcttcgtcgttttaatttgcatttttcactttttgatgaagaacgttgcaatgattttgatcttgatgctgttaatccattcatgactgaaagcttaattatttgttctctaaattggttagaaacgcatccaaaccgagtagaacaggcacttgatgctcaatttgactgtttaattgtggatgaggcacatcatctggtatggtcggaaagcgcgccaagtgcagcttatttattagttgaacagcttgctcgcatcattccctctgtcttgttactcactgcaactccagagcaacttgggcaagaaagtcattttgctcgtttgcgtttactggatccagaacgtttctttgattatcaaacttttgtgaaagagcagaaacgctaccaacctgtggttaatgctattgaatctttgctggcaaataaggcattaagtgcggtagaaaaaaatcatatttctgatttgttgcttgaacaagatgttgagccactttttaaagcgattgcatcaaataatgatgaagaacagcatcgtgcccgtcaggaattgattcaagccttaattgatcgtcacggcacggggcgaatgttattccgcaatacacgtcaaggcgtgaaaggtttcccccaccgtgtttaccaccaaattacactctcggaagagaatgataaaattgattggctgattaatttcctcaaactacatcgcgatgaaaaaatttttgtgatttgccagacagcggcaacagcgattcagttagaacaaattttgcgtgaacgtgaggcgattcgtgccgcagtgttccacgaaaaaatgtcgattatcgaacgggatagagccgccgcttattttgcggatttagaaaacggcgcacaggttttactgagctcgagtattggctcggaagggcgaaatttccaattcgcagcaaatttagtgttatttgatttaccgacaaatcctgatttattggaacaatgtattgggagattagatcgtattggacaaaaacgtgatgtgcaaatttatgtgccttgtgcgaaagattcgcctcaaattcgtttagcgcgttggtacaatgaggggctgaatgcttttgaacaaacctgcccaatgggaatggcattattttcgcagtttgaggacgagttggaaaaagtgcggtcaaattctaccgcactttcagagaatgaattttctgaattattaaaacaaactaaaactgtgcgagaaaaactcaagattgagttagaaaaagggcgagatcgcttgttagaactaaattctaatggtggaaagcaagcacaagcgttagcggatcaaattgctgatgaagataattcgcctgagcttgtgaattttgccttaaaattatttgatattattggcgtagagcaagaagatcttggcgcaaatagtattgtaattagcccaacagggacaatgcttgtgccagatttccctggtttaaaagaagaaggtgtgacggttacctttgatcgagaacttgcccttgctcgcgaagaaatggaatttttgacttgggatcatcctatgattcgtcaaggtattgatcttgttgcttcgggagatattggcaaagccgcaatggcattgcttgtaaataaacaactgcccgctggaaccttattaattgaattgatttatatagtggaaagtcaatcgccaaaagggttacagctcaatcgtttcttgccgccaacgcctattcgtctgctgcttgataacaaaggaaataacattggtgagcaggttgcctttgaaacattgcatagcaaattaaaaccacttggtaaaaatattgctaatcaaatggtaaaaatggcgcggggtaatattgaagccttgattacacgaggcgatcaactcgtaaaatctttagctgaaccgattattaccgaagctaaaaatcaggcagatcaacaattaagcgcagaaattaatcgtttgcaggctttgcgagcggtaaatcaaaatattcgccaaagcgaaattgatattttggaacaacaacgaacacaatcactggatgagctttctaaagcaaattggcgtttagattgtttgcgtgtcattgtgacgaacaaggaataaaaatggcattgattgaatacaatccgccccttgaaccttatttagatattatttatcaagataatcatttgtgcgtagtgaataaacctagtggtttgctttctgtgccgggtaatcaaccacaatattacgatagtgcaatgagccgagtgaaagaaaaattcggcttttgcgagccagctcatcgtttggatatggcaacgagcggtattattgtgtttgctttaagtaaggctgctgatcgtgaattaaaacgtcaatttcgcgaacgtgaaccgaaaaaacattatcaagcgattgtttgggggcatttggagaaagattatggcgaggtaaatttgccaatgatttgtgattgggaaaatcgtcctcgccaacgtttggatttcgttttagggaaaagagcggtcacaaaattcgaagttttagcacgtttgcccaataacagtactcgcgtgaaactgacgcccgtgacaggcagatctcatcaattacgattacatatgttggctttagggcatccaattttaggcgataaattttattcacatcctcaggctaaagctatgtcgccaagattatgcttgcacgcagaagaattgacgattacccaccccattacaggggaaacaatgacttttaatgcgaagtcagatttttaaatttccgtagaaacacgagatcacgaatgaaaaactttttagctcaacaaggaaaaatcacgctaattctcaccgcactttgtgcgcttatttatattgctcaacagctgggttttgaagacgatattatgtatttgatgcactaccccgcttacgaagagcaagatagcgaagcgtggcgttatatttcacatacattggtacatttatctaatttgcatattttgtttaatctgtcttggttttttatttttggtggaatgattgagcgcacttttggttcagtcaaattattgatgttgtatgttgtagcatctgtaataacaggatatgtgcaaaattatgtgtctggccccgctttctttgggctttctggtgttgtatatgcggttctaggttatgtatttatacgtgataaattgaatcatcatttatttgatctgccagaaggttttttcacaatgttattggtggggatcgcattaggttttattagccccttatttggtgttgaaatgggaaatgctgcacatatttcaggcttgattgtcggcttgatttggggatttattgatagcaaattgcgcaaaaattcgctagagtaagtccgtttaatttggataaaggattcgctatgaaacaatcgttacgccatcaaaaaattattaaactggtggaacaatctggctatttaagcacggaagaattggttgctgccttagatgttagccctcaaacgattcgtcgtgatttgaatattttggcggagttagatttaattcgccgccatcacggtggtgcggcatcgccatcttctgcagaaaattctgattacgtggatcgtaaacaattcttttcattacaaaaaaataatattgcacaggaagttgcaaagttgattcctaacggtgcatcgttgtttattgatattggtacgacgccagaggctgttgccaatgcgttgcttggccacgaaaaactcagaattgtgacgaacaatctgaatgccgctcatcttttacgccaaaatgaaagttttgatattgttatggcgggcggatcattacgaatggatggtggaattatcggcgaagctacggtaaattttatttctcaatttcgcctagatttcggtattttagggattagtgcgattgatgcagatggttcattattggattatgattaccatgaagtacaagtaaaacgagcgattattgaaagttcacgtcagaccttattagtggccgatcactctaaatttactcgccaagcgattgttcgcttgggcgaattaagtgatgtggaatatttgtttacaggtgatgttcctgagggcattgtcaattatttgaaagagcagaaaacgaaattggttttatgtaatggtaaagtgcggtaaaaatatctttgattttcttattaatttgtcgataaaagaagctattactcttaatttttgatttaattgaaatttatctaaaagtaatctaaatattctctcgctgaattattgtcttttctataattaaacatttccaagcgtaaaagtatcttgcttttttaatcaattaaagaaatttcatatttctgtattatctaattatttttagctaccaatattctttaaaacattccgagcttagataagaaaatcccttgctgggcaagggatttagtaatgggttaaagtgcggtagaaattaccaaccttttacaacgccatctttaaagtgtttttgagcttcttggtaaacttcttctgtttggtaagattttacgaaatcttgaacagctttgctgtctttgttatcggtacgagaaacgataatgttcacatatggcgaatctttatcttctacaaatacaccgtcatcttgagcatttaagcctacttgacccgcataagtattgtttactacagctaaatcaacgtcgtctaatgcgcgtgccgcaacagaagtatctacttcagtgatgtttaattttttcggattttcaacaatatctaatacagttgaaagaaggttatttgcatcttttaatttgattaaaccttgtttttcaagaagaattaatgcacgaccacggtttgttggatcgttaggaacaacaactttagcaccgtcttgtaattcattcacatttttgatttttttagaataacccgctaatggatagacgaaagtattacccacgataactaagttatttaaatttttcgcttttgcatcttcatctaaataaggtttatgttgcattgcgtttgcatctaaatcacctttagatacagcttcatttggtaatgcgtagtcattgaattcaacgaattgaacgtctaaaccgtatttttctttagcgacttttgctgcaatttctgcaacttgatgctcaggaccagacattacaccaactttgattttaagcggtgctgctgcagcttcaggttttttgtcttctttacagcctgttaaaacgagagctgatgcgattgcagtgattgcaaaaagttgttttaatttcataggatttccttcctgtttaagttaagagttgcatttaattaacgatgatccacttttctagccagtgtatcgccgagtttttggctaatcataacgaatagcacaataataatggttgccacccaagtgacataaggcatattgcgatatacgccgtagttgatagcgaggctacctaaaccaccgccgccttgcgtccccgccattgctgagtaaccaactaaagtgactagcgtgagcgtgatgccattaattagcgtaggtagagcttctgacaaatagaatttacgaacaatttgccatttagtagcccccattgcttgagctgcttcggttaaaccatttggaatttccattagtgcattagcagttaagcgagccacgaatggcattgcacaaatactcaatggaataattgctgctgttgtacctaatacggttcccacgatgaaacgagttacaggtaataagattaggagcaaaataataaatggaatggaacgcccaatattaataatcgtgtttaacataaaatgagtgcggttgttttgtaaaatctcattttttccagttaagaaagtccatacacccacaggcacgccgactactacggcaagtaaagtagatgcaaagctgatataaacagtttcataagttgctgttgcgacaacaccccacatttgaggtgttaattgctggctgaatgttgccaagaaatcattgaacataaccaagcacctccacgcgcacgttgttttccattaaataaactttggtttgcgtaatggcatcttcatcgccttctacttcagcaatggtataaccaaatttcacgcctccagcataatcaatttgtgaggttaagatactgagctccacgccaaatttttttgatgcttgagaaagtaacggtgcatcgactgagcgacccgtaaactcaaatttgatgattggatacgctttgctgtgtttcggtgtatcagtaagattttccaaatattcatcaggtagactgatgtggaaggtcgaacgaataaactcttgtgctaattctgttttagggtttgcaaaaatttcaccgacagtaccttgttcaactaggcgaccttgatcaatgacagcaacttgatcacaaatctgtttaacaacttccatttcatgggtaatcaacaaaattgtaatacctaaagtgcggttaatttcttttaataattgcagaatagattgcgtcgttgcaggatctaatgcgctcgttgcttcatcacataataagactttaggatcgctcgctaaggcacgtgcaatggctacgcgttgtttttgcccgccagaaagattgcttgggtaagcatcacgtttttcacttaaaccaacaagatctaaaagtgcggtaattttttcttggatttttgcttttgactcactttccaattctaagggtaatgccacgttttcaaatacggtgcgagaacttagtaaattgaaatgctgaaaaatcattccaatttgacgacgagcaagtactaattcgcgatcagaaagttttgttaattctacgccatcaacaataacggaaccgcttgtcggtttttctaataagttcacacagcgaattaatgtactttttcctgcaccagatgcaccaattacgccacagatttgacctttttcgatattcaacgaaacattatcaagcgcagtcaattttttgttcggtagctcaaaaattttcgtaatattatttagcttaatcatataagccctttttatttattgtttttaaatctgttttggtattctagatgtctagattgctatgtcaatatgtcagattatcttttttagacagattagttatgacttatatttgctaattgcttggattaaatagataattttcgtcaatttgacatgtataaaaggcaagagaatgaataaggctatttttttagatcgcgatggcacgttaaatattgattatggttatgtacacgaaattgataactttaaatttattgatggtgcgattgatgcattgcgagaattaaagaaaatgggatatatgttggtattagtgaccaaccagtcgggcattgcacgtggttatttttctgaggatcagtttttacaattaacagaatggatggattggtcgttagctgaacaagatgtggatttggatggcatttactattgtccacatcattctgagggaaagggcgaatataaagaagattgtgattgtcggaagcctaaatcgggaatgttattgcaagcgatcaaagaattaaagatcgatcctacgcaatctattatggttggagataaagttgaagacctaaaagcggggattggtgcgaaggtaaaaatgaacgtattagttcgtactggtaaaccagtaacaggggaaggagaaggaatagcggattatgtgttagattctatcgtagatcttccgagaattttaaaacgcttaaaaaaatagccaaaaagatctatattttgctctaatcgcttgtactttaatcaaaagatcatttttttaaatatttttacaaaaagtacttgcaagggatttgaaaatccctataatgcaccgcacacaacgacgcactgttgtgaagttttttaagtttccaagtgcgtcgttattttttgctctttaacaatatatcagacaatctgtgtgggcacttgttgattgacttgttttaaaaatattttaattttgaagtcttaataggtgcttaactgaaaattcatcattacttttttaagtagtgttttatttatagctaagcagtttattgagcgattgaacttgaattgaagagtttgatcatggctcagattgaacgctggcggcaggcttaacacatgcaagtcgaacggtagcaggagaaagcttgctttcttgctgacgagtggcggacgggtgagtaatgcttgggaatctggcttatggagggggataacgacgggaaactgtcgctaataccgcgtattatcggaagatgaaagtgcgggactgagaggccgcatgccataggatgagcccaagtgggattaggtagttggtggggtaaatgcctaccaagcctgcgatctctagctggtctgagaggatgaccagccacactggaactgagacacggtccagactcctacgggaggcagcagtggggaatattgcgcaatggggggaaccctgacgcagccatgccgcgtgaatgaagaaggccttcgggttgtaaagttctttcggtattgaggaaggttgatgtgttaatagcacatcaaattgacgttaaatacagaagaagcaccggctaactccgtgccagcagccgcggtaatacggagggtgcgagcgttaatcggaataactgggcgtaaagggcacgcaggcggttatttaagtgaggtgtgaaagccccgggcttaacctgggaattgcatttcagactgggtaactagagtactttagggaggggtagaattccacgtgtagcggtgaaatgcgtagagatgtggaggaataccgaaggcgaaggcagccccttgggaatgtactgacgctcatgtgcgaaagcgtggggagcaaacaggattagataccctggtagtccacgctgtaaacgctgtcgatttgggggttggggtttaactctggcgcccgtagctaacgtgataaatcgaccgcctggggagtacggccgcaaggttaaaactcaaatgaattgacgggggcccgcacaagcggtggagcatgtggtttaattcgatgcaacgcgaagaaccttacctactcttgacatcctaagaagagctcagagatgagcttgtgccttcgggaacttagagacaggtgctgcatggctgtcgtcagctcgtgttgtgaaatgttgggttaagtcccgcaacgagcgcaacccttatcctttgttgccagcgacttggtcgggaactcaaaggagactgccagtgataaactggaggaaggtggggatgacgtcaagtcatcatggcccttacgagtagggctacacacgtgctacaatggcgtatacagagggaagcgaagctgcgaggtggagcgaatctcataaagtacgtctaagtccggattggagtctgcaactcgactccatgaagtcggaatcgctagtaatcgcgaatcagaatgtcgcggtgaatacgttcccgggccttgtacacaccgcccgtcacaccatgggagtgggttgtaccagaagtagatagcttaaccttttggagggcgtttaccacggtatgattcatgactggggtgaagtcgtaacaaggtaaccgtaggggaacctgcggttggatcacctccttaccaaagacgagagacagcgagtgctcacacagattggctgatagttgtagacaaatgagcagaagaaaacattacccttgggtctgtagctcaggtggttagagcgcacccctgataagggtgaggtcggtggttcaagtccactcagacccaccactctgagagtgagtgaagcgaaaggtgtagtgtaaataaataataactaaaaggtaaataattagttattaaattatgatgaaatggggatatagctcagctgggagagcgcctgccttgcacgcaggaggtcagcggttcgatcccgcttatctccaccacttatcatcgttaaataaattagaaaaagacaaattaataaagtattaaggtagtgatgaagctattttaaatattaggttattgttattttaagtttaattttaaatttaattttgttttagttttagtttatttaacgatgataactgaaaagttttatcaactgttctttaaaaaattggaaacaagctgaaaacaagagattttcgagagaaagtctgagtaggcaagataggaaagtgagaggagggaactgaaaagggaactctaaaaacaaaacctgttttgcataaaatcttgattgaacaaaagcaatcaagtgtttagttgaatgaaaatacgcatcaaattgaccgcactttgaagtgaaaacgtaaagtgattgaaaacatttgaggttgtatagttaagtgactaagcgtacaaggtggatgccttggcaatcagaggcgaagaaggacgtgctaatctgcgaaaagcttggatgagtcgataagaggcgtttaatccaagatatccgaatggggaaacccagtagatgaagaatctactatcaacaagtgaattcatagcttgttgaggcaaaccgggagaactgaaacatctaagtaccccgaggaaaagaaatcaaccgagatttcgtcagtagcggcgagcgaaagcgaaagagccagtaagtgatagcagtatagtgaggagaatgtgttgggaagcacaatcaaagagggtgataatcccgtatctaaaaaccatattgtggtactaagctaacgagaagtagggcgggacacgtgatatcctgtttgaagaaggggggaccatcctccaaggctaaatactcctgattgaccgatagtgaaccagtactgtgaaggaaaggcgaaaagaaccccggtgaggggagtgaaatagaacctgaaaccttgtacgtacaagcagtgggagccccatcacttaatccgattggaaggtgatgaaaagcaaccgcacttaaacaatggtaagaggagcgaagcgagtcaaaccacccaaaagaagcagtgggattaagtgatggggtgactgcgtaccttttgtataatgggtcagcgacttatattttgtagcgaggttaaccgaataggggagccgaagggaaaccgagtcttaactgggcgtctagttgcaaggtatagacccgaaacccggtgatctagccatgggcaggttgaaggttgggtaacactaactggaggaccgaaccgactaatgttgaaaaattagcggatgacttgtggctgggggtgaaaggccaatcaaaccgggagatagctggttctccccgaaatctatttaggtagagccttgaggtgacacctttgggggtagagcactgtttcggctaggggtccatcccggattaccaacccgatgcaaactacgaataccaaagagtgatactcaggagacacacggcgggtgctaacgtccgtcgtggagagggaaacaacccagaccgccagctaaggtccccaagtctatattaagtgggaaacgaagtgggaaggcttagacagctaggatgttggcttagaagcagccatcatttaaagaaagcgtaatagctcactagtcgagtcggcctgcgcggaagatgtaacggggctgaaatatagcaccgaagctgcggcatcaggcgtatcactaatacgccttacgattaacaagctagaatggcgcgaagcggcatgaaaggttgttcaagcaacccgaacgttgagtcggggtatttttgaagtaaggattattagtgatacgcctgttgggtaggggagcgttgtgtaagcggatgaaggttaatcgagaggttagctggacgtatcacaagtgcgaatgctgacataagtaacgataaaacgggtgaaaaacccgttcgccggaagaccaagggttcctgtccaacgttaatcggggcagggtgagtcggctcctaaggcgaggctgaaaagcgtagtcgatgggaaacaggttaatattcctgtacttggtaaagctgcgatgtggggacggagtaggttaggttatcgcactgttggatatgtgcgtttaagttggtaggtgggaagtttaggcaaatccggacttccttaacacagagagatgatgacgaggctctacggagctgaagtaactgataccacacttccaggaaaagccactaagcgaaaggctttactaaaccgtactgaaaaccgacacaggtggtcaggtagagaatactcaggcgcttgagagaactcgggtgaaggaactaggcaaaatagcaccgtaacttcgggagaaggtgcgccggcgtagattgtagtccctagcgggcgaaggttgaaccggtcgaagataccagctggctgcaactgtttattaaaaacacagcactctgcaaacacgaaagtggacgtatagggtgtgatgcctgcccggtgctggaaggttaattgatggtgtcatcgcaagagaagcacctgatcgaagccccagtaaacggcggccgtaactataacggtcctaaggtagcgaaattccttgtcgggtaagttccgacctgcacgaatggcataatgatggccaggctgtctccacccgagactcagtgaaattgaaatcgccgtgaagatgcggtgtacccgcggctagacggaaagaccccgtgaacctttactatagcttgacactgaacattgaattttgatgtgtaggataggtgggagcctttgaagcagtgacgccagtcattgtggaggcgaccttgaaataccaccctttaacgtttgatgttctaacgaagatgacgaaacgtggtctcggacagtgtctggtgggtagtttgactggggcggtctcctcccaaagcgtaacggaggagcacgaaggtttgctaatcacggtcggacatcgtgaggttagtgcaatggtataagcaagcttaactgcgagacagacaagtcgagcaggtacgaaagtaggtcatagtgatccggtggttctgaatggaagggccatcgctcaacggataaaaggtactccggggataacaggctgataccgcccaagagttcatatcgacggcggtgtttggcacctcgatgtcggctcatcacatcctggggctgaagtaggtcccaagggtatggctgttcgccatttaaagtggtacgcgagctgggtttagaacgtcgtgagacagttcggtccctatctgccgtgggcgttggatgattgattggggctgctcctagtacgagaggaccggagtggacgcatcactggtgttccagttgtctcgccagaggcattgctgggtagctaaatgcggaagagataagtgctgaaagcatctaagcacgaaacttgccaagagatgagtcatccctgactttaagtcagtaagggttgttgtagactacgacgtagataggtcaggtgtgtaagtgtagtgatacattgagctaacagatactaattgcccgagaggcttaactatacaacgctcaagtgtttttgggagctaagtgaagtaagagatgaaaagcgaagcaaataaaagtagagcggaaaccgaagtaaaagactaaacaaagaaaagtaaatatagaagacttaatagagagaaaattgagttcagcttgtggccaataagaacgagtgaaaggtagagtaaagactgagtaacgagagataaaagagacgagagataaaagagaagacgagttatcaaagaattatcctggcggcgatagtgcggtggacccacctgagaccataccgaactcagaagtgaaacgctgtaatgccgatggtagtgtggggtttccccatgtgagagtagggcaccgccaggttaccaaatacttatctaagttaaataaaaacagaagaaccccgtgtcgaaagatatggggtttttgttttttagaagtttatactttaacaaaataagtttagataaagtttatgtttgttagtgagaaaaatacgcactagtgatacaatccacaaaattttaagaaaggtaccctatggctcgtaagaaaaaaacacgtcgaattacagatattatgccaattcgcaaagcagataaaaaaatagatataacaaaagcacgctctggtaaaaagcttactcgttatgaattggatgctaaagctcgtgaagataagaaaaaacgtaagcataaaggtttagcttcaggatctcgtcatagtgcggttgaagaaaaagcgaataaacttcaaaatgaaattaaagatccaaaaattggtagtaagaaaaagataccgttggttgttgaatttgttaataagcctgaaaaaggtcaagtaattcctgtaataaaacaggtgaaaaaacaagatccaatgaaagagcttgaaaatctggaaaataatgaaattcttaatgaattattggatgctttagatgcgggtaaaactattagtaaatcagatcaacaatttgtagatgaatgcttagatcgaatttctgagttaatggaagaacttggcattgaagacgaagatgaaagcgaagatgatttataccgcactttcgagcgtatggatattaatcaatttaggtaatctatgatttggatattttttgtcatcgcacttttcttggtaactggattgactctatatgcaatccgtttattaaagcagttaaaagttcaaaaggaattgattgctaaagctaagaataatcgggttatacgattaaaagagagcattgatattattgctcgtgcaatgcagtctggagaatgtaatctttctgaaggcgtaattcgtcttactatgctattaaggccttttggtaagaatttatcatcttatcctgcgatggctaatttatatgaagtggtgcgtgatatgcctacacatgatgaccgtaaactacttgagaaaagagaaagaatgcgtctggatttagctcgagaaagtgcagaagcacagtttgaaaaaaatattaaacaagaattgtatattttattagaagatattaaatctattgagctaatttaaatattataattttaaagaaaaatgcgctaagtctctcctagcgcattttttatgattatttttaacgattttgttcaaaaaataataccgttgctgcaacacgagaatgaacatttaatttacgtaataaattacggatatgtacttttacggtttcttctgaaataaacagttgtgctgcaatttgtttgtttgataagccagttgcaatttgacgaagtacgcccatttcacgatccgttaagctgtctaacggattatcttcgtgagtacgttctaataataaatttttaatagaatcactcagaatgacttcgccttgtgctatgcgcttgatttggtctagcaatgtatcaggttcagtatcttttaacaaataaccatctgcacctgcatcaattagagtataaatatcattttttgcatcagacactgttaaaattaaaattcgcgcatcaacgccttctgcacgtaatcctttgagcgtatctaacccagaaagtcctttcatgttgagatctaaaatgatcacatcaggtgatgtttgtaatgccacagaaatcccttctgtgccgctgcttacgtcagccactacttcaaagttatcgtctaattctacaagttgtttaatgccacgacgcattaacggatggtcgtcaatcaataaaacttttagcttatcttgcataatttctcctttagtggttagaagtccactttaaaaagcatgacattttataaagaattcaattctatgccaatctagaatagaaaaaaatttgatttatatcacaaacttactatttgaggtaggtttattgatggataaaaatagaaaaagtgcggtagaaaaatagataattttttaccgctcttttttaagataagaaatattaaatggtcgattctaatgcccaaagttcctgtaaggtttctcgacgacgaattagataggattgatcgccatctactaaaacttctgcagtgcgggctcttgaattatagtttgatgacatacttgctccataggcaccagcagaacattgagcaatataatccccttcagcaattgaaagttcccgttgtttgcctaagaaatcagacgtttcgcaaacaggccctacaacatcataaatggctttttctctttctaaagtgcggtcaatttcgacgatgttcatgtaagcctcatacaatgctggtcggatcatatcgttcattcctgtatcggtaatggcgaaattacggctttcattactttttaagtattgtacttttgctactagaattcctgcatttgcagaaattgctctgccgggttcaagaataatttcaagttcgggataattttttagtttttctaataacgcatttgcgtaatcgcttggatgcggtggtgtttcatccgtataagtcacgcctaaaccaccgcccagatcgagatgttttaatgtaattccatcttcttttaattgttccattaggacaattaatcgatctgttgcatctaagaatggttgtaattcggtgagctgtgagcctatgtggcaatccatccctgttatttttatgtttggtagcgttgaggctaatttatatacctctcgagcttcatttacgcttacaccaaatttattttcttttaatcctgttgaaatataagggtgtgtatgagcatcaacatctggatttacacgtaaagaaataggtgcgattttacccatttctcccgcgatttggttaatgtgcttgagctcagaaactgattccacattaaagcaacggattccaacttctaatgcgcgcataatttcttctcgagatttcgcaacgccagaaaagactacttttgacgcatcgccacctgctgccagtacacgctcaagttcgccttgtgagacaatatcgaaacctgaaccaagttttgccataatatttaacacgccaatatttgagcaagatttcacggcaaagcaaattaagtgaggacgcttaccgaaagctgagtcaaaagcgtgccaatgacgttctagtgtcgcgcgagaatatacataaagaggtgtaccgaattgttcagcaagttgttgaactggcatatcttcggcataaagtttgttatgtttatattggaagaaattcatgttgtgtgcctgttttagttattttgggaatgatattagataatagattattgagtttgttgagcttgatctttttcaggaaaatataaagaaccttttacgccgcatcctgttgtcacaatgcaaattgcactaagcactaaaattgatagtagttttttcatttttctctctctcacttatcggtaaatccgcctttcacaagcttgagaaaggctttataatttgccacattttatcagatttaaacaggaacattttatgaatattgcagaatttcaccaaaatattgaacaagtttggcaaaaaattgaagaagaattggaaaaccaaggtgcagatgtagattgtgaaacgcaaggttcagtatttacaatcacctttgataatcgcacacaaatagtgattaacaagcaagaaccgctgcttgagctttggattgcaagtaaattaggcggtttccattttgcttttaaaaatggcgactgggtttctaatgacggacaacgtttttgggattgtttcgttgaagcctgtgctgcacatggcgagaacgtgcagttctaaaatgctggattctcctttaccatcaaaaataatagaaaaaccgaccgcactttctgttttgaaatcggttttcggttatcaatctttccgtaaagggcaggaagaagttattaatgctgctttaaatggacaagatgcgttggtggtaatggcaacggggaatggcaaatcgctttgttaccaaattcccgcactttgttttgatggtttaactttagtgatttctccgctgatttccttgatgaaagatcaagtggatcagctgcaagctaatggaattgaggcggattttcttaattctagtcagactttagaacagcagcaacaagtacaaaataagcttatttctgggcaacttaaactactttatgtgtcgccagaaaaagtgatgacgaacagtttctttcaacttatttcttatagcaaagtctgctttattgcgattgatgaagcacattgtatttctcaatgggggcatgactttcgccctgaatatacccagcttggcggtttaaaagccagtttccctgatgcgccgattatggcacttacggcaacggcagattatgcgactcaaaaagatattctgcggcatcttaatctgaaaaatctgcacaaatatattggtagttttgatcgaccaaatattcgttataccttggaagaaaaatacaaacctatggagcaactgacacgttttgtgttggctcaaaagggtaagagtgggattatttattgcaacagcagaaataaggttgagcgaattgcggaaagtttacgcaataaaggtgtctctgctgctgcttaccacgcaggaatggaaacggcaattcgtgaacgtgtgcaacaggattttcagcgtgataatgttcaagtagtagtcgcaaccattgcttttggaatggggattaataaatccaatgtgcgctttgttgcccattttgatttaccacgtagcattgaatcttactatcaagaaacaggtcgagcaggacgtgatgatttgcctgccgaggcggttttgttttatgaaccagctgattacgcttggttacaaaaaattctcttcgaaaaaccagaaacgccacagcgtcagattgagcagcataaattagaagctattggggaatttgcggaaagccagacttgtcgccgtttagttcttctcaattattttggcgagcatcgacaaacaccatgtaataactgtgatatttgccttgatcctcctaaaaaatatgatggcttagtcgatgcgcaaaaagtaatgtctactatttatcgagtgggacaatgttttggtgcacattatgtgattgcggtgttgcgtggcatgcacaatcagaaaattattgaacgccaacaccataaactttcagtatatggcattggaaaagataaaagcaaagagcattggcagtctgttattcgtcagcttattcatttgggttttgtgcaacaggttattagtgaattaaatccaacgttgcaacttactgaaagtgcgaaagtgattttgaaaggcgaagaaccgttagaattggcaatgcctcgtatttcttcaatcagtaaaattgcccataatccacaacgtcaaggtgttgcaaattacgataaggatttatttgcacgcttgcgtttcctacgcaaacaaattgccgataaagaaaatattccgccgtacattgtctttaatgatgcgacgttgcaagaaatggcacaatatatgccgacaagcaatattgaaatgttgcaaattaatggcgtgggctctatcaaattagagcggtttgggcagccgtttatggcattgattcaagaacataaggcaattttggcgaatgcgcaaaataatgactaagtgttaaaagtgcggttaaaaatgaccgcactttttgttatacttgcgccaattttttcagttcttagaatttaaggttaaacaatgcgtacaagtcaatatttattttccaccctaaaagaaacgccaaatgatgctcaggttgtgagccaccaattaatgttgcgtgcaggtatgattcgcccaatggcatcaggtttatataactggttaccgacgggtattcgcgtattgaaaaaagtggaaaaagttgttcgcgaagagatgaacaaaggtggtgccattgaggtattaatgccagttgtgcaacctgcggaattatgggaagagtctggtcgttgggatcaatatggccctgaattgcttcgttttgaagaccgtggaaaccgtaactttgtacttgggccaactcacgaggaagtgattacagatttagtccgccgagaagtttcttcatacaaacaacttccacttaatttataccaaattcaaactaaattccgtgatgaagtgcgccctcgttttggtgtaatgcgttcgcgtgaatttattatgaaagatgcgtattctttccacacgacacaagaaagtttgcaagcaacctatgatgtgatgtatcaagtatacagtaacatttttagacgtttaggcttagatttccgtgcggtgcaagcggatacaggttcaatcgggggttcagcttctcacgaattccaagtgttagcttcaagcggggaagatgatgttgtgttctcaacggaatcggattttgccgcgaatattgagcttgcagaagcaattgctataggcgaacgccaagctccaaccgctgaaatgtgtttagttgatacaccaaatgcgaaaactattgcggagttggtggagcaattcaatttaccaatcgagaaaaccgtaaaaactttgattgtgaaaggtgcagacgaaaatcaaccgcttgttgcgttgattattcgcggcgaccatgaattaaacgagatcaaagcacaaaaacacccgttagtggcagatccccttgagtttgcggacgaaactgaaatcaaagcgaaaattggtgcgggcgtgggatcgttaggcgcggtaaatcttaatattcctgcaattattgaccgcactgtggcgttaatgtctgattttagttgtggtgcgaatattgatggaaaacattatttcaatgtgaactgggtacgcgatgtagcaatgcctgaagtatttgatttacgtaacgtagtagaaggcgatcctagtccagatggcaaaggcacgcttcaaatcaaacgtggtattgaagtggggcatattttccaactgggtaaaaaatactctgaagcgatgaaagcgaccgttcaaggcgaagatggtaaaccacttgtgatgacgatgggttgctacggtattggtgtaactcgtgtggtggcttcagcgattgaacagcatcatgatgatcgcggtatcatctggccatcagacgaaatcgccccattcactgtggcgattgtgccaatgaacatgcacaaatctgaagccgtgcaaaaatacgctgaagaactttaccgcactttacaatcgcaaggcgtagatgtgatttttgatgatcgtaaagaacgcccaggcgtgatgtttgcagacatggaacttatcggtataccgcatatggtggtaatcggtgagaaaaacctagacaacggtgaaattgaatataagaatcgtcgtaccggtgaaaaagaaatgattagtaaagataaattgctcagtgttttaaacgaaaagttaggtaatctctaatcagtattttattttgtatattgtgacaaaagagcggttaaaaatagccgctctttttgttgatctaacgtttatattgaacaatgtttaatccaaactaaatgctcgaatataaggtagttttcctttttctaacatctcttgaataccgctttgatggtcattgctgcctaacccccttaattctaaggttatgccaatgctattatcataaacaatttcattacgtgtttggttttggtggtttgtgacattgcgttttacaccaacacttgcagcccaacagcaactgttatattgaacgcctagatattgttctactggtttttgtaaggcgagatcttgataatagcgtcctactacagcccaattattggcaatttcccagcctacaactaatcccacttgttggatatcttgttgataggcgttagccgatttacctaagttttggtcaatatattcttggttcacatatcgataatttaactgaattaaattatttttttcaggattatattctagtgatgtattcgctaatgatgttgaattggtatgagtatcaaattgatagctaccacgccaataccatttattacttattttccaattagattctaatgcccaagcagatgatgaagttggtgttttattcgcagggttttcatcaatacgagaattacttaagtaataaatttgacctgcagataaattaaatcgttcttcgccagcaatatcataaaaacgcgttgtgccacccaaggtaacttgatttgccgatgaaattcgatctaaaccactataacggcgatcacggaatagcgaatagtaatcttgctgtactaatgctgaatcgtaaccaaatcccaaataatcattattaagtgttgaaccaatattgctttgatttcggtaaggacgatataaatactgcacgtgcggttcgaaggtttgtgtatactcttttaagaacgttatatcgcgtgataatacactttgtaaatcaactttaaattgtggaataactcgatttaccgttttttgcacgtcctctgcattttttcctgaaccttttttctgctcgtaacgagtcgcataaagtttcgtttcaatattcaaactgccgtatttatttgacattaaagaatttaggctaggttctgcatggaaacgccatgcagttggcatcaatttactgtcattatcaaaacgaactgcttgtgaatgtaatttgaaatttaaccatccattcgctaaatcatatttgtgatagttgaaatctaattgtggtactgcacggtaagggccgatgtttacaatatcatcaaaaatttggaactgatgtgcagaaagagaaaaattataatttggttgataataagctatgcgagcatattggttcgcataaccatcggtactgcgtccataaatagaatcaaagtcgttgaaataacgtttatcgcttactcgggtgtaattaatatttagacgccaattttgtaaaaagctagaattgtgattccaatagaacaaatgacgttttcgattatcactagcatattcagagtaacgatccttacctaaatattctcctgccactttaccttcgccaatggaggttaaatagcgaaattccccatttgcttgccaaccacggcgagacatatatttcggggtgaaagtaagatcataattaggagcgatattccaataaattggttgtgcataccaaagaccatctcggttagatgttcccgcgcttggaatcaataaaccagaacgacgacgatctccaatgggtaattgtaagtaaggggtataaaagacgggaacaccatgtattttaaagcgagcatgccacatttcagcatattcttctttcacgtattgacgaatttctgacgcatctacagcccaagcattgtcgccgtgcaaacatgacgtaaaggttgcattcttcattacacgataattattatgcagtgttatattatcagctttaccacgtccttgacgaccgacaaattcatattctgaatttgttaaattaccatcgtgactatctaaattaaactctgcatctttacccaacatattgatctgattatctttataatcaaatccattgcggacataagccatgcgtaaaggtgttgattggtttccagattgtttgacctgcacggattgtgctaacaaatggcgattgccttgtttcaaatctacattaccttgataggtcgcatcatttggctgattaatttctgcgttatccgcttcaatatatacaggcagagaattcacatcacccgtcacgacttcaccgctaaattttggcacgcccattaaacattgttcgtgcaaatctgccaaactttgttggctataaagtgcggtcaaaatagcaagtgaaattaaagtgtgttttttattcatcgtcttgttttaatttgtcagaaaattggtcagattatactggaaaaagtgcaaggctagtaatatttttcaagaagtgattattaatagaatatccactgggttatgattaaattttttgtctattgaaccatcaatacgccaagacagcccatatcttctaacattaaattcgataccccaaataagaatgggaagttgccagaagatgcttgatcaaatttcactaaaatttgagttttgttttttacccaaacggtatctttccaagctaattcttcagcttgtaattgatgttctccttggctttccaccacaaatttggcaccttgaatagtaaatccaacaggtaaacttgcatttaaaatccagcgttcaatggtgcctttacgagccataacatcaaccttgcgcgggtcaaaacgtctttgattaattaaaccgtttgtgacatcaatattaaattctcgagtttgtgcaacggcttgttgtaatattgctggtgcatccgtttcgaaagttagattcggttgtttgttaaatgcggatagttgtccttgagcacgtaattcaaggacggtgttattagcgagttcatcgcctgagaacaacatattttttattttttcgtacaagctacgtttacttccgctaatgagagatacgttgtcaatttcattcatattaaccagtatttctgcgcgttctcctggcgagagaaccaaagatttgactgatttcgctttgggtaagaaacttaaatcttgtgcaataagtagcatttcttgatcattatccaagcgtaaatcataagcacgcgctaatgaggcattgagcaaacgtaaacgaatccaaccccgtgcaacatctaaatatggtgcttcaataccattcactaataagcgattgcctacaaagtgcggttgattttgtttgaataattggagaccatcattgttaaattccatatcttgtaaaatcaatggaatatcatctacgccgtatttattgggaagattagcttttaggctttgctcatcttcaattaaccacattccagctaagccacgataggtttgataggctgagttggctaatgtcgcggaacgataccagcagcttgctgcaggttgttcaataggcacgatgggtgcccaagattcgccttttttgagaactcgagctgccccgccaaacagttcgcctgatgcttgtaaaccttgaatagacaaggcaacggattgtggcaaattgttatgataattaagtttggcaaagctacctgatttgattttaatggttgggccaagataattaccgttgaatccccataccgtcacattgtgtgagccatctaacggataattcgtttcctgcatggttaatacaatcgggcgaccgcgacgaacttcaattagtggcggcacaactagtttttcacggcttgccgctaacaatggtgctggcacggtggaaagtgcggtagaaatcgcagctgtttttaataattgacggcgggaaaggcgtggcattttagtttccttttgctatctcttcatcaagttcggcaatgcgtttttccattagatcatgacaataagccgcaagatcgcgaacattgtctttggtatagcctgaaacatcgattggatccattatttcgcaaatcactttgccattatcccaacgatttaaattaattttgttatgcgtgcttgaacacaccactggaataattggtacacctgctgaaatcgccgcatggaatgcacccgttttaaagggtaataaaccgcgaccgcgattgcgagtgccttctgggaacatccaaattgataaattatcttcattaattcgtcgtgcaagctgtgacatcgtattatgcgcttttgtgcggttttctctatccaagaaaatattacccgttacccaatataaaatgccgaagaagggtatccaaattaagctttttttacccacacttactgtgcgaggttgcaccatataagagattgttaccatatcataattattttgatgattaccgatataaatggcgcggctaatttgcttctgatcttgaggaatacgatgttctacctttaagccaaaaagtggatataagcgtccaaaccaacgagcaacaatgcctacgttgcttggatttttaaagcggataaaagaataaatcgtacccagtacacaaattagaatacagcagattaatacgaggaaaattcgaagtagttttaacataaggatgccctatacaaaatttcgttaaagtatagcaaattcaatatcaatatgtgttaatctaaacaaaaatcgtggaatttttatgaaacatagctattttatttctgatttgcatttaagcgaaactcagccagaattgaccgcactttttgtcgattttatgcagaatcttgccccacaggctgaacggctttacattttaggtgatctttttgatttttggattggtgatgatgagcaatctgcattgattcaacaagttaaagatttaattaagtctgtaagtaatcaaggtgtgcaatgttattttcagcacggtaaccgtgatttcttaattggtgaacgttttgcgaaagatacaggtgttcagcttttacctgattatcaattaatcacactttatgataaaaaaatcttactttgtcatggcgatacgctttgtattgatgatgaggcttaccaacaatttcgccgtagagtgcatcaaaaatggctgcaacgtttgtttttgtgcttgccattaaaagtgcgggtgataattgcggagaaaattcgagcaaagagcaatcaagataaacaagcgaaatcacaggaaattatggatgtaaaccaagccttcacggcagaaaaagtacaagagtttgatgtaaatttattaattcacggacacacacaccgtgaggcgattcatcaacaagaagaatttacccgaattgtattaggggattggcgaaaaaattacgcatcaattttaaaaatggatgaaagcggagaatttggttttattaaagattagaagtgcggtaaagcaaaaactcgttattttacttaatgatactagaataatacttatccataaaatcgtacctaaaagctggtggataagcccaacttttagatacagataaaagtgcggttaattttaggattagttttctttcggtaagcgaagcgacgcgtaaattaatcctccccacaataaagtaagggctatgatcatcataataattgcgccagtagtcattttattctcctttagtttcatcaatcgttaatttggtttcgcttttccattttaagcgagaaaggaaaaatgccacgacaagtaagctaatcgacattccccaaccaaaggtatttacaaaccagtttggatagccttcgtaaccttcagagaagacttttgccccttcgctgaaaagcataaatgctaaaacaccactcgttaatacaatgcataaacgccagaagaaacccactttgaaagatgacgtttcatttaagtgattacccaataaaccgagtttttcatttgctacaatcgcaattaaagacgcaaatgctacggcaacaataccgaaatagttcacaaatttatcgaacacatctaacatcggtaagccagttgttgtaccgaataagatgacagaaactagcatcattggtacacccacgatgaatgtcacttttccacggctaatacgaattttatcttgaattgcggaaataattacttcgataactgagatgaatgaagtcaatgcggcaaaggttaatgcaccaaagaataacatgcctagcacttcgccaaatggtgctttgttgatgatggttgggaatgcgaaaaatgctaaaccaattccgccttttgctacttcgctaacttcttgaccttgcgctgttgcaataaaacctaatgctgcaaatacgccgatacctgctaacacttcaaagctactgttagcaaaacctacaaccaagccactacccgtcaaatcggattcttttttaagataagaggcgtaagtcaccataatcccaaagccgattgaaagagagaagaagatttgcccataggcggcaatccacacactcgggttggataattttgtccaatctggtgtaaataatgcatctaaaccttttgccgcacctggtaagaataaggaataaatcacaagcaccataaacatcacgacgagcactggcattaatacggaagagaccttagcaattcctttttgaacacccatagaaagcacgcctaaggcaacaatccacatcgcaattaatggtgcggttaccataccaacaaattcaaagctgataccgtttttaatatcgcccatttttaaaaattcaccgatgaagaaatcaatgggtttatcgccccacgcaccagtgaaagaaaaatatgtgtagcttgctgcccagcctaacactacagcgtaatataatccgatgatgacattcaccatcatttgccaccagccaaacacttcaaagtgcgggctaacacgacgataagaaagtggcgcaccaccacgatgacggtgcccaatggcataatctaggaataaaagaggaatccctgcggttaataatgcaataaggtaagggatgataaatgcgccaccaccgttttcataagtggtgtaaggaaaacgccaaatattaccaagaccaacggcagaaccaattgctgccagaataaatgcgcgacgaccagaaaaagtctcacgcttttgtgcttttggagctgagtgcaccataaattatcctatgtaaaaaaatgaaaagagtttcaatataatgaaatctaacaatcagtcaataagcaagcttaaagagcggtaaaaattcactaaattttttaggggaagaacaggaatattcaaaataagccaattttcaccgcactttttttcgtttttttctctccaagccctaccaatgactcgaaatttcgctacaatgctaaacttatcccaaaataaaaataacaggaaacaaacacaatgacaggtgcacaacttatcatggcgtgcttgaaagcacatcatgtcacgactcttttcggctatcccggtggcgcaattatgccaacctacgatgccctttatgacgcaggcttagatcacttactttgtcgtaatgaacaagggactgcaatggctgcgattggctatgctcgctccacgggaaaagtgggcgtctgtattgcagcatcaggctctggtgccactaatttagttattggattaggcgatgccatgatggactccattccagttgtcactattgaaccttggcgtgaacaaatcagaaatttcaaagcaaaattagatttcacttatgttgaaaatcaaggcaatcgcccgattgatccttgggcattactcaacagcctatctaatcgcaaaccaaataatgcgataatttgtactgatgtgggtcagcatcaaatgtggtcagtgcaacacattttacgcgtagcacgtcactgcggatttaccgttacaacaatggaaatgacactcattgaaacccaagtgcggttaaaaatcactgtaaaatctgaccgcactttagatctattagtgaatcagttggttaagctgccggatgttttaatggttaattaatcatacaaacgaaccctaaattttactcggagagattatttatgcccaaactacgttcagcgaccagcacacaaggtcgtaatatggcaggcgcacgtgccttatggcgtgcaacaggaatgaaagaaaatgactttggtaaaccgattattgcggtggtgaactctttcacgcaattcgtaccagggcatgtgcatttaaaagatatgggacagcttgttgccgcagaaattgaaaaagcgggcggcgtagcaaaagaatttaacaccattgcggtggatgatggtatcgcgatgggacacggtgggatgctttattccttaccaagccgtgatttaatcgctgatagcgtggaatatatggtcaatgcgcactgtgctgatgcgatggtgtgtatttccaactgtgacaaaatcactccaggaatgttaatggcggcaatgcgtttaaatattccaactatcttcgtttcaggcggcccgatggaagcaggtaaaactaaactttctgatcaattaatccgcttagatttagtagatgcgatgattgaggcagccgatccaaatgtaagcgatgagcgtattgatgcgattgagcgtagcgcttgcccaacttgtggttcttgctctggcatgtttaccgctaactcaatgaactgcttaactgaagccttaggtttatctttacctggtaatggttctatgttagccactcacgcagaccgcaaagaattattcttaaaagcaggtcgtcaaattgtcgagctttgcaaacgctattatgaacaagatgatgcaagcgtattgcctcgttcaatcggtacttttgatgcctttgaaaatgcaatgagcctcgatatcgcaatgggtggttcaagtaacactgttttacacttattagcggcagcacaagaagcaggcgtggattttaaaatggaagatattgaccgtttatcgcgcaaagtgccttgtttaagcaaaattgcaccaaacaccaataaatatcatatggaagacgtacaccgtgcaggcggtattatgggattgttgggtgaattagatcgcgctggattaattcataaaaatacacacaccgtgcttggaatgagcatgggagagcaactagaccaatacgatattattcgcaatcaagatgaagaattacataaattcttccgtgcaggccctgcaggtatccgcacaactcaagcattctcacaagattgccgctgggataccgttgataatgatcgtgtaaacggttgtattcgcaataaagaaaatgcgatttcacaagaaggtggcttagccgtattattcggtaatctcgctgaagacggatgtatcgttaaaaccgctggtgtagatgaatctatttggaaattcactggcacagcaatcgtatttgaaagccaagaagatgcggttgcaggcattttaggtggcaaagtcaaagaaggtcatgttgttgttatccgttacgaagggcctaaaggcggaccaggtatgcaagaaatgttatacccaaccagttacttaaaatcgatgggcttgggcaaaaaatgcgctttattaacggatggtcgcttctctggcggtacatcaggcttgtctattggacatgcttcaccagaagctgcttctggcggtgcaatcggcttagtacgcgatggcgatattatcaacattgatattccaaatcgtgcaattaacttagaaatcagtaatgatgaactcgcagcacgcagagccgaacaagatcaaaaaggttggcagccagctaaccgtgaacgtgaagtatctttcgctttaaaagtattcggtcactttgcgacctcagcggacaaaggtgcggtacgcgataaaacattattaaaataatttaacggttcccctctttcataagagggggataaaacaaaggaaaaactaaccgcactttatcatcaaaacaaacactatgaaaaatctactcaccaatcctcaaccctctcaatcagattatatcaatgccattgttaaacttggttcgcgcgtatatgaagctgcacaagtgacccctttacaaaaaatgggaaaactttctgaacgactgcacaataatatctggattaaacgagaagaccgtcagccagtaaatagctttaaactacgcggtgcttacgcaatgatttctagcctttcagaggaacaaaaagcagcaggcgtaatagcggcatctgcaggtaaccatgcacaaggcgtggcattatcagcgaaacaattaggcttaaaagcattaattgttatgccacaaaacaccccaagcattaaagtggatgcagtgcgtggttttggtggtgaggtgttgttgcacggtgctaatttcgatgaagccaaagcaaaagccatcgagctttcaaaagaaaaaaatatgacatttattccaccattcgatcatccattggtaatcgctggacaaggcacgttagcgatggaaatgctacaacaagtggcagatttggattatgtgtttgtacaagtcggtggtggtggcttagctgcgggtgtggcaattttgcttaagcaatttatgccagaaattaaaatcatcggtgtagaatcaaaggattctgcatgcttaaaagccgctctcgataaaggcgaaccaacagatttaacccatgttggattatttgccgatggcgttgccgtaaaacgcattggcgacgaaacattccgcctatgccaacaatatcttgatgatatggtattggtcgatagtgacgaagtatgcgcagcaatgaaagatttgtttgagaacgttcgtgctgttgcagaaccatcaggtgcattaggtttggctggtttgaaaaaatatgcgaaacaaaaccatattgaaggcaaaaatatggcggcaattttgtctggcgcgaacttgaatttccacacattacgttatgtatctgaacgttgtgaaattggtgaaaatcgagaggctttattagccgtgaccatgcctgaacaaccaggtagtttcttaaaatttgcttatgtattaggtaacagagctgtaaccgaattcagttatcgttatgcagatgataaacgtgcttgcgtgtttgttggggtaagaacgacaaatgagcaagaaaaagcagatattattgcagacctcacgaaaaatggttttgatgttgaggatatgtctgatgatgatattgcgaaaacgcatgttcgctatttaatgggtggtcgagcatcaaatgataacgaacgtttatataccttcgaattcccagagcaaaaaggtgccttattaaaattcttggaaaccttgcaaaatcgttggaatatttcattatttcactatcgtgcccacggtgcggactatggaaatatccttgctgggttccaaattgaagaacgcgaacaagcagaatttgaacaggcacttgcccaactcaattatgtttttgaagatgtaacagaaagcaaatcttatcgttatttcttacgttaatcttataaaaaggcgtgatatttttcacgcctttgtcttattcaaactctaattccaccgcactttcgccgagtaaattcaccaattccgtcagaatttcatctgttggaatgatcgaccattgcacgcctaaacgtaacaacgcacgacctttcggactttgataatacacgttaataggcaatgttccaccactcactggctcaagtaatgctttaaattgtttaatgaaacttggtgtaatttgatgctcagaaagactaatagccaaggatttgacataacgagaacgtgcctcatctaaggtcattaactcgcgcaccgtcattttcaagccaccagagaaatcatcaaagctcacctgccctgaagcaacaatcactgtatctttttgtaatttctcaccaaattgttctaggctttcaccaaataatgttaaatctaagcgacctgaacgatcgtccaatgttgcaatacctagacgattgccttttttcgtcatcgcaattctcgatgccacgactagccccgccacagtgctaatttgtccacggcgatttggtgcgagatctttcaaccgcgttgatgtgtaatgagaaagttctttcaaataacggctaacaggatggctacttaaataaagccccaaggtttctcgttcgccatcaaggatttgtttttcagtgtaaggtggtgtattagcataggcattttccacgtcttcatgggtttcagtcagcacaccgaacatatccgtttgtcccattgcttcatctttcgcatgctgatcggaagctctaagtgcatcttccaaattcttagaaagtgcggcgcgatgtgggcctaatttatcaaaggcacccgacataattaggctttcaaaagtacggcggttaatttttttcaaatctacacgagcgcataaatcgaataaatctttgaaaatccccccttcatttcttgccgccacaagtgcttcaatcgggccttcccccacgcctttaatcgcgccaatcccatacacaatttcgccttgttcattgacactaaaatggtgttttccgatattaatatctggtggcgtcacttttaagcccatacgcaaacattcgtcgtacaaacctacgattttatccgtattatccatttcagatgtcatcactgcagccataaattctgcagggaaatgagttttaagccaaagagtttggtaagacaccaaggcataagcagcggagtgagatttattaaaaccatagccagcaaatttttccaccaagtcgaaaatcttcatagatagctcgccatcaacaccgtttttctcagccccctctttaaacactaaacgctgttttgccatttcttctggtttctttttacccattgctcgacgcaataagtcagccccacccagcgtatagccagccaacacctgcgcaatttgcatcacttgttcttgatacaaaataatgccgtaagtcggctcaagaataggtttcaaacttgcatgttgatattctgcgtcagggtaagatacttcttctctcccgtgtttacggtcgataaagttatctaccatacccgattgtaacggacccggacggaacaatgctaccaatgcgataatatcttcaaaacagtcaggttgcaggcgtttgatcaaatctttcatacctcgtgattccaactggaacacagcggtggtttcggaacgtttaagtaattcaaaagattcaggatcatcaagtggaatggcggcaatatctactcgaggcttgccttcacgcaccatacgaacattaattatatccaatgcccatttaatgatagtgagagtacgcaagcctaggaagtcaaatttcacaagccctgcatattccacatcatttttatcaaagtgagtaaccggatgtaagccttcattatcacaatagagtggtgcgaaatcagtaattaaggttggcgaaatgaccacgccacctgcatgtttacctgcattacgtgtcacaccttccagcttgcgcgccatgttaatcaatgctcgcacttcttcatcgctatcgtaggcagtctgtaattgcggctcggtctcaaacgctttggcaagcgtcatacctggatctggcggaatcaatttagaaatacgatcaacgaaaccataaggatgccccagcactcgccctacatctcgaataaccgctttcgccgccattgtgccaaaggtaataatttgtgataccgcgccacgaccataggtttctgcaacgtgctcaatcacgcgatcgcgaccatccatacagaaatccacgtcgaaatcgggcatagacacacgttctggatttaagaaacgttcaaatagcaaatcaaactctaacggatctaaatcagtgatttttaatgcataagccactaatgaacccgcaccagaaccacgacctggccctactggaatatcgttatccttagaccattgaataaattccattacgatcaagaaataacctgggaaccccatttggttaattacatctagctcaacttgcaagcgttcatcatattttggtcgtttttctaaccgcactttttcatcagggaataaaaaaactaaacgttcttccaagccctctttggatttttgcactaagaaatcttctgtacttaaatcgccagttggaaattgaggtaagaaatattgaccaaggcgcaaagtcacactacaacgttgcgcaattaataaggtattttcgagagcggaaggaatgtctgcaaacagcttacacatatcttcttcactacgaaaatattgctgtgaggtataacatttcggacgtttaggatcgtctaaagtatagccatcgtgaatcgctacgcgaatttcgtgggcttcaaaatcctctgcattcaaaaacatcacatcattagttgcgaccaatggtaaatcacaacgttctgctaatttcaacgctgcttgaatgtaacgttcttcatttgggcgacctgtacgacttaatgctaaataaaaatgatcggcaaaaaattcttggtaaaaagcgaccgcactttcaatttcggctacgttttctttcaacaattttttacccacatcgccttgcgttccccctgataaaataatcacgccgtcgcgatgttcaattaaccaatcttgatcaatataaggtaaatcgttataaccgcgttgataagcctttgataacaataaagtaatatttctatagccttcattatttttagccagcaaagtaagatcaaagtattcatcgccacataatgggctttttacttttacatctgccccgataatgggcttcatacccgaagaaagcatttcgctataaaaactaaccacaccacaaaaattagtaaaatccgttaatcccatagcaaccatttcattggcagcacaagctttcacaagaggttttactttgacgatactgtcaatcatcgaaaaatctgtgtgtgtgcgaagatggacgaagcgaggttggaatgacattgaaaatccttaaaatgcggttaaattttgccgtaaatattaaagcggtattatagcgaatttttcaaacaaatgcttatgctacaaatagtgttcccaaattggctcggataaccgattgcgtgaataaaaaatgttaagtagatcaaaaaattgataattagccgttttcattttgttagatttccgctagtctaacggcgattttttatttatttcaacgaataaggataacgctatgacaacactttttgaggttgcacaacattggttaaaccaagatcctgacacagaaactcgtgcagaattaaccgcacttttagatgcagcaaaaggcggagataaagcggcagaagcagaattacatgcgcgttttgatggtcgcttacaatttggtacggcaggtttacgtggtcgtttacaagctggctcaatagggatgaaccgagttttagtttctcaagctgctggtggtttagcggaatatttaaaaggttacgataaagaaccctcaatcgtcattggttacgatggccgtaaaaactctgacgtttttgcccgtgacaccgctgaaattatggcgggtgcaggcgtaaaagcttatttattaccacgcaaattaccgactccagttttagcctatgctatccaatattttgataccactgcaggtgtaatggtaacagcaagccataacccaccagaagataatggctacaaagtgtatttaggtaaagcaaatggtggcggtcaaatcgtttcaccagcagataaagacatcgcagcattaattgataaagttgcggctggcaatatccaagatttaccacgtagcgataattatgtggtgttaaatgatgaagtggtagatgcgtacattacaaaaactgcatcattagctaaagaacccgcttgcgacattaactatgtttataccgctatgcatggtgttggctatgaagttttaagtaaaacactggcaaaagcaggattaccacaaccccacgtagtcgcagatcaagtttggccagatggcacattcccaacggtgaatttcccaaatccagaagaaaaaggcgcattggatttagcaattaaagtggcaaaagaaaagaacgctgaatttatcattgcgaatgacccagatgcagaccgtttagccgttgctgtgcctgatgcacaaggcaactggaaatcactacacggtaacgtggttggctgtttcttagggtggtatttggcaaaacaatatcaaggcaaacaaggtacattggcttgctcacttgtttcttccccagctcttgctgaaattgcgaaaaaatacggtttccaatcagaagaaaccttaactggtttcaaatacattggtaaagtatctggcttattgttcggttttgaagaggcattgggctatctagtggacccagacaaagtacgcgataaagacggtatttctgcagcaatcgtgttcttagatcttgtgcgtaacttgaaaaaacaaggcaaaactttagcagattatgctgatgaatttaccaaagaatttggtgcttatgtgagtggacaaatctctattcgagtcagcgatctttcagaaatcggaaaattaatgaccgcacttcgtaacaatccaccagcagaaatcgctggcgtgaaagtggcacaatttatcgaccatattaaaacagatcgtcaaagcgatatccttgtatttaacttggaaaatggcggacgcttaattgctcgtccttcaggtactgaaccaaaaattaaattctacttagatgcgcgcggtaaagatccaaaagatgcagattgcgtattggcagaatttgatgaaggtgttcgtcacattcttcgccaagatacttatggcaaataagactgctaattgcacaatgggatgtggatacgtcaaacggtgcattgacttgttgtttgcaaagggtgtggtatttggtcataaaaaatctgcaccttagttggttatttagtccagcttttggggtgcagatcatttctagcttgccttttgttttaccatttaattaatgtttagtttgttcttcctcagatttttcttctgcattttctgcttgttggcgattcatatattcaacaaacaatgcatcaaagtttactggagataagtttaatgcagggaacgtaccgcgattgactaggttagacactaattcacgtgcataagggaaaagcatattcgggcattgagaggttaaacaatgcgccatttgaacatcttctaaaccgctaatagtgaatacgcccgcttgttttacttcacaaataaatgcgacatcaccactatcttcaagtgtagtttcaacagaaatgtttaataccacttcatataagtcatcgccaacttgggttgtttcggtgcttaaatcaaaaccaagttttggtttccattcttgttggaaaatatgtggaagatttggagcttcaaaagacacatctttcacataaatacgttgaatttggagaacgggttgttgttcttctgttgctgcaacgtcttgtttttgttctgacattttctattccttattatttatgttttttaactaaaggtaaatttgctgctacccacgcggaaaggccttctttcaacacaaatacagaattaaaaccttgtttggttaaaaatactgcagaagcagaggctgaagtaccatttgtatcgactaatataagagctttctctttatgcgactctaattttccgatattttgatttttaatttcgcttggaagcacattaatactattaatgatatgtccacgttgaaattcttcaagactacgtaaatctaccacaatggcttcatcggaatttattaaccgaataacttcattgtgcgtaattactttaaatttactcgttgcgcctttgtagaaggtataaatcaccatcacgaaaatcgcaaaccaagaaactgctaaaagcgtatgtttttgagcaaactctgttgccattgagataaattcttgcattgttttctctactgattaagtacgtcaaaatagggctcaagtataaccgcacttgggttatctttcaaaaaaatattcaaaatatagaatacattaaattatctttatttcagctgatggaaaataacagaatttttcaacattatttattgatccaagttatggaatctctacctatttgttgctatattacacgccgtttcaacaaataaaataaagtgtttttttattaacttaggggggcagtatgtctgcaatgtttttactacaatttgccatcgtattattgtgtatctttgtgggtgcacgtgtaggtggtatcggtttaggtgtatttggtggtttaggtcttgccattctttcttttggctttggcttgaaaccagcaggtttacctattgatgttatgtttatgattatggctgtagtggcagccgcggcagcaatgcaagcagctggcggtttagactacatgatcaaaatcgcaaccaaaatcttacgtcgtaatcctaaacacattacgtttattgcgccagcagtaacttggttattcactctcttagcgggtactggtcacgtggcatattctgtattgccagttatcgctgaagtgagccgtcaaaacggtatccgtcctgaacgcccaatgtcaatggcggtaattgcatcacaatttgctatcgtagcaagcccaatcgctgcagcagtggtggctgtggttgcttaccttgagccacaaggtattcatcttggcgatgttttaatggtaaccattccttcaactattctaggacttttccttgcttgcttatttgttaataaaatgggtaaagaattaaaagatgatccagaatatcaacgtcgtttgaatgatccaaaatatgcagatatttttgcttctaccactttagtcaaagaagtagaagtgagcaaaacagctaaaatttctgtttctttattcttatttggagctttacttgtcgtgttaatgggtgcagctccttctattcgacctgtttttgatggaaaaccaatgggaatggcacataccattgaaattattatgctttctattggtgcattgattatcttaacttgtaaaccagatggcacagcgattaccaaaggttctgtattccatgcaggtatgcgtgcagtaatcgcaatcttcggtattgcttggttaggtgacactttaatgcaggcacacattactgaagtaaaagaaatggtgaaaggcttagttgaaactgcaccatgggcatttgcttttgcgctatttgtactttcagtattagtaaacagccaaggtgcaacagtagcgacattgttccctcttggtatcgcattaggtatccctgcacctgtattaatcggtgtatttgttgctgtaaatggttacttcttcatccctaactatggtccaatcattgcatctcttgacttcgataccacaggtacaaccaaaatcggtaaatacattttaaaccacagctttatgcttccaggtttattgagcatgtttttctgcttattaatcggtttaggtctttctcacgttattctttaaaatgtgattcgataacaaagaacggtgctgaaatagcaccgtttttgttattctaatatcaacttaaaataactcaaaaaaataaccgcactttgatatataagtgcggttatttttatgaaagttttccgccctgtttcgttgttatgttatcattacattaatgtaacatttttaacaatttaaacttttaggagagctttatgaaaaacgtcgtgatcgttggtgggggtgctggcggtattgaattagcaacatttttgggtaataaattaggtcgtcaaaaacaagctaaagtaacgctggttgatcgcaatgccacccatttatggaaacccttattgcatgaaattgcaacaggcgtaatggatgatggcgttgattctttaagttatcgtgcgcacggtaaaaatcattttttcagttttgagcaaggttcaattatacgtattaatcgcgagcaaaaatatgttgaacttgcacctgtttatggacaagagggcgatatgcttgtcattgctcgtcgaattccttacgattatttagtgattgccattggcagtaaatctaatgatttcaacacaaaaggggtggctgataattgtatttttttagatagttcaaaacaggctttacgttttcaacataaactgttggaattatttttaaaattttcagaaaaccgtgcattagatgacattggcgaagaagaatttaaacaaaagttagtggatgaaaataaagtaaatattgctattgtgggaggtggtgctactggtgtggaattaaccgcagaactttatcatgcggctgaagatttgtcttcttacggttatggtaaaattgatagttcttgcttacaagttactttagtcgaagcaggaacacgtttattgccagcattacctgaaaatttatctgctgcagtgttagatgaattaaaggaaatgggcaccaatgtgcaattaaacacaatgattactgaggcgcagccaaatacacttattaccaaagatggcggggagattaaagctgatcttattgtttgggcagcaggagttcgcgcctcaacagtaacgcagcaatttgatggattagaaattaatcgtatcaatcaattagtggttaaagatacacttcaaactaccgttgatgatagtatttttgcgattggcgattgtgctgcattaatacaatcaaatggtaaattggttccgccaagagcgcaagctgcacatcaaatggcaaaggcttgtgcaaaaaatatttttgcattgtttgaaaataaaccactgaaatcttttaaatataacgataaaggtactttagtttctctgtcaaattttaccgcacttggtagtctaaccaataagtttggtaaaaatccacttaccgttcaaggtaaatttgcgcagtttgcttatgtgtctttgtatcgaatgcaccaacatgctttgcacggttgtattaaaattggtttgattattctcgttgataaattgaatcgttatttaaaaccaagattaaaattgcattgattaagtataatttttcgttaaatgcgatctaaatcatttatataaaagaaagggcatcaatgatgccctcagtattgttttatgaagaaagatcttcggatttttcaattgttcctttcaccgttaagcaaatttctgttgaaatcaaatgggaaagcgttgaagctaattcttctattttatcaagaacagtataaccagattcatcaaagtaacgttgctctttcaagtttgcaataaagcttgaaaaaaccgctttatcaaagaattctggtgcatttatgccgtgtaatactgataaacgttgagcaacaagctggctttctttttcaagttcagctcgagaaatagcaggttgtttttgtaaaatagtgacagtaatgtaataacgttgcaagatttcccgcgttcccgcagaccaaagctgtaaaattcgtacttttgatttattaatagataagaagttatcatttgaattaataacgctttggcgtgcaaattcattaatgatttgatggatttgtacattcaattcatcttcattgaaatgtaagaacaattcgccttgtaagaaagggtaaatttttctaatcgcgtctaataataaatctttttggatcgcttcgtaatgcaaaataatactcgcaactaaagatggtaatacgaatagatgctgaatattattacgataataagtcattagtacagcagatgaacgttctaagcgtacaatttcgccaaaattatctttttcaattaacacacctatacgatctaaagctaatacgtgttctaacattgcttgcggtgtcacatttggtagcactacgtccgtagaataagggacattttgtaacaattgttgataactactaagttgttctaacagttgctcacgtgaaagtgctcgctgacgagatgaaagtagtgctgtacccacaaggttcattgaattaactgccgctgctttgttaatattaatcattacttgtttagaaatattatttaccgcaggtgtaaaccattgtggtttttcttcgtgattttgctctttccaatcagggaaatgttggctcaaatagtttgaaagcgtaattggctcaccaaaatttacaaaaccttgaccaagattacgtaattttttaattacacgaagtactaaacccgcattttctttttctttcgctgcaccacgtaattccttagcataagtgtctacttctaatacgtgttcataaccaacgtaaacaggaacaatcgaaatggggcgagtttgactatgttgcaatgcttgaagtgtcattgacatcatacctgtttttggtgccagtaaacgacctgtacgagaacgaccgccctcaataaaatattcgacggaatagcctcgatggaatagttctgataaatattcgcgaaaaatggcagaatatagtcgatttcccttaaaagtgcggcgaataaagaatgccccccaactacgaaacattctacctataggccagaaatttaagttaatccctgccgcgatatgtggcggaacaagaccttgatgataaagcacataagaaagcaataagtaatcaatatgactacggtggcaaggcacataaacaatttcatgaccttctaacgctaatttacggacacgattcgaattttgtacatcaatacctgaataaagtttattccaaagccaacgtaaaaaacgatctactgcacgtaaacttgaatggctgacatcagctgcaatttcatccaaaattttatatgcttctttttgtgctttttcaatactgatattttttgattttgcttcatcttcaattgctcgtcggattgcttctgattgcaataatttattaaacattgcttgacgatttggtaaacgagggcctgtcgctgaaatacgttgttttgcgaagtgcatttttgcaactcgagccagcttttgtgcaattttttcatctgagccatgttcaactaccatataacgtaatgaaaccgcttgagaaaaacgcacaaaagtatcacgtccaaaccaaattgctgcaaatgttttttgtataccatttaataaacgcaaattaggcaaatctgatttatcttcttgtccaggagaacgtccccaaagaacagaaacaggaataagttgcacatctaaactttcagaagtgcggtgtaattcaagatatttattgaaaatggtagtggtttcgtcttttgcaccttttgatttaaaaattcggcgaccttcgtctaaatatacataacgtggtaacttaacgccattaatttcatttttctctgcgggatcgggcaagcctaacgctaagcaatttcggcggaaaataacgaaatcagtttgagatgtataaggcaaaacataaacaataggttgatgaatattaagtgaaagctcttctattggattggcgggaataggattatttttcaccaatgcagacagcggcaagctcaataattggcgatacatatttataaaatttgccataataaattttctctttgttataagtttgtagatcttatagacgtttaaaaagcagtttgtgaatagaactatttttagccctttggtgtttttatcgtccaaaaactcaaatattttaacacatccgatctcaactaatttagaaaatttggcgacaaaatgtgacttaatacacagatttaaaaaataacagttgcaactttacacaatctgtatacaataccagttatctgtgtttaaaaacaggagtgtatatgagaccattaaccgcacgccaacaagaagtgttggatttattaaaacgccatttggaaacaacaggtatgccaccaacacgagcagaaatatctcgagaattaggtttcaaatctgcaaatgccgcagaagaacatttgaaagcactttcacgtaaaggtgcaatcgaaatcattcccggcgcatctcgtggtattcgtattttagacaatagttcgaatgatgaatttgacggtttaccgcttgtagggcgcgtggctgctggagaaccgattcttgcagagcagcatattgaagcgacatatcgagtagatgcagatatgtttaaaccacaggctgacttcttacttaaagtttatggtttatcaatgaaaaatgttggtatcttagatggtgatttattagctgtgcatagtactaaggatgtacgtaacggacaaattgtggttgcacgtattgaagatgaagtaacagtaaaacgtcttgagaaaaaaggttctatcatttatctacacgcagaaaatgaagaatttgatcctatagtagtcaatcttgaagaacaaaaaaattttgaaattgaaggtattgcagtaggcattattcgcaataacgcttggatgtaatctggtaccaagaatgaataaagtgcggtaaaaatttacggtatttttaccgcactttgcttatactagagtgctttatttgccatgatttttgctgctctttataatgcaaaaatcttgaatttatacaaaggatggaaaaatgcagttttccaaaatgcacggattaggtaacgattttgttgtggttgatggagtcactcaaaatgtgttttttactccagaaacgatccgacgtttagccaatcgccattgtggaattgggtttgatcaacttttaattgttgaagctccttacgatcctgaactcgactttcattatagaatttttaatgctgatggaagcgaagtttcgcaatgcggaaatggtgctcgttgttttgctcggtttgtgacattaaaagggctaactaacaaaaaagacatctcggttagcacacaaaagggtaatatggttttgacggtaaaagatgataatcaaattcgtgtgaatatgggcgaaccaatttgggaaccagcaaaaattccatttaccgcaaataaatttgagaaaaattatattctgcgtacagatattcaaaccgtactatgtggtgcagtttcaatggggaatcctcattgtgttgtacaagtagatgatattcaaacagcaaatgttgaacagcttggtcctttgttagaaagccacgaacgttttcctgagcgtgtcaatgctggttttatgcaaatcatcaacaaagaacatattaagcttagagtttatgaacgtggtgctggcgaaactcaagcctgtggaagtggtgcttgtgcagctgttgcagttggaattatgcaaggcttattaaacaacaatgtccaagtagatttaccgggcggttcgctcatgatcgaatggaatggtgttggtcatccactttatatgacaggcgaggcgacccatatttatgatgggtttataactctttaatattttttccccatttatcttaaaaaaagatggggcgtttttcttaaattagcgtaaacattttgtatctaaatatatttttattgagctgtttgataactttaagtaatcagaacaagcatttttcatacaatctctagattttttacttaaagaaatagattattagcataataaaaaaccgcctctcggcggttcttgttttaaatcttttatctactacgctaacactgccaatgcagcttcatagtttggctcttctttaatttcttcaactaactggctgtgtaaaacattgttttgttcatctaacacaataaccgcacgagaagttaaacctgccaacgggccagtttgaatatctacgcctaattgtgagtgtaatgcgtggttacggaaagtcgaaactgttttggcattttcaatcccttcagctccacaaaaacgagcttgagcaaagggcaagtctgctgaaatacaaagcacaacagtattacttaattttaccgcttgttggttaaatttacgtactgaagtcgcacacacacctgtgtcgatgcttggaaaaatatttaggactttgcgtttacctgcaaaatcgtttaatgcaacatcggctaaatcattaccgactaaaataaagttttctactatttcgcccacttgagggaaatgtccgccaacttcaatagggtttcctgctaatgtaactgtcataaaatcctctttatttagattaagtgaaaagtgtttaaactataccacgctttctaattatttccaccaattaaagctatccagaatttgattttcgggaaaatttcagccaccacacaataaccaatagcaaagactaatgaaaacagtatgtgcgttaccccaatccagttaaatccgtgaaatcaatagggctgctcggtggaaaaggatgctccgctccccatttaacgaaagcagagataaaacctgcaaaaaattgcaacgccataacgacgtttagatggttctgaaaataagctcattgttgtatccttaaattaattaaaagtataaaaatttccgagtttatgaaagtgtgtaattttacgtctgttatatcacattatcaaacaaaaatacttcaattgggttatctttggctggctgttcataaggttttaaaatttattagcaatagataaattgattgattttttagcggttgtagagcgagtataagctttgtattacttgaaaatagggagtatgtttgaacataaatcttattgttttattttgaatgcaaacgtttgctttgttcgttataatacgtctgtttttttatttttcttttatacggaactgcaatatgactgtcaaaacctttcgtggctcgcctgctctttctgaatttcgtttaactcaacttcaacaaaaatgccagcaatatcaattgcctattacgtcagtttatgcagagtatttgcattttgttgaacaaaaaacatcgcttgtagaagatgaaatcgttaaattacaagcattattgcattatgggtcaatgttttctgaactcaagcctgcaggatattgtttaattgtgactccacgagtggggacaatttcctcttggtcttcaaaagcgacagacatcgctcacaattgtggtttgtcgaaggtaaatcgtattgaacgtggtatagcctattacttcaatattgagcgtgatttaaccgaagcagaattggctacgctgaaagatttattacacgaccgtatgttagaaaccgtgttaaatcacgaaacagaagcagccttgctttttactcaacaagaacccaaagcattaactaccattgatattttaaatggtggccgtcaagcattagaacgggcgaatattgccttgggtttagcgttggcagatgatgagatggattatttagtggaaagttttactgccttaaagcgtaatccacaggatgtggagctttatatgtttgcacaagcgaattcagagcattgtcgccataaaatttttaatgccgattggattattgatggcaaaaaacaggataaatcgctgtttaaaatgatcaaaaatacctttgagcaaacgcctgattttgtgctttctgcttataaagataatgctgcagtaatggaaggttcgaaagtcggccgttggtttcctgatcctgatggacaatatcgtgttcatcaagaagatgcgcacattttaatgaaagtggaaacgcataaccatcccacagcaatttcgccatttcctggtgctgcaacaggctctggcggggagattcgtgatgaaggggcaacggggcgtggggcaaaacccaaagcaggtttaacaggtttctcggtgtctaacctcgttattccaaactttgaacaaccttgggaaaatccattgtctaaaccaaatcgcattgcttctgccttagatattatgatagatgcgcctttaggtagtgcggcatttaataatgaatttggtcgcccagcattattaggttatttccgtacttatgaagaaaaagtaaatagttttgcaggaaaagaagtacgcggttatcacaagccgattatgttagcgggaggaatcggtaatattcgtggcgaacaggttcaaaaaggcgaaattccaatcggtgctaaattgatcgtgttgggtggggcagcaatgaacatcggtttaggtggtggtgctgcttcttcgatggacagtggtaaatcaaaagaagatttagattttgcttctgttcaacgtgaaaatccggaaatggaacgccgctgccaagaagttattgaccgctgttggcaattaggcgaagaaaatccaatcctgtttattcacgatgtgggggcgggtggtttatctaatgcaatgcctgaattggtacatgatggcaggcgtggaggaaaattcgatctgcgttctattctttgtgatgaaaaaggtatgtcgccattggaaatttggtgtaatgaatcgcaagaacgttatgtattagccgttgcgccagaaaacctcgaattatttaccgcactttgtgagcgtgaacgtgccccttttgcagtgattggcgaagcaacacaagcagaacatttaatcttgcacgatagtcatttcgataataatccgattgatttaccaatgaatgtgttattaggcaaaacgccgaaaatgacgcgtgaggttttatcaaaaacagtggaaaatcaatcacttaaaacagaaggtattcaattaaaagaagcattccatcgtgtattacgtttacccgttgttgcagaaaaaactttcttaattactattggtgatcgctcggtaacaggaatggtagcccgtgatcaaatggtgggaccttggcaaattcctgtatctgatgtggctgttactactgcttcactggatagctaccacggcgaagcaatggcaatgggcgaacgctctccagttgccttgctaaatttctcggcttcggcacgcttagctgtggcggaggcgattactaacattgctggcacccacattggcgagatgaaacgtattaaactttctgccaactggatgagtgcagcaggtcacacaggcgaagatgcgggactttatgaagcagtaaaagctgtgggcgaagaactttgtcctgcgttaggtttaactattcctgtgggtaaagactcaatgtcgatgaaaaccacttggatcgataatggcgaacaaaaatcagtgactgccccactttcattagtaatttccgcttttgctcgtgtagaagatgtacgtaaaacgcttacgccacaacttcgtaccgacaaaggtttatcgagtttattgctaattgatttaggcgaagggcataatcgattaggtgcgactgcacttgctcaagtgtacaaacagttaggagacaagcctgccgatgtggtaaaggttcaacgcttaaaagatttttacaatgcaatgcaaactttagtggcagaagataaattgttggcttatcacgaccgttcggacggcggtttaatcacaactcttgcagaaatggcgtttgcagggcattgtggggtagaagttgatatttcagctttaggcgacaacgatttagcggtattatttaacgaagaactgggagcggttatccaagttgccgatagccaattagaaagtgtacgtgaggtgttgaaagctcacaatttgcttggtattacccaccaattaggtacggtaactgctgatgatcgctttgagatcagccgcggcagccataaattattcagcgaaaaacgctctgaattacgtagtatttgggcagaattaacttaccaaatgcaacgcttacgcgataatccagagtgtgctgagcaagagtttgaagctaagaaaaaccctgacgacaaaggcttatccgcatttttgacttacgatgtgaatgaagatattactgcgccatttatcaataaaggtgtaaaaccaaccattgcaattttacgtgaacaaggtgtaaatagtcattatgaaatggcagcagcgtttgatcgagcaggctttaatgcaattgacgtgcatatgtctgatttaatgattggtcgtcgtaatttagccgaattcaatgcaatggttgcttgtggcggtttctcttacggcgatgtgcttggcgcagggggcggttgggcaaaatccatcttatttaacccgaaattacacgagcaattcagccagttttttatcaatccaaacacactgaccttaggcgtatgtaacggttgtcaaatgatctctaacttggcggaaattatcccaggtacagaaaactggccgcattttgtacgcaacaaatctgaacgctttgaagcgcgtgtgagtttagtgaaaattaatgaagtggattcagtttggtttgcaggaatggctggctcacatatgcccattgcggtttctcacggggaaggacaagttaagtttaaatcagttgaacagtttgcaggcttaaaagcacaaggcatcattgctgcacaatatattgacaacaacggtagccccaccgaactatatcctgccaatccgaatggttctgcggagggcattactgcaattacaaatcttgatgggcgagttgctattatgatgccacaccctgaacgtgtgttccgtgctgtgagtaactcttggcacccagaaaactggacagaagacggtgcgtggatgagattattcagaaatgcaagaatggtattttagagaaataaatggacttgaaggttaaaaaagtgcggtggaaatctggcagattttcactgtgtgcgttacttttaaaacggaatttacgtatttgtaaaatgaataggtaggggtataattatctaccataactaaacaaatcacatcgtttacgatttgtctttttataaataaatattttatgaaggcggaattatgttaatcacattaacacatattaataataacttgataataagaaatgaaattttagatagtcttggcaagcaagcaagcaagcaagcaagcaagcaagcaagcaagcaagcaagcaagcaagtaagcaagcaaagagtgacttaaatagtacatcacaaagcaaacaaattattcttcaagaaataaataaggtaaaagaaaacaatattagaaaaaataataagattgtttactaaacataaaagaattactgctacacaaaataagcagaaatttatcgttccatttaaataactatggagagattatgtttattacacctatcttcattattaatctagaaaaatctacagatcgaaaagcttatatgcaagcacagtttgaacagttattttcgaataatttaatacaagaaattcacttttttgatgctatttatggaaaatcaaatccgaatcacccattgtttcaacgttacaatgaaaataagcggttgaatgcaaaggggtatcctttaaccttgggtcaattaggctgttatgcgagccattattctatgtgggagaaatgtgtagaattagattaccctattattgtattagaagatgatgctaaatttaaaaataatttcttagaagtacttgattttattaatagcgataaaaatacgtttgaatttttctggttacaacctgatcgtttgaaaaataaaagaaaattgatctctaatttcggtaatctttcgatatatcaatttagtaaaggatttgctggtgctacaggttattatttaactccccaagcagcaaggaaatttttaacacaaagcaaggagtggtatttaaccgtggatgtgacaatggatcgtttttttgagaataaagtgccaccttatgcaatagtaccattttgcttagaagatgatggcgagatagaatcaactatttatgagaaacaaaagaaacagagatcattaaaaatagtgattatgagagagttgtttaatctaaaaactaatattaaaagacgtatttataacttattccattgataaattgatatagtagacaaagcagttgttaatgtttatttttaaatattagcaactgttttattttggaattccacgcaataatcctacaggctcaaaaggttctatagaagttggcgcgggcacttcgctgaataataaaataaatggcttgtgcggaataactttttcatttcgccataaatttcccattccgactaattgaatatcttcgggtaaattacgaagtcctgcttgtaaaactgcaatcgtattttggcgaggatgacctattgcaatggcggagccgtgttttctagcatagtgaattgctgctttaaattgacgttgaacgtctgcgaattcgttactatcatctaaaaatatatggcgatctaatgaacgcacgccttgttcttttgctattttcccagctacagattttcctattgttcgactatctaaaaagaataaatgtttttcttgaagtgcggtcattaaataagtcattaattggggatctgccgtagctgcactccccatatgattgttcataccgatggcatcacgcacaatatttttagccgtattaacgcgatcatttacttgtgctgcagacattcctaaatgcagcccaccgtcttctattttcactgcacttactggttgcatcggcatatggattaaaatatctctaccttgagattttgcttcttgattacgtgctcgagcatagggcgcagcaggaataattgctacggaaatttcacgtggcatcgcaaaaattgctgcatcttctttggaatgatagcctacatcatcaatcacaatagcaagtttactttgagcaaaagaaaaagaggtataaagtgcggtagaaaaaacaatgaaattttttaccgcactttttatcagaatattcatcaacgaacccaccctgcaggatttactggcgttcctttacggctaataccaaaataaagcgcagaacgtgatatttcccctgtatttcctacttgagcaataacctgccctgctgaaacaagctgaccaactttcactgatacggcttgattgaagccatataaacttaaatcagtttcgccgtgtttaacaataaccatataaccataaccatttaaatatcccgctaaaatgacgcgtccagcagcaattgctttaacaggcgtgcctgctgatgcgccaattaccatacctttccaacgtacttcgcctgcttggatagaaccaaaagtatgcaaaattgaaccagaaactggtaaggaatattgtttttttgccgcccctaaaccgcttgtactattaagtaattggcgttcttgtacagttggttgataaggttttgatgttcgtttttcttcagctttttggcgttgagcaagtgcctctctttcacgtttttcttgttcgcgcgctgcttgttcagctcgttgaatttcttgacgaagtgcttgttcgtttgcttttagtgcattcaatttatcttgatctagggctaaatttttattgagttcattcagcgtagattgatgctcttgctgtgctttttgcaatgcttgttgttgttttttttgtgtggaaagttgatttcggtgattcttttgttgagagaaaatcgcctttttttgtactgcaatttgtgcttgcgttgcttttaaattattaatcatttcaatccgaacttgatttaaatgctgataataaactttcattcgctctgcttttgtcggatcttgggcaaacattcgttcaatcagcgatggattaatgcctgaacgataaattatatctatttgtttggttaatcgtgctttttgctcacgttcctgtttttctaattgtttgagttgcttatctgcatcggcaatttgcttacgaatttcctttaaacttatttctgtttcaagcagttcgccctcaacactgttaattttactctcgtgtttttttaaatttgcttgtaacttagcttgctcacgtttttgcttctctattttagattcttgttgcttaatttgtttttgaatttgattgagatcggaagattggctgacaggcgaaaatattaataaaccgcagcttaaaagtgcggttaataataatgatgttttttgattaacgccaaaacgcaacataattcatcctaaattcgtaaaactcgcaaatcttatcatatttgttaaaaggcgaaaaagtttgatggttattttttgctaaagatcaggaaatcatcccttttaacttttaaagctaaggattttttgctataaaatgcgcgttctttttatttgaaaacattaggagattcttatggaattagtatttatccgtcacggttttagtgaatggaatgcgaaaaacttattcacaggctggcgtgatgtgaatttaactgaacgtggtgtggaagaagcaaaagctgcgggtaaaaaactgttagacaaaggttatgaatttgatatcgcatttacctctgttttaactcgagcaatcaaaacttgtaatatcgtgttagaagaatcccatcaattatggattccgcaagtaaaaaactggcgtttaaatgaacgtcattatggtgctttacaaggtttagataaaaaagcgactgcggagcaatacggtgacgaacaagttcatatttggcgtcgttcttatgacatttctccaccagatttagatccacaagatccaaattctgcacacaatgaccgtcgctacgcaaatattccatctgatgttgtgccaaacgcagaaaatttaaaattaacattagaacgcgcattaccattctgggaagatcaaattgcaccagcaatgctttctggcaaacgtgttttagtagttgctcacggtaattcacttcgtgcgttggcaaaacatattatcggtatttctgatgctgaaattatggattttgaaattccaacaggtcagcctttagttttaaaacttgatgataaattaaattacgtagaacattactatctttaattaagttcaacgtattgttgttctaactgtataaaacaaaaccccgcaaattagcggggtttttaaacaagtccaaattattttgtgcttggaattttgaaacggctgttgaaacgctcgacacgaccaccagtatcaacaacacgttgtttaccagtgtagaatgggtggcagttaccgcacacatcaagattgatgtctttgcctaaagttgaacgtgttttgatcacattaccgcaagaacaagtcgcagtaacttctttatattctggatgaataccttgtttcatagaaaaacctcaaaatgaagccacgccgctataggaactttctccccacaccgcgtgagtgaataatacgccataattggcaccaaataggttgcgaattatactgaaaaaatgcagataaacaagctctattttcgtgtaaaatcatcagcatttttaaccgcacttttctttttatgttagcaaaatcttccatcaatgcgccatttgccaaatctgttttagcttggtacgacaagtttggacgcaagcatttaccttggcagcaaaataaaacgctttatggtgtatggctttctgaagtgatgttgcaacaaacgcaagttgcgacggtaattccttattttgagcggtttatcaaaacatttccaaatatcaccgcacttgccaatgcttcacaagatgaagtgttacatttatggacaggcttgggctattatgcacgagcgcgtaatttacataaagccgctcaaaaagtacgggatgaatttaatggaaatttcccgacaaattttgagcaagtttgggcgttatctggagtgggacgttcaactgctggtgccattttatcttctgttttaaatcagccttatccaattttagatggtaatgtgaaacgtgtgttggcgcgttattttgctgttgagggatggagtggcgagaaaaaagtagaaaatcgcttgtgggcattaacggagcaagttacacctacgatgcgtgtggcagattttaatcaagcaatgatggacattggtgcaatggtttgcacgcgaactaagcccaaatgcgatctttgtccgttaaatattgattgtttggcttataaaaatacaaactgggaaaaatttccagctaaaaaacctaaaaaagcgatgccagaaaaaactacctattttttaattttgtcgaaaaatggcaaagtatgtttggaacagcgagaaaactcaggattatggggcggattattttgttttccacaatttgaagataaatcctcgttgcttcattttttagcccaagaaaaagtcacgcattatcaagaatggccgagttttcgacatacatttagccattttcatttagatattcatccaatttatgctgaaatggagagcgctttatgcgtagagcaggctaatttagactggcgaaaagtgatggaaagcacaaaagaataccaatcaaacctatcaagtgcggtcaaatattggtatgatccacaaaatcctgaaccgatcgggctggctcagcctgtgaaaaatcttttaatacaatttgtaaggaatcattatggcaagaacagtattttgtgaatatctcaaaaaagaagcggaaggcttagattttcaactttatcctggagagttggggaagcgtatttttgattcagtaagtaaacaggcttggggtgaatggattaagaaacaaacgatgcttgtgaatgaaaaaaaacttaatatgatgaatgcagagcaccgtaaattattagaacaagaaatggttaattttttgtttgaaggtaaagatgttcatattgaaggttatgttccaccatcaaattagttatctatcctacaatgaaaaaatatttattattggcattattgccttttttgtatgcttgtagtaattcatcgaatcaaggtattaactatgatgaagcctttgctaaagacacgcaagggttagatattctcacagggcagttctcgcataatattgaccgaatttggggcgtcaatgaattgttagtggcaagccgtaaagattatgtgaaatatacagattctttttatacgcgtagccatgtgagttttgatgaaggtaatatcgttattgaaacccagcaagatttaaatcgattacataatgctattgttcataccttgttaatgggagcggatgcaaaaggtattgatttatttacttctggcgatgtgccgattagctctcgtccatttcttttggggcaggttgtagatcatcaagggcaacaaattgctaatcaagttatcgcaagtaatttcgccacttatttgattcaaaataaattgcaaacacgtcgattacaaaacgggcataccgtgcaatttgtttctgttcctatgattgcaaaccacgtagaagtgcgtgcacgaaaatatttaccattgattcgtaaagctgcacaacgttatggcattgatgaaagtttgattttgggcattatgcaaacagaatcaagttttaacccatatgcgattagctacgcaaatgctattggattaatgcaagttgtgcctcatacagcaggtcgagatgtatttgcaatgaaaggcaaaggtgggcagccatcaacgcgttatttatatgatcctgcgaataatattgatgctggtgtgtcttatttatggattttacaaaatcaatatttagatggaattacgaatccaacctcaaaacgtttcgccatgatttctgcatataatagtggtgcaggcgcagtgttacgtgtttttgataatgataaggatacggcgatttacaaaatcaatcaaatgtatccagaacaagtttatcgcattctaacgacagttcacccatcatcacaagcacgcaattatttgttgaaagttgataaggcacagaaaaaattccgtgttagacgataattgaattttttcagataatcaaaaatgctcgctggctaacaccattgagcattttttattaaaaaagtgcggtaaattttaaaatagtttttattatttcgttgttttaataaacatattgatgattaactattcaaacgaaatgttttttccattttttttgaatttagttattgaccgaaaaccgaaaaaatagtttaatacgccccgttgtcaggcagtagccaataacgataacgcctcgatagctcagtcggtagagcaggggattgaaaatccccgtgtcggtggttcgattccgcctcgaggcaccatttcctccttagttcagtcggtagaacggtggactgttaatccatatgtcgcaggttcgagtcccgcaggaggagccaaatttagaaaggccgctaaagagatttagcggctttttgctttcttatatataaaatatataatcttctctagtcttgtaactataactaggcatcaaaattcaaaatggtgtatcaatgagcgagagccttcttatttttgatgttagcaagcgacctaagtcgcttgcgtttaacttaaagaagaaaaatgaatcggcttttattttggaatagatttatttttcacgatcatcgatggtttgcagcaaataatttccctctgcatcagcaagactgcggaaacctacattcgtgattttgtagggatactttgttcgataagtaaagttttcgtgatgatgtccgtggaatactagcttaacccccatcttcattgccaaatcattaattacttggaaacccatcggatgtggtttaggggcttcgtgacaaatcaacacatctgcttgttggttttctaagatttcaatatctgatggaaaaattgacgtgcgatgacgcaaaggcacaccgcctcgccaaatcttctcctgtgggctatattggcaataatgaataggatcaaaaaacatggggcgatttggtggcatccaaatttgcccacggaatacaccgcctaatcccgcaatgcgagttccttgaatatcaactatgcgattgtgtaaattgcgtgattgccacttagaaccccaaattgcattaaaagcactaatggttttgctatcatgatttccatgaataaaccaaatatcacaatgttgcgcaagtttatccaactcatctgctgtcgtgagctgtaaatcgcctaaaattatcagtgcgacattttcctgttcttttataaaagggtaaatgtgatcatagcttccgtgcggatcaccagcaaataaaatcattgagatgtcccttttataggaaaggttgtgttttgtaattcactgatttcctcttcatttaacactttctcaatgactgctttaacttggttatagcgatcaagataacttggagattcaatctctatataaggaactttatatttatctaacagttttttgagtagttgttgaaattgttggcgttgtttttgtgagcctaagctgcgcaagccatcatccacccattcagtattatttttaagtaaaatagtgacatcgaagggatattctttaatcattgagtctaaaaatggatgagcttttccttcatattgaatgcagaacgcttgcgtggtaatgaaatccgtatcaataaatgcaattttatgagaatggcgcacggcataatcaatgtatcgttgatgaccaagcgccatttgcggatagtcagaatattgcatcgcttgctcgtcgccaccgagcttttcaaatacaaattcacgcccgtattcccacgcagaagtggtattaaatacggcggctaacttattaactagcacgcttttaccactgctttctccccctaaaatcgccaccgttttggcaaagaaaggacgagcttctttcggaataaacttccaatattggaatggagtggtgcgaattttggttgcggacacattaaagaaagtgcggtcaggatcgactaacgatacttctaaacctaagtatttctcgtaaggcgctttatcttgaggctcgctactaaatacgattgaaggttcaaaatgtttttcatgaaatagggttttaactgcttcactccaagattgccagccgtttggataacttggaataccgtcttcaatcaaatgatgaataaaaatctgatttttttgatatttgaaaatttgctgcatccaacgcaaacgatcttgcacggttggcatgcgtttcattttactatcgtaaaataatttcaaatcgcgcaccgtgtcactacacacgataacgtgtagttcatcgactttactgaacgcttcataaatcatatttatatgacctgtgtgtacaggataaaatttcccgaaaatgacaccgacttttttctcttttgtttttgacataatctgctcttgatagcgtaagaattgagtgtgtttattgtaggctaaatgaaaatatttttcacgttctgatttagtgcctaggtattttgcgttatacttagctcgcattctcagggcagggtgaaattccctaccggtggtaaagcccacgagcgtttaaaagtgcggtcaatttttggcaaatttttcctgcgaaattgtcctgattttcacttttaaagtcagcagatttggtgaaattccaaagccgacagtaaagtctggatgaaagagaataaaacgagttgggttcccaaatcgttcattttatttgcatttctcagccctgattctggtatttaattgaaatctcaaattaggaaattactatgaatcagtcaattttatctccattcggcaacaccgctgaagaacgcgtacttaatgcaattaatgctttcaaacatggaactggcgtattagttttagatgatgaagatcgtgaaaatgaaggcgatttaattttcccagcagaaacaatcacgtcagaacaaatggcaaaattaattcgttatggcagtggtatagtttgtttatgcattactgatgaacgttgccaacaactcgatttaccgccaatggtagaacacaataatagcgtaaacaaaacggcttttactgtaacgattgaagccgcaaaaggtgtttctacaggcgtatctgctgcagaccgagtaaccactattcaaacggctattgctgataatgcagttccaacagatttacatcgtccaggccatgtcttcccacttcgtgccgcaaatggtggcgtacttactcgccgcggacacacagaagcttccgttgatttagcgcgtctggcaggatttaaagaagcaggcgttatttgtgaaatcacgaatgacgacggcacaatggcgcgcacccccgagattgtagaatttgcgaaaaaatttggttattcggtgctaaccattgaagatttagttgaatatcgtttagcacataatatttaaaacgaagaagtgcggtgaaaatttctatgatttttttaccgcactttttatattatactgttccaactttttatttatttgggttacttattatgcataatgcagctcagcacaattatgttatcagtttaactactgaacaaaaacgccgaaaacatattacagacgaattcggtaagcagaatattcctttcgaattttttgatgctattacgcccgacattattgaagaaaccgctaaaaaatttaatattgcattagatcgctctcctaaagccaagttgtcggatggggaaattggttgtgcattaagccatattgttttatgggatttagcattagaaaataatttaaactatatcaatatctttgaagatgatattcatttgggggaaaatgccaaagaattattagaaattgattatatttctgatgatattcatgtcttaaaattagaagcaaatggcaagatgttctttaaacaaccaaaatctgtaaaatgcgatagaaatgtttatcccatgacggtaaagcaatcaggatgtgctggatatactgttacagcaaaaggggctaaatatttgcttgaattagtaaaaaataaaccacttgacgtggcggttgattcacttgtttttgaggattttttacattttaaagattataaaatagtacaactttctcctggtatttgcgttcaagattttgtgttacatccagataatccttttgaaagcagtttacaagaaggacgagatagagtacacggaaatcaacgcaagttttctattttagaaaaaataaaaaatgaatttggacgagtaaaaataaaaatgtttggaaaacaagttccatttaaataataaaagtgcggttaaaaatcttattaaattttaaccgcacttttttgtttattctacttctggtaaatttaccgcacctttatagcctaattgtcgccacgcttcataaaccgttactgcgacagaattggacaagttcatactgcggctattggctgtcattggaatgcggattttttgttccatcggcatttcatttaaaattgacatcggaatgccacgagtttctgggccaaacattaaataatccccaagttcaaatttcacttggctatgggctggactgccttttgttgtaagtgcaaaaaggcgtttgggtttttcgctttctaaaaaggcttcaaaggttttgtggcgtttgatttccgcaaattcgtgataatccaaacctgagcggcgtaagcgtttatcatcccaagtgaaacctaggggttcaattaagtgcaagcgaaatcctgtattggcacaaaggcgaataatgttccccgtattttgtgggatttctggttcatataaaacaatatctaacataatttttctctaattctgatataaacgatagctcaccattcccgtcgttttttctttcaataacgtccagttttcaggagtaataagcggtttatctttctctgtttctacgtaaattaacgcattgggttttagccagttattttcacaaagcaaactaattgcttgttctgccaaattaaaatgaaagggtggatctaaaaacaccacatcaaagtgcggttgattttgtggctgttttagaaaatccaaactactttgattaattacttcagcctgttctgatgagcatttgagtgtttgtaaattcttttttaattgattggcaacggttttatccaattctaaaaaagtcacctttttcgcttggcgagaaagtgcttcaaaacctaacgacccactccccgcaaagccatctaaacattcagattgatagatataaggcattaaccaattaaaaagcgtttctttcactctatcgccagttgggcgtaagccttcagaatttaatacaggaagttttcgccctcgccatagtccagcaataatgcgaacttcgccctttgcatttggcgtttgtatttttttcataaagattcgatttttattgaaaattgtgcttagtttagacgattttttgctagaatgaacgacatttttatcggattacagttaagagagcattttatggctgaagaaaataaaaaaggcggattttgggcatcattatttgggcgtaataaaaagcaagatgaacctaaaattgagccaataattgaagaagaaaagataaaagatatcgagccgtctattgaaaaatttgaaactcatgatttagtcgaagaagaaaaaatacaggaaatttcaaccgcacttgagccgattgaagaaatcatcgaagcgaaaaagttagaagatgagcttcagcctgttgctgaaattgaaactcgcgaaaagccaagtgaagggggcttttttagtcgtttggttaagggattactgaaaactaaacaaaatattggcgcgggttttcgtagttttttcttaggaaagaaaattgatgatgagttgtttgaagaattagaagaacaactgttgattgcggatattggcgtgccgacaacaagtaaaatcgtcaaaaatttgactgaacatgcaagtcgtaaagaattacaagatgccgagcttttatatcaacaattaaaagtagaaatggcggatattcttgagccagtagcacgaccgttagagattgatagcacgaaaaaaccttatgtgattttaatggtgggcgtaaatggcgtgggtaaaacgacgacaattggtaaacttgcacgtaaatttcaggctgaaggaaaatcggtgatgctcgcagcaggtgatactttccgcgcagcggctgttgagcagcttcaagtttggggagaacgcaatcatattccagttgttgcgcaaagcacgggttctgattctgcgtctgtgatttttgatgcgatgcaatcagcggctgcacgcaatattgatattcttattgcggatacggcgggtcgtttacaaaataaaaataacttaatggacgaactgaaaaaaattgttcgtgttatgaaaaaatatgacgaaactgcaccacatgaaattatgcttacgctggatgctggcacgggacaaaatgctattagccaagcgaaattatttaatgaggctgtgggtttaacagggatctctctaactaaattagatggcacggcaaaaggtggcgtgatttttgccatagccgatcagtttaagttgcctattcgctatatcggtgtaggcgagaaaattgaagatttacgtgagtttaatgcgaaagaatttattgaggcattattcgttcatgaagaagaataaaaagaataaggaaaaattgtgattaagttctcaaatgtttctaaagcctatcatggtgcaacgcagccagccttacaaggcttgaattttcatcttccagtgggaagtatgacttacttagttgggcattcaggcgcagggaaaagtacattactcaagcttattatggggatggaaaaagccaatgctggtcagatttggtttaacggacacgatattactcgcttgtcaaaatatgaaattccatttttgcgtcgccaaattggcatggttcaccaagattatcgtttattaacagatcgtacagtggcggaaaatgtggcattgccattgattattgcaggtatgcatccaaaagatgcgcatacacgtgcgatggcatctttagatcgtgtaggattgcgtaataaagcacactatttgccaccacaaatttctggcggtgagcagcaacgcgttgatatcgcgcgtgcgattgtgcataaacctcagctcttactagcagatgaaccaacgggtaatttagacgatgaactttctttaggcatttttaatttgtttgaagaatttaatcgtctaggaatgactgtgttaatcgctactcacgacattaatttaattcaacaaaaaccaaaaccttgtcttgtgcttgaacaaggttatttacgttattaaggaataatcatgagccgatcaacggatgcatctgtttttgttcaaacagcctatactttgcgtgcagtatgggcggatttatggcaacgtaaatttggcacgctgctcacgattttagtgattgccgtttcgcttacgatcccgactgtgagctatttaatgtggaaaaatttgcatttagccaccactcaattttatcctgacagtgaattgactatttatcttcataaaaatttaagtgaggaaaacgcgaatttagtggtagaaaaaatccgccagcaaaaaggcgtagaatcactgaattatgtttctcgtcaagaaagtttaaaggaatttaaaagctggtctggctttggcgaagaattggaaattttagatgataatccattgcctgcggtcgtgatagtaaaaccgacgagcgaatttaatgtgtcagaaaaacgtgatgagttacgtaccaatttaaataaaatcaaaggggtacaagaagttcgcttggataatgattggatggaaaaattaaccgcactttcttggttaaccgcccatgtggcaattttctgtacggtattaatgacgatagcggtatttttagttattggtaacagtattcgctctgatgtgtacagtagccgctcaagtattgatgtgatgaaattgcttggtgcaacagatcagtttatccttcgtccttatctttatacggggatgatttatgccgtgttaggtgggttagttgcagcaatttttagtagttttattatcagctattttacttctgcagtgaaatacgtaacggatatttttgccgtccaattcagtttgaatggattaggcgttggcgagtttgtattcttattagtgtgctgtttaattatgggctatgttggggcgtggattgccgcgacaaggcatattgcgatgatggagaggaaagaataattggatatcaaaagaaaagcgaatttcttaaaagaaattcgcttttttagttagaagtgaaatatttcgctgttgtagtttaggaagtaaatagttataagcgttctacaatcatagaaataccttgaccaccgccaatacaaagtgtagcaagtccaagttttttatctttttcgataagattgtgcaataacgttactaaaatccttgcaccactcgcaccgattggatgcccaagtgcgatagctccaccatgaatattggttttattcatatccaaattgagatctttgccaacacctaagaactgtgaggcaaaggcttcatttgcttctatcagatcgatatcatcaagatttattcctgcttttttcaatgctttttgcgttgctggaactggacctaatcccataacagatggatctaccccaccgctggcatagcttctaatttttgcaatggcttttaatccaagtgcatgagctttgctttcgctaactaaaataagtgctgcagcaccatcattaatgccagaagcgttacctgcggtgacagtaccctcttttttgaaagcaggttttaatttagctaaaccttcagctgtagtatctgctttaggatactcgtctcgtgaaacaataatgtcacctttgcgagtttttaccataacagggataatttccttatcaaatacacctaattgcacggcttgagatgctaaggtttgtgaacgtaatgcgagttcatcttgtgcttggcggctaataccatattgttctgcaatattttcggcagtaatccccatatgatagtgattgctagcacaagttagtccgtcttcaatcattgtgtcccttaatgtgagattacccattttgacgccttgtcgtactttgctatctaaaagataaggtgcttggctcatattttccatgccacccacaacaacaatatcagcatcaccactgataatagactgtgcacctaatgcgacactttttagaccagatccacatactttattgattgttaaagaagggatttctttctctattcctgcttttaatgctgcttgacgggctggattttgccctagtcctgcttgtaatacgttccccatgatgacttcattaactaatgcactttcaatgttggcacgtttgatggcttcttgtatcacaattgcgcctaaatcaaccgcacttacggaagataatgcaccattaaagctgccgatcggtgttctaactgcactaacaataacaacattttccatttttaactccttttctataagaaatataaaccaataataaaaattggtgcggtgaagataagtgcggtcatacagaagcccataatatctctcacgccaagccctgcgatacccagtgctggtaatgcccaaaatggctgagccatgttcatccattgctcaccataggcaattgccattgtagacttacccagatctgtacctaatgcttgagcagcagggataacaaatggtccttggatgacccagtgaccgccaccagaaggcactgcaaagttaataaaggcagaactaaagaaggttaataatgggaaagaatctttgttagcaacattgataaagaattctgtgattaaaccacctaagcctgaatgctccatcattagttgcacacccgcatagaatgggaattgcactaagatccctgctgtgcttcttgtggcattaataattgctcgcatataggccattggcgagccatgaagcacaattcctgtgattaagaaaataaggtttacattattaattgtgagattgaatccgtttttgtagaaatacataccgaggtaactatatcctaatgccccgattgtataggctaagaagcggctttcttccattttttcagcaagtgttgcatctttatccaattttttatcaaatgttggatcgggcgcaataagttttggatcaatactttttgcttcgccatttttgggcatcatcatataggtaatgaaaggcaagcaaatgactaaacttaacgtgataaaaatattgtacccagagaaaagcgtactaactgcaggaataataccttgtgggttgctttcgctcaccattaaatgagcaactgggttgcctggtgttgcggctaaaagtggcattgagcctgaaaaacctccaccccatgtcataaatgcaatataggcgcaggcaatcagtaaggcgtagtcactgccttttattctccgcgcgacttcttttgcaaacatcgcaccaacgaccaaaccgaagccccagttaatgatacaggcaattgaacccataaacgtaactaagacaacaccttgtgctggtgtttttgctattgaagcgattgtagaaagaaacttacgaatttgtggtgaggttgcaagagcattaccagttacgacaattaatgccatttgcataccaaaaccaagtaaattccaaaagccattaccccacatattaactaaatcaacaggtgtactatcggttaatccccaagcacaaatgaatgtgacaaaggtgcgtaacacggcaaaaataagtgggtctggcaggtatttactgacgaatgtcgtcataaaacgagaaacgcgactaatcataattaaagtcctttctggctgatttgcatttctttgaaatcatcggcaacaatgaaatcggcttctgttttggctttaattgtttctaaatccacatgaggagcatgttcttttagaactaatctgccttcaatgaagttaaatactgccaattcggtaaccaccatggcaacttttttacttgctgtgagcggtaatgtacatttctttagaatttttgaggaacctgacttggcacaatgttccatgccaataatcactttttttgcaccagtcactaagtccattgctccgcccattcctggtaccattttgccaggcaccatccagttagcgagatttgcttcttgatcaacttcaagtccacctagcacacaggcatcaacatgaccgccacgaattaaagcgaaagaaaaagcactatcaaaagtagcgccgccttttttaattccacaaggctgaccaccagcatttactaagtttgaattagcattttctgggtcaaatgcagttaaaccaagaaagccattttctgattgaagtgtaatattgacattatcaggtaaataattaacaacctgtgttggtaaaccaataccgagattaacaatatctccatcatgtaattccatcgcaattcggcgagcgattaattcttttgcattcatggcgttctccttattctgaacaaacaatgtaatcaattaatgcggctggcgtgatgacttcatctgggggtaactgaccgacctctagtagattatcaacttgggcaatgacagttttggctgctaaagcaactagtggattaaagttcctagcagataattcataagctaaattgccattcatgtcacctttttgagcatggataatggcaatatcagcttttagtgggagttcaagtaaatattctttgccatcaatttgaattttttgttttccttcttcaacaacagtgccgacacccgttggtgttaaaataccacctaatccggcgccacctgcacgaatccgttcagctaaggtaccctgtggaacgagttctacatctatttcaccagcaatcatttttttgccagtttctggatttgtaccaatatgggatgtaattaaacgtttgactcgattatttacaattaaaggccctacgccagtgtcaataaaggctgtgtcattgcctatgagtgtgagatcctttacgccagaatctaagatttgttggacaagtttggctggagtgccgatacccataaatccaccaaacatgatgctcataccatcatgtaggtgttgatttagattattaagcttaagatgtttttgtgtcatagagacctcctaataacgagattaaaagaaagaatatcaacaaataagtatcttatatttcaaatggatatgtttcttgtgatgatccttgataggcaataaaggaactagattgatattaaaaatagcaaaaaaaatttcgtaaaagaaatacatctttcttaggcgggtataagttattttgatagtgttttaaacaatccttgtgctatattttgtaaaaatggcagtccttaggggggtgaaaatgatggatattaggcatctaagatattttgtttcaatcgtagataatgattttaatttaagccgagcgtctcaaaatttatatgtgtctcaacctgcattaagtatgatgattacggagtttgagaatcgtgaaaatattcagatatttaaacgggcatcaggaaaaattattggactaacctttgcgggggaaaattattatcgtgatgcaaaagaagtgatcaagcgttacaatgatatgagaacaaatctttataaatcaaaagattgtaagaaaggcacgataacaattggtattcctcccttagttttatcagccgtgttctcttctgtattgcctcatcttattcttaagaatccagatattaattttattattaaagaaattggagcttatgctctaaagagtgaacttcttttagataaagttgatttagccgtgttgttatatcccgagcgaatatcaaaaaatattattgattcaattgaaattcatagttctgaattagccttatttctttcaccaaagcatgtcttagcaaaaaaacaacaaatcacatgggctgatttacatcagcagaaaatggcaatttttgatcaaacatttatgattcatcatcatttgaaggaagcttttgagcgcaataattgttatccagatattgttttggattcgagttgttgggattttctgctaagtgcggtcaaaacaaacaaagaattattaactattctaccgttacctatggctgagctttatcattcaaaagaatttttgtgtcgtaaaatcgaaagtcctgttccgtggaaagtgacactatgtcgtcaaagaaaaacggtttacacacaccttgaagaatatatttttgataaattattagaggcttttaggccaacaaaatagttaaaataaaagcttgcaaatagggttgtctttctatagaatacacggactctcaatatgagagccgtttaatgtaatcatttattgaacgggcatgacgatatgtcaggctaacaatgtttccgatttggagactatataacaggtaacttgcacctccttttctatatttgaagttagaattgtgattggtgttagtttttttattagctaaattttattggagctctggtctaatgcagaaccaaagaatccgtatccgcttaaaagctttcgatcaccgtttgatcgatcaatctactgcggagatcgtagaaacagctaaacgtactggcgcacaagttcgtggtccaattcctttaccaactcgtaaagagcgtttcaccgtgttgatttctccacacgtaaacaaagacgcacgtgaccaatacgaaattcgtactcacaaacgtttagtagatatcgtagagccaacagaaaaaactgttgatgcattaatgcgtttagatttggctgccggcgtggacgtgcagatcagcctaggttaattaagaggttattacaatgattggtttagtcggtcgtaaagttggtatgacccgtatcttcaatgaagacggcgtgtcagtaccagttaccgttatcgaaattgaagccaaccgcgtaactcaagttaaaactcttgaaaacgatggctatactgcagttcaagttactactggttctaaaaaagcgaatcgtgtaactaaacctgaagcaggtcatttcgtgaaagcaggtgttgaagctggtcgcggtttatgggaatttcgtactgaaggtgaagaattcactttaggtcaagaaatcaatgtagacatcttcgcagatgttaaaaaagtagatgttactggtacttctaaaggtaaaggtttccaaggtggtgttaaacgttggaacttccgtactcaagatgctacacacggtaactctttatcacatcgtgtacttggttctattggtcaaaaccaaacaccaggtcgtgtgtttaaaggtaaaaaaatggcaggacatttaggtgctgaacgtgtaactgttcaatcacttgaagttgttcgtgtagatgctgagcgtaaattgctattagtaaaaggttctgtacctggtgctatcaatggcgatgttatcgttaagccggcagttaaagcataagtctaggagatagagatggaattacaagttgtaggtgcaaacgcactcactgtttctgaaactaccttcggacgtgagtttaacgaagcgttgatccaccaagttgttgttgcttatgcagcaggtgcgcgtcaaggtactcgtgcgcaaaaaactcgtgctgaagtgtctggttcgggtaaaaaaccttggcgtcaaaaaggtacaggtcgtgctcgtgctggtgatattaaatcaccaatctggcgttctggtggtacaaccttcgcggctaaaccacaagatcacagccaaaaagtgaacaagaaaatgtaccgtggtgctatcaaaagcattctttctgaattagttcgtcaagaccgtttggttgtggtggaaaaatttgaattagatgcaccaaaaactaaagttttagtacaaaaattaaaagatttagccgttgaagatgcgttaattatcacagcaagtttagatgaaaatctattcttagccgcacgtaacttatataaagttgatgtacgtgatgttcaaggtatcgatccagttagcttaatcgctttcgataaagtgattgttactgttgatgctgtgaaacaaattgaggagatcctagcatgagtcaagaacgtttgctaagtgtgctacgtgcaccgcacatctctgaaaaagcaactaacaatgctgaaaaatctaacactgttgtacttaaagttgctttagatgcgaacaaagctgaaattgctgctgcggttgctcaattatttgaagtaaaagtagattcagttcgtactgtggttgttaaaggtaaaactaaacgccgtggtaacaaaatgggtcgtcgcagcgactggaaaaaagcttatgtaactttagccgaaggccaaaacttggacttcgtggacagtgcagagtaatcggaggaaattagagaatggctatcgttaaatgtaagccgacctccgctggtcgtcgtcacgttgttaaaatcgtgaaccctgaattacacaagggtaaaccttacgcacctcttctagatactaaatctaaaactggtggtcgtaacaactatggtcgtattactactcgtcacattggtggcggtcacaaacaacactaccgtttaatagatttcaaacgtaacaagttagacattccagcggttgttgagcgtttagaatatgatccaaaccgttctgctaacattgctttagtgctttataaagatggtgaacgccgttatattttagcacctaaaggtttgtcagtaggcgatcaaatccaagctggcataaactcaccaattaaagtgggtaactcattaccaatgcgtaatatcccagttggttcaacagtacataacgttgaattaaaaccaggtaaaggcggtcaaatcgctcgttctgctggtgcttatgtacaaatcatcgcacgtgaaggcaactatgtaactttacgtttacgttctggcgaaatgcgtaaagtattagctgaatgtgttgctacaatcggtgaagttggtaactcagaacatatgcttcgcgtattgggtaaagctggtgctaaccgctggagaggcattcgccctacagttcgtggtactgcaatgaacccagtagatcacccacacggtggtggtgaaggtcgtaactttggtaaacacccagtaactccttggggcgttcaaactaaaggtaagaaaactcgtcacaacaaacgtactgataaatatatcgtacgtcgtcgtggcaaataatagattaaattaaagaggattagccatgccacgttctctcaagaagggtcctttccttgacctacacttgttgaagaaggtagagaaggcggtggaaagcggggataaaaaaccaattaaaacttggtcccgtcgttcaatgatcattccatcaatgatcggattgaccatcgcagtccataatggtcgtcagcacgttcctgtttatgtatctgatgaaatgatcggtcataagcttggtgaatttgcaccgactcgtacataccgcggtcacgcggcagataagaaagctaagaaataagaggtaaagagatggaaactatcgcaaaacatcgttacgctcgcacttctgcccaaaaagctcgcttagttgccgatttaattcgtggtaaaaaagttgcgcaagcattagaaattttaactttcactaacaaaaaagcagcagctttagtgaagaaagttttagaatcagctattgcaaatgcagagcacaatgacggtgcagatattgatgatcttaaagttgctaaaatcttcgttgatgaaggtcctagcatgaaacgtgttatgccacgtgctaaaggtcgtgcagatcgtattttaaaacgtactagccacattactgtggttgtgtcagatcgttaataagtagaggaatagcaatgggtcaaaaagtacatccacatggtattcgcctaggtattgttaaaccttggagctctacttggttcgcgaatacacaagacttcgctgacaatcttgaaggcgatttcaaagtacgcaaattcttaaataaagaattagcaaatgcttcagtttcacgtattactattgagcgtccagctaaaagtattcgtgtaactattcacacagctcgtcctggtatcgtaatcggtaaaaaaggcgaagatgttgaaaaattacgtaacgcagtgtctaaaatcgctggcgttcctgctcaaattaacattgctgaagtgaaaaaacctgaattagatgcgaaattagttgcagatagcatcgcttctcaattagaacgtcgtgtaatgttccgtcgtgcaatgaaacgtgcggtacaaagtgctatgcgtttaggtgctaaaggtatcaaagttgaggttagcggtcgtttaggtggtgcagaaatcgcacgttcagaatggtatcgtgaaggtcgcgtacctctacatactcttcgtgcggacatcgattataacactgcagaagctcatacaacttacggcgtaatcggcgttaaagtgtggatcttcaaaggtgaaattcttggtggaatggctgccgttgcgcaatcagaacaacaacctgccgacaagcctaaaaaggctcctcgcggtaaaggtcgtaagtaaggagaaacgctaaatgttgcaaccaaaacgtacaaaattccgtaaagttcacaaaggccgcaaccgtggtatcgcgagcggtactgaagttagtttcggtacttacggtttaaaagcagttggtcgttgtcgtttaaccgctcgtcaaatcgaagcggcacgtcgtgcaatgtcacgtgcagtaaaacgtcaaggtaaaatctggattcgtgtattcccagataaaccaattactgaaaaaccattagaagtccgtatgggtaaaggtaaaggtaacgttgagtactgggtagccttaatccaaccgggtaaagtgctttatgaaatggatggtgtgtctgaagaagtagcaagaaacgcatttgcattagcagctgctaaattgccagttaagaccactttcgtaactaagacggtgatgtaatgaaagctcaagatttacgtacaaaaagtgttgaagagctgaatgctgaattagtaaaccttttaggtgaacaattcaagttgcgtatgcagacagccaccggtcagcttcaacaaacccatcaggctaagcaagtgcgtcgtgatattgcacgtgtaaaaactgtattaaccgaaaaggcgggtgagtaatgactgataaaattcgtagcgtacaaggtaaagttgttagcgacaaaatggaaaaatctttcgttgttgctattgaacgtaaggtaaaacaccctttatatggtaaatttatccgtcgtacaactaaattacacgtacacgatgagaacaatgaagccaaagttggtgataccgtagagattcgcgaatgtcgccctctatcaaaaaccaaatcttggactttagttcgtgttgttgagaaagcagttattgcttaattaataacaaagagtaataaaataaaagccaatagtgtaaatctattggcttttttgtttttaaagtgcggttaaaattcaatgaattttaaccgcactttttcttttaggtgttattgacataacacctaaacaaatactgaaaaaaatatttttaataatggtacttaagagaaatttctgaagatcttggttttgaatattctgatgagtggaatactcgttatttgggacatagattaattaatttcatcaacggcgttgatacccgtaaagaaacgtcaaaattagcagaggataaattcccagaagaacttatcaatgatacagatactactgggaatatttctaatgaagattgggattggtggtgtcatttatctgatacaatgaagtatatattaatacatgatcttccttatcaagaagaggagattggcatcacagagttttatgatgaaaatgatttggatacagaagcagatatatatgatcgagagacttttagaatcttattaggagaatatgtaacaggattatatttgttagatgatacttttatagagccagtgcttgataatataaatattcctaacaatgtttatagtacaaatatatttgctattcatcatgttgcaaagcatattttgggtattaaagatctagataaacgtttaaaatctggtgatattgaattagttcgtgaattaggagaagtaacaattggtggtaaggagaagtatttttactcttttgcaactaaatattgtagtcatcataatccaattgctttcccaatttatgatagctatgtggagcaagatctcctctattttaataaagtagataaattttcagcctttaaaaggaaagatttaaaaaattacagaaaatttaaagagattttgatagattttcaaagattttataaattagaaagatttaacttaaaagagctcgatctgtatctttggcttttaggcaaggaaattttcccaaaatctgaaaactgatgaatttatctaaggtaagagaagagagcgtttcattttttctgcagtttatttttcattcgataaatttttgagaggatgaggatatttttataattccaaaagtgcggtaaattttaactggattatttagtaaatagatcaataagaggaagctaaattatcattgcctttctctttttcttttgataaaatccgccgcctatctgccattctatctgaatagtgtggatgggttcgtcccgaaagggtgtttttttaatcttaacggagcactaatatgatccaagaacagactatgctggatgttgctgataattcaggcgctcgcagcgtaatgtgtatcaaggttctaggtggatcgcaccgtcgttatgctgcgattggtgacatcatcaaaattactgtaaaagaagcaattccacgcggtaaagtaaaaaaaggtgatgtattaaaagcagttgttgtgcgcaccaagaagggtgttcgtcgcccagatggctcagttattcgtttcgatggtaacgcttgtgtaattttaaataataacactgagcaaccaatcggtactcgtatttttggaccagtgactcgtgaacttcgttctgagaaattcatgaagatcatttctttagctccagaagtactgtaaggggaatgtaatggctgctaaaatccgtcaaaatgatgaagtaattgttcttactggtaaagataagggcaagcgtggcaaggtaactaaagtgttaccaaacggtaaagtgtttgttgaaggtatcaacatcattactaagcatgaaaaaccagttcctgcattaggaaaggctggtggtttggtgaaaaaagaagctgcaattgacgcttcaaatgttgcgattttcaatcctaaaacaaataaagctgaccgtgtaggttttagattcgaagacggcaaaaaagtacgtttcttcaaatctaacaatgaaattatctaacaaactggagtaatgcgatggcgaaactgcatgattactacagagatcaagtagtaagcgaattaaaaaataaattcggctacaaatctgtcatgcaagtcccacgaatcgaaaagattaccctgaatatgggtgtgggtgaagcattgaccgacaaaaaattgctagacaacgcagtagcggacttagcagcaatcagcggtcaaaaacctttagtaactaaagctcgtaaatctgttgctggctttaaaatccgtcagggatatccaatcggttgtaaagtaacactacgcggtgagcgtatgtgggagttctttgaacgtttgattacaattgctgttccacgtattcgtgacttccgcggcttaagtgcgaaatcattcgatggtcgtggtaactatagcatgggtgtgcgtgaacaaatcatcttccctgaaatcgattacgataaagtagatcgtgtacgtggtttagatatcactatcacaactactgctaagaatgatgaagaaggtcaagcactacttgctgcctttaatttcccattccgtaaataaggcaggttataatggctaaacaatcaatgaaagcacgcgatgtaaaacgcgttaaattggctgaaaaattctacgcaaaacgtgttgaattaaagaaaatcatttctgatgtcaatgcctctgatgaagatcgttgggatgcagtgttaaagttacaaactttaccacgtgattctagcccatctcgtcaacgtaaccgttgccgccaaactggacgtcctcatggcgttttacgtaagtttggtttaagccgaattaaggttcgtgaagctgcaatgcgcggtgaaatcccaggccttaaaaaagcgagctggtaatataccactttattttggaatcggagaaaaagtacaatgagtatgcaagatccaatcgcagatatgctgacccgtattcgtaacggtcaagctgcgaacaaagttgcaatcaatatgccttcttccaagctaaaagtggcaattgccaacgtattagctgctgaaggttatatcgaaagcgtaaaagttttagaaggtgctaaacctgaattggaaattactttaaaatatttccaaggcaaaccagttgtagaaagcatccaacgtgtaagtcgtcctggtcttcgtatttacaaacgtaaagatgaattaccaaaagttatgggcggtttaggtgttgcagttatttctacatctaaaggtgttatgactgaccgtgctgctcgtcaagcaggtttaggcggtgagatcatctgttatgtagcttaatagagaggtaggaaaatgtctcgtgttgcaaaggcacctgttaatattcctgccggcgttgaagttaaactcgacggtcagctattaacagtaaaaggtaaaaatggcgagttatctcgcaaaattcatgaatcagttgaagtaaaacaagataacggacaatttacgttcactccacgtgaaggttttgttgaagcaaatgctcaatcgggtactgcacgtgcattagttaatgcaatggttatcggtgttactgaaggtttcactaaaaaattagtattggtgggtgtaggttacagagctcaacttaaaggtaacgcaattgcattaagtttaggctattctcacccagtagagcacactttgccggtaggtattactgcagaatgtccatctcaaaccgaaatcgtgttgaaaggtgcagacaaacagttgatcggtcaagttgcagcagatattcgtgcttatcgccgtcctgagccttataaaggtaaaggggtacgttacgctgatgaagtggtacgtatcaaagaggctaagaagaaataattaaggtaacactatggataagaaatcagctcgtatccgtcgtgcagctcgtgcacgtcatatgatgagagagcaaggtgtaactcgtttagttattcaccgcactccacgtcatatttatgcacaagttattgcaccaaacggttcagaagtgcttgccgctgcttcaactgttgagaaagcaattcgtgagcaagtaaaatacaccggtaataaagatgctgctgcagcagtcggtaaagctgttgcagaacgcgcattagcaaaaggcgttcaagctgttgcttttgatcgttccggttttaaatatcatggtcgtgtccaaactttagcggacgctgcacgtgaagctggtctacagttctaatgaggtaaattgagatgtcaaacatcgaaaaacaagttggtgaactgcaagagaagctaatcgcagtaaaccgtgtatcaaaaactgtaaaaggtggtcgtattatgagtttcactgcattaactgtggtgggcgatggtaatggccgagtaggttttggttatggtaaagctcgcgaagttccagcagcgatccaaaaagcgatggaaaaagcacgtcgcaatatgattaatgtcgctttaaatgaaggtacattacaacatccagttaaaggtgttcatactggttcacgtgtatttatgcagccagcaagtgaaggtacaggtatcatcgctggtggtgcaatgcgtgcggtattggaagttgcaggtgtacgtaacgttctttctaaagcgtatggttctaccaacccgattaacgttgttcgtgcaactattgatgcattagcaaatatgaaatcaccagaaatggttgctgcaaaacgcggtaaaactgttgatgaaatcttggggtaatgaataatggctaaaactattaaagtaacacaagttcgtagctcaattgctcgtttaccgaagcataaagctaccttgcgtggtcttggtcttcgccatatgcaccacactgttgagttaattgatacgcctgcagtacgtggtatgattaaccaagtttcatacatggttaaagtggaggagtaagagatgcgtttaaatactctatctccggctgaaggtgcaaagcatagtgctaaacgcctcggtcgtggtattggttcaggtttaggcaagactggtggccgcggtcataaaggtcaaaaatctcgtactggtagcggtgttcgtcgcggtttcgaaggtggtcaaatgccgttataccgtcgtttaccaaaatttggttttacttcaatgaaatctgcagtgactgcagaagttcgtttaaatgaattaaccaaagttgaaggtaatgtagtaactttagaaacattaaaagcagcaaatatcttaactaaagatatccaattcgctaaagtaattttagctggagaagtgaaatctgcagtaacggtacgcggtttacgtgtaactaaaggtgcaaaagcagcaattgaagctgctggcggttcaattgaggaataattagcaaatggctaaacaaccaggttatcaagcaagaagtactaatagcggtaaaggtgaattaaaaagccgattacttttcgttttaggtgcacttatcgtttatcgaattggttcattcattccggttcctggtattgatgcgactgttctagctcaattagttgaacaacaaaaaggcactatcattgacatgtttaacatgttctctggtggtgctctaagccgtgcatccattttagcattaggaatcatgccatatatatcggcatctattgtaattcaattgcttgcaacggtttctcctgctttagcagaattaaagaaagaaggtgctgctggtcagcgtaaaatttctaaatatactcgttatgcgacagttgtttttgcaacgattcaggcagtagctatttcaacaggcttaccaaatatgttgtctggcttagtgccaaatgttggatttagtttttacttcacttcagttgttagtttagtcactgggacaatgttccttatgtggttgggtgagcaaataactgaaagaggtattggtaacggtatttcaattcttgtttttggcggtattgtagctggtttaccatcggccattcttcaaactattgagcaggctcgtcaaggacagatgcatccattagttcttcttctgatcgcagctattgtatttgcagtaacttattttgttgtttttgttgaaagaggacaacgtagaattcgcgttgaatatgcgaagcgtcagcaaggtcgtcaaattttaggtggtcattcaacacatttaccattgaaagtgaatatggcaaatgtaatgccagcaatttttgcttcaagtattattttattcccagctacattaacacaatggtttgggcaaaatgataaatttgaatggttaaataatttatcaatgttattgaatcctggtcaaccactttatttgcttgtttatgctgttgcaattattttcttcagttttttctatacagcaatgcaatataatcctcgtgatacagcagataatctaaaaaaatctggtgcatttattccaggaattagacccggtgaacaaacatcacgttatattgataaagtgatgactcgtcttacattaattggcggtctctatgtaacgtttgtatgtttagttccttatattatgacatcggcttgggatgttaaattttacttcggtggaacatctcttttaattgtagtcgttgtaattatggatttcatcgttcaggttcaaagtcatttaatgtcttctcaatatgaatctgcgttgaaaaaagcaaaccttaagggttttggacaataattgttcatttaaagtaaaaggataagcaatgaaagttcgtgcttccgtaaagaaaatgtgtcgtaactgtaagattgttaaacgtgagggtgttgtacgcgtattgtgtagcgaccctaaacataaacaacgtcaaggttaattaacatttttcttgccaagaaccagttgagtagttatactgctcaactcatttatgtccttgatattctgtttgagtatcctgaaaacgggcttttcaagatcagaatatcaaattaattaaaatataggagtgcatagtggcccgtattgcaggcattaacattcctgatcataaacacgctgtaatcgctttaactgccatttacggtattggtaaaactcgttcacaagctatttgtgcagcagcgggtattgctgaagatgttaagatcagagaattgtctgaagagcagattgacaaactgcgtgacgaagttggtaaatttaccgttgaaggtgacttacgtcgtgaagtaacactaaacatcaaacgtcttttagacttaggatgctatcgtggtttacgtcatcgtcgtagtttaccagtacgtggtcaacgtactaaaactaatgcgcgtacccgtaagggtccacgtaagccgatcaaaaaatagtcggggtaaataagaatggctaaaacaccagttcgtgcacgtaaacgtgtaaaaaaacaagttgtagatggcgtagcacatattcacgcatctttcaataatacaatcgttactattactgaccgtcaaggtaatgctctagcttgggcaactgcaggtggttcaggtttccgtggttctcgtaaatcaactccgttcgcagcgcaagttgcggcagagcgttgtgctgaaatcgttaaagaatttggcttaaagaacttggaagttatggttaaaggtccgggtccaggtcgtgaatctacaattcgtgcgttaaacgcagcgggtttccgtatcacgaatattactgatgtgactccgattcctcataacggttgtcgtccaccgaaaaaacgtcgtgtttaagacgtataggatagttggagaaagaaaatggcaagatatttgggtcctaaactcaagctcagccgtcgtgaaggcactgatttattccttaaatcaggcgtgcgtgcgattgattcaaaatgtaaaattgatacagcaccaggtcagcacggtgctcgtaaaccgcgtttgtctgactatggtagtcagttacgtgaaaaacaaaaagttcgtcgtatctatggtattttagaacgtcaattccgtaactactataaagaagcaaaccgtttgaaaggtaacactggtgaaaatttattagtgttattagaaggtagattggataacgttgtttatcgcatgggatttgctgcaactcgtgcagaggctcgtcaattagtgagtcataaagcaattgttgtgaatggtcgtgttgttaatattccatctttccaagtttctgtaaatgatgtagttgctattcgtgaaaaatcgaaaaaacaagctcgtattaaagcatcattagaattagcagagcaaagagaaaaaccaacatggttagaagttgattctgcaaaaatggaaggtgtattcaaacgtgttcctgaacgttctgatttatcagcagatattaacgaacatctgatcgttgagctttactctaaataatagttaagcttaaaaccaaagagaggataaaatgcagggttctgttacagaatttttaaaaccacgtttagtagatattgaacaaattagttcaacacatgctaaagtgatcttagaaccgttagagcgtggttttggtcatactctaggtaatgcattgcgtcgtatccttctgtcttcaatgccaggttgtgctgtaactgaagtagaaattgatggcgtattgcatgaatatagtagtaaggaaggtgttcaagaagatattcttgaagtacttttgaaccttaaaggtctagcggttaaagtacagaataaagatgacgttattctgacattaaataaatctggaattggccctgttgttgcagcggacattacccatgatggtgatgttgaaattgtaaatccagatcatgtgatttgtcatttaactgatgaaaacgcttcaattagtatgcgtatacgtgttcagcgtggtagaggatatgttcctgcttcatctcgtacacatacgcaagaagaacgtccaattggtcgtttgcttgttgatgcttgttatagtccggttgaacgaattgcgtataatgtagaggcagctcgtgttgagcagcgtacagatttggataagctcgttattgagttagaaactaatggtgcacttgagccagaagaagcaattcgtcgtgcagcaacaatcttggcggagcaacttgatgcattcgttgatttacgtgatgttcgtcagcctgagattaaggaagaaaaaccggaatttgatccgattttattacgtcctgtagatgatttagagctgacagttcgttctgctaactgtttgaaagcagaaacaattcattatatcggtgatttagtgcaacgtactgaagtagaattattaaaaacccctaatcttggtaagaaatctcttactgaaattaaggatgttcttgcttctcgtggcttgtcacttggtatgcgccttgaaaattggccgccagcaagtattgctgaagactagtttggtcataggttaagatttttctgagaaggataagatcatgcgccatcgtaagagtggtcgtcaactaaaccgtaatagtagtcatcgtcaagcgatgttccgtaacttagcaagtgctttagttagtcatgaaatcattaagactactttgcctaaagctaaagaattacgccgtgtagttgaaccgttaattacattagcaaaagtagatagcgttgctaaccgtcgtttagcattcgctcgtactcgcaacgttgaaactgttgcaaaattatttaatgaattaggtccacgttttgctcaacgtgcaggtggttacactcgcattttgaaatgtggtttccgtgcaggcgataatgcaccaatggcatacattgagttagttgatcgtccagaagttgctgaggcaacaactgaggaataaaaattaattctaaaaagaagctcactttatatagtgggcttttttattttatatattacaaaaatctttatctgatttaatcattacttagatatattatttacaatcagcgagcagtggtaaattttaagagcatattcgtagatgtcgtgtatttttatctaaaattccttgttttttaagctctctactaatacgaattgcggtttcagtttcacatccacaaaattccgctacttctcggtaggtccaaggataatcgggataactttcagttaaattttcaatggcatcaataatacgttcgtaactacgcttataagctgtattacttattcggtgttctgcatcatataattcattagaaagttgtttcataagataacaagaaaaatcagggttatttgcaataaaatttgcgtgattaccaggaaatattctaactatatcggcttccattaatacttttgcactgcaatgataagatgtttcactaaaaatagtacgaaaaccaaaatattcattagcgtgataaagtcgagtcaatgtttctttgccattttccagactatgatacagaccaactagcccttgttttaaaaaataaaattctttaggcttctcgccttgtgcataaattaagctgtttttttctagagttttactctcagaaataatacatttatttaagttttgtggtagataataggacaatgtaaacataaaggcgtcttttaatatatcaataactttagattactatacaaatttctatatttttcttctataagcaaattatgaaaatgtgaagtgtttaacaaaattttgaactagataaatattattttattttgccaaatgattttgcaaatgactttaaatatggatccatatgagaaagtgctgaataatatgcctcacaaagttgattatgtgttttaccaaatccttgaattgtacgatgttttggacatcctccgtgacatgcaaagcgaaacttacagattttacactgttcggaaagaaaagatttcgctgcaccaaaattcttttgtttagtattattatcaaggagctgtattagaggggtttcaataagatttccgagtttatattcaggataaacataatgatcgcaactataaatatcgccattttgttcaataaccaattgatcgccgcaggtttcacgaaaaatacataaacttggttgtaaaccaaggtaagccataaaccattgttcaataaattgaataccaattttgccgacatcattggcataccattcatcaaaaatattaattaaaaattgaccgctcttttgtagaaatcaagacctgctagggttggctcgccgccttgccataggaaagtaacttgttgttgaggcgttgcttcaatataggatttgatataggcttctaatacttcattagtcatagcccgttgatttaagtgaggtttttccaagtaaaagcaatatttacaatctaaattacaaattgaaccagtaggttttgccattaattgaaatgaattcatatctacgtatcctccttattctttttatcatagcagaataattttaactgtatatgatagcgatcataagttgcgcatatgctcttacgtcaaaatgaagtatgattaaatgaatttttaaataggatctaagatggcgtttagtacaatttttatcttactgatttgcggtatttgtaccaatatggtttctgctatttttggtattggcggtggggtattgatggtgccaattttacgtacattgtttcctgcgttaccgattcaagttatttcagctacgtcactcaccattgtgatgtgtaccgcattgattaatttattatttttccataagcaaaaaattaaaattgattatatcaatatgattttatggtctattgctatggtgattggggtgcaaattggttttgaattaagtttttatttttctacagcgataattagtttaatttttacggttagtttaagtgcactagcgattaaaacatttttgaacagatcgagaatacaaatagaagtgtttaatatgtctcctatagaacgagctaaaggtagtattagtttttgtggaggaggcttaattgcgggtattacaggtattggaggcggttctattcttgcgccccttgtcgggcaattaaagggggtaaaaacgcaacaaattgccgtttatacgaactatatgatgattattggtggtattggtaatctatacggctatctcactagagcttttccctatgatatcagcctaagtggccaactaggatatgtaaactttcttgtagttggtgtcgttaccttgggttcatttggaatgagtttcttctcaatgaaattgcgtggattaatgaatccagttttaacaagaaaattattggcgattattttattttgtattgcagcctatatgtgcattttggaatttgtattccattaaatcgaataaactagacctagttattctaggtctattctctaattagtgttttcgcaatctctcttgcttgtgcatcaatttcgagtacatcatcaatattttgaatggtataaggcgaaattctctcaattgttttcgaattaatttttgcaatatccataaaactaatttgacgatctaaaaatgcttgtacggcaatttcattagctgcattcattgctgttgtcgcatattgacccgcagcaaaggcatcaatagccagttttaaattcggatagcgattaaaatcaggttcaataaaagtcagttctttgattttaaagaaatcgagtggttctactccagcaaaagtgcggtgaggatatgccatagtttctgcaattggtgtacgcatatctggatttcccatttgagctatgactgagccatcaacataacgcaccatagaatgaataattgattgtggatgaataatgacttccatttcttccgcacttgcattgaaaagccagcgagcctcaatgtattctaagcctttattcatcattgtagctgaatcgacagaaatttttttacccatagaccaattagggtgcgcaactgcttgttctggtgttatgttggtgaattgttcaagtggcgtgtaacggaatggtccgccagaaccagtgagtataattttacttacacctaattcagaaagtgggcaaaaaccgattttttcttgtgcttctggcggtaatgattgaaagatagcattatgttcactatctactggtaaaagcttcgagccatagttttttacggcatcaataaaaagctgtccgcaggttaccagtgattctttatttgccagtaatacccgtttacctgctttaaccgctgaaagagtcggtaacaatcctgctgcaccaacaatcgacgccattatctgatcggcatctgggtgtgctgcgagttcgcaaatagctcgtcgtcctgctaatactttcgttggaatatgatgcgcaattaatttttcacgtaaaattttagccgcatttacatcatcaagagccgcaaagtgcggtcggaatttgatacattgttcaaacattgcttctacattttttccgccgacgagtgcaaatgcatgatatttctgagggttattttcgataacagaaagggtactcttaccgattgatcccgttgaaccaagaatgacaatgttttgtttttgcatagaatctttaccgcactttgttgattatattttcattggtacgtctaaattcgcatacctaataaaataaaggcagacaaaactgtctgcctttcgtattttttgatgattagaaatccattaattctttttctttatccgctaatacttcatctacttttttaatgtaaatatctgtgattttttggatttcttcttctgctttatgttgttcgttttcgctgatttctttgtcttttaataatgctttgattttatcattcgcatcacgacgcacattacgaatcgcaactttaccttgttcaccttcgccttttacgatcttgattaaatcgcgacgacgttcttctgttaatggcggaagcggaacacggattgtggtacccgctgaagatgggtttaaacctaaatctgaggttaaaattgctttttctaccgcagagattaaagaacgatcaaaaacagttacggctaaagtacgcgcatcttctgccactacgtttgctaattggcgaagtggggtcgccgcaccgtaatattcaacttgaattgcatcaagtaaactcggttgagcacgaccagtacgaatttttgaaatatgaccttttaatgcttcaaggcttttttccatacgatcttgagcatcttttttaatttggttaagcattgcattgtcctttttaattgatgaaagttagaacgccgtgattttactggatttttttaaatttttgaatacatttatcagcttgaaaacagataaaaaatgaccgcacttcagttacccaaagtgcggttaatatttttagtatttttaattaagctttaggaccagctgcaattaaagctttgccttcttcgttagttgcatatttaacaaagtttttcacaaaacgacctgctaagtcttcagcttttgattgccattgtgctttatctgcgtaagtatcgcgaggatctaagattgcagaatctacacctggtaatgctttaggaattgctaagttgaagattggcaattcgcccatttcagctttttcaattgagccatctaagattgcatcaatgattccgcgagtatctttgattgagatacgtttgcctgtgccattccaaccagtattcactaagtaagcttcagcacctgctgcttgcatacgttttactaacacttctgcatattgagttggatgaagcgttaaaaatgctgcaccgaaacatgctgagaaagttggcgttggttcagtaataccacgttcagtccctgctaatttcgctgtgaaaccagataagaagtagtatttagtttgttctggtgtcaatttagatactggaggtaatacaccaaacgcatctgcagttaagaaaatcactttagttgcgtgacctgcacgagaaactggttttacaatgttatcgatgtgataaattgggtaagacacgcgagtattttctgtttttgaaccatcatcgaaatcaacagaaccatctgaacgaacaaccacgttttctaataatgcgtcgcgacggatagcgtggtaaatatctggttcattttcttctgaaagatgaatggttttcgcataacaaccaccttcaaagttaaagataccaacatcatcccaaccgtgttcatcgtcaccgattaattcacgttttggatccgttgaaagggttgttttacctgtgccagataagccgaagaagattgctacatcaccatctttaccaacgttagctgagcagtgcattgcaccaacacctttgagaggtaggaagtagttcatcattgagaacataccttttttcatttcgccgccgtaccaagtaccgccgattaattgaatgcgttcagtcaagttgaaagcaacaaagttttctgaatttaaaccttgttctttccagtttggattggttactttagaaccgttcattacaacgaaatctggttcaaaatttttgagttgttcttcagttgggcgaataaacatattttttacaaaatgtgcttgccacgctacttcagtgacaatacgtactgcaatacggtcgtgttcgctcgcaccacagaaaccatcaactacaaataagcgtttacgagaaagttggttggttaccaagtcttttaagctttgccatgtagcttggttcattggcttgttgtcgttttttgctgtttcagatgtccaccaaacagtatctttggttttttcatctaacacgatatatttatcttttggagaacgacctgtgaagatacctgtatctactgccactgcaccagtcgtagttaaagtacctttttcaaagccttctaagcctggtttagtttcttcttcgaacaattgctcgtagcttggattgtaaacaacttcttttacgtcataaatgccaagagcttcaagttcttttaccactttatttaagtctgtcataagtcacctctaatatgtaagattaaaatttaactgtggcttattataatggatgtcaatataaaaaaatgttaagtagatctcatttttaaacatttttttaagaactttacctctttttagtgatattgtgatatagagcaaaaatcccgacattgtgtcgggattgtttttaaactcttgttgattttaatttttcaatcgcttctttattaaagaagtagtgtgtaccacaacactcacattgcatatcaatactgcctttatgttcggctaatatttcgtcaatttcttcatcagagatgagcagtaatgcagaactagaacgctcagcagagcagccacagaaaaattgtacatcttgtgctggataaagattgacggtttcttcgtgatataaacgatagagtaactcttctgcagggagaccaaataattcttcatcttttactgttgctgcgagcgtagttaaatgctcaaaatcttctggtgtaccagaaccatcaggcataatttgtaataacatacctgctgccactggcttgccttcatattctccagtacgaataattaattgagtttgaagctgttctgagcgtacaaaataatcttctaagcattccgtgatcgtgggtttatccaagctaattacaccttgatagcgttcgccttcttttggtgcaatagtaatgaccaatacgcctttaccaatcatattatgcagactcatattttcagtgatgttgccatccactcgagcaagggcgcggatttgttgttgatcattaccatttactaatgctaagcgtaatgggccatcgccttgaatttgtacggtaatattgccggcaaattttagtgtggcagtgagtaaattagtcgctaccatcatttctcccaataaatcctgtactgctttaggatactgatgggtatttaatgtatcagtaaatgttttatttaagcgaacccattctccacgaactgcacgatgttggaaaagataacggtaaagtttgtcattgtcttgagtatagtcttgttgattggtcattgattattcctaattgagataaaaagtgcggtggttttttccgcactttttgtttttatcatcttatttaagtgtttttgcttataaataggtggtacttagaggcttgtaaaatccaatgtgatctctaagttataatattaattaagcaaatcttgttttggcttctgcaatagcttcggcaacacgcaatggcgatacgccaccttttgcacaacgtttgtctaagcaagattggagagaaagaatctcgtaaacgtcatctcccactacttcactaaattggcggaattcagggatagtcagatcttctaatcctttgcctttctcgattgcataaaccactgtttcgcccacgatatgatgggaatctcggaaaggtacgcctttagagactaaataatccgctaattcagttgcgtttgaatatccttttaacgcagcttcacgagtacgttcaacatttactttcaattcatctaagacgaacgttgccatatctacacagttttgccaagtatctaaggcatcaaaaatgccctctttgtcttcttgcatatctttattatacgcaagtggcaagccttttaaggtgattaacatagatgttaatgaaccaattactctccccgttttgccccgaattaactcacaagcatcaggatttttcttttgtggcattaatgatgaaccagaagtcacacgatcggatagttccacgaaatttgcttctccgctgttaaagataatcatatcttcagcaaagcgggaaagatgtgccatactaagagaggcgatagaaagtaattctacgatatgatcgcgatcagagacgctatctaagctatttctagttgcgaaagcaaaactaagatcgtgcgcaagtgaatcacgatctacagcataagccgtaccagccagcgcaccactaccaagtggacaagtattcatacgattatacgcatctgttaaacgtgaatagtcgcggtcgaacatttccacatatgccatacaccaatgggcaaaagtgattggttgagctcgttgtaaatgggtgtagccaggcattactgcttgttgtgtgttttctgcggtttgaactaagtggcgttgcaaattacgcacggattcttgtaattcaaccacacgctgtttgcaccacagttttatatctactgccacttgatcgttgcggctacgaccagtatgtaattttttaccaaggttgcctactttatcaattagcttactctcaacccaactatgaatatcttcagcatcatcttgtaaaattgcttgcggatttgaccgcacttcaacaagtaattcatttagtgcttgctcaagttgatgctgttcttcaacagttaatacattcacttttactaaggccttggaccagccaattgagccttgaatatcctgttctgccaaacgatagtcaaaacgtaatgagtcattaaaatctttaaaacgcttatctgcggcttgtgtaaaacgcccaccccaaagtgccataatttttcctttttgttttaattaattattctattattgtgcatatttattcataaagcaatattctatattaataataaaacaaaaatggacaaaatctttcattttgtccattttatttgtattagtgctatttatagcgtttttgccaaatttttgataaaggatttaaattctttacctaatttttcgtgacgaataccatattctacgaaagcttccatataaccaattttatcgccacaatcaaaagtttcccctgtcatatgaaatgcttcaacggtttctttttcaatgagcatatcaatagcatcggttaattggatttcatcgccaacaccaattggtgttttttctaacaaatcccaaattgctgctgaaaaaacataacgcccaaccacagcaagatttgatggtgcgtcttcaatagaaggtttttcaacaatactattaatttttgcactttcgccgccattaagctcaatgccaccacaatctgcaacaccatagctactcacattttcttgcggaactggggttaccataatttggcttgcgccagtttcattaaagcgttgaatcattgcagcaagattttcttttttctgatctgcactaaattcagctaataatacatctggtaacataacggcaaaagattcatttcctactaaaggacgaccgcataacacggcgtgacctaaacctttcgcattaccttgacgaacgtgcataatggttacattttttggacagatagaacgaacttcttctagaagctgacgcttcacacgtttttccagcattgtttctaattcaaaagatgtatcaaaatggttttcgatagcattttttgatgaatgtgttaccagcacaatttcttttatgccagcagctacacattcatttaccacgtattgaattaacggtttatccaccaaagtgagcatttccttcggaatcgccttcgtggcgggcaacatacgtgtgccaagaccggcgacaggaataattgctttcatattattatatccattgtttaactaagaggaacctaaatagggttcatctttcgtttgtttaattcgttggtaaatttcttctcggtgaacggatacttctttaggtgcttcaacaccgagtttaacttggtttccacgtacactcaaaaccgtgatagaaatatcatctccaataagtacactttcgccaactttacgagttaagattaacatcttttatctccttagtttgcatttattagatatcctatcaatcaaggaacggttggcattccaccaaccagcttgtactacagatttttgtttaaccagtcttgtgccactttaattgcttgtgccacattttctggttgggaacctcctgccattgccatatctggacggccaccgccttttcctccaacttgttgagccattaaattaacaagttctccagcttttattttggcggttaaatcatttgtcactccaacgacgagattaactttttcatctaatattgatgcaaatgcaattacgcctgatccgagttgattttttaaatcatcgaccattacgcgtaatgattttgtttctataccatctaattgttgtgcaataacagaaacaccgttgattttgaccgcactttttacaaaatcagaaccagcctgcattgcggctttttcttttagaccttgtaattctttttccactttcttcgttttgtcttgaagttgttggattttttccactaaggtatttacgtctgattttaataagtctgcgctttgggtcagaatgcgttgttgattatgtaaccagtcaatggcattttgacctgttacagcttcaatacgacgaatgcctgcagccactgcgttttcagtaataattttaaataaaccaatatcgcctgtgcgttttgcgtgaataccgccacacagctcaattgagaaatcgcccatcgttaatacacgaaccttatcgccatatttttcgccaaagagagccattgctcctttcgcttttgcggaatcaatatccataatatccgtttgaactggaaagttagcgcggattttttggtttactaatgtttcaatttcactcaattgctctttggtaatggcttctggttgcgcaaagtcaaaacgtaaggctttatctgaaacaagcgaacctttttgcacaacgtgtaaacctagaatttgacgtaaggcagcgtgcaataagtgtgtcgctgagtgattgagtgatgtgttgtggcgacgtttagcgtccacaatcgcattcactgattgtccaacttttaaacttccttgcgttaattccccaatgtgtccaaatacttgcccatatttttgggtatctttcacattaaaggttacaccttgtgtgcttaaatatccgctatcgccaatctgaccacctgattctgcataaaatggcgtattttctaaaataacgaccgcactttgacctacttcgatactttccactgatttaccatcatagaaaagtgcggtaatttttgcctgagattctacttcagtatagccttcaaacttagtttcgccatctacacgaataacgctgttgtagtccacaccaaactggctcgctgcttgagcacgagtacgttgtgcttccatttcacggtcaaacgcttgttcatcaatagtaatgttacgctcacggcatacatcagccgttaaatccaatgggaaaccataagtatcataaagtttgaatgcaacttcacctgaaagaatgccatctttcacttgagaaagtgcttcatctaataagctcaagccacgctctagagtacgagcaaattgttcttcttctagacgtaatagtttttcaacatttgtttgttttgcttttacatcttttccagcttcagccattacttcaattagagttggcacgagtttatagaaaaaggattctttggcacctaatagatgaccgtgacgaactgcgcggcgaataatacgacgtaagacataaccacgcccttcatttgatgggataacgccatcggcgattaaatatgcacaagaacgaatatggtcagcaataacacgtagtgatttgttagttaaatctgttgcgcctacaatttccgccgtttttgcgattaatgttttgaaaatatcaatctcgtagtttgagttcacatgttgcaacacagcagaaatacgctctaaacccatacctgtatcaacagacggacgaggtaatttttccattgtgccatctgctaaacggttgaactgcataaacacaacgttccagatttcaatataacggtcgccatcttcttctggtgagcctggaggtccgccccaaatatgatcgccgtgatcgtagaaaatttcagtacaaggaccgcaaggacctgtgtcgcccattgcccagaagttgtctgatgcgtaaggtgagcctttattgtcaccaatgcgaataatgcgttcagcaggaacaccaacatctttattccaaatattataggcttcgtcgtcagtttcatacacggttacccagagtttttctttaggtaaaccaagccattgtggagaagttaaatattcccaagcaaaattaatcgcatcctgtttaaagtaatcaccaaaactgaagttaccgagcatttcaaagaaagtatggtgacgcgcggtataaccaacattttctaagtcgttatgcttaccaccagcacgcacgcaacgttgtgcggtggtggctcgagaataagggcgtttatccattccaaggaatacatccttaaattggttcatcccagcgttcgtgaaaagcaaagtcggatcattttccggcacaagtgagctactctcaactacttggtgacctttgctatggaaaaaatcaaggaatgattgtcttatttctgctgttgttttcattaaaaagaatccttgttacccataataaaataaaaactaaatcgccctatttttgcatatttttgaaatttataaaaaggctttttgccaaaaccccaaaataaaaccgcacttcacgacgctatttgagaagtgcggttaaaatttaagttatttcagattattcaaaaaacaatttcttgttaattattcatctctaagcggaacaaccaacatatcaattttaatcgtattcatcacttgacgtgttgaagacattaacttactccaaaaatcctgatgatgtcccgtcactaataaatccacatcatattgttcgatggcatcacttaaaacttgtcctaaatcgccgctgccactcaatttttctgaaattggataatccacactttcagctaaatctaataaggctttttgtgtttccgtggaaatcctgtcttgcattgaagacatattcacatcaatcaatccagtataaagatccgagaagttcacatcaacgtggatgatagaaagttttgcgtcgtggcgtttagcaatcccaactgcttttttaagtaaaattggactttcttcagaaagatctactgctactaaaacgtgtttgtacataatcgactccttaactgattggttcggtttttaactggctccaatgctaacattttgagcaataaaaaactgtgtactagatcacaatttaaacatttttattaaaaattcattaaattttcaatgtctgcaatttctttagggacagcagcggttaggattttattaccatattcagtcatgagtaaattatcctcaatgcgcacgccaatgcctttgtattgctctggcacatctgcatcttctgaaatataaataccaggctcaacggtaattaccataccgatttcgagtatccgttgtttatcttggccataactacccacatcatgcacatctaaccctagccagtgccctaatccatgcatataaaattggcgataagcttgttgttcaataagtgtatccacatctccttttaagatgcctaaatccactaatccttgggttttaatacgaataacttcatcattggcttgcttaatggaattgcccggtacaagtaattcaatcgcacgtttttgggcttttaaaactaactcataaatttcacgttgaggcgggctaaattttccatttacaggaaaagtgcgggtgatatcgcctgcatacatggcaaattcacagccagcgtcaatcagtactaaatccccatcatttaatgggcgatcattttctgtgtagtgcaaaatacaggcgttacttcctcctgcaacaatggaattgtaagaaggaaatcttgcgcaatggcgattaaattcatgcaaaatatcgctttcaatttcatattcaaagcgatttgggcgtgttgtttgcatcgctttaatatgcccaagtgccgtaatttgtcccgcttgttgtattaagcggatttcattcggcgattttataaggcgcatttcgctgagcattggtcgccaatctaaaatctcgctaaaattcaccgcactttctgacaccaatgtatcaccccaagtatgaatttctggcacatggtaaagtgcggtcaaatttttcagtatttttggcagtacggtagcgaattcttcaatagaataggcttcatttacattaagttgctgtggtgcacgctcaacacctaatcggcgaccattccacgtttcaagtaacggatcgcatggacgaagaaaaataatggctttttctacttgttctgttttcagtaataacagtgctgcattcggttcattaaagcctgttaaataccaaaaatagctatcttgacggaaaggataggtacaatcattattacggcgtttttcgatttcagaaaaaagcaataatgctgaattaggttgcatttgagcgaatactcgtgtgcgacgttcctcaaattcttctttaggcaatttagccatataagtcaattccatcctagatctccttaatgtaatacaggtttgctctcaatttctccttcgttgaaatgagaatagaataacattgcaatggtgcgaacatattcaatgatttcttctagtgcttccgcaagctcttcttcattatcatcttcattataaccaagttggcaaatatcttgtaaatcatctaccgcttcgccaatttcacctttttcttttgctaattcaggttgtgctaagccaagaccaagtaagaattggtttgcccagtcagataggctatccgcttgtgcaaagacattttcatcttcggttaaaccaagtccaaaggtaaatccttcaacatctgataaggtttgactaattttttcataaagttctgtaacgggttgaactaatgctgttgggtaagcgtgattatcattgctgaattgatataagagcggtagccaactttgatcttttaatccaccacaaagtaaaccgcttaaaaagccgtgtagttctgttgcattaaagccgattccagcagatttaagttgttggttaaggtcagaatgagaaatgagcataatagatttcctgagtaaatgtgaagttagtgtaaacctttgtaaataaaaaagccatcgcttgaccaattaaattagattaagaggctggtggtgtgtcactgcttttaacgctagaaatgaacctaatttatagatcttgtaatgacatttttattataaataatggtttatttaaatttaaactctgtccattgataatattgctcgcttgctttttgaattccgccgtaattttgccattcaggatgattaggcgtatctggtaaacattgggtttctagtgctatgccagaaaaatcggcatataattcgccatttctcgttggtgtacctgcaagataattacccgtataaacctgcaatgcagcttgcgaggttcttacttccaaacttaaatcgccagttggagaggttagtaacacacaaggcttttgccaagctttattgacaataaaggaatgatcgtaaccttttgttgcttgctgatccccttgtaaaaaatcttgcttgatgggtttagcaatacggaagtcaaaacttgtattcaccacgtgctttaatggagaattaggaatcccctcattatctacaggcagataaaaatcagcatttaaacgtaatgtatgttcacgcacgtcactgccttgcgctgcattttctaaattgaaataagcatgattcgttaggttcaatgcagtatccttatcacaaatccctgcatattcaatttttacgctattatcatctgttagcgtataggttacagacacatccacattaccaggaaaaccttgatcaccatgctctgactgtaatgaaaaacacacaaaattctcaccgcactcttgaattttccaacgacgtttatcaaaaccctctccaccatgaagctggtgctttccttgattactacttaatttaataagttcgccattcaattcaaattgtgcatttgcaatacgatttgcataacgccctacgcttgcgcctaaatagctttgatgagtgggataattctctaccttacaacccaataaaacctcgcgtaatgtgtcatttactggcactttacaagaaagccaagttgcgccccaatccagaaattgaacacgcatcccattttcattttgtagggttataagctgataaggtgcaccatcaggcgcattaaaagtggtttgttctaacatcattttctcttaaatcactcgcacaccttgtgatgcggtacacacataaaaagtttcttttaaaccagtcgttttctcgtaattatccgcaataattttacgaactgcatcgactttatcatgcggcgtaagtgcgacaatacagccaccaaaaccgccgcccgtcatacgtgcaccgccacttttgccaataacaagttgagccaattcaactaaataatcaatttgtggcacggtgatttcaaaatcatcacgcattgaatcgtgagatgcttccattagtttacctaaacaagtcaaatcattgttcttcaatgcttctaccgcatcaagtactcgttgattttctgttacgacatgacgagcacgttttgctgctaacggagaaagtgcggtcaattctgcttctcttttttggaattgctcaactgaaacatctcgtaatgctttcgcgccaaaaaattttactgcctcttcacattgctgacggcgagtattgtattcgcctgttactaaatcgtgcggtacgtttgaattcacaataatcacggcgacatcttgtggcactggtgttggaatagtttcaagactacgacaatcgatcatcagtaagtgattttcctgcccaagcgcagaaattaactgatccatattgccacaattagcaccgacaaattggttttcagccttttgcccattcaatgcaatatccgtgtgagaaagcggtaaatcgccaagttgttggcagaatttacccaccgcaacttctaacgctgcagaagaacttaatccagaagaaagcggcacattaccagaaatcactaaatttgcaccttgttgaaagtgcgggtaacgttcttggataaattttaccaccccacgcacataattagcccatttgtgttcactcttaggaatttcaacattgagagaaaattcatcagtttcatcaagatctgcagcataaacattccaaatatgatcatctcgttttgtaccagaaacggccgtaccaaaattaattgcgcaaggcataacaaagccgtcgttgtagtcagtatgttcgccgataatatttactcgaccaggggcatagacggtaatttctggcaaatttttatgctgtctattgaaaatttgttgagcattttggattggggtcatatttctatcctttatattaaatctatactcgatctgcaccactctttgctaaagctaaagaggggaactgactatattatttagttctttctttataatgaacttcactcaaagcacgtaatcgctccgctgcctgttctgccgttaaatcgcgttggttttcgcctaacatttcataccccaccataaatttacgcacagttgctgaacgcaaaagaggagggtaaaaatgagcatgtagctgccaatgttcgttatcttcgccattaaacggtgccgcatgaaatcccattgaatatgggaaagaggtttcaaagagattgtcgtatttggtcgtcaattttttcaaaataaccgcaagatcttttgattgttcgtcacttaattcagttaaacgttttacatgagtttttggtagaagcaatgtttcaaatggccaaatagcccaataaggtactaaagcgacccaatgttcagtttcaacgacaatacgttctttcaacgccaattctcgttttacataatcaaccaacattactgagccatgttttagcaaataatcacgttgtgtacgatcttcacgagcaacttcatttggcaagaaactatttgcccaaatttgaccatgcggatgagggttagaacaccccattgcagcccctttgttttcaaaaatttgcacccattggtatttcgcaccaagttcacgaagttgttcctgccatactttaatcacttcttcaatctcaagtgcggtcaataatggcaatgttttactatgatcgggagagaaacaaatgactcgactttccccacgagcttgagaactttggaaaagaggatcggaggatttttcaggggctggcgtatcttctaaaagcgcggaaaaatcatttttaaatacataaggtttacgataatctggatttaattcccctgtaatacgcttattactcggacaaagataacaagttggatcataacttggtttttgttcttcattgactttttcctgttgcccttgccacgggcgtttggcacgatgtggcgaaactaaaacccattgatcgattaacggattgtagcgacgatgtggatgttctgtaggttcaaaaagtgcggtcattttgactcctgttttttatcaatgtaagcgattacattaatttatactaaattattgtaaataaaccgtgatctttgtcacaaaataagaaaataagcaaaattttttatgatttagttcatacttatgaaagtaaccgttttcaatttatcgtaaattatttatgatcaaaatataagatttatagattataacaaggaaaaagttatgagtactattcgagatgtcgctaaattagccaatgtatctgtcgctaccgtatcccgagtattaaatcactctctttctgttagtgaaaatacacgccttgcggtggaacaagctattgcacagttagcttatcaacctaatgcaaatgctcaagcccttgccgtgcagaacaccgatacaattggcgtggtggtaaccgatgtgacggatgctttttttgcgattttagtgaaagcggtggataaagtagcagaagcgcatcaaaaaacgattcttatcggtattggttatcatcatgcggaaaaagagcgggaagcaattaataccttattacgtaagcgttgtagttctcttgttgtacattctaaagccttatctgatgatgaattaagccattatttaaatactgtgcaaggaatggtaatcattaaccgtgttattaaaggttatgaacatcgttgtgtcagtttagataaccaaaaaggcacttatttagccacggaaatgcttattcgttatgggcatcaacatattgcatatatcggttcaaatcacgccatttttgatgaagttgaaagaagaaatggttatcttgccgcattaaaagatcacaattatcccatcattgaacaggcgataacactcaatagtccagactttgaaggcggcgaaaaagcaatgattgatttacttagttataacaaaaatcttacggctgtcgttgcttataacgattcaatggcggcgggagccatttcagttctcaatgaaaacaatatcagcgtaccaagccaattttcaattattggttttgatgatatgccgattgcccgttatttgatcccaaaactaaccacaattcgctatcctattgatttaatggcaacttatgcggctaaattagcattaagtctaactgacgagaaaataattacacctccagtagttcaatttaaccctactttggtacgccgtttttcggtggaatcgcgctaatttgtgacatggatcacaaattcataattttttatgtaatcattttcatttttgcaaatttgctcatagattaattacgataatttatttatgatgtacacaaccttatctatccacatcaaccttccaaataggagtgttattatgaaaaaaacagccgtgttaagtaccgtcgctttcgctattgcattaggttcagcatctgcaagttttgctgcagataatcgtattggggtaacgatttataaatatgatgataactttatgtctttaatgcgcaaagaaattgataaagaagctaaagtagtcggtggcattaaactcttaatgaatgactctcaaaatgcacaatctattcaaaatgaccaagttgatatcttactctctaaaggcgtgaaagcacttgcgattaacttggtggacccagcggcagctccaactattattggcaaggcaaaatcagataatattcctgtcgtattctttaacaaagaccctggtgcaaaagctatcggttcttatgaacaggcttactatgtaggtactgatccaaaagaatcaggcttaattcaaggggatttaattgcaaaacaatggaaagcgaatccagctcttgacttaaataaagatggcaaaatccaatttgtattattaaaaggcgaacctggtcatccagatgcggaagtgcgtacaaaatatgttgtagaagaacttaatgcgaaaggtatccaaactgaacaattatttattgatactggtatgtgggatgctgcaatggcgaaagataaagtagatgcttggttatctagctctaaagcgaacgacattgaagtcattatttctaacaacgatggtatggcattaggtgcgttagaagcaacaaaagcgcacggtaaaaaattacctatctttggtgtggatgcgttaccagaagcattacaattgattagtaaaggcgaacttgcgggtacagtattaaacgatagtgtaaaccaaggtaaagcagttgttcaattatctaacaatttagcacaaggtaaatctgcaactgaaggcacaaaatgggaattaaaagaccgtgttgtacgcattccttatgttggtgtggataaagacaacttaggtgactttttaaaataattttccatcaatttttgttgtagtctaaggggaagtggatcttcccctttttaaagaggttggatatgacagctcaaactcaatgtcaagacagccaagtgctgctcacaatgaccaatgtctgcaagtcctttccgggcgtaaaagccttagataacgcaaacttaacggttcgatcacattctgttcatgccttaatgggtgagaatggcgcgggcaaatctacattactaaaatgtttattcggtatttatgccaaagatgaaggcgaaattcttttcttaggcgaacccgtcaatttcaaaacatctaaagaagcccttgaaaatggtatttcaatggtgcaccaagaactcaatctcgtgcgccaaactagcgtaatggataatttatggcttggacgctatccacttaaaggtccttttgttgatcacgccaaaatgtaccgtgatactaaagcgatttttgatgaattggatattgatgtagatccgaaagaaaaagtcgccaaactttcagtttctcaaatgcagatgatcgaaattgcgaaggcgttctcgtataacgctaaaatcgtaatcatggatgaaccaacatcctcgctttctgaaaaagaagttgagcatctgtttaaaattatcgacaaattaaaacaacgcggttgcggcattatttatatttctcacaaaatggatgaaatcttcaagatctgtgatgaaattactattttacgcgacggtaaatggatcaacacggtaaacgtgaaagaatccacaatggaacaaattgttggaatgatggtagggcgtgaattaacacagcgtttccctgaaaaaaccaacgtgccaaaagaagttattttgcaggtggaaaatcttaccgctaaaaatcaaccatccattcaagacgtatcttttgaattacgcaaaggtgaaattctcggtattgcaggacttgtgggggctaaacgtaccgatatcgttgaagctatttttggcgtacgtgaattaatcgaaggaacgattaagttacacggaaaaactgtgaaaaatcataccgcacttgaagcgattaataatggctttgcattggttactgaagagcgtcgttcaacggggatttattctaatttaagtattgagtttaattcattgatttcaaatatgaaatcttatctcactccgtggaaattacttagcacgaagaagatgaaaagtgatacccagtgggtaattgattcaatgaatgttaaaacaccatcacacagaactacaattggttctctttctggtggtaaccaacaaaaagtcattattggtcgttggcttttaactcaacctgaaattttgatgctagatgagccgactcgtggtatcgatattggggcaaaatttgaaatttaccaacttattcaagaactcgctaaaaaagataaaggcattattatgatttcatcagaaatgccagaattactgggtgtgactgatcgcattttagtaatgagtaacggtaaattagcaggtatcgttgaaagcgcaaaaacatcgcaagaagaaattttgcaactcgcggcaaaatatttataaacataaggaatgaattatgagtgccttagaaaaaaacaaatcctttgatctcttaaaacaaaatgcgatttattttgtgttattgattttgctcggcatcatcattgcacaagatccgacattcttaaatttagtcaatttcagtaacatcttaacccaatcttctgtacgtttaattattgctttaggggttgcgggtttattgattacacaagggactgacttatctgcaggtcgtcaagttggtttgtctgcagttatctctgcaacaatgttgcaatcaatggaaaatattaaccgcgtgttccctgaaatgggacaaataccaattccagtggttattctcgcagtttgtgctatcggtgcagtaattggtttagtgaatggtttagttatcgcttacttaaatgtaactccattcatcgcaaccatgggtacaatgatcatcatatatggtttcaactcactatactatgatgctgtaggtggttctccaatcgcaggttttagtgaaaatttctcaacatttgctcaaggattcttccgagtcggcagctttaaactctcttacatcacgatttatgcagctattgcagcattattagtatggattatgtggaacaaaactcgtttcggtaaaaacgtatttgctattgggggtaacccagaagcagctaaagtttcaggcgtgaatgttgctcgtaacttagttgcaatctatatgattgcaggtatgttctatgcctttggtggtatgcttgaagcgggtcgtatcggttctgcaactaacaacttaggttttatgtatgaattagatgctatcgccgcttgcgtagtgggtggcgtatcttttgctggtggggtaggtacagtaattggtgttatcactggggttattatctttactgttatcaactacggtttaacttacatcggtgtaaacccttactggcaatacatcattaaaggtagcattatcattctagcggtagccattgactcgttaaaatatgcgaagaaaaaataaagctgacgcaatcttaataaaatgaatgaaaagtgggcaaatttgtccacttttgttttatctattcaattctgaattaaggatatttatgcaataatcggcaaaccctgtataattgcgccaccattttcatagagagaaaaaaatgctaattaactttacacaagtattgcaagacagttggaatttcttccgtaatcagaaaaaaattatgctgcaatttgtcgcaattttatttattgtgcaaagcgcgagtgcacttttaagtttttcagttaatgatgaaaataaaaatgatgtattaaatctcgccaatacagatatcacaagttttatattttcagttgcaatcactcaaattttaacgagctttattgcagcttggggattaacctcaatccataaaattagcctacaaaattatcgcactttaggtgaaaccttctcacttaccttgcgccgttttgcaggcgtaattgtgttagatctattaatggttgcaccaatgttacttggtcttggtgaagcctttgctgcattactcacaaaaaaatcgccctctattatgtcacttatcgcgatgcttgttggcgtttggttctttgtccgtttaaatttaacggtagtacattatctttctactcaagaggcactttcgcaaactatccgaaaaatttggatgcgaggaaatactcgaaaaggcgtattgtttatttacaccctactggtttattttctcgtgccaattcttattttccaattaagcgcattttccaataatgctatatttgatatggtaataggcattttcaccgcattacttaatattttcatgctagtagtgacttatcgtttctacagcttatttatgaaggattaatcaatatgaaacaactccttgactttatccctttaattttattttttatcacttacaaactcggtggtgtacgtgaagcagccatcgtattagtggttgcaacaattttgcagatcgtgattttaaaatggaaatacggaatagttgaaaaacaacaaaaaattatggcaagtgcggtcgttttttttggacttttaaccgcttactttaatgaaatccgctatttgcaatggaaagtgacaattatcaatggcttatttgctattgttttgctcgtcgcacaatttcaatttaaaaccccattaatcaaaaagttacttggtaaagagctacaactgcccgaaaaggcttggaatacacttaaccttggctgggcattattctttattatttgcatgttggtgaatatttatatcagccataatatgtcggaagaagcttgggttgatttcaaatcttttggaattattggtatgacagtgattgcaaccattatttcgggagtttatatttatcgttatttgcctaaagatggctcaaattcaaaagacggagagaaataatgtctgccaattttactgataaaaatggtcgccaatcaaaaggagttcttttactacgaactttggcgatgccttctgacaccaatgctaacggagatatttttggtggctggattatgtctcaaatggatatgggcggcgcgattttagcgaaagaaatcgcacacggacgcgtggttactgttgccgttgaaagtatgaattttatcaaaccaatctctgtgggcgatgttgtttgttgctacggtgaatgtctcaaagttgggcgttcttccattaaaattaaagtagaagtatgggtaaaaaaagtggcgagtgagccaattggcgaacgttattgtgtcaccgatgcggtatttacttttgttgcagttgataataatggtcgctctcgcacgattccccgtgaaaataaccaagagttagaaaaagcattagccttaatttcagaacaacccttgtaaataaaaggaaatcattatgtactatgttatttttgcccaagatattcccaatacgttagaaaagcgtcttgccgtacgcgagcaacacttggctcgtttaaaacaacttcaagcggaaaatcgcttactgacagcaggcccaaatcctgcaattgatgatgaaaatccgagtgaagctggttttacaggttcaaccgttattgctcaatttgaaaatctacaagcggcaaaagactgggctgcacaagatccttatgtagaagctggcgtatatgcggatgttattgtaaagccgtttaaaaaagtcttttaatttaaataacgtaatatgaaaaaagtcgccttaatttctctttgtatttttaccgcactttctgcttttgccgattcgcctaatacggcaacagcatcaatcaatcttgagcaagagaaacaaaactgggcgtcaatacagcatcaagactacttaaaacgtctaaaacaacgtgaagtctttttgcaagttgaaggtttgctaaaaagtgcggtaaaaaaacagcaattttctgaagcgattcaaaatatcacaaaaaccttaatagactcattgcaaggctaccctttgcaatatgatctgcttgctcgattttgggagacaaaaatcgcctttttgcagaatgatgatattcaaggaaaacaacaagcaataaatgaagtcaatgcgttagtgcaacaaaattacccttttgtgacaccagcatttcaagccttattacaaaaactatccacgttaaacgaacaacaaacatcagcaacttcagataatgctaaagaaaataacagggttcaaaaagaacaaaatcaagtagaaaatcctaaacaacttgctgaaattgtaagaaaaagtgatcctaacactttagataaaaccgtattaattgatgctttcccacgttatcttaaaacgctacctgaacaaatgaataacctaagttttgaatcctatcaaaaatgggcaaatacttggcagctctcagaagatgaaatcaaacagtggaaaatcgcctttttaaatcgcttttttgataatgaaaacactgattttcaaaaatggcgtgatgaacaaatccgacaattacagactgataatttaaccgaacgccgtttacgaatggctatttggcaaaaaactgaattaacctcttggctaaatttgctttctgccgaatcaaaaagtaagcaagaatggcgttattgggaagctaaacaagatatattaaaaaataccaaaaaactgaccgcactttcaaaagagcgtggcttttatccaatgttagcggctacacaattaaaacaagcatatcaactgaatgtccctattgcgtcaagttttactcaagctgaacaacttccttttaagcaagtttttgcaatgattacagaattaagagaacttggacgaaatggtttagcaaaacaacgctggcgaattttacttgataatgttgatttcacaactcagctaaaactttctgaatatgccaaaaatcagcaatggtttgaattagctgttgatgcttctattgtagcaaaagcgtggggttacctgtctcttcgtctgccaaatgcttattctgaatacttcaatgctgcattacagaatttgaatatcagcaaaacttttgctatggcaatcgctcgtcaagaaagtgcttggaatccaatggcacaatcttcagcaaatgcgaggggcttaatgcaacttttgccaagtacggcaaaattgacagcagagaataatcaactaccttatcaaggcgaacaagatttattcaaaccattgaataatattttgctaggtaccgcacatctgaatgaactcaatggaaaatatcctaataatcgaatattgattgcagccgcttataatgcaggagcaaatcgagtagaaaaatggttaagtcgcgcgagtggaaaattagcattagatgaatttgttgcatctattcctttttatgaaactcgtggttatgtgcaaaatgtagtcgcttatgatttttactatcaaattttgcaaaataaagaaaacccacaaatctttagccaagaagaattgaatcggctatactaaatgcactagtttaatagtgtgaaatgggagcataattatgtatatcagccgtaatttagagcaatggaatgcatttcttcaaatgctaaaaatcgcctttgaagaaaacaaagcacaggaatttctaaccttattattaactgcagacgaacgagatgctgtaggattacgcttgcagattgtctctcagctgattgataaaaatatgcctcagcgtgaaattcaacaaaatctgaatacaagtgccgccacaatcactcgaggttccaatatgattaaaacgatggatcctgattttatgcaatggatgaaacaacatcttgatctcattgaaaaaaactaagcgaatttttaccgcactttctcacttatttagtcctaaatggtggaaaaaaaactggcagcgagttgtcttttgtttttttttcgccgtttttgctttgttgctgatttttcgctttgtacctattccattttccgcttatatggtacaacaaaaaatcgctaatcttttacaaggcgattttcgatatcaaatccaatataactgggtcagcctagaaaatatctctccaaacattcaattagctgtgatttcatcagaagatcagcgtttttttgaacatttaggctttgattttgaggctatccaacgagcaattcggtataacgaaaaatctaacaaaggaatccgaggggcatcaactatttcccagcaaactgctaaaaacttaatgctttggcacggacaaaattggctacgaaaaggtttagaagttccagcgactatgttgcttgagctgacttggtcgaaaaaacgtattttagaagtgtatttaaatattgcggaatttggaaacggcatttttggtgtggaagcggcaagtcgctattactttaaaaaatcagctaaaaatttatctcaaaatgaagccgcacttttagctgctgtgttgcccaatccaatcatttataaagtaaataagccaagcttattagttcgtaaaaaacaaacttggattttgagacaaatgggaaatttaggcactgaatacttgagcgatttataaaaaatgcaatcgaatttctaaagtaaaacaaactaaaaaatatttacttaatatataaaataaaaaacgagtctaagactcgtttttttatttataacatttttattacaggtttattaccgcaaataatacccaaacggtataaattgtggctaaaccgtaaaagataaatccaccagctggcacatgtactttaagatcgtgcataccgtgatgaatacggtgtaaaccacaccacattgggaaaatagtaagcactaaaataactaatttaccaatccaagaataagcaaaagtaattaaattatgcgcatcgactaaaccaaatggtaataacaaaccgatgattagaataacgacaggaagaaaaattgcactcactgtgccacctgcaccgaacattaaccatactggcggttcgccggagcgttttggattttgatcaaccattttttctctcccttaaatataaactaaaactaacgcaatcacgctaactaatgtggttaccgcccaaagtgcatttcttacaacagtgtgtggtaagcgttcatttttcacaatgatattcatcacttttggtgtcattaagaaatatgtcaccgtatgataaagcgttgcgataagcgtaataatatttaagaacaccacaatagggtttcttaaaaactcaataaagctcaatatgcctaagcctggcattggattgcttgcaagacaaagaacaccataaagcaatacaatacaaaaccatacagcaaagactgaagtcgcttcacgtagcatataagctttgtagaagtccaatttttgccaccaagtcgctgtcattggacgaacatattttttacgtttactcactgttactgacattccttcccccttagccttttggttttagcatagagataacataatctttggcactttccactttgccttggttaattgcagaagcaggatccacatgttttggacaaacttctgagcaatagccaacgaaagtacaactccaaaccccgtttttaccatttaataatgacatacgttttgctttaccatggtcacggttatcaagattataacggtgagccatcgtaatagctgcagggcctaagaattcaggatttaaaccaaattgagggcaagcggcatagcataaaccacagttgatacacattgagaattgacgatatttctcaagctgtgctggcgtttgtttagtacggctaacttgcaattctttcgatggatgtggtttaccatctaatgctggtgcttcgttaccaataatataaggcttaattgcctctaaactttcgataaagtggcttaaatcaaccactaagtcacgttcaattgggaagtttgctaacggctcaatacgcatatggccgctgtaatcacgtaagaacgttttacaagccaattttggtttgttatttaccatcatcccgcaagaaccgcagatcgccatacggcaagaccaacgataagaaagagatggttcaagtttatccttaatatagcctaacgcatcaagcaatgaagtttgattatcataaggtacttgataggtgcttaaatgtggctcttgatcgatttcaggattgtagcgtaatacttcaacattcattactggtgaattagccatttgcttgctccttagctttcgcagctgcttcttgagcttctgcttccgcaccgtaaacacgttttgcaggttgagatttagtaattttcaccggactgtattcaatgcgcggcgcaccattctcattgtagaaagcaagtgtgtgttttaaataattgacatcgtcacgttctgtgtaatctaagcgttggtgagcaccacgagattctttacgttcaatcgctgaatttgcaatagattgtgcaacatctagaatgtaacccaactcaacggtgtaaagtacatctgtattgaacacgcttgaattatctgatacgcgaatacgtttgtaacgttcttttaactctgcaattttatctactgctttttgcatacttgcttggtcacggtaaataccacagccttcttccatcacggtacccatttcatcacggatttcagaccaagattcattaccttcttgtttgtgaagagcttctaggcgagcaacaacatcttttgcttgagcatcaaccgcactttgatttaccgattgagcttcaactgcacgttgtgccgcatattcccctgcaacgcgacctaacacaacaagttcagctaaagagttagatcctaaacgatttgcaccatgtaaacctgaagatgcgcattctcctacagcaaataaacctttgatacgtgtttcgctattgaaatcgacttcaataccgcccatggtgtagtgaacaactggacgaactggaattggttcatttactggatttacaccttcataagcacttgctaattcacaaatgaatggcagacgctcatgtaaatatttttcaccaagatgacgtaaatctaaatgcaccacatctacgcctttcgcagtttttaaggtattaccttttttccattcttgccagaatgcttgagaaaccttatcacgagggccaagttccatatatttattttgcggtttgccaattggcgtttcaggacctagaccgtaatcttgaagatagcgatagccatctttattcactaagataccgccttcgccacgacaaccttcggtcattaaaatacccgtattaggtaagcctgttggatgatattgaacaaactccatatcacgaagtggtacaccgtgacgatatgccatagataagccgtcacctgttacaatgccgccattggtattaaatttaaatgcacgacaaccaccaccagttgcaataacaaccgcattggcattaatttgcacaagcgaaccttccatcatgttcattgcaaccataccacgagcatggtcatcatcaacaagaatatctaatacgaagtgttcatcaaaacgttggatttgtggatattgaatagaagtttggaaaagcgtgtgtaataagtggaaacctgttttatctgcagcgaaccaagtgcgctcaattttcattccaccgaaacggcgtacgtttacatcgccatcagctttacggctccaaggacatccccaacgttctaattgagtcatttctacaggggaatgttgcacgaaatattccactacatcttgctcacaaagccagtccccaccagcaacggtatcttggaagtgtttatcgtaagaatcttcttctttgataactgccgctgcaccaccttctgctgctacagtatggctacgcatcgggtatactttagaaactaatgcaatttttaagttaggatttgcttctgctgcggcaatcgctgcacgtaaaccaccgccaccagcaccaacaatcgcaatatcgacattaactgtttgcacgatatcctccaatcaatagaaagtaaaaataaatcccctaaaagggtaatattgtgtgggcattgtgccattttttgttacaaattaataacgttttttatgtctaaagatggaaaagatcgtattttgtgatctacctcaaaaaagctaagattgagttgagagtagctctcgtttacaatgtgcaaaatttttaaaacaggattaaaaatgaccgcacttaatcattggcaaccttctgccgatataaaaaatcttcttaaacgggcaaaaattattgctgaaattcgtcaattttttacagaacgcggtttgcttgaagtagagacccctgttctaagtgaatttggcgtcactgatttacatctctccacctttagcacggaatttcttgcgcctttcggtgaacaatccaaaacactttggctttctacaagccctgaatatcatatgaaacgcttgcttgcagcagggagtgggccgatattccaaatcagtaaagtgtttcgcaatgaagaagctggaaatcgccataatccagaatttactatgttggaatggtatcgaccgcactttcatatgcatcgtttaattaatgaagtagatgatttgctccaacaaattttagattgtccacctgcagaaagtttaagctaccaatttgttttccaagaatatgtaggcttagatcccttgtcagcagaacgttcagaattaattgaagcagcacgtaaacataattttatggctgaagataatgaagatcgcgatacgttattacagtttttatttagtgaagtcgttgagcctcaaattggaaaagaacgacctattgccgtgtatcatttcccttcaacacaagcagctctagcacaagtaagcccagaagatcagcgggtagcagaacgctttgagttctattataaaggtttagaattagccaatggttttcacgaacttgccgatgcgcaagaacaacgtcatcgctttgaattagataatcaacaaagacaaaaatgtgaattgcctactcgagaaattgatgaacgctttcttgctgccttagaagcgggtatgccagatgcttcaggtgtcgcattaggaatagatcgtttaatgatgatcgctttagattgtgaaaaaattaatgacgtcatttcttttgctgtggacaatgcttaaaggtaaaagtgcggtaaaaattgttatcatttttatttaatgggtgatccataatggcaattttatattcattgatagcccgcctaatatttctttttgataattaacaatattcgcttcttttaatgggggaataaattctgagatcgaaattaggtacagtgatcacaaggctcatcattatgaaaaaaagaaaaccaaaacataagaaatgtttggatagtgagttgatttaaattgaaaaaataacctaatttcataaaaattaggtgactaaagcgtatccttttccgcgtaaagttttaaaccaagagggcttgttttttcgttctggtaatttgcgtcttaaattagagatgtgcatatcaagagaacggtcaaatggagtgagtggtttttccatcacttctaaacttaattcttctcgacttaccacatttcccttagatttaagcaataaacaaagaatcttaaattcataatccgttaaatttagattttcttcattataggttgcaattccgtgagaaaagtggagagtaattccgtcaaaagaaaggatttctacatttgcggtattatttgaaggagatacactacgacgcaaaatcgccttaattcttgcaataagctcacgatcgttaaaaggcttgggtaaacaatcatccgctcccaattctaagcctaatacgcgatcaatgtcttcgcctcttgctgttagcatcatcactggcacgttagagactttacgaatttcttttaatgtttcgataccatttaactttggcatcattacatcaagtaaaaccagtttatagctttcattgagtttttgtaatgcttctaatccattatttgcagtttcaacgtcaaaaccctcaagttctaaaagtgtagaaagtagttcagttaattcaatatcatcatcaacgagtaagagttttgacattggagattccttttaccaattattcttattgtagtgcggtgaaaataaaaagattatttccagaatttccaccagcttgattttggtttctcacctgtttcaataatggtgttattttcgccttgttgtgaaacctgtggtaaaggtttatcaagatgggtttctgtcacaatcccacgttgatcaaattttactgtgaaagtatgttgaactggcgtttcataggcacgttgttgtaagaatacgtagtaccaagtgtagttattataagggtcgattaatattggtgttcccaacaaatattgtacttgttgagaagtcatgccttctttaacttgcgcaacggtagtcgcctctaaatagttgccttgcggtacatcaattcgatatacaactttttcaacggtggaacaagaagcgaggcttaatgctaaaaaggttgcgcctaaaagtgttttaacttgcattttctttaccttaatttgtgcaaaagttctgtcaaataatatccaaaattgggtgtatttccaaattaattctctgattgtaaagccttttgtaattgatcttttaaatttggtggtaagcctttgatggttagggtatctgtcataggatcccattgaatacgtgtattcaataattccgcatcaaaacttagggtaacgccctttcctgacccagagaattttgttagcgatttcaatgttgaacgtattggtggaatactctcttccaaaccataattctgttcttccgtaaagacgacaaaaggctgttcgtttagagtgggtaatgaatcagaaagttcccttaattcaatattgttaccatttgaaagctgacctttacaatattcaaacacttgtttttttaccgcttgagtttgctctttgttgagttcgccttgatcgcagtaatcactcacagcttgcaataaacattgattttgaacttgtggatttaatccttcttcggcacctaaaaaatccataaaaaaatcactaattttgcgaccaacacggccttttataaaggttaaataacgattagagttcgcgtttacttgcaaatccgtcaaatttatccgtgccgcaatatcaaactgagtaatatccaaatattctgtacggcgaatatctaaatgctcatcgactaacatactatgacggctatcaagcaatgcaataaacaaataatctgtcgctaagaaattatattgacataaaatcaaggtgccactttcagcaaagttatatttacctagctcatctgcaagcaattttgttgaatattgactaaaacctaaaaattcaatttcttgctctaataaacgatttaaatgttgtgcaaatatagacttttcctgaaacacgccaaaagccttagctttattttgatagccttgatgcaattgcaacatcatttgttctacttctggtgtaatggacagcaactcgtcgcgtaatacgctttccatttttatactgtcgccatccacatttttgactaactgatgcaaaacaatttgattaacggtaatactcatttttgtcacctttgaaaaatttgccgcaaattataaccgcactttttaagcaagaaaaaagaaattatttaggttctaccaaataatcgggtatcataagccaaattttttttatttttaacattatggctcaacattctaaatattctgatgctcaattaagtgcgattgtaaacgatatgatcgcagtattagaaaaacataaagcccctgtagatctatccttaatcgcattgggtaacatggcaagtaatttattaaccaccagcgtgccacaaactcaacgtgaggcattagctcaagcattttcgaattccttaattaatgcggtaaaaacacgttaatatgaaatggattaaaaaaggcaccttcagcggcaaacaataccgcgatgacgtttcacgaaaaatttcgtggggccattggtttgccttttttaatatcattgttgctattcttattggcgcacgttatgcctttatcattgactggccagatactctcgcaggaaaactttatttctttgtgagtttgctcgggcatttcagtttcaacgtttttgcgttgtacttactcgtggtctttccactgagttttattgttaaaaatcaccgcacttttcgcggattaaccgtaattttttccaccatttgcacaaccttattattatttgataccgccgttttcaatcgttttaatctgcatttatcctctgttgtatggaatttgctggtcaatccagaaaatggtgaaatgtcacgcgattggcaaattttctttgcaccaatgccaataattttactggcacaaatgttattttctcgctggagttgggaaaaattacgtagtcttgaacgccaaaaatggctaaaaggcactggtatattcttaaccacaacattcatcgcgacgcatttaatttatgcttgggcagatgcttatttgtatcgtccgatcactatgcaacgctctaatttccctttatcttatccaatgacagctcgttcttttttagaaaaacacggtttcttggatggggaagaatatacgcaaaaattggcgcaagaaggtcgtttagatgccttaaaaattgattatccgaaaaaagaactcacttatgcaccaattacgcacaaacctaatattctgctcgtaacggtttcgggtttacgccatgatgcgatttctaatgaaaagatgccaaaacttgctaaatttgcaacaagctcaacggaatttactaatcattacagcacaggcaatagtaataacgcaggcttaattgggttattttacgggctaaatgcaaattacaccgatagcattttaagcaatcatacccaatctgttttaatcgaaaaattacgtgctgaaaattatcaattgggtttattttctgctacgaatttcaaagatagcatcttccgccaagcattatttcgtgaaataaaactttcatcgaataaaaccaacaaaccaaataatgaaagtgcggtaaaaaatctcaatgattttattaaagcacaaaaaactgactcaccttggtttgcttatttggatttagccttggatgctaaaaacccatcagattatgaccgcactttgcaagacattgattctcttttaacaaaagcgttagaaagtacaccgcttgaaaatacattagtcataatcacgtcagagcatggtttaacctttaatgaaatgaatcaaaaagagcgagaaaactactttgggcgtgatgaaattcaagtgccattgcttgtatattggaaagatttaccagtaggtaaacagaatggattaagtaatcatgcggatattttctctgcattaatgcagacagtattccgtgtagaaaacccgttgatggattatagtcagggacgcaatctctttgatcttaaaggagatgactgggtacttgcctcgaatttccgctggaatgtggtgattcaacctgatggaacacaatatcacattgatcgcaaagggaattacaaaaaattcgataaagattatattgagcaatcttcagacagaccgccacttggaatttttttagaagccttccaattacaaaatttcttctttgaaaaataatctataagtgcacaaaagaatggattttttgcccttaagtctttatactcacgcctcagtttaagactgaaaaatgttattaatgaaaatccgtgagtttttcataacattatcataatgcttctcgccgtacttacagtacctttcaattaatatacattctcgtctttttatcctttcttttttacggagtttgtatgaaaagccatgttcgtagttttaaaacctatattcgcgatgaaattatcaaaaaaggcgggtgggtaaatgcccatgctcatgctgaccgcgcttttacgatgacgccagagaaaattgggatttatcatagtagtaatttgcaacaaaaatgggatttagtggatgaagtaaaacgcacttccagtgttgatgattattacgcacgtttttgccaatctattgaattaatgatatcccaaggtgtaaccgcatttggtacttttgtcgatatagacccaatttgtgaagatcgtgcaattattgccgcacacaaagcccgcgaagtgtataaacatgacattattttaaaatttgccaatcaaactttaaaaggggtaatagaacccactgcgcgtaaatggtttgatattggtgcagaaatggtagatatgattggcggcttaccatatcgtgatgaattggattatggacgtggcttagaagcgatggatatcttgttagataaggccaaatctcttggaattatgtgtcatgtacatgtagaccaattcaacaatccaagtgaaaaagaaaccgagcaactttgcgacaaaaccattgaacacggaatggaggggcgagttgtaggtatccatggtatttccattggctcacattcaaaagaatatcgctacaaactttacgaaaaaatgcgtaaagccaaaatgatgatgatagcctgtcctatggcatggattgacagtaatcgcaaagaagatcttatgccattccataatgcactcacgccagcagatgaaatgattcccgaaggtatcactgttgccctaggcacagataatatttgtgattacatggttcctctatgtgaaggcgatttatggcaagaattaagcctattagctgcgggttgccgtttccctcacttagatgaaatggtcaatatcgcaagtattaacggtcgtaaagtgttaggactagagctaatttagttgcgtatggtgggtttaagccagctagttaccataactattttaaaacccagaaaaacgcgtaaaagtgaaagaattgattgcgatatttggtgctcgtaaataataaaaataaaccgcacttttgttagtgttcggttagatgactgttttctttaaatcatctagcgtattaaaattctcgaagttaccttcttcttgcgtgaattttactgaaatcccgccattttctttcataaattgtaaaaggcgtcgttcacccgatgctaaatagtgtcgcaatttttcctttagctgaacggacattaaacaaaaaacgggatgttcacgttcttcatcgcaagcatacgcaattaaagtgcggtcatttttaaccgcacttttgagtttatctaaaagattcataggaaaaaaaggcgtatcacaaggtgtaaaaaggataaagtcactttttgtcttttctagagctgttagcatgccacttaatggcccttgaaaatcgggcagttcatcggagaaaacaggaaagccaaattttgcatattctgtttgatttcggttagtgttaattgaaatctgatgaatttgtggttgtaagcgattaataacatgttcaattaaagattgtttacctaaaatctgtaatcctttatcttgcccgcccattctgcgtgctttgccacctgccaaaattaccgcacttattgtaattgtcatattttaatctatcattatttcaagtatcatttgcctattttttacgattaaaacggaaatagcaatgaaatgtaagcgtttaaatgaagttttggaacttttacagttttattggtctaaagactcggatttgagtttaatggaaattttgcaaaaaattgccaatgaatcaggtttccaaaaaccattaaatgaattaactgatgaagtgattatttatcagttaaaaatggatggtacagataaatatgagccaattcctggtctcaaaaaagattacgaagaagattttaaaaccgcattgctccgtgctcgcggtatcattaaataagaggaaagaaatgaaaaaagtattacttgcgttaggtttaggtgtcagcacgcttatgtctgtaaatagttttgccgcagatttacaagaaggcaaacaatatgttcaagtgagtcaacaggcttcacagcaaaaagaagtgattgagtttttctcattctattgcccgcattgttacgcctttgaaatggaatacaaaattccacaacaagtcgtagatgctttaccaaaagatgtgaaatttaaacaatatcatgtaaatttcttaggtcatcaatctgaaaacttaacacgtgcttgggcgttagcaatggcattaggtgcagaaagtaaagtaaaatcaccattatttgaagcggctcaaaaggatgccttgaaatcaatggatgatattcgagctatcttcttatcgaatggcataaccgccgagcaatttgatggtggcattaatagttttgcagtaaatggtttagttaataaacaagtgaatgcagcagaacaatttaaagtgcgtggcgtacctgatttttatgtaaatggaaaattccgtgtaaaccctgaagggttaaattatgatgatttcgtgaaagattatgtgcaaaccgtaaaaggtttattgcaaaaataacgaaaaattggtttaatgccagccctattttgtaaatattaatgaaagaagagagaatattatggctgcaagttttagcgtaacgcgtcgtttctttgacgacaaaaactaccctcgtggtttttcccgtcacggtgattacacaattaaagaatcacaggtgcttgagcaatatggtcaagcgttcaaagcattagacttaggggaacgtgagccagcgactaaagaagaaaaagatttcgtcgcattttgccgtggtgagcgcgcagcagagactttctttgaaaaaacttggaataaatatcgtactcgtattaacactaaaaaacgtgtttacaccttatctagtgatgtgagtgaagctgcctctggcggtgaagattattccggcgaataagatacgttaaataaggcaggcggaagtctgccttttgtttttgaatagcttgtgaaatcacgcgtaattcacggctgataactttattctcctatctttgtatgaacgattcgtcttcatacaccctatgaatactaatttctatgcaattaccgatttctcaatacaacgaactgctacaaaaaaaacttgaaaaattaaccgcacttttacacccttttaatgcaccagatattcaagtttttgactctccaacaagtcattatcgcatgcgtgcggagtttcgtatttggcacgagcaagatgatttttaccatattatgtttgatcaagcgacgctgcagcgttatcgcgtggatgaatttccaatcgccagcatgctaattaatcgtatgatgcaaaccttattacctttgttaaaacaacaagaagtgctacacaaaaaattattccaaattgattaccttagcaccttgagtaataagattattgtgagcttgctttatcataaaacactcactgaagaatgggaaagtgcggctaaaaatttgaaagatttactcgaaaagcaagattttgatgtgcaaataatcgggcgtgcaagtaaacaaaaaatctgttttgagcaagattatgtggacgaagttttacctgtgaatggcagaaattatgtctatcgccaagtcgagaatagttttacccagccaaacgcaacggtaaactgcaaaatgcttgaatgggcaattgattgtacccaaaatagcgaaggtgatttattagagctttactgcggaaacggtaatttttctatcgcacttgcacaaaatttccgtaaggtattggcaacagaaatcgccaaaccttccgtagccgccgcacaatttaatattgctgaaaataaagtggataatttacaaattatccgtatgtcggcagaggaatttacgcaggcaatgaatggggttagagcctttaaccgcttgaaagggattgatttaaaatcttatgaatgtaataccatttttgtcgatccgcctcgtgcggggcttgatcctgatacagtgaaacttgtacaaaattacgatcgcattttgtatatttcctgtaatccacatacgctgtgtgataatcttgttgaactatcaaaaacgcaccgcattgaaaaagcggcgttatttgaccaattcccttacactgaccacatggaaagcggcctatggctcattcgcaagtaggaattcagctgatttctgaatcgacagaaaaaacattagcagaattgatcgcactttgtgctgaacacaacattattcataatgaaaagagcccacttgcacttgttcaaaccgatgaccgtttagaacttcgtaaactagacgaacctaaactcggagcggtttatgttgattttgttggtggcacaatggctcaccgtcgtaaattcggtggtggacgtggagaagccgtagcgaaagcagtagggattaaaggttcggcattgccaacggttattgatgcaacagctggtctaggacgtgatgcctttgtgttagccgcaattggctgccaagttcgtttagtagaacgccatcctgttgtttttttacttctgcaagatggtttaaatcgtgcttatcaagatgaggaaatcggcgagatgttgcaacaaaatttgcacttgctgaatgttcagcatattaatgaacttgatcctaatagcgattatgccgatgtggtttatctcgatccaatgtatccgcataaacaaaaatctgcactagtaaaaaaggaaatgcgtgtattccagcatttagtcggggctgatttagatgctgatgaattgcttttacctgcactccaattagctaaaaaacgtgtggtcgtgaagcgtcctgactatgcggaatttctttgtggaaaacaaccgcactttagccgtgaaacgaaaaatcatcgctttgatatttatatgggagcatcccaatgctaagagaaagtgccgttgttattagctatgaaaatggcattgccaaagtgaaatgccaatcccaaagtgcctgtggccaatgtgcagctaaaaacagttgtggaacatcaagcctttccgaattaaacggtaaacgtggcgagcatatttttaatgtggaaacattaatgccattacgcgaaggtcaaattgttgaaattggattagaagaaaagtcgatgttgttgtcggcattattgatgtatgttgtaccgcttttgaccttattgattgtgactatgttgtccgattacataagcgataatgaaattctgcgtgccattttaatctttggattaaccgcactttctttcatttttgtaaaatcttatagcagaaaattagggcaacaaacagaatttcagcctgttttattgcgcatattatcttaagttttttattcgctttttattatttctgcgatctagatcgcaaactataaagctagttatttaaattacccattgaaaaaagctctttagaggcttggtcaaacttagtgatgatgtggcaaaagttgctattctagcaatgcctgttatactctatggcgagcaaccgcttttcctaaaaggatgaaatattatttttttgctcattattgcttatgcttgccttgtgatggggcgtaaatttcgtcaattagtggagggaaaataatatgtggcttactatagggcttggcattgtttcgcttcttgctattggcggacttatttttgccaattatgtagcaaaacattcttaatttattaaccccgatctttcggggttttccgtatctaaagtgcggtgatttttaaggttatttttatgaacaatcagattcctttacttggaattaccggttatagcggtagtggtaaaacaacattattagaaaaacttattccagaactgatcgctcgtcacattcgcgtttcagtgattaaacatagccatcacaatatgcaagttgataaagaaggaaaagatagctggcgtatgaaagaggcgggttcttctcaagtcattgtagcgaatgatgaacgctgggcgattatgacggaaacgccaaaacctgtttcattggattatttagcgcaacaatttgaccgcactttaacggatttagtgttggtggaaggctttaaacaagagccaattccaaagattttgctccatcgtcaagaaatgacaaaacctttacccgaaattgacgaatatgtgctcgcagttgcaacgaattattcccttgaaattgaccgcactttgttggatattaaccgcattccgcaaattgccgattttattgaaaattggttgcaccattttcacggagcacgatgactactgaatccaatgcctatcgcggtttagcttgggtagcagcaatggcactttttatgcaaagcctcgatgcgaccattctaaatacagctttacccgcgatatcttccgatttacataaacccgcctttgaaatgcaaatggcgatcatcgcttattctttagctgttgcattatttattcctcttaccgcttgggctgcggcaaaatttgggacattgactgtttttcgtggtgcagttttcacgtttattttaggttcagttgcttgtgccgcggcctctaatttagagagccttattttagcccgagtgattcaggggataggcggtgcctttatgatgcccgttgcgcgtttagctattattcaagctgtccccaaacaacaattagtgaatgcttggaatttaatggcaactgcaggtttgattgggccaattctagggcctattttaggtggatggttagtcattcacgccagttggcactggatttttttaattaatattccaattggtgtgctaggaattttggcatcgggcagcgtgatgaacaatatcaagggcaaggcagagaaattagattggacaggttttttactctttgcattggggttagttggtattacgcttggtttggatttactcggagaaagtcagcataattcaagtgtaacttatagcatattagttgttggtattctgttactcgtaacttattgtggctatgctaaaaacaatgaaaatgccattttacctttatcccttttccgaactcgtacattcagattaggtattattgctaatatttttatccgattatctgcatctggtgtgccctttttattgcctttgatgttccaattatctttcggttacagtgctgaaatgtctggctggctattagcaccgattgcgttaatttctgtgatgttgaaaatattaattggacgaattttaaatcgttggggttataaaaccacgttaatttcatccgcacttttgatggcaggttctgtgatttcaatggcttggttagataaacaaagctctctaacttggattatttgtaatcttatgtggtatggggcttgtatgtcgatcatttttacttcaattaatacgctggctgtaggcgatctttcaaaacaacagtctggcacaggctctaccgtattaagtattgtacagcaagttgggattggatttggtattgctgtgtcatcaataatcttaaatctttatcgacatttctttaacgcaagtgattgcttacaacaggcattcagctatacttttttaacttcatcactttttgtaatcgcccttgtttggtcgcttatgaaattacacaaaaatgatggcgatcatttacgaaaaatgccttagattaatttgttataatccatagaatttttttatttaaaaaaagggaaatttgcttatatcttattgatatttcttgttggtggagatagctccatcgtttaaccataaatggtagggcattccctgcctaacattgaggtatgcttatgaaactaaaagcaacattaactctcgccgctgcaactcttgttttggcagcttgtgatcaatctagctcggcaaataaatctactgctcaaactgaagcaaaatcctcgtcaaataatactttcgtttattgcacagcgaaagctccattgggatttagccctgcgttaataattgaaggtacttcttataatgcaagctcacaacaagtgtataaccgcttagttgaatttaaaaaaggctcaacggatattgaaccagctttagctgaaagctgggaaattagcgatgatggtttaagttatacttttcatttaagaaagggtgttaaattccatacaacaaaagaatttaccccgacacgtgattttaatgcagatgatgttgtattttcattccaacgtcagttagatccaaatcatccatatcacaatgtatctaaggggacttatccatattttaaagcaatgaaattccctgaattgttgaaatcagtggagaaagtagacgataacacaattcgtattaccttaaacaagacagatgcgactttcttggctagtcttggtatggattttatttctatttattctgcagaatatgctgattcaatgctgaaagcgggtaaaccagaaacacttgatagtcgcccagtggggacaggcccttttgtttttgtggattataaaacagatcaagccatacaatatgttgcgcatgaaaattattggaaaggtagaacacctttagatcgtttagtcattagcattgtgcctgatgcaacaacacgttatgcaaaattacaggcgggtacttgcgatttaattttattcccaaatgtagcggatttagccaaaatgaaaaccgatccaaaagtacaacttttggaacaaaaaggtttgaacgtagcgtatatcgcattcaataccgaaaaagcaccgtttgataatgtcaaagtgcgccaagcgttgaattacgcagtggataaaaaagcgattattgaagcggtttatcaaggcgcaggaatatcagctaaaaacccacttcctccaacaatttggagttataatgatgaaatccaagattatccgtacgatccagaaaaagcaaaacaacttttagcagaagcgggttatccaaatggttttgaaactgatttctggattcaacctattattcgtgcttctaatccaaatccaaaacgtatggctgaattaattatggcggattgggcgaaaattggtgtaaaaactaacccagtgacttatgaatgggctgattatagaaaacgagcaaaagagggagaattaactgcgggtatctttggttggtctggcgacaatggcgatcctgataatttcttatccccattattaggtagctcaaatataggtaattctaatatggcacgtttcaataattcagaatttgatgctttactcaatgaggctattggattaaccaataaggaagaacgtgcgaaactttataaacaagctcaagttattgtccataatcaagcaccttggattccagttgcccactctgttggttttgcgccacttagtcctcgtgtaaaaggttatgtacaaagcccatttggctatgacgctttttatggtgtgagtgttgatggtaaataattcatattgatttacttattttaagcccttatttataagggctttttatttatcaaggattattctgtaaaaaatatgttaaataactttaacttgagtataatgctctgcattatttctatcggatatgattccgtagaataataaaaattaattgttaatataaggaacaaaaatggatttcaatcgaattatcactcatatgaatgatcatcatcaagatgatatggctgccctttgtaaaaaatttggtggcgaaaaggaaatcacagatgtgacgttagttaatgtagattttgctggtttagattttaaatataatggtggcaaaacattacgtgtggaatttccacaacaagctgacgcaggttcaattaagcaagctatcatcaatctttgtgtagaaaataaaccagtagcaaattacgatcgtattaaggctaaaattgatgaatttcgtcaagagtttaaaagctgtgtgctttctactttagataaagatggcttaccgatggcgtcttatgcaccaattattttctttgatggaaaatattatatttatatcagtgccattgcagagcattatgagaatttaaaacgcaatccaaatcaagtagaagtgatgtttttagaagatgaaaacaaagcgaagtcaattattgtgcgtactcgcttacgttataaagcaagtgcacgttttattcctcgtgaagatccaattgttgaaaaagtcttagataaattagccgaaactatgaatgatgtaggcggaattaaaacaattcgtgaatttactgattttgatttagttgaacttacatttggaacaggtcgttttgtaagaggttttggccaagcttatttgattgatgctaatggggaaatttctcatattggtgtcaaaggcaatccacatgaaaaagaaagtgataaataatattgtctcttaatgaagataaagggttgagtgtaaatttatactcaccccttttgtttacgataagttcgagtgaaattgaaatttctttatttttttaccgcactttattttcattaaggacaaggcttgcttactataatttcgataacctgtctgtcgatatgctgcatactttttgatgcaatagcgcagagattatcaatagttcgatcaagatcgtgttcgacaataccttcattgccgcagcaataggcaatccaaccatacctgttcctggcactgcaacgcccaatccatttttcatcagattaggcgaaacttttacttcaatgcgttcaggtgttttgcctaaatatttcgccgctgtagcagatgcgagtgcaagagaaatgggttcggtacagcctagggctggcacaacatcgtgtttaacgatgtggagtaatggtttttcaatttcgttaagtctttctaaattcattcttacttatccaattaatgcgcttcatcccaattttgacctacaccgacttctacgatcaacggaacaactaattccgatgcatcttccatttgttgtttaatttgttcacggaaaaactcgactttttctgaccgcacttcaaacactaattcatcgtgtacttgcataatcatttcaatgtcgggatcgtgatagattacttcatcaagtttaatcatcgctcgtttaataatatccgcagctgtgccttgcatcggtgcatttatcgctacgcgttctgcccctttacgacgcattgcgttgctagaattgatatcaggtaaatataaacggcgaccaaataacgtttccacatagccttgtgctttcgctttttcacggatatcggtcataaattgctgtacactcggatagcgttggaaatataaatccatgtatttttttgcatcaggacgagaaatatcaagttggcgtgaaagtccaaacgcggacatcccataaattaagccgaaattaatcgctttagcattgcgacgttgctcgctggtgacttcatctaatgatacaccgaagatttcagcagccgtggagcgatgaatatccttgccttgagagaaggcgttaattaagccttgatcgccagaaagatgtgccataatgcgtagctcaatttgagaatagtcagcagcgacaatagaataaccttcacgtgcgataaatgcttgtcgaatacgacgaccttcttcattccgaatcgggatattttgtaagtttggatcacttgatgataaacgtcctgtcgctgtcaccgcttgatgataagaggtatgcactcgtcccgtttgtgagttgaccatttgaggcagtttatccgtgtaagtggatttaagtttgctcaacccacgatgttcgaccaaaattttgggtaattcgtggctataggctaattcttccaatacttcttcattcgttgatggcgcaccttttggcgttttttgtaaaataggtaggccaagtttatcgaacaaaatttcttgtaattgtttggtggaagccaaattaaatggctgacctgctaattcgtaagcttgttcttcaagtgcggttaatcttgtggcaatttcgttagattgcataaagagggcattactatcaatcaaaacgcctgtacgttccatgcgagaaagcacatgaagtaatggtaattccattgttttatacaattcaacaagcgttggttcttgttgcaatttcaaccacagtgcttgttgtaatttcattgtcacatccgcatcttctgctgcgtattcagtggcttgttctaatggaatttgattaaacgtaagctgattttttccttttccagcgatgctttcaaatgcgatagtttcatgacctaaataacgtttggctaaatcgtccatattatgacgacccgtactatttagcgtataagaaagcaacatcgtatcaaattcaacaccttgtaattcaatgccatgacgggcaaaaatgctttcatcaaatttaatattttgtccaattttgtgaatgtcaggattttctaaaatgggtttgatagccgcaagtgcggtcgatttttcgagtgtttttggcgcatccaaataatccaattgcaatggtaaataagcggcttcgccattttcaagagcaaaagatatacccactaaattagcagacatataatcgaggctatctgtttcagtatccactgcaatgagttttgctgtattgagtttttcaatccagcgcgttaaatccgcttgagtgagtaaggtttcatattttgtacgatcgatttgaattttaggcgtattttccaccgcactttgatcttgtgaggtcgcctgatactggttcattttcactggctgttcagtggtttgggttatggagtcagcaccattcatcacttcattaagccagcgtttaaattcgtagcgagcaaaatattcaatgagttgatccttttggctttctccaagcaacaattgatctgttgtcacgttaagttcaacatccgttttgatggttgctaatgtataagaaagatcggcattgggtttttcagccaataatttttcacctagttttttcgccccacgaattggcagttccgctactttttcaagattggcataaatttcagccatgcttcctatgccttgtagtaaaccaagtgcggttttttcgcccacgccagcaacgccaggaatgttatctgcactatcgcccataagtgcgagataatcaataatgagttcaggtggaataccgtatttttcaatcacaccctcacgatccaataggctattattcatggtgttgatgagcataatattgtcatccaccaactgtgccatatctttatcgccagtactaatgagcacttttttacccaaacttgatgcttgtagtgcgagagtaccgatcacatcatctgcctcaatcccttccaccactaaaagcggaatgcccaatgcacgaatcatatcgtgcaaaggctgaatttgtttgcgtaaatcatcaggcattggcgggcgatgagatttatactgttcaaacatttcattgcgaaatgttttcccttttgcatcaaaaacaacggctatatgagtgggctgtacttgtgagatgaggcgttttaacatatttaacacgccgtacatcgcgtttgttggctcacctgcggcattagttaaagaaggaaaggcatgaaatgcacgatataaataagaagaaccatccactagcacaagcggatttgttgcaatttgggccataaaaatctcgttttaaactgaaaaatgtgggcattatagcgtaatttatggtgatgagcgaatggcgggtttaatgtaaaatttatgacgaatattttttgctatggcataatatcagccattcaaatatttaatttaaggaaatcaaatgtcgttaaaattggtcgaaattttagttttgggtcaggttttgcgtttaaatgtacccattgaacaagaagaattactgcgccaagctgcgcgtaatttagatatattggtttccgaaatgaaagaaaagacaggccttattcagcttgatcgtgtgctctctattgtggcactcaatttgagttttgaattaagccaagaaaaaaataaaacggctaaaattgaagaggtattgagaacgggtatccaacaattagatcattcattagaaaatattcgtgttacaaaagaaccgcattaaattaatgatcaaattagagtcattttgtcgttttataagcaactcgttaaatttgacaaataaatgctagtcaatactgggaatttgggctagtataaacccataagaattacctggagtgttcgtcagtaggctatgtccctgagccgatactttaaatcttataaattggtttcctatcgttggtgtgtaggcttaacctttgactcgttcattgggctaagaaacctgaaaacggtatcaactgatttccttgaaccgtcgggttcaaggactactgcccgcagcggcactctgggtcctatcttctcctttcatttctatgaatactcaaaaacgccagcaaatccgcgctgaaattcgaaaaatacgcgcaaatttaaccgcacttcaacagcaacaagcagcacaatcagtgacccaacaggcgttaaatcttatcgagcaacgacaagccaaaaatattgcattatatttttcttttgatggtgaaatttcaacaaaagccttaatccaatccctgtggatgcaaaataaaaatgtgtatttgcctgttttacatccttttactaaacactatttattgtttttacgctatttacctgatacgccaatgaaacaaaatcagtttggcatttgggagccaaagctaaatgttcaaaatgttttgccattaaatgaactggatattttatttacgccattggtggcttttgataaaaaaggaaatcgccttggtatgggcggtggattttatgatcgcacgttgcagaattggcaaaataagtcttttattccagttggtttagcgcaccaatgtcagcaagtagaaaatcttcccactgagcattgggatgtgccactgtttgatattttggtggattaaaacctatcatcaaaatcttattgatagataaaatcaaaatatttcattttttctcttgaaatttattcaaccgagcttacttagtttatgcgaatggcgaaagccgaaatcaaattgaggaaagcgtatgaacattgaaaaatttacgacaaaattccaagaagcgttaagcgaagcacaatcacttgctatcggaaaagacaatcaatttattgaacccgtgcatttattgaccgcacttttaaatcaacagggcggctctattgcgccaattttgacagcaagtggcgtaaatgtggctttattgcgtaatgaattaaagacagaactaaataaattgccgcaagtgattggcaatggtggagatgtacaactttcacgccagcttattaatttacttaatctatgcgataaattcgcacagcaaaaccaagataaatttatttcgagcgaattgtttttgcttgcagctttagaagaacgaggaacgatcagcgatattttgaaaaagtgcggtgcgaaaaaagaacaaatttcgcaagctattcagcacattagagggggacaaaacgtgaacgatcaaaatgcagaagaaagcagacaagctcttgaaaaatatacgattgatttaaccgctcgtgcagaaagtggcaaacttgatcctgtaattgggcgtgatgaagaaattcgtcgagccattcaagtattacaacgtcgtaccaaaaataaccctgtgttaattggtgaaccaggtgtagggaaaacggcgattgtcgaaggcttggcacagcgtatcgtaaacggcgaagtgccagaaggtttgaaaaataaacgtgtgctttcattagatatgggcgcattgattgctggtgcaaaatatcgcggagaatttgaagaacgtttaaaagcggtgctcaatgaactttctaaagaagaaggtcgcgtgatcctctttattgatgaaattcatactatggtcggcgcgggtaaaaccgatggtgcgatggatgcgggtaacttattaaaaccaagtttagcgcgcggtgaattacattgcgtgggtgcaacaacgttagacgaatatcgtcaatatatcgaaaaagatgccgcacttgagcgccgtttccaaaaagtatttgtggacgaaccaagtgtagaagataccattgctatcttacgtggtttgaaagaacgctatgaaattcatcatcacgtggatattactgaccctgcgattgtcgctgccgcaacgctttcacatcgttatatttccgatcgtcaattgccggataaagccattgatttgatcgatgaagcggcgtctagcattcgtatggaaatagattctaaacctgaaccgcttgatcgccttgaacgtcgaattatccaattaaaattggaacaacaggcattacaaaaagaagaagacgaagcaagtcgcaaacgtttagaaatgttagagaaagaattggctgaaaaagaacgtgaatacgccgaacttgaagaagtatggaaatctgaaaaagcaacgctttctggctctcaacatattaaacaagaattagatactgcaaaaaccgaactagaacaagctcgtcgcgcgggtgatttagcgaaaatgtcagagttgcaatatggacgcatccctgctcttgaaaagcaactcgagcaagctgaaaccagcgaaggaaaagaaatgacgcttttacgctatcgtgtcacggatgaagaaatcgcagaagtgctttctaaagccacaggtattcctgtatccaaaatgatggaaggcgagaaagaaaaactcttgcgcatggaagatgaactacataaacgagtgattggtcaagaagaagcagttgatgcggtagcaaacgcgattcgtcgtagtcgtgctggtctttccgatcctaatcgcccaattggttcattcttgttcctagggccaacaggtgtgggtaaaacagagctttgcaaaactttggctaaattcttgtttgatagtgaagatgcgatggtgcgcattgatatgtcagagtttatggaaaagcacagtgtctctcgtttagtgggtgcgcctccaggctatgtcggctatgaagaaggcggttatttaactgaggctgttcgtcgtcgtccatattcagtgatcttattagatgaagttgaaaaagcccatgcggatgtattcaatatcttattacaagtattggatgatggtcgtttaactgacgggcaaggtcgtactgtggacttccgtaatacggtggtaattatgacctctaacttgggttctgatttaatccaaggtaacaaagacgaaagctatagcgaaatgaaagccttagtgatgtcagtggtaagccaacatttccgtcccgaattcatcaaccgtattgacgaaactgtggtattccatccgcttggtaaagagaatattcgtgcgattgcaagtatccaattagaacgcttagcaaaacgtatggaaactcgtggctatgaattagtgtttaccgacgctttattagatttcattggtgaagtggggtatgacccaatttatggtgcacgtccattgaaacgtgctattcaacaagagatcgaaaacagcttggcacaacaaattctatctggtgcgttattacctggtaaggttgttaccattgattacgccaacgcagaagttcaagctagacaataggtattaaaaaaagtgcggtaaatttaccgcacttttcttatgaacctaaacgctgacgtgcaatttcaaataaacatacccctgttgcgacagatacatttaatgatgaaactgaaccagccattggaatactaatcagttgatcgcaatgttcacgcgttaaacgacgcattccttcgccttcggctcccataacaagtgctagtggtcctgtcagtttgctttgataaatggtttcagtggcttcgccagcagtgccaaccacccaaatattatggttttgctgtaaatcgcgcagtgtgcgagaaagattggttacacgaattaacggcacggtttctgccgcgccacaagcaactttacgtgcgatagatgttaattgtgcggatttatctttcggtacgatcactgccactgcgcccgctgcatccgctgttcgcaggcaggcacccaagttgtgtggatccgtcacgccatccaaaactaataaaagcggattttgtttattcgcaagaatttcatcaagatcattttcattaagttcttttgccgcttgtactcgagcaatgacaccctgatgaacctcaccatcggcttttttatcaagtgtttgtcgattaacaaattgcacaccaattcccagggaataaagctcatttaagagtggctgtaggcgtttatcttcacgtcttttaagtacgaagacttcaattagacgctctggcgaatgggttaaaatactattaaccgcgtgaataccgtagatttgttctgacataaatttctctttttcttatttgaatttttaattcatttttacaataggaagtgaattattttcgttttctagatgctttcttcaaaacatctttcttttttaccgcactttttcgtttctgggatgttttagacggtagttctttaaagactttcttggctttttctttcgccgtttttccagcacgacgaggtttacgttcactccccatcagcgagaaatcgaccattttattttctaaatgtactgcttcaactttgatacgaactttatcgcctaagcgatattgcattccgctattttcgccaattaaacgctgttttgctgcatcgaattggtaataatcgttttctaaggtggaaatatggactaaaccatcgatgaataaatcatctaagcgtacaaataaaccaaatccagtcacagatgaaataacaccgctaaattcaccgccaacatgatcttgcatatattcgcatttcagccaatctgccacttcacgagtggcgtcgtcggcacggcgttccgtcattgaacagtgattgccaagtaaatccatttcatcaaaagagtaatgataaccgcctgtatcggtggttttacgttttgcgccttgttctttagcgagtaaatacttgatacctcgatgaagtgttaagtctggataacggcgaattggcgaagtaaagtgtgcatattcttccaaagccaaaccaaaatgcccaatattatcagcatgatagacggcttgacttaatgaacgtagcaacattgtttgaataagttcatgatcatgtcgttctttaactttttctaagagagcagcatagtcttttgtggttggcttcaatccaccttctaaggttaaaccaaactcacttaagaaagtgcggaacgatgttaatttttcttcgctcggggtggcatgaatgcgatataatgcaggttctttatgtttttccataaaattagctgctgcgatattcgcaagaatcatacattcctcaatgattttgtgggcatcattgcgaacaacgggttcaatacgctcaattctccccattgcattaaaaataaacttagtttcaatggtttcaaaatcgatcgcaccacgttgatgacgtgcaccaagcaacgcttgatagagtttataaagatcttctaaatgaggcacaagcgtagaataacgagcgcgtaattcttcatcgccttcaagcatttttgctacttttgtataagtgaggcgggcgtgagaattcatcactgcttcataaaagcgataatctatgagcttacctttggcagaaatttgcatctcacacaccatacacaaacgatccacttgtgggtttagagagcataagccgttcgataaaatttcgggtagcataggtacaactcggttcggaaaatagaccgagttaccacgattatgcgcttccacatccaaagcggaacgtaaacgtacgtaataactaacatccgcaatcgccacccaaagtttccagcctttgccgtgtttttcacaataaacggcatcgtcaaaatcccgcgcatcttcaccatcaatggtcacaagcggtaaatttcgtaaatccacacggcctttttttgcttcttcaggcacttcttcagtgaatttttttacgtatttttccaccgcacttggaaacttatggggaatatcgtggttacgcaaggcgatttccacttccatttctttcgccatattatcgcctaggatctctgtgattacgccaattggctggttaaaactggcagaacgttcttgcaactcgacaaccacaacttgtcccatgcgagcaccattacgatgttcatttggcacgagaatatctcgaccaattctgctgtcatcaggcaccacatagctaaaaccgttttctaagaaaaaacgacccacaatttgttttttacggctttctaatacgcgcacaattcgcacttcacggcgaccacgacgatctaatccagcaagttgcgctaagacaaaatctccatgcatgactctttgcatttgatggtttggaatgaataaatcatcctttttgccatcgacctgtaaaaaaccaaaaccttcgcgatgaccaattaccgtgcctttaaataaatctaatttttctggtaaggcatagcgtttacgtttggtgaacactaattggccatcattttccatcgcgcgtaatcggcgacgcatcgcttctatttgctcttcatttcgaatggaaagtgcggtcaaaatttcatcccgattcatcggtgcattattgtctcgaataacgcttaaaataaattcacggctcgggattggattgccgtatttttccaattctcgtttgtaatgaggatcttggctgattaagtttttacgtttttttgtcattattttttacagttttaaaaagtgcggagagtttgacactgtaaggaggataatgcaagacggggataaaattatcactgtatattttaaggatattttaaaattgaagaacttaacgatctttccccagcactataacagtgatgactttttatagatatttttaaagtatgaaaagcgcggtaaaaattttatgcaggaacgcgttctgttacgagcatttgtagttttcgtaaaataacatttaatactacgccataggctggtacgaataatataatgccgacaaatagcttaaataggtaatctacaaaaccgagttgtgcccagtgttcagccatgaacggatctgcactttgatagaaggctacactgaagaaaacgaatgtatccgccattgagccaaatgtcattgagctagttggcgccacccaccaagtttttaactggcgtaagcggttaaatacgatcacatcaagcaattgtcctaccacgtaagcggcaaagctcgcaatagcaatacggaatacaaacagatcaaaatgcgttaatgattcgaaaccttggaatttgctttcagagaataaaacagatatgacgtaacttacaataagtgcaggaaacatcaccacgaagatgatttttctcgcatcttccgcaccgaaaatgcgtacggttaaatcggtagctaaaaagataaatgggaatgtgagcgttccccaagtgctgtggaaagaaaaatcgtttgctgcaccaagtgcggttaattttagcgtgatttcaaaagggatttgtacaaagtaattgctcgctgcaatgatgaatatgtggaaaaagctgagccagatgattgcacgacgtttttgttgatcattaaagatcggagaggttaatttcatgttgtacctttttagtttaaataaatcggggttagggaacccgaggctgaatatagggagctagatgatacgcatatttctaataattgcaagagtcgattgcatttgagttttatattttatgaaaattgacgaatgattttacagcctttattctatttgtgtttttcatcaaatttgaaaggagagaaaatggagttacacaatattcgtgatgaatatactaaacgcgtgctttcacaacatgattgccataaaaatccaatttcgcaatttgaacagtggcagaaagaggctattcatgctcaagtcaatgagccaaccgcaatgaatattgcgactgttgatgaacaaggtcgcccaaatagccgaatggttttgttaaaagaagtcaatgagcaaggatttgtcttttttaccaattatcttagtcgaaaaggcggctgtattgagcgcaatccttatgtcgcgctgactttcttttggcctgaattggaacgccaagtgcggattgaaggtaaggcggttaaaattccagcagaacaatccgataaatattttgctacccgaccttacaccagtcgtataggggcttgggcaagtgagcaaagtgcggtgatttctaattataaatctttgctagcaaaagccgcattggttgctgctaaacatccgttaaatgtgcctcgaccagattattggggcggctatttagtggtgccagaaaccgtggaattttggcaggggcgtccaagccgtttacatgatcgcattcgttatcgtaaagaaagtgataattggattagagaaagactttctccttagtaaattgagcataaaataaccgcactttagttgtatcccaaaagtgcggttaattttttctaaattttagcgtttagctttatttattaatgcgtgctagtacttgttgttgtacgatttgcacgtttacgatcgttttccgttaaaagttttttacggatacgaatcgactcaggtgttacttccactagttcatcatcatcgataaattcaatcgcttgttcaagactgaattttacaggtgtagttagcacaatcgcatcgtctttacctgacgcacgcatattagttagttttttaccttgcaagcagtttacggttaagtcatttgagcggctatgaataccgataatttgcccttcataaacttctacgtttgcatcaatcattaacttaccacgttcttgtaagccaaataatgcatagccaagtgctttgcctgtcgcattagaaattaatacgccgtttttacgttggccgatatccccacctttgatctcatcgtagtggctaaagcttgagtaaagtaagcctgtaccagaagtcattgtcataaagtctccacggaagccaatcaatccacgactagggataatgtattccaaacgcacacgacctttaccgtcaggcaacatatcacgaacttcacctttacggatacccaatgcttccatcacagaaccttggtgttgttcttccacatcaatagttacttgttcgtatggctcttgttttttaccatcaatatcacgatagattactttagggcgagaaacggcaagctcataaccttcacgacgcatattttcgattaacacggaaagatgtaattcgccacgaccagatacacggaattcatctgggtttggggtttcttctacgcgtaatgccacgttgtgaaccaattctttatttaaacgttcaagaatttgacgtgatgtgacatattttccttcttgtcccgcaaatggagaggtatttacacagaagaacatggttactgttggttcatcaaccgttaatgatggcagtgcttcaactgcgttgatatcacaaatcgtatcagaaatatttaattctcctaaaccagtgatagcaacaatatcgccagcataagcaacgtcttcttcataacgttgtaaaccaagatgtccaagtacttgaccgatacgaccttgacgagtttttccttcactattgatgatagtaacaggttggtttggtttaatcgaaccgcgcttaatacgaccaataccaataacgcctacatagttgttgtagtctaattgtgaaatttgcatttggaatggcgcatcaagttctactttgggcgattctacatatttcacaatggcttcaaataatggcgtcatatcttccgctaaatcttcgtgttcaagacctgcaacaccatttagcgctgaagcatagataattgggaagtctaattgttcatcgcttgcaccaagattgacaaataagtcaaatacttgatccacaacccagtctggacgcgcaccagggcgatcaactttattaattacgacaataggttttaaaccatgagcgaatgctttttgtgtcacgaaacgcgtttgtggcattgggccatcaaacgcatcaacaactaatagaacagaatccaccatagaaagtacacgttcaacttcgccaccgaagtctgcgtgccctggagtatctacgatgttaatgcggtagtcattccagttaatcgcggtattttttgcaagaatggtaatgccacgttctttttcaagatcgtttgagtccataactcgttcatccacatcaccacgagcagattcaaaagtaccagattgttgaagaagtttatctacaagagtggttttaccatggtctacgtgcgcaataatggcgatgttacggagttttttaatatcaatttcgtttttcattatctaatgcttcgagtagggtgcaattttgcacggtatatgattttataaaaaaggtgcaatttacagcacctaattataggttgttgtcttatgttgaagaaaacgagacattatacctcagatttatttacgtagtctcattttctttgctttcaaagcgtgttttatatcattaggtaaacgtaatatatcccagatcaaccgaaaaatcagattttggtaaattcttggtttggaatatataccaatttttttatatacaaacttcggcggaattaaaatatcttgtgtgtaatttttcttttcttcgagaataaaagtaattgggttattcagtggtgataaagggaaataattacatagaggactttctggcgaaatgcaataaatatttactccataatgtttttgtaaaaaataaagtgcatttaaatcatattccatagaatggatatcgctttgacttttattttgtgaaaaagaaggtaataatttaataatattttctgtttgatgatgaaatgcgtaaggattccctttttcttgataaaaatcaatgcctgtcaaataaagatctttataacccattgcagttgccactgcacacatatagacgcctgatgtaatcctcttattctcatatagttcgtgatattgtaaatgagcatcaaaagctcgtagtttttttaaatagctatgaccaagatcgatttgtggtagtaatttttctaaacgctggattttctttaattctgaatcccctaaatttagaaaagatgataaaataatatcagcatattcatattcattatttttaattaattgcataaacgtatagtattgttcaaaaattacagaacaattaaaaaataccttttttattttcttaccaagaaaataatgatcctcaaaataaaattgattgcaacggaaaacatcataatctttaggtaataaactatagtcaattgattttaaacttgttccattacctgcaataatgacagactttgattgattgattgattgattgattgattgattgattgattgattgattgattgattgattgattgattgattggacatattgtaccgttcattgaataaaatataacttatctttaatactaaaaaatagtagctattatacaggctttctgtgctttttactataacgccacaacaaatctaatgaaagtcagatttgattagactataatacttccttaattttttatatagaaagaggatctactatgtcaaatgccattgcttccgtgtttaaattgatcgaagagaatgatattaggtttgtattgcttcgttttactgacattaaaggtaaagaacatggtgtttctatcccagttagccttgttgatgaagatatgtttgaagacggcaagatgtttgatggttcctctgttgaaggttggaaaaccattaataaagccgatatgttgcttatgccaatagctgaaaccgcagttgtcgatccattcgcgcaaattccgacactttctattcgttgtagtgtttatgaaccaacgacaatgcaaagctatgatcgcgatccgcgctctattgcaattcgtgcagaaaattatatgcgttcaacaggtattgcggatcaagctttttttggccctgaacctgaattcttcttatttgatgatgtgcgttttaatgtatcaatgaacaaagcgtctttttctattgatgatatagaagctgcttggaacacgaataaaaaatatgaagaaggcaataatgcttatcgcccattaaaaaaaggcggatattgtgccgttgcaccgattgatagtgcgcacgatattcgttctgaaatgtgcttgattttagaagaaatgggattagtcatcgaagcccatcatcatgaagtggctactgcagggcaaaacgaaattgcgactaaattcaatacgctcactttaaaagcggatgaaactcaaatctataaatatgtggtgcaaaatgtggcattggagcatggtaaaacggcgtgttttatgccaaaaccaattactggagataatggttcgggtatgcactgtaatatgtcgttaagtaaagacggaaaaaatattttccaaggcgataaatatgcaggcctttctgaaaccgcactttactacatcggcggtatcattaagcacgctaaagccttaaatgcgttcactaatccaagtactaattcatataaacgtttagtgcctggttatgaagcaccagtattgttggcttactctgcaagcaatcgttcagcctcaattcgtattcctgctgtaaccaatccgaaagcgattcgcgtagaagcgcgtttcccagatccattggcaaacccatatttagcatttgctgcattattaatggcaggtcttgatggcgtggtaaacaaaatccacccaggcgatgcgatggataaaaatctttacgatcttcctccagaagaattaaaagatattccagctgttgcaagctctttagaagaagcattgaattcattagaaaaagactatgaatttttaacccaaggtggcgtatttgctaaagattttattgatgcgtttatcagtatcaaacgtaaagaagtggaacgtttaaatatggcaccacatccagttgaatttgaaatgtattatgcgtaatgtcattgacgtaatcatttttaaaagtgcggtagaatttaccgcacttttcgtttgaaattgtttataacgagactcgggtaaaaatgtcgaatacaaatagaacaattctagtgactggtggagcggggtttattggttctgcgcttgtccattatcttcttgaaaagacacataataaaatcgtaaatgttgataagctgacttatgcaggaaatttagcctcacttaaaaccgtagaaaaccatccacgttatgcttttgtacaagcagatatttgtgatactaaagcgttgtcttatattttttcacaatatcaacctgatgctgttatccatcttgccgctgaaagccatgttgatcgttctataaatgcttcttcggagtttatacaaaccaatattgtaggcacttactgcctacttgaatcaactctagattactggcatcgtttagataatcaaaaaaaatccagcttccgattcttacatatttccaccgatgaagtttatggggatttaaaaagtaatgagggtttatttactgaaacatcagcttataaacctagcagcccttattctgcttcaaaggcggcaagcgatcatctcgtgcaggcttggtatagaacatatgggttaccgacaattattacacatagttcaaataattatggcccgtatcagtaccctgaaaaattaattccattgatgattttaaatgcgatagagggaaaaacactgcctatttatggcgatggtttgcaaattagagattggttatttgttgaagatcatattgatgcactatataacgttttgatgaaaggaaatattggggaaacctataatattggcggaaataatgaaaagtccaatattgatgtagtgcgttctatttgttctttgctggaagaatttttacctaataaaccaaaacatattgataaatatgaagatttaatttgctatgtgcaagatagaccaggtcacgatcttcgttatgcgcttgatacaagtaaaatcaatcataaactaggctggatacctaaagaaacttttgaatcgggattaagaaaaacggtaatttggtatttaaatcatcaagaatggtgtcaaaaagtgagtgaataaggtcaaataattaactattagaaataaagctggtatagtttctaaatttattttgtttatacatgggggaataaatatgcaaattacactttcaaataacttagcgaatgatgcttggggaaaaaatgctattttgagctttgactctaataaagcaacaattcatttaaaaaataatgaaaaaactgaccgcactttagttcaacaagctgctcgtaaattgcgtgggcagggaattaaaaatgtggaattgctcggtgaagaatgggatttagaattttgctgggcgttttatcaaggtttttataccgcaaaacaagattacgggattgagtttcctcatttggatcatgatctacaagatgaattattagcgcgtatcgaatgtggcgattttgtgcgtgggattattaatgagccagcacaaagcctaacaccagtaaaattagcagaacgtgcggctgaatttatcttaaaccaagctgatatttataatgaaaaaagtgcggtaagttttaagattatttctggtgaggaacttgagcaacaaggttatcacggaatttggactgtgggtaaaggctctgctaacttgcccgctatgttgcaacttgattttaatccaacacaagatccgaatgcgcccgtgttagcttgtttagttggcaaggggattacctttgacagtggcggctacagcattaaaccaagtgacggaatgagtacaatgcgaactgatatgggcggggctgcattattaacgggggctttaggtttcgctatcgctcgtggattaaatcaacgcgttaaactgtatttatgttgcgcagagaatttgataagcaataatgcctttaaactaggcgatattattacttataaaaatggcgtgacagcagaagtgctgaatacggatgctgaagggcgtttggtgttggctgatggattgattgaagcggacagccaaaatccagattttattattgattgtgcaactttaactggcgcagcaaaaatggcagtaggaaatgactatcattcggtattatctatggatgatgatctcgtgaagaatcttttccaatcagcacaagaagaaaatgaacctttctggcgtttaccatttgaagattttcatcgctcacaaattaattcatcttttgcagatattgctaatattggttctgttccagttggggcgggggcaagtacagcaacagcatttttatcgtattttataaaaaattatcaacaaaattggttgcatattgattgttccgcaacttatcgtaaatctagtagtgatttatgggctgttggggcgacagggattggtgtgcaaactttagcaaatttaatgttatcaaaatcattgaagtaaggagatatgatgacagaaagaactttttcgattattaaatctgatgcggtaaagcgtaatcttattggagcaatcttaactcgttttgagcaaaatggctttaaaatcatagcctctaaaatggtacgcttaactcgtgagcaggctgaaggcttttatgcagagcatcaaggcaaagaattttttgctcctttagttgaatatatgatgtcttcgccgatagtggtttctgttcttgaaaaagaaaatgcagtgaaagattaccgcactttgattggtacaacgaatccagaaactgcagaagaagggacaattcgtaaagattttgcattaagtcagcgtgagaattcggttcacggatcagatagtatagaaaatgcaaatcgtgaaattgcttatttctttactgattgtgaaatttttgagcgttaattgatagcaaaaagcacctaaaagttttaggtgcttttaaagttttaatgcttacaaaattagactttcttaaggtttatagatgaactcaattccttcatcatcttcttcagtccaatcgtcatcccaatcttcgtcatcatcaaattgataccccgctagttgttcctgatgataatcttcccatttgaattttacttcttcaggtgcaacttgttgtgtttcagcttcgcgtggatttgctatgataaagtccataatatcacgacaaagtggtggaacatttttccttgttgcagctgaaatcaggtaatagtcttcttcccaacctaattgttcagtgatttctcgaacccgctcttcagcttcttcatcgctcatcgtatcaattttattgaacactaaccaacgtggcttttctgataatttttcactgtattggaaaagttcagattcaataatagcgacattatctgctggattagatccatcaattggagcaatatcgactaaatgaataagcactctacaacgttctaaatgttttaaaaagcgaattcctagcccagcaccatctgcagccccttcaattaatcctggaatatcagcgactacgaaactgtgtgaatcgtctactttcacaacaccgagacttggtactaaagtagtaaatggataatctgcaacttttggtttggctgctgaaacggcacgaataaaagtggatttaccagcattaggtaaaccgagcattcccacatcagcaagtagcattaattccaataataaatcgcgtttttcgcccggcgtacccattgttttttgacgcggtgcacggtttactgatgatttgaaacgagtattccctaaaccgtgataaccacctttggctaccaacattttttgaccatgttgggttaaatcccccaaggtttctttggtgtcgttatcaatagcacgagttcccacgggaacaggtaaaataatatctttaccgcgacgtcctgtacaatctgaactccgtccattctctccacgctctgcggcaaagcgtttattaaagcgataatcgattaaggtattgaggttttcatcggcttgtaaatagacatcgccaccatcgccaccgtcgccaccatcagggccgcctttcggaataaatttctctcgacggaaacttacgcaaccgttaccaccatccccagcctcaattcgaataagggattcatcaataaatttcattaaaacttctccaaaataaaccgcactttaatgatttttatgcggtaataatttatgtccaatcgcggataaaattgccccgcatactacaacaaatgcgccaatatagctaatattattcaattctggtgctgcaaaatctactgggctaaaataatgggcaatatgtgaaaataggatcgtgaaaagaggtacaagtgtgataacaacactgacttttgatacatcccaacgattaagtgcctccgcataagagccgtatccaattaaggtatttaaacagcagtaaataaaacaaatcagagctaaaggtgtgagttcttgcacttgcgagaattcagccatcggcataaagactatggcacaacctaaatacatcattagcaagatttgttgtgaattaaatttacgtaacattaatttttgcgccattccataagcgacccaaataagagcgccccctatacttaaaatgacacctgttgaatactgatttagtccagaaaatacagcaaaacgattattaaagaataaacttagaccaattaacaataagaaaagcccgatcttttggtgcaaccctaatttttctttgaaaatcagtacaccacagatgagcattccaaaagaggataaatgaataaaaatttgtgcaactgacggttcaatgtaattcagcgagctactaaataatagaaaattgccagtaagaccaattactccaataagcataatccacgcatattggcgaactttcattaattcaggtaattgttttttataagcaagtaaagccaataatgaaactgcagcaataatgaaacgataccatacgatagtttgcgcattcattacagacaaaacttgtttcaaggcaataggcaatgacccccaagccatagcggtaataagcgcaaaggtaaagcctaataaaggttgttgtttcattgcttgctcgcttatgtgaaattaaaaagacaaaacgccccacaaaattgtagggcgtttcaatggaatagattttaaattattcagtaacaatacttacgtatttacggcttttctcgccttttacttcaaatttaactttaccatctgcagttgcgaataaggtgtgatctcttcccattcctacgttgttacctgcgtggaatttagtaccacgttggcgaacaataatgctacctgctaatacagattcgccaccgaaacgtttaacaccaaggcgtttagcttcagaatcgcgaccgttacgagttgaaccaccagcttttttagttgccatctacttgatctcctctgaaattatgcttgaatcccagtgattttcacttctgtgaaccactgacgatgaccttgttgtttacggctgtgtttgcgacgacggaatttaacgattttaactttctcgccacgaccttgtgcaattacttcagccactacttttgcgccagcaactactggtgcaccaattttaacatcttcaccattaacgaccatcaacacagaatcgaactcaactgttgcgccagttgcaagttcaagtttttctaaacgaacaacttgaccttcgctcacacggtgttgtttaccgccactttggaaaactgcgtacataaatactccgcttaattgtgttttcctgctttttagcagtccacacttaaaaattcacataaataggtcgcaaattctacggaaaaatcctacctatggcaagaatttatttataataaaataaaaaaattcccttcatttgcggattgatttcagaaagtctgaaaattcgggtaaaatgcaccgcacttttgactgataaatgatgaaaaatgaagaaacaagatcttatgagcatagacgagatccagaaactagcagatccagatatgcaaaaagttaatcaaaatattcttgctcagcttaattcagatgtaccgctaataggacagttaggtttttatattgttcaaggtggtggtaagcggatccgcccgttgatcgcagttctcgcagcacgctctttagggtttgaaggatctaattcaattacttgtgctacttttgttgaatttattcataccgcttctttgttacacgatgatgtcgtagatgaatctgatatgcgtcgtgggcgtgctacggcgaatgctgaatttggtaatgcagcgagtgtgttggtaggcgattttatttatacgcgtgcatttcaattagttgcacagttagaatcattgaaaattttaagtattatggctgatgcgactaatgttttagcggaaggcgaagttcagcagttaatgaatgttaatgatcccgaaacgagcgaagctaattatatgcgtgtaatttatagcaaaactgcccgtttgtttgaagtggctggtcaggctgcggcaattgttgcgggcggaacagaagctcaagaaaaggcgttacaagattatgggcgttatcttggcactgcatttcagctcgtggatgatgtattggattatagtgcaaatgcgcaagctctaggcaaaaatgtaggcgatgatttagctgaaggaaaaccaacccttcctctgctacacgctatgcgtcatggaaatgctcaacaggcggctttaattcgcgaagcgattgagcaaggtggtaaacgtgaagcaattgatgaagtattagctattatgactgagcataagtctttagattatgcaatgaatcgtgcaaaagaagaggctcaaaaagcagtggatgcaatcgaaattttgccagaaagtgaatataaacaagcgttgatttcattggcatatttgtctgtagatagaaattattagtccataatttagcttatatacttgatacccattaattttaattaaactttatgaatacagaacttcaacctaaactagaaaaaagtgcggtcaattttcaagctaaaccgcgaaaacaaaaaatccgtaaggatcctaacgcaccttttattcgtgaaaaacttgagttgccagatggacacaataagctccttttgcattcttgttgtgcgccttgctctggcgaagtgatggaagcaattcttgcatcaggcattgaatttacgatttatttttacaatccaaacattcatccactcaaagaatatttgattcgtaaagaagaaaatatccgttttgcaaaaaaatttggtattccatttattgatgctgattacgatcgtcaaaattggtttgatcgtgctaagggtatggaatgggagcctgagagaggtattcgctgcacaatgtgttttgatatgcgctttgaaaaagctgctgaatatgctcatgaacatggtttccctgtatttactagttgcttgggaatttctcgctggaaggatatgaatcaaatcaatggctgtgggcatcgagctgcggaaaaatatgatgatgtagtttattgggattataactggcgcaaggaaggtggttcacagcgtatgattgaaattagtaagcgtgagcggttttatcaacaggaatattgcggttgtgtgtattctttacgtgatagtaataaatggcgagaagagacgggtcgtcaaaaaattgaaatcggaaaattatattatagtgctgattaaaaaatagaaaaataaaggtgttgtttcacagaatttgctgaacagcaccttttatttcactattttatcacttcatcttgatcataatgattaatttttaaacgttgaaaataatcttttgtttcttcaatgatcacttttcgcaatccaataagcgcaataagatttgggaaagccatcaaaccatttacaatatcggcgataatccatattaaatttaagtgtaagaatgcccctaaaccaaccaacataatataagctagacgatatagttttacgccacgaataccgacgagataaacaaagcaacgttccccgtagtaacaccaacctaaaatagtcgtgaatgcaaaaaataataaaccaactgttacaatcgttgcaccaattgatgtgcctaaaccttgtgcaaaggcatagtttgtgacggtagcacccgctaattcaggattgttccacgctcccgttaataccaatacaatacctgtcattgtacagacgatgatggtatctaagaatgtacctgtcatggaaattaagccttgtcgcacaggttcacgagtttgtgccgctgcagctgcaattggtgcgcttcctaaaccagattcattggagaaaatgccgcgcgcaacgcctgattgaatcgctttcatcacagtaagccctacggcaccgcctaatgctgcttgcggatcaaaagcactatcaataattaataaaatcgcatctggtactttttctatatttaaaaggataataaccagtgaagtcgtgacgtataaaatcgccataaacggcacaattaccgatgatgcggttgcaatacgttttacaccgccaagaataattaagccgactaaaagcgtcacaataattgcagtaactaaaactggaatattaaaagtatcttgcattgcatgggtaatcgcattgacctgtgggaatgtgccgatcccgaaaaaggccaccatcacaccaaataatgcaaataattttgctagccatttgatacctagtccgcgttcaatgtaatacatcgggccgccagccataaagccatttttatcgcgaacacggtatttaacagcgagtaaacattcagcatattttgttgccattcctaacaaagcaaccagccacatccaaaaaatagcccctggcccacctgcttgtaccgcagttgcaacgcccacaatattacccgttccaattgttgctgctaatgcagtacaaagtgcagcaaaagaggaaacgtctccttttccacctttatcttttttaaataaataacctagcgcacgcggtaagtagcgaatttgaataaagcctaagcgtaacgttaaatagagtcctgtaccagataataatataagtagaggtgcgccccaaataaagctatcaatagctgaaagaattgactcaattgtcattgtgattcctcgtcgtttaaatcaaaaataaacacgacaagaagacgaaaagatacaatggaaaagaaagtgcggtaaaaaaatgaataatttccacacttacaatagattgtcttttgcccctgtccttttgcctgagcgtttgaaaaacgattgaaaaattaaccgctcttttgcgccttcggcgtccatttctaaaatggatctctccaagggttcgtccagtaacagtccctgccatcgcacctgaaagattttacatcgtcggtgtggggtcaattccccgctctccagctaccttcatccgaactcactttccattagatattgaaaagtgtgcgaattctaacaaaacaggaaatgaatttcaaaaaggaatttttatgtagaaaaatcacttcattcaatatctccgcaaaagcgatagccttctccatgtatagtcataatgatatttggagtatttggatgatcttcaaaatgttttctgatacgtcgaattgtgacatctacggtacgatcctgaggttttaactctcgtcccgtcatttttttcagcaattcttcgcgcgtttgcaattttcctggattttcacagaaatgtaacattgcacgaaattcactgcgaggaagtttgaattcttgtccttctggtgtaattaaactgtggctatttaggtctaatttccaaccattaaaacgatagaattctcgaccaaatgtattttctttttcttgatgcgacattgtgcgatgcaatagattacgtgcgcggatagtcagttctctagggttaaaaggtttggttaaataatcgtcggcaccaatttccagacctaaaattttatccacttcattatctcgaccagttaaaaaaataagaggtaagcttaattcttcacggagttctcttgccaataataagccgtttttgcctggtaaattaatatccatcacaaccaaattaatattatgatttgccaatatatgatgcatttcaacaccattttctgcttcaaacacatcatatccttccgcttcaaaaatccctttaagcgtatttcgagtgacaatttcatcttcaacaacgagaatttttggagtagtcattttccatccttatacttattttggcgtatgctatcaaagctatcattctatctgtgcaacattattgtaacaataaaaaagtgcggtgattttttacctgattttcctttttgtgatctaaatcatagttttaggtattcaaatttctttgtgatagaatttcgagcatctatatttttatactcaattctatgaaaaaactctttcttttttttacgctgattttcaccgcttttgcggctaattcaggtttattcgataaaaaacaaacctttttaaaagtagatgatgcttttgctttttctgctactttatctacagataaaagccagttacaagcccattgggatattgccgatggctattatttgtatcaagataaaattagtgctgagttagtcggtaaatcaaatcctctctctttacatacccaacaggcggcggaattacatcaagatccttattttggcgaagtaaaagtttttactcactcaattgatggcatatttaggggcacatttaataatgctgatgataaggttgaaatcacttatcaaggatgtaccgaaggtttttgctatccgcctgaaactaaagtattacgaattggggatttagccgtttctcaagagcaaattgtcgaaaaaacagttgaaaaaaataccgcacttttatctgaacaagatcgtttagctgatggtttattccatagtaaatggacaatttttggtttctttttattaggattgggactggcttttacgccttgcgtattgccaatgttaccgttgctttctgctattgttatcggtcagcaacaacgtccaaatatgatgcgagcgtttagtttagcttttctttatgttcaaggcatggcactgacttacaccttgttagggctcgcggtagcggctatcggtttgccgtttcaaatcgccttgcaacatccttatgtgatgatagggctttctattttatttgttgctcttgccctttcaatgtttgggttatttactattcaattgccaaatagcttacaaaataaactcaatacatggagccaaaaacaaacctcgggtgcttttggcggagcctttgcaatgggaatgattgctgggctggtggcatcaccttgcacatctgcgccactttctggtgctttactttatgtggcgcaaagtggcgatttattcacaggcgcagcaaccctttatttgctcgcacttggtatgggcgtaccgctaatgttaatcacattgtttggtaataaaattttgccaaaatcaggtgagtggatgaacacagtgaaacaaacattcggctttgtgatgttagcgttacctgtatttttactttctcgtattttgcctgaagtatgggaacctcgcttatgggctgggttagcgacagtattttttatttggtttgcgttgcagatgtctaagaacggttttggttatgctattaaaattattagttttgcgttggctatggttactgtacaacccctgcaaaattggatttggcaaactcaaactacaacacaaagtgcggtagaaaatatgcctgtttctcaagttaaatttaagcaaattaaaaatactgaagaacttgaccgcactttagcggaaaatccgcattcaattgctatgttggatttatacgcggattggtgtgttgcttgtaaagaatttgaaaagctgacgttttcagatccacaagtgcaacagcaatttcaaaatatcttattgttacaagtgaatatgacaaagaatagcccagaaaataaagcattaatggaacgctttaatgtgatgggattgcctacgattttattttttgatcagcaaaataatgaaattcaaggaagtagagtaacgggctttatggatgctgatgctttttccaattggttaaaagccttgcattaagttagaattatttacaataagtaaaaactctttttctgttatacatcttgtttaacaaatagctaatcattactatagctgggttttaatttatctttaaacgaaaggaaagcaaaatgaacaatcttgaaaaatatcgcccttatttcttggcatttttacgtatcgttgccgcttatatgtttattttacatggcacagcaaaacttttggaatttccaatttctatgactggaggaaatggtgcagtaggcgatccaatgctactagtggcaggcgtaattgaaattgttggttccattttattaatcttaggtttatttacacgccaagctgcgtttattttgtcaggggaaatggcgtatgcctatttctttatgcacgtagcaggaaaaggaaacctatttttcccaattgcaaatggcggcgagcttgcattactttactcagttctctttctatattttgtattttctggcgcaggtgcttgtgctttagataataagttttttaaaaagtagtttagttgtagtttcataattttatccttatttttgcccacatttatgtgggcttttttatgcctgaaatttatcgcattttttaccgcactttaagaaattatatttaatcttttctatatttaagcaaacgtttgcgttataatccaactcgcttatttttaaccatttaatgaaaggaaaatacaatgacagatcgtccaattcgtcaggctttactaagtgtgtctgataaaacgggtattgtagagtttgctcaaggtttagttaaacgtggtgtaaaactactttcaacaggtggaacggcaaaacttttagcacaaaatggtttacctgtaattgaagtgtctaattacacaggtttccctgaaatgatggacggtcgagtgaaaaccttacatccaaaaatacacggtgggattcttggtcgtcgtggtacggacgatgccattatgcaacaacatagtattgaaggcattgatatggttgttgtgaatttatatccctttgcagctaccgttgctaaaccagattgcaccttgactgatgcggtagaaaatatcgatattggggggccaaccatggttcgttctgcggcgaaaaaccataaagatgtagcgatcatagtgaataataatgattttaacgccattcttacagaaatggataaacaccaaaacagcctaacttttgaaactcgttttgatcttgcgattaaagcatttgaacataccgctcaatatgattctatgattgccaactatttcggtcagctagtaaaaccttatcatattgcagaggaagaagaggcgaatgcgaagtgcggtcaattcccacgaactttaaatcttaatttcgtgcgtaaacaaactatgcgttatggcgaaaattcccatcaaaatgccgccttctatgttgatttaaatgtgaaagaagcgagcgtggctacggctaatcaactgcaaggtaaggcattatcttacaataatattgccgacaccgatgctgcacttgaatgtgtgaaagaatttgatgagccagcttgtgttatcgttaaacacgctaatccgtgtggtgtggctttaggtaaggatattttagatgcttataatcgcgcttaccaaaccgatccaacgtctgcttttggcggcattattgcttttaaccgtgaattagacgaaaaaacggcgaatgaaattgtggaacgccaattcgttgaagtgattatcgcaccgaaagtttctgctgaagcgcaagaagtaatgaagcgtaagaaaaatgtgcgtttgcttgaatgtggtgaatggacttctcgttccgaacgtttggatttcaaacgtgtaaacggcggtttattagtacaagatgcggatttaggtatggttggcgtggatgatttaaaagtcgtgagtaaacgtcagccaactgaacaagaattaaaagacttattattctgctggaaagtggcaaaatttgtgaaatcgaatgccattgtttacgccaaagacaatcaaactatcggcattggtgcaggtcaaatgagccgtgtgtattcggccaaaattgcaggtatcaaagcacaggatgaaggcttgaccgtggcaggttgtgtgatggcatctgatgcgttcttcccattccgtgatggcattgatgctgcagcgaaagtgggaattcaatgtgtgatccatccaggtggttcaatgcgcgatcaagaagtcatcgatgcggcggatgaacataatatggtaatggtattgactggaatgcgacattttagacattaatttatctaactatccccctctttacaaaagagggggaattgcaggtaaaaaatagccgtactttttttaaattaggcatacgcaaggactacaacatgaacatcctcatcatcggaaacggcggtcgtgaacacgccttggcttggaaagttgcacaatctccattagcagataaagtttttgtcgcaccgggtaacgctggtactgcattggaacacaaagtagaaaacgtgaatatttctgcgacagatattccagcattagtgaaatttgctcaagataaacaaattggattaaccattgttggtcctgaagcccccttagtgattggggtagttgatgcatttcgtgaagctggattgaagatttttgggccagctaaagcggctgcgcaattggaaggttcaaaggcattcactaaagattttctcgctcgtcataaaattccaacagcggaatatcaaaacttcaccgaagtcgaacctgcattgacttacttgcgtgaaaaaggcacaccaattgtcgttaaagcggatggcttggcggcgggtaaaggcgtaatcgttgcgatgacattgcaagaagccgaagatgcagtacgcgatatgctttctggtaatgcctttggcgaagcgggcagccgagtagtgattgaagaatttctagatggcgaagaagcaagttttatcgtcatggtagatggtaaaaacgtagaacctatggctactagccaagatcataaacgcgtgggcgaaaatgatacggggttaaatacaggcggtatgggcgcgtattcgcctgcaccagtaataacacccgaaattcatagtcgcattatgaaggaagtgatttacccaaccgttaatggcatggcagcggaaggcagtgtttacacgggtttcctatatgcaggattaatgattatgccaaatgggcagccgaaagtgatcgaatttaattgtcgttttggtgatccagaaacgcagccaataatgctacgtctcaaatcagaccttgttgaactctgtcttaaagcatgtgacggcaaattagatgaagtaatatcacaatgggatccacgagcttctttaggtatcgtattggctgcagagggatatccaaaggattatcgcaaaggcgatgaaatcagcggattgcctaaaagtgcggtcaaaaacgagaaagttttcttagcgggtgtcgcagaacaagaaggcaagctagtcacaaacggcggtcgtgtactttgtgtgactgcgttaggcgaaagtgtatttgaagcacaacaaaaagcgttaaaattggctgagcaaattcaatggtctgggcgtttttatcgtcgagacattggttacagggctgtggaacgagaacaagcaaaatagttagaaatcttgttgaatttaattagataaaaaatattgtacagggtagaattgtattttcctaggatttaggattttgttagggcaacgtttacgattgctctgacaataaattagaattattattttgttactttatgaggttatatcaacttatgcgacaatttgtcatcgtagtattatattctgcaattcttctttcattagaagttatttatagaaaattatttaatatttctagtattgagagatacactgaaagttatttgtctgtctgtttgtctgtttgtttgttttttcaaaatatagaattacaagaatattagttggcgctttatttgcaataagtattgttgttaataatgtacattatgcagtataccaatcttggattggacctgttaattactcacttgcatttaaagaaattaatgagataacaaatgctggcttaacaatgatagataaattcatatatccattgttatttggtttatttgaagttgctgtgtttttaagtttaagtttcataaaaagaaaagtatataaactttcttggatttttgactttattttttatgctgtgatgatgtatgtttttgttcgagcgtatacaacaaaatcccatgagcgttttatttcacctaacactgtttattctcgattaaaatccaattatttatcgttgggttattttataggacgaattgttccttatgagatattttctttatctaatattcctctttatcataaatctaagcctatgaaatcgggctctccgaaaattaagaatataattttaattatgggggaaagtgcgacctcaagtcattttagtgcttttggttacgggagaaaaacatctccttttttagatagcttaaaatataaatcaggagctcttgttggtaaaacttattcaggaggaaagctaacagcaatttctttaccaatgttttttaatgcaattccttatccaaatggaatacaacagatagctaaaggagatacgaatttatttaatttagcgaaagagcaaggctttcagacatatttttattcagctcaagctagggatgatatgcatatgatcaattttttaggaggagcttggattgatgatattcgttttccagataatgaagggtattctttaagagattcaatgcctgataataaattacttcctgcttttaaaaatattaatttagataatggttatcattttgttgttttacatcatagagggagtcatattccctatggggcattattagatgaaaaagagaaggtgtttggaaaaaataacgcaacagataattatgataatactattctaaatactgataactttatctcagaggtttaccattacttatctaataaatcttctaaagattggataattgcctatacatcagatcatggtcaatatgtaaaaggcgacacttataagcaagggacatttgatgaagataattatattgtgccattagttctatatagtccaaatgaagaaatacagaaactagtgttggacaattttgaatcatgtaagatttcatttcataatcagttatctagctttattattaatataatgggatataactattcagttagcacttgcgataagggggttgttaatggaaatattctcacaggtgatgctggatacctaaaaatagaatctaatggtaaacaagagtatgttcattaaattagacgctatgatgaattaatttcatttaagtaatgaaaatttaggaatgaaattttaattaagtttttatccataaacagttaaactatctgccataaattacataacaggagaacacaatgtttacaagaaatatgactatcgctgattacgatccagtattgtggcaagcgatccaagatgaaaatcgtcgtcaagaagaacatatcgaactcattgcatctgaaaactatgcgagtccacgtgtgatggaagcgcaaggttcacaattcactaataaatatgcggaaggctatccaggtaaacgttattacggtggttgtgagtatgcggacattgtggaacagttagcaattgaccgtgcgaaagaattatttggtgcagattacgtgaatgttcaaccgcactctggatcacaagcgaatgctgcggtgtatggtgcattgattaatgcaggcgatactattttaggtatggatttggctcacggtggtcatttaactcacggtgcaaaagtcagtttctctggcaaaatttataactccgtactttatggaattactgcggatggcttaattgattatgaagatgttcgtcaaaaagcattagaatgtaaaccaaaacttatcgttgctggtttctcggcttattcacaagttgtggattgggcgaaaatgcgtgaaatcgcagatgaagttggtgcgtatttatttgtggatatggcgcatgtagcgggattaattgcagcgggtttatatctaaatccactccctcatgcacatgttgtgacaacaacaacccataaaacgttgggcggtccgcgtggtggtttaattctttcatcttgtggcgatgaagaaatctacaaaaaattacaatcatccgtattccctgcaaatcaaggtggtccattagttcatattattgcggcaaaagcagtttgctttaaagaagcattagagcctcaatataaagaataccaagcaaatgtaatcaaaaatgcgaaagcaatggttgaggtatttaaacaacgtggttatgacgttgtgtcaaatggcactgaaaaccacttgttcttagtaagttttattaaacaaggattaacaggtaaagcagctgatgcggcattaggcaaagcaaatattacagtgaataaaaatgctgtaccaaacgatccgcaaaaaccattcgtcacttctggcatccgtgtaggtacaccatctgtgactcgccgtggtttcaatgaaaatgatgtgcgtgaattagctggctggatgtgtgatgttttagatgctttaggcaaagaaaatgaagaacaagtgattgctgaaactaaagaaaaagtattagcaatttgtaaacgtcttccagtttatccgaaatgatttattttctttcgttgattatatgtttagcggcgattaatatcgccgcttattttttatgggaaattatatgacttatattgttggcttaactggtggcattggtagtggtaaaacaacgattgctaatttatttaccgatcttggcgtacctctagtggatgcggatgtggttgctagagaagtcgtcgcgaaagattcccccttattgtcaaaaattgttgaacattttggggctcaaattttaacggaacaaggcgagcttaatcgcgcggctttacgagagcgagtgtttaaccatgatgaagataaattgtggttaaataaccttctacatcccgctattcgtgaacgaatgaaacaaaaattagctgaacaaactgcgccttacacattatttgtcgtccctttattaatagaaaataaattgaccgcactttgtgatcgtattttggtggtggatgtgagtccacaaactcaacttgctcgttcatcacaacgagataacaataattttgagcaaattcaacgaattatgaattctcaagtttctcaacaagagcgtttaaaatgggcagatgatgtgattaacaatgattctgaactggcccaaaacttaccgcacttgcagcaaaaggtgctagaattgcaccagttttatttacaacaagcggaaaataaaaatgcctgacgaaatgattgaagtaccttgtccgatttgccaaaaatcggtgccttggataaatgaaagtacttttcgacctttttgtagcaaacgttgccagttaattgatcttggcgaatgggcggctgaagaaaaagcgattccaagtgatactgctgattttgcaatggatccaaatgtgagtgacggatggagcattaaatagagattaaccgataggaaaccctatcggttaatttttataagtgcggtgctttttttgaggatttttcctaaaaatgctatgctaaacgtgattttattattctaaaatgtgatttttatgcaacaagattatttaagccaacaacgattctccgctcttcctctacatccgattgtgcgaggtgctttggcaaaaaaaggctttgatttttgtaccccaattcaggctttatccttgcctatcagtttaaatggacgagatgttgcaggacaagctcaaacgggtacaggcaagacaatggcttttttaacggctacttttcaccatcttttaactcaccaagatcctaatcttgaatatcctcacccaagaactttgattttagcacctactcgagaattagcggtacagattagtaatgacgcagaatttcttgcaaaagcgagtggattaaagaccgcacttgcctatggtggcgatggttatgataaacaactacaagtgattgagcgtggcgtagatattttgattggtacgacggggcgagtcattgattatgtaaaacaaggcgtaattggtttagatgaaatccaagttgtcgtgctagatgaagcggatcgaatgtttgatcttgggtttatccgtgatattcgttatttattgcgtaaatgccccgctccgcaagcgcgtttaacgatgttattttcagcgacgctttcttataaagtgcgtgaattagcatttgaggatatgaatgatcctgaatatattgaaatagaaccggaacaaaaaacaggtcatcgtattaaagaagaacttttttatccatctaatcaggataaaatggcacttctcttaaccttaatggaagatgaatggcctgagcgctgtattgtgtttgcgaatacaaaacatcgttgtgaagaaatttggggttatttggcggctgatggacatcgtgttggtttactgactggcgatgtagcccagaaaaaacgtttatcgttattaaaacaatttaccgacggtgatttagatattttagtagcaacagatgtggctgctcgtggcttgcatatttctgatgtgacgcatgttttcaattatgatttacctgatgatagggaagattacgttcaccgaattggccgtactggacgagcaggggaaagtggcgtttcgattagttttgcttgcgaagaatatgcgatgaatttaccaggaattgaagaatatattggccattctatcccagtgagccaatatgaaacagaagccttgcttgaactgccgaaaccgtatcggttaaaacgtgcagtaccaccgcaagggcatacaagacatcgttcttatcacacaaaataaggtagcctcattctacaccttgatttgatgatgaaaagtgcggttaattttgactgcattttatattcctattttttatatcctcctttgtttatcattcatcttatgggtttacggattacctacagataagtattgttacgctttttgttttttaacttgccaaaaaataaaaaataaataaaatgaacgtccattcatttttgagcaattattgctccttattttactcaaggatcttatgcgacaagctaaaactgatttagccgaacaaatttttcttgctaccgatcgtttaatggcaaaagaaggtttagatcggctttctatgcataaaatcgcaaaagaggcaaatgtagcagcaggaacgatttacctttatttcaaaaacaaagatgagttgcttgaacaatttgcacatagagtgttttcaatgtttatggcaacacttgaaaaagattttgatgaatctaagccttttttcgaacagtatcgacaaatgtggaaaaatatttggtatttcttacaagaaaatcccaccattctatccaatttaaagcaatatgaatctttgcctaatttcaaggatatttgtaaaaacgttaaaaattgtcgttgggatttattttgtgaccaagccaaaaaagctggcttattagcggaattatctgaagatattctctttttattaagtttgaaaacggcgataaatttagcctctgatgcaaaatttatcgatttcgatcttaagcctgaaattttagaatctgtgattgaacgctcttggcgtgcgattcagaaataattgttgttatttttataacggagctttaaacatgagtcaaactcaacatcaaagaccaaaacgctcacatattttcttgatgaaaataattttagtggtatttgtcttaatttttgtcggtgtcatcggttttaatataataaaaggcgtaatgataagccgagccattgcagaaatgccagaatcttcaagcccagtaaccgcacttgaagttcaaccgcgtgaatggacgccagttattaacacaacaggtcttgtgcgtccaaatcaaggcgcattgctcagtacacaaaatgcaggtacgatttctcaagtacttgtgcaaaatggacaaaatgtgaaaaaaggtgaggtgcttgtggaacttgatagttctgttgaacgagctaatctacaagctgctcaggcacaattatcagcacttcgtcaaacttaccagcgttatgtgggtttattaaacagcaatgctgtatcacgtcaagaaatggataacgcaaaagcggcttatgacgctcaactagccaatatcgaatctttaaaagcagtaattgagcgccgtaaaattgttgcgccatttgatggcaaagcaggtattgtgaaaatcaatgttggacaatatgtgaatgttggaacagaaattgtgcgtgtagaagatactagctcaatgaaagtggattttgctctttcacaaaatgatttagataaattacatatcggtcagcgcgttacagcgacaacagatgctcgcttgggcgaaacattttcagctcgaattacggctattgaacctgccattaattcatcaacaggtttagttgatgttcaagctacatttaatcctgaagatgggcataaattgctttcaggtatgttctctcgtttacgcattgcgctaccaactgaaacaaatcaagttgtcgttccacaagtagctattagctacaatatgtatggcgaaattgcctatttacttgaaccattatctgaagaagaaaaaggaaaaatgtcaggtaatgaaaaattggatcgtctctatcgtgcgaaacagatcaccgtatttactaaagatcgtcaaggtgtttatgctcaattacagggaaatgaagttaaagcgggagataaaattattacaggcggtcagcaaggtattggtaatggaagtcttgtggaatggattaaaaaagacattgtgggtgcagtagagcctgcacataaaacaccactttaatgtatgaggaaatccgaatgaaatttaccgatatatttattcgccgtcctgttttagcagtttcaattagtttgttaatgattattttagggttgcaagcaatctcgaaattggcagtgcgtgaataccctaaaatgactactacagtcattacagtgagtaccgcatatccaggggcagatgcgaatttaatccaagcatttgttacgtcaaaattggaagaatctatcgcgcaagccgataatattgattatatgtcttcgactagtgcgcctagtagttcgactattacaataaaaatgaaattaaataccgatcctgcaggcgcgttagcagatgtgttagccaaagtgaatgcagtaaagtcagcattaccaaatggtattgaagatcctagtgtatcctcttcttcaggtgggagcggtattatgtatatcagtttccgatctaaaaaactagattctagtcaggtaactgattacatcaatcgtgtagtcaaacctcaattctttacgattgaaggcgtggcagaagtacaagtatttggtgcggctgagtatgcattacgtatttggctagatccacaaaaaatggcagctcaaaatctttctgtgccaacagtgatgtctgccctttctgcaaataatgtacaaacggctgcggggaacgataatggctattatgtgagttatcgtaataaagtagagactacaacgaaatcagtggaacaactcagcaacttaattatttcatcaaatggcgatgatttagtgcgtttgcgtgatattgcaaccgttgaattaaataaagaaaatgataattcgcgtgctacggcaaatggtgcagagtccgttgtgttagccatcaatccaacctcgacagcaaaccctttgactgtcgcagaaaaaattcgccctttatatgaaagtataaaaacacaactgccagacagtatggaaagcgatattctttatgaccgcactattgccattaatagctctattcacgaggtcataaaaactattggtgaagctactttgatcgttttagtggtaattttaatgtttatcggttcgttccgtgctattttaattccaatattggctattccaatttctcttattggcgtattaatgctgctacaaagtttcaacttttctattaatttaatgaccttgcttgctttaattcttgccataggtttagttgtagatgatgctattgtggtgctggagaatattgatcgtcatattaaagcgggagaaacgccattccgagcggcgattattggtacgcgtgaaattgccgtgcctgtaatttctatgactatcgcattgatcgcagtttactcaccaatggctttaatgggggggattactggcacattgtttaaagagtttgctttaacccttgctggtgcagtatttatttctggtgttgtggcattaacgttatcgccaatgatgagtagtaagttactcaaatccaatgctaaaccaacatggatggaagaacgcgtagaacataccttaggtaaagtaaatcgtgtttacgaatacatgcttgatctcgttatgctcaatcgtaaatcaatgctggcttttgcggtcgtgattttctcaacgctcccatttttgtttaattcactttctagtgaattaacgccaaatgaagataaaggcgcatttattgcaattggtaatgcgccatctagcgtaaatgtggattacattcaaaatgcaatgcaaccatatatgaaaaatgtaatggaaacacccgaagtctcttttggtatgagcattgctggtgcgccaacttctaatagctcgttaaatatcatcacattgaaagattggaaagaacgttcacgtaaacaatccgcaataatgaatgaaattaatgaaaaagcaaaatcaattccagaagtgtcagtatcagcatttaacattcctgaaattgatacaggggaacaaggcgctccagtctctattgtattgaaaactgcgcaagattataaatctttggcaaacaccgcagagaaattcctcagtgcgatgaaagcctctggcaaatttatttatacaaatttagatttgacctatgacacggcgcaaatgacaatttcagtagataaagagaaagctggtacttacggcatcacgatgcaacaaatcagtaatactttagggagtttcttatctggtgcgacagttacgcgtgtggatgtggatggacgcgcttataaagtcatttcgcaggtaaaacgagatgatcgcttatcgccagaaagtttccaaaattattatttaactgcatctaatggtcaatcagtgccattaagtagtgttattagtatgaaattagaaactcagccaacatcattaccgcgtttcagccaattaaattcggctgaaatcagtgctgtaccaatgccgggtatatcaagtggtgatgccattgcttggcttcaacaacaggcaaatgataatttgccacaaggatacacttatgatttcaaatccgaagctcgtcaattagtacaagagggtaatgcacttacgacgactttcattcttgctgttgtaattattttcttggtgcttgccattcagtttgaatctatacgtgacccaatggtaattatgatttccgtaccattagccgtaagtggtgcattggtgagcttaaatattttatccttctttagcatcgcaggaacaacattaaatatctactctcaagttgggttgattactctcgtgggattaatcactaaacacggtatcttaatgtgtgaagtggcaaaagaagaacagctaaactatggtaaaactcgaattgaggcaatcactcacgcggcaaaagtgcgtttgcgtccaattctaatgacaacggcggcaatggtagctggcttaattccattactctatgcaacaggtgcgggagcggtatctcgctttagtattgggatagtgattgtagcgggattatccattggtactattttcaccttgttcgtcttgcctgtggtatatagctatatcgcaactgaacacaaaccattaccggtttttgatgaaaataaaacaacccactaattaaaacatagaaaaaacaaaccgcacttaggttatcttacgtaatttgtacttataaatagttgttttatccaacttttttgagcataacctgtataagtgcggtatttttttattctgttaattatataaataatccacttatgttagtctttatttaaagactatttttcagtaaacttagcgaattttgttgaattattaaaattatcacttcaaatctaggaatttattgtggcacatcgagattttgctgcgcgtcgtagctcaaataataagaaaaaaaataagaaaaagaatacaaatgtcttgatttttcttgctttatttattgttctagtttttgttgttggactttatttgttgaaaaatcagaacagtaaggtaagcgtgcagcaagctataacacaacaggaaaaagctcaacctaaaagtgtgttacctaatcgtccagaggaagtgtggagttatattaaagccttagaaacgcgtactgtacctgtagataataatccagcgagtgtagaacaaaatatgcgtttaacagaagaacaacgtcaagttttaattcaaatagaaagagatcaaaaagcggctgatgaagctagaaaactggctgagcaacagagaatagaagatgcaacgagaactcaatccaaaaaaacggaagatatgaaaaatacagagtcagaaatcgtaaaattggaatcaattaaaaagcaagactcacagaaaattgaaagcgcaaaaaaagtagaacaaataaaaacggttaataatgtacgggatagcaagaaatttggtttacaatgcggtgcttttaaaaatcgagcgcaagctgaaaatttgcaaggtcgtttacagatgacaggattaaatgctcaaatacaaactaacggcgaatggaaccgtgttcgtgtagcaagttttgatactcgagagcttgcagtacaggcgcaaagtagagctaaaactgttaccgattgtgttgtgattggtatgtaatatatatttattttaatgctgagtactaaaaggtggttttgcaaaccaaatcacaataagcaatcctaagaatcccatagctgataaccaaaatatttcatttgcgccaataataaatccttgcgatgttatttgttgagcgaggtaagctgaagtttgcgtatcacttaaaccaaattgattcatttgatggtaaaaactttgggaaatcgggttataaggattaatgtgttctgttaattgagtgtggtgaacagcttcacggttataccacataaatgtggtcaaagatgttcctacagaacccgctaaagttctcaaaaagttaaataagctagaggctgaagccattttatgcgcaggcaagccagacagcgttattgtagtaagtggcataaagaaacaggacaccgctaaaccttgcactaattgtggtaaagctacatcaacaaatgtcattgatggctcgaaagttaccgctcgccaataaaatgttattgcatatacaataaagcttatcgtcactaaaattcgcatatcgatcttataaccgaaacgcccaataatcggtgaaagcaaaattgggaataatccaactggggaagccgcaagccctgcccacgtcgcggtgtaatggaagacttgttgtagcaagagcggaattaataccacagaacctagataaatcaaaaaggctaaactagtacataaacaccctacgctaaaattacgagaatggaaaagtgaaatatccactacaggattgtcatctgtcaattcccaaataaccaaggcaatcagacaaacgacagcaacaacggctaatataatgatttcattagaattaaaccaatcttgctcacgaccctgatcaagcattaattgcaaacatcccactcctaagacaagtaaaactaaaccgactttatcaataggttgatgaacaatttcactttctctgcttcccaaaatcttccagctgattagcacaactaacaaaccgatcggaacattgataaaaaagatccatccccaatggatattatcgctaatccatccgcctaaaattgggccaaaaataggcgcaaccacaatagtcattgaccaaaatgccaatgccattccgcgtttttctggtggataattatttaataataaactttgcgaaagagggatcactggacctgcgacagcaccttgaatgacgcgaaaaataattaacgcctcaagactatctgcaatcccacagagccaagaagagacaacaaataaaaaagttgagactaaaaataaccgcacttcgccaaaacgttttgctaaccaacccgttattggaatagaaatcgcatttgctaccccaaaagaagtgattacccacgtaccttgactaaaagatgcgccaagatcgcccgcaatagtaggaatcgccacatttgcaatggtagaatctaatacctgcataaaggtggcgagagataaagccagtgttaataaaatcagcacaccaccttgaataggcgggaatttttttgcggaattgtccataacgccgccttaatggctgttttgctgaatgatagattcaatcaaattttctaccgcactttcatcatatttaagtgtatcagtagaaaataacgttttcggttctgttttttctcgtagcattgcgcctgatgaatctgaaattcttacttttgccgttgcagaaagaccaattctcaatggcgtttctgtaaattgttgtggatctaatttaattcgcacaggtacacgttgtaccactttaatccagttacccgtagcattttgcgaaggtaaaagagaaaacgcattgccagtccccatttcaatgccatttatcacgccatcaaattctttatttttaccgtataaatcaaaatggatttttactggctgaccaatgcgcatattcgttaattgggtttctttgaagttagcttctaaccacatttgttcattagataccaccgccattaacgcgccacccactgaaacggcttgcccaacttgaacattacgacgcgccacatagccatcaattggacttctaatttttgtacgttgcaaatttaaccaagcctgtttaagcgagtttatcgcattctgtatttgcggttgttcacgtaatggaacgttacgcaataaagcctgattagcagccaattgatttttagaggcatttaaatttgctttggcaagctcgacagcttcttttgcgtgttggaaagattctttatcaatcgcacccattttttcaagttgaactcggcgcgccaaattgccttgagcttgagctaaagaaatttcattggcgtgcacagctgattgcaattgctgcacagtgaaacccagttgttctacctgacgtacagcattggcgagattgcttttggcctgttcaaaactaagtttcgcattggtatcatccaattcaactagaatatcacctgcatggactttatccatattgtctgcattaatcttcgctacattacctgcaacttgtgatgataccattacttgatttccacccacataagcatcttctgtttcttcaaaatccttcaagaagaaaaaccaatacaaagcacaagcaataccaataataagcaggagaagaataaaaatgcttaagccttttttacggttagttttatttgatacagatttatttgatggagtttcaattgcagttttcgtcataatgtcttccctgatttgggataatgtttaaaaatgggatatttaaaactatcaaaaataaaatgaaaggtcattatgaaactttaaaaaggggaactcaaggggaaattatcatctctttgtttttgctagattaatgaatgttctagaagtattgtttcatttatttgatttattttcgggtaagaattaaaaatcggcaatcatagcgattttgtgcatctgccttacgatattcatcaaattcaatttcccactcctcccaattcaattgagggaaaaaagtatcgccatctagttctgtttgaatttgagtaaggtataacttatctgctttgggtaaatattgtttgaataactcgcccccaccaatcaacataatttcatcaaaatctctgacaaaattgaccgcactttcaaagctatctttccatatcacaccttcgtgttcaaaaagctggcgagaaagtacgatattggtacgtttaggtagtggacgaccaatactttcaaaggttttacgccccataatgacaggtttaccagtggttttctgacgaaaccaagctaaatctgcaggcaagtgccaaggcatttgattatctttaccaatcacattatttaatgttatcgccacaattaaactaaatgtcatagatccccctaaaatttgccgttactatacctgatattaagtgatttttcattgatttagtgataacgttaatgtcaattttaagaacgttggaaaggactatgaacaaaaaaacaatcgttgtgaaattcggtactagcacgctaactcagggttcgccaaaattgaattcgccacatatgatggaaatcgttcgtcaaattgcacaactgcataatgatggatttcgtatagtaatcgtgacttctggtgctattgcagcgggtcgccattatttaaatcatcctcaattaccacccactattgcctcaaagcaactgcttgcagcggttggtcagagccaattaattcaggcttgggaaaaattatttgctatttatgatattcatatcgggcaacttttattaactcgtgctgatattgaagatcgcgaacgttttttaaatgcacgagatactttacatgcacttttagataaccacattattcctgtgattaatgaaaatgatgcggtggcgactgcggaaataaaagtaggagacaatgacaatttatctgcactagtcgctattcttgtgcaagcggaacaactttatttattgactgatcaacaaggtttatttgatagtgatccgcgtaaaaatcctgaagcaaaattaattccagttgtagaacaaatcactgatcacattcgatcaattgcaggaggaagtggtacaaatcttggcacaggtggaatgatgactaaaatcattgctgccgatgttgccactcgctctggaattgaaacaattattgcaccaggtaatcgtccaaatgtaattgcagatcttgcttatgaacaaaatattggtacaaaatttattgcacaccaatctgatcgattagaaagtcgcaaacaatggcttttcgccgcgccatcggcaggcattatcactattgatgatggagcgaaaaatgccattcttgaacaaaataaatctttattacccgctggtattattaacgtggaagggcgtttttcgcgtggtgaagtagtcaaaatatgcactcaatctggtaaagacattgtactaggtatgccacgctataacagcgatgctctacaattaattaagggcagaaaatcagcagatattgaaaatgttttaggctatgaatatggtgcggtggcaatgcatcgtgatgatatgattattttgtcataatgccctttggttgataaaagcactgatttatgaaacaatcttgagctatttttataggaaaaatgtaaggtaaaacgatagtgatcgattttgatggctaccgtccaaatgtgggtattgtgatttgtaatcgcaaagggcaagtgctttgggcgaagcgttgtgggcaaaattcgtggcagtttccgcaaggtggcattaatgataatgaaagtgccgagcaagcgatgtatcgcgaactacacgaggaagttggtttacaacctaaagatgtgcgtttgttatatgtttctaaacattggttgcgttataaattgccaaagcgtttattgcgttatgatagcaagccgatgtgtattgggcagaaacaacgctggtttttgctacagcttgttggcgatgaaaaaaatatcaatatgaaaacgaccaaatcgccagaatttgatgggtggcgttgggtaagtttttggtatcctgttcgtcaagttgtgtcttttaagcgagatgtttatcgaaaggtaatgaaagagtttgcttcggtattatttacggataatccaccaatattttccgcatctcgtgaagcaaattcacagtctaattcggcaaataaaaaatattctcagacaaaatacacaaaacgccatttttacaaatcaaaaggtcaataatgttcacttttattcttctttgtttacttgttggtgcattagcgggttttcttgcaggattatttggtatcggcggagggttagtaattgtgccaaccttagtgtatttactgcccattgtagatgtaccagaatctttgttgatgtctaccgcacttggcacatcatttgctaccattgtgattactggcattggatcggcacaacgtcatcataaattaggtaacatagtctggcaggcagttcgcattttagctccggttattatgctttctgtctttatttgtggtttatttattggaagacttgatcgtgaaatttctgccaaaatttttgcttgcttagtggtatatttagccacaaaaatggtactttcgattaaaaaagatcaagtgacaacaaaaccacttaccccccttgcttccgtaattggcggtattttgattggtatggcatctagtgctgcgggaattggcggtggtggatttattgtgccgtttttaactgctcgtggcattaatatcaaacaagctatcggttcttccgcattttgtgggatgttattgggcgtatcagggatgtttagttttatagtgagtggttggggaaatccattaatgcctgaatattcgctcggttacatttatcttcccgcagtgttaggtattactgccacttcattttttacttccaaattaggcgcaagtgcaaccgctaaattgcctgtttcaaccttaaaaaaaggtttcgcccttttcttaattgtggttgcgatcaatatgtttctgaaataaggaaaattatgaattcaaattatttacttcttccccactttgatccgagtatttttacgcttggcgatagtaatatcggcttacgttggtatggtttgatgtaccttttaggttttgtttttgcacgttggcttgcggttcgccgtgctaatcgcccaaatagcggttggacagtagatcaagttgataccttacttttcaatggttttatgggggtgtttattggcggacgtgttggcgatgtatttttctataatctcgatcatttcttacaagaaccactttatttattccgcgtttgggaaggtggaatgtcgttccacggtggcttaattggtgtaattgttgctatgatttggacatcctattcacaaaaacgtaatttttggcaaacggctgattttgttgcgcctttgattccgtttggtttaggtttaggcagaattggtaatttcattaatcttgaactatggggacgcgaaacgaatgtgccttgggcaatgattttcccgaatgatcctcttttactgcctcgtcatccatcacaactttatgaagcctttttagaaggcctggtgttgtttgcgattctgaatatttttattaaaaagccacgtccaatggcttctgttgcaggtttattcttaattggttatggtgtcttccgttttattgtggaatatgtgcgtgaacctgaagttgaaaatttctttgggattattacacgagggcaagccctttgcttaccaatgattattggtggtgctttcattatggcttgggcttattcacgcaaaagtgcggtcataaaataggagatttttatgaagcaatatcttgatctttgtcgccgcattgttagtgaaggggagtgggttgctaatgaacgtacaggtaagcattgcctcacggtcattaatgcagatttagaatatgatgtggcgaataatcaatttccgctgattactacccgtaaaagttattggaaagcggccattgctgaatttctaggttatattcgtggatatgacaatgccgctgatttccgcgcacttggcacgaaaacttgggatgctaatgcgaatgtaaatgcagcttggcttgcaaatccgcatcgtagaggcgttgatgatatggggcgcgtatatggtgtgcaaggcagagcatggcgtaagcctaatggagaaaccatagatcagctacgtaaaattgttaataacttaacgaaaggtattgatgatagaggagagattttaactttttttaaccctggggaatttgatcttggttgtcttcgtccttgtatgcacacgcatactttttctcttgtgggcgatactttacatcttactagttatcaacgttcctgtgatgttccgcttggattgaatttcaatcaaattcaggtgtttaccttcttagcgcttatggctcagatcacgggcaaaaaagccggcaaggcatatcataaaattgtgaatgcgcatatttatgaagatcagcttgagttaatgcgtgacgtacaacttaaacgcgagcctttcccattgccaaaattagaaatcaatccagatataaaaacgcttgaagatttagaaacttgggtcacgatggatgattttaaagtcgttggctatcaatctcatgagccaattaaatatcctttttccgtctaatggatgcagcaaaagtgcggtcagaatttgacgagaaaatgatgcgctacgcccttgagcttgccgataaagcggaagcgttaggtgagattcctgtgggggcggttttggttgatgacgctagaaatattattggagaaggttggaatctctccattgttcaaagcgatcctaccgcacatgctgaaattatcgctttgcgtaatggcgcgaaaaatattcaaaattatcgcctactgaatagcacgctttatgtgacattagagccttgcacaatgtgtgcaggggcaattttgcatagccgtattaaacgccttgtgttcggtgcatctgattataaaactggcgcgattggatcacgttttcatttttttgatgattacaagatgaatcatactttagagattacatctggcgtattggcagaagagtgtagtcaaaaattgagtacattttttcagaaaagacgcgaggagaaaaaaatagagaaagcattattaaaaagtctgagtgataattaattctttatttttccttatatttgaaacttaaaatccaggattgatcgttatctcaaaccctgttacttgcggaaattcttcttgaattagtgttaataattcaatttgtttaaatagaatcccctgccgaacaatagcattagacacttcaataaaaattaaatgatctgttatgttgccaatacgaaatttgccgtgaaattcctgtggaaaaatgcggttaaatttttgattaagttcattgatggcaagaccttttttgattattttggcaaagggcgattgctcaagcacatccataatattgactgctttttgataacgatcagccttgttttccataaagtcagcccccagtaaatgacatcagtttagatttccgctacaatacacgcaattttcataataaacaatgagacgaatgatttcaggcactgtcaaaccgaatttttggtcgcgattacttttaagtatcatcgcgatttttgctttgcctaacgcacaaagttttgaaaatcaaaataatacggaaaattattcctcaagtgtttccattcaacaagcgttagaaacggtaaaagttgctcgtgaagtgcaacgacaagccattcctcaaccttcaatttcccgtcaaactgaaaaacaacctaaaattcaaccgcactttttagcggatgtattgaatcttagtgcgccaattcgagcaggccccttacttatttaatttttctgttttttgtgaagaatattgctattgaaatagcgatattttaaaaaattattgtgcatgaaataaagtatttcataagcatttaactatttaacttatatatttaaaaagagaaattatgagcattttaacaagaatttttggtagtcgtaatgaacgcgttttacgtaaattaaaaaaacaagtcgtaaaaattaataaaatggagcctgcttttgaggcattaagtgatgatgaattaaaagcaaaaacacaagagtttcgtgatcgtttaagtggtggcgaaactttgcaacaaattttaccagaagcattcgcaacggtacgcgaagcaagtaagcgtgtgcttggtatgcgccattttgatgtgcagcttatcggtgggatggtattgactaaccgctgtatcgcagaaatgcgtactggtgaaggtaaaacattaacggcgactcttccttgttatttaatcgctcttgaaggtaaaggcgttcatgttgtcacggtgaatgattatcttgctcgccgagatgcagaaacaaaccgtccgttatttgaatttttgggtatgagcgtaggcgtcaatattcctggtttatcgccagaagaaaaacgtgcagcttatgcggcagatattacttatgcaaccaatagtgaacttggttttgattatttacgtgacaacttagcccactcaaaagaagagcgtttccaacgtactttaggctatgcgttggtggatgaagtggattctatcttaatcgatgaagcgcgtacgccattgattatttctggccaggcagaaaacagttcagagctttatattgcggtaaataaattgatcccaagtttaattaaacaagaaaaagaagatacggaagaatatcaaggagagggcgatttcactttagatttgaaatctaaacaggcgcatttaaccgaacgtggtcaagaaaaagtagaagattggttaattacgcaaggtttaatgcctgagggggactctttgtattctcctagtcgaattgtattgcttcatcacgttatggctgcattgcgtgcgcacacattgtttgaaaaagatgtcgattacattgtgaaggacggtgaaatcgtgattgttgatgaacacactggtcgtacaatggcggggcgtcgttggtcagatggtttgcaccaagccattgaggcaaaagaaggggtggatgttaagagcgaaaaccaaacggttgcgtcaatttcttatcaaaactacttccgtttatatgaacgtcttgcgggtatgacggggactgcggataccgaagcatttgagttccaacaaatttatggtttggaaactgttgtaattccaacaaatcgtccaatgattcgtgatgatcgcactgatgtgatgtttgaaaatgaacaatataaatttaatgcgattattgaagacattaaagattgtgtagaacgccagcaaccagtattagtggggacgatttcagtcgaaaaatcagaagaattatctaaagcgttagataaagcaggtataaaacacaatgtgttgaatgcgaaattccaccaacaagaagcggaaatcgtggcagaagcaggatttcctagtgcagtgactatcgcaacgaatatggcgggtcgaggtaccgatattattcttggcggtaactggaaagcgcaggctgccaaattagaaaatccaactcaagaacaaattgaagcccttaaagcagagtgggagaaaaaccacgaaattgtaatgaaagcgggtgggttgcatattatcggtacagagcgtcacgaatctcgtcgtattgataaccagttgcgcggtcgttctgggcgtcaaggtgaccccggttcttctcgtttctatctttctttagaagatggtttaatgcgcatttatttgaatgagggtaagctcaatttaatgcgtaaagcgttcacggtagcaggcgaggcaatggagtcgaaaatgttggcgaaagtgattgcatctgctcaagcaaaagttgaggcgttccattttgatggccgtaaaaacctacttgaatatgatgatgtggcaaatgaccaacgtcacgcgatttatgagcaacgcaatcatttgcttgataatgatgatatttctgaaactatcaacgctattcgccacgatgtgtttaatggtgtgattgatcaatatattccaccacaatctttggaagaacaatgggatattaaagggcttgaagaacgtttatctcaagaatttggtatggaattaccgatttctaattggttagaagaagataataatcttcacgaagaaagtttgtgcgaacgcattgtggaaattgcagaaaaggaatacaaagaaaaagaggctttggttggcgaagacgctatgcgccattttgaaaaaggtgttatgttgcaaaccttagatgaactttggaaagaacacttagcttcgatggattatttacgccaaggtattcatttacgcggctatgcgcaaaaagatccaaaacaagagtataaaaaagaatctttccgtatgtttacggaaatgttggattctttaaaacatcaggttatcacgactttaacccgtgtacgtgtgcgtactcaagaagaaatggaagaagctgaacgtgctcgtcaagaaatggcagcacgtatcaatcaaaataatttacctgtggatgaaaatagtcagacaactcaaaattcagagactgaagattattcagatcgtcgcattggtcgcaacgagccttgtccttgtgggtcgggtaaaaaatataagcattgtcacggcagtcgtgtggcacgccagtaatgaacaatcaaagtgcggtgattttttaccgcacttttttcatacctctacattagatagaaaaatggataaaaaaattatacaagttgctgcggggattattcgtaatgaatttggtcagatctatttaacgcagcgtttagaaggacaggattttgcccaatctttagaatttcccggtggaaaagtagatgcgggagaaaccccagaacaggctttaaaacgtgaactggaagaggaaataggcattgttgcgttaaatgcagaactttatgaacgttttcaatttgaatatccaacaaaaatcatttcttttttcttttatctggtaaatgaatggattggcgaaccttttgggcgagaggggcaagaaggtttttgggttgagcagcgcgcattggatgcaggacagtttccccccgcaaatgcaaaattaattcatcgattactaaatgaaactcacaatttcatataaaataaatgtggtttaaagttatattaaaagatttagtatgatttatcacatataactttttaatatactcgccaaaatatttgtattttttgcattattggagtcattatgtctcaacttgccaatccagaactgatgaaagtcgttattttactcgcatctagcgtaacaattgtgccgttatttaaaagactcgggttggggagtgtgctaggttatttagtggcaggttgtttgattggtccatctgtctttggcatagtgcaagatccaacagctgtggtacatttagcggaattaggtgtggtaatgtttctttttattatcgggcttgaaatgtatccagaacgcctttgggcaatgcgtaaagctatttttggcagaggtttgttacaagttggattatgtggttgcttactcactttttcgggtatttatttattaggattaacaaaagaagtatcatttatcgctggtatgggtttcacgctttcctctactgctattgtaatgcaatcactagaagaaagggggcttacttctacgtcaaaaggacaacgcgtaatttcgacattaatttttgaagatattgctattgtaccacttttggcttctgtcgcttttcttgctccccattcgaaagaagcgacaccacatactgattgggtatcaattggtatagcattaagtgctgttgtggggttaattgtgactggaaaatggctaatgaacccactatttcgtttaatttctaaagcacgtattcgtgaaatgatgacagcgggcgcattattggtcgttttaggtgctgcattagcaatggaaattggcggactttcaatggcaatgggggcgtttgttgctggtgtgatgatgtctgaatcagcgtttcgccatcagcttgaagcggatatagaaccatttcgcggcttattactcggattattttttatgggcgtaggaatgtccttagatttgcatttagtgtttaatcattggatcttgctacttggaattgtttttctttatatacttggaaaagccagtgctgtttatattattgcccgaattacccgtcttgatcatcgagaagccataggacgaatgtctttgatggcacacggtggcgaatttgcctttgttcttttttcagccgcagcaactgcggaagtaatcagtaatgaagaacaagcgacattcactgctgcagtgattatttcgatgcttttttcgcctattattgctcaaattgctcgcaaacttatacagcgtacagagcctaaacatcttgatcaacttgatgaaaatgatctagacagcatcgtggatttggaagataacgttttagttattggttttggacgttttagtcaaattgtctgccaaacattattgattcgtggaattagcgtttcagtgattgatcgcaatatcgaaaatatccgtgctgccgcaaagtttggttttaaagtttattatggcgatggcattcgattagatgttttacgagccgcaggaattgaaaaggcgaaatgtgtcgtattaggtattaacgatacacaaagaattgaacatattgtcagtcaaatgaaagaggcttatccaaatttaccgattttaacccgaacttatgacagaaaaacaacagttagtttgattaagcaggatgtagattttattgtgcgtgaaacttttgaatcagcaattacacttagtcgagcaacattgatgaaattaggtattgataaaattgaagcggaagaaattattaaggaagtacgaacattggatcaagaacggttaaatgaagaagttttacacggtttttcgaatgaaatagtaaaaaaatattggacaccaagaccatttattaaaccgcatcttgatacaaaagcattaaataaagaaacagaagaaattctaagtgagaaaattgaagaagaaatatcaaatgatcattcataaaattattttttatctataaaaatattaaattttaacttctcgtttaagtatttacttttgagtgatttaaatcacgtaaatttttattttaaggcaataaatgaataataaaattagtgtttatgataaagataatttctttgagctttatcagaaactccgtgcaaatccaattagcctcaatgaaattatcgaaaagcccaccatgctttcattgttgcctaatttaaaagggaagaaattactcgatttaggctgtggtacgggagggcatttacaactttatttagaacgaggggcggctaaagtaattggaactgatctttccgaaaaaatgctcgaacaagctgaaaaagatcttcaaaagtgcggtcaattttcagggcgtttttccttatatcacttaccaatagaaaaattagctgagttaccagaaagtcatttcgatgtgattactagctcttttgcctttcattatattgaaaattttccgacattattatcaacgatccatgacaaactctcgtctaatggcacattaattttctcacaagaacatccgataactacctgccataaagagggagaacgctgggaaaaaaatgacaaaaaacagcaagtcgcttatcgtttaaatcattaccgagaagagggcgaacgcaatagaaattggttcaaacaaccttttcaaacctatcatcgaacaacagcaacaattatcaataatttaattcatgcaaggtttcaaattgagcaaatggaagaacccatgcttgctgaccaaccgcaatggcataatgaatttaaagatttatcacaccgaccaccattgttatttatcaaagcaagaaaagtggagaaataaacaaaataaactggtttttaaccgcactttatggtataaatcgccccgctgtttttgcctttcaaaagcagttttttaattactaacaacacacacatattaacaaggcttaatcggggtgccaaacggtcgattagctgatatgtggaggctcaaccccaacaaaaggaaaatattatggcacaagtttcaatgcgcgacatgatcaacgcaggcgtacacttcggacaccaaactcgttactggaacccacaaatgaaacctttcatttttggtgctcgtaacggtgttcacatcatcaatcttgaaaaaactttacctttattcaacgaagctttagcggaattaactcgcattgctagcaacaacggtaaagtattattcgttggtacaaaacgtgcagcgtctgaagcagttcaagcagcagcattagattgtcagcaatattacgtaaaccaccgttggttaggtggtatgttgactaactggaaaaccgttcgtcaatcaattaaacgtttaaaagatttagaaacccaatctcaagacggtacttttgataaattaaccaaaaaagaagcgttaatgcgtagccgtgagatggaaaaacttgaattaagccttggcggtatcaaagatatgggcggcttaccagatgcgttattcgttatcggtgcagaccacgaacatatcgctgttaaagaagcaaacaacctaggtattcctgtatttgctatcgttgatactaactcaacaccagctggcgtagatttcgttatccctggtaacgatgatgcgactcgtgctatccaactttacgtttctgcagctgcagcagcggttaaagaaggtcgtggtaacgaagctcaagttgctgaagaattagcagctgacgcagaataatttaagttttgcaataaggcgaagcccttaataatcaagcgattaattggcataggggctaaaatttagcccctatatttttatctaaaagtgcggtcaaaataaaccgcattttcgacagaggattttaaaaatggctgaaatcacagcatcattagtaaaagaacttcgtgaccgtactggcgcaggtatgatggaatgtaaaaaagcattagttgaagcaaacggtgatattgagttagcaatcgacaatatgcgtaaatctggtcaagctaaagcagctaaaaaagcaggccgtgttgcagctgaaggtgttatccttgctcgtgtagaaaatggtttcggtgtattagttgaaatgaactgtgaaactgacttcgtagcaaaagatgcaggtttcttaggtttagcaaacgaagtagctgatttcgcagcagcaaacaaaggtaccactatcgaagcattacaagcgcaatttgaagaaaaacgtgctgcattagttgctaaaatcggtgagaacatgaatattcgtcgtgttgcttacctagatggtcaagtaattgcacaatacttacacggtgcaaaaattggcgtattagttgcgggcgaaggttctgctgatgaactgaaaaaagtagcaatgcacgtagctgcatctaaacctgaattcgtgaacccagaagatgtatctgctgaagtggttgaacacgaacgccaaatccaaatcgatattgcgatcaactctggtaaaccaaaagaaatcgcagagaaaatggttgaaggtcgtatgaagaaattcactggtgaagtttcattaacaggtcaagcatttgtaatggatccttctgtatctgtaggggatttcttaaaatcagtaaatacttctgtttctaacttcattcgtttagaagtaggcgaaggtattgagaaaaaagaagaagattttgctgctgaagttgcaaaaatcactggcggtaacgcgtaattctttaaagataacgatatgttaataagcccaacttaagttgggcttatttgttttataggataagctgcttaattaacgggcttaaacttttttagttacgtttagtaaaataaaaaatccacactttaatagtaaacttttaaagtgtggattttgtaataaaacctcagaagaaattaagaaattttcttttctaacgcttttaaacgtttatttattccatcaatacctaacgttagtgctgctgttttacgccattctttattcgtttgcaatggaataccagaggaatatacgccaggctctgtaattgggcgcataaccattcccattccagtaatggttactttatcgcaaatttccatatgaccattaatcacacttgcaccaccaattaagcaatagcgaccaacagttaagctacctgccataataacgccacccgcaaccgctgtaccagtgccaatatgaacattatgtgcaatttgacaaaggttatcgataataacgttatcttcaataatcgtggcatctaatgcgcctctatcaatacaggtattcgcaccaatctcaacgttattaccaattattacttgccctacttgtggaattttaatccaacgaccacgatcatttgcataaccaaaaccatcactaccgataactgttcctgattgaattaagcaattagctccaatctcaacgttatggtaaacagtgacattagcccagagctgagtgcctgaacctatcttagtatttttaccaacaaagcaatttgcaccaatgatcacgttatcacctagtacaacaccttcttcaatcactgcgttcgcaccaatagatacattttcgcccaataaaacaccatcaaaaatgaccgcactttttgcgattccttgtgccgcttttggcgtgctatccatatattgcgctaaaattgcgtaagccacataaggatctttaacaataagtagattgctttctggagaacagtgttcaacatcctcttcagagacaaccaaaatccctgctttagaatctttcaataatgcacgaaattttacgttagaaataaaagtgagttgatttgattgggctttatcgagaggcgcgatattctcaacaacaacatcggcgttaccgcgaacggtagcgccgatttgagttgccaattcttgtaaagaataggatttttgcattatgagaacctattattttttctcttgtgctttttcagaagcagggatagattttaatacttcttcagtaatatctttaccctctaccgcaaatacaactgaatttgcatcaagcacataagtataaccttttgcttttgctaaattatttgtcgcagtttgaatgctatctaataatttaccacgttcttcagcttgacgtttttcattttgagcttggaattcttgaacttttttatcttgttcttgcattagtttttgtaattcagcatcttcagccgcacctaatttattaatttcctgttggcgtttttgaatatcagcttgacgtaagcgaggtgcatctttttctaaagccgcaacttttgcttctacttttttacgagcagcagcaattttatcatcaacttcttttttgcttgctgctaatttctcagctacaggtttaaattcagcatcaagtttatctgctactgcttggcgatctgggtgatgttgaaaaatataacctgcattaatgaaagcaattttttcttcagcggaagcatagcctgaagcaagtgcaatacctaaagcaagtgcggttacttttgcgatgtttttcatttgataaatatccttaattaaatgatgggtttaatattttctctgcccaattaaattaggcagagaacgttgtttttgagttctgatgaagaaaaaagttcaatttattagaaagaacctccaatactaaattggaactgttcgacatcatcattttcatattttttaattggtttggcataagagaataccaatggcccaataggagattgccattggaatccgacacctgtagaggcgcgaatacggcttgatttgccataatcgggtaagctttttaatacattgttatctaacccactcttatccgatttccacttagtattccaaacacttgccgcatcaacaaatagggaagttcggaccgtattttggctcttatcgctcacaaacggtgttggtacaataagttctgcactcgcagttgtgattgcattaccaccaatcacatcagaacttatcttattaaaagtaccattactattactattactattaccattttgagcggcataaattgcgttaggtccaatactaccataagcaaaaccacgtaatgaaccgatgccacccgctgtataagtttgatagaacggtaaacgcttgtttccaaaaccatttgcatatcctgcagatgcttttgcagatacaacccagaggtgatctctgtctaatgggtagaaaccctgtacatctgcacttagtttgtagtatttgttatcagaacctggaatagtaactcgtccaccaagacttgctttaacccctttagttgggaaatagcctctattaaggctgttatagttccaaccaaaagaaaaatcaaagtcatttgttttaatgccattacctttaaatttcattgattgaatatataaattacggttatattctagagcaaagttactaattttattataggtatggcctaatcctacataataggagttattttcatttacagggaaacctaaagtaacattacttccataagtcgtacgcttatagttagaggatgtatcacttttagagttatcgtagttttcaaagaaaacatttccaccaagacttacaccatctttagtaaaatagggctcggtataacccaaattgacactcgtaccataatcatttttcgtaccagctatacttactgcagcccctgttcctaagaaattatcttgtttaacacttgcttgataactaataccactctctgtaccgtaaccaataccaaagttgatactacccgtgttacgttctttgactttatatacgacatccacttcatcattgctaccattgataggatcaattcggttttcgactgtttcgaagaaacctgtacgatctaagcgaatttttcctaactcaactaattgtgaattataccaagttccttcttgttggcgcatttcctgacgtaaagtgctatcagcagaaacggtatttccttcaaagcgaagttggcgaacagttaaacgtcgtccagcatcaacaacaagggttatcgctaatgttttatttgcatcatcaaaatcaggtactgaatttaccgttgcgctaccgtaaccgcgttctccaagttttgctttaattgcattttctacatctgcaatatcactacggcggaaagtatcatttaaatgtaatgctgaaagtaaaggttcaagctcggcagacatacctcccagattacctataatgcgtgcactacgaaggtcatactgtaaaccttcatttacatcaatggttacattaacttttgttttttcatcatttagctgaacatccgttttagtaatttgtgctttggcatagccattatttaaataataatcacgaattgactgcaaatctttctcgaattgcgcaccttcaaatttatttccccataatttccaccaagaatcaggttgtaattccatttgttcttgtaatgtactgctactaacagattcgttccccttgaaagttaatgatgccaattttgctttatcatcttcattgatttgaattaaaatttcagcgcgattatttggtagcgtattgacaataggttcaacggttgcgttatagcgacctacacttgcatagtgttcttttacacttttggcaaattcatttaatttttctcgaattaaaacatcgccaactttaaacccgttagcatctaagttttgttttagtgcttcagtgggaataatagagttacctttgattttaacatctgaaatgatcgatttagccacaacgctaacaacaagcacatcgccttcttgatgcgctttcacatcatcgaatcgaccacttacgaataaagagcggacaatattagccacatcattgtcagtcacacgctgaccggcacgaacaggtaaacttgctcggatttgttgttttaagtcaccttgaacaccatccacacgaatatcttttgccacaaaaggtgcggcaaacacagtcgttgtcgtaccgaataataaacttgcgattagaagttttttcatcgattgtatcctatataaattatagacgtaaaaaatcattaaataatgcaaacaccgttaagcttaataacagtgctgcgccaattcgataacagatgctttgcacccgctcagaaacaggttttcctttaacagcttccattgttaaaaaaactaaatgaccgccatctaatactggtaatggaaataaattcataatccctaaatttacactaatcaatgccataaaacttaaaaaatacaccaatccaatatttgctgatgcaccagcaccttttgcaatagaaattggcccacttaaattatttaatgacaaatcgccagtaagtaatttccctaatattttcaaggttaaaagggaaagctgccctgttttttcaatgcctttttgtaaagattcaagaataccatattttaattcagtacggtattcatccgctaattttgtcaaggttgggctaaccccaacaaaccatttgccattttgattacgcactggagttaggactttgtcaaatgtttctccattacgttcaactttaatagaaaaagattcgccttgttcgacctgttttataaaatcttgccaaggaagtgcggttaaattttcttttaaaattttatcaccgatttgtaaaccagctttctcagcgggagaattttgaacaactttagaaagcaccatttcaattttagggcgcataggcataatccctaatgcctcaaaagcactttctttttcaggatcgaatatccaatttgtaagatttaaagtccgttgttgttcaatattagaattgaaaggagaaagggtaatttcaacattaggctcacccatttttgtggcaagtagcatattgatggtttcccaatcttgagtttcttcgccatcaaccgctagaatttgtgtattaggttcaatgtgagcttgtgctgcgatggaacttggtgttattgattgaatcactggtttaaccgttggcattccataaaggtagatgatccaataagcaaaaattgcaaaaataaaattagctaaagggcctgcaataattacaaatgcgcgttgtaatacgcttttactgtcaaatgcttgtgatttttgctcagcaggaactacttcattacgtccatcaagcatttttacatagccgcctaaaggaatcattgaaaccgcaaattctgtaccatatttgtcaatgcgtttccaaattacttttccaaaaccaatggaaaaacgatggacttttataccgcactttctcgctgcccaaaagtgaccatattcgtgaacggatactaatacagcaatcgcaatgataaaagaacctagtgaccacaaaaatgacattaaaaatccttataagacaaagaaatagaaatagctgaaaaaaggtactgcggcagtcaagctatcaatgcgatctaacacaccgccgtgaccaggaatcaattggctactgtctttaactcctgactcacgtttaaacatactttcagttaaatcgcccaatactgaaattgcaactgtcgctacagaaagaatgataaatccagtaatatttcgatcgcctactaaagtattgttagagaaatgaataaagataaaagaaagcactaatgctgtaattaatccaccaatgaccccttcccaacttttacctggcgatactttaggggcaagtttacgtttgccaaaggcgcgtccgctaaaataagcaccagaatcagccgcccaaacaagtataaatacgtaaagtaataaaaataagccgtgataaggatcatgggtatagtgttctaaacgtaaacgtaatacacctgcgacaaatggaatcaacgtagaaaaggcaaataaaagttgtaaaagtggatttttagaccaaaatttagctgatttaggataactgatcacaagcaacaaagctaaaccccaccagctaacagcatttatcaataaaagctgaagatgttgttcaaacacacgccctgcatctaaatagttgccctcagtatagagccataagaagataaatacgcctaaaaaggtagccacaaaaaaacgtatcaaaggttgtttaaggcgagcaaattgagtccattcccaaatgcctaaaatcgctaccgcccctaaagcgagggcaaaataaaaaggcgtgaataaaaatagcgcacataaaactgcagcaattaacacaatagcagataaaactcgttgtttaagcataattttaatccgtttaactattcagtcccgccaaaacggcgatgacgttgttgataacttgcaatcgcgtgattaaattctaattgattaaaatcaggccaaagcacatcggaaaaatataattccgcataggcaatttgccataataaaaagttgcttatgcgctgttctccactggtgcgaattaataaatccacaggtggtgcattttgggttgcaagatgatgttgaaaagtcgagttattaatatctgaaactgacatttcttcttttttaactttttctgcaatttgtttagcggcttgaataatatcccaacaaccgccgtaatttgccgcaatattgagtgtaagtgcggtatttttttctgttaaattttccgcttttttgattttttcttgtaaagtttcactaaaacgagatacatcgcctataattttcagacaaatattatttttatgtaattttttcacttcgcgatccaaggcttgcataaaaagcgacattaacgcgctgatttcttgttctgggcgactccaattttcgctactaaaggcataaagtgtgagtacttccacaccgatttgtcgtgcataagccactgctttgcgtaccgcagtaacgccattggcgtgtccgaaaattcgcattttatttttctgttttgcccaacggccattaccatccataataatggcaacgtgttttggtatatttgtttgatccaactctatcattatttttattattgagagacctctataaatttggtggtaaactatatcataagttatattggcttgccatggattcctttgttctaatctgttctgtaaaaattgaaaatttattgtaaaaaacaactaaaaaaccaccgcactttttatttctctccctattaatttttgccattttacggtattctatgccacattttctattgtcaaaatgctgcaaaagtgcggttaaaatttaaggtgattttatgcaagaacaatatcgccccgatatgatcgaaccaaaggttcaacaatattgggcagaaaataaagttttcaaagcaatcaaagacgaatctaaagaaaaatattactgtctttctatgttcccatatccttctggtcgcctgcatatggggcacgtgcgtaactacactattggtgatgtcatttctcgttatcaacgcatgctaggcaaaaacgtattgcaaccatttggttgggatgctttcggcttacctgcggaaggggcagcaattaaaaataaaaccgcaccagcaaaatggacttacgaaaatatcgcctacatgaagaaacaacttcaacttttaggctttggttttgactgggatcgtgaaatcgcaacctgtaaaccagaatactacaaatgggaacaatggttcttcactgagctttacaaaaaaggcttagtgtacaaaaaaacctcaaccgtaaactggtgtccgaatgatgaaacagtactcgcaaacgagcaagtacacgaaggttgttgctggcgttgtgatacaccagtggaacaaaaagaaatcccacaatggtttatcaaaattactgactatgccgagcaattattaggtggtttagatgcccttccacaatggcctgacatggtaaaaaccatgcaacgtaactggattggtcgctctgaaggggtagaaattacctttgatgttgcaaataccaacgaaaaagtagcagtttacaccacgcgtccagataccttttacggcgtgagttatttaggcattgcagcggcacatccattagcaagtttagcagctcaaaacaattccgaattagccgcctttatccaagaagcgaaaaacgccaaagtggcagaagctgatcttgcgacaatggagaaaaaaggaatggcaacgggcttatttgctattcatccattgacgggcgaaaaattaccgatttgggtcgctaatttcgtgttaatgcactacggtactggcgcagtaatggcagttcctgctcacgaccaacgtgactttgaatttgctcaaaaatacagtttacaaatcaagcaagttattgaacccattgcagatgaagaaattgatttaactaaacaagctttcgttgagcacggtaaattagtgaactcagctgaatttgatggtaaagactttgatggtgcattcaacggtatcgcggataaattagaaaaattaggtgttggaaaacgtcaagttaattaccgtttacgtgactggggcgtttctcgccaacgttattggggtgcgccaattccgatgctaacccttgaaaatggcgatgtagtacctgcaccaatggaagatttacctattattctgcctgaagatgtggtaatggatggcgtaaaaaacccaattaaagcagatcctaactgggcaaaaacaacccttaacggcgcaccagcgttaaaagaaacggatacctttgatacctttatggaatcctcttggtattacgcgcgctacacttgtccacaatatcaaaatggcatgcttgatgcggaagaagcaaactattggttaccagtggatcaatatatcggtggtattgaacacgcaacaatgcacttactctacttccgcttcttccacaaattattgcgtgatgcaggatttgtaaccagtgacgaaccagccgataaattattatgtcaaggtatggtgcttgcagatgccttctactacacaagtccaaccaatgagcgtatttgggtaagtccaacactggtgactcttgaacgtgatgaaaaaggcagaattattaaagccaccgatcctgaagggcgtgaattagtccacagtggcatgaccaaaatgtcgaaatccaaaaataacggtattgacccacaagaaatggtagaaaaatatggtgccgatactgttcgcctctttatgatgtttgcctctccagcagaaatgaccttggaatggcaagaatctggcgtagaaggggcgaaacgtttcttagggcgtgtttggaatttggtatatcaatatcaacaaaatccagcaaaaactagcctagatatcaccgcactttccgcagaacaaaaagtgcttcgtcgtgaagttcataaaaccattgcgaaagtgagcgatgatattggtcgtcgtcaaacatttaatactgcgattgctgcagtgatggaattgatgaataaactgactaaggcatcgcttgatagcgagcaagatcgtgcagttatggcggaggcattaagtgcagttgttcgtatgctttatccaattacgccacatatctgttttgaattatggcaagctcttggcaatgaaagtgctattgatactgcagaatgggtaaaagccgatgaagccgcaatggtagaagatgaaaaactgattgttgtgcaagtaaatggcaaggttcgtggcaaagttactgttgcggcagatgcagatgaagacacagtcaaaacgattgcttttgcggatgaaaatgtgaagaaatttattgataatcaacacattgtcaaagtgatttatgtcgtaggtaaattattaaacgtggtagtgaaaccataatacatagggtgtgtggatttaaaattcacgcaccattttttataggtatgtgaaatatttacattttacacgtcctacaataaaggtaatttttatgatcaactcaatcaagactttactgcttatcgcaacattagcaattctttctgcttgcggttggcattttcagcagtcggttactatgccaaatgaatggcgaacattagcccttgaaagtgatgactcttataatgattttactgttattatgcgtcgcaaattgcaggaaaatcaggttaatgtcgtcaatttagaacaaaatattcccattttacgtattaataaacagattacttcagatcaagttgcgtctatttttaagcacggacgtgaggcagaaaaacttttaatgttggaagtagaagccactttccgccttgctaatggcgaaagctatccaatcaatgcgaaagtaaaccgtactttctttgataatgcacgtgcagcattagccaaatcagaagaacgagaggtaatttggaatgatatgcgcgagcaagtagcgcgtcaattaatcgtaaaaataattgcgttacaaaatcaaataaaaaggaaataatgaaccgcatttttccagagcaactaaatcatcatcttgcgcaaagcttggctagagtttatctcttgcaagggcaagatcctttattacttagtgaaactgaggatacactttgtcaagtggcaaaccagcaaggttttgatgaaaaaaatactattcaggttgatagccaaactgattgggcgcaacttatagaatcttgtcaatctatagggttgttttttagtaaacaaatactaagcttgaatttacctgaaaatttcaccgcacttttgcagaaaaatctgcaagaacttatatccgtattgcataaagatgtcttgcttattttacaggtagcaaaattggctaaagggattgaaaagcaaacgtggtttattacacttaatcaatatgaaccaaatacaatactgataaattgtcaaacaccgacggtagaaaacttaccacgttgggtaaaaaatcgtaccaaagcaatgggattagacgctgacaatgaagcaattcagcaactttgttatagttatgaaaataacctgctcgcactcaaacaagctctgcagcttttagatttgctctatcctgaccataaacttaactacaatcgtgttattagcgtggtggaacaatcctcaatttttacaccatttcaatggattgatgcgttgcttgttggaaaggcaaatcgtgctaaacgtattttaaaaggtttacaagctgaagatgtgcaacctgttattttattacgcacactacagcgagaattatttacgttgcttgaactaacaaaaccacagcaacgtattgtgacaacggaaaaacttccaattcaacaaattaagactgaatttgaccgtctaaaaatctggcaaaatcgccgaccgctctttttaagtgcgattcaacgtttaacttaccagactctctacgaaattatccaagaactcgctaatattgaacgtctaactaaacaagaatttagtgatgaagtgtggatcaaactcgctgatttatctgtaaaaatttgtttgtagtcacaaggcaaataaaatagacaatattgaaataagatttttgataaaaaagaaattttttgctggaaaaatggtcccccctaccggacttgaaccagtgaccaagcgattatgagtcgcctgctctaaccgactgagctaaggggggagagtgcggtaattatagagaaataatcacttgaagtctataaaagaagggatgattgacgaaaaatcaaccatccctttttacattattgaagcactgaaatatcagctacttgtaagaataacccttgtaacgtatttaaaatcgctaatcggttttggcgtagtgctggatcttcagcatttaccatcacgttatcaaagaaactgtctactggcgcacgtaagtttgctaatttatccaatactgcggtgtaatcgccttgtgcgataagcggttgtacttcagtgcgtaatgccagtaccgcttcagcaagggctttttctgctggctctacgcaagcggttaaattgatctcgccaattgccgcacctgctttcgctaagatgttgctaacacgtttatttgctgctgctaacgcttccgctgaatctaaagtacggaagtgtgaaaccgcacgcacgcgcgcatcaaaatcagcagggcgagttggacgacgtgccaataccgcttgaattacatccaccgcaatgccttcatcttgataccatgcacggaaacgaccgagcatgaagtctactacctcatcaaggattttttgttttggaactaaatcatcaccacgtgtaaagaatgaaacataaccttctgggtattcactaaatccacctcttgttttggcaataggtgcattacgtagtctttcgttatcaagttctttatataaatcaaatgctttgctaataatgtcattcagatcaagaggcaaatttttctcaacgataatacgtaatgcacctaatgccgcacgacgtaatgcaaatgggtctgcgctaccttttggtgcttggccgatgccgaagatacccgttaaggtgtcaaatttatccgctaaagcgaccgcacttgccactaaagacttaggtaattcatcacccgcaaagcgtggcatatattgttcgtttaacgccactgccacttcttcatcttcaccgtcgtgacgagcataatgcatacccattacgccttgcgtatcagtgaattcgaataccatgttggtcatcaaatcacattttgacagtaaacccgcacgttttgctttcgcttcatctgcgccgatttgttttgcaatttcgcctgcaagttgttcaatgcggtcagttttgtctttcaatgtgccaagttgttgttggaacaacacggtttctaaacgtggtaaacgatcaaccagtttttgttttaagtcggttttgaagaagaattccgcatcggttaaacgtggacgaaccactttttcgttcccttcgataatcgcggttggatcttctgggttgatgttcgagacaaagataaagtgcggtaataatctgccgtctttatcataaatcgggaaatatttttggtctcctttcatggtgtaaaccaaggcttccgcaggcaccgctaagaagcgttcttcaaattttgccgctaaaacatttggatattccaccaaggaagtgacttcttcaagcaggctttcttcaatgtcagccacgccaccaagtgcggtcgcttttgcttgagattttgccaaaatttctgctttacgctcattgaaatctgccaccacagaacctttatcacgcaataattgcggatattggtctgcatgttgaatgtcaaattctttctcgcctaagaagcggtgaccgcgaatggtgcgagcacttgccacacctaaaatttcgccttcgattaactcatcacctaacaacatagtcacagtgtgaactgggcggataaattgcacggttttatctgcccaacgcattggttttggaattggcaatttcgctaacgcatttgccacaatatcgttaagtaagtttttggtcggctgacctttaatttttgtacggtgaacgagccattcgcctttatcagttgcaatgcgttctgcttgctcaacagtaatgccacaaccacgcgcccagccttctgccgctttagttggtttaccttccgcatcaaaggcggctgatactgcaggccctcgtttttcgatttctttgctcggttgttgggttgctaagttcaacacttttacggctaaacgacgcggtgccgcaaaccattcgattttatcgaatgataaacctgcttgattcaattccgcctcaacgttatccgcaaaagaggtcgctaatgttttgagagcttttggtggcagctcttctgtgccgatttctacaaggaagttttgggttgtcattttgttttctctggtaaggtgcaacttgctgcattgattacttatttacattttatctatcacatcattaatattttcaataatatattcatgattttctaaaatccaaagaagagatttaattcttgtctgattatcatacttattagttgtgaatttaccataaaagttaccttcattatcaacaatcactggcccacttgtagaatacttattccaaggactttcactgttatacttagagccataagttccgtatttattccaaatactatcgctattatatttagagccgaattcaccatatttattccaaattgatgagttatcatgtttactacagttcaaacagcctaaaaatttatcatgattatctccaccaaaaagcaaatatgctggtgctgcaaaggtatttattgataaaaataataatgggggtaacaaaaatttctgtaatgtcatagcattttccttagattaatataattgattcaatgtggagtgagaattttaatagctcacacacgatttaattgttttcttcgtttaacttctgccacaaacgcaagcgtttgtggcagaggttaatccaacctcatactcaatcagtccttacattctctaaaaacaaataaatctgctctactaccgcttcaatttcacgcatgacttcatcattgctaaaccgcatcactgtaaaaccaagtgaatttaattctgcatctcgcaatgcatctttttcctgataatcaggtttatagtgctgactaccatctaattcaataatcagctttgtctttgcacaataaaaatcaacgatataacttaaaagtggcttttgtcgattaaatcgaaatcctaataattgatctcgattgatgcgttgccatagctttctttctgtatccgtttgatccgctcgcagtttctgcgaattcagctttaagtatttttcatagggttgcatgaaaactgctgttctatctttcccaaaacttaaaaaattacttttaactttgataggtctaaaacaacatcgccatttggtaataacaatgcaggaatgcctaaatagccatttgctttcgagttatcaaattctgcactgctatcgcgtaaacgaatgaattgtttgagattaggtaatgaagtcataatttctacttcatcgtaatccacacctaagcgatccaactccgcgacaaatggcgcggtatctgggcatgtttctgcataaaaaagaatgggtttgctcattttgctctcctaaagtgcggtcaaatttcaccgcacttttttgaattacctttaaatgttattttttacaacctgggaaacctaaggcttcacggcttgcataataggcttccgccacgcctttggttaaggcacgaatgcgtaaaatatagcgctggcgttcggtgaccgaaattgctttacgcgcatctaataagttaaagctgtgtgctgctttcaaaatacgttcataagctggcaatggtaacggtttttctaaggctaataactcttgtgcttctttttcgtattgatcgaagcagtagaataagaaatcggtgtttgcgtgttcaaagttataggttgattgctcaacttcattttgatggaaaacatcgccataagtggttttgcctaatggaccgtcagaccaaactaagtcatacacagaatctacgccttgaatgtacatcgctaaacgctctaaaccgtaagtcacttcacctgttacgggtttacattctaagccacccacttgttggaaataggtaaactgggttacttccataccgtttagccatacttcccaacccaagccccatgcacctaatgttgggttttcccagttatcttccacgaaacggatgtcgttttgtgttggatcgaaaccgagcatttcaagcgagcctaaataaagttcttgaatattatctggagaaggtttgatcactacttggaattgatagtagtgttgtaaacggtttgggttttcaccgtagcgaccgtccgttgggcggcgtgaaggttgaacataagcaaatgccattggctctgggcctaatgcgcgcaatgcggtcattgggtgagaagtacctgcgcccacttccatatcaaaaggttgcacaatggtgcagccttggtttgcccaatattcttgcagggctaaaatcataccttggaatgtttttacgttaaattttgtactcataatcgttgatctaatgtgattaaaaatgttggtattatacttgaatccgtaaaagggataaaggcgaaaaatgcggttgaaaatcaggctttataaagatatcaagtaagtaatttggaatatttaggtagattttaagtttttttaattatagttttttttgattaatttaatagatttcgattgtttaaacctttctatatgatacgcaagaaattcatttcaacctaactaaatttattaacttcacaaggagtctacaatgagttctcaatgtcctttctcgcacttagctgcaacaaacttaacaatgggtaacggtgcacccgttgctgataaccaaaacagcttaacagctggtccgcgtggtccattacttgcacaagatttatggcttaatgaaaaattagctgatttcgtacgtgaagtgatcccagagcgtcgtatgcacgctaaaggttctggtgcatttggtacttttactgtcacacacgatattactaaatatactcgtgcaaaaatttttagtgaagtgggtaaaaaaacggaaatgttcgcacgttttactaccgtggcaggcgaacgtggtgcagcagatgctgagcgtgatattcgtggttttgcattaaaattctatactgaagaaggtaactgggatttagtaggtaacaatacgccagtattcttcttacgtgatccacgtaaattcccagatttaaataaagcagtaaaacgtgatcctcgcactaatatgcgttcagcaactaataactgggatttctggacattattaccagaagcattacaccaagtcactgttgtaatgagtgatcgtggtattccagcaagttatcgtcatatgcacggtttcggttctcacacttatagtttctggaacgaagcgggcgaacgtttttgggtaaaattccacttccatacacaacaaggcatcaaaaacttaactgatgcagaagcggctgcagtcatcgcaagtgatcgtgaaagccatcaacgtgatttatatgaagcgattgaacgtggtgatttccctaaatggacattatttgtacaaattatgccagaagcagatgcggaaaaagtgccttaccacccgttcgacctaaccaaagtgtggccgaaaaaagattatccgttaattgaagtcggcgagtttgaattaaaccgtaacccagaaaacttcttcgctgatgtagaacaatctgcatttgcaccaagtaacttggttccgggtattggcgcaagccctgacagaatgttacaagctcgtttatttaactatgcggatgcacaacgttaccgtttaggtgtgaactaccgtcaaattccagtaaaccgtccacgttgccctgttcatagcaaccaacgtgatggtcaaggtcgtgtagatggtaactacggtagcttgccacactacgagccaaacagcttcagccaatggcaacaacaaccagactttgctgaaccaccacttcgtatcaacggagatgcagcacactgggattatcgtaacgatgataacgattacttcagccaacctcgtgcattatttaacttaatgaatgcagatcaaaaacaatcattattcaacaacacggcagcagcaatgggcgatgcgcctgatttcatcaaatatcgtcatattcgtaactgccactggtgtgatgccgcatacggtgaaggcgttgcgaaagcattaggtttaaccgttgaagatgcattaaaagctcgtgatactgatcctgcattaggtcaaggtggattgttataatctttcgagttaattattttaaataaataatagtagtaatgaatctgcacccaaaagttaggctaaggtttaactgattagggtgcagatttttttcaatgaaatattactaattcattacataatacttgaacgattttgtaatcgttcaaaaatttgaatgtaaaaataacctataatagcttccattttttatggtaaatattgtatttaagtaatgctaaatatatatcatggcacaaaataatgaggtataaaatggctatcattccccgtcactgcagtaaaatcttcgcgtaatcccataccgcaagccacatcccccacaacccaagagccgataattggatacattccatcaaaacttggcaattcaaatttttgttgataaacataacctgaattagcataaaacgttgagtgttcgcttcctttcgctgcaaattctacaccattatttttctcataatagaaaacattggcaccttctcgacctaacaatggttttttcacccacatcaataaatcttttggtaattcaaaaggcgtaaaataagcaggcaataaattcggatgattaggataacgcgcccaaagttttgccaatagtgctttattacttaacaacattttccacgctggttcaataaatcgtgtttcagccgttgtaatatggcgagcaaactcagcgtggcttagccattctagcggatacaatttaaataacatttcaataggttgatcatttaaatctacaaatttttttgtttcgctgttatagccaatatcttccaccgctaattgatgaatattccaacctgcgttataagccacatcagctaaataatccacattgccccaatcttcacggccagcatcctgcatggcactcaaatggaaatctgttttgccactttgttgtttcaaaaattggaaatgttttattaattcttcatgaatccagttaaattgatcacgatgtttcaagccctcaatttgctccaaccactgccattggacaatcgctgcctccaacaaagatgttggtgtatcggcgttatattcaaacatttttaggttgttgccatcatagccaaaatcaaagcgtccatataaataaggatcttgattacgccaagaggtttcaacaagctgtttttgcaactccgtaaaatgataattttcataatcgccttttttaatttcatccgccgcaaaatctaaacatattgaatgcaattcattagttgtatcctcaatgcgatcaatttccgctaaggtaaattcataggcaacattatcagaccaataatgagatccatcactggaaggcaagttataataatcaaatccaacattaagtagctgttgcaccatatttggtcgagtaggaaacccagttacacgtttcatttagcccccactgctacgatgagtattatttgggctactaaaaccaccacgagatacaggtttgctattcatgcttcctgcatttcctttcacgagcattggttttccaacagaacgattcgtttgaggttgcacaacttgccctgttggtgtggtgacagctcgatttccaggatgatagcttgggccaaggaaactactaattgcacgagccgccatataccctataacgccaccagcaattgcggctcctaaagaaggatcggtactttcagcttttgcagttgattcagcattgttctcgctttgattagcttgtacattattttcagctggattttttaccgcactttctgcattaccattatcacgaatatttaaaccaagcccctgctgtggtgtagtttcagttttctgagtactttcagtatttttatctgcctcacaaagctcaatttttttccaatccgctaaacaatcgtctaaagactgatacacatcacgttgtacttgctcttctgaacagcctcctaataaggccacaatagataaactaactaaaatctgatttttctttttcattgttctcaatttttatcgaatggttttcacgcctagccattgctcagcctgtttattagtaatttcttcacgagtccacatactcattaaatctggttgtggatatttattgctgttatagccgactaaacgggcaaaatcaaatacagcatgaggatagccattaataagcaacaaggctaaataaccactctcatcccaacaaatttcaagtttgcgtgcttcatgatgattagaggttgaatcaacattatacacgtgcaacatatccactatcggttgagcattttgacgcatatcgagcgcataaaaatagccagtttcgccgtcatcttcaaacattacggcaaaatgctcaaatactgtcgaatgtgttcccacttgctttggcgttcctaaaaagagttcgtcctctaaagttaaatgtaacattctctttcctttaaatattagatataaaaacaccgcacttttatacaaagtgcggtgagattttacagtaaattcagcgtgaattacgcttgacctttaaccgcttttaagcctgggaatgctgctggagtaccagcgcgttctaatgcttcttcgatacggattaattggttgtatttcgcaatacggtcagaacggctcatagaaccagttttgatttgacctgctgctgtacccaccgctaaatcagcgatagttgcatcttcagtttcgcctgaacggtgagagattacagcggtgtaacctgcatctttcgccattttaattgctgctaaagtttcagttaaagaaccgatttgattgaatttgattaagatagagtttgcgatacctttttcgataccttcttttaagattttggtgttagttacgaataaatcatcgcccactaattgaacacggtcgcctaacactttagtttggtatgcaaaaccttcccagtcagattcatcttgaccatcttcgatagacacgattgggtattgtttagttaattcttcaagatagtgtgtgaactcttgagaagtgaatgatttaccttcacctttcatttcgtacataccattttctttgttatagaactcagaagatgcgcagtccatcgctaaagtaacgtctttacctaatacataacctgctttttctactgcttctttgatacaggctaaagcgtctgcgttagaggctaagtttggtgcgaaaccaccttcgtcaccaactgcagtgctcatgcctttagattttaatacttttgcaaggttgtggaatacttcagcaccgatacgaagtgcttcacgtaatgttttcgcaccaactggttgaatcatgaattcttggatatcaacgttgttatctgcatgttcgccaccgttaatgatgttcatcattggtaatggcatagaataaacaccagcagtgccatttaattctgcaatgtaagcgtaaagtggtaaacctttagatgctgcagctgcttttgcgtttgctaaagataccgccaagattgcatttgcaccaaagttagatttgttttcggttccgtctaaatcgatcatgatttggtcgatttcagcttggtttgttgcatctttaccaacgatagcttgtgcaatttcgttgttcactgccgccacagcttttaatacgcctttacctaagaaacgagatttgtcgccgtcacgtaattctaatgcttcacgagaaccagttgatgcaccagatggagctgctgctaaaccaacaaaaccaccttcaagatgaacttcagcttcaacagttggattaccgcgtgagtcgatgatttcgcgaccaatcactttaacgatttttgccatttttattttcctcaattaagttaattaaaacgggttaggcgagcctaaaacaggcgatatgataaagctattttgagattttgtcttgtaaaaaatgcgtatgctttgatctttatctatttattgtcttgagatacttagagcgcaggcataagccgagctccacgcccactggaagttataaccaccgagccagcccgtcacatccaatacttcaccaataaaatataaaccgctgacttggttgctttccattgttttagaagaaattactttagtatccaccccacccattgtgacttcagctgtacgatagccctctgtgccatttggagtaaattcccagtgatgaataaaatccaccagattttttacccgcactttgctgatgttagcgctaacttcatcttgcacaatgccttgttcaatccaaagttcgaccaattttttcggcaataatcgaaccaagatggttttcaacatttgttttggtgaatgttgttttgcttgattaatttcctcttccacattgtggttcggtaataaatcgatttccactgactcagtgggctgccaataattagaaatttgtaacaccgcagggcctgaaataccacgatgagtaaacaaaagctggttgtaaaaagattttccgcacagtgccgtgatagtgacaggcaagctaatacctgaaagtgcggttaaaaatttatctgtttctcgataagtaaaaggcactaaactcgcacgaggcggaataacaggaatgccaaattgttccgcaatttgataaccaaatggcgttgcgccaagcccaggcatagaaagcccacctgtcgcaacaatcaaatttttacattgccattgggttgaatttacctgtaaaacaaaccgcactttttcatcattttgaatccgttcaacttgagaaacttcgctacgcaataaaatcttagcaccatatttatcgcattcagatttcagcatttcaacgatttgttctgcaccctcatcgcaaaataattgccccaattccttttcgtgataagtaatcccttgctccgccactaaagaaataaaatcccagttggtataacgagctagtgccgatttgacgaaatgaggattttgcgaaagataatgagctggcgtaacctctaaattggtgaaattacaaaacccaccgcccgacatcaaaatcttacgtccgatttttttgccgttgtcgaaaactgttaccgacttgcctagcttagccaattgtgcggcacaaaataatcctgccgcacccgcaccaataataatattttcagaatattggctcacggattttgtcctttttcaccacgttgtaaaaaatccaacatcttcattcgttgaataactgaacgacgatccactgccgcattacctgaatctaataactgctgtaaatacataccggcttgttgatattggcgattttctaaggcaattgtcgccaacaaagaaagactagatacttcatttttatcttttgccaaagcttcattcaaaagttgctcgacttttggggtcacttgctgacctgcttgataataaagtgcggtggctgccaagcctaaaatattaggtttacttcccgacaatttttccgcattagaataagccacaagcgcgctatcaaattcattattctgcacataggcttccccaagttgaagccaagtttccgcattattcggatcagttcgcagtttattttggagcttctcaatcacattttcatttttgtgttcatcattcatttcaacattttgattatgttgctcaatcatcgattgctcgccttgttgaacacgactaaaacgatcaagggaaaaataataagtagctggaatagcgatgagtaaagtaaaaagcacaaaataaattttgctattcacttttcccttagaaagtttacttggctccccttgcttgcggggggagctgccaaaggttgaggggagggaaattatttcatcattctctagttgttgtgcaaccactttttctgaaaactgttttttcctatttgagaaataaagcaatactgcagctagaattaaaagggcgactggcaataaccataacaacgccgtattccatttgaatggcggtttgtaattcacaaaatcaccaaatctagccgtcattttatcgataatttgctgattgcttttgccctcatccaccattttgtacacttcaagacgcaagtcataagcaattggagaattagattccaccaaattttggttttgacattgtgggcagcgtaaagattttgccaactctacggcacgagtacgatcatcttgattttggaattgataggtatccaccatttccgcttgagtaaacaaggaaaatgcgaataaaagtgcggttgcaaaaacaaatgttttttgaactcgagtaaaaatatctaataggcttttcatttattcttcaatgcttcaatttttggcaaaaataccgtttgccaagtttctttatccaataaaccagaatggcgataacgaatcacaccattttcatccacaagataagtttctggcgcaccatccacgcctaatttgagggcaagttctccctgactatcatcaatagttaagatgaacggattgcccattctcttaagtatttcaataccattttgcggattgtcgcgataatctacacccacaataggcaacgtttttgcaatctcaattaacaacggatgttcttctttgcaataaccacaccaactgccccacacatttaataaaaatggctgtttaggaaaatctttcgggcttacgatttgtgatggatcatgtaaattagcctgataaaactctggaacgggtttatcaattaaagccgacgcaatttttttcggatcttgatttaacccagcaattaataatacacacacgcctaaaagcacaaagagcggtgcaaaaaagagaagttttttgttcattatttttcctgttttctgcgtaatccgaagacgctaaaaagtgcgccaaaggccattaaaataccgcccgcccaaagccaacgaatcagtggtttataatgtaagcggaaagtaaattcccctttgccgagagaatcgcccatcacaatatataaatcgccccaaaaaccgccattaagccccacttcactcattgtcattgtacgaacatcgtaataacggcgttcggggataatttctgcataaggtttaccattttcagttacgtcaaaaaaggcgacttctgccgtaaagtttggtccgatttcattagaaaattggcgatagtgaaattcatattgtcccagcgtttgactttgttgcggtgctaaacgcacaccaatttcactgccaaaataaccactcattaccgcaccaatagttacaatcgccacgccacaatgcgctaaaatcataccaaattgagacaaacgaatttgtcgccaattttgccataaagtgaccaacaaaagccaaatcgcaagagttaataacacaaaagcgaaagcgtgaaaattcaacgcagaattatggcgtagctgttgccaaatcattaggcctgcaagaattaaagacggaataagcaaccacccacaacgtatcaataatgtgcgatcaaattgccccttacgtatgctaagcacaattaccattaggattaaaatcgccgtaataatggggaagaaaatactattaaaataaggacttcccaccgaaattgagccccaattcatcgcttggaataacatcgggtaaaaggtacctaaaaaggtagaaaccgtcgcaatggtcagcaaaatattcagtaataaaatgccacccgatttagaaatgaactgaaatttcaccgcactttctgatgaacttcccgctcgtaaagcgaataaaccaaaggctaacgctgtcaaaacaaagaaaattaataacaacacataaccgcgcgtgttatccaatgcaaaggcgtgcacagaagtgagcgcgccagaacgaacaataaacgtgcctaatacgctaaaggcaaaagcaagcagagaaaaaagcgttgtccaataactaaatacgccttgtttttccgtcgccattaaactgtgtaataacgctaacccaagcaaccaaggcattaaagacgcattttctacgggatcccagaaccaccaaccgccccagccaagttcgtaatatgcccaccaagcaccaagcacaatgccaatggttaaaaacaaccaagaaaccaacacccatccacgcattgagcgggcaatttgtcgtgcagattggttataaatcaacgcactcaaactcattgcaaaatttaccgcaaagcccacatagccaacatataataaaggcggatggaaaattaatcccacatcttgcaacattggattgagatcgcgcccttctgcgggagcagggaaaatgcgtccaaatggattggaataaaataaaataaacaccgcaaaaccaaagcaaatcaatcccaataaagataaagattgagcggaaaaagtgcggtcattttttcgattaaaaaaagcaaaagcagcaagccataaactcaatgaaaataaccaaaacaacattgaaccttcatgtcctccccaagtggcagccactttaaaaaatgtaggtaattgagagttggaatgtgccgctacatattcaagggtgaaatcatccaccgcaaaagaataagtaagcaaaccaattgagaacgtcgtcgcaagggtaaaaatataactaagcggccaagcagcattaattaaagtcgaattttttttgaacaacccaaattgaggcactaacgcaagaaaaaacgcgctagctgttgcgagtaaaagaaggaaaaagccaagttctggaagcataatgtcgtcgtttttttcgttgatgcgcagataaagtcgctaatcaagtatgtttcattaataaaattaaaaatagcaccttgataggtgctattgtgcttataaaaattaatgattaaattcagcacctaaacaagggcgaattttatttaacatttctttaattacgcgtgatggtgcagcaatgatattgccactgcgtaagtagccgttaccagcatcaaaatcgcaaactaaaccacctgcttcacgcacgattaaatcgccagcagcacaatcccatgcttttaagcccatttcaaaataaccatcaatacggtttgacgccacatagcataaatctaatgcggcagaacccgtacgacggaaatcagcggcatcttcaattaaggcattcatcattgcaaattgagctggcattaattttggttgtttgaatggaaaaccagtggctaaaattgaaccttgaagttcacgtttactatctacacgtaaacgtacttcatttaattttgcaccttcgccacgcacagcagtaaataattcattgcggattggatcgtaaacaaccccgacttcagtgcgattttttacacgaactgcgatagacacagaaaagtggggaagccctgtcataaaattacgagtaccatctagcggatcaataatccattgtacatcgctatctttgccttctttgccttcaattgcgcctgtttcttccgtaataattgtgtgatcaggataagatttacgaataatttcaatgatttctgcttctgccgctttatcaacgtttgttacataatcattaatacctttttgtgtgctttcgatagcatcacggcgttcataatttttagcaatcacattacccgcttttcgtgccgcacgaatagcgatatttaacattggattcatatttccaccagattttaaagaacagaaaaattccgcaccattatagcgagatttgccaaaataaccagttgaaaatcataaaacaatggtttttatagattttcagaaaaactttgcgatatagatcgcaaaaatcacatcaagtgatttttctacccattatttatggttaaagtgcggtagaaaattggagcgttttatgcagaaaggtgtgacattagtggaattattgattggattagcaatcatcagcattgtgctgagttttgtcgtgccattatggcaaaccgattcacctaaaacgattttagccaaagagcaacatcgcttgtatttatttctacgacaaattcaggttcgtgcagaaaattcatcggaagtgtggtttttacttatcaatcggaaccttgcgacacaacaatggtgcttaacggcacaagtaaaaaataaccaaacttgtgattgtttaaatccgataaattgcccgaaagaggtttatgcgcatttttactatccttattttcctaataaaacgatgattcaaagccatcatatttatccaaaagaaatcacgagatttgatggcattcgtaatactatcgttactcgttgctttattttgcaagcagaaaatgaacgtacgttatttttatttttcaatgttggcagtattcgtttaaaaaccaatcaatttgatagtgcttgtaattaatgatgaaaacattattaaaagggcaaaccctattagcactgatgatttcactggctttgtcttctttattgctgctaagcatttcgcatttttatgtgcaaatacaaacacaaaaccaacaaatgttattacatttaaaattacaagctgaattacaacgaatattacagttaataggcaaagatcttcgccgattaggatttcgagcattaaatgcaaaactgacggaaagcaatttatttttatttgaattagatgaacaaggcacagccatttttattagccaagaagataatgcgccacctaatagctgcgtgttgttcttttatgatttaaataaaaatgggtgtattggtaaaggttcgccgaaaacctgtatgaaaaatgggaaaaatacatctaaaagtagtactgaagaattatttggctataaagtgagtaacaaaatgataaaaaccaaactgacttatcaaagtgttattcctactaattgcacggcagaaacgtgtaaacgtgcttttcaacaaaccgcttgcaacgctgggggaggttgggcagatttattagataacaacgaatatgaaattactaggctacaatttaattggttaattgaaggcaaaggattagaaatcaagttaaaaggaaatttaaaacaaaccccaaatatcagttatgaaacctcccttgtcgttgctctttggaatcaaaaacaatgacaatacaaaaaggtattattacgctgactattctgatttttatttcaggcttattaagcgtaatcttattgttagatgatagcaatttaagtttttttcgggcgcaacaaaatcaacgaaaactgtatgtggaaagaacattacaattacaaagaataacagccttgaaaaaacaaactgcctgccttgatttatcattaaataatgatgaaagtgtaaagcaaatcagcattacgcttgatggtgccacagattcaattcaatattttctttggtgtgaaagaatgagcctatttaaaaaatcgcctaaaaagggagataatcaaggcgcattgaaagattttgtgagtggcgaaaaacttgcctattttcgaccgcacttttcttctccgcccagaattttaaacgcgaataaaacgcctaaactttattggttttcagattcacaagcagaggttgaaattaatggcacggtgtctgccgtattaattgcagagggcgatttaaaattgactggcaaagggaggattagtggcgcagtgattaccaacgggaatttaactttagatggcgtaactttagcttatgggaaaaagacggtggtcgctttagtgcaacaatatagtcagtggaagttagcagaaaaaagttggagtgattttaatgttcaggatgaataaaggaatgtctcttattacattgttattttctttagctttatttagcgttttatttcttgtttttaatcaatggacggcagaacagcgaaaaagtgcggtaaaaatttatcaagattttcaggcaacacaaattgcagagaatcaagctcaacgccaatttttagggttagcttgtgaacaattgatacaacaaaatggcttaacttttcgtattcgatgtgaaaatgaacgcattattgtgcgttatcctacgagtgaaattttgataaaaactcagtaaaatggcgttgttttttctaggttaaatcatcaaaaggtcgccattgtgttcattatttattattccaatcagcttgaaaaacaaaaagaaattctttcttctttattcaaatctttaccacctgaagatccttttcaacaagatattattttggtgcaaagccctaatatggcacaatggctacaaattgaactcgccaaagaaacaggcatttcagcgaacctaaaatttcctatgccagcaagttttatttggcagctttatgctcaaaatttacccgcaacggcattggaaaacccttttgataaagattcaatgatgtggcgtttaatacgcttaatcccgacttttctcgagaaagaaaattttttgcctttacgaaattatttagcatcttcgccacattctgaacaatacaaactttatcaacttagcagtaaaatagccgacttatttgaccaatatttagtttaccgagctgaatggatttttgcttgggaaaaaggcgaagatgaacaaatcactgcgcaaatacgaaagcaacaacctaacctaaacgatacgttgtttgagcaaattcaaggcaatataaaatggcaaggggagctatggcgtgcgttggtcgtcgatgttaaatcagatgttgatgatgctacacatcgagcggctttgcataatcagttcttagccttgcttgcggataaaaaagcaccgaaaaaattaccttcacgcatatttatttttggtattccagcgcttccaactgcttatctcaatattttgcaagcgatatcctctgaagtggatattcatttattttttaataatccttgccaagaatattggggggatattagtgatctacgccttgattatttgcgttctcgtcagcgttatcaattcaataaacaaaatgaaaatcaaccgctcttttctgaggaacaactttctcaactagaaaacgctcagtttgacgtcacttatcaaaatgaaaaccttcaagtaggcaatccattgctggcggcttgggggaaaatgggacgagattttctctataccttagtgcgagatgaagaacatattccaacttatcccgtcaatgcttatcaagaaattaaatcgaacagtttacttggacaattgcaatctcaaattctgcatttagaaaataaaccgttaaatatcgcaaaaaatgaccgcactttaactctacattcttgccacagtgctatgcgggaagtggaagtcttgcacgattatttactcgatttattcaatcaagatcctaaccttacgccaaaagatgtagttgttatggtggcagatataaatcaatacacgccttatattcaggccgttttcgggcaaaaaaatagaaatgctccacaaattccattttcactttcagataataaactttcagaaagcgatgtgttggtctcaagttacttaactttattacgcttaaaagaaagcaattttagtgcggaagatgtgttagcgttgttggatattcctgcgacgcgagaacgatttaatatttctcttgctgatttaccattagtgcgagaatgggtggcggattcagggattcgtttcggtttgcaaaaaaatcaagatggcatcaattttaattcttggcaagctggattagaaagaatgattttaggctatgcgatgcgtgaagagcagggtatttggcaagatagtttggggttaaacagcagctatggcttaaaaggtgaacttgctggaaatttatcgtactttttcaccgcactttccttgctgcatgaaaccctgcaacaagcacattccatcgaaaaatggcaagaaattttaaccgcacttttatcagatttcttcgtacaaaatgaagacactagcgacacgattttctatattcaagagaaaattaatgaattagctgagcatctaaaaatgctccattttactgaaaaattacaagcagatgtgattgccgatgtcatcacaatgaaattggaagatgcgccaaatagcctcaaattccttgcagggaaagtaaacttctgcaccttattaccaatgcgttcagtgccattcaaagtggtttgtttacttggaatgaatgatgccgattacccaagaacacaaacaccaaacagttttgacttaatgcaatatcattatcaaaaaggcgaccgtgttcgccgtgatgatgatcgttatttgttcttagaggccttattagccgcacgtaattattgctatatcagctatattgggcgttccattaccgataatcaaccgaaagaaccctccgtattggtaagccaactcgtggattatattaatcaagggcaaaaggaaaatgtccttactgtcattgaacatccaatgaccgcatttagcccagataatttcaaatataacgagaaatttacccgctcttttgcgacaaaatggttgccaatggctcaatttgacgcaagtgcaagtaattcggaatttgccgtcactatgacagaaaacccagaaaaaatcgaagaagttgaactggattctttagtcagctttgtggaaaatccagtgaaatttttctttgaaaaacaacttggtgtttatttccgcgataaagatgaacgcattgctgacagtgaaaacttcactttaagtgggttagataattattctctcaataatgacttaatttaccttgatgaacaaaattttgctgattattttagacaagcagaagtaaaaggcgtgttaccgcgcgcagagtttggaaaggtttatgctgaaaatattcgcgataatgttttagaatttaaagagaaaatagccgatcttggcgagcctaaacaggcttctatagattttaatattgccgtagattggcaaaacgaaaatcaaaaaatccgtttatttggttatatggaggctttatttggcgataattcacaagtcattcactggcattttgcgaaatacaaagatcgttattgtattcgtccttggatttattatttaattcaatgtgttacacaagaaaatgcggtaccagcaaaattaattacgcaagataaggttctcgaattaccgcctattgagcgtgaagttgcgcttgctcaattacaaatttacgtaaaagattatttacaaagccaaatagaaatacaattggtgccaacagtaagaaatataagtgattttattgtaagtgatgaaaattccgtttctgaaaaacttcaggaattaactgaaagtaatggtttcgggtcaaaagccgatccatattggtcacgagtattagcgcagacctcaagatttaaacaacctgaaaatattgcgaaattattaaaacaaacaaaagcttggtttggcttattattcgcacaaaagaagacaagaaaggcacaaagctaatcgtcaaataacctattttttagtagaataacacccttttatggagaattatctatgcactgtccattttgtgatacagaagaaactaaagtcattgatagccgtttagtatctgatggttatcaagttcgccgccgccgtgagtgcggtcattgtcacgaacgttttactacttttgaaatggcagaattaatcataccgaaaattatcaaaactgatggtacacgtgagccattcaatgaagataaattgcgcagcggtattcaacacgccttagaaaaacgtcctgtaagtgcagatgatgtagaaaaagcaattaatcacataattcttcaactgcgtgcaactggagaacgtgaagtgccaagtaagttagtgggtaaacttgcgatgaatgaattaaaaaaactcgataaagtggcttatattcgttttgcatcagtctatttaagttttgatgatattgatcaattcactatcgaaattgaaaaattaaaggattaattatgcttgaattctcctcacaagattgcgtatttatgcaacgtgccttagatttagccgccaaaggtcaatataccactacaccgaacccatcggtgggatgcgtattggttaaaaatggtgaaattgtgggggagggctttcattttaaggcaggacaacctcatgctgaacgcgttgctttagctcaagctggtgaaaatgctaaaggagcaaccgcttacgtcaccttagagccttgttctcactatgggagaacaccaccttgtgcattaggattaattgaggcgggcgtagtgaaagtcattgcggctatgcaagatccgaatcctcaagtcgcaggaaaaggtttgaaaatgttgtctgatgctggtatcgaaagtgcagtgaatctattaaacgatcaagcggaaaaaataaataaaggctttttaaaacgaatgcgtcaaggtatgccttttgttcaactaaaacttgccatgagtttagatggacgaactgcaatggcaagtggagaaagtaaatggattacgggcccagatgctcgttcggacgtacaaaaaatgcgagcaaaatcatccgcacttttatctacttctgcgacagtacttgcagatgatccaagccttaatgtacgctgggacgaatttcctgaaaatcttaaaacagaatataaaaaagaatggcttcgccagcctgtgcgagtcattttagattcacaacatcgcattcagccgactcataaactttttttaacccattctcccgtttggttagtctctagtgaaacacgagatttaacaggctttcctgatttttgtgaacaaattattcttccgaaagaaaatttactaaaagaattaatgcgagagctgggaaaacgacaaatcaataccctttgggtagaagctggagcaaatttagcgggcagtttaattgatgcgaaattagtggatgaattgattatttacattgcgccaaaattacttggagacaatgctcgtggtctatgccaattaccgaatttaactaaacttgccgatgcaccattatggcaactcaatgaattagaacaaatcggtgacgatataaaattaacttacacaccgaaaggagtctaaatgcttaaaaaacttttccattccgcactttggggcttggctgctgcgggcgtgattttgtttgcggttccaagactgaataacagcaatatcttcacttcagacgatattatatcgttcaaaaatgccgtgcgtattgcctctccagcagtagtgaatgtttataaccgctctttttcttccgccagcattaatgataatgatcagctacaagtgaataacttaggttctggtgtgattatgagtaaagatggctatattctgacgaataaacacgtcatccaaaatgcagatcaaattgtagtagcgttgcaaaacggaaatatttttgaggccagtcttgttggttcagatgatctcactgatctcgctgttcttaaaattcgtgcagataatctttcaactattccacaaaattcagcgcgtcaagctcacgtcggcgatgtggtattagcaatcggtaatccctacaacttaggacaaagcgtgtctcaaggaatcattagcgcaatcggtcgtaatgcggtaggcgattcggtgggcagacaaaattttattcaaactgatgcttcaattaaccgcggcaactcaggtggcgcattaattaattctgctggggaattggttggaattagcacgctaagtattggcaaaaccgccaatgaaatcgcagaaggactaaattttgccattccaatagatattgcaaatgatgtactacgtaaaattatgcgtgatggacgtgtgattcgaggttattttggtgtacaaagtgatattagttcaagtagtgaagaaggcatagttatcacagacgtaagcccgaacagcccagctgcgaaatcaggtattcaagttggcgatgtgattttgaaattaaataatcaagaggggatttcagccagagaaatgatgcaaattatcgcaaatacaaaacctaattcaaaagttctcgtcaccattctacgattaggcaaaatcttacaaattccagttgttattgaagaatttccagtaaattaaaaatagcggtctattttgaccgctgttttcattatatttaatactttcttttcaatttgaaaatttatttgttctaaccccttttctgacatttcgggcaaaagaaactattacgctgtccaataattaaactttcaatttttccaccgcactttggacaaggtttatctttattgccatataccaataattcttgtgcaaaataacctgggcgaccatcgggctgtaaaaaatctttaagtgttgttccaccttgaataatggcttttctcaaaacatctttaatcgtgttcactaaagagaaacattgattgcgcgtcaaatttttagcgagtttaaggggatgaatgccacaaataaacaaactttcattcgcataaatatttccaacgcccactaccacagcgttatccatcaagaaagttttaagtgcggtagatttttgacgagattttttgaataaatattctgcattaaattcatcagaaagtggttcagggcctaactttaagaaaagatgaaagtcatctagattctccgtccacaaccaagcaccgaaacggcgaggatcgttatagcgtaataacttgccattattcactacaatatcaatatgatcatgtttatctattgcactatcctgtggcacgattcgaacagatccagacatacctaaatgcccgatgatatagcctttttccgtgtgaataatcaaatattttgctcgacgagtgagatcgacaatttttacattttttagcgttattaattcttctgatacagcccagcgcaatttaggcttgcgcacgacaactttctcaatcgtaaaattcttaagataagggctaataccacgtagtgcagtttcgacttcaggaagttctggcatgattttcaacttagtaagtggatagaataatgatataaagtgcggttagttttaccatttttttatattctttgaaaattaaaatgatgaatatttcaaaaatataggtagttatctaatggataaaatttatatatctcgtttgatctatgctaaaagatttttattttacagaatagccgcctgttttcagatacaagcggttattttttgtgttaattgactaactaattaatcaatgggtggtgtgtaagtgccatttttgatgtcatctttaatgcgatttgcttctgttagtacttgagttaataacgctttaacattttccaatgttgcaatcgggcttagggtagtcattttcagtgattgtttgtcgcctactttagtcacgccaatattcgcttctcctcgagcaaagagttcatctgccacgttttggtttagtgcatcaataaattcagctggatagtcttttggtacgacacggaataacaccgatgcaaactgacttggcacaagcatttctaaggcaggagtatcgttgatgtattgctcgacttctttggtcagttttacgccgtgatcgatcattgaagcgtaaagatcttcgcccaatgcttcaagggtaaaccataattttaatgcgtcgaaacgacgagttgtttgtagcgattttgccactaagtttggcacgccgtgagcttcatcatattccgaattgagataatccgctttgtaattgataaagcgatagttctcaggatctttcaacaagaacgccccacacgagatcgtttggaagaagtgtttgtggaaatcaagcgtgatggaatcagttaattcaataccatctaagaaatagcgataatctttggaaagcaataatgcgccaccccaagcggcatcaacgtgtaaccacgcttgatattcatcggcaagtttgcggattgcttttaaatcatcaattgcgccagcatctgttgtgcctgcggtagcgacaatacaggcagtaattttgccatcagctttaagctgtgcaagtgtttgtttaagtgcaataagatccatttgtgcattggcatttgatggcacggtcacgaccgattggaaccccatgcccatcattgccatatttttttgtacagagaaatgtgcgttttctgaacaaatcactttcactttttgcattgcttctgctggaataccatcacgttgtactgaccattcagagccgtcttcgtttttccagtggtttgcaatcgcccaatcgcgtgccaacaatacgcccattaagttagattgagtaccaccagaagtgaacacgcctgatgtgccttcgccatagcctgctttttggcgtagccagttgatcaaatgctcctccataattgaacctgctgggctttgatcccatgaatccattgattggttggtcgcattaatcagtacttccgcaatttggcttgttaccatcgttgggcaatgtaaatgggcaagtgagtgtggatgatgtactttaaggcttggattaaggaaaatttttaccaaatgatcgagtgatttctgtacacccataccctctttcgtcggattaaaaccgcttattaaggctcgcatttgtttgattgaaccgcctgtgtacattttttcatttttcagccaagcagagactgcttgcaccgcattatacatcgctgtttcataatcgttaatggcttcgttatcgttgcaaaacaaagcttgtttgtgttgtttgaggtttgacataattattcctagatatgaattacacccaattttctgtacgtaatgctataactcgctcaaattctcttaaattgttactaaccagaattaacccttcactacgagcatgagcagctatatgaatatcattttcgccaatcaatttcccttgtttagagagttcagctttaatattgccgaaatgagctgcatgctttggttggtaatctaaaatggtgaggcgtgataagaaatcttcaataaccgcaatgtttctttcgggatattcgcttttttcagctccataatagagttcagccacagtaatgctactcacgcacatttttcctgcattttgattaaagcgagaaagaatttccaatggcctacgcttaatcacgtaaatcacaatgttagtatcaagcatatatttcaacactataaagcctcacgctctggttgaaatgcaatttctcgttcattcataaaatcatcgctaactgcttgatcattcaagaaaaaactatcccaagattggttgagaggcgataaaatccgatcactgcccgatacacgaaccgataattttttgatttcttcagaaaagcgaacttcagcgggcaaacgcacagcttgacttcgattagtcataaaaacagaggcttcaatcatagttattccttatgcttaattgtatatagcataagtatatcccagttttatacagttgagtagaaaaaaggtgggatttccctaccattttgaatttacaagcggtcaaaattcgcaaaacatttgcaaaatcagaccgcttttaattaactacgcaccactttcaatgcgtctacaacagattgtttgaagcgtttgatgaactcttcacattcactttggttgatgtttaccgcacaaagcacgcgaaccacgttgccaccgcgtccgccacgttcgagcaagagtttgtttttgaagcaagctttttggattgctgccgctaattcacaatcgcgcgggtaagcccctatcgcatctttcgcttggcgttcgtctacaatatcgatccccatcattaagccacgaccacgtacgttgccgatgcacggatattctttgcttaattcacgtaatgcgttggttaagtattcaccacgctcttgggcattttgtgcgaggttttcatcacgcataattttaagtgaagcgtaacctgtcgccatcgctaattgattgccacgaaatgtacctgtatgtcctgcaggttgccaagcatcaaattctttacgaatagctaatacagctaatggtaagctgccaccaactgcttttgacatcacaataatatcaggctcaatgcctgcgtgttcaaaggcgaacattcttccagaacggcagaaacccgcttgcacttcatcgacgatcattaaaatgccgtgtttttgggttacttcacgtactttttgtaagaagcttattggtgctggaacaacgccgccttctccttggattgcttctaaaattactgcagctggttttactacgccactttctacatcttcgatgaagttctcaaagtaatgttcaactgctttcgcgcctgcttcgccaccaatgccaaatgggcagcggtattcgtgtggatatggcataaattgtacgccaggcattaaattttcaacggcattttttgcaccaagattacccgttaaggctaatgccccttgggtcataccgtgaaaaccgccagagaaagcaatgatattgccacgccctgtgtaagttttggctaatttgatggctgcttcatttgcatctgcaccagaagggcctgtgaattgtaagatatatttatctttcgggaagaatgacaataattcttcactaaacgcatctttaagtggagtggttaaatctaaagtgtgtaacggcaatccgctatctaatacgtctttaatggcttgcattaatataggatgattatgtcctaatgcaagggttcctgcgcctgctaaaaagtctaggtattcattaccttcaacatcagtaacccaacagccttgtgcttttgcataggcaaaaggtaatttgcgaggataactacgtacgttggattccattacatcttggcgatctaaaaaatgttggtttgaagcaagaattgcttgtacaggggtaatcattgtcatttttgattaaaaccttctaaaagaggtgaaaaaaataagtcgggtgccttgcgataaatttactgtttataaaacagacacatagggcatttgactcgctacttattaaaaaaagcgtttcagcttttttgtttttaccctagtttgcccattggacgggctaggttggaaacaggttttgatgtagggttacgtcaaaacggggacaattgtatattctttttgcaatatgaaaagcaaatttagcttcttacgagtcaaacggctaaataaaaagcaaacgtttctaataagaacaaataaaaaacccgagtttctactcgggtttaaaataattaaatcaatattatttgatttttgcttctttatagataacgtgtttacgcactactggatcaaattttttgatttccattttttcaggcatattacgtttgtttttatcagttgtgtagaagtgacctgtctctgcagtagaaactaaacggattttctcacgagcacctttagctgccattttttagctccttagattttttcgccacgagcacggatttcagctaatactgcatcaatgccttttttatcaataatacgcatacctttcgcagttaaacgtaaggttacgaaacggttttcactttcaacccagaaacggtgagtgtgaaggtttggaagaaaacgacgacgtgtcgcattcattgcgtgtgagcggttattacccacagctggacgcttgcctgttacttgacaaactctagacataataatctccaataattaaatataagctcgagcttacggttcggattgtttaaagctggttaaacctagcttgctacctcgtcaggtcgcgctaatccgacccgcttactatattaaaggtcgcaaattatactgactttgttttcatttctcaagtgtaaatgcgattttcctgaatgtaatcggtaaaaaaatggtcaatattataaaaatttataataaacaattctccgcgaaagaataacaatcgcttttccctacaattaaatgatcaagcacgcgaatttccattagttcagccgcatcttgaatttttttagtaataagttgatccgaataactcggctccgttatacctgaaggatgattatgtgccaaaattaaagctgccgcattacaatagagtgcttctttaataatttctcgcggataaaccgctgatacattaattgtacctaaaaataaccgctcttttttaatcaaacgatgttgattatctaaaaataaaaccataaatacttctctttcctcgtgttgcaattcagtgagtaaaaaaagttttaccgtttcaagatcattaataatcggcgtacttaacatctcttgctttaaataacgcttggtcatttccgtaatcgcttgcagttgaataaattgcgtaatacctaagccttttacagaacagaaagcttttttatctgcggaaagtaaagcgtgcaaggagccaaaatgcgttaatacatttttagaaagtgacataacaggacaatctttgataccagtacgtaaaaaaatcgcaagtagttcataatcacttaatgcttttgctccgaatgccagcaatttttcccgtggcattaattcatcattgttttccatatatttataaaagaaaaataagaaagattttgaccgcactttttaggtttgacgagcaagtgattcaaaatctgcgatgcatatcgtaaaaatagcgttgggcattcaataaaattaaagtaaaataacgaaattgtggttaagtactaacaagggaagaaaatgaatttaaacggaaaacgtgttgtcgtcggtattacgggcggcattgcagcctataaaacaatagagttgattcgtttattacgcaaagcagaagctgaagtacgtgtagtattaaccccagctgcagcagaatttgttactcctttgacacttcaagccatttctggcaatgctgtatcgcaatctttacttgatccacaagcagagctggcaatggggcatattgaacttgccaaatgggctgatgccattattattgcgccagctagtgcagactttattgcccgtcttactgtaggcatggcgaatgatttactttcaacaatttgtcttgcaactgatgcgccaatttttcttgtgccagcaatgaatcagcagatgtatcaccaatccattactcaacaaaatttaacgactcttcaaacacgtgggattgagcttatcggccccaatagtggttttcaagcttgcggcgatatggggaaagggcgtatgtcagaaccagaggaaatttttaccgcactttctgactttttctctcaaaaacaagatctacaaggattaaatgtcgccattacagcaggcccaacgcgtgaggcaatcgatcccgttcgttatatttctaaccatagttcagggaaaatgggatttgcgattgctgaagcatttgccaaacgtggggcaaacgtcacactgatttcaggcccagtgaatttaacaacaccaaaaaatgtaaatcgaattaatgtcatctcagcacaagaaatgtggcaagcctctcttgaaagtgcggtaaaaaatcaaatttttattggttgtgcggctgttgctgattacagagtagctgaagttgcagaacaaaaaatcaaaaaatctggcgatgaaatatctatcaagttaattaaaaatcccgatattatctcagatgtaggacatttaaaaacacatcgtccttttactgttggatttgcagccgaaacccaaaatattgatgattatgcaaaagataaacttgaacgcaaaaatcttgatatgatttgtgccaacgatgtatctggcggacaagtttttaacgcggatgaaaatgccttgcagcttttttggaaaaatggtcataaaaaattatcgctaaaatcaaaagtagaacttgccgctgatttagtcaatgaaatcatcgaacgctatcaaaaaaccttataattccaaccgcacttttacctaaaaatgaatttcaaacggagtattaaatgaaaaaaattgacgtaaaaattttagattctcgcattggaaatgaatttcctctgccaacttacgcaactgaaggttcagcaggtcttgatttacgtgcgttgatcgatgaaagctttgaaattcaaccaggcgaaaccaaattaattccgacagggctatcaatttatattgcggatcccaatttagctgccgtgattttgcctcgctcgggtcttggccataaacacggcattgtgttaggaaaccttgtgggattaattgactccgattatcaagggccattaatggtatcaatgtggaaccgtggaaatgaaccattcaaaattgaagtcggcgatcgtattgctcaacttgttttcgtgccagtagtacaagctgaatttaatattgtagaagattttcaacaaaccgaacgtggagaaggcggtttcggtcattcaggtaaacaataatttatggtagaagaacaattatctttatcaggcgtagaagaaattgcgcctaaaattgaaacaccgaaaattgaaaaaagaacggtaaaagaacgtcgtcagcaagtgcttacagtattgatacatatgcttcattctgaacgtggaatggaaagaatgacaaccgctcgtctagcaaaagaagttggtgtgtcggaagctgcgttatatcgttactttccaagcaaaacaaaaatgtttgaagcactaattgaacatattgaaagtactttgctgagccgaattacagcgtcaatgcgtaacgaaactcaaacaatgaatcgcattcacgacattttacaaacaattttggattttgctcgaaaaaatcccggcttaacacgtgttctaacaggtcacgcgttaatgtttgaagaagcgcaattacaagcacgtgtggcacaatttttcgatcgtcttgagatgcagtttgtcaatattttgcaaatgcgtaaattacgtgaagggcgtgctttcaacgtggatgaacgtataattgcctcacatttagtgacactctgcgaaggacaatttatgcgctatgttcgtacaaatttccgtctgaattcaagtcagtcttttgaacaacaatggcgttttatcgagccactttttgcctaattgactttaccgagtaaatatatgattattccttggcaagaactggaagcagaaacattagataatatcgtagaaagcgtgattttacgcgaaggaaccgattacggtatagaagaactttcactcaaccagaaaaaacaacttttactgactcaaattcgcaatggaattgcgttgattgtatggtctgaattacatgaatccattgacatcaaaaataaaacggaatttttgaaacaggaatgtaaggagcaagaatgtcaaatgaattaaccgaaattgatgaagttgtaacctcctctcaagaagaagcaactcaacgagatcccgttttagattggtttcttactcactgccatttgcataagtatcctgcaaaatcaactttaattcatgctggggaagatgcgaccacgctgtattatgtaattaaaggttctgtaatggtatcttcaaaagatgatgaaggcaaagagatgatcctcacttacttaggtgcaggacaattttttggcgaagcgggattatttgatgaaggttcaaaacgatcagcttgggtaaaaacaaaaacaacatgtgaaattgctgaaatttcctataagaaatatcgccagttgattcaggcaaaccctgaaatcttaatgtttcttactgcacaattggcaagacgtttgcaaaatacatcacgtcaagtcacgaatttggcatttttagacgtcgcaggtcgcatcgctcaaactttaatgaacttagctaaacagcctgaagcaatgacgcatcctgatggtatgcaaatcaaaattacacgccaagaaatagggcaaatggtgggttgttcacgagaaactgtggggcgcattattaagatgttggaggatcagaatcttatccacgctcatggaaaaacaatcgttgtatatggcgcaagataatttttcatcataatttattcaaaataaaaccatccgaaattaatttgggtggtttttgtttaattgtaaataatattcaaaacattaattgacaattaatataaaggattttatcattgctccacttcttgcggatattgtaggaagacaggattggtctcctgatatagtggctttaaaggtttaaaccttattgcatagttttatgctgcaaaagctagaacaccgagatgcattttttaatctatggtgggctgggtagaaatcccgcagggatgcgtgcagtaagccacttgctgttaagaccaattctgcttagttccaccacccttctttcaaattccctagccttttctagcttaccttaattaatcttttttctttctagtaaaactaatacttcatagtgagatgtttgcggaaacatatcaaaaagttgaattttcaatggtttataacaagttagatgttgtaaatctttacccattgtcatggcattacagctggaatacaagataaagtgcggttgaatttggttgagaaattcacttaattcctttccaattccacgacgcggcggatttacaatcacaagatctggcttattttcatttttattttcaatcacgcttgctgcatctagagattggaaatttacatgttctaaacctaatattttcgcagaatgactggctgccaaaatagcagaggaagaaatttcaattcctgttaatttaatgggttttccccatttttcctgcaacgctttggcacaatgtaagccaaatccacctacaccacaaaatagatcccataggttataaataggtaattcagatacccattgttgagctgttgcatataatccctccgccactttaggattagtttgaaagaagccttgtggacgaataaaaagcggaatactattgaaattttctggcaaaaattgttgttctgtcagaaaaatttcttgttctccctccaaaatagcagcgtgcagtggttgcaaattaacgctaaccacttctaagtgcggtagtttttctaataattttggtaattctcgacggattaacggcaatttattttctgtacgtaacacaaaacgcaacattaattttcctgttgcgatactttctgtcagtaaaatatatttaagctcgcctttttgtttagcaatgttataaggtactaaacctgcgcgaccaataaaatctttgaggattgaaaaaattattgagaaacgtgcaggataaagaggacaatcacacaaatcaatcgcactttgtggatcattaggattttttaaaataccaagtattgggcgttccacactaccactaacaagcattttagctttattacgaaagcattgttcattagattgaaaaggagctaaccattgagctttatcgcaattaatagaaatcagttgctgttttaaatgatgttgtttttcagcaagctgctgactataaggtatttcaagccattgacaagaacgacattcattttgttgatagtatcgacaatcaatcattttttgcggcctgaatatctagccaacggctttgaatatctgcgagatttcgatgattcagtttccaacgttgatctaaaaccaagtcattccattcgattacgctacgcttaaataaattttttaagcgagcttgacgagccataaagtgcggttcattttcagtaagttttagattatctaatacttgaatgacaccttcacgttcattgcacagtaacaaaagatcacaacctgcattcagtgcttttttgctacgctctacaaaattccccattactcccgcgcctttcattcctagatcatcggaaaaaattgtaccttggaaatttaatttcttgcgtaaaatttctttcaaccaatattctgaaccacttgcaggctgactatcacattgtccataaatcacgtgagcaggcataatcgcatcgagtttattttgtgaaatcaactgttggaaaggttggagatcgtaaccaaaaatttcgtcttttgcgcgatcatcataaggtgtttctaaatgggaatcggctaatacatgaccatgaccgggaaaatgtttacccgtagatgccatacctgcttgatgcataccatcaataaaattgatggctaaatttaccgcactttttacatcagatgaaaaactgcgatcaccaatcgctcgacattcatgccccaaatccagcactggtgcaaaactcaagtcaatatccaaagcaatcatttctgctgccatttgccaacctgcttctttagcaaaacttacttgttcagttgctgatagtgtttcttgaaaagcctgcattgaaggcaacattgtaaatccatcacgaaaacgttgaactcgtccaccttcttgatccactgtaattaataaaggcttttttactcgttggcgaacagaacgaattaattcttgaatttgttctctgtcttcaaaatttcgagtaaataaaatcaatcctgcaacaagagggtgcgaaagtaactcaacttcctcttgttccaactcttttccttttaaatcaattaacaaggtgctcataaattattttaaataaaggcggtaatttttactttctacagtaggtttaattaaatcgattgatttctcttcttgtggttttagcgaaaattgagcggaatagctttcttgctgattttcccaaatttgggtaactcctaaatgatcataccaatacaaatggtaacttacattcaaaagttgctgacttttattttttataaccgctgatttttgagtcgtttcaacttgaattaaaggcgaaagagacgacgtaatattcaaaatcggctttgttgaataagttaagttttgctctgaaattgaacaagctgcgagcataaagctcgccaaaattagaaaatattttttcattatttcgctaacattttacctaaaggttctccaccaactaaatgcatatgtaaatggaatacttcttgcccaccatatttattgcaattcacaattaggcgataaccatcttccgcaatgccttcttctttagcgagtttagccgctacgctaaataatcgacctagcgctacttcatcttgctccgtcacatcattcactgtgggaatgactttatttggaataatcaaaatatgtgttttagcttgaggggaaatatcacgaaatgcagtgactaattcatcttgatagacgatatttgccggaatttctttacggataattttactaaaaattgtttcttctgccattgtttgctccctataaaaagtgcggcgaattaacctgtccataattgttgcttatttagtctaacttttaaggacagagcaaatcaatcgcactttttgttttacaatgaatttaattatgcaaagtatcgaacttctccattgcccactacattttctacacaacgtgcacaaagtgttggatgtcctgggcttaccccaatttcgtcagaataatgccagcaacgagggcatttttctgcgttagaacgtgttacgcttaccgcaataccctctaattcgctgtccgctaaatcagcaggtttttccgataaagattttacatctacttttgaggtaattaatacgaaacgtaattcattacctaattgtgctaacaatgcacgatattcgtcattagcataaacggtcacttctgcttctaaaccgccgcctatttctttattgttacgagaaatttctaatacacggtttacttctgaacgaactttaatcagttgttgccagtaagcatcatctaatttttcatcctcgcctaaaccaaataagccttgatagaattcttcagtaaatacgaattccgcacgagcactttcagtttgtggcaagtgttgccaaatttcatcggcagtgaaagataagatcggtgccatccaacgaactaatgcttcagcaatatgccataacgcagtttgacagctacgacgcgcaaggctgtctgctttggttgtatattgacgatctttgataatatctaaatagaatgaccccatttctaccgaacagaaacgcattaaacgttgtaccacagtgtggaattgatagttatcgtatgcatctttaatttcattttgtgcatctaatgcacaagctaccgcccaacgatctaggctaatcatttcttctggtttgactaaatcacgttttggatcaaaaccattcaagtttgctaataagaaacgagcggtgttacgaatacgacgatagctgtccgctgcacgttttaagatctcatcagaaacggtcatttcgcctgtatagtctgttgaagcaacccataaacgtaaaatatcaccaccgaatttatccatgacttcttgtggcgtcactatgttaccgatagattttgacatcttacggccttgaccatccacagtgaaaccgtgagttaatacttgcttgtatggtgctttgctgtttgttgcagtagaaagcattaaagaagacataaaccagccacggtgttggtcggaaccttctaaatacatatcaatatcttgaccattaaattctaggcgatttgcaacaacagaagaataggttgatcctgagtcaaaccatacgtcaagggtatctggcactttgcgataggtttctgcatccgcccctaataattctttttcgtctaaatcccaccacgcttgaatacccgctctttctacacgtttcgccacttcttcaagtagctctaaggtacgcggatgaagttcttcggtttctttatgcacgaacaaggtcatcggcacaccccaagtacgttggcgtgaaatacaccagtctgggcggttttcaaccattttctcgatacgtgcttgaccccaatctggaatccagcgaacttgtttgatttcgcctaatgcttgttggcgtaaaccttgcgtttccatgccgataaaccattgcggtgttgcacggaaaataattggcgttttgtgacgccagcagtgtggatagctgtgtttgattttctcaacttttaataagttacctacttcttgtaatttttctatcacaagcggatttgcttcaaatacgcctttgcctgcaaagaattcggtcgttgaaataaatttaccatcattcgatacaagacccgccattggtaaatcatattgtttacccacgataaagtcgtctaaaccgtgatcaggtgcggtatgtactaaacccgtgccgccatcagtggttacgtgatcgcctaaaattactggtacagtaaaatcatagaatggatgatggaaacggcttaattcaagatcagcaccttttacagaacccagaatttcaacttgttctacgcccaccgcttttgccactgactcaactaattcagcagctaaaatcacgcgctcatcgccaagttggactaagttgtattctaagtctgcattcaccgcaatcgcacggttagacggcatcgtccaaggtgtggtagtccaaatgatggctgataatttaccttgtcctctaccttgtgcagaaaatttagcttcaatttcaaccgcactttccgcagggaaacgaacgtaaattgacggagaaactttgtcttcatattccacttctgcttctgctaaagaagaaccgcaatccaaacaccagtgaactggttttgagcctttatacaaatgaccattttcaatcactttacctaaagtgcggataatattcgcttcggtatcgaaattcatcgtgagatatggattatcccaatcgcccaacacacctaaacggataaagtcttttttctgaccttctacttgttccgaggcatattcacgacatttttgacgaaattcagccgcagaaattttctcgtttggtttgcccactaaaccttctacttttaattcaattggcaagccgtggcagtcccaacccgggatataaggcgaatcaaaacctaacgccgttttggatttaataataatatctttcagaatcttgtttacagcgtgaccaatatgaatgttaccattcgcatacggagggccatcgtgcagaataaaagattttttgcccttactcgctttacgaattttttggtaaagatttttctcgtaccaatttttcaacatatcaggttcgcgcttagctaaatcaccgcgcattggaaagctggtttccggtaggttaagagtgtttttgtaatcgactgtcattttattttccaatttttacattttaaaattaactgttaaaaaacgctttcgcagtttctacgtctttctcaatttgcactttcaaatcatcaaaagaggggaatttaatctcgtttctaatcttgtggcagaattccacttccaccatttggccataaatattctgagaaaaatcaaataaatggacttctaataattgcattaatccatttatagttgggcgttttcccatgtttgccacgccgttaaaaatctcccccgattttaaccgcacttttacggcataaacgcctttgattggatttacttgtctatgcaaacgaatatttgccgttggaaatcctattgttctacctaatttattcccatgaatcacacgcccgaaaatacgataaggtttaccgagtaaattttctgcaagttgtaaatcatcattcgctaacgcttcgcgaatcgcagtgctactaattcgctgtgcatctagacaaaaactacggttatcttcaacaataaaaccaaaacgcttactagctgcttgcaacatggcaaaattgccttggcgttttgagccgaatttgaaatcatcgccaatgcttaaaaatttcacatgtagatgattaacaagcgtttgttcaataaaaacatcggctggttgctcggcaaaagtgcggtcaaatttcgccacaattacgacatcgaccttagccttttcgagataataaattttgtcacgcaaacgcattaaacgtgcaggtgcattttcccccataaaatattcacgcggctgtgattcaaataacaataccgccatgggtaaatttaattcgtcagctttttggcgcaaatggcggaggacggtttgatgccctaaatgcacaccatcaaagttgccgatcgttagcgcacaaccttgtaaaacacgatttgcattatgaagcccacgaattaattgcatgtccttatccatgaaaagaagagaatttcggcattatagcgagaagttagttttttgtcagcaaatggtgcttgcgaacgcctaataaaatcaacgttgtgccataaactattgcggctaagacaatcaaccaaacaagccaataaacacgcataaagaaatccatttttgcccattggttgatttcaggcacgtaataccaaactgccgcacccattgcgattgcagccaataaaactttgacaaaaaagaccgcacttttacgtgaaaaatggtacacatccgctttggctaagccgcgatagagcaaataggcgttaagagttgcggacattgctgaagcaatagctaaaccaacatagctgaaaggaatcgccaatagattaaagcccatattactcaccatggcaataatgccaatttttactggggttttggtatcttggcgagcgtaatagccattggcgaggattttaatcaacataaagctaagcaaacccgcattaaacgcccataaagaataagaggcggcataaacatcatttagcatgaaatttccacgcataaagagcgtaagtaacatcggttgagccaatacagcaataccaatggcagcaggaacgccaagtaagaaaatcattcgcacgccccaatccattgtattacgaaaatcaaccgcacttttagctgaatcgccttcacgattaacgtggtggcgagcaagcgttggtaaaattacggtagaaatcgcaatgccaaataaaccgagaggaaattccagtaagcggtcggaataatacagccagctaatagagcccgtcattaagaagctcgcaatcactgtatccagcaaaagattaatttgacttaccgatacaccaaataacgcagggatcattaatttacgaattttggttacgccttcatcccgccaagcccattttggtttcaccagtaaacctgcttgtttcataaatggaatttggaataagaactgtaataatccgccaagaaaaatcccgatagccagtgcaagatctgggttatccatttgtggtgcaaggaaaagtgcggtggcaatcatcgctatatttaataacacgggtgaaaaggacatcacgccgaattttccaatcgtgttaagtacagctccaaaaagcgcgacaaaagtaacaaaccataaataaggaaaagttattttaagaagaagagaggcttgttcaaatttatgtgcatcagggccatcattcatccaatcggtaaaccagcccatcccaaataaagcggcaacgacaggcgatccaaccatcgcaaggatcgtaacaatactcaccaatcccccaagggtaccagaaacttttccaataaattcacgggttttattcatatcgccagatttttgatattctgcgagaacagggacaaaagcctgtgaaaaagccccctcagcaaataaacgacgaagaaaatttgggatacgattagcaaataaaaaaacatccgccgcagcgccagccccaatgagatgagcgataactacatcgcgtacaagacctaacactcttgataataacgtcatagaactaacaacaatgctagattttaaaagtcgtttactcaaaatattcttctctaccctaaaatttttgcctaattgtatagaaattttgtttttacgctatattccgtgaaaaaaaactgataaaatccgccacacatcgtttgtgtgagcccatattgaaagagcttgtaaaaataacgatacttactttcggttgtgtctcaccgaaatcaacacaaattttccattgacaaaagtataaaaaatcggcatattgacgccctttattttgtctatcaatcaacagaaattttaggagtttgaccttggctaatatcaagtcagcaaaaaaacgcgcggttcaatctgaaaaacgtcgccaacacaacgcaagccaacgctctatgatgcgtacttatatcaaaaaagtatatgctcaagtggcagcaggcgaaaaatcagcagctgaatcagcattcgttgaaatgcaaaaagttgtagaccgtatggcttctaaaggcttaatccacgctaataaagcagcaaaccacaaatctaaattagctgcacaaatcaaaaaattagcgtaatttttagctagaaagaatgaaaaataaaaccgcactttaaagtgcggttttttattgcatcgaattttagactaaagtaacaacatcgatccccatttgataatatcaaagaagaatttattttgattggttgcaatgccatcagaattttttggtgtgccatcttcatttttttgcacttccaccataccatttttatattgacctttcacgacagccaaatcatcgtgcgcttcgttacgcaacttcaaacaagactgtttagttaaaggttcaacattgctcactttggtacggaattttttaaactgatagcttgcataattcattgatttttcatcggcttggataatcttcacatattgttcgccaataattttttccaacggatagaaaaagacatattgtgagtgaatatagctatcttcttttgaaaaatgctgttgcaaaattcgagttaaatttgggtaaacgcattgttctacttgcttacttgcaatcgcccattgttttgcatgttgatcggaaagttggtaatcagccccagcaaattccgctggaattgcggattgttgactatcaaacattgaacagccagacagcaatgctgccatacctaaggttgcaattaatttcacatttgatccttataaaagtgagaatgcacaaaattctagcaatatcttcacaacagataaagcagcaaatgaatttagttttcctgatctgaaaaacttccgctataatgaccgcacttttttacgttaattaaaaggaattcttatgcaaaatccaaaagatgatgtgttatatgcgcctgttgaatgggtcgatcacagtgaaggctatagcgatattcgctatcataaatccactgatggcattgcaaaaattaccattaaccgcccagaagttcgtaatgcgttccgcccacaaacagtgaaagaaatgatcactgcattttccgatgcacgtttcgatgaaaacattggtgtcattgtattaactggcgaaggcgaaaaagcattctgttctggtggtgaccaaaaagtgcgtggcaattacggtggttacaaagatgacagcggcgtacatcacttaaatgtattagatttccaacgcgatattcgttcttgtccaaaaccagttgtagcaatggtggctggttatgcaattggtggcggtcatgtattacatatgctttgcgacttaacgattgctgctgaaaatgccattttcgggcaaactgggccaaaagtcggttcattcgatggcggttggggcgcaagctatatggctcgtttagtggggcagaaaaaagcgcgtgaaatttggttcttatgccgtcaatataatgcacaagaagcattagacatgggcttagtcaatacggttgtgccttacgctgatcttgaaaaagaaaccgtgcgttggtgtcgtgaaatgttacgcaatagcccaatcgcaatccgttgtttgaaagcagcattaaatgcggattgtgatggtcaagctggtcttcaagaattagcgggtaacgcaacaatgttgttctatatgactgaagagggtcaagaaggtcgcaatgcgtttaacgaaaaacgcgccccagacttcagcaaattccgtcgtaatccttaattatccgtagttttttatatttataacgacactcttgccttcccctgcttgcgggggaaggtgcccgaaagggcggaagggggctttatatcctttctctaccttcggcagctctccccacaagcagggggagccaagcgtttttgatagaataattcaaggacgtaaaatggcacaaaaatccttcaatctttaccgttattccatccccgttgatagccaacttattctgcgtgatcgttttttaaaacgccgtgaaggcttaatcgtaagagtgagttgcagccgagacggttggggagaaatcgccccactacctggttttagcgaagaaaccctagaccaaactcaagaacaagcaattgaatggctaacgacatggtgcaatgcaagctgtgacgcacctcgcgtaccattagatggcacctatccctctgttgcttttggtatcagttgcgcaatggatgaaatgaaaggttatttacaagccgaaggcaattatcatacggcaccactttgttgtggcgatccagatgaactgtacgccaaacttgcgagcatggaaggcgaaaaagtagcaaagatgaaagtgggcatatacgaagccaatcgcgatggattaattgccgatatgtttttagaagccattcccgatttacaattacgactagatgcaaaccgacattggtcgttagaaaaagcgttacaatttgccgctaaagtcaaaccgcaacatagaaaacgtattcaatttttagaagaaccttgtaaaacacaagaactcagtcgtgaatttgcagctcaaaccgacattgcgattgcatgggatgaatccgtgcgagagcctaatttttgcctggaaaaagaaccgcacttatcggctgtcgtaatcaaacccactttaattggttcaattcaacgttgtactgagctcattaaccaagcacattcgttaggtctaaaagcggttattagttcaagtatcgaaagcagtttaggactctctcagctcgcgcgaatcgcacaacaatacaccccgaatgtaactccaggcttagacacgttagatttgatggaatatcaagtactacgcgcttggcctaattctaatttacctattgttaatttagaatctgaatttatcactaaaattatctgattcgaccaccaaaaatcgaaaaaccagtataatgcgccacacaaaaaggattaaaaatgtcgcaaacacacagaattttgctgttaaatggcccgaacttaaatatgttaggggctcgcgagccaaaacattatggcagtatttctcttgcatccattgaagagaaaatacaaacattagccactcagcacaatgtaaaagtggaatgttttcaagccaatagtgaagaaaaattaattaataagatccacgaaagttttcagcaagtcgattttattttaatcaatcctgctgcctacacccataccagtgtggcattgcgcgatgcacttttagccgtttcaattccttttgtggagattcatttatccaacgtgcataaacgtgaaccatttcgtcatcattcttattttagcgatgtggctgaaggtgttatttgcggtttgggtgcaaaaggttacgagtttgcctttttatttgctattgattaccttgctaaaaaataagaaaatcgagcatttttggcgaaattcatagaattttatcgcaaatttgcaaaatttgaggtaatctctacaacaaaaaaacaagtttattcataaccgcacttttttcgtttaaaagtgcggttaaaatttcaatctttttaggaagaacgtatggacattcgtaaaatcaaaaaattaatcgaattagtagaagaatctggcattactgaattagaagtgcaagaagaggaaggcacagtacgtattagccgtgccacaccagtcgttgctccagcagccgttcaatatgctgctgcaccagtagtagcaccgactcctgccgctgcgccagctcaagcaccagcagctgcgacaccagcaccagccgcatccgatgaattatcaggtcatcttgtacgttctccaatggtgggaacgttctatcgcagtccaagtcctgaagcaaaagcatttgttgaagtgggtcagtctgtgaaagttggcgacgcgctttgtatcgttgaagcaatgaaaatgatgaatcgcattgaagcggacaaggctggcgtagtaaaagcaattcttatcaacgacggtgacgctgttgaatttgacgaaccattaatcgttattgaataatttccaatattttcgtcgggcggactttagtccgcctgtttcatatacaaataattagagcgaatttatcgtaggcgatataaattgaaatctgttcacaccaaattttatagggagaacaatatttcaataacctacataaaaattcacgtctatctgactaaacggactcttttatgttagaaaaagttgtgattgctaatcgtggtgaaattgcactacgcattttacgtgcttgtaaagaattaggtattaaaactgtggcggttcactctaccgctgatcgtgatttaaaacacgttttacttgctgatgaaaccgtttgtatcggtccagcaccttccgcaaaaagttatttaaatattccagctatcattgctgccgccgaagtcacaggtgcggatgcaattcatccaggatatggttttttatctgaaaatgctgattttgctgaacaagttgaacgttcaggtttcactttcattggcccaacagcagatgtcatccgtttaatgggtgataaagtttcagctattaaagcgatgaaaaaagcaggcgtgccttgtgtacctggttctgatggccctgtaggtaatgatattgctaaaaataaagaaatcgccaaacgtattggctatccaatcatcatcaaagcatctggcggtggtggtggccgaggtatgcgtgttgtacgtagcgaagacgcattagaagaatctattgcgatgacaaaagcagaagcgaaagctgcattcaacaatgatatggtctatatggaaaaatacttagaaaacccacgtcacgtggaaattcaagtgttatcagatactcacggtaatgcagtttatttggctgaacgtgactgctcaatgcagcgtcgtcaccaaaaagtggtggaagaagcaccagctccaggtattacagaagaagtacgccgtgatattggctcacgctgtgcaaaagcttgcgtagaaatcggctatcgtggagctggaacctttgaattcttatatgaaaatggtgaattctatttcattgaaatgaatacgcgtatccaagtagaacaccctgtaactgaaatgattacaggtgtagatttagtgaaagagcaattacgtattgcagcaggcttaccgatttcctttaaacaagaagacatcaaagttaagggacacgcaatggaatgccgtattaacgcagaagatccaaaaacattcttaccgtctccaggtaaaataaatcacttacattctccgggtggtttgggcgttcgttgggattctcacgtgtacggtggttatactgtgcctccacattacgactctatgatcgcaaaacttatcacttatggcgatacgcgtgaaattgcaatccgtcgtatgcaaaatgccttatctgaaacaattattgatggtataaaaaccaatatcccacttcatgaattaattcttgaagatgaaaatttccaaaaaggcggaacaaacatccactatttggagaaaaaattaggtatgaatgaataattaaacgttaaatggctaacaatggttagccatttcttatatatgccgatatttatttaatgataataaaaactaaagctagtaaagcgttttgaattattcaaaaaagttgtaatatgaataagtataaggggcgtaggatatatgtgcctcttataccattcaaaaaatatactttcacttataaaaatttaaggaagaaacatgacattaaagcaacgttatcaacaagctggtaaagaagccagttgggcattaggcctatctattttatatgtgataggttggtgcttatgtgcttatttacccaaagaaacccaagggccgattggtttccctctctggtttgaactttcttgtatttacttacctattttattcatcgtgattggttattggattatcaaaattatttttcaggatatttctcttgaaattaacgatcaggagagtcagaaatgaatctaggtattattcttcccttaattatttatctcacttttgtttttggtgcggcaatttttgcctatgtaaaacgtacaaaaggcgattttttaacagaatattatgtaggaaatcgctcaatgacggggtttgtacttgcaatgaccacagcctctacttatgccagtgcaagttcttttgtaggagggccaggggctgcttataaatacggcttaggctgggtattacttgcgatgattcaagtccctgctgtatggttagcattaggtgcgttgggtaaaaaattcgcactcttatcaagagaaaccaatgctttaaccattaatgatcttttcttttatcgctataaaaacaaatatttagtttggctatcaagccttgctcttcttctcgcattttttgctgcgatgaacgtgcaatttattggcggtgcgcgtttattagaaacaaccatcggcatttcttatactcaagcattactcttatttgctttaacggtaggtatctatacatttatcgggggcttccgtgctgtcgtactgacggataccattcaaggtaccgttatgatttttggaactataattctccttgttggcacgatttatgccctcggtggtgtagaaagtgcggtcaataaattgactgaaattgatcctgacttagtcacgccttacgggccaaatggaatgttagattttcaatttatggcttctttctggatactcgtttgtttcggggtggttggtcttccacataccgcagttcgatgtatggcatttaaagacagtaaagccttacatcgcggcatgctgattggaacaattgtactttctataattatgttaggtatgcatttagctggtgcgcttggcagagcggttattccaaatttaacggtatcggatcaagtaattccaactttaatgttaaaagtattgccgcctattgttgcagggattttcttagctgcgccgatgtctgcaattatgtctacaattgatgcgcaacttattcaatcatcttctatttttgtaaaagatttatacctttctacgaaaccagaagccgcaaaaaatgagaaaaaagtgagttatttttcatcaattattacgctaattttgaccgcacttttaatctttgccgcactcaatccaccagatatgattatttggttaaacctatttgcctttggcggactggaagccgcatttttgtgggtaattgtgcttggtatttactgggataaagcaaatgcttatggtgcgttaagctcaatgattatcggcttgggaagttatatcttactcactcaacttggcgtcaaattatttaacttccatcaaatcgtaccatcattagcatttggattgatcgcttttttagtaggtaataaattgggcgaacgtcgaatcgaaaaaactcaattaaaagctaccgcactttaagcgtcaatcaatatgctgtcaccttcttctaaacttagaggaaggtgatatttaattttctcactttcagcaatttctaggctaaaacatagaattggaactattcacagggatacatcaatgctctatcaaattctcgcgctacttatttggagcagttcattaatcgtcggtaagctcacttattcgatgatggatcctgtgcttgttgtgcaagtgcggttaattattgcaatgattttggtaatgccactttttttgcgtcgttggaaaaaaatcgataaaccaatgcgtaaacaactttggtggttggcattctttaactataccgcggtctttttattacaatttattggtctgaaatacacctctgcgtctagtgccgttacgatgattgggctagaaccgctacttgttatatttgttggacatttcttttttaaagacaaagcaaaatggtttcactggctattcggcgcaatggcatttattggcgttgcaattttaatcaatggtggaaaaaataatgaaggcattgataatgttagtttattaggttgcttattagtgctaagcgcagggattatttttgcgactgtattacgttggacgcggcgagttgttgccaaagtttcaacgcaagtttacacatccatcagtattgttcttggtgttataacaacattaccttttaccttattactgacagaaaactggcaaatatcattaaattccacgggaattgtaggtttattatatcttgcgcttggttgtagctggcttgcttattggttatggcataaaggactcaataccgttgatgctaatatctctggtattttacttgcacttgaaccattattcggaatcttatttgccgtatcattacttggcgaaacgctgtcattttcagccgtacttggcataacaattattatgttagccacacttggctcgattttactaccgaaacttttgaaaaaatcggtataatacgccccattttatgaaataaaggaaaaaacaaatggcttggattcaaattcgcctaaatagtaccaatgaaaaagcagaacaaataagtgattttttagaagaaatcggatccgtttctgtgacttttatggatagtcaagataccccgattttcgagcctttaccgggcgaaacgcgtttgtggggcaatacggatgtaattgcgctatttgatgcagaaacagatatggcagaaatcgtccgcttattaaaagaagcaaaacacttagatagcaatacggcatacaaaattgaacaaatagaagataaagactgggagcgagagtggatggataatttccacccaatgcaatttggtaaacgtttatggatttgtccaagttggcgtgatgtgcctgataaaaatgccgtcaatgttatgcttgacccaggcttagcgtttggtactggtacgcatcctacaaccgcattatgtttagaatggcttgatagcttggacttaaaaaataaaactgtcatcgattttggttgtggttcaggcattttagccattgctgcattaaaacttggtgcgaaaagtgcggtgggaattgatatcgatccacaagcaattctagccagtcgtgataatgccgagcaaaatggcgttgtagatcgcctacaactgttcttatctgatgaaaaaccttctgatttaaaagctgatgtcgtggtggcaaatattcttgctggcccactcaaagaactttacccaatcattagccaacttgttaaaccgaatggcaatcttggtttatcaggtattttagaaactcaagctcaatctgtctgtgatgcttatacgcaaacatttgcgttagaacccgtcgcggtaagagaagaatggtgccgaattacgggtaatctaaaaacgctttaatttctttttgtcaatcaaaaaaagtgtattttttaaacaaatttcactttgcaaagtaaggcaaaatgcgtattatagccagccttgtcggttgtcgagcagttcaatataaattagatttaggcttgctaggaaggtaacgtaaaatgcgaatcggttcataccaattaaaaaatcgtgttttacttgcaccaatggcaggtattactgaccagcctttccgccgtctttgtgcatattatggtgcagggcttacattttcagaaatgatgtctacaaatccgcaagtttggcatactgaaaaatccaaattgcgtttggcgtacagcgatgatttaggtctcaatgccgtgcaaattgcaggtagtgatccactcgagatggcacaagctgcggctattaacgtggaatatggcgcgcaaatcatagacattaatatgggttgccccgcaaagaaggtaaatcgcaaacttgcaggctctgcattgttgcaatatcccgatttggtggaaaaaatcttgcgcgaagtggtggctgccgtgaatgtgccagtgaccttaaaaattcgtacaggctgggataaatctaatcgaaactgcgttcaaatcggcaaaattgcagaacaatgtggcatacaagcattaacggtacacggtcgtacaagagcttgtctttttgaagggaaagcggagtacgacaacatcaaagccgttaaacaagcgattgttataccagttatagctaatggcgatattgattctgctcggaaagcaaaattcgttcttgattatactggagcggatgccattatgattggtcgtgctgcgttaggtaacccttggttatttcaagcggtagaaaacctaattgagcataactcgataagtcaaatgccaagtttaaacgaaaagtgcggtcagattttgcgtcatattcaagaattacatcaattctatggcgaacaaaaaggctatcgcattacgcgtaaacacgtggcttggtatttacagggaattcaacctgattccgtttttaaacagacttttaatgcaattagtgatcctaaagagcagctgattgtattggaagattttttcaatttaattttggataaagaaaaatgttagaacaacaacgtaatcctgccgatgccttaacggtatcagtattaaatgcgcaatcacaagtgaccagcaaaccattacgcgattcagtcaaacaagcgttgcgtaattatttagcacaattagatggtcaagatgtgaatgatctttacgagctagtattagcggaagttgaacaccctatgttagatatgattatgcaatatactcgtggtaatcaaacccgtgcagcaaatatgcttggtatcaaccgtggtacattacgtaaaaaattaaaaaaatacggtatgggataaggcgatattcttttattaacaaaaagattgaatgtttttcattctattttaaaaattagccccaagtaatttgaatttggggctaatttattattacaatttaagatcttcgatgtgcatttttcataatgcgatcttttgttactttccattcacgttctttaatatcatcacgtttatcctgttgttttttacctttggctaaaccgattttgacttttgcccacgcacttttccagtaaagagaaagtgcaactatggtaaaaccgtctcggtttgctttgccaaatagggatgctaattcgcgtttatttaacaataacttacgagtgcgagttggatcacaaacaatatgcgttgatgcaacatttaatggctgaatgcttgcgccgaataaaaaggcttcgccatttttaaaaataacataactatcactaatatttgccttgcctgcgcgcatagatttgacttcccagccttgtaattcaagacctgcttcaatttcatcttcaataaaataatcgtgtcttgcacgtttattcagtgcgatagtatttgaattgggttttacttttttctttgtcataattttatcccttattttgcctgaggcattttatcggatctctattttgatagcaaaaagatcatctaggtagaactggcagtcgcatttattttcaatctttaaaaataaatgatttgtagaaaataagagaaaaactgaccgcactttttaagaaaaaacagacacattgttgtgtctgtttgagaaagataaaaagatgaattaagtgttagtgatttatatagtgaataaaggattattccaaacgttttgccactttaagccaatcagccttaaatacacgctgcatattattaatggcatcaataatatcgtgatgaacgagttgttcattttggatacctacgcaatagccgcctttgccttgtagcaataaatctactgcgtatgcgcccatacgtgaggcaagaatacggtcaaaagcacaaggagaaccaccacgttgaatatgccctaaaacggttgcgcgagtttcgtgacctacgcgagcttcaatttcttttgccagagaatgaacatcagttaaaagttcagtgatagcaataatagcgtggcgtttaccgcgaataatgctacgttcaatttgttgaattaattcttcgcgattaaattcaatttctgatgcgacgatatattcacaaccgccagcaatgcccgcagaaatcgttaagtcactacaatggcgacccataatttcaacgatagaaatacgttggtgtgagcttgatgtatcacgtaaacggtcgattgcatccactgcagtttgtaatgcggtttgatagccgatggtatagtcagtacctgcaacatcattatcaatagtaccgggtaagccaacacaagggaaaccgtgttcttcggttaataatttagctcccatataagaaccgtcaccaccgataaccacaagtgcatcaatgccgtgagaacgtaaaatttctgcacattttgcacgaacatttggatctttaaattcaggaaagcgtgcagaacctaaaaaagtaccgccacgattaattacatcagatacgctatagcgatttaattgtttgattttattattgtataaaccttggtaaccatcatagataccaaacacttctaagccttctgcaagtgcagagcgtactacgccacgaattgcggcattcatacccggcgcatcgccaccacttgttaaaactgcaatttttttaatcataatttacctacttttaaccataattgaaaatgggcataagattacatcattcaaagaatctgctctagcaaaatttgacgagattttgatctacattatttttcacaaaacagttgccatttcaaattttgtaaatgttttctttctatatccacaatgtatttttgcaaatgttgttgtactttatcgacagataaatgtttagaatgcgttggttgctgtattttctgcgaatattgaaattgcacaaagccacattggggcaattgtcgtcctttcatcacattgacttgccaagatggattttcctttgttggcgaatagatgacatatccatttaattcatttggattggtcgaattttctggaatagtatcaaaatgaaaatctttcacgtctgtattgcgataaatgcgttctcttaatgcaatacgttctttaatagaacgttcggattgattgcgatcaaagagaatttcaatttcagattgccaattttctagcgtatctggcttagatatatacgcatagcgtgcaatggttcctaaatcttggctgccagtaagtacataatgtttgccattatattctaactgcgtaggcacatttaattgggtcagcttagttgcacagcctgaaagtataagtgcggtcaaaataacaaaaattttattcattaatatctcgcttaaagacaaattcagtttcagtggaggatgctgaatcaaaccaataaccacctaaatcaaattcttttaactgttcaatgtcggttaaacgattttgaataagataacggcacattaatcctcgcgcttttttagcataaaagctaattactttgtattttccatttttattgtctaagaaaactggcttgataattttggcgttaagttggttttctttaacagatttataatattcatcagaggctagattgactaacacattatcgccttgtgcatcaatagcttgttgaactgcttgggtaatcacatttccccaaaaggcatacagatcttttcctttcggattggctaattttgtccccatttctaatcggtaaggttgcattaaatcaagtggttttaaaagcccataaagcccagaaagcatacgtaaatgggattgtgcaaaaatgacatcatcttccgaaagggaatcagcatctaaacccgtataaacatcgcctttaaatgcaaagagtgcagggcgagaattgtcttcattgtgaatttttgtccattcagcaaaacgtgcaacattaagccctgctaatttatcgctgatagacattaatgatgaaagatcttgcggagaaagtttacgacaaacctcaataagttgttcgctgtaatcagtaaagtgcggttgaaaaacaggaaaattttttaccgcactttcaaaatcaagggttttggcaggggagataatggctaacataatcgtccttttatgaaaaaagaatgggcgtatcttagcataaaaatttacgttaaatgcgtttatataagccattttcacttatgataagatcttgtagctcaagatcgagcaattgaacaagtaaaacatcgacacttaaattaaattcttcagctaaatcatcaatgctcacaggagtatagccaatacgtgaataaagtttcgggtggcttggtgcttctactaatcggcgaggatcgggtggtggcgtgtaattaggcacggcgatctggtcaaaatcaatttcagtttggctgtggatagaatgttggtagagcgtttccaaaatgtcctttgcattttctaccaacattgcgccttgtttaatcaggcgatgacaaccttgacttgattcattttgaatattgcctggcacagcaaaaacctctcggttttgttccaacgcataccgtgcagtaataagtgatccacttttttcggtggcttcaacaacgagcgtgccgactgaaagcccactaataatccgattacggcgtggaaaattagcagcaataggtgcttggttaggtaaaaattcagagactaatgccccattattttcgatgatttgtgctgataatctttgatgtttagagggatagatttgttctaatccactgcctaagaccgcaatagtttgcccttgaatattgacgacagcctgatgacaatgaccatcaattcctaatgctaaaccgcttgttatggtaaaacccgctaatgaaagttctgttgcaaaatgttttgcccaatattctccataagtcgtgcaataacggctcccaaccattgccatttggcgttgtgaaagtgcggttaaatttccttttacaaataatagtggcggaaagtttgcggtttgtttcaataaaaagggataaaaaggggaaaaataatttactaaatgatttccctctttttgtgaccacgcgagtgctggctcaataaattttgcttcaggtttgaaccaacggcgaatttgaatggctccccatcccatttgtcggaaagcaacatcatcataattaagtaattcatttaaggtaatattggacaaaattttatcaatgccaacgccgccaagtttaggcacttgcattaaacggagtaatgtgtaggtaatgtcattcatattttttcctttttatttgaaagcctagtatgggaaaaacgagggaaagaaacgattaatttaaaagcattttgcgatgtagatcgcaaaaattctttttaatgaataaaaaattgcaaaatttttcttattttgaaaatgtaaaaaatccaataagaaaaatttgttgatgacgattaaattggttaaatattctgattttattaaatttattagttaaatatatatttaataaagtgtgagtaggtttatttttaatataaaatgccaaaaaatagtttgacagccagttttttattcgtaatatggaaaacgttttacacagaaggatttttatttatgtttcgtattgtttctttatctctcaacctgctgctctcacattttgcgtgcggctaagttgtggataaaaaacagtcagatgtaaatacccaattttaaacccgcactttataagtcgcgggttttttgtctaaaaaatacaggaaaaacgcaccgcacttttggagtgattttagaggaacttttagtaaggatattgttatgacagatcgcgttattatttttgataccaccttgcgtgatggggaacaggcgttaaaagcaagtttgacggtaaaagaaaaattacagatcgctttagcacttgaacgcttaggtgtggatgtaatggaagtggggtttcccgtttcttctcaaggggattttgaatcggtacaaaccattgcgcgccatatcaaaaacgctcgtgttgccgcgttatctcgagccgtagataaagacattgatgccgcataccaagcattgaaagtggcagaagcattccgtattcatacttttattgcaagctcggcattacacgttgaagcgaaattaaaacgttcttttgatgatgtggtaggaatggcagttgcagcagtgaaacgcgcacgtaattatacggatgatgttgagttctcttgcgaagatgcggggcgtacgggcattgacaatatctgtcgtattgtagaggcggcaattaatgcaggtgcaactacagtaaacattccagataccgttggtttctgcttaccaaatgaatacggcaatattattgctcaagtgcgtaatcgcgtgccgaatatcgacaaagccgtgatttccgtgcattgccacaatgacttaggtatggcaaccgctaattctttaaccgctgtacaaaatggtgcacgccaaattgaatgtactattaatggaattggggaacgtgcgggcaatacttcccttgaagaagtggtaatggcaatgaaagtgcgtcaagatttcatgggcgtggatactcgtattaatacccaagaaattcatcgcgtgagtcaaatggttagccagctttgcaatatgccaattcagccgaataaagccattgtaggctcaaatgcttttgcccattcttctggtattcatcaagatggtatgttgaaaaacaaaaatacctacgaaattatgtctccagaaaccattggtttgaaaaaagaaaaattgaatttaactgcacgttctggtcgtgcggctgtgaaaggtcatatggcggatatgggctacaacgaacaagattatgatttggataaattgtatgacgcgttcttaaaattggcggataaaaaaggtcaagtgtttgattatgatttggaagccttggcatttatcgatatgcaacaaggggatgaagatcgtttggtattagataaactttctgcgcattcaaccaaagaatatccagcaacagcctttgttcaattgaaattagatggcgaaaaattaagcacttcgtcaattggtggtaacggcccagtagatgcggtttataacgccatcttaaatttaacaggcttagaaatcaaaatgtctcactataacttaaccgctaaaggcgagggcgcagaagcattagggcaagtggatattgtggtggaacacaaagggcgtaaattccacggtgttggtttagcaacagacatcgttgaatcttccgcacttgctttagtccacgctatcaatgccatttatcgcgcacataaagtggcagacattaaaagccataaacatcactaacccaatccccctctttagtaaagaggggttaggggagatttggcagaagtaacatcaacctcagtggtgaattttatatcgttaaaatctcctccagaccctcttcacaaaagatgagagaaaattaaccgcacttttgcagtaaaaaataggaaaaataatatgcaatcatacaatgtagcagtattagcaggcgatggtattggccctgaagtaatggcggaagccatgaaagtattaaataaagttcaagaaaaatttggttttaaacttaacttcaacgagttttttgtcggcggtgctgccattgatcattgcggttatccattaccagcagaaaccttaaaaggctgtgatgaagcggatgccattttgtttggctctgtgggcggccctaaatggacaaatttaccgccagatcaacagccagaacgtggtgcattattgcctttacgtaaacactttaaattattctgtaatcttcgccctgctaccctttataaaggactcgaaaaattctgtccattacgtgcagatattgccgcaaaaggctttgatatggtagtggtgcgtgaattaacgggcgggatttatttcggtcagcctaaagggcgtgaaggcgaaggctcacaaaccaaagcatttgatacggaagtgtattacaaatatgaaattgaacgcattgcacgtgcggcttttgaggcagcaatgaaacgcaataaaaaagtcacttctgtagataaagcgaacgtattacagtcttctattttatggcgtgaaactgtgacagaaatggcaaaagactatcctgaagtgactttagagcatatctatatcgataacgccacaatgcaattaatcaaagcaccagaatcttttgatgttttactttgctctaatattttcggggacattatttctgacgaagcggcaatgatcacgggttctatgggaatgttgccatctgccagcttaaatgaagccggttttggtttatacgagcctgcaggcggttcagcaccagatattgcgggcaaaggcattgccaacccaatcgcacaaattctttctgctgcgatgatgttgcgttatagcttcaacttaaacgaagcagcagatgccattgaaagtgcggttcaaaaagtcttggcaagtggtcatcgcaccgctgatttagcagatgattccacaccagtttcaacggcagaaatgggtacattgattacacaagcaatttaatacttgccttcctccgtttacgggggaaggtgcccgaagggcggaaggggggcaatctcccacccttagttatttagaaatatccccaataaacagggggacaaagtatttaaagtgcggctgaaaaacacgtcgaattttaaccgcacttcccttaacgaatagagaaaaacattatggcaaaaacactttacgaaaaattatttgattcccacattgtttatgaagcagagggcgaaacgccaattttgtatattaaccgtcatttgattcacgaagtaactagtccgcaggcttttgatgggttacgcgtcgcaaatcgccaagtacgccaagtaaacaaaacttttggcacaatggatcacagcatttctactcaagtacgagacgtcaataaacttgaaggtcaagcgaaaattcaagtgttagaattggataaaaataccaaagcaacaggtattaaattatttgatataacaaccaaagagcaaggcattgtacacgttatggggcctgaacaaggtttaaccttaccgggtatgacaattgtttgtggtgattcacacaccgcaacgcacggtgcatttggtgccttggcttttggtattggtacttctgaagtagaacacgtattagccactcaaactttaaaacaggctcgagcaaaaagtatgaaaattgaagtgcgtggtaaagttgcatcaggtattacggcaaaagatattattcttgccattatcggtaaaaccactatggcaggcggaacaggacacgttgtagaattctgcggcgaagcgatccgagacctttctatggaggggcgtatgactgtatgtaatatggcgattgaaatgggtgcaaaagcaggcttgattgcgccagacgaaaccacatttgcatatttgaaagatcgtccacacgcaccgaaaggcaaagattgggatgatgccgtagcttattggaaaaccttaaaatctgacgatgatgcacaatttgacactgtggtaacgctagaagcaaaagacatcgcaccacaagtcacttgggggacaaacccagggcaggtaatttctgtgaatgaaactataccaaatccgcaagaaatggcagatcctgtacaacgtgcttcggcagaaaaagccttacattatattggcttggaagctggcactaatttaaaagatattaaagttgatcaggtgttcatcggatcttgcaccaactcgcgtattgaagatttacgcgcagcagcggctgtaatgaaaggtcgtaaaaaagcggataatgtaaaacgtattttagtagtaccaggttctggcttagtgaaagaacaagcggaaaaagagggcttggataaaatctttattgccgcaggtgcagaatggcgtaatccaggttgttcaatgtgtttaggaatgaacgacgaccgtttaggcgaatgggaacgttgtgcttccacgtcaaaccgtaactttgaggggcgtcaaggtcgtaatgggcgtacccatttagtaagtcctgcaatggcggcagcagcaggaatgttcggtaaatttgttgatattcgtgaagtggcattaaattaaggctcaataagaggaaaaagaaaaatggcaggatttaaacaactttcaggcttagtcgtaccattggatgcggcgaatgtagataccgatgcaattatcccaaaacaatttttacaagccattactcgcgtgggtttcggcaaacacttattccatgaatggcgttatttagatgtggacggcaccaagccaaatccagaatttgtcttaaattatccgcaatatcaaggtgcaaccattttgctcgcacgtaaaaatcttggttgtggttcttctcgtgaacacgccccttgggcattggcagactacggctttaaagtaatgatcgccccaagttttgcagatattttctataacaacagcttaaataatcatatgttaccgattcgtttaagcgaagaagaagtagaagaaatcttccaatgggtgtgggcaaatgatggcaaacaaatccacgtagatttagaagcgatgacggtcactgttggggataaagtttatcactttgaactggatgaattccgccgtcattgtttgttaaacggtttggacaatatcggtttaacccttcagcacgaagaaaaaatctcagcatacgaaaaaaatattccagcgtttttacgttaaaaataaaaaatgtgctgatttttcaccgcacttaatcactgaatttcattcaaaaataaagccctgtaatacacagggctttgtcgtttataacgctaattcaaacaggctgattaaaaactaaaacttagtttcacttctgcagttttttgtttttccgcttgttttgcttttgttaatccgccaattagacttaatttcacattatgatatttcaatttaagtcctgcgttatattgctgttggttttccacattgtaagcaaaatcatatctatctacattaattttgccgctgccttgatttgcatcatatcgagcagacaaaattggcgtaatggaaaactcgcctaagtgataagtataacttaaatcaacttgagcaaaggctgttttgacagatattggatttactttaatgcgatctttagctaatgcaaaattagcgtttgataagtaactataacgaacccctacagttggtttaacagcaaaattgccaagattaaatgctttgcctgcggttaaaccaaattgtgcagtatggcgagcaaatttcgcattatgattagtttgtaagttgctttggaaattaccatagcctaaatccaccgctaaataccaatgattatccatataatatttagaatagagatttgcttgtgctaaggtatttttactgcttgccttatcaaagttgttactattgcgaacataagtaaacacaccacctaactgaacattgcttgagattgtttgatcccaaccaagttgagtttgcgcacttttagaactaaaatgacgatattgacttgaggaataattttctttcattgaagtattagatacccaaacgttatattgcccctcgttattcatttctaactggctaatatgttgagaaacggctttccctacatttaatgcaacaaattgtgcttttgccatggcatcagaaattaccgcattggtgtttgtacttgtgagatcgcgcaatactagttgtgtagccacatcatttcccgattgcggattctccgcattttcagtatgtagttccactggctcgtaactattctgagctgatctacgagttcttctgcttcgtggttgtggagtagatcctgaattatccactgttgtttcttgagtagaagctactgttgtttcttcagcagaagtcactttagactggctaacaacagcttctgttgtcgctgtttctgattgaactgcctctgaattaaccgtagattgagttgtagcaggtgttgtattctctggatttttcactacagggttttcagtgcttactgttgtggtttctgtcacaggttgttcagcttctgtagttttattctcaacaggtttaataggtgttgtagcattttcaggtgtaacaacttctgttgaagcaacagcagtgtgggcttcaggctgatgaatattttcatctgtcgtttctgttgattgaggattttctgctttattttcagctgtttttggattagctacaggttgagcagtttctttctgttcactgtttgatgcagttgtctctttcgcagcaacagttgtaggttttgcttgcggttgagcttcttttacattattaacagtcgaaacattttcacgagcaggctctgcttgctgtgtggtagtttctggctgtgcttgcgattgaacagttttaggctgttcttgctgtttagccatttctggttcttcttgttttggagacgcttgaaaagccacttgaggggcttcttgagttttctctgtttctactttagcagtatcttctgttcctgctagatttatattattagaagacgagctaatacttcttctaggtctgctctttggttcactgattgtaggatcatcttctactactgtttcttcagtagaatttatttcagactgacgagcagtttcagcctcttgagtttcctcggtttcgcttccattttgggcgagttcatttgtttgagtgttagcttccacagttggtttagcttcttttgcaacttcatcattttgagctgttgtctcggttgctttttgctcgtttttcgctactgtttcactttcttgcggactattttcagccactttttcaattgtctctgatggaacactttctgaatttggatcatcagcctgtgttgtatcagcttgtggttcagatcccgatgggtgagtagtatttgtatcttccattgtaggttgaacggtttctgcaggacgagtttctggttgctcgtttgccattgctgatccagtagcaggtgcaggtggtgctggcagtggaattggtgcttcaacacgagcggtttcttcatggttatttgatacgctaggtacatcagcttgcatattattagctgttgcaatacttggcgtatcgacagtttgatttcttctttctacttctgggttatgcaagtaataacgtccactattttctttcaaagtatagctccaagcacctcgatcaactttgccattagccagtgaaacatttaagccacttctttcagttgcatttgacgcatcaaaaagcgtaagttcattatgatttggctcgcctgttttatttgccacttgtaatgtaaaggtacctttggctgatttggttacaacaactttgtcgccctgatttttggtaaaatcaacccaataatagaaagaaccattacctgataaattgctaatattgagcgtgtggtattttgtttcttttgttgcatctgagacattatttaaatgaatatgcccatttgctagatctaattgatgaacatcactatttcctgttaaataccaatggctgttttcttttaaattaacttggctattttccgtgctgttaattgtgccaaataagttagctttgcctaaggtaaagtttgcactttcggttaaatttacattaccgcgcaaattagttggattaaaactattgagtgcttttgtagataaagtgtcattatggcaagtcacatagcccgtatagtcagaacgtacacaaacggtatcgcctgctttatagccgatatgcacttttgctttattagaggctgtgatatttgaagtaatactttcaacattgcgacctgaataaagggttgcgttattggttacattaatatttgttgctttaaaagtgcggttaatccagtcgtcttctaccaccacttcattattttcagcaaagtgtttatctttttctgttgaagaaatatttgcaatatctcttgcgtgtggtgttggtctgccagaaaggaataatgtacctttttcaacttttaattcaccgttaaggtttgttccgccagtcaataaaaagcgattttgatcacttttgccactaaaggtaacatttaatttaccgttttgatctgccttagttgcttcctcgccaaaataaccattaaagccattcatacgtctgttattgatgtacaccatggctttcttttgtgcatcattttgattgtcgcccatgaattcccaattagcatctgatttttcagagctatagcaaggcatttctgcagtagggcttccaccttgctttaacgcatagtatttataacaggtattactaaagtaaagatcttttcctcttggaatagatggcacatagtaataattatcatcatcggcggttattgctggtgtatatatagtgacctgacttggatttgtaattaatcctgctccagtaatcgttatatttgaggcattagtcatattatgattaactagtcttgcaccatcatcaatattacggatatgttcaaaagtgagattattgccattggcatctaatcgaccgcctctaaaaccaaagtaaattgaatttggatctacttggttatcatcattaagtacaacagttgagcgaccacttacaattcctacagaagcaaaagcgtgttgtcctgtagttgtttgttgttttaaaacaactgtgccatcgcccacttttagcgaacctttattatctcctcttccttcaacaattagctttcctttaccaattttagctaaacgatcaaattgagggttatgcactttccactttactgtttttccttcagcaacagatataccagcccctttccaagtcgtattttctgaagtgcctttaacttcataatcaccttcaaagaacaatccgcctgcaccttgatcgatattattatttaaggtaaggtttccacttccttcaaacgtaacatttttcccatgattgagatttttattatccactaaatcaacacttaatgattcagatgttccagatatcaagcttgtattacctttgcttgtccagttatattgcgtattacctttcagtaaaccagcactgtcttttttgagaatattttcagcaaattgtggtttataaatattccattcttgccaagattttttcttataccctccccaaaaatcataagcaccaaggaaaagccatttctctttagatttatcataaacaaataacggtgagccactatctcccaagacagcataattagtaagcggtttacgagataatatctcttttggatcgttatgatcttcggttgaatcaccaaacccaatgagtccatcgtctgtatgattcactttataaggcgtgcctgcaataccataggtataagcgttaccaactaatttaagattatctccacctacatcccatctgtgtattatttcctttttctcgtttttctcttctaaaattaattcataatggcttccttttttatagataaattgagagccacttcctaatctcacaaaagcaggatatttattctgatcattatatgttccagcatcactacttgtagttgaagcctctatcggtgcaacttcggtaacaaatttatcaaggcgtggcatataataatcttcacggcgtttttggttttgctgttctttaactaaggcttgtccatataattcggaaggaacatcttttttattagatgtatactgtttatctttttcgttattttgtgtttttccgtttaattcagaagaaaaattatttttttcaacagtgtaatatctgttttcctcccaagatacatctcgatgctgaatagaatttccaaatttagggttccaattcccatttaaattcccaaaatgtagttcacccacaccgttaccaacgtgttttacccccacaacatattgtggatttaccaacgtggcaattctcttatctacatccacagcactaaaatcaatcatcggaatatctttaggtagcgcactgcccaaattattatttttgttatctctcacttccacatttgttgcaccaacagaaaacttccctttattctctgcaaaatcacgaaatatttgataatccacatcgtttctcactaacgcggcttctgtataaggggttaatgcgtaggcgacagtaagcgcaataaaattgagtttgaattttttatttagcatagaagctgtccttattaattaagtttaaaaagtagatttgatatacagctacaagttgattcaaatcttggctgtgttgcgttgatagtttgcaagttgtcttcatttttataatgagtgggttttatagcataaatcgctcaaaacttgaattacatttattaggtaatgataatgatttttgatattttttaaaaaattggcgtattttttaccgcacttttggttaatttaaggcgttaatgatgccattatggacagaaaacatttttttgttttccacttgcatttcttttagttgtctttgagtgatggcggtaacaaatacttgcgaaccgctttgttgtaatcgttctgccaacaaggcacgtttgtattgatctaattccgaggcaaaatcatcgatcaaaaaaatacaatggcgttgcttttctttcattaaatgctcgccctgcgctagtcttaatacacacattaaaagtttaagctgtccacgagaaagcacatcttcaacaggcaatccttgtgctttgaaacgaaaatccgctttttgagggccagaaaaggtgtaatttaaggcacgatctcgttcaaaattttgttgaagaatttcataataatcagcatttttttcccacccttgatgaaagctgacattaatttctaattcaggcagaaaaagttggcaagtttgttcaatttcagggcggagagcttctgcatattcggcacgccattgacttacttggtgggcaagtttggcaagttcaacgtcccaaatttttatggcagagtaaggctgattttgtgcgagtgcggcatttcgttgtttaagtaatcggttgagattgctccaagcggaatagaaacttgtttggtggtggaataatccccaatctaaaaacgcacgacgataacttggcccaccgttgagtaaggttaagccctctggcgtgattaattgcattggtaaaagatgggctagatcggaaattttattgccatcttcgccgttaatttttactaaggtgttgccttgacgaagtttttgtaagccgacagaccattgatgttggctttcttggatttgtccaaatagggtaaagtgcggttcgtcgtaagaaatgatgcggtttgtgaccgcacttttaaatgaacgtccgtgaccaagataaaaaatggcttctaataagctggtttttccgctgccgttgttgccgattaaaaagttaaagcagggatcaaaatcaagatccactgctgttaaattacgaaatttttcgaccagtaaacgagaaatcgccatattataaacgcattggcataatgacgtattcgcagctgctgtcttcacagttttcaattaagcaactggagaacgcatcagttaagcgcattcgcacttgattacatttaagtgcattcagcacatcaagaatataggtgacattaaagcccacttctaattcttcgccattgtaattgacatcgacaatttcttctgcttcttcgtgttctgtgtttgaggcagtaattttaagctggttttcctttaagcttaaacgcacgctgcgcgctcgttcattagataaaatggacgcacgaacaaaagcctgtttcagcatttcccaattgccttcgacagtttttgtggcattacgaggcaatactcggcgatagtcaggaaagcgaccatcaattaattttgatgtaaataccgtgttttttaaatggacacgtaaattgttggtgccaatttgtaaacgcgctggttcatcgtttgtttctaataaacgaaccagctctaacacacctttacgcggtaaaatcacagaatgattttgtaattcttgttcaagggaaatggtacacaccgcaagtctatgaccatctgttgccaccgttcgcaataaattgccttctgtttcaaacttcataccatttaagaaatagcgcgcatcttggtttgccatagaaaattgagtggcttcaattaaacggcgtaaggtattttgcggtagttgaaaatccacttcagactgccaatccgtgaggtttggatattcttcggcaggttgggttgtcagcgtaaaacggctacgcccagactgcactaaagcacggtcttgttcaaaagtcaccgtgatttctgaatcatcagataaagtgcggcaaatatctaagaatttttttgctggaatggtaaaagtgccattttcagaagacgatgaaagctgagtttgactcgataattcgacttctaaatctgtaccagtgatagtcagacgattgtcttcaatttgcaacaatacgttgtttaatacaggaatatttggacgattactcaatacgccacatacttgttgcaacggttttaataaattttctcttgaaatgctaaattgcattgcgttctccttttatgcaggatttattgtatttcttggctccacccatttctggggggagctgccgaaggctgaggggggattaaccagcccccttccgccctatgggcaccttcccccgcaagcaggggaaggcaaggtatttgtctagcgaaaagttctttgctgttttatatctttttcaattttagattatgcggacaaagtgcggattaaattcgcccaatcttcttgaatgctattgtcttgctcgcggaattttggcacttcacggcaagcgtttaatacggttgtgtgatcacggtcaaaggcacgaccgatttcaggcaaactgcggtttgttaattcttttgctaacgccatggcaatttggcgagggcgagtgactgaacgcgcacgactttttgattttaaatctgaaaccttaattcgataatattcagccaccactttttgaatattttcaatagtaaccaagcgttcttgtaaagccaaaatatcttttaaggtatcacgcacgaaatcaatatcaatgtcaccgcctttgaagtcttgcattgctttcactcgatttaatgcaccctcaagttcacgcacgttggtacgcaagcgttgagcaatgaagaaagcaacttcttctggcaagttcatattatgttcttccgcctttttcaataaaatcgctacgcgagtttcaagatcgggcggttcaatggctgttgttaagccccagccaaaacgtgattttaaacgttcttcaattttttcaatttctttagggtaacgatccgaagttaagataatttggcgacccgtttcaaataagttattgaatatatggaagaattcttcttgagttttttctttttcagcgaaaaattgaatatcatccactaaaagcgcatcaagagaacgatagaattttttgaactgatccattttattatcacgcactgcttttaccatatgttgcataaagttatttgcgtgaatataaagcactcgcgcattcggtttatcggctaaaatgccgttgccaatggcgtgtaacaagtgagttttccctaaaccagtgccgccatataaaaagaaaggattagccgatggttcgcctggtgcttgagcaagtttttgaccgactgcacgtgcgagttggttcgatttaccttcaacaaagttatcaaataagtgtttagtattgagatgagattcaaattttactgaagcactagattcagcttgaaaatctaccgcactttctgatctaagtgatatatttggcgtattttctactactttaggtgcaggcttgaccccttcttttaaagaaatacgcagttcaggattttgtgtaagtgtttgacaaatttgctggatttgtgcgagataatgggtttccacccaacctttcacaaacatattagaagcatataaaacaatgtggttatccgccaccacatcagcctgtaaaggacgaagccaagtgctaagatcgctggctgaaacttgatcttgaagttgtaacaggcaactttgccaaagatttgagagattcacaaaaggatccttgttgtttttattataaaagtgcggtcaaaattgtcggagattttacaataaatgtgtgaaaagatcttctaaaaaatctagtgttgagttttcatttcataagattatagaactgaaaagaaatgcgccagtgcgatatagatagcgtgcttaacctgtctggcgcattttaatttagaatttcatttctaatgttaaggtatagtttcgtcctgatgctgcgtagcgagtataattaccaacattttgatgttgattgaccgctccttgtgctgtttgacgcaccgcttcccaagtgacatagcgatagtttaataaattatatactcctaatcggaacaaaatacttctattcaccatgtaataacccgatacatctaagatatgccatgcccgagtaagttttcttgttgattttacaccccttgaagtgttacctaatgaacgttgtcctagcaattcattttgagattttgcttttgattgagtaaacattgtattaattccccaagtattacttggatgatcatagcctaaaccaatgatataacggctgggctgaatggcatcaaataaataactgcttacggaggctaaaccagcattgattttttgatctttaacttttactcggttataagcaaatgttgcataccaaccgtagggaatacgtttccataaaccattaaaatctaattgcgcagttatatttacgccaactaattttgcattttgtgcattatgatatccataattgcccttgccctttccatttttaagttcttcagcaaaggcgataagatttcgataagcattactaaaatgactgatctcaatattaccaaaatccccttttagagcgagaccaaactcttggttacgagatgtttcaggcttaaatttacctacataaacctcgtcattcttgccaccataccgccatccatacatttcagcaaaactaggatttctaaatccagtagaaaggcgataagaaagatcaagccattccgttggttttatgacaataccagtattccaagagaaatttttaaatttaccaacactaatagttgattcattagcttttgtacgagatacgtcataccgaatacctaaacctaaatcaacgtatttccctaatgccatattattgcgtgctgcgaaataataatttttccctttaattaaccgcactttacagtcactataattagaggagctaccttgataattacaatgatctcgtcctacaaaagatgcatttggttttgggtataagtaaggttgtaatttgaaaccatttcttcttggtgtttcaccaggtttctctgaaatactctttgccgtagcggtaacacgtcgagttaaataatctttatgctgaagcgctgaagtaaagtcatcaaaaccaagattgaagacaatttgatgagtaagccaattttgttgaatttttttctctaaattcaattgcaacatattatgtttttctttataaacatttctatcagaatgatagtatgaataaggtttatcaagtgttgggcggcaattcttacttggattaggataaagactgcaatgtgtatgttgcatataactgtcaagtataatgttttgttgattagcacttaacactgctttgtcaatgattcccgctttgttcttattttcgtaaatatattcaatacctacacgctgttttctatggtgttcatcgaaataaagcccacttgcatatttaacgcctcggccatcctcaatacgttgatatgcaccataatcttgctttggataaaaagaactattttctaaatccggtttttctgttgatcttaaataagcgggaaatgtcatatcacggatatcaaatttttgttgtgtgaattcaaaaataccaccaatataatgttgttcagaaaaatgatagcctcctcttaaaaaccaagactggctttcatatttcattggattaggtttgatacggttagcccccgtataatctgaaacgcttacggtttctctttgggaggataacttcgcaggtggtttggctgaaggtatacaactgttataatcctttggacactcatcttccatcacaaagtatgcattagatccatcttctttggcgattaatcgattataactttgcacgccttttaatgcatctttatggacttgggtttcaattgaatttcgttgagtgtaaatagcaagtccttcaaatccaccttgttttcctgctacagctaaagaatgggtaaagcctttatttttgcttgaataagcatttttagtttgaattccccatgatttgtctccttctaagatatcggctgcggatttgctttgaaatgttacagaaccagctagtgctccattaccatactcagaagaactcccccccttgcttatttcgacggcctttacattttcatattcaatttcattaattgcaccagtgccagaatatcctgaacgagcaactaaagggctttgcactacataagattgcgtttgaggtaaaccatctactaataaagcaactctatttctgtccataccacgaatagaatatccagaacttgcaccgcgaccttgttctacaactgaaatccctggatcatagcgtgttagatcacgaatatttaatacttgttctcggctgatactttcactagttttgataattttgccaagtccagttacttcattatctttacgatctcttactttttctgcagtgactgagatagtttctaattctgaatcttctgtactttgagtgtccacttcagatgatatagcttcttttgtatcttttatactttgagtttctgcttttacatagcatgaaattaaaagacaagaaataatacttaggcgaaaatagggttttttagtcatttttagtattccattatttgtttttttctacttgttggttgtttctacttgttggttttttctacttgtcttttagctccaaagacaactgcagctcttgcatttggtgaattgggtggtgaaggtacggttgaggaactttcagaatttgtagctgtaggattgtttccgttataggtgaaataaccgcctaattctgtagcgtgcggaccataaaatgccccgtttactgttgtcgtgaaattgactttagatgtggcttgtgtatttttgggatcaatcactacatttgcggttgctttaccttcgaaggcattactaccatttttaaaggttgcctcaatgttaaacacggtattttgtgagtcggctcgttttaatttgcctgttaatgttttattgtcaaaattgacatcaaactcggcgggagcatttttatcttgttgtttatttcctgtagtggagtaagatgtcttgtcatcaccaatataaccaaaccaactaccgagatatttcacgtttcccgttacaggaatttgagaactgggagtacggagacctaacaaaaattggtggtattgtcctgtttgatttgtgtttttcttctctttatcctcataatacataccaaattttacatagcttagattcttgcaacatgcttctactttataggttttatttccaatatcgtgatgtttactcgttacgaagtcatcagtatccccttcagggaaaagaggaacagggtaattatcaattaaaaggtaatcagcttcaccaaaacttgatatatcttttgtcgtaaagtttttttcatcggtttttacatcggctgttgtactggctgttgtactggttgttgcatcggctgttttagtagagaaagtaattagcttgccatcaattaaggtttctttggataatttttccttttctgtttctggcgtttctttggcactaaataccccaaaaactcgtttatccctagctaagaatttaccccctagttcttcagcattaggtccataaaaaccaccttctaatgttccctcgctggtaaagggatgttcatccgatgtggatttcgtaggagtaactttacccctgaatctattactataaatatgggcatctatatcatagagtttttccttttcatattgttgaatatcagtttttcttttggtgtaagacagttgtcctgtcagttttttagtcccaaaatctgcactaaattcacttattaagcctatatcaccattctttgaattattttctaaatcaatatctcctcgagtagcactacgtcgaaaataagcttgacctctagcattactgaacaaagaataattttggccatatttagttgcagtgatgaaatcccaagttcctttatacgttgctacaccgcttactggcaagtctgttgcagttttattaccataataaaacgcataaccataatggccactataggcttttttttctgttgctaatttggaaaagtctttccaattctcaatatagtacaaaccagaataaacgtatttttgtaaattggggtcttgtaatgctctattaggttcaagcccaattggatttgtatgtattttattttctgttttaacatttttaacatcatcttcaatcgtagaaggtgaggaaaaatatgatatatagccattttcatttaagaaactaggttctttattaccactcagattctgagccactaacttcatccctcctcctaaagaaggaatggacaacttttccaaattagattttgttcttgaacttgaagtatcgtcttgataacgtggtttagaagaggagggattagagacgtcatctacatcaaaagaaccacctcccccgctacaagcgcttaataaaaaggaaagtccaccagtgataagaggtacagatttcatagaattaatacttatacaaaattgataataattcgcattattgttctttttttgtaataatgtcaagttagagttttttaagaatatggataaaatatgaaaaatggcgtaaaacaaatttctttcttatcattaataggcttatcattaataggcttatcattaacgaatatagcttgggcaaaagttgcacgtcctaaaaatgatacactgacaaatacgattcaaagtgcggaattaaaaacctcctctttttcctctatgcctaagaaagaaataccaaataggcatattatttctctttccaaaagccaattagcacaacatccaagacttgttttgcgtgggttaattcttgctttatatcaaaataacactcaggcagttcaactgttattaccactatataaacaatttcctcagcacgataatttcttactcacttgggcaaaggctattgacgcgcgtgaacaaggtgatttaactcaatctattgcttattatcgtgaattattcgctctagacgcatctttactacctttgcgttatcaattagctcaagccctattttttaactatgaaaatgaatctgccaaaattcaatttgaaaaattacgtacagaggtagatgatgaaaaatttttaggtgttattgatcagtatcttttaacactaaatcagcggaatcaatggatatggcaagtaggcttaaattttttaaatgatgataatttgaataacgctccaaaaagtggcacaaaaattggtagttggaccgcttgggaaaaagaaagtgggaaggggggtagggtattctttatcagtagaaaaaaatggccatgggcagatcatttttttagtaaaactatgtttaatgggaatggaaaatattattgggataataaaaaatacaatgaggctactttgcgtataggtggtggtttaggttatcaaactgccttagttgaagtctcgttgtttccttttcaagaaaagcgttggtatgcaggcggtagctctggaacgaatacaatgaagcaatatgcggataaattgggtattcgtttagaaaacgtagattggctaagtaaaacttggcaaatttctaccgcacttgagtatggagaatctcgttataaaatccgaaaacatttagatggtaattattatttcatttcatcaacactattttatttacctaaaagcactcaattttggtttgttggcatggattttcatcgagaaaatacacaagcattagataatgcttatcaacaaaagacattgagacttggttgggggcaggattggtcttatggtatttcatcacgtcttacttttagttatgccaatcgagtgtatagagagaaagatttgattgggatacagcaaaaaaatcgtgaatacgcaaccacaattactttatggcatcgaaatatacattttatggggctaacacctaaattatcgtgggattatcaaaaatccactagtaatcatgctttttatcgttatgataaaaatagaatttatctcgaaattggaaaaatattttaaggttgtaaactaactgttgagttatctctaacattgttaaagtgcatacactatatttttaatattagtttgaaattttttaaaaaatttctgtttcttatttgacgaacgcgcattttatgactagaattgcaccctattttattcactcttaattgtatttaggtaaattaaaatgaaacgtacatttcaaccttctgtattaaaacgtagtcgtactcacggtttccgtgctcgtatggcaactaaaaatggccgtcaagttttagcacgtcgccgtgctaaaggtcgtaaaagtttatctgcataatcacaattcttagtggttaagctgaacttttcaagggagttacgtttattaactcccattcaattcaaaaatgttttcgaacagccattcagagctagtactcccgaaattacaatccttgctagaaaaaataatcttgaacatccgcgtttaggtttgaccgttgctaaaaaacatttaaaacgcgcccacgagcgtaatcgaattaaacgcttagtacgagaaagttttcgtttatcacagcatcgcttgcctgcttatgattttgtttttgtagctaaaaatggtattggaaaactcgacaatagcgcatttgcacaaatactcgaaaaattatggcagagacacattcgcttggcacaaaaatcttaattaagattattcgtctttatcaaattatgattagtccgtttattggggctcgttgtcggtttgtgcctacttgttcttgctatggtattgaagcattaaaaacacacggattattaaaaggtggttggcttacgctgaaacgtgtattaaaatgccatcctttaaacgcaggtggattcgatcctgttccaccaaaaaccaataataatgatgagaaaaaataatggactcaagacgtagcctattagtgcttgcactgatttttatttctttccttgtttatcagcaatggcagttggataaaaatccacctgtgcaaactgaacaaacaacttcaataactgccacttctgacgttccggcaagttccccttctaattcacaagccatagctgattctcaaactcgtggtcgtattattactcttgaaaacgatgtgttccgtttgaaaattgatacattgggtggcgatgtaattagctctgaattattaaaatatgatgcagaattggattcaaaaacaccgtttgaattattaaaagatactaaagagcatatttatattgcgcaaagtggtttaattggtaaaaacggtattgatactcgttctggtcgtgcgcaatatcaaattgaaggcgataattttaaattagcagaggggcaagaatctctttctgtaccgcttctttttgaaaaagatggcgtaacttatcaaaaaatctttgtgttaaaacgtggtagctatgatttaggcgtagattacaagattgataaccaaagtggtcaagccattgaagttgagccttatggtcaattgaagcattctattattgaaagctctggtaatgttgcaatgcctacttatactggcggtgcatattcttcttcagaaactaactataaaaaatatagttttgctgatatgcaagataataatctttctattgatactaaagctggttgggttgcagtgttacaacattatttcgtttctgcgtggatcccaaatcaagatgtaaataatcaactttataccattacagatagtaaaaataatgttgcatcaattggttatcgtggtcctgttgtcactattcctgctggtagccaagagacgattacaagttcattgtggactggccctaaacttcaaaatcaaatggcaactgtcgcaaataatttagatttaactgttgattatggttgggcttggtttattgctaaaccgttattctggttattaacctttattcaagggattgtatctaactggggtttagcgattatctgtgtaacaattgtagtgaaagcaattttgtatcctcttacaaaagcacaatatacttcaatggctaaaatgcgtattttgcaaccgaaaatgcaagaaatgcgtgaacgttttggagatgatcgccaacgtatgagccaagaaatgatgaagctttataaagaggaaaaagtaaatccacttggtggttgtttgccaattcttcttcaaatgccaattttcatcgcattatactggacgttcttagaagccgttgaattacgtcatgcaccattctttggttggatccaagacttatcggcacaagatccttattacattctccctattttaatgggtatctcaatgttcttgttgcaaaaaatgtctccaacaccagtaactgacccaacacaacaaaaagtaatgaattttatgccattagtttttatgttctttttcttgtggttcccatcaggcttggtattatactggttagtatctaacttgatcactatcgcccaacagcaattaatttatcgtggtttagagaaaaaagggttgcattctcgtaaaaaatagtcacgaacaggcaaaaagaaaggcacggaatgtgccttttctttattttactgccgtgggtatacctaccctaggtagtagtgtacctaccctaagcaatcaaccgtgggtaagtatacccacggttaattatagtaataatagttcccctttggggaacgtcaagctctaccccaaagggtagcactaggataaacctagggtatacttaccctaggtagtagtgtacctaccctaagcaatcaaccgtgggtaggtatacccacggttaattatagtaataatagttcccctttggggaacatcaagctctaccccaaaggggtagcactgggataaacctagggtatacttaccctaggtagtagtatacctaccctaggtagtgtgtacctaccctaagcaatcaactgtgggtaggtatacccacggttaattatagtaataatagttcccctctggggaacgtcaagctctaccccaaaggggtagcactgggataaacctagggtatacttaccctaggtagtagtatacctaccctaggtagtgtgtacctaccctaagcaatcaaccatgggtaagtatacccacggttaattatagtaataatagttcccctttggggaacgtcaagctctaccccaaaggggtagcactaggataaacctagggtatacttaccctaggtagtagtatacttaccctaggcaatcaaccgtgggtaagtatacccacggttaattatagtaatagtagttcccctttggggaacatcaagctctaccccaaaggggtagcactgggataaacctagggtatacttaccctaggtaatatcatatttccccagacaataataggttttttatgaaagaaacaatcgttgctcaagctactgcaccaggtcgtggtggcattgggattttaagggtctcagggcctttagcaacaaaagttgctcaagctatattaggtaaatgccctaagccaagaatggcagattatcttccttttaaagatgctgatggcactattttagatcaagggattgcgctttatttcaaatcgccaaattcatttactggtgaagatgtgttggaattgcaaggtcacggtgggcaggttgtattagatttattactcaaacgtattttacaaattgacggaatccgtttggcgagaccaggcgagttttctgaacaagcttttttgaatgataaattggatcttgctcaagcagaggccattgcagatttaattgatgcaacatcagaacaagcggcacgctcagcattaaaatcattacaaggcgagttttctaaaaaagtaaatgaattggttgattctgtgatttatttacgtacttatgtagaagcaagcattgattttcctgatgaagaaattgatttcttggcagatggaaaaattgaagcaaatttacgcggtattattaatcagctagaaaatgttcgttctgaagctaaacaaggttctattttacgtgaggggatgaaagtcgtgattgctggtcgcccgaatgcaggcaaatcgagtttgcttaatgcacttgctggtcgcgaagcagctatcgtcacggatattgcaggtacaacccgtgatgtattgcgtgagcatattcatattgatggtatgccattgcatattattgataccgcaggtcttcgagatgcaaccgatgaagtagagcgaattgggatttctcgtgcttggacagagattgaacaagccgatcgtattattttgatgttagatagtagcgatcctgaaagtgcagatttaagcaaagtgcggtcagaatttttagcaaaattaccctcaaccttgccagttactattgttagaaacaaaattgatttaaatggcgaacaagcaagtgaaagcgaacagggcggttatcaaattattagtctttctgctcaaacgcatgatggtgtaaaacttttacgtgaccatttgaaacaagcaatgggttttcaaacaggtatcgaagggggatttttagctcgtcgtcgtcatttagatgcacttgagaaagccgcagagcatttacaaatcggtttggttcaacttacagaatttcatgcaggagaacttttagcggaagaattacgcttagttcaaagctatttaagtgaaattacgggtcaattcacatccgatgatttacttggtaatatttttagttctttctgcattggaaaataggaagcgtaaagtgcggtcattttttggcaaaaatttaaatcaaaagtggcaatatttggtggtgttttgttgataggaattggtattagctggctttgtgagcatggagttttcactttttaagatgctaattttttacgtttagattataatcaggaaaattttatatttataacaagggttatagaatgttaattgaaaaaatgcacaatttaacaaactcaaaggtttctaaatttatcttaggtttgattactgtatcgtttttagttggtggaatgtctggctatctttttagctcaaatgatacttatgcggcaaaagtgaacggcgaagtgatttctcaacaagattttttaaatcgctataatcaagaatttgaaatacgcgcacaacgtgagggagaggcgtttgtggctcagtcagattctcctgaatttgttaccgcacttcgtcaaaacatcgtcaatctaatgattgatcaagaattacttcgccaatatgttaaagaattaaaattaggcgtgagtgatgaaatgattaaacgtgcaatcgtgaccgatcctaattttcaagtaaagggtaaatttgataatgctgtttatcaacgaatattacaacaaaatcatttaacttcagatggttacgcttcaattttacgtgcttcgttacctcttgaacaaatacaaaatggcgttgctaacagtgaatttattgttcctgctcaagtaaaaaatagtgcagaagttttctttcaaaagcgtttagctcgtttagcaactttatctcttgaagatgaaatggcaaaacaatcagtctctgatgatgaaatcaaaacgtattatgaagctaatcaaaagtcttttgttcagccagagcaggttaaagttcagtatattgatctttctgcagataacatcagtagaaatcttcaagttacagatgtagaaattgcgcaatattatcaagataataaagcacaatttatgactcaacatttagcacatattcaatttgcaaatgaacaagatgcgaaagtggcttacgaggaattacagaaaggggcaaatttcgctgatgtcgctaaagcgaaatctttggataaaatttctggtgagaatggcggggatttaggctgggtaaatgagaatgaattaccaaaagcctttgaagatgccgcagctgcattgcaggtagggcaatatagccaaccaatcaatgtggatggcaattaccatattgtgttagtgcaagaacgtaaagcgcaaagtttggagaatgtgaaagctcaaattgcagatttagttcgtaaatctttaatggagagtcgttatttttctttagaaaaacaagcgagtgataaggcttttgaagacagtaagtctcttaatactgcagcacaagcagcaggtgttaaggttcaagagagtgattatttttctcgtcaaaatgtgccagctggattaaatttccctaatgttatttacacaatatttgaatcagatactacgaatgttggtatgaattctgaaccaattaatgtaggcgattatcacacaattattgtacgtgtgttggatcgcaaagcagagggcgtaaaaagtttagaagaggctaaaatcgatattgaaactttcttaaaacgtcagaaagctgagaatgcgcttaatgaaaaagcacaacaagcagtgaaaaaattaagtgaaaaccctgaatcaaaagtagatggcattaatttctcaagtgagcagacttttactttaagtgaaaataaagatcctattttaacaaatggtatattttcaattgctaaaccaaaatcaaatgaagctctttatcaagtggtgcataattcaaatggcgatgtggttgttgttgccttgaataaggttgaacaaggcagtttaagtgaaaaagaattgtcgcaatttggtatgcaattattgcgtagtcatcaatctgaattacaatttcagttaatacaaggattacgtgagagagcaaaaattgaggtaaatgactctttcatcaatcaagatgatgaagtgcaacaataacaggttaaatgataatttgagataaattttgctcaaaagtgcggtaaatttcaccgcacttttttacttttgtgcaaaaggaagttaatgatgtttgggaaagaaataattcattctaaaacaatatggttttattttttgttgtttctcttttccatatttaccaatatgggattaggcaatgtattaagtgagaatattcccgtttcagattacgcaattttatttgttatcacggcgatttctttttattttaccccttggcttgggcgaatattaattactgtattattcctcagtgcgctattttattgctctgctggttttttctatggaattccatctttggggattatcgcttctgtttatgaaacgaatattaatgaaaccttagaatattacacaaccattcctttttggatatttttatttcaagttagttatatcattttatttgttgctttaatgaaattaagtttttatgttaaacaacaagcatttaaatggctaaatatggttgttatcagcctattattagttttttcttataatcaattttctaattggaactacgcctataaattccgtttttatccagttcttttttattctgaatttgatcgaatgaatgatctatatttagaacaacgagattttctaaatcaatccgttaatgcgccgtctcaatgggatattcaatcttttacgccaaaatataaaaattatattttaattattggtgaaagtatgcgaaaagattatatgtcgttatatggctttccactgaaaaccacgccatttttagagcgtgtgaaaagcacagtttttgaaaattattattctgcagcaccgaatacgcaaccgtctttacaacacaccctatatcgagcagataaaggagaaacggtttatacggataatattatttctttagccaaaaaagcgggcgtgaaaacttattggatttctaatcaaggcaaaattggggaatttgatacgatggcctctcgtattggtcaaagtgcagatgaaacgatttttatgaagccgttaggttataactctaaaaaagtttatgacgatgaaatgttgcctgtattagataaagccttaaaagaaaatattacgaatccaaaattaattgtgattcatttaatgggctcacatccagccttttgtgagcgtcttccgtacgaagttaaaaattattttattaatcaatctatgtcttgttatttagaatcgattaaatatacggatcagtttttagaaaaattaaattcgcagttagtatcgcaaaatgaaccctattcggtgatttacttttctgatcatgggcttgctcattatgaggattctgaaggtttatcattgcatccaaataatctttataaacaaaattatgaaattcctttcgttatgttttcgagtgatagtaaaaagctagaaaaaataaaaacgccacaatcggcatttaattttgtttatggttttgctgattggatgggaattaaggaaaaacatttacaaggcgtggatttcttccatcctgaaaaacaggaaattaaagtatttgattggaataacgttgtaaatgttaaagagttggctgatgatccagcaaaattaccagaagccgttcagtaaatgagatcgtgctttatcatttatcggcttgtgctagaattagcggaatttttttaaaagggaaatagtatgtccaaaaaatcagggctttcatttttatggttaagtgcggtcgctttcgtggttgatttgcttacaaaatacattgtggtacaaaaatttgatttgtatgaaagtgttaatgtgctgcctgtttttaacctgacttatgttcgaaattatggcgcagcatttagtttcttagcggatcatagtggttggcaacaatatttctttattttgttggcattggctatttcaggaatgttggtctattttttagcaaaaaataatgccgaacaaaaaatccaaaattctgcttatgcactgattattggtggggcgttagcgaatatggtagatcgcacttacaatggtttcgtcgtggatttctttgatttctattgggatatttaccattatccagtatttaatatcgccgatattgccatttgtattggcgcagggttattagcattagatgcgtttaagagcgaaaagaaaaaagtacaagataaacaagtagaaaagtgcggtcaaaaatgaagataattttagccaatccacgaggattctgtgccggtgtagaccgtgctattagtattgttgaactcgccttagaaattcatggcgcaccgatttatgttcgtcatgaagtggtgcataaccgatttgttgtgaacggattgcgtgatcgtggtgcgatcttcgtggaagaattaagcgaggtacctgatggtgcgatcgtgattttttctgcgcacggcgtatctcaagccgttcgacaagaagcgaaagaccgcaatctcaaagtatttgatgcaacctgtcctttggtgaccaaagtgcatatgcaagttgctcgtgcaagtcgaaagggaacaaaagcgattttgattggacataaaggacaccctgaagttgaaggcacaatggggcagtatagtaatgaagatggcggaattttcttgattgaaaaagtagaagatattgcacgtttgccaatgcaagacaatgatgatttaacctttatgacgcaaaccactttatcgctagatgatacagcagaaactattgctgcattaaaggaaaaatatcccgctattcaagggccacataaaaacgatatttgttatgcgacaaccaatcgtcaagaagcggtgcgagaattggctaaattatcagatttagtgttggttgtggggtctaaaaactcatcaaattcaaatcgtttagctgaattggcgtctcgaatggggattaaatcacagcttcttgatgatccttccgatattcaagatgattggtttaatgatgtaaaaaccatagggattacagctggcgcgtctgcaccagaagaattagttcaatcgattatttcccgcttaaaagagtttggtgcggatactatagaagagctgcaaggtttagaagaaaatatgttctttgaagtgccaaaagagttgagaataaaagaagttaattaatactaagggcttatcgtcaatgataagtcctttgttttttcattcaaattaagaatttttgagatcgagatcgcaaaagtgcggtcagtttcttgaggttttttgcaaggcaggaaaaaatgtgtgtgttgattgttgatcaacggttcatattataaggaaacctctatgaaattaatgaaaacattattcacttcgtttgtattgtgtgggtcacttgcagctggttccacttttgctgaagacaaggtggttgagcaaacaactcaagctgttgtgaccactcaaacggattcacaagtagcaccagctatgatgggagataaattgaatattaacatagcaactgccagtgaaattcaaaaatccctaactggcattggtgcgaaaaaagcggaagctattgtgcaatatcgtgaaaaacacggtaattttactaatgtagaacagcttttagaagtacaaggaattggcaaagcaacactagagaaaaatcgtgatcgtataatcttttaattttctaacctccaatgaatgccctgtttcacagggcttttttattctttacacacagaatacattaaaaagccgttggcaacttgagtaaattttaatacactagcaagcctagtcggggtgcaatacgctgagatcatacccgtgaacctgaaacagttaatactgacgtaggaaactaggaatataaccttatctccttttcgtcattattgctgccttttaatcataaataaggatgtaataatgaaacttcttaaattaaccttaatttctaccgcacttttttccactgctgcattagcacaatcacagcaaagtgtgaacgtatatagctacgattctttcacttctgaatggggtgctgggccaaaagtaaaacaagattttgaaaaagcacacccacaatgcactattaattttacgccttttgaaagcgttggagtgttgctcaaccgtgttcgcttggaaggaaagaaaacaaaagcggatattgtgctaggtttagataacttttttttggaacaagctgaaaaaacaggtatttttgcaccaaataacgtggatttaactcagcttgatttaccaacaaaatggacaaataagaccttcttacctttcgatttcggtaattatgcttttgtgtacgataaaaccaaattacaaaatccgccgaaaagtttgaaagaattagttgaacgccaagatcttcgtgtgatttatcaagatcctcgcaccagcagtgtgggacgtggtttattggtttggatgaatgtaatttatcctgaagataaaattcaatctgcttggaaaaatttagataagcatacggtaacagtgggtaaaggctggtcagatacttacggtgcattcttaaaaggcgaagcggatttagtattaagttacagcacatcgccactttatcatcaactttttgagaaaaaagataattatgcggcgacagattttgcggaagggcatattactcaagtggaattagcggcgcgagttgccaaccatccaaatcaatgtgcggatgattttatggcatttttaatttcgcctacagcacaaaaacatattgtgacagccaatattatgttgccagttattcaaggcgaaattgaaccgcactttgatgcgctgaaagttcaacaaaaaactcaaacgccaattaatccaacagtgaatgctgagcagttaaaaaattggatcagcacttggcaaactacattaacaaaataatttgatgttgtcgttatttcatcatccacaacttcgccctcgtcattatgcgggcggggttgttgtcattagtttcattattcttttttatggtagtgccttaagttcgatctttacattgggcgatgaattgcaatggcgagcttggtttactgatgattacctacagcatctgattcttttcagttttgggcaagctttactttctaccgttttatctattttctttggtttacttctcgctcgggcattattttataagccattttttggaaaaaagtggttgttaaaattaatgtcgctaacttttgtcttacctgctttagtggcaatttttggtttgatcggtatttatggttcaagcggttggttagcttggtttgctaatctttttggaatgtcgtggcaggggcatatttacggactgtcgggtattttaattgcccatctttttttcaatatcccactggcagcacagcttttcttacaaagtttgcaaagtatcccttatcagcaacgtcagcttgcagcacagctcaatttgcaaggttggcaattcgttaaattggtggaatggcctgtttttcgtcagcaatgtttgcccacatttagcttgatttttatgctgtgctttaccagttttaccgttgttcttacgttaggtggtgggcctcaatatacaacattagaaacagcaatttaccaagcgattttatttgaatttgatctgccgaaagcggcactctttgctatgttgcaatttgtattttgcttgcttttatttagtttaacatctcgtttttcgccttctaatcaaaatggcttgagcaatagtaatatttggtttgtgaaacctaaaagtgcggtcaaaattttctatgtttttgttttaattgtttttgtctttttccttttttcgccagttttgaatattcttattagcgcattgagttcatcaagtttactcaaggtttggcataattctcaactttggcgtgcgttaggttattcactttctatcgcacccttgtccgcattacttgcattaacgatggcgattgccttattgcttttatcacgccgtttagaatggttacattatcagaaaatcgctcaatttattattaatgcaggaatggtaattttggcaatcccgattttagtactcgcaatggggttatttttattattacaagagcgtgatttttcgaatattgatttgtttattatcgttgtattttgcaatgcgttaagtgcaatgccttttgttttacgtattttgagcgcaccttttcataataatatgcgttattacgaaaatctgtgtaacagtttgggaattgtgggttggcaacgtttttatctgattgagtggaaaaccttgcgcgcaccgttgcgttatgcttttgctttaggtttggcgttatctctcggcgattttacggctattgcgttatttggcaatcaagagtttacttctttaccgcatttgttatatcagcagttaggtaattatcgtaatcaagatgccgctgtaaccgcagggattttattattgctttgtggcatattgtttgcctttattcacacatatagggatgctgatgatttatctaaataatgtgattttgaatgataaaaccttaccaatgtgctttaatttgaacgttaaggctggcgaacgtgtcgcaattattggcgaaagtggggcggggaaaagtaccttattgaatttaattgctgggtttgaatttcctgctcaaggagaaatttggttaaacgataaaaatcatacgcgtagtgcgccttacgagcgtcctgtttccatgctatttcaagaaaataacttatttccccatttgactgtacaacaaaatcttgccttaggaataaaaccctctttaaaattaaccgcacttgagcaggaaaaaattgaacaggccgcttgctccgtaggattgggcgattatttagagcgtttaccgaattctctttcgggggggcaaaaacaacgagtggcattggcgcgttgtttgttgcgagataagccaattttgttattagatgagcctttttctgcattagatcagaaacttcgggtagaaatgctggctttaatcgctaaactttgtgacgagaaagatttaacattgctacttgttacccaccaaccatcggaattaatcggttcgatagatcaagtgttagtggtggaaaatggtcagataagtcaattgcaaaaaggggtgtaaaattagtttcattcataacgttgaattgattgtttctaccatatacactaattcatcaattaagaaagtataaaaagcgtggtgtttttaaccgcactttcaaaggaaaaacatgttagcggaaaaattacaaattaactctattacacctcatccaagtgtagaatattggtctgtttgcaaagttgaggcgttatttgaaacgccatttttggaattagtttaccgagcaacgcaagttcatcgtaagcattttaatcctcgcgcgattcagttatccacgttaatgtctatcaaaacggggggatgcccagaagattgtagttattgccctcaatcagcccgttatcatactggcgtacaaaatcagcagttattagatgttgatgagatcgtcgctaaagcaaaaattgcgaaagcacgtggtgcgggacgtttctgtatgggggctgcttggcgaggccctaagccaaaagatattgagaaagtcacagaaattattaaagccgtgaaatcacttggtttagaaacttgcggtacctttggtttattgcaagacggtatggcggaagatttaaaagaagctggattagattattacaatcataatcttgataccgcaccagaacattatgcagaagtgattggtactcgccgttttgatgatcgtcttagtaccttaggaaaagtgcgcaaagctggattaaaagtgtgttgtggtggcattgtggggatgaatgaaacccgtaaagaacgggctggattaatcgcgagccttgcaaatcttgatccgcaacctgagtcagtgccgattaatcaactcgttaaggttgaaggtacaccgttagccgatgcggaagaattagattggacggagtttgtgcgaacgattgctgttgcacgtattactatgccaaaaagttatgttcgcctttctgcaggtcgtagtggtatgactgaagaaatgcaagcgatgtgttttatggcgggggcaaattcgattttctatggcgataaattacttgttacagataatccagaagaagatggcgatcagttattgatggcaaaattagatttagagccagaaactgcagaaaataaaaagttgtagtttgcgttagaaagctgagaaattaagtataaatctattcctttctttatttcatatctcacaataattttcaatagccaataaaaaagctccttgaatatcaaggagctagtttagtttaatcttaaagaatttctttcgcttttgctaccacgttttcaacagtgaaaccaaagagtttaaataattgatctgctggtgcggattcgccaaagctattcataccgacaacacgaccattgaatccaacgtatttataccagaagtcagcaatacccgcttcaatcgcaacacgtttggttaccgctgcaggtaatacactttcacggtatgcttcgtcttgtttatcgaaacggttagtacttggcatagaaacaacgcgtacttttttaccttcagcacttaatgcttcggctgcttgcactgctaattccacttcagaacctgtcgcaatgaaaattaactcaggtgtgccatcacagtcttttaatacataagcaccacgtttaaccgcatctaattgtgcagaagtgcggttcatttgagcaagattttgacgagtgaaaattaacgcacttgggccatcttgacgttcaaccgcttgttgccatgcgatggctgattcaacttggtcacatggacgccatgtttcaaggtttggaattaagcgtagtgaagccgtttgttctactggttggtgtgtaggtccatcttcgcctaaaccgatggaatcgtgggtataaacgaataatgtgcgttgtttcattaatgctgccatacgtactgcgttgtgagcatactcgtagaacattaagaaggttgcgccgtaaggaatgaaaccgccgtgtaaggcaatgccgttcataatggcagacataccaaattcacgaacaccgtagttaatgtagttaccacttacgttttcgtgggcacgaatcggttttgaaccactccataaggttaagttggagcttgctaagtctgcagaaccacctaaaaattctggcaataggtgtgcataggcttcaatggcattttgtgatgctttacggcttgcaatactcgctggatttgcttgtaatttttcgatgaacgctttagattctgccgcccagtttgttggtaattcgccagaaacacgacgtttaaattctgctgccaattcaggataggcttttgcataagcggcaaatttttcttcccaagatttttctgctgcagcacctttctcttttgccgaccattcagcatagtattcagctggaatttcaaatggcgcatattcccaaccaagtgctttgcgggttaaagcgatttcttcatcgcctaatggcgcaccgtggcaatcatgagaacctgatttatttggagaaccaaaaccaatgatggttttacaaataattaacgttggtttttctttttctgcttgagcaagaacggcagcagcgcgaatttgctctgcattgtgaccatttacattacggattacttgccagccataagcttcaaaacgctcggcggtgtcatcactgaaccagccatcaacatgaccatcaatggaaatattgttgtcatcgtagaatgcgattagtttacccagacctaatgttcctgctaaagagcaagcctcgtgagaaatcccttccattaaacagccatcgcctaagaacacataagtgtggtgatcgacaatttcatggccttcacggttaaattgtccagctaaggttttctcagcaattgccatacccaccgcattagtgataccttgacctaacgggccagtcgtggtttcaacaccaggtgcataaccatattctgggtgacctggggttttagaatgtaattgacggaattgttttaaatcttcgatagaaagatcatagccagttaaatgtaaaagactataaatcaacatagaaccgtgtccatttgaaagcacaaaacggtcacgatcagcccatttaggattggttggattgtgttttaaaaagtcgcgccataatacttcagcaatatccgccatccccattggtgcaccagggtgaccagatttcgctttttgtacagaatccattgctaagacacgaattgcattggctaattgtctacgagttgccattttgttctcctgtgataattcgttttgaaaaataatcttgcgcattctaccttatttctgaaggaaatttagcaaaaatccgcactcaatttaatagtttgtgacaataatcaaattctacgacgacattgatgaaaacgcatactactagattttattgtcaaatttaccgcacttttttctctttgagtttatgataagaacagcgataatgacttaaaaaatacttgttttacaccaaataagataacgccaaatatcgctaggcttagcgaaataatcgttgcaagtatcattgagtagtttttctttaattattttcactttttcaattcacatcggttaaaatctttttagtcgccacaacttacaggatttttatgcaaattcaatgtttcgaaagtattacacaaaaatatccacaatttcctaccgcacttttggctaatgaggagcctatacagaacggagagccttttatcttatacggcacaaagttggacataactaagctagaaaaatttcaacaaaagtgcggtcaaaattttcagatttttgatgtttggatggtagcgaaaaatattatcgtcttattgaaaggtcaatggttttctgatttcattaaatttgctcacgatgttgaagtggatattgctaaattagatttcagccctaaattgtctcaagcagggttgttggtgatggatatggattctaccgctattcaaattgagtgtattgatgaaattgcgaaactagcgggtgttggcgaacttgtttctgcgattacggaaagtgcaatgaggggggaattagatttcgagcaaagtttgcgttgtcgagtgggtacattaaaaggtgcgccagaaagcattttgcagcaagttagagagaatttaccgctaatgtctggattagttgaaacgatccaaaccttacaaaaatatggctggaaaactgcaattgcttcaggcggatttacttattttgcggattatttgaaagccttattgcaacttgattttgctgcatcaaatcaatttgatattgaagatggaaaactcacaggcttagttaaaggcgatgtggttgatgcccaatataaagctaaaacattgcaacatttgttagaggaatacggtatttattcccaacattctattgctatcggcgacggtgcaaatgacttggcaatgatgaatgtggcgggactaggtgttgcgttccatgctaaacctaaagtgcaacaacaagcgcaaattgtggtaaacttcgccgacttaaccgcacttttatgccttctaagtgccaatgatcgaatttaataaaatgggagaagactatgccatcttttgatattgtttctgaaattactttacacgaagttcgtaatgcagtggaaaatgcaaaccgtgtgcttagcacgcgttatgattttcgtggtgtcgaagcggtaattgaattaaatgaaaaaaatgaaacgattaaaatcaccacagaatctgatttccaacttgaacaattaattgagattttaattggatcttgcattaaacgtggtattgagcacagttctttagatattccagcagaaagcgaacaccacggtaaactttacagtaaagaaatcaagcttaaacagggtattgaaacagagatggcgaagaaaattactaaattagtaaaagattctaaaatcaaagttcaaactcaaattcagggcgaacaagtgcgtgtgacaggtaagtcacgcgatgacttacaagcagtgattcaacttgtaaaaagtgctgaattaggtcagccattccaatttaataattttagagattagtttttcaaataagggcgaaatgttgccatagttttttgataaaacttgacgaacaccgctttcaagcgtaacattcgcccgattttttaacgagaaggacacacactttggacagtcatagtcgataccgaatatcgctctagacgctcgccttttattatcggcgtgcgttcgccggtaaatttaccgttgtttcggcatctcttaacgaaaactttgcgattttttaccgcactttcgtttcttctttaatttgttcactgttagctgttcataatcctataaggagtatgaaatgatcaatgcgtttgctatcaatgattcccgcttggttcgtattgacgaagaccaaactgatctcaatactgccatttggcttgatttacttgagccgacaggcgaagaacgtgaaatactacaagaaggcttaggtcagagcctagcatcttttctagaactggaagatatcgaagcttccgcccgtttctttgaagatgaagatggtttacaccttcactcatttttttattgcgaagatgaagacaattatgctgatttagcgagcgttgcttttactattcgtgatggtcgtttatttacgttgcgtgatcgcgagctacccgcattccgtttataccgtatgcgttcacgtagccagcgtttgttagaatgcaattcctatgaagttttactggatttatttgaaacgaaaattgagcaattagcggacgtgattgaaaatatttatgcagatttggaagagttaagtcgcgttattttaaacggaaaacaagatgaagcctttgatgaagcattaaatacactcacggaacaagaagatacgagctcaaaagttcgtttgtgcttgatggatactcaacgtgcattaggtttcttggttcgcaaaactcgcttaccaactaatcagttagaacaagcacgagaaatcttacgagatattgaatctttgcaaccgcataatgaatcattattccaaaaagtaaactttttaatgcaagctgcaatgggttacatcaatattgaacagaacaaaattatgaaattcttctcggttgtttctgtgatgttccttcctgcaacattagtcgcgtctacttatggtatgaactttgattttatgcctgagttacattttaaatatggctatccaatggcaattggattaatgatcgcagccgcactgacaccatatatttattttagaagaaaaggatggttatgatggaattatcccaaaccgcattatttatcggatcaattattaatctttacgcacttgtagtaatcttacgagcttggttgcagtttgctcgtgtggattattacagtcctgtttcaacatttgcagtcaaaatgactgatccaatattaaaacctctgcgtaaaattgcgcctactgtgaaaaatatcgatacttccgcattactgcttgtatttattattggtatgttaaaaggtattatttattttggcttatcagtaaatgtactcttagtattgggcgtattaactgtattgaaaagcattggtttagctattttctatgtgctttttattggggctgttttaagttggtttaatcgaggtaataattctataagttatgccttttatcaactctccgaaccacttttaaaacctatccgtcgattcttacctacattaggcatgattgatttttctccgatggtcgttgtatttatcttattatttttaaataattttatgcttgatcttctaggtggactttggattatcgctggttagatattcatattccttatttgaatattgctttataaaaatattgaagatttagttggtaagaatagtattttctattcttacctttttatttcgtttttagaggtttttgatttttataattcttataaaagatatgaaattcttttataaaaataaggggagtttatttacattgatatttaaatagcagaatttattgtcctattacctaaagtaccatcatcaatcgcttcttttggcgtcccaataacttcggcgattttctctccatttttaaaaaacacaaatccaccattttccatttttgtccaagattcatctttggttaaaggaaatgttgtgatgatattgaccttatctcctgcttttgcataattgctaaaatcaattactccatcatcatcaatacggtgagctttgccaaaaggtgcttttcgcataacataatgtaagtttgttgagcaatgtgcaatcatccactcgccattagaaagaatgaaattaaacgtaccgtgttgagcaagttcttgtgttactttttgaattgcttcaaaaatttccatttcacttggttttttgcggaaagtatttttaagatactcagccatataacagaaagcagcttcagaatctgtagaacctattggctgtaaaaaatgatctgtcatatctggtaagttttttaaattaccattatgtgcaaaaacccagttttgtccccaaatttcacgaatgaacggatgggtgttttcaatattgacttcgccttgtgttgctttacgaatatgcgcaatgacattaagagatttaatattatattgttttacacaatctgcgatgggggaaagactggctgtttgattatcacgaaaaatacgtacacctcgtccttcaaaaaaagcgaccccaaagccatctgaatggcaatctgttaaacctgcgcgacgacggaaaccttcaaaagaaaaaacaatatccgtcggcgtattacaattcattccgagtaattgacacataattttaattagatataacctcacaatatgtgagtgatttaacaccattatagggagaatatcaagagagatttaatgaatttttatgttgtatagatattaatgatagaaatggtatttaatctattattttttattaatattctttatttttaaagaatggtaaaaaccactgatatttgaaaagtcattgcttagatagaattaacctcctttgcaatttaaccaagttacttgcttgccttgttgattcttgtagtaaattgaactttgagatcgcacgattaaatctacataacttccttgaattggatcatacgaacgataaatcgcttcaaattttgtaccacgggtattgagtgttagcgtatataaatgatcaaaaggtatcgctttgccattatctaactgaaaataaaaactaaaattttctttcatacggctttcacgcgacagagggaaataagtcgtcaaatgagaaattcccccagtttctttattattacaacgataatgatatggcttgtaattaacagaattatttaactcagtttggctaatattattctttaaaaatcgagatttaaccgttttcttcggctgatgtattgtggtacaagcaaataaactcacaagagccccaacaaacaatgccatctttaatttattcataaatacaaaattcggagaaataagaggcgcgtatgatagcggaaattggggactgtgcaagggattggaatgagactaaaaaatgcaataaaaactggaaatgtaattccaaatacatacaaaaaaataaaatatggaaattaacttccaaaccttgtacactttttacaaatatgaaattaacttccaatgagtaaaactatgatctctcgtgaaaattatttacagcaactgattcaatttaaagatactgattttatcaaagtcatctcgggtgttcgtcgttccggtaaatcggtgctactcatgcaataccgtgattaccttcaacaacaaggcattgcttccgaaaatattctttatctcaattttgaatcttttgaatatcaatgggtgaaagacgctcaagattttcaacagctgattcaagaaaaaatgccgtcttctcaaaagaaaatctactttctgattgatgaaattcagtttgtggaaggttggcaaaaaatcgtcaatgggcttcgcgtgagttttaacgctgacattgtgattacaggttccaatgctaacttgctttccggcgagcttgcgacgttgttaagcggtcggtatgtagaaatcaaaatttatccgctttctttcaaagaatttttgcacgccaaaaatgtggatagccaatcaagattggtcgataaactctattcggaatatgaaaaatatggcggtttccccagcgttgtgatggctgatgagcctttaaaagaaacgattttatcgggtatttttgattccatcgtgctaaatgatattgcccaccgagctggagtgaaagacacgcatattcttaaaagtgtaattctctttttagcggataacgtagggcagttggtgaatccaagcaaaattagcaacacgctcacgtccgaacgtgttcccacttcaaatcacaccataagcaaatatcttgatttgttagaaaatgcctttcttttttataaagcaaaacaatacgatattcgcggaaaaggctatttaaaaaccaatgccaaatattttattgtggataacggtttaagacgacacgctatcggcaaaaaaggtgcgaattatgccaatcgcctagaaaatattgtctttattgaattgcttagacgaggttataccgttgatgtgggtaaactcgacagcaaagaaattgattttatcgcccgaaaagctgatgaaattttatatgtacaagtcgcttttgaaatccctgaaaatacccacgaaacagataatcttttgcatattaaagataactataaaaagattttaattacggggaaatattacgaacaaacagagattgatgggattgaagtgatttatgtggtggattggttgttgcaataagtctaaaaacgttgaaaattttcaccgcacttttgtgtttaacgcttatgccgacgcgcgtttcccaacgcgtgccctagaaattaaagtgcggtgagtttttgaggtgtttttattgaagttaggcacacgctgggaagagtgcgccatcgtgggggcagtactgtagagtttgttagtaaacaacatctacttattatttaataattggtcatatgctgggcgaactccacttggaatacttccagaatcaattaattttaaagcttctataaatcttattcttccatattcatcgttggtttttcttccaattttagaactattaatttttgcatgggtaatcattaggttaatttcttttggagaaaagtttctaataattttttcataaaatggaattgctccccatgaaactccatatttgtttcccaaataacaagaaactatcgtatctacaaaatcactttgggctgtttcagggactgctgtattttgagacaattctgctaatctttcagcatagggaggctcattataaaaattgtttagcccatcatgagcgatttgcaacctgttaattgctgctgaaaaaatcgcatgttgttgtggagctgatagcaaccctaataaacttaatttctcaaaaaattgactagatgctcttaatctttgttcatctccttttgcgatatattcagagtgtttatcaattaatgaagattttagtgaagcagaaaaactattttgaaagaaagcacaaatatctaaagcatttaatctagttgtttcctgtgagtttgggtcacaataaataccgtgtgccataataatcaataattgtttctgtgcttcgtgagttttagatagcctatcaatccaatattccctttgttcttgattaaatcttccacctttaatcgattgaataaaatcactaatattgactcctttaggtgaagaagaatcacctaaagcatattttatacaacgatttaagaatgtaatgaattctctatcattcaaattgccaagtgaagggtgagcagcagaaaaattattacggatatttctacattggcctagaaaaagaaagccttcttcgttaagaatgtttaattgcaaacataaatctagtaactgactatcctgtaatgctattaaatggccttcttcaaaatccctttccaatacttgagcaacaattggaagaccaaaggttctaactttatcacgcaatctcaaaatagaagcattccatatatagttgattgcaccatcaaataatcctgagctaattgcaatgcacatacgagcaataagctcaggattcacattctggactggtatatttcttaattctctaggtaaatcattccaagcatatctaatttcttcatcacttgctaaaacgtctcttggaatgcgaagagcagaaactagttgattaattgcgggaatagtattaactgataaatcgggtaactgactattaaaagttgttagcgaattatttaaggacataaaattttctcccataataaattaagttaataaatagtttaagtttttattcctaggctctaattgtatagttttaataaataacttcaaatataagataacgttatatcataatatgttttatccctacttcatcgcccccccccaaccacttcaacatctctctctcatcccaacctttacgtttggcataatcttgagcttggtcttcatcaatgcgacctgtgattgatgccgaaaatggctaaattcattgacatcaagcacatcataactacgaaaggtatccgtgtacacaatgctatcaggcttaacttttcctcggataattgacaataatgtcgctgattgcgcattagggacaacgacggtataaaccttgccatttcgtttgagaagccagaataccgcgactttttctcattggtttattctaacctaaatgggatttttagtcgttatctagtacagcctcaagatttttatttaagtgtaatggctgcgacaaaacaggtaattttacattctccgcacccattgcaacgttcattatcaatctctaaagtgctggagattgcttgttgtgtgcaagcggtttggcagtctggacaggtttgattttgtaggattaaacaggctgaggaaaattgtggacgaagtaatgtatccgctggaaaattaggatgtagtgcatttgtcggacaaacttctgcgcatttaccacacaaatcacaaggtgcgtagtcaatttcaagggtggcttgttgctgttttagttgaattaaaccattagggcaagctgaagcacattccccacaaccattgcagacggcggaaaataaatcttctcgtgctgaaaagggaggacgagattgcgttttttctattgttgattttgtagctggaaatatatgacgcaatagtcctctacgagaaatgtgatggtggcttaaataagcctgataataggcttcgtttttcattatcgataaaatcttactgtcggtatattaatatgtaaatctacttgccattgttgtaaagtttttagggtaagtaatgcaagagcttgataaaaatcagaattttctattttgcttagttgttcaaggaaatgatacgcccaagttaagaagtgttcacgtagaaattcgattaataagtgcggtcgattttctgctaaatatgcagcaagcattaacattaagccaatatgatcttctggttcatcttgttgtgtttgaaatgcgatttgatgttgttgtaagaaatcgcgtaatgctaagagagaattaccaaaaataacacattcaggatcaagatatacggatccccaaggtggcgtaggtaattcatttggaccaataaataaatactgatattgttcattgatattttgttgcagccctttttcaataagtgcggtaatttttttatgtgtttttacatcaaatgaaatttcccattcttgcatccaatttggttggcgaaagaatgtcaaaatatcagtaagtcgtgcatcattaggctcatagtaaaatactgcaccgagtaaacgcccataaatagaaatttgttgaagagtattttgcatagtatctccgaaaacaatttgtcattagtgaatggggatatgagggttggttaaatattactaattaacgtttctaaaaattgaggcgtatgctatacgcctcaacataatttaaccaccaatcgccatgccgtaagtcatatgtaatccataaaataatacgcgaccgatgccttcagctactaacgttaatagaacggaaatacctaatagtcctatgtttttcactcggaataagaggaaagctacaatggaaagtaaacataagcgagttacggtcattatggcataatttggtacgaggtcagcggcattttgaatagcactgtgaatattgtgtaaattgaagccttgatatatggctactattgcgaccaataatactccaatggcaaataaacttggcagatgctgaagctgatattcacgttgtttattagggattaataacgcatagcttaatgttaatccacctaatacaacggtaagatagaatgaccaagaggttaatgcattattccaagttggtatgcttgtaatatggtaaacctgattcattacatacataaatagtatgccgataagggcggtcacaattcgccatacatttccaagtgaagctggcattttacctaaaattgcaatcagccagtagaaacctgctaatgcgaaaaatattgcaccagtggcaatttcattactcatcattgatgagccgactctattaagtgaattaaatgcacgtataggtaagccaagatgcataatggaagcaataaatccaatacctagcaaagccaaaatcacaaacattactttatgaatataagtgcgactttttgtatttttctcatttaatagtacaaatgtgaaaacaagccaagcaccgaccgcactttgtgccaaaactgtaaaaaatactagtggcagttcatataatcctgtattcatcttacacctctcttgggtttcctaagaacccacttgtatcgccacttaaacgagcgtgtttattgggttttacaactaaatttggttgagtgatatcagccggtggtagtggtgcgatggaggcttgagtgccgtattttgctcgaagttcatcaataggagcgaaatccaatgctcgtagtgggcaggcatcagcacaaatcggtttttgacctgattttacgcgagaataacatccatcacattttgtcatatgacctttttgtgcatcatattgcggtgcatcataaggacatgccatatggcaataacgacaaccgatacaaatttcttcattgacgatcacgaaaccatctgcatttttgtgcattgcaccagttgggcaaacttttgtacaagcaggatctgcacaatgattacaagaaatagacatataataagcaaatatattttgatgccagcatccatctgcttgttgattccactgaccacctgtatattcataaatacgacgaaaattgacttctgtgccaagatctttgtaatccttacaggctaattcacaagttttacagcctgtgcagcgttcagaatcaaaataaaaaccatattgttccataattatccccctacaaacgttccacttgaactaaattagaatgttgcggattacctttcgcaagcggtgatgggcgttgtgtcgtaagtacattaatgcaacctgaatgatcgatacgatctttatctggtgcataccaagccccctcgcttaatgccacaacccctggaataatacggggggtaatttttacattaatacgtacttcgcctcgatcattaaagatacgaatcatatcgccatttttaatattacgaggttctgcatcaataggattcatccaaacttcttgtggattagctgcttttaatacatccacattgccataagttgaatgggttcttgctttgtagtgaaaaccacttagttgtagcggatatttttccattaatggatcgccgtaatgctcaaaactttgggcgtgaattggtaaaggatgaattatttcatcttctgctaatttccaagtgtttgctatttcagctagacgagaagaataaatttcaattttgccagatggcgttttaagtggatgggcttctggattatcacggaaatctttgtatgcaactttaaagccattaggatcaacctttttaaaaataccttgttgtctaaattcttcaaaagtaggtaattcaggtaatttttctcgagattgctcataaatatggcgtaaccattcctcttgtgttcttccttcagtaaatttttcttttacgcccattttctcagctaaatcactcaacatatcgtaaataggtctacattcaaaagatggtttgatcacttgatctgcaaaaatgacataggccatattggatacaaaggcatctaaagcgaaatccatttgttctgaagttgtacaatctggtaataaaatatcactgtatttggcagtagatgtcatatgattatcaatagtaatgatcatttcacattgggtatcatcttgtaaaatatcgtgagtacgattgatttgtgcgtgttgattaatcaaacagttacttgcgtaattccaaattactttaattggggacgataatttatcaacaccacgaataccatctgtaagtgcggtcatttctgtgccacgaataattgcatctgtccataaaaacattggaatgcttgctttcacaggattttttagcgttggcatccgcacaaatggaatgctatacgcactttcacgtgcaccagtgttaccgccgtgaattccaacattacctgttaagattggcaacatcgcaatggcacgagagattaattctccattactacgacgttgaggcccccaaccttgggaaataaaggcaggttttgtgctgccaatttcacgtgcgagtttaataattctctccgccggaatacccgtgattttagccgcccattctggggttttagcgataccatcattaccataacctaaaatataggctttataatgaccatttttaggggcatccgcaggtaatgttttttcatcataaccaacacaatatttatctaagaaaggttgatccacgagattttcttgaatcattacataagcaagggcagaaacgagggctgcatcagtgcctggacgaattgggatccactcatcttcacgccctgcaccagtatcattataacgaggatcgataataatcattttggcattggaacgagctttggcttgttcaatacaataagttaaaccacctccactcatacgagtttctgcaggattattaccgaataacactattaatttggtgttttcaatgtcagccattccatttcccaatgcccaaccaccaccataggtataatctaaaccgactgcaatttgtgcggtgctgtaatcaccataatggtttaaatatccaccaatacaattcataaaacgagcgatcatagtggatgcaggaggccaagatttagccattgtgccaccgagtgttcccgtaccatagtttaaataaattgattcattgccatattttttgatattgcgtttcaatgcgtctgcaatttcagttaaagcctcatcccaactgattcgtttgaatttaccttctccgcgtttacctatacgtttcattggatattttaaacggtctgggttatacactcgacgacgcatagaacgtccacgtagacaagcacgaacctgatgatcaagattatatgtttctgtccccgtattatcggtttccacataagtgattcggttatcttttacgtgcattcgtaatggacaacggctaccacagtttactgtacaagcactccaaacaatacgttcctgactattttcattgaggtgttgtgtctctttagccattacattgaaaggtaaagtaagatttgaaactgccagtgcagctcccgcagatgacgccttgacaaaatctcggcgacttatttgattaaagttactcataatatcgtcccccacagtaagatcgagtaataactaaaacgagttaattataatctttgtatagaagttttacttgagccaaatcaactaattattaataggtacattatttatagggtattttagtaggttgatgtttttataaattttggaataacaaattgactatagatttaaaaatccgttagcatagtggcgtattagtttatctaatatgttaagtttaactattattaactagaggatcttttcatgaagaaacttatcgcggttgcggtgttttctgcgtgtggctcgttagctcatgcaaacaccattattccaaactacaatacagacgcccatctttacgaattcacgcaaacctatgatttagttgtgccaaaaggctcgcaaggacaaaccaatttatgggttccattaccatttaatggggaataccaacaagtgaaatcgattcactttgaaggtaattacatgaatgcctatgtaacagaaaacaataaatacggagcgaaaaccttatttgccacttgggataaagatgcacaaaaacgtgatttaaaagtcacgatggtcattgaaacaaaagaccgtgaaccgatggtgaaaggtgctttagagaattatactccgccaaaagatattcagtattccgtggatgtacaagaatacttaaaagctactccacatattaaaactgatggcattgtgaaagaatttgctgacaaaatcctaggtaaagaaactaatccattgaagaaagcagaacttattcaccactggatcgtaaaaaatatggaacgtgataattctgtattaggttgtggtgacggcgatgtagaaaaaattcttaccactggcgtgttaaaaggtaaatgtaccgatattaactctgtatttgtggcacttgctcgtgctgcaggcatccctgctcgtgaaatttttggtattcgcttaggtacggcagagaaaatgggcaaatattcaaaaggtgccttcggtagtgcaaatgaacaaggcatcgtaaacgtaagtggcggtcagcactgccgcgctgaattctaccttgcaggatttggatgggtaccagttgattccgcagacgttgccaaaatgcgtttagcagagaaaaaatctgttgaagataaagatacacaagccgtagcaaaatatttgtttggtaactgggaagcaaactgggtgggatttaatcatgcccgtgacttcgatttatatccacaaccagaactggctccaatcaataacttcggctatccatatgcagaagtaggtggcgatccgttaaattcctttgacccaaaagaatttaaatatgactacgtatctaaaaaactctaataaatccttttgggttgccatagccgccgcactaagtgctgcggtggcatcaaccttgtgctgcatcgcaccattaatttatttagtatttggtgtgtcgtccacttggttgattggcttaggcgaatatgattatttgcgtattcctatgcttatcatttcattatgtgcctttgcctatggattttggctgttgatgttttccaaaaaaatcatttgtagcaaatatatttcccgtaaaaaacttatcgttttatattggattgtatttatcgtgatgatttttttcttaacctatccaacaattttaccttggattttagaattagctaattaggaataaaaatgaagaaattatgtaccgcacttttgctttcgctgtttgcaatttctttcgctcatgcgaatgaaaccaaacaaattgtgctaaaagtaaaggaaatgaattgccagctttgtgcttacttagtcaataaagaactgcgtaatattgatggcgttatttcaacaaaagcatctattaaagatggtttagtgacggttgtggaagatccaaaagtcacaaaccaacaattattcgatgcaattcacaagctgaaatatactgctgaagtcgtgaattaaacgctaaatatctagcaaaaaagtgcggtgaaaattcaccgcacttttctttagctattaaattagactaattttttaattagcttgattacagtacaattaattaaatatgataaacgcaatattattcagcacttccgcttaaaaatccgccactttgatgattccaaagtttagcgtacagaccattgagctctagtaattcggcgtgcgtaccttgttcgacaatttgtcctttatcaagcacaatcaggcgatccatcgctgcgatggtggataaacgatgggcaatggcaatcacagttttattttccatcatcttatctagactttcttgtattgccacttccacttctgaatccaatgcacttgtggcttcatctaacaatagaattggtgcgtcttttaacattacacgagcaatggcaattctctgacgctgaccaccagaaagttttaccccgcgttctcccacatgggcatcatagccttttctaccttgagaatcactgagaaatgggatgaaatcagcggcttccgctcgttcagcagctaaaaccatttcttcatcagtagcattcgggcgaccataaataatattgtcacgtacagagcgatgtagcaacgaagtgtcttgagtgactaaaccgatttggcgacgtaagctttcttgttgcacattgagtacattttgtccatcaatggtaatttcgccttgttgtgcttcataaaagcgaagtaataagttcacaatcgtagattttcctgcaccagaacgaccgattaacccaaccttttcccctggtttgatagtgagattgaaatgattgagtaatggttttgtcggatcgtaagcaaaggtaatatcgttaaacttaatttccccttgtttcacttgtaacggtgacgcttgtggtttgtccacaatggtgtggggtttagttaaagtattcattccgtcgtttacggttccgatattctcaaacaaacgggcagattcccacataatccagcgagaaagcccatttacgcgtaatgccatggccgttgccgttgctattgcacccacgccaacttgaccatttttccataaaataataccaagtattgcagtacttaacgtaagtagaatatttgtagcgtaagtgagtgtatctagtgatgttgctaagcgcatttgggcgtgtactgttaccataaaatcttgcatagaacgcttggcataagtagcttcgcgtgagccgtgagaaaataattttactgtagcaatattagaataagcatctgtaatgcgtcctgtcattaaagaacgagcatcagcttgtcgttgtgcggtttttgatagtttaggaattagggttcgtaggatcaaaccgaagagtataatccaagtaataaatggtaataagaaccaagaatctaatgccactagcactacgccagaggtaataaaatataccaatacataaacgaacatatctgcaagtgtaagtactgtgtcacgtactgcaagggcggtttgcattacttttgcggatactctacctgcaaattcgtcttgataaaaacttaaactttgtccaagcattaaacgatggaaattccaacgtaatcgcattggaaatacgccttgtaaggtttgtaaatgcacggccgaagctaaaaatccccacacaatactaataagtaatagagcagccattccaattaataaatgacttttttcttgccataatctttcaggtgtaaatgtgcctaaccaatctacaagcgttcccataaattggaataatacagcttccattacacctgtacctacggttaaaattgcgagcaaaaaaatccagcctttcattcctgtaatactagaccaaataaaacggaacaaaccttttttaggtgttgttggattgctttctggatagggattcaaacgattttcaaaccacgaaaaaattttgttaaacatatcttttccttaaaaagaaaaggcaacgcgggttgccttttagaagtgcatattattatagcacaaaaacaaatcaatttataggctgacagattttctgtattggcttggagaaagttggtagtaatttttaaaaactttacaaaaatgcgcttctgattgataccccacttctaaagcaatggcaagcacagattgttgtgattgttttaataaaaacgccgcagattgtaaccgcactttcgtgagaaaacgtcctggcgacataccaagttgttgttgaaaaacacgaataaagtttgcacgagacattgttgcaagttcagctaattgttcaatatgccaatcattttgaggttgttgtaatattgctatcagtgcagtatttaatcgcttatcttgtaaggcgaataagatgccttgttcaattaaattttgttgaatggcgtgacgtaaaatataaattaaaagtacatttgaaagtgcatcaacgaccgatttcgtacccgcatcatttttttgtgcttcttgcaaaaaaagctgcactaaaggatgaatgggcgtgtcgcataaatttatatgtaaatattcaggcattgatgccgtaagaagtgcatcttgttgataataaaaattaccgcagaacatttttaaatctggtgtacctcgtccaatctgatgtaactcaaataatccttgatgacttttttttgtaggaatatctgcccttttatttactgaataatgcataaagtgcggttgattttgaggaagaaaaaaaatatctccctcttttaaatgaaattgtttttcatttagtgtaagctggcactcgccttgttcaataagatggaatatgccttttcctgcatccttttcttgatgagatatttgccattcgccttgaaattcacagcgaatattaatttctccacgcacttgtgctaaatgggtaagtttatctaaatagtccataatgagatgttagcgataaaaattgagataaataagcaagtatcataatctaatccgcctataatttgccacaccagttggttattaattcaatatatttaggagaacattatgtttgcagattggaaagaacacacatctcacgttaaaaaatcatttggcgcattgggtaaacaacaccctaaaatgttacaagcttaccaagcattaggctcagccgcggaagagggcaatgtgcttgacgctaaaactcgcgaacttatcgcattagcagttgctgtaacaactcgttgtgaaagctgcattagcgtacacgcagaagaagcagtaaaagctggtgcaagtgaagctgaggttgctgctgcattagcaacagctatcgcattaaatgcaggtgcagcttatacttattctttacgtgcattagaagcatatagcgtacagaaaggttaattactcgtcattccataaagttaagttgattaagagaaagggagcattttttaatgctcccttgttttgttaaggctgtgttttaataatacaccactctatttttcaagctatgtctctcctaaagggaataactccgtaaattgtccatttttctgatgatcagtaaaaaacggcaaaccgatcaaacgataatgcggtgtatctttttgcaggatcttatccttcccatattccactgtgattgattttaaaaaagcttctttccacctatcagtttccactaaatgttcgcctttgggttcaatgaaaatttggtaatgcaaaaagtcgttcacaccattggaagaagatttttgtttatctttcagcaataaaacaaagtccggcataaatccttcaccatcggcaaagttattcaatttaaacacttcttcattgcggattaaatgaacgtcatatttagatttcaaatcgcccaaacgctctgaaataaattgaattaacgcttcttccaaactcgttccagcaaaattatccatcacataccaatcattttgcatggcaatagcagtttttacatcatcttttttgacccatttttgttttggtgtgccaaaaatttcccacaattttttaggcgtaaattcttttgtaccgataaatggcatatcactttcattgagacgtttttcaaccatttccaagatttttaggcagcctgcaagttgtcatctgggctaatctgtttatcttgccctaatcccaaaaattcaatttgccaatcttttaacaagttattttgcaattcattgcgattttgaatgttgagtttgctttgcaagcgatcgaaatgaaataaagattgactattttttcctttgatatgcaaggctttattaaaaatgtgccgctccatttcactcatttttatggtttgagtaaaattattttgtgtgccgatttgtcgggcggtttcatcattttcatcggctgtaaattgcgtttcctgcaacaattgattgccgtgaatttggaatgaaagcgtttgcggattggcttttaggctgtctgcattattggctttagcattgggattttttactttttgatttgcccaaatcaataggtttttaaaagtttcatcatctgcaaattcagattttagtttgaaggtggttaaaaccttgtctttatcgttttcgggaataaagccatctttgcgaagttctgcttttaattctgaaatatagcgagattgctcatcgtgcgtgtaataaaacaattcttccaaaatacgcaattcgtgttgcatgtcattgtcaaatttgcgtttattcggctgtttatcttcaaacgcaaatggaaaataacgcacgccacgaccaatcaactgcttttccgatacggtggcggcagccgttttgcctgattttttatttgaaccgccgccgttttgcccttcatataaacgcacaatatcaaacaaattcagaacgtcccaaccttcggttaatctgtccaccgtaaaaatggcacggatcggattatcggccgcttccaaattatttagcaatttttcggtttcgctgtcggttttttcggttttggttttgttgctctcggagttggtaataatcacattgtgtttttgataattttgttttacccaatctgccaaatgtgcaaactcaacgcctttttcctgcataaattttagggcttgttcagtgcgggttttgccttgttcgttggcgttatcgctatcgctatcgttcaagcttgttgaaaatgtagttaaaaacgaaaaatcaaccgcctgcacattttctgcccaatttaaaaatgccagataatccgcttttgattcatcaatcgtcttacttctaaacaacatcacaggcttgaaattggcaatgccatatttcaacgcaattcgatgtcgataccaagcaaacaataaagcgtgtaacactcgctctttcttacccagcgtactggataccaaattgatttctttggtataacctttttgcaaaaattcttttaagccaaattttgtgatgattttatcagcgtacttttgttgcacgtcagcattttcaggcagcgtggcggtaaattccaacagcacattttggctatgattgccatttttattgagtaacaattccaaaaccatatgctcccagcctttacgttcaatttcggcattgctggtgcggtcgttcatttccttttctaaatctaattcgccttgttttttgcctttggtttgcgcgtttaaatggtgcgcttcatcacccagcatcacaaggttcaatttgtgcaaatccgccaatgtggtttgattttcccgccgggtgcgaatatcgttatacagcttttgaatgctggtaaatttaatttcaatgccgtctgaatgtgggctaaatgtctccactttgcgaataggaattaccgtatcgccctgcaaaatcttctcggtaaataaaaattttgcgtgcgtcggatcggtaaaattattttccgttttatccacgatattgttttgattcacaaaaaacagaaaatgccgataccctttttcaaaataatacaaaatcaacgctgccatcatcatcgttttgcctgcacctgttgccatattaaatagcaaatgggtagggcggtttttgatatcggggaagtcctttaattttggagtgcggtcaaaaattacaaagttttctaaagccgatttctgccattcaaaaaacggatatttcaaattatttgaaacaaattcaggcagtgcgaaaaaatctgtctgttccatttcttccagcattgatttgcggtcttccacccaatcaaacaacgttttattattcgccatcttttttctccgcttgattttttactgattgatagaacgcacggcttaacgctttatcgtcatcgtttaagcaacctgcaaattgttcatcgtccatttcggataatgaaacatacatttgatttaaatccaacatttcaagcatcatttgtttttgttcgtcaagtggtaaggtttgaaattcaggttcttcaatgatttgactaaattcattcacgcttacattgtatttcaagaaatagcgttcgcataattcattaaacagcgttttgatgtcgtttgaattttcgcacgccaaaatttgttgttttgctgtttcgttaaatggagcaagttcggcataaacaaactcgccaccgccttgccaattcacggctttggaaataccgccttgctcgccttcaatcacttttttcaagcgttcaacggcaagcgtttcaatataatccatttgttcaataccgatgtattggcggttcattttatgagcgacggcggcggttgtgccactgcctaaatggtagtctaggacgatgtcgttttcgttggttgctgttttaataatttgtgaaattaaacgctctccttttttgccatttttaaaatctacgctcccttcttttccaacatttcccatatcaaggtaaaaaccttcccaccaattaccacgaattttacgaagtccctcatcattattgtaattatcagtttttccccaagaatcttgtagtcttaataattggcaaactttgccatttttatctaatgtaagaatatattttcttccatttctctcaacttctttccatttgctattttctaattcaacggataaatcaaatccagtaactttatcgcttcttacaatcttggaaagatgtgttttcacaatctcggcaaattcattacttttcttaaatgcttcttttaaagaaagtgcggttgtattttttaaatcttttggaaatctataatcatataattctttaagttgcccaatagccccatcgttttttaaatatagcgaatagtgttcatcatattctgaacgcaaatcatacaagggatttattgcaatatttttatgtccattttttgaaaaaactataatatattcagcatttttaacaatatttccatcttgtgccgctttaactttcattccttgcgttgtggacatttggcaatgaatggttgtaacaaaattttcacgaccaaaaacttcgtccattaaaattttcaaataggcttgttcattgtcatcacattgaacaaaaatcacgccatcatcagccaacaatgttttcgcaatttccagccgatttttcataaaagtgagccaagtggaatgattaaatttgtcgttgtatttgaaaccgtcattgcccgtgttatatggcggatcaatataaatcagcttgattttgcctttaaactgcttggcaagcgaatgcagggctatcagattattgcctttgataatgagattttcggctggcgtgccgtcaaaatggcgtttgatttcgccaacgggttgcttgccatctgcggtatagcgagagaattttgagaatgcttttgcgtcaaaaagtcggtcaatttcatcaaaagcaagggtttgattaaaaaagatttcttgtctttttcgggttaatttagtgtataattggctggctggctgttattgcgtttaaaataaatttcttcgccttcttcggtgctttgtccgccatttagcacacaatctttaaacggaaaatccaacacaatatccgaactgtctttcaaaaagcggttgccgtccgtcaagccaatgcgattggcgtattttgtgtaggaattattgattctgtgtttgtccaagaaaaaacgaaaatcctgcaatttaaacaccaaaacaccattcacttccacaaaaaaatggcgttttaactcatcattccccaataacaacccgataatagtcgggtcggttttttctaccaaatccaacagaatgtttttggctaaaatggttttttcttcgttcgcccatactttttcgtgtgatagtagggcttgggttaattcggtttgaatgtctgtcttcatcgttataaatcctcataagtcattattttaatgtgctattacaaaggaatagcagagtgtttaggtatatttatcgaccgtacaggtttaattactctcttaacctgttttctttgactcacagaagtcaaaaaattttgtttatgtgcatcaaattttagtgaaagcattaacacagtattaaaacacagcctttgttaaaccaaattagcattctaaaactgttctagtgcttttttcactggggcaaagctacgacgatgttgcggtaacgcaccaagttcagctaatttttccaaatgtaatttggtcggatagcctttatgctgggcaaaagcgtattctggatattgcttgtctaattcttccatttcttggtctcgtgccactttcgccaaaatagaggctgcactgatttctgccacaaggttatcgcctttgacgacggcttgcgctggaatagctaaatcttttgggatcttattgccatcaaccaacacaaagtgcggttgaatttttaaagattttactgctcgagtcattgccagcaaggaggcttgcaggatatttatctcgtcaatttcgttagcttcagctcgacctaatgcccaagcaagggctttttctttgatttcttcagcaagggctaaacgttttttctcagaaagttttttagaatcagcgagtccttcaattggattattcggatccaaaataacggcagccgtgacaacagccccaactaaagggcctcgcccaacttcatcaacaccagcgatcaattcatagccttgtggatattcaaacattttctgttccttctaataaatcaatgactgcttgagccgcttgcttatcggcattgcattgaatcttttggtgtaaatccgtgaagtgctgaattaaaatatggcgattttttaccgcactttcatcatcagaaagataagcagataatttttcagcgagcaattctggcgtgcattcttcttgaatcatttcaggcacgagcatttcattcgcaagcaaatttggtaaagaaatataatcggttttcactaaacgttttgctaagaaataggtcagtggtttcattcgatagcctaccaccattggggatttacaaagcattgcttcaagtgctgctgttcctgaagcaagaagtgttgcatcagctgcaatcattgcttgtcgtgcattgccgtcaattaaatgcaggtctagatttggcgcaattttagctttaatggcttcaaattgaattcgtcgtttttcgttcaccaaaggaacaaggaattgtaaatcaggaaattgttcttttaacaataaagctgtttttaagaaaggctcagccagaaattccacctctgaaccacggcttccaactaggatagctaaatagcgttgtgcgggatcaatctgtagcatttggcatgcttcggcacggtttggtttgagcggaatagcatctgccattgtgtgtccaataaaacggcaagggacattaaatttatcgtaaaaggctttctcaaaaggcaaaaaggcaagaacttgatgggtcgctttggcaattttatggatacgattttgacgccatgcccatacagaggggctcacgtaatgaatggttttaattccgttagctttgagcttgagttctacatccaaattaaaatcaggcgcatcaatgccgatgtaaacatcaggtttttcttgcaacatagtttgaatgacatttttacgaattttcagcaaacgaggaagatgtttcaagatttcagccaaacccataacagaaagctcttccatatcgacgagcgttttacagccttcagccaacattcttgtgcctgcaataccaataaagcgagcattaggataatgtgctttgagctggcgaattaaaccagcaccgagaatatcaccagatacttctcctgcaacaagagcaatggttggatttgttttgttcatcaaatttatcctaaaaaataaccgcactttggtgtgcaaagtgcggttgaaaatgaagaagttttattaacgaataattccgcgagttgaacgtttgaaaaattcaacaaaaaaactgatcgctgaatcggtttccgcaatttgctcaatttctggtaacacttcttcaagtgttttaccgccacgatagagcattttataaatgttacggattgtgtgcatggttggtttatcaaaaccacgacgtttcaaaccctctaagtttacgccaaatggacgggcgtggttgccttgcgccataacataaggtggtacatcttggcttaccatagaaccaccgcctaacataacgtgtgcaccaacaatcacaaattgatgaatcgctgacataccgccaacaatcacgaaatcatctaattctacgtgacctgcaagcgttgcattgtttgccagaatacagttatttttaatttggcaatcgtgtgcaacgtgaacattcaccattaataaattgttattgccaatagaggttacgccacagccttgaatcgtgccacgatgaattgtcacgtgttcacgaattcggttgctattaccaataatggtttttgtagcttcgcctttatatttcaaatcttggtttacttcgccaatgctcgcaaattgatagatttcgttatcttcgccaatcacggtatcgccacgtaccacaacgtgagatttcaatacagtgcgagctttgatttcaacactgccctcaataatacagaaaggcccaataaaaacgtcttcgccaattacagccccttcttcaacgagggcagttggatgaatttttgcacttgggtggatcatatttaccccttaattaacgacgagcacacattagttttgcttcacaagcgatttcgccatttacggtagcaacgccagtaaatgaagtgataccacggcgttctttaatcacttgaacgtttaattccatttgatctccaggtaacaccgggcgtttaaagcgcgcttcatcaatacctgcaaagtagaatagttcgccgccttttaattcgagagttttaaaggctaaaatgcccattgcttgtgccaaagcttctaaaattaaaacgcccggtaaaatgggttcgcctgggaagtgacctgtgaaacaaggctcattcacgctgatatttttaatcgcttttaaccattcgccttctttaaaatccaatacgcgatccactaacaaaaatgggtagcgatgtggcaataaagtcataatttcttttgattcgatcactcttggttgttgttctgacacgttgataccttacaaaaaataaacaaataaaatctgtcggattatacgatatttatagctaaaaataaaacgtactcaatatgctccgtgtttaggacgaatatcaatggctggatcgtcatctttacgatatttttcatcaattcgtttttgcaatccaaagtcatttttatccgattcgttagaaaataaatcttctgtttgcgttaattgaggattttgaattcctatccaatttgcaatcccttctaagaaatttaaacctgatttaaacaccttatattctttgcgttccatatcatctgatgaaattttgaatagcggaatattatggtgctctcggctgaaacagttttgattgaacaaaagtatattgtttttttcatcttgttggtggcacaaaccgtgatctgagaaataaatcattgagaaagtgcggtgatttttcttcgcattttcttcaagctgatcatatacacgttttaaaaattcatcggttttcttaatagacgacacatagcaatttaaataaccatatttcggattaagatctttatcatcaaaaatttttggataatcttcgatacgatcgcaagccattgggtgtgaaccataaatatgcaacacaataaaacgttttccttgaacagaattttctaatacttgggcgaatttgggtaataaatcaaagtcactaaagttagtcgaattaaagcttccgccttttttcaagaaaaaggtttcatcagattttgaagcgagggatgaaacgggcgtatcgaatttaccgagcataccttgattagaaagccaataagttttcacgcctgcagatttgattagatccactaaactcaagctgtaatttggttcccatttttctttgttaggaagggttagcattagacgaagtgaggcgacggtatttgttcctgctgaacgaaaaccatcaatcaacgtgcctttagcgttagacataaagggggtgttttctattggataaccgtaggcatggtggtaatctttccgcgcactttccccgagtacaattacataatcatcatagcgtgaattttctaatgttgattttccccagttatcagattgagagatttgttttagtttttgcacttcatctacaatttttaatgtggaacttatggtttctttaataggttcggcaagtggcatattgtaggcaaagagcaaggtcgctaaggcaataaatgttttattacgataaaattttatgccaaatttcaccgcacttttgtactgaagaaaaattaaaataggaatggcgaaagcaattaagtaactactcactggaatttgcaatagaaattccttcgtttccaatatatctgtcgcgaaaagcgaggcgatatattgatagcttggagggccaaaatttagccccgtaggtgtataaaaagcatgcagtaacgtaagaggtagcaaaataaaatagaaggattttttactgctgcttaataagagaatagttattgtcgcaagcagaataagatctacagttggttctgtaaacatcccagaaccgattaaaataaaataacccgcgaatgcggcacaaatcaccgcaaaaagtgcgggcaaaatttggcttgtttttttcgtgttcatcattgtcttccctgaaaagaaaatatcgctattatccacctttcactcagaatttccatatttaacttcttcactcttgagcggttattttatagaataagccaatttttttaagccagaaggaaaaaacaatgagccaaccaatttataaacgtattttattgaaattaagcggtgaagcattacaaggagaagatggtcttggtatcgatcctgcgattctcgatcgtatggctgttgaaattaaagaattagtggagatgggtgtggaagtcggtgtcgttcttggtggtggcaacttattccgtggcgcaaaactagcaaaagcggggatgaatcgcgtggtgggcgatcatatgggaatgcttgctactgtgatgaatggtttggcaatgcgtgattctttattccgtgctgatgtgaacgcaaaattaatgtccgctttccaattaaatggtatttgcgatacttataactggtctgaagcaatcaaaatgttacgcgaaaaacgcgtagtcattttctctgcgggaacgggaaatccattctttaccactgattctaccgcttgtttgcgtggtattgaaattgaagctgatgttgtgttgaaagcgactaaagttgatggtgtgtatgattgtgatccagcgaaaaatcctgatgcaaaactttataaaaatttaacttatgcagaagtgatcgataaagaattaaaagtgatggacttatcggcgtttactttagctcgcgatcatggcatgccgattagagtgttcaatatgggtaaacctggtgcattacgtcaagtagtgacaggcactgaagaaggcaccactatttgttagtgaatgttgaaaagaataatattaaagaaaatacataattaaattaaggactaaacttttaattcattgagtttagtctttttaatttaaataaagcattacggcaggaatgaaagttttcgtaaattctgtttagtcttcatagttggattatttagatataaaaatctgcacgctaataagtgagaaagttaatcaaacttttagaatgcagattaattttttataaaaagtcagtttaggctacagtgagttgtcccgcatataaaacaaagaaacgtaaacagaataccccaattaagtcaaaaattgacaccaagataataaagttacgattgtattttaaacggtcatttacaaacatattggcgattaatgggatcaagataccgataatcaatactccaacccagaatatcgctccccaaaaaccagataaggcattatgtaaggcaactgttttttgtccgccaccaaaatgtaatccaacgaagaaacacacaatcaaaccaagttctgtcaccataattggcacttcaaatttgtggatgaagtgcgattcgtgagaatcaccttttagttttcctgcaattaagataattaagaaggttgcagcaataccagatgatgtgccagaggctaaaaataatgcgggtaatactgggttattcaacattggatagctaatcaatgcagaaagtaagaaccctgtgtatgcaccaagcactgcagccaatatgaaaagaataacttcgactggacttgcaatacgttctgcaataccgatgagtttcatcacaaattgcagttttggtataaagcgattaattaatgcttcgatttcttttttgaaaatcactacaccccaaattactaaaaataacatatagatttggaatagcatgacccccatcgacattacggagttgaattgatagttaaacatcaatttccagaatgtccaaggtcgagtcaagtggaaaattaatagcgttaaaccaattaatgttggcacagatcctaaaattaccccagatcgaataatccagttttggcttagattttctagtttattactgcgtttataggcaattgctaactgtactgcaccagatgagatccccaataagaacaagtagatcgcaatggtataatcccatactagattaggcgtatgaaatggaactggataatctaacgtcatcttctaggctccccatgttggaatggaatgtgatataagtttggttgtgtacctaattccactttagtgcgataaaccggtttttctttcactttacgtgaaactgcacttgttggatcattcatatccccaaaggttaatgctttggttgggcaagcctctacgcaagcaggttgtttaccattggctaaatttgtatcgcggcagaagttacatttatctgcggtacgatgtactggatgaataaaacgtacacgatatgggcaaactgctatacagtattggcagcctacgcataaatctttatgtacatctacaatgccagtctctttatcaataaaagatgcaccagttggacaaactgctacacaaggtgcatttgtacaatgttggcaagattgacgaaagaactcgtattcttgatttggaaattccccataaggttcactacgtagaatctctaagcgagaaacgccttctggcacttggtttacatcacgacatgagtccatacaggctgtacaaccgatacacgcattttcatcatgtatcattgcgtaacgtttaggtttatccgccttgtcttcttttgcaaaagaaggtaaagatgttcccgtcataaggatcactgcccccatgccagaaacaaagtttcggcgtgagcagactgtcattgtttatccttttgtttggttagtttatcttgttcagctttacgtttttgttgtttaccatggcaatctacgcaaagtttaacgcgttgttttggttgaatacctttcattgcgtcttctttagggtgaagcgtatggcaacttgcgcaaggcaatttcattgcgtgtacatcatgagcccataatttttcacgaagtttgtcaggttgatggcaagcaaaacaaacttggttttgttcttgaactgaatacatcggttttttattaccgaaaatatctccttcaaaacgcataacatctttagcaccgcgacgatgattttcggaaacattgccgtgacagcttacacaagtaatagctttaccgttatttggatttttcttatctaaatgtgcaccatggaatttaccaaagtggagttcgccaccagaccgatctagcgtttggtttttatctattttgtcgaatttatggcatttagcacaatattgattaggatcgcgttggttatctaattgcggttcataagtaacatgatccgcaggtttttgtgcatcatccgcataagccaaaaatggcaatgctacaaatgccgcacttaacgctaacgcttttgcagatttgttgattaaagaagttaaattcatttgggttacctcaaatttgaccttgaaaatcaccgcactttccagtttgcactaaaaagtgcggtgcatttttcatttatttttgtgctggtggatcaactaataagcctttttctctagcttgttgctcccattgcggtaccacagtttttaagaattcttcttttgctttacgttctttttcaatatcaatacccattactttccacgctttatcagctgttgaaatatctgggatttgaactggagttttcacaccgtgtttagttaagattacagcaagtttagtgcgcgcgtctgctactttatctaagccagaagctaatacacgaagtactacttcaggcgcatgcatatgaccaccatggcttgcagcagtgtaatcccaacgccattgagcatgacgaatatccattaatgctgcttccatttcttctttagttgcacctgcgtcccaagccgcttttgcttcaaagtgagatttaacaacttggtcttctaaacgacccattacatctttcacttcttttttacgtgaagtaacaatatcgcgtaatttttctttgctttgatcgtgacaatttgcacaagtgtggtcaaatgcatcgaatggattttggatttggtggtcagtataaactttaccatctgcgccttgtactttcggcatatggcaatctacacaagttaccccatttttaccgtgcatacctaaagaccaaatttcaaagtcagggtgttgtgcttttaacattggtgctttagaaagtgagtgagtccagtcagtgaaaccaatatcatcataatatttttcaatatcatctgcggtttgaccattatcccaagggaaagttacttgcttgatgtcccctgcaaaatagtattcaacatggcagtttgcgcaaatttctgcacgtttttcagtacgcgccgccgtgttgaaacttaaattgttgtgtgggcgaccttctgctttatctttttcagcagtggctttttctaaagcatcaagggcgcgtaatacgtgtgggcgagcaatacgtaatgcaggtttgccttcagcaaaatctttagaggttgtgtcgtgacagtcagcacagccaattgagttcacgatttcaggccctccctttgcccatttcgcattgaaataatctttctcaccccattccgcgattaaacgtggaacatcaggacctttacatgtccaacatgccatagcttgagggccatcatttgcagtttttggcgcacctgtacgtaaaatattacgcacatctgttaccgcataaaagtgaccgcgtggtgcgttatattcttttgcaaatgcataaccaccccaaagtacgattaggcgcggattttcttcatcagcataaataatgttttcgccatcgccgtttgctgtagaacgccagctgttatattgatttggatatttttctgcaaatttttcatttacagattcaattttcaaatcaggttttgcgggttcaacaggttgttctaatggcttatatacaagctcagcagtggctgagttaaataagcttaaactcgcgaaagacgctgccacaataaggctttttttgaatgcgttcacgataattactccatttgttgtaataaaaaggttaagtagaaagttgagaattattattaatatccatacaaaacgtagatatattttcattcaagcgtaagataccaaaagaaaaaagtttttctactcgcagaatgctaaagtttgagcttgatcaagcttatcttttaaaatactcaaaaagaggtatattgttattttgaataaattaaggcggtataaaaccgccttaattttgagtattattatcattagtattgactaataatatttgctattcttttatctgatatttgatattttgtccccaactgctgggcaaataaactcacacgcaattcctcgatcatatagcgaatttccgcaatttcatcagaaatcggtttagattttggcagtttagccagtaattgttggtaagcctgttgcacttgttccacgcgtagcatcgcagcacgatcacggtttacatcttgagccaacttatcaatacgtttatcaatggcttgcagataacgttgtaaatctggtaggcgatcataaccgctcttttgcacaaaaccttgatacaccaaacctgcaagttgcgatttgatgtcggataatgcaaatgccatcgtgaaatccattttgcctttaaggcgttggttaagttggtaagtgagagtaagaatctgctccactttctgcgcaatatccacggtcacttcgttaaggttttctcgaacgaaatcacgcaatttttcaaatcctgcttcatcccacacaaaaccgccaaaattggcaattagcttatctacggcacaagcaatacagtcatcgatcaaatccaatacgcgaccgaacggagtaaaatacagacccaatttagccttattcggcaatttttcatgaagatatttaattggtgatggcacattgagcaataacaaacgacgtaaaccttgttgcatcgccaccgattgctcaaactctgtttcaaacagtttgatacccaccgcatctttttcatctacaatagctgggaacgctttgacgctgaaaccacgttgtttttgttcataacattgtggtaaatctgcaaagctccaaatatgcagcctgctttgctcaatgccatcatctgccacagcagaaatactttcctgcacacgatcttttaagttgaatttcagctcatccaaattcatggattctgcgattttcttaccgttttcatccaccacacggaacgtcattttcagatggcttggaatttgttcccaattccaatgttccgcttctacggtgacgccagtcatacgacgcaattcataaatcagcgtatctaataatggcttttccaacggcaccgcacgacttaaaaaagcttgagtataattaggtgcaggcacgaagttacggcgataagatttcggcagcgatttaatcagcgcaatcaccaactcttcacgcaagcctggaatttgccagtcaaagcctgtcatttccacttggttgagcaatggcaatggaatatgtactgtcacgccgtccgcatcggtacctggttcaaattgataagtcaatttgagttttaaattaccttgataccagaaattcgggaaatccagtttgctcacttgttccgcatcatcattgatcaaaaatgaacgttcaaaattaagcaattcaggatctttttgctgcacctttttccaccacgtatcaaaatgcttctgggaaaccacttccgtgccaatacgctgatcgtaaaattcaaacaatgtgcgatcatccaccaaaatatcgcggcggcggcttttgtgttccaattcttctacttcttgaacgagcctttgattttctttgaagaatttatgcttggtattccaacccccttccaccaaggcagattgaataaaaatctcacggcttaccgttggatcaatagcaccgtaattcactggtctcgcagccacaatcggcacaccgtaaagtgtgactttttcatctgcaatcacggcgccacgggatttcgaccaacgcggttctgaataggattttttaatgagatgctcggcaagtggctcaatccattctggctcgatttctgccaccatacgcccccaaagtttggaggtttccactaactctgccgccatcacccatttcggttgttttttgaaaagcacagaattggggaaaatcgcaaaatgggcattacgtgcgccaagatattgttgtttctccgcttcttttaaaccgatatgagaaagcaaaccgcttaaaagtgcggtatgaatttgctgatattctgctttttcagaattaatcggtaagcccatttcacgcacggttaaacgaatttgatgataaatatcctgccattcacgaatgcgtaaataatttaagaaatccttttggcactgacgacggaattggtttttactcaattctttttgttgttcttgtagataataccaaagattgaggaaagccaagaaatctgattttttatcggcaaaacgacgatgtttttcatcagaagcttgctgtttttcttgtggacgctcgcgcggatcttgaatggataacgcagagacgatgatcatcatttcataaacgcagccaaaattgaccgcacttaggatcattttggcaaggcgcggatcgactggaagttgagcgagttggcgaccaactctagttaataggcgtttttcacccgatttagtttgaacagtttcaaacgcgcccaattcttccaacagttttatcccatcttgaatatggcgtttatctggcgcatcaacaaatgggaacgcttcaatatcatccaaacccaatgccgtcatttgcaaaataacggaggctaaattggtgcgtagaatttcaggatcggtaaactctggacgagaattaaaatcctcttccgaatataaacgaatacaaatcccttcacttacacgaccacatcgacctttacgctgattagcagatgcctgtgaaataggttcaatcggtaaacgttgtactttggtgcgatagctataacgggaaatgcgcgctgtacctgggtcaatcacatatttaatgccaggtacggtcaatgaggtttctgcgacgttggtcgccaatacaatgcgatttaaaccgcttggatggaaaattttattttgttcttgcgcagacaagcgtgcaaagagcggtagaatttccgtgtattttagattttgtttttgtaaagcttcggcggtatcacgaatttcacgctctccattcataaagatcaagatatcgcctcgaccttctgcttgcaattcatccaccgcattgagaatgccttgtagctgatcttgatcgtcctccactacgggacgataacgcacttcaacaggataggttctgcctgagacttcaatgatcggtgcattattaaagtgtttggaaaagcgttccacatcaatggttgcagaagtgataataagttttaaatcacgacgacgtggcaacaactgtttcagataaccgagaataaaatcgttatttaggctacgttcgtgggcttcatcgataatcaaacaagaatattgattgagaaaacgatcgttttgaatttctgctagcagaatcccgtcagtcatcaatttgatttgggtgttatcgctgatttgatcgttaaaacggactttataccccactaaatcgccaagttctgtttccagttcttccgcaatacgtgccgccaccgaacgagcagcaatacggcgtggttgagtatgaccaatcatgcctaaattgccgaaacctaattccaaacacattttcggcaattgggtggttttacctgaaccagtttcccctgccaccacgatgacctgatgttcagaaagcagtttttgaatttcgactttgcgttggctaacgggcaaactctctggaaaaataatcggattttgtaccgcacttttccgttgttctacacgtaatctagcttgttcaatttgctgttggatttcagcggcaacggcttgttgagcctcttggcttttaatttttccaataccatgaatgcgggcggataagcgacgttgatccacccgcatgatgtcatttaattgagaaaaaagagattgttgtaagggagttaatgtgtgttttaccgagctgtttttcatagcgatttacttttgaaacttccgtaagctaagctaatccatccgattaaaaataaagtgccgccaataggcgtaatccatacaattacattgcttgcttcgaaagcaagtgcgtataaacttccactaaataataagattccaattaaccaagaagacatagataatcgggcgaatttattgtcacgtaaagcagataatgcaacggcaagtactgcaatggtatggaacatttgatattctaaccccgtatcaatccatgataatgctttggcttctaatatatggcttaggccatgagctgcaaatgcgcctagtgcgacacagaagaatccgcttaaagtggcaatagtaaggtatttgtttttcatttaaattttccctaaaagtaaagctaatatacctgcagcaataagtgggccaacgggaattccacctaaaaatgctacaccaataattgtgccgataagcaagccagtgactaaaatcggttgttcgcccattaaaggcacacctttacctgcaagccatgccacaagcactccaactgcaatagaaagagccattttccaactaagaaaacctgataaatcaggcaactgaatttttcctgaaactaaggggcttaaaaccccaatggttaaaataatgataccaattttaacgccatatttttcgagcaaaggaatatgagaagataaaaaagtttgctgcatgataagtaatacggcagcagaaatggtaattgcgctgttgttgcttaatacgccaagaataagaagtatcactagtaatagagcaatggtattgagttgtaatgtcataaagtgcggttaaaaaaatggaaattttggtaaatattctagcatagaaattcgtaaaattattttccattgttgttgagaaaaagataaatgagaaaagttaaaaagggttcattatgaacccttttatttagtcggtaaaattcttaaatcatttattcttcaaatttaccttttttttctttattgatggtgcattttgcactagcccaaattgcaaacaatacacccactacccaaatcgcatataacattctatttctccttagtataatgagtgtttatttttatcaatgaaattagcatctaaacgaccaaacatttttgagtaagaccaaatagtataagctaaagcaatgaccacaaaaacaactgcaaaaatcagcattaatgttaatgttaattcacttgaagtcgaatcccacattaataaactttgttcaggatgtgaacttgaaggcatcacaaatgggaacattgatactgctgcagtaataatcacaccagccattgttaatgcagagaagaaaaatgcaaaaccacaacgattcgctttagaaaatgcagcatttaataatgcagcaactacagctaaagcagggaaaatccaaagaattggcatttcattgaaatttctaaaccacgcgccagtttctacagcaacttctttattcattggagacgatggagcgaaatgatcgatagtgctagtaactacataaccatctttagaatataaccatacgccagctaatacgaatgtaattaaagtcacaatagaaccaatttgacttactgaacgagcacgatcacgtaagacttcagtggttttcatttgtaaccagtttgcgccgtgagtgacaagcattgataagctaataacaccacataataatgcgaatggatttaatagctcaaaaaatgaacctgtataagtcacttgagttaattcgttaaaatggaatggaacgccttgtaataaattaccaaaagccacgccaaatactaatgctggtacaaaaccacctgcgaataatccccagtcccaaacagaacgccaagttggattatcaatttttgcacgatattcaaaacccaatggacgtaagaataacgctgccaagactaatactaatgcaatgtaaaaacctgagaaagatactgcatatacaattggccaagctgcaaatattgcaccacctgcagttaataaccaaacttggttaccatcccaatggggagcaatagtgttgatcataatacggcgttccacttcttttttacctattacaggtaaaagtgcagtcacgcccatatcaaatccatcagttacagagaagccaatcaataatacaataactaacacccaccaaataaaacgtagaaattcataatcaatcataatttatctcctacttatttagctgattgttcaaagtagtatttgccggtttttaacgcacttggacccaaacgcgcatatttaaacatcaaatacatctcaacaataatgaacgcaagataaagcgcacaaattaaaccaatggagaaccataaatcgcctgtacttaaattagaagcggatacgccaacaggtaagatctcgtaaatagcccaaggctgacgaccatattctgctaagaaccaaccgcactcaatggcaatccaaggtaatggcaagccccataaaagaacttttaacaataatggaatttgagtgactttattacgtaaattttgaacaaatgcgccgaatgtaagtaaagcaattaaaccaccagctgcaatcattgcacgaaatgcccaaaaattagggcctacatttggaatagtatcacgagcggcttgtttaatttgttcttctgtcgcatcaacaacattgtttgtatagcgttttaataataaaccgaaaccaagatcttttttaacttcattgaattgtgctttggtttcttcatttacttgaccatttgcttttttctcagcgcgtagttgagtaaataattcataagcacggataccactacgtacacgagtttcatttaatgcttgaagatcttttagacctataatttctttatcaattgaacgagttgctattacaccgccaagataaggaatttcaatcgcaaaatcatttttcatttcagccgtatttggaattgctactggaaggaatggagcaggtgctggatgagtttcaaattcagcttccattgcggctaattttactggttgtgctttaccaatatcataaccagattcatcaccaagaattagcactgaaatagaggcgataaatccaaaagtagcagctacggagaaagaacgttttgcaaattcaaaatcacgaccttttagtaaaaagtatgagctaatggctaaaacaaaaaatgcgcctgtcacataacctgcagaaagagtatgtaagaatttactttgtgcaacagggtttaaccaaagatctaagaagttagtcatttccatacgtacagtttcaaaattaaattttgaacctgttggtgcttgcatccagccatttgcaaccaaaatccacatagcagataaattagaaccgaaagccacacaataagttgctaataagtgttttccttttgataaacgatcccaaccgaagaaaaataaccccacaaaagtggattctaagaagaaggcaagtaacgcttcaatagcaagtggcgcaccaaaaatatcccccacgtaatgagaataataagaccagttagtaccaaattggaattccataataataccggtggtcaccccaagggcaaagttaataccaaataactttccccaaaattttgtcatatctttataaacttctttacctgtcgccacataaatagtttccataattacaagaataaaggataaacccaatgttagcggcacgaaaatgaagtgatacaacgcagttaaagcaaactgcaagcgagaaagatcaacaacgtctaacattctcaactcctttgtataaacaacattagttccaacaatgattaacaaggcgatgccttaaataatccctaattactcaactccaatcagctaagtttatattgacttatctacataattatttttaaaggttaaaaaaacaccagttattatagagataatccaaattggcggctattctactactaaacataaggataaaaaatagtaaaaaatgctatatagatcacatttttgatataaatacaaaaatagggcttatttgttatatttcatttaattgatttagatcaaattgacatttttgcaataatttttgttttaaagatgattaatttcattgtgtaagatcatattttaatatttgtctcaaccaacatcatctcttgatgtttttaactgcttgaataagtatgtagtggcatttaatacttaatttatcattcaacatttgtaatgtaattgttgatcctttccaaggataaaaaggattaagccaaaactagcattgagttcattgcgcaaatcaggtaaactaccatcccgtctttgatagctaattatcttcgatttttgaccgcacttttggttgattttgtctgtaagatgattagctataatcatttatattccaatacagattaggttccctatggctacaaattatattttcgtcactggcggtgtggtttcatcgttaggtaaaggcattgcggcagcatcattggcggcaattttagaagcacgtggtttaaacgtaaccattatgaagttagatccatatattaatgtggatcctggtacgatgagcccaacccaacacggggaagttttcgttactcaagatggtgcagaaacagatttagatttaggtcattatgagcgtttcatccgcacgaaaatgaccaaacgtaataacttcactacaggtaaaatttattctgaagtattacgtaaagagcgtcgtggcgattatcttggtgcaacaattcaagtgattccacatatcacgaatgaaattaaagatcgcgtcattgctggtgctcaaggtcacgacgttgtgattgttgaagtgggcggcactgttggggatattgaatcacttccattcttagaagcattacgtcaattagccgttcaagttggtcgtgaacatacgttatttatgcatttaaccttggtgccttacatcccaacggcgggtgaagtaaaaactaaaccaacccagcattcggtaaaagaattgctttctattggtattcaacctgatgtgttgatttgccgttcagatcgtatgattccaccaaatgaacgtgcgaaaattgctttattttgtaatgttgcagaacgtgcagtcatttcattaaaagatgtgaattcaatttatcaaatccccgcattattaaaatctcaaggtttagatgattttgtctgtgaacgtttccgtttaacttgccctgaagcagatcttactgaatgggagcaagtgctttacaagcaagccaatccagtgggagaagtaaccatcggtatggtaggtaaatacactgagttacccgatgcctataaatcagtaaatgaagccttaaaacacgcaggtttaacgaaccgtttaagtgtaagcattaaatatattgattcccaagatgttgaaaccaaaggtgttgaagtattaaaaggcgttgatggcattcttgttccagggggatttggttatcgtggtgtagagggtaaaattcgtaccgcacaatatgcacgagaaaacaaaattccttacttgggtatttgcttaggtatgcagatcgcattgattgaatatgcacgtaatgtagcgggtttaactaaagccaattcatctgaatttgataaagattgtgaacaacctgtggtggcattaatcacagaatggcaagatgcggagggtaatactgaagtgcgtaccgatgaatcagatcttggcggaacaatgcgtttaggcgcacaacaatgtcatttggtatcaggtagccacgctcgtgagctttatggcaaagaaaccattgaagaacgtcatcgtcatcgctatgaagtgaacaataccttgcttccacaaattgaaaaagcaggattgaaagtaactggattatctgcagataaaaaattggtagaaattatcgaagtgccaaatcatccttggtttgtcgcttgtcaattccatccagaatttacttctacgcctcgtgatggtcatccgttgtttgcaggctttgtaaaagcagcctatgaaaatcacaaaaaatctgtgaagtaattcttggttctgcaataagtgcggtaaaaaaatgaaatatttttatttggttatgatataacttgatgtttttgaagtaaaaaaatccccgttaaatttatcatttaacggggattttttataagctatttactgtttttatatttagttagtacgcttaactaatttcgtccagttataataaccatacaacgagttaagtaagtaggctgaatacattaagtatattgcaggtgtctctgcccataagaaaatagaaagaatatttaatccaatccataacaaccactgttcacgataacgtaaaatcattaaaatctgtgccgcaaccgtaataattgtagttagaccatctaaacctgttgaactaccaccagcagcttgtaatgcttgaacaaaaagcaaagtgccaaccgtagtcataacaattaatgtcatccatcctttaacagttaatgcttttgcaatcacgctttctccaccatcgctattttgcatattggctttccacataaagtaaccaataaattgagagggcaaatatacgtaaagtacggtgttcatttcgcctaagaaattcgatccccaagcaacataaaaataagtataggcaaaaatcaatccaaagaaataattactaattttacctttacttaccaataccacacacaaaatacccgagataccagaaatcattgctaaccaagaatcaggtgtttgtacataagcccaaatttgcgcaatgataaaaagcgcaagccaaaccacctcaaaaggtttccaaccagaaacaaattctcgttttaaacgcgctgccaaagtcattatttactcctattgacttaaattttaacgtgagcattcttattcttgcatagtgaattggtaatgtaaaggtgtagaagcatttaattctaaagttgtgaaatccatcacgttttaattaaagcctacattatccattattgagtttgtttcaaaaaacgctctaaaaattgaccgcactttaaatataataatcaagctcaagtggtatttttgcttgtaacaagaactgtttagtgcgctcgtgttgtgggcaagtgaagaatttatctgccgtattttgttctacaatatatccatccgccattaaaatcacacgatccgcgacatctttcgcaaactgcatttcgtgagtaacaataatcattgtccagccttcttgggcgagcatttttagtgtttgtaacacttcgcccaccaattcaggatctaatgccgatgtaggttcatctaataaaataatatcaggttttaccgcaagggctcgagcaatccccactcgctgttgctgaccgccagaaagttgggatggaaataaatccgctttatttttaagccctactttttctagcaaactaagtgctttttcacgagcttgagctttatcttgtttttgcacaacaaccattccctccataacattttcaagggcagaacgatgagggaataaattgtattgctgaaagaccattgatgaacgtcggcgtaacttcaattcatctgctttactaattttctggctaaaatcaatttttagactgccatcagtaaattccaaaatgccttgctctggtcgttcaagcaagtttaaacaacgtaaaaaggtggtttttccagaaccagaagggcctaaaattgcgaccacttcacctttattaatttcaaaatcaatgccttttaacacatgattgccattaaagtttttctgaatattacttacttttaacatagacattccttataaatggcgagataagcgaatttcaagacgatcttgtaagaaagataaaacaaaacagaaaatccaataaatcaaagctgcctcactataaattaaaataaattcatagttcgctgccgtaatattctgtgcgacacggaataattctgtcactaaaacaagagaagctaatgaagtgtctttcactgtactaataaaagtattagaaagcgatggtactgaaatacgtaaagcctgtggcataattgtacgaataaatgcttgtcgataattcatacctatcgcataagaggcttcccactgccctttaggtatagcaataattgaagcacgaacagtttctgctgcataagcacctatattaatagaaaatgcaataatcgctgtcggaaaaggctctaaagtaataccgacttcaggtaacccataaaaaataataaaaatttgtactaacatcggtgtacctctaattatagagatatacactcgacataaagcctgtaacaattttaagggtaaattagggctaggcaaagtacgaataactgcaacaatcactgcaataagcaaaccacagaagaaggaaatgactgccaatggcaatgtgtataaaattgctgcttccaacataggccaaaacgagctgattacataatcagctcgttctgcactcataaatggaagactcgccaaccaattattgagtaatatcataaccaaaccattcaattgaaatctgttttaatgtaccatcttggcgaagtgcttcaagtacttgattaaattttgtaatcaatgcatcttcaccttgtaaaaaagcaaaggcagtcggagttttatccccacgatcataagcaatttttaaaccagaatttgggtgttttttaaaataatctaatacagccaatttatcattaattgttgcttctgcacggccttgtttaataagctctaagctctgtgctaaaccatccactacaagaatctgcgcacctgcagcttttgcatctttaccccagttacttgttgcagattgcgcagatttacgacctttcaaatcttcaaatgatttaatactgttatccgatgattttgttacaatcaccccaccagaataattataaggcgttgtgaaactgtatttttttaaacgctctgggcttgggttagtttggtttgcaatcacatcaaaacgttttgcatttaaccccgcatacattgcatcccattgtgtttctttaaattccactttcaaaccgagcttttcagcaactttacgaataacctctacatcaaagcctgttaattttccacttttatcatggaaagtaaatggtgcataagtcccttctgttccaactaataaagttttcgttttttcaacacgatcggcaatttcgcctgcgtgagaaaacgttgagaaagcaatagctccagttaaaagtgcggtcgtaaaaagtaattttttcattttttcttccttgtgttgtgtttgtctaagcgtgattataaaaaccaaacttatgaaaaaaaaagattatttatttatggtttataaattttagttataaaaaattgatataagtgattactatcaaaataagaaaataatctaccgcactttcttgtagaaaaatacgtttctaaacaatgcaatcaatctactcttataaaatttcagtaaaaaaatgcctttctaaagaaaggcattaatagaaatttaagattataaataaacttgtaatttattatagaaaagtcgcgtacctaattacgcttcatcacttctagaaaaacgttcaattttcgcacctagagcacgtaatttatcttcgatatgttcataaccacgatcgatatgataaatacgatctacaatggtttcacccgttgcgatacaacctgcaagcactaaactgattgaagcgcgtaaatctgtcgctattacctctgtgccagacaattgttcaaccccgtgacataccgctgtattcccttcaatttcagctttaccacccatacgaattaattcaggaatatgcataaaacgattttcaaaaatcgtttcagtgataatgcttgtaccttctgccaccatatttaataaagtaaattgagcctgcatatcagttgggaaccctggatgtggtgcagtacgaatattcactgctttagggcgattaccaagcatatctaaagtaatgctattttcagttacatcaacttgcgcaccagcttcacggagtttatcaattacggcatctaaagtatccgctttagtattttgacaaacaacacgaccgcccgaaattgctgcagcaattaagaatgtacccgtttcaatgcgatctggcacaatactgtgctcacaaccagttaaacgttcaacaccttcagtcgtaatgtgatcagaacctgcacctgttattttcgcacccattttattaaggaaatctgcagtatctacaatttcaggttcacgagcggcgttttcaataacagtcgtacctttcgcaagggttgctgccatcataatagataaagttgcgcctacacttactttttctattacaattcgagttccaacaagacgatctgatacttgtgcttttacatatccttcttcaagaacgatgtccgcacctaatttttctaaaccgctaatgtggagatcaacaggtctagctccgatagaacaacctccaggtaatgagacttgagcttgatggaaacgagcgactaaaggtgccaatgcccaaattgaagcacgcatagttttaaccaattcataaggtgcagtgaaatgattgatattagaggcatctaataaaactgcaccagtttcatcacgatttgcaattacgcctaattgacgcaaaatatttaaagttgtttcaatatctttaagttcgggaacatttgtcaatttaacaggttctgtagctaaaatagccgcaaaaagaattggaagtgcggcgttttttgcgcctgaaatattcacacttccacttaaacgagattgcccataaacacgaaatttatccatttttaaatccttaattaaactggtttaatgcacgatcgcgtttccatttttctacggtataagttttgatggttagagcgtgaatttcaccagtgctaaaataaggcattaaaggggcataaatcgtttgttgttgttttacacgagatagtgcagcaatttcatcactcactacaattacaccaaaatgtgcattttcaccttgtgcatagacttctacgatatttagcgtgtcttttaaaatttgttcaattttttgaagttccattggatttccgtttaagtaagctatgtaaaatttgcgatccaatcagataaaccaacaagatctgctagggttaataattgttttggtggataaactaatcgtactgttttgttaatcttttgacactctcgtaaaaaatcacaaagagctgtaaaaccagctgaatcaatatgctgaagaccagataaattccattcaacaatagttttatcaagtgtactttctgacaaaaaaacgccacgttgctgccacattggtaacaaggtgctgcgagatagttccccaaacaaaaagagcgttattttatcattatttttttgcaaatcccaatttagcatagttattcatttattgattgaaaattataggttgtgaggcagattgctgcatctttgtgattaatgtatcaataccttgtttgtttaaaataccaacccaattttttatcgtatcttccagcatacttacgcctgctgctgccatatcgtaggctttccattccccacttttattgcctttacgccatttaaaatctaataggatcggagcaacgccattagtttgaataatacttacgcgaatatttacaaaattgttatcgcctaattctttttctgattcaatttgaattttttgattagaataatttgttaatgtttgtgcgtacttttgctcaatcaactcaccaaaagtcttgaaaaatttttctcgttgttctgtagaggttgatttgtagtatgaacctaatactttagaacctgcatattctaagtttacgtaaggcaataaatcattacgaacaatagtacgtaaataatttggatcttgtttaattttactttgattagcttgtatatcagaaaatagtttatctgacgcttgctgcattaaaacataaggacttgtttctgcaatagctgttcgtgtaaccaaaagtgcggttaatacgaaagttaaaatagtaaaccatttttttagttgagtaaggtacattgtcaatctcctaatttataaaatttaacctattattctgcggattctgatttttcattgccgtctgattttttacttccgtataagaattgcccaattaaatcttccaatactatagctgatgtagtgtcttgaatttgactaccatttttaagcattgctgtatctccatcatcaaaacctattgtcaaggcaatatattgctcacctaataaacctgatgttttaattgataaagaactgttttctgggatttcattatattcttgattaatcgcaatacttacttttggtaaatagcttttttcatcaagcgtaatagcactcacacgcccaattactacgcctccaatttttagtggtgcgcgcactttaagtccgccaatattattaaaaattgccgtcacggtataagatttcgtctcagcaaaaccttgtacattagctacgcgtaaacctaaaaaaactaaggcaccaataccaagtaataaaaataacccgacccaaaattcatatttaattgtttgtctcataaaaaatccttaacttgcgccaaacataatagcagtcaaaataaaatctaatcctagaacaacaagtgaagcgtgcacaactgttcgtgttgtagcttggctgataccttctgatgttggcatacaatcataaccattaaaaagtgcaatccaagttacggctacagcaaagaaaaccgctttaataaagccatttaaaatatcatagctccaactcacggaattttgcataacagaccaaaagctgcctgaatcaacacctttccaatccacacctactaaggaactgccccaaataccaatcgcgataaacaagattgacaaaattggcatggaaataacccctgcccaaaaacgaggtgcaatcactcgacgtaaaggatcaacagccatcatttcaagactagaaagttgttcagtggctttcattaagcctatttcagccgtcaatgcagaacctgctcgaccagcaaataaaagtgcggtaacaacaggccctaattctcgcaaaagagaaagtgccaccaactgacctaaacttgtttcagcagaaaaatcaactaatacgacataaccttgtagtcctaataccattccaataaataaaccggacaacaaaataatgagtaacgattggacacctaaaacatgcatttgcttcacaagcaaaggaaaatgcttacgaatttgtggcttgccgatcaatgcaccaaataacataaagcctgctcgccccaatgcacggaaaaagtcgatcacctgttttcctaaagcagaaataaaattgacgatcattcaaacaattccttcatataatcttgcgctgggtacttaaagcgcacaggaccatcagattcaccttttaagaattgcaccacgcgcggatcttggctttgtaaaagctgctcagatgttccttctgcgatgactttttggtctgcaataatataggcataatctgcaatactcaatacttcctccacatcgtgtgacactacgatagaagtcaaatttaacgcttcatttaatcgtttaatcaggcttaaaattacgcccatactaatcggatcttgccccgtaaatggctcatcaaacataattaaatcagggtcaagcgcaatagcgcgcgctaatgcagctcgacgagccataccaccggaaagttctgaaggcatcaatgcggcagcacctcgcaacccaaccgcctccaatttcatcaacacgatttgacgaattaaactttcaggcaaatgcgtatgttcacgaattggaaaggcgacattatcaaaagtagaaatatccgtaaaaagcgcacctgattggaataacatccccatccgcttgcgtacttcgtacagttcacgattagatagacgacaaatatcttgtccatcaaacaaaatttcaccttgctctggcattagttgcccacctatcaatttaagtaaggtggttttaccaatccccgacggccccatgatcgcagtgatttttcccttttttacttgcaaattcaggttatcgtaaatcacgcgatcaccgcgtttaaaggtgagattcttaacttcaattagattttgattcattaaaatctcgtttataaataaaaagttcaatcagttttatatgaccttaaaaagttagattcgtttaatttaaagattaagttttgttatttatagcaacacatttttttggcttaactttaatgtggtcataaaaatagttataaaaaatagtgataaattctatttttaataacttaaaattttgccatagtaacattctttttgacctcactaaagaagctttacatttcttcattatttattgaattttaataatactttgtttatggaaaataaacattgataaatgcctataaataataagcctgtaaaagatacagatttgataaaaaagattgcaaaagaaaagttatagagaggaaagcagaaaaacctaacttttgctaggttttcctatgtttattattttgcacagttacagtgtgctgttttttgttcaaaacgttctgcaacgaaatcccagtttaccacattccagaattctttaatgtagtctggacggcggttttggaattttaagtagtaagcgtgttcccaaacgtctaaacctaaaagtgggaaaccctcacaacctgccacttctttacccattaatgggttatcttggtttgctgttgatacaacggctaatttaccttcagcggttaatactaaccatgcccaacctgaaccgaaacgagttgctgctgctttttcaaactctgctttaaatgcatctacagaaccgaaatcgcgttcaatcgcatcttttaatgcgccttgtaaagtagtgccttttttcaaacttttccaaaataaactgtggtttgtgtggcctccagcattattacgtaatgctccacgtttttctgcaggaattttatcaaggttagaaattaaatgacccggatacatttctactaattcagcaggtaaaccttctaatgcagcatttgcattgtttacgtaagcttggtggtgtttactatgatggatttccattgtttgcgcatcaaaatgtggttctaacgcattgtaggcatagcctaattcagggagagtgtaagacataatgtattccttctattgttaaaaacagatttcgttgaggttttggtctataaccaaaattgagcaaataatagcaaaaaaattgatttagatcattaaatgtttttccttttttaaaaagtgaatttattaaattttgttttaaatcaataaacctatcgatctacttctaaagagttatgtgtttgagttgcgaaaatttcatcaaatattagaataccaccactttctattttccctctgtaattatgtttgagcaacacaagttatctctgcaaaatttatcctgccaacgtggtgagcgcgtactttttcgtgctttgacttgcgattttaatagcggtgattttgtacaaattgaagggcataacggcataggtaaaacgagcttgttacgtattcttgctggtttagcccaacctttagaaggcgaagtgcggtgggatgctgaagcaatttctaaacaacgtgaacagtatcatcagaatttgctttatttaggacatcttttaggcgttaaaccagagctaacggcgtgggaaaatttgcagttttatcaacgaattagtcaagctgaacaaaacaccgatatgttgtgggatttgcttgagaaagtgggattattagggcgtgaagatttgcctgccgcacaactttctgcaggacaacaaaaacgtatcgcgttaggtcgcttatggctgtctcaagcgcccttatggattttagatgagccctttactgcgattgataaaaaaggcgtggaaattctaaccgcactttttgatgagcatgctcaacgtggaggtattgtgttattgaccagccaccaagaagtgccaagttctcatctgcaaaaattgaatttagcggcttataaagcggaataacttaatgatttttttagagataattaaacgagaacttcaaattgcaatgcgcaaaaatgcggagattttaaatccgctatggttctttttgcttgtgattactttgtttccgcttgttattgggccagagcctaaattactttcccgtatcgcaccgggtatcgcatgggtagcagcattactttcagcattgctttcttttgaacgtttattccgtgatgattttattgatggctctcttgaacaattaatgctaactgcacagcctttgccaatgacagctttggctaaagtcgttgcacattggttgctcactggtttgccgcttattttgctatcacctattgccgctttgttgctttctcttgaggtcaatatttggtgggcattggttttgacattgttactgggcactcctgtattgagctgtatcggtgctattggcgtggctttaacggtgggattgcgaaaaggtggcgtgttgttgagtttgcttgttgttccgttgtttattcctgttttaatttttgcttcatcaatactagaagcagcaggattaaatgtgccttatgggggacaactggcgattttaggtgccatgatggttggtgcagtaacgctttcgccttttgccattgctgcagcgttgcgaattagtttagataattaattttatttcattgtataaaagtgcggtggtttttctctttaatttttaaggatcttttttatgtggaagtggttacatccttatgcaaaacctgaaactcaatatcgtatctgcggtaaattgagtccgttatttgcatttttaacgcttatcttactcggtattggcattgtatggggcttagcattcgccccagcagattaccaacagggcaatagtttccgaattatgtatgtacatgtgccgacagcgatttggtcaatgggtgtgtacggttcaatggcgattgcagctgtggttgccctagtgtggcaaattaagcaagctcatctcgcaatgattgcaatggcgccaattggtgcattgtttactttcttatcgcttgttacgggggcaatttgggggaaaccaatgtggggtacttggtgggtgtgggatgctcgcttaactgcagaattgattttattctttctttatcttggtatcttagccctttattctgctttttcagatcgtaacataggtgcaaaagcggcggggattttatgcattacaacggtcgtgattttaccgattattcatttttcggtggagtggtggaacacattacatcaaggggcgagtattaccaaatttgaaaaaccatccattgcaattccaatgttggttccattaattttatgtatcttcggttttttgaccttgtatatttggcttactttagttcgttatcgcgtggaattattgaaagaagatgcaaaacgtccttgggttaaagcattagctcaaacactgaaataaagtgcggttagttttttagcgattttttataaggaatattttatgtttttccaaacttggagtgatttttttaatatgggtggctacggtttttacgtatggttatcctatgcagtaagtttagtggcagttattgccttaattgttcaaagtgtaaaacaacgcaagacagtgttacaaaatgtattgcgtgagcaacaacgcgaagaacgtttacaacaagcaaataaggggaacacactatgaatccaagacgtaaatccagatttaaattagtcatttttgttgtgctcggcattgctattgcaagtggattgatgctgtatgcattacgtcaaaatatcgacttgttttatacgccatctgaagtgattcaaggtaaggataataatccgaatcaaaaacctgaagtggggcagcgtattcgtgttggcggtatggtggttgaaggcacggtagtgcgtgatccaaaaagcttaaaagtgcggttcgatttaaatgatattggtcctgcgatcactgttgaatatgaaggcattttgccagatcttttccgtgaagggcaggggattgtggctcaaggcgtattaactcagtcagcggttttaagcgcgacagaagtattggctaaacacgatgaaaattatgtgccgccagaattaggcgaaaaaatgcaaaaagtacataaaccaatggggattaaggcagcagatttaaaaggcgaaagtgagcgtgatcgtcaagaaaaagaaggcgcaaaatgattgctgaattaggaaattatgtgctggctttaagtttagctgtatcgcttatgttggcgattttccctttgtggggggcggaaaagggcaatgtacaattaatggcattagctcgcccaatgacttatggtttatttgcaagcctaagcattgcttttgctgcgctattttatttattcgcagtcaatgattttagcgtgcaatatattgtaaataattctaatactactttacccatttattatcgtttatctgcggtatggggttcccatgaaggctctttgttactgtggatttggttactggcggtttggtcatttgccgttgctttattgagtaaacatttaccccaagaagcggttgctcgcgtgcttggtattatggggattattagcgtcggttttgtattgttcgtcttgtttacctcaaatcctttcacgcgtactttccctgatttcccagtagatggaaaagaacttaatccaatgttgcaagatgtaggcttgattttccaccctccattactttatatgggctatgtgggtttttcggtggcatttgcgtttgcgatagcatccttaatgactggaaaattagattcagcttgggcgcgttggtcacgtccttggacgcttgctgcttgggtgtttttaactttaggtatcgtactaggttcttggtgggcttattatgagcttggctgggggggctggtggttctgggatccagtagaaaactcatcgtttatgccgtggcttgctggtactgcattgattcactctctttctgtgacagaaaaacgaggttctttcaaagcttggacggtattacttgcgattttagccttttcactttgtctgctcggcaccttcttagttcgttctggtatcttagtttcagttcacgcatttgcatcggatccaactcgtggtttgtatattttggcttacctcgttgtggtaattggcggttcgcttgcactctatgcgtataaaggcagtcaaattcgttctcgtgataatgcagaacgctattcacgtgaaagtatgttgttattgaataatatcttattaatgaccgcactttgcgttgtattcttaggaacgttgttaccactcgttcacaaacaacttggtttaggctctatttctattggtgcgccgttctttgatcaaatgttcttaattattatgacaccatttgcattattgcttggtattggacctttagtgaaatggcgtagagaccaattttctgcaattcgtacgcctgttgttatcagcgtatttgttatgctgattgcaggttttgcgttaccttatttcttgcaagataaaattaccgtgagttcagtgcttggttcaatgatgactgtgattattgtgttacttgtgctttatgaattgcaacaacgtgcgacgcatcgtgaatcattctttgttggcgtacgcaaactatctcgttctcattggggaatgatgttagctcacttaggcgtagctatgactgtttgggggatcgcatttagccaaaactttagcgtagaacgtgatgtgagaatgaaagttggcgagaacgcacaaattggtcgttacgattttaaattcgctggtgtgacggatgaaaatggtccaaactatattggtggaaaagctcaaattgatatttcgaaagatgggcaaccagagacaagtttattcgcagaaaaacgtttttacacagtaagtcggatgtctatgacagaagccgcaattgctggtggtttaactcgtgacctttatgtggcacttggcgaaaaacttgaggacaattcttgggcgttacgcttatattacaagccatttattcgctggatttggattggcggcttatttatggcgttaggtggattgttgtgcatgttcgatcgacgctatcggtttaatgtgttgttgaagaaatagtttatactgccatgggtaggtatacccatggctaattgaaatggttcccctttggggaatttcaactagcctcaaagaggctatacttttactagcctagggtatacttaccctaggcactaattttaaagtgcggtaaaaaatgaaaaaaaaattactcgttcctcttattctctttttatcgataacaattgcctttttagtgcaattaaaacgtaatgcacaaggcgaagatattaaagcattagagtcagctttggttggaaagcctgtgccagaaaaaaatttgacggagttgtttgaaaataaagcttacacgaacgaattgtttcaacaaggtaagccagttttgcttaacgtatgggcgacttggtgtccgacttgttatgccgaacatcaatatttaaacaaacttgctaaagagggtgtgagaattatcggtttagattataaagatgaatcacctaaagcaatgaagtggttaaaagatcttggcaatccttatcaagttgttttaaaagatgaaaaaggttctttcggtttggatttaggggtatatggtgcgccagaaacgttcattgtagatggaaaaggcgtgattcattatcgttatgctggagatgtaaacgaaaaagtttggactcagactttaaaaccaatttatgacaaactttcggagcaacaataatgaaaaaaacatggttatttttgaccgcatttttgtttagctcagtggcgttttcagctattgacgcattaaattttagttctccacagcaagagagtgattaccaccaattaacacaatctttgcgttgtcctcaatgtcaaaataacaatattgcggattccaatgcgactatcgctgtggatatgcgtggcaaagtatttgagcttttacaagaaggcaaatcgaaaaatgacgtagtggattatatggtggcacgttacggcaattttgtaacctatgatcctcctataacagcgagtacattagtgctatggattgcgccattattgcttgtgttgttaggcgtggtgtttttattaagacgcaaacctaaaacccaaagtgcggtgaaatcccaagaggttttaacggatgaagataatgcgcgtttggcagaattattaaacaaggataaatagatgaattttacattaatttttatcttaaccactttagttgtggcgttaatttgtttttatcctttattacgtcaatttaaagcgaaacatgggcaaaaacgtgatgatttaaataaggcgttatatttctcacgcttggaagaaattgagcaagataattcccaaggtttagttgaaaatgttgagcaactcaaacaagaattacagaaaaccttgcttgatgatgtaccgagcaaggttcaagagaatgtggattattctggcaaatcttatggaaaaatttggtttgtctctggtgtattagcgttaggaattatcgcaggttcttcttattttatggtgggatcttggcaagccgaatcaatgttagagcaaacttatgcgaaattgccctatttctttgaccgaatgaaagatgaagataaaaatccattttctgatgcagaaatgcagcaattttctaccgcacttcgaatcgatttgcaaaaaaatccaactgatgctaaaaaatggtggatgctcggtcaaattgggatgaatttaggtgatgcacgtttggcattcgatagctatcaaaaggctaataaacttgaaccagataatgtgcaatataaattaggctatgctcgtatattgatgttttctgaagatgcgactgataaacttaaaggtggcaatttattgcgtgaagtgattcgtcaagaacacactaacattgaagcattgagtttactcgcattccgttattttgaaacagaagattataaaatggcggcagtgacttgggcgatgatgctacgcttaatgccgaaagatgatgagcgagttccattaattgaaaaaagtattcgtaccgcgcgtgatgctttagaagcgcaaaatgaagaaaaatcaaaaagtatcactcccgaaaaataacctagtacgttataagactttttgatatagtgcgaaaaaattattcgtagtcgaacagattagcatttaataaagtactaaaggaacgagaaatgaataataaaaattgcacttttttctttgttctgcgtcattattggaagtttatttacttcacaattttcgattgcagaaaatgattctagtgcagttgattctgaagataaaaaagcatttaattccgatgtttcaaataatgatgctcaaaaactagctcaaagtattgaatttaaagtttataaaatagatgaaaccacttcatcagaaagtatttatgaatctccagctggaatttgtcagggatttaagattacaagaggtgtagattacacaaattcgacttaccattatctttatccagacaatagaggagaattctatggcagtgtggttggtgcaaccatttataaccaaaaagatcctcaaaatttaagttatgtgcctgtttattcaattacagacaaagatttgtctaagtgtattcaggcacaagaaaataaaaaattaaaggaaaaagcagcgaattatgtatcagaaggtagggctgtattaactgacgtaatttgtaaataggatgtatttaatgagaaaaatagtttttgttagttgtgtaattttaggtttagcagcatgttcatctcaaccagaacaaattggtggcggtgtttacgatatgaaaactgtgcaagaatataatgctcgagttattagtggtaatactgttacacaaactcaaaaggataaaataacgcaacaaattgatacaagtttaaaattaaaccaaagtgacaataaagttaaaacgagaacaagacgtgtattgcctgttcttccagttacaccaagcgtcgggtatcattataattatcactattttagataaaaaattatcttgttatctgtgctaaaaattcttcttctgttaatactgtaatatttagttcttgagcttttgcaagtttagagcctgccccatcacctgcgataacgaaatctgttttactggataccgaaccacttacttttgcaccaagctgttgtaataaggcttttgcttcattacgccccatttgtgtaagagtgcctgtcagtactacagttttatctttgaacaagttttcactcgcttctttcacttctacagtttcccaatgcacaccttgtgcgattaaatcctccacgactgcaacattatgcgcttcacgccaaaatataaaaattcggttcgctacaacttcccctacatcaggcacttgttgaagttcttcaagatttgcgtctttaagcgcatctaaagttttgaaatgattagcaagatttaatgcagtggcttcgcccacttcacgaatgcctaaagcaaaaataaagcgatcaagcgtcgtgctttttgcattttcaagactattgagtgcgttttctgcagattttgcacccattctttctaagcgtgtgagcgtggttaaatcaagtttaaataagtccgcaggtgtatgaattagctctcgatcgactaattgctctattaattttccgcctacaccatcaatatccattgctttacgagagacgaaatgttttaacgcctctttacgctgtgccgcacagaataatcctcccgtgcaacgtgctactgcttcgccttcaatacgaataatttgagaatcgcacacagggcaatttgttgggaaaatgattggtttagcattatcagggcgacgttcgtgtaatacgccaataatttgtggaattacatcgcctgctcgacgaataacaacagtatcgccaatagcgatatttaaacgttcaatttcatcgccattatgtaaggtggcattacttactgtaacgcctgcaacaaacactggctctaatttggcaactggtgtgattgcgccagttcgacccacttggaattcaacatcattcaacagggttaattcttcttgggcggggaatttataagcaatcgcccagcgaggtgctttagaaataaatcctagttcattttgtaaggctatatcattgatttttaataccgttccgtcaatatcataacctaacgagctacgtttgttttgaatatctcgataaaaacctaaaacttcatctgcaccattgcataaacgaatttcaggatttactggaatcccgatagattttagccattgcaaacgatcataatgcgtagtcggcagatcaatcccctcagcaattccaataccataagcatttaataccagcggacgtttgctggtaatattaggatcaagctggcgtaaagagcctgccgctgcattgcgaggattagcaaaggttttttcattatgttctaacgcatatttatttaaacgctcaaagcctgcgtgcggcataaaaacttcgccccgcacttctaaacgtgctggaggattatctgttaaaagttgtaatggaacattacgaatcgtgcggatattggctgtaatatcttcgcctgtggtgccatcaccacgagtggcggcttgtgtaagttcaccattaacatacaaaatactcacagccaagccatcaagtttaggttcgcaacagaaagtaagtggtttcggtaataggattaaacgatcttcaatgcgttttacaaaagcattaaattctgcatcggaaaaagcattatccaaagagagcataggaatttcgtgacgaatttggctaaacccagaaagtggttttgcaccaacacgttgagtgggcgaatctgacgtcagaaattcaggatgctctaattctagggctttgagctgatgaaataaacgatcgtattcgctatcaggcacgctcggattatctaaaacgtggtattcgtattcatattggcgcaaggttttgcgtagattgtctagttgagtttgaatatttgtcataaaattctcggagaaaaatgaccgcacttttctatgtatttagcgtgaaaatagacaggtacaaagcctgtctaaatgaatataaaagtgcggtaaatttaaggtatgaatttacactcgagcaagataggcttgctctgcatttgcatcaaaaatttcttgttcttcagtcagtataacaccttgtaaatcttcggctaatgtatgggcagcacgcatcatcatacgtaaattagcaagattattacctggagagggcaattgcataaataatacaattcctatggtgttaaattccgctaagttataagcattgaatgtgccgggttgttctaaatttgccacactaaaaagcacgggacttgccacacttaaatctaagtgacgatgatacatttcatctttacccaagataaaacccaagttttcaagagcctgcaccaatttagcaccattaaattcttcgctagattttggaataagataaagttgaatatagccagttgtttgttttggctgagctgtcgtttctgcttttggttcattgaacgagaggttgtagtctacttgatgttcttcgtgagataattctgcaagctgcactcttaattctggcgatgatgaattaatgccattaaaaccaacattttgactttgtgcttcaagttgttctaaggtcatacttgcgacattatttgcggttggcatatcgtattgaggttgcgttggttgtattggctcggaacgatgattccccatatcataaataggttgcgtgttaggaatagaaattttgatgtcatccacacttttatcgctttggcgataatcgatcaattcagcttctgatggtaatttttctgtggtcggttgagaaattggtgtatgcccattttccacataggtattcggcgaaatattgtttggctgtaccatttcttcttgcgtatgggatctagatgttggagaagtgcggtcaaatttattggctttatcaaaatattttgatttctcacgacgatttgaccataatccgtgtacgattaaggcgacaagtgctacgatacccacaataatcaaaattgtatttaaatccatttttattccttacgcgcgatagttcggcgagagtactataaatggtgctaatgctaccatatttcagtaggtgaaaaaatacttcaaagtgtggaattttaaaggaaaagtgcggtctgttttaagcatatttttattgaaaggaaagaaaaatgttaaatcttaatgaattaaaatctggtttccactattttgtgatgggctggcatttcatcacacaaaaaggtttgcgtcggtttgttattattccaattttgctcaataccattttgctttgtggtttattttggctttttattagccaaatcagcagtgctattgattgggtgatgaattttattccagattggcttagttttctcagtgtcattttactgacactttcgattttaacgattttattgctcttttattttacttttaccacgttttctggctttatcgcagccccctttaatggtttgttggcggaaaaagtagaaaaaatgctgacggaggaaaatattaatgatgatagtctcgtggatataatgagggatgtgcctcgtatgcttgctcgagagtggcaaaaattacgttatagcctacccaaaattatcgccttatttttactgagttttattcctctggttgggcaaaccatcgtgccagtacttactttcttgttcacttgttggatgatggcaattcaatattgtgattatccttttgataatcacaaagtctcttttgatatcatgaaaactgcacttggcaatcaacgaactcaaagtttaacttttggtggattggttacttgttgcacatttgtgccagtgattaatttattaattatgcctgttgcagtatgtggtgcgacgctgatgtgggtggaaaattatcgtaatgacttaggttttaatatgaatagatctttttcctctcaaacggggcttgatgttcgttcagaaaatacagggattgttaaatagcctacagttataaatagatcaaataactatttttttaatcaaaagtgcggtactataaataaaccaacattaacgaagtccaacgaaagggaaatattatgacaatttatgcagacaattcttattctatcggaaatacgccgcttgtgcgtttaaaacactttggccataacggcaatgtggtggtaaaaattgaaggtcgtaacccaagctacagcgtaaaatgccgtattggggcgaatatggtgtggcaagcagaaaaagatggcacgctcacaaaagggaaagagattgtagatgcaacgagtggtaacacgggcattgctttggcttatgttgcggcggctagaggttataaaatcacgctcactatgccagaaacaatgagtcttgaaagaaaacgcttattgtgcggattgggtgtaaatttagtgcttaccgaaggtgcaaaaggaatgaaaggtgctattgcgaaagcagaagaaattgttgcttctgatccaagccgctatgtcatgcttaaacaatttgaaaatccagccaacccacaaattcatcgagaaacaacagggcctgaaatttggaaagatacggatggcaaagtcgatgttgttgttgctggcgtaggaacaggtggttcgattacgggtatttctcgcgcgattaaattagattttggtaaacaaatcacttctgttgccgttgagccagtggaatctccggtcattagtcaaactttagcgggtgaagaagtaaaaccaggtccacacaaaattcaaggtatcggtgcgggtttcattcccaaaaatttagatttatctattattgatcgcgtagaaactgttgatagtgataccgcacttgccacagctcgtcgcttaatggcggaagaaggcattcttgcaggtatttcatctggtgcagctgtcgcggctgcagatcgcttagctaaattaccagaatttgccgataaactcattgttgttattttgccttcagcttctgaacgctacttaagcacagcactgtttgaagggattgagggataaacaaaaaagaataaagtgcggtgaatttttaccgcacttttattaagactagagtagttcaatctgaatgacatcagattgtttaatccccttattttatcctttccttcttattcaaaatcaattttttcttcttttcatattctgttcattgaatttttttattaatgcagtaaactagccaccgatttttaatcatctttcttttcactttaaatgttacccgcgagtaacaaaaggacacatcatgacaaacaaagtaaacagttatggctggaaagccttaattggctctgccgtaggctatgcaatggacggtttcgatcttctcattttaggtttcatgcttagtgcaatttccgcagacttaaatctaacacccgcccaaggtggatctctcgtaacttggactctgattggtgccgtatttggcggcattttatttggtgcattaagcgataaatacggtcgtgtacgcgtactgacttggactattcttctttttgcggtgtttactggtttatgtgcgattgcacaaggttattgggatttactgatttatcgcacaattgctggtattggcttaggcggtgaatttggaattgggatggctctagcagcagaagcatggcctgcacgccaccgagcgaaagcagcatcttatgttgcattgggttggcaagttggtgtgttaggtgctgcgttgcttacaccattattgctcccgcatattggctggcgtggaatgttcttagtgggtatcttccctgcatttgtcgcttggttcttacgttctcatctgcacgaacctgaaattttcactaaaaaacaaaccgcactttcaacgcaatccagctttactgataaattacgttcattccagcttctgattaaagacaaagccacgagcaaaattagtcttggtatcgtcgtactcacttcctgtacaaaacttcggttattacggcattatgatttggttacctaatttcttatcaaaacaacttggattcagtttaactaaatctgggctttggaccgccgttaccgtctgcggcatgatggctggcatttggattttcggacaactcgccgaccgaatcggacgcaaaccaagtttcttacttttccaattaggcgcagtgataagtatcgtggtttactcacaacttaccgatcctgacatcatgcttcttgctggggcatttttaggtatgtttgtgaacggaatgctgggcggttacggtgcattgatggcggaagcctacccaacagaagctcgagcaacggcacaaaacgtacttttcaatattggtcgtgccgtagggggatttggacctgtagttgtgggcgcagttgtacttgcttactctttccaaacggccatcgctctacttgcgattatctacgtaattgatatgttagcgacaattttcttaatccctgaattaaaaggtaaagccttagactaagaaaatataaaagataaaaatgctcgccaagtgcgagcattttttatgaaacaagtcatcttataagtaatatctttataagttttcttttcactaagcaaactttcattattttgctaacagttcgttcagtttttctaatgccatttctggcgtaatatcaatcaaactttgatgataccccccctctttgtcgcctttacggactttaatcaatccaccttcaattaaacgaataatcgttgctttatctgaaagcggcggcgtatattgtgggctagttggtccataaagtgcaatcaatggacgatttactgctgccgcaatatgcattaaaccactgtcattggtcacgaccgccgtacaatttgcaattaaatccactgcttcatttaagttggtttttcctgctaaattgacacaaaactcacgcaacgcttctggcagtgcttgacgaatttcttctcccactggttcatctttagctgaaccaaatagcgccacagcatagccttgggtaattaacatttctgctaattttgcataatgataatgtggccaacgttttgccgggccaaattccgcaccaggacaaaaaccaataattggacgctcgcctaaaagtgcggtttgttttttaaagttttttaaggtttcagcttgttgagtgggatcaacggttaaataaggttttagaacaggaatatcagccgctttcggtaccgcattttgctcaaaagctaacgcgacataacgttgcaccatcataggataatcacgtttattattgcgtaaatcgttaagcaagaaataacggctttcccctttccagccacgacgcaccgcaatttttgcaaaagcgggaataaaagctgacttcaaggagtttggtaatacgatcgccatatcatattgattgcgcaatgccttacctaaacgataacgcgttcccaattcaaaggctccgtgccctaatggcatttcaatcgccttacgcacttctggcatacgcgcaagcaaaggcttacaccaattcggtgccatcacatcaatattgcagtttggatattgaattttcagttgctggtacaaactgtgcgacatcatcatatcgccaacccaagatgggccaataattagaatattcattttctgtctttcagataaaagtgcggtcaaaaatacttgttattatggcacagagttgaataaaaatatgctcctttaacaatttagtcgaaactctttaggagtcatttcaaattctttcttaaaaacagagtaaaaatattgaattgatggatagccgcaaatctcagcaatttcttgaatagaaatatctgtttgttgtaataaattctttgctcgggaaattttttcttcgtggatgacttggtgaattgttttattcatttcattcttaaaacgttgttcaagattagaacgtgaggtttcaagatgatctaaaacttgttctactttaattcgatgacaggcacgatgacgaatataatgcattgcttgaatgacaagcggatctgttaatgatcgataatctgtagaatttcgagagtgaacggtaatcggtggaattaaaataggggtatgtgaaactttttgaccattgagtaatttgtgtaataatttcgcagcttgataaccaatctctctcgtgccttgttctacggaggaaagggacatacgcgataaatattggatcaattcttcattatcaataccaaccacacaaagctcttcaggtacagcaattttactgtattcacaagcctgcaataaatgacgagcacgcgcatccgtaacagcaataataccagtatgagaaggaagagattttaaccagacaattagcttttgttgctcttccaaccaattttgagcatgaacctgcacaccctcatataggtaaatagggtaatgatttttctccatcaactctacaaaagcatctcttcgttctatagaccaatgcttatgagtatttacttgcaaaccataaaatgcaaactgtgacagtcctttctcctgtaaatgagataaagccatttcaaccaatgccatattatctgttgctacataaggaaagtgcggataaaaatcagcttgtttataagatccaccaactgctatagtaggaataagagtgtgttgcaataattcaacagtttttggatcatcaaagtctgcaataatgccatcaatagaaagttgattaatagtatcagtatgatagataaattcatcttctacaaaaatatcccacatacattgcgatgcctgaatatattgtccaataccctccaccacctgccgatcatatactttgtttgcattaaataagagggcaattttgtagtattgttccgtcattttatatccttatctatgggaaattgctatttaagttataatagaaaagatatttagcttcaagataaaaatagccagaataactggccatttttatatccaataccacatttatttttttagcttcgcaatacctattccacttgcaccataaataatagcaaagataataccgctccaacataaaattgcccaaggtaaataagacaatgttgcaacacctaatgtgcctgccatatatgcacctgcggcagtccatggcaaaataggttcaataattgttgcggagtcttctgctgttcgacttagattttttggatgtaatcctttttctacatacgcatttttaagcatttctcctggaattagaatagaaatttgcccattacaagtaaccccaatcattgttagaccgcaaagaatcgttgtaataatcaaagaaagagttgaatgaacaaaggtgagtaatttttgaataatcacggttaatgcaccgctcaattgtaatacacctgcaaatgataatgcacagaaacaaattaatagtgttcccatcattgagttcattccaccacgattcaacaaacgacttaaatcagagctaactgaagtatggtgaatcattgaggtatcaaatccattaactgcgctattaatcacatcagatagagagaatttttgaattaagatagcattaataattgcgataaatgctgataataacatcactggaatagtcggtttcttagtaatagatccccataatacaatagcgactggaataagtaatagaaagttaaaatgataaacttgctctaactcatgaatcattgtatttactttttctggagtcgctacattagaaaaatcgtagtttaaaccatataccacatagacagtagccgaaagaataaaagatggtaatgttgtataaagtaagtgaactatatgctcatataaatctacgccagcagctgcggatgcaatattggttgtatcagataatggcgataatttatctccaaaatacgcaccagcgaccacagcacctgccgtagcagccaaattggcgtctaatccaatcgcaactcccataaatgccacaccgacagtccctgctgacccccaagaggttccagtacaaatggaaacaatagcagtaaggaataaggctgtcacataaagatattctggtgatattgcttttagtccgtagtagatcatcataggaattgttcctccactaatccaagttccaattaataatcctacagtaattaaaattaatagcgcaggcattgttttagctattttttctgaaatggcgtctaaaatatctaaatagcaatgacctaatttaataactaaaaaaccagcaaataccgttgaaataatcattaatggctctgctggcaaatcaaataaagcatacccaagccctaacagtaatagcatcacaatgattggtgaaaaagcttctaatgttgttggcattcttgtgcgatgagtggttttcatattaaatctccctattgtttaataaacaaaacccatttttgattcgattcaatgcttctaataatttttttctaggcatagcgacattcatacgaaagaaaccatctccctctttgccaaattcactccccaaagatacttttactcttgataaattattaatccaataagctaattcattttcatttatacttagctttttatagtttatccaaagtaaataagttccatcactttcagtaatatctaataatggaatatactcattgaaaaattcttttactatcttcttattattctttatgtattcttttagatagattacccaatcagtacaatatttatataacgaaataatagctggtatagagaaataatttggattatgtatacctaatgccatcatttcttttataaatttttctcgaatttctttattctcaataattaggttagctatttccaatccaggaatattaaaagtttttgctggggataaacagatcattgagtgatttgctacccattcatctaatgatgatattaaatagtgggagtcatttgttagtgtaaagtctgcgtggacatcatcggaaatgataaatacattatgttttttagctaagtttataattttaataaggacttctttattccaaatcgttccagttggattatgaggagaaattaaaacaaatactttagaatgtttaaaacattcctctaataaatgaaaatcaatatgatactttctattttcataaaccaaaggacattgatataattttctgtcatttaattttatcgtgtttaatattggactatatgaaggtgatagaatacatattccatcattttcttttgtaaatgctcgtatataaatagatacggcttggattattcttgggcaaaatacaattttttcagagagaacagaataatgatattgttcgaaaatataatcactgattatcttgtaatagtcggctggtaattcagtataaccataaattcctaaacgattaaatttttctaattcatctatcattatctgaggggctggaatatccatatccgcaacagacattggaataatatcattatctacattccatttagcactaaatgtatttagacgatcaataatcacatcaaaattataaaaattattcattattcctcctgatgtataaggcaaatttactttagtcaaagaagaaaagaattaaaattactaaaactactttatctattacgttttttcacaactgtgatccacgccacagttgcaaataatcaacatagaaaaattaaataacataattgatgaaaagttagtttttcacaaaaatgcgaaaaatttcatcacctagagaggaaaatgttatgacaacctatttcgataaaattgaaaaaatctcctttgagggagaaaaatccacaaatccttttgctttcaaacattatgatgctaatcaagtaattttaggtaaaactatggctgaacatttacgcttggcggtgtgttattggcataccttttgctggaatgggaatgatatgtttgggctaggttctttggagcgaagttggcagaaaaatccaaatgtgcttgctggcgcagaacaaaaagccgatattgcttttgagtttttgaataagttaggcgtgccttattattgttttcatgatgttgatattgcacctgaaggtaattcagtgcgggaatatgtacaaaattttcatcatattgttgatattttagaacgcaaacaagtagaaacgggtgtaaaactcttatggggaactgcaaattgttttactaatcctcgttatatgtctggtgcagcaaccaatcctaatcctgaggtttttgcttgggctgcaacacaagtgtttaatgcgatgaatgccactcaacgtttaggtggagaaaattacgtattatggggtggacgtgaggggtatgaaactttattgaataccgatttgaaacgtgaacgtgaacaaattggtcgttttatgcaaatggtggtagaacataagcataaaattgggtttaaaggtacattattaattgagccaaaaccgcaagaaccaactaaacatcaatatgattatgatgtggcaacagtgtatggtttcctaaaacaatttggtttagaaaaagaaattaaagttaatattgaagctaaccacgcgacgcttgctggccatacctttcaacatgaaattgcaacagcttgtgcattagatatttttggctcaattgatgctaatcgtggcgatccacaattaggctgggataccgaccaattcccaaatagtgttgaagaaaatacgttagttatgtatgaaattttaaaacatggcggttttactactggaggctttaattttgatgcgaaaattcgccgacaaagtattgatccttatgatttattttacgctcatatcggtgcaattgatgtattggcattatccttaaaacgtgcagcaaaaatgttacaagagaaaaccttacaaaaaattgttaatgcacgctatgcaggttggaatagtgaacttggtcagcatattttgcaaggtaaaacttcacttgaaacacttgcgcaacttgtccaacaaaaagatttagcaccaaaaccagtttcaggtcagcaagaatatttggaaaatttggtaaaccaagttatttatagctaaaaatgaagcaaaagtgcggttgtatttcaccgcacttttttattttaggagacattatgtatataggaattgattgtggcacacaaggaacaaaggcaatagtgcttgattctgtccaaaaaaaagtgattggagttggttacgcaaaacatgaattaattacacaatccaatggaagacgtgaacaacaaccaaattggtggattgaggcattacaacaagcattacaaattgcattgaaacaagcaaaaaattcaccgcacttttcacctaatttagtgaagggaataggcatttcaggacaacaacatggactggtaatgttagataaaaacgatcgtcctctatataaggctaagctttggtgtgatacagaaaccgctacggaaaatgatatactgatcgaaaaattaggcggacaaacagccgtatttgaaaaattaggcatcatttgccaaactggttacacagcttcaaaactaagttggtttcgtcaaaattatcctgacaaatttgccaatattcgcaaaatcatgctgccacacgattatctaaattattggctaacaggaaaattctgcactgaatttggtgatgcttctggtagtggttatttcgatgttgtgaaaagagaatggaaaagagaagtcttcaaatatcttgcaccagaattaaatatggatgaagtgttaccaaaattactttctgctgaacaaaaaatcggtgtgattaaacctgaaattgcgactttatttggttttaatgagaatgtcatcgtctccacaggtggaggcgataatatgatgggagcaattggtacaggaaatattcgagaagggattgctacgatgagtctcggtacttctggtaccttgtatgcttatacgcaaaagccattgcttaatttaccaccaatgatcgcaaatttttgttcaagtaataatggctggttaccactggtttgtgtaatgaatataacctcctcaaataaacagctaatgaatttgctcaatattgatattgaagaattaaatcaacttgctcaacaagcacctattggcgcgaatggcatcactattttgccattctttaatggtgaaagagttccacctttacccaatgcaaaagcgagcattttaggattagattcaagtaatttcacacgagaaaatctttgtcgagcaatgatggaaagtgctacttttacgcttcgctatggcttagatttatttcgtcaagctggcctcgaaacctcacaaattcgcctaattggaggtggcgcgaaaagctcattttggcggcaaatgattgctgatgtgatgaattctgaagtggtatgtttgcaggaagaagaagctgctgcattaggaggagcaattcaagctatgtgggcaaatggagaaggagaactggaatttttatgcgaaaccttcattcacttagatgaaaactcaaaagcttatcccaacttatcacaggtgaaaaattatcaaagtgcttatgagcgttatttaatacatttatcacaattatattaaataaaatcccctatgccgataagctataggggatttactacattaataatttattttctattcaaccacgccatatattcagtcacgccttccgcgactgttttgaatggtttatcgtagcctgttgagcgaagtttagttaaatctgcttgagtatattcttgataacgagatttcaaatgctctgggaatggaatggtttcaatctcgccttttccgtggaatttcactaccgcatcagccaccgcacggaaactttctgcatttcctgtaccaaggttgtaaatacccgaaataccattttgccaacaccaaatattcactgcagccacatcgcctacataaacaaaatcacggcggaatccttcgctgcctgcaaataattttggattttcgccttttaagatttggttattcaagtggaatgccacactcgccattgaacctttatgattttcacgcggcccgtaaacattgaaataacggaaaccacatactggcgattttgcttctggcaaaatgttacgcacatattgatcgaacaagaatttagaatagccatacacatttaatgggccttcaaattcacgttcttcacggaatactttggtgtctccataagttgctgcgcttgaggcatagaaaaaaggaatttcacggtcaaggcaataatgcaacaactctttagaatattcgtagttgttgtgcataatgtatttaccatcccattccgtagtcgcagaacatgccccctcgtggaataccgcatcaatatcgccaaattcatcgcccgcaataatagaagcaatgaaatcttctttatcgcaataatctgcgatgtctaaatcaactaaatttgcaaatttcgtgccatcttttaagttatccaccactaaaatatctttgcgccctaaatcattcaatgctttgacaatattactgccaataaaaccagcgccgcctgttacaataatcataattctgtcctctttaaaataagtttgcgtattgtaatagattttctaccgcttagccaaaaaactctgcgaaaaacaaccgcacttttaatccccaataactcgtaaggcctgtcgtaacaagatccattttgcctttactcaacaacacaattgtgggtgtcacattaatttgccatcgttctgcaaattcccctttaggatcattaaccgtagtgaagtggtagtcatgcttacttaaataatcatttacgtccgcctcattgcctgagcgtaatgccaccgatacaacttgatagccttcgtttgctaaagaattaattgctggcgaagtataacgacaataaccacaccaagttccccaaaaataaagtaatgtgggtttgttttgatcaagactatcaagagagaacgtactcccttgaagatcttgtaacgtgattttatttatttcctttggcactacagggcgacgaacaaaatccagtatgctagttatcacaataaaagttaaaaagagggataatccattcttgagtaattttttaatcttcattttatttattccttatcttgttgagatgattgtaattgagcgtacaaccatagtcaaaaataaagaatttttgctacaataggtaaaacataaataaaaggaggaaaataatgacatcaaatcaacttgctcaatatatcgaccacaccgcacttaccgcagaaaaaaatgaacaagatatttcgacactctgtaatgaagcgattgaacatggattttattctgtatgtatcaattctggttatattccactcgctaaagaaaaacttgctggctcaaatgtaaaaatttgtaccgtagttggcttccctttgggggcgaatttaacctctgtcaaagcatttgaaacgcaagaagctattaaagcgggtgcaaatgagattgatatggtaattaatgtaggttggataaaatcgcaaaaatgggatgcagtaaaacaagatattcaagctgtatttaatgcttgtaatggcacgccattaaaagtaattttagaaacttgtttgctcactaaagatgaaatagtgaaagcctgcgaaatttgtaaagaaatcggtgtagcttttgttaaaacatcaacgggtttcaataaaggcggcgcaactgtagaagatgttgcattgatgaaacaaacggtcggcaatattggtgttaaagcatcaggtggtgtgcgtgatactgaaactgcacttgcaatgattaaggcgggtgcgactcgcattggtgcaagcgctggcattgcaattattagcggtacgcaagacactcaaagcacttactaatcctttcacgcgtggtattctttccacgcgtttttacatattcgacaatttctgcagcaaacgatccattgctcgatagcccaaggcctccgccaagtgcggttgagaaatttgttgttctccttgtagatcggcaatggttcgagaaactttcaaaatacgatgataagcccgtacagaaagcccaagtttattcagtgctttttcaaggaaaaaggcatctttatcatttaacttgcaatcacgctcaatctctttactgttcaaataagcgttgattttccccgctctttccatttgaatctcacgtacttttaacactttttcacgaacttgcacgctggtttcgccacgatcgcccgtattttgcaagctaccttgtggcagtaaaggcacttcaatagataaatcaaaacgatctaaaaatggccctgaaagtcgattcaaataacgcataatttgctgtggtgaagtgcggttatgtgtcccagtataatggcctgtagggcttggattcatcgctgccactaattgaaaacgagctgggaattgaatttttgcattggcacgagaaataataatctcaccactttccaaaggctggcgtagtgcatctaacacttttcgctcaaattctggaagttcatcaagaaaaagcgccccatttgttgctaaggatatttcgccaggtttagggatcgttccgccaccaactaaagccggcattgatgcactatggtgtggtgcgcgaaaaggacgttgcttccaattatgaaaatttaactcgttttgaactaaactcgttacagatgctgtttctatcgcttctaaatctgtcatttcaggtaaaatccctgtcaaacggctggctaacatggttttccctgtacccggtgggccaagaaagagcaaattatgctgccccgctgcggcaatggtcaatgctcgtttagcgtgctgttgtccgataatatccgttaaatctaacgtatttttacctgaaaaatttaccgcactttctttcacaatttcagtggcgaggggtaatttttcctgaccattgagaaattgcactacatctaaaagcgtttgagcaaaataagtattttgatcagacacgagcgaggcttcattagcattttgtttcgcgataattaactctcgctttgacttttgcgctgcaagaatagcgggaatcacaccatgtacgccacgcaattggcccgtcagcgcaagctctgccacaaattcaaattgctttaaacggcttgcatcaagctgatctgatgcagctaaaatcccgatagcaataggcaaatcaaatcttccgccttctttcggtaaatccgcaggggcgagattcactgtgatacgcttggctgggtatttaaattgtgcattcatcaacgcactacgcacccgatcttgtgcctctttcacggttttttctggcaaaccaacaagtgtaaatcctggttttccgttgcttaaatgcacctcaatggtgactagcggtgcttgcacacccatagaagcacggctgtaaacaatagcaagggacatgataatccttaaagtgcggtaaaaatgaagatagtttttgcactataaaaaaagcacgtaatgaaatcattcattccgtgctttttttgcgatctagatcgcaaaattcatattttatttcgcaaaaagtggcgaaaaccaaaaatctaatttcgccgccaatttatcaataccaattttattttgtgcagaaaaagcctcaacttgtatatcgccttgaaatggaagaattgcttcacgcaccatttttacttgtttactacgtgcgctttggctcaatttatcggctttagtaagcaataaaagtaccggtaaatttgctgaaaccgcccattcaatcatttgttggtcaagatctttaagagggtgacgaatatccatcaacacaaccaatcctgccaaacattcgcgtttttgcaaatattcgcccaaggatttttgccattggattttcatttgctctggcacggcggcatagccatagcccggtaaatctaccaatttacaatttggttccacttcaaataagttaatcaattgcgtgcgccccggtgtttttgaggtgcgcgctaaatttttttgattggttagtgcattaagtgcggtcgattttcccgcatttgaacgacccgcaaacgcaatttcaatgcccgtatcttcaggaatggaacgaatattcggcgcgctcgttaaaaagtgggttttgtggtaattaagtttaatttcagacataagtattccttttaaaaattgtgtttagaatagcataaatggaaaatttcctgaaattatgtcaaaattctctctgaaattataatcaattaatggcaatccagatgacaacaaaaacaacttaccaatggcctcaatctaaggatatttatccatatcgaccagggcgttttgatgcaccaaaacattggcgttataacttacgtagctttttaaatcgtggttcaattcgtcgctttgaacaatttatcaatcaatatccttttctcgtcgatatttttaatacgcacttggattatagttatcctgttgcttgtcgttttttagataagcgttttaacgcatcacaacgttttcatgccgtttgtgagaatcttttatttttacccgaaaaacttaccgcactttctacgccgttatgggaaaaacctctaagttttggcgaagtcattcctgattttgaaatgacattaagcatgacaacccatcaaccgatggaaggatattgggtattggagctatggcataaaccaagaaacgaattagtctatttgcttacctttgccaaattaggcgatgcgttgcttattgctgttgtacaagggccaaattttgaaggctcaaaggaaatggtgaaacaactaaccaaattatgccacggtttacgccctgcctatttaatggttgaaaccatgaaatcactcacaaaaatactaggctacgataaattgcttggcattccgcaaaaataccaaaataaatctcgcttcattcaaagtaaacaatatactgtggattatgatgcaatttttggcgaatcaggcggagaattaaaagattactgggaattgcctttagaaatggatagaaatctggatgatattccaagtaaaaaacgttccatgtatcgtaaacgttatgcgatgctagatgatttggctaaggtaattgaagaaaagttaggattgtaaaagtaaaaagtgcggtgaattttaaccgcactttttgttttataagactttcaagcaagccacaaaatggctgttgttttggctggtgaaaggtggtttttgtttcgcacaattctcatcagcctttagacagcgagtacgaaatacgcaaccagacggtggattaattggcgaaggcaaatcaccttcaagtaattcgatggatttattgcgttccaattttggatcggggatcggaacagcagacattaaggctttggtataaggatgtttggtatcgttatatacttccacatcgctgcctaattccattgcattgcctaaatacatcactaatacgcggtcagaaatatgttttaccaccgctaaatcatgggcgataaaaattaaggaaagccccatttctttttgcagggatttcaataaattcaccacttgagcctgaatcgacacatctaacgctgaaacgggctcatcacaaatgatcattttgggctcaatgattaacgcacgagcaataccgatacgctgacattgaccaccagaaaattcatgtgggtagcggttaatcaagttcggtaaaagcccaactttcaacatcatagcttgcactttttctttcacttcggcggcacttaagtgcggttggtagatctttaatggctcagcaatgatttcgccaatattcattcgcggattgagagaggcgagcggatcttggaaaatcatttgaatatctttacgcgtttctttccattgtttcgctgattgttttcgtaaatgtttaccaagccacaagatttccccttcactcgcttcgactaaaccgataatagcgcgtgcaagtgtggatttaccacaaccagattcacctactacgccgagagtttcacctgcgtaaagtttaaaagacacatccttcaccgcttttaaggtttgcggtttggcgaagaaaagggatttatcatttttaattttaaaactgacgcctaagtgattgacttcaaggagtaattctttgttgtttgagactgtcataggttaaatttctccgctgataaccaacaattacgtaattgaccgtgattaaatgtagtcagttttggcgcaatttggcattgttcggtagcaaattggcaacgaggtgagaatggacaaccttttggcaaatgcaataaattcggtggattgccaggaatggtgaccaagtgttcttcattgccgtctaagcgaggaatcgcatccattaagcctatggaatagggatgggttggatgatagaaaatttgttccgctgtgccgtattccatggttcgtccagcatacatcaccatgacttgatcgcagataccagccactaccccaagatcatgggtaatcataataatcgcagtattaaattcgtgttttaactcatttaacaaggtcatgatttgtgcttgaacggtcacatccaaagcggttgttggttcatctgcaatgagtagtttgggacggcataatagggccatcgcaatcatcacccgttgacgcataccgccagaaaactcgtgcggatacatgcccatgcgttttttagcttctggcattttaactgcgtctaacattttcacggattcggcaaaggcagtttgtttatcatagcccttgtgcaattgcagcacttccatgagttgttcaccgattttcatgtatgggttgagtgacgtcattggatcttggaaaatcatggaaatttgctcggcgcggattttattcaattcagcattcggtaaattaactaattctttcccttcaaaaatggcagagccttccacttcaccgttggctgccaataaacccattaaagcaaaggctgtttgtgacttgcctgatccactttcgcctacaatgcccagcgtgcttcctgcattcagcgtgaagtttaagtcattcactgctgtaacgacgccatctggtgttttgaagcgaacgtagagattttttacatctaataaaggattcattattcgctcctatctatctttcggatcgagcgcatcacgcaacccgtcaccgataaagttaaaacaaaatagggtaaggcaaaggaaaaatgccgggaaaattaataaccaaggcgacacttccatttgtgcagcaccatcacttaagagtgcgccccaactactcatcggctcttgtgtacctaatcctaagaagcttaagaatgattcaaatagaatgagcccaggcacttcaagcgaggcataaactgccactaagcctaatacattcggaataatgtgtttcaaaatgatttggcgacgaggtacgccacaaacgatggcggcttcgacgaattctttattttttaggctgagggtttgtccgcgtacaatacgtgcaagaccaagccaggcaatggccccgatagcgataaaaattaagaaaatgttttggccaaaaagggtcaccaacaaaatcacgaaaaacataaatggaaatgagctaagaatttccaaaaagcgcatcatcagcatatctgttttaccgcctacataaccggaaatagccccataaattgtgccgatagtcacggaaatgaaagcaccagcaataccgaccaataatgaaatacgtccaccgatagcagtacgtaccaacaagtctcgacctgaggcatcggtaccgaagaagtgatagccttccattgttggtgcggagctcatcatattccaatcggtatcttcataggtaaatgggaagaaccaaggcgctacggtgataaatataataataaacgccaaaataatcagactgacaacggccgctttgttgcggaaaaaacggcgtttcgcatcttgccataggctgcggccttccagttgcatttcttcaatacggtcagccacttgttccacaaaatccgcatttttctgattaatcggctgagtacgataatctgtcataacttatccttaataacgaatttttggatcgatgatggcgtataaaatatccacaatcgcattaaataaaatggttaatgcccccactaaaatggtgaggctcaaaactaaagagtaatcgcggttcaatgcgccgtttacaaataataaccccatgccaggtaaaccaaatacgctttcgatgaccattgagccagtaataatccctacgaaagcaggtcctaaataggttatcacgggtaaaagtgcgggacgcaaagcatgttttaaaatgattctcgacatggaaagtcctttagctttggcggttcgaataaagttggaatgtaacacttcaatcatcgaaccacgcatgatacgcgcaatccctgcaacataagcgatagttaaggaggctacaggtaagatcatgtacatggcggtaccgccgttccaaccgccagctggcagccatcctagataaatggcgaaaattagcactaaaacaggtgcaaatacgaagcttggcataatgaccccaagcatcgagaaactcatcaaaatataatcccaacggctattttgattgagagcggcgagcgtacctgctgttactcctagcacgactgcaaaggcgaaggccaccattcccaattttatggaaacagggaaagctgacgcgattaaatcattgactgattggtctttatatttaaaagagggaccaaaatctcctttggaaagattttctaaataaaggaaatattgtttatataatggttcatttaaatgatacttcgcttcgatattagccatgacttctggcggataagcgcgttcagaagtgaaggggctgccaggggcaagacgcatcaaaaagaaagaaaaagtaatcaaaataaacagcgtcggtaaggcttccaacagccgtttaaaaataaacttgagcataacaactccaaccaaaatgggcgaaaagtgcggtcaaaaaatacgacgatttttaaccgcacttaaatacgagcaacgaattaatgtttaataatataaagattgcgtaagtaaatatgatcttgtggatctttgcctgaataaccttttacgtaaggtttcactaagcgtggattcacatagttaaagattggtacgataccgtaatcttttccaagaatttcttcggctttcgcataagcttttgcacgaccttctgcatcagttgctgcgtaagattctgccatcgctttatcatattctggattcgcatatttcgcggtattgttactagaattagataagaaatagttgccgaatgttgttgcttggttgtaatccgcatgccatccagcacgcgccacatcgtaacgacctgcacgacggctatcaatgtaagttttccactcttggttttctaatttcacatcaatcaaacctttggtgttagctttccacatagaagctgcagcaatagccacttttttgtggttttcattggtattataaagaatgctgaatttcaacggattcgctttactgtaaccagcttcttctaagagtttaatggcttcttcattacgttgtgccatcggttcttttgaataagcaggttgttgaatgagatgaccttcttcgatgtaagttggggtaaacacataggttggtgtttgaccttggcccaatactttatcggtgatcacattacgatcaagggataagttcaaggctttacgaatattcacgttatcaaaaggtgctttcttattgtttaattcataagaataagttcctagggtacgagtaacgtatacttcgcctagcaattctttttttaatttagcgaattgttctggcggtaaaccataactggtcatgtctaaatcgcccgcacgataacgtgctacatcggtacttgggttttcaatggcgaggaatgtcgcactattgattacggtttctttatcgttccaataaagtgggttacgttcaaattcgattttttcgttaatgatgtggttagccagcttatacgcaccgttacccacgtagttttcttttttcacccatgcatcacccaatttttcgactactttttgtggtaatggcaataaggattggtgagtcgttaaactgactgcataaggcacaggattggttgcatgaaccacaaaggtgtaatcatcttttgcttccacgcctaattcagccggttttttcttaccgtcaataatgtcttgcgcattttcaacttgtaaataacttaagtaactcgcataaggtgcagcagttgcaggatccactaaacgacgccacgcaaacacgaaatcgtgtgcagtaacaggatctccgtttgaccatttagcatctttacgtaaatggaatgtccaggttttgaagtcaggtgtattttcccagctttcagccgcacccggttgaagtttaccttcagagtctgaggtgactaagccttcaagtaattgataagcaacgttagattctggcacaccttcggttttgtgtgggtcaaaactttgcggttcagccccgttattgatgacgatatgttgtttttcatctaattgtgttccttcaggcactataactgcttgcacagaataggaaagagcaagagcgattgcagagaagagtagtttgtgttgcatttgaacctccttgttattaggcgatatttttataaaaagtcttctacttattagctcaaaaattcatttttgtaaagatttgtcaggaaattatttgaagaaaaattgagttttgtgagttgtgtctaataaatcgctaaaaaaattgctaaaagtgatgatatgagaggggggaatctaggatgtattgatttttcctattgtaaatattttcctacataaattacccttttaatgctaattgtgctatcgtaacctgattagatttaaacaagtccattcaaggagaatacaatgacaacacagttagattcacttcgtaatatgaccgtcgtcgtagctgatactggcgatattgatgcaatcaaaaaataccaaccacaagatgcaacaacaaacccatctttaattttaagtgcttcagcattaccacaatacgccccattaattgatgaagcggttgcttatgcaaaagctcaaagcaatgataaagcacagcaacttattgatgcagaagataaattagcggtaaatattggtttagaaattttaaaaatcgttccagggcgtatttctactgaagtggatgcgcgtctttcttacaacacacaagcaacggttgaaaaagcgcgtaaattaatcgcactttataatgcagcaggcatctcaaatgatcgtattttgattaaaatcgcttccacatggcaaggtatccgagctgcagaaatccttgaaaaagaaggcattaactgtaacttaaccttattattctctgaagctcaagctcgtgcttgtgcagaagcaggcgtttacttaatttctccatttgtaggtcgtattttagactggtacaaagcaaactccgacaaaaaagaatatgcgccagcagaagatccaggcgttatttctgtcaccaaaatctacaattactacaaagaatatggctacaatacagttgtgatgggcgcaagtttccgtaatgtaggcgaaattactgaacttgcaggttgcgatcgcttaaccattgcaccagcattactgaaagaattacaagaaaattcaaccgcacttatacgcaaactagaatacaaaggcgaagtaaaagcgaaaccacaaccattaacagaagctgagttctactggcaacataacagcgatgctatggctgttgaaaaattagcagagggtattcgtaaatttgctattgaccaagaaaaattggaaaccatgctttcagcaaaactttaatctataattcaatataaaaaataaccgcacttcaatctgctcttgaattagttaaagaaaatatttaactaatttgagtgcagattttttatttattaagatataaaagtgcggtaaaaattcggtgtatttttgtttatttactcctagcggcaatagataatggttacagaaatattattaagtaatacattttcataacaaaatagatgaaatttattataaaaatattttaataaagataaattatatttttaatttatactaaattagtagttagaattttaacttgcgataatcagataaaagtggtagttctcttaagattttatacattccagaatgactaccatttgatatatgattataaattagcttaataaatcacttaatttcttaattaagataatttttctttcctcaaagaattgatcaaaattaccaatagataagttcacatcaggtataaagatggttgtcgaaaaaagaggttatattagattttgcatttttatctaccattcttcaagagaagcatctttttttcgatgtattttcatcaagccattgtaagttataaatagaattataatttttatcagctttttgagttaatagtaactccttaataaatttatcattgatagattaatttaccatccagcttgtgactgcgataaaaatagcaaagatgcaaaaccaaattatgtggagttttgtgcttttacgattgacttcttcattatgtaagcgtcgagcttctaatctttgtttgtacatctctagatctttttgtttgaaagagaagccgcaattagggcaattttctgcattttcactaatcttttttctgcattcagggcatcttgttaaggacatatttgcttttatacctattcaattacttatttattagcattttaatggatgttttagattttacaaatgtgatacaagtcacaaatcttataaaaatctttaaattcaattttgatttgacgtaatttgaaatagaatacagccgcttgtttagggcatataaatacttttactttattttttgaggagccttcctatgttatggtttttcttttgtgtagccgtgttgattatcggttactttatttatggaaaaattatcgaaaaaatttttgtgattaatccaaaacgtcaaacacctgcttaccaagtaaatgatggtgtggactatatgccaatgtctaaaacgaaaatttggctaattcaattgttaaatattgcgggaacaggccctatttttggccctattcttggtgcattatatggacctgttgcaatgctttggattgttattggttgtatttttgcgggcgcagtacacgattatttctgtggtatgttaagtattcgtcacggtggcgcaacaatgccatatttggcgggtaagtttttaggtcgtcccgttaaagtctttatcaatacattagcacttgtgttgcttttacttgtcggtgttgtgtttgtggcaagcccagctcaattaatgggtaccattacaatggatgtatttggtgcttcgcaaagtgcgttagtgcttggtgatgcagaggcagttcatcattctgttgaagctggtgggattaaagtatggggaatggataaagcaacagtggttgctctgtggacagcaattatttttgcttattatattcttgcaaccttacttccagttgataagattattggtcgaatttatccactctttggtgcgttattactctttatgtcagttggtatggtatacggattagttgtttcacattttagtgcaacagatccaattgagtttttccgtacaatcaatgctgatggcgagggtttaacttgggcgaaatttacacaaaatttccaagtgaaaggtgatgttccaatttggccacttttattcttaactatctcttgtggcgcattatcaggtttccacgcaacgcaaactccattaatggcgcgttgtacagaaaatgaaagtgaaggtcgcttcattttctacggtgcaatgattactgagggggtaattgcattagtatggtgtatggttggtcttgcattctatgaaaatccacaagcgttacaagatgcaatttcagcaggttctccatctaaagttgtgtatgatagttcgttacatttcttaggttttattggtggtatttttgccatattaggcgtgattgttcttcctattacttctggcgatactgcattccgtgctgcgcgtttacagatagccgaaatttttaatgttgatcaacgttcattacctaaacgtttattaattgctgtgccgttgtttgtattaggttattttatttcaaccattgatttcagcgtattatggcgttatttcacttgggcaaaccaaatgacagcaatggtaatgttatggactacagcgggatatttatatcgttatcataaattccactgggttgcgtctcttcctgcgtggtttatcacaacagtatgtgcaacttatttgttctacaacaaaattggtttcggcttagattatcagctttctgtgtatcttggtttagcaacaaccatcgtttgtatcgtattgttcttcacaatgcttaaaccattaggtacgcgagatgaagaagcttatataaataattagtcaataaaatttgatgaaaaaagccgtttgaattgtttattcaaacggcttttttattttgataaaaatcagttgctttaatgtggaattacttgcaagttgagcgaacaaattataaacttgccagaagtggagaaaagtggtgttttgtggagatttttagagattttctaaaaataagttcaatttttaaggtgtaatatgtttcgtggtgcaacggcggttaatttagattctaaggggcgtgtagcgatcccaactcgctatcgcgctgaaattcttgaaaagaaccaagggcaaatggtttgtactgtagatattcgccaatcctgtcttttactttatccccttgatgaatgggaaaaaatcgaacaaaaacttctcgcactttctaactttgatcctacccaacgccgtttgcagcgagtaatgcttggccatgccactgaatgtgagatggatgctcagggtcgtattttgcttagtgggccattacgccaacacgcaaaattagaaaaaggtttaatgttggtagggcaacttaataaatttgaaatttggagcgatgtagaatggcatactcaaattgcagaggatatagaaattggctccagcacagattttgctgctgatgcgttaaatgatttctcattatagaaaataatgtagtacttttatcttaaatttatgaatagcgaaaattccttttcttcatctgaacatattacagttttacttcacgaagccgtgaatggcttggcattgaaggagaatggcatttatattgatggtacttttgggcgtggggggcattctcggtttatcctttctcaactttcttctaatggtcgtttgatagctgtagatcgtgatcctcgtgctattgcagaagcacacaaaatccaagacttgcgttttcagattgaacataacagcttttcgcatattcctgaaatttgtgacaaattaaatttagtgggcaaaattgacggtattttgcttgatcttggtgtgtcttcccctcagcttgatgaagcagaacgtggttttagttttatgaaagatggcccgcttgatatgcgtatggatacaactcaaggtttatctgctgaagaatggttaaaacaagtgtccattgaggatttaacttgggtgttgaaaacttttggcgaagagcgtttcgctaaacgtattgccactgctattgttgatttcaataaaagtgcggtaaaaaatagcacagaatttttatcgcgtaccagtcaattggcggaacttatttcacaggcagttccttttaaagataaacataaacatcctgcgacgcgtagtttccaagctattcgtatttttattaattcggaattagatgaattagaaagtctgcttaattctgcgttagatatgttagcaccagaaggtcgtttatcaattattagtttccattctttagaagatagaatggtgaaacattttatgaaaaaacaaagtaagggcgaggatattcccaaaggtttaccattgcgagaagatcaaattcagcgtaatcaaaaattaagaattattggtaaagccattcagccaagtgatgcagaaattcaagcaaatcctcgttcaagaagtgccatattacgtgtggcagagagaatttagcgatgtctgaaaataataagcctcgttatccgttacagcagattttagtcgaagatttattttcttcaaataagttagtggtgttgctgttgatagggattttagtttctgcaatgggaacgatttggataacccataaaactcgccaattaatttctgaaaatggaatgttaattttacagcgtcaagcacttgagaatgaataccgtaatttacaagtgcaggaagctacggaaggggatagcacgcgagtagaatctattgcgattagtacattaaaaatgaaagttgtttcttcagagcaagaagttgaaattagagaataataggtaaaaaagatggtgaaatttaattcctcgcgtaaatcaggtaagtcaaaaaaaacaattagaaaattgaccgcacctgaaactgtaaagcaaaacaagtctcaaaaggtgtttgaaaaatgctttatgcgtggacgttatatgctttctacggttcttattttacttggtctgtgtgctttagtcgcacgagcagcttatgttcaatctattaatgccgatacgttatcaaatgaagcggataagcgttctttgcgtaaagatgaagtattatcggtgcgtggttctattttagatcgtaatggtcagcttttatctgtaagcgtaccgatgagcgcgattgtggcagatccaaaaacgatgttgaaggaaaattcgcttgcggataaagaacgaattgcagctttagccgaagaattaggtatgactgaaaatgatttagtgaaaaaaattgagaaaaattctaaatctggttatttgtatttagcacgtcaagttgaattaagtaaagctaactatattcgtagattaaaaattaagggtattattttagaaacagagcatcgccgtttttatcctcgtgtagaagaagctgcacacgtggtgggttatacggatattgatggaaatggtattgaaggcattgagaaaagttttaattccctgcttgttggtaaagacggttcacgtactgttcgtaaagataaacgtgggaatattgttgcacatatctccgatgagaaaaaatatgatgcacaagatgttaccttaagtattgatgaaaaattgcaatctatggtgtatcgtgagattaaaaaggcggtgtctgagaataatgcggagtctggtactgcggtgttagttgatgttcgaacaggggaagtgttagctatggcgactgcgccctcttataatccaaacaaccgtgtcggcgtgaaatcagagttaatgcgtaaccgtgcaattaccgatacttttgagccaggttctacggtaaaacctttcgttgttttaaccgcacttcaacgaggtgtcgttaaacgagatgaaattattgatactacgtcctttaaattaagcggtaaagaaattgtggacgttgcaccacgtgctcagcaaactttagacgagattttaatgaactctagtaaccgtggtgtaagtcgtcttgcattacgtatgccacctagcgcattaatggaaacttatcaaaatgcaggtttaagtaaaccgacagatttaggcttgatcggagaacaagttgggattttgaatgcaaatcgtaaacgctgggcagatattgagcgtgcaacagtcgcttatggttatggtattactgcgacacctttacaaattgctcgtgcctatgcaacccttggtagtttcggtgtttatcgcccgctttctatcactaaagttgatccgccagttattgggaaacgggttttctctgaaaaaataactaaagatattgtgggaattttagagaaagtagcaattaaaaataaacgcacaatggtggaaggctaccgtgtcggcgtaaaaacaggtacggcacgtaagattgaaaatggacattatgtaaataaatatgtggcatttactgcgggtattgcaccaattagtgatcctcgttatgcattagtggttttgatcaatgatccaaaagcaggagaatattatggtggtgcggtttctgcccctgtattctctaacattatgggctatgcgttacgtgcaaatgctattccgcaagatgctgaagcagctgaaaacacaacaacgaaaagtgcaaaacgaattgtttatattggcgaacacaagaatcaaaaagtgaattaaggaaaaattatgaaaaaactcaccgcactttttaatttgcctgaattaaagaatgatatagaactccataatatggtgttagatagccgtaaggttaaagctggcgatctttttgtggcgataaaaggtcatcaggtggatggaaatcaatttattgattctgctcttcattctggtgcgagtgcggtggtttctgagacagaattatctagcgagcatttaactgtggcgtttatcaggaatgtgccggtagttaaatattatcaacttgcacgtcatctttcgtccttagctgatgttttttatgattcgccctctaaaaatttaacccttgttggcgttacaggaacaaatggcaaaaccactatttctcaattattagcgcaatgggcggaattattggggcatcgtgcggctgtgatgggaaccattggtaatggacttttggggcaaattgtagaagctaaaaatacgacaggttcagcagtagaaattcagtcatctctttcaactttcaaacacgcaggtgcagattttacctctattgaagtttcatcacacggtttggcgcagcatcgtgtagaagccttgcattttaaagcggcaattttcacgaatttaacccgtgatcatctagattatcatcaatctatggaaaattatgctgcggcgaagaaacgcttgttcactgaattagatacccaaattaaagtgattaatgctgatgatgaaattggataccaatggctaactgaactacctgatgctattgccgtaagtatgaatgcggattttaaagtaggttcacaccaatggatgaaagcaataaatatccattatcattttaaaggtgcagatattacttttgaatctagctggggtaatggtgttttgcatagcccattaattggtgcttttaatgtaagtaatttattattagtaatgaccacgttgttatcgtttggttacccattggaaaatttactcgctacggcgaaatctttaaaaggagtatgtggaagaatggaaatgattcaatatccaaataaaccaatcgttattgtagattatgcgcatacaccagatgcgttggaaaaagcgttgattgctgcgcgtgaacattgccaaggcgaattatggtgcatctttggttgtggcggagaccgtgatagaggcaaacgtccgttaatggcacaggttgcagagcagtttgctgaaaagattattgtgacaaaagataatccacgaacagaaccacaaagccaaattgaagcagatattgtcgctggctttaaaaatatggaaaaagtggggattattcctgatcgcgcacaggcgatccagtttgcgattgaaagtgcggtagaaaatgacgtgattttaattgctggaaagggtcacgagcattatcaaattattggttcggaagttgtgcatttttccgaccaagaaattgcacttgatttcttaaaataataatcactcaattatgattaaactctctactgtacaacttgcacagattcttcaagctaaattaattggcgatgaaaatgtgcaagttgaagaaattaatacggatactcgaaaaagcgtatcaaatagcttattttttgctttaaaaggcgaaaaatttgatgctcatcaatatcttgatcaagcggtgtcacagggtgcgcttgcgcttgttgttcagcaagaaaactcgtctattttagttcctcaacttgtggttaaagacactcgtattgctttgggcgagcttgcaaaatggttacgcgagaaaattaatccgcgtactgtggcgatgaccggctcttctggaaaaaccacagtaaaagaaatgacagcaagtattttgcagcataccgcagcagattcagaagcggtactttttaccaatggtaacttcaataacgatataggtgtgcctttaactctgcttcgcttaacagaaaaacatcgttttgctgtgattgaacttggtgcaaatcatcaaaatgaaatcaattacaccacaaaattagttcaacctaatgccgcattgattaataatattgcgcccgcacatttagaggggtttggttctttagcgggagttgttcaagcaaaaggcgagatttatcgaggtttaacaaaaaatggtgtggcgattatcaatgctgaacataatcacttagatatttggcaaaaagaaattagtaatcacgccattcaatatttcaacggcaaggactattccgtcaaaaatgttcaaggtaacgaacaaggttcaacctttacgttagtttctccgcaaggcgaaattgatattagtttaccttatcttggagagcataatgtaaaaaatgctttagctgctaccgcactagcgatgaatgttggtgctacgcttgccgatgtcaaagctggattagaacaacgttcacaagtgaaagggcgtttatttcctattcaagtaacgcctaatttattgttattagatgatacttataacgcaaataaagattctctctgtgcggctattgatgtcctaaaaagttatgatgctttccttattctatgtgtcgcagatatgaaagaattgggcgaaaattctctcgctattcatcgtgaagttggacaatatgttaatttggtaaatttagatttggtgtgttcttatggcaatgaaagtgcggttatttctgaggctgttttgggtaagcattttacggataaaactgaaatggtggatttcttagttccacttattgaaaaccaattacaacaaaataaaaaagttgtggtgctgggaaaaggctcacgctcaatgaaaatggaagatgtgatctattcattaaaggataaaattaaatgttagtctggcttgctgaatatcttgttcgttacgaaaccgcctttaatgcgatttcttatattaccgtccgcgcaattcttgcattattaaccgcactttttatctcactttggattggccctaaagtgatcaaacgtttacagatcttaaaatttggtcaagaagtgcgaaatgatggccctgaaagtcactttgcaaaaaaaggcacacccactatgggcggtgtgatgattttattctctattggcgtaagtacgttattatgggcaaatcttgctaattcttatatttgggtttgtttatttgttttatttggatacggcgcaattggttttgtggatgatttccgtaaaattacccgtaaaaatactgatggattgattgcgcgttggaaatatttctggatgtctgtggtggcattagtggcaatcctttggctttattggcttggtcacgacactgatgccacccgtttagtgattccattctttaaagacattatgcctcagttaggtttgttctatattgtgttatcttactttgtgattgttggaaccggtaatgcagtgaatttaaccgacggtttagatggattagcgattatgcctactgcgcttgttgcaggtgcgtttgctttaattgcttgggctacaggtaacgtgaatttcgcagaatatttgcacattccgtatattaaatacagttctgaagtagtggtgttctgtacagctattgttggcgcgagtttaggatttttatggtttaatacttatccagctcaagtatttatgggggacgtgggttctctagcattaggtggtgcgctgggtgtcgtagcaattcttgttcgtcaggaatttttgcttgtgataatgggtggtgtatttgttgttgaagcactctctgttattttgcaagtagggtcttataagttacgcaaacaacgcatttttagaatggcaccgattcaccaccattttgaattgaagggatggcctgagccaagagtgattattcggttttggattatttccttaatgttagtgttgatgggattagtcaccttgaagttgcgttaataaatgttgtgaggttcgctctttcagtttttgaaagagcgagcttttacgttataaattgatattcccatcagcaaaatttaaaacttatagtaattaagaagaaataaaatgaatgcctatcaaaacaaaaatattacgatcattgggcttggcaaaacaggtctttcttgtgtggattatctcttatcccaacaggctaatattcgtgtgattgatacccgaaaaaagcctactggtattgataaacttcctcaaaatatccctcttcatactggtagtttaaatcaggaatggttacttgaaagcgatatgattgttattagcccagggcttgcggtaaaaacaccagaaattcaaaccgcacttaaagcgggagtggaagtaatcggcgatattgaattattctgccgcgcagcgacaaagccaattgtggggattacaggttcaaatggaaaaagtactgttactactttagtttatgaaatggcgaaagctgctggcgtgaaagttggtatgggcggaaatattgggattcccgctttgtcattgttgaatgaagattgtgaactttatgtactagagctttctagttttcagcttgagacaacttatagcttaaaagctgcggctgcgactgttttgaacgtgactgaagatcatatggatcgctatatggatttagaagattatcgccaagcaaaattacgcatttatcataatgctgaggtcggagttttgaataatgaggataagctgacttttggtgaaggtgaaaatcaagcgagacaaaccgtttcttttgcggaaaatagtgcggattattggctaaaaactgaaaatggcaagcaatacttaatggtaaaagatgaagtaattttgccttgtgaagaagtaacattagtcggtcgccataattatatgaacattttggcagcaacagcattggcacaagctgtcggtattaatttagattcaattcgtaccgcacttcgtcatttcaaagggttagatcatcgttttcaattagtgcatcaagctaatggtattcgttggattaatgactctaaagcaacaaatgtggggagtacagttgctgcattagctgggctttatattgagggtaaattgcatttgttgctaggcggagacggaaaaggggctgatttttcagaattagctgaattaattaatcaaccacacattatttgttattgttttggtcgagatggtgtgcagcttgcaaaattttcatcacaaagctatttgtttgaaacaatggaacaagcgatagaatttttacgcccaacattgcaaagcggagatatggtattattgtcgcctgcttgtgcaagtctcgatcagtttgcttcttttgaaaagcgcggcgaagaatttacgcatttagcgcaatattcagcctaatttagtcattaataaaaataagatggaatttttacagaacatcaaaaaaaattacgatgaatggacacgcatcacacctcaaggtttgttgtatgatcgcgcactattttggttatttgttattttgcttttaattggtttagtggcagtaacatctgcttctattccttatagctctcgtttatttaatgatcctttttactttgcaaaacgcgacgctatttatgtgctactttctttgctcacttgttatatttcattacaaatttcttcttcgcaatgggaaaaatggcacgctaaaatttttttattttctgtcatattattattgcttgtcccttttatcggtacatcggttaatggcgcaaaacgttggatttcattggggatcttaaactttcaacctgcagaatttgcaaaattggctttgacttgttttttagcaagttatttcactcgtcgttatgatgaagtgcggtcgcgacatgttagtatttttaaaccgtttattgttatgcttgtattgggttgttttcttttattgcaacctgatttaggtagtacagtcgtgctatttattattatgtctgggatgctttttatcgtaggggcgaaaattttacagtttgtaggattgatagcattaggtggaatcttattcgtttggctagtattgaccgcctcttatcggttaaagcgatttataggatttttagaaccctttaaagatccttatggcactggtttccaattaacaaactctcttatagcatttgggcggggagaaattactggcgaaggattaggtaattcaattcaaaaattagattatctgcctgaagcacataccgatttcattatggcgattatcggcgaagaatttggatttatcggtatattgattgttattcttttattaggtttattaatttttcgtgcaatgaaaattggacgagaatccttaatgttagaacaacgttttcgaggtttttttgcattaggtattggtttttggattttctttcaaggctttgtgaatttaggtatggctcttggaatgctaccaactaaaggtttaacctttccactcgtgagttatggtggttcgagtattatcattatgtccgccactattggtattttattgcgaattgatcacgaaaatcgtttatttcgtataggtcaagcacgcttgcgtgatgattagagataaaaaagatgaaaaataaaaaattattagtgatggcgggtggcactggcggtcatgtttttcctgccattgcagttgctcaaactttacaaaaacaagaatgggatatttgctggttaggtacgaaagatagaatggaggctcaacttgtaccaaaatatggtattcctattcgatttattcaaatttctggtttgcgtggtaaaggtataaaagctttgttaaatgcgccttttgccatttttcgtgccgtgttgcaggcaaaaaaaattattcaagaagaaaagcctgacgctgtacttggtatgggaggctatgtttctggccccgctggcgttgcggcaaaactttgtggtgtaccaatcattttacatgaacaaaatgcgatagcgggtttaacgaataagttattaggtaaaattgcaacctgtgtattacaggcatttccaactgcttttcctcatgctgaagtagtaggaaacccagttcgagaagatttatttgagatgccaaatcctgatattcgtttttcggatcgtgaggaaaaattacgtgtcttagtggttggtggtagtcaaggagcgagagtgcttaatcatactttacctaaagtagtcgcccagcttgcagataaattagagcttcgtcatcaagtaggtaaaggtgcggtagaagaagtcagccaactttatggcgagaatttagaacaagttaaaataacagaatttattgataatatggcagaggcttatgcttgggctgatgtggttatttgccgttctggcgcattaaccgtatgtgaaattgcagcagtgggagtcgcagcaatttttgtaccattccaacataaagatcgccaacaatatttaaatgcgaaatatttatcagatgttgacgcggcgaaaattatagaacaggcagatttaacgcctgaaatgctagtgaattatttaaaaaatttaactcgtgaaaatttattgcagatggcattgaaagcgaaaacaatgtcgatgcctaatgcggcacaacgtgtagctgaagtaattaaacaatattcaaactaggggttgtggcgttttataaatagcctcagtcataagtattttttatatccaaaagtgctaatattagaaataaaaacgttgcgaattttaaccgcacttttagttgagttttgtcattgggagaaaaggaaaaataaatgaaacattcccacgaagaaattagaaaaattatccctgaaatgcgccgtgtacagcaaattcatttcattggcattggtggtgcgggaatgagcggcattgcagaaattttattaaatgaaggttatcaaatttcaggttcagatattgccgatggcgtagtcactcaacgtttagctcaagctggggcaaaaatctacattggtcatgcagaagaacatattaaaggtgccagtgttgttgttgtgtctagtgcgataaaagatgataaccctgaattagttgcatcgaaacaaaaacgcattccagtgattcaacgcgcacaaatgttggcggagattatgcgttttcgtcacggtattgctgttgcaggaacacacgggaaaacgacaacaacagcaatgatttcaatgatttacacccaagctaaacttgatccgacttttgtaaatggtggtttagtgaaatcggcgggtaagaatgcacatttaggggcaagtcgttatttaattgccgaagccgatgaaagtgatgcgtcgtttttgcatttacagccaatggtatctgttgtaactaatatggagccagaccatatggatacttacgaaggcgattttgaaaaaatgaaagccacttatgtgaaattcctgcataatttaccattctatggtttagccgtgatgtgcgctgatgatcctgttttaatggaacttgtgccaaaagttggtcgccaagtgattacatatggttttagtgagcaggcagattatcgcattgaagattatgaacaaacaggttttcaaggtcattacacagtgatttgcccaaataatgaacgtattaatgtgttgctcaatgttcctggaaaacataatgcattaaatgcaacggctgcacttgctgtagcaaaagaagagggtattgctaacgaggcaattttagaggctctggctgattttcagggggctggtcgtcgttttgatcagctaggcgaatttattcgtccaaatggtaaagtgcgtttagttgatgattatggtcatcatccaacagaagtagacgtaaccattaaagcagcgcgagaaggctggggagataaacgtattgtaatgattttccaaccgcatcgttattcgcgcactcgtgatttgtttgatgattttgtacaagtgctttcgctagtagacgctttgattatgcttgatgtgtacgcagcgggagaagcccctattgttggcgctgacagtaaatctctttgccgttccattcgtaatcttggtaaagttgatcctattttggtatcagatacttcgcaactaggcgatgttctcgatcaaattattcaagatggcgatttgattttggcacaaggtgctggtagcgtaagtaaaatttctcgtggcttggctgaatcttggaagaattaatgccagatggattgattgaaaatcttagtattagaaaagtatcatcagtaagaagaacaggatagaaaatgaacttaaaacaagaaaaaatcgcggtgttattaggcggcacatctgctgaacgtgaagtttctttcaattcaggcaaagcggtattagaagcattattaaagcaaggttataatgcacatcctattgatcctaaagaatataatgttgcaaatcttaaaaaggatggctttaatcgagcatttaatattttgcacggtcgtggtggagaagatggcacaatgcaaggtttattagagcaaattggtttgccttatacggggtgtggcgtgatggcttctgcattaacgatggacaaaatgcgtacaaaaatgttgtggaaagcttttggtttacctgttgcagatatgaaagtggttacccgagaaactttttctgaattagatcctcaggctgttgtggcaaaattaggcttaccattaatggttaaaccctctttagaaggctctagcgttggcttaacgaaagtaaaagcggtagaagagttaaaaagtgcggtggaatatgcgcttaaatttgataataccattctaattgaagagtggttagctggcgatgaattaactgtgcctgtgcttgacaatcaagtattacccgcaattcgtattgttccagagggcgaattttatgattatgaagcgaagtatatttctgataatacgcaatatttctgcccagcaggtttaacgcctgaacgcgagcaagagttagcaatattagtaaaacgtgcttatgatgcactgggatgtcgtggttggagtcgtattgatgtaatgtgtgatgcaaaaggtaatttccgtttggttgaggttaatactaatcctggaatgacgagccatagtttattcccaaaatctgcagcgacagtaggtatttcttttgagcaactcgtcgtgaaaattttggagttgagcctgtaatgaacattctgaaaagaaaaacgccacagaatattcgttttggagaacaaaagcctaaatattattttcatattcgggcttttgcggtattgcttggtgtcttttttttacttggtgtttattttaattggcaaagcattttagaaaaaatggatgataagccgattagtgcatttgcacttgttggacaaaatacctttactactgctgatgatattaaagaaagcctattaaaaatgggcgaattaaaaggattttgggggcaagatgtggcaccgattcaagagcaaattgaggctttaccttgggttaaaggtgcaatcgtaagaaaaatgtggccaaatcgtttaagtatttgggtatcagaatatcaacctgttgcgttttggaatcaaaatcaatttgttacccttgatggtatcgtttttcagcttccctctgtacgtttaactgcaaaaaatttgccctatttgggcgggcccgattatcagagtttgaaagtaattgagacgtggaaccaaatttatattaatttaaaatcaaataatataatggcaaagggaattaatattgatgatcgcggtgcgtggcagatccagcttgataatgatattgtgctaaaattaggtcgtggcgattggaaatcaaaacttgagcgatttgtcacaatttatccgcaaattgatgtgccagaaaacaaaaaaatagattatatagatttaagatatacggcaggtgcagctgtaggtatggttgatagataaaaataactgggtgcgaaaatggttaaaggtgtggaaacaaaaacaatagtaggtttagaggttggcacgtcaaaagtggtcgctgtagttggcgaagtatttcctgatggtgtagtgaatgtgcttggtgtaggcagttgtccttcaaaagggattgatcgtggcagcatcactgatcttgatgccgtagtgggttcgattcaacgtgctattgaagcggcagaatctatggctgattgtcagattatgagtgtgactttagctattactggagagcatattcaaagcctcaatgaaagtggttttgtgccgatagcagaaagtgaagtaacacaagaggaaatcgattccgcacttcatacagcaagctcaataaaattgccagaaggcttatctttattgcatgttattccacaagaatacgctgttgatcgtcagatgaacattaaaaatccattgggattacaaggcgtgcgtttaaaagcacaagtacatttgatcgcttgtcatcaagattggcaaaataacttaaaaaaagccgttgaacgttgtggattgcaagtggataaagtggttttctctggttttgcagcaacacattctgtgctaactgaggatgaaaaagatctcggcgtgtgtttaattgattttggtgctggcacaatgaacgtgatggtttatacgaatggcgcattacgttttagcaaggtaattccttacgcaggaaatattgtgacaaatgatattgcgcacgcttgtacaatttcgcgagcagaagcagaacggatcaaagtgaactatgctagtgcattttacccagctcgtttgcacggagataaaaaaattgaggtggcaagtattggcggtcgtgcgcctcgttcattaacaaaaagtgatttatctttaattacatcagctcgttatacggagcttttaggcgtggtaaaagatgaattagataagttaaaagctgaattagaagcaaaacatattaaatttgaattaattgcaggtgtggtaataactggtggtggagcgcagattgaagatcttaaagaatgtgcttcaaatgttttccattgtcaggtgcgtattgcgagtccattaaatattactggtttgactgattacgtgaatcgtccacaatattcaacggtggtgggattattgcaatataatcacagtaatagtgatgatgatttaatttcaggaagtgatgattctgaaggaactttctttgaatctatttggcaaggagtaaaaaaaattgtcaataaagtgcggtcagaattttgattattttaatttttcatctacaataaagggaatttatattttatatatttagtcagcttatctggcagtaacggagaacatcaatgctatacccagagtaccctgagtacgataattttaacgaatccggcgcactgatcaaagtcgtaggtgtaggcggtggcggtggcaatgccgtaaaccatatggtaatgaatatggtaaaacaagaaatgggcggaacctttgttggcgaaagttcattaacatcagaggaacacggtcgcatagtattttatgccgtcaatactgatgctcaagcattgcgtaaaagtcaagttcaacagaccgtacaaattggtggagaaacaaccaaaggtttaggtgctggggcaaatccgaatattggtcgtaaggcagctgaagatgatcaggatgaaatccgtaaaatgcttgaaggtgccgatatggtctttattgcagcaggtatgggtggcggcacaggtacgggtgcggcacctgttgttgctaaaattgctaaagaactgggtattttgactgttgctgtagtgactaaaccttttgcctttgaaggcaaaaaacgtatgcaatttgcagagcttggtattaaagatttatcccaatatgttgattcaatgattattattccgaatcaacaaatccaaaaagttctccctaaaaatgctaaattaattgatgcttttgctgctgcaaacgacgtattgcgtaattctgtaatgggaatttcagatatgattacctctcctggtttaattaacgtggacttcgctgatgtaagaacggtaatgtcagttcaagggcaagctatgattggttttggttcagcggtgggagaacccggtgcgggtagagcagaagaggcggctcgccttgcggtacgtaacgatcttctagaaaaaatcgatctttctaacgctcaaggaattttagttaatattactgctggaatggatttagtttttgatgaatttaacattataggtgagacaataggaagctttgcttctgaagaggcgacggttgttgttggtacgagtttagtgcctgagatgagcgatgaaattcgtgtaactattgtggcaactggtcttggtgaaattgcaggaaatgagccaattcaagttgttcgtcaagggctttctacgcagaatattgaaggcgaagggcgtgtaaacattgttcctgaacttcatcgtcgtgaatctgttgaagtgtcaaggtctgcatcagaagaatatcaacgaccgttagataaaccgattacagatcgcttggaagcatttaagaaaaataatttttttaatcctgcacagcgtgaagaaaattaataagtttcagaaaatacctagtaaatgaaggtagtagaatgattaaacaaagaacattaaaacaaagtattaaagtaacaggcgttggcttacatagcggtaataaagtgacattaaccttacgcccagctatgccaaacacaggtgttgtttattatcgtacagatttaaaccctgcggtggcatttcctgccgatcctaattcagtgcgtgatacaatgctctgcacagcactaattaatgatcaaggtgttcgcatttctaccgttgagcatttaaatgcagctttggcagggcttggtattgataatatcattattgaagttgatgcccctgaaattcctattatggatggcagtgctagtccgtttatctatttgttgttagatgcgggaattgaagaacaaaatgcagcgaaaaaatttattcgcattaaagaatatgtacgagttgaagatggcgataaatgggctgaatttaaaccttataatggtttccgtttagatttcactattgattttgaccatcctgctattggcaaagatgtacgtaactatgaaatgaatttttctgcccaagcatttgttcatcaaattagccgagcaagaacttttggctttatgaaagatattgaatatcttcaatctcaaggtttagcattaggtggtagccttgataatgcgattgttcttgatgattatagaatcttaaatgaagatggcttacgctttaaagatgaacttgttcgtcataaaatgttagacgcaattggcgatctttatatggctggttataacattatcggtgattttaaagcctataaatcaggtcacggtttaaataacaagttacttcgtgctgttttagcaaatcaagaagcgtgggaatttgtaacctttgaagataaagagcaagtgccacaagggtatgtagctccagcgcaagtgcttatttaattgttttattgttgaaaaagctatatttctggtgggaagtatagcttttttatttcatctcgcgcttaaatatcgaatgtactaaaagtgcggtcaatttcgtgggattttttataaggaagcattatggcattagaattatctgacattcgccaacaaattacgcaaatagatcgtagtttattaaaattactttctgagcgtcatcgtttagctttcgatgtagtgagaagtaaagagatctcgcaaaaatctttacgtgatgtagagcgagaacagcaacttttacaagaactagtgcaatttgcagaaaatgaaaattatcagcttgaagcacaatatatcacttcaattttccaaaaaatcattgaagactcggtattgacccagcaagtctacttgcagaataaacttaatgaacaacgtaatcaaaatttacatattgcttttttaggtaaacgtggttcttattctaatttagctgcacgtaattatgctgctcgttatcaaaaacaatttgtagaactaggatgtcagtcttttgatcaagtatttgaaaaagttcagactggagaagctgattttggtgtattgcctttagaaaatacaacatcgggtgcaattaatgaagtttatgatttacttcagcatactgatttatcattagttggagagttggcttatccaatcaaacactgtgtgcttgtcaatgataaaacagatttgagtcaaattgatacgttgtatagtcatcctcaagtgattcaacaatgtagtcaatttattcatagtcttgatcgtgtgcatattgaatattgcgaaagcagttcacacgcaatgcaattagtcgcaagtttgaataaacctaatattgcagcattgggtaatgaagatggtggaaaattgtatggacttagtgtattaaaaactaatattgctaatcaagagaacaatattacacgttttattgtggtggctaaagatcctcgcgaagtttcatcacagattcccacaaagaccttattattaatgacaacttcacagcaagctggcgcgttagtggatgctttattggtgtttaaaaagcatcaaataaatatgacaaaattggaatctcgaccgatttacggtaagccttgggaagaaatgttttatctagaaattgaagcaaatatccatcatccagatacgaaacaggctttggaagaactaaaaaattatagtaattacttaaagattttaggctgttatcctagtgagattgtaaagccagtgagcgtgtaaaaaaagtgcggtcaataaaaatgatgtttttatgaccgcactttttatatttttttgttccgttctaaagatttatgttgaatttgtaccgtttttcctttggcttgaaaatattcgcctaactgctgggcaatataaacggagcgatgttttcccccagtacatccaatggcaatcgtcaaatagctacggttatttttttctaacattggcaaccaagtatcaatgtaatgacgagtgagataaataaattcattgacttctgtatgactatttagaaattctgcgacaggggcttctaatccagtcattgggcgtaatgttggatcccaatgggggttaggtaaaaagcggacatcgaaaacataatccgcatctaaaggaatcccatatttaaaaccaaaagattcaacaataatttttaattctttttcactattatcgcgtaaaaattcgcgtaatcgttctgcaagaatatgcgtagaaagatgggtggtatcaagaataagatttgcgtgttgaatcaatggctcaagatagcgatattcttcatctattgcagcttcaagagatagatcttttaatgaaagcgggtgcaaacggcgtgaatcgctatatcggcgaatcagggtagcgcgatcagcctctaagaaaatgattttaatttgatgatgcttttgtaacgttgaaagggtttgctcaagagaattagcggagcttggaatattacgaatatcgagactaatggcgaccgaagattgagattgagacagaatatcagtcaattgaggaagcaaatctaaaggaatattatcaacacagtaatatcctgtatcttctaatgctcgtaaggctacagattttcctgcaccagaacgcccactaataatgataatttccataaatttccccactgtaattattctttcacttcttcaagtgtcgtttctgattgatcggtaatttcaaaaacttgccaaatttcatccgcacttttggctgatcgtaattgtttcaacacatttttatcagtcagtttttctattaatgatgctaaaactggaatgtagctttcacattgattttctggaatcagtaaggcaaagattaagtccactggtttactatcaacagcatcgtaatcaatcggattatcgagttgcataaacactgcgattgctttatctgatactgttacggggatttttgcttttggcattgcaatcccatttcctaaaccagaattccccagtttttcacgttcaaaaaggcattcaaaacaggcttgttcgccttgttctgcaaggatttgttcttctacaaaatgcgcaatagactcaaataatcgttttttgctagaaaaactaacgccctgacgaatattctcagagcttaatagttcagttattttcatttttataatttgaattgttcgccaagataaactcgtttaacctgttcatcgttcatcacttgtgccggtgtacctgttgcgataattttacctgcaccaacaatataagcgcgttcgcaaacatcaagggtttcacggacattatgatcggtaatcaaaacacctaatcctcggttacgtaagtcggtgataatttttttaatatcgctcacagaaataggatctacaccagcaaaaggttcgtctaatagaataaattttggatttgcagctaaggcacgtgcgatttctacacggcgacgttcgccgcctgataaggcttgccctaaattatctcgaatatgactaatgttaaattcttcaattaattcatctgctttttcgcgacgttgttgtggggttaaatctttacgaatttccaataccgccatcaaattttcatagacagtcaaacggcgaaaaatcgaggcttcttgcggtaaataaccaatgccacgttgcgcacgattatgcattgggagcaaactaatgtcttcgccatcaataacaattttgccttgatcttggcgaacaagcccaacgaccatatagaacgtggttgttttacctgcaccgtttggcccgagcaaaccgacaatttcattagaatttacggttaaactgacatccgaaacaactttacgacttttgtagcttttagctaaattctctgcagtcaaaattgacatagattacttccctttagcttgttgtaattgagatggaataagaactgttgttacccgtgattttccattaccattagctttaagttgttgtttcttcacatcataggtaataacactgccattaattttactatcaagctgctttaattcggcattgttagttaatgttaaaaattcgttgccaagatcataatgaactttatttgcttttccatctattggagtgccattatctagctgttgatggaatgtgactggcgtaccaaatgcttctacagtttcttttttccctgatttttcagcgggacgagtgataacaactttatttgctttaatgatgatagatccctgtgtaattactacattatctgtgaatgtcactacacttttttccatatctaaggattgattatccgaaacgatatttatcggctgattaacgtcatctttcaatgcaaaagctgaacttgatgctaataccatcgttgcaagaaaaagaattttattgcttactaacttcataatatgtttttacctgttcctttaatgtcgccacttgttggcgtaaatttccgactaattttaatcctgtagaactaaaatttttccccttaattttaacctgtgtttcggaagtcatatcctgtgtttttaaattgacgaccgctgattctgtttcaatgcgttgcaaacgagaatctgatgttaaactttgcacgacgacattaccctctaaatacaatatttgatcttttgtcaatcttgcttgatttgcgcttaatttccagttttgtgtgctaaaaaaatctacattttgattgggattttgttccttttcatttgatgttgtgggatataaataaactaaaggcgcggtaaaaagggtttgttcattgactgtataatgctcaattttatcggataaagccaaatattgttttttaccctcaggggaaaaaaccgttgtttccattttataacccacataatcaggactatctggttttttcacaagttcagataaatctgcggtttcctgatttaaggaataaaaccacgccaaagcacaaagtgcgataacgcccaaaattacattccaacgaatattcattttatttcaatcacttatccacaaagtgcggatgaaaatttcaatgtttttaatcttccaacattaataccttgagcatttgataaatttctcgataggcttttgatggtttattttgttccagttctttttgtgcagaacgaatcagattgcgtagttgctgacgatcgccatcaggataatcatttagtaaatcagttaaagccacatcacctttttccaccaattcatcgcacactttttcgattttgtgcaacatagcttgttgttgattatgcttattttcaattttatctaaggcttcacgaataggttcaacatcaattcctcgaaataatttgccgatatactgtaattgacggcgacgagcttctttttgtaaacgctgtgcaagttcaatggcatcaagtaaggattcatcaagtgggattttggcaagattagctttggttaaattgacaatcttttcgccaagttgttttaaatcttccgcatcgcgtttgatttcgcttttactcacccaaataatttcttcttgatcttcatcttcccaatcgaaaacttcttttttcttacgttttgccattttttatcctttataaaaattggtgcacattttaccataaactttgaaaataagataaaatgttgaaaatttttaataggaaaaaataatgaaaacagctgaaaattcaaccgcacttttaaaagcacaagaacaagaattacgtcaagccgtcagttttgcagtggcgttagcaacgaaagctggcgcgagtgcagaagtcgcggtcactaaagtgagcggtttatctgtatctgctcgtttgcaagaaattgaaaacgtagaatttactaatgatggtgcattggggatttctgtttatatggggcaacaaaaaggcaatgcctcgacttccgatttaagcgaaagcgcaattaaaaatgcagtggaagccgcacttgctattgcaaaatacacctcgcctgatgattgcacagggttggctgataaagatctaatggcttttgatgcgcctgatttagagctttatcatgctgctgatgtggatgttgataaagcaacagaacttgcacttcaggctgaaaaggcggctttagaggcggatgaacgtattataaatagtaatggcgcaagttttaattcacatacaggcgtgaaagtgtatggtaatagtcacggtatgttgcaaagttatttatcaagccgttattctttatcttgttcggttattggtggcgtagaagctgccttagaaaatgattacgaatatacaatttctcgtgaattcgacaaactccaatcgccaatttgggtcggagaaaattgtgcaaagaaagtcgtttctcgtttaaatcctcaaaaattgagtacacgagaagtgcctgtcattttcttaaatgatgttgcaactggtcttatttctcactttgccgctgcaataagtggtggcagtttatatagaaaatcgagtttcttgctcgatcatttaggcaaacaggtcttaccagattggttcaatatcagtgagagaccacatttattacgtcgtttggcttcaacgccttttgatagtgaaggtgttcgtacgcaagatcgtgaaattgttgaaggcgggatattacaaacttatttagtgacaagctacagtggtaaaaaacttggtatgccaagtacagggcatgctggaggcattcacaactggcttgttaagccaaatttaacgggaggattgaccgcacttttacatcaaatgggaacgggattgttagtaacagatgtgatgggacaaggtgtcaatatcgttacaggcgattattcccgtggtgcatcaggtttttgggtggaaaatggtgaaattcagtatccagtggctgaaattaccattgcagggcaactacaagatatgctgaaaaatatggttgctgtagccgatgatatagagcatcgttctaacattcaaacgggttctattttgttagataaaatgaaaatttcaggaaattaagaatatttttgaaattgagaataattcttattgacaatgaataaatatctgttactatacacacatctgttaagcgattgcaggttgctccaacaggtagagtagaaagtaaattcgttagggttcaaaaaggctgaaggtttaaacttcagtcttttttattttttgattttttattcgccaaaggaagtttttcagtttataggctgggctttagcccaccctacaactaattaaaaacgtggtgtcgcgggatataacaaactcgtgggctaatgtagggcaggaatacaaaggctgaaggtttaaacttcagccttttttttgtaaaatagcaaacgattttatcccctatcatttcataaggaaacacaatgaaaaaacaccacgtagatgttttaatctcagagaatgatgttcatgcgcgtattgctgaattaggtgctcaaattacaaaattttatcaagaaaaacagatcgatagccttgttgtcgtagggcttttacgtggttcctttatgtttatggcggatatcgttcgtcagataaatttacctgtggaaattgaatttatgactacttcaagttatggcactggcatgaccacgaatcacgacgttcgtattaccaaagatttggacggcgatataaaaggtaaacacgttttaattgtggaagatattattgatacgggttatacgttggaaaaagtgcgtgatattttgaatttacgtgagcctgcgagccttgcaatttgtacgttacttgataagccttctcgtcgggaagtggaagtgcttgttgaatgggttggttttgaaattcctgatgaatttgttgtggggtatggtatcgattacgcgcaacgccatcgtaatttaggctatatcggtaaagttgttttagaagaataatttgattttattgaaaagtgcggttgaaattttaaatgaatttttagccgcacttttttatattatttcattgctattttctcgatcacttgctaaatctttttacagcaaatacagccattatattgataatcttgctggggcaattttcttatttttcggcggctatttagtttattcaggcgtgctagccactgcagccgcattttaattaccaaaaagtataaaatataacgaaagaaaacttgttatttttactgaagttgatagtctccaaacactttaatcagttttggagattttttatgttattagtcaatttggcgatatttattgcttttttattgctgttagcacagctatatcgcaaaaccgaaaaattagggcaaacggtatttatcggtttattgctcggtttgctttttggtgcggtattgcaatccgcttttgaaaaacctttgttagacgaaactttagattggatcaacgtggtcggtaacggttatgttcgtttattgcagatgatcgtgatgccgttggtgttcgtgtcgattttatctgctatcgctcgtatcaatcaaaccagatcattgggcaaagtcagcgttggcgtgttatccaccttgctgattaccaccgccatttccgctgcaattgggattgcgatggtgcatttatttgatgtgtcggcggcaggattaatcgtgggcgatcgtgaattagcggctcaaggcaaagtgttagataaagcagggcaagtgtccaatttaactgtgcctgcgatgttggtgtcctttattccgaaaaatccttttgctgatctcacgggtgccaacccaacgtccattattagtgtcgtaattttctcagcattacttggcgtggcggctttgagtttaggcaaagaagatcaagcacttggcgaacgaattgcacaaggtgtagaaactttaaacaaattagtgatgcgtttggtgcgttttgtgattcgcttaaccccttacggcgtgtttgcgttgatgattaaaatggctgccacctcaaaatgggcggatattgtcaatttgggcaattttattgtggcttcttacgctgctattgccttaatgtttgtggttcacggcattttattgttcttcgttaaagtcaatcctgtggattactacaaaaaagtgttgccaaccttaagttttgcgtttacatctcgctcaagtgcggcgacaattccgttaaatattgaaacgcaaaccgcaaaattaggtaacaacaatgtcatcgccaactttgctgcctcattcggtgccactatcggacaaaacggctgtggcggcatttatccagcgatgcttgctgtaatggtcgccccaatggtcggcattgacccttttagcttcagctacattctaaccttaattttcgtggtcgccatttcttcattcggtatcgcaggcgtaggtggcggagccacattcgccgctatcgtcgtgctatctacgttaggtttaccactggaattagtcggtttactcatttccatcgaaccgatcatcgatatgggacgtaccgcacttaacgtaaacggtgccatggtggctggcacgattacggatcgcttgctaaataagtaactggaaatcaataaaaaaatctgcaattgagaattcagttgcagattttttatcgctcaatacttttgactaaaaagtgcggtggttcttttcagtgttttataacttaaatcgatgaataatttgatttgcggaacctcgccaaactaaacttgggtcagcctgttcttgaataaatttcccatcaattaatacatcaatataaggcaacatagcacgttgttgttcgtctaattcatctagcttataacccgtccaaacccagatgtctttatcggggcattctcgttttacacgttgcacaaagggcaataatgtttctatgttacggggatgaagtggatcgccacctgaaagcgtgagaccttggcgtttaatgcgtgtgtcttttaaatcattgatgatttgttgttccattgcgtcatcaaataatacacccgctgaaaatgaccaacttttttggttgtagcaacctttgcaagcgtgcgtacagccactgacgaaaagtgtgcatcttgtgccttcgccattaatcacatcggtcgggtagtattggaggtagttcatttcataaaaatcctaaaaaggtggcttaaattctcgccaaattcaccgcactttttaattaatctttgcaatatgacggtaatttttgcataatagtgcgaaatcgcattgcgatatcaatggaaaccttctcggtctctcgcaacggtgtctggtttactcggtcaggtctggaaggaagcagccaaagtcggaattactgtgtgccgagaagaagctgggaaggtttccgcccaacttccttttctcatactcgctcaatcaatcttttaaagaaaccattttctttagtgattaaactattgtaatcgccttcttcgattaatcttccgctatcaattacacaaattttatcgaattgttcaattgaactgagacggtgagtgaccataattagggttttattttcggcatgttgcagaattaaacgtaaaatttgacgttcagtttcgcgatctaagccttcagtcggttcatccaataataaaattgacgcattattgagtaaaatacgcgctaaacctaaacggcgttgttccccaccagaaagtggacgaccgccatccccaagccaaagatttaaaccttttccctcttgctcaagtaatttacttaagccaacttgatgtagtacttcaatcatttgttcatcagaaattttatccgcacttgcaaattgtaaattttgacgaagtgtatcgctgaatacgtgaacacgttgagttaaaaaacaaatttggcggcgtaatgtctcttctgaataggcggaaatgggtttttctgccaataaaagttcaccttgattcgcatcataattgcgtactaaaagttgaagaagtgaagattttccacttccagttttgcctaaaatagcaatttttttgccctgttctaaatctaatgtaagattttttaatacgagtgtttcttgttcgggataggaaaaatttaaattcttcgcagaaattaaccgcacttttgtttcaaattcctcgttgccattaaactcaacaatcggtttttgctcaatgatttcggtcacacgttctgctgccgcaataacttgacctatatgtaaaaatgctgcccccaatggcatgataatctcaaaggcggcaagtgcagcaaaagtgaaaagtgcaatataagccgtgcgatattcatctgtgccaaaatcggcgttacttgcaaaccatagcattccagaaatcaacaaaccattaagaaagagaacaagtgcggtagagaatccgcttaattttgcttctttggcttgatcttcctgccatgttttttctgtggctgacattttttcttttaatctatcttccgcattaaataataaaagctcggcttgtgcttggataaattctaaaaactgggttcgataggtcgcgcgtgcttggattaagcgttcgccaaattgctgtcctagtcgatagaaaacagttgggataatcattaataaaattaataaaaataagcctaaaccaagtgcgagtggaatattgataaagctaagtccaatggttatggcaatgattacaaatacagcagtgaaaaatggcgcaagtaaacgtaaatagaggctatcaagggtatccacatcggaaactaaacgatttaataaatcgctgttgcgataacgatttaataccgctgggcttaaaggaatgattttttcaaatacttgcacgcgtaatttggacaaaatgcggaatgttgcatcatgcgttactattttttcaaaatagcgcatgacggttcgtccgatagctaaacctcgcacactggctgaaggatagaaaaagttaaatagcgtgcctagtcctgcaatggctgtagcggctaaaaaccagcctgaaacggtaagcaagcccatactagagcccaaacctagaatcattagcaccaagcctaaaataagcgggaatttggcgaatttaaataaacgtataaacggaagtaatgtgcgcattattggatatcctgttgtcgttgagcgagtagttcagcaaagaaaccttgatgttgtaattcggtaaatttaccttgctgtactatttctcctcgttgcatcacaaaaatttgatcacattgtttcaaatcttcaattcggtgtgtaatcatcagtgtagtttgatgctgacttgcttcattcaatgcttgtaaaacaagattttctgattgcgcatctaggcttgcggttggctcatcgagcagaagtaaatcgcctttgcgtaacaatgcccgagcaatggcaaggcgttgcgcttgtcccacagaaatgcctaatccaccatcttttatttcgtgatgaagtccaagtttatcggtaaattctttcgcttgagaacgcattaaagcttgattaatttcttcatcgttggcttgaatattgccaagtagtaagttttctttaattgtgccttgtaataacaatggattttgtcctacccacgcaatatgtttgcgccagtcagctagattactttcgcgaagttcttgcccattaattttgagcgagccctcataaggtaaaaagcccagaatcgcatttattaatgaagtttttcccgcgccactttgtcctacaagcgcaacattatgatttgctggaatttggaagtttaacggcttggttaatgctgaaccctgtgtcgaaagcaccactaaattttcggcagaaatttcaaccgcactttctaaagaaattgttttttcattttgatgtacagttaaataatcagattctaaaaaatcaacaatggcatccgctgcaccaatacctgctgcacggtcgtggtaataggtgcctagatcgcgtaagggttgataaaattcaggtgcaagaattaaacaaaagaaacctgtgaaaagtgtaagcggtgcattataggtaccaaattcaatttgacctaagtagctaaaaccaaaatagaccgccatcagtgcaatggaaatagaggtaaaaaattccaatactgcagaagagagaaaagcgagttttagcacatccattgtggtttcacggaaatcttcagtggcattttcaatatgctcagtttgttcagaagtgcggttaaaaagacgcaaggtttccaaaccgcgtaagcgatctaaaaattgggcactgaggcgagaaagggtatccatatttttttggctgttgtcagccgcagcaataccgacaatgatcataaacagaggaacaagcggtgcggtaatcattaagattaagcctgcagcccagttcaagggaaatacagcaatgaaaataaccactggaacaatggctgaaagactttgttgaggcagaaaacgggcatagaaattatgtaagttttcaacttgttccaacataatgcttgcccaacttccagctggtttttgattgattgtcgcagggccgacaagatgaattttatccagaattttttgacgaatatggttgcgtaataattgtccgctttggaaacctattttttcgcgtgcccataaaataatagcacgcatcccgaagccgataattagcccgagaaaataaggaataagttcatcacgaggcacattttgcataatcagtttatcgagcaacgtcgcaagaaaataagtttgtgcgactaaaatgaatgaagaaagcgtagctaagacaatgtttgcacgcattaattttttgataggttcttgttgtgcgcgaagccatttttgtaaatatttttggcgaagtttattcattgttttggtcgtgattatagaaaaagttcccctctttaaaagagttaaaagaggggaattggttagaagatttatgcttcttgagcatctaaatagcgttctgcatccaaggctgccatacaaccagttcccgcggaggtgatggcttggcgataattgtgatccatgacatcgcctgctgcgaacacgccttccacagaagtggcggttgcatttccttcaagaccagattttacaacgatatagccattatttaattctagttgcccttggaaaattttcgtatttggcgagtgaccaatcgctacgaataagccatctaatttgagttcttctttctccccagtttttgtgttggctaaacgtaatccggttacgcccatgttgtcacccaacacttcatctaaagtgcggtcagtatgaagaacgatttttccttcttccacttttttgtacaaacggtcgataaggattttttccgcacggaagctatcgcgacggtggattaaatgcactgtacttgcaatattggctaagtaaagggcttcttccaccgctgtatttcctccaccaatgacaccaacaggcttattacgataaaagaaaccatcacaggttgcacaagcagaaaccccacgacctttgtagttttcttctgaaggtaagccaatatagcgtgcagaggcacccgttgcgataattaatgcatcacaagtgaaattttgcacatcgccaaaaagtttgaatgggcgagaagataaatctacgcgattgatatgatcgaagacgatttctgtttcaaatttttctgcatgttgcaacatacgttgcattaaacctgaaccagtagtcatctcaaaatcacccggccagttctcaatttcatctgtggtagtcagctgcccaccttgttgtaaaccagtcaccagtacgggttttaagtttgcacgtgccgcataaatggctgctgtataaccagcagggcctgagcctaaaattaaaagttttgcgtgtttgatatctgacataaagaatccttgtttgtagttaagtaataatataatgcaataagttgcattttactgattataaactttttgcttaataaagcagcgaataaagcaatcgacgaaatttatttgtcagcggatcagcattgcccattgcgcttaaaatagataaaaattgttgtttaacttcgccattctgcgcgcttaaatctgtttttaaaatgccgaaaagtagtgttaatgcttcttcatttcgtccagcttgatgaagttgtacggcaagttttattgcaatttcagctgttgggtttttagcataatcagcctgtaattgttggatttcaggtgtatcggctgcttgaatttgtagctcaatttgtgcttgtaatccgtgccaacggctatctcgatcttgcaatggaatttgatttaaaatttcttgtgctggctccgttttcttcattgcaatataggtttccgcatagagcagggcaacatcactgtttttcttatcggaaagttcccatgcgtctttcaacaatggcaatgcggcttcgtaattttctacttgcaagaaatctaatgcttgttggaattttaaatcttcctctttaggtaaaataatgcttaatcgttggattaatgatgctttatcaagcatgcctggaaatgcctctaatgcctgtgcttctttaaacaaataggtggttggcaatgcttggatgcggaattgtgcggcaatcatttgctctttttcacaatctacttttccaagaataaattgtccttgatattgttctgcaacttgctcaagtagcaccaaaaaatccgccgattctttatgggttggcgcgtaaaaattgatgacaagtggtttttctaaggattgttgcagtatttcagtaagattttgttcgttgatctcaacgataaaaggaaaatcagccatgttttatccttgtgaaaaaataatggctgattttagcaaagtgcggaagattttagaaacgttttaccatttctattattaagcaagtttttctaggatcaattttcccatcatttcaatatgtgtatgctctacatttagtgcgggaatatattgataagattgcccgccattggttaagaaattttctcgattttctttatcaatttcttcaatggtttctaaacaatctacggagaaacccgggcaaataacggcaattttttgaatgttctgtgttgcagctgattctaaaaatttatcggtgtaaggctgtagccattcttcacgcccaaagcgcgattgaaacgtcattccccattggttttctgttaagcccagcttattaacaactgcaatagtcgtttgtttacaatgttcacgataataatcgcccattttttcataacgcagaggaataccgtgataagaaaatagtaaaaattcatcggattttaaccgcacttttatggagtttgctaaggcgttaatgtaattttcatcaatatgataagaatggatgaaatcaaaaggcactaatcctcgttcttctttaagggcattagcgaaagcatcaaatactgcgcccgtggttgagctagagtattgcggataaagtggcaaaacaataattcgttcaacttgatttttaagcaaattttttaccgtactttgtattgatggattgccgtacgtcatggcaatttctacttgagcattgatattttgcgtatctaaataggcttgtaatgcgtctttttgttgtcgtgaaatggcaagtaaaggcgaaccttgttctgtccagattgcttgataatttttggcgatacgttttgaacgcaatggtaaaataatggctttaagcagtggataccatttgcaacggggtaaatctaccacgcgaggatccgttaaaaattgccataaataacggctgattgacttcggtgttgggctatctggcgtgcctagattggcaagtaatacgccgatttttgcggattttgtcataaattgattacggaaagggttaatctagaaacacaacaaagtttattctcttctgtgcggatgtcaatttgccaaacttggatatttctgcccaaattaattggcgtggctctcgcggtcactttacctgaactaaccgggcgaagatgattggcgttaatatccaatcccaccgcagttttgccttcttctaaacaaagcgaacccgcaagggaaccaattgtttcagctaaagcaacagaaacccctccatgcaatacaccaaacggctgcatagtacgataatccaccggcattgtcgcttcaatccaatcctcgccaaaagcagaaatttcaatgccaagatggctaactgcactgttggagcaaagttgatttaagttttcgagcgtgaagtttttttgccaaatcatgatgttcctttcattacgctaaaatttctaataatgcctgcacagggtgttttaacaccacatgttcataacgttttacctgactgcggcaagaataaccagttgctaaacaaaagtgcggatctttttcatgcagttttttgtgccaggatacatcgtagatttctcggctcattttttgattttgcacttcatgtccaaatacaccagccataccgcaacatcctactttttctacattaagttgttgtccaaatcttccaaaaatttcttgccattcttttgggctgtttggcataaaggtagattccgtacaatgctggaataaataccaatcgaaagtgcggtcagttttggcgatgttttttaacttctcttgtaaatccgcattttgtaatctttgttttaaccattcgtgtgcggtgagaacgtgaaaatcgccacgtttttcttgtagtgcttctttgtattcatctcgataagacagcacgatggctggatcaacgcccacaagaggaatgcctaattttgccattcgatttaaaaactcggcttggttttctgctgttttgctaaagcgttttaagaaacctttaatgtgcattgctttgccgtttggtttaaatggcaacagaattggtgtgaagcctaatttctgcgtaagcataacaaaatctcgtaccactttcgcatcatagtaagaggtataaggatcttgcacaataaataaaatatcgtttttttctaccgcacttaggccttccaattcttccaaggatttgccttgataatgaatttctaccagctgttgttgcaaattgggttcagaaagcaagggcaaatcggtcatgcctagcgttttttccactaatgtttgcgtgacttttagcttggtaaaataattaaagaattttgcctgttttgccatataaggcgcagcgatttctaaatttgccacaatgtgatcttttgcggggcgtaagtagcggctgtgatagaaatgaaagaatttcgcacggaaacttggtacatcgattttaatcgggcattggctcgcacaggctttacaagcaaggcaagtatccattgcgacttttacttcgtgagaaaaatcataatcgcctcgccattttttaaccgtattgcttagtcttttcacaagtgcggttagttttatttctgttttacggaagtctaattgtgcgggcgaaacattttcattcgccatcaatcgaagccattctcgaaccattgctgcgcgacctttcggcgaaaatacacggtttttactgactttcatcgatgggcacataatgctgtgttcatcaaaattgaaacataatccgtttccattgcagttcatcgcacccttaaattcatcacgcacttggataggaatttggcgatccttatcagctcgcattggcgaaagaatagaataaagttcctcttgggaatccaaaggtgtacagattttgccgggatttaagcgattgttcggatcaaacaaggttttgatataacgaagttcgtaccagagttctggggtaaagaatttttcgccgtaatgggatcgcacgccttttccatgttctccccagagtaatccaccatatttaatcgtaagttctgccacttcatctgaaatttgtttaaataatttcacttgttctttatcgcataaatcaagtgcagggcgaacgtgtaacacaccagcatccacgtgaccaaacatgccatattgtaaatggtgctggtctaataaagcgcgaaattcactgatgtaatccgcaagattttctggggggacacaagtatcttccacgaaaggaatcggtttggctgcaccttttgcattaccaagtaagcccactgctttttttcgcattgcataaatacgttcgatagagggtaaatcagaacaaacttgatagccaataatgtgatcttggttatgttcgattttttcatcaagtaagtgacaaagtgcggtgacttggcggcctattttttctttattattaccagcaaattccacaatatttaaaccgagaattggatctttttcatcttctgtaagaagttcattcacagaatgccaaataatatcttgtttggcgaggtttaagactttggaatcaacggtttccacagaaagcgcattggctttcaccataaaaggtgcattgcgtaatgccgcgtcaaaagaacgatatttaatattgatgagcgtgcgatactgcggaataggcagaagattgagtttggcttcgcaaataaatgcgagagaaccttcagaaccagtgagaattctcgtgagattaaattcactttcatcttcattgaatacatttttgagatcgtatcccgttaaaaaacggttaagttgtggtaaatctttaatgattgccgctcttttttctttacagtgttgcgcgattgtttgatggagtcttttgctgctctcacttaattcaagcgcatcaatgttttctaaaacatcaacagaattgaccgcacttgtatctaaaatttcaccgttcattaatacggcacgtaatgccaaaacatgattagaggttttaccgtattgcaatgaaccttgccccgaggcatctgtgttaatcattccgcctaaagtcgctcgattgctggtggatagctctggggcaaagaataaaccatgtggttttaaaaattgattaagttgatcttttacgacacctgcttgtactttaacccaacgttcttttacattgagttctaagatggcagtcatatgacgagaaagatccactattatattgttattgatggattgaccattagtgccagtgcctccaccgcgaggcgtaaagctgattgattgatattcagataaatttgccaatttggttatacgcactatatcagcaatagttttcggaaaaagaatcgcctgtggaagctgttggtaaacgctgttatccgtagccagacttaatctatccgaataatttgtcgcaatatccccctcaaaatgttggtgttgaagatcatcaagataatcaagtacatattgttcaatttgaggaatgcgatttagacttggcaacatagtatttaactcatttaaaggtaaaaatggcaggttattgataatatcttaaggcgttaatgatgtcgaattagattttgagcatttttaaggagtgttttatggagtaaatgagtcaagaaaagtgtgttgtttggatgaaaaataaacaaaaaattcaaaagaatttgatcttttcaatttttataggataataagcgcacttttgaacgttcctttggcgtaaacaaaggaattgaatttgtcaaaaggtagcaatgaggcaaattcaaaccctcgttaagtactgtttagaagataactttgatgaaaagttcggtctaaacgggaataattttttattactattcgatgactaaatagaggacatcaaaatgaaaaaaactgcaatcgcattagtagttgctggcttagcagcagcttcagtagctcaagcagctccacaagaaaatactttctacgcaggcgttaaagctggtcaaggatctttccatgatggtattaacaataatggcgcaattaaacagaatttatcatctgctaattatggttacagacgcaatactttcacttatggtgtatttggtggttaccaaattttaaatcaagataattttggtttagctgctgaattaggttacgacaattttggccgtgtaaaacttcgtgaagcaggaaaacctaaagctaaacatactaaccacggtgcgcacttaagcttaaaaggcagctatgaagtgttagacggtttagatgtttatggcaaagcaggtgttgctttagtacgttctgattataaattttatgaagttgcaaacggtactcgtgaccacaagaaaggtcgtcacacagcacgtgcctctggtttatttgcagtaggtgcagaatacgcagtattaccagaattagcagttcgtttagaataccaatggctaactcgcgtaggtaaataccgccctcaagataaaccaaataccgcaattaactacaacccttggattggttctatcaatgcgggtatttcttaccgtttcggtcaaggcgaagcaccagttgttgcagcacctgaaatggtaagcaaaactttcagcttaaattctgatgtaactttcgcatttggtaaagcaaacttaaaacctcaagcacaagcaacattagacagcgtctatggcgaaatttcacaagttaaaagtgcaaaagtagctgttgctggttacactgaccgtattggttctgacgcgttcaacgtaaaactttctcaagaacgtgcagattcagtagctaactactttgttgctaaaggtgttgcagcagacgcaatctctgcaactggctacggtaaagcaaacccagtaactggtgcaacttgtgaccaagttaaaggtcgtaaagcgcttatcgcttgtcttgctccagaccgtcgtgtagaaatcgcggtaaacggtactaaataattttagtatttgtttaacgaaagattaaatacagaaaaaggcttaaacttcggtttaggccttttgttttaaatgaatataaaaccaagcatttcaatcaagttttaacttgtgataaaatgcttacctcgtttatttatagggaacattatggaaaccttagacaaaatcaaaaagcaaattagtgaaaatcccattcttatttatatgaaaggttcgccaaaattaccatcttgtggtttttctgctcgtgcatctgaggcattaatgcactgcaaagtgccttttggttatgtggatattttgcaacatccagatattcgcgctgaattaccaacatatgcaaattggccaactttcccacaattatgggttgagggagaattaattggtggttgtgatattattttagaaatgtatcaagcaggcgaattgcaaactttattagctgaagtggcagcaaagcacgcttaatcacagtggaaaaataaaacccgcaataagcgggttttttatataataagtttccctttcattattaaataatagattaagcaaactttaataccttagaaagtgcggtgaaaaatttatcgttttcttcaggtaaaccaatacttatacgtaaatgatttggcatgccataaccagcaattgggcgaacgattacgccttctcgtaacaacgcatcataaattggtgcggcaggttgtttgaaatcaatggttataaaatttcctttagagggaatataatccaattgatttttttgacaaaagtcttcataacgtcgcatttctattcgattattttcagcgactttttcaataaattcatcgtcattcattacggcaactgcagcggttaatgccaaagaattacagttaaatggctgtctaactcgatttaataaatctgcgatttctggattagataccgcataaccaatgcgtaagcctgccaagccataggctttagaaagagtgcgtgaaataattaaatttgaatatttttttaataaactgaaagagtccactcgttcttcagatctagtaaattctgtgtaggcttcatctaataccacgattacattttcggggacttttgctaaaaaatcttcaatttcttgtgatgttaaaaaattacccgttggattattgggattagcaatgtaaatgagctttgttttatcagaaagtgcggttaaaaatccttgtaaatcgtgtccccaatttttagctggaatttcttttgcaattgcatttatcgctttagtcactaaaggataaacaataaaagcatattgtgaataaatgatttcatcgccttccgttgcgaaagtgtgagcaaaaagttctaataaatcatttgagccattaccgagtgtaatttgatttggttgaacgccaaatttttttgcgatagtttgttttagttcaaagccattcgcatctggataacgagtcagtttatctaattgttcgaaaattgctttttttgcactttctggaaaaccaaatgggttttcgtttgaggcaagtttaacgatattggaaataccaatttctcgttctaattcttcaatcggtttaccagcttggtaaggtgataaggattttacgccacgattggcaatgttaatgtactgcatagtgttatttgtaaatattgatatgggttagtatgtatttttaaataaatttgggcgtagtaaatacgcccattggaaatatttttcctattgaggaagattttcagcttcaaattttttcataaatgaaatgagtgcctcaacaccattttgcgacattgcattataaatagatgcgcgcattccacctaaaaccttatgacctttcaaggcttgcaaacccgtagcagtagattctgcgacaaattttgcatctaattcaggattacctgtgatgaaagtgacattcattgttgaacggttttcttttgctaccacattgcggtaaagtttgctcgaatcaatataatcataaagagtttgtgcttttagtgcattacgtttttcgattatttctaagccgcctatttctttaagatgtttaaatacgagggaacataaataccacgcaaaagttggaggcgtgttgatcattgaatctgcatcacgttgagttgcataattccaaatagagggggtttctttacgtgcattaccgattaaatcatcgcgaataatcactaacgtaatacccgcagggccaagatttttttgcgcacctgcataaattatcccaaatttactgatatcgatttgacgtgaaagaatatttgaagacatatccgcgaccaatacggcattgcccacatttggcacatcaaaaatctctacaccactaatagtttcattcgggcaataatgaacgtagtcatattgatcagcgatatggctaaaatcaagatcggtaattcgagtctgttcgccattttctacgatagtgatttcatcaatttctgcaaaatttcttgcttcttttgccgctgtagctgaccaatgcccactatttaaataaagggctttgccttttttaccgattaagttcatcggaattgcggcaaattgaccgcgagcgccaccttgtaagaaaagtacacgatagttatcaggaatattgtaaacctcacgtagatctttttccgcttgggtaacgagttccataaaatactttccacgatggcttacttccattacagaaacaccttgattgagccagtttgtaagttcattttgtgctttttgcaacacttctgggaaaatcatcgcaggacctgcgctaaaattaaagacttgtgacattgtatttccttgctttttatgaaaataatgatgtcttttttatcactacaaaaatcgataatcaatgctttttactgaaatcaaaaaaattctttctatcattcataaaatagagggtaaattttgacgattgattaaaaaaaagctaaattacggcacagtcattttatttattttaaagggagttgttatggaaattgtgaataaacaatcttttcaagaagtgttggaatacgtgcgtatgtatcgtttaaaaaatagaattaaacgagatatggaagacaataatcgtaagattcgcgataaccaaaaacgcatattgttattggataatttaaatcaatatattcgtgatgatatgactattgcagaagtacgcggaattattgaaagtatgcgtgatgattatgaaagccgtgtggatgattatacaattcgcaatgctgaactttctaagcaacgccgtgaagcgagtacgaaaatgaaagaacagaaaaaagcacacgcagaattattgaaaaatgctgaaaaataataggataactagagccgactaaatcagtcggcttattttttataagctattcattgcgttaatgattttaatttcatcaaaattgacaatatcttcttggaatattgtgcgttcttgaattttcccttcttgtaataatttttctcgttgtgtgcctaaaagcaatggcgtgtctggcgtgtaccatttttttccttggcgaaaaattaaattaccgatggaacaatctgtcacttttccatttttgataatcataatttcatcacaagcaccacgttgagcaaataatgtattaattaaactgcgatctaaatatttcaaactatattcaatgtcatcacaaattacaggttgaaaagtgcggtagatttttcgttggtattcaaaatattgaatttgtgtggtttcggcattgtaatcaatgcggcagcgaactaattgattttgtaaatcttcaggcagttgaataagggaaaaaagattaaaaattttcaccgcacttttgccataatattcacgcaaactacgttcatatcgcgcttggtgtaaatcgatattttgaattttcccgttttcaatacaaagggtttcaaatagaggatacattaatcagcaccttcaatcggtaaatagactttttctaataattcttcatattcatcttgcgcattgctatgaatggtaatcccgcctccactatgaaaataaaatttttcatctacttgagaaataaatcgaattgctaccgcactttgtagtgttttgccatcaaatatgccaaaaattcccgtgtaataaccgcgcttttgtttttctgcttgttgaataatttgtgtggttttttcttttggtgcaccactaatagacccagcaggcaacagtttctctaaaatatcaccaatttgattttgccagttttcattcgattttccgtaaatttcagaactggtttgcagtatttcgcctttttgtgttttgatgcgatcgatataacgaaattttttcacttgaatgtgttctgccaccatggataaatcattacgcattaaatcaacaatcgtgtaatgctcgcgttgttctttttcatttgtgagtaactgattttctgcatcgggcagagtggcattaattgtccctttcatgggataggtaaaaatattgttgtcatgaatattgacaaaacattcaggcgaaaagcaaacgaattgatcttgtaaccacaatttataaggtgcattggtttgatgaaaaatttgttcaagtgacagattacctgaaatttcagtggggtaggtgagatttaataaataagaattacctttttgtaattcactttgaacaagttcaaaaccttgttgataatgcgagaaaggcattggatgtttggtgaaattaagagggagagattgtggagaaatcgtgcaatttcttttgcctaaaatatcaaaataaatgccttgttgtgcagaattttcgagaggacaaatcaagggtttttctttttcaaaatcaataagaaagaaaaatggcgtgcgttgtttgccataatgattagcctgttcaataaaatgttgcattgtgctttgtgccattttgcgtaaaatgacctgattataacgaataccgaactgttatgaaattactcatcattaataatcacgattcttttacttttaacttggtggatttaattcgaaaattaaatgtgccttatgatgttttaaacgtggaagatttaaaggaaagtacagcggaaaaatatagtcatatattgatttcgccagggcctgatataccacgcgcttatccacaacttttttctatgttggaaaaatattatcagcaaaaatctattttaggtgtgtgtttagggcatcaaaccttatgtgaattttttggtggtacattgtataacttagagaatgttcgtcacgggcagaaacgaacattaaaagtgcggtcaaattctccattgttttttgatcttccaactgaatttaatatcgggctatatcattcttggggcgtacaggaagaagattttcctgattgcctagaagttaccgcactttgcgatgaaggcgtggtgatggcaatgcaacataaatctttgccaatttatagtgtccagtttcatccagaatcttatatgtcagactttggcgagaaaattttgcgtaattggttggcgattcctccctcaactaacccataataccgcttgcttattaagcaaaaatgcgtattatagccgtctatacgtcaatacatccaaatttaaaagaagaagagagaaaatatgtctagctatttatttacatctgaatctgtctctgaagggcatccagataaaattgccgatcaaatttctgatgcagtacttgatgaaatcctaaaacaagatccaaaagcacgagtagcttgtgaaacttacgtaaaaaccggtatggcattggtgggtggggaaatcacaacctctgcgtgggttgatattgagaatttaacccgtaaagtgatttgtgatattggttatgaacattctgaaatgggttttgatggtcattcttgtgcggtgcttaatgcgattggtaaacaatctgcagatattaatcaaggcgttgatcgtgaaaatccattagatcaaggtgcaggcgaccaaggtattatgtttggttatgccaccaatgaaacggatgtattaatgcctgcagctattacttatgcacatcgtttaatggaaaaacaagctgaagtgcgtaaaagcggtaaattagcatggttacgcccagatgcgaaaagccaagtcacgttaaaatatgaagataataaaattgttggtgtggatgcggttgtactttctactcaacattctgaagaagttagccaaaaagatttacacgaaggtgtgatggaagaaattatcaaacctgtattaccaactgaatggctttctaaagaaacaaaattcttcatcaacccgactggtcgttttgttattggtggaccgatgggggattgtggtttaactggtcgtaaaattatcgtggatacttacggtggtgctgctcgtcacggtggtggcgcattctcaggaaaagatccatctaaagtagatcgttcagcggcttatgctgcacgttatgtcgcaaaaaatattgtggcagcaggtttagcagatcgttgtgaaatccaactttcttatgcgattggtgtggctgatccaacatctatcatggtcgaaacctttggaactggaaaagttgcaaatgaattattagtgtcattagttcgtgagttttttgatttacgtccttatggcttaattaaaatgttagatttaatccaaccaatctatcgtgaaacggcggcttatggccatttcggtcgtgagcaattcccttgggaaaaagtggatcgcgcagaagatttacgtattgcggcaggtttaaaataataggcttgaatttttagtttgaaaggcttatattgaaaaggcaacaaggtttcttgttgccttagttggtttaggttgctaccaagctggggagctaaaggacagcaacaagaacccgataataatcattaagatgatttttatcataaggctatctcctttcagagttgttaaacaaagctgatcgagattgagttactgcctgacccgccagtcaggcaataacgtacctgaccaaccactggttattctatcatataaaagccgcttatctagcggtttttgcttttaccgatgacatcaatatcacttattccattccgtcatttaaaaatgcaagtgcaacgcaaattgaatcagtctttgctgcttgcagaggcttattttaagcgaaaatttacaatgccagaggtaaattatgagttacgaggtataaaggcaggcgtggcttacctacaaaaaaatgaaataaaatttaaccgcactttattgcaagaaaatacggatgaatttattcgacaagtcgtgccacatgagcttgcgcatttgattgtgtatcaaatgtttggtcgcgtaaaaccacacgggaaagagtggcagcttgtaatgaatgaaatttttaagcttcccgcagacacttgccatcaatttgatataaaaaacgtgcaaggtaaaacctttgaatatcgttgtgcttgccaaacccattttctaactattcgtcggcataacaaaataatgaaagaaaacatcgaatatttgtgtaaaaaatgtaagggaaaattagtttttgtcgatgatgaagaataatttttgtgatatatttttccaatttattcaataaataaaggagttatccaatgaaaaaatctttattagcagttattgttggtgcatttgcctttgcttctgttgcaaatgcgaatatttatgctgagggcgatatcggtttatctcaaactaaagcaaacggtagtaacaatacaagagttgaacctcgcgtatccgtgggttataaagtaggaaatacacgtgttgcgggtgattatactcatcatggaaaagttgatggcacaaaaattcaaggtttaggtgcatcagtattatatgattttgacacgaattctaaagtgcaaccttatgttggtgctcgtgtagcgactaatcaatttaaatacaccaatcgcgcagaacaaaagtttaaaagttcttctgatattgagctcggatatggggttgtagcaggtgcaaaatataagttagatggcaactggtacgcaaatggtggagttgagtacaatcgtttaggtaattttgatagtaccaaagttaataactatggtgcaaaagttggtgtggggtacgggttctaatttttagaatataaaaatcttttttataaaacactttaatttaacggtgatcgtttaaaacaatcaccgttattggtatcagcagagccagaaaggctaattaccatatttggtttaggcgtataacggactccagctgcaacggcagattgtcctcgataagtccctgcagctatgccagtaatttggcgggttatgcctcttattttattccccactgaaaccgaacccgcagtgcctttccaagttgaaactaattcatttttagctgtttcataagatttagttgcgttgtcaatcttagcttgatttggattagctgcggttttcaacttttccatattgctttttaacctagcaacttcctctttttttttcggcaaatcgtaaagaatattacgtaattctgccaaatcagcataattttgacgctctgttttataagcattttccaatggcttaatatcaaaaatatgtgatcaagatcacaaaataaaaaatcccaacggagattgggatttaaaatcactaaaaattttaccgcactttatgctttgcttacttcaaaacgttcaaatgccaatacttttttctctaatttacgtagtaataatgttgcaatgcctgtgataattaaatagataccacccgcaatgccgtaaattgtgattgcatcatattctgtaccataaagttggcgtgcgtaacccataatatccataatcgtaatggtggatgctaatgccgttcctttaaataccaaaataatttcgttactgtaagaaggcaacgcacgttttaaggcataaggaattaagattttgagtgtctgtaatcggcttaaccctaacgctgcgcaactttcccattgtcctttaggaatggcttttactgcaccgtgaaataattgggtggaataagctgcgctgtttagtgctaaagctaatacggcacagaaccacgcattggataagacataccataatgggctgtcaataatccattgaaattggcctggccctgcataaattaaaaagaactgtactaacagtggcgtgccagtgaataaagtaaggtataaattgaccgcactttttatccatttgttttccattgaaagtaaaaaagtaagaaataaggctaaaaagaaagcaatcagtaaggatacgactgtgagtagtaaactcgttggaatcccttgtacgatcacgcttaaatattcttgaaacattatttcatgcccctttcaaaacgagtaaaacgcagctctaattttcgaataccaacttggctaattaatgttaccgctaaataaattaacgcagcaataccgtaccaagtaaagggttgatgagtattggtattcatcagatccgcttggtgtatcaaatcgtccacaccaattaatgaaaccaatgccgtatcttttagcaatacaagccattggttgcttaaaccaggtaaggcgtgacgccatacttgtggcataacaatatgaatgaacgtatagcttttgcttaagcctaacgctgcacctgattcccattgtccttttggtatggcttgaattgcaccgcgtaatgtttgtgaagcataagctgcaaaaatgagagaaagcgcaaacacaccacagccaaatgccccaaattcaatgtattctcctgtcagtatttcgactaattcagtagaaccaaaatagacaagtaatacaacaataatttcgggtaagccacgtaataatgccacaaatactgtcatcggcttgccaacaaagcgatttgcttcaagcacggcaaaaataaggcttaaaaataagcctaagagcaatgaacagaccgcaagccctaaagtcattagagcagcggtaaacattaaagaaagaaagtcagaaaacataaattattttgtcatccatttatcatagattttttggtattcgccatttgctttaattgcagctaaacctttgtttaattgtgcagccaaatctttgtttgatttgtgcattgcaatacctaaaccattaccaaaatattttttattggttactttttcgcctataaattgaatttctggctctttggaaatcatatcggaaagcactgcggtatcgcccaaaataatgtcaatccgaccgctctttaagtctaaaatggcattttgtaaacttgcataggattttggactatattgcttggtttctgctacggtatattgttggaatgttgtaccattttgaacacctatattttttgcactttctaaggttgctttgcctttaagagcaacatagcttgcagagctatcgtaatacgcatcagagaataacacttgttttgcacgagcatcggtaatatcaattgcggaaattgctgcatcaaaacgttttgcttttaaacttggaattaatgaatcaaaggtttcgctcttgaatttacaggttgcttgaatttcttgacaaattgcatttgctacatccacatcaaaaccaataatttcgcctttttcatttgtggtttcaaatggtggatagctaggttccattgcaaaagtgagttcttgtgcgcttacagcaatagatgatcccaataaaatggcagttaataatgtttttttcatcgtaagctccttattttctagtgagaaagatagtgtttaaattgttccgtttttggattttcaaagcaatcagccgatcccatttcgacgattttaccttgttccatatagacgacttttgtcgccactttttgcgccacattgacttcgtgggttacaatcacttgcgtaatgccagtttcttgtaattctttaataatatctacaacttgcgctgtaatttctggatctagcgcagccgttggttcatcaaataatagaacttgtggcttcatcatcagggcgcgcgctattgcaacacgttgttgctgaccgcctgataaatgcaatggaaagcgatcggcaagttgttctaaacgtaaacgttttaacaattccattgcatcagttttcgcttcactttcactcacaccacgcactttcattggtgcttcaattaggttttcaattaccgttaagtgcggccaaagatgatattgttgaaaaaccattcctacatcttgacgtaattgtcggattgctttgggatttgccattgcattggataaattaaaatcattatttgcaatacttaattcaccagactttggcacttctaacaaatttaatgtgcgaattaatgtacttttgcctgcaccacttgggcctagcaacacaacggtatcgccctcttccgcttcaaggttaatatcaaataacgtttgtgatgaaccgtaaaagaaattgagatttttaacacgaatagccatttttcttctctatgctttataagatgaaaaaatattacatttttatgcataattatgcaagtgctattaataaaaaatcccaaaaaatttgggattttaaaaactcgattgaaatcaaccgcactttaggcttgttttgccatttcaaactcaattaacatcattaaaatatgaataactttgatatggatttcttgaatacgatctgcataacgaaaatggggtacacgaatttcaacatccgctaatcctgccatttttccgccatctttgcctgtcatcgcaatgactttcatgccttttgtttttgccgcttcaatagcgtttaaaatattttttgaattgcctgaagtggataaaccgaataacacatcgcctttttgccccaccgcttcaacatagcgagaaaagacatattcatagccaaaatcattacttacacagcttaaatggcttgcatctgaaatcgcaatagcggggtagccagggcgattttcacgataacgacccgttaattcttctgcaaaatgcatcgcatcacagtgcgaaccgccattaccacaagaaagcactttgcctccttgtttgaagctattcgaaattaataatgccgcttcttgaattaatttaatgttattttcgtcagaaataaatttgtttaacacatcttgtgcttctacaagttctgctttgatttgatctaaatacattgattgctccttgttgggaataaaatcgcgatagcattgtatagcagatgaagattcttcgctagcctaaataaaaattcatcttttttcgatgaaataatgattttttgcgatttagatcgaaaaaataagtttgagtggttggatatttttcaagatatgtttatcttgcgtaaacttattagccctttaattttcaaaaacacaatgaaattttaccgcactttgttacttttctttgctagttcttttgcttttgctaactcagatttaatgcttcttcatacctataataatcaacccatagagggttgggtaatgtctgaaaagttagatggcgtacgcggttattggaatggaaagcaattattaacccgacaagggcaacctttatcgccgccagcttatttcattaaggattttccgccttttgcgattgatggcgaattatttagtgagcgaaatcattttgaggaaatttcatcaatcacaaaatctttcaaaggtgatggttgggcaaaactgaaattgtatgtttttgatgtgcctgatgcagagggcaatttatttgagcgtttagctaaattgaaagcctatttacttgaatatcctacaacttatattgaaattattgagcaaattcctgttaaagataaaacccatttatatcaatttcttgcacaagtcgaaaatttgcaaggcgagggcgttgttgtacgtaaccctaatgcaccttatgaacgtaagcgaagctcacaaattttaaaattgaaaacagcacgagatgaagaatgtacggttattgcacaccataaaggcaaaggacaatttgaaaatgtgatgggggctttaacttgtaaaaatcatcggggagaatttaaaatcggttcgggttttaatttaaacgaacgagaaaatccccctccgataggatctgtgattacttataaatatcgaggcattacgaatagtggaaaacctcgatttgcaacctattggcgagagaaaaaatgagcctatttataaatctgacaaaatgaatttaatcaatatggaaacaagcgattaattttccatcagtatattgttccaagtgcggttgattttcacgacatttttctgtcgctttccaacaacgaggattaaatgcacagccttttggcggattaattgggcttggcaattcgcctgtcagcttaatacgctcacggcgcaagtttggcgacaaacgtggtgtcgctgaaagtaacgctttggtataaggatgctgaggattagagaaaatttgttctgtcgtccctttttcaatacaacgacctagatacattaccatcacttcatcagcgatatgttctaccacagaaagatcgtgtgaaatgaacacgtaagacaatcctagttcatcttgtaaatccatcattaaattcagtacttgtgcacgcacggaaacatccaatgcagaaacaggctcatcggcaacaacgacatcgggatctaacattaaaccacgagcgatggcaatacgttggcgttgtccgcctgagaacatgtggggataacgatcataaaattcagcgcgcaagcccactttttccatcatcgataaaactttttctcgccgttctttggcggaaagttttgtattgatgattaatggttcttccaaaattgaaccaatctttttgcgtggatttaacgatgcgtaaggattttgaaaaactatttgaatttttttacgacgtagtgcttttgtttcagaatcattttctaaaaaattatgccctttgtaataaagttcgcctttggttggttcttcaatcattgtcaataaacgacctagcgttgattttccacaacctgattcacccacgactgctaaagttttacctcgttcaagctgaaaagagacaccatccaacgcttttacttgctgtggttttgcaaacaagcctttttttacagggtaatatttttttaagccaatggcatttaataatggcgtattttcttttacttcattcgtcattattaagctccttgatattcaactggattgccttgctcgttcagcggagtatggcattttactttatgcgaaccgatatgatgcaattgaggttcaacttggcgacaatattcggtggcataagggcagcgaggatttaataaacagcctgttgggcgatcgtattttccagggacgaccccttgtaatgattctaagcgagattttccctctgcaaattcaggtaatgaacgtaacaaggcttgtgtgtaagggtgttttggctcgcggaaaatatcttttgcggtgccttcttcaacgatttgtccagcatacatcacgataattcgctctgccgcttcagccacaagtgctagatcgtgagtaatcaaaattagggacatgcattctttcttttgcaattcaagtaagagttccataatttgagcttggatagtcacgtccaatgccgtggttggttcgtcagcaatcaataatttaggtctgcaagcaattgccatcgcaatcatcacgcgctggctcattccaccagacagctgatggggataaacatcaatccgagattcaggatcaggaataccgaccaattttaaaagctctaaagtgcggtcttttcttgccttttttgtgccgccttcgtgagttttcaacgcttccataatttggaaacccacagtataagcaggattcaaacttgtcatcggatcttggaaaatcattgctacatcagcaccaataagctggcgtttagctttactctctaaagtgagtaaatcagtattttcaaattgcaaggattcagcagatacacgtccaggatgatcaattaatcccataattgcgagagaactcacagatttacccgaacctgattctcccacaatgccaagcacttcgccttgtgcgacttgatagctaatgcgatccactgctttaaatggcgtttttttatcgccaaagtgaacagaaagttcttttacgtctaataatgccattctgttttcctattgtttgagttttggatcaagggcatcacgcaagccatcgcccattaagttgaaagctaataccaaagataaaatcactaagccaggaattgtaactaaccagtttgccgcttgcataaaaccacgagcttcggaaagcattgtgccaagttctggtgttggtggttttgcaccaatgcctaagaaaccaagtgtcgcgagttctaagatagcattggatattcccatagtcatttgcacaattaaaggggctaaacagtttggtaaaatcacaataaacatgaggcgtaaaatacctgcccctgccactttagatgaagtcacataatcacgatttttttcattcatcatcgctgctcgagttaaacgcacatagctaggaatcgataccacggcgatcgctaaagtggcattggcgagtgatggctctaaaatagagacgacaacaatcgtcaaaagtaagtttggaattgcgagcataatatcaattaggcgaatgataattgtatctagcacgccgccataataaccagaaatcaagccaaggctggtaccaaaggcgcaagatagtaatacgatgataaatcccgcaaagacggaaattcgcgttccataaataatacgcgaaagaatatctcgcccaatatcgtctgtgccgagtaaataagcaggattaccgccctcataccaagcgggtggcagtaaaagtgcggtacgattttgttctgttggatcaaaaggtgcaatataaggtgcgagaatgctgattaaggcaacaatcaaaataaaaattaaaccaattagcgcaccacgattttgtttaaagtaaaaccaaaattcttgtaagggtgtttttggcgcaaaagttaaaggcgtgtcagacataatttctcctacaattaatgacggatacgcggattgaccacgccgtaaagtaaatcgacggttaaatttaccacaataataatcgtcgcaataatcagtacagaaccttgcaacacaggataatcacgggcttgaatggcatcaataatccattttccaatccccggccaagagaaaatagtttctgtgagaactgcaccagaaagcaattgacctacaattaacccgaccacagtgacaacaggaattaacgcattacgcaatgcgtgaacaataacaattcgagtatagcttaaaccttttgcttttgccgtgcgaatgtaatcttcgcctaatacttccaacatcgcagatcgtgtcatacgcgtaataatggcgagaggaactgtgcctaggactattgcaggaagaattaaggatttcaccgcattttcgaaggcacctggcataccagaaagccagctgtcaataagcataaatcctgttggtgtatcgatccaaaattcattatctaaacgtccaccttgtggcaaaccgagttgtggcgaaacatataaaattaaaattaaaccccaccagaaaatcggcatagaataacctgtgagcgatgcagctgtaacggtgtgagaaatccaactgtctttttttactgcggcaatcgtgcctaaaattattccacctaataatgaccaaaataacgcaaaaaaagctaattcagcggtagcaggaaaaagcgtaaaaaattcagtaaggacaggttgttgagtgcggaacgatgcaccgaaatccccttgaattacattgccaatatagtggaaatattgctgataaagaggtaaatctaaacccaattggtgcatcatttgttgatgtacttctgccgttaagccacgttcccccatcagaatttccacaggatcaccgggaataaaatgcacaagggcaaaggtaataagagtaatggcaataaaagtagggatcaccattaagattcgtttgaatacaaatttaaacattccatcactcgtagataataaaagtgcggtaaaaattcaccgcacttttcaaagaaattaatcggtaaaaaatataatactcttgaattctaccgcactttttccaattttgccaaatgcgcaatcaaccatttaatgccttgagcttggaacgctatttgtaaacgtgtgttattttcagatccttccacattaatcactgtgccgaaaccaaatttttcgtgtttaactttttgacccattttccattcattttcgaccgcactggtattcgacaatgaaccgacttttgctaggttcatcgcacgcgtgactgtccctcgtaaacgaatttcttggatacattctctcggtaattctgcgataaaccgtgatggcaaatggcgttcttctttggcatataatcgacggctttccgcataagagatggtcagttttttctgcgcacgagtaataccgacataagctaaacgacgctcttcttctaaacgtccgggttcttcaaaagaacgaaaacttgggaataatccttcttctacgcccaccataaatacacgaggaaattctaagcctttcgcagagtgcaacgtcatcatttctacacaagattgatgcggcgaggcttgttcttcgccagcttctaaggaagcgtgcgttaaaaaggcagtgagttcggtcatttcttccgcattatcaggtttgataaattcacgggttgcggtaactaattcttccaaattttcaatacgcacttcgcctttttcgcctttttcttgttgatacatttcatataagcccgaatgtttaatcacaaaatcagtttgtgcgaaaagcggcatttctgcggtatcaagttgtagtgaattaattaattcttggaaacgtaataaggctgttgaggctcgccctgccaacatattttcttgtgttgcgacttgtactgcttgccataaggtaatttggcgttcacgtgttaagttacgcaatatatctaaagtgcggtcgccaatgccacgggttggcgtattaattacacgctcaaaagccgcatcatcttgacgattattaatcaaacgaagataggctaacgcatctttaatttcttgacgttcgaagaaacgcataccgccataaatacggtatggaatttgacaacgaattaaagcttcttcaataacccgtgattggctattactacgataaagtacagcgcaatcatcaagttttccgccatgttccacccaatcctgaatttgtgaggcgacaaattttgcttcgtctaattcattaaaggcagcatagatgcccacaggatcgcctttttcaccctctgtccataaatttttaccaagacgatcactattgtttgcaattaattcatttgcgctgtttaggatattggcggtagaacgatagttttgttcaaggcgaattgtttcggctttgaaatctttcaagaatttttggatattttctatttgtgcaccacgccaaccgtatatagattgatcatcatcgcccacaatcatgactttgcctgtttttccagaaagaattttgatccatttatattggattttattggtgtcttgaaattcatccaccaaaatatgctgaaaacgttgttgataacgttgcaaaattaatggttttttctcaaataattcatagacccgaattaataattcagcaaaatcgaccaaccctgcgcgatcgcaagtgtcttgatagatctgataaattttaatccattcacgttcttggcgatcattaaaatcttcaatatcatttggtcgcaagccttcatcttttttgttattgatgtaccaacaagcctgtttaggcggaaaagctttttcatcaaaattatgtaattttaataatcgtttaattaaacgaagttgatcttctgaatctaaaatttggaaatcttgtggcaatcccacatctaaatgatgagctcgtaataaacgatgggcaatgctgtgaaaggtgccaatccacataccaactaattgatgttgtgcgtgtttggcaagggtagattgaatacgatgacgcatttctgctgcggctttattggtaaaggtcaccgccataatgctgccttcagaaatattttcgaccgcaattaaccaagcaatacggtgcgtcaatacacgcgttttgcccgatcctgcaccagctagcactaggtgattaccaagaggagcagctacggctttgcgttgtttatcgttaagcccgtcaagtaattcagaaatatccatcataaactatctttaatctgtttaaatttacagttattatagtctcatctatcttgtgaaacaataagatttgtgagtatatcaaaagtagggtagaacattttaagaataatattaagcgggattctcctatatccttaaactcaacatcaaaaccatatgctttgaaagctatttttatactatctataaacaaatttttaattcgtttacctctcattcctaaaatgcaaggtttctcatttttccaaaaatacccatgatgtaatagtataggaatgttgtttaatgacttaatcaatacttgatttgctaggattcctgtaatgattttataaacatttgcttttccttctacttgcacgccattttacgcatagtcggtgattttgtccgaattaagttttaggttaaaaagttactcaaattcaatgttattcataattaatacaaataagaaagagtgagatatggtacaaaatttcaaaaaatggttagcacaaaggaatgggagaagtgtgctatccaagtttcattatgatcactctctaaagtagaaaacgtcatatactaaattatatactgatcaaaaaataatatttccttctattactcaataccaatcaatttatgtgtttgtaaacttagctgccatttaggtttatttgaacgttgattcaattgaccaagtaaagtgatagtctcaagtaaattcattttcccatcaatttcacaaggtgaaagatagtaattctttgcttttattttttgctcgatcaattcacaaaatgatggcatattactgtccattacaatacgtacttcatttgcaaatggaatgcaacgcttttcatacttatgagcataaaggctcttaggactcgtcgcaatataatctatttgtgcaggaattgcttttagaccattggtttcaattgcaagaaaatagccatctgatttaaattgctcaagtaagtattcaatttttggtacaattgttggctcaccacctgtgatgataatattctttgacgaaaatgaccgcactttttctagaatttgtgatacagaccagcgtttaaaattattataaggtgtatcacaccaaggacagtctagattgcatttaccaaatcgtacaaaaacacttggcattcccgtattgaagccctccccttgcagactttcaaaaatttcgactatgttaaagttcggttcaaaatcatgatatttttccatcaacatttactcctgatactcgcaaaatgaagctggggtttcccataaacgaatggatgatatggacagttgttcatcatgttttaaacgattaaaaataaaacgagctatttcttctgccgtagttctaaagggaacaccaaaagtttttgagtttaacttttgcaatagagtggcaatttggctttctcgctcattggtttgatcataaataaaggcgtgatccatcggatctaaaataacttttttcacaatagactttagatctgaaaaatcaatgaccattgctttttttgcacctgattcatataagtcacccgaaatttcaacttgtaatttatatgtgtgtccatgtaaattttgacatttcccatcatgtccatctaataaatgtgccatgtcaaagctaaattctttggaaattttaaacattttttctacctttttgagtcaaatatttctttagacctttattgcgtaaaatacagcttgggcattttccgcatccaccttcgatgccttcatagcaagtgtgagtatgtttttgtacataatctaatacgcctaattcatcagcaagctgccaagtttgggctttagtgagatacattaatggtgttttgatattgaattgataatccatagctaaatttaatgtgacattcattgacttgataaacacatctcggcaatctggataaccgctgaaatctgtttcacatacgccagtgataatatcttgaatgccttggcctttcgcataaatcgctgcataaagtaaaaatagggcattgcgaccatcaacaaaagtgtttggcaattcattctctttttgctcaatatgcgcctgttcatccattaatgcattatgtgtgatagctttcataacagatgtatcaatcaaggtttgtttaatgccgagatcttgcacaatggcgcgcgccttttctaattcaatagcatgacgctgcccatattgaaaggtaatggcttctatgttttctttgccgtattcagcaatagcttggaataaacaagtcgtggagtcttgtccacctgaaaagatgacaatcgctttacgatcgtggtttggattgaaaatattcatattttacctagttttttattgtaggaggtttgcgaactacggggggtattctagtggggaagttctattttagcaagacaagtgaaatatttcgttggatgtgaagtcgttgtgctacaattcgcaggtttttaatttagcaaaaaggtttacttatgaaaaaatggttgttgattatcgcaggcgcgttgattatttcagcttgcgcaaataaggatgtgtattttaacggtgcagaaggttcgcattcaggtgttaaatttgataaagattctcgccaatggggattgaatcaataaaaaagtgcggttgatttttaaccgcactttcgtttttctattggtagaaattattctactttcacaatccagccttcaggtgcttcgatatcaccgaattggatgcctgttaattcatcataaagacgacgggtaacagggcctacttcagtttctgaatagaatacgtggaattttccgttgtgttgaatgccgcccactggagtaatcaccgccgctgtaccgcacgcaccagcttctacgaattgatcgagttgatcgatatacacatcgccttcaatagcttccatacctaaacgctcttttgcgatatgtaaaagagagtatttagtgatacttggtaaaatagattctgattttggtgtgatgaatttattgtcttttgtgatcccaaagaagtttgccgcaccgacttcttcaattttagtgtgagtttttggatctaaatagattgcatccgcaaatttacgttctggcgtaccttgttctgcggctaattcgtgtggaagtaagcttgctgcgtagttcccacccactttcacaccaccagtgcccattggtgcagcacggtcataatcagtcgtgataaagtttgatggagccaaaccacctttgaagtaagcacccactgggcaacaaaaaacagagaaaataaactctggtgccgttttcacgccgatattttcgcccacgccaattaagaatggacgtaagtataaggttgcaccagaaccgtaaggacccaaccaatcttggttagctttaaccacttctttacatgcacgcacgaataattcagttggtacgcgtggcattaaaagacggtctgcggtacgttgcatacgctctgcatttgcttgcgggcggaataagttgattgaaccatctttgcaacggtaagcttttaagccttcaaagcattgttggccgtagtgaagtgcggtagaaccttcgtgaatatgtaaagtattgtctgtggtgagttttccttcgtcccatttgccatctttccagtgagcgatgaagcggtaatctgttttaatataactaaaaccaaggttattccagtctaagtctttcattttacttccttaatattattttttgaatgaaatttcgcttaatctacaccattcctgaagtgatttaaataataaattctcgaaatgatgcaatttttagccaactaaaaaggaataatgaaattttggaaacagggcaggaaataacaatatagttatgctaaaatcgggatgaaaaaaacgccactcaatgagagcagcgtttaaccaaatcggtttaataatatacaggaagtaaatgagtaacaaattgttactcaagttcggtttcccgaactatatgcaaacacaacatcatacttaagtctgaaactcattaactagtaagaaattaccaatcattaagtatggttgtattgtaaggaaaagggtaggaaaggacaagtgacgtttttttattttaggtattagaaaaactaatttgaaataaatcttgtccattatagacgaaaattttataaatggaaatactatatgtataaacgtttgccaccattgaattcactaaaatcttttgagtcggctgctcgttatttaagttttactaaagcagcagatgagctttgtgttacacaggcggcggttagtcatcaaattaaattattagaagaatttttagggattgaattatttaagcgaaagaatcgttctttagaattaacggagcttggtaaagcttattttgttgatattaataaaattctgcgtcgcttaaatgaagcaacagagcgattattaacgttaaaaacggatccgcatttaaatattagcgtgccacaaacttttggtatccaatggttagtgccacatttaagtgaatttaatcagctttatccgcaaattgaggttcgtttaacaggcgtggatcaagatgaaggtttgttaaataaagaaattgatcttgctatttattatggtttgggaaattggcagaatcttcaagtagatcgtctttgcgaagaaaatttattgattttagcctcacctgaattgctagcagaaaatccaattattcagcctgaagatttaaaaaaacacacattaattcacattcatacctgtgataattggcaagcgatggcaaatcatttacagttagatgatttaaatattcagcaagggccgttatttagccatacatttatggcgttacaggcggctattcacgggcaaggtattgtattagctaatcgcttattagccttgcaagaaattgaaaatggctcattgcaagcagtgttgccgactaatttgcctgatccaaaatcattttatgtggtcaatcatcttgatcgccttgatgaccaaaaaattcaagcattccgtcagtggattattaactcaattaaacaagaagaaaatgaataaactcgcattatattgtcgcccaggttttgagaaagaagtcgccgcagagattaccgatcaagcaagtcatttaggtgtatttggttttgctcgagtgcaagataattcgggctacgtgatttttgaatgttatcaacctgatgaggcagatcgccttgcccgagacattccttttaatcgtttgatttttgctcgtcagatgatggttatttccgatttattggaagatttagatcccgctgatcgtattagtcccatcgtggcggcatttgaagaattatcacaacaagttaattttgctcaatctagcgagctttttgtagaaactgcagacacaaatgaagcaaaggagctttccactttttgtcgtaagtttaccgtgcctttacgtcaggcattgaaaaaacaaggttggctttcggcaaaggcgagtcaaaagtgcggtcaatttttacattgtttttttgtaaaaccgaattgctgctatgtgggatattcttatgtggataatcattcctcccattttatgggaatccctcgtttaaaatttcctgcagatgcgccgagtcgatctacgttaaaactagaagaagctattttgacttttattccgcgtaaagaagagaataaacgtttaaatgaaaatatgattggcgttgatttaggggcttgccctggcggttggacgtatcaattagtcaaacgaggtttatttgtttatgcagttgatcacggaaaaatggcggcgagtttgcatgatacggggtgcattgaacattgcgcggaagatggttttaaatttcagcccccaaaaaggaaaaaagtggattggttagtctgtgatatggtggaacaaccaagtcgtatttcgttattgattggtaaatggttgttgaatggttggtgccgagaaaccatcttcaatttaaaattacccatgaaaaaacgttatcaagaagtgatattatgtttagaaaacttggctgttatgttggctgagcagaatttaaattttgatatccaagcaaaacatttatatcacgatcgtgaagaaatcacggttcatatagcattaaaaccttgagtgaattgttttcataaccaaaaaggacgtcgcgaatgaatttacacgaataccaagcaaaacaactatttgagcattatggattacccgtaaaaaatggggcagtctgtcaatctgttgaggatgtcgatttggtactggctcaactttcaggcgataagtgggcggcgaaatgccaagttcatgctggtgggcgtggtaaagcgggtggcgttaaattggtacaggatgtagaggaagcgagagcttttgcagaaaaatggctgggacaacgtttagtcacttttcaaacggataaattgggtcagccagtaaaccagatttattttgaagaaacttgcgatattgataaagaattttacttaagtgcggttgttgatcgtgcctctcaaaaagttatgtttattgcttctcctgctggtggaatgaatattgaagaagtcgcgcaaaattcactgcacttactccataaagtcgagattgatcctttatttggaggattgccttatcaaggccgtgaattggcgtttaaattagggttaagtggtacgcaaaacaaacagtttaccgatatctttatgggcttatctcgtttgtttttagaaaaagatttatctttagtggaagtcaatccacttgttctaactaaacaaggctatttggtttgtctcgacgccaaaatatctgtcgatgataacgctttatttcgccataaagatctcttagcactgcaagatttaactcaaaatgatgcccgtgaagcagaagctgaaaaattccagttaaactatgtggctttagagggcgatattggttgtatggtaaacggggctgggcttgcaatgggcaccatggatattgtgaaactctatggtgggaagcctgcgaattttcttgatgtgggtggtggtgcaacgaaagagcgggttgctgaagcgttcaaaatcattttaaccgatccttccgttaaagtgattttagtgaatatttttggtggcattgttcgttgtgatttgattgctgaaggcgtgattgctgcagtaaatgaagtgggcgtgagagtgcctgtggttgtgcgattagaaggaacgaatgctgaaatgggtcgccaaattttagcgcaaagcgacgttaatattcttacagcacagagtttacaacaagctgcagaattagctgtgaatgcagcaaaaggagaacactaatggcgattttaattgataaaaatactaaagtgatttgccaaggttttactggtggacaaggggcttttcattccgaacaagcattagcctacggaacgcaattagttggtggcgtatcgccaaataaaggtggaaccactcatcttggtttacctgtatttaatacagttcgtgaagctgtcgaaaatacgggggcaacagcgacagttatttatgtgccagcatcattttgtaaagatgccataattgaagccattgatgcagggattcagttaattgtctgtattactgagggtattcctacattggatatgcttaaagtgaaacagaaattaaatgaaacgggcgtagtaatgattgggccaaattgcccaggtgtgattacgcctgatgaatgtaaaatcggcattatgcccgctcacatacataaaaaaggtaaagtggggattgtttctcgttctggaactttaacttatgaagcggtaaaacaaactacagatgaaggctttggacaatcgacttgtgtgggtatcgggggagatcctattccaggttctagttttattgatattcttgaaagatttcaacaagatcccgaaacagaagccattgtgatgattggcgagattggcggctctgcagaggaagaagcagcaatcttcattaaagataatgttactaaaccagtggttgcgtatattgcgggtatcactgcgccaaaaggaaaacggatggggcatgcgggagccattattagcggcggaaaaggtactgcagtagaaaaaattgcagcgttagaagccgctggtgtgacctgtgtaaaaagcctcgctgaaattggtgaagccttgagaaagctattaaaatcatctaaaaattaaccgcactttagttttctaaagcgtagattggctttctacgcctttatttttatatgctcgccattataaagtgagcacaaaattgctataatcagcgcacattttttaaggaagaaacacatgagccaatttttctatatccaccctgaaaatccacaagcgcgcttgattaatcaagccgtagagattttacaaaaaggcggtgtgattgtgtatccaacggattcgggatatgccttgggctgtatgatgggcgataaacacgcaatggatcgcattgtagcaattcgtaaattgcctgaaggacataattttaccttggtgtgtagcgatttgtcggaactttcaacttatgcaacggtaaataataccgcttatcgtttgattaaaaataatacgccagggcgttatacttttattcttacagcaacgaaagaattacctcgccgtttaatgacatcaaaacgtaaaaccattggtttacgcgtaccagataataaaattgctttagatttgctttcagccttaggcgagccgattttatcttgttcgttaatgttgccgaatgaagaacatactacgcaatccgatcctgaagaaattcgtgatcgtttggaacatcaagtggatttaattattcatggtggatatttagggcaagagcctacaacagtggtagatttaacggaagaatcgccagtgattttacgcgaaggaagtggaagtactgctccttttatttaacctatagacgcttgtgaaagcgacctttccattattcaaggaaaacaatgaaacctagtcaaaaacaaactcaaagacaaccgcacttttccaaagattcagcaaagaaacgtgatttttcagctaaaaatgacagacgttcagtatctcgtactgctcgcatagaaacagcaaatacgaaaaaaagtgcggttaattctgacaacaaatttttatctaagccaaaagcgaaacctgttgtaagagcctcgaatcaaccgaaagcagagggcgaaaaattacagaaagttttagcgcgtgctggacaaggctctcgtcgtgaaattgaaacgatgattgccgcaggcagagtgagcgtagagggtaaaattgcgactttaggcgatcgtattgacgtacattctggcgtgaaagtgcgtattgatggtcaaatcattaatcttagccacgcacaaaaagaaatttgccgtgtattaatgtattacaaacctgaaggcgaactctgtacacgtagcgacccagaagggcgtgcgaccgtgtttgatcgtttgccgcgtttaacgggatctcgttggattgcggtggggcgtttagatattaatacatcaggtttattgctttttaccactgatggcgaattagcaaatcgtttaatgcacccaagccgtgaagttgaacgtgaatattctgtgcgtgtatttggtcaagttgatgatgcgatgttagcgcgtttacgtaaaggcgttcagcttgaagatggtcctgctaattttaaagaaattaaatttacaggcggtgtgggtattaaccaatggtatgacgtaaccttgatggaaggacgtaaccgtgaggttcgtcgtttgtgggaatctcaagggattcaagttagccgcttgattcgtattcgttatggaaatatcaaactgatgaaaggtttgcctcgtggtggctgggaagaaatggatcttgaaaacgtcaattatttacgtgaattggtgggattacctgctgagactgaaacgaaattagatgtaaaacaggctagtcgtcgtccaaaatctgggcaaattcgtaaagcggtaaaacgttattcggagatgaacaaacgttataaaaaataaggacttttttatgaaaatgcatcaattgcgttatatcgttgagattgtaaaccaaaatttgaatgtcacagaagcggcaaatgcactttacacatcacagccgggtatcagtaaacaagttcgcctattagaagatgaattaggtctggaaatttttgagcgtcatggcaagcatataaaatcaattacaccagcagggaaaaagattatctcaattgcacgcgagttacttgttaaagcgcaaggtatccgtgccgttgccgatgaatatactcggccaaatcacggtgtattacgtattgcgacgacaaatactcaggcacgttatatgctgccaagcgtgattgaacgtttttctaaaaaatatcctgatgtgagcttgcatattcatcaaggttcgccaacacaaattcacgatgctttaatgtcaggtgaagtggatttggcaattaccactgaagcaccttatttatttgatgatttagttcagattccatgctattggtggaatcgtgccgtgattgtttcgccagaacatccgcttgccaaagtgaaagaactgaccattgaggaattaggcaaatacccacttgtgacttacacgtttggttttacgggtgtttctgatttagattacgcatttaatagtgcaggcattttaccaaatatagtttttacggctaccgatgctgatgttattaaaacttatgtgcgcttgggtttaggggtgggcattatggcatctatggcgcatacggcattagatgcggatcttgtgctaattgatgcaagccatttgttccgcccgagtatgacgaatattgcatttaaacatagcacgttcttacgtaattatatgtacgattttatggaatatttttcaccgcacttaattcgtagtgtcgtagaaaaagccgagcgtttgcgtgataacaattcagtgaaaaaattatttgaaggcattgaattggaaacaagataacaatgtataaatgaagtgcggttgaaatttaataagaattttaaccgcacttgaaagattaaaacagatcgtgatatttcactaaatctttacgctgaatagcaaatacgcctagtccgccatttttaagttctacccattcaaatggtacatctggatattgctcaattaagctaatcatactattacccacttcacacaccaacacgccattttcggttaagtaatctggtgcttgtttcaaaatttgtttggtaatgtttaagccatcactgccagaacctaaggctaactctggttcaaaatggaattcttctggcatatcggcgagatcttcttcatccacataaggtggattggtcacgataagatcgtatttctgtcccaaaatattttcaaataagtttgattgaatcgggaatacacgatgctctaattgatggcgtgaaatattgatctctgcgacattaagtgcatcaaccgataaatctaccgcatctacttccgcattcgggaaagcataagcacaagcaatggcaatacaaccgctgcctgtgcatagatcgagaatatgatttggttcttgtgaaattaaatcttcaaagcgatcttgaattaaagcactaattggagaacgtggaataatggttcgttcatcgacataaaattcgtgaccgcagaaccaagcgctattcgttaaatatgccacaggtatgcgttgttcgattcgggttaatacaagttgaactaaggtttctttttcagatggggttaatcgactgttaaataattcggtaggtaaatcaatgggtaaatgtaagccacttaaaacgagttgcaggctttcatcccaaggattatcgtgcccttgcccgaagtaaatatcagaacgattgagaatgctatacgtccaacgcagaaaatcttggatggtttgcagttcgtttgcaacattatcttccaagatagttgcaactaattcttggttatgtgaagtttccatcgcatttctccataaaagtgagtagaaaagttagcataaaattcggtatgaaaatttggcgtagttataccacagatgagaatgtagaactatgatatgatacgcaaaatttgaaattaatgagaaaaaaatgcaagacgaatttgatttattccgtgcggaaaccaaaggcattaagccaatgaaacaagatacttttgttgcccctcaccaaaaacgtgatcagaaaaaaatagaattgaaagaattacgagcgaaagaagatacgttattttatttttctgatgaatatgagccgttactgaatgagcatgatggtgttgtgaaatatttacgtgatggggaagattcccatttattaaaacaacttcgtcgtggagatttttcgccagaattgtttttagatttacacggtttaacccgtgaacaagctaagcaagaattagccgcacttttactggcttgtgaaaatgagcatattgattgtgccagtatcatgacgggctatggcacctttacattgaaaaaacaaattccacgttggctagtacaacatcctaaagtgcgggcattgcatcaagcgccaagagaatggggcggtgaagccgcaattttgattttggttgatttgtaaaaaaacgttataaaaaaataccgcacttttactgcctagggcaaagtgcggtattttcttttacaattttgtatgaactattgtgttgcttgaattgcggttaaggcaattgtgtatacaatatcatcaactaaggcaccgcgagacaagtcattgactggtttacgcataccttgaagcattgggccaatagacactaaatctgcagaacgttgtactgctttgtaagtggtgttacccgtatttaagtcagggaatacgaatactgttgctttacctgctactggtgaatttggtgctttagagcgagccacgtcttccatcacagctgcatcgtattgtaatgggccatcgattaataaatcagggcgtttttctttcgcaatacgggttgcttctttcactttttccacatcagcaccgctaccagatgtacctgttgagtaagagatcattgcgacttttggatcaataccaaatgctttcgcagaatccgcagattgaattgcgatttccgcaagttgttctgcagttggatctgggtttaccgcacagtcaccgtaaacaagtacttgatctggtaataacataaagaagatagaagaaacgattgaactacctggtgcagttttgatgatctgcattggtgggcgaatggtgtttgcagtcgtgtgaacggcaccagatactaaaccatctacttcatttgcttctaacatcatagtaccaagcactacggtatcttctaattgttcacgtgctgcggtttcggtcatgcctttcgctttacgtaattcaactaaacgatcaacatagttttctcgaacatctgctgggttaatgattgtaatgcctttacctaatttaacaccttgtgcttctgcaacacgttgaacggatgcaggatctgctaaaagcacacattccgcaatgccacgttctgcgcaaagtacggctgctttgattgtacgaggttcatcgccttcaggaagcacaatacgttttttcgccgcacgagcaagttcagttaattggaaacggaatgcaggtggggataagcgaggtaaacggctagaatctgcaactaaattattgataaagtcagcattaaagtgttggctaatgtattgtttaatattctcaatacgttctttgtcatcaacaggcacttcaagattaaagctttgtaaacttaatgccgtttgccaagtattgccttcaatacggaagatcggcaattttgctttttcaaaagtaggttggcaaagtttattaatttgagcatcaattttataaccgcctgttaataaaataccgccgatttcaataccatttgacgctgcgagagcggctgctacaagcacatctggacgatctgctgaagcgactaataaactgcctgcacggaaatgctcaaccatatttggtaaacttcttgcgcagaaagtgataccacgaatacggcgattgatttccccttcattaatgattgatgcacctaaatgtttgactaagtcgattgctcgtgtagcgattaaatttgcattccaaggcacacaagctaataacttgatggcactacctgcaaataatttgtttacttctgtttcgctaatatgattgtgttggaatgaatcaaagatttcagcaagatcggggcgtgtacgaccagattcatcaacaggtgcattgaatttgtttacaactacgcctaaaagatttggattgtttttaccaccaaataaagaggctgctgcttctacacgatcttttaattcggttggggtttcagttgctggtgctgcaactaatacgatttctgcatctaatgcttgtgcaatttcatagttgatattatttgcataaccgtgttttcttgttggaattaaaccttccaccacaacgatatcgttgtttttggttaattgttggtggttagctacaattttttctaacaatacgtcagactgattttgaccaattaatgattctgccacgcttaacataaagggttcggcagtttcaaggctagtgctagtgcgaataatagaggttgtgcgatccaatttatcttcgccagtgcttggttgagaaacgggtttcataaaagcaacttttgtgcctttttgttcgagagagtggattaatccaagactaatgctagttaaacccacgcctgtacttacagggataagaataatcgtgcgagacatagttaaaccttaatatgtatatgttataaataaaaactgccgaaaaattcggcagtttgttgttgaattagaaacaaagtcttgcggtatcttgtgcgataaccaattcttcgttagttggaagaacaatcgctttaaatgcggaatcatcagtcgtgattacgccatctttaccaaaacgtgcggcaagatttcgttcattatcaattttaatgccaaataattttaagtgattcaatgctaattcacgaacgtgcgctgagttttcgccaataccaccagtgaatgcaatcgcatctaagtgatcatcgcccaacacagccatataagcaccaatgtatttcgctaaacgatagctataaacatttaaagcgcgttttgcttctggtttagatgcattatcgtagttatcttcagcataacggcagtcgctggttacttcagttaaacctaaaagaccagattttttcactaaagtctcttcgatttgttccatagacatacctagtgttttgtatagatagaatacgattgcagggtcaatatcgccacaacgcgtacccattaccaaaccttctagtggagttaaacccattgacgtatcgatacattgaccgttacgcacaacagaaacagaaccaccattacctaagtgacaaataatagcattgacttggtctgcgggtttgcctacatattcagcgacttcacgagaaatgaagtagtgacttgtgccgtgtgcaccatagcgacgtacgccgtgttctttatataaagagtatggaagggcataaaggaatgcttcttcagacatagtttggtggaatgctgtatcaaaaactaccacgtttttatcttttaagtgtgggaatgcgttaaatgcttcgcgaataccaattaagtgagctggattgtgaagtggcgcaaattgtgcagcatcttcaatacctttaacaacttcatcagttacgataacagattgggtgtatttttcgccaccgtgaacgatacggtgaccaattgctgcgatagaattttttagttcatcagtcagaatgttagatgcaataaaattaagcgcttcagtatgcgctgcgcctgcgcctaaatctgcgttacctttctctccattgagtttccatttgatacgtgcttctggtaagaaaaatgcttcggctaagccagataatttttcttcccctgttgctggatcaagaattgcaaattttagtgaagaactaccgcagttaaggataagaacaagttttgacataggaaccctatatttgattgaggttaatagaaatccatcatttaagatggtttgaaaaattaggtataggatacaccttttgatgaataaaataaattcatcggtaaggaaaaaatacaaactttatcgtattttttgaaaaattaaactatttttactaaaaatagacttaaaatagcgtatgataagtgcggtcaattttttgaggtgttttttatggcgtttttttccatttttaaacagggacaaatttatcttaatacttggccgcaggaggcgaagttagggattattttccctgaaaaccgtattatgaaagccacgagttttgcacaaaaatttatgccttttgttgctgtatttgcaatactgtggcaacagatttatgcaaaaaatgatttaatggcattttctatcgcaattttgaccgcactttttgccttgcttattccttttcaagggctttattggcttggtaagcgtgcaaattcgccattagaaaatcaaagtgcggtatggttttacgatatttgcgaacgcttaaaacaacaaaatgaacccttgccttttgtgcaagaaaaaccgacatatcaacatttagcggaagtcttaaggaaagctcaaagcaaatttgaacgtgctttttggcaggaaatttagtttacgcaaacgttttctttttggctgtatttttgtagaatacctcggtcgttttaaacggccgtttttcattgagagattttttaatgatcgattacattattattggcattatcgctttttccattcttgtcagcttattacgtggttttgtacgcgaagtactttcacttggtagctgggttgtggcatttatcgtagcaagccagttctatccttatcttgccacttatcttacgcaaattgaatcaatgtatgtgcgtaatggaactgcaatcgccattctgtttgttctgactttaatcgtgggcgcaatagtaaattatgtgattagtcaattagtagataagacgggtttaagcggcactgatcgcgtattaggtgctgctttcggtttagtgcgcggtgcattgattgtggctgcgttgttattttttatggatacttttaccaattttgaacaaactgattggtggaaagaatctcaattaataccgcattttggttttattattgaatggttctttcaacagcttcagtcaagttcaagttttttaaatccaacgcttaatcaataaggaacacaaaatgtgtggtattgtcggtattgttagccaaagtccggttaatgaatctatttatgcagcattaactcttttgcaacatcgtggacaagatgcggcgggtattgtaacggttgatgatgaaaaccgtttccgcttacgtaaagctaatggcttagtcagcgatgtgttccgtcaagagcatatgctacgcttgcaaggaaatgctggattagggcatattcgctatcctacggcaggaagttctagcgtctcagaggcacaacctttttatgtaaattctccctatggtgtcactttggtgcataacggcaatttaaccaactcagtggagttaaaagaaaaagtctttaaaactgcccgccgtcacgtaaacactaattcagattctgaacttcttcttaatattctcgctaatcatcttgatcacattcctcaaaaccatcttgatccacaagatattttctatgctgttcgtaaaactcacaatgatattcgtggtgcttatgcctgcgtagcgatgattattggacacggaatggttgcatttagagatccttttggtattcgtcctttggtgttgggtaaacgtgaagaaaatggcaaaactgattatatgttcgcctctgaaacagtagctttagatattgtgggtttcgagtttgtgcgtgatattgctgcgggcgaagccgtttatgtgacatttgatggcgagctttattcacaacaatgtaccgaaagtgcggtgttaaatccttgtatttttgagtatgtttattttgcacgcccagattcaacgattgatggtgtctctgtttatgcggcacgtgttcatatgggggaaaaactcgggaaaaaaattgcaaaagaatgggcggatgaaattgataatattgatgtggtcattcctattcctgaaacctccacagatattgcgttacaaatagctcgtgttctagggaagccttatcgacaaggatttgtgaaaaatcgctatgttggtcgtacctttattatgccaggtcaagcacagcgtattagttctgttcgtcgcaaattgaataccattaaagctgaatttaaagataaaaatgtgttattggtggacgattctatcgttcgtggcacaacctctgagcaaattgttgaaatggctcgctcagctggtgcgaagaaaatttactttgcctctgcagctcctgaaattcgttatccgaatgtatatggtattgatatgccgagttgtgatgaactgatcgcttacggtcgaaatgttgaggaaattgcacatttgatcggcgtagataaattaattttccaagatctgaccgcacttactgaatctgttcaattggaaaatccagccattcaaggttttgattgttcagtattcacaggcgaatatattacaggcgatattagtcctgaatatcttgataaaatcgcacttcaacgcaacgatagtgcaaagaaaaaacgtgaaaaacaagcatccaatcttgaaatttataatgaacaataaattgcgataaggtgagatatttagtccgataaaaatcaccgcattaaaaaagtgcggtgattttttatttgttttttaggatttcttctagatagtttttgcaatcagaatactgaaattggaatccagcgttgagtaatttttcaggcacaacattttggctttctagtaatagattcgctcgttcgccaagaatgaaatgtaatatccattttggaatagttgcaaaggcaggacgttttaatattccagccaaagtgcggttaaatttatgctgttttatgggattcggggcggtgaagttaaatgatccttggcattctgaatggtcgagtaaaaataaaatgccgtttaccatatcttccaaagcaatccaagggaaatattgctctccattgcccagtttaccgccaagtccccatttgtataaaggcaacattttagcaagtgcgccaccttttgtagaaaagaccatgcctgttcgaatcaaacaaactctcgcattagcttgttgagcgatattttcccaatcttggcataattgtgcggtaaaggtttttgctgttttgcttgtttcggtaattttttgttcgccttgatcgccgtaaattccagttgctgaacctgatataaaaattgggtattgctgatactgattgatgaattcaaccagttgagtagtgaggcttaaacgactttctcgtaaaatagatttctggtttttcgaccaaactttatgaaaaattggttcgccagcaagattgatgatggcatcaaactgttcttgtaaatcgagttctgaaagtgcggtaataaatttgatgtttttttgctttgagagagtgtgcggcgaacttgagcgcgttaagatcgtcacttgttcattacgtaagcaaagttgttcaacaagtgctttgccgataagccctgtgcctcctgttaataaaatattcattacaatgcgttttcaaataaacgttggatattttgcaataattcagcaataggtttatcgtttgtgggcgtgacaaaaatagtatcatcgcctgcgatagtgcctaaaatgccttccgattttccaatggaatcaagtaatcgtgcaattaattgagcagcaccgggcgtcgtttttattacgattaacatcgaattgtgatcaacatctaagacaagattttttaatggactactggtattgggaacacttaattcatttggtaagcaatagaccatttccatttttgtattacgagtgcgaaccgcaccaaatttgctgagcattctcgatatttttgattgattaataccagtaaagccttgtttttttaaggcatcgacaatttcattttgagaaccaaagcgttcttgattgagtaattctttaaaagcacgagttaaattgtcagtcatctttattttttaatagtcaaaatttgcataagaattgcataaaaattcactttcatcaactgaaatatgaataagaacaaagagaagaaaatatttatctcagaaatgtgaactagatcatagaatgatatttctctatttgtaattgtaagatgaacattttaaaatcagtctgttttaaattaactaacacataaggagtatttatgaaagttgctgtattaggtgccgcaggtggtattggtcaagcattagcgttattactaaaacttcagttgccagcaggcaccgacttagcattatatgatattgccccagtaacaccaggtgttgcagtagatgtgagccatattccaacagcagtgaatgtaaaaggtttttctggcgaagatccaactcctgcacttgaaggtgcggatgttgtattaatttctgctggtgttgcacgtaaacctggtatggatcgttcagatttattcaatattaatgcaggtatcgtgcgtggtttaattgagaaagtcgcgattacttgcccaaaagcttgtgttggtatcatcactaacccagtaaatactactgttgcgattgcggctgaagtgttgaaaaaagcaggcgtttatgacaaacgtaaattatttggtgtgacaactttagacgtgttacgttctgaaacttttgtggctgaattaaaaggtttaaatgtttctcgtaccagcgttcctgttattggtggtcactcaggtgtgactattcttccattactttctcaagttcaatatgcaaaatggaatgaagatgaaatcgaaccattagcaaaacgtatccaaaatgcaggtacagaagtggtcaatgcaaaagcaggtggcggttctgcaacgctttcaatggcgcaagctgcggcacgttttgctcgttctttagtgaaaggattaagtggcgagacagtggttgaatgtacttatgttgaaggcgatggcaaatatgctcgtttcttctctcaacccgttcgtttaggcaaagagggtgtagaagaaattttaccaattggcccattaagcaattttgaacaacaagctttagaaaatatgttgccaactttacgtgcagatattgaattaggcgaaaaatttattaatggttaatcgttaaacaataagaagggaatataaaattctctttttattaaaataaaaaagccaccaaatggtggcttttgtttgtatctttattatttctgacgcattgcagggaataagatcacatcacgaattgatggtgcatttgcataaagcattgctaggcggtcgatacctaaaccttccccagctgttggtggtaagccgtgctctaatgcaacaacaaagtcttcatctttaaacatcgcttcatcatcgccagcttcttttgcagccacttgtgcatcaaaacgttcattttgatcttctgcgtcatttaattctgagaaaccattaccgatttcacgaccaccgataaagagctcaaaacgatctgttacatctggattttcatcattacgacgtgcaagtggagaaatttccgcaggatgagccattaagaatgttggttgaattaagtgatgttcagccacttcttcaaaaattgcattgacaatgctgcctaaaccccaagatttttgtacttcaatacctaagcgttctgccgtggcttttgcacgatcaaagtcatataaatcttcttttacgatacctttgtctgcaccatatttaaccgttgcatcgtgtaacgtaatacgttcgaatggtttaccaaaatcaaattcgtattcgccgtatttcacaatagtagtaccaagaatatcaatcgctaatttacgaagcagttcttcggtgttatccattaaatcatggtaatccgcataggcttgataatattcaagcatagtaaattctggattatgacgaacagaaaccccttcattacggaagttacggtttaattcaaatactcgttcaaacccaccaacgactaagcgttttaaataaagttcaggtgcgatacgtaaatacatatccacatctaatgcattgtgatgagttacgaaaggacgcgcagatgcaccgcctggaatgacttgtaacattggcgtttccacttccataaagcctttagaaatgaaatattcacgaatccccgcgacaactttagaacgaataataaaagtgcggcgagattcttcgttagaaattaaatctaaataacgttggcgataacgaacttcttggtcggttaaaccgtggaatttatctggtaatgggcgaagtgctttagttaaaagttgaacctcagtggttttaacggtaagttcatcggtttttgttttaaataaagtgcctttaacgccaacgatgtcgcctaaatcccaagtaccaacgtcatctttataaacaccttcaggcaaattatcgcgtgcaacataaagctggattttactgctcatatcttgaatagtgataaacgttgctttacccattgcacggcgagtcataatacgaccagcaacttgtacttcaatgcttttctcttttaagatttccccgtcttctgaatcatattgattgtgcaaatcttgtgcgagcgcatcacgacggaatttattcggaaaggcattaccttttgcacgcaatgcggctaatttttcacgacggacgagcatttcgccattgagatctaattctttaacttcttgttctgacatgttgtttacctttaattttaactttaaaaataccttaaaaaataaccgcacttttgggttatttctatgatgggataagtaacgcgtctttacttatccagcaaatcatgcttaaagcccagcttttaaactcgcttcaataaatcgatctaaatccccgtctaatacggcttgcgtattacggttttccacgccagtacgtaaatctttaatgcgtgaatcgtctaatacgtaagagcgaatttggcttccccaaccaatgtcagatttattatcttccattgcttgtttatccgcatttttcttctgtaattcaagctcatacaatttcgcttttaattgtttcatcgcttgatctttgttcttgtgctgtgaacggtcattttgacattgcaccacaataccacttggcatatgggtaattcgcaccgcactttcagttttgtttacgtgctgcccaccagctcccgatgctcgataaacatcaatacgtaaatcagcaggattgatttcaatatcaatatcatcatcaatttcaggatagacaaatgccgcgctgaatgatgtgtgacgacggttattggaatcaaatggacttttacgcactaaacgatgaatgcccgtttctgttcgtaaccaaccaaaagcatattctccgctcactttaatggttgccgatttcaatccagctacatcaccgtcagagacttccatcagttctgttttaaaacctttgctttcagcccaacgaagatacatacgcagcaacatttctgtccaatcttgagcttccgtaccgccagaaccagcttgtaagtccacatagcaatcgcaagcatcatgttcgccactaaacattcgacggaactctaatttttcgagttgttgttcaagttcatctaattcagcaaccgcttcattgaaagtgtcttcgtcttctgcctcgatggcgagttctaacaagccatcaacatcttctaagccttgttctaaatttttgatggtatttacaacttgttctaaagaaacccgttctttaccaagcgtttgggctttatctggatcattccaaacatctggctgttctagttccgcattgacttcttctaaacgctcaactttggcatcgaagtcaaagatacccccgaagcaccgaagtgcggtcagataaatcgatgattttattttttacaggattgatttcaaacataataaattcactgtgtgataaagtgtggaattatatgctattttctgatttttggatagtttgaccttgcagaaattagcaatctctctataattttaggctttctcactcaagtaaatttaggaacaaaaaatgaagaaaatttttaccgcacttttgtgcgtggctgcggctaatgcaatggcagatgatgcggcaattaaacgcaaattacagtcttttaatgtgtcaaatattgctattaaatcttcgccgatttcaggcattagaacggctgtcacggatcaaggtatactttatgtgagcgaagatggaaaatatctttttgaaggtaaactttatgaactcacaaataatggccctgttgatgtagcaggtaaaattttagtagataaacttaattcttataaagacgagatgattgtttatcctgcgaaaaatgaaaaacacgtagtaacagtatttatggatattacctgccattattgccatttgttacatcagcaattaaaagaatataacgatcttggtattactgtgcgttatttagctttccctcgtgcaggtatgaataatcaaacggcgaaacaaatggaagcgatttggacggcgaaagatcctgtttttgctttaaacgaagctgaaaaaggcaatttaccgaaagaagttaaaacgccaaatatcgtgaaaaaacattatgaattaggtattcaatttagtgtacgaggaacaccaagtattgttacctcaactggtgagcttattggcggttatttaaaaccagctgatttattaagagctcttgaagaaacggcacaataattttataatgaaaaacaaggggcagttgcctaccccttgtgtttagtcggttatgcttaatatgctggggagcttaaaagcattaacaacacaaaaattatgatataaatacataatttaggcatcattaaaatccttagctgacacaatcgttagactaatggtcagtagggcttttaacccctgtcagcattcagggttaaaagccctgaccgacaggaaaaagtatagataaaagagctgttgatttcaacagctttttgcttttaggtatgaattaatatccagtgaaaaaacttatcaaacgccgtgaaattccagttggaaattctgtttcaaaccatcccttattagatcgcctttatcgtgctcgtcatattaaaaacaccaaagaattagaccgcactttgaaatcaatgctcaatccaaatcaattatatggcattgatcaagctgtaaatttattagttgaagcctatcaacaacagcaaaaaattgtgattgttggggattttgatgctgacggtgcaaccagcacagcattgagtgtgctggctttaagacaacttggcttttctgatgtggattaccttgtgccaaatcgatttgaacaaggttatggcttgagtattcctgtggctgaaatggcgattgaaaagggcgttcagcttttaatgacggtggataatggcgtttcgtcttttgacggtgtggcatttttgaaagaaaaaggcattcgagttttagtcacggatcatcatttaccccccgaaactttgccgccagccgatgctattgttaatcctaatttaagtcagtgtcatttcccttcaaaatccttggcaggtgtgggtgtggcattttatttgatgttagccgtacgagcaaaatttcgtgaactcggtatttttacggcagaaacacaacctaattttactgatttgctcgatctggtggcactaggcactatagctgatgttgtgcctttagatcaaaataatcgtatccttgcttatcaaggtttaatgcggattcgtgcacggcgttgccgtcccggtattgttgcgttggcagaagtggctaaccgtaacgtagagcagtttacttcaagtgatctcggtttttgtattgggccgcgtttaaatgcagcagggcgtttagataatatgtcgattggggtagagcttttgctggcgaacgaaatgtcaaaagctagagaattagctttagatctcgatcagcttaaccaaactcgtaaagaaattgaagcaggtatgaagcttgaggcaataaaaatttgtcaaaatcttaccgcactttttaaagagttaccctatggtattacgctttatcaacctgattggcatcaaggcgtattaggcattgtatcatcaaggattaaggatcaatatcatcgtccagtgattgcctttgcacaagatagtgagggaattttgaaaggttctgctcgttctattgaaggtttacatatgcgtgatgttctggagcgtattcattcgcaacatcctaatatgattttaaaatttggcggacacgcaatggcggcaggcttgagtattcgcgaagaacattttgccgatttccaacatatttttaatcaaaccgttgccgattggcttgatgaagaacatatgcaaagcataatttggacagatggcgaactaaattcaaatgaatttaatcttgaaacggcagagctgataaaatcggtaggcacttgggggcaagagtttcctgagccttgctttgatggcgaatttaaaattttagaccagcgcgcaattgggcaaaataaaaatcatctaaaaatgttgctagaaccgaaacaaggcggggttttattagatgcgattgcatttaatattaatacaagattgtatcctgatctttcaattaaacaggctcgtttagcctataaattagatattaacgaatttcgtggcaatcgtagcctacaattattggtagattatattgagccgatagatgagtgatagaatgaaattaaagggaatattggcattttgtttgctttttttatcgtcgtttgttttagcagaagtcaatcagaaagaattttcagtgcaaaattctccgcacttgccatcaagggacacaatctattttgaagacgggcgtgattatttttcttataaagaacctattgaacaagtgtctcgagcggataaaaaaatccgcattcaattcttttttgattatgattgtcgagtgtgttcttcagcgcaggatattttagaactttatagccaaatacgcacatataaagttgtgttggaacaatatcctattgcaactgccgatagccagtttagcgcacgtattttttatactttgcaagcattaagtgcgagcgaattatccaatgttttgttatttgaaacttcagaaaaatcccgttatacagaattgtccacatcaaataaaattcagcaatgggcggaagaacaagggctagataagcagttatttattcaaactgaaaattcacaaagcgtaaaagaacagatccaaaatgcgattgaattgacggaagaatatggtgtttttacctatccttacgttgttatcggtggaaaatatgtactcactgcaagtacgctttataacgatgattatagcgtagcagtgttagattttttggtaaataaaatagaacaggaacaaaaacaatgaaaataggaattgttggtgcaatggcacaagaagtcgaaattttaaaaaatttaatggctgatagaacggaaactcgagtagcaagtgcggtcatttttgaaggcaaaattaatggtaaagatattgcattattgcaatcaggcattggcaaagtggcagctgcaattggcacgacggcgttattgcaattagccaagccagattgtgtgatcaatactggttctgcaggtggggtagcaaaaggcttgaaagtgggggatattgtgatttctgatgaaacacgctatcacgatgcggatgtgacagcttttggctatgaaaaagggcagttgcctgctaatcctgctgcatttttatcggataaaaaattggcagatctcgctcaagaaatggcagaaaagcaagggcaatcagtaaaacgtggtttaatttgttctggcgatagttttattaatagcgaagacaaaattgcacaaattcaagcagatttcccgaatgtaatgggcgttgaaatggaagccacagcgattgcacaagtttgttatgcttttaatgtgccttttgtggtggttcgtgctatttctgatggcggcgatggcaaagcaagtatgtcttttgaagagtttttaccattggcggcgaagcagtcttcggcattagtattagggatgattgacagactgtcgtaataatcttttaataagataataaatgctaaaattgaaggcatagctattagctatgcctttttatatgaacctattagaatttatagtttaaactcagaatataagttcttccacgtgcaaagttataaagcacggttttatcttttcctccatcttcacaatcctgacttttactacaaattgaatcatttaaacttgaataataacgttgcgaagccgcatcatttccagcatctaacggatcaacataacgtttatctaatagattttgtacttccgctttaataatcaaatctttgattggttcatagctgacgtgtaaatctaaaataatcggttgttttttaatctcttctgtttttttcacaacgtagtaagttcttttacctgaggtctttaattcaaagtgagatccattgatatattcttcttcaattgtcgcacgtttactttttccataataacgagctgccatacctaaggttaatttttgatcaaaccaacgtgtaccaatctctaatctgccgtagtcttttggtagcattgaaacacgagataagccataaccttgtttcaaaatgtcttcttttgaagcattattcggacgtgagctggcatcggcataattggttggctgattagtacgttgataagcgtaagagacattcgcaaaaaaacgtcccatatcataattaagctctaactccgccccgctttttttcacgataggttgataattttgatgtgcgatagtaaagcgaaaaccagtactgtctgcccacgtaggtacaacgccatctcgccaccaaacaccgtaaacattatggatatagtttttaataaagctacgataacccactaatttgatgcctagcacatcgtcttgagtgaagagaccttttttataagtattaaagcctagttgataggtatcagattgttcaggttttaatgccgtgtttacccctgcattagacacttgagagaaaaacatctcttgaatattcggcattctgtgtgtgcgtgaataagtgaaaaatggcataaaataatcgcttagctctgcacttaatgtagcggaatgattgaatgcctttttatgccctgatttatgcaaaatcggttcattaatttgattcgctgtattttcatatccaacatactcaccattaaacgcataatgggtaaaattcacgctgtaatttaaatggtaaatacctttagaaagtgcggtatcaaaatacaccgttttaaatttttgcttgccagaaggttgtaaaatcactgaacgttgtggcagtaaattacgattacctctaaatcgtcctaaattactatagttaccttgatcatgtgaatcatcgttataaaacaaacttaattcttctggaaaacggtttttactgtattcattggtaaaatagttaaaacctaatgtggtttttaaatcgatttcttttggcaacaagaaagtatggctgttgtttatatcaacaatatttgccacatttttggtaataagtttgtctgccactcgccagccagcaaaaaaaccacccttaggataaatggttttaccaatgttatgtgcagccattaaattaagatcgagatagttgttattattgaagttataattgacttggtaattacggttttcaattttgcgagaaccaattttattatccaatgtacgtatttgtgctcctaaattttggtgatcatcgccatattcaaattttaataaatggctacgcgagcgtgattgcaaactaccaggctcaattggtgcaacactatattgatctttattacgttcaaatgatttgtcagtttctttaattccatccttaccgttttggagctcgtcaatattctcaggttttgttccagcttttaattttttgagaatttcttttctatcgttttttctaggatcaaaagaataatgtgtacatttaacattctctatattctctgctaaacgaggagggtcttcgttacaagaccaagcgttcttacttagatcaggagtccactgtccagcatcatttaaaacataacccgcattacgaaaataagcttctttttctttcgcgagaatatcttgccctaatgatgctaatcgttctccgcctccaatacggtaatcttgtgaaacttcacgttggctataaccatacaccacgcctacatagccaccattatcaagccattttctgccagcagccatcgtcataaaattggatttagtggcattgcttcctgtcattcctttcagaataatgccaaatggtttgtcatcggtaataacatcattaacgcctaatgttctaaaattagcactgcctgctaacgcatttataccgcttgctcccgaaaagttacttttattaacatctacacctgcaataaaattaggatcgattgccgcaccaaattgagaacttccgcctgattgaccagagtctaaggctgtagaatagaaggtttgggttacaccatcaaccatcgtattgacacgacctaatccattttcgccacgaatatttacagaaacgacacccgagcctttatcttgttgagtaaatgccccaggaatgctccgaatcacttggtcaatggtttgtgtttccttaaagacattttcacgtgtacttttggctttggcttcagtgaaaggttttttatcgtttgatataactttttccactacatcaatttgtcctaatgtttcttcggcttgagcttgtgtaatcgtcataccgattgtattaattaggccaagtgtaattaaatttaattttatagctttcttcattatagttcctatttatttttgagaaatattacgattatccattttataagagggatttcaaggaatgatttaataaatttaatgaaaatacctaaaaaaataatgaaaaaaattaattttttagagaggaaacacgtttagaagatagagaaaaagaaaggttgatttttgcgaaatggacaaatttattcgctaaattaaccgcactttaatgggttaaagctcatttttgatagtagaaacataaaagagaaaaataggaaatgaccgcaaaagtgcggtcatttttggcgtaaattttatagattataaaataaaggtactaagaatagcgcgccaagtgcggcaatgataccgtaaatgatcataggtataatggttttcttaataattgtgccttcttggtttgaaatatttaacactgaacttaccgctacaatgttatttatacataccatattccccattgccccaccaacagattgtaaagcaagaacaagtgcgacagaaatgcctgttgtttctgcggtagaaagttgaacactaccaaatgttaggttagatacggtatttgaacctgagaaaaaggatccaatcgcgcctaagaaagaggagaaaatagtccagttactaccagaaatttcagcaaaagttctacctataatttttaccatagaatgttcgccacccactaacattaggtttaccatcactaaggcaccaactaaggcaataaatggatttttagattgttgtaaacttgatacaaaaatctgtttaacatttgaactggaaattttaaagacaggaatcgcaattagtactgtaatgacaaatggaatcaatgcgggtacgtaaagaagtttatagcttgatgaaacatttgagccaaaaatattttttaagctaaagattaaacctttgctaatttcaaataatcctaacgaacctaatgtggttgagaaccaaatagttgcatcattcatcattgctttgaatggtaattgatgaatacgagtcacaattaaaaatgcaataagtaaacctgtagggaataatgctttaactacttctcccgtacttaccgcattattatcaagggtatttgttacttttgctaaaccaatattgcgattagcagcccatacagaaataaataagccgattgcccccccaacgagtgatggaaattcgtaattgacttgagcaatcaagaaataaggtactacgcaacccagtacgctaatatagataaatacgatgtttttacgaatatcatcccaatttactaagatacgaagtgctaataatgggataataagtgcagcaatggagtgtataaatgctgtaatagacccaatttctaaaatcatatcttctgataattttaaagcaccaaaaccaaaccaagttggtgtacctaccgcaccaaaggatacgggaactgagttcataataagtgccaacatcgccacttttaatggatgaaaacctaatcccactaaaataggtgcagcaattgccgctggtgtaccaaaaccacttgctccctcgatcataaaagcaaacgcccaaccaataatcattaattgtgcaacgggatttggattaatatttcctagccattttcgcataatatttgttgcgcctgaaatttcagagaaacggttaaagagaatcgcaccaaaaattactgtaataggtgtttgtaccgcaataattgcagaaacaacatttgcactaatagtgacaatatctgtattaaagtgtaaaagatgaacacccataactaatgtcgcaatccaaggtaaggcaacataagaaggtagcgcgtttctttttaccataagataaatcagtaaaacgataggaaaaatacttagaataaaagacagcataaaatatcctcagagttagattaaaagatgtgattattttatggatttatatgcaaaagcatatacctattttaagaaaatgtgatcaatatctcataaaatttaacattttgttttcattttttacatttttattactatttgtgtttagttatagcattaatagaagaatatggaatatgataaagattgtttaataccatattaacattagcaggatcaccaaattctcactataatgcgcaaaattttgagaatgaaaggataatttgtatgggaatgattattactgttgatggtcctagtggtgctgggaaagggacgctttgttatgcgttggctgaaaagttgggctatgctttttattgataaaaatctccccttttaatcgaggagatttttattattcttctttaaattcttccatcatttcttgtgctttttttaccatatcttctgaaccaacaaaaagtggaacacgttcatgaagtgcggttggttcgatatctaaaattcgacgataaccatctgttgcgacaccgccagcttgctccgctaaaaatgcaataggattgccttcatataataaacggagttttccatttggatagttggttgcacttggataaatataaatgccgccttttaataagttgcggtggaagtctgctacaagtgaaccaatatagcgagatacgtaagggcgatgagtcgctttatcttcttcttggcaatatttaatatattttttcacaccttgtgggaatttcaggtattgtccttcattgatggaataaattttgccctcttttggcatttgcatattttcgtgggaaagacagaatgtaccgatagacggatcataagtgaaaccattcacaccgtgaccagtggtataaaccaacattgttgatgaaccataaacaatataacccgaggcaacttgtttattacctggttgcataaaatcttctaaggtaacaggtgagccaataggggatacacgacggtaaatggagaaaattgtaccgacggatacgtttacatcaatatttgaagagccatcaaggggatccgttaaaataatatattttgcattacgaccacgttccgtatcaaatgcgataaaactttcctcttcttcagatgcaaacccagccacttcttcacgtgccattaatgccgctttcatcgtgttatgggcgaataaatcgagtttcatttgactttcgccttgtacattttcaataccagattgaccgagaatatttgttaaacctgctttgttaatatctcgatgaattattttcgctaaaagacgaattgacgacaaaataccactcaattcccctttagcatttgggtattctgcttggcgttcaacgataaattcacttaatgttttcataattttccttttagtttttcataatacattgattaattatagggagtttggagtgtaaactctaatggcagattatcagaatgggatctttatcacaaaaaattcacattaattgttgtaatttttagaagctatcacttatttgttaattaattctggagtgattttgtgaatttgcgctccaaataaacttgggctaccataaccgcactttattaagccaaaaggtaaaaaatgaaaattgcattaggcattgagtataacgggcaaaattattatggttggcagagacaagaaaaagtccgtagtgtacaagaagaattagaaaaggcactttctcacattgcaaatgaaaaaattgagatattttgtgcaggcagaacggattctggcgtaagtggaacgggtcaggttgttcattttgaaaccaatgcggttcgtccagagaaggcttgggcttttggtacgaatgctcatttacctgatgacattgcggtggcttgggcaaaacaagtcgatgatgaatttcacgccagattttccgcaacagcacgccgttaccgctatattctttattgtaataaattacgctctgcgattttagcgggaggaataacccattgccatttagatttagatgcggaaaaaatgcatcaggcagggcaatgtttacttggcgaacaggatttttcctctttccgtgcggcacaatgtcagtctcatacgccttggcgtaatgtgcatcatttgaatgtgtctcgtatcggaaaatatattattgttgatattcaggcgaacgcttttgtgcatcatatggtgcgcaatattgtgggaagtttgattgaggtcggtgctggaaatcagccgattgaatggatgcaatggctacttgagcagaaaaatcgtcagcttgctgcaccaacagcaaaaccagatggattgtatttggttgatgtgatttatccacaaaagtttgatattcctaaacgcccgattggtcctttatttttagaggatggtttattaaatcgtactttgaagtaaagcgtaatttcatgttttaaataaccatatctgaaaatattcttcataaaaaaagaccgcactttaaaagtgcggtcaatcttaagtgagttttatattaattttgatattccataattcactaaaaatccaccaaccattagccataaataaattagtgttcctaaaacaagtggttttaatcctgcctttttgattgcgcttgcttgtgtcgttaagccaagggcagccatcgctgaaattaataagaaagaatcgatttcaactaataatttcacgagttcttttggtaataaatcaaaagaattaaaaatcgcaacgccaataaaaagtacagcaaaccaaggaattgtaattttgtgtgatgtattttctgatactccattactacgtgttaataaccaagaaagcattaataaaaatggtgcgagcatcatcactcggatcattttggaaatgacggcagtattcgccacgataggatcaatattttccccaatcgcatacacttgagccacttcgtgtacactagaaccaacataaataccgaattgatgggcgttaattaaatcttgtgaccacgtgtagaacaaggggtaagtaaaaatagcaagcgtcccgaaaatgaccactacggcaatcgctactgaaactttatgagattctgctttggtaacaggctctgccgccataaccgctgccgcaccacaaatactacatccagccccagtgagataaaccaattgtttatccatttttagataacgaatgcccaaaagtgcggtaagaaaaaaggttgaaattagcataatcgcatcagtgacaacagcatttaagccaacatcggcaatatcgccaaaagtaaggcgaaaaccatacagcacaatgccagtgcgaagaagcgtgcctttcgcaaataacacgcctttttccacttgtgttgaaaattgcggataaatggtattgccgattgccattcccagcaagatggcaataattagagcactgatatgataatgatgggaaaaatcagtgtttcctaaatagtgagcaagtatagcgataatcgcaataaatataagtccgaaataaaagggacgagtgttcatttttcctttccttagtgagtgtttttgtcttttacccaagcggtttcatctaaaattttgccaaaatagctttcgactaagcgacgagtaacatcagtttgtggatcagtaaaaagattttgagggctgccatattcaatcatttttccgtcatccattacgataatcgtatctgcaatatgtttaattacaccgagatcctgtcccacataaatataagatatacctaaacgttgttgtaaatcaagggttaaattaagcaattgaatacgtacagaagcatctaaattgccaattgcatcatctattataataatttctggtgctaaaattaatgcgcgtgctagggcaacccgctgcttttggctgatagagagatgcttaatattgagatttgtgtaatcaggataaagtccaacaagagagagggtctcaaagattttttcattacgttgtgtttctgtccaatctgtcgctaggcttaatggttcgtctaatatttgtccaatatttaaacgtggattaaatgcagagttggcatcttggaaaaccatacgaatatgtttagctctagattgggcatcctgatattgtaattctcgatcattaaataaaattcgaccagaagttggcggaataatgcccgctatcattttcactagagttgatttaccagagccattattgccaatgattgcaagtgtttgtttacgttcaagggtaaaactcactttatccactgcattgaattgatttcgaccaaataaactggcgtgacctttaaaagttttagttaaatcttccacttgtaataagggcattattcatttcctttgcaattaagtataaaaggggtggcggttgttttttctttgaaatttttttctcgtaaattaataggataatgacaagaaaattcgtgttgttttattttcaatcgtcttggtttttccatacattttttttgtgcaaaagggcatcttgggccaagacgacagccaattggcatttgctctaaaataggcgcggtgccttctaacgtacccaatttagttttaaaccccaaaggttgagtaaaatcgggtactgcattaattaaggcttgggtataaggatgatggggactttcgattaatatttcagtcggggcagattcggtattttgcccacaataaagcactgaaatttgatcgcaccattcactaatacttttaatatcgttactcgtaagtaaaattgttgttccctgattttggttcatactggaaagtaaacgaaaaacttgtagggcagtggttgattctaatgtatttgttggttcatctgcgattaataaacgtggctgattagcgacagccattgcgatcataactttttgtccttcgccttctgtcagttcgttaggatagcttgccataatatcacgatgatctttaattcctacgcgatgtaacaattcaatagcacgtctttttttccacccaaaccatttccaccatttatttttaaatgtccaattaggaatattttggatgagttgtttccctatttttcgacttggatcaaggcaagataagggattttggaaaatcatggatatttctttgccgacaatcttacgtcgtttattaggactgagttttagtaattcgatatcgtgaaaacgaaagcgatcggcagtaataatccaattttctttgattgcattacaaatgactttagcgattaagctttttcctgagcctgattcgccaactaatccactgatttccccttcgttaagggaaagattgacgccatctacaatttttatacgtccattggaggtttgaatttcaatattgaggttacaaatgtctaaaagtgccataggctattcttgatgttgattgatggctttagttaagccattactgaaaataatacttaataaaatagtaaaaataatagcgaaaccgggtaaaagtactgtccaaggtgcaagataaagtagttccaaagagtcttttatcattgccccccattctggtgtaggtcgttgtgcaccaagagaaataaaacttaatgcgctaatatccaacacggctataacaaaagcatgagccacttcttgaatataaataacagtaatattcggtaaaatagtgctttttaataaggtttgattggaaatgccttcaagttttagcattacaacataatccttttctaattctttttgaatagcgcgatagatagtgtgaatgaaataaggcaaaattgctaatagcgtagcaaacattgcattccataaacttggttccattaatgttgaaataacaacggcaattaatagaataggtaacgataaaaaagcatcaaaaatatgcccgacaaaacgagctttaatacctttcagtagtcctgcaataattcctagtgcgccgcctattattgccactgaaaagacaaccagtaaagcagaacctaaggtataacgagtacccataattaaacgacttaatatgtcgcgacctaaatcatcagtaccaaagaaaaaagcaatttttcctctatctacccaagaaggaggcattaattcttgcccaataaattgtcgattatcagcataaggtgcaagataactagcaaaaagtgcggtaaaaattaatgcgattaataaataaaagctaaaaagtgcgatggtattttgacgaaagcgtaaccaaatttgaaagattgaggtgctttcgcggaattcatcaggttctttatcttgcataccaacctttctttttaaatggatcgagtataaaagtgaatattttagtgaatgtatcaatcaaaataatacatacaccaataacaattacacctgcggcaatgctgttgtaatcttgttcatttacggcattaattaaccaacgaccaatgccaggccaacctaaagccgtttctaccaacatacattgcgttaatactaatgtgaatacacgtggtacttgtggaacaagcaggggaaaagtattacggaatacatattgatggagaattttccattttgaccaaccccgtgttgtcgctactttagaaaaattttgattcaaaatatattctgctcgttgatgaataatacggataatttccattgttggcaaaatacacaataccaatgttggtaaggctaaatgttgcaatatgttttgtacgatttttgtacgataaggtacttccataaaccacatatcaataacaggaaatcccgtaatgggtttaatttcgtaaagcaaattatattgtccaatagcggcaatttcccaatgtgagagcgcggcaacatacagtaaaatgggggctaaccaaaatattggaatagatagccctacataagataggatttgtaaactttttgcaaaaacttgttcagaattgaccgcacttataatgccaagtggcaaaccaaaaataaatgccaaaaacaatgtaatgaaacaaagttccaatgtgggaggaagaaccgtaagaataaggttcattaatgattttccaccgttataggtaatgccaaaatcaccttgtaacaaggtgcctaaataatggaaatagccgatataaatgttttgtgtaacaagattcgcattaagaggatcgcgcaataaaataacaaagcctaatagcgataatacgagtaataataatgccacccacagaatatggcgaagaaccgaccagaacattagtgtttctcctgaataaaatataaggtggaaaaatctaagctaccaaaaggcgtcatttttactcctttcacacgactatttgcgactaaaattcgttttacattggcaataggaataatgggtaattcacgtaaaacgagttcttgggcttcattataggcttttgcgcgtgaacttaaatgtgaggtggtaatggcacgatccataaattgatcaaattcttcattacaccaattagataaattagtgagttcattttttgttccacagcttaaaattggacgcataaaaccatcaggatcaagattaccagctaaccaaccagatagaatcaaatcataattttccgattgattgcgtaattgtgcagttaaaaatggacgagttacggcacgcactttaactttcacacccgcttgagctaaatcccatttgatcatttcagccattttaaaaggtgctggattatagacttgttcttcattaattacccataaatttaacaaaaggtttttatctgctaatttatttttggcgattttgggatggtaatcaaactcaaattctggcgtattgacagttgaagcccaagacacttcaggaataatgttattagcaacagttgctgtgttatggtaaatgctatgaatgattcgagctcggtttaaactttgtgaaatagcagcacggatttcgtgatctcgcattaatggcttatcaaaattaaacgctaaataggctaaattcataccatcagtagattgcatataataatgtttgtcatcattttttaataagccaatttggcttacttcaggataagaggcgatttgacattcattattgaaaaatttgactaaacgtccgctgcgatcagtagaaagatccacaataatatgttctatcttggcttcttttttccaatagttttcgttacgcactaagcgaacatattggttatatacataatcttttacttgataaggccctgtgcctactgggtgggtatctaattgagcaaggttgtcatctgcgcttaattgataggcatattcttgtgaaaaaataatggcatactggctggcaagatgcgacaaaatggaggaatctggtgcaaataattcaatttttacttgataaggcgaaagtgcggtcacagatttgattttttcgttaagtttaatgctatcaaaataaggaaaacgcacttttcttgcttgttcgtgaaacactctatattgtggattactataggtaacattcgcctctgctaaggttggtaaataagtattatgccctaatacacgattaatcgaaaatactacgtcttcagcgttaaaatcacgtgttggggtaaaccaaggggtttggtgaaattttacgccgtgacgtaaatttaataaaatttctttaccatcagctgaaatggaataagattgtgccagcattggtgttaatgttgcactgtgattttttatatcaaataatttgttataaatttgttccgtgaccacattcatactggttcctgcatctgctgtttgcggattaaatgaaaaacctgaagcgtgggtgcaataagttaagccattttcagttaaaaatgttggaacacttggcgcagcctgtaattctacactttggcttatacagagcagaaaagataaaaatctcagatttagacgtaacataacaaatgcattgtgataaattatgtgtcaaattgtaaggcatattagtaaaaatggctaggatattgaatgtttaatcgggttcaaaaggaaatcaatcaaattattaatcgtggttttgatcgcactttgcgtttagcggtaacagggttaagtcggagtggaaaaacggcgtttattacaagtttaatcaatcaacttctctccattaatcaacattcatcacagaatttgcccttgtttgaagcagcgagaaatggtgcgatcttggcagtcaaacgagtatcccaacaagatctcagcgtgccacgttttgattatgaaagtaatttaaatgatttgtcacaaaatccgcctcaatggtttcaatctactcgtggcgtgagtgaaacgcgtttagccattcgttttcaacgccaatctggcttgctacgccatttgaaagaacgaggcacgctttatctagatatttttgattatccaggggaatggctgatcgatttgccgttattaaatctagattttcaacaatggtcacaagagcaaattaaggtaacaacaggcattcgtgaagaattggcggagaattggctcgctatgttgcaggatttggatttaagtgcggtcgcaaatgaagatgttttagccaagatagcgaaaagttatacggattatttacatcaatgcaaagtgcaaggcatgcaatttattcagcctgggcgatttgtattgccgagtgatttagagggcacgcccgcattacaatttttcccattaattcatctttcagaagaacagtggcgaaccttgaaaaaaacagcaaaatcaaatagctattttgctgtgctgacaaaacgttatgattattatcgcaataaaattgtgaaaggtttttacgaaaattatttttctacctttgatcgtcaagttattttggcggattgtttaacgcctttaaatcacagtcagcaagcctttttagatatgcaaatgggcttaaatcagttatttaataatttccattatggcagcagaaattttcttcatcgtttgttttctccgcgaattgatcgattaatgtttgttgcgacaaaggcggatcatattactcgtgatcaaattcctaatttagtaagtttaatgcgccaaattgtgcaagagggtggtcgccatgtggaatttgaaggaatcgatacggaatataccgccattgcggctgttcgtaccacaaagcaagtgattgtgaatcagcaaggaaaagaaattaaagcaattcaaggggttcgttctattgataaacagctgattacactttatccgggaacggtgccgagcaaattaccaagagcagaattttggcaaaaacaaccgcactttgattttgatagttttgaacctcagcctttagaacaaggggagagcattcctcatttgagaatggatgcggttttacaatttttattaagtgatcgatttgaataaaaagtgcggaaaattttccgcacttttttcatctttctagcctgtattgcgcatcccagccgcgatacctgtgatggtaatcatcaatgcttgttccacatcgggattgacttgctctggattttcacggaaacggtgaagcaattccacttgcagtagattgagtggatccgtgtagatattacgtaatgcaattgaatctgcaatccaaggtaaatcagacatcaattcactttggtgagaaagtgaaagcacagtttgaatatcatcttcaagttgcttacgtaaattttcacctaaataccaaagctcttttttcactaatcgttgatcatattgttgggaaagccaagtatccgatttactaaataccatttccaacattccgattcgcgttgaaaagaacggccagttttcgcacattttatgaataatatcgcctttgccttgttcaataacttgacgaatagctgcaccagcccctaaccaagctggcagcattaaacggttttgcatccaggcaaaaatccacgggatcgcacgtaaactttccacaccgccatttggattgcgttttgcagggcgagagccaagcggcaatttggagagttcctgttctggcgtcgcactgcggaaataaggcacaaaatctttatcgccacgcaccacaccacgataaatatcgcaagaaatcgtggaaagctcgtccattatagtacgccattctggtttcggttctggtggtggtaaaagatttgcttctaaaatggcgctggcgtagagatcaaaggtttctactgctactgcgggtaaacccagtttgaaacgaatcatttcgccttgttctgttacacgtaaaccattttttaatgaacgaggtggctgagaaagtaatgccgcatgtgctggcgcaccgccacgaccaattgtgccaccacgtccgtggaataaagtgagttcaatgccaagtttttctgttaaatttactaaggcttcttgcgcacggtattgcgcccaagaagcagccatcattcccgcatcttttgccgaatctgaatagccaatcattaccatttgacgattattgatcacgccacgataccaacccacattgaaaagttgagtcatcactttttcggctgcatctaaatcctctaaggtttcgaataatggcacaacaggaatatgatatggcacgccagcttcttttaagagtaaatgaacggctaaaacatcagatgcactgcgcgccatcgaaataacataacacgcaatgacaccttgtttttgttgagcaatgactttacaagtatctaaaatttctttggtttcaggcgatggcgtccagttttgcggaatcaatggacggcgagagcttaattcacgaattaagaaagcctgtttatcgtcttccatccattgagagtaatcgcccaaaccaatatagcgcatgatttcagcaatggcatcggtgtgacgagtgctttcttggcgaatatccatttgagaaagcgtcacaccaaaacaactaatacggtgcaaaatatccaacaatgaaccatttgcaataatgcgcataccacattgaattaaagattgataacaatcgtaaagcggctcccacagttgattatcttccaaaataatctcgctttcggagactcttggtgtgcgattagataagtgatcatcaaaataagctaatgttgctgtaagttgattgcgtaaattttttactacgaaacgatagggttctaaatgttcgccgtatttatcacgaaattcatcgctacatttcatcattgaaagttcatcggctaatttgctgatgtcttgtaagaataaatccgccgctttccagcgggcaaaataaagtacttttttggtaatttgtgcggtaacaaatggatttccatcacggtcgccgcccatccaagaggaaatacgcacaggttttaatcctaccggcaaatcgtaacctaaaaattcacgggcggtttcgttgagttggcgtaaaaattctggcacagcttgccacaaactgttttctaacatcgcaaagccccatttagcctcatcaaatggcgttgggcgaacagtacgaatttcgttggtatgccatgcttcagcgattaaacgaagtaatagacgttcaataatattgcgttctttttccgttaaatcatgatgttctagcttgcttaaacatttattgatttcaatgtgtttatgaattaatgaacgacgtgttgtttctgttggatgtgcggtcagaacaagctcaattaataatttttcgacggttttatgcacctcttccactgaagcattttgttcttttaagcgtttgaaaagttcgcttaaggattgagaagaactttgtgcaagagaatgttcacgggaaatggtttgatattgttctgctatgttagtgaggtttaaaaattgactgaaagcacgtgcgacgggaataatattttcattagaaatactaccgagcgtatcgagcaatgcttgtcttgctttatcatcgccagcacgagaattacgagaaagtttacgaatgttttcgattaactcgagaatatcctcgccctgtgcatcattgatggtttctccgagaaaacgccctaacatactaatgttattgcgcagagtactgtactcttgtgtcataggaactcctaaaagtaaaaaataaaatttgtcagttggcgatagatataactaaaaatagggtggagggcaaatgctattcagagaaattttgaaaataatcaagaaaagctaaaaaatagctaaaaaagaaccgcactttttagggattatttaaaaagtgcggtctatttttgctaagtttataaaatcgatttaacggattttcgaatgataagctcaggggttatatcgatacgactatattgttgaacaccttcatctttgtgagtaattcgttctaatagaatatttactgcctgtctgcctaaacgtagttttgattgatgaatggtggttaatggtggtgcgtagaaacgtgaggcgtgaatatcatcatagccgataattgacatatcctctggcacacgcaagcctttttctgttagtgctgatattgcaccgagtgccatcacatcgttacagcagaatagggcggttggtaattcctcttgagtcagtaaacgattcatacattcatagccatcttcaggctcaaatgcaccctctagtacccaagacggattgattgttaatttagcttcttccattgctttttcaaagccttcataacgcgttcttgcggtagttttattgagttcgccgcagataatcccgatttttttatgaccgcactctataagatgtttggttgctaaataaccgccatcaaaactatgatcatcaatcacatcggtattcgcatttgggccccaatccattacaaccattggaatagtggaaaatgatgaaagtaaatccaatgaatcctgagtatattcagaacacattacaagcaaaccatcgacccttttttttgccaacatttctaaatgatttttgactttttcaggatcattttgtgtgttacacaaaaataaagaataaccttgtcgatagcaatgttcttcaacagaatggattatttcggcaaaatacggtgcttcactggttgtcacaatcataccaatggatttggtggtattgacttttaaactgcgtgccacagcactaggggaataattaagttgtttaattgcggataacaccgcttcttccgtatcttttgcaacgaaacgggttttattaattacgtgagatacggttgtggtggacacaccagccatttttgccacatctttaattgttgccatatatttaaatccctaaaaaatttttcctattataaaggtttgttgagaatttagtcatctttattgcaaattttttataaaaagaagtgattttttcgtattattcttgctagaatgtctgcgttattttttttatgaggagaacaaaatgagcgattttggttatgcaatgattatggttgtttttagtatgtctgttgtcgtggggcttgcactttcaatcttttaatcaaatcaactttttattatcaccgcagttttgtttctacaaagtgcggtgattttttttcggtgttttgcttgcccgtttaaaatatggtaaaactaatgccgttttattcacaacatatataggaagttctatgtcaaatttacaagcaattattgaagctgcatttgaaaaacgtgcagaaattacaccaaaaaccgttgatgcagaaacgcatgcggcaattgaagaagtgatcgaaggattagattctggaaaatatcgtgtagccgaaaaaattgctggcgaatgggtaacacatcaatggttaaaaaaagcggtattgctatctttccgcattaacgataaccaaatcattgacggcgcagaaacaaaatattacgacaaagtggcattaaaatttgcggattacactgaagaacgttttactgaagaaggtttccgtgttgtgccttctgcaacggtgcgtaaaggcgcatatatttctaaaaactgcgtattaatgccatcttatgtaaacattggtgcttacgttggcgaaggcaccatggtagatacttgggcgacggtaggttcatgcgcacaaattggtaaaaacgtgcatttatcgggtggtgtaggcatcggcggcgtgttagaaccattacaagctaacccaaccattatcggcgataactgttttattggcgcgcgttcagaagtggttgagggtgttatcgttgaagatggttgtgttatttcaatgggcgtattcattggtcaatcaaccaaaatttatgatcgtgaaacaggcgaaattcattacggccgtgtaccagcaggttctgtggtggtatcaggtagccttccatcaaaatgtggaaaatatagcctatattgtgccgtgatcgtgaaaaaagtggatgcaaaaactttaggaaaagtgggcatcaatgaattattacgttctattgaagaatagtaaaaaatataaaaaaagaccgcacttttaaagtgcggtctgaaaatcaaaagaaattaagcagcgaacggatcacgtaaaatcattgtttctacacgatcagggccagttgaaagaatatcaataggtacgccagttacttcttcaatacgtttaatatagttaatgcagttttgtggcaatttatttacatctgtgatgcggaaagtattttctttccaacctggtaatgtttcataaattggttctacaccttcccaatctttcgccgctaacggtgcatattcaacgatttcgccatttggcattttgtaagcaacacagatttttacttcatcaaaaccatctaatacgtctagtttagtcatacagaaaccagaaatagagttaagttggattgcacgacgaatggcgacggcatcgaaccaaccgcaacgacgtggacggcctgttaccgcaccaaattcgttacctttacgtgcaatttcagcacctacatcatcaaataattcagttgtgaatgggccaccacctacacgagtacagtaagccttaatgataccaagtacataatcaagattacgcgggccaaaaccagagcctgttgcaacaccaccagccgttgtgtttgagctggttacatacggataagtaccgtggtcgatatctaacattgtcccttgtgcgccttcaaataaaatatgttcgccatttttgcgcgcagtatcaagaattgtagtgatatctgccaccatacctgtgattacatcggcaattgccattacatcatctaaggttttttgataatcgacaggttcaactttgtagtagttcaccaattggaaattatagtattcaaggatgtttttgagtttttcggcaaaggcttctttattaaataaatcgcctacgcgtaaaccacgacgagctactttatcttcataagctgggccaataccacgaccagttgtacctatagcttttttgccaagggctgcttcgcgtgcgtgatccattgcaacgtgataaggcagaatcaaaggacaagcttctgaaattaataaacgttcacgaactttaatacctcggctttcaagttcgcccatttctttcattaatgcttcaggcgaaaccacaacgccattaccaattaagcaagttacgtttggatgtaacataccagatggaattaaacgtaatacggttttttcgccattgataataagtgtgtgacctgcgttatggccgccttgataacgaactacgtattttacgcgatccgtcaaaagatcaacgatttttcctttaccttcatcgccccattgtgcgcctaagataacaacgctttttcccataatttccgccttttattcggttaaattagtcaaatgaacagccgtttactttactctttttcggctttaatctcaatgatataaaagaaaaagtgtggtgatttttcaccgcactttaggtttaaattttattcaaataaggatttgtgtaacgagcgtacaatttcatcagaatgttcactttgtactaacatacaaacattgttggtacttgccccataactaatcattcgcacattataagattgaacagtatcaaaaatacgttttgccacacctgaagtgatatgcagatcattgccaattaatttttcacgttctgtcgcttttacaccatttactaaagccactaataaatttgttacaccagctgatgcagaaagcacaactacgcgtgtattgggatcggcaatgacaatttttgcacaagctgtcatcgcattgtagttagcaacagatgttccgccaaatttggcgactgagagatggggcataagatactcctagatgttgtgttttttttagaatagtgggtatagaaataacgatttaggcattttttgtcaaataaattttaattaacaataaatgaacgcataaaagaaaaaataggattaggaaaaatttggctgttgagaaagccatataagttgtttaaatgaataaaaaataagtgatatgcttcattaataaccaaacaaacataaaattactttttttgtaaaaaagtatttgacgaggatcatcaaaattagcataatacgccccgcaaagccgatatggttaagcaaattaagtgatggctacatagctcagttggttagagcacaacactcataatgttggggtcgcaagttcgaatctcgctgtagccaccaaatttgcgggactggcgaaattggtagacgcaccagatttaggttctggcgccgagaggtgtgtgggttcaagtccctcgtcccgcaccatttatcgctttgtaattcaaatagtcgttggggtatcgccaagcggtaaggcactgggttttgatctcagcattcctaggttcgaatcctagtaccccagccatactatcaaaaaagtcttctttatatctaatcaaagatttatctaattggggtatcgccaagcggtaaggcactgggttttgatctcagcattcctaggttcgaatcctagtaccccagccatattttcaatatcttcgtaataacttgcaaaaatcgttatttgataaaaaattaaagtttaggtatttattgggaaataattaaaatactcagaacaaaaaagctaagattgatctcttagcttttttactttgttcaaacttgtgaattacgcgcgtttgaagtcaatgtgaaccaattttggtttgaatgggtgacgttgcattgcttgtactttaactgcaacttctttaccaccgatcactaaagtaatcacttcagaatagaaagattcgtgtgcttgcgcgttgtttaattcatcgtggtttaagatgattgaaacgggctcttcgctgccaccataaacgattgcagggatttgaccattgttacgcaggcggcggctcgcacccttaccttgcgctgtacgaacttcagcgttaaatttaaatgccatttttatgttctcttgaaattaaatgttaaaagaaagaaaatcgcaggcgacccagcaattttcctaaaaaccgctcaaagacaagccttgagagccgtggattatagaatatccttattttcaaatcaaacttttttctaggctttttgatttgaaaagattaaaatgtgaaccaattttttatcacatctattaatataataaaaaagcaggaacaaatggaatttttaattggattttttactgaatatggttattgggctgttctttttgttttaattatttgtggatttggtgtgccgattccagaagatatcacgttagtttctggcggtgtcattgcggggctttatccagaaaatgtcaattctcatttgatgttgctggttagtatgattggtgtgcttgctggcgattcctgtatgtattggcttggtcgaatttatggcacgaaaattttacgtttccgaccaatacgtagaatcgtaacattacagcgtttaagaattgtgcgtgaaaaattcagtcaatatggcaatcgagtactgtttgttgcacgatttttacccggtttacgtgctccaatttatatggtatcaggtattacacgccgtgtaagttatgttcgttttgttttaatagatttctgtgctgcgattatttctgtacctatttggatttatcttggggaattgggggctaaaaatttagattggctacatacacaaattcaaaaaggtcaaattgtgatttatatatttgttgggttacttgtactattctttttttggaaatggaaaaaatctaaaaaatcaacgcaataatagaataataaacggctaaaaatatttctatttttagccgcactttttaattttcttctttattttcttctttattttctttaaataagcctgatgcaccatccgaataatctctaggctgttcattttgagatttatctgttgcagtaattaactgttgggtgaataaacctttgtgatctttttcgcccagtaaattattggaggaagttgcgtagtggcgataaagtttttgataatcgttaattaaggttttgaataactcagcactttctgcaaaatgtttttcgatttgcgccttttgtgtatcaagctgggttttgactgtttttaattcagcctctgttttagcttgatgttttaccgagcctttggttaaacgcacaataatgtaaccaataaataacccaacaataaaagcgataccaattgctacccaaatttcatttgtccaattttccataatattctcctgtttattcggcttaaaaaactaacaagttgcaataataacaatttcaactttccaacgaggatccgctaatttagcttccactgtcgctcgacttggtgggctaacatgatcgacccattcatcccaagcttgatttaattgaacataatcttgcatatctgccaagaaaatttgcgcagttaaaatattgcttttattggagccaatttctgctaacaatttatcaattaaacctaatacttctttggtttgttcgtaggtattttgctcgatggttaattctggaacttgccctgcaaaataggcgaggttgttatgaattgaaacttcacttaaacgtgcattgggtaaaatgcgttgaattgtcatagggttctcctttggggtgttttcttctattctaaatagcctttactgctttgtaaaatcctctttactaggctaaaatatccgacaattattctcaattatttaattattatgaaactgcttatctctaatcagcacggtgctattgttatggcactactgccttttatttatggtatgttgcttgctaatccagtatgggcgcacatgtttttattattaggatggttttcgctttatttgatgacttatccttttttgaatttgtttaaaggtaaaaatcttgagttatataaaaaatggtctgtgatttattttgctgccgccgtgatttttgcgattcccgcgttaatttataattggcaggtgttgtattttatgtttgccatgttaccgtttgttgcggtgaatatttatttcaccaagaaaaaagatgagcgcaatttatggaatgacttggcagggatcttaatttttgccctagctggaatgggatcctattacttttctgaccgcacttttgatgaaaaaatactttgggtggcgatttatccaacattattttttattggaacaacactttatgtaaaatcaatgatgcgtgaacgaaaaaatccacgttatttttgggcatcagtgatttttcacttattatgtgtgctgatttttgtggtttcgcaacaatttattttagcattagcttttgtgcctggattagtgcgagcggtttatctgcccactaaaaagctttctgttatgcaagttggactaacagaatttgcgattactgccgtattttttattttacttttagtagcaaccttgtaaatgaaactgaagttattttttcatatagtattactttgttttagtttgcctgtttgggcgatgaaaaccattgatattacagcgaattcgaaaatggatgatcaagcaagaatgaatttggcgcaagagtttgccaataaacagcaatggagctctgttttcgatatcatgtatccgatggcgttagagggaaacaccactgctcaaagcaatctaggtatgttatataaccttgggcgtggcacggtgagagactatgaaaaggcttattggtggtttagcgaagcggcagagaagggtagtgtgaaagggctaaataaccttggcgttatgtatctacgtggcgattacgtcaaacaaaatacagagcaagccattaagctttttgaacgtacagctcgagctaaagatacggatgcgatgatgatgttaagtaatatttatcgcttacaaaaccaacctgaaaaatcattggaatggctgaaaaaagcagctgaattaggcaataaggaagcaaaacagcgtttatctagtcagccataatcttaaaagtgcggctattttaatcgcacaaatttcacgccactatgttgcaatagcaatttcattggatcttcatcattcgagactgttttttcacgtaattcaattaatttcatccgtaaatgggcgagttcgtgaatccttgttgccacctctttaatgtgtttatctaacacacgattaatttcttctgcttgttgtttggaggcattttctaaattcagtaggctttttatttcacttaatgaaatatctaaatttcggcagttacaaataaatgataaacgttgcaagtgttcttcattatattgccgaaaattgcctaaagtacgttttgggggcgggattaaaccttgttgttcataataacggatggtttctacggtacagcctagggctttagcaagtgctccaattttcatcaatttccttaaaaaatgacttgattctaaagttacttcatattttatcatacgcctagattttcttaaacaaacaaggagtatccaaaatggaattgaaaaaaatcgctgtaggattaaccgcacttttaggtatgtctgttgctaacgcacataatgtttggcttgagcctgcttcatcgcaagatgaatacgtagtgaaatttggacatgaacaaactgaaacctatccagaatctaaacttaaatctatccaagccttaaatgcgcaaggcaaattaactgctgttgattaccaattcagaaatggcgaagcctatcttatgcctaaatcagatttagttttcgttcatttcgataatggtgtatggtcaaaattaccaagcggtaaatacgttgaaaaaacaaaacgtgaagaaccaacagcagaatttagtactaatcctgttaaatttggtaaagcgattttgaaatgggatgctgaatctttcaaatctcatcaacaagcatacgaattgattcctcaagaaaaagcacaagcgaataaaccactttctatccttgttttacataatggtaaaccagttcaaggcattaaagtgggtgtgagtgaagatgcaccgttcaatttaactaatgaaaaaggtatcgctcaatttaccccaactaaaggcttcaacaaagtatgggcagagtttgaggaaaaagtaacaaataatgcagattacgatcgtcgaactgtggaatatatgctaacttttgatgcgcaataatatggatttgggatgaaaaaatttgcttttttaaccgcactttttgcggcttgctatctcccgaatgcttatgcccacgcgctttatgtgtttgcccaatatgatgggcaaacactttctggcaaatcctattattctgatatgaccccagcagctgaaacttatttagaagttttccgctcaggtgtttctgatcccgttttaactggaaaaacagaccgccaaggtgcatttaagctttctattgctgatgtaccacatacaaccttaaaagttgtggtggaaggcgatgaaggacaccgtgcgtccgttgttgctgctgctcatacgtctgccgaaaatcaaagcagtgcagatttaatgctgcttcgtgaagatattgcgcatttaaaagataaaatttatttgcatgatattttaggtggaatcggttatatcgttggtattgctggacttattgctttacgtaatgcgcgtaaaattaaacaaggacgtatttaatgcatttatctgaaggcgtgttacatacgcctattttattagctggtgcagtgcttgctgttgcgggcattgctgtgggggtacgtcgtttagaatcagaacgtttaccgctcaccgcactttttgccgctgcattttttgtggcaggaaccattcatgtgcctgtaggaattggtagcgtgcatttaattttaaatggcatggctggtttatttcttgggtgggccgtttttccagcattcctcatcgcacttttattgcaagtcattttcttttcttttggtggatttgccgtgttaggtgtcaatctttgcgtgatggcaataccagctgtgatcgcttattatcttttccgttctcgtttacagccacaaatggcattaaaagatcgcttattagtcggtattggtgctggcgtaattggcgttggcggagcaggcgtgcttgcttcttttgtgctgatgttagatggtggtaaaagttatctgaatcttgtttggctcttgctagtctctcatattccagtatttgttttggatagtattatcagcgtaggggtgattaccttgcttggtaaaatgtatcctgaagtcatgaatcgtaccgagaatttctcttaatgaaaattcatcgcttatttcaaccgcactttaggttgatttatctgtttatctgggggctaatcattagtggattgagtgatcttacttggcttatctcccttaatgtgcttgcagtttctctcttttttatttcactgcagctcagtcaaaaatcttttttgccttatcttaaacgttggtttgctttagtcatttttattgctttaatgtgggcggcattaagttggcaaattggagaaaatggcattgaactcaattttcaaggcattgaattagcagaaaaattgagtttgcggactcatttattgttgatttctctttggctttttttgtggaatattaatgatgcagtacttgttcaagccattggtaaattgcctttgccagaaaaattaattcaactttttgtgctgaccgtacgttacattgcactgcttggcgaactgcgtcaaaaaatggatattgccatgcgagctcgtggatttcgtcctgggcttaatcgccgaaccctttatgtgacggctcaaagtgtcgctttattattgatccatgccctattaaaagccgaaacggcgcaaatggcgttaaaatgtcgtggttttcagtttggcaaaaagagagaaaaataatatgttagctgtaaataatctttgtatagaacgcaatggtagagcgattattcaagatttgagttttaccttggaaggtcaaaaacgcctcttcgtacaaggggaaattggttcaggaaaaaccactttactgcttgctttgttgggatttgttcctgtaaccaaaggggaaattaaattatttggcaaagtttgtcgtgaagaaaaagattttgcgccctttcgtggcacgattggtatttgttttcaaaatgccgatgatcaactttttggcccaacagtgttggatgatgttgccttcgggccattaaaccaaaatatgcccagagagcaggcgtatcatatcgcagagcagcaattagaacgtcttggtatcacaggtttaaaagatcgtatggtgcataccctatctggtggtgagaaaaatttcacggcacttgctggtgtcttagcgatgcagccaaaaattttattattagatgaacccaccaatggattagatcgaaaaaatactgaaaaattgaccgcacttttgcgtgagctttccttacccatgttgatttcatcccatcatcatggatttattaacgaattagccacagaaattattagatttaccaacaaatgaaccattgccgagaatttgttaatgattaaataaaattaaagccttgataatcaaggctttattttttacttacaatattttagaggatatattatttctaaccctattaaagcactttcacaatgctttcacataaatagcgaatattatcttcagtaataccagccacattgatacgaccagaacgaacagcataaatggcaaattcttcttttaagcgatccacttgttccccagttaatccactgaaagagaacataccgttttgttcaatgataaagctgaaatcttgttccgcaccgtattcttttaataactgaacgaataaatgacgcatttttttgatacgttcgcgcatttcagttaattcattttcccactcttggcgaagttgagtgtcatttaatactgttgctacagttgcgccgccgtgagatgcagggttagagtagagtgtacgaataattgatttcacttgggttaatgcggttgatgcaatttctgcattttctgccacaagagtaaaggcaccaacacgttcattatataaaccaaagtttttcgagaatgaactcgctactaacaattctttgtggtttgccgcaaaagcacgcaagccataagcatcttcatctaatccattggctaaaccttgataagcaaagtcaaagagtggcaaccagccgtttttcgccgaaagtgcggctaattcttgccattgttctggagtagggtcaataccagtcggattatggcaacaaccgtgtaaaagcaccacatcgccttcgcttgcttggcttaaatcttcaagtaaatgatcccaatcaagggctttgcgttcagcatcataataacgatattcacgaattgtcataccgacggcattgaaaatggcattgtggtttggccaagttggggtgctgatccaaacattttgtgctttagtttgacgtttaataaattctgccgcaatgcgtaatgcgcctgttccgcctaaactttgtactgttcttgcacgattagatttgatgacttcagaatctttaccgaaaagtaacgcttttgtttgttcgttataatcagcaataccatcgatagtcagataatttttcgttttttccttatcaaataagcgtttttctgcttctttcactgcacgcataatcggggttgtgccttgcgcatctttataaacgccaatacccaagttaattttattttcgcgagtttcggatttgaatgcttcgcctaagcctaagattggatcggctggtgccgctttaatatgttcaaacatagcttttccttatgtatcagttgtgtgatggataattttatacttcagccgttttattttatcaagaaagatttttataaaaattaaccgcactttaatatttttaaatatttatcaaaaagtgcggtcattttttacattattttagtttttcaatcgcccaatttaatcctgattgataatcttcgggtaattcaattcggagcttttctaattgttgaataatgaccgctttattaggatgagaaagattgatatgcccaaccttacgcccagccctcacttctttaccgtaccaatgaagttgtgcaaaaggtatattaagccattttggattatggtttgtgccgattaaatttaccattacacttggggcaaaaatttgtaagtcaggtgttggcaaatcaagtagcgtgcgtaaatgtaattcaaattgactaatagcacatcccagttgtgtccaatgtccactgttatgtacgcgaggcgcaagttcgttaattagtaatttgtcgcctacaacaaaacattccattgccatcacacccacatagcctaacttatccataattttgccgagcattgtttcagcttgtttttgttgtgcggattgttgaggaaatgcattatcaatcacactgtaacgcaaaataccattttgttgcaggttatgcgtaacgggataaaaacgcttttcgccatttttaaatcttgcgcctacaatagaaacttcataatcaaaaggaataaatttttctgcgatcacttcaccaaataagtcatcagtgatgtccgctttgttttcatcgctgataatccattgaccacgcccatcatatccgcctgttctacgtttgacgacgactttctcgccaacagtttggaaaacatcattccattgcgttttatcttttaataaacaccaaggcgaggtagaaagattgagttcatcaagcaaggatttttgagcaaaacgatcggctaataatccaaatacatgttgattaacgaagtttttatgattgccgagtaattcagtcaaaggtgttttttcccagcgttcaatttctgccgtgatgatcgcattttcaggtaagtcaaaaactggcgcattgaaggctaagggttcaacataaatatctaaaggtgcaccagcgtaacctaacattctgccgagttgtccgttgccaagtacataaaccgttgggtataaggtggagttttgcataatatttctcgttaaatttacgaaaaaaacaaccgcactttaaaagtgcggtcagatctgaagatatttttatgtgcgtggatcgggattatcaagcacattactcgtttggctttcacggaaagattgcaagcgtgaaagcaattctgcatcccaacttgctagaatttgtgcggctaacaatccagcatttgccgcacccgcagggccaatagccaatgttccgactgggattccttttggcatttgcacaattgaataaaggctatctacgccacttaacatagaactttttactggcacacccagcacaggcacaagggttttggctgcgatcatgccgggtaaatgtgccgcaccgccagccccagcaataattactttatagccatttttttgtgcattttcagcaaattcaaaaagtttatcaggcgtacgatgagcagagacgatttccacatgataaggtacttttaattcatctaaaatctgagttgcctcttgcatggtagcccaatcgcttttggaacccatcacaacagcaatttgtgcagtttttgacatgctattttctcaattttctaattaaaaaggtggcgtagaatagcatagattacatatattgagcaaacgtttgctatttatgtaagtattaatggggattattttataattatttgatttttaaattttagtaactatacttgataccaaattaatgggcgatagtttatatgggacgaactgaaaaattattagataagctcgcacaatcaaaatctacatttaattggaatgaattagtttctttgttagctcaacaaggttatgaaaagcgagaaatggcaggctctcgagtgagattttataatagaacactcgaacatacgattttgttacacaagcctcaccctgaaaattatattaaaggtggtgctttaaagtcagtgaaagaatcattaaaacaggtaggtattctatgaagttattaaattataaaggttatgttggcacgattgaggcggatttagaaaacaatatattgtttggcaaacttgcttacattcgtgatttagtgacttacgaagcagagtcattatctgagctagaaaaagaatttcgtcaatctgttgatttatatttacaagattgtttggaattaggtaaagaaccgaataagccttttaaaggtgtatttaatgtacgaattggcgaggaattgcatagagaagctacgatcatagcaggcgatcgttctcttaatgcttttgttacggaagcgattcaagaaaaaatttttcgtgaaaaaccaagtttaagataacaaaacgtatttacattttctttcatcaaaagtaggtcaaattatgttagccaaagcaaaatatagaaaagattacaaacaaccagattttacggtcacagacatttatttagattttcaacttgatcctaaacatactgtggtaaccgcaagcacaaaattccaacgcttaaatgatgaagcgacttctttacgtttagacgggcatagcttccagttttcttctattaaatttaatggcgagccattttctgcttatcaacaagatggcgagagtttaacgctcgatttgaaaggcaaaagtgcggaagaatttgaacttgaaattgtgactttccttgtgccagctgaaaatacttcattacaaggattgtatcagtctggcgagggtatttgtacgcaatgtgaggcggaaggtttccgtcaaatcacttatatgcttgaccgtccagatgtattggcgtgctatacaaccaaaattacggcggacaaaagcaaatatccattcttactttctaatggcaatcgcattgcaagtggcgaattagaagatggtcgtcattgggtggaatggaatgacccattcccaaaaccaagctatttatttgctttagtggcaggggattttgatttattacaagataaatttattactaaaagtggccgtgaagttgcgttagagctttatgtggatcgcggtaatcttaaccgtgcaacttgggcaatggaaagtttgaaaaaagcgatgaaatgggatgaagatcgctttaatttagaatacgacttagatatttatatgatcgtcgctgtcgattttttcaatatgggtgcaatggaaaacaaagggttgaatatttttaattctaaatttgtattagccaatccacaaacggcaacagatgaggattatcttgctattgaaagtgtgattgcacacgaatatttccataactggacaggcaatcgtgtgacttgccgtgattggttccaattaagtttgaaagaaggcttaacggttttccgtgatcaagaattttcttcagatacaggttcgcgtgcagtgaatcgcattaataatgtgaaatttttacgcactgtgcaatttgccgaagatgcaagcccaatgtcacacccaattcgccctgaaaaagtgattgaaatgaataatttttataccgtaaccgtatatgaaaaaggggcagaagtgattcgtatgttgcataccttattaggtgaacaaggcttccaaaaagggatgcagctttatattgctgaaaatgatggcaaagcggcaacctgtgaagattttgtttctgcgatggaacgtgcaaataacctcgatttaaaccagttccgccgttggtatagccaatcgggtacaccagaattattgattagcgatgcttatgacgaaaaaacgcatacttatcgtttaacggtttcacaatccacaccgccaaccgcagatcaaatggaaaaagtgaatttacatattccattaaaaatcgcgctttatgatgcgaatggcacgaaacaaatgttacaacataatggcgaattgttgagtgatgtattaaatgtcactgaaaaagaccaagtctttgaatttcacggcatttatggtcgcccaattccagcattattatgtgatttttctgcgccagtaaaactggattatgattataaaacggaacagttattaggcttgctgaaatttgcagacaatcaatttatccgttgggatgcagcacaaatgctatttgcgcaagaattacgtcgtaatgttgtgcgtttccaacaaggcgaggcactagaaatttcgcctgaaattttgaccgcactttcttatgttctgaataattacgagaaagatattgaactggcaacattaattctcacactgccgaaagaaatggaatttgcggaaggtttcaaaactatcgatcctgatggtatttcagtcgcaagagcatttatgcaagcgcaaattgcagaatcgttaaaagatgatttcttgcgtgtttatacccatattcgtcttgatgattatcaagttacgcaacaagacatcgccttgcgtgcaatgcgtaatctttgcttaacttatttggcttatacgaatttgggtaacaacttagtgcaaaaacactataataatgcgaataatatgacagatacattggcagcattaagtgttgcaactaaagctgcattaccttgcagagatgcgttattagctgattttgaacaaaaatggcaacaggatggattagtgatggataaatggtttgcattacaagccactcgcccagatgaaaatgtgttggaaattattcagttattaatggatcacccaagttttaattttaataatccaaaccgtttacgttcattagtgggtagttttgcaaatcacaatttaaaagcatttcacaacgtaagcggttctggctatcgtttcttaacggatgtgttaatccgtttaaatgaaagtaatccacaagtggctgcgcgtttaatcgagccattaattcgattttctcgctttgatgctcaacgccaaacgctgatgaaacgtgctttagaacgcctaagcgttgtagaaaatctttcaaaagatttatttgaaaaaattgagaaagcgttgcagtaacacttgatgatgtgagaataggttttatgactattctcactttattcaattgcttaatatttttaaatgaactaaaaattttttgactgcaaataattttctacagtatctacaatagcttgcgtttgaggatcgatttcaatattcacaatatcgcccactttacgttgccccattaacgttctttgcaaggtttcagggattaaattcacacagaattgcgtgccttttacttcaccaatagtgaggctaataccatctaccgcaacaaatcctttcgttaaaatgtatttcattacatctgcgtttgggagctcgaaccaaatttgtcggttattttcactagcgataatatctgaaatttttgcggtgcaataaatatgaccagataataaatgtccgccaatttccgttcccatttgcatagcacgttcgatattcacataatcgcccacttttattgtgccgagatttgtaatttttaaagtttcttgcatcagatcaaagctaaccagatcgccattgatttcagttacagttaaacatacaccgttatttgctattgatgcgccaatttccagatctttacgcatttcaggtagtaattttaccacttgtgttctaaaattagccgtttctttaatggagtggatgggggcggtgccttgtacaattccagtaaacataattttttccttttctaaaaatttttagcagtatatcaaatttatgaattttcgtcttttatctcaataccacgctgatattaaaaagttgattaaaatttccttgcctattttattagcacaaatcgcacaaaactcaatgggattagcggataccattatggcgggtcgtgtgagttccactgatatggcagccatttctattggtgcttcaatttggatgccattgatgctttttggacaaggtttattgttggcattgccgcctacaatttcttatttgaatggttcaggccaacgccatcgcattgcccatcaagttcgccaaggcatttggcttgtgttaggcgtgagtattcctttagggttgctgatttatttctgtgaaattccgctgcaatatatgcaaatggaaagcaaaatgtcagatttagcacgggattatttacatgcgatgttgtggggattgccagcctatttgatgctgattaattttcgctgtttaaatgatggtattgctaaaactaagcctgcgatggtcattacctttttaggtttgctaattaatattccacttaattacatttttatttatggaaaatttggcatacctgcttttggtgcggtgggctgtggtattgcaacagctattgtgaactgggcaatgtgcttaatgatgattttttattcctatacgaatgctcaagaacgttcactaaaagtatttagccaattaatcgaaatgccaaatctgaaaacacttaaaaaattactgcgtttaggattacccattgccattgcaatttgttgtgaagtggcgttatttgcacttacgtctttaatgctttctccgctgggtgcaactattgtcgcaagccatcaaatcacattgaataccagttcttttatttttatgttccctatgtcgattggtatggcagcgacgattctagttggacaagcgttgggtacaggttctccacaaaatgcgaagaaaattggctatgccgcattattattagggctaacggtgacgattattactgcattaattacgattttcttccgttatgaaattgcctctattttcgtaaccgatgaaattgtcatcgcaatggcggcaaatttattattatttgccgcactttatcaattttcagataccattcaaatggtggttggtggcattttacgtggctataaagataccaaaatgattttatacattacccttttttcttattgggtaattggtgtgccacttggttacacactcggtcgtacagattggcttattccacatattgatgcgaaaggtttctggattgcttttgtggtctcactcacttttgcggcgttcttactttctttgagaatgaaaaaaatgcaggccatgagcgataacgccattttacaacgtttagaaaaacttaaataaggaactttatgcaacttccagctttacaatcggcaaaattaattcgtcgttacaaacgctttcttgcggatattgaactaccaactggtgatgtgatgacaattcattgcgccaatacaggtgcgatgactggctgcggtgaaaaaggcgataccatttggtattcacattctgatagccaaacccgcaaatatccccattcttgggagctcacacaacttgcaaatggacaactttgttgtatcaatacgcatcgttctaatcagcttgtctttgaagcattgcaaaataaacaaatcaaagaattagcaatgtatgatgaaatttatcctgaagtgaaatacggcgaagaaaatagccgaattgatttcttactaaaaggcgagggtttgcctgattgttatgtagaagtgaaatcaatcacgcttgtaaaaggtaatttaggtatgttccccgatgcggttactacgcgtggacaaaaacacgttcgtgaattactcgcaatgaaaaaacaaggtcatagagcagtggtgctatttgctgggttacataatgggtttgatcgtttcaaaatcgcagaatatatcgatcctgaatatgatcgcttattaaaagaagcaatggaacaaggcgttgaagcctatgcttatgcgggacaatttgaaatttctaatgaaattcctaccgcactttctttgacagaatcggtgccttatataaaataatattttttttgagaattattttcatttatttattgacaatattattgataacaattatcatctaatcattccaacaacaatattagataatcactccaacattcccgcctatttccccacaaataggcgttttttttattcacaaatcgctaagaatccctataataaaaccttttaaaacataatttaggaaataataatgactaacattaataccgttctcgcggaactaaagcgtggtactgatgaaatcctttcagaagcggatttaatcgaaaaactgaaagaaaatcgcccattaaaagtaaaattaggcgcagatccaaccgcaccagatattcatttaggacatactgttgtattaaataaattacgtcaatttcaacaactcggtcatgaagtctatttcttaattggcgattttactggaatggtgggcgatccatcaggtaaaaatgcgactcgtcctccacttagccgtgaagatgtattgcgcaatgcggaaacctataaagagcaaatttataaaattctcgatccacaaaaaaccaaaatcgtcttcaactctgaatggttaagcaaacttggtacagaaggtatgattcgtcttgcaagcaactatacggttgcgcgtatgcttgaacgcgacgacttcaaaaaacgctttggcaacaaccaacccattgccatccatgaatttatttatccattactgcaaggctacgattccgttgcattagatgcagatgtagaactaggcggtacagaccaaaaattcaacttacttgttggtcgtgaattacaaaaatcagcaggcaaaaaaccacaggttgcgattacactcccattactcgttggattagacggcgagaaaaaaatgtctaaatcacttggtaactatattggcgtaacggaagcaccaagcgatatgttcggtaaagtgatgtcaatttctgatgaactcatgtgggattggtataaccttctttcatttcgtccattaagcgaaattgcacaattaaaatcggaagtagaaaagggcaaaaatccacgtgatgtaaaaatcttattagcaaaagaattaattgcacgtttccacaatgaagaggcggcaaacgctgcagaacaagaatttattaaccgtttccaaaaaggcgcaatgcctgatgaaatgcctgaatttacgttttctggcgaaattggtttagccaccttattaaaagaagcaggccttgttccttccacttctgaagcgattcgctctgctcaacaaggcggtgtaaaaatcaatggtgaaaaagtcgataacgtaaaagataatgcaccgaaaggcacaaatgtttaccaagtgggtaaacgaaaatttgcgcgtgtgactgtggaataaaatagataaaaaaataccgcactttggcaataaaagtgcggtattttttattgaaattttaatttagttaaacatcgcagaaatagattcttcgttgctaatgcggcgaatggcttctgccagcatggaagaaagcgtaagcacgcgaactttaccgatcgctttcatttcttctgatagaggaatcgtgtcagtaactacaacttcatcaatggcatcgctggctaaatttttggctgctgcaccagagaaaacggcgtgagttgcataagcaaaaacacgttttgcaccacgttcttttaatgcttctgccgctttacaaagcgtaccgccagtatcaatcatatcatcaaccaaaatacaatcacggtctgcaatatcaccgataatatgcatcacttgtgctacatttgcacgagggcgacgtttgtcaataatagccatatccgtatcgtttaataatttagcgacagcgcgagcacgcacaacgccgccaatatctggggaaacaacaattggattttcaagatcagattttttcaaaatatcgtgaattaaaactggcgaaccaaatacgttgtctacgggaacatcaaagaaaccttggatttgttctgcgtgtaggtcgcaggttaagacacggtcaataccaacaattgaaagtaaatctgccacaactttagcagtaataggcacacgagcagaacgaacacgacgatcttggcgagcatagccgaaatagggaatcacggcagtaatacgaccagcagatgcgcgacgtaacgcatctaccatcacaaccaattccatcaagttatcattggttggcgcacaagttgattggatgataaatacatccgcaccacgcacattttcattaatttgaacttgaatttctccatcgctgaaacgagcgactgttgcatcgcctagtgaaatatataaacgttcagaaatacgttttgcaagttcaggtgtagcattacccgcgaagagtttaatgtcaggcattttataaaacctcaggtttagattgtcgatgagtatgagttgatgatagctgcttcaacattgcgtgcaagggagacacattgagtcctttagcgacgaaaccaaaaaatgcttctggtttttgtctaaataccgcttgcgcttctgcttcatgatcaaattcagcaaaaacacaggctcccgttcctgttaatcttgccggcgcatattgtagcaaccagtttaacgctttttcaacgtttgaataatgatttatcacaactttttcgcaatcgtttttataaggttcactcaaaagttgttcgagggattttttcggtgtattacgtggtaaatttggatcttgaaagatgacagccgtcgatattgaatcatcgggttttaatataacaaaccatttctcggcaggttcacaataagtgattttttccccaacgccttcagcaaaagcagcctgtccgtatacaaatattggcacatccgcgcctaatgttaatcccaattttgccagttcatcaatggataaattggcttgccataaataatttaaagagactaatgcggttgctgcattggatgaaccgccaccaacaccgcctcccattggaagaattttatctaaatgaatatttgcacccaattgaatattggctttttcttgtaaaagttttgcagctcgataaattagattattttccgtttttagatttggaatttctggcgttaaaacaatttgattatcttgttcccgaatactaatgtctaaccaatcgccaaaatctaaaaattggaaaagcgtttgtaattcatgatagccgttcggcaattttccattgatataaagaaataaattcagtttggcagggctagggaagcgtaatggctgcccatttgattgtgttgtattttggcaaagtgcggtagaaaattgatgtgatttcattaatgtattcattagtaaatccactcgtctacgcgaatttttaaggtttgttttgtgctgtcatttttcagcaaaatattttcaggcatcgaattatttgagtgataggttagataatctgccgtccattgagaaccatccacatgataagtaaatgcaccaagtaaatggttggtacccacttgataatccgcgttcattgctggttggcctttcaaccaataagctaaatgttctaatggcacatccatgccaatgatctcttgtaatagtagtttagcattggctgcagattgttgattgtcattgttatcggaaattgtcatcccactttgatgcatttgaatcaacagggtagatttactgattaaagaatagagtttaagtgtataagattttggattttggtattgccattcaaagcggctagaaaaacgttctgtaggactgatataaccaatttgtcctttggcttgataggattgaattttttgaatcttttgtaaatgttgttgccatatcgcatccgttttatcaatgtattgtacattagtaggacgttccatatctaatgtgcaagcggttagaatcgcagtggcaaaaagtgcggtgagaaatttaaacgttttcatattattcatcaagttaataagctcgcatattttaaggatttagtttaattgagtaaagttacttttatttgttaatttgttgggtaattcgtttttgtttgtttaaccgctaagattcttcgtttcgtcaattcatttttgattgcttgtttctcaaatccatcagcaataacttgctgtacatctacttcatttgcagagtgtaataattgattgatgtaatctatttgtggatagtctttagtttcaaaacctgttctacctcgagtatcagctaaacatacttgtagaaattcttgaaagcgttgtggttttctccacacatcaaaacgattaaacagcgttatgacggtttcagctcgaagctcaaaggctttgtgaatatgcgtgtgaaattcacaagtcagttctgcaagttcttgaaaataacttggaaccttcaagcgtttgcacaatgatctagtcggttttatgccagcttgttcatgcccataatgatgaggaagaatattttgaggtgtaagagccttgccaagatcatgacaaatagccgcaaaacgaaccgcacttttatttaggatagggttattttcagtcaaattaaccgcttgttttaataccaacatggtatgaataaaactatccacttcgggatgatgttttactggatttggcaccccatgaagggcatcgatttcagaaaataaaacgcttaatgcgcctgttttatgtaaggtttcaaaataaatttcaggatttttttcgtttaaggctttttctgtttctagccaaacgcgttccgccgtgagatgttgtaattctcccgatagggcaagttctgtcattagagctaatgtttccgaggcgattttaaaaccgagagaatgataacgggctgcaaagcgtgccacgcgtaatactcgtaaaggatcttctgaaaaagcgggagaaatatggcgtaaaattcgattttctaaatcttgttttccgccataaggatcgataatttcaccgtcttcgctttgagccatcgcgttaatagtgagatctcgtcgaattaaatcttgttctaatgtgattgttggggagaaatcacaaataaagccagtgtaacctgcgctagatttacgttctgttcgggcaagcgcatattcttcttttgttttaggattgagaaaaaccggaaaatctttgcctacttgctgataaccgagagagagtagcgtagcgtggtctgcgcctaccacaatccaatcacgatcttttactggtaaccccaataattgatcgcgaacagccccaccaaccaaataaattttcattcgtgattatgcccaaccatcacgacggcgacgttttggtaatacataaggaataagcaagccgaagagtaagcctacgcccaatactgaaccgccataaataaaccattggatcgcaatttctcgtttacctgcatcaagtatcgcttctaaatcacgatttttatttttggtcatttcaagttcacgtttaagttgagaattttgctctaaaagatccgcactttgttgctcagcttgtttggttcgacgttgcatttcgacggtacgttgttgccaatcgccatctaaacgactaagttttaaggttaattcttggacttgcgcttttaattttggattttcttctttactacttggcgtgctacttaagtctgaatttaaaatccaagcttcacgatttttattgtcgcgaatgagtgtgtatttgccttggcgttctaatacattcaccgcttcgcctgcttgaattgaacctgcaattttaaattgttcgccagcaccacgacgtaagaaagtacttaaattttcagtaacatattgggtttccgcataagcaacatttattgatgtacttaaaagtaaagatgagattaaggctttatagatctttttcattttttccccttaaacatcacaacaaaagtgcggttaaaattaaccgcactttttattgagatcaattaattaaagatagttcttagcacatagaaaataataatggcgaaaaatgcgcctgctggtaatgtgacaatccaagaactaatgatgtttcggataaccgttaaattcagtgcagcgataccacgtgcaaaaccgatacctaaaatagctccaacaagtgtttgtgttgttgagatgggtaagcctgtgcctgatgcaactacaacagtcattgcagtagcaaattgagcagcaaagccacggcttggcgttaaatcggtgatcccagatccaacagtcgccatcactttttgtcccatagtaattaagcccacagcaatacctaatgcacctaagggtaaaatccaccaagttaaggctccacctgaaacaattttaccgccttcatttacaatagagaccactgcagaaagagggccaattgcattggctacgtcattagaaccgtgcgcaaatgccatcgcacaagcggttaataacattaaaatactgaagactttttctacggcaccaaaagtgcctttgtttgctgattgagtgaagattttgcttttaaaatagaaatggaagaaaaacattccgataagactgatggcaagtgaaatgattaaagtttcactgtttgaaagatttaagcctacgtgttttaagccttttttcatcgtcacgatacaaagtacaaacacggttatccccatataataagggccatatttttgtgcattttttaatggctgttcagtatcaaaaataagtttttgcgtacttgcaaagattgcataagccaaaatacccgagatgacaggcgtgataaaccagctaccaacgatgctgccaatatttgaccaatctacagaactagggccaatcgtaatacaggcaaatccaataattgcaccaataatagtgtgtataccagaaactggccaacccattttggttacaataaataaccaagcacctgatgcaaataaggttgaaagcatacctaaggctaaaatatcgggtgtatcaacaaattgtattgggtcgattacgccactttttatggtttgtgttacttcgccaccagctaaatatgcacctgcagattcaaaaattaacgcaataataattgcttgtttggctgttacagtaccagatcctacggatgtacccattgagtttgagacatcatttgctccaattccgaacgccataaaaaagccaaaggctgctgtgatccacaccaaccaagaaccatattgactaataatttccatagttaatttcctatgttttgttgattatgaacgcgccagcattaattcaatgcgcgaaccgactcgttgtgcttggtcagccaaaacgccaacccattcaataattttatataagaacattacatcaattggattataacggctttcgatggtgtaaagcattttacgcaatttgatctgcatttggtctgtatcatcttcaattgaatcaagttcttgaatcatatcattgactaatttgagttcacgacctttaaaacccgtttctaatagcttatccatttcttcgattactcggtgggcttgatgaattgcatctaaactacgttttacgtaatgtaagaattcttcctgcatttcttcaggaataccaaattgacgaccaatcatacggcctgcaatatctttggcataattggcaagtttatcttgttgcgtgactaattctaaaagatcagtacgatcgataggtaagaataaaccacgtggcaatttcaaccgaatttcgcgttttaaactatctgcctcacgttcgcattgagaaatttctaagcgtttttcttccgcttgttcccaattctttgagaaagtcgtttgaaaaaaaggaatcaaaagatcgctacattcggtcactttttcagagtgtttttgtaacggcttgagaggcgaatgggcaaataatccgagaatattattcattgccataagtgatttactccaaactaaggggttaaaaattcgtgcgcatattacctgatttttgttgatagttaaaatttttcaaaaaaatttgtaagaaaaaaggtttatcttcgactaactaagtaactgggtaatatttcctagtgtagtaagataagtaactcaatacacttttcgctttaaaagcgagaaaatttgaaaggtaaaaaaatgaaggattgtaagatgcaaagtatcggcagtggcgtaagtttattgattttacgcttttttcttgcgtgggagttttttgaagcaggattagaaaaatggaatggacaaaattggttcgctgaaatacaagatcgttttccttttccatttaatcttattccagctgatattaattggcacgttgcaatgggatcagaattaattttcccatttttgctgatatttggagtgctaacacgttttagtgcattaagtttaacgattttaatctctgtcgcgtggtatagcattcacgccgattcaggttataacgtatgtgataatggttataaattaccattaatttatgtggtgactttattaatcttaattacacagggagcggggaaactctctttagacacgcttattaagaaggtttatccaactaaaagctggttgaaatttctctaattatttattcaaaattcaaactctaggagattattcaaatgaaaaaattagcaacattaacagcattagcaagtgcattaacgatggcagtagcgacagcagtacaggctgaatcaaagtcaagcaatactgataatacagcaacaccttgtgtaggcgataaatgtgtcaaaacgaaagccgcagaaggtaagtgtggtgaaggcaaatgcggtgcagataaagctaaatctgctgaaggtaaatgtggcgagggtaaatgtggtgcgagcaaaccgaaagctgctgaaggcaaatgtggcgaaggtaaatgcggttctaaataagaataataattatgctggcgtaacaatttatgccagcttttattaaaaaggagttaattatgaaattacaaggcgctggactaggttatcgtcggaatttagctgaggattttttacaacttccctcaaataacgctattcaatttattgaagtcgcaccagaaaattggagtaaaatgggtggaatggcacgttatcaatttgatcaagcagcagaaagatttccgttagcagtacacggtctttcactttctttaggtgggcaagcaccacttgatcgcgaattactccgtaatacgaaagcattaattaatcaatataattcgtctttcttttctgaacatttaagttattgtgaatgtgaagggcatttatatgatttattacctatgccatttacagaagaagcagtaaaacacgttgcacaacgaatacgtgatgtgcaagatttcttaggattacaaatttcattagaaaatacttcttattatttgcattctcctactagcacaatgaatgaagtggaatttttaaatgctatcgcacaagaggctgattgtggcattcatttagatgtgaataatatttatgttaatggtgttaatcacggattgcttgatccttatatctttttagatcaagttgatgttaaacgtgttaattacattcatattgcagggcacgatgaagaacattctgctgcacaagttgtagagaattcagcaaatgaatcatttaataaagtaaaaggagcatatcgccatttacctgaattattaattgatacacacggagaagctgtaaaaggcactgtatgggatttactcgaatatgcctatcaacgactacctacgattcctccaacattattggagcgtgatttcaacttcccaccatttgcagaactttacgccgaagttgagcatattgcacaattacagcaaaaatacgctcacacagaggtaatgtcttatgcagcctaagtcatcattgaaagaaactcagcaagcattggcaaatgctattcggttaggtaatgcagatcctttaaatggttatgctgaaagccgtttagcggtatatacacgtttagttcgtaataatgcttttggttttattgatcgttgttttgttgaagcaccattgcatattgagctagagtattggaaaaatgctaaagaaaattttgtgcaaaatggtaatgcccattctccttatttccaagatattgcaggagaatttctcttgttttgtcaagaaaaagagatatttgatacaaatatattggcattgatggattttgaaaatacacaattactcgcagaagtttctttagccaaagtgcctgaaaaatttgagtggaatagacatagcgtaatgcaattatctggtgcagcttatttaaaaagttatgaagttgattttttatcaagtgactttaaacaatttgatgatacgccaattcaagttattatatggcgtgatagtgattttaggattcagcaacaaatcctttcagagttagattactggttgttaagttatctacaagaacaaccaaattcattagaaaatgttttgtctgctcttaatacaatggttgaagatagtacgtcaataatcccattattagagcaagtatggatgaaatgggttacatctgaagtaatttaccccgaacaaagataaaatttttgaaaatgctgagtaagatgaaaatattcatattttcatcttacttattttaattgacatttcacaattattgctaatttagattagtaaatattcacattttaatctggctttgttatttaaaattatcaatattatccgatgaaatctgtttatgtttttcggattatttttttatttaaaagtcgcaatattttaatcacaataaataaaaatttgtttgtagataaagccatccaacataactctcacgcataatccaacatcaatgagaagaatttgggggaagtggggaagaaatgagaaaggagaaatgaagcggagttacacatagataaaaagaaaacctagagacttttttacagttactaggtttatttttaggattgggcgaatatattaaacggccgtttggcaatttcttctttctgcacacgtttgacgattttgtagatccattgcaacgataaagcatacttcttagcaagggagacgtgattattacttgtaaattcgttgaaaatctgcttttcacgtttgcaggcgaaaagcgatattgatttcggcatatacacattcaaggcatcctagttgtagcatgacttacgtgatatcaagcaagccaaaggtattaacttgtccgttgatttttgggaacaattgtcagagaagttcagaaattcgaccgctatatggtttgttaatgctgcttgctttaaccattgtaagtacgatgcaagtggtaggcgttattttggtggtggtaatgttaattgcgtcaagaattaccgcacttacgctcacaaatcttttgataaaatgttatggattgctattataagttcaattatatcaagcctaattggtgtaatattgagctatcattttgatgcctcaacaggtgcttgtattattcttctgcaagccacattttttgttatagcattagcttatagcaagattagaacaagataatttttctaccccctctttctcaaagaggagcacaacctgataacatcatttacattctaacccgaggacatcgtttacatttttcccgtaaactcatcatcaaaatacctaatccactggagattgatgatgccttggatagagaccgatgcgatgcaacagcgtgtacttttcttaaaagcgtggctaagccaacgctatactaaaactgaactgtgtcagcagtttaatattagccgtccaacggcagataaatggattaaacgccaccaacagcttggctttgagggctaaacctcatcatagccctaatgccacgccataatggatttatgactggcttatcagtgagaaacttaaacgtcctcactgggggtgccaaaaagcttttagatagctttactcagcaatcagaagttttgctattcgctaactattacggataatttcagtcgctttttattttgctgtaaggggttgccgaatacaaaatcagtgcctgttattgctgagtttgaacgtctttttgagtaatttggtctgccgtattcgattcgtaccgataacggctcaccttttgcatcgcaagcattagtgaatcagtgaactttctaaatggtggattggcttaggtattcgtcctgaacgaattcagctatcacacccagagcaaaacggacgacacgagcgaatgcactgtagcttaaaagcggcgcttcaacctcaaaatagctttgaagctcaacagatattattcaaccaattcttacgagaatacaatgaagaacgttcacacgaaggcgtttgacatatttattatcgcttttatttactgggcagttttgatgccaaggaaattaaatttgccacactgtggcataaataagctaatgaatgtaaacgatgccttagggaagatgcaaactatgtttgggttgtgtattccatgccgtggttagtaatgttttgtcaaccaacttcgacagtggcaatcttgctgaatcgttttcttctcacgcgctacgggtgtgttccgctctaatttgaccgcttatttgtaccgccaaaatttcttggctactcctcgatgcatttatcgcaccgactatatcatattctttgcgatatatctgcgacttgggtcatttttcgataggatggtaaatggatgtttatcatactacgtaatttgtaatccaatcgccgtctgaactcataccaagattggtctaatatcgctcggttcaaacttgatttctatttcacgtttttgccgtgtttttccgctgtgcctttggctgatttagacatattctctacctgtaaatcttcaacataaatcatcgcgtgtttttttgctgattcggtgtggggtttgatgcaagtcgtttttttgtgggtattggtgattttgtggtgcaatttggtgattttagcctttaatttctgccagttttggctaaaatctctgccataaaaggcagagttttacggcgggaggctgataaactgtgagcgcgcgggagcgttataaatataaaagtgcggttgatttttgagagttttttaaaacgctttgaaaattggccgcacttttactttaagaaaccgttattttttactcaagtgctttcgtttccattcatttgttttcttaagcagtattttacccaatggacgagggtcgcctgtaaaaagcttttgtaagccgttgttttctatgatgtaacgacggagttcaaggcgttcttggtggttttcagccaaacgtaaagcacattcaatgtatgtttcgcgagtatcggctatcagccattctggtagtcctaagcgtttaaacagaccttcatcaatatgttcatgtacttcatcccccgttttgcatacaccaactaaacctaatgtaaccatatcaattatgccgtttgtattaccgaaaggaaacggatttagtagcatatcgcaatcacgcaatattgccagataatcgtgataaggtgcgtggggatgtgcagtggcatcgtcacctaaatagctttcaataaaccatttgacataagggtgtgtcaagcctgttgattgtccaagtgcgaaatgaaaatgtattttgactttagctttatctctgatttcttgcaatgttaccaaaaattcagggtttaatttcattgtggtagcggcaataccgatattgactacttcagggttttctcttagtacataatccactttttgtggggcgagtgcagatggtacataaggtagggcatctttgggtaagcgtaaaagggtttcgctgaaacaatcttcactgcccacataatcatcttctacgatgacataatcaataaattcagagtgcgtagtggcaggatgacccaaggctacagcttgaataggggcaagccgagtgttgctcacaaaaatcgtggtaatatccatgccaatgcttggcatatagaaaactgcgggctggaaagtttcgcactgtttacggataaaaaacagtctctccattatattattgctactgatttcaaaaaactcgtcaaacacttctcgacctatttcatcgacactctcagagcctaagccaactaaatagaatttttctcgagccgcaatcattgaagttgagtgtgtgcgataaatcgaatgccccgaattaaaatgttcaagcagtaccatcattacaggtttgccgtcctttttacctaaggtataaaggtagcggtcttgccatccttgcgtgaggatatgtttacggacaagttcgtttaatggacgcttaacatcgtgcttgttttttgctaaatcataactgcagtgcatatatacatcatgaaggatgtttgcaggcaattcatttaaatcagcaatttcggcgagttttttaggaaaccactgtaaaaccaccgctcttttatgaaacgcagatgcggtaccaataaaacgtgaagattgcaacgcaaaacacaatgaagcacaaagttgttgattccctgcccataacgcatctaaactcatattgatattggattcgggcaagtaaaaaatacagaatttagcaatagaagagttgtctgttgctaaatgaaagccaccttcggaatctgggttgatattatatttattgagaatgtggtctgcgttaacgtagggggaggaagcaaaaatcagcgtcaaccagcgttgcagactaatcatctttaatgccccttcttcggaaattgccaattcggggtcggaaaagagtgttgtaattgcattagcgagacgagtggcaaaatgaattagtagtttttcgggtagatatgccagctgagcgggtgcgtcaaattcaatatcgtgaacgcctccaaaattagcatccattttttccagaatcaccattaattcacgacaagcaaactcataatcttttttttcgatatgttgttccaagcgcaataggctaggtttgggtgattgttgaagcatttgcggggaagtttggttgttgtttgattccacaagtgaaacggtcgtattttgtggagcgttttgcaaattttcttttgtcatattattaaatcccttgtatcgccatggtgtggagtatattttagtttatcatataaattgttttttagcattgcttagtttactttacttggttttcttagttttcttagttttcttagttttcttagttttcttagttttcttagttttcttagttttcttagttttcttagttttcttagttttcttagttttcttagttttcttagttttcttagttttcttagttttcttagttttcttagttttcttagttttcttagtttgcttggtttatttatttgatatacaggggtgaaaacagggttgcgtatagactgtaaattggcgggtaaagcatatagttataaactggtaggcggaacgcttaccagttgattaaatttcagggttagaaactgaatgttaatctaccccagaaggttgtaggtgagcttgtgcgttttttgttgccattcaaattgtcactattggcatttgcaaagcgacgagcaacaaaagcatctaggcttaagttttgtgtaggagaggttttaatgcctaaccccgcagaggatactgtgtgcatatcttcaccgtaaattttagcattttcgctattataacggaactgacctgcatcataaaacgcataagggctgatttgaaagcgggtgtattttggcatacttaattcattacgccatacaagaccgcgctcaccacttgcaccgccgtatttaaagcctctgacgccataagtacctgttacagagaataaatctatgctacttatatcttgtagagtagactgacccgataattgactgctaaaatgccaaccttgagcaaactcttgactcaaccctaaactggctgtgctaatgtgatagctgcgattaaatgtttcgccaatgcgctccattccaaaagagcctggtaatttactcgcgtaataatgatgagttaaatcaatattaaagattgttttaggggtaaattggatatgtccatcaatgcctgcacttacgcctgatactgcaaattttttcttcgttgcacccagggtgtttaactcggatgtttgattaatatggcggtagttgtagcctaaattaattttaaactggtcttccataccaaggttaaatgtcgggagataataactccatttcagattcgcagagatagattgaccttttgataatttacgattaatcgcacttggtaagccgtcgatatcattagaatcagcataactcatgctggtataaaggcttaaggattggtgtttactataaaacggataagtatatcccacgcctaccgcataagattttgaaggtgctttcacattggttaatgcgtttaggtttaacacatcatcatgtccagttaaattggcattaacaaaacctaaacttacacgttgatagttaaactcccttgcaccgaaattatcataagaaataaagctacgcgttttaccaaaaggcgagaagcccgcaattatcaaattggaggttttgtttttagggtttagttcgtaatgtacacgggtaaccttaagcgggttctctttcgccatattaaattcacgcaaatcgaaccactgacgaccatcttcatacacttttccttgtttcaaagatggcaggctacgagcgatattttcttcactataaccctggctcgccttataaaaaacttggctttctgcggctgatttcgagactagctcaaacatgatattgccatccgtaatggtttgttgtggcaatatcacatcaaatttatttggctcaattttatctagcacagcctgtaattcaagctgtgctgtttttaggtttgttaaagtttgcgtaccttggtatttggataaagattttgctacagataattgggcgtcttcacttaaagtttcaagtgcgccagatagctgaaaaccttttactaaaaacgcttcttctgcatacaacgatgaagaagccaagccaagcaatactgatattgcactgagttttaatctgctttttatatttttcataataataacctgttaaaaatactttattgtatttttcgtaattttttacaaggtgggtgaaagcccgtactgaactttaacccacacagtaaataatacgaaaataaaatgacttcattgcaggatgaaatctacctcgtcaattactgactactgctgtccatcgtcagcaacattggtacatactgctgcgccatcaccacttgagaaacacgccttaccttcagaaattgtcacttgacttgatggtctggttgtaaactcgttctgcgtattaaccgtaatggcattatttggctcaacaaaacgtacggcacttacaccaagtttggctagcgtttctctttcttcatcagataaatcttttaccttctcaagggcacgcttcgcttcaattacttcttctgcgcttgctacacctggctgaatgtatttcacatcaatttcagcaccttttaacactacagtgtttttaccatttttcgaaatgatgtttaatccgtttattgtgcttaaatctccagtgatgtttacgctgcttgaggttaccgcagttacgctaccagagccgcttgcgttgactgcattcacttctgtacggtcgcctgatgcatcaccatttagtgtggcgtcttgtgcgttaataactaaggtgccttcgtttgcgttaatgcttgaacccactacggtagttaaagtgcctgtggtatttaatgtcacattagcggcatcaatacttcctgcgatactgccatccttggctgtaagagttgtctggccattgtttgaggtaatagtagagcctgcttgagtggttaatttgcctgattctgcagttaaggttgcagctccatttgtcgcatcaacttttgcaccgcctttaatagttaaactaccagtatttgctgtaacatttactgtattgccagagattgtgccgccaattatacctgttgcacttgttacattagcctcgcctgtttttgcttcaatttttgaatttgctttggtaattaaatcattggttgctttaacgcttaccgtgttaccagaaattgcaccgccaatatcgcctgattggcttgaggtggttacactctcagttccgctaatcgtagagctttcttgggtggttaatttgcccttatctgcagtgatggtaacagcattgcctgaaacattacttacattaagcgtgtcgccgtttgctgtaatatttacattaccggaagtggatttgacttcacctttaatatcacctgttttggctgtcacttctacgttaccagtggttgcattaatggttgcatccgctttggtggtaagtttttctgacgcggtgatatttactgttttgttagaagtaatgttgttttttacttctacatttttcgcggcaatagttaagccggcattattgccactgccgtctccagtgttgtcagtattaccagatgtttccactttgctatttagtgtcacattgtgatcgttagcagagatttttgaatctttaacctggttaaaggttacttttttggcattagtaccatcagcactattggtgttaccaatagttaaatcactaccatctttagctgtaatttctgctttattaaagcctgaaatgtttaggtcttctaccaattttaactctttggttttaatggttagattggcatcacttgctgtgcttgaactagaatccttctcatcaacgcctgctttaattgttatctgcttggtgatatttactttgtcagaagaaattgtgagattgccttctttttgtgagatattgccgccaatttggatttcagtatcattaccattattcgtaatatttaagttgccttttttgttggttatatttccgttaataatggttttttgatttttttgggcattagtggtaatgtttaaaccacctttattggtaatatcaccttggatgtttaccacccctcgttttatattaatgtcggcggtaccgttgttggtaaaggtgccggtaatgtttaggctgtcattggtttctcctttaaaagtggcaccgtttaaaacggcaagatcgccttttacctccacctttgagccagttaagcttaagtttccagaggtggacacattaccaagagttagagtttttttcttatgacctttgatgctattgtcggcgtaagcttgtaatgtgacatttgcttcggcagcgatggtgatatttcctgtaatgttactgcttgaattctccccgcccagagtgacattgccgccaagaatagttagattacgagttgaattaatggcgtctcctgtgtattgattttcaaataaatctttcgtttgtttaagactaaattttgaattagttgcatttatagttaagtcttttttgatttcaaaagcattactattgcgattatgggatgttatggaaaagtcaagcccgccggtaatgttaattgaatccatgtttatgctggcagctctagaggtaagattggcgtgtatgtcaaacatcacagagctatcactgctaccggtagctgtaatgttggcgttaaaagtaataggtaattctttttttgggtctgtagcggcgtttggttttaatttaaataaggcttttgcgttagctccgatgttgaagtttgttttgcctccggtgccgttaaaatgtacgcctgcaaaacgtctacgtgctgacctcaaatcttgggaatttgagccgctatcaacgaattttataaaggtaaattttgcatcgtcattcaaagtaagagaagaaacattccagtaagagtcttttgatgcatgccagtatttagcatcttttttcgtggtttggttaattgttactattccagatatgttaatttcgccatcaaatttatgagtgaaattattttgatttgcaataaactttaaaccctcgcccgtcccgttaatagatacattattgaatctaaattgtttatcatctttattgacggttatcgtcccttgtgcggtaatttgagcatctgttgcgttacgtgcgttattgccccctttctcaaaagctacagaacccccagcggtaatatttaaaaaacccgtaccaagcgtaatatttttatgaacgtcaacccatccgccggagttaatggttaaatttccgccttcagaagtaatatctccatcaatctgaacgcctccgtccccctgaccttcactatggagaattaagtgggatctacttccgatactgattgagctattaacggtaagttttctctttgccgttatgttcatcactttggcattttgcagaaaatttgaaatggtttcattggtcagtattgttttgtcggcgttttttttagggctgttttcagtaccgtcaccgattggaaattctgaactaatgtcagtgtcagcgcgagaaaggctaggagcttcaattgttacattatcagggtccagtagccactcttttgttttaacaattgcattgctgtcaatggataagtaatgccccgacgtctccacaaagccaccagttttagcgatatcgctaccttgagcattaatattgccgtcaattaacgcaatatcgccccatacaatagcgcgcccgcctttttctttacctgatacattaattgttgagcctttttctaaagaggttttctttgctaattgaatgccgtttttaccttcgccgcgctcgtcgccgccaagataggtctctcccccttctttacctgaaaggtcgataactgcacccgtttttaatgtaactttatcgcctgtaatcatcaacttaccacctttggcttgctgattttgagcggaaatcacaccgctaatttctgcttcaccctctttggcggaaagaataatgttgccgcttttatctttgcttacagaatcggcagaaagtttacctttattgcgaatagtggcggcgcggacattgatgttaccacctttggcaaaaatatcgcccagattgattgcttcattttcaggggcagcaatgctgtaagtaatggttgggtttattatgtcgctgatggttattttttgccctgcaagtaaagaaatgctaccgccatttacgctaattacaccctcattttttactttgccgccaataaggtttacgctaccgtctttaccaacggtaattaaaccgtgattcacgatttcagcgagtgctttatccttggtttgttcaagggtgaaattacgcgccttgatgttttcgttagaaatgtctagcgtagaagcagtaaagccattagtgttaataattgcttctttacctattgtgataccatttgggttgattaaaaagacctgtccgttagaatctaaaatcccttttaattgggaaatctggtcagatgtaacacggttgaatacggcggagttgttgttttcttgtaaaaactgcaccatttcattttggtcaatgttaaattgtttccaattaatgatagcattgacactattgcggatggtggttttattgccgtctacttgcatggttgctgtaccgtgtacgacgctcattccctgtaaaccgctcgctaaaacagattgcggaatggatgccatgcccaaagatagcaatatagcggaaagtggctttaacgctaagtggcgtacttttgtacgaacaggtttttcactgcctttttctgtggaatggtcacaaccccgtgtcaattcagacacagcaaccaaagcattcaggcgtttgctgaatttgagacgatatatcttgttcatattttctcctaaggttagttgaacaattaaattactttatcatttgcgttcattcatccctctctttattctcgcttccctttccctctctctcacggttcatcatgtgaaagatgaaagatgaaagatgaaagatgaaagatgaaagatgaaagatgaaagatgaaagatgaaagatgaaagatgaaagatgaaagatgaaagatgaaagatgaaagatgaaagatgaaagatgaaagatgaaagatgaaagatgaaagatgaaagattataccattttatatggcggatttatactatttttttaaaatatttgcatatagattgcaaagaagctgttgtaattgttgtttgtcatcacaaaaatcttgatttatttttattgtattgtatattcaaacagttaatttgagtaaggaatattatgctacaagaaattgaattaaaattggcgatttcgccacaaataggtattgaattgccacaatatcttgcaaaatttacgattttagaacatcaaaatttatttttgggtaacacctattatgattatcccgatcattttcttgctaaacaaaaaatgggattacgtattcgccaagaagagcaagaacttacattaacgcttaaaaccaacggtaaagttgttggtggattgcatagtcgtccagaatataatttactattaaccgaaaaagaaacgccaaccaatgcccaattaagagagctttatccttttgaacaattacctcgttcttcactacaacctattttctccacagattttaaccgcactttttggttagttgaatttcaacaatccaaaattgaagtggcgttcgatcaaggcaaaattattgcaggcgaatctgagcaaccgatttgtgaaattgagtttgaattgaaatctggcaacgtgcaggatctttttgattttgtagaaaccttgccttttgaaagggatatttattttaatagtggaagtaaagcgaagcgaggttatttgctgggctcaaaacaatttttaacagattggttaaataaatggcgtgatttcttaaaagaagaacgagaagaaagtgcggtagatttttgtgtaaaatttaattccgtgttgaaaatggaacagaaacttttggaagaaaccttatccttttctcccgcactttttagccaagattttatgaaaacagtagagcgagttggggtattttttaatctttatcattattatgatgaaaatggaaaaatcctagaagcggtggcaacagagaaacaaaaagaaacgctattgctagctttgttagaaagcaatcagaaaatctttgctgaaattcgtgacttgattcgttttcatagtgaaaccaaagacaatgaaaaaactattgaaaaattgaccgcacttttgaaaagtcgagtttattttaagcgaatgatcaaattaatggaattatcttatgacctagggtaggtataccttaggctagtctaagtgctactccgttgaggtggtttgatgttcttcaaagggggatagtataaccataattaactatgggtatataaagtgacctaggtgtaggtataccctaggctaatctcagtgttaccccgttggggtagtttgatgttccccagatggaactactataaacataaattaactgtgggtatacttacccacggcaaatacggagaatgaaatggctaaagccccgaaaacagcttatgtatgtaacgattgtggtgcagagttttctcgttggcaagggcaatgttcggcttgtaaagcgtggaatacaatcacggaagtgcggttaatttccacggcaaaatcaaaaaatgatcgttttagtggctatgcgggggaaactcaggcaaaaattcaaaccctttctgaaattagtttgcaagaaacaccacgtttttccagtggctttaatgaattagatcgggtattgggcggcgggatcgtaccgggcagtgcgattttaattggtgggcatcctggtgcagggaaaagtaccttgttattacaagttatgtgtggtttggcgaaaaatatgaccgcactttatgtgacgggagaggaatcgttacaacaggttgcgatgcgtgctagtcgattgggattgccaaacgatcaattaaaaatgttgtcagaaacctctgtggaacagatttgtaatttgtcggatcagttaaaaccgcaaattatcgtggtggattctatccaagtaatgcatttggcagatattcaatcatcgccaggcagtgtagctcaagtgcgtgaatgtgcttctttcctcactcgttatgcgaaaactcgccaagtggcgattattatggttggacacgttacgaaagacggaacccttgcagggcctaaagtgttagagcatgccattgactgttcattattattagaaggcgaagccgattctcgttatcgtactttgcgtagccataaaaaccgttttggtgcagtcaatgaattaggtgtatttggaatgacagagcagggtttgcgcgaagtgaaaaatccatcggcgatttttttaagtcgcggagatgaaattacgtcaggcagttctgttatggtactttgggagggtactcgtcctcttttagtggaaattcaagccttggtggatcattcaatgctggcaaatcctcgccgtgttgcggtgggattagagcaaaatcgtttgtcgttgttattggcggttttacatagacacggaggtttgcaaatggcggatcaagatgtctttgtaaatgtcgttggtggtgtaaaagttagtgaaacaagtgcggatttagccttattgcttgcgttaatttctagtttccgtaatcgccctttgccacaagatttagtgatctttggtgaggttggattagcgggagaaattcgtccagtaccaagtggacaggaacgtattagcgaggctgcaaaacacggttttaaacgcgccatagttcctttcggcaataagccgaaaagtgcggtcgaaaatatgcaggtttttactgtgaaaaaactcacagatgcgctcgctgtgttagataatttataaaaaatcattgcctactgaaaatgaaagtgaaattctgtagaatagttgttccttttttatgtgcaaagaaataaagaaaatggaaaaaaaacgaaataaagcattggatgcgatagatataaaaattctgaatgaattacaacgcaacggtaaaatttccaatatcgatttgtcgagaaaagtggggctttcgccaacgccttgtttagaacgcgttaaacgtttggaaaaacaaggtgtgattatggggtatcgcgcactgttaaatccagaattattggatgcaccattgctagtaattgttgaaattacattagtacgaggtaagcccgatgtgtttgaagaatttaatgcggcgattcaagagttagatgaaattcaagaatgccatttggtatcgggcgattttgattatttattaaaaactcgtgtggcagatatggctgaataccgaaaattgctggggacgacattattgcgtttaccaggtgtaaatgacactcgcacttatgttgtgatggaagaagtaaaacaaaccaatttccttgtattgaaataatatgattaaacaaattacagaacgatttacgccaagacagtatttagctgaatttttgctaggattgaccgcactttttggattttatttgattgttgcttggtcaagttatacgccccttgataattcttgggctacagccagcgcgtatggaaacacaattaataaagtggggacatttggagcgtggataatcgatcttttttttgttttttttggctatgtcgcccatattattcctttcaccgcttttctcgtgcctatttatttattgaaaacaaaagcagttaaacagctttcctgtactcgaattattttacgtagttttggctttaccatgctgattattgggctttgtgtagtgagtatgttgcttttatcaagtaatactttttatttgagtggcggcgtattgggcggatcgcttgttgtaaattggttttatcctgtattaggtaaatttggttcaattttaattggttttgtgcttgctttaattggttttattttttgttctggcgcatcattaattcgattaattgttgcattttatcattggctaacaatgaaaaatgagcaatcagaaaatgctgagcaagaaaaatcaacggaagaattagagcaaattgtgattgtaaaatcagatcgttcagaaacagaaaatctagatcaaaatcatctcaatgtagaacaaaatagtgagattgaaactcaaaaatcatctttagaggcagaagaaagctcagttgagcaaccttcgcatttaattaatattcatggtttaaatccagaggtttctataaaatcagaatatgaactcgctaacgaagatagtgaaaaaccgcaattttcttttgggtttgattctgaaagcttgcctagtgtgaatttatcgagtgattcagatgaacaaagagtgagtaaaaatgattttgtagtagtttggaataagcctgtaaaaacagttgttcaagaagatctagcaattaatcaaagtgcggatgattttacgcaagtttctttgctgacaaatgatgaaatgccaacagtttcattaaaatcaacctctgatactgaaatggcagataatcattttgctgctcaagttgatgaaaaggtagatttagaaaaagatgaagtgaaatttagcgtatctttacagaataatgtgggcgtaattgaattagacaaaaatcaagagcctaattataaaggttacagtggtagtttgattcatcctgcatttcaacagcaaacaacaaaacgtgaaaaaccgagtacaccattacctagtttggatttgcttttaaaatatccgccaaatgaacaacgtattacaccagatgaaataatggaaacctcacagcgtattgaacaacaattacgcaattttaatgtgaaagccagcgtaaaagatgtgcttgttggccctgttgttacgcgttatgaattagaattacagcccggtgtgaaagcatcaaaagttacgagcatcgataccgatttagcaagagcattgatgtttcgttctattcgcgtggcagaggttattccaggtaaaccttatattggtattgaaaccccaaatcttcatcgtcaaatggtgccattacgtgatgtattagatagcaatgaattccgtgatagcaaggcaactttacctattgctttaggtaaagatattagtggtaaaccagttattgttgatttagcaaaaatgccacatttattggtagcaggttctacgggatcaggtaagtctgttggtgtgaatacgatgattctcagtttactttatcgtgttcaaccagaagatgtgaaatttattatgattgatcctaaagtcgtcgaactttctgtttataatgatattccacatttactgacaccagttgtaacggatatgaaaaaagccgctaatgcgttgcgttggtgcgtagatgaaatggaacgtcgttatcagttgctttcagctttacgcgtacgaaacattgaaggctttaatgaaaaaattgatgaatacgaagcaatgggaatgcctgtgccaaatccaatttggcgaccgagcgatacgatggatgcaatgccaccagcgttgaaaaaattgagttatattgtggttattgtcgatgagtttgctgatttaatgatggtagcgggtaagcaaatcgaagaactgattgcacggttggcacaaaaagcgcgagctattggtatccatttaattttagccacacaacgcccctctgtggatgtgattactggtttaattaaagcaaatattccaagtcgcattgcctttacggtggcaagtaaaattgactcacgtactattcttgatcaagggggtgcagaagcccttttagggcgtggagatatgctttattctggacaaggttcatctgatttaatccgcgtacatggagcctatatgagtgatgatgaagtcatcaatattgccgatgattggcgagcacgcggtaaacctgattatattgatggaattttagaaagtgctgacgatgaggaaagtacagaaaaagggatatcaagcggtggagaattagatccactctttgatgaagtaatggactttgttattaatactggtacaacttcagtatcttctattcaacgtaaattcagcgtaggttttaaccgagcagcgcgtattatggatcaaatggaagagcaagggattgtcagcccaatgcaaaatggtaagcgtgaaattttatcgcatcgtccagaatactaatttaaaaggaaagtaaaatgaaaaaaacaaccttaaaatttgccgcacttaccttacttggtttgagtaatttggcattggctgatgcggcaagtgaattacaaatgcgtttagctaaagtcgatgtattaagtgcagaatttgtgcaaacagtgacttctggaagtggaaaaaatgttcaacaaggaagtggcaaacttcaaattaaacgcccaaatttattccgtatggagactaaaacccctcaagaaacccagattatttctgatggtaaaaccttatggttctacgatccatttgtgcaacaagtgaccgcacaatgggtaaaaaatgcggtaaataatactccttttgttttgcttaccagcaatgataatagccattggcatcaatatacggtaacacaacaatcggatacctttgtgttaaaaccaaccttatccacaagcaacattaagcaatttgatattcgtgttgatgctaatggaatattgcgaaatttcagtacgacagagaaagatgggcaaaccaatctttatgttttacgtaatattacgaatcaaaccttgtctgatagcttgttccaattcaagccagaaaaaggcgttgaagtggatgaccaacgtaaaaaataacaagtgattattttaaataagggcgtagaaatacgcccttcaattttgtgagaaataaaaatgtctaacctcaattttgattttgccgaaaatgattttcgcccactggcggccaagatgcgtccaacaaatctagaacaatattttgggcaaagccatttaattggcgagggcaagccactgcgaaaagctatccaagctgggcatattcattctatgattttgtggggcccaccaggtacggggaaaacaacccttgcagaaatcatagcacaacgtattaatgcagaagtagagcgaatttctgcggtgacgagtggtatcaaagaaattcgtgaagcgattgatcgtgcaaaacaaaatcgtcttgcggatcgtaaaactatcttatttgtggatgaagtccatcgttttaataaaagccagcaagatgcatttttaccgcacattgaagacggaaccgttatttttattggggcgacaacagaaaatccctcttttgagctaaataatgcgttgctttctcgtgcccgagtgtatgtgctgaaatcactcacaacggctgaaattgaacaagttttgcagcaagctgtagaagatcctgaacgaggattgggtaaagagcggttaattttagaagagaatttactgcaagtgcttgccgaatatgttaatggggatgcacgattagccttgaattgcctcgaattaatggtggatatggcagatgaaatggaaaatggaaagaaaattgaccgcactttattaaaagaagtcttaggcgaacgtcaagcgagatttgataaacaaggtgatcgtttctatgatttaatttctgcgctacataaatctgttcgaggttctgctccagacgctgcactgtattggtatgcaagaattttaacggcaggtggcgatcctttatatgtcgcgcgccgattacttgccattgcttcagaagatgtgggaaatgcagatcctcgtgctatgcaagttgcattggctgcttgggattgctttactcgagtgggggcttatgaaggagagagagccatcgcccaagccattatatatctcgcagtagcgccaaaaagtaatgcggtttatactgcatttaacacagcaaaacagcaagcgaaagatttgcccgattacgatgttccaccacatttacgcaatgcgccaactaatttaatgaaagagcttggctatggggctgaatatcgttatgctcacgatgaacctaacgcttatgcggcaggcgaaaattatttcccacctgaattaaaagatactcaatattattttccaacgaatagaggtatggaaattcagattaaggaaaaactagaacgattacgtgagcaagataaaagtacggtgaaaaaacggtataaataatatttatttaggatttttttagaatggaatgaaagtgcggttaattttaaaaacctttttgaaattgaccgcactttgggttgcctgttataaactattaattttctgattggttatgtatatttttgccatttcttctaatttgtttacatcatctttatcattaaaaattgttttttcatttacaatttttgtcaaaattaatttcatttcattgtggtttgaaggtttacaataagataacactaaatttgcccattgagttatacgatcatctttaatgtaatttccccaaagttcagttagaatattttcaggagtttctaaaataaattttttaattgcaagaatattgttctctactctctttaatacagcagaacaaagatgtgtttcaccacaagtatcagttattttttgttgccctcctgcagaaaactcatctcttaaactagtgtttattactccatgtttagtcactagccatagtgcgaatttatcatatttatttctaggatttcctaagatcgtttcagggaagaaagcatatgcttgagcaattaacatatctcgctcatatttttctattaccttccagtgtctaactttgggaggggcaatatcatctaaaacattgtttgaagtccaccataaactttcaccttctattaatagagatttatagtatttagctacaggagttattggattatctaattctcggagagaatcatatgtggtctccattttttcaaatatgctctcccccttttctaataacatatctattttatatctagggtaatgggttacagctatatcacataaacacgactcatatggtttggataggaatttaatatttccacctaatttaccaaatgttaagaaaattttttctatatttggaattcgtgtagactcaagaatagaactgccaattgaagtccatttatctccttgtgtactttttacttcaataccataatattgactagctacaatgtctggaaaatgtttccctgatactaaactaatagtgtcttcgaaaggagtattttgagcacaataacaaatagcctcatatacatctttttctaaatcaataccactacgtttcttatagtatgcaattctattttctgcatcatgattaagaaaattatcgactctattcattaatgccgtgaattcatgtaaaggtggatacttatttttagagaaaatcataaataaatcctatttaaaataaagattccattttttttctatatttttagcaatattataagctaatacacatggtaccgcattgccaataattttataggcattactagctgaaacagaaacgttttctgctgttttaggtaaaataaattggtatctatcaggaaacgtttgtaatctagcacattctcttatagtaagacgacgttcgagcatgcctttagataattcgttaatatatttccctccatgctctatgcttagtctacgatattcaatattaccatgatgttcagatcggattgttgggccaacagaattaagtttaatttcaacctgcccttgacaatggtttcccatatatttggcttttgaatatttttgttgagaggggtctttgctaaaattgggttcttgtagatttataaatgcatcggtgcatgtaacaacagctttcaaattttcttttccatgagttgggggaggatatggattgtaatcctcagcaatattttctttttgtaattcttctaaagcttttttatttagcgcattttttttaaaaccaaaaaaaatgacacgctcacgtgattgaggaactccataaaactgagcatttaatacttgagctggtacaactaagtatccttcgtcactagcttgaccaaaatcatgttcaataatttcttttacatctttaaggttcgttaatccttttacattttcagctatgaataatttgggttgagttatagatattacttctctcatccacatgtataattgtcctctattttcaattgagggttcatctatatttgatatttttccatgatgatttttgtgagaatcaaatcctaatcgttttccagctacagaaaaatcttgacaaggaaatccacctgttaatatatcaatgtcttttgggaaaatattgtgagtttcccgttctttttttacaagatcaacaatgctttctaagtggtagatttcgtttgcattcgctttttggtctaagaaataagaaacccatgctgctttagcatcaggtttaatatcattagcaaaaattgtctcaaaagaagtgggcgaaacggtaacccattcattttctgtggagctgatccattcagggtggagctcctcattaatagatttttttagacaagagaaactaccttcaaatccgatatccattcccccacaacctgagaatagagatattagtttcatttatcccccgaaattacatatggaaatgcgtttagatattgataaaagtgcatttatatcctaattagagttaatgttagaacaatagttataaagattttttccaatcatatatattcttctaacagtttaaggtcataataatctagtttggaattataagttaaaagtatgatattgtaaaaatactctattgatatacaaagtgcggttaattttgaaaacttttttgaaattgaccgcacttttttaatttaatctcttaagcaaattttctcaaattcactaaagaatgtaggaaaggttttggcagtacatttgggatctaaaatcgtcacaggtgtgtttgatagtgcgattagagaaaaacacattgctatacggtgatcgttataggtctcaatattggcgtgtttaaattgattgagtggaagcggttgaatatgaataaaatcttcaccttcttcgacttctgcaccgactttacggagttcagttgccatagccgttaaacgatctgtttctttcacacgccagttataaatattgcgaatgacggtttcgccgttggaaaaaagtgcggtggtcgcaatcgtcattgcggcatctggaatgtggttcatatccatatcaataccatttaattcagcgtgttcggcttggataaaatcctctccccaagtgatttttgcccccattttctctaatacatcagcaaataaacgatcgccttgaattgagtttttgccaatgcctgttactttcacttttcctttaatggcgccagctgcaagaaagtaagaggctgatgatgcatcgccttctaccaagtatttattaggcgaaatataggattgatttcccttaacttgaaatttttggtagtgatgattttcaaccttaacaccaaaatctcgcatcattgcaagggtaatgtcaatatagggtttagagactagttcaccgataatttctatttctgtgtcattttctgcaagtggcgcagacattaaaagtgcggtcaaaaattgagatgaaattgaaccatcaattttgacttttccaccttttatccctttgttgcgaattgcgagcggaggataaccctcattctctaagtagcgaatatctgcacccgcttggcgtaaagcatcgactaaatggagaattggccgctctttcatacgaggttcacccgttaagatgatttcgctttcggtttttccttttaagcaaagtgctgcggttaatggacgcattgcagtcccagcattgccaagaaagagtgaaagattgtcctgtatattgaatgttccacctaatccttctacttcacaaatagttttatcatcagacagttgatagcgtacgcctaatgctttcagtgcgttaagcatatgtcgaatatcatcgctatctaataaattggttacttttgttgttcctttagctaaggcggctaaaagtaatgcgcgattcgataaacttttagaacctggtaaattaattgttccttcaaccgcacttattggtgcaagagtaattttttccattacaacaccaccgttttatttttataaacaaaaattctatcgtgtaaagcgagatcaagggcgcgacttaacacggttttttccacatcacggccagcacgcatcatcgcttctgcattataagtatgatccacattaatcacattttgcataatgattgggccttgatctaattcgttattaataaaatgtgccgttgcgccaataatttttacaccgcgttcataggcttgttgataaggcttggcaccaataaaagcaggcaagaatgaatgatggatattaatcactcgatttggataacgtgcgacaaattcagggtttagcacacgcatatatttagcgagaacaatataatctggcgtatattcatcaattttttctgccagtaatttgtcgtgttctacacgggttaagttttcgtggctaactaaatgaaatggaatattaaaacgttcaacaagttcacgtaaattatcgtgattgccgattacggctgcaatttctacatcaagcgcaccataataatttttcattaaaatatcgccgaggcagtgagcttctttggtgactaaaattacaattcgcttacgttgggtgccaattaatcgacaattcgtttcttcgggtaagctatattttagatcttctaataaagtagcttcgttaaaaataccttccaattctgtgcgcataaagaaatgtttggtttcaaaatctacaaattcattattatgaagaatatttagttgatgtttgtaacaaatattagttatttttgcgattaagcctttatcatcagggcaatcagtgagtaatatttttttttcgatcataatgttgtgtgctatgtttagataaaaaaatagaacccataaaataggttctagtttcaaatagaaaaattaaatttcgaaatcagataatgatttacctttgttcaacgcattttgaattgggcgtggtgtgcgaccttgacccgtccaagttttatgctcgccattttcatcaataaacgcatattttgcagggcgtggagcacgttttgctcgaattgatacagtttttgtgccaaaaatttcgtgtaattcttcaggtgtaataccttctttttccattaattctttatatttagctaaacgctcttttcgctctgtctctgctttaattaattctgcttcattagcacgtttttcttcgatagctgtttgtaatttttctagggcattttctgcttgttctaacgttaattcacgtacagctgcacgtaaactacgaagatttgttaaacctcttactaattcgttcataataaacctcaataaataacattaaatgtgggaaaatttatttaataatagagaaaataaaatttattgtaaatatctattattaaataaatggtcgaaacagatatatttttttgtgtttattttctttatatttttattaaagtttataaaatttttataaaatctgttggcattttgtttgttttacggtaatctccccaatcactacaaaagtagaggcgcaattattataagtattttttcagagtggataacgaagaagaaaaaagaaaggaatagttgccgaaatcaaataaaagtcgttttgtttggttggtggcgtgctcgaaaggggcgacactgtcatagtttttctgattaactatggagtgctacggttgttctggtcttattctgtcctatgctttccgttctctccattaattataggtattatttaatggaacttattgatttttcatcatctgtttggtcaatcgtccctgctttgttggcgataattttggcgatagcaactcgccgtgttttggtttcccttagtgcggggattattattggatcattaatgttaagcgattggcaaatcggcagcgcatttaattatttggtaaaaaatgtggtttctttggtttatgccgatggtgaaatcaattcaaatatgaacattgttttgttcttattattgcttggtgttttaaccgcacttttaaccgtatcaggtagtaatcgtgcctttgctgaatgggcgcaaagccgtattaaagatcgtcgtggtgctaaattattagcggcatcattggtttttgttacttttattgacgattatttccatagtctcgctgtaggtgcgattgctcgtcctgtgacagatcgttttaaagtttctcgtgcgaaacttgcttatattttagattcaacggcagcaccgatgtgtgtaatgatgccagtttccagttggggcgcatatattattactttaataggcggtttattagcgacttattcgatcacggagtacacaccaattggtgcattcgtagcaatgagttcaatgaacttctatgcaattttctccattattatggtgttttttgtggcatatttttcttttgatattgcttcaatggtgcgtcacgaaaaattagctttggaaaatactgaagatcagttggaagaagaaacgggtaaaaaaggtcaggtgcgtaatcttatattacctattttagttttaattatcgctacagtttcaatgatgatttacacaggcgcagaggcattggctgcggatggcaaagtgtttagtgttttaggtgcatttgaaaacaccgtagtaggaacatctttggttgtaggtggattctgttcaattattatttctactttattaattattcttgatcgtcaagtgagtgttcctgaatatgcacgttcttggattgtgggaattaaatcaatgtcaggtgcaatcgcaattttattctttgcttggacaattaataaaatagtaggcgatatgcaaacaggtaaatatctatcttctcttgtgtctggtaatattccaatgcaatttttgcctgttatactttttgttcttggtgcagcgatggcattttcaacaggtacgagctggggaacattcggtattatgttaccaattgccgcagcaatggcagcgaatgccgcaccagaattattgcttccttgtttatctgcagtaatggcaggggctgtatgtggcgatcattgctcgccagtatcggatacaacaattttgtcttcaacgggtgcgaaatgtaatcatattgatcacgttactactcagcttccttatgctgccacagttgcaacagcgacttctattggttacattgtggtagggtttacttattcaggtttagctggttttgcagcaacggcagtttcattgattgtcattgtatttgcagttaaaaaacgctaaaagtgtgatctcattcaaaaacttgaataaaaaataatatttttactattttataaaatgcggcattttgtcgcatttttttatttttattgatgtaaaaatttataaaaaactaaattttcatttatctttggttttttatatttttttaattgatttttttgttgttttagtggctagacaaattttttttactttgtatgatgtggaatattgacataatctgttcgtatttttaaaagtgcggtgaatttaaggagtgaaaaatgaagaagttatctggcgcagagatggtggttcaatctttacgtgatgaaggcgtagagtatgtatttggttatcccggaggcgcggtattagatatttatgatgcaattcatacgctgggtggtattgaacatattttagttcgccacgaacaagccgcggtgcatatggcggatggttacgcacgttcaacgggtaaagttggatgtgtgctagtgacttcggggcctggtgcaacaaatgctatcactggtattttaacggcttataccgattctgtgcctatggttatcatttcgggtcaggttatgagcaatttaattggcagtgatgctttccaagaatgtgatatgctgggtatttctcgtcccgttgtgaagcatagctttattgtcaaaaaggcggaagatattccatctactttgaaaaaagccttttatattgcatctacgggtcgtccaggccctgttgttgtggatattccaaaagacactgtaaatccgaattttaaatatccttatgaatatcctgaatctgtcgagttacgttcttataatcccacagtaaatggacacaaaggtcaaattaaaaaagcgttaaaagcacttttagtggcgaagaaaccaatactttttgtcggtggtggcgcaatcactgctgaatgtagtaagcagttaattcagtttgcacaacgtttaaatttaccagtgacttcctcattaatgggattgggtgcttatccaagtacggataaacaattcttaggtatgttgggtatgcatggtactttagaagcgaatacggcaatgcacgaaagtgatcttattttggggattggcgttcgttttgatgatcgtacgacaaataatttagaaaaatattgcccaaatgcaaaagtgattcatattgatattgatccaacctcaatttctaaaaatgtgccagtagcgattccaattgtcggaaatgcgaaaaatgtattggaagaatttttgggtttattgaatgaagagggattaaaatctcaaacggatcttgaaagttggtggcaagaaatcaaccaatggaaagcaaaaaaatgtttggaatttgaccgcacttctggcgtgattaaaccgcaacaagtcgtggaagcggtatatcgcctcacgaaaggacaagcttatgtggcttctgatgtaggtcagcaccaaatgtttgctgcgttacattatccattcgatgaaccgcgtcattggattaattctggtggtgcaggcacaatgggttttggttttcctgcggcacttggtgtgaaattagctcatcctgaaggaactgttgtttgcgttactggcgatggtagtattcaaatgaatattcaagagctttctaccgcaacgcagtatggtattcctgttgtcattatttgtttgaataatcatttcttgggaatggtaaaacaatggcaagatttgatttattctggtcgccattcgcaaacctatatgaattccttgcctgattttgcgaaattggcagaatcttacggtcacgtaggaataaaaattgctacccccgatgaacttgaaagcaaattgcaagaagcattcagtattaaaaataaattagtctttgtagatattaatgtagatgaatctgaacacgtttatccaatgcaaattcgtggtggagcaatgaatgaaatgattttaagtaaacctcaagaggagacaaactaatgcgtagaattttatctgttttactcgaaaatgagtctggtgctttatcgcgtgttgttggtttattctcacaacgtgcctttaatattgaaagtttgacggttgcaccaacggatgatccaacgctttctcgaatgaccattgaagctgtgggcgatgctcaggcattggagcaaatcgaaaaacaacttcataaattagtggatgtgtttaaagtggttaatttaagtgagcaggaacatatagaacgagaaattgttttagcgaaagtaagagcagtggggtcatctcgcgatgaaattaaacgattagcagatattttccgcggtcaaattgtagatgtcacaccaaagtcttacacaattcaattaagcggtacaaatgataaagttgatgcgtttatttctgcattgaaagaagaaactacattgttagaaattgttcgttctggattgattagtgtgtctcgtggagaaaagaatattctttaaagtaggggcgtaaagtgcggaaatattttaatagaattttaccgcactttattagaaatatatttgtttttagtttttttataaaaaaattgtgaccaagttcacaaatctaaaaatatgtatttgcataactgatcggatttctttattctgaaaccactaaaaacaagtgctatcttaaatagccgacatctattttgctttccgagtagtgccccaatggggcactttttttattcagtaaacaagtataaaaaatccctttcctgagaaagggattttaattatctaaattacattttttctacggttttaataccgagtaacgttaaaccctgttttaaggttttttctgttaataatgccaatttcaaacgacttaattttatagattcattttcagcatttaaaattgggcaatgttcatagaatgacgagaagatgccagcaagttcatataaataagcacaaagcacgtgtggtgtgccttcttttccgacagtttgcacggcttcttcaaattgtagaagcttgattgcaagcgttctttctttatcatctttaatagttaaaggtgcagccaaaagtgcggttgaatttatatctgttttattaaagatcgaacgaattcgagtgtaggcatattgcatataaggtgcagtgttaccttcgaaacttaacatattatcccaatcaaaaacgtaatccgtggtgcggtttttggatagatctgcatattttaccgatccaataccaatagcctcaatcacagcttgtttttcatcattagataaattggtatttttttcattaattaatacagtggcgcgttcgatggcttcatttaatagatcggctaattttaccgtgccaccagtacgagttttaaatggcttgccatctttaccaagcatcatcccaaagtttttatgctctaacgagaaactgtctggtacataacctgctttacgagtaattaaccaagcttgttgcatatgttggctttggcgagtatctgaaaaaacaagtgcgcgattagcttttaatgtttcataacgatattttgctgcagcaatatcagttgtagtataaaggaaaccgccgtcttttttttgaacgattacacccattgggtcgccatctttatttttaaattcatctaaataaacaaccaatgcaccatcattttccacagccaaaccttgttttttaagatcttctacgatgcttggtaacataggattataaagactttcgcccattacatctttttcggttaaagtcacgtttaagcgattatagttgtgctgattttgttgcatagtgatatcgactaaacgtttccacatcgttcgacaatattcatctccactttgtaattttacgacgtaattacgtgctttttcagcgaatatttcatcttcatcgtagtgttttttggcttcgcgataaaaggcttcaagatcttgtaattccatttcactggcgtgttcgttttgcattttttcaagataagcaataagcattccgaattgcgttccccagtcgcctacgtggttagcgcggatgacattgtgacctaaaaactcaagggttctagctacagcatcgccgattatcgtagagcgtaaatgacctacgtgcatttcttttgctacgtttggagaggaataatcaatcacaactgtttgtttattggtagcttgaatacctaaatttttgtgggaaagtgcagctgaaatttcagttgttagccaagttggatttaagaaaatattgataaaacctggacctgcgatttctaatttttctgcaatatcagatagttgaagattatctaaaactttttgagcaaattctcgtggatttaaacctaatttttttgctgcagccataataccgttggcttgataatcgccaaattgtggtttgcctgattgacgaacaagcgcatcacaagattgatcagcacctgcaataaccattgcttgtttaattttatcggatagaatagattgaatattcacgttttttcctatgttcaaattgaataataaaaataatcggttatgataccgttctttgtatatttctcaaagggacaaaatgacaaatttacaggaaaatttgaccgcactttcagcagatttagcaacatttgaaagaaaaattcagcatttagccaaagaaatgacaatagatctgtctcactatgaaatcgatcatcttgcattacgggtaaatagtgagcaaactgctaaaaattggctgatacttttattaaagtgcggtagaattttatctgataatattgttaatggtcgtaagatttatcttattgaattagaaaaaccagttaaatttgccaatcaatttgtggatattattgaacttccacttcctaaaaataaaaaatatccaattgaaggttgggaacatattgagattgtagtgccatttttaccgaatgaatcgataaatgaatggattgaccgtgttaatatgtattttttatggaacaaattaactcaattaaccattaaagtgagcgagcctaaggtggatggggaaagattaccaaatccatctattgcagtaagttttacggataaaacagtaaatcatacttgcattaaggttcatccttattctattaaaaaaatacttgaggtttagtaaaaatgaataaattatcacttgcattcgttgttttagcaacagtaggcttgagtgcttgttcttcttttcaaaaagatgaaaatgcttaaaggtcaaatcgtttttagccaaatggaaggcgaaaatcttaaattaactattcgtaaaaatgattgttctggtaaccagcagaaaggagaggaagttattattgtgcataagtatgattcaactcttgctattggggcttgtgtgacggtgtctaataatagccaagtaaagaatatttcatcattttcgccaagaaatccattttaattcttaaattaaggatatagatatgaaaaagaaaacactagcattagctatcttaactatttttagtgtggctggatgtacgaatacagatatttttagtggcgatgtgtatagtgcatctcaagcaaaggaagctcgttcaattacttatggtacgattgtttctgtgcgtcctgttaagatccaagctgataatcaaggcgtaattggtacgcttggtggcggtgcgttaggtggtattgcgggtagtgcaattggcggtggtcgtggtcaagttatcgcagcagtagttggtgcgattggtggtgcagtagctggaagcaaaatcgaagagaaagtaagtcaagtaaacggtgctgaacttgtaattaaaaaagatgatggtcaagagatcgttgttgttcaaaaggctgacagcagttttgtagctggtcgccgagttcgtattgttggtggcggctcgaacttaaatgtttctgtgctataactaatagcattaaagtctaatatgattaatcagtgccttaacttagtaaggcactgattttttataattaaactcatttaaaatatatatttatcgtttatctaagataaatttaaaggactaaattagaatttagtcctagacaaacttggaatttgttcctcccctttctgaacactccatctaaaacataacatttatttttctgataaatttttttataatcttaaaattttgctttaaatcaaataatttaagatgatatttaataaaatgtaagagtgaagttatagtatatttatctaagctcatatacatatcataaagtatacttttcaacactttattacttttatccacatgatatatttctagcaacgacacactattaattacttttatatctatacctatcttattaaggtaatatgtaatattttccccctttatctttttagctacctcattttgcttatgattataaactgatgatgtttggtttccatgtagtctatattttactaatgcttcaggataattagctaaacaaccaagcctactaacctctgaccaaaacttataatcttctgcatagggataatctttattaaagattaatttatgctctctatatacatttgctctcataatcatagtgttgttatgtatcggattatagaaaagcatagcttcacaaatatcattatgtagcaatggatttttccatatatcaccagttttatatttagaaccgataatgccacattctttttctacaataatctctaagtatgatcccattgctgtaatatgatcatttttctccagataggtaactattttctcaatccacgatggtttagctatatcatcagcatccattcttgcaaaatatttacctgaaaaacaaccaaggcctatattcaaagaatttatgaaccctaaattatatttattactgataatttttatccttttatctaatttagatatttcttctaaatgagacaaagtcaaatctgttgaaccatcattgataactataatttctagatttttataactctgattaataatggatgaaatgctttcatctatatattgctcagcgttataagcacaaacaataaccgatactaatgggggattttccatataagatccaattttacactcttatttaaattgttttatacgttatttaaataactagataaccagttaaaactctcctaaattaattgttttacaatagaaatttgagttttttaaatcactgtgattaaaacgccattcatattcctttaaaaatagcttaagaatatcataacctctgtagaaattcatataaacaatactaccttgtttaccttttctcgaataatcagtaacagtgttgcagattgcatattcataaccaccacggtgtatactttgctatttcgtttcaaaaaacaaattacgaagtttttccagcttatccttgaccaagtttacctttcagagcaccaccaaaatagctttcattcgcttgaatttcaccttcaaacatttccaaatgtaggctgctttgagtgataaataatggtagacgatgaaagtaataagctgaagtttatttatatttaccaacttagctgcagctagagctgtcacacttgccagaaatatctcaataagtttattttgcttatattgacttaagcgactttctctcatttgattatcttaacctaaatagagtttttagtcgttatctgtgacagctctagaattattcaaatccaaataattaacgccatgctttaaattgattgattaatccatttgttgaactatcgtggcttgcgactttttcagaatcggttaattcaggaagaattctatttgcaagttgtttgcctagttcgacaccccattgatcgaagctaaagatattaaaaatcacaccttgtacgaagattttatgttcatacatcgcaattaatgcacccaaggtaaatggcgtgattttttgaacgagaatggaattagttggcttattacccgtaaatactttaaatggaacaatatttttcacatcatccaaagatttccccgcttttacaaattcagcctcgacttcctcttttgtttttccgaatgctaatgcttctgtttgtgcaaagaagttggaaagcaatttattgtgatgatctgccaatgggttatggctttgagcaggtgcgataaaatcacaaggaattaaagtagtgccttgatgaattaattgatagaacgcgtgttgtccatttgtacctggttctccccaaataatcgggcccgtttggtaattgttaatgacattgccatcacgatccacatatttaccatttgattccatattaccttgttggaaataagccgcaaagcgatgtaaatattgatcataaggtaagattgcttctgtttgggcaccaaggaaattggtattccataaaccaactaaggctaaagtagttggaatatttttttcaattggagtagtgcggaaatgtttatccatttcatgcgcgccatttaataacgcttcaaagttttcaaagccaattgatagtgcaattgaaagaccaatagctgaccataaagagtaacgaccgccaacccaatcccaaaattcaaacatgttattggtatcaataccaaatttttctacatctttagcattggttgataatgctgcaaaatgttttgcaaccgcactttcatctttcgctgcttttagtaaccaatcacgcgcactttgtgcatttgtcatggtttcttgagttgtaaaagttttcgatgctactaagaaaagagtcgtttctggattgactttttttaaggtttccgcaatatgtgtaccatcgacatttgaaacaaagtgcatatttagatgatttttatacgggcgaagtgcttcggttaccatataagggcctaagtcagagccaccaataccaatattcactacatccgtaatggctttgcctgtatagcctttccattcgccagaaataatacgctgacagaaatctttcattttagctaacacagcattgacttcaggcataacatctttaccatcaacaagtactggcgtattagtgcgattgcgaagtgcagtatgcagcacggcacgattttctgtacgattgattttttcgccagtaaacatcgcttcttttgcactatcaagtgcgcattcttgagcaagttggcgaagatgtgaaagggttgtttgattgatgttgtttttggaaaaatcgacaagaatttggttattgaatgttaaagaataatcgtcaaaacgatttttttcttgtttaaataaatcttggatggtggtgtttgataattcagctttatgtgcttcgagagatttccacgcttgggtgtgagttgggttaatatttttcatggtatttcctttcattaaaaataattgaaattttaaccgcactttctggaatttttattagggagaatgactccctctgttcaaaaaatgcagtgattaatcaacgtattcagttataacacgaggtgttaattttgtaattagctcgtagcttaaaatgcctgtgaatttagctacggtttcaataggtaattccttgccccataaaattacttcatcgcctaccaaatcttggctatctgcgcctaaatcaacagtgagcatatccattgacacacgtccaacaattggtacgagacggccatttaaataaacaggcgtaccttctggcacatcgcgcggataaccatcgccataacccattgcgaccacgccaattttggtatctcgtggacttgtccaaataccgccgtaacctacaggatcgccttgtttatgatggcgaacggcaattaatgacgaggttaaattcatcactggcgttaagccaaactctttgccaatagtatcagttggagaaatgccgtacataataatgcctgggcgaatacattctaagtgagattttggccagaaaagaatgccgccagaagctgcgatagtgcgttcaccttgtttatcttttgtggcggataaaaaacgattgatttgaagttgggtgtaatctgattctagttcatcggctcggctgaaatggctgacaaagcctaagtgcggttgaatttgagggagttttttcagttcttgataaaaataatccacttcatcaagagcaacgcctaaacggtgcattcccgtatctatttttaaccaaaccttaattggacttggtaaatttgaacgttttaaagcctcaagctgttcgtgattgtgtaccacggtttcaatattattaacggctagaataggcaaatcttgttcattaaaaaagccttcaagtaataaaatcggtttagtgatgccgttggagcgtaatgctaaagcctcttctaaacgagccacgccaaagcaatcgacattttgttctaaagttgatgcaacaaacacaacgccgtgaccataagcgtttgctttaaccacagcaataattttgctatttggtgctttttgtttaattatttctaaattttgttttaaggcgtgcgaactgattttcgctgtcgccggttttacgttcattatttttccttaataatcatctcgatattcacgttgttcggcaagattgtcaaagcgtgagaattgtccattaaattttaaccgcactcgaccaattgggccgttacgctgtttaccgataataatttctgcaacgcctttatcttccgagttatcgttatagacttcgtctcggtaaataaacataatcaagtctgcatcttgttcaatagagcctgattcacgtaaatctgaatttacagggcgtttgtctgcacgttgttctaaagtacgatttaactgagaaagggcaactactggcacttgtaattctttggcgagtgctttgagggaacgagaaatttctgcgatttctagtgttcggttatctgaaaatgcgggtgcgcgcattaattgcaaataatccaccataatcatacttaatccaccattttcacgataaactcggcgtgcgcgcgaacgaacatcggtaggtgttagacctgaagaatcatcgataaaaagattatttttttgcttgaacattcccactacgctagcaattttattccactcgatttcatctaaattttgacctgttcggattttagtttgatcaacgcgagcaagcgatgcgatcatacgcatcataatttgttctgctggcatttctaaactaaatactaaaacgggtttttcacttgccattgcggcattttcgcaaaggttcatggcgaaagtggttttacccattgacggacgtgccgcaacgataattaagtctgaaggttgtaaaccagccgtttttttatcaagatcggtaaagcccgtcgtaacacctgttacacctgaatgattttcaagtttgcttaaaatatcgattttttcaatggtactttctagcacattgatcacattttgtgggccttcgctagaagttgttcgtttttctgcaatcgcaaatacttcacgctcagcctcatcaagaattaacttaatgtcttgccctttaggagaatagctattttcagcaatgcgatttcctaccgaaataagttctcgtaatatggctttctcacgcacaatatctgcataagccaaaatattaatcgcgttcggagtattattagaaagctctgctagataggcaaatccacctacttcatcgctgacaccgtggcttcttaaggcttgatctagcgtaattaaatcaataggcgattgattacgcattagatgttccatttctgtaaaaattagacgatgctgaaaagtataaaaatcgtcagcaatcacacgttcagcaatgccatcccaatgttgattgctcagcatgatgccacccaacacggcttgttcagcctcaattgagtgcggaggaatgctaacttgtgctgtttttttgtctgaagatttgatttgaggttgtgatgccataggacttatttcgatactagaatgtcgcctatgataccgcaaatatctattggatttaagtgaaaagtgcggtgaaaaaaggaaataaaaaacggtggaaaaatccaccgctcttttattttaacatatttagattgttgattattcaacaattaatgtacgacatacgttagtttgtgtcgcaccttgaccaccttgggttaccagtactaaatcgccagtagataaataacctttttcttttaatgattgaagtgctgcttttgcacctgcttctgtacgactttcttcaccgtgataaattggtgttacaccgcggtatagtgcacaaaggtttagggtttcttgattacgagataaagcaaagattggtaagccagagctaatgcgtgacattaataatggagtacggcctgtgctagttaaagtgacgattgccgctacacctttcatgtggtttgctgcatacattgcagacatcgcaacagattcttcaatggtttcaaattctttatccatacggtgacgagaaacgttaatgcttggcattttttctgcacctaaacatacgctagccattgctgccactgtttcagaaggatattgacctgctgctgtttctgcagaaagcataactgcatcagttccatctaatactgcgtttgcaacgtccattacttcagcacgcgttggcattgggttactaatcattgattccatcatttgagtcgctgtaattacagcacgatttaattgacgtgaacgacgaattaattttttctgtacaccgactaattcaggatcgccgatttctacgcctaagtcaccacgagcaaccataattacatcagatgctaaaataatatcgtccatggcttcatcattagcaacggtttctgcacgttcaactttagcaacgatttttgcatttaaacctgcttgttgagcaagttcacgtgcataatttaaatctgcacttgaacgagggaaagaaacggctaagaaatcaacaccaatgcgtgcagcggtaataatgtcggctttatctttttctgttagggcatccgcagataaaccgccacctaatttattgatacctttattatttgataatggaccaccaacagtaacttcagtgaaaacttttgcaccatcagttgataatacttttaattgaacacggccatcatctaataaaagaatatcgcccggcacaacatcttgaggaagcgttttatagtctaaaccaacggattcttgagtgccttcgccttttggtaattctgcatcaagaatgaatttatcgccaacgtttaagaaaattttaccgtctttaaaagtagaaacacgaattttaggaccttgtaaatcacctaagattgccacggttttacctaattttttcgcaatagaacgtacacgttcagcacgtccgatatggtcatcaggtgtaccgtgagagaagttcatacgaactacgtttgcgcccgctgcgataattttttcaagattgttatcacggtcagttgatgggcccatagtacatacaatcttcgttcttcttagtcttctagacattatttactccgtcaataattacaaaattttaaaggtgttattttacttcgctacatatattagccagataaaaaatcggtgcacattatacgcttaaaacttttggaaatcaaaaacggctcagttatttaagctggttttgtttacttttttgccagttatatcgggttttaagaaaaatacttgtgttcaagttaaaaatatctataatcacgactacttcacacagtgcgactatagctcagttggttagagcaccaccttgacatggtgggggtcactggttcgagtccagctagtcgcaccaaattttcttttcaatccctctcaatccatatcaaataaaattaaatttcctggtaaatcaaggcattatctgcttttataaagtcaatctatatcaatctatattaatctaactcacttttttggtattatatttggtaatataattttggatttttaggtgtcgtaataccaaaattcataaaaatactaaaaaatcacgcttaccaaaattattttcgtaataccaaatggggggaaggatggctgtattagtgaaaccattaagcattacagaaatcaataatgctaaacctaaagagaaagactactcactgtctgatggccaaggtcttttcttgctcgtaaaaatgaatggttcgaaaatttggcgatttcaatattataaaccaatttctaaaaaaagaactttaattagtcttggtgtttatcctgagatttcattgaaagatgctcgagagattagggatttatatcgttctttgttggcgaaaaatatcgatccgcaagattatcgtttacagcaagaacaaaaagccatccaagaacgtcaatttaccttgagcgaaatggggaaggaatggctatacctaaagaaaaatgaagttgatactgggcgattaaaagaagtgacttttattgatattgggaaacggttagaacgtcacttgtttaaagtgttggggcattattctattagtgagatttctgctcctcttgctattgagaaattaaaaccattagaacgagcaggaaaattggatacattgcatcgtattattggttatttaaaccaaataatgatttattcggttaatagaggggtaattaattataatgcaaccgcagatattggaagggtatttattcgaccaatagctgaaaataaccctactattcgcccagagcaattacctaaattgtttgaagatttgcagaatagtacccttgaaattgaaactcgttgtgcattagagctactactacttaccgcaggtcgggctggggctattactcaattagaatgggaaaatgtagatttcgaaaacagcttattgaatataccgaaagaaaaaatgaaggggcgacaaggtaaagtacaagattttatcttgccattatccaaacaagctgtaacgattttgcgcttgttacagaagttgaatcgttgcaatagtaagtttgttttccctagcaaaaaaaatccaagacagcctatatcgaaagagacgccaaataaagcacttggacggatcggttataggaatattttgaccgcacatggtttacgatctgtttttagcacagctatgaatgaggccgaatttaacagtgagattattgaggtgtgcttggcacattttgaatattcttccgttcgtggcacatacaataaagcaaagtatatgccacaacggatcgaatatatgcagtggtgggggaattttgtagaagaggcatctgatgggaaagcattaatgggctgttaagatgaatagcagcctgattcaattctttcaatgtaatcatttatttgtgcatcagtccaaaagttattcccaccgactagatgaggctttggaaaattggggtcgttttttatccttctgtaaattgttggtgcgctcatatctaataaagcagaaacagttttcaaattatgtaattttcttgtcgtagattccatatttcctccaataaaaaccgcccttatgggcggttataacggtttattttagttagcccacttcatctaacttattcatctttttgtaaagaggatagggcgatttaatgggttgtaaatgggttttaaaaatcgttcgggtcgtcgtcttcctctagctctatcacatcaagccgttgaataacttcaaatttagctaaaaaacgcagtctgttctcaaaatcaccatctctccatacatacataacttcgcgttccggttcttcaaacatatcccaggaataagcgttttctttcgcgatatgtaaagcgacattatcaaaacacctactttcatcttcccatgtatttccatcatcattgtttgtaggattgttactttccaatgcgtaacgatataaatatttagccataatttattcctccggtggttgtggtagcggttgccaataaataacctccacttcctcgccagggttttcatccgattcccaatacggaattaaacaaccttcacaatccgacttatcgtcatataaataccagccaagaccaacagcccaatgatcaccatcctcagtaaaataaattaggtgtttgttagttgcattacgatactctaagtcggtagaaaatggttctggtagttcgtttgcacaattaatccagccattattttcactcatttttcccctccaaaattgctttgcgttttgctttaataattggcgtaactacccgtttaatcgccagttgcaattcacctataaaggtctcatctttcatattgtcaaatgcaatacccatcaacttcgtcaaacacaccaccttcccagtctaatagcacgatatttccgcctaacacttgcgtattttttgatattttaagttgatcacgttggtagtcgtccatttcaacttcgattgttatgcggactttttgggttatttcattgctcatttcctactccttttcctttgtaacttggatattcagatctcaaaatccgataacaatttgtttttaactcaaaaatgcttctcggcagagcgttaataggcaatgttttacaggctctcccggtgtcgtccataccatacggcacaccgattgcgcgccaacatcgtgcggcatgtaccgctgcgtctttaaccacatccgagttaatcacaaagctattcggcccaatgcgttgcaacaaaacaccttgtgccataagctttttaacccgccgtctaaattgactttcgcttaatccagagccttcaataaggtgtcttacactcaatattgcaaagtcttctgctcttttctctgcatgatcatcgctatacgtgccaacactgccaccgatatacgttaccaaggtgtgttgtgcgatgcggtctaatgtttcatcccagatatactcaaggatatgttcgtctagcactttcatatcttccccaatctcattctcatccctgacaaccgctccgaacatttaatccattcgctcatatcacaccaccaatacatataatagccattctgtgaatcctttcatgcttactcctaatataaatcttctgagaacagaatatctgagtttggtgaaccagataaacgaattacttggttctgagctttagcaatttccattgcttctttacgacctacaaaacgacctttattagttagaaacccttgttcccaatctaaaagagcatacttgtattgtttttctaattctttaatctgcttacgcatgaatgggtcatagtgtcttaaaccatatacttcatggataatctcaccgccatcttcatttgtaccatctctttcatctacaaacacttggcaagcagagcatacaattctttcaggaatatctacatattctcttttttggtttaagagtttaataaattcattgaataatgtttgtctttcttcaggcgtttgttgtttgattaaattaataatatccatcacttactccatcatactcttcataaaatcaagccatttttgagcatcttcttttgtgcggaaacattgaccatttatcatcaagttagctgcacaatctgcataaaacgaaaaatatctaatcactccatcgcttaaatagaaaaactcatcgccaatatgtggtttaaacggcttaggtaaagtgcttgtgtcgaattttggatcaagtttttttacaaagaaccattccatggtcagattagcgagccatggttggatgatgccatcttccggctgcatcacaaactcgccgtttttagttttggcgataacttttagaggtaaatcaggattaccatcgcatagcactagcaaatcctcattacaagccttttccagcacttgttctgacgttagtttaggatcttcccacattccaatgatgtcatattccatggttgcccaatgtactgatttacctgttaagttccatgatgtcgtattaatgtaaataccatcaaatctatacccgattaacggatatacggtatctcttacctctagcttttcaacctcgttaagcaaattgtatttaacaacggcttttcctccatttctcaacatcacaggctcgccattcaaggctgcttttaagttaaattctttcattttctttctcctaaaacaaaaggcgctcacttggaacgcctattggatttatttgtttaaataattaatcattctttccccgatccacttaataaccggtacagccatactattgccgatagctttatagcgtgggctatccgggcaatcttcggctggtttatttcgatacgatatttgcgtataacctggaggaaaaccttgtaatttttcgcattctgaaggggtaagtttgcgaatgttttggttgatgctcatgcatggaatgttattcccacctgtccccattcttgcggtaagtgttggcgtagtgccgtccttttgtatgcgcacaacatcgcgtcgatctgaaatatcgaacaaaacattttcctgcccattattgcgccccaggcagtgggcagttgatgtggaaataatcgggtcttgcgtaccatgtactacaatagtttcagagccaccaccaagcgccccaccactagcttttactagcccccccaatacggattggcgatacgttccaaagcttccctcagcgtagcaggtaaaaccttgttgcgtttttccgcacgattgagaatacccttgcaagcttttgcgctcaaaaagtatttgggcgacgcttctttctctagcacttgccacaaggaacacgcgcttgcgtcgttgggcgagtccgaagtattgagcatcgaggattcgccacgcgatagttcgggacgaatgcacataaccagcgtttgaccatttagcccctgttggttgcagtggctcacgctcttgaaccaatccagccaaaaggtgtccgaatgcgttgtcttttgtggatagtacacccggaacgttttcccacaacaaaacgcacggctgcttaccgtcttggtatctaacataatcaatagcctctaatatgtgtattaaagttaacgtgagatttccgcgctcgtcatctaacgagtttcgcaaaccagcgacagaaaatgcttgacaaggagtaccaccaacaagcacatcaggcgcaggaatttcacggtttaagattttttcgggtaaggtggtcatatcaccaagatttgggatgttgggataatgataagcaagcacggcgcaaggaaaaggctcaatttcgctaaaccacagcggtttacttaagcctttccatgccacgcttaccgcttcaatccctgaacagattgaaccgtaggtaaacatagtgcggttattttttcctctgttttggattaatcacaggcaacacaggcacaatcggttttgctgttgtagctgttgttgatgggctactgcggttttcatttatccagtcaaatagttcctcccacgaatcgtagtcaagtttgtggaatgcgttatttcggtcgcttgcccagcgtttcagatgctcattaatatcgcgagtaattacctctcgagtattactgcttaacacgctccagtaggttttaacatcgtgaatagtttcgctaacgatataagtatgtcgtggcaagctgtatcggacgtgactaatcattaaattttggaatttatgtaaggggagtttgatgttaatttcattcattttcgtttgcttttctttttacgtttactaaaaatacgttcttgttttattgctctaagctcagtttcaagcgtcgcattttctcgttttagttgattgttctcagcttccagacttttaattaattcacccaattttcgtagcttcaattcatggagttcgatagatttatcaatatgtttatccaatcgtctaagatcgtctatcaggactttttcagctagccgtttaagtaatctcataatctatccctaatcccgccaaattcttttattaggctatccactgttttaccaagcacgctcgccattaagacaaagtctacatcaaaacgagcagttacatcttcttttacaatatcatcgttctgctcggtgatattgtcgtcaaatttcaggcgtttcagcgtgccatcttcgattaatacgaatttaaggttgttttcccactcaagcgcgagtttagagatcaagccattttgaacaagctcaataatttcctcgtcttcaacatctttttgcttgcagtgaataacgccaagatcttctttttcgcggatttccacttccttacgcaagattagccaatcaggtgcagtatctgtaacccatcttgtcattacttcacacggcgcacagttaaacgccaacggtactactagcaaactacctagcgatttgcgcaaaagtgcgagtgcatcctcagctgttttacttgatgctgcatcaacaaagataagttgtttcaacgtgtcgatgtaaagtgcggtcgttttgatgcgagaaaatgcttgcggaagtagagtagctatcacgtcatcttttaaagatgatcgttctactttctttaattttcgctgttctttttcttcaagtgcagtgattcgtttattgagttcacgattcacaacttccacaggcaaaatcttctcttctcgtttagctacaagtaagatttttccgttcgcttgatgtgctaaattttcgctggtgacgagcggagcagaccaaccgaaatggctaacatctgctgaaccacacggagtaaattcacattctttgagttgtttttcgatattctcaaagtctatttgttttgttaattggtaaataattgcatttctgaaccagtacatttttattattcctcataaataaaaagccgctaattaatagcggcagattttaagcatcatcttcgtagtagtgttcttcaaccacgaatctatcactaccatagacaggttctctatatggtttttagtcatctttaacctcaacaaactcaccaaattcatctaacgtgtaccaagtatcagctttgatgttattttcaccgacttttgatgctttgatatggattagctcgccatcatgattgcgatatacacaaacaatagcaccattaatactcgccttagctttagattgccaaccaagcgcaacagctatagattgcttgccagatatttccgctaccgactgatcgcctgtattagtcgctaccgaccgatagcctgtattagtcgctgccgaccgatcgcctgtattagtcgctaccgaccgatagcctgtattagtcgctgccgaccgatagcctgtattagtcgctgccgaccgatcgcctgtattagtcgctaccgaccgatagcctgtattagtcgctgccgactgatcgcctgtattagtcgctgccgactgatcgcctgtattggttgctgccgaccaattgcctgtattggttgctgccgactgatcgcctgtattagtcgctaccgaccgatagcctgtattagtcgctgccgactgatcgcctgtattagtcgctgccgactgaccgcctgtattagtcgctgccgactgatcgcctgtattagtcgctaccgaccgatagcctgtattagtcgctgccgactgatcgcctgtattagtcgctaccgaccgatagcctgtattagtcgctgccgactgatcgcctgtattagtcgctgccgactgaccgcctgtattagtcgctgccgactgatcgcctgtattagtcgctaccgaccgatagcctgtattagtcgctaccgaccgatagcctgtattagtcgctgccgactgatcgcctgtattagtcgctgccgactgatcgcctgtattggttgctgccgaccaattgcctgtattggttgctgccgactgatcgcctgtattggttgctgccgaccaatcgcctgtattggttgctgccgaccaatcgcctgtattggataccttggctgcatcccaatcaactttaccttttatccattcaacggctttttttatcatttccggtaagttaatttcggtttcgatcgtgatttttgcagatgcaatttttgtatcatcactatcttttgatgtttcgccgctcattttaactacagcaaatttacttaccgctggactgtaatagctaagcacatcaagcgggtattcgcaggcgtggaatccactctcacaagccttaacattacctttatgctcatacgttttgcctacctcatactgataacctcgacaagtccagtcttgcttaaaccctttataagctataatttctttgttttcttcagccatttttgcctctcaaatttagataataaaaaagccactattggttagtggcttgtggtgtaactcaaaacggaatatcatcatcaaacccatcttgttctgccgctgcgcttaatgggtcgggtttttctttgtctttgcttggctgttgtgtttcattgtttgccttgctgtctagcatttcaaaggattgtgtcgctactttaagtgcggtgcggttattgccgttttggtcttgccagctttcctgtaccagtttccctgttacacagatttttgagcctttttgcagatattgtcttgctacatcagcagaattgccatgcaccacaataggtatccaatgcgtacgtttaactgtattaccttgtttatctcggtaatcatcaccgatagcgagattaaatgtggcaatttgcccaccattttggaattggcggatttctgggtcactgcctaaatgaccgactaatatcacggtgttggtattacgtgccattagcgcatctcctgtataagttgttgataatattcttgagcaatttctactcgttctttgattttctcgatgactttctcatcacgtttaattgtgacggtggtgatacgtttttcttgggggatttgctcaactaagtcaatgtatcgacttgggtcatcatagcttgataattggtcgtaaggggtggggaggaggacaaaatcaatttgcgcctcactacaatcccatagccacatatagccttgcatttgtgcgtcataccccgcttttttggctttttcttccgcctcatcagcaaaaaaagggtgtgagccaatatcccaagaacatttagtatctatgattaattttcggcttggcacataaatatcgcactcgcctgtaatccaatcgttttcacgtctttccgtgttctttttaagaggtaatccacgtttacgaccgcttaacttaatggcttgttcttctagtgcaatgcctttctcggtgtatttattcccctcaaaatctcgataaccgaataaatcaaatttcactatctttctcaccgcactttttgctgtagcagatattccattaccgcttttaggctttaccattaaatcagccaagccagagcatttagctttgagttggtacatttccattctcaatcgcctccaactccgcaatctgctcttggctaaattcataagccccactatcacaaagctcttgtagggtggtttcgccgttagcaatgctttgtttgcattgttcgaatgtggcttcatcaacaaccgctaaaaattccgcttcttgaatattgtcggtgtagttgaactcttgattttctacatctttcacaacggcttggtcggctaatacggcttgttgcatttcaacagagagtggagcttgttttgatagcaataacttagttacagtttttaatgccattgcctcgaagttatcgtgccatacgccatagccttttttgaatgtttggctgtagcgttgagcgtgtttgacgatgtcatcgtgactcatatagagttcagccgaaaaatcgtttaccagtttaaaataggcgtaatagccgattggattttcgttttgttcaggctcttgctcccagtcgaactcaaaaccattgatgaaatcttttttgataagttgctttttgtacacaggcaatgcgactaagcgtttaaattgcccactacgctgtgccagttggataaagcctttatagccaatttggaattgcgcttcggttttcttttccttgttgtttctgaaagggacgatgtaggcaaagcctaagccattttgtagtggcaaattcaatgtcgctgccatacaagcggcgttaaaaatgctcattgggtctgctgttttaagcattgcattgctattggcaatttgcataacacttgttgcaaaggttgccgcatttttgccaacaagttccttaatcttattttgcacattcgcactttcaaaaaatgttttaagtgcaggtggctgtttattttgttgatgttggacttggtttgtcatctcgcccctccattaatctgggtcataatcattcattctgtcgtgcaattcacgctctgcgattttcttaatcgcctcttgtctataaggctcataacttgcaccgctaccaatggcaagccagaaattatcgttatcacacaacatttccgtgagttcgtgataatgcgtttggtcgccttgttgtaaatcattgtcgatttccgtggcgacttcatctaaagcgatttcatagcctgcttgccaatccactttacgttggtgtgcagcatcgagttgatagtagtaatcatcggaaggtttcattgtttactccaagtgcggttaatttcggcttgcttttgtgcggtgtaagcctgcagttctttttctgctgccagtgtaagattaggcggtaaacatacaccgttttcatatatgccccctttcagttcacatcgggtttcttgttggatttgttggcttaattcgttatcgtgccaatcggtggggtgggcattggcgtgtaggctaatcccacccacaatcatggcaataatcaaggcggcgagaaaatagcagattctgtttagccatttttcactgcctttcataaagtgcgtgaagctttgtttttcttggcgtaatggggttttcgagtgtttcatttggggctccttgttagatattaagcattttttcttttgcgattttgcagctgtcttttttgatttcaaagccataggacgggcggttaagctctcgtgcggcgcgtagcgtggatgcactgccagcaactggatcaatcactacatcgccctcatcggtaaagatttcgatgaggcgttttaacacggcaatgggcttttgtgtcgggtgcagtttagggatttccttgcggttgtccttttcccattcgaaccagtttttaatcattttgccgttgttgttaaatttcggcagtttatcgcggtataaaatcaaggcatattctgttgcgccgacgactttcatattcgctttgagcacctgtggtgatgatgatttaataaacaccaaagggatgtgatttttaaagccgtgctgcttggcgtaatcaatcaccattgagatttgctggaaagcgcagaacacaatcatacaaggggctttgccgcgttctttcggttctttgatgagcatttttgaacaaaaatgcataaattcggcaatgcggaaatctttatctgtatcaaaaaaactactgttggctttgtcgctttcgccgtttttgttatcgccgtttacataccattcagggtttgaagcgtaagcattattaccgagattgtagggaatgtcggcgatgactagctgcgcttttgggatgtggtagcgtttgtagttttggaagtgatcgttgaataattcggttttcatttttgtttcctttttagtcgatttgttgaattttgggtgtaataatccgccacacgatttttcaaaagtgcggtcggattttttgctgttttatagaatttctaattgaaaacccgtttttttaggatcgtaggcgcgaagatattttaatacgcgccagttatttccttgctcgcattcaaattgctctgtaatgcgtgtcaatacgttatgggcgtgacggagagtactgcgatattcgtaagctatgtcataaacggaagcagcgtagtgcgaaccaatttgttttagtgcggggtgaagcacttggcaaagttccgtgccacgcaataaagcaaaccacgcccacgccattgtttgcaattcgtgttcggtaaattcaaacgtaaatgttgtcggttcctgcgtggcaatattgggggattgattttcttccatatctttctcttttttacgttgatttatgccttctttgagttttacaaaggcggaaaaggtgggtttaatttcatcattgagttggtgatactgtaatttctttcgccaagccatttcaacacgtgaaattaattcgagattttcaagggtgcaatttcttgaattgccgtctttgtaatcaataatatgtccacgcggaatttttctaccggctttgcgccagagataatgcgatttccgttcataacgtttaatgcttgcttttattaaccaacattttgcatttttacaatatcgctcaaagccaatcggttttaaattttcacctttctcaaatcgacctcttcgtccggttagccattgtctcttcacgcgcaaaacctttaacgcgtgtggattaaatggtttattgaaataaacttccattttttgagccaagattctttcatttaacgtgcaattcgctttaatgaacgcaagttcttctttgctgtaacgattagcatgcttaaggcttggaatattgtgtttcttttttaatttatagaaaacattacgatttattaataaatcaaactgttgctgaaacaatttaattagatcagatggctttttatcccaatgtaagcgaataaacgcaatatgttcatcggtgaatttaaatcgttccgcattagaggtcatcgccttgcgccttagatattcttagaaaatcaggggattctctttcaatttgacgattttcaaacaatgtcattgctttaagcgaaatcgcattgcttgcgataatatttgccgcaatgcctgatacggcattggcacgtttaatttctcgattaagttcttcatcggttaagtcttcatcaagcagtttttctaactgggaaaataaatgattgtttaagtctgtgattttatttttcattttaaatacccttaaaaaaccgccctttcgagcggtcagtggagtagtgcaatcagtctatgctgattttgtctagaatagagtgcctttctttatgcttgtaaggctcaagccgaggctatcgtattaattctcttacccctagtctgcgcttctgcactgcgtgcacggtgtttgtaccagcaggtttacctttgcagcagtggtagttggctatgtcgataaattgctctttttggcggttggctgcaaatttaattgcgcgatccgccgcactttcttttaccaccattttttcaaacgcggcattaatgcgacgttgtttatcgaacattctttctaatctgcccgctttaccacgttgtaaaatttcgcctttttcggtgaatttgcgtgaacctgcatcacgctttacgatgatagttgccatagttggctccttgtttgtgtaccatttttaaccgcgctttaatgtgataatgcgcttaatctgtcagattccgcaacgcggtcgccgtcaaatcgatttcggctgcattaagagaaaagtgcggttaaaaatggcgttatcttgattgcctcagccccacgcgttcaagttacgcattattcccaatgttgatgttggttcgtgggtgattcgatttgttaaagagcaattaaaatttttattcaaggccttctcaaagggcttagtaaaaactttaggcgataaacttaagtgactgttcttatttttcttcttcttttattaaatcccactgccgtctctgcttatctctcggcttacgcctgctattgcggtgggtacatttttaaatatgtgctacaacttgttttgcctctacttcaacttcatccataatcagatttctgaaatcttcattagtcataaacaaatctgctaaggcttctaaggcttttcctgttttctctgcgtaacgctctaacacttcggtaatgaaaaaggcttttaattctgctgggctattaatgttcatgttgggttccttatgggtgtttgttttgatgtgggtataatatagttttttctattctgtgtaaatagttttttctataaaaatatagtttttttgacttgctgaaattttaggtaataaaaaagcccgcgattgcgggctgggtgggttgtgtattgcgttattttttcttcactctaaaattttcatcatcttgacaatactcaaggcaatcacgaatgataccgctcaatcttaagatgttttcagggcaatctataataatttggctgcctgagatttccaaaccagcgcgcacgatctcctttctgttctcgtcatttagctctataggaattacaatcgatgggcgttgcttgttatcgtaataacgtaagatccagcggttcgtttttccttgatacaaaatgctgaaatagctttcagtgtctttggcgatcagttcaacttcttcgcctagaattaatgaaacatattcagataataatcgctcagtataggttgtcacgattttactattgttaggatcgacgacaggcgcggtttcatcaatcatctccgatgctggctcttccaactgctccattaccggctgcttggataagcctgatacaaccatttcgctcacagctttctcaactgcctgcttcacgattggggtaatggattcaataaaacgctggttaagctggcgtccaatattggaacgaccggcaatatatcgaacaaaatcgctatctacatcttttagagacgatgaaataaccttagtgaaagcggaaagataaacactttcttccgctaatgtgcggagtgcttctggttgaaacttatcgtggcagaattgcgctagttgtgggattttagtttcatcaagactgctaaagtttatgcgtaaaaatggtgtactatccattatatttttatctttcaagtcagtgaaaaatcgccattctttgccattggtaattgctgcaacggctacttcaggggttgcattaaaataacgcgcgagctgtggtgcatgattgcttaagtcttcattgtaggattttgcttcaataaacattaccggcacgttatgacaaaatagcgcgtaatccactcgttcaccattttttgcgccgacaaaatctgcagtatattccgcttttactttagttggatcgtatgatgtaaagcctaatatatccaagaatggaagaattaatgcttgcttggtagtttcttcggttgtgcaatgtggcccagcacgtaatacgtgttgggcgtgagataggattttatcttttaaaatggcatcagtcataatacattccttattgattatttcgctgatcttttggggtgtagtggaaatctaaatattcggctaatggtttaagttcagggataaaatcattattctcagccgcatcttcaattgctttttcttttttcttatctacgcccttatcaaggcaatcagatgtaatttttttactgcatttgctaaatccattggttatatacgctcgtcgtgcgacgatatatacgatcttatttaaaaatacttttgatgtatctacgccttttgttaaaaggttattataatctgcgagatattgatctgtaatggatttgatgacatcggcgcggaattggcaattgtctagcattggtgttcccgccacttctccggcaccttcacaaactaaatttactttatcgcttttatttaaatcgatcactttatcgtaagcagattttttaaattttgcttgtgtcgcgttgaagttaaattcattttttgatttaaatacaatatacgggtgatcgaataaatccgtctcaatgctacctatcgtgcctgaaactatcaaatttttgcctttgaattttttgttggctcgagcttcatttttatcatattccttttctaattcagatatggtggtaaatacgtaatcaccatatttataagcagttttcccaccttgaaagtagacatctatttcttccttgatcactaatttcattaattcaatttcttgtggacttggattgtagattttatcttcggcaagcgttgaaaagggtaatgcaactaagattagcgaggatagcacagcttttttcattttagtttccttgatgttagcgagagatttttggcatattacacaataggtggggatcattcagtgatatagatcacattttagaaaccaaacgcctaccgaagcagacgtttgatgaaagtttaagcgagaaaaatacacttattttgcgttagaagtagttttagagattgatgcgcggcgtaaagataagattttatcgttggtacactcactctcatttcccgccctacgtcaccttgcgataaattgctaacataccgtagcataaacacttgatataactctggtgtgacgttgcgcataataagtgttgcgtcgtgaatgcgcattgcggtttcatcatccaacatcgggatgccgtgatcgggcgtggatttgcgtaaaaaaggctgaattgcgggatagttaattcccacgccttcacgcgcccatttgccataacggcgagcagttaatttaatatctaagatgtgtttggtctgcatattatccctttcttttttctattaatcggcattttttgttaaaaatctgtttgatgcgccgtaagtcatcggggaaataatgccgtgggcggttgtcagcttcaatttgttcgactttttcgctacctagtctatcaagcaagcctaggcgatattgctgtacattgccgccgtagtagcggttgcattttttacattgaccgtggatattgagagtataaaagcgcaagtgtggcgcagctccacgtgagcggtaatgcccagcatcaaaccctcctcctagctgttctgccactaagggcgtgccgcaggagatacattccttgcccacatcgcgcaggcggatatatttatttactgccacttgcgcttccttggtcaattcgtgcttggttttgtttttctctttaagtgcggtcatttttttgcggttttcgattcgcgcctgtttgtcttttttctcgcgtgccttgcgggtctgttcgcgcgaaagtttaatggcacattccggcgaacagaccttttgcaagctagaaacgatttttataaagtagtttccgcacattttgcatttatattctttcgccattagctaaccaccatattaaacattccccaaactgccacaataaaaagtacgatttttaactctaaaatctcgtcatcatttaatttcattttcatcctttacttgtgtgtatgcttgtgtataatttatcgtgattaagacgacaaggaggaagcatgcgatccagcgacttaatcaaggaacttaaaagtgcaggttgtacttttgtcaggcacggtaaaggcgatcatcaaatctggcaatcgcccatcacagggaagacgttccccgtaccgcatccaaaacaacacgtacccatcggcacattaagatccatcaaaaaatcggcagggcttctatagctctgccgagctaacccacaaggagcgactatgttattcactatcggcattgaaaccccaacaaacgaaaatgaagcctacggcattacggtgccagcattatttactgaagaatattcctgctttagtgccgctgatacccttgaggaaatcccaacgcaggtgactgatgccattcattccatcttagaaatgatgtttgaagacggaatagacatcaacgaacttcaagataaaggctatcgtcactaccaaacgcaagaagatttcaactattgcgatacttggttgttgcttgatgtagatatttccgcatatcaaggcaaacgccaccgtattaatatcagcttgcctgaataccttatcaaacgtattgatagccgtgttgcaagcaatccaatctacaaagaccgcagccactttttagcgattgcctcacaaaaagagctacggcaataattacccaaaaaacgcatacaactgatttaacgtattttcatcggttgtatcgttaaaaatatgcttgattgctgcactaattaacgctttgtaacagctttcaaactctgcttgctccatattcccataactcaaggattgcgcctcaatccgcaaatcccctttaatgttgtatgtagattcgtaaaatcccgccaataccgttagatgtttacgaaaggtgtcaaattgcttgcgctcatcaaagtgttcccattctgttttatctgcagcccaatggttaaaacagaatttaaaaaaggcgaacaccttacgatggaaagcgggattgcgtgtacggatgatttcaatttcatactgctcgccattttttaatgatttcaattcttctgattccagttcatcaagtggcgcaagcacaccgccttgtaacttaatcatctgaatttttaaccgcccttcagttcgtttcccgtgtgcttttttaatatcatcaacactacaagccattaacctatttctccatgcggatatacccactaacctttttaataaaatcaaggctaattgaacgtgtgacaaagtcttccattgttggatcaaagactacgaccatttgccctttgctattccccttgatttcttttcctgttacagggttgataaatgcaattcgaccacctgtaatatcaatcacttcatttgccacgccttgaatatggttttgataccattgagtagatttatcattgttgagtaacatcacgactaaataaccagcatcacataattctttcgcacgttgtagatatggtgtaacgttggaataaggtggattcacatagattcttaacggagccgaacaacgttctgcgacttcatccaacaatacatctaacatttgctcaatcggcattagaaagtcatctgcgattgattgatgctcatcattatctgagttaggctcgccgatatagtgacatgtcaaggcgttgttggctgtagcgcaaccatcaagatcgaaccagccgaaacgttgagatagccattcaaatacatagcacggtgtttgccatgtatttttatcaaattgttgttctgtcattgcaatgcccctttcatcattgccatcaagctatcgcgcgccttatcagccttcgctttatcgtaaaaacttggctttgctggaatcatcttcggaatatcctcaaaaggaaaattcgaccgcactttttccgccgcttctgtgagtaatttcggaatagctttcaacgtgtcctcttccgattttttcttgcacttttcgtacagatttttaagcaaccaaaattccacttttgaacgatattgaaattcatcccgattgaatcgggcatagcctaagaaagtgttataacgttggtataattccgcttcgttcggtaaacctagtgcgtgatagtcgtaggctttgcaccaataaacgaacaaccctacgctaggtaaaaatttatcaagcgatttttccgcttcacaaatcccgttctccaactgaggtctcgtaattttttctcgtaccaacacacgcaaccaagtttttttagcagagagataatccgcttcggtttcaaaggctgcacgccaaccaggaaaaattgatttaagctcgttaaagagccagttaatcgtctcttccgcacgctgtgctcgttctggtgggagcgtgttaatttggttttgtgttatggaatttgccattgcgtaccgtccactgtgaaattcattcctgcagaccagcctgtctgcgtatcgtcaaatttgggtttgttggggtgtgattgccctaagtgcggtaaatttggtcgcagtttttcatcacgccaatcccatgatgcgttaaatccctgccagttgcgttcaatgcaaatctccaccgcttcacaaatcgaaatccccgccttgtccgcttgtttttgcaggcggttgagttgcgtttggttaattacgccctttttggctttgcggtgtgcgataaaatctttcgccagttgtccggtaataccgaactgctcaagcaacatttcggattcgcttttttgcgtagtttttttaatatgatggttatctgatggttctattgatggttcagggttaagctcgtttactaggggtggtaaagctgctttactagggtggttaagctcgtttactaggggtggtaaagctgctttactagtaaaaggctctaatatttcccagttttcgggatgcaagatatacacattagtggcgttgccgttttcggttttacgttcacgaatggataaatatttcatcgcttccaatttcttaacgtgcgaaattgccgtagggcgcgaaacttcacattggattgcaatacgtttataacttggataacaaacgccatcatcattcgcattatcggctaattttaccagcactaattttgttaaaggattgccggttttgcttttaaatgctttagtcattaactcaacactcatctcataccgccataaaatacgctttatatactttgcctgtgcgtgcatcgtggacgaactcgtccgaaatctgatgccagcggttttttaaatctaaaattcgcgccgaaagacgcaagcaaccgaatttgtctaaagcttcgagtgatgtcagtcgcttacctgattgcaaataacgcaaaatacggtcacattgcgattgacttattttttcgtttggattagtattctccataaatacattccttaatgattagccacggttcccgccgtggtttttttattgctctaattcccactttaagcacaatgcgctttcaatgagcgcgtcaatgctggcggaaatcgtttgtttttctttgttggataactcgcgccctaaatctgaattaggatggactgcgcttttgatttgttcgccaattttccctgcattggtggtaatgtctaaaaagccttgcacgacatcggcgcagcaactggcgcatttgggcataggtacgataagatgatcgattttgtcggcaatggcggcgacggtgcgcgtgctattggtgatttcgatgagatcgagggcttcgataaagctgagatgattgttttcgcattctacgttaagtttattgcctaaaatattcggcgatttgcctagcgtgagtgccagcgtagtgataccgccagatgcgtttttacaatcgcgatgtaacgtgcgctgaatgtctttactgttcattaaaacctttcctttttcttgaagatttttactattcgttgcgctattgtgactttgtgagtgagcgcaagatgtcggtttcggtgacttttccattggatgctttggcgataagcgggatgtatttgccactaataccaccacggtgaagccaagcaaaaaccgtaggctgtgcgacactgcacagctttgctaatttggcttgaccaccacattcatcaatcgcaattttaattgttttattgatcaaaatagtctttcctattaagtaaataaagtttttactattctaaaggaaaataaactatttataaataggtaaatctatttttttatctatagaaatatctataaaataaaatagaaagggaaagggagtaaatatgacaacattgggcgagcgattgaaatttttgctgattgaaaggaatgttacacaagcagaattggcggaaatggtgggaactacccaaggtgcgatcagtaatatcgtgaaaggtgaaactcaaaaaccaagaaatattcttgagattgccaatgcgttaggtgtagatccaaactggttaaaatatgggagtacaaaaatgacaaaattatcagagagattaaaagcgttgctggtagaaaaaggaataaaccaaaccgaatttgctaatatgatcggcattgctcaaccctctatgcagaaaatccttgccggagaaaccagaaatccacgcaaaattgttgaaatagcaaaagagctcggtacaacgccggattatttgttgtatggcgatatgaccgttagtcattccactttggaaaattctcagatcaataacaatcaggggcagaccgtcaataatttttttgacagtggaagtgatgaattacgcgagatgttgcataagcagcagatttcattaaaaacgaagccaacggaagaatgggtttttgccttagatgtaaatcgtttagctgagacagatataattaatgtgcatttccctcgcccttttgaagctttgcacctttcgcaagatgggatgatggatttattgaaattacgctctacggcgaacgtggcgatgataacgatgtttaatgagagtatgtcgccggtaattaataaaaaagatttgatgtttgtggatacgacttgtaaacaatatgctggcgaagggatttatttgtttgtaatgaataatgagttgtatgtgcgtcgtttatatcaaacaccgagcggtgtattaaatgcggtggcggagaatgagcgcgtgggatcgagctttgaaattgatgatttgtcacgtttaaacgtactgggtcgttgcgtgcgaaaattttctattgttgcagaggatttataagaaaaggggaaatttcccctaaattttttgagttcccctaaaaaagtttcaaaaaatccttgaaatggctagctattaggtgtattattttatttatagtgcggttttagcacgttgagaacgcacaaaaaatatttacagccctgagcagaaatgcttggggcttttctgtatctgtaaaataggttttattatgccgactaaagatccgactaacttggaatcttttttacgctggctcccattggtttttatcggattatttgccggcgttgcaaaatacgcaagcgatattcaagcgggaaagctccactttagcgtggggctttttttatgccaagtgcttgtgtctatgtttgcggggtggattgggggattgatttgtctttcttccggtcttgatagcgatttagtttatgtaggctcagggctttctggttatggtggtggcgcggtgcttaatgccatttggcgggggttctttgcgtctaaattggggattaaagatgagcaaatttaagctatctgctgctagtgaagaaaaactagtaggcgttcacgcggatttagtgaaagtggtgcaccgtgcaattgaattaagtgtggtggattttaaagttattgagggtaaacgcacgttagagcgacaaaaagaattgtttgccaagaaagcgacaaagacaatgaatagtcgccatttaactggtcatgcggtggatttagtgccgttaccagtgaattggaatgatcgcgagccatttaagaatgttgccagtgctatgtttcaagctgctaaacaattgggcgttgctattcgctggggcggtgattggaatatgaatgagagttctaatgatgagcgtttttatgatggaccgcattttgagttattacggagtgtatatccatgacgtggtggctatttgttataaaaaaacttgggcttaacgtgtttagtcatggttgcaagcatttcaataaagttgtcgctgtatttgcaggagtgtttattcttgcgttgctttatatgcagcacacaaataagctcaatattgaacgccaatcagctgttattgattctctgcatgaaaaagtcattaagcgggataagattattgatgaattacacgaagatgtggacgagcaaagaaagattgccgaaaagcggttagcgcaagagcagttaatcagggagcaaagttatgcgcaaattcaatccattaagaaaatactggaaagtaatcagtgcagccgtactgtactgcctaacggtgttgctgacgagttgcgcaagtaagccagaaattgaataccgcacgcttgccttttcgccgccggtgagtttgcttgccccctgccctattccatcattccacggttcaacctttggggagacggtggaatatgcgttattgctcaagcaagaattgcggttatgtgcgaataaggtggacggggtgcgggagtatgtgaaggcgcgggaaagtgcggcggaaaattagaaagataaatgatgaataaagatttaaatattgaatatatttctacggatgttctaaagccttatgtcaataatagtcgcactcattctgatgaacaaatcgatcagatttgtgaaagcattgaagagttcggttttacaaatccaattttgattggcgagaataatggaattatagcgggtcacggtagattattagccgcaataaaactgaacttatatactgtgccgacgattagattaacgggcttatccgatattcagaaaaaagcctacgtgattgctgataactcactggcgttgaatgccggctggaattttgagctattaagtttagaattaaatgaattaaaagatctcggttttgatattgatttgcttggctttgatgatgattttttaaaaagtttagatggtgatttattggctgatataagcggtgattccaattctaaggaaaaacttgatcttaaacaggcgtttttagccccccctttctcaattttaaattctagagaaggttggtggcaggatagaaaaagaaaatggaaagccttgggtattgatagcggttcaggtcgcgatagcggtatgcagcgcggtatgaacagtatggcaaggtataactcgaaagaagatacttcaatgtctgaaagcgatgattcaatatttgatcctgtgctttgtgaaatactgtattcttggtttagccctaaaggctgtcaaattttagatccgtttgcaggtggtagtgttcgcggtattgtggctagtaaattaaatagaaattatatcggtgttgatcttagagccgagcaaattgaagctaatttgaagcaacgaaacttggtttgttctaatgatgagttgcagcctatatggatttgtggcgatagcataaatattgataaattagctaatggtgtctccgccgatttagtctttagttgcccccttatgccgatctagaagtttattctaataaccctaatgatttatctaatatggattatgataattttaaaaaagcgtattttgaaattatcaaaaaatcttgtgatatgttgaaagataatcgctttgcttgttttgttgtcggtgaagttagggataaaaaagggaattactataatttcgtaggagatactattcaggctttcttagaagccggtttaagctactataatgaaatgattttagttaatgtatgtgggactatgcctatgcgtgcggctacgccttttaaaggtagccgcaagataggaaaggtgcatcagaatgtcttggtctttgtgaaaggaaatcctaaaattgctgctgaatattgtggagatgtagacgtgtacatcccgaatgaagacaattaaccgtatttggcaatcaatgcttggatgccctgataaattaacttatcggggtctttttttatctggcggacaaaattagggtttgtgtaagccatttgcgctgatttaattgcatctttagcatttcccaatctaggaaatttacttgctagtgagattgcttttttccattcatttttagccatcaaatcttttaatacatcaattttcttcatcatatttatctccttagtgattattagcaactgtactttaatgtgtaagaatgtccagctatgagtaagaaaaaaacaaaacctaagattgagatagatttatcaatggttgaaagtcttgccgctcaggggcttactaatcaacaaattgcagatagcttaggtatttcagagagaacgcttcaaaatcgtaaaaaagataatgcagaatttgccgaagctataaaaaaaggcaaggctaaaggaattgcggtggttacgaatgctttaatgaagaaaattaaatcggggaacgttaccgcgatgatattctttctgaaaacacaaggtggttggaaagagaacaatcagcttgaaattgagatgaagaaagagaaaaaattgcctaccctggcggagttgtttggcgatgagacagaccctgattaaaccactaaagcccatgattaagtcttgccgttataagattttgtatggtgggcgtgggagtggtaaatcgtggggcgtggcgcagttattgattgagattgctgttcgtaccaaagtgcgggtgttttgcgggcgagaattgcagaactcgatgagcgatagtgtgattaaacttattgcggatacgatagaagatcttggctatctagaagagtttgaagtacagcgcaatgcgatttactgcttgaaaaccggctcggagtttatgttttatggcataaagaacaatccgaacaaaattaaatcgcttgaggggattgatttggtatggattgaagaagccgaaaacgtctctaatgagagttgggatattttaattccgactattcgtaaagagcgatctgaaatttgggtgacatttaacccgaaaaatattcttgatccgacctatcagcggtttgttattgcgccgcctaaaaattcgttcgttcgcaaaatcaactacgatgaaaacccttatttccctgaaacgttacgccttgaaatggaagaatgcaaagagcgtgactatgaactgtatcggcatatttggctaggtgagccagttgctgatagtgacaaggttatcattaagccggtatggattgaatgtgcagttgatgcgcataagaaattgggctttttgcctgccggtcgcaagattgtgggctttgatgttgcagatgacggcgtggatagtaacgccaatgcgtttgttcacggatccgtggtgttgcgtgttgatgaatggcgcggggaagatgtgattggtagtgcagacagaactcggcttaatgcattggaatttggcgcaaatgaaattgtttacgatagcatcggcgtgggtgccggtgtaaaagcacactatcatcgcctagacgataaatccattcgtattaatggctttaatgctgggggcgcggtatttgaacctgatgcagaatatgtttatggtaaaaccaatcgcgatatgttcgccaatattaaggctcaggcgtggtggcgtttacgcgatcgtttctataaaacctatcgggcgataacgtatgaagagcaatatcccgttgatgagatgattagtctttcttccgatataagggatttggaatatttaaaagcagaattggctcgcccttatgtggattatgacggtaatgggcgtgtaaaagtagaaagtaagaaagatatgaaaaagcgtggcattccgtcaccgaataaggcggatgcgttggtaatgtgtttcgcaccgaaagaagatgtattgtcgcgtttcattgggttaggaagttaatatggcatttaatcaagacggctacgccgaagccttggggattaatcattttgcaagaaattctgcaaattcaaccgcactttttgatttaacgttatatgagttaggtggtttagccgcacgggtggtcgatatgccagcagatgcggcgatttcacgttcgattgaaattcaaggcgatcaagatgatgcgattagcaatgagattgaacggttgaagattttgcctgcattggcagatatggtgcgttggtcgcggttttttggtggtgcggttatggttttattgaccgatgacggtgcgcgattaagtgagccgttagagccaagtcgcattacacgtatcgatgaagtgcgagtgtttgatttaagtcaaatttcgcctacggctaatcgctattccgatccaaccaagccaaattatggtcgctattccagttatcggttaaatatcggtacgattgctggttcgcttgatagtcaggtagaaatccatgaaagccgtttgttatttatgggcggcgattcattgccagaacgtctaaaaaatggcttacattggattgggcgtagtgcggttagatcggtttatccaaaaattcgtgattatcaaaaatcattgatgtgggcttcgttaattcttgaacgcaaacagcaagcggttcataaaatgaaagggcttgcgttggcaattgataatggattagagcctgttattcgagagcgtatcaatcttgttgaacgtgggcgtagtctgttaaatggcgtagctgttgatagcgaagacgattacaacattctcaatgcggatttaggcgggattgttgatgtgcttgatgaatttaaagtagcgatttcggctgatgtgaatattccagtggcgattttattcgggcagtcagctaaaggtatgaacgccacaggacagagcgattttgaaagctattacgatttggtcgaaagtattcagcaacataaaatcaagccagtgcttgaaaagctgattgagctattgatgtttcaaaagcatattaagccgtttgagaactggaaaatcaaattcccgtcgcttaatacaccaactgacaaagaaatagccgatgtgcgtaaaacgaatgcggatgcagcgaaaatcgagcttgatcgcttaattaatttggttgattcgggtgcgttatccacagaagaattgcgagtacagattgctggagagtttggcattcaagcggacaaattgccacaggtagatgacgatgatgttgaaaagtatcaagaagaacagaaagccaaaggtgtggttgtttcctcacgcaattgagcgtgaatatgtgggttatttacgtggtgtggcgagaaacattaatacgatggttaatcaaaaactcgttgaaattcgaccgcactttcaggcaaatattcgacaagatagtttttctgatacgcttgaacgttggcttattgaattattgcaagcagtattgatttttgttgatgaaaaagaaattacgcagtttgtgcgtggctatattcatcagacggcgaattttaacggcaagcagtttcataaagtgctgaaatcagtttatagcgtcgatgttttcacgactgaaccttggcttgatgatgcgttaaaaattgcggaatgggaaaatatccgcctaataaaaagccttcctacgcagacgttagaaaaattgcgtagtcgctttactcaagcggtgcgcggtggttggcgttgggaaagcgtggtagatgatgtgaagtctatccttaacaccaacgagaaacgtgcaacattaattgctcgtgaccaaattggcaagttaaacggtcatttgacgaagttgcgccagcaaaatatcggcgtgaagtcgtatatttggcgcggtatgcttgatgagcgtgagcgggcgccccacgttgatcgtgagggtaaacaatttgattgggataatccacctgatgacggacatccgggggagcctattttatgtcgttgctatgcggaggcggtattccctgaatttgaagatctaaacggtgtgatttatgcggagtaagaaaaatggtaatgcgatacgaccgccgtggcattcaggcacggcgagatgataacggttttatttatgacacccctattctgacaagaagtggggtgtttgtttatgagcttcctaatggcaaaactcggcgtgaatatcgtccgcctgatgaagtatttaaggcggatagtttacgcgcttacaagggattgccgattacagaagatcatcacggacttgtgacgaaaaataatgcgcatttggtggtgggctctatcttaacggaaggtaaacaagatgggcaaaatttaacggcagatattgtgatccacaatacgaaagccgttgattttggaaaaaaagaattgtcggttggctataaggtagatattgacgagacgagcggtataacagaagacggcgagccgtatgatgtgatccagcgtaatattcgtcctaaccatttagccattgtgacagttgggcgtgcaggcaatgccgcacttaatttagatgcggcagatgccgtggaatttaacgaagatggagaaaatccgatgagtaacactcaaacaacgctttctgacattcgcttagatagcggcattacgtatcaagccgcgcccgaagtgattgtggaattaaataaactcaaacaagacgccaaagatgctgtgacggcgaaagacaaagaagcggcgcgcgcagatgcggcagaagcgaaagtgaaagatcttgaagcacaggttgaacaaattaaacaagatgcggtaagtcaagccaaggtgcgtgttgaattagaaaacgtagcgaaagcgcataaggtggaagtgaaagctgatagtaccgaccgtgcgttgcgtgaagcggtaattaaggcaattcgtcaagacaatgcggatttatcgcaaaaatccgatggttatattgaagcagcgtttgatattgcggtaagcgatgccaaacaacgagcggatgcggcaggtgtgcagcgtcagcaattaacaccatcagccacaaatcaacccacattcacgcaggatagccaaacgaaattaactggtcgagctgcgatgattgcaagtcgtaaccaataggagcataaaaacgatgtctatgtacgatcaattacaacaaaaagcctttgctggtatgaaaggcgacagccgttacgatttagtcgaaacctttgcagcagaaaatgaaatcccattcggcgtagtgattacgcaagggacgagtgccacacaagctaaattaggtggcactaagcccattggcattgcgttacattcccatgctgtagtaggcggttatgcgaaatttgatgcggtttccgtattgcgtaaaggggttgcgtggtgtgtagtgaaagacagtgaagcgattacggcaggaagtgcggtaagttttgaccccgcttcaggcaaggtggcaaaaactggtacggcattaccgaatgcaacctttaaaaccgccgtagtggattgcggtaaatatggcaagctcgcattagtcgagttagcttaattattcaatgtttaacgatgccctaagtgaaaacttggggcttttttattggagaaaaataatgacagatattcgtcaagatgcatttgagttgaatgcgattaagacttgtttaaatgcggtgggtgtatttaaccaagatgcgggcttgtttacgcaacgccaattagagtttgtgcgcaacaaaatctatgaagaaaaattaccgggtatgaatggcttatcgctcgtcccagtctcttctgaatcccctgaatgggcagaaaccgtgactgaacgcatttacgatatggtcggcatggctaaagtcgttgccaactatgccgatgatttaccgcgtgcggatgtggcgatgacagaacgtgcagtaaaagtgaaaaacatcggtgctgcttatggctacaatctacaagagttgaaagcggcgtcagctaatcaaacggatttaccgtcttctaaagctcgtgcagcgcgtcgtgcggtggaagtaaagatgaacgaaattgccttgttaggagataaagaatttggtttaaacggctttattaaccacccgaatttaggagaaacctcggtaactggtggctggaaaactgcaacggcggatgcggtgctagcggatttggacaatctacacgataccgtcgtgttgcaatcaaaaggcgtgcatcagccaacacacttattgttgtcgctaacagattatcagacgttatccagtaagtatatgaacacggctgacaaagtggacgtattgacgttcttcaagcgtaaacatcctaacttaactattcagggcttatgggaattagagaaagcgggtacagggaataaaaacttagcgatttgctatgaaaaatcccttgataacttaactcttgaaactccgcaagattttacccagttaccggcacaagaacgcaatttagagcttgttgtgaactgtgtggctcgtgtgggcggcgtgttcttacgttatccgttatcggcaaccaaagcggagatttagcgatgattgtacgtaatattgaagcgcgtttaattcgtgttggcggcgagtttatcgcccctaatcaagaggtggaaattgccgatgatgcggtagggcttgatcgtttaattgaacgtggcgtattaattgacgtaacgccgaaagcggaagatgcgaaaaaagacggcaaaagtaaaaagcaggagtaataaatgagcgcatactcgttacttaatctcttttacccattaagccaacaaatgcctgaagatatggtaaataaggtgttaagcgtggctgataataaacgtccagactgtttatctgatgaaaagcaagatgaggcggtggcgtggtatgcggcttatttgttggctcagtcgattgaaagcggggtaaatgcggcaggtttacgacgtgaacgtgagggcgatttagaacgtgaatatttttcaagcagcgataaaggcggcaacgctgaacgctttttggcgaagtataacgagctaaacaatatttgcgtgcgccttggtgcgattaccgtagggagtcattgtgtctagcgtggttaaggtaaaaatcaacaataaagggcttgaaaaagaacttgagttgataaacaaaatcggcaaagcacgcgtaaaagtaggcgttcaagcggatgcaggcattcattctgaatcaggcgaaagcttggtggatatcggtatttggaatgaatatggcacggcacatatcccgtctcgtccttttattcgtcaaacctttgaagacaaccaacaggcattggcgcaatacttagggcgtgtggtcgagaatgtggcgaaaggggatgatttggtgcaagagctttcaaaacttgggcaatggtatcaagacaagcagaaaaagaccctaacgtcttatccttggacaccgaatgcaccatctacgcgtaggcgcaagaaaagtagtaaaccgctcgtagatacctcgcaattagtcaattcaattcgttataaggttgaaatctgatgcagatattttcttctcaatcttcttttcgcaagccttataaaatacttgtgcgttctgacggagagtatgtgaaaggcaagtgggtaaacgacggcgaaatcgagcagacgttaatggcatccattcagccgttaagcagtgctgaaatggatcgcctagtggtatcaatgcaggggcggcgcgtttcaagtgcggtaaaaatttacaccgatcaaaaactaacggtggctggagaaaatgcacacaatgtcgcagtagtgctatttgacggcgagcgatacgaagtgatttcacgagctagttatcacagtggtgtgttgtcacatcatcgctacgtggctatacgggtaaaataatatgcttgagcgtttgtatgatttattgggcgatctatcggatcgcccttttattcgcgcctatgaaaatgggcgtgagccagaaaagccattttttacttatgaactgaagtttgagaggacaccagaacattttcattattcggcggtaaatgatgaaggcaatcagacggtaaaaactcatatcgatgccgtgcttgagttgaattatttcggtggaaacagtttacaggcattgcgagatgtttgtatgcgcttatctatgcagtcttgtcgtgagcgttggttaaatgatggcgtggcattgattcgcattgggcggattacccatttagcctttctaaatgaacagcgtgaatatgaagatcgggcaatggtagagcttgaaattcgttatgcggctagtgtgcaggatattgtgggtattattgaacaagtggaagtgacggcaaatataggacgtgcttctgagaaaaatttaataggggtaaataaaaatggcgaaaattgatcgcttggtaaatgtggctattgatttaaatacaaccacaatcgccggtaaatcttttagtgatttattaattttaggcgaacatacgctgaataattcagcacgtttgctggtagtcaccgatccaaatgaattattggatttaggcttaaaatcaaacaatccgctttatatcgctgtggctaccgcctttgcgcagccgtcacacgtggcacaggtatttatcggacgtaaagcacaagatgaaagcgtgacggatgcgcttgctgcggtcgcacgagaaaataacagctggtatggcttggcgttggtctcgcgtgaagacgctgatgtgatgttggcggcggcgtgggcagaaaccaatggtaaattatttgttaccgcctctgctgatgaaaaattgccacaatcggcggagaaaaccgatattgcgagcaaacttgaagcgaaacaatattaccgctcggcggtaatgtattcccataaagcaacggaagaatacccagaaattgccttaatgagctattccttcacattctatccggggtcagaaacgtggaacttgaaaaaacttgctggcgtatcttattcgccgttaatggaaggcgaatacttagcttgctcgaagaaaaacgcaacgacatttgagaaatttaacgatagctttgcggtaacgcaaggcggcaaagtcgcagctggggaatggatcgatattatccgtttccgtgattggttggtgcaggaagtgcaaattaatgtgacatccgtcttaatcaatgcttacggtaaagtgccttacaccgataaaggtattcaattaattggtgcagcagtgcgtcaggcgttagatttaggtgtagcacgtggcggtattgcgccgacagaattggatgataataacaaggaaattccaagttatgtgatttcccttccactggcggcaaaggtatcgaataacaataaaggtaagcgtttattgcaagatgtgaaatttacggcacgtttagccggtgctattcacttgacagaaatcaagggcaatctggcttacagtctttaatcattaaccgaccgctaaagtgcggtcattttttaggagaattttatggctttagcaacttatgcgcccgatgaagtaagcattgtgatcggggcgagtattgtttctggctttgcagatggaacctttattgatattgaagaaatgtctgacggcgtatcatctgttgctggtgcagatggcgaagtagcacgtgcaaccagtgccgatccacgtaaaaaagtcacattaacgttattacaaaccagtgataccaatgatgtgttaagtgaactctatgcagcggataaagtgagtaaaaacgcaacctttccaattgcggtaaaagacttgcgtggtcgctcattattcgctgcaagcacggcgtgggtggttaaatcggcgaaacttgagcttggaaaagaagtgggttctcgcgagtggacgcttgaaactgcggacggtaaattatttgtagggggaaatgactgatggcacgcagtgaaattcaaattggcgaaagcactttttttgtgcaaaagttttcggtaatggatcagttacgcatttttggcgatttgcagaaaacccttgtaccgtcactggcgaaagtaatcggatttagcgatgaaaaaccgaaagatgcaacgtcagctcagttagccgaattagcacagaaaagtgcggcgaattttgcgcaaggtttacaagatttaagccagcaattaagcggccaagagttagttaaactagctgatatgctaatcaaacctgaactagtgacggtgcagcgtgatgatttcaacaatgggacagataaaaaacttagcaaaactgattttgatttggtgtttgatgatatgtcggagcttatcgagttggtaattttcatcttacaacttaatttcagcagtttttttacgaaatttcttgcccgtcttgggtcggtgcaagagcttgtgaagaaagcgtaagcgttggtaaatacagcgaacagacgctaagtgagatgatcgcttggcgtccttttttagccggtaaagttacactaacagagcttaatacggcaggattgacggatatgggcgagcttttgaagattaatcgcttactagatgcggtagatgcgatggaagcaaaacaaatggagaaaaaccgatgaatgctatacgtgagctggtaacgttattgcgttataaagtcgataattccggtttaaaggcttatgttgttcaaactcaacaggcggcaaaaggcattcgtagcaacctgaataatgcagtcgatggattacgcgctaaattctcagaggctgccgtgagcgcgaaaggcgtcggtaataatctgaaagacgctaaaaatcaaatactttctctacgtaactttgttgctggttattttgcgatgattgcaggcggcaatgtgattaagattgcggacgattgggctgcggtggatagtcgtgtgaaattagcgacaaaatccgctgaagaacataaatatgcattgagtcagattttcgatctttcgcaacgttccggacaagactatctcgccagtgcggatttattctcaaaagtgaatcgaagtgcgggtgatttggggttaagtcttgatgatacgttaaatttaacggaaatcattgggcaaacgatgactattggcggcggcgatcagggggcgcagcaagccgccttgatgcagcttggtcaagccttaggctcgggtgcattacgtggcgatgagctgaactcaattattgaacaagccccacgtttagcgaatgccattgctgatagttttggcgtgccgattgggcaattaaaagatctaggtaaagaaggtaagctcacatcaaaagaactcgcacaaggtctgctaaaacaagcggataaaatccaaaaagaatttgatcagatgccgaaaacttttgggcgcggtatgacgattctgaaaaataaagccggtcaattgattgatgtggcggtcaataaagtctctaaactcggcgcggctttctataatgctgctgaatgggtgacagaaaacattcgtttagtgggctttttagctggtacggtaatcggtggtaagctgatgtttgcgctggcagcgtcgaaaaagagcttgcgtcaattgttaatgatgggcgcacgtgcggtggcaccttacttagcgatggctgcggcggcgggtgtcgttgccttagtgttagaagacatttatggttggacgcagggagatttatcctttactggggcattagtcggacgctatgaagtttgggcggataaattcgccgcgctaggtaaactggcggataagctctggatcaatgttcgtggtttattaaaagatttaagccggatggcgggcgttgagattaattttgactcttggcaggcttttgcaactgatgttttagaatatattattgccgccgtgaggaatctcattaatacggtaagcggtatggtgcggattattcgcgcattaattaatggggattatgccggtgcttggtctagtgcgggcgatatgattgatggattaagcttgaaattcctaccgctttattctgttgggctaatggtgctgggcggtattctctccgctgtatgggcgttattttccccattccgtgcatttttcggattgttgaaaggtggatttagatccgtaatgtttgtagccaaaccttttattaaggtagcgaaagggattgcatctccatttatctgggcgcaaaaacattttaaattattttcccgtgtcggcagtggcgcattctcgctgttgaaacgtggggcggtcaaatttacggtttatgggttgaaagcctttaaatggctcgctataaaaggtatcaatgggttctttggtattttgcgtgcggcggtcaaatttggcgtgatatttaaatctgtcgtcggcaccgtggtaaaaggcatttttgcgatcggtcgtgcgatgtttatggcggtagcaagtaacccaattttgcttgcgattagtgcggtgattggcttggttatcttgcttgttgtgtattgggatgaagtgaaagcctttgccattgctgcgtgggaagccatttccacaaaagcggcggagatttggcaaagtatcatcactggtgcaagcgagatgtgggataacatcacaaataaagcagcggaaagctgggataatgtaaagaaagatgctggcgaaaaatggaatagcgttacgacgatgtttaaaaatgcgtggcaaaaatctatcgataccgtggtgggctggtttaattcacttattccgagctggattagagatttgttttctgacggggcgaaagcagaagttaagctgagcggcgaagccttaactacaccagtaagcggccacgtatcgccacagcggttaggctatggcggtcgtcctatttttgcacctaatcagaatatgacgcaaaccaataacttcaatattcaaggttccgctaatcctagcggtgtggctaatgcggtatcagacaaattaagccgtggttcatctacatcgtttggaatgggggcgattgaatatgctgggtaaaaaagtgcggttgattttaaccgtactttaaaaaaacaaaaccccgaaacgttaaagcatttcggggttttctattattgtgtgattagcttatgcagtaaatcgcttgcctgttgtatatcttgctgaatgtttttgttgaacacaaacagatagctatctccatttggaatgctggaaaaaaagaactccacaaggcgtttttgatcttccagttgtgcgcctgtaatggcttgctggaagttggcatattgtgatgcgtaagttaccatttttgccattgcctgtttaagttcatcactgacaagcggtagtgtaagttgttttggctcgttacggtgcattgctaagaacgcacgtaatacgatcaaatggaattttgggctaatccacattgcgtaggctaaaacaagttcttcgcaagcgtaagtgccgccttgagtgccgcgaatagttttaaatgcgcagatctgcgcatttagatcttcgtcttgaatttctttaattaattcttgagtggtttctaagcggataaattgatttgggcggtgtttctcttttcgaccgctagcaacgtgtaaatcgtttaaagagaaaagattttcgtatgaacgaatagaattgttgagaatggttaagtttgacatatctgattttccttttgatggaacccctaattttaggttagggcgatcgacagctcaaaactggtcagataatccagcggacgtattcccttgcggtattgtattagtcgcactgtcgatcattgaataaattgttaatttttgctccgcacttctaatgaattaaataatggtggtttaactcactaaaatttggatacaaaaaaatcacactaacggggtgaaaaccgtatctgataaaggtttttgagaccttaaattaatcctaatgaaattctcggccattgtaaagagaaaaaagtaaattatgagcatagtaaaccttttattttcagcccttgcgggcaagcgtacgacaattggtgtattggaattggacgcacttttaaccgaaaacacatcactttctagccaaatcacggaatatcccattgaagacggtacggtaatttccgatcacattacacgggaaagtgagcggttaagccttagtggtgtgattactggcacaggaacattgtttaatgttggcttagggaaatataaattgattgcagcaaaagagacgttgcgagaattacacgctaagcgtgaattagtgacgattgttaccggtcttgatgtgtatgaagattttgctattgaaagccttgagattgagcgcaacagtgatgacggcgagcggttaaatattagtgcggaatttcgaaaaattcaaaaagtgacgttacgcaaggaagaggtgccaccagagaaagccgcgccaaacgcaaaaggcaaagcgggacagacgaaagtaaaaaccggcaaagcacaaactggcaagccgacaaatacgcaggcacaaaaaatcacgaagtttggcgaatggactggtaaaaaagaatgatcacaataaaccttgcaaataaaaacgattttattaccgaagtaaatcttgatgatgaagtcttttttttacacttttcttggaacgacacaatcggattttggtcgctcactattgaaaatgcttataacgatgaactggtctcaagcattgtgattttgccgaatcgtcctttaattgcaccagtgcgtcgtgatgaattaccacttggagaattgattgcggtgcgtgatgataatttacaaacgattgggcgtgatgattttatcaatggcaaggcggtgttgatttatatcggagtggatgaatgagttatcgctttttacgtagttataaattgatgattggcaagaaagggcaaaaagatgccattgtgattgagccgccaatgcgtattgagttcgatattgaaaaagattgtgaagccgagccgaacgaaaataccattaaaatctataaccttgcatccactacacgaaaaactattgagcagccggatatgcggtgcgtgctgtatgccggttatgcgcaggaaggtgacgtgttgttatgctctggcgatattgccacggcatattcgtatcacgaaggcgcagattgggtaacggagctttatgttttagatggcttggtagaaattcgcgatacggcggtttcattaggttatgtcggtggcgtgagttctacgcaaattactaatgatattgctgcaaaaatgggcgtaaccgtagttggtgcagataatttgaaatcacgcacttgggcaaatggttttagtttttacggtgccgcacgtaaagcgttagacaaagtcgttgcaggaacggggcttgagtggtcgatccaaaatggcgaactgcagattgtaaaccgcaatggcgtgacaaagcgatcgggttatgtgttggcaaaagatagcgggctaatcggttttcctgaacgcacacgtgaagcagcacgcagtaagaagcaggatacgccaaataaaaagaaagatgagaaatttgcctttgatcggcaagcgagggacggttggaatgtaaaaagcctgttactgcctatggtaaacccttgtgacaaaatcaagctggaaagtgtgacggtaacaaattggttccgcgtggaaaaaatcaagcattcgggggatagtcattctagcgattggcaaagcgaactacatttagtagatctaaacgcaccgactaaaacgcagatggaaacgcaaagtaaacatcgtaaaaaacgtaagaaaaaggacgattaaaaatgacggatattttaaccgcactttctgaaattaatgtgtcattacctggaaaaattgttagttatgatgcggaaacggtgcgagcaacggtacaaccctctattcctaagcggttagccaatggcgaagtattaaatgcaccgcagattgtaaacgtgccggtaatgttccctatggcagacattaacggtgcggtagcacaagtgacattaccagtgaaagcgggagacggctgcttgctgattttttcgcagcgatctctagaaaattggttaagtggaagcaatgatgcgccagatgatccgcgaatgtttgatttatccgatgctttttgtgtaatgggcggtaatagtcgctctccaaatgccgatgttgagaacctttgtattaaatacggtagcggtaaaattaaaatcgcaccaaatggcaatattacgatcaattcgcctgatgtaagggtaacaacggataattttactgtgactgcgacaaccagcacctttaacggcaatgtaatcgtaaatggcggtatttcaacggcaggtaacagtggcagtgtatccgttagtggttctttaacgacaactggcgatgttatggcagatggtgtgtcattacaaagtcacaagcacaaaggcgatagcggtggtacaacagggaaaccattatgatcgatttaaaattgagtggacaacacgatttgatgataaaagatcgtaaactagtacttgtagatggcatcaatcaaaaagcacaacagattaaggttgtgcttttaacgtttttaggagagtggtttttagatacaacaattggactgccttattttgatgaaattttgacaaagaatcctgataacgcacgtattcaatccatttttcgcaaaaagattatgggtgtgaaaggggttctagcggtagagcgtttatctcttgaatttcatctaaaagatcgggtgttggcggtgcaattttcagcacgaaccaacgaaggtgtagtaaaagacaaagtgagtataaaacgaaatggctaattatggattaacgcgtagtggctttgtacgtaagcgtatgccagagcagttaaaagagctttatgaaaatgcgaagaaaatgtttggggaagatattgatttgtcacctgaaactgtgatgggaatgatgttaaacattgaatcagaacgctttgccgccttatgggagcttattgaaagcgtttatagtgcaatgtatccgattagcgcaaccggagcaaatttagatcgagccgtttcttttacaggagtcactcgtttacaagcagaacattcaacggtgccagtgattttttacggcaatgcaggcgttgaaatcccccaatatactgcagtacgcaatgcaggaacacaggttttatattattcagatgaagacgcacgcattgattcaaatcaagccgcttatgcacggattgagctaaattcaaataccattaatacgggcgatgtattttccgtcgtagttaatggtgtgacgtatcgttttacagcaatgcgttcatcaagtgcgagtattattcaaggtttagccaatcaattaaaagcgataagttatgccgatgtgagtaatgataatgtaattattgagatttcggcacaatctataccgcacttttctatctccgttagccaaaatcttacgctttctcgcttaggcgtgcgttgtatgctttccactgaaagccctagtgaagataaagccgatattgggcaaatgattgaactggtaaatatgattgatggcgttgttgaagtgaacaatgttgttgaaggtgcatccggtcgtttagaagaaagtgatattgaattatatcaacgttatcatcgtggtgtttggcaaaatggagccggtacaattgattcactttatgccaatttaagcaaggtagcgggcgttcattcattgagaatttatgaaaacgatgcagatcagacgattaatggtattcctaagcgttcactgtatgcggtagtcaaaggtggtttagatacggatatcgcatcgacattattaaaatttaagcctttgggtattggcacacacgggcaaaccgaagttactgtgcgagacagtcaaaaccaaccgcacttgattaaatttagtcgtccgactaaatgttacatttggttaaaagttaccattgaaacctttgttgatgaagatgaaattgcgagagctggttacattgtaagtgcactcaacaatatcttgaaatatggtaaatcacttggcgtgggagcagatgtaattcatcaacgccttattgctgcttgcattgcggttcaaggcgtgggaaaagttaccgttcagataggtaaaacgaataatattaccgatccagagccaagataccaagaacagaatatcaccatcgcacctgatgaagaagcgattttcgatccgtctatcattgtgatgagttaggagaaaatatgaaagatattttaaccgcacttaatgatgattttaagcagttagggcgagagcgattactttctcaatttaattactcgcctaacttaaacgcatttttatcacttcttcttttaccgcatcacgaaattcaagcaaccttaaagcaaatgcttacagaaaggcatattgataccgctataggaaaacaacttgatggcgtaggcgatattgtcggtatgccacgccctttcgctagagtaaatggcgattggtatttcggtttttctggtcaatcaaaggcaaaaccctttagtcgagcccctattcgtgatttagccacgcaaactaattctagagattttaattatatgctcgatgagcattatcgacgattaattaaatggaaagttatcgccaatcattcacatggcacccttgatgatgtaatcgaagcctgtagggctatatttttagcagagcgtgtttcaatcacagaaggacaggatgcagatgtgcatatagcgattacacgaatggcaaaaaatagattagatgcagtagaacaagagccggttttgtggattcccacggcagcaggtgtaaaggtaacggtagaatttataaacgcataaggataacaaatgaagttaaaactaatcgatttattcaaaagaattacttgggcgaaaaacggcgatttaaccgacttttctcaaactaattatgaagcaggctgggcgcatttaggcgatgatacgccaacagtgcaagactttaactatgttcaacaaatgaacgacaaaaaagaccagtggttgtttaatcaattaaaagccgtgttggaaaaagccaatatcgagccaacagaagaaaatgttaattcattgcgtgatgcgattttggcattatcaaaaggctatagcaatcctaaaagcctaacggcagacacagtgaattttattgatgagcaaggtcacactcacgaaatcgctaaagcaaccttgcaacaacaaggcatagtccaacttaccaatgacacggggcttgaaagtgaatctcttgcactcaccgcaaaagcagggaaaaaactcgctcaacaaacaacacaattacagttaaatgtctcgcaaaattacatccaaaacagcaaaaaatcctctgcagtaaatagcgaaagcgaagataacgtagcgacaagtaaagcagccaaaaccgcctatgacaaagcagtagaagccaaaactaccgcagagagcaaagtaggattaaggggcaatgaatcgattcaaggtaccaaaagttttgaatctaaaatcattgggtttcgtggcattggggtggctgattcgcaaacttatgcaaatgctaatcacctcttaaatatgggggcaaatgatggcgacggttggatagagtataaaaaaagtaaccgagttatcggcaccattcgtattcgggcaaatggggaattgtcatataacaatcaaaaaatctaccacgctggggcaaaaccccaatttaatacggatattgaaggcaagcctaatacacttgcaggctatggtattgggaattttaaagtagaacaagggcagggcgatgccaatggctataaaaccgatggcaattattacgtagcaaacggtcaaaatctacccgaaaatggggcatggcatattgaagtagttagcggtggggcaacaaatgcggtgcgtcaaattgcacgtaaagcgaatgataacaaaatcaaaacacgcttttttaatggctcaaattggtcagaatggaaagatgcaggcggcgacggcgtgcctattggtgcagtggtgtcattccctcgtgcggtaactaatcccgttggttttttaaaagcagatggctcaacatttaaccaacaatccttccccgatttataccgcactttgggcgacagcaaccaacttcctgatttaactcgtagtgatgtggggatgacagcttattttgccgtggataatatccctgcaggctggattgcctttgattcaatcagaacaaccgttacacagcaaaattaccctgagttatatcgttacttagtcggtaaatatggttctatttcaaatgtgccattagctgaagaccgatttattagaaatgcatcaaacaatttatctgttggtgaaacgcaaagtgatgagattaaaaagcacgttcacaaagtgagaacacactgggttaattcaagtgatagtaatattttttatgacaaaacgaaaacagttatagattcacgattacgcactgcaactacaactgatgataatctcagtgataatggatttatgcatccgctattagatagcccaatggctacggggggagctgaaacaagaccgcgagcgattgctctcaaactttgtataaaagcaaaaaacacatttgatgacgtgcaattctgggtgaaggctttcggtgttgttgaaaatgctggggctttagatgcgggtacacttgcgcaaaatatgcaagcgttatctgagcgtgttgaacaaaaaatagaagagaataaacaatcaactttgcgagaaatcaccaatgcaaaagctgatataaatcagcaatttttgcaggcacaagggaatttatctcaaattggcacattaaaaacagtctggcaaggtaacgtgggttctgggcaaattactatatcagagaagtgcttcggtaaaacgttaattttatatcttcaatcatcagtaaatcacagccttgatgataataacgatattgaactcgtcagttttgaagtgggtgcagaaattgaaggtaaaaaaggtggcagagttcgttggcttgatgttcgtgaagtaaatgcacacagcaatggtggtagacctatttattatgtagaagtcaagagattcgatgtgactgttgatagagacggtacaacaatacaaattcaaaatcttgctggtcgttttgtaaaacgtattgatattcgatgaaggagtgattaatgaaagtctattttttaaaagaaaatttgaatagttatcaaattttccctattcctcaaaacttaaatgattttgtggaaatggaagtagaaaacgaatcagagcttgagactaaacaacttattgattttaaaagtcaatacattctagttgatagacaaccaacagaattacacaaatggaacggaaacagctgggttgttgataaaaaaaagaaaactgaaattaagcgtgaactcattaaaaatctagttgatagcattgatgatacagcagctaacattagtgcaagatggacaaggtttgccgaagagtataaggagcgagaagctgccgctattgcctttaaagaagcaaattttgctggagaagtaagcgtttatatcagcagttttgcaacggttgcaggtcttgataatcagtctgcgtcacttttgattcttcagcaagcagaaagcttgcgtacattgcaacaacaattagcagtgcaaagaatgcgtaagtatgagttaaagcatgaggcgttgagtgatgaagaactgcaacgtattcatgacgatattataggtaaaatgcaaacattagcggaggcacaacaatgataggcgctaaaatctatctcgcattatacaaaggtaaaaaaacgggtaaaaacccgagcgcacttttggcacgtttgagtgactggctcactcgtaaattgacaaaaggcgtgtattcgcattgtgaaattgcagtaatgaaagaagtatttgtcagtgggcatcactatgaaacagaagtgatgtacgagtgttattcgtcttcaattcgagacggcggtgtacgttgtaagcaaattgatgtttatgatagagaaaaatgggatttaattgagctagagggagttactgaagcacaaatcaaagcttattttgaccgcactttgggctgtaaatatgactggtggggtgcgttagggattgtgctaggcatcaaacaaaaacgctcaaaatatttttgcagtgaatggtgttttaatgcgatttgcggtagcgagagcggttggagatttagcccaaatcaactagcggctatatttaataaagagaaaagttaaaaggagcgtttaccctgcaaaacttcaaagggtataaagatttaaattgcttagcgagttggttattgttcagtgggcaacaagtggcaacgtttgatgacttattccaacataatttctggcattgtattcgtcagtctgattatccaaaggctgatggctatttggacggcgtagagattgtgaaagaatcattccacacgcttttgcctaagtttagcgatgatccgaaagcgttatttgtgttagatccgccttacctttgtaccaagcaggaaagctacaaacaagccaaatattttgacctgattgacttcttgcgattggtcaatatcacgcgaccgccgtatgttttctttagctcaacgaagtcggagtttattcgctttatgaattatatgctggaagataaggtggataattggcaggcgtttgaaaacgccaaacggattacggtcaatgccaagctgaactaccaagtggcgtacgaggacaatttagtctataaattttagctatgaaaaaggcttcgggtgatcacgaagcctttgttttagtcttctaattcggaaagcaagcaataaaacggtggggcgaaaggggcgagcgtggacgtaaatctcaccacgcaatctttgcgtccgtcttccacaaaacgcacatctaaaaatgccgtgttatagacaaaagtttgcccgcattcgttaggcagtgaatattgcgaaccgtctacaataaaaccgtcgtgttctttcactgcaataagggctaattccatcatcatttcctgctcggttctcatttgaaaatttgtcattttgtggtttcctgtgcttgtttaagttggtcacaggattactctcttcggcaggcatagcaagtcatcattgcggcaaaacgactgactgcggtcgaattagactgggggggtatggacggctaaataagtgcagatatgtaatgccatttcactaaatgaaaaaacaagaaaaggaaattatcttgcttttttaggaacggttatgttgtgcgggtttatctaaagtgtaaaatttaaacgccctttaatgatgatttaaagggcgttttgtctagatatatggcattaaatataatggtattatgaatggtattatataattatgtttcttttgaaaatttcgttttaaatcaaaatattatttaattaattctaatccagctagtcgcaccatctctatttttctctattccccaattttcagatagaaatagataaaatataagtaaaaacaatagcttatataatttcacacactaaaacataccttcttttttatatcaaaatcgcctaaaaggtagtatttttataccgattgggatcgatttcgatctgttctatactccattgcacatatttttgcacacgtgtattgcacacatttttatggaataaacaatggcgacaattatcaagaatggcaagcgttggcacgcacaagtgcgcaagtttggcgtgagcaaatcagctactttttttgactcaagcagacgcaaaaaatgggcagaaatgctcgaaaaacagctcgaatcaggaaagtataatgaaatccctgatattacattggatgaactgattgataagtatctaaaagaagtcactgtaaccaagcacgggaaacgtgaagagcgcataagactactgcgtctttctcgaactccgcttgccgcaatatctttacaagaaataggaaaagcacactttcgtgagtggtaaaatcaacgattaaaagaagtctctccagcaacagttttgcgtgaacgtagttcgctttctgctctaatggccaaaacgattgaatgggattttataacagcccccccctaaaatatcttgagaaaccaaaagcaccagcgccaagaactcgtcgatataatgaacatgaaattgagcgtctgatttttgtgtcaggttatgatgtcgaacatattgaaccgccaaaaaccttacaaaattgcacgggggcggcatttctttttgctatagagacagcaatgagagcaggggaaatagcaagtttaacttggaataatatcaattttgaaaagcgcaccgcctttttgccaattactaaaaatggacattcaagcacggtgcctctttcggtaaaagcaatagcgattttacaacatcttacttcggtaaaaacagaaagtgatctgcgagtattccaaatggaagcacgccaactggatcacaacttccgcaagctcaaaaagatggaagggcttgaaaatgccaatttacattttcacgacacccgccgtgaacgattggcagaaaaagtggatgtaatggtattagccaaaatatcgggccatagagatctcagtattctgcaaaatacttattacgcacctgatatggcagaaggctataaaacaaaggcgggttatgatctgaccccaaccaaaggcttgagccaacggaattttttcttctttaatgaaaacttcatcgttttcacaacaaatccaccgatagtcattaagctgtaaccgtccatggagcattaaaaggtcaatttgtgacggttttaatggcgaaccgataggcaacatcaatagattagcttgatgttcaatttttgaacggttacagttattgacacaagtccaagcggctcgatgcgccttgtttgttcggtggtctccgaattaagtgcggtggaacccaacgcacttttcgctgatttaatcacccagttttttaatttggtgatgattttcttttctgtgaatctgttttttacccccacaattttcttacgaatctcaccgtatttattcggttcgcattcttcatactcaatacaaataggctgatcacaacgttttgtcattgcgccaccttgcgcaaactatcactcaacaaatcattttgccgtatttgcaaattaatgttgatccgaatattgcgccacatcgtatcccttattttgagtttgacacaaaagaatatgaagacttatcggtatttgcagatgccatccctaaacttacgggcattggcgtgcagatttcggaaagttgggtgtgggataaattagggattcctgaaccgcaggaaggttaggcgaaagagatttgaaacgccgtgggattgataagcctgacgacagttctgaatttttggtggaagtagaacgcccagcagataagcaaggtaatcgtgaaaagacggtagggtttaaattgcctgatggcacgatacgtgtgacggataaaggctttgattacaatgtagggcgattaaactacaagcctaatttggatctttatcctgaaaaactggcgcatgcgtttgcgaaggttgagatgaaaggtggggagtttaagcacgattttgagttgttggcaaagcatatggcggagatgaaacaaacgctcagcctagatggaaaaaaactcactgttgatcaaatgttacaggtgcgagatagtcttaccaaaaattttaaatttgcggcaggtgtcttgagtgcggaaagtaaggatttattgaaaagcaaaactggcacagtgtggctttctgatgatactttaattaaacagtttaatagccgtgatgggcaagattttggactggaaagctatgcacttttccctgatttatttaatcagcctgatattgttctacaagataatgatcgtttttattttatcaaaaactttgagaaacagcgtattttaggtgtaataaagcacttatctaaatttaatgaaatttttgtgctttcggcaagggagattaatatcaaggaagtagaaaaaatgaaaggtaaattggcagttatcaagtaaggctcccgatcacttacacacgctctcggacacctgagcaggacgagccacctcaagtaggctgcggcagggagattatcaccgcttttttaataactgccttgcatgaatatacccccttaaattttaaaaatcaacaattacttcctcaaatttttatgcgagcaaaagggcgatcgattcgtttgattgggttacatgtcaatttacccgaagaaaataaacaagaacaaatgagcctctggtgatataatctcgcggttttttaggagtcgataccatggaacataaattagaagatattattgcaatttttaatcaatgttttgaagaggaatacaacactcgcttagtcaaaggcggtgatgagcccatttatttacccgcaaatgatgaagtgccttataacgcgatttattttgcgcgaggcttttacagcagtgcattgcacgaaattgcccattggttagtggcaggcaaagaacgccgtaaactagaagattttggttattggtatgagccagatggacgttcagaagaacgtcagcgtgattttgaaaaagttgaagttaaaccgcaagcattagagtggattttggcaacggcggcaggtttccgttattttgccagtgcggataatttgaatggcaatccgggcgatacacagccttttaaacaagccgtgtatgaacaagtgaaaatctatgcggaaaaaggtttaccaaaacgagcggaaatgttacgcaaggcgttagtggcattttatggcacagaagatgaaattgatctggcgaagtttgatgtcgtgcgtatttaatagcagaaagtgagcaaaattgctcacttttttcagtcttaagcccccaattccctcctaattaaatagttcaatttttaatcatttcacacccagtatactgggtgttgtactctctttacagagagtacaacaaaacataatgctaaacaaaaaatgtttggttgtttcaattgttgattaataaatggacgatttctatgcgattcacaaaaacactttttaccaccgcacttttaggtgcttctatcttttcttttcaatccaccgcttgggcggatacgctggaacagcaattccaacaaggttctgaagccactacgagaggcgattatcaaaccacctttaaatttttgttacctctggcggagcagggaaatgcagaggctcaattgatgttgggcgtgatgtatgcaagaggaataggcgtcaaacaagatgattttgaagcggtgaagtggtatcgccaagcggcggagcagggatatgcaaatgctcaagctatattgggattctcatatcttttaggacaaagcggtgttcaagtaaataaatctttagccaaagaatggtttggtaaggcttgtgataatggtgatcaaaatggttgcgaatattatggcaagttaaatagaggggagctctaatgccaactttacaatgcgaattttggaatgtagggcaagggttattttcaagtgggcgtattcaaatgggagacgccccagcctttcattgggtttatggtttgcaagttcctcatcatggttcaaagccaattttagtgaataaaaataaaagattatccattcattcaatttaataggaaaacaaatgaaactcacaaaaacacttcttaccaccgcacttttcggtgcttctattttttcttttcaatccaccgcttgggcggatacgccggaacagcaattccaacaaggtttaaccgcttatgagcaaagcaactatcaaaccgcctttaaactttggttacctctggcggagcagggagatgcacaggctcaaggtggtttgggcatgatgtatgaaagaggacttggcgtaaaacaagatgatttcaaagcagtgaactggtatcgcaaagcggcggagcagggggatgcagatgctcaattaaatttgggtgcgatgtatgcaatcggacgtggcgtaaaacaagatggtgttgaagcggtgaagtggtttcgcaaagcggcagagcagggaaatgcaaaggctcaaaatggtttgggcatgatgtatgacggaggacttggcataaaacaagattatttcaaagcggtgaaatggcatcgcaaagcggcggagcagggatatggaggtgctcaagttatgttgggattctcatatctttcgggaaaaggtgttcaagtaaataaatctttagccaaagaatggtttggtaaggcttgtgataatggtgaacaagtgggttgtgaatattatggcaagctaaatagaggggaacgctaatgccaactttacaatgcgaattttggaatgtagggcaagggttattttcaagtgggcgtattcaaatgggagacgcccaagcctttcattgggtttatggtttgcaagttcctcatcatggttcaaagccaattttagtgaataaaaataaaagattatccattcattcaatttaataggaaaacaaaatgaaactcacaaaaacacttcttaccaccgcacttttcggtgcttctgtattttcttttcaatccaccgcttgggcggatacgctggaacagcaattccaacaaggtttaaccgcttatgagcaaagcaactatcaaaccgcctttaaactttggttacctatggcagagcagggatatgcaaaggctcaatttaatttgggcgtgatgtatgctaaggggcaaggcgtcaaacaagatgattttgaagcggtgaagtggtttcgcaaagcggcggagcagggatatgcagaggctaaatttaatttgggccatatgtattctaagggacgaggcgtcaaacaagatgattttgaagcagtgaactggtatcgcaaagcggcggagcagggagatgcagatgctcaagctatattgggattcttatatcttttaggagaaagaggtgttcaagtaaataaatctttagccaaagaatggtttggtaaggcttgtgataatggtaatcaaaatggctgcgaatattatggcaagctaaatagaggggagctctaatgccaactttacaatgcgaattttggaatgtagggcaagggttattttcaagtgggcgtattcaagtgggagacgcccaagcctttcattgggtttatggtttgcaagttcctcatcatggttcaaagccaattttagtgaataaaaataaaagattatccattcattcaatttaataggaaaacaaaatgaaactcacaaaaacacttcttaccaccgcacttttaggtgcttctgtattttcttttcaatccaccgcttgggcggatacgctggaacagcaattccaacaaggtttaaccgcttatgagcaaagcaactatcaaaccgcctttaaactttggttacctctggcggagcagggagatgcaaatgttcaatttaatttgggcgtgatgtatgctgaggggcaaggcgtcaaacaagatgattttgaagcggtgaaatggtatcgcaaagcggcggagcagggagatgcaaatgctcaggcttatttaggtttggcttatactgaagggcgtggtgtaagacaagattataccgaagcggtgaagtggtttcgcaaagcggcggagcagggacatgcaaatgctcaagctatattgggattctcatatcttttaggaaaaggtgttcaagtaaataaatctttagctaaagaatggtttggtaaggcttgtgataatggtgatcaaggtggttgcaaatattatggcaagctaaatagaggggaacgctaatgcctttattccgcttaccgcaataataatgcgaattttggaatgtggggaagggattattttcgagtgggcgtattcaaatgggatacgccccagtttcccattgggtttatgattatggcatgaattcaagtcagcaacttattcaaaatgccatacaaaaatataaaaataaaatcacaaataaagcgtctgagattcttaatttccttttcgctgtcaattttccctaaaatcggctagaatgcaccgattttattttcggtgacttataaatgatgaaagattccattattgcaaaattagaaagtttaaaagaacgttatgaagagctagaagccttattgggcgatgtttctgtaattagtgatcaggataaattccgtgcgtattctaaagaatattcgcaacttgaagaagtagtgaaatgttttaatcgttggacgcaattaaatcaaaatattgaagaagctgaaatattgctcgacgatcctgaaatgaaagaaatggcgcaaatggaaatcgaagaatccaaagcggaaattgaagaagtggaacaacaacttcaaattcttttactgccgaaagatcctaatgatgaatataactgctatttagaaatccgtgcgggaacaggcggtgatgaagcaggtatttttgcgggtgatttattccgtatgtacagccgttatgcggaaagtaaacgctggtgtgtagaaatgctcagtgccaacgaaagcgagcagggcggttataaagaagtgatcgtaaaagtaagtggcgaaggcgtgtatggccagcttaaatttgaatcgggcggtcatcgtgtgcaacgtgtaccaaaaacagaaagccaagggcgtatccacacgtctgcttgtaccgttgcggtaatgccagaattgcctgaatctgaaatgccagaaattaatccagcagatttacgtattgatacttatcgctcatcaggtgcaggtggtcagcacgtaaatacaacggattctgcggtgcgtattacacatattccaacaggcattgttgtggaatgtcaggatgagcgttcacagcacaaaaataaagcgaaagcaatgtcagtattagcgtcacgtattgttcaagcagagcaagaacgccaagccgcagaacaaacagatatgcgccgtaacttattaggttcgggcgatcgttctgataaaattcgtacatataattatccgcaaggtcgagtaaccgatcaccgtatcaatctcactatttaccgtttggatgaagtaatgaatggtaaaattgatgaactgattcagccgattattacggaatatcaagcggatcagttggcggcattgtctgaacagaattaatgataggggcatctgatttcagatgtcctttttaactttaaaaggaaataaaatgatcattgaaaatcaaaaagatgctgaattttcttctgctttcaaatcttctcaacctgctcaagcaagccgttttaaacgttggcttgcgagtatgattaatgggcttgtgctttgggtgatggctggtctcggttttgcattgggggattttgccggtgtagtggggatgattgtatatgctggttttcagttatatttcatgaaaacttatggtcaaacaatggcaaaacgctggttaggcttgcgcgtatttaattatcataccaatcatcctgttgaatttggtaaatacatcggtcgtgagattattgatattttattggcatggacaagtttcttattgattattagcggtattgttgcacttgtgcgtgatgatcgccgttctttaacggatttagtggctggcacgatggtgttaaaagacgaaaaataatgaattataaagaatggctggcacaagcgattgtagatttagcacaaaaaaatcccactgaaaatagtaaaattgatgcacttgtgcttcttcaacacgctactggcaaatcgcgtacgcaaatccttgcttttgatgatactgagattgatgaaaaagtgcggttaaaattgaccgcacttttagatcgtcgtctaaaaggcgaacctatcgcttatattcttggtgaaaaagaattttggtcgttaccattaaatgtttcaaaaagcacattgattccaagaccagacacggaaagtttagtggaaaaagcattacaaattgcgttagaaaaactggaagaaaatccaccgcactttcgtattcttgatctcggcactggcacaggcgcaatcgccctcgctttggcttccgagcttgagcccatttgccaaaagcggcatattccgctggaaataattggtgttgatcttatgcccgatgttgtggcattagctcaatctaatgcagaaagaaatcagctaaatgtagaatttttgcagagccgttggtttgataatataacagggaagtttgatcttatcgtcagcaatccgccttatattgatgcgcaagatgaacatttgcatcaaggcgatgtacgttttgaacccctttctgcattagttgccaatgatgcagggtatgctgatttacgtcatattattgaattagcatcgagttatttgaattctaatggcgtattattgcttgaacacggatggcaacaaggagaaaaagtgcggtcaattttccaagaaaatcattgggaaatggttgaaactgtgcgtgattatagcgacaatgagcgtgtcactttaggtttttggaagaagtaatgaaatattatcgacgtgcgttatacgataaatttgtgcatttttatcttgttatctctgatgatggcagctcagaagcacaacttcggggaaaaatgggtgggcttgtgcgtaaagcgcgtaaaaaaatttcgccagattggccgaaagaagagcagattcatcagttactacagctattttatggtgattggggctttcattgcgatccagaagattatttttatgctcgcaatttatatttgccttatgtgtttgaacatcgtcaaggaatgccagtgactcttggggcaatggtgttttatttagctgaggcattggatttgccaatttacccagtaaatttcccaacacagttaattttacgtgctgaagtcagagatgaagtggcttttattgatccttgggatggcacttatatttcacaagaaaaattgcagcaactttatgaaggtgcatttgggtttggggcgaaaattcaacccgaagaacttgatagagccgatctttctttactttattctcgctttgagcaactggcgaaaaatgcgcttattcgtgaagagcataacgatatggcatatcactatattaagaatttaatgattactgatgctgaaaatccttatcatatccgtgaccgtggcttagttttagctcaaatgggggcttatccttcagcattgaaagatttagaattttttgtggaacattgtccaaaagatccaacggcggcgtttatccgcacgcaacttttagaacttaaaggcgagattaataaagatacttttcccctccattgatttaaggaaaatttatgcaaaataaaattgtaaaaattggcaatattgatgttgcaaacgacaaaccttttgtgctttttggcggaatgaacgtgctggaaagccgtgatatggcaatgcaagtgtgcgaagcttatgtgaaagtgacagagaaacttggcgtgccttatgtatttaaagcgtcttttgacaaagcgaatcgttcatctattcattcttaccgtggacctggcatggaagaaggattaaaaattttccaagaattaaaagatacattcggggtaaaaattattaccgatgtacacgaaatctatcaatgtcagcccgttgctgatgttgtcgatattattcaacttcccgcctttttggcgcgtcaaacagatctcgttgaagcgatggcaaaaacaggcgcagtgattaatgtgaaaaaaccacaatttttaagcccaggtcaaatgggcaatatcgtggaaaaaatcgaagaatgtggtaatgataaaatcattctttgtgatcgtggaacaaattttggttacgataatttaattgtggatatgcttggctttagtgtaatgaaaaaagcctctaagggtagccctgttatttttgatgtaacccattcacttcaatgccgtgatccatttggggcagcatcgagtggtcgtcgtgcgcaagtaaccgaattagcgcgttcaggtttagcagtaggcattgcaggtttattcttagaagcacatccaaatccaaatcaagcaaaatgtgatggcccttctgcattgccactttctgcgcttgaaggctttgtttcccaaatgaaagccatcgatgatttagtaaaatcttttccagaattggatacctcaatttaaatttcatcaaaagtgcggttaattttgaccgcactttgtatataaaaaaggagcaattaatgaaaatcgtatttttagatagcacggctattcctaaacatatttcaattcctcgcccaagttttgaacatacttggactgaatatgatcatacgtcttctgccgaaaccattgagcgagcgaaggatgcggacattgttattaccagcaaagtgatttttgatcgtgaaactttgcaacaactgccaaaattaaagctgattgcgattactgcgacaggtacaaataatgttgatcttgtggctgcagaagaaatgggcatcgccgtgcgtaatgtgacaggttattccagtacaaccgtgccagaacacgtaatcggtctgattttttctttaaaacacagtttggcaggttggttacgcgatcaaacggaagcaaaatgggcggaaagcaaacaattttgttattttgattatccaattacagatgtgcgcggttcaacgttgggcgtatttggtaaaggttgcctaggaacagaagtggggcgtttggctaatgccgtgggaatgaaagtgctttatgcagaacataaagatgctactgtttgccgtgaaggttatacgccttttgatgaagtattaaaacaagcggatattgtgacgttgcattgcccattaacggaaacaacaaaggatttaattaatacagaaaccttatccaaaatgaaaaaaggtgcatttttgattaatacagggcgtgggcctttgattgatgaacttgccttagttgatgcgttaaaaacggggcatttaggcggagcggctttggatgtaatggtaaaagagccaccagaaaaagataatccgttaattttagctgcaaaaacgatgcctaatttaattatcacaccacatattgcttgggcgagtgatagtgcagtgacaacattagttggcaaagtaatgcaaaacatcgaagaatttgtacaacaattacatcaaaaataatgaattttcctatttctctttatattgcactacgttattggcgtgcgaaaagtgcggatcgttttgggcgattagtaactaatcttgcaagcctggggattgtgctaggtgtgatggcattgatcatcgtgctttcggtgatgaatggattagaaggttaccaaaaacaacaggtgctatcttccattcctcatgcgattgtgagcgaagaacagcctatttctacagaaaaaacgctagaaaatttaccgcactttgtccaaaaagccgtgccgatcaatacaacaaatgtgatttatcaaacggcaaaaggcgtaagtgcaggacaaattataggtattcaatcattttctgatgatcctttggttgaatcttttgatcagactaaatttaatgaaattttgcctagaggggagtttaaactggtcattggtgatcaactggcgcaaaaactgggcgtgaatattggggataaaatccgtttgatgattacggaaaatagccaatatacaccattcggtcgggtgccaatgcagcgtttatttactgttagcgatatttattatggttatggcgaagcatctggttacgaagcctttgctaatattacagatattggtcgcttaatgcgtattcaacctcagcaagcgcagggctatcgtttatttctgaatgatccgttccaaattacagaactcccacaacatttcccgacacaaaaaatcacagattggcgtgtgcaaaaaggcgaatttttccaagcagtgagaatggaaaaaaatatgatgggtttgctgattagtttgattattgtcgtggcgatttccaatattgtcacctctttaagtttgatggtggtggataaacaaggggaaattgcgattttgcaaactcaaggcttaacaaaatcccaagtgcgttcagtgttcatttatcaaggattactggtgggatttgttggcacattactcggtgctattttaggtgttttagctacgttgaatttaacggacattgtaagtgcggtaaatccacaaggtgtttttttaccgacagaattatcctttgttcaaatgatttttgtcattggattttcgctgttactttccttgctttcaaccctttatcctgcttatcgagctgcgaaagtagaacctgcagcagctttgagatacgagtaaatggtaaataaatgatggatgaacaatcacttttagcttttgatacacaacatatttggcatccttattcttcagtttcttctgatatgccgctttatgcggtggaacgtgctgatggtgtgatgataactttaaaagatggtcgtcgtttgattgatggtatgtcctcttggtgggcggcgttgcatggttataatcatcctcgtttaaatgcggcggcacagaatcaattagcaaaaatgagccatattatgtttggcggatttacccatgaccctgcggtggaattagctcaattattggtacaaattttgcccaatggattagataagatcttttttgctgatagtggttctgttgcagtggaagtagcgatgaaaatggctattcaatatcagcacgctaaaggagaagtacaacgacaaaaatttgccactattcgttcaggttatcacggcgatacgtggaatgcgatgtcagtgtgcgatccaaccacagggatgcatcatttatttcatcatagcctgcctgtacaatattttcttcctcaacccaacattccatttaatgaatcttggaatgattgtgtcattgaacctttagctgatttacttaagaaaaaaggtagcgaaatcgccgcactgattttagaacctgttgtgcaaggtgcgggtggtatgtatttttattcgccaacttatttagtgaaagcgcaagcgctttgtaaacaatatggtgtattgctgatctttgatgaaatcgccacgggatttggtcgaacagggaaattatttgcagctgaacacgcaggcatttcgccagatattatgtgtatcggtaaagcattaacgggtggttatttaactttatcggcaagtattacgaccactgaaattgcgcaaattatttgtagcggtgaggctaaatgctttatgcacgggcccacttttatggcaaacccgttggcttgtgcaattgcagcggaatctatccgtttattgttggaaagtccttggcagcaaaatattcagcgaattgagcattccttaaaacaacagctttcgcctttagctgaaaaagattacgtcaaagaagttcgtgcattaggggcgattggggtggttgaaatgaaaagtgcggtaaatatgaaaactttagttccacgttttgtggaacaaggtgtttggattcgacctttcggaaaattggtttatgttatgccaccatttgtgattaaagatgatgaacttcagaaattaacggaaggcatgattttggctttaattcaggaatatgaacattaggataaaaaatggatgctttcaaacagcaactggaacagcttagcgcacaaaatcaatatcgttcaattccagatttagttcatcaaggacgatatattatgcgagaaaatcgcaaaatgctgaatatgtcatctaatgattatttaggtttggcatcaaatgaaaacttgcgccagtcttttttacagcaatacggcggtaatttcccctcttttaccagttcttcatcgcgtttattaacgggcaactttcctatttataccgatttggaagagcttgtcgcacaacgtttccaacgggaaagtgcgttattatttaacagcggctatcacgccaatatcggcattttgcctgctttgacgacgaaaagtttgattttggcagataaattagtgcatgccagcatgattgatggcattcgtttaagccaatgtgagttctttcgttatcgtcataatgattatgaacatttgaaaaatctgcttgaaaaaaacgtcggaaaatttgaccgcacttttatcgttaccgaatctgttttcagtatggacggcgacgtggcggatttgaaacagcttgttcaattaaaaaaacaatttcccaatacttatctttatgtggatgaagcccatgcaataggcgtttacggtaaaaacggattaggtattgccgaacgagctaatgtgatagctgatatagatttgttggttggcacttttggcaaggccttagcttcaatgggggcttatgtcgtctgtgatcaaatattaaaagaatgtttgattaatcaaatgcgcccattgattttttcaaccgcattgccgccgtttaatgtggcttggacttattttatttttgaacgattgccgcaattctcaaaagaaagaagccatcttgagcggttaagtgcatttttacgccaagaagtggaacacagaacgcaaataatgccaagccaaacttgcatcgttccctatattttaggcgaaaacgaagcaacccttgctaaggcgaaagatctgcaagagcaaggttattattgtttgccaatcagaccgccgacagtaccaaaaggtacatccagaatacgattgtctttgacggcagatatgacaatggatgaagtgaaacagtttgtggcatgcttataaggaaataatgtgaaaacgaaattttatgatcatcaaggtgagcatttaatagtttattttgctggctgggggacacctcttgatgctgtagttcatttgattttgccaacagatcatgatttattaatttgctatgattatcaagatttaaatttggattttgatttttccgcctatcggcacatccgtttggtggcgtggtctatgggcgtttgggcggcagagcgagtattacaaggaatcaccttacaatcagcaacagcagtgaatggaacaggtttaccttgtgatgatagcttcggtattccctatgctatttttaaaggtacgttagataatctcacagaaaatactcgttcaaagtttgaacgtagaatttgtggtgacaaagtatcttttgaacgttatcaacaattttctgcacgaccatttaacaaaattcatcaagaactcaccgcactttttgcgatgattcagcaggataaacgcacaaatcttattcactggacaaatgcatgggttagttctcgcgataaaatttttacgccagccaatcagaaccaatattgggcatcccgttgtgccgttcagaaaatagagggtgagcattatgtgttttcaagatttacccactggtcggcattatggaatcattaacttccgtaaataaatcgcgtattcaacaagccttccaaaaagccttaaatagctatgatgaacatgcgttaattcaacaaaaaatgaatattaagttaatgatgcatttgcaagactatttaccaaatgggtcattagatagcgttttggaactaggttgcgggtctggtatgttgagtacgttgttgcagaaacagatttcagccaactattggttatttaatgatttgtgcgatgtgcgcactctactcactgaaaagctgattcaaccctttgatttttattgtggtgatgcagagaactttccttttcaacgacgatttgacttgattgcaagtgcatccgccgtgcaatggtttcaccaacccgacgcttttatcgcccattgcaaaacaggcttgaaaacaaacggattattggcggttgcaacctttggcgaagacaatttgaaagaagtccgccagatcacaaatataggattaaattacccgactttatcccaatggcaaaattggttagccaatgattttgagcttttatggtgtgaggattttaatgtaatactagactttgatacaccattggatgtactcaaacatctgaaatataccggtgtaacagcgactaaccaaaaaaattggacaagaaaaaatctcaatggatttattggcgattacttgtcggcgttcagtatgccgtcggacaaagtgcgcctgacttatcatccgttattttttatcgcacgctattctcacatagaaaatcagtaaggaatatttatgggcaaggttatttttatatctggcattgatactgatgtgggaaaaacgattgccacaggcatttatgctaaaaaattgatggaacaaggctgctccgtgattacacaaaaaatgattcaaacaggctgtaaaaatatcgctgatgatttacttgtgcatcgaaagattcaagacattgatttaacggaagaagatttacaaggcaaaacctgcccttatgtttttgaatatccttgttcgccacatttagctgcaaagcgagaaagtagaaaaattgaagcaaaaatccttgaaaaatctaccgcacttttggcagaaaaatatgattatgtactattggagggtgctggtggcttaatggtaccttattgtgaagaagagacgacgttggattatatccagttaaataattaccctttaattttagtgacatcgggaaaactaggcagtataaaccatacattattaagtttagaggcttgtcgtactcgaggtatttcagtattaagtgtaatgtataacggttacccagaatatgatcctattattagtcaagaaacccaacgctatttaaaacgttatcttgaaaaacattttcctgaaacaggatttgaatactttgggtgtattgaaatttaagctcaaggaaaagtgtgatagactcgcgcaagtttttgatgggattatctgccgctaaagtgcggttaaaacgagtaaaaaatgaacaactatttattaaaatgcgaaaatatcaataaattttatcaagagggcgaaaatcaaacgcaagtgttaaaaggcgtttctttttctatggaacctgcagagttggttgcgattgtggggagttcaggttcagggaaaagtactttattacatactttagggggacttgatcagccaagtagtggggaagtgtttattaatggacaatccttgcaaaaagcatcggctaatgaattagctgctttgcgtaatcgttatttaggatttgtgtaccaattccatcatttaatggcggattttaccgcacttgaaaatgtgatgatgccgatgttgattggtcatcaaaataaaactgaagcgaaagatcgcgctgaaaaaatgctaagtgcggtgggattaagccatagaattacccatcgtccttctgcgctttctggtggggaacgtcagcgtgtggcgattgcgcgtgctttagtgaataatccatcgttagttttagcggatgaacccacaggaaatctcgatcacaagaccactgaaagtatttttgagctgattcaacaacttaatcaagaacaaaatatcgcctttttattagtcactcacgatatggggcttgcggaaaaattatcacgccgtttagttatgcaagatggtcttttgaaggagggggcgtgatgaatacgccgttttttattagctggcgttatcaacgtggcaaacaaaaaaatcctttagtcgcgttaattgcaaaattctctgcaattggtattgcattgggtgttgcagttttaattgttggcttaagtgcgatgaatggttttgagcgtgagcttaatcaacggattttggcagtcgtgccgcatattgagattttttctgcgcatcaagcgaaagatcccacaattcatcattggcaaaatttagaaaaacgcctacaacaaaatccacaaattaaaggaatctctccttttgttagctttacggcattggtagaaaatggctcaaaattgaaagttgttcaggtcaaaggtgttgaaaaacaagcagaagataaggtaagttcaattggcaattttgtacaagagcaaggttggaacaaatttgagaaagaaggcggattggtcttgggagcgggtatcgctaaagaacttgatgtaaaagtaggggattggattaccttgcttatttctcagcaaaacggcgatgaacaatttgctcaaccaactcgtgagccagtgcaagttaccgctattttacgcttagatggtcagcttgattatagttatgccttattgccgcttgctcaagcacaaacctttttgacttatcaacctgatcaaattacaggtgttgaattgaaattagatgatcctttttctgcgagaaatctggatttatcaatgcttaatgattatccgcagatgctatatatgcaaaattggattagtaaatttggttatatgtatcgcgatattcagcttattagaaccgtaatgtatatcgcaatggtgcttgtgatcggtgttgcgtgttttaatattgtttctacgctgattatggcggtaaaagataagcagggcgatattgccattatgcgcacgcttggggcgaataatgcgtttatcaaacgtatttttatttggtatggcttacaggcaggaatgaaaggttgtttaattggaattgtgttaggcattatacttgcattaaatcttacaacctttattcaaggtattgagtgggttatcggtaagaaattattatcgggcgatgtgtattttgtggatttcttgccaagcgagttacattggttggatgttttgatggttttagttgcagcacttgcattgagtttaatggcaagcctttatccagcaagccgagctgctaaattacaacctgcacaagtattaagtagccattaatttcgagagtacagcacaaaagtgcggtatttttttatcttttatttacttaattatttcgttttattcagcttgcaagagagttgtaaagatagtttaatagggaattcgtaggttttattctaaaaaaaacatatcgaactagtttactagtacaaaaataagtgtagattagctacataatgaaaacacaacatttgaaagtttgagagtgatatatggctaaagagaaaattgaaattgtcgtggcaaacgacgatacgcgaattgaaaaagtcgatcaggtgttaccacccattgccttattagaaaaatacccagcaagtgaacaggctgcggcgttagtgaagcaaactcgtcatgaggcacataatattattcatggtaaagatgatcgtttattagtcgtgattgggccttgctctattcatgatccgaaagttgccattgaatatgcgactcgtttaaaaccattacgtgaaaaatacaaagatagccttgaaattattatgcgtgtgtattttgagaaaccgcgtacaacggtgggttggaaaggtttaattaatgatccatatttgaatgatacttatcgtttaaatgatgggttacgcattgcacggaaattactttcagatattaatgatcttggtgtgcctgcagcgggcgagtttttagatatgattacacctcagtatttggcagattttatgagctggggggcgattggggctagaacaacagaatcacaagttcatcgtgagttggcttcaggtttatcttgtgctgttgggtttaaaaatgccactaatggtggtgtgaaagtcgctttagatgcaattggtgcggcggaagctccccactatttcttatctgtcactaaatttggtcattctgcaattgtttctacaaaagggaatgaagattgccatattattttacgaggtggagataaaggtcctaactatagtgctgaagatgtagaaaaagtttgtgctgatattgaaaaaacagggcgtattccacacgttatggttgattttagccatgcaaacagcagtaaacaatataaaaagcaaatggatgtttgccaagacgtatgtaatcagattgcatttggttctaaacaaatctttggcgtaatggtggaaagccatttagtggaaggtcgtcaagatttagttgatggcaaagcgcagacttatggacaaagtattacggatgcgtgcattggatgggaagattctgaaagattattgcaacaactttctgatgcagttattgctagacgtaaagcgacgagtaattaattgaaatataatctagatactagatagaagtgcggttgattttcaccgcacttttttatttgcttttaactacgctgcccatttcattttattgcgacgtttcatttgatgaatcgtattggttacggtgccgacaataggtaaatttgaccaatcttttgtatttatattttgtgttgtggaatccaatgccataaaaaggtaattgccgctatgcgtcataaattcatagacatgaaattcgttattttcttctagcacaacaagatcaccagaataaagatcgtcatttttttcgacgactaacatatcgccgctttcaattccccaagccaacatatttgggttagttatatgaataaaacaagtttgttttggacgtttgatacagtaaagatttaaatctaattttttgttgaatttaaggttatcttctatatcactgaaaaaaggcagtggattataagaaaaatccatttcatattgtgtagccaaagtttggttgttcattctcttatctcctgttaaataatatggataaataaccttttaccttgtttttttgtacagttaaattttactgatatttcatacagggtgtcaataggttaaataaaaaatttttttataagtatgtttttagagaatatctaataactttagaaaaaagttcacttttagagtgaaaaataataaaaatattttctttcattaaaattttacgctatctttaatcccccctaggtggattggtaacaatctgaagttaaatttactaaaagaaagataaaaatatgaacacatcacgtctatttagtctgttatttcagggtagtttggtaaaacgaattgccgctggcttggttcttggtattgttgttgcattgatttcagcaccattacaagaaaccattggttttaatcttgctgaaaaagttggcgtattaggtacgatttttgtaaaagctctgcgtgccgttgcaccaattttaattttctttcttgttatggctgcccttgcaaaccgtaaaattggtacgaaaagcaatatgaaagaaataattgtgctttaccttttaggcacattcttagctgcatttgttgctgttattgctggtttcgtattcccaacggaagttgtacttgcaaccaaagaagatgcaagctcagcaccgcaagctgttggccaagttttatttacccttatcttaaacgtggtagataatccattaaatgcaattttcaaagcaaactttattggtgtattagcatggtctatcggtttaggtttggctttacgtcatgcatctgatgcaactaagaacgtattatctgattttgcagaaggcgtatcaaaaattgttcacgtgattatttcttttgcaccatttggtgtattcggtttagtggctgaaaccttatctgataaaggtttagtcgcattaggcggttatgtgcaattacttgctgtattaattggtacgatgttatttactgcttttgttgtaaatcctattttagtttattggaaaatccgtcgtaatccttacccattagtgtggacttgtgtacgcgaaagtggggtaactgcattcttcactcgtagttctgcagcaaatattccagtgaacattgaattagcaaaacgcttaaatcttgatgaagaaacttattctgtttctattccattgggtgcgaacattaatatggcgggtgcggcgattactattactatcttaactttagccgcagttcatacactaggcttagaagtttccttcgttagtgcgcttttattaagtattgttgcagcactttgtgcttgtggtgcatctggcgtagcgggcggttcattattattaatcccattagcatgtagcttatttggtatttctgatgatgtagcagcacaaatgatcggtgttggttttattatcggtattttacaagactcaaccgaaacagcattaaactcatcaactgacgtattatttactgcggcagtatgtatggaagaagaacgtaaaaacgcagcataatgatgatgcaaataagagagcgggctatgcccgcttttttttatgtgattttatatgcaaagtgcgctctattttgatagacttctgtcacgttttatttccctacaaataggtaagaaaaatgaatcacttaattatttttgctcaccctaattcagtgcgtagttttgggcgagcgattgccaatcgtattgagcaaattagtcaagaaaatggtgtaaatgtattttttcgtgatctttatgaaatgaatttcaatccaattttatctcatgaagaattgcagaatgctaacaaaggtattattccagaagatattcagcaagagcatgattttattcttcaagcagatttaattacgttggtttatcccctttggtggatggggttcccagcaattttgaaaggatatttagatcgcgtattaagtcacggttttgcctataaaacggaaaacggcgaatcagtggggttgctaaaaaataagcaaatgcagcaatttattacgattggcagtaatgttgatcaatataaagaatttggtgtggataaatcgcttaatcattgtttgattaatggattattcaattattgtggaattgaaaatgtcgagtttgaattatttggagatattcatttaattgatgatgaggctcgtaaggcgatgattgaacttgctgctcaaaaaactcaagcaaaattgaccgcacttttaaaggaaaaagagtaatgtctgaaaaacaaattaataatttttcattaattagtcgattattcggtaatcttttttatcgttctccaacagataaagtactcgctgacgcatttgtttggttacaacaaaaaggtttgagtcaagtttgggcgttagatactgataaagaaagtgaattagcactgaatagcttgcaagttaaaatcgatctcaatttattgaacgaagagtatcaaaaattatttggtgcgaatgggaaagtgatgacggctatttcagcttatggcattgatgttgaagaatttgtgaattttcgccttgtacgcaatatgccagaggtggaaagtgcggatcattttgctttattattgctcactgcttcttggcttgaagataattcggattctttagtggctcaacaagaattctttgaaacttttttactgccttgtgcagcgaagtttttaactcaagttgaaacgcaagcaactttgcctttttatcgtgcattggcccttcttacacgagaaatattggcagcgatggcggatgaattggaagaagagtaggcaatattttgctttcctctaagtcttgaggaaagcaagcaatattttatagataggttacaaaatcttttgtatcaataatacggcattcacgttcggctttctccatacttgtgccaatcatgactaacgcaatcacacgatcttgttcacgacatccgaacgcttctcgtaatgcagtgccattaacccatttccctgaaatccacacattatcaaatccttgtgcttgtgcagccagttgtaatccataagttgcacaacctgcactcaacatttgttcccaatctggcactttagcgatagttggatcgatttttgctaccacgccaataaccataggtgcgcgatgtgctaggttttcggctttcatcaatttttcttccccaagatcaaattctacaacggcagctttaagtagcgtttctaatttatttaagctctcattttccattacaataaaatgataaggatgtaattttccgtgatctggcacacgcattgctgcttcgaaaatacgctcaagctgttctgcattaggtgcaggtacggtcaattttttgtttgattttcttgtggttaaaagtgtaagtgcatccattttattatcccttataagtaaaagtgcggtggattatagcatagtttttgacaaggctttgtgatacgctagtacaaattttttaaaggtaatttgtatgtttcgagtattaaaattttgttggaaagtgctgtgtttcattcgtgatcttgtgatgaatgttgtgtttttaggctttgtactattgctagtggcgattattagcttttcaagtggcgggaaaaaatctactgcattaacgagcgaaggcgcattattgctcaatttagatggttatttagcggacaaccgagatgaaacacttcgttggcaagatgcgttaagcgaattgaatggcgagcatgtccctagaaaaatttcgacgtttgatgtggtatttgccattcaacaagcggaagatgatcctaaaattaaaggattagtgctagatcttaattattttgaaggggcagatttacccgcattagattttattggtggggctatcagtcactttaaagatgcagggaaaccagtgatcgcctatgcagataattattcacaaggacaatattatttagcgagctttgctgatgaaatttatttaaattcaattggaagcgtggatattcacggtttatcgcaagagaatttgtattttaaagagatgctagacaaattagccgttacaccacatattttccgcgtggggacttataaatcagcagttgaaccatttttacgcaacgatatgtcggctgaggcaaaagcaaatatgcaacgttggttaggcgaaatgtggaataattatgttttatccgtcagtgaaaatcgtaatattaagaaagatcgcattttgccgaatgcgaaacagtatcttgcagaacttaaagcgttaaaaggcaatagtacggcatatgcacaacaacgtggattagtaactgatgttgtaactcgtttagatttagataaaaaatttaccgcactttttggcaaaggaagtgatggaaaagcgaaccttatcgaatttgatgattatttgactcaactgcctgatcgtttagaacattacaacgtaccgaataaaattgcggttgtgaatgttgaaggaacgattattgatggagaaagtgatgaagaaaatgctggtggcgacaccattgcgcgaattcttcgtaaagcccacgatgacaattctgtgaaagccgtgattctacgcgttaattcacctggcggaagtgcttttgcttctgaaattatccgacaagaaactgaaaacttacagaaaattggaaagcctgtcatcgtatctatgggtgcaatggcagcatcaggtggttattggatttcatccactgcagattatattattgccgatgcaaatacaattacgggttctatcggtattttcacgatgttcccgactttcgaaaatagtattaagaaaataggcgtgcatgcagatggtgtttcaaccactgaattagctaatacatctgcgttttctccattagcaaaacccgtgcaagatatttatcaaacagaaattgagcacggttatgacagatttttagaaattgtcagcaaaggtcgtcagctttctaaaacacaagtagataaactggctcaaggtcaggtttggttgggcagtgatgcattccaaaatggtttagtggatgagatcggttcttttaatgaagcagttaataaagcagagcaattagtgaatcaacgccaagatactgccgtgcaggattttagtgtggaatggtttacagatgataatgttagtttaattagcaccttattacgcgatactaaaaaaggtacgcaagagcagttagttaaatggcttggtctgccggctccaattcaaaaattacaaaaagaattgaatgtattaactaaatttaatgatcctaaaggtcaatatttgtattgcttgaattgtggaaaggttcagtaataattgaaaaagggcagaattaaatctgccctttcgcttacaaaatatacgcttcttgaatatgatgtggcttttggtcttcttctggtggaagcttcatataatctccataatattgcgttaagtgttcgtgatatccattcattacttgaaattgtcgtccttcaaattctttataaacaatgtgattaaaatattctttcggcatataagatttttgccaaccaccgtagtcagataatacaagaccaatataatcgcattgttttatcggatattttatttggaattgtgctaaatttttttgcattttggaaaataaaaagtggcttaatttaccaagtatcgttctttgcaaagtattttcttttgatcttaaccatcttttcttacaagaagaaaatcgaagtttaattcttcggtgctttttcatcagtgggtaaatgatctttggttcattcggtacaccatcgtagataaatatatccataaacatcgggctttttcttcccttagcatctgttatttgagtgcgacaatcgaaaatttttgccatttcaccggtatattgagcaagtatatcttctgccgtttccatattgtagtattcgtgagtttcttgaaaccaaacatcaacgaacctttgatattcatcacggtgcatataaacatcaatatcatcatcccaagggataaagcctttgtggcgtattgcaccgattaatgttccaccaccaagagaatagtgaatttggtgtcgctcacataatgcgtggaaataatctaatatattgagacaaacgagttgttgttctctgagcgttaattttttcattatttttccttgtttggtgtcaatttttgtaaaatgtggtgatagtcatcaaggttatccatttcaaatatatcatcactgttaagttgttccgtatagatatttaatttctctatatattccatcggaatggtatcccaataaagttttggattttttaaccgcacttcacttgtgtattctttgagcaaagttagaatgatatcgcaatcccgagttgtccaataagatacccctgacaagctagactggtttaatgatccaatctcaatacgtattacttgcccattactatttaaaatcggtagccattcattgtgcgttttagaacggataaccgtgaaatatttgctgtgtgatggtttcgttagaaaaatattacgattaagcactacatccgcatcaataacataacaatcactaaagaagtcttgtgccagagaaaaggaataaatgctgttatattcgcgatatttttcgttgtaaatcaaggtgcagtcatattttttctttagatactcgaattgttcgtgtaaataccctgtaacaatgacaatattgtcgatatttgcttgacgtagaaaagtgagtgtccgttctaagttaggtgtgccgtgaatatctaacaatgatttatgtgtgctttgtgtgatgtctttaaaacgactgcctaatcctgcagctaaaataatcgcattcatttttgttcccctttgtaataaagtgtaacgatcactcctgcacttaataataaggtgagtagtaaggtaatgggcttaattggctgtttatagagcagataaccaagtccaattgcccatacagaatatgtgatatttaatgccattgctttgattggttttaacagataaatcgcttggtaatagcagcagtaagataatgcaccaaagattattacaccagcaatttgtacataattaaaactaagtatatctagtgagaaatttttcaaggaaagaataaatagaatcaataaataaccaatagttgaaccacatagtcttaaaaaatacacctgaagtccagagagagaacgcattgtataggaggatatcactatttcagatgaccaccctaatatgcaaatggctaaaaaaatgagaccgcttgtattgaagtttgctttttgcccgacttcaatagccaacaatgcagaagcaataaccgccaatccaaatccaaactgcgctgttctagagattttttcttttagaatccaataagacattaacgcagcgaaaacaggaaagagagatgaaagcggtgccgcataatagatcgttaaataatgaatgcttaataaataggcagacattcctattggcccacctaatacgccagataacgcaggttgccaaaaaacgccttgaaaatctaccgcactttttcgccataatgttatgccgataactaataacgagcaaaaatcaattaaaaaaagcaatgaaattattttccctaatgcatcatattcacttaatggcaattcattatataacaatccagataatgcccaaaatacagcggacagtatgccaaagagatagccacgcattatggcaattcctctaacagtttaaatgctgcgtctaagcgttttaatgcataatcgccaaaattctcgccgtgttcttcttttacttttgtccataaaaaccacaatacattttggcaaaagcgatggatttttaaccgtttgtgagcgatttgaaattctgtcttgtgatatttatttgtctgattgcaataggtttctaatagaaaatcagcagcttctttcgataaatgagcttcctcaatgatagtagctatatcaaatagcggatcatttaagcccgaatattcccaatcgataaaaaatagccgatcatcttgtaataacatattttcagggactaaatcattgtggcacggacgtaaaattatctctttattgatttcttcaaattgccaaaatacagctgaaagtttatccattctagaatcagcttgataaaaagcggatttgttttctagcaatgaaaaatattggcgaaactcatcgaatacgctaaatacattacggaaaacaaattcactattgtgtaaacgatataaattattcacaacttgagacaaacaactttgttcgtttaattgtatctggcttaaagtattactattttctaaataacgagtcagttttacgccacttttggcatctaatacgggagtttctacattcaagccagcacgatatgcctgagcattattgaatgcctcatattctcgatttataagtgataaatttacggcattagggatccgtaatacaaacttaactccagaaatattaagtagaacattttgattggtcattcctccaatggaggaaaaaggaatggaatgctgatgaagaaaatgaaatacttcttcaggcttgtagcaagttttaacaaatcctacaatttgattgattgattgattgattgattgattgattgattgattgattgattgattgattgattgcatagcatttttgtattcatttttatatttaaattttgtttgattttaacacgttaaagttatttttgtaaggctctgaatcttatgaatttattcaacttttgaacctttcaaccacttttttacccaagctcggttagctgaaagattatgtaatatgccttcgcttattggtaatggctcgccataaatgattgaagctaaggtttcgcctaatagtggagcagaggtaagcccgcgagaacctaaggctgcgattaagaaaatattctgaaaattggccgcactttggataggttgtttacggcggcggaggttaaatagattgtaataatccgcttgttgctgttcaaaatgaggcacgtttcccaccattggggcaagatctcttacagagcagcggatgcctacacgagcgagattatctgatgtattcacatcttgagtccaaggttgggcgatattttgttggagtttttgttggttttcttgttgttcttgttcactaaagtggcgatcaacattatcacgaacatggcttgcgccgatgcaatgtgaggtttttaattgattggctggagtaagatagccatcataacaaagcacagatttcagtttgagtaagttttctgatgttggaatttggctaacttgcccgcggatagggtagagcggtagcttttctgtttgaacaaaatcagtaattttatatccgttcgcaagaatgacgacttcatggcagtatttttgaccttgcgtattttctagttcccaacctttttcttgttgagaaagtgcggtaattttttgtgaggttttaatgattacaccttgcttttcaagaaatgaaaaggcattttgaacaaattgtcttggtgcaagccaagccccttgttcaatccaaccgccttcgcaattaagcggtaatcccactttttcactgagttgttcagcactcagcatttggaagatttcgttcggtaaaccaagttgagaaatctttgttaatttaaccgcacttttttcgttgtaagcacatagtgccacgccacaaaattcgtgctcaaactctatgttttgttcgatcgcccaatcaagtaattggcgaccgtagctaaaagcgtgcaggtaaaaatcaacggtgagcgcattatcatcgctaagttgcggataaaatgcgccttgtttattgcctgaggcattgagagcgagcgcatcatcttcacaataaatggtgacttttgccccacgttttactaaggaaatggctgcacaaaaagaagcgataccaccgccgataatagcgacatcttgtttttccattttcgcaggctgagcaagataccaaggtgtggaaagtacggtagattttgattgtatttttagcccacttaaacattcccgttttttgccaaagcctttacgttttgtcacattaaagcctgcggattcaagtccttttctaaccgcacttgctgcggtgaaagtggcaaaagaaccattgggttttgtgaaacgaaacattaatttatagagatcatcattccacatttcaggatttttgctcggcgcaaaaccatctaaaaaccaagcatcaatacgttcattcatataatcaccaagttgtggcaagttttctgatacattaccaagccataaatctaacgttgtctctccaaaatgaatacgatgacaacctagaatcaatgaaggccaataacgttgcaaatgagcgcttaaatcttcaaactgcggataggcaaggtgcgcttgcgaaagtgcggtgatttttagcggatatttttcaaaggaaataaaattaaggcgttttaaaggatgattctcgtgttgctggcgaaattcacggaataattgggttaccgcgaagaaatttaatcctgtaccaaatcctgtttcagcaatgacaaaattagcctcgttgtggcttatccaacgttcccaaagttgattaccttgtagaaaaacataatctgtttcggctaatccattttcgttagaaaaatagacatcattgaattgatctgagacgggaatatggtttcgattgaagtgaatctcagcatgttgcacgctaaaggtcattttattcctttcttgcctaatgaaatttgcgtataataacgcaattttctgaactggtcgaacaaatgaattattgcttgaaatatttttatttcgtagtaattttgtgccgttatttttacatataaaacaataaggaagaagcaatgagaagagctgtaattacaggctttgggattatttcaagtatcggtaacaacaaagaagaagtattggcttcattaaaagaagggaaatcaggtattgaagttgtgcctgagtttgtagaaatgaatatgcgtagccatgttgccggaacaatcaaattaaacccaagcgagcacattgatcgtaaagtgttccgttttatgggtgatgcagcggcttatgcttatctttctatgcgtgaagcgattgaagatgcaggcttaacagaagatcaagtttctaatgatcgtactggtttagtgattggtgcaggtacgggctctgcacataatcaattagtggcttgtgatgcggttcgtggccctcgcggtgtaaaagcgattggtccttacgctgtaacgaaaaccatggcatcaagtgtttcagcttgtttagcaacaccttataaaattcgtggtgtgaattattctatgagttctgcttgtgcaacctctgcacattgtattggtcatgcggttgaattaattcaattaggcaaacaagatatcgtttttgctggtggtgcagaagaattatcttgggaatgtgctactgagtttgatgcaatgggtgcagtttcaactaaatacaatgaaacgccagaaaaagcatctcgtgcttatgacgcaaatcgtgacggtttcgttattgcaggtggtggtgctgttgtggttgtggaagaattagaacacgcacttgctcgtggtgcaaaaatctacgcggaaattgtcggctatggcgcaacttctgacggttacgatatggttgcaccaagtggcgaaggtgcagagcgttgtatgaaacaggcaatggcaactgtagataccccaattgattacatcaacgtacacggtacatctacaccagttggtgacgtgaaagaattaggtgcaatcaaaaatgtatttggcgataaaatcccagcgatttcttcaactaaatcaatgacaggtcactctttaggggcggcgggtgcacacgaagcaatttacacgttgttaatgctggataatgattttattgcgccaagtattaatatcgaaaccttagatgaagccgctgaaggttgcaacatcgttactgagacgaaagaaaatgcaggattacaaactgtcatgtcaaatagctttggttttggtggtacaaatgcgacattaatttttaaacgttataacggttaaaacgattctatgaaaaagccactttcgattgaaagtggcttttttgtaaattaaaagaaaaattaagcaacgataccaaattgttctttcattaatgcttcaaagtcagtgcaaccaccaattggtttttcatcaataaagatttgtggtacggtttctactggcttaccaactgattttgataaatcttctttagtaatgccttctgcatgaatatccacataacgatagtcaaaatcagcaacttcgccttttaatttttcagcaaggttttttgcacgcacacagtaagggcagccaggacgaccaaaaataacaacgaacataagatttccttttttgagttaaacattctaggcaattctacctgatttttatcgtctacataaagtgtttttattcgtgtaatatacggaacatcgtagataataaattaaatgttatgaaattattaatgctttgccgcgaacctcgtctttatagttgccaacgcttaaaagaagctgctaaacgtcaagggcatgagatggatattttagatccgaatcgttgcctcttaaaactctcacaaaatccaccgcactttcagattttttatcaagaaaattcagggtctaaaccttatttattgcctgattatgatgcagttttgcctcgatttggcacaacaagtacacaaatgggatgctcagtcttacagcattttgaaggcaaagggactttttgtttaaatttatctcaggcatttttaaatgcacgtgataagtggaaaagtttgcaacttttgctgaagactggtgttcctgttcccaattcatttttaagtggcggtgaagtgcaagctcaggcgacgatacctcatatcagttcgccgacaattttaaaaatgctaaatggttcacaaggaattggggtaattttagctgaaaagccacaaagtgcggtgagcattatggaagcttttaagcaaactaatatatctatgttgcagcaagattttattgaagaagcgggcaatgcggatattcgttgttttgtgattggtgatcaagttgtagcaacgatgcaacgaatcggacaagatggcgagtttcgagcgaattgtcatcgtggtggaaaaactgaaaaaattatactaagcgatgacgagaaacagatagccattagagcaacaaaagccatcggtttagatgtggctggtgtggatttaattcgttcaaaaaatggattattggttttagaagtaaatgcaagcccaggcttagaaatgattgaaaaaacaagtggggttgatattgcagctgaaataattgattatattgaaataaatgcctttatcaatttaagataaaggcattttttaaaatattgtcaatttcaaccgcactttacgcgagcatatttacaactgcaaatgagactttcaataatgctgcgttgattaagtcgataaagaatgcacccaccattggaacgattaaaaatgctttgtgtgatggtccaaaacggctggtaacagcttgcatattagcgattgctgttggggttgcgcctaaaccaaaaccacagtgtccagcacttaatacgacggcatcgtaatctttacccattgctcgataagtaatgaagattgcaaaggcagccataaatgcgacttgaatagcaagaacaattaatacatcaattgctaaacctgcaagttcccaaagtcttaatgacattaaagcaattgctaaaaagatggataagcctacgctacctaatacgtcaatagcggattctgctacttggaaacggaaaatgttgcttaaaatattgcggacaataacaccagtgaataaacaccatacgaaagttggtaattggagtgcagtaccttttgtttgtacatctaaatattgaccaattaataaacatactgaaatcattgcaattgtttcaattaatgaacgtgcagtaattttacgtttataagttgggtgttcaaatgcttcttgaatgtcatcaacttcatcattttcaggattttcgccttgtttttggcgatttaataagaaacgagcgacaggaccaccgatgataccaccgaatactaaaccgaaagttgcacaggcaatggcaatttcagttgcaccttgtagattaaattgatgtgcaaatgtatccgcccaagcagctccagtgccgtgaccacctgttaaggttactgaacctgcaagtaaaccataagcgggatggattcctaatgccattgaacttgcaatgccaataacgttttgtccgaagattaataatgcagcaatgaatagaaatacaacgagtggctttccgcctttaattagacgggaaaagttggcacttaaaccgatagaagtaaaaaacactaacatcattgtggtttgtagatttttatcgaagttaaaggatgttccatcaattttgtgccaaattaaaagaccaatggcaacaataaagccgccaacaactggctctggaatgttaaatgtttttaatacattaatgcgtttaaccaaaaaatagcccaatagcaaaactaagcttgctaatgcaagggtttcatacgtgctaaaagtatagctcataaattggatctccctacgttatgtttaagtgatgtgttgtgttacggctcgactaccataatttcaagattggtatgtaatccacgtggtaatgtcgaaccttttctgcctcgttctgcgcggaacttttgcagatcttctggttttaatacaatttttcgttttccagaataaaattcaagacttgcttgatctgaaataagcaataattttgtcaatagttcgctacgatcttttgcattcgctgcgggaatagtgatcattttattgcctttaccttttgataataccggtaaatcttgtgctggaaaaatcaacattctgcctgctgatgtgattgcgacaacaagtgcggtagaatttatcaatgttttaggcttcaacactttggcattttctggtaaagaaatcaaggcttttccagccttgttacgtgcaattaaatcttcaaatttacaaataaaaccatatcctgcatcagaagccatcaataattcttgctgttcgctggccattacaacatattcaatggtcgcaccagtgggtaaattgagtttacctgtaagtggttcgccttgggagcgagcggaaggcaaggaaagcggatcgagtgcataactccgccccgtgctatcaatgaatacaacggcttgattacttttgccacaagcgtgagctagatagctatcgccagctttgtagcttaatgatttaggatcaatatcgtgtccttttgcacaacgtacccagcccatttctgataagatgacagtaactggttctgctggcgtcatatcactttcagagatcattttggcttcttcacgttcgaccagttgagacatacgtgggctggcatattttttcgcatcttcttgaatttcttttttgataagcgtattcaaacggcgttctgatcctaaaattgcttctaaatttaaccgctctttttcaagttcatcttgttctgctttgagttggttttcttctaatttcgctaaatgacgtaagcgtaaatttaaaatggcatcggcttgttcatcgcttaaattaaagcgtaccatcagctctgcttttggatcatcttcgtggcgtataatttcgataacttcatcaatatttaaaaaggctatcatcaagccttctaaaatatgcaagcgagagagtactttatctaagcgatattgaaggcgacgagtgaccgttgtgcgacggaagtcaagccattcatttaagatttctaataagccttttaccgctggtttatgatcaagcccgatcatattcatatttacacggtagtttttttcaagatctgtggtcgcaaataaatgtgccattaaggcatcagtatcgacgcgatttgagcgagggactagcacaatgcgaattggattttcgtgatcggcttcatctcgaatatcttctagcattggcagtttttttgccgtcatttgttcggctatttgtgcaataactttggatggcgaagattgatgtggaagcgcagaaataataatttcaccgtcttcttgtttccaagttgcacgcatttttattgagccacgaccttgctcataaattttacgaatttctgattttggcgaaataatttccgcttctgttggaaaatctgggccttgaacaatttcaagtacatcatctaatctcgctttaggattatctagcaacattactgccgcatcagcaatttcgttaatattgtgtggtggaatatctgtggccatccccaccgcaatacctgttgtgccgttcaataaaatatgaggtaaacgagcaggtaaatattgtggttcagccaaggttccatcaaagtttggttgataatctactgttccttgtccgagttcactcaacaagatttcagagattttagataggcgagattccgtataacgcatggcagcgaaggattttggatcatctggtgccccccagttaccttgaccatctacaagcggataacgataagagaagggttgtgccattaacaccatagcttcataacaagcgctgtcaccatgtggatggaatttaccaagtacatcaccgacggtacgagcagattttttgtattttgccgtggcatttaagccaagttcagacatcgcatatacaatacgacgttgaacgggttttaaaccatcaccgataaaaggcaacgcacgatccatgatgacatacatagaatagttgagataagccttttcagtgaaggtgcgtagaggcatttgctcaatgccttcatagttgatatttgtcatttttgtttctgttaattgatatattcttaatttattaaaattcggatttgctgagattaatttagtctaaacagataaatcaacctgatcgcctttcgcttgtaaccaatttttacggtcttcggaacgttttttcgctaataacatatccatcagttctaatgtatctgagccttgatcttcccctaaatcataagttaattgaacgagacggcgcgtattaggatccattgttgtttcacgcaattgcgatgggttcatttcacctaaacctttaaagcgttgaacattcggtttgccttttttgtttttcaaccgatctaaaatcgcctctttttcattttcatctaatgcgtagaagacttctttatttaagtcaatgcgataaagtggtggcattgcgacgtaaacgtgaccgtcttgtaccaatttcggaaaatgacgtaagaacagggcgcagagtagggtggcaatatgcagaccatcggagtcagcatccgcgagaatacagactttaccatagcgaagttgtgataaatcattgctgtcaggatcgatccctagagccacggcgatatcgtgaatttcggttgaacctaatacttgatcaggggaaacttcccatgtgtttaagattttcccacgtaacggcaaaatcgcttgatattcgcgatcacgtgcttgttttgctgagccgccagcagagtcgccctccactaaaaataattccgttttttctaaatcctgtgagccacaatcagctaattttcctggtaatgctgggccactaacgagtttttttcgcacgacttttttggcggcgcgtaatcggcgttgtgcagaactaatggcaatttctgctaatttttcagcatcttgtacattttgatttagccataggctgaacgcatcttttaaaacaccgctgacaaacaccgcactttggcgtgatgataagcgttcctttgtttgccctgcgaattgcgcatcctgcattttaagggaaagaatgtaagaacaacgatcccaaatatcatcggcggtaagttttaccccgcgtggtaatagatttctaaattcgcaaaattctcgaatggcatctaataaaccttgacgtagaccattaacatgcgttccgccttgaattgttggaattaagtttacgtagctttcgccaatcagttcaccaccttctggcaaccaaagtaatgcccagctaaccgcttcatttgttcctttaaattcgccaacaaatggtttttccggaagggtttcaaagccatttactgcttcgataaggtaatcggaaagcccatcttcatataaccaaatgtcttgagtattgtttactttatcaatgaatttgatttcaagccctgagcagagtaccgctttcgctcttaataaatggcgtaggcggctaacggaaaattttgcgctgtcaaaatattttggattcggtttgaagtgaacggttgttcccgttgtgcgtctaccacaagtcccgataatttccaattcttctactttactgccgttttcaaaggcaattttatagatttcgccattgcgtttgacttgaatatccacgcgttcagaaagcgcatttaccacagaaatccccacaccgtgtaaacctcccgcaaattcataatttttattggagaatttaccaccagcatgcagtttagtcaggattacttctacgccagaaacgccttccgtaggatgagtatccacaggcataccgcgaccattgtccgttacttcaatggattgatcagggtgtaaaattacttcaatttttgaggcaaaaccggcaagggcttcatctacgctgttatcaataacttcttgtgctaaatgattagggcgagtagtgtcagtgtacattcccgggcgaatttgcactggttcgagatctttaagaacggtaatttcttgagctgaataattggttgtcatggtgaggttattcgttaattttttaaatttgagaaaattctatcaaaaagtgcggtgatattcgaccgcacttttaatcgtataaactaggcgtcttttcatcggggcgcgttttaaaacggcgatgtagccacatatattgtgatatccccttcatgatttccttttctacgatttgattcattcgcgcagcaatcgccgtttcatcttgtaaatccgtaaaatcaacaggcgctgaaatactcacggtatagcctgaaccatctttattgcgtaatggcgcaaatggaatcactttgctgttttgtgaagatttcaataaataataactaccagtggttgtgcaagcatcgggtaccgcaaaaaagggaacaaaaacggcattttttctgccgtaatcgtgatcaggcgcataccaaatggtttcttcgtggcgtaaagctttgatcattccgcgtaaatctttacgatcaagcatatctttattagagcgtaaacgaccttgcgtttgtagccaatcaagcaaaggattatcatttggacgataaacgccaatgccgggatgatgcaaaccaagaatgcgcgcgccaagttctagcgttaagaaatgaacaccaacgagaacaattccatctttttgattttcttttagataatgtaagccttcaacttttgaccattttttgatacgtgaatccgaccaaaaccaagccatgccagtttcgataattgccatgcctacagagcggagattttcttgcaaaatcgcctcacggtcgttttcagacatatcaggaaaacaaagttcaagattacgacgtgcaatggctgctcgacgtttacccacttttaaatgtgaaaacagccaaccgagaccatgaccaatatggcgcaaaataggatagggaagacataaaatacttcgccaaattgccacgcctaaccaaaaaagccagtattttggggctaaaaagtgcggttgaaattgagggagtttttcgtttttcattgttctttccacgtaagttaggggcgtagtttatcgtaaatttgagttgtggtaaaattgccacaattttggttattcaaatagagagattttaaaatggctcaatattcagcagaatttaagcaagcaaaagtacttgtattaggcgacgtgatgcttgatcgttattggttcggcgcaaccaaccgtatttcaccagaagcaccagtgccagtagttcgtgtacaagaaaatgaagaacgcgcgggtggtgcagcaaatgtggcgatgaatattgcttcactcaatgtatccgttcagttaatgggattgattggacaagatgaaactggttctgcactttccctcttattagaaaaacaaaaaattgattgtaattttgttgcattagaaacccatccaactattactaaattacgtattttatctcgtcaccaacagttactccgccttgattttgaagaagatttcaataatgtagattgcaaggatttattagcgaagttagaaagtgcggtgaaaaattacggtgctttgattctttctgattacggcaaaggcacgcttaaagatgttcagaaaatgattcaaattgcacgcaaagcgaatgtgcctgtgttgatcgatccaaagggaactgattttgaacgctatcgtggtgcgacattattgacacccaatatgtctgaatttgaagccgttgtgggtaaatgtaatacagaagaagaaattattaagaagggtttaaaattaatttctgatattgaattaaccgcacttttggtaacgcgttctgaaaaaggcatgacattattacgcccaaatcaagagccttatcatttgccaaccgttgcaaaagaagtgtttgatgtgacgggagccggtgacactgtcattagcgtattagcaaccgcattagcagatggacgttcttttgaggaatcttgttacctagccaatgtagccgctggaattgtggtgggtaaattggggacttcaacggtttcgaccgtggaacttgaaaatgcgattcatgctcgtcctgaaactggatttggcattatgagtgaagcagaattaaaagatgctgtcgcacaagctaaagcgcgcggtgaaaaaattgtgatgactaatggctgttttgatattttgcatccagggcatatttcttatttagaaaatgcacgcaaattgggcgatcgtctaattgttgcggtaaacagcgacgattctgttaaacgcttaaaaggcgaaagtcgtccaattaataatcttgaaaaccgtatggcggtattggctggtttggcatccgtggactggttggtgcctttcactgaagatacaccacaacgtttaatcggcgaaattctaccagatcttttagtcaaaggtggcgattacaaacccgaagagattgcaggcagtaaagaagtttgggcaaacggtggcgatgttaaagtgctaaactttgaaaatggttgttcaacaacaaatgtgattgaaaaaattaaattattgaaagattaagtgaaaggttaggggctacttgtttatcataaaaaacaacgaaatataatgggaagtggaatataaccagatggttatccacagtttcgtggattaaaattagtttagtgttttttaagtaagcttggttgcttgtgttaaaggctctatctgaaatacaatatctctcgttttttattattttaattttatatgtcattaacttatctcgatttattttctggtgctggcggtctttctctaggatttgattatgctggatttcgccagttactttccattgagttagagccagtatattgtgaaacctaccgcgttaattttccgcatcatcgatcttgcaacaggatctaactcagttatctaatgaacaggcaaatctttaccgtagcgatattcccaaccgagggattgcaggcgttgaagagtgagttgttcgatatcgttttcgttgagcatgatgagttccttagtgtgtggtttaaatctcccctaacccctctttacaaaagaggggaatggtcttgagcgtagttttagtttaggtgttttcatgaataatttttctgttaattcgaccgcttgcagctaaacattccaaatagtccccctctttagcaaagaggggttaggggaaatttggcataggtgaaatgaaccttgtaagaaattagagcgtgtccatcaaccgttcatattctatttgctcaaactccaataccatttctctataggtatcaggatcttgagcaaataatgcttgtgaatatgaaattttatatattgtttccatttcatacgcctcatcaattaattcgttgattctttgattatcttcatattgtatcctttcacttctacggtaatcatttgtagcaatgtaaaagtgtagaataaatcctaaaattgcattggttgaatgaagtacaaataaagcaagatcactacttatttgtttgtgttctatatcttgaccgtgagaagcataactaccacattcgtttctaatttctgcaatataatgcaaaatcgaaccacaaaattatccgcactttcgggcggttggttacgcaaagcggcactagcacgtgcattggtatgcgatcctgatgtgttattacttgatgaaccaaccacttggatgtggaagttattgaatggctggaaaatttcttactggatttccaaggtagcattgtatttatttcccatgaccgttcttttattcgcaaaatggcaacacgcattgtggatttagatcgcggtcaattgcagtcttatctaggcaattacgatttatatttaaccacgaaagaagaaaatctacgcgttgaagccttgcaaaatgaattatttgataaacgtcttgcacaggaagaagtgtggattcgccaaggtatcaaggctcgccgtacaagaaatgaagggcgagtgcgagcattaaaagcgatgcgtgaggaacgtcagttaaagccttatcggggggagaacgaaatcgtttattactcgcaaaattgttgctcaaaccaaataatttattgattcttgacgaaccgaccaatgaccttgatgtagaaacattggagcttttagaagaaattttgactgattatcaaggcacattgttaattgtgagccacgaccgtcaatttatcgataatactgccacagaatgttatttattcgaaggtgaagggcatttgaataagtatgtgggaggattctttgatgcgaaacagcaacaagccaatttctgggcaagtaaagcagtggaagagcaggctaaagcgaagaaaactgaaccgctaaaagaagaaagtgcggtgaaaaatgaccgcacttctaagccgaaatccgtgaaactttcttataaagaacaacgtgagttagaacagctgccacaactattggaagagttggaaactaaaatcaccgtacttcaagctgaaatagccgatccagcatttttccaacaggctcacgatattaccgacgctaaattaaaagcattggcggatactgaagccgaattagaaacagcatttttacgctgggaagaattagaagaaaagaaaaatttggctgacggtaaagcttaaaaaaataacgcccaaaagggcgtttttttatgtattttcaagatgatcttttttcaaaatattttcttcatcaagtattgataaacgagcgatagcgtttcgataagaaatttcaagggtttctctgctggttgccattacgccttgatccactaaaaatccatcatttacatcatatacccagccgtgtaatgagagtttttgtccgcgttcccaagcactttttacaattgatgtgcgccctagattgtaaacctgttccgctacgttaattttagttagcatatcggcacgtttttctggagaaagtttaccgagaagatgaccgtgtttaaaccaaatatcacgaatatgaagaagccagttgttgataagccctaaatctttatctgccatagcagcgtgaattcccccgcagttggtgtgaccacagataataatatgttcaattttaagcacatcgacggcatattgcacaacagaaaggcaattaaaatctgtgtgaattacttggttagcaacattacgatgtacaaaaagctcacctggttcaagattcgtcaatttctcagcgggtacacggctatcagagcaaccaatccaaaggtaatgtggcgtttgatgatccgcaagttctttgaagtaagtagaattttcttctttcattctttgtgcccaactgtaattgttggcaaagagttgtttaattttatccattttactttccttaaaattctgaaaaaattaaccgcactttggcgtaagtgcggtcaatattaaagttaaattgaattagaaattcgcatttcttggcgcgcgtgggaatggaattacatcacgaatattttgaacgccagttacatagacgattaaacgttcaaaaccaagaccaaaaccagaatgtggaacactgccgtatttacgaagatcgcgataccaccaataatcatctggatttaatcccatttcttccatgcgtttatcaagcacctctaaacgttcttcacgttgtgaaccaccgatgatttcaccaattcctggagctaacacgtccattgccgccacagtttttccatcatcatttaaacgcatatagaatgctttaatgtcttttggatagtttttcaccacaactggtgatttgaaatattcttccgctaagaaacgttcgtgttcagaagaaagatcaatgccccaagaaacagggaattcaaatttcttaccagattttaataacacatcaatggcatcggtatagtcaatttgcgcaaaatctgagtttacaaagttttctaaacgagtaataacatctttatctacatgtttttcaaagaattgtaagtcgtctttacgctctgctaatactgcacgaaatacgtatttcaacatatcttctgcaagttttgcgttatccgctaaggttgcaaatgcaacttcaggttcaaccatccagaattcagctaagtgacgggtagtattcgagttttctgcacggaatgttgggccaaaagtataaattttgcttaatgcacaagcataggtttcgccgtttaactgacctgaaaccgttaaaaatgattctttaccgaagaaatcttggctgaaatccacttttccattttcactacgtggaagattttctaaatcaagtgtagaaacacggaacatttcacccgcaccttcagtgtctgatgcagtaattaatggggttgccacccagtagaaaccttgctcatggaagaaacggtgaattgcttgagacaagcaatgacgaacacgcgcgaccgcgccaataatattggtacgagggcgtaagtgagctacttcgcgtaaatattcgatagagtggcgttttgctgccattgggtaagtatctggatcttcaacaaaccctgtcacttccactttttctgcttgtaattcaaccgcttgtccttcagaaggtgattcaacgactttaccagttacaatcacagaacagcctgttgttaaacgtaaaatttcgctttcgtaatttttaatatcgttattaataattgcttgaattggatcaaagcaagaaccgtcataaaccgctaagaaagataagcctgctttagaatcgcgacgggtacgaacccaaccacgcacagtgacggtttcaccaatcgccactttcccttgtaatacatcaacaattgatgccactttagacatattaaacctctgtaactgaatgtaattcacataaaattgccgacagtttaccttaataaaggaaattttccataaaaatatagtgttggtgcgggctatgaacaataaaatcgccttaaaaatgagccctaaataaaatagggtaaagcctcattaatattgaatatacgcgattttatgttaaaatctcgggccaaaatcattatggctaataataggaaaaaatatgaaagttttagaaggctcagttgcagcacctaatgcaaaagttgcagtagcaattgctcgttttaacagttttattaatgaaagtttattagaaggcgcaattgatgcattaaaacgtatcggccaagtgaaagatgaaaatatcactatcgtgcgtaccccaggcgcgtatgagttgccattagttgctcgtcgtttagctgaaagtaaaaaatttgatgcgattgtggcattaggtacagttatccgtggtggtacagcacattttgaatatgtagcaggggaagcaagcagcggtttaggaaaagttgcaatggatgctgaaatccctgtcgcttttggtgtattaactacagaaaatattgaacaggcgattgaacgtgctggtactaaagcaggaaataaaggtgcagaagcagccttaaccgcacttgaaatggttaatcttattcaacaaattgatgcggcataaatcatgacagaacaaaaacaagtgaaaaagccttctgctcgtcgtcgtgcgcgtgagtgtactgttcaagccttgtattcttgggcagtatccggcaatactgcagaacaagtggaattagcctttgtgttagatcaagatatggatggggtagataaaccttacttccgtaaattatttcgtcaaacagtagaaaatattgaaaccgttgatttttcaatttcgccttatattgaccgcgcttttgatgagcttgatcctattgaaacggcaattttacgtttggccgtttatgaattgtgcttcgagttagatgtgccatataaagtggttatcaatgaagcgattgaagtggcaaaagtattcggtgcagatgaaagccataaatatatcaatggcgtacttgataaaatcgcaccagcattagggcgtaaataatccttttaaactgagaatggcgcgcgtttttaatgcgtgccttttcttttataagataggtgaaaaatggcaatgggtgaatttgatttaattaaacgatattttcagcaacaaatattagttgatgattccgttcaattatctattggcgacgattgtgcgctggtttccgtgccagagaattatcagcttgccattacgaccgatacaatggtggaaaatacgcattttttaccaaccatttcacctgaggacttggcttataaggcggttgcaacaaatttaagtgatcttgctgcaatgggggcacagccaaaatgggtttcactggcattaactttgccaaatgtagacgaaaattggatttcaacatttagccaaagtttattacacacgttaaaacaatacaacgtcacattaattggtggcgatactacaaaaggtaatttgtctattacgattacggcacaaggttttgtcgaaaaaaacaaaggaatttgtcggcataaagcacaaatcggtgatttaatttatgtttcaggcactttaggcgatagcgcggcaggtttaacacaaattttattgggcaaaagtgcggttgattctgatgatgtttttttgcaacaacgacatcttagacccacacctagaattgaacttgggcgggcgttaattgatattgctcatgctgccattgatctttccgatgggctaatatctgatttagggcatattcttgaacgaagtcaatgtagtgctgaagttgaactgactgcattacctctttcatcatcgattttaaataaatatgatcgcactcaagcggaacaatttgccttaagtggtggcgaagactatgaactttgttttaccataccgcccgaatataaagatgaattagaattacgcttgaaaaaactgaacgtgccttgcacttgtattggtaaaattaatgaaaagtgcggtgacttttctccccgttttttacgggatggaaaacctgtgaatataattttttcaagcggtttcgatcattttaaggaatcaaaatgacagaaaataatcctcttaaaaaaatctctcttttaaatcctattcatttgcttgccgttggttttggctcgggtttaatttatccagcacccggcacttgggggagcttagctggaacaattttaggtgtgattttactttccttattaggcgtaaaaatctttttaattttcaccgcactttgttttctactcggttgctacctttgccaaaaaactactgcagatatgggcgtacacgatcatggttctatcgtctgggatgaatttgtcggcgtatttattgtattagcagcgataccgtcattatcttggcaatggattttggctgcttttgcgttattccgcttttttgatattttaaaaccgtttccaattcgttattttgacgaaaaactcgaaaatggttttggcattatgatcgatgacgttttagcggcaatttatgctgtgattgttgtatttgctattcaatattggatgttgtgatgctaaatttaatcattgtgcatttatttggattaatgacgccagggcctgatttcttttatgtaagtcgaatggcggcaagtaactctcgtcgtaatacagtttgtggcattttaggcataacgcttggtatcgctttttggggaatgctttctatgttgggattggcggtgttgttcgttaccattccagcattacatggcgttattatgttgctaggcggtagttacttagcatatctcggttttttaatggctcgcagcaaaaaatacgctcaatttgaaccgcactctgatactgaatttaatcagcaaaccacaatcaaaaaagaaattttgaaagggcttttagtgaatttatccaatgcaaaagtcgtggtgtattttagtagcgtgatgtcgcttgtcttagtaaatatcactgaaatgtggcaaattatcttggcttttatggtgattgtggtagaaacattttgttatttttatgtgatttcattgattttttcacgtaatattgccaagcgtttatacagtcaatacagccgttatattgataatatggcaggtattgtatttttattttttggttgtgcgcttgtttataacggcatcaacgaaataattcattaatagaaaaggaagtaacatgacattaaaaattgcaatcgctggtgctggcggaagaatggggcgtcaattaattcaagcggttcattctgcggaaggcgtagaactaggtgcggcttttgaacgcaaaggatcatctttagttgggacggatgcgggagaattggcaggaattggtcatcttggcgttgcagtttcagacgatcttgaaagccaaaaagataaattcgatttattaatcgattttacccgaccagaaggctcccttgaacatattgcattttgcgtagcgaataataaaaaaatggtgatcggtacaacgggttttgatcaaaatggtaaagcagcgattaaagcagcttcagataaaattgctattgtgtttgcatcaaatttcagtgttggcgtgaatttagtcttcaagcttttagaaaaagcagcaaaagtgatgggggattattgcgatattgaagtgatcgaagctcatcaccgtcataaagttgatgcgccatctggcactgcactttctatgggcgaacatatcgcaaaaaccttaggtcgcgatttaaaaacgcacggagtcttctgccgtgaaggaattacaggcgaacgtaaacgggatgaaattggtttttcaactattcgcgcttcggatgtggtgggggaacacacggtttggttcgcagatattggcgaacgtgtagaaatttcccataaagcatcaagccgaatgactttcgctaatggtgcagtgcgtgctggtaaatggttagaaaataaggcgaatggcttatttgatatgaccgatgtattagatttaaataatttataaatcaatttcaaggtcactttctacgtgacagcaacataataaaatctcatcaggttgaataaaggcaagaggcatttctttataagacaccttgccttttttgatcttaacgcgacaagaaccacaatagccactacggcattgatattcgtgatgaatattatttttctcgagatgatcaagtaaacttgtttcattattgaattctaatgtggtgttatggcggataaggtggattttcataataacgatatgttgtaatttgtcgtactattatataaggaaaagatgaaattattgataaaaacttcacttagtcagtggatttgcttgaattttgccaaaattcctatttttaaaatgctaggttttataaccgcactttttattacggcttgtagttctattagcaaagaaccagtgaagactgtggatatttatattaaaccttattattctgctgaaaatggaaaagcagaaaatgtatttgtacataaagaaattgatcctatgttacgtgaaaatacgctaaaaggttataaaagtacggtaaaatttttagaagaaaatccagctcgcatttcaccaatgacaatgtttaccttagccgctcgggcttacgattttggcttaagagatgaagcggttacttggttttatcgtggtcaaaatcgtttgatcaccgcactttatgtgttggatttaccaaaacaaacggtgcaggataatacagggttcagccatgttgtagggcagtttgttaatgcttatgcgttttgtgattttgataaacaaagtcgtgctgccgaaaatgcggtgaaatggacaattgcgcatccttatgaagtggttttcttaccagcattacccgcaaaatttgcagatcgtcaaaaagcgttaaaagaatcggaagaaaaattagttcaacgtttacaggaacaagcccgtttttttgctaatccaaaaaataaagaaaaatggcaaaaaaagcggtcagaaaattttgtgaatgaacgattttgttggtaacaagaaaaaatggaatagcgaatacgttattccatttttatttttgataagccaatgatttttcgcattattcttttactttttaaggacttggtattatcattactcggttttttattttatagagaaaagagaagcaggggaaactatgcaacatctgaacgagcttgttgagaaagcgaaattagcgattgaatccattcaggataaaagtttaacggctttggatgaaatccgtgtcgaatattttggtaagaaagggtattttacgcaattaatgcaagaattgcgtaacgtgtcagcagaagaacgtcctgcgatgggcgcaaaaattaacgaagcaaaacaagctgcgttagaatttttaaatgcaaaaaaaacggagtgggaacaggctgaacttaacgcaaaattagaaaaagaacgtgtagatgtcagtttaccaggtcgcaaagttgaaactggtggcttacacccagttaccatgacgattaatcgtgtaacaaaatttttctcagaacttggcttttcagttgaaaatggccctgaaattgaaagtgattattacaactttgatgcgttaaatattcctaaacatcacccagcacgtgccgatcacgatactttctggtttaatccagaattattacttcgtactcaaacttctggcgtgcaaattcgtactatggaaaaaatgcagccaccaattcgcattatggctccaggacgtgtatatcgtaatgactacgatcaaacgcatacgccaatgttccatcaaattgaactactttatgtggataaaaaagcaaatttcaccgaattgaaaggtttattgcacgatttcttacgcgctttctttgaagaagatttacaagtgcgtttccgtccatcttatttcccattcacagagccttcagcggaagtggatgtgatgggtaaaaatggtaaatggttagaagtgttgggctgcggtatggtgcatccaaatgtgttgcgtaacgttggtattgatccgaatgaatattctggttttgccgtgggaatgggtgttgagcgtttaacaatgttacgttataacgtaacagatttacgttcgttctttgaaaacgacttacgtttcttaaaacaatttaagtaatttctcggatttgaattaaaaggataacaacaaatgaaatttagtgaacagtgggtaagagaatgggtgaaccctgcggtgtccaccgagcaattatgcgagcaaattaccatgcttggcttagaagtagatggcgtggaaagcgttgcgggtacatttaatggtgtcgttgttggtgaagtagtggaatgtgcacaacatccagatgcagataaattacgtgtaactaaagtgaacgtaggcggtgatcgtttattggatatcgtgtgtggcgcagcaaattgtcgtcaaggcttaaaagtggcttgtgcaacagaaggtgcggtattacctggcgatttcaaaattaagaaaacgaaattacgtggtcagccatcagaagggatgctttgttcattttctgaattaggtattgatgttgaagcggatggtattattgaattgccacttgatgcaccaattggtactgatttacgtgaatatttagctttagatgataatgccatcgaaattagcttaacgccaaaccgtgcagattgtttgagcatcgcaggtattgcgcgtgaaattggtgtggtaaataaacaactcgtaaatcaaccgcactttgaagcagtgccagcaacaatttctgataaagttcaaattgatttacaagcaccagaagcttgcccgcgttatttattacgtgtgataaagaacgtcaatgtaaaagcaccatcgccaatgtggatgcaagaaaaattgcgtcgctgtggtattcgttctatcgatcctattgtcgatattactaactatattttgcttgagttcggtcagccaatgcacgcgtttgatgcagctaaagttacacaacctgttcaagttcgtttcgcgaaagagggggaagaattagtattattagatggctcaaccgcaaaacttcaatcaaatacgttattaattgctgaccaaaatgggcctttagcaatggcagggatctttggtggtgcaaccagtggcgtgaatagtgaaacgaaagatgtgattttagaatccgcatttttcgctccattagcgattgcaggccgtgcaagacaatatggtttacatactgatgcatcgcaccgttttgaacgtggtgtggattttgaattagcccgtaaagcaatggaacgagcaaccacattattacttgaaatctgtggtggtgaagcgggtgagatttgtgaagcaagcagtgaaactcatcttcctaaagtcaatacagttcaacttcgccgtagtaaattagatgcacttttaggtcatcatattgaaacaggaagcgtaacggaaattttccaccgtcttggtttcgatgttacttatgcaaatgatatttggacggtaacttctgcaagctggcgttttgatattgaaatcgaagaagatttaattgaagaagtggcgcgtatttatggttataacagcattccaaacaatgcgccattagcgcatctccgcatgcgtgagcacaaagaatctgatttagatttagctcgaattaagaccgcacttgtggatgcagattatcaagaagctattacttatagctttgtggatccaaaaattcaaagtttattacatccacataaagaagcacttgtattgccaaacccaatttctgtggaaatgtccgcaatgcgcgtgtctttaatcagcggtttattaggtgcagtgctttataaccaaaatcgccaacaatcccgtgttcgtttatttgaaacaggattacgttttgtgccagatgccaatgctgaatttggcgtgcgtcaagaatttgttttaagtgcggtgattactggaacggcaaaatctgaacattgggcaggtaaagcagagtctgtagatttctttgatcttaaaggcgatttagaatcagtactttctttaacagaaggtggtaatagagttcgttttgttgcaaaacaatttgatgcattacaccctggccaatctgctgctattgaattagatggtcaagaaattggttttattggtgcaattcatccatctattagtcaaaaacttggcttaaatggcaaaacgtttgtatttgaaattctttggaatgcaattgcggcacgtaatgtggtgcaagcaaaagaaatttctaaattcccagcaaaccgtcgtgatttagctttagtcgtcgcggatagcgtaccagcaggggaattaatcgcagcatgtaaacaagcaggtggcgaaaaattggtgcaagtgaacttgttcgatgtatatcaaggtgtgggcgtcgctgaaggctataagagtttagcgattagcttgactgtccaagataatgaaaaaacacttgaagatgaagaaattaatgcagtgatttcagcagtattagcggaggtaaaacaacgctttaatgctgaattaagggattaatatggctacgataactaaacttgatattattgaatatttaagcgataaatatcacttatctaaacaagatacgaaaaatgtggtggagaactttttggaagagatccgcttatcgctagaatctggtcaagatgtgaaattatcaggatttggtaattttgaattacgcgataagtcatctcgcccagggcgtaacccaaaaacaggtgatgttgtgccagtttctgctcgccgagtagtgacatttaaacctgggcaaaagttacgtgcccgtgtagaaaaaactaaatagtaagcaacaaaaagtgcggtgaatttctaccgcactttttatatgaaaaggtatgaaagtatataaatcatttttaatcgctactgcctcgctgtttttattcgcttgttccagttttcaaaacgatgattatgcgatgaactataaaggtcaaatcggcgatcctattatggccatagccatgttgagcgaacaacaacatgaatgggctggtacaccttatgtgctcggcggcgtttctcgtcgtggggtagattgttctggttttgtgcagaaaactttcttcgatcgttttaatcttcgtttgcctagaagcactgttgaacaagctaattatggtaaacatgtacgcaaagaacatattcaaactggcgatttaattttctttaaaactggccgaggtcctaatggttatcatgtggggatttatgtaaaagaagataaattccttcatgcttccaccagagggggagtcgtctattcttcaatgaataacccttattggtcgaaagccttctggcaagtcagacggatttaaaaagtataatgctggaattttccagcattttttataatgatttttttcaaattagggagataaaaatgccctcaaacttaaccgcacttcaaattcaacttgaaattttacgccttattccaaaaactcgttttattaccgcagaagaaatcttacaaaaacttgctgatattggtgttcaacgtgatattcgttcaatccaacgcctgctagaaagtttgtctcaacagtttgaaattgagcgagatatgcgtgataaaccttatggatatcgatggaaatcaaatgctaaaggcttggatttaccgattttaaatgaacagcaatcacttgtgcttatgcttgctaaacaatatctcaatggcattttgccttctagcattatgaactcaatggaggcgttctttcaacaggccgaatataatttggtttatgacagccataaaaaatcaggggcagaatggcttaataaagttgctattgcaccaactagtcagccgttattacctgccaaaatcaatccagaaattttttctcaaattagtaccgcactttatcaaaatcgatttttacaggtgcattatcggagtattcacggtaaagaacataaggcacaggtcaagccattggctttggttcaacaaggaccaagtagctatttagtcgcacaatatgagaatggcgatattttacaccttgctttgcatcgcttgcttaaggtaacagtgagtacaatgatatttgaacgccctgattttaatttgaaatcttatgtagaaagccaaaagtttggttttacctatggtcgaaaaattcgattaactttccgcattaataaagatattggtggatttttaacagaaacaccattatcaatggatcaaacagtaaaagattgtggcactgaatatgaaatttccgctaccgtgattaagagcgctatgctggaatggtggatagcccattttggtgaagattaccaagaaattgaccgcacttatttagacgaaaatgcctaacgacataaattgtcgcttcatcttttatcattaagccatcaacagagagggcattaaaatgaagaaaattgtttatattgatatggataatgtgatggtagattttccatcaggtattgcaaaactagatgataaaaccaagcgagaatatgaaggtcgatatgatgaagtcgagggcatttttagcttaatggaacctatgccgaatgcgatttctgcggtgcataaattgatgaaaaaatatcatatttatgtgctttctactgcgccttggcataatccttctgcttggagtgataaagtaaaatggattcaacattatttcggtgaagaaaaaggttcagccttatataaacgattgattttatcccatcataaaaatctcaaccaaggtgattatttaattgatgatcgcactaaaaatggtgctggcaaatttcaaggcgagcatgttcattttggtacagaacagtttgctaataaaaggagcctgaaaaatgacagagaaaaataaaccaatttgcgtggtattaacgggagctggcattagtgccgaaagtggaattccaacttttagatcggaagatggtttgtgggcagggcataaagtagaagaagtttgtacgcccgaagccttgcaaaagaaccgtgcgaaagtgcttgatttctataaccaacgccgtaaaaatgcggcagcagctaagccaaacgctgcgcatctcgccttagttgaactagaaaaagcctatgatgtgagaatcatcacgcaaaatgtggatgatttacatgaacgtgccggcagctcgaaggtgttgcatttacacggtgaattaaataaagctcgcagtagctttgatgaaagttatattgtggattgttttggtgatcagaaattagaagataaagatccaaatggacacccaatgcgcccttacatcgtcttttttggtgaaatggtgccgatgctagaacgagcggttgatattgtggaacaagcagatgttgtgttagtgattggcacttctttacaagtgtatccagccaatggcttagtcaatgaagccccaagaaaagcgccaatttatctgattgatcctaacccaaatacaggatttgttcgtaagcaagttattgcaatcaaagaaaaagcaggcgagggtgtgccaaaagtggtggcagagttattagagaacaccaaaaactcatagaaaaatgaccgcactttttaaacaaatagcgacttcggtcgctatttatcattttttctcttgcttaagcatatgcataataagcctaataagcgtttctttttgtttcggatcagattcagcaactaataaagtgagcgcggcaagcccagtatcattgataactgggtatccattatgatcaaacaaacgcccatttctatgtaagaaatctacaaataaaaatgcgccgctacgtttattaccatctgaaaaaggatgattcttgacgacaaaataaagtaaatgcgccgcttttgcttcaatgcttggataagcaggttcaccaaatacactttgatctaaattacctagaatcgcagataagccgttatctcgttcacgtccaaagagatcacttgcttcaccttttgtcatcagctgtgattttaactctgctagtgcagaaaaagcctcagcataagtcggtaatgtaccgccttgctgtgtttgtggttcggcaagtaaaccttcatcatattgttgtagccataaaaacgtatgcgtataacggctgacaatatccactaatccgcgaccgctttctagcgttaattccgatgaatttgccgttttttgaataagcgcaagtgcttgttctaattcgtgagcattttgctgtaaacgtttttggttaatggtatagccttgagtcagatattcttttaaacgtgcagttgcccaacggcggaaactaatgccttgtttagattttactctatagccaacagagataatcatatctaaatcataatgctcaatttcacgattgacttggcgtttaccttcttggcgaactatccggaatttccggatagttgattctttctcaagttcttcgtcatcaaatatattggtaatgtgctcattgatggtgcgaatatctttaccaaataacatagccatctgcgcttgggaaagccaaacggtgtcattttcaaatctcacttccacttgcgttgtgccatcttgagtttggtaaatttcaatcgggttttggttattcatattattttccttaataactaacatgtatatataaccagataaatatgcatattgcaatacagagcatcttatttgcaaaaaatcttctaaaaataaccgctttcaatattcacaaacgacacaagttgtcgcttcctttcatataatttctccataaagagaaattctttacttcttacatatttataaagcctttaattaagaaaaaggagcaaataatggcaatgaaagtaattatggcaagagatccactttttgaggatgtaaaaaaatatgtgcaacaacaaaaatttgcatcttgctcaatgattcaacgcagatttatgttgggttttaatcgagctgggcaaattttagaacagttggaacaagcgggtattatttcatcaatgaaaaatgggcagagaaaagtattatgaaaaatgatttgaattatgcagtggaacttatccgcaaagcggatggcattttaattacagctggtgcgggtatgagcgtggattctgggcttcccgatttccgcagcgttggcggattttggaatgcttatcctatgtttaaagaacataatatatcttttgaagagatcgcaacgccactagcttataagcataatcaggaactagcctattggttttatgggcatcgattagttcaataccgaaatactcttcctcacgaagggtatcagattttaaaatgctgggcgggagataaacctcatggatattttgtttttaccagtaatgttgatgggcattttcaaaaggctggttttaatgatagccatgtttatgaagtacatggtactttggagcgtcttcaatgtgtcaataattgtcgaggattaagttggtctgcatcaagttttcaacctgtcgtggataatgaaaacttatgtttaaccagtgaaaaaccacattgtccttattgtgggggctttgctcgtcaaaatgtactaatgtttaatgattggagttatgcaagtcaatatcaggattttaaaaaagtgcggttagaatcgtggttaaaagaagtgcaaaatctcgtcgttatcgaactgggagcaggaaaagccattccaactgtgcgtcgattttctgaacgtacggcgaaagcaaaaaaagggggggttatccgtattaacccacaagatgcaggcgtgccgaaaatgcactttttaagtctagaaatgaaagcgttagatgcactaaaagcgattgatcgccttctaaatccttctcaacaagcggttgaataatggaaaatttttgcgaaattaccttttgccaacaaattggcagcaacaagcgacgcaaccaagatgccctttttaatggcgaggcggtgtttcaatataaactcaaaacggctgaaaaacgccttgaaaaccgaccgcactttattgtgggcgtggcagatggtatttctaatagcaaccgacctgaaaaagcgagcaaattggctatgcaattattaagccaaatggaaagtataaaccgtcaaacgatctacgatttacaatccagtttatcagcagaattagctgaggattattttggttcggcgaccacatttgtggctgccgaaattgatcaaataacccgtaaagcgaaaattctcagcgtaggcgatagtcgtgcttatttaattgatgcccaaggaaaatggcaacaaatcacccaagatcattctattctttctgaattattgactgatttccccgataaaaaagaagaagattttgccaagatttatggcggcgtttcttcttgtttagtcgccgattattccgaatttcaagataaaattttttatcaagaaattgaaattcagcaaggggaaagtttattactttgttctgacggcttgaccgacgggctttcagatgaaatgcgcgaaaaaatttggcagaaatatcccgatgataaatatcgccttacggtttgccgcaagatgattgagaagcaatcgttttcggatgatttgtcggtagtttgttgtcattctattattgagtaaaaaatatgtttaaattgttttttttttgctcaattatctataattcggtgaattttaactagaaataaggaaaaactatgtttgaaaaaattgaacctactaatattcgttttattaaattaggcataaaaggatgttgggaaaaagattgtattgataaaaatagtacagcaagtacaaaaaatacgattcgtcttggctatgaatctacatcagagattcacaaagaatgtttgaataatcaatgggatagttgtattgaatattgtaaaacttattggagtgaccatacaggaactgtttcaaatcacttgagacaaattcaagatttttatcaacttggggaagatacactttggatcaccttctttggacgtaaattatattgggctttttgcagtaaagaggttgttgaggaaagcgatggttctagaacaagaaaagttattagtaacaatgggaattggtcttgcgttgatgctaacggtaaagagcttttagtcgataatcttgatggtagagtaacaaaggtccaagcctatagagggacgatttgtggtgttgagatggaggactatttaatacgtcgtataaatggtgaagttattgaggaaattacagaagcgaaagaggcgtatgaaacattaattaaatcagttgaaaaattaattaaaggtttatggtggagtgactttgaacttttaacggatcttgttttttctaaattaggatggcaacgatactctgttttaggtaaaacggagaaaggaatagatcttgatttgtattcgtcttcaacgcagaagagagtatttgtgcaaattaagtcagatacggatattaaacaattagacgaatatgtttcgaactttgaaagtgaatataaaaactatggttattcagaaatgtattacgtatatcattctggtttagaaaacatagatgaaaaacaatatcaagctaaaggaattaagcttgtaaatggccgaaaaatggcagagcttgtaattagtgctggtttagttgaatggttgattaacaaacgttcttaaaactatccttaacgacaccttttgtcgcactactcactaaaatactccttaccaacccagtaaggagtatttttttatgtctgaatataaattaaacccaccgacagtgtcttcttatactgaaaatatgatgcttaaagttttatttgagcataaaggtttttccgaagtgtttcgggagactagctggcgaagtgatgaaattgccagtgcatttgggctgcctgaagaattgagagaatgataaaaatttacgcacggttgctcgtcggcttttaaaagagcggtataaaaaactccaaaaatccaccgcacttttacctgagttatggaaacaggcgtatgaaaatttggcaacgttggcagaatttttgcaactgaatcccgttgaacaggaacttctccgctttgccatgcatttacgtagtgaaggagctatgcgagatttgtttggctacttgccgaaatcggatttacaaagaacggctgcgatcatggcggatttacttaaacagccgaaaaatcagattctatctgccttaaagaaaggcagtaaactcgatgcttatggcctgattgatcgcgattatcgccccgatagtgtgcatgattatttagattggggcgaaaccttagattttgatgaatttgtgacacaaccattaaacgaaaacgtcctattaaaatcttgtacggaagtcgctcaagtgccaagtctgcaactggatgattttgaccatattgccggcatgaaagagatgatgttgacttatttgcaacaagcactaaaacatcatcgaaaaggcgtgaatcttttaatttatggcgtgcctggcactggtaaaacagaattcgccgggttgcttgcacaggcgttggggatttcggcgtataacattacttacatggattctgacggagatgttgtggaggcagagcaacgcctgaactacagtcgtcttgctcaaacgctattgaacggcaagcaggcgcttttaatttttgatgaaattgaagatgtgtttaacggctcgtttatggagcgttctgttgcacaaaaaaataaagcgtggacaaatcagttattggaaaacaataacgtgccgatgatttggttatctaactctgtttcgggcatagatcctgcttttttacgccgctttgattttattttagaaatgccagatttgccgttgaaaaataagtcagcactgattacgcaactgactgagggaaaattaagtccggcctatgtgcagcattttgctaaagtgcggtcattaacgccggcgattttaagccgcacaattcgggtggcaaaggaactcaatacatcaaattttgctgagactttgctcatgatgtttaatcaaacgttaaaatcgcaaaataaaccgaaaattgaaccgcttgttttaggcaaagccgactacaacttggattatgtggcttgtaacgacaatattcatcgtattagtgaagggttaaaacggtcgaaaaaagggcgaatttgttgctatggcccgccgggaacaggaaaaactgcttgggcagcgtggcttgcggaacagttggacatgccgctattgctaagacaaggctcagatttacttaatccttatgtgggcgggacagaacaaaatattgctcaagcctttgaacaagcgaaagccgataatgcaatattggtgctagatgaagtagatacgttcttattttctagagaaggcgcaaatcgaagctgggagcgttcgcaagtgaatgaaatgctaacacaaattgaacgctttgagggcctgatggtggtatcaacaaatttaattgaggttcttgatcacgcagctttacgccgttttgatttaaaattgaagtttgattatttaacgctcaaacaacgcttagattttgctaaacaacaagcagaaattttaggattgccgttgttatcggaagaggatttaagtcagattgaatcgcttaatctgctgacaccaggggattttgctgcagtggctcgtcgtcaccaattttccccttttcacaaggtgcaagattggctgatggcactacaaggggaatgtgaagtgaaaccagcgttttctgcaacgacaaggcggatagggttctaaacagccatacaacattccgatgattatcaaagatccaaactctgatcgtgtaaatcaagaagatgataaccttgtttatcttcacgacttaacttcaacagtctttgatttagccaatcaaaaagtgccagaaagttttgaagggcagagcattcttccgattatgcgccaacaccaagataaccaacgaaaaggtgtacttggtcagcttgcggggcattttgtgtattttgaacagcgtatgtggcgtcgtaaagattacaaactcgtatttaatgcgactgatgtttgcgaactttacaacatccgtaacgatccagaagaaatgcacaatttgttttatgatcctcaatataacagaatcaaaaaagagatgttggaagaaattcgtgcagagatgaaacgtctgaatgacccactggaaaattgggtttatcgaattattgacgaaatttaatcaaagtcgtagattaagggcgtatctgatacgccctttgttatctctgcaccttatttatcttttaaaataggaataaacatgaaaacaacattactaaaaacactgacaccagaacttcatcttgttcaacataatgatattcccattctttatctaaaacacgctgttggaacagcaaaaatttccctgcaaggggcacagcttatcagttggaaaccgcaaaatgcgaagcaagatgtattatggctaagtgaagtagagccattcaaaaatggcaatgctattcgtggtggtgtaccgatttgctatccttggtttggtggcgtaaaacaacctgcgcacggcacagctcgtattcgtttatggcagttaagccattatgatatttcagcccataaagtgcggttagaatttgagttgttttctgatttaaatattatcgaagcgaaaattgctatggtatttacagacaaatgtcatttaacttttacccattatggcgaagaatcagcccaagcagcattacatacctattttaatattggggatattaatcaagtggaagtacaaggtttacctgaaacttgttttaatagcttaaaccaacaacaagaaaatgttccgtcaccgcgtcacatttctgaaaatgttgattgcgtttattccgcagaaaacatgcagaatcaaatcctagataaaagtttcaatcgtacaattgcactgcatcatcataatgcaagtcaatttgtcctttggaatccttggcacaaaaagacgagtggaatgagtgaaactggctatcaaacgatgttgtgcttagaaactgcacgcattcatcacttacttgaatttggcgaaagtttaagcgtggaaatttcgcttaaaggctaaattttgttgcataagtggtgtgaatactatagaattcgtgggattttgctcgtttctcgcgggcaacaaatttgaaatcttttatttttagcgaaaagatttttactattaaccaatagaaggaatacgattattaaaaccgtaaaaaaagcaccggcagtaaatcgcccaaaccgtatcaatgaagagattcgtgtaaaagaagttcgtttaattgaccaaaatggtgaacaggcagggattgtttctattcaacaagccctagaaatggcagaacaagcagagcttgatcttgttgaaattagcccaaatgcagagccgccggtttgtcgcattatgaactacggtaaattcctttacgaaaaaagtaaaaccgctaaagaacaaaagaaaaaacaaaaagttgtgcaagttaaggaaattaaattccgccctggcacagacgaaggtgactatcaagttaaattacgcagcttaatccgtttcttagaagacggtgacaaagcgaaaattaccgtgcgtttccgcggtcgtgaaatggctcatcaagacatcggtttagatgtattagagcgcgtaaaaaatgatttagctgaaatttcagtggttgaatctgcaccaggtaaattagaaggccgtcaggctgtaatggtgttagcaccgaagaaaaaataagaattttgctgagattcttcagcaaatctttttgtttaagtttgacttaaatgaaaagacaactgcatgttaggcacactacgcagcctaactgcttttgaaaaggcaatttaatttgccttatgatggaaatgatcagtgcttccaagtaactttataagttcgcctgattatgttgttttaaacgaaaaatgcggagttattttaacaatgcctaaaatcaaaacagtacgcggcgcagcgaagcgcttcaaaaaaactgcttctggtggtttcaagcgtaaacaatctcacttacgtcatattttgactaaaaaaacaactaaacgtaaacgtcatttacgtcataaatcaatggttgcgaaagcagaccaagttttagtagtagcttgcttaccatacgcataagccgttatttaagcaaaacgtacgattagttcattttagaaaaatattacataggagattaaataatggctcgtgtaaaacgtggtgttattgcaagagcacgccataagaaagttcttaaggctgctaaaggttattatggtgcacgttcacgcgtgtatcgcgttgctttccaagcggtgatcaaagctggtcaatacgcatatcgtgaccgtcgtcaacgtaaacgtcaattccgtcaattatggattgcacgtatcaacgctgcagcgcgtcaaaacggtttatcttacagcaaattcatcaacggcttgaaaaaagcatctgttgaaatcgaccgtaagattcttgctgatatcgctgtattcgacaaagtagcgtttgctgcattagttgaaaaagcaaaatctgcactttaattttttaaagtttagataaagaagaattaggacgctgaaaagcgtcctttttttgcatttgtgacttcaaattttgtaaaatgatgccattagttctcatctgttaaaatctatggccgaaacaatcccactgaatcccatcacgctacctttaaatcaaattagcttaatcgaagcatctgctggtacgggaaaaacctacactattggttctttatatctccgacttttattaaaggcgggagaaaataatttttcacgtccattaaatgtggaagaaattctggtggtaacctttacggaaatggcaacagaagaactcaagaaaaaaattcgtgagcgtataacagatgcgattaataaactcactgcctttgctaaaacccaagataaatccgcatttaaaaatgatgaatttcttaccgcactttgtgataatttagatatttttgaggcaattcatcgcttaaagttagctgaacaaaatatggatctggcggcgatttataccattcacggtttttgtcgccgtatgttgatgcaatatgctttccattctggcattcatttcaatttagaattaataaaagatcaatctgatttattagttcgttttgctaatgaattttggcgagagcatttttatccgttggattttgaatctgcgaattttatcgcgacagaattagtatcaccagcaaaggtgttgtctttgttgaaagcggatttaggtaaagatttgcaggtggagattgaaaataaacaggcgttatctgtaccaatacaaatctttttaccgcaatatcttggtggttatcaaaaggcgttgaatgaattaaaggcattttggttagaaagtgcggatgaaattttagcgattattaccaatgaactggagaaagattatccaaaagatcagttgaaatcgttaaatcgtaaaaagtaccaagtaaagcgtttaggggattggattaataaaatcaatcaatggtcaaataatcctagagattatcaaattaataccacattgaaagactatttcctacaatcatctattgagaaaaattgcgaagaatcaacggataaaaataaagataaaaaacccgcaacgcctttttattccccgatttttgcagagcttgaaaagcgcgttaatgccttaatgacaccagatttactaagcaaactcactctttatcattatcgacaaggcttacaacaaaaacttttagactataaactaaatcatcaagaaaaatcctttgatgatttattgcgtttgctttgtgaagccctgcaagatgcgcaaggggatgaattagcggaaatgattcgtttccaatatccttttgcgatgattgatgaatttcaggatacggattcacaacaatacgctattttttcaaaaatttatcgtgataatcccgaaaaaaatactggttttattatgattggtgatccgaagcaggcgatttatcgtttccgtggcgcagatatttttacttatctaaaagcctcagacgaagcccaatctcgctttgaactcactaaaaattatcgttcagagaagcatttggttgatggtgtaaatgctttattcgattttcctcaatcgccatttatttatcaaaatattaaatttactgctgttgattctcgtgatgatcatctgcgattttatttaaatggcaaagccgaaccagcttatcgtttttatctaactgaaagtgacaaagtgaataaaactgaaatggcaaaaatatgtgctatttctattcaacattggctaaaaagtgcggctgaaaatcaggcagtttttcaaaatgaagatactcgtaaaacattgcaagcggcaaatattgccgtattagtgcgtgataaaaatgaagcggctttagtaaaaaatgaattgcaaaaattagggatcgcgtcagtttatctttctgatcaaaatagcgtatttgatagcaatgttgcgaaagaattagcttgggtgcttaaagcctgtttgaatgtggcagaacgtccaattttgaacgcgattgcgaccgcactttttggcttaaatgcagcggatattcatcaaattcagcaaaatgaagcagattggcaacgttgggcagatagttttgctcaataccaacaaacttggcaacgccaaggaatattggcaatgttacatcaaattttattggagcaaggcatttcagaacgcttattaagccaagccacgggcgagcgagatttaacggatttcctacatttggcagaaattttacaacaagctgccacgctacacgaaagtgaatcggcattgctcagttggtttgaaaaacaaattcaaggcgaaggtcgtcaagaggctcaaattcgtttagaaagtgaacgccagttggtaaaaatagtgacaatccataaatctaaaggcttagaatatgatttagtttggctaccatttttagctgtgccgagcaaagatccaagtaaaaaagacatcaatatttattattctaaagaacgagatgaaaccttatgggatatagaaaatcgcaatttaaacgctctttgtgaagaaacttttgctgaagaattacgtttactttatgtggctttaacacgtgccaaatatcaaatggcattcgcgttgcctgcacaatttgataaaaaatggaatgccttacattatgtattaagccaaggtgaaataggcaaggaaataaatttgtcgaattctaaagataccgagacgttgttgcaagcctttaaagaaaaaatgcgagataatgtggaaatctgtactaagccaaatctagaggcttttccggctttatctatcaatacaaaaaatgatgagcttaaagccgcagaatttacgggcaatattgagcaagattggcgaataaccagttttacttcaattgaacaaggtcatcgccgacaaaattatttcgctgaaagtgcggagaaaaaacacgctgtttttgatgacgcaaaagattacgatagtcaaaatgctattgaaatatccaccgcacttttaaacgaaaatgaatcaaatattttagatttaccacgaggtaaacaagtcgggactgcattgcatcgccattttgaaaattgctatttttctgatttagcaaatatagaagaaattgacaaattaagacaatccttacagttagatgaaacttttacagagccgctacaaaattggctacaacagatttcacatacgccactttctcatgaaataggaatagcattagctgatttggcaaataaagattgcattaaagaaatgccattttatctggctatttgggaacattttgatgttgaagagtttaatcgcacattgaaagcccatcatcatttaccaagcgagccacttcaatttgagcaaattcaaggaatggtgagaggttcaattgacttagttttccgccataatggaaaatattatcttattgattataaatctaatttcttaggttcaacccttgctgactacaatcaagaggcattgaaaaaagaaatgttacacagtcactatgattggcaatatttaatttatacgctggcattacatcgttatttacaaagcgttgtgcctcattacgattatgcacgagatttcggcggggtattttatcttttcttacgtggaatgaacggtgaaccacaatctggcgtattttacgatcgtccaagcgttgaattaatcacagaattagacggggtgttttaatgttatctgtattacacaaacttaaagagcagcgcattctttctcaaggtgattattattttgctaagttgatagctgataaacaatgtcatacggattatgcggaaccaatcaaaaatttagctatattattagccgcactttgtagttggcgttatacgcagggaaatacttgcagccaattagatcgctatttagaacataatttatttggcttggcttatcgcactacagaagaagactatttagctgaaattcgtgaaaagattggttatttagctgtggaagattggcaaaatgcgttgtgcgggcatatggcatttacgcaagatcccgtcaatcaaattgcaccaatggtatttcaatttggcgcgttgtatttctatcgtacttggcaagatgaatatcgtatcgcgcaatatataaaaaacactttaaaaaaacaccgcactttagccttttcttatgatgaaattcatcaaaaattagagaaatatttccctgaaaaacaggaaaaaacagattggcaaaaagtggcagtggcgacagcgattaaaagtccattttcgattattacgggtggcccaggaacaggaaaaaccacgacagttacgcgtttattgctcgttctacaagaattatttgattgtaaattacacatcaaattggttgcaccgactggcaaagccgcctcccgtttggaagagtcgattaaaaatgcgttaggttttatgcaagaaaaaatgaatgtatcccattcacttttcaatgcgattccacaaaaagccagcaccttgcatagtttactgggcgtgaacgcctttaatgattacacgcgctataacagccataaccctttgcaattagatgtgttagttgtcgatgaaacatcaatgattgatttgccgatgatggtaaaacttatcaatgcgttaaagcccgaaacccgattaattttattaggcgatcaggcacaattagcctctgttgaggcgggggctgtattgggggaattagctcaatttgttactcaaccttatagtcatgaacaagtcgcatacttactagcaacaacaggctacaaagtagaaggttccgattgttcaaatccaatacgtgattgcttatgccatctaacagaaagtcgccgttttgataaagattcaggcattggaaaattggctgaattcattcaaaaaggcaaagcagacgatagccttgagttatttgaccattatccgcaagaattgcactttaatgccctaaatgatgaaagcgatgcggtcaatcaagtggtgaaaagtgcggtggaaaattaccgcactttcttaaaaatgttggacgatttacgtaaacaaaaaattgatcctaacgctaaaaatgaacaaggcatttcctatgccgaagccattcaagcgcaatttaattctgtgagatttttaaccgcacttcgtaataacaatttaggtgtcgaaaatctcaataaagaaattgcgttagcgttgcgagagcaaaaattgctttggttccgtaatgaacaagattggtatatcggcaagccaattatgattactgaaaatgatcataacgttcgcctttataacggcgatattggactatgcttggcaaatggcaaagtatggtttggcaatcgagaagtgctgacaaaccgaattccagcgcacgaacccgcttttatgatgacgattcataaatctcaaggttccgaatttgaacacactgtcatggtgcttccaacagaagtaaatccagtactgtcgcgagaattagttttcacgggcgtcactcgtgcgaaaaaagaactcactgtatttgccgatgaaaaaatatggaaaacagcgattcgtcagaccgtcaaacgccagagcggattgggaaaattattggaagatttaaattagtaaaaggcggtaaatttggaagataaatcaatcagataatctccatttaaaataacttttggggaagattattttaataaattcttcaaactggttttcattgctgccatttgattttcaaattgtgccttgctttctctttcgtcaatcatataggtaattgtttccgaaagtgtcatcttcatttttcgagaatatttagaaagacgtagccaaacagcatattccaaatcaatggattttttcttggtatgttgtttttctccattaaaaaagcgtttacggcgggcacgaatggcttgatcaagcttaattggtaaggctggagaaagatgatttttaatccattcttcaatttgtgaaggataattttgggattctaataattcttgggctttagcttcttgcaaactacgttcttcgtagcgagtaatattttccccttcgcgatgtttacgaattaggtaaatccatttccaatttgattcttgattttcgagtttttggtatttcattttttatcattgagtgacgtggtaactgcattaatatacgtgtttttatgccgattttctagtggattttcacaaggctattaaatatgcgataatgtggtcaatttttctagaaagagaccagccgtgagttcattattttctcaacaacaagctattgagcaatctttaaattggcaggcattacaacctgatttggtaattcaagattttcctttagaaccagtggatttctgggcgttacaaccgaatgctacacagggtatcgatttatttttacgtcatccgacacgttccttactaatgatgaaagtgggcgaacctgttgaatatgcggagttattacaaaattttatatcgcaaaatcatcataaagtgcggtcaatttttggtgtaaattatgtgatagagcagggcgactctttttcttttcctcatgtttatactgagccagcaaaatctttagatgataattttgctagtcaaggagaggcgttaagtgcattgtattgcgatcaattccagcttttcggtagttttcggattcatccaagttcacaagatattcaattagtgccgggattggtgcataaggctaatggtggcgttttgattttaagtgcggcaacattgttatctcaatttgatttatgggggcgattaaaacaaattctgcaaacccagacttttgactggtattcagcccatccatttaaaaatttaccttgtgatataccaagctatgcgctgaacttaaaagtgattgtacttggtaatcgtactgaattagccactttggctgagttagaagaaaatctttattctttcgccgattatgctgaaattgaaagttatatttctgtagctgaagtggaggaacaaaaaacttgggcgagttatgtacaacaaatggctcaagagcaaaatattgagctagattttcttgctttaaataaactctatcaattattagttcgtgaaagtgaaaatcgctttttaattaatgcatctcctctcaaattaaaagaaatattacaggatgcttcaacttttgctgaaaaaactgcattaagtgcggtggattttgagggtatttttcaacaaaaattagcacaatatggtttcttaaaagaacaaacttatgccgatattttaaacgagcaagtttatgtcgaaacgcaaggcgaaattgttggacaaattaatgggctttcggtaattgaatatcctggtacgccagtatgtttcggcgaaccttcgcgtattagttgtattgtgcaatttggcgatggggaagtgattgatgttgaaagaaaaaatgaactagcgggaaatattcacggtaaaggcatgatgattgcgcaagcttgcctttccaatatcttagatttgccctcgcaattgccattttctgcctcattagtgtttgaacagtcttatggtgaaattgatggtgatagtgcatctttggcgattttctgtgtgctagcaagcgctttagctgatttgcctttgcctcaacatatcgcaattacaggatcgattgatcaatttggacttgttcattctgttggtggtgtaaatgataaaattgaaggcttttttactatttgccaacgtcgcggtttgactggaaaacaaggtgtaatcattccaatgacgactattcagcaactgagtttgtctaatgaagtgaaaagtgcggtaaaaaatggcgagttttttatttatcctgtggaagatatttatcaggcttgtgaattgttatttgggcgtgatttgttagatgaaaacaaagattatacagaaaaaactgagcctttatctcgtcttattcaacgtcgtattgagggacgtgccgattctgaacgaaaaagtttttggcattttttccgctcctaatagagaaaagcgagcattttttcgcttttctttttttctataatttctaagagtgactgctccgacaagttttgcgaacaagtgttagctatttacagtttactgcgttcattttaaaatagatatatcagttataaactggatttatcatatataaaggaatctgaaatgcaaaacacttgtacacttaataaaaaaaatagctattcttatgatgatttgctcgcatcaggtcgcggcgaattattcggtaaagaagggccgcaattacccgcgccaacaatgttgatgatggatcgtatagttgaaatgaatgaagaaacaggtactttcggtaaaggatacattgaagccgaacttgatattaagcctgaattgccattttttggctgccatttcattggcgatccagtaatgcccggttgtttaggattggatgcgatgtggcagcttgttgggttttatttaggctggattggtggcaaaggaaaagggcgagcattaggggttggcgaagtgaaattcactgggcaaattttgccgacagcgaaaaaagtagtttacagaatccatatgaaacgagtaattaatcgtaaactagttatgggaatggctgatggcgaagttgaagtagatggtcgtgttatttataccgcgacagatttaaaagtaggactattccaagatacctcagcattttaatttttctttattaatttatataaaagtgcggtgaaaatttttcttagattttcaccgcatttttccttattaaattgtaataaattcttaaaatatctataatattcttgctattttttcaattttattagtagtaaataaaatttattttaaagctttttaatagacgttattatagaaaataataaattaatttctatttaaactataaataatatactgaagtagtgggaatatgatggcaaatgatgattttcaagaatatgtgaagcaactggtaacaaaacatcgagatgaacgaatttatccttttcaatatgaaggaaaaaaatattggttgaaacaacctgaaaaattgaaagggatttggctattattaaaaccccatcctaaaaaatcttttaaaaatgaattacatactttattgaagcttgctgaacaaaatgcgccagtgccaaaagtctcttattatagtgatcatttttttgtgttggaaaatgtgggactgactgtatcacaatggctatgcaataaaaatatagatgaacaacagaaatttttaattatttatgatgcttgtctcgctttgattgatttgcacgctaaaaatttgatacacggtcgtcctgctattagagatattacttgggataaagggaaggttacttttcttgattttgaatctcgtgcaaatagtcaaaatcaaaattgggtagttattcgggatatgttatttttctttgatagtttatgtcgagaagaagatatttcagacgattttattcaaaaagtagcgttgtattatcaagcttattgtagagtagaaaattggcagaatatgatcgtatttttgcagcgttttcgctgggtttattatcttttattgccttttaaaccttttgcaaagaaagatttaattgcagtttatcgcttatttgaaattttattaataaagaaaaaatgatgaagaaaatattttttatttttgtattatcaggcatattagctgcttgtgccatgggtggtggtattcgtgctggtggtggaagtaatggtgtaggattaggtgtggggattggatctggcattcgcttctaataatgaaaagtgcggcaagtttgatctttatcttgcattttagcgtattcatcgctagaatgcgggctccttatcatcgctgagttagagatcggcgaatgatgtattaacaacactaccttttaggagtaaaaaatgtctctaagtactgaaaaaaaagcagcaatcgttgctgaatttggtcgtgatgcgaaagatactggttcttctgaagttcaaatcgcattattaactgcacaaatcaaccacttacaagctcactttgcagagcataaaaaagaccaccatggtcgtcgtggtttattacgtatggtttctcgtcgtcgtaaacttttagactacttaaaacgtactgatcttgctttataccaaagcacaatcgctcgtttaggtttacgtcgctaattttttattacgatagtaaaaaatcaagccctagaatattgagggcttttttatggggctgtactagataactagaccaaactccccttaactaattgttttaaaatggaaatttgagattttatttcgctattgttaaaacgccattcacattcttttaaatacagctcaaaatgctctttgggaatgccattaaacttctgtaaatggcgttttgcgtgattccaaaaattcccaattccgtttatgtagttgtgattttcagcaaaatgcgtgctgtgattgatgcgaaaatggctaaattcactgacatcaagcatatcataactacgaaaggtatccgtgtacacaatgctatcaggcttaactttctttcggataattggcaataatgttgctgattgcacattaggaacaacgacggtataaaccttgcatttcatttgagaagcccgaataccgcgactttccctgcaacactgcgaccacgtttgccttttcgagtactgccgaaatagctttcatcggcttcaattttgccttcaaacatttccaaatgtgggcttgtttgataaatgagtaagcgtaatcgatgaaagtaatagtggctgtatttttgtttacattaaccaatttactggctgttcttgctgtgacacctgcgacaaacagttcaatgagtttattttgtttatgctgacttaagcgactttttctcattggtttattctaacctaaatgggatttttagttgttatctactacagcaccttaatatttatagagttcgttatataaattacgctcgaattgtactaatggggcacgttttgttttgctttctaaatcgcccgttgagtagccattaataaattgtacaaatgccactttttcccctcgcgcatttgtcataaagccagctaggttataaacgcctttcaaagaaccagttttagcaatcacgtttttcactaatggtgggctaattaatccacctcgcccactgatcgtgccatctacacctgcgatgggaaaagtttccattaaatgtaatttatcttcgtttttggcgatgtattctaaaacggatagcatcgttttaggtgccacaagattatggcgagatagacccgaaccatcggctaaaatgctattaccaaaacgaattccttgtttttgcaatatggatttaaccgctaatgtgcctaattgaaaggaggcggggcgtttatagtaattgaatgccaccgctcggaataatgaatcggcaatttggttatccgattttttcatcatttttttcaataaatcaggtaatggttttgataaatgtttcgctaatagctgaccttgttgtggtttttggggtaacaagactttgccattgaactcaatacctaattttcttaattgacgttgaataatcgcggcagcataagcatccgtattttgcacggcaaaacttaagccaaaaggtttatattgacgggctaaacatccttttacttgatagcgattattgtcgtgtacaacaacatcgagctgacaataaggcgcttcattgctatccgctacataaacttgtccgaacacttgaattggaaattgtgcaggcacattaatttttactatttcacctggatttttattcgcatctagttccgcataaaaacagttgttatcaatattcgcagctgctggtggagagttgaaacacattgtgagatcgttccaaatccaacctaatcctcggtcgtgactagaaaaaacagaggtatctaatactaaatcgccattaatttttttgatgccttgtttttttaattctgcaagtaagctataaagctgacctcttgtgagatcaggatcgcctgtgaaactcacgattaagttgccatctaaattcccattttgaattttcccattactcaaaagtgcggtctcaaattggaattgatcgcctaatgcaagtttagcggcaacggctgtaaaaactttttgtgtactcgcaggcagcataaaggttgagccattataatcagcaattatttgattttgattgatatttttagcaataacacctgcgttagagccttcaggcaatttttgtgttaaatctgaaacattaatattggcgaaagttggtaggctaaaactcactgaaagtaaaaaggaaccaagtgcggtggaaattgaagataattttttcatattaggtttgttatggttgctatttttttttagacgaacaataataagccccgaatgaaattgagtaaatcattttctcatttcaagtttatttttgataatactgcagtaagattttagaattttactgtggtttttgttttatttagtaaaaggaaaaacaatgcaacaaattccaatgactgtgcgtggcgcagaacaattacgagaagaattggatttcttaaaaaatgtacgtcgtccagaaattattaaagccatagcagaagcacgcgagcacggagatttaaaagaaaatgcagaatatcacgcagcgcgtgagcaacaaggtttttgtgaggggcgtattcaagagattgaaggtaaacttggtaatgctcaaattattgatgtcacaaaaatgccaaataatggtaaagtgatttttggtgcaacagttgtacttgtaaatacaaatacagacgaagaagtcacttatcgcattgtaggcgatgatgaggctgatattaaatctggtttaatttcggtaaactcgcccattgcgcgaggcttaattggtaaagaattagatgataccgttaatattacaacgcctggtggtgtcgttgagtttgatattattgaagtgaattatatttaaataaaaaagtgcggttaaaaatgaccgcacttttgttgttatttgcgtggaagctgaatttttgcttcttcgcttgggcgataaagcaccaaaatatgcccgatagtttgtacttgtgctgctttagtttcacgcacaatcgcattgataataagttgttttgtttcacgatctgcaccagcaacttttactttaatgagttcgtgatgattaagtgcattttcaatttcagcaagtacgccttcggttaagccatttccaccaagcataacgactgggttaagatggtgcgcaagaccttttaaaaattgtttttgtttggttgataaggttgtcataaggatccctaataaaaaagagcggttgattttctcaatgttttttactgatttcaatcagcttcggcttgaatttgacagattgtacccaaatataggcgaaacgactacaaaaaatagaagattatgggaaagaaaaaacgttcagcgagttcttctcgttggctgaatgaacattttagtgatcaatttgtgcaaaaagcacataagcaaaagttgcgatcacgcgcttattttaagattgatgaaattcagcaaacggataaattatttaaacaaggaatgaccgtggttgatctcggtgccgcaccaggcggttggtcacaatacgtagtaagccaaattggtggcaaaggtcgagtgattgcttgtgatattttagaaatggatcccattgtaggcgttgattttctgcaaggtgatttccgtgatgaaaacgttttgaatgctttgctagagcgcgtgggcgaagctaaagttgatgtggtaatgtctgatatggcaccaaattttagtggaatgccatcagtggatattccacgcgcaatgtatttggtcgagcttgctttagatatgtgtaaacaagtcttggcaagcaaaggaagttttgttgttaaagtctttcaaggggaaggctttgatgaatatttaagagaaattcgttctttatttaatgtggtaaaagtgcgtaagcctgaggcatcacgtggacgatctcgtgaagtatatattgtggcaacaggctataaaggataattgctttgatagcttttcattgctaatgatgtgtagtatcttgtgacgaaattttttaacttaggaaaggtaggttagactttgaacgatatggtcaaaaatctagtgctttgggtggtagtggcagtcattatgatgacagcataccaaagtttcaattcatcttcggtagaaaattctactgattatacaacctttgtttacgatgtaagcaacggacaagtgacagcggcacgttttgatgccaatgaaattacggtaacgaaaaccgatggttctaaatattcaaccgtaatgccaccacttgaagataaaaaattgcttgatgatttattaagcaaaaaagtgaaagtggaaggcacgccatttgaaagacgtggttttttatcccaaattttaatttcttggttcccaatgttattccttgttggtgtatgggtattctttatgcgtcaaatgcaaggcggtggcggcaaagcgatgagctttggtaaaagccgagccaaaatgttgaatcaagatcagattaaggtgacttttgcggatgtggctggttgcgatgaagcaaaagaagaagtgggcgaaatcgttgatttcttgcgtgatccgaataaattccaaaatttgggcggtaaaattccaaaaggtattttgatggtagggcctccaggtactggtaaaactttacttgctcgtgcgattgcgggagaggcaaaagttccattcttcactatttctggctctgatttcgtagaaatgtttgtaggtgttggcgcatcacgtgtacgtgatatgtttgaacaggctaagaaaaatgcaccttgcttaatcttcattgatgaaatcgatgcagtgggtcgccaacgtggtgcgggcttaggcggcggacacgatgagcgtgaacaaaccttaaaccaaatgctagttgaaatggatggctttagcggtaatgacggcgtaattgttattgcggcaactaaccgtccagatgtacttgatccagctttaactcgtccaggccgttttgaccggcaagtagttgttggcttacctgatgtgaaaggtcgtgagcaaatcttaaaagtgcatatgcgtaaagtgtctgttgcacaagatgttgatgcaatgacgttagcgcgtggtacgccgggctattctggtgcagatttagcaaatttagtcaatgaggcggctttgtttgctgctcgagtgaataaacgtacggtaaccatgcttgagtttgaaaaagcgaaagataaaatcaatatggggccagagcgtcgcactatgattatgacggataagcaaaaagaatccactgcttatcatgaagctggtcatgcgattgtggggtatttagtacctgagcatgatcctgtacataaagtgacgattattcctcgaggacgtgcgttgggtgtgacattcttcttacctgaaggtgatcaaattagtattagccaaaaacaattagaaagtaagctttctaccttgtatgcagggcgtttagcggaagatttgatttatggtgaagaaaatatctcaacaggtgcatcaaatgatattaaagtcgcaactaatatcgcgcgtaatatggtgacgcaatggggattctctgaaaagttaggtccgattctttatacagaagatgagggcgaggttttcttaggtcgttcaatggcgaaagcgaaacatatgtcagatgaaaccgctcatgcaattgatgaagaagtgcgtgcaattgtaaatcgcaactatgcgagagcaagagagattttgatcgacaatatggatattcttcatgcgatgaaagatgcattagtcaaatatgaaactattgaagaagaacaaattaaacaattgatgaatcgcgaacctgtcacaccgccatcaggttggggagagccgaaaactcagcaggctgcttatgcaaattcaacaacgaatgatacaaagcctgaaagtgcggtagaaaataccgacaattttaatgtttaacttatcaaagcctttcttcggaaaggctttattttttcctaatgatttttttcttggatgtatttcgctataatcgcccaccaaaatcactctaaaaattaaccgcactttatgaaactttacgcaaataataaatgtcttgatttaagcgttcctaagattatgggaatccttaattttacgcctgattctttttctgatagcggacagttttttagtttggataaagcgctttttcaagttgaaaaaatgttggaagaaggggcgacaattattgatattggtggtgaatctacgcgtcctaatgatgcggatgaagtctctgaacaagaagaattgcatcgtgttgtgccagtagtggaggcggtgcgaagccgttttgattgctggatttctgtcgattcttcaaaagcagttgtgatgcgtgaagcagcaagtgttggaatggatttgattaatgatattcgtgctttgcaagagccaaatgcgttagaaaccgcagtaaaactagctttacctgtttgtatcatgcatatgcaagggcaacctagaacgatgcaggcaaatcctcattatgagaatgtcgtacaagatgtattcgcttttttacagaaacgtactaatgaatgtctttctgctggtgttaaaaaagaaaacttaatttgggacatgggattttgttttggtaagtctgtacagcataattatcaattattacaaaatctgaatgaattttgtcatagtggatatcctgtgttagcgggattatctcgcaaatcaatgattggtgcggtgcttgataaacccgtcgatcagagagtgataggtagtgcggcaggtgcgcttattgcagcgcaaaaaggtgcaaaaattttacgcgtacatgatgttgctgcaacatcagatatgctcaaagtttggcaggcaacagaaaatgcctgatggttttataaaaaaattaaaggaattgtattatggcaaatcgtaaatattttggaacagatggtgtacgtggaaaagtaggtagttatccaattacaccagatttcgcattaaaattaggctgggctgcgggaaaagtattggcttctcaaggttctaaaatggttttaatcggtaaagacacccgaatttctggatatatgttggaatcagcccttgaagcaggtttggctgctgcgggtttatctgctgcatttactggccctatgcctacacctgctattgcttatttgaccagaacttttcgtgctgaagcgggtatcgtgatctcagcctctcataatccttattatgataatggcattaaattcttttcagcaaaaggcactaaattgcctgatgaaattgaagaagccattgaagcgatgttagagcaaccgatggattgtgtggaatctgccgaattaggtaaagcaagccgtattaatgacgcagcaggacgctacattgagttttgtaaaggtacatttccagcacacttaggcttggaaggttataagatcgtggtagattgtgcaaatggggcgacttatcatattgcacctaacgtattgagagagcttggtgcggaagtcattgaaattggtacagatccaaatggtttgaatattaatgaaaaatgtggtgcaactgatgtgacagcattgcaagctaaagtagttgaaacgaaagctgatgttggtttggcttatgatggcgatggtgaccgcattatgatggtcgatcatttaggaaataaagtcgatggcgaccaaattctctttattattgcacgtgaagcattgcgctcaggtcaattaaaaggcggtgtcgttggcaccttaatgagtaatatgagcttagagattgcgttgaaaatgcttggtgttcccttcttacgtgcaaatgtgggagaccgttatgtattggaaaaaatgcttgaaaatgattggacgcttgggggggagaattctggacatattatcattgcggataagaatacaactggcgatggcattgttgcgtcattggctgtattggcggcgatggcacagcataaattatcattaaatgaattagcaagtgcggttaaattattccctcaagtgttaatcaatgtacgttttgcgggtggggaaaatccacttgaaagtgatgctgtaaaatctgttgccgcagaggttgaaaaacgtttagaaggtaaaggtcgtattttattgcgtaaatcgggtacggaaccacttattcgtgttatggtggaatgccaagatgctgaacttgcacaacaatgtgcagaagaaattgcagaagccgtgaaaaaaattaattaatttttgaccgcacttagtaaagtgcggtttatttttataaagtttttaggaaagcaaaatgaacatttttattatgcgtcacggcgaatcggaagtaatggctaatagtgataaagctcgtcgcttaactgcttatggtattaaacaagctttttctcaaggagaatggttaaaacagcatttaagcacgctagtaattaattcactagaccgtattttagtgagcccttatgtcagagctcaagaaacctttcatcaagttaatcaagcgtttgatttggagttagaaaataaatttgaaatttgggagggaataaccccttatggccatgcacattccgtcattgattatttagaagtgctaaaagacgagggcgttaaatctgtattgattgtttcccatttgcccttagtgggagaaattgttgctgaactgtatggaaaacgaaatccaatatcattttatcctgcaactattgctcaattattatgggatggtaataaatcagaaatattgatgcatcaagcatctcctgtaatttatttaaaataaactattctttttttacaaaaaataaaatttttattggttttttatataatctattaaaaatcagtatcttagatgttgttttataaagtaatctttttaaagaaaggtaaagttttactattattgtttttctttttatgaaaattcccgtaaactaaactgcatcaaagtaatagggctttgtaataatcaaattattctatggagaaaataatgaaaaaattaacattagcattggttttaggttcagctttagccgtgacaggttgttttgataagcaagaagcaaaacaaaaagttgaggatacgaaacaaactgtagcatcagtcgcatcagaaacaaaagatgctgcagctaatacaatgactgaagtaaaggaaaaagcacagcagctttctacagacgtgaaaaataaagtagcagagaaagtggaagatgcgaaagaagtaattaaatcagcaacagaaacagcatcagaaaaagcaactgaaataaaagaggcagtttcagaaaaagcaagtgagatgaaagaagctgcatcagaaaaagcaagtgagatgaaagaagctgcatcagaaaaagcaagtgagatgaaagaagctgcatcagaaaaagcaagtgaaatgaaagaagctgcatcagaaaaagcaagtgagatgaaagaagctgcatcagaaaaagtaggcgaaatgaaagaaaaagcaactgaaatgaaagaggcggtttcagaaaaagcaactcaagcagtagatgcagtgaaagaagcgacaaaataataggtttaatttaaataacaaaatccctgttaaagaaatttaacagggattttttatagattaatccaatttgatttttacaaataatatcccgccattgagctatataccgcattttcactttgtagcacttgatattttgcattcaaaatcgcaagttgtgatgatttttccgtattggctgcaactaaccattcgcgcaattcggacacgcccgcattatagcgatttcgataatattgtgtgatacgctgattgtaactatgggtttgctgtaaattacttaatgtactttgcgcttgggtaaaggcaaaatagttggtatccacattattgagagccgtggtaatacgttgttcgtaatttaaacgtgctgtttcatagtcagcttcagaaattttaacgttccattttacggtgttccaatttaagaatggcaagctaattcctactgtgccagcagccacagggttatgtaatgccgtaccaactgtgcttgctgttgaagaaaggcttgcacctaaattaacctctgggaaccaacttttttgagttgctttggcatttttgaatgcactgcttaaacggaattgtgctgcttttacatcaggacgatttgcaattacagacacaggcacgtttaagtttacgcctgccgttttcacattcataatatgtgggaacgtgatatttaatgcttcatttggttttaggttgagaagattacgcagtgtttgttctgctgttttgcgttgggtttcaaaatttaatttgttattacgcgccgttaatatggcttgttgagcttgatcaacgctggctgcatcagccacgccttgcgctaaacgcgtttgcataatattgccaatatccgtgtaatatttgatcgtttcgttggttgtgctaatagcatcatttaaataagcaatttgataataagttgttactacagaattgattaatgataaacgagccgattccatatcttctgcagttgctttgtgcgaccattccgccgcatcaacagtattggccaaacgttgccacagatctaatgtatagctcacatttaaagaacctttgtgtgaagtggcagagtttgtactgatatcaactcggcgttgtgctgctgatgaagttgaaccattaaatgcaggcactaaatttgcacccactaaattcgcactataaagcgcacggtttaccgctacagcagctttagctaaatctttattgtttgttaaagcttgctctataacacgatttaattgcgcatcatcatataacgaccaccaattttcttttacattatattgcttggtaatttcttcatattgcttgtaatcttcaaggcttgcttgataagaatcgccaatattggcacatcccaccaatgcaccagacatcaacaaagcaagcgtgatatttttcattttaaacattgaattttcctttctacgaactaaaaagtgcggatgattttaaccgcacttttttatttataaaataaatattgtgacttttatttataatgaatgtttgttcagaggcaagtattttaaagttaaatattggaatttgcacgaaaaaatttgtatttcctttacatatcaatttatttaacgtaaagtcacgcttcttttttgttttatcctaggaggatataacatgttttattacaattctgcaagcaagcaagcaagcaagcaagcaagcaagcaagcaagcaagcaagcaagcaatgctaatcttttcttttcatctgtcaagccaaccatgacagcttcacttatcagcacagtttgctgatctcttctcaagcctttgcggcgagtgacaattcaattagtacgaattacggcattaaagagtttggggcgtatagcctgatcattggtaatttaaagaataatacaattaatagtaaaatttccaatcaggctttaacgagttaaatggcaaaattggtaagttagacagtaaattagaacgtggtttagcggcggctaacgccctttctggtttagaattgccacaagtggttggaaaagcgagtttttctgctgcggtgggcggttatggcagctgtaatgcgatggcaattggtgtcggctacacactaaaagcaaatatcaagttaaaaagcggtatcaattattcttttcttaaacacctgattttttcctaacttcgcaaaatagattcaatgtaaaatttttcattttaaatttccttttttgagtgtaaaaatagctaccttagtatgttaaaggaagtgggtttcatttcttatataagttttaaaggaattaaaatgaatgttatttctgatcttgagcttcagcaaattcgcactcaaatgctgacatttgcacaattgcaagtaaatcaagctgatcttgctgaagatttagtacaagaagcctttttaagtgcattcaaaaatcttgataattttaagcatcaatctgcatttaaaacttggatttttgcgattcttaaaaataagattattgattatttacgtcagaaagggcggtttgttttagaaagtgaacttgaagatgaagataccaataattcattttttgatgaaaaggggcattggaaaccagaatattacccgagtgaattacaaggcgaagaagaaactgtgtattccgatgaattttggctgatttttgaaacttgtttgacttgtttacccgccaaacaggcaaaagtttttatgatgcgagaatttttagatctttcatctgaagaaatttgtcaagaaacgcatttaacttcgtctaatttacataccaccctttatcgggctcgtttacagttgcaaaactgtctttcaaaaaaactttaggagaaaattatgcgttgtcgccaagccactcgaatgatttccgaatcgcacgaacgttcattagatatacaagaaaaagtagggctaaaagtgcatttagctatgtgctcgcgttgtcgtcgttttcaaagaaattgcaaaaccttaagtatgatgatgaagaaatttaaagattcacattaagagtgatgaaagtattaaaaaatccgctattttgaccgcactttatagcggtatttctaacttatccatacggcattttgtaatctcaaaggttttatttcttcagcttcgccaataaactcactgcgcccacaattataactgcaccgagccaaaaatagaggttaggcgtatgatgccaaaagagccagtcgaaaacgctagagaaaaccacgccagtgaaagcaaaaggagtaatgatattggcgggtgcgtatttaaaagcgcgcgtgagtaataattggaaaatcaatccgaaaccgcccaccaatagtaataagccaagctcgtataaattagggattttccattggttaataaagaagactggtaacatgaacgtaccaatcagatgaaaataaaatacgatattttttggtgtgttgtatttgtttaattcttgtaagccaataaatgccattcccgctaatacagcaccagataatccaatcagcacataaataggatcaacattgccattgtgattggtgagtaaaataatggaaacgccaagaaaaccgattaagctacataaaagcacattaagcggtgttttttgatggaaaaaaagcaataaaatcgggataaatagggcagaggtattcatcaataagacagcgatggaaagcggtaagaacttcacgacataaaagttaatcaacatattcgatacacccgcggcattacgcaggattaaaaatttccattgacgagtatccactttaaaatcgcgatctttaatcacaaaaggaagtaagaaaagcaagccgattaaaaagcgtgaaaataaggtttcacttgcagggattgtttgagaagccgttttgacaaatacattcatcaaggtaatggaaaagtacgctgataccataaaactaatcgctttgtgataaagtgaaggaatggaatgtgattgcatatagatttttaccttagaaaagagggggagattgggcatcttaacgctttattattggttataacaatggattttaatcaatttctttaaaaattttgcaaaaatctgtaagaaatcgaattatccgccgtctaaccttatgtaacgttaatttttacttcataaggaaaagcaatgaaactatcaaaaacatttctatttattaccgcactttgcagtgctacaccaactttagcaatacaaaattcaacatcatcatctggagaacaaaaaatggcaatggaaaatacacaaaacatccgagaaatttatcttgctggtggttgtttctggggtatggaagcatatatggagcgtattcacggtgtgaaagatgcgatttctggctatgccaatggtaatacggggaaaaccagttatcatatgattgggctaaccgatcacgcagaaacggtaaaagttacttacgatgcaaaccaaatttcgttagataaattgcttaaatattattttaaagtgattgatccaacgagtgtaaacaaacaaggtaacgaccgtggtagacaatatcgcacagggatttattatcaagatggggcagataaagcggtgatcgaacaagctctcgcccagcttcaaaccaaatataaaaaaccagtgcaagttgaggtacaaccgattaaaaattacatcgtagcggaagaatatcatcaagattatttgaagaaaaatccaaatggttattgccatattgatattaccaaagcagatgaacctgtgattgatgaaaaagattatccgaaaccgagtgatgcagaacttaaagcgaaattgacaccgttgcaatattccgttactcaaaataaacatactgaacgctcttttagtaacgaatattgggataatttccaaccgggtatttatgttgatgtcaccacaggagagcctgttttctcttcaaatgataaatttgaatcaggttgtggctggccaagttttacgaaaccgatcattaaagatgtggtgcattatgaaaccgacaatagcttcaatatgcaacgtaccgaagtgttaagtcgtgcgggcaatgcccatttaggacacgtttttgacgacggcccgaaagataaaggcggtttgcgttattgcattaacagtgcatcaattaaatttattccgttagctgaaatggaaaaggcaggatacggatatttgattcaatccattaaaaaataaggagatgtaggatgttagatcagcaactccttattggaactgtatttttagctgggcttgcttcttttctttcgccttgtattttcccgattattccaatttattttggtattttgagtaaaggtggtaaaaaagtcctgaatacttttttatttattttagggctttcccttacatttgtcagtttaggctttagttttggctttttagggaatattttatttagtaacactacccgcattatcgctggcgttatcgtgattattttgggtattcatcaacttggcatttttaaaattggtttgttggaacgcacgaaattggtggaaataaaaacatcaggaaaatcgaccgcacttgaggcatttgtgcttggtttaacctttagtcttggttggacgccttgtattggcccgattctggcttccgtgttagctttatcaggcgatgaaggctctgcactttacggtgcatctatgatgtttgtttatgtcttagggcttgcgaccccgtttgtactgttttcgttcttatctgacagcttgctcaaacgtgccaaagggttaaataaacacttagacaaatttaaaatcggtggcggaattttaattatcgtgatgggtattttattaattacgaataatttttcgtaagacataacctcaacaaaagaaacctataactaaggaaaaaagcaatgaaaaaactactatcaatatttctaatggcattcagcctaaacgcttttgcacaaactaatttagcggatgtgcaactcaaagatttaaacaatcagccagttactttaagccaatataaaggcaaacctgtgtatgtcaaaatgtgggcatcttggtgtccgatttgcttggctggattagctgaaattgatgatttaagtgcggaaaaagatcgcaattttgaagtgattaccattgtttcgcccgatcacaaaggcgaaaaagacaccgctgattttattgaatggtacaaaggattggaatataaaaatatcacggtgcttttagatgaaaaaggcgaaatcattgacaaagcaagagtgcgtggctatccgttcaatctctttttagatagcgatttaaacctgaaaaaaaccgtaccagggcatttaggtgcagagcaaataaaagtttttgcagggaaataatgatgaaaagcggcttatttttaagccgcttttttatatcctcgtttttacataataaagagataaaatatcctacatagaaagtttgttcattgagcgtttggtagattgataaaaaatatatattataagcggtatgattttattgcttgtataatagttttttatttttacgttatcgttactttttccaaataacgtgaaattcgcgatcttcttctcggtgagaaattaagaatttagcaaagacatcatccatttcatcttgtttattgactaagcccacccacacttcagcgtattcttcaggatcaatcagtacaccaatttcttcttcccaatcatcggcggtttcaacaaattccacaccaccgcgttcttcaaattgtaggttgaataaaagaatataggcaggatctaaattttctccagccatttctaagaaaatatcgtaagcaatatcaatggctgtatcgggatcaagttttttaatttctgttgtcatagtgttttgtcgtaaaggttatggttaataaaagtgcggttaaatttttttctcttttgaagcgttttattccatattggttggaagtttaatttctcgaatattcatcgaaaaaccgtcaatcatcaataagcgtccacacaaattcttaccgatttttaaccgcactttaattgcttctaaggcttgaatgcagcccacaataccgacgattggtgcaagcacgccagcttccacacagcttaatacattttgtccaaataatttgctgagatcacgataagtaggcgtatttggttcataagtgaaaacggaaacctgaccttccattcgaattgcagcaccagaaataagaggaatttttgcatgattacattggcgatccaattgattacggatttccacattgtctgtacaatctaaaacaatatcaaagtgcggaatgatttcagccagtttttcttcgtccaacttcgcattaatcgtctctatgtttatatgtggattgatttgttccagtgcaattttagcggattccacctttggcatattcaagcgcgtatcgcagtgtaggacttgtcgttgaagattcgaaagcgaaactgtatcgaaatccaacagtgttaaatttccaacgcctgccgctgcgagatattggctggctgcacatcctaagccaccaagcccaacgatcagcattttgcttgctttaagtttttcttgcccgtcaaaatctacgcttttaagaataatttgacggttataacgcaattcttcttcgtgactaagttcgatcattttttatcctaataaatgattgaaaggctcaattgtcactgtttcgcccgcagagacattgccacgttcttgttctaacacgataaaacaattgctttttacaaaagcactaaagagatgagaaccttggaaacctactgattgcacttcaatttgaccttgttcattgatgtaataaaaaccccgttggaagtctaaacgtcccactgcttttttcaaattcattgtagcaatggctgaaaagtgcggtggatttttccattgtttttgtccttgcagtttagcgattaatggctgtacaagttgatagaatgttactaatgcggaaacaggattgccgggtaaaccacagaaccaagcattttctaatttaccaaaagcgaatggtttgccgggtttgattgcaattttccagaaatttactttgcctactttttccaatactgctttagtgaaatccgcttcaccaacggaaacaccgccactggtaatcactaaatcggcttggctttgtgcggcaataaatgctttttcaaattcagcttcgttatcaggtaatagtcctaaatcaatgacttcacagtttagtttttctagcagtaattttacggtgaaacggttagtgtcatatatttgtccgctttgtaatggcttgccgacttccacaagttcatcgccagttgagagtacaccgacttttaattgacgatagcattttacttctgcaatgcctagagaggctaataatggcaaggaaactggggtgagcggtgcgccttgttctaatacaacatcccctttttttacatcttcaccaatacgacggatgttttgatttggtttaggtaattcactaaaagtgatggtgccgtcttcattgagtgttacttgctcttgcattatcactgcatctgtgccttcaggaatcatcgcgccagtcataattctgaccgcactttttgatggccattcctctttgaatggattacctgcaaaagatttccctgccactgaaagggttaaagattgttgtaaatccgataaacgtacagcataaccatccattgctgagttatcgaaagagggaacattgataggcgaaataatatcttctgcacaaattcgattggcggcttcttgtaaatttaggtattcagtttgagtcgggaagggaagctgttcaagcattttcgagcgagcttgatccaatgtaagcatagaaaatccttatttgataaaatttgtcagctattctatatctaaagcctaattcattcaaatttgcaatttttctcattttaccatcctattatcctttgctagaatagccgattatttttttaggaaagactattatgagcaaaatttcactggatgcactgaatgtaagaaatgccttgattgaaaaaggtattgagacacctatgattgatccaacacaggctaaagatgaacgtcgagaaagcattgcgaaacacatgcatgaagtaatgaagctgattggattagatttgcgagatgatagtttagaagaaacgccaaatcgtttagctaaaatgtttattgatgagatttttagtggaatggattatgccaattttcctaaaatgacgaaaatcaaaaatcagatgaaagtcagcgaaatggtgcaagtgaatgacatcactctaacaagcacttgtgaacatcattttgtgacgattgatggtaaagtttgtgtagcgtactatccaaaagattgggtgattggtctttctaaaattaatcgaattgtctcgttttttgcgcaacgtccacaggttcaagaacgcttaactgagcaacttttgacagcatttcaaaccattcttgaaaccgatgatgtggcggtatatgtgaaagcgacccatttttgcgtgaaagcacgtggtattagagatacaaatagttatactgtcacatctgcttatggtggcgtattcttagaagatagagatactcgtaaagaatttttagccacagttcaaaaataggaaatgataaattgtaatccgcacgtaaaatgtgcggatttttatttcgggaaattaaatatgctatgtgccatttataaaagtaaaaagaagttaggaagttacctttatgttgctaatagagaggatttttctttagttcccagcgttttactcgaacattttggtaaaccagaattagtgatgatgtttaatctgcttgggcgtaaagcactatacaatgtagattgtaatgaagtattggaaacaattaaacgccaaggattttacttacaaatagcaaaacaagatgatggtttatttaatagcttgagtgagatcaaataatttgtctatttataagataaaaaaagtgaaaatttgcgttatctcaaattattaaataaaaaattcctttaaaatccaccgcactttttaaaggagaaaaaaatgagtagcttttttgtcgcagggacagatacgaatgtggggaaaacaacagcagcgcgcgcaatgattcaagccttgcaagagcagggagtgcaagttgtcggctataaacctattgcttgttgtggagaagagagtatttatcctatcgcacaatcagaaaatacatctgattatgatcatttcgtaaatgctgatgtattaacgctgatgcattcaacaaaagaaaatgtgtcttatcaggatattaatagttatacttttagccactgtgcacccatgctcacgcaagataaaatgcgaattaaattagataaaattaattatgatttaacgcatttgaatcaaacttatcaatctgttgtggtggaaggatcttttggtttaatgacaccaatggcagaaggaaaaagttttgcagattggattactcaacgaaaaatgccagtagtacttgtagttggaattaaagatggttgtgtaaatcacgctttattaacggtaaaggttatccaacagttgggtgtgccgttattaggttggatagcaaatcgaattaatccattattaagccattatgcagaaattgttgatttacttgttgaacatattgatgcgccgcttttaggtaaaattccttatttacataaacccgaagaacaagaattagggcattatttaacgaatatagatcgattaatgtatatgcaaacagagttcataaaataataaagtgcggttgaatttttttagttttgtataagggcgaaatatcgcccttattttgtgtttgaaaagaaatatattattgtgataattaaggtcttacacctaacatatgacagatagcataagttaattcactacgatttaatgtataaaagtggaagtcattcacgccttcgcgagataaaatttttaccatatccattgcaacacttgctgctacaagattacgtgtagttggatcatcatccaaaccatcataggctttaactaaccacgctggaattttcacattagtgaatgatgccattttttggagttgtttaaaattagtaacaggtaaaataccgggtacgatttcagtatcaataccaattgatgcacaacgatcacgaaaacgtaggtagttttcaatatcaaagaaaaattgtataatgacgtggtttgcacctgaatcaattttacgttttaaattaattaagtctgcttgtgcggattttgcttctggatgaacttcaggataagcggctacagaaatatcaaaatcagcgacagaacggagtaattccacaagatctgacgcataaaatggttttttcgcgtaacctttaggttcgtcaccgcgtaacgcaacaatacggcgaataccactatcccaataatctctcgcaatttgttttaattcttcaggtgtggcatcaattccagttaaatgtggtgcggcttctaagcccgtttcttgtttaatggctttcacaatgccgtgagtgcggtcacgttctcccgaatttgcgccgtaagtgactgacacaaatttaggctttaagacttttaaacgatgaatggaatcccatagaagggtttccattttttcgtttttaggaggaaaaaattcaaaagagacattaatttttttattaaaatctgcaatatgttgatttaatgtatcaatttctttcgcgtagctcataaggcttcctttaggattctaaaatagtatttgtacaataaaataggttttaatatgagtcaatttcaatttattcattaaaagtatgattattattaataattcaataaatggataatgattgttcaataataattaatttttagatcaaaacgtacccaaaactaccgcacttttgttagcaatgatttatcctattttacaatgaaaaaaagtgcggtaatttttttgtatatttttatagaaagataaatgcgtgttaaataaatacaatagatttattttttagtgcaaaaaattagcattttatgaaaaaacgagtataatacgccgaccctgtaaatgtgcgaattcccatcgtacattattttatcgagatcacactcgaaggggtgatgattaagattaatggttgtgttcataagaacactgggtatcaaactaatttttggtaattaattaatgaaaacttttgtagcaaaaccagaaacggttaaacgcgactggtacgtagtagatgcgacaggtaaaactttaggtcgtttagcgactgaattagcacgtcgtcttcgtggtaaacacaaggctgagtacactccacacgtagatactggtgattacatcatcgttatcaacgcagacaaagtggcagtaactggtcgtaaagaaacagataaactttactactggcacactggctatgtaggtggtattaaacaagcgactttcaaagaaatgatcgctcgccgtcctgaagcagtgattgaaattgcggttaaaggtatgttgccaaaaggtccattaggccgtgcaatgttccgtaaattaaaagtgtatgcaggtgctgaacaccaacacgctgcacaacaaccacaagtattagatatttaatcacgaggtttagaaaatggcagagaatcaaaactacggcacaggccgccgcaaaagctcttcagctcgtgtatttatcaaaccgggcagtggtaaaatcactatcaatcaacgtgaattagatgtttactttggtcgcgaaacagcacgtatggtagtacgtcagccattagagttggttgaattaactgataaattagacctatacatcactgttaaaggtggtggtatttctggtcaagcgggtgcaatccgtcacggtatcactcgtgcattgatggaatacgatgaaacattacgcccagcacttcgtgcagctggtttcgttactcgtgacgcacgtcgcgttgaacgtaaaaaagtgggtttacacaaagcacgtcgtcgtccacaatactcaaaacgttaatttttattttcgtttccaaaagaaaagcagagagaaatctctgcttttttattatttgagttactctaacttattgattataaaacaataaaaaagattatgttggcaaataggtaatgctttatggtaaaatgttgccccttaaaaacctagaatatttttggatcttcggaggaataaatgtccagcacatcaagtaaacgttcagtaatgacccttttttcaaataaagatgatatttattgccatcaggtaaaaattgttttggcagaaaaaggtgtgctttatgaaaacgcagaggttgatttgcaagctctaccagaagatttaatggaattaaatccatacggcactgtgcctacgttggttgatcgtgatctcgtattatttaattcacgcatcataatggaatatcttgatgagcgttttccacatcctccattaatgcaagtgtatcctgtttctcgtgctaaagatcgacttttaatgttacgtattgaacaagattggtatccaacccttgcaaaagcagaaaatggcacagaaaaagaaaaaacttcagcattaaaacagttaaaagaagaactattagggattgcaccaatttttcaacagatgccttattttatgaatgaagaatttggtttggttgattgctatgttgcaccattattatggaaattaaaacatttaggtgtggaatttacaggcacaggaagtaaagcgattaaagcttatatggaacgtgtgtttacacgtgattcttttttgcaatctgtaggtgaagctgcaccaaaaaatttaatggatgataaataatggaatataaatcttctcctaaacgcccttatttattacgcgcctattatgattggctagtagataatagttttacgccttatttagttgttgatgcgacttacttaggtgtgaatgttcctgtcgaatatgtaaaagatggacagattgtattaaacttgtctgccagtgctacgggcaatttacaacttacaaatgatttcatccagtttaatgcgcgttttaaaggtgtctctcgtgaactgtatattccaatgggcgcagcccttgcgatttatgctcgtgagaatggcgatggcgtgatgtttgaacctgaggaaatttatgatgaacttaacattgagccagatactgaacaaccaacaggtttttatgaagcagtagataagcctaaaaaacgagaagaaaaaaagaaaacaaaatcagtttcccatttaagaattgtggattaagaaaaaacgcgatgaaattatcatcgcgtttatttttataaattaccttgttttgcaataaagttgagaattttttcttcaatgccttttgtatccaatcctaaatctgccaatgcttcttgccgtgtcgcttgtggaataaaataatctggcaaaccaagttgtaaaagtgcggttgattttcctgatgaatttagtacttccgcaacagcagatcccgctccaccttgaattgcattttcttccaatgtgaccaaataatcgtgagtttgtgcaagcacattaatcatttcaatatcaatcggtttcacaaaacgcatatcgacaaccgttgcattgagtttttctgataactctaaagcggatggtaatagagtaccaaaatttaaaatcgcaattttttgaccttttcgaattaaacgtgatttaccaataggaagcatttctaaaggagtaagttttacaccaacggcatttccgcgagggtaacgcactgccgcaggttttccacattgataacctgtatagagcatttgacggcattcattttcatcactcggcgtcataatgatcatatttggaatgcaacgcataaagctaatatcgaatgcaccttgatgtgtagccccatctgcgccaactatccctgctcgatcaatcgcaaatagcacggggagattttgaatggcaacatcatgaattaattgatcgtaagcacgttgtaaaaatgtcgagtaaattgcgacgacaggtttatatccgccaattgcaagtcctgtggcaaacgtgacggtgtgctgttctgcaatcgctacgtcaaaatattgttttgggaagcgttgggaaaattctaccatacctgaaccctcacgcattgcaggtgtgatacctataattttggcatctttttctgccatttcacatagccaatcgccaaaaattttcgaataagttggtttactattgtttttgggcaattcgccactgattggatcaaatttaggtacaccgtggaaaccaatcggatctttttctgcgggtgcgtatcctttaccttttttcgtttttatatgcaaaaattgtgggcctttcagattacgcatattcgtaagcattgccactaattcatcaatgttatgcccatccactgggccaatatagttaaaaccgagttcttcaaataatgtactttctggcgaaaacattacacctttcatatgttcttcggtttttttcataaagtttttgattggcggaactttatcaaggatttttttactgccatcacgaagcgtagagtaaagagagccagagaaaatacgcgcaagatgattatttaatgcaccaacgttttctgaaatagacatttcgttatcatttaaaataactaacatatctgtatgcaatgcccccgcgtgatttaatgcctcaaatgccattcccgcagtaattgcgccatcaccgatgacgcatactgtttttctacctgcattttctcgttctgcggcaacggcaatgcctaatcccgcactaatagacgtagaggagtgaccaacacttaatacatcaaattcactttcttcacgccaaggaaaaggatgaataccgtctttttggcgaattgtggacatttgctctcggcgacccgttaggattttatgtggataagcttgatgtcccacatcccaaattaactgatcaaatggcgtcttatatacataatgcagcgcaacggttagctcaacagtgcctaaacctgacgctaaatgtccgctagtttgactaacagattctaaaagataagcacgtaattcttgacagagttgtggtagctgatctttatttaaaagacgcaaatcttctggagaattaattaaagataaaagaggataattgttcatattattagtcattttaaaaacgtgataaattttgaccgcacttttgtgagtgtttaactttttctggtaataacgaattcagctaatgcacgaagtgcggttgtatcaaaaggaattttttctaattcagacaaagcactttgatatagatcttgcgctttttgttttgcgccacttaatccaagtaattttggatatgtacttttatctaaatcaagatcggcacccacctgtttgccaatttctgcactatcgccttcaatatctaaaatatcatcttgaacttgaaaggctaaaccaatggcttccgcatattgtgttaaggattgttctaaccttttgtcggtaaaatgtggagaacaaatgaaacctaattttaatgcggcaattagcaatgcacccgttttgttacgatggattaattctaattcgcttaaactaatctgtttatgctcagaaataagatctaaactttgccctaagcacattccttgtacgccagcgccttgcgctaaaatttgaattaaagccagtttttgttcagcagaaatattcggtgttttggttaatatttcaaatgcgaaactttgcagcgcatcgcccgcaagaatagctgtagcttcatcaaattggatatgacaagtaggatgtccacgacgtagattgtcatcatccattgcaggtaaatcatcgtgaattaaggaataggcgtgaatggcttcaatggcagcagcagcgtaatctaaggtttgtttctctgcaccaagcatttgacctgttgcgtaaactaagaaagggcgaactcgcttaccgccaagtaataatgcgtatttcatcgcctcaagcaaaagtgcattatgactttcaatgccctcaaattgagcttctaaaaagcgattgatacgagtttgaacctgttgtaattcttcagaaaagtgacccattaagcattcccttcataatcattccctttataatcattcagtggcgcgtcttctgttttttgcaataagatctgaatacgttgttctgcttgttgtaaacgttcttgccctaacttagcgagttgcacaccttgttcaaattcttttaacgcttcttctaacggtagatcgccattttctaaatgtgtaacaatattttctaactgcgctaacgttgtttcaaaatcttgtgaagatgcgggtttacgcgccatggaattatcctttttcacggtaaaaattgtttgccattgtactgtattttatttgagttgttaaaaaattatttcaagctaggaccagtggacttttcactatctttgcgtaaaatactcgccactttaaatacccaagaaatacctaagctatttatatgaaatttatcgttaaactttttcctgaaatcatgattaaaagcgaaactgtgcgtaaacgtttcgcaaaaattttaacctctaatatccgcaatattttacagaaatatgatgaagaaactgcagttgtacgtcactgggattacattgaagtgcggtcaaaaaatgaagagaatcgtgaagaattaatcgccttgttacaacgtattcctggtattcatcattttttagaagttgaagaaaaaccgtttaccgatttacatcatatttttgaattgacgcttgcggatgtcgcgcaacaacttcaaggcaaaaccttttgcgttcgagtaaaacgtaagggtaaacataaatttagttcgattgaagcagaacgttatatcggcggtggattaaatcaacatattgaaagcgcaaaagtgcggttaaaaaatccagatgtgactgttcgtattgatattgaagatgacaaaatgatgttagttaaaacacgtcacgctggtattggcggttatccgattggtacgcaagaagatgtgctttctttaatttcaggaggatttgattcaggcgtatcgagttatatgttgattcgtcgtggttcccgagttcattattgtttctttaatcttggcggtgcagcccatgaaattggcgttaaacaaatggcttatcatatttggcaacgctatagtgcttcacataaagtacgctttattacgattaactttgagggagttgtcggtgagattttagagaaagtcgataacggacaaatgggcgttgtattaaaacggatgatggtgcgagccgcaagtaaagtcgctcaacgtttcaatattgaagcgattgtgacaggggaggcattaggacaagtttctagccaaactttaaccaatttacgcttgattgatgaagccgctgatgccttagtattacgcccgttaattacgcacgataaagaacaaattatcgcgatggcgaaagaaattggtactgacgatattgcaaaatctatgcctgaattttgtggcgtgatttcaaaaaatcctacgatcaaagcggttcgtgaaaagattctagaagaagaagggcattttaatttcgagattcttgaaagttcggtgcaaaatgcgaaatatttagatattcgccagattgcagaagaaacagaaaaagaagtcgtggaagtcgaggcaatttctgtattaggtgaaaatgaagtgattttggatattcgtagcccagaagaaacggatgaaaagccatttgaatcaggtacacatgacgtcattcaaatgccgttctacaaactttcttctcaatttggtagccttgatcaaagtaaaaattacgtgttgtattgtgaacgtggtgtgatgagtaaattacaagccttatatttgaaagaaaatggtttttcaaatgtgcgtgtatttgcaaaaaacattcattaattaggatataaaatatgcgtaatcaaactaaacagcatcttgaacagcttcaaattaccatgcagcagcttaatttatggcaaacgatgccccctgctgcagaggcgtttttaagtgaagaacctttttcaattgatacgatgtctgccgaagagtggctacagtgggtatttattccacgcatgcaggcattattagaaagtggttcagccttgccacataaaattgctatttctccttatattgaagaagcaatgaaggaatttgatgagttacaacaactattaactcctttagttgctttagaagaacttctgaacaataaccaatgctagaaattttatatcaagatgagtttctcgttgcggtgaataagcctgatggtatgttggttcatcgcagttggttagatcctcacgaaactcaatttgtgatgcaaactttacgagatcagattggtcagcacgtatttcctattcatcgtttagatcgaccgacatctggcgtgttgttatttgcattgagcagtgaaattgcgaatttaatgtgtgaacagtttgaacaaaagtgcgttcagaaatcttatttggctgtagtgcgagggtatctacagggaaaagagcggatagattatccactaaaaattcaattggataaaatcgcagataaattttctcaagaagataaagagcctcaagaagcagtgactgattatgaaggattaaaaatagtcgaaatgccttatcctgctgggcgttatcaaacggcacgttattctttagttaaattaatccctcatacaggtagaaaacaccaattacgtcgccatatgaaacatatttttcatccgattttaggggatacgcaatatggtgacttacatcaaaatcgtgcattaatgtcacatttaggttgttctcgattatttttacattctaatagtttgtcttttattcatccaataacgaaagagcaaataacaattacagcaggtttagatgaacaatggcatcaattaataaatcaatttgggtgggaaaatgtttgatattaacttaacacacgaacagcaacaaaaagcagttgagcaaattcaagaacttatggcaaaaggaattagtagtggagaagcgattcaaatagtggcgaaagcactacgagaaattcataaaaatgataaaaaaactccagataattaaattttttgtgatctacttatcatttttgaatattgctcgttgcataaccgttcaaaatatttaaacataacggacctaattagtaggtgataaggcgagagtcttgttgatttattgttttaataggctaagcctagagaggtcttttatggaaattggtattgtaaaatggttcaataatgcaaaaggatttggtttcatttccgcagaaggtgtagatgccgatatttttgcacattattcagtgattgaaatggacggctatcgttcattaaaagcaggtcaaaaagtacaatttgaagttctccacagcgataaaggatctcacgccacaaaaataatcccaattgcggatactcaagaataataaataccctaaatttttttctattaatcctaacttaaaagacaagaattaaagttagaaagtcagtaaaggactaagcttagtccttttagttcgtattaaataagaaatccgcctttaaatttataagtccatcacttattcatcaacaatatcagtaaattctgcacctaatacttttgctaaatcttgtggcgcaatttctacgcttagcccacgttttccgcctgaaacataaatcgtttcaaactcaagtgcggttgaatttatcacggttttcacgcgtttcttttgacctagcgggctaattcctcctacaagataacctgtacttttttgtgctgcatctttatccgccatttccacttttttcacaccgatagattttgctgctttctttaaattcagcatattggccgttgcaagcacaaaacaagcgagttttttctgatcgccattttccgccacaagtaaggttttaaaagagcggttaggatcaatgcctaatttttcggctgcctcatcaccaaaatgttgattattcggatcatgatcataagtgtgcaagataaaaggaattttttgttttttaagtaaatcaattgcgggtgtcattatttcgttcctggttttggtgtaaaataatgctgattattttacagcggagagaaaaatggacgcaaccttaaatattgcgatagcagcagaatttgaattaagtgaaaaaattgtagagcgtttagaacaaagtacgcttgaaattagcaaagtttctattgttgaaataataccttttgaagaagaacaaaatattcgttttcgcaataaaggcgttgaacaacttgcgccaaatgaagtagagtgggctgattttaattatgtcttttttgcaggaaaacttgagcaagttgcccatattgcgcaagcagcagagcagggctgtattgtcattgatatgttaggcgtttgtagtgcgctttcggatgtgcctgttgttgttccaacggtaaatgaatcacaattacttgaattaagacaacgtaacattgttagcttgcctgatcctcaagtaagccaacttgctttaacgcttgccccgattttacaagaaacgaatctcaatcaagtatttgtcacctctttattgccgacttcttatacggatgcggaaaccgtgacgaaacttgcgggacaaacagcccgtttattaaatggtattccattagacgaagaagaaactcgcttagcctttgatgtttatccgcatcaagcacctaatttatcgaatcaattacaacgaatttttccgcaattagatcgtgctacattccactcaatccaagtgcctgtattttatggattggcacaaaaagtcaccgcactttcagattatgatttcgactatcagcctcaaaatagcgagcttgtcgctttagaagaaaccttaattacgcctgtgcttaatggagaacaagaaaatggcgaagaatcagtaaaacttcatttaagtcaaataagtgcggtagaaaatggcgtagaattttggtctgtggcagatgaacaacgctttaatctcgctttactttcagtgaaattgttggaaggaatttatcagcaaggttattaatgaaattaaggagaatagtatgcaaaatattctatttataatccattcagccccttatggtggatggaagctgacaaagtattaaatttttaattttctcgatagctaaaagaaacccgccacaagtgcgggttcttttttgcttattttgttgcagctttcatcgtttgaacaaattcagctaattcagctaaacattgctcgtgattatctaaatttcgctcaataatttttactgttgccgaacctgaaattgcaccagccgctcccaaagctaaggcttctttaacttgtgcaggctgtgcaatgccgaagccttgtaaaattggcggggcatagtgggctttaagttgttctacaagggtatctaaatttgctgcgtgagcttgattttcagcactggttacgcctgcacgtgagactaaataggtatagccttcgctatttttcgctacgccttgaattgttttctcatccgcatttggcgggcaaataaagacgggttgaatgccgtgttttttggccgcttgtacataatcttcttttgcgagtaacggaatatctgctacaagcacagcatcaacaccaacttctgcacagcgttgataaaaagcatctaaacctttagcaaaaattaaattggcacaaagtaataagctaatcggaatctcgggatattttgaccgcactttttccaatagtttaaagctatcttcactgctatgacctgcagttaaagcacgattattcgcggcttgaataactgggccatcgagtagcggatcggaaaaaggaaaaccgagttctaaagcatctgcaccgttatccacaagtgtgcaaatgatctcaaaagagcagtcgaaagtagggtcgcaaagggtaacgaacggcacgaaagccccttcattttttgcgttaagtgtcgcaaattgcgtttcaaaacggctcattagttcgttcctccatttaaaattttatcaacagtaaaaatatctttatcgcctcgtcctgaaagattaaccactaaaagttgttctttttcaggattttgtttaatcaatttcaaggcataagccaaggcgtgtgagctttctaatgcaggaataatgccttcgtgttttgccaattcttggaatgcgttaagggcttcttcatcggtaatcgatacataatcagcacgaccaatctcatttaaataagcatgttgcggcccgacagaagggaagtctaacccagctgaaacagagtaagattcctctacttgaccatcttcggtttgcattaaaggggatttcatcccgaaataaatgcccacttttgcatgacctaatggtgcgccatgttcaccgctttcaatgcctttccctgcaggttcaacaccaattaaacgcacatttggttcatcaataaaatcagtaaacataccaattgcgttagaaccaccgccaaccgcagcaatcacagcatcaggtaaacgaccttctcgttctagaatttgacgtttggtttcttcgccaatcattttttgaaattctctcacaatcgtcgggaaggggtgagggcctgccgccgttccaagtaaataatgggtggtttcatagtttgctgaccaatcacgcatcgcttcacaacaggcatcttttaaagaacaagagcctttttctacaggaattacttcagcccccattaaacgcatacggaacacgtttggtgattgacgctcaacatcttttgcacccatataaacacgacacggcatatctaacatagcacaagctagggcggttgccacgccgtgttgccctgcacctgtttcggcaataatacgcgttttgcccatacgtttagccaataaaatttgccctaacacttggtttgttttgtgtgcaccaccgtgtaataaatcttcacgtttaagataaagtttagtttttgtgcatttggttaagttacgacaaagagtaagtgcggtcggtctgcccgcataatttttgagtaaatcagcaaattctgcttggaatgtaggatcattttgagcctccacaaaggcttgttctaattgcttcaaaacaggcactaaaatttcgggtacatacattccgccaaattcgccaaaataagggttaagaagtgtgtctgacatattttttcctattattttatttttcttttgaaacgctcattcctgcaaaagattgagcggttggcattacttcaatacgattaatgtttacgtgttcaggttgttgatgaagccataatacaatgttcgcaatatcttcaggctgaaccgattgcacgttttcatagacttttgcggctctttcatcatcgccgtgaaaacgcacattagagaactccgtaccgccacataaacccggttcaacattgcttactcgaatttttgtgcctgccagatcggctcgtaaatttaagctaaattgtgtgacaaaagctttagttccaccatatacattactgcccgcataaggataagtacctgcaattgaactcaaattgataatctgcccgtgattacgagcgaccatatttggcaacacaaggcgagtgatagtaaccaatcctttgatgttggtatcgatcatctgataccaatcttgtaaatccgctttatgtgctggctctaatcccaaggctaaacctgcattattcactaataaatcgaccgcttgccaaccttcaggaagggtatttagagcgttaattgtgacttgttcatcacgaatatcaaaggcaagcggtagaaaattattgcccaattgtgaatggatttctgccaatcgatctgcacgtctacccgtgccaatcactttatagcctgcttcgatcaattttttacagatcgctaagccaaagcctgcggttgcacctgttactaatgcagttgtggttctcattttttctcctaaatcttgagcttatttgtactattaaagtagtacaaataagttttgattgcaagcaatttcattttaattttaaaaatgtcattaaatgaattaatttaacaatatcgcaaacttttgcttgatggtataatctgcccaatttttatttcaactgattgaggttaatcgtgagcaacacacaactgagctataaagatgctggcgtcgatattcacactggaaatgaattagtcgaacgtatcaaaggcgatgtaaaacgcactcgccgctctgaagttatgggcggattgggtggtttcggcgcattatgtgctttacccaccaaatataaagagccaattttagtttctggcacagatggcgttggcacaaaattacgtcttgcgattgacttgaaaaaacacgataccattggtcaggatttagtggcaatgtgtgtgaatgacttaatcgtacaaggtgcagaaccgcttttcttcttagattactatgctacagggaaattagacgttgatgtggcagcaagtgtgatcaaaggtattgcagatggttgtgaaatgtctggctgtgcgttagtgggtggcgaaaccaccgaaatgccaggaatgtatcacgaaggcgactatgatttggcgggtttctgcgtaggcgtggtagaaaaatcagagattattgacggcacagcagtgaaaacaggcgacacgcttatcgcactcggctcaagcggtgcacactcaaacggttattcgttaattcgcaaagtgcttgaagtaagtggtgcaaatccagcggatttattagaaggtaaaccacttagcgaacactttttagcaccaaccaaaatctatgtaaaatcgattttacagttgatcaagcagaccgaagttcacgccattgctcacttaacaggtggtggtttctgggaaaatatcccgcgtgtattacctgcaaacacaaaagcagtgattgatgaatcaagctggcaatggcctgcgatcttcaactggttacaagaaaaaggcaacatcagtcgttatgaaatgtatcgcacctttaactgtggcgtaggtatggtaatttcattaccagaaaaagaggttgaaaccgctcttgcattgcttgaacaagcgggcgaaaaagcgtgggttatcggcaaaattgaacatcttggcgaaggcgaagcacaggttgagattcaataataaaatcttaaatttaaattcagcccttttgggctgatttctataaggaagaaaatgaaaaaaattgccgtccttatttctggtcaaggaacaaatttacaaactattattgatgcctgccatttaggcgatattcccgccaaaattgcttgtgtggtaagtaacaaagctgatgcttacggcttagttcgagccaaacaagcacagattccgcaagcggtctttcttcgcaaaaatttttccaataacctcgaaatggacgacgccattggcgattatttgcaaagcctagccgtagatttgatcgtccttgctggttatatgaaaattcttaccccaaaatttacccaacgttttgcagggaaaattttaaatatccatccttctcttcttcctaaatacgcaggcttaaacacctaccaacgtgcgattgaagcaggcgacaatgaacacggtacaaccgttcattttgtcaatgaagaagtagatggtggtgcgattgtcttacaggcgaaagtgccaatcttccctgaagatagcatcgaagaagtggaggctaaaacccgtgagcaagaatatcaaatttatccgcttgtgattaaatggtttaccgaagggcgattaagacttaaagataatttggcatatctagatgggaaagctctgccaaaatctggatatgcaaatgaataacttagaatttagacagactatttctgtattttttatttaattaggatgtaaaagtgcggtgaaattttaccgcacttttaaaattagtgatgatggtgttctggttttggaggtagtttagctaatcctttaccaaccggtaaaattaatgtgctatagcttgcagattgctgacaaatttgttgatctgcaaatggtgttttatgaataactttaattttccaaataccatcaattaatggaatgatattcacacgtccttgactatctgttttacctgaaaaaccttgtggttcacgatgacctgtacttgcttcaagatctttcacgataatagtatcagcggttgcgatgacagtttcgcctgctaatggctgatcttggtagaaaatttgaacagggaacggttcgcctgatttcgctttgctaggatcacgcaaaggaacaatttccagtggtaaaccaactcttgtcattgccatttctgcatttaatggttttttaccaacggtaacaagacttttgccaaacatttgagtttgttcacaataagtgggattttctaattctttcaaattatccattttccaaccttcagcattttgtgaccaaaaagtaggtttataagtcgctgttacccaataagaaccatcggacaatgctttctctgattgatattgatagttttcgcctttttggattaaggtttgtttttctccatcttgacgaataatttccattggtgcaaaaatttttaaacgtgcttcaggaattttttctacataagggtaatccccataagctaattctgcttttaatacagaaccagatgttaatttcgtcggtgcttgaacccaaacttcatgagcttgtgctgtgccagctaaaaccaataatcctgtaatcaatgtctttttcatatatttccttaataagaatggaggagttaaaaatgagtgtgaatactaaatgaaaagagctatcatttaaatagctatttaaataaaattttaagatttgtgatcgagatcacaaaatgaaaaataccataagaaatagtataaaaataccctaaatacaaaatatttagggcgtcttataaattgaggaaaatgttttaatcgtcttttttagatggtttaatgcctaataaattacaacttaatttactaatcacatgttctgcagtattgcctaataatgcggcagataaacctgttcgtcccactgtgcctaaaatcactaattcagcttcaatttctttcgccacttcaggaataacttcctctgggaaaccttcgcgtacgtgagtatgatcttcatcaatcccaaacttctgacgtaacgctttcatattaatgagatgctgacctcgaataccgttttcataacctgaagtattaaattcaggtaaatcaatcgccatattgattggcgcggaagggtaggctgccaccaaatggacattaccacgatttagattttccgcgagtgaaatacctgtttctaccagctcttgattaaattcatcttgatattcttgttctccagaaacattcaccgccacaagaatacggcgttgatgtttccaatcgccatcacgaaccattaagacaggaatagggcatttacgaagaagttgccaatcaatgggagtaaagataagagacgtcagtttttcttcgtctttagtatattttacgactagatcgtaattattattttctacttcttcgttaattgcatcagcttcattgctattccacacaatatgagattgtaattcaatttctggatttgcatatttatctaagtaatattgaaccacatggcggtgtttttcaattacttgttgatgcatttctgaacgttcttcagaagaaagtaaagctgacatttcataagataaatcatagactgataaaagtgcggtgatttttaccttagtttcatttttttgttcttcaactaaacgcactgcacgagctagggcgtactgtttttcattactaggattaagtacaacgagaatatttttaaatttcataatagcctccaaaattgaggcataggataaaaaagaatagcaaaaatggcaaggtacaagattaatttggataaatttatttttatcaagcacaaaaaggcgtgatattcacgccttaaatttatttaactaatgtaatttttgttttattcgtaccagttaattcaattaaaccatttaaatcattgattgtaatatatttgccttgtacgctaatcacgccgagtttttgaaagcggcctaataagcggctgatggtttctactgttaaacctagataattaccaatatcgccacgtgtcattgttaaacgaaattctcttgctgaaaaacctcgagcagaatagcgtttagaaagattatgaataaaagcagccaaacgttcttctgcattcattttagatagcaataaaatcatctcttgatcacttttaatttcactgctcatcaaacgtaaaatttgctggcgtagttttggcatttttcctgccaaatcatctaaaatatcaaaaggaatttcacataccatagccgtttctagagcttgtgcaaaactagggtgttgcatttgagtaatggcatcaaaaccaactaggtcaccgggcaaatgaaatgaagtaatttgttcttcgccagattcactaatcgtatagctttttattgtgccagaacgaatagcataaattgaattgagagaatctcctgctttaaacaatacttgagacttttgaatcggtttttttctctctatgatattatcaagctgatctaattcttgttcatttaaggtaaaaggaatacaaagctgactaatactgcaatcctgacaatgaatcgcacaaccgcctgattgaattttgcgccctgattgagctcctgcaacgaaatttttcatgtacgtctcaaatattgaaaaaaatagtgtaaaattgatctaacgcaaatattctaccactaattagtcagattaagaagagtaaagcattatggcagctgaaaaattaacaaaaaaacgtttagctcaaattttaattatgttgtgcattttaattattgcatttgtttggcgatatttttagaaaacagaaaattcttgcttatttttaaaacaaatggattatttccaataaattttgcttgtcacattcttatatatacgtataattcaaccccattaagcctgggtggcgaaattggtagacgcagcggattcaaaatccgccgttgaataaacgtgtcggttcgagtccgaccctaggcaccacatacaaacccttgatcgttggtcaggggtttttcttttatgcatttcaaccagtaaaatcaataagttacgttcatatccgctataaattcatcaccaatcccaacctcaaatattgccatttttaagtatttttatgcatcgattacgccaaaattacgccaatgcaacatgaaatggggtgcggaagaggaaaagaaaatagaattgcaagcgcaaggattgcaacctgatacattattttctatttgaacgaaattacgccaacaaagcgtggagaaaagcacgaatttaatcggctgaatcgctttttacgccatccagttacggataaatatatatctgatgttagtcggataggggatgaggaattgtgttttgatattaagtctagtgtgcttgatgcaacattccgaaaactcaaaaaacttgccgagcgagaatatttgcattttcacgacacacggcgtgaggcattgactagactatctaaaaaagtagatgtgatgacattagccaaaatatctgggcataaagatatttcgattttacaaaatgtctattatgcccctgatatggcggaggtggcggaattactcgattagctaatatgtttagcattgatccgccccaacgaacaacttcgcctgcgatatagcgtgggcgagaattttgttgatcgactgtaacgggttttgggaaattaggcagttttgaaataatcttggcaacggtttgatagtgtcgcccaaaatatattgcgatatcctcaagcgtaattaaattttggcttttctcggtcaaattagataacgccgccatttttgccgcattcacaatttcttcttcggctttctgcgaaagtttaattggttccatatttcctccaataaaaaaccgcccataagagcggtggtttgttaatattgttgtgtctgttcggcatgacagattttgccgtcacagtcttgattaagatttagggcgtgcgccatatacaccacaaatgcacacacgagcgtaatgattaatttgttcattttctgttcattttgtcggattttaggtgtgagaatccgccgcaggcttaaaaaagtgcggtcggattttgtgatgttttattgggcaatgaggtttttcgctctttcccaattcatttgattagacgctttaaatggtgcaattaatttctgagttctttgcccatatcgagggtaatgtgatattccttgcgtgggcgtccgttggtgcgttcggtgatgacgaggtagtcttcattttggatgaagccatattcgttgatgcggtttttgatccaatcagtgtattgctgtttgctttctacgaatgcgtgaagttcacgagcgttgcaaagttgaacgggttgattttggattaagccattaaaaacaggaattaagtttaagtgtgtcattgtgatgtactctaagttaagttttaaaactcatcacgaaccactgcgaatagttggtgatgaactgaataggattcgcagtaccgtacttagagcaaaacggcggatctttcgatcctcctaaacagttcatcattgggctttttcataaatttatgaaaaaggtagaatagctgttttgtggcgataaaaaaagacgcattgagcgtctgtctttccaccgctccaagttattcagaaactgcgacattcccgactttctgttgaaagtgtggttatcttaatccgaagtgagggcggtgtcaaataaaaagcgctgagaatttgagggagcgagttattcatcatcaattaattcttttgttttctttggaatgtcattcacctctcctttaataccatcaacagctttatccaggcgttttcctactccatcgataattgtttcaagtggtgtgctttttaaatctttgtcaaagactttggttggatttatccccaaattatccacggcaatttgcagaagttgctgatgtaatttagggtcttgttcttgtacttgtttcttataaccttcaaatgccattgctgaggaatatttgtagttataatcctcccttaatctaaagagataagcccgttcttttgcttttaaccaggcgatgacaagtaacgggattgtcacaatggacttagcaagaaattgtaaaatattaaggctgtctgctgcactcaggcttgttgaataattgaacaatgaaataacagatgttgcaacaagtgacccaagcaaaattttatctacagctttcattttactatcgatattttcagattgagttttaaacgaacctgccatgcttgctcggttggcgtcttcaataatcatttcaatctcctctttttgtttattgaataatttaatcataccttcaatatcttcatgatatttttcgatttggggtttattggtttccgctgtggttgctaatgtcgtaattttagtaagattattttgtgcggtgaattcatagttcgaaatgtcgccacttaatttctctgactgttcgtgccactgggaaatttcagttatttgttcttgtgcgtcgttataagattttttgagtgtaatcagtgagttttttaaattttcgaactcctttttattctctactaattgctcttcaagtgagatgtgctcttctaaattcaattttgctttggatatatctgcagcaatagcattgagttcttcttctgttcttaattcacccttaacttcaattaaatataattccttgattgtcattcttagtttgattagagataaaataaatgaatttacatcatattcatcccatttattactcgctctttttttattgaggatgcgaattatttttttaattaattgaagagaaatatattttgcataggaaatttcaagactttttccagatttttctattttctctattaagggataaagttgctctatttctttgataatttcgggtgattttatttcgcccatccactcatagtcttcgttgatttttgtattaattaagttttttaactcagtcagtcttgctttaacggttttcatagcattccctttatatattaaaaattattctgattgtaaggtaatttttcgggataaaaaagccctcgttttacagagggaaaaactaaggaaccgcataagttttaagccctcatgctcggctaacttcgtttgtctgccatttcaaagcgcactctgtcttgcatttgtgtttctgtgcgcttggattcactctctgctgagtacgctttgaaatttaccgtctttccggtatgtcacgcctttagctaacgtttgctgtctgtcgctttcccatttttaaccaacttgaaaacagaccaaaaggtgtggttcggtttacctgtctgtttccactttcggcaactgcaccgtttttcacaggcttccacttggacagatattcaaaacacagtgttgctaagtaggttagggctttcaatctaacgaccgcctagcaccgttatgcactgtgattctgtagccaaattgtctaaaactcaaaacaggttaatgatgagtgcctttctttatacttgtaaggctcaagtccttattgtcaccacaacacataaggaatataatttccctcaaccacaacacaaaaaataaggaagcatcatgaaaaaaatagcagcagataaaatagctcttgttatggcaagagatattttaaaaacaaactctcaatatttgcgagaagttaatgagtatgtggccgaagatattgccagatttgtttcaacattatcatcaagattgcaagaatctattgatgatagcatttccagttcagatatttttaacgcccataagaatcaataaacatcactgccgaacatacactctcagctaattcacttggtgttaaatttgtatttttatcagcactttctaatacagcctgtttgattagatttttatctttatcagataggcttttttcttgtttttcttccatatttgaacctcgtttgttttatgtctgccatttcaaaacacacttcatctatcattcgcaacggtttcacatgccgttgtgtctctgtactagcaaatgtgttttgaaatatccacattgggatattcgcctgcttgagctccactttcggcaactgcaccgtttttcattggctttgcatgggcagactttaaaactcactcttaactaagtaggttagggctttcaatctaacgaccgcttagcaccgttgggcttccgtctgcgcttccgccgagtgagtttctttaaccaaattgtttaaaatttgtgatgaaagtcactgacttacataaactttttagctattcttgtaatcaaccttgatactttcgatagcggattttcaggaatgtaaactgaaaggtgaatctcgccgtcaacagtaccttgggacattgcttttagcttttcttccgcttcttcgaatgaatgggcgtaaacatctgtcgcccaccttttgccgtcgaagtgataagaaattgcatagcgtttcatttcttcttgcataaggaactacctctatgtattttcagatatttcagggtgtaaacaatcagtggtattggcgactaaaagccgccaatcatgaaaccattgcagttagcgagggttatacaaccaaacaaaactgcctacattgcattggtctagttatggatactgatagaaagacacctatttatgaatcttaataactaagccctgttcgcagggctttttttcatcacaaatttttaaagagcattgagattgtgtatctcgttttgatgtggctaattctacttaaagtagatttaattgcaactaaaatttgcacaaaagtagatttattctctactttaatttgtaatccgttgatttaaaaagaaaagaattttgagaaaagttgtttgattgcctgttttttaggcaaattaggtgagggaggtgaaaagttcggtcgatttttgaggtgtttcggtgagttttaggaaaaagaaaaccgccacgaaggcggtttaggtgtcatataaatttaggagtaaagaaagtctttagtgcatctaacttataaattagtccacgcattgcagtgttccttacctcaagattatctgatacaagatgatctgtaattgcttgttttacttctcttaactccattctagggtaacgttctgaatttgataggcttttaatttccagacattttgattgcaatcttttatgaaatgcaatcataaggtggtaatccatttcatcacttaaatttgattgtgtctttttgtggatatttaacgcttctgtaaaaacaagatcgcacaaatcagataattttgagagctctccattataagctgtattttttaaaccccttgcgcctaatatatagcttataggtaacgcaaagatagaaactataagcgcggagaaagctattagatcagaaagagtcatttattatccttcaaagataaaatctcaatctctttttctacataacttttaatttcgtcaataatatcatggtcgtcatttgaaataaggtttttaacaagatttaaaacaacctctggagaaataccttttctaattgctcctccaaaagtttcttcaagaaatgaagagccatatccttctgtgtcatctaaattaagaatgatatcaggatccctttttattgctgggataagaatagaatctctaaattcctctccactagctttaccatctttaatgtaacgtggacctggatattggctgaaatcttttacataaatagtttgcattattattccttaatttcttgtagcggaatgttccactgaacaacagtaccattaatagagtatctagattctttggttaaatctggcttatctttgccattatacacatacattcctcgatttgaacgaattattagcctgcttcctggtgttttgtcaataaatgctcgaatatcacttcccccttttcctctatgtcccaatcctgttcgggtttctttaatgagggtagaggcttttatatataaacaatcttttgtcggtttccccagctgctttagtctattccaaatagcagaaagtacatttgctttctgtgttttttctagggtattagggatcccgtgacccaaatcacaaacaaaaagtgacaattttccttctaggatagcaagcaacatccaccaacgttttataggaaattctcgttcactataaatattttgggcgtaagcatgttctaccgcatttgcaatcgcttcaatgtaactaggatatatccctttcacccccatacttttaagttcatctaatagtggctttgtgatttcgccatctgcactatcactataaacataatgccaacatttcacattttcttgagaagatgaagatgtataattaaaccctaaggatttatatagtcctatatgacaaaatatagcatcaacatcatagggaatatgtttacgatgatctgctggttttgattttggtcttacaatttgaaatttcaaggttctatattgcgattttatcgtatctaaaacagctattaaaacgctacaagcggcagcatcgataatatcagtgtcccgaaaatttagtttcaggcgacttcgacttcgtgctgctagttttgctttttcttcgagctcttctttaaatgctacaaattcataccctatttctttagctaaaataattttatatggggcgataacctcaaaaagattaaaggatttatgagcaagatgtttatatttaggctttccgcctctttgtctgattttcttttctttacttgtgagagctcgtaatgttctttgtctaacaatagatctccataatcgaatatccatagttggttccttgggtaacttatgtagaagtcgttttagttattatgttttctataataatactgaataccaaaacactttccctaacacagaaatatcttgtagttctgctatttcatcagggtgttcttcggtgttataactgcggattttcacttgttcgtttggcatattgtaaagtagctttatgcgtagtagcccaccgtgatttattgcgtatattttcccatctcggattgttttattaccaagatcaatgccaactgttgttccatccggaataacaggctccatcgagtttccgtcagcaatcacacataccgcattttcgtactgtacgccttgtttacgtagtgttgatttggaaaaacgcaatttgaagttgttatagtccgctatgtcatcagcaaatccgtttccagcagcaaggcgaatgtcttgataaaacggaacggcgtattcatcgctatttagtggagtattgcgatcccataagtcgaatgagccaacgtctttcacattagaagttacttgattttctaaagaatcgactgttccgtatttcaaatgagcaggggtaactccaaagtacttcgctatagcttcaattttattatctctcggggttgcagtgcctaaagtgtaacgtctagccatttcataggttacgccaacagctttttgtaaatccacaatatttttgccttgtttagccattaattcattaagtcggcttgctaaatctgtcatagacactcctttattctactaaaggtagaagatacaaaattaaaatggttgattcaattctatttttaatagtagaattatactactttaaatagaataaagaggttaaaatgctaccaatcgaaaaagcttatgaaatcgtgggcggtatttcggctatggctcgacatttcaatcttaccccttgggctgtttccaagtggcgtgaaaaagtacctgcggaacgttgcgcaaagattgaagaacttacagatggaaaagtcaagaaatccgaattacgtcctgatttgtgggattaatttaccaacctttaccaaaaagaaaaccataaaaataaggcaaaaattatggaaatgaagaaagttattatcgaaatggttgatcggattcctggggggagaagtgcggtagctggattcctaggttttaccgaaagtgaattaaagaatcgtctttatcaaacaaagggtcagcgattcaaaaatgaagaattaattgcgattcagcaagaatatggctgcacgcaatttattgatgaactatgccgtttggctggtgggcgttttgtacctgatgtagcagagaatgaattagacaaggttgagcttgctaatttacaactgcacgagctttccgcacgaggcttgttatttgctgcattagaaacagcgttagaagacggcgaaatcacttcgaaagaagaagacaaaatacgtcaagcattgagtaaacatttggcagcgacgcaacattcgattgaatgtgcgattgtgttacacaagaaataaaaaaagccacgaggagatttcgtggctaattcattaaggaatatacagatgaatcaattattaacgatttcgaaagaaaacacaagcactttgacgatgagtagtcgtgaaattgcggaattaatcaataaaaaccacagcgatctgtgtcgttcaatcgaaagacttatcgcaaaagaggtgatttgggggtatcagccaatggcttacacccatccacagaacggtcagacttattatgagtaccatctaaccaaacgagatagtttaattgttgttgctcagaattgtcctgaatttactgcggcaattgtcgatcgctggcaagcgttggaaaatcaacaaaaaccaaccgcacttattccgcaatctttttctgaggcgttgatgttagccgctcagttacaagcagaaaaagagcgtaatgcgcctaaagtcgcttttgttgatcactatgtggaagtagggacgagtaaatcatttcgtgagacggcgaagattttaaaaatgcctgagcgtgcattagtcaatcgcttggtggaagataaatatttgtatcgtcaatctggcgtgcttttgccttatcaatcggcacgcaccaaagatctttttacggttaaaacaggtaccgctgaacacggtcacaattacacacagacacgtgtaacaagcaaaggcattgaatttattgcgtcacgttatgcttcggagttgatgttatgagtatgcgattaatggttcaagcaatgaattgtaaggttggtaatcctgctagaaaacttgtgcttttaaaactggctgataatgccaatgatgatggaatttgtttcccaagttatcaatacattgccgataaatgcgagatgacccgacgtagtgcaatcaatcacattgaatatttaatcaaaatgggattagtaagcaaaaaagaacgtaaaaataaagatggttccatctcaaatttatactttttacaccttgaacaaggtagtgaaaattttgcactgggtagtgaaaatatttcactaggtagtgaaaattttgcactagggggtagtgaaaatatttcacccagaaccagtcactctttagaaccagtcaatgaacctaaaaaaactacgcaaaaaagcgaagccgaaatgttgcttgagcagttcggtattaccggacaactggcgaaagattttatcgcacaccgcaaagccaaaaagggcgtcattaatcaaacgcaactcaaccgtctgcaaaaacaggcggacaaggctgggatttcgatttgtgaagcggtggaaatttgcatcgaacgcaactggcagggatttaacgcatcgtgggattggcgtgatgaaaaactgcgaccaaattcaccgcacttagggcaatcacaccgcaacaaacccaaatttgacgatacgcagacaggctggtctgcaggaatgaatttcatagtggacggtacacaatggcaaattccataacacaaaaccaaattaacacgctcccaccagaacgcacacagcgtgcggaagagacgattaactggctctttcaagagcttaaatcgatttttcctggttggcgtgcagcctttgaaaccggagcggattatctctctgctaaaaaaacttggttgcgtgtgttggtacgagaaaaaattacgagacctcagttggagaatgggatttgtgaagcggaaaaatcgcttgataaatttttacctagcgtagggttgtttgtttattggtgcaaagcctacgactatcacgcactaggtttaccgaacgaagcggaattataccaacgttataacactttcttaggctatgcccgattcaatcgggatgaatttcaatatcgttcaaaagtggaattttggttgcttaaaaatctgtacgaaaagtgcaagaaaaaatcggaagaggacacgttgaaagctattccgaaattactcacaaaagcggcagaaaaagtgcggtcgaattttccttttgaggatattccgaaaatgattcctgaaaagccaagtttttacgataaagcgaaggctgataaggcgcgcgatagcttgatggcaatgatgaaagggaaaggggcattgcaatgacaagctataaatgcccaaagtgcggtgcggaattagaggatttttatacgccagattattttatatcgagcagcgaatgggatgacgatcgttttcgctgtaacggtcacttaattgagccgataccgtttccgcaggtaagtaaatacagtgcagtgaatcgaacaaaatcttgcggttattttgggttggaagatttaggtgtggagtacaaagaatgagttttgcgatgttattcaagcgctgggaatgatgtgatgagccaatataaacctttctttttacgcgatcaacgcattaaaaataattgcttggatttaatcaaagagctgccaatagacgataaaaagccattggtagtcaaaatccaaccaataacacgctcacttgagcagaactcaaaacttcacgcactactaagcgatattagcaaacagtgcgaatttaacggtaaaaagcgagacattgacacgtggaaaatgattatggtatcggctcacaaaattgcaacaggcggtcaggctgaaatggtaatcgggcttgagggggaagttatcaatctacgagaaagcaccgctcaaatgagcgtaaaacgactagcaagcctaatagagtacattaccagttggggcgtgcaaaatggcgtgagatttaacgatagatgggggttttaaatgaaacgcttaaacgatgatgagattttggagttaaaaattgtacttttgattgcggcagtttgggtaatgtttaatatggtgtttggctaatggcgaaagagtataaatgcaaagtttgtggcaaagcgtttgtaaaaacctttagctcaacacaaaaagtttgctcgcctgaatgtgcgattaaattagtccgagaacaatcaagaaaaaggcaaaagaaagcggaaaaacaagaacagatagagcgtaaaaaaagattactagatggtgagagggcattggctaaaagctcttcaaaaagaggtaaataaatttataagattgagagataaaggacaaccttgtattgcttgtggaacggtatggaaacctagttttcaagcgtctcattttattccgcagggaagaagctcatttttaagatttgatgagaggaatatccattctggctgtatcagatgcaatcttttcgtaggtggcggaaatatacatggatatagaccaagactagtcgagaagattggcgagcaagaggttgagtggttggaagaaaatcaacatcgaattaaaaaatgggaaatttctgagcttaaagaaatgctaaaactatacagattgaagaacaaggaattagaaaatgaaatgcaagattgatggttgcaacagagaggctatgtataaagctgattgcgtttgccaaatgcactattttagatttatgagaaacggaacttatgatcttcttccgaaaccaatccgaaaatacagaagacacaatggaaagggttatcagttaattttcgaaccaagacaccaattagcaatgagcgatgggtatgtttatgagcatagatttgtgatttatagcatttatcaaaataatttacctaactgcaagctttgtggctgcaagctaacttggagcagttgtcacatcgatcatattgataatgacattaccaacaacacgctagaaaaccttagaccaatttgccgagcttgtaacgtaatgagaagtcacacattaatacctaaatatacacacaaaggtcattctaaaataacttttaatggattaacaatgacagcagctgagtgggctagacaagatggcgtaacagtagctgggaatacaatcttgagaagaattagagatgggtggagcatagaaagagcattatttgagacaagttcaacacatccaaatgcagcagttaagcacactactactaagtataaaaatagatttgaagtgaaatctactggaataagcttagatttaagattgcaaggcgatgattaagcattacaaggcaaaaattaaggagcttacgtgaatattgatgtgatttcagttgaatttggttattgggctacacctcgttatgagactgaatttccacgtgtagccgcagggtttgcagagatgaaatgtgatgctcgttatgctgaaaaatatcgtatgcgtcctataagcgatgaattaggcatggaaattgatggctaccttggtgtaattagaaaagtcacaccagaactttatgatgtattcgttctgacttatatcaagagatgggaaaaacaagaaatttggcgatatttacatatttcacggcgtgaatatttcaatcgattgaaaacggtaaaaacatcacttttattgctattatcaacagaaggcaagcaatgtttatttattgcctgaaaagtgcggtctattttgaccgcatttatttcaagggtaggtattctttctattcttgtccttcctgaagtgtgagtttggggtgtatcttatctaacatttcataaaaattatctttatctttagatagctttaaaagtgtaacgatagaagataaatgttcacgcaatttagggtgccctacgtcttccgttaaaaactggtgtaattttactttttttgcttgtttacttgccgattttttgagttctggtaataactctggagcgagtcgggcatacacggcgttgtttgtaatatgcccgaagaattgtggaaattgattattatttttcggagggaattgaacgccatataaacgacataattccttgtaatagtctaaaggaaaggttttaacccaaggttgtaattcttttgcgacaaaggcttcaaaaatttttgcgagtgcgtctttggctcgtgcatcttgatagccggtgacttcatccactaatgccacaatgcccactttggctaaagagcggattagaatttctgctttttgggcggtgttttgttgcttaccaaccaacgccccttcttcacgtgctcgtagataaatatcacacacgacaggtaaaatagtcgcatcatatccttccttaattttaccgtctttggtgcgatatttaacccctttgatcacatctataacatcttgattaataaatggttttagattatttgcatccataaacgcagggagtttgatcaattcttcgttttctgttattgcgccaccacgagaaccacgatttgggcgatctaatgcttcaaaaacagaagcacttgaaataatgcgtaagtcattttgaagcactgccacatcaagcgatttatcaccaatgcttaatacgccttcgtgaatagctaaagggagttcttctagtgcttttttatgttcccagcgtgctaacgctgctttctcggctcgttctttacgtttttcagccgttaaggaggtagaaaccatatgttgctccattgcttatttataacttttattagcataatgctaaattatatttaagtaaagcattattttatgctttacattctcaaaattttcctctactattttattcaaggtctcaaaagccttatcaagaacggtaactcaccccgtcagcgtgatttttttatgcgtaaaatttaccttgtttgttttattgccattaagacttacaacgcataaaaagaaaattatcaatcaatgttcgacagtgcgactaatacaataccgaaagggaataagtccgctggattcttgaccagttttgagctgtcgaacgcccgatttatcgggggcttccatcaaaaggaaatcaagatgactactcaaatccaattctcaatatttaatttcaaaaattccccagttcgcacgattaccgatcctaatagtgaaatttggttctgtggcacagatgtgtgcgatattctcggttatgtaaatgcgcctgatgcaatgaaaaaacattgtaaagaagctggtatagcaaaacgctatatcagctatccaagcggtagaaaggaagcgatctttatcaatgaaccaaatctttaccgtctgatcatcaaatctcgtaaaccagaagctgaaccatttgaagcgtgggtatttgaagaagttcttccgcaaattcgtaaaacaggaaaatatcaacttcaaccgcaacagctcgccttgccagaacccgaaaagaaattcagttttgaatttaccgagtatgaacttcaacagcttgtttggttgtggttcgctttcatgcgtggcatcgtcacattccaacatatcgaaaaagcctttagagttttaggctcaaatatgagttcacaaatctacgggcaggcttacgagtatctaagcgtgctacgctctaccaatcaaatcttaaaccgcatcacaagtgattttgacatcgaccaaatgacaaactggcgtgtattaaaacacttgcgaggctttaatccaaaagcagtcaaaatcgacttctaaaaacaacggaaaatccgaccgcactttaccgtgtggcggatttttacacctcaaattcacgaaaaaggatacattatgttcagaattctctttgcggtggcgttgttatgggcagcatacgaactcaatttaaaccaagattgcgatgggtatatttgcgacacgtcatcactaattaccgcacttcataaaccgcttgacagtgcacactaaaagtgtatcatatgtactatattgcggttttagtgcatagcaaacgcaagaaagaattttacagccctgatcggaaacggtcggggcttttttattgcctaaagaacaggcgggagaaaatatatgccaattaaagagcctgatgtgtgggcgttaatatggtcttggttgcaaacaaatcttagttctagctcagcacagagtgctttttgggcgttatttatttctcttttaagatttgggtttatgcgtaaaaagccagctattcgttatgttttaattgatgcggctatgtgtgcatccattgcgggtgttgcagtgccaatttgtacgcatttatttgggcatacagaatattcttcatttcttggcacgatgattggttttgttggtactgaaaaaattcgcgagtttttatttaaattcattaatcggagaattgaaaaagatgacaatgatgatttccgaagtgacatttaataaaatttttccacacgcagttaaaggtgtttatcaagctatttcggcgcagatagaaaaagcaggttgtgtgaataagatgcagcaagcgatgtttttggctcaatgtggacatgaaagtggcggatttacaagatttaaagaaaatttaaattattcttggcttgggctttctaaaactttccgtaaatatttcccagaccctcttatagcgaagaaatatgagcgcaaacctgaacttattgccaatcgtgtttatgctaatcgtctaggtaatggcgatgagaaaagtggagatggttggaagtatcgtggtcgtggactgattcagatcacaggtaaggataattatgccgcgtttagaaaatggttaggtagagatattgagccagatgatgtggcagggaatttagatttatctgttaaaactgcagtgtggtattggaaatgctatgagttggctgagcttaattctgtggaaaaagttacgcgaagaattaatggtggactaaatggcattgatgagcgttgcaagctctatcgagcattaatggtaacggataatgactaagtacatttacatggcgttagcgggtgttgtcgtggttttgattggtgcattgcgttaccaatctagcgttatagatgagttggaaataacgacaaaacaacaagaaaatactatccagcaacaagaagatgctaacaaatcattaagtcttgcgttacaacaagagcgttatgccattattgagcaacaagagcgtaataatgaaatagaaaggatagcaacagaaaatgctgaatcagttaaaacaatcattaagactcaaccttgtgctcacactcgtttgcctcagtctgttcttgaccgcttgcacgaataaaatcacgactaaaccagaatatatttatccgcctcaagcctatactgcaccttgtgtcaaaacagcatttactggggaaacatacggcgatgtagtcatacagttagttaaggtaaccgcagagcgagataagtgcgcaagccaagtagatcatcttaataagtggattaatcaagcaaaaggtggtaaatagattaaaaatctaattgagcggaattaatgccaagtgctgtcgctattttaatgcgagtgcttttacgcaaggtctgtgaattttcgtgttgtgaataagcagcttgagaaatgcctaaacggcttgccacttccgcttgtgttaaacctaagtgttcacgccaagcacgcaatgcagaataatcgttcaataaagctaatttggcaaccgcttctggaatacctgtctcaagtggattggtaaagatgattttttcataaaatgttaataaatggttcatctttctattttataagttttattcaagtattttaaggatttcctatgtcagacgtgaaaggaaaatctacgtctggtcgtggattaacacctaaacaagaaaaattttgccagctttatattgagctggggaatgccagtgaagcatatcggcagagttatgattgccaagatatgaagtccgaaagtataaaccgattggctaaaaaagaattagataagatcaagattagatcaagggttgatgtgcttcaacaagagcaccgacaacgccataatcttaccctagataatatcattgcggacttgcaagagtatcgtgatatttgtatgggaagaaagccacttactattaccactgtggtaaaaaatgctcaagaaggaacggcacaaagcgttaataccgaatgtttcgtttttgaaccgacaggtgcaaataaagcccttgaattgcttgggaagcatttagggatgtttaccaataaagttgatgtaacaactgatggcaagcccttacctactgtgattaatgtgacatttagcgatgagccagcttaatattcaatttcctacgaaattccgaccgctctttgaatctatttggccgtttattattttctacggtgggcgaggttcaggtaaaagttttagtatcgctagagcattagtattgcgagcctatcaatcgcctgttcgagttttgtgttgccgtgagatccaaaaatccatttctgattcggttattcagatgttggcagatcagattgaaatgttaggtctacaaaatttcttcgatgttcagaaaacgcaaattatcgggcaaaacggttcacgcttcacgtttgctgggctgaaaaccaacatcacatcaatcaagtcaatgacgggcattgatgtagtttgggtagaagaaggcgagaatgtttcaaaagaaagttgggatatattgattccaaccattcgtgaagacggttcgcagattattgtgagctttaacccgaagaatattcttgatgatacctatcagcgttttgtgattcatccgcctgagcggtgtaaatcggtcttagtgaattggcaagacaacccatattttccgaaagaattaatggaagatatggagcagatgcgtgagcgtgattatgaactttatcgtcacgtttatgagggcgagcctgtggctgattccgatttagccattattaagcctgtatggattgaatgtgcggtggatgcgcatctcaagctcggttttaccgctaaaggaatgaagaaagttggctttgatgtggctgatgagggtgcggatagtaacgataatgcatttgttcacggttctgtggtgcttgacattgaagtttggaagaatggcgatgtgattgattccgccaaccgaacaaatcaaagtgcggtcaaatttaaagctgatttgattatattcgatagtattggcgtgggggcgggagtaaaagctcactttaaacgcttgccaaaatctttacaagtggaaggatttaatgctggtggtgcagttgcttatcccgagcgtgaatatatcaaaggaaaaaagaatcaagatatgttttcgaacattaaagcccaatcttggtgggcgttgcgagatagattctataaaacctatcgagcagtaaagcatggggatgtttaccctgacgatgaactgataagcctatcgagcaatatcaaagagcttgagtatttgaaagcagaattatcacgtcctcgtgttgattatgacaataacgggcgggtaaaggttgaaagcaaaaaggatatgaaaaaacgtggcataccttctccaaatatggcggatgctttagtcatgtgctacgccacgacaaaacctaaatcactactggatttataagatgaatattttagatggcatcaaatcacttgcgttaaagttaggcagcaaacaagaccagacatattatgctcgtgggcttagcttaaccgatgacttaatgcaaatcgaagcattatggcgtgataactggattgcaaataaggtttgtattaaacgttcggaagatatggtgcgtaattggcgcgatattttctcgaatgacttgaaatctgaacagctagacgagttcactaagctcgagcgcagattaaaactgcgtgagacattaactaaagcgttgcaatggtctagtttgtatggggcagtgggtttattacttgtcactgacacaattaacatcacttcgccattgcagcctacagaacgattaaagcggttgattatcttacctaaatggaaaatttcacctacaggacaacgagatgatgatgtgttttcgccaaactttggtcgatatagtgaatataccattattggcggcacacaatctgttttagtgcatcattcacgtttattaattatcaatgccaatgatgcacctttatctgataatgatgtttggggtgtgtcagactttgaaaagattattgatgtacttaaacgctttgatagtgcctcagcgaatgtcggcgaccttatttttgaaagtaaaatcgatattttcaaaattgcagggttatctgacaagatttcagctgggttagaaaatgatgtggctcacgttatttcagcggtgcagtcgattaaatcagcaaccaatagtctgttgcttgatgcggaaaatgagtacgaccgaaaagaattatcttttggtgggttaaaagatttattgacagagtttcgcaatgcggtggcaggtgcggcagatatgccagtcaccattttgtttgggcaatctgtttcgggattggcaagtggagatgaggatattcaaaactaccacgaatccattcatcgattgcaagaaacaagattgcgtcctgtgcttgaagtgcttgatacattactatgcaatgaattatttggtgggcaacctgatgactggtggtttgagtttttaccattgacggtggttaaacaagaacaacaagtcaatatgcttaatacctttgctacagcggcaaatacgttaattcaaaatggcgtagtaaatgaatatcaagtagcaaacgaactgcgcgaaagtggcttgtttgccaatatctccgctgaagacattgaggaaatgaaaaatgttaatgaatttgccggaaattttgaagagccagaaaacacggaagatgcgcaagttcaagccagtgaagatgagcaagagaacggagctttggtatagacaacagcttaaacagttcgtcaaaacgatgaccgatgatgtagaaagagctatgcaacaaccgcaaggctctttttttatggatgatgcgaaagggttccaggcgattagtgcgaaagcgctgatgaaagtattagaaaagtacgaaaaatctgaccgcacttctcaagctgaaaatatcgccaatggcttcgttggtcgtggtgatgcacaaaaccatgctgaagtatcaaccaatttgaaaaaccaaactggcatcgatttatccgcttatttacgcaatagtccaaatattgctgaaagagtgaatgcattgaccgctggtaatatccagttaatcaagtctattcgctcgcaatatcttgataaagtgcaaaataccgtcatgcaagcaatggttcggggttctttaaataaagaccttgcagcacaagtaaaagacttaggtaaaacaaccgaaaaacgagcgatgtttattgctcgagaccagtcctcaaaattaaatgccgccttaacgcaagcgagacatgaagaggttggtataaaaaaatacatgtggtcaacatcgggtgatgagcgtgtgcgagaaagccatgcggaaaaagatgggcagatattcgaatatgccaatccgcctgccgatactggtcaccctggtcatgatgttaattgtcgatgcgttcagattccagtgcttgatgatgtagttaacttaaaatcagaagaaaccgaattaagctaccaggccgcagaacctaataagacagggaaaatggatctcgatgagttatttgaaagctctatcggtggaggtggtaataagtcattttctaactttggtggggttaattctgaattaattacgttagcgaaagagagtattggtttggatattacagattggcaacacagtattgatgaatcaagcatccgacacatattgaaacaacatggaaacgaaaaagcggaaaataaacgagggcaaagagccgttacaaaaaaagacattttattattgcctttggttgtctccgcatttgatagcattgagtacactgggacaagcgattcagggaatgaaacgtttttgattaaaaaagagattgatgacgaaatattcagcgtgcaggaagttaggaagagacacaagaagattgcagttaaaacaatgtggattaaaaggaaaaagaaagccacaagctccgcatagtgcttgactcacaaatggcgtctgcttaacgtccgaaacgtgctatgccctattgcctgtggcttggcttggcttattttatcactcttaagatactaaattcaactcggcctgaaattgccgagttttttattggggtaaataaatgaaatttacagacaaaaccactcaagcagctacacaaagaaccatcactaaagatggttttttagttgtgcccgcaaccatttctaaagttggggtatttgattaccttgctacagaactaggcttaaaagaagacggcattaaaaaggtcgctcgcacagagaaatcattgtaatgctcgtgtagagcttaattttacaatattttccattaattatttctttattatttgcacatcatttttgttcctcgtagaatacgagcaaccttacctttaaagtgcggtgaaaattgaccgcacttttcttacagtaaactatcctgagagataaacgagtatgtatcaattattccgtcacggcattttccaaatggatgctgaaaaggctcatgatttcacgattcaatgcttgaaattagccagtaatcctttatttcaaccgatcttaaaatctcttattcatgctcccaaaggctttccgaaaacggtaatgggtgtaaattttcctaatcccattggattggcggcaggggcagacaaaaatggcgatgcgattgacggctttggtacattgggtttcggttttctcgaggtaggaacagtcacgcccgttgcacaagatgggaatgcaaagccacgtcagtttcgtttgattgaagctgaaggcattattaaccgtaatggttttaataataatggtattgactatcttatagaaaatgtgaaaaacgcccgttataaaggtgtgataggcatcaatattggtaagaataaatttacatctttggaacaaggcaaagatgattatattttctgtttgaacaaagcctataactacgcaggttatattacggtgaatatttcatctcccaatacaccagatttgcgtcaattacaatatggtgattatttcgatgatttattgcgaagcattaaggatcgtcaggctattttggcaaaccaatacaataaatatgtgccgattgcggtaaaaattgcaccagatttaacggaaagtgaattagtgcaaattgcggatacattggttcgtcataaaatggatggcgttattgcaacgaataccacggtttctcgtgatacggttatggggatgaaaaatgccgaacagcaaggcggattaagtggaaagccgttgcagcataaaagcacggagattattaagcgattacatcaagaactgaaaggtcagattccgattattggtagcggcggcattgatgggttgcaaaatgcacaagagaaaattgaggctggtgcagagttgttgcaagtttattcaggattgatttatcacggtccaaaattagtaaaagaattagtaaaaaatattaaataatgacaaaaaaatacgatttacattgtcatagtaccgcatcagatggagtgttgagtccaactgaattagtgcatcgtgcttatgcgcaaggtgtgaacgtgctggcattatgcgatcacgatacgattgtgggtattgatgaagctgagattacagcgaaagaagtaggcattgaattgattactggagtagaaatttcgacaaattgggaagggcgagggatccatattgtaggattaaacttcgataaaactcatccaaaaatgaccgcacttttgcaaagtcaaaaagcattacgggaaaaaagagcggtggaaattggcgataaattagaaaaagcagggattcctcatgcttatgacggggcaaaagccttagccgatggcgaagtgacgcgtgctcattatgcacgttatttggtgcagattggtaaggtatctaatgatggtcaggcctttaaacgctatttagggcaaggaaaatcagcatttgttaaagctgaatgggctgatattcccacggcgattgagacaatccatgccgcaggcggtatagctattattgcacatccattacgttataacatgacggggaaatgggtgcgtaagctgatagtcgattttaaggcttggggcggtgatggaatggaaatggcggattgtggtcaaacaaaagatcagcgtcaaatgcttgctcgttgggcaaaagaatttaatctgctgggatccgttggctccgattttcatttcccttgtggctggattgagttaggaaaaaatttagatttagttgatagcgttatcccagtttgggaaaaattttagtcagatagagaatgttcaaataataaataccggtttccttgataataatttattgggaaacaggtattttttatggcacaaaatataaaaaactgaatttatccttgagattttttctgactatctaataaataatttggcggtaattcaggtgtagaatcttgttcatcaaaggattcaatttcaggtttgagataaaactctgtcgcttcatgattgcttttcgttttgcctaataattgtggctgaagttttacaaaagtactattcggtgcaagccaaatgccgataaatgcttgattaaatttagcatcaaaatcgtgttctaaaactgtatcatttaagacgaagtagcctctatcgggtaaggcaatatagttcaaaatatcgtttggtgagaaatcaggaaaggtcgcttgcatttctttaagccagctttgagtatcgccatcattaagttttaaggtttcgatttctttaatgagcgtaatcgcaaaattttttccttcaatgggtttttcatatttgaaagagagcattaatggacgttcattttcttgataagtgccagtttcagaaaacaaaccaatggtataaacatggaacggcccccaagtgtattcggcatttccgatgggttgccaatgagcaaaaggtgcggcagaaaaaaacgttatcattgccacaaaaagggatttcattttcataataaatagccgtgaataaaattttgttgattataacaaaccgcatcaaaaagcaaattagaaatcagtaaaaaggcgagtaattttactcgcctttgatcgttgtaatgttaatttgtgcgatgaattattttaagctacccaccatatcttctgggcgaacccatttatcaaaatcttcggcagacactaaacctaaattaatcgcttcttcacgtaatgtggtgccatttttgtgtgcggtttttgcaattttagctgcattttcataaccgatattcgtattaagtgcggtcaccagcatcaatgaattttcaagttgttgtttaatgcgtggatagtttggctcaatacccactgcacagtgttcatcgaaagatacgcaagcatcgcccaataattgagcagattgtaagaagtttgcaatcatcacagggttgaacacatttaattggaagtgaccttgtgaacccacaaatgcgattgtagtgtcattaccaaatacttgtgcacagaccattgtcatcgcttcgcattgagttgggtttactttacctggcataattgaagaacctggttcattttcaggaattaaaatttcgccaattcccgaacgagggcctgatgctaatagacgaatatcgttcgcaattttaaataaactcattgctaattgacgtaatgcaccgtgagtttcaacaatcgcatcatgagcggctaatgcttcaaatttattatctgcagtgacaaacggaagtgtggtgaattttgcaatgtaatctgccactttaacatcatagcctttcggcgtattcaaacctgtgccaaccgcagttccacccaatgctaattggcttaaatgtggcagcgtattttttaatgcttttaagccgaaatctaattgagctgcataagccgaaaattcttgacctaatgtgagtggcgttgcatccattaagtgagtgcggccaatttttaccacgtttttgaaggcttcagattttgccgcaaaagttttttgtaaacgttcaacacaaggaatggtgtgctcaactacttttttatatgccgcaatgtgcattgccgttgggaaagtatcatttgaagattgtgatttgttcacatcgtcatttgggtgaataatagatttttcacctaattttccaccgtttatcacatgtgcgcgattggcaactacttcgttcacattcatattagattgtgtaccagaaccagtttgccaaataacaagtgggaattgatcatctaatttatttgctaaaatttcgtcacaagccagagcaattaaatcacgtttttcaagaggtaatacacctaaatcatgattagcaaatgcggctgcttttttcaaatagccaaaagcttcgataatttcatgtggcattgatgcggctgggccaattttaaagttattgcgtgaacgttcagtttgtgcagcccagtatttatctgctggaacttgaacttcacccattgtgtctttttcaatacgaaatgccataaaatactccgttagttttgaaaaggtggaataacaaaatttagggtatatagtagcgattttgttttgttcaagcgataattttatgttggttttatgatgtagatcacaaaatgctaggtaagatatggattaaatataaaataaactcaatgtaattttccttccaaaagaaaaaatgcggtcaaaattaaccgcactttgacatacaaggcaattgggttatatttttctgtctgtctgtctgtctgtctgtctgtctgtctgtctgtctgtctgtctgtctgtctaagattatcccaagaaagatgatgataaaacaagtattcttcattataaaaacgaggagagttagctgaatgttcctttaaccaaggtttgttgctaccaatgtagtgaataatatgcggagtaaattttattttctctttatgttccatccataaatattcaataaatttaacctgaatattaaattttacaggtaataatttaatcaaattcgtaggtatgctaaaattaataacatcttgatctccatacacaaaaaattcaccatatttggcagcgtactcaataaaatactgctcaatgttattttctcgccatttatttagattaattaacatcactcccgcattaatatattgctgtttttcataaaatggatgttcccataaatattcagaaaaaaagtcactcacacccgcaattaagctatcttctaaattaatatcccataattcgtctatagcctgatgaataataagatccatatcaagataaataactcgttcaatatgctgaggtaaaatttgatgaagatataaacggaataatgaagcagtgctttggatgtgagcaggagatattacagttggaaatgagaattgattaatattaaattgaatatcgtacagtgtgttatcaaatttagcacaatgcatttttaatttttctaaactttcagcaggaataccatcgtgtattacataaatattgatgttattatgatggtagcaaagggattttagtacggtgtctaagtgactagcaaaattacaatctagtgtaaatacaatgttcattattactcctcaattttaatgttgattattcggatcgtgattataagtatacaagtaaaagcaatcttttgttttttcagtaaatcaataattgctggtgtaattatttcgttcttggttttggttaaaacaaaataatgcaggttattttatagcatagagaaaataaagtaaccttatttgtgatatcagtagaattgtcatttatgtgttaggcgtttgtagtgcgctttcggatatgccagttgttgtcccaacggtaaatgaatcacagcttttagaactaagacaacgtaacattgttagtttgccttatccataaataagccaacttgctttaacccttgcccctattttacaagggactaatcttaatcaaatgtttgttacctctttattgccagcgtcttatacaggtgtggaaaccgtaactaaacttgctggacaaacagcccatttattaaacagtattccattagacgaagaagatactcgctttgcatttgatgtctatccgcatcaaacaccctgtttatctaatcaattacaatgaattatttttaataatatctatttaattatttatcttctaaggttttttcgttaaaattctcagttttatatggggcaagattgagaaaataacggggctaaaatggcaaaaactgcacaattttatattcttacggaaaattgtactttaactgtcgaagaaatagcctgtaatcttgctgcttcaatatggcgttcagggaaaaaagtactaattagttgcgaaagtgagagccaagcattagaaattgatgaacttttgtggcaacgagatcccaatgaatttgttccgcataatttatcaggtgaggcaacacaatatcccacaccgattgagatttcgtggcttggaaaacgaaatttacaacaccgcgatttgttaatcaatttgcaacaagaaatcccagattttagccatagttttacccaaattattgattttgtgccgaaagatgatgcgttaaaaacacaagctcgagaacgttataaacaattacgtctgcaaggttggaatctttctactgaaaacgtgggttaataaatgaacgatattgccttttatcaacgctttcaattttgagtattgagcagtaggttttgaattaattaaagaggataattgatgactgaacgtgagaaaattattcaacaacagaaacaacttaaagcgttattttcagtttggatgaaagagaaaatgaatcacgaggtggttatctttcaaaaaactgatggcaagatagtcgagcattatctggatggttcggaaaaaattgtgggttatgcaaaataaagcgattttttattgtggaaaaatggttcgggaaaaagtactttacgttcttttaaccaagatgctgtgcaaattgtgattgattctgatcatattgcaatgcagattaatcctcaaaatccaagacttgctgatattgatgcaggcagaaaagcgatagggctatttcgttttgctattaagctacatattgatttttctatggaatcaacgctttcgggcaattcaattattcagagaataaagaacgctaaagaaaatggtttctatgtacatttaaattatattggtattaatcgcattgaaataaatcttgcacggattaaggcaagagtaaaaagtggtggtcattttattgctgaagatattgtaaaatatcgttattaaataagtttagataatttatttcttgttttgtcatattgtgatgaaatttttatttatgataattctagcattgcgcctgaattgatttttcaactaaaagataactgtattactcaatttagtgaatttttaccaagttggtgtgaaaaaatattgaataatttgagaaatctaggatttgaaaaaattttctaaaatataaccgctctttaaggagcaaaatgcaaccaaacgaaatcactttttaccaacgttttgaagccgatattctcgctgggcgtaaaaccatcaccattcgggacaaatccgaaagccattttaaagcaggcgatattttgcgtgttggtagatttgaagataatcaatatttctgcaccattgaagtgttaagtgtatcgccgattactcttgatgaactgacggaacagcatgcgaagcaggagaatatggggttggataagctgaaagaagtgattaaaacaatttatccaaatgaacatgagtcttggataattaattttaaacttattgggtagttttaaaatttgccaattattataaaggaaataaacattaataatgaatttttcttatattttagaacaacttaaaagttttactattgaggacgttattctcaaaatctgttattttgttatctcaattatcgtaggtaaagtttcacggcaatgttggaagctgattagaatatacgttaatgaatgtagaacgattagagagctttctgaatcagataaagaatttattcaaaataataattttgaatttgaagtcgataaggaaaatgaataccaaaatttagaagagctaaagcggaaaggattagtaaatattgagttttgtgaggatgaattacaagatgcctcaggaatttatttatgtactgtaacaaataaaaatagattaaaaatttcattaacgaaatttggaaaacaaataaaatatcttatagaaaaataatttagtactttagtggattagattcccacgcaacaaaaagagaaaaaataaatgacacaaaaattcgaaatggcagaccgttttaatccgtctgcggtagaacaagccctttatcaacattgggaagagagcggttattttaaaccgtctgaaaatgaaaatgcgccgagctattgcattgcaattccgccgccgaacgtaacaggttctttacatatgggacacgcattccaacaaaccttaatggataccttaatccgttttaaccgtatggaagggcataacaccttatggcaagcggggacagaccacgcaggtattgcaacccaaatggtggtggaacgtaaaattgcggctgaagaaggcaaaactcgccacgattatggtcgtgaagcgttcatcaacaaaatttgggattggaaagcttattcaggtggcacaatcagccaacaaatgcgccgtttagggaactcaatcgactgggaacgtgagcgtttcaccatggacgatggtttatcgaatgcagtaaaagaagtgtttgttcgtttgcacgaagaaggtttgatttaccgtggcaaacgcttagtaaactgggatccaaaacttcacaccgcaatttctgatttagaagtagaaaacaaagagagcaaaggctccctttggcatttccgttatccgttagcaaacggtgcaaaaacggcagatggtaaagattatttagtggtggcaaccacccgtccagaaaccatgttgggcgatacggctgttgcagtgcatcctgaagatgagcgttatcaatctttaattggtaaaactgttgttctaccactggctaatcgtgaaattccgattattgccgatgaatatgtggatcgtgaattcggtacaggtgtcgtgaaaatcaccccagcacacgatttcaacgactacgaagtgggtaaacgtcataacttaccaatggtaaatgtattgacgctgaacgcaaatattcgtgatgaagcggaaattatcggtactgacggcaaaccacttgctggctatgaagcgacaattcctgcggattaccgtggcttagaacgttttgctgcgcgtaagaaaattgtcgcagattttgaagcactgggtttattagacgaaattaaaccacacgatttgaaagtgccttatggcgaccgtggcggtgtgccaatcgagccgatgctaactgaccaatggtatgtgagcgtgaaaccgcttgctgatgtagcaatcaaagcggtagaagacggcgaaatccaattcgtgccgaaacaatatgaaaacctttacttctcttggatgcgtgatattcaagattggtgtatttctcgccaactttggtggggacaccgtattccagcgtggtatgacgcagaaggtaacgtttatgtcgcgcgtaacgaagaagaagtgcggtcaaaatacaacttagattctgcggttgaactcaaacaagatgaagatgtgttagacacatggttctcatcaggcttatggacgttctctaccttaggttggccagagcaaaccaaagagctcaaaatgttccatccaacggatgtgttaatcacaggcttcgacatcatcttcttctgggttgcgcgtatgattatgtttacgatgcactttgtgaaagatgaaaatggcaaacctcaagtgccattcaaaactgtgtatgtaacaggcttgatccgtgatgagcaaggtcaaaaaatgtcgaaatcgaaaggtaacgtacttgatccaatcgatatgattgacggtatcagccttgaagatttacttgaaaaacgcactggcaacatgatgcagccgcaattagcagagaaaattgccaaagcaacccgtaaagaatttgcggacggcattgctgctcacggtacagacgcattgcgttttacattagcggcgttggcttcaaatggtcgtgatatcaactgggatatgaaacgtttagaaggttaccgtaacttctgtaacaaattgtggaatgcaagccgtttcgtcttaacgaatgaaaaattagatttaagtgaaggcgagatcgaattctcattagcggatcgttggattcaatcggaattcaatcgcacagtggaaacgttccgtaattcattaagccaatatcgttttgacctttgtgctaatgcaatttatgaatttacctggaaccaattctgcgactggtatttagaattgactaaaccagtatttgccaacggcaacgcagcacaaatccgtgcagcaagccaaaccttggttcacgtgttagaaaaattattacgtttagcacatccgcttattccatttattactgaagaaatttggcaaaaagtgaaaggttttgtcggcattacggctgacagcattatgttgcaacctttcccacaagtggaagagaacggctttgatctagaagcagaagctgaaattgagtggttaaaagaagtgatcgttgcggtacgtaatatccgtgcagaaagcaacatcgcaccaagtaaaggcttagatctgttattccgtaatttaagcgcagagaatgcaaagattcttgaaaaacagaccgctcttttgaaagcaatggctaaattagataacgttcaagtgttagctgcaaacgaagcagcaccgcttgcggtagcgaaactcgttggcaatgcggaattactcgtgccaatggctggctttatcaataaagaagcagagcttgcccgtttaaccaaagagattgaaaaatatcaaaacgaagttaaacgcatcgagaataaacttagcaatgaatcttttgtggctaaagcacctgaagcagtgattgcgaaagaacgagaaaaacaagcggaataccaatctggattagaaaaaatccaagagcagtataaggcgattgaggcattgtaacaaaacataaaaagtaggcattatgcctacttttttatttttgatttaatcctaaaaaatctccaacttcgtgttcgagttggctcattgtgatcagagcctcttgggttttcttggcttcatcttcatcaataacactcattgcaaagctcacatgaacaagcacccatttgccaagtaaatcggctggatttcccagaaatatttacttcacgttgtacgctacatacatctactgtggcaagttgaagataatttgtatcaattttgacaatttgacccggaacgcctaaacacataatatttttactcctattggcatttaagctgaaatacagatttattttactattagatagaataaattattacaatctggatcaatagttgcgcatttcggattatttagtgatttctatgttattaaaattaataaatattattaaaaactaaccgtactttttcttgatcttttacgcccacagaactttctactcctgaattaagatccaagcctaagcaattttgttgaatggcttgttctacattatttggcgagatacctccagctaaaataatcttgtgcttaagatgttcgggaattaatgaccaatcaaaggttttacccgtgccgccttgttggttcgctgtctggctgtcaaaaatataacgatccacattcaaatcatcggtaaaatcgaccgtactttgggcttcagtattgaccgaaatcgctttccagatttgcgtgttttttggtagttgctggcgaagtgcggtaataaatgcttcagtttctgcaccatgtaattgcaccgcataaagctgcaactggttggctattttgacgataaagtcaatttcttgattctgaaaaacaccaacaaatcgaagtggcgcagcggttactaattcttgcgcttggcgtaaactcacacaacgttttgaatgttctacgaagattaatccgccgtaaagtgccccgttttcgtaaacgattttgacatcttgcgtgcgtgttaaaccgcatactttattttctccaaaaatcaccgagcgaaccgcattattcaaatcttggttgcccattaagctactcccaattaagaaaccatgcgccaccttttgtaattgatgaatttgcttgtgattgtaaatgcctgattcgctaataatacgtacatcagcagggattcggtcggcgtatttttcagtgagtttaacaacacgatttaaatccacagttaaatcgtgcaagttacgattattaacaccaatgattttcgcaccaagcgcaagggcgcgttcaaattcttcttcattgctggtttctgtcaatacgcccatgccaagagaatgtgcaagctctgccagcacacgataagtttcatcatttaccacagaaagcattaataaaatcgcatccgcttgatagtagcgagcaaggtaaacttgatattcgctaatcataaaatctttgcaaagcacaggttggctcacgataccgcgaactaacggcaagaactcaaaattgccttggaagtatttttcatctgtcagaacagatacagcagaggcataatgtttatagacattggcgatttcttccaaattaaattcagcacgaattaatcccttagaaggggaggcttttttacattccaaaatgtaagcgggcttttgatgcgtaccttttgctaacgcatcataaaaagagcggtcagagttttgaatgttttgtttaaattgtgaaaggggaaattccttttcttttgctttaacccattgtgctttatcaagcacgattttttgtagcaccgtagcggaatcaatgggtttggtaaaatcttgagtgatcatcatttttcttcttattgtggtgtatcaaattagctttttattaatatgtggttaatttctgtaatgttttaaaggcgttacctgatgcaagatgcgccaatacattttgcacattttgttttaaatcatcgtaaccgaataatttcaataataatgccgtatttgcagccaccgcattagcatgttcagcctttcctttgccttgtaaaagtgcggtcagatattgggtattttcttgtggttcaccaccgcgaagactttcgagggattgcgtttttaagccaaaatcttcaggcgttaaagtgaaatattcaattttgccatttttaatttctgccacttgtgtttcgccgtgcaatgcgacttcatctaagccagaaccatgtacaacaaaggaatgttgatgttctaaggcaactgcggtttcagcataggtttttactaattcaggcgcatatacgccaagtaaatgataagttgggcgagcaggattgataagcggccctaaaatattaaatatagtgtgcgtttttaaagcggtacggactggtgcaacatgacggaagccagaatgatattgttgagcaaataaaaaacagacaccaatttcatctaatgcttgtcgagcttgctctggtgtgacgttcacattaacgccaagtgcggtaagcacatcgctagcacctgatttactcgacacgctacgattgccatgttttgccacttttgctcccattgatgccgcaacaatcgcactggctgtggaaatattaatggtgttttgtccatcaccacccgttcctacaatatccgcaaaaggataatctggacgtggaaatactttggcattttgtaatgaggcggcaaccgcacccgtaatttcctcagtatttgcttcccgcacttttaaagcaataagcattgcagcaatttgttcattggaaagctcaccttggatgactgcattaaaaagtgcggtgctttctgaggttgaaagtgaatgtccgctataaagttgctctaataattggttgtgttgcatagtttattcctgtttttctttgtatatggatttgttaattttctatattttattaaacataaatatcgtaatctaaatcgcgtgcctcatcgcctgtcattcctcggaaaccccagcaatgtgccggttgttctttaatcgtaatttccacatcgtgagctcgaataccgagtttgtactctaattcgctaaatagcatttttatcaagcgtttttttgtaccttccatacgaccagccatcaggttaatttcgatgacggtgtaatcatcgctacgatcaaaagggtagtaaaaatcttctttttctaaacacaaaaagcgaatcgcgtgcttgccttttggaatgtctaatccgagatgaagactgttataaattacttccgcgagttgttcacgacgtggtgcgagtttggatttaagtccgaatacggtgatcattttttctcctttaaagtgcggttaaaaatcaccgcacttttttctgtcttatctatttaacaaccattcaattgattgttgtaataattgcgaaccttgcacagttaaaatactttcagggtgaaattggaatgcgcaaatgggtaaatcacgatgacgaattgccatgataatgccattatattccgcattgacgataaattcttttggtaaatcttgtcccattaaagaatgataacgcgccgcaggcattggattagcaagatctttaaacatagcttcgttatcatgggatatacgagaaactttaccatgcaacacttcgccagcgtgaacaaccttaccaccaaaggcttgaatcaacgcttgatggcctaaacaaattccaataatcggcacttgattttttaagcgttcgatcaatggcagtaaaatccccgcttctgatggtgttcctggccctggagaaagtgcaagaatggtatcaagtgtattgatattgagtgcggtttctaccagtttttctaagtcgcagtcattacgataaattgtgacgttgtgacctaatacacgaaattgatccacaagattgtaagtgaaggaatcgaagttatctaaaaataaaatattagccataataattcttccttattttgcttgtgtattaacttgacgaattgcttttaagacagccgctgctttatggcgtgtttcatcggcttccatttgtggatcagaatccaatacttcaccgcaacctgcttgtacatgggctatcccattttgtacgaaagcagaacgaatcacgatacaggtatcaaaatgtccatcagacgtgagataacccaccgcaccaccgtaactatggcgtttttgttgctcaaattgataaataagctgcatcgctttaatttttggtgcaccagttaatgtgcccatattcatacaggcttgataggcgtgaagtgcatctaattcagggcgtaatttacccaccacacgagacactaaatgcataatgtgagaatagcgatccacttgcattaattctgccactttacgggtaccattttggcaaactcgagcaatgtcgttacgcgctaaatcaactaacattaaatgttccgcttgttctttatgatcaagacgaagttccagttctaaacgtgcatctaattcaggatcaatgttgccgtgagcatcaaaaccacgagggcgtgaacctgcgattgggtaaatttctaactgacgattttctggcgcatatttcagcgcactttctggcgatgcaccaaacaaaataaagtcttcatcattcatatagaacatataagggcttggattattttgtttgagttgagcataactggctaatgtattagggcaagcaagggaaaaacgacgagaaggcacaatttggaaaacatctccaatattaatatggtgttttaaggcttttacgataccagtaaattcaggatcgtcaaagtttgttttaacttcatcacttgccgatttaatagaaagaacgtgatcaatattttttagtttttgtgcgatagaaagcgaggttttcgcaatattgacttgttcttcttgagcaaaacagaaacttttaagtgtcgcttgttgattttgatggtcgatagtaattaagtgttcggcaagatagaaactgtaatcagggcagttgataccatcattttttaatgtaatgccatccattggaatgaaatttgcgacgagatcgtaagcaaataatccgcctaaaaaaataggcgtttggctatgttgataaagagtagaaacaacacgcaacccatcaaaaatagtagcagactgtaatttattatcttcatcgagttgattatcaagtggcgaaaattgtacagaaaattcgtcttcaaaattgaccgcacttatttttccaagtgcggttaattttggatgaatttcttttaaaacttgttttccattcttatttaaagctttaaatgtgacgttgtgacctaagcacgttattttaaccgcagcattaactaaaataagactttgtaaactatttttactccctatttcggcagagtcgagtagaagagaatttgaattaggttggcaaagtgtattaaaaatagcggtggtatcagcataatagggaattgattgagctgtcaccgcaataaaggcttgagtttgaatgttcatatttatccttttggaaaattttgtactattaaactagtacaaaagaaataagtcaagcctgatttttattttttatactttttgattaaaaattgtattttttattcctttgcccaagggcgacctccataatattctatattttgctgatttatcacttctaatatttttgcagaaatattattgttatcttcatctgacaaggataattgaggaaaaacacgacgaacagcaattagtttattgaaatcagctctgtatttaacggtatattttcctgaagtttgacctattaaccccaaactttttaaggcagataaaaagctgcgatcaccaattaatggtgtgttccaactatatgaagttttttgtgcaatctcacgaggtacggcgtaacaattagtatcaatatgtccattaacttcattaaaagtaaaatgtatttgtttctgaatatcttctattttaacatctacgaaaatatcgctttttgtattccaatttccgagagagtcaaaatcatcattgcaaataaattgatgatttgaatcgtaaaaagatcgcaaggaataagcaaaatcagcaccttgctcaatcacgtttactaagctttccacgtgatcttctcgtagctgattgtcatcatctaaataacaaataatgtcttcttcaacaagaaaagctgctactgcgttaattgcaccgttaagtattccattttttcctgtattcattggcaaataaataggaattacatcaggaaattgttccaatatagatttggctttatcccagaaaatattgccatcaacaaatacataatgcttacatggataagtttgattttgtacgcttttaatagccaaagataattctggacgacctattgttgaagttactaccgcaacggttttattattttggttggttggttggttggttggttggttggttggttggttggttggttggttggttggttggttggttcatcagtataaatccttttcatttttataataccttgattaactcaaaatatgcaatagaaaatattttggaaaatttggaataaaataatctggcagacacattattttaaataaaagatctgccagatttgataatctataattaggctttagtagagagattacctaaatccttatcaattaggaacaagcctttgccatcttctccaagaaaatttaatttatctaaaatactactaaataatttttcttcttcatgttgttcttccacataccattgtaagaaattaaatgcagagtagtctttttcttcaaaggttttacctactaattcattgattttactggtaattaatttttcatgctcataggtagcttcaattacttcttttaatgatttatattcatgtgcaggtgcttcaattgcagaaattacagcaagtgagccagtttcatttaaataagtaaataatttacgcatatgttgcatttcttcagcagcatgaactgataagaattttgcagtgccttcaaagccttgctgatcgcaccaagcactcatttgtaaatataaattagaagaataaaactctaaattcatttgatcgtttaatagttttactacattttctgataacatactattttctcctatctattccaaagttgcgagttcacgatcaataaagaataatcctttaccatcttcgccaacaagattaaatctatcaataattccactaaataatttttcttcttcatgctgttctgctacataccactgcaggaagttaaaagtagagtagtctttgctttcaaaagtaacttcaactaattcattgatttttgacgtgactaatttttcatgttctaaagttatttcaaaaacttctcttaatgaagaataatcatgtttaggtgcatcaatttttcctaaaataggcataccactagtttcacttacataattaaacagtttttgcatatgttctaattcttcatcagcatgacgaagtaagaaggtagcagccccctcataaccgtgttttgaacaccatgcactcatttgtaaataaacattagaagagtagaactctaagttaatttggtcgttcagcttgtttatgattatttgattaagcataactaattcctttccattttgattgataaaatgcaataaagcgtaatttgcggcaatcattttaaattcacaaatgataattgcaagtttttttatcaaaaattttgatataactaattaattttaaaaagaaaaataaaaaacaattattatcatttacataattctataaattaaatatgacgttgtcacaataaaactaacaaattttaaattagtattagatatgtctttactttcctccttagatttggatgaaaatttagattatcgagtaaacatgaaaacttaccaacttttattaaacctaaagatcgttatcaattaattgacaaatgtaatatcattctgctagaaaaacacggtcaaatttacctgtacttttcttataactactttcttttgattatccatttaaaatttttcatattgtcatcaaactgtcacaattattttctacacttcgctacgcaatctaaataacactcaaggagaatttgttatgtttatgcataaaatgaaaaaaaatcttattatcgttttaaccttaggtacgttaccttttgctcaagctaatagcatcactggtgctggagcgtctttcccttatccaatttatgcgaagtgggcatctttatatgagaaagaaactgggaataaagttaattatcaatccatcggttcgggcggcggacaacagcaaattattgcaaaaacggttgattttggtgcctctgacgatccaatgaaatccgaattattacaacaacaccaactagtccaattccctgcggttatcggtggtatagtgcctgttgttaatttgcctgaaattaaacctggtaaattaaagttatcaggtaagctgttagcagaaatcttccttggtaagattaaaaaatggaacgatcctgacttagttgcattaaatccaacgcttcctttaccaaataaaaacattattgtgattcatcgttcagacggctctggaacaacatttggcttcactaattatctatctaaagtttcgaacgattggaaaaatcaagttggtgaaggtaaatcagtgaagtggttaacaggtcaaggtggaaaggggaatgagggagttgcttcttatgttcgccaaatgaaatacagcattggttatgtagagtatgcctatgccaaacaaaatcagcttgcttggatttcattacaaaatcaagcagggcaatttgtacagccttctaatgaaagtttcatggcagctgcaagtcacgcaaaatggcacgaaaaggcaggaatgggtgttatattaaccaatgaaacgggggaaaaatcttggccaattacggcggcgagttttattttattaaataaatattctgacaatcctgaaacaactaaaaatgtattagccttttttgattgggcattctcaagagggcaagatgcggcaactgaattagattatgtgccaattccagctgatgtggtgtctaccattaaaagtcaatggaaaacagagctaaaacaataaaaatctctttattttataccgcactttatacaaaacctagcacttaacattaataaagtgcggttatcttaaataattttggaaaatacttatgctcacaaaaagtcggaaatattttaatcaaacatggattgaatcattattcaaacagactacggcattgtttgctttgcttgtgtttattttacttgctgctattttaatttctttagtcataggaagctgggaaagtattaaacgttttggtgggagttttctattagaaacatattgggatcctgtacaagaacaatatggggcaattattcctattttaggtacgcttattacggcgggtatcgcattatttatcgcagtacccatttcatttggtattgctatttttttaacggagctagctcccaattggctaaaacgtcctataagcattgcaattgaaatgctagctgcaattccttctattatttacggaatgtgggggttgtttgttttcgttccattatttcaagaacatattcagccagtactaattgacaatttggggaatttacctggattagaattatttttttctggcgtaccttttggtgttggtttatttacggcaggattagtgcttgccataatgatcattccttttattgcatccgtaatgcgggatgtctttagtatagtaccaccaatgttaaaagaaggtgcttatggattaggtgcaaccacttgggaagtggttcgacaagtgattgtaccacacactagaatagggcttgttgggagtgtgatgctaggattgggaagagcattgggcgaaacaatggctatcacttttattataggtaattcgtttcaattgcctaattccttattttcaccttctacctcaatcgcatctgctattgctaacgaatttaatgaagcaggtggattacaaaaatctgcattgatggaattaggattacttctctttgttatcacaactatggtattgattttatcaagattaatgattacaaaaatgcaacaaacaaaagggaaataagatgaaaactaatcaaaacttgcgtttttattggcgtaaaacacacaataaattaatgttagggctttcctatatttcagtcattatcggcttattttggttgtgttggatattattcactctaattaccaaaggcattccagctttatcaattgatttattcacacaatctacccctgcccctaatgaaaaagggggattgttaaatgcactgattggttcgttttttattgtcggtgcgggtacattgataggcacgcctataggggtattggcaggaacgtatttggcagaatatggtcgttatagccgtttcgcacaaattacccgttttcttaatgatattcttctttctgccccttctattattattggtttgtttgtttacagcttatatgtatcaaaaatcgagcatttttcagggtgggctggagcattcgcattagctttattgcttattcctatcgtggtacgcactacggacaatatgttattacttgtaccaaataatttacgtgaagcagcggcagctcttggttgctctcaatggcaagttattatgatgatttgttatcgagcagctaaatcagggattttaactggcgtgctattagcagttgcccgaatttcaggagaaactgcaccgctattatttaccgctctgtctaatcaatttctatcttggaatatgaatgaacctatcgcaaatttacctgtagttatttatcaatatgcagcaagtccttttacagattggaataatctagcttgggcaggtgcagctctaataacattatttgtgctttgcttaaacattttcactcgactcttctttcaacataaaaaataatgaggcaatatgattagtctacaagaaaccaaaatagctgtgcaaaatctaaatttctactatgaggattttcatgcattaaaaaacattaatttacgtatcgctaagaataaagtgaccgcctttattggtccttcaggttgcggtaaatctactttattgcggagttttaatcggatgtttgaactatatccaaatcaaaaagctactggtgaaattaatttagacggtgaaaatttactcacaacaaagatggatatttctctgattcgtgctaaggttggtatggttttccaaaaaccaacgccatttccaatgtcgatttatgataatattgcattcggtgttcgtttgtttgaaaaattatcaaaagaaaagatgaatgaacgagtagaatgggcattgactaaggccgctctttggaatgaagtgaaagataaattacataaaagcggagatagtttatctggcggacaacagcaacgcttgtgcattgctcgagggattgctattaaacctagtgtgttgttgttagatgaaccttgttcggcattagatcctatttcgactatgaaaattgaagaactcattacggagttaaaacaagattatactgtggttatagtaactcataatatgcaacaagctacacgttgctccgactatacggcattcatgtatttgggtgaattagttgaatttggtcaaacacaacaaatttttgatagacccaagatacaacgtacagaagattatattcgcggtaaaatggggtagttattttgagctcactcttattaaaaagtaaaagtttggtgagaatgtattatttctcacttcacttttatgccataaatcaaatgaaggagtattatgacgagaaaaattctgatagttgaagatgaatgtgcaatccgtgaaatgatcgcactgtttttatctcaaaaatactatgatgtgattgaagcgagcgatttcaaaacagcgataaacaagataaaagaaaatcctaaactaatattattggattggatgctacctggtcgttcaggtatacaatttatacagtatattaaaaagcaagaaagctatgctgcgattcccattattatgcttacagctaaaagtacagaagaagattgtattgcctgtttaaatgcaggggctgatgactacatcactaaacccttttcacctcaaattttattagctcgcattgaggcagtatggaggagaatttatgaacaacaaagtcaatttatacaaatcgatgaactttccattgatgaaaatgctcagagagtgtttttccaacagcaggaaattaatttaagtagtacagaatttaaattgttacatttttttatgaggcaccctgaaaaagtttattctagagaacaattgttaaatcgtatttggcataatgatctagaagttgaatatcgcactgttgatagctatattcgccgtttacgccgtaatttagctccttttcaatgtgaacattatatccaaacagttcgaggatctggttatcgattttctagttatttacgagataaacaatgaaaaaaatattgaattttattgttgaaataaatttggcaatcattatttccttatttacttctgattttattctttggtttgcaataatacttttattaattttagcttggcatcatattaatgaatatcgtttactcaaatatctcaatttaaagcaagataataaattctctttattacaattaggaacattctctcaaactgaagcctaccatcgtcatcaaatttacaaagaaaaatgtgcaagtttacgtttgttatctcaaataaataaaaatattaagtatttaccagatgcaattattatctgtcagcataatggtaatatttcttggtgtaattcaattgcgcaacagatgtttgatttttgttggaataaaaaagtccagaaaaatatttttgatgttattttttatgaacaatttaaacattattttttcagtcaaaaaaaaagacgaccgttagtactattaacttataatcaacgttatattgaggtgcagtcgcacgcttataattctcatatgattttagttatcgctcgagatattacagatatgattcatttacttaattcacgccaaaaattcttgagtaatattaatcacgagctacgtactccattaaccgtattacaaggttacttagaaattcttgcagataataatattcagaaccctctacaaaaaaaggctatttttgcaatgcaagagcaaagccaacgaatggaacatctattacaacaatttaattttttagcaaaaatagaaacaacttcagataaggattttcgtaaatttgatatgtcagccatgataaattctttaagaaaagatacagatatattaaatacttataatcatcatattgaatttattattcagcctaatatcattatttttggaaatgaatctcaactaagaagtgccgtttcaaatttaatttataatgctattaagcattctggtaaacagtgtcatattcaaattcaatgggaaacttgtgaacagggtattaaatttaacgtgatagataatggtgttggcatatcaccacagcatattccacatttaacagaacgtttttatagagttgatgaatctcgtagccatttaactggtggaagtggtttaggactagctattgtgaagcatactttattacaatatcattctcatttaaatattgaaagtactgaaacgaaggggagtagtttttcgtttatcatacctaaacgctttgtcatatcaaaaaataataaagaaattcaatgataatacgcgttgcaagtattagctgacacggtagtaaataacacatcagaaaatcgaaaatagcgggctagtggagagcttagatacataaaaaacacagcttggtagtttttcacccatctaaacttatattatttagattatgtagcagttgctaaatcacctaaatctttatcaatcaagcataaatctttaaatgctgcagtactttcacacccatgaatcgaacactgtaaataaacatcatagtatggctctaaattaatttactcgttcatcttatttgattaagtataactaattaagagaggagaaataatctctttataacctataattaaagttactttgcatttttacaatttaacataatatacattatgcgaaattagttatcaggttagcggaaactacggattaaataaatcacacagttatgcacaagtcacaggtactagcaaaacaagacaaaataaggctagataacacgttgtaacgcgtcattttatagagttattgaacggatgaattgaaatgtaaaggaaatgtaaagtgaaataagcttaaatctatgtgattacgctacgtaaaatctggagaatttcttggatattttcttccctgaaaaacaacaaaaaaaagcacgtttttattaaaacgtgctcttctaaaaaatgtgacaacgtatcgactaacctagtaattttataccatattcatatacttgttgtagcaaagatagtttttcagaattatctgaatgttcctcggctaaacgttgtaaacctgattgaaactctaccgcacttttttcaagtttattctgtcggtatttttgccatttaatttgttcagcgcgtgtgagggttttataaaagtggcgagcacgataatggaacaataattcaaggatacgtttatcttcaaaagctaaaccatgttcagataatttttctgcaggtaaactacgtaaaatagccatattatttttatcagcattgctaaaaaagccattgtataactcagtttctacattatcattcgatgcaaattgacgttcttcattaaaaatatccgccactttttcacgaatatcaaaagatgctcgtaattttgcaagattatccaagcataattgtcgatcaatacccaatcgatttgctgtttctggtaacaaagttttagctggtgctaaaataggacatttattaatatgcacaagttttaacggaacggatgaaactcctctttcttctaattcagattttttggtatataaatctgtccgtaattcatccgcacttttggctaataaattatcgatatcgccagttaaatcacacacaattaatgcattttgatttgtcggatgccaagataaaggtgcaacccaagtgcaatttccacgataattccctagcattccagaaacatgcactaaaggtgtcattgcgcctgtatcaactaatttttcgatttcttttttaccgcgattttcaaagaaatattggaataatttaggctgtttttctttaattaatttcgccatagcaatagttgcatatacatccgccatggcatcgtgagcattttcatgctcaataccatttgctttagtgagtttttctaagcggaaacttggcattccatcatcgtcataagcccaattaattccttctggacgcaaggcataacaggctcgcactaaatctaacaaatcccagcgtgaattcccatttttccagctgtattcataaggatcaataaaattacgataaaacgtataacgcgtcatttcatcatcatagcgaatattgttataacccatgacacaagtattgggttgggaaaattctgctaagatatttgcggcgaattcaggctctgaaagccccttttcattacattcttgaggcgtaattcctgtgaccattacggcttcaggagccggtaaataatcgttggtttgtttacaataaaacattattggtttaccaatgatattaaaatcagcatctgtacgaatacccgcaaattgcgcagggcgatctgttgctggatttacaccaaaactttcataatcgtaaataaaaaagctgaaatcttttgccatgactactctcttttacgcgataagtttatctaaataatataggcagaaaatagccgataaactaaaaataatacctagccaatttagcttactgattttttctttaaaaactaatgcgccagttatcgtacctaggcaaattaccccgatattcattcccgcgaaaacaagcgtcggatttccagcaaaactttgatgtgcttttatatagaataaaatattaaagaaattcaatacacctaaaacgatgccgccaattacacttgatgatgtccattgcgcacgttttaagaataaatagataaacataacgcaagctgcaagcgagaaagaaataaacaatgttgcaggaaatgcaccaccgcttttcgctacttgtttgaataaaatatcaatgatgccgtaaccaaaccagacgccgattaatcctaaaacacctttaaaattgaccgcactttgcccttgagttggcttagttaataaacaaaataaaccaataaaggctaatacaacgccaatgattttagattggcttagtgtttcatgaaaaattaaaaacgctgctaaaatgggaagaaataacgaaagacgttgcgctgcatctgaacgtacaattccagcaaactccactgcttttgacataataataaatacgctaggtagcaataaacctagtgctaaaaaaatgggtgaattttcgctttgtgcaatgtaatcagtaaactctaagcctttaaaatcaggtttaagtaagaaataactgaaagtgatggctgtaatgtagttgaatgcgatagcttgttcaataatgatattttttttacgggcaattttcagtaaaactgaaactgctacgctgcaaagaatggcaaaaataagattgtgcatttattaatccttaatagcttgtttaattaaactcataatgtattcaagatattgggtgctttcaatggtgatttcataatctccattcccccagtgaccagtattagatacattttttgctaaatttttaggatcgtctaactctccataaggaagattaatccaaatttttaaattcttttgttggatacgaatatctgcaatatttcgatcttttttgaatgcaatgtaaagttttctagtattaatttcgatattaggatctaaatttaaaatgccttgtttaaaatcttcgtatagttcttgaataaaatctgatttatcacttaagtgatcagattcttgataaacttttatttcttttaatgtagaaaattcttcatttttttcaatagaaacagctttaatattcggtgctgattttgatttattaataatattgagcgtaataatatcattatcaaagcgattaacttcccataattcaataggtaaatctttaaaatttgtggcttgaatttggaaatcattaaaagtaggtgaaacaaaaatcaccttagattgtgaccaatccacatcatttcttttaagtggggctttttgcttttcattatattccacaataaaatcagctttatattcaagcatcaaattaagataagaaatcccttgatcaaccacactagaattttgttgtcttttatattcaataatgacaaaggcttgagtttcaggatcaaaagctaaggtatcaatacgcgaatttttaatagaaaattctgagcgaataaaaatatagccacttaataaggtaagattttcttcaaataaacgctgaatatccttttccagcttaaatttttgctgcttcagctgtgataattgtcctttttttgatgtaaagattttcattattccttccttaaaggcttaagtgcggtcaaaaatcttaaaattttaaccgcacttcccttctattttttattctgtcgcaccgaatcctcgtaaaccaacaacgtgtacatgctcttggttgcctgcgattttacgcacgagtttataggttgttcctttttccgggctaatgttttctggcgcagcaataagcaactgcatatccaaacgttcgcaaagttcgaataaggtagaaatagatttaccgtctaaacgcgctgcttcatctaagaacaacaagcgacaaggcacaatatctttgcctcgaattcgacgactttcttcttcccagctttgaacaaccattaagagaattgacatacctgtaccgatagcttcaccagtagaaagagcgccactttcagcgcgtaaccaaccatcagcgccacggaatacttccacttcaagttcaagataattacggtaatctaacaattcttcgccgattgtttgtgctgtgcgttgtcccatatcaatatgtggattgatacgttgatagagcttcgccatagcttcagaaaaggtgatgcagttgtcgttaaataagtcttgatattcatcttgctgaccagaaagtgcgtccaacaacatggcatgggtatcacgaatattcactaccaaacgaacagattttacttgaccaaacgagatgttttgcaaaccttgattgagcatacgaatacgattttgttcacgctgaatcgttttacgcataatatttgcaacactttcagaactgatcgccaattttttctcacggccagttaattcagccgttaaacgagaaagctcaatttccatttgttcaatggcatcaattggatcatccgttttaatgatgtcttgacgaatacgttcacgtaaatgctgatacaccgcaataaagaaccgcactttattttcaggtttgcgactatcttccgacactcttaggctatcacgtagatattcattatctgccaccgctgtacgcaacgcacctaatgctttatccgacattgaacgtaactcatctgcagataaataagcgagctctcggcgattgaggcgtttttccatatcagaattacgtgatagacgtaaaactacacaccaactcactttcgctgctaccactaattcacgttgagtcttataatcgcgttcagttttgcggattagacgatttaagttgtccgcttcactttcaattaatgtgagttgtttttctacataagaacgacgctgacggctcgttgaaagttgttgatgtaattcatcacgacggatacgcgcgcgttcttcagcaccatcatcagctctcacgccaagatcgctaatttcactaatcaattcatttaaaagctgatatttactatcgtaagagctttgtaactgaatcaatacgcgattatattcagcaaattgactttgtttttgacgaacttgctcacgttgcatatctcgctgagcctgcatttgttctaaacgttggcgaagtttttcgttgagttcagaagttttagcctgccctgcatcttcataaccaaaatgatgtttacgttgtacaacatcagctaacgcaaatacacgttgttgaacttgtttttgacgctcaatcgcttgagttaattcattttttaagccgtcgtaattttctggatcactttgtaaactattggcaatcggctctaattgtgacaacgttacgccatattgacgaataaaatattcatcttgctctgcaatatctaattgttcacgacattcttcaatacgatcaattaaatcttcatcagtcaatacattgagctgtggaattaacttgttgagtaactgtagtttttcttttgcattatctaattgaatgcgtaattgttgttcgccgttattgaattgatttaattcacgatcaatttcattacgttcgcgattaatctcagacattaactcttctggatttggctggaatgccagcgccaaatgcaacccaacaaattggctgaaatgttcgtgtaaacgttggcatttttgtacatcaaacgcaatttgggcatattgttctgccacttcatcacgttcaatttgtaattcttctaaacgtttttcacgtgctgctcgcccaaataatggaatttcagggaatcttgaatagcgtaattcacgatctgaaacttgcacgacaacacctagctcaagttcttgtgcggacaatacgctgtcgtcaaatgcggtaggatcgccttcaattaaatataaatcatcagggcaatcttctaattgcgcaagttgttcacgcactgcattgagatcacgcacaacaatagcatgacgtgcaggtccgtaaagtgcggagaaataaggcgcatcttcaatggttacgtcatcgtaaagctctgaaagcagtacaccaccaaaacgttctgccagcatatttaaacgcggatcttctgaaccatctggctgacttaaacgagaaatttgctcatctaattgcaaacgtttttgttcaagttgatcacgttgcatcgtgagttcacgttctttcacaagttgtgattgcataaagttcatcacatcttggctatgttcaaacgtctcgccactttgttgctctaaacgttctaatgcagcttgagctgtcagccatgctggtgctttacgcgcattttcatcataaagtgcggttaaattttcacgtttttgacgaagcgtagaacggttttccacttgttctgaaagtcttgctgaaatatcttcaatcaacgcttcttgctctgcgtgataatcctctaattcttctgccgtttgtaaacttaaattagcacgttgattaaaatcattaagtaatttgaccgcactttgttgttgtgcataacgttgctcaagttcatgtaattttgtgcgaagttgtggcgtttgttgtgcctgcaatttttggcttggatattcacgtaataattctttcgcactttcccacgcgctcgagcgtggaatttcgccggcaattttgcatactaattggtacgctttatcgaactgagattttgccgcttcagaaatagacattttgtgctcaagttcaagcacagtttccgttaaactttcagcatgggcttcaaattctgcgtgataatcttctacatttttaacacttaaatcagctaagccacacaaggttttagccttttcgagtgcagtaatggcttgttgatattgaagtgcgcgagtttgttgggcatctaatgcttgttgataatctgctaattgcgctcgtacagcgtcaatttcaatttcagtttgctcaaattgggcttggctttcttctaacgcatcattcgcatcttcaaccactattttttgttcttctaaacgctcggtgagttctgcaatatcttcttgatagcgcgtgattttttcttggtgacgcaaagcgtttaacactaagttaagatgatcaaccgcactttggtgatcaacttctaaagtacgttcattttctgccaattcagccgcttctcgacttaaatcaactaaacgatgttgagataaattctgctctgcttttgctttataccactcgcgacgagattctaatgcagcctcaatattgccacggcgttcattcgcattacgcatataatccgaagcaacataattagtggtttcagtaattaaatgtttaaataaattgcgatctgattgcgtgaccttaatcgcctctaaagtcatacggttctcacgcaatgcactttccatatcttggaaagctttgcgcacacctaaattttctggcaataaatagtcacgtaaagagcgtgtgattgcactggaaataccgccgtataaagatgcttcgataagtttatagaatttgcttcggtctgatgctgaacgtaaacgtttcggaataatacctaaatcgaacatcatgccgtgataatcggtgatggaatgatattgtttaaattgtgcaccgatattttcaattttatctttgagttcgtttaaattaaggacgcgagcttgacgttcgcccacggtttctgtgaaaagtgcggtcggattttgagataattctacaccttgaattgaaaacgtttttaaatcaacctttttatcacgacccgcaatttgctgcagacgcacaccgacaagaatacgttgatgacgtgagttaatggtatctaataccgcgtaacaaacacctggacgcaatttaccatgtaaacctttatcgcgagaaccgcctgtggagccagcctctgttgtattacggaaatgtaaaagggttaaatcgggaattaatgcggtcacaaatccagccattgtggttgatttacctgcaccgttaccaccagaaagcgtggtaactaattcatctaaatcgaaagtacgggcaaaaaaaccattccagttaattaaggttaaagaacggaatttaccacgctctacaccattatttgtcgtcatgctaaaaggcataggtgcgtcaacgatttcttcgacgttttcattttccataatgacttcatcgctctctaattcgatttcattttctaattcaaaaacatcagacattattcttgttctccgtcaaattcttcgtcaatttcatccgcactttctgtatcgttttccactaattgtgcttgtttttccaacgataaggattcaggtgttgccgcttccccatcacgaatgagtctagcttgggcctctaatggatcatctccgctacgcacttccgccccaaaacgaaatacagattcagaaatagtaaatttcccactattttgttcgccaacggtttgaatcatacctaaacgacgtaaacgaccaattgcagctcgcactttttctgccaatttttgtttatctaagtcagaaccacttgaacgctgattaactgcttttaataattttccttcatcagcaagatttaataattcatcatacacttcttgcgtgctaaaaataccttgttgggctaaacgttctgggcttaaataaagataacaaagcactttaccaacaagcatttccaactcagaaagtactgaacgtgcaattaatgtcgttgctttcgggcgaagatagaagaatccttctggcgcacgaattagttccacgttatagcgacgataaaatccgtctaattcattttggaaatccattaaaaatgcgtgattatctaaatgctccgtgctgatatggcgacccgagcgcaatagactatctaccgctggaaatattggatttgcaatcgccacagcgagttttggggaaattacatcttgaaggttgtctgtcataggttatttctcaatatctaatgctttattgtattcacattcatgaaaaaagtgattgaaatctactatatcggttgcaggaaattctaaacttatttcatttctgatatgttctaatatcttgcttcccactaaatatgcagatttcccgcgcaatgctttatcgtaccattttattagatctgcctcagtgataatactctgaatcttagaacgccaaccaatttgatttaataaagacaaaataagtttttcttcactctctttacatacaataactattcggtcagatgaaactgaagatacaatgttttcagctaattcttcagttaatgataaatgttttatttgaattgccataccaaaattagcccacatatccaaaccccgatctgaagcatttgttacaccaactctattaatttttgcattaagttccaaactagtattctcactatcaagagaaataatttgacgagtaaaatcttcaaactcctttaacaaatcaatattcgataaatctaaatcaatttttactttaacgcctaaagcctctattaaagatgaaaacaacgcataaacaactatttcataaactttatcaatacttcgttttaaaccgggttctaaccaaaaaagagcaagaaattcacttagatgaaaattatctggagtacgagaataactatactctaaggctgatgacatctgattaaagcgttcaaaaaactttttataaatataactttctactccaccatttgtttttctattcatttctcctaatatatttaaatgtttgggaggcatagcgttatcattaaataaatcgtcttgatatttagctgacgatgttgatactcttcctaaaaaacggatacaaataacatcccgccattttttagaaatatttcgatatgtttctttatctaataaattaatatttttattaactctatcttgataaagaatttcagcaatttgtataggcttgtataaatgtactcttgctttctttataattttatctaaagattcttttgctacttgaatatcgttcatttttagtccaataatgaaagttgaattgcttgatttattttaggcgttgccatatttaaactattaatcattgaaccagcaatagccctaattacaggaatactaactgaattgccagcaactttacgtacctgagaataaggtatattaatttcaaaagtatctggaaatccttgtaatcttagcatttctcgcccagttaatcgacgtaccccatttacaactagataattataacttcccccagctcttaatgcacaagagtatggaagagcagaaacatttcctgaaatattttcatgccaaattgaaggataaggcacatctttagtaattgaacttaatcttttccgttttagttcatctgaaagaaaataattattaggaacaacatcatcactctctaatatattagaaagttcttcatactttcctataggctttggaaattcaaaatgcaatttatctaaaaaacccacaatgtaaattcgctctcttttttgtggtaatccaaaatcaagggtatttaatactttatgatataccgtatatcctaacttatttaatttatcgttaataactttaaatgtattaccattatcatgtgttgttaatctttttacattttccagcaaaaaagcttttggttttttagctttcaaaattgcttctatattaaaaaataatgttcctctagtatcagcaaagcccaatcctttaccagcaatactaaatggttggcaaggaaatccagcaagtaaaatatcatgatctggtatatcgctaggagatatatcattaatatctccaaaaggtttttcgccaaaatttacttcatacatactttgagcatacttatcccattctgatgaaaatacgtttttacatccaaatgcttcaaaacctagacgaatgccaccaattccagcaaacaaatctattgttttatattctttcatacttattactaattaatacttatcaatcacatgcgcttgcacttcagcaccacgtttattaattgcttgccaatctggataaatacccgataaatcatcattcgccataccaaggcgtactgcttgatcaacaatgattcgagccacatcaaaatgacgagaaagtggataattttccagttgttcttttaacactaaactcaaatcaatcggacggttattttcacgataagcaatcagtaagccttgcatatgctctacaatttgatcgtgtaaatcagaaagggattcgtattgcaattcttctggtaattcacctaaagcatcatcttcacgcaacaccatttcttcatcacgcagatcgactaaacgctcagcttgcgctgtccataagaaccaaggatgctcaaaataatgatgaatagaattacgtaaacgttgtgagaacacacgatttttatccatatcaatggcagttcggataaatttatgtacatggcggtcataaccaatccataaatcaatggcttgttgtccccagctaataatacggtctagtttggattgcaaatccgtaatcaactgatcgataaaatacaaatcatctcgcccaatcacacaatcttgaatacgcaataattgcgcttgaagtttatcccctgcggcatttagcgtatcttgcaattcacgcaaattcccagatgtttcatctaataaacgttcacagcttgaaattgccgcttgccaatctttagtaagaagctctgcaatttcatctttaatactttgctgattttcatccataatacgttgtgaaagatcgatgctatcaaaaatctctgcaacggaatattttaatggcgcaaacacattacgacgccaataatgttcactttcattattctccacaccctcttccgcagaatcagaagcacgttgaatttcatctgccacaatggaaagttgcactgaaagacgcaatgcggaaaattcacgctgacgaatgtaataatcagacacaccaacacctaatggtgttaaacgataaatcgccaagccctcagtaaattcgctactaaaacgatttaacaaacgttgtttcactaattcattaattgcattattcgctcgtgttgcaatggcatcggtggattgctcaaaagcattcatcgtgtggcggaaaatatccacaagatcggcttctaacatttcgccgtctaaacgttcgttgttataaattgcaatcgccagcaggaaaaccaagcgttcggtaggtaaattcaaagaaaactcgcgatcttttgcccaagagacgagttcaggaatagtttgggatgtttcaatcattgaattgcaaagcgttaaaattgaacaaaaaattggaaagattatacaggattttttgcggatcttaaaaatcttcttttgaattgaccgcacttttcctatttttcacgtataatgtgcgactttcatgaataactaaagataacagaatgacccagttagcccaacaagaaaaaaaacaaacctataattttaataaattacaaaaacgtcttcgccgtaacgtaggcaacgccattacagattttggaatgatcgaagatggcgataaagtcatggtgtgtttatccggaggcaaagacagttatacgcttctcgatattttgttgaatttacagcaaaatgcaccgattaaatttgatattgtggcagtgaatctcgatcaaaaacaaccagggtttccagaacacgtattgcctgaatatttagaaagcattggcgtagattacaaaattgtacaagaaaatacttacggaattgtgaaagaaaaaattccagaaggaaaaaccacttgttcgctctgctctcgcctacgccgtggaattttatatcgtactgccacagaacttggtgcaaccaaaatcgctttaggacatcaccgagacgatatgttagcgaccctatttttaaatatgttttatggcggcaaaatgaaatccatgccacctaaattgatttctgacgatggtaaacaaattgtgattcgtccgcttgcttattgcaaagaaaaagacattgagaaatatgccatcgcgaaggaatttccgattattccttgtaacctatgtggctcacaaccaaatcttcaacgccaagttgtaaaagaaatgcttaatacttgggatcgccaatatccgggacgcttagaaaccatgttcagtgcaatgcaaaacattacattgtcacatatgtgtgatccgaaattatttgatttcaaaggaatcaaacatggacaactaattgatggcattgaaggcgatacagcatttgatgaagaaaaaatcacaccaatgcaatttgaagacgaagatcaaactgatttttcaaacaacgaaatgattaactttaaagaagtaaattaatatgttgaatatcaatggaattgaagttgaaactgataaagatggttatttgctccacagccaacaatggaacgaagatgtcgctcgtgctattgctcggttagaaagtatcgaattaacagatgcccattgggaagtgatttactttgtacgagacttttatcaagaatataacacctctccagccatccgtatgttggtaaaagccatggctgaaaagcttggtgcagataaaggtaatagccgctatttgcaacgcttatttcctgaaggccctgcaaaacaagctacaaaattagcaggtttgccgaaacctgcaaaatgcctataaaagtgcggtcaattttttaaaagttttaaacgcttagtttattaacgacttgttttttgtaagataaaacacaggctcttttaaaccctaactaacaaggaaatgttatgaaaattagtgcaagaaaccaactaaaaggtaaagttgtttcaatcgaaaacggttcagtaaatgcaatcgttcacattgatatcggtggcggtaacgtgctttcttctactgtgtctttagctgcagttaaagaattaaacttagaagttggtaaagaagcatacgcaatcatcaaagcaacttctgtaatggttggcgtagaataatttcttccataaaacagaattgaatataaccgcacttttaaaagtgcggtttttttatttctttgatacctcttttaagtcgaattccccttgcatttataaattttaaaaatataatgataatcattcttatttatatcttttattttagggaactatactatgtatcaaaaaaagccattaatgttgttattctgcacaacatttgttagtccatttgttatggggaaaactattgaaacaaccaacaaccaacaaccaacaaccaacaaccaacaaccaacaaaaatatattgcccgaaattgttgtgtatggcgacaataataaatcactttcttccgttaaaacactctcttctgacgagataagtaaaacgcctacatcaaacggtaatatcactgattatcttcgttctaatccccatattcgttatgaaaatagcgaccaagatggttttcaacgtggagaaatcaagcctgaaaatatttcaattaacggtgccgatccaaatcaaactgcttattttgttgataatgtcaatataaataatgaacttactgctgatagcgatatttttgatggttctatgcaagttgtacccggaattagtcacactcaagcttatttctttgatgcgactatgctttctaaagtggaggtacaagatagtaatatttctgctagcttagggggatttatggggggtgccgttatagccaaaacaaaacaatatagcggcactgatagcataaaacttaaatatcgcacgacaaattcctcttgggcaaaaatggaagctggagactcagtacaaaaaatacttaaacaagtaagaccagatcttgtcggagtggcagagctacaacctaaatatgataaacaaacattcaatattttggctgaaaaaaggctaaatgataatttaggaatggtttttggctatagccgtagaacatcatctattgaacaaaatcgtttaattggctttgatcaaaatgccaataataaagcacagttagacaaacaaaatcatcaacgactttccgataatcttttattaaatttcaattggacaccgcaagaaaaagaacgtattgaactcggtttacgttattcaaattataaagaattgaaatatttccaggaaaatataaataacaacgtaagcgattatcatcaagcattggggacaacactagcttgggtgcattcattcaactctggcgtttggacaaataccttagcatacgatcgttttaaagataagcgtaaatcatcctcaaatagtgttgaaacaacatctgtgttagatgaatattatgaagcgctttataattttgaaaaaggcgggcatggtaatagccgtttaacccaagataatttacatttttctactgaatatgtaatggatcctttttatttagcttctacggagcattctgtttctattggtggaatttatcaggcaactaaatatcaattctatcgtccacaagatgttcattcaaaaataacattatctactttgcaaagtgatgggagtatgaatattttcagatcagataaaagtacaacaccaaaagtcgtgttaaaaccagctatcaaaatatcgctatttatgctgaagatttaattaaatggcgtaaatttgaatttcgacctggcattcgcattgaacgtaatgattatttaaaaaacaataatattgccccgcgttttgttgcacgttaccgaccttgggataatacaggatttacactaggtttaaatcgttattacggtcgttcttttgcttcgttaaaattagcgaatggtattttaaagcttaataataatccaacacgtcagcatcagaacttttcatccctaaaaagcccttatgcagatgaattaagtttaagttttgaccaaaatatgggtaatttagcactgaaactcggttatattcatcgtgataataaaaatcgtatcatattgaaacgagagactataagggaaaacataaaaactagttatatcaatggacgtccattcggtgttgatatttatactttccaacttaacaatatagaaccttggaaattaggtaaaacttattggactacgtcacttggttttgattggttaaatacaaaacgagctgatggcgaagaatttgatctaaataaacttgtttctttagatggtaaattaatgacttatcgtgaaatgttacgacaagttaatagtaacactgaagattggattgctcgtttaggtattgatatgacgataccaaattacgatattacttggtcaaataaagtgtatatgaaagcaccaattcgtcgttatgatttgattaacagcgataacgatgatgacattccacgctatcgtagctatcactatggcagacacacacaatgggatagcagcattcgttggcaaccaaccattagaggtaagcatagcgtttatttgcaagtagatattttaaatgtacttaataaaacacgtaaaaataaagtcgctactgctatttctaccagcgatgaatatggtgtctatacgcctgggcgtgaattttggctagaagttggctatcaattctaattttcttcaatgtatagggcttatgggtttttgaaatgtccaccagccctactctacgctagttttacttagcgtagagttttcttttttctaggtaaaaataatgaaaaaaacaaccgcactttttttacttatcttttcactaattgcttgtcaatcattggaactatcgcccaataatgatttaccttttgatccaaatattcagcacggtaaactatcaaacggtttgcaatactttgtattaaaaaatactgaacccaaagaacgcgtttatattcgattagtaattaatgcaggctcaatgcacgaagatgatgatcaaaaaggcattgcccatttagttgaacatatggcatttaatggctcaaagaaatatccagaaaatcaaattattaatgcgttagaaaaacttggaatgaagtttgcacgagatattaatgcttttaccgattttgaaaatacagtctatactttaaatttagatagcaataatcagcaaaaattagaattggcttttgatgttatcaatgaatggatgaataatattacttttttgcctaaagatgtggatggcgaacgtggtgtagtacaagaagaatggcgaagacgtttaagcccaatgttacgtattggcaataagaaaagtgctattgaaatggcgggttctcgttatgtattacgtgatcctattggagatatggatattattaaaacaatttcagctaaacgcgtcgctgatttttaccacaaatggtatcgaccagataatatgtcagtaattattgtaggcgatattgatacaaaacaagtagtaaaactattaaaacaaaacctatcccaagaaaacccaattactaaaacaacattggaaaaaattgattttaatattcctcttatcaacaaatggcgattagattctatttctgaacaaggcacaacaattccaagtattgaattaagtttttttgaaaatacaattgaaaccaatacattagcgagctataaacaagaattaattcagcaaattaccactcgattacttaacttacgtttacagcaatgggaaaaggaaacagaaaatggcgtagattctgcaaatttttatcgtactcatttaggtaaagaaaccctacaaagcattttttctctccagcttatagatacacaatattcaaaaacgatagataaattatttgcctttattgccagtataaaacaacaaggttttactcaaaatgaattaaacggcgagattaaacgcttaactcaactcaatgaaaaacaattaaatattcgttctggtagtttaaaaattgccgatgatctcattacttctgtggcaaataagcaagtggtattgagcgtaaatgatcgttatgaactcaataaacgttttttatctcaaattacattagctgatttacaacgcacgttaaatcaaaccttagcattaaaagcaaaattattattaatcactcaacctttgccacaaaaagccttgccttttgatgtagtagaaatagaaactcgttggaacaatgcaatgaaaatgcaacaacaccaatgggatgaaaaaaaacaaatcgaaaaattaccgcacttaacatttaacacaggctcactttcccaagaaaaatactgggatcgcggcgatatttatgaatttcgtttaagtaatggaagtaaattgatttaccactatagtgacaaaactccaaatcaagtacattttcgtgctgttactcaaggtggtttacgttctatcccagataaggactatcacttattgcgtgctgccgttagtgtagttgatgaaacaggtgttggagaactttctctttctgcggttaatcaaattttttcgcgtgatccattggtaattgcaactgtgattgatgatgataaacaaggttttactggtgtatctaaacctaaagatttggaaaatttactgacattgttccgcttaaaattacgttcttcgcctatatccgatcttgccttagaaaaatatcgacgtgaaacccgtgattatttcaaacagattgatttagaaacacaatttatgcaagccgtttcaaaactgcgttttccaaatattgaaactgtctatactcaaaaacaagcacagcaattagcatttgataaaaaccaattaagtaacgcttatcaacgttatattttaaataaaacagattttacctattttattattggcgatattgagcttaatcaagtaaagaaattggcagaacgttatttagcttctgttgaatcaaaaactcagatacgtcactttgtccctactattattcatacaccaactcaatcatttattatgaatggtttgaaagaaccgagagctgatgtagaaatataccttaccgcagataatacttggcgagcggaacaaaaatacttattcaatattcttgctgatattgtgcaagaaaaattacgcttaattctacgtgaaaaagtttcaggtgtttattctgtaaatagttggtttatgcaagatgttcatacaccacaaattgagggaaaaattgaatttagttgcgatcctaagcgagtagaggaacttacgcatcttacaaatcaggtgctagatgatattgtaaaaaatggcattgatgaaaatttattacgtaaaaaactagcggaacaacatactcagattcgacgtgaatttgattctttagtttcagttgcttcgattattgaagaaagttactggcaacaagataatccagatgccatttatacctatcaacatttagatcagttagcgacaaaagccacaatagatgcgttggctcaaaaagccctaaaaaaatcaggcagatttgtcagcgtattaaaagcagctacttattagaaaataaatgaaatctcaatagatctgaaacagataaaaataacggtgatcgcttaaacgatcaccgttaaattgaactcactgtttaaacagtaaattatattggttattttcgagaagtattactcttcattcaataactttaattcacgacttcttacttgatttttcaagatttccgcaaattcttccacagtaaatgtacctaaatcagcacctttacgggtacgtacagccacttttccttctgcgatttctttatcgccacaaacgagcatataaggcacgcgacgtaaagtatgttcacgaattttgaagcccactttttcatttcggaggtctgctttaacacgtaaacctgcatcagataaggttttaacgacttgttgtacatagtcagcttggctatcagtgatattcatcacaactgcttgggttggggctaaccacgcagggaagaaaccagcatattcttcagtaatgataccaatgaaacgctcaatagaacctaaaatcgcacggtgaatcatgacaggggttttacggctattatcttctgccacataagttgcatctaaacgacctggtaatgcgaagtctaattgcactgtaccacattgccattcacgacctaaacaatctcgtagtgcaaactcaattttcggaccatagaatgcgccttcaccttcttggatttcatattcaagaccgttgtgtgctaatgctgctgcaagacctgcttccgctcgatcccacatctcatctgaaccgatacgattttccggacgagtagaaagtttcactgcgatattagtgaaaccaaaggtgctataaatgtcgtacaccattttgatacagctagttacttcgctctcaatttgatcttcagtacagaaaatgtgcgcatcatcttgagtaaagccacgaacacgcattaaaccgtgcaaagaacctgatggttcattacgatggcaagaaccaaattccgccatacggattggtaaatcacggtaagattttaaaccttgattaaaaatttgaacgtggccagggcagttcatcggtttaattgcgtattcacggttttcagattgagttgtgaacattaaatctgcgtaattttgccagtgacctgttttttcccacaatacgcgatccatcataaatgggccttttacttcttgataatcgtattgttttaatttagtacgcacgaacgtttcaagctcacggaaaattgtccagccatcattgtgccagaacaccatacctggtgcttcttcttgcatatgatataaatctaatgctttaccaattttacggtgatcgcgttttgccgcttcttctaagcgtgttaaatattcagcaagttgttttttatccgcccaagccgtaccatagatacgttgtaacattttgtttttgctgtcgccacgccagtacgcaccagcgactttttgtaatttgaaatgctgacagaaacgcatatttggcacgtgtggtccacggcacatatcaatatattctaagtgatgatataacgcaggcgttgcagtacgttcaatgttttcatctaaaattgccattttgtatggctcgccgcgtttttcaaaggtatcacgcgcttcttgccaagtaacacgttttttcacgacgtcataatttgtttttgccaattccaacatacgtttttcgattgcatcaatatcttcttgggttaaagagcgatctaaatctacatcataatagaagccgttttcaatagttggaccaattgccatttttacatctgggaataattgtttaatagcgtgtccgagcaagtgagcgcaagaatggcggataatctctaaaccgtcttcatcttttgcagtaataatttctaacgttgcatcttgctcgataacatcgcacgcatcgcgacgttctccgtttacacggcctgcgatagtggctttagcaagacccgcaccaatatcttgtgcgacttcaagaacagaaacaggacgatcgaattgacgttgggaaccgtcaggtaaagtaataattggcattgttttttccttatacagtggtcacccatacgaaaggtgacgtgttcatttaaaattctatcaaaattaaccgcacttttgccctacttggcttcattcctaccattgaacgagcgaaattaggcaaaaaatgcgtggcgaattctatcactttcttgaagtattgttaaataaatgcccatattttacaaaaaggaaataatgtttttctgactaaaggctttatctcttaaaaataaagactagaataaccgcacttttaactaggtagcaaggaataaaaatgagcaacgtattagtattaaaatctagcatttcaggaaataactcgcaaactaatcaattagctgattatgttatcgaaaaattacaaggtaataacattgtagtacgcgatttatcccaacaacctcttccatattttgataccgcagctgcaattgctgtgcgtggagaaccaaaaacaacagaagaaaaacaacttctggcgttgtctgataaactaatcgaagaattaaaaaacgcacaaacattgataattggtgcgccgatgtataatttaaacgttccaacacaattaaaaagctattttgattttatcgcacgtccgcgcgttactttccaatatacagcaaacggctctgagggtttattaaaaggcaaaaaagccattgtgttatgtgcatttggtggattgtatgatgaagaaaatctagtgacacaatatatgaaatcaattttaggttttattggcatcacagatgtgcaatttgtttatgcacaaggcattggattcgggccagaggcgattgaaaaagcccaagcgtccgcaaaaaataaaattaatgaaattgtagcagccctttaatcctcagataatctaaaaaatataagaaaatgtattaaaaacaaaaaagtgcggtgattttaccgcacttttcttcttatttctttcgttcaacccattttccattggtgaaatcaacaatccatttagtcgcttttccctctttttcagaagtgacatattgttttttctctttgcgactaaaacgaacaatcgcttcattctcttctgggtctttttgtggagcatcggctaaataagctaatttttcaggtaaacgctcgcgatattgcacaagttcagcgattttaactgggcgtgtttcgcgggattttgggaagttatgtgctgacataaataccccactcgcaccatcacgcaatacaaaatatgcatcagatttttcgcattttaactcagggaaatgtactggctcttctttcggtggtgcgacctcgccacttttcaaaattttgcgcgtgttatcacaatttgtacatcccatatacttgccaaaacgaccaagttttaaatgcatatccgcaccgcatttatcacactcaacaacagggccatcataacctttaattttgaatgagccttcttcaattaaatatccatcacaatttggattattaccgcaaatatggattttacgatgtgcatcgattacatagctgtccattgccgttccacattttgtgcaacgtttacgatccattaatgctttagtttctgaagattcatctaaaacatttaataattccgcttcaggaattaaattaatcgttgttttgcaccgctcttttggcggcaatgcataacccgagcatcctaaaaatacccccgtacttgccgtacgaatggccatatttctgtcacaggttgggcatttaatatcggtttccacgagattattcggacgcataccgccttcaagttcatctaattcagctttagaaagctggctagaaaaatccttaaagaattgattcaattcagttttccaatttactgaaccagaggcaattttatctaaggtatcttccatattcgcggtgaaatcgtaattcattaattcgccaaaagactcattgaggcgatcagtcacaatttcgcccatcttttctgcatagaaacgacgattttcagtgcgaacataaccacgttcttgaatagtggaaataattgccgcataagtggaaggtctgccaataccacgtttttccaattcttttactaaagccgcttcagtaaaacgagcaggtggtttggtaaagtgttgtgttggttgcacttcttttaaagcaagtttttctgacacagtaactgaaggcaattcttgatcttcaggatttttacctatctgtggcaatacttttgtccaaccatcaaaacgtaaaattctgccttttgctttcaaggtataatcgcctgcggaaacggtcagcgtgctactatcatattgtgcaggtggcatttgacatgctaaaaattgacgccaaattaaatcataaaggcgcaccgcatctttttccattccctctaaggattcaggcaatgctcgaatatccgatggacgaatagcctcatgtgcctcttgtgcattttctttactagaataaaaatttggtttttctggtaaatattgtgcaccaaaatgattttcaatatagctacgcgccatattcagcgcatcttgactcaaattggttgaatccgtacgcatataagtaatgtaacccgcttcatataaacgttgggctaacatcattgtcttcttaacgccaaatcccaagcgagtacttgccgtttgttgaagtgttgatgtaataaatggtgctcgagggcgagaacttgttggcttagtttccaaatctgtgacaacgtaatctgaaacattcagaaaatctaccgcactttgtgcttctttttgattttttggatcaaatttcttgcctttataatccgtaacatccaagcgtatagcttgtttattttgattattcgtaaggacggcaacttcccaatattcttcaggctggaacgctttaatttcacgctcgcgttcgactaataatttaaccgcaaccgattgaactcgaccagcagaaagcccgcgtgccacttttttccaaagtaatggtgacaccataaagcccactactctatctaaaaaacgacgagtttgttgggcattaactcgatccatatttaattgttcaggcttttcaaaagcctgtttaatggcatttttagtgatttcgttaaacaccacgcgactaaaacgatcattgttaccaccaatcacttcacgtaaatgccatgcaatcgcttccccttctctatccaagtcggttgcgagataaatgtgatctgcttttttagcaagcgactttaactcggaaaccactttttctttaccaggcaaaatctgataatttgctttccaatcgtgataaggatcaatccccatacgtttaactaaggcgttacgttccttttctgccttaatttttgctttttcttcggcatccatacctttggttgaaattggtttagctttttcacctgtactagaaccaaccgtcggcaaatcacgaatatgtccaacgctcgatttcacgacatattggctacctaaatacttattaatagtttttgcttttgctggcgactccacaatcaccaaggatttactcatttgattacctaatatcactagaattttgtaaaattggcggtatagtgcaaagttatgttggcaaaatcaagcattttttcaaaaaaggtctataaatggataaactcaacgcgatttctattttctgcaaagtcattgaaactcaaagttttacattggcagcaaagcaacaaaatatttctgtggcgatggcaagcaaattagtttcacaattagaagaacatttaaaaacacgattgttacaacgtaccaccagaaaaattatgcctactgaagctggaataatgtattatcaacgctgccaaggaattttacttgatttagatgaagcagattccagcatcacccaccttaccagttcattacaaggaaatttactgatttccgttcctcgtgattttggtttactttttattgcaccaaatttacccacttttatggctaagcatcctcatttgcatattgaagttgaatttaatgataagaaaatcgatttattatccgaaggctatgatcttgctcttcgtattggttatatggaagatagctcgttagtttcacgtaaaataggaactactactgttcattttgcagcgtcgcctaattatcttgaaacgaatggtattccacaaacgcctgatgatttagaacatcacaatggcttactttataaaaatgcaatgaatcaggtaaattgggttggttcacgtataaatcaaacccaacgtttcaaaatccaatccaaagtggtaagcaatagcggttttgccttattaaatatggcaaaagcgggactaggtattgctaatttaccaaaatttattttaggtagagcctttgaaaaaggcgagcttattgaaatattaccagaatataaacaacaaaaattagaaattcatgtggtctatccaaacagaagacatttaccaataaaagtacgggcatttattgaatttttatctggcttaggcttgtgttcagaaattttggaaaatcatgaagataatatttaaatgctataaataaaaataccgcacttaagcaaccccaagtgcggttatttttatacgtgttttttataatgcttttaagatatcttcaacgcgatcttttgcatcaccaaagagcatttgcgtattctctttgaagaataatggattttgtacgccagcgtaacccactgccattgaacgtttgaacacaatcacattttgtgctttccatacttctaacacaggcattcccgcgattgggctatttggatcttccatcgccgctgggtttaccgtatcgttcgcacctataaccaataccacatcggtatcagcaaaatcatcattgatttcatccatttcaagtacgacatcgtaaggtactttcgcttcagctaaaagcacgttcatgtggcccggtaaacgtcctgcaacagggtgaataccaaaacgaacgttcacaccacgttcacgcaattttgccgtaatatcagcgactggatattgtgcttgtgcaacagccataccatatcccggcgtgataatcacagaacttgcatttttcaacaactcagctacttcttctgctgtagtttcacggtgttcgccttgttcttcgcttgaagaaacttgaacatcgttaccaaaaccacccgcaatgacgctcacaaatgaacggttcatcgctttacacataatgtaagaaagaattgcaccagaagaaccaacaagcgcacctgtaacgatcagcaaatcattattcaacataaaacctgccgcagctgctgcccaacctgaataagagttaagcattgataccacaactggcatatctgccccaccgattgatgccactaagtgccatccaaatgcaagcgcaatcgctgtcattaataacacagggaaaatgctttctggattattcaagaatgcaaccatcaataatgcagataccacaagtgcggctaaatttaatttatggcgatgcggtaacattaatgcttttgaattaatttttccgcttaatttaccaaatgcaacaacagaaccagtgaaagttactgcaccgataaaaatacctaaaaatacttcaacattatgaatattcgttaatactacttgctctgctacaaatgcggcttgtgctgctgcatctaatccttctggcattaacgcctcatggtgtaaaccatagctattaaagccaacgagtacagctgctaaaccgacaaaactgtgaagaatcgccaccagttctggcatttcagtcatttctacttttaatgcacgttgaacaccgattgctccaccaatgatcatcgcaataatgatccaaaatgttccttcagaatgagggccaaaaatggttgcgataagggcaattgtcataccaacaataccgaaccaacaacctgctttagcagtttcatgtttagaaagtcctgccaagctcataatgaaaagtaatgctgctaaaatatacgcagcctgtactaaaccttcagacattgtgcgctccttaaccttttctaaacattgctaacatacgttgtgtgacacggaaaccaccaaaaatattgatgcttgccaccaaaatcgccacaaaagctaacgcatcgataaatagattgcctgttggctgacgaatttgtaataacgcacctacaataataatgcctgaaattgcatttgttactgccattaatggtgtgtgaagtgcatggctaacattccaaaccacgtaataacccaccacacaagctaaaacaaatacggtgaaatgtgataaaaatgcagctggcgccacagaagctaaccaaaggaataacacgccaacaccagccatcacaccgtatttcacacgaggatctgttggtttagattcttttttctctgccactggtgcagctttggtttcttgttttggttgtgcagacacttgaatttgtgctggtggaatttcttccccatcacgaacaacggttacaccacgaagaaccacatcttcaaaatcaatattgatattgccatctttctctttgcacaaaagttttaataaattgactaagtttgtgccataaagttgagaagattgcgttggtaaacggcttgggaaatctgtataaccaatcactttcacttggttttcagttgtaacaactttccctgcttgcgtatattcacagttaccgccagttgcagcggctaaatccacaatcaccgaacctggtttcattgaatctaccatttctttggtgattaaacgaggcgctggtttacctggaatggctgccgtagtaataataatatcgacttctttagcttgttctgcataaagctccatcgcacgacggttaaattcttccgacatcactttcgcataaccatcgccactgccaccttcttctttgaaatcaatttctaagaagctcgcacccatactttgaacttgctctttcacttcaggacgagagtcaaaagcacgaacaatcgccccaaggctatttgctgcaccaattgccgccaaaccagccacacccgcaccaataaccaacacttttgctggtggaactttacctgctgcagtaatttgcccagtaaagaagctaccgaattcatgcgcagcttcaatgacagcacgataaccagaaatattcgccatagaagaaagcgcatccaatgcttgcgcacgagaaatacgaggcaccgcatccattgctaacacattaatttttttcgcggtgagttttttcattaactcaggattttgcatgcgccaaataaagctcacgagagttgctccttccttcatttgagcgatttcttcatctgtcggtgcatttactttgaagataatatccgattgccaaatttcagccgacgtaccgatcttcgcgcctgcctctaaaaatgcttgatcttcaaaactagctttaaaacctgcatcgtgttccacgatcacgtcaaagcccaatttcaatatttgctgaaccgttttcggcgttgccgccacacggctctcattctcaagcagctctctaggtacaccaattaacatactgtttccctctgattgatgattgggttaatgaaattaatgaacaaaccttcgcctattcatcgttaaaatgacaaaaagtcaaacggatgcaaatgtatcattaattgaatgaaaataggtaacgtttttaagtggttttacaagatattgtgatagggatcacgaaaaatcccacataaaaacatctcaaaaatttaccgcactttccataaaaaaacaccacaagtaaaaaacttgtggtgcttttaattttattattaatcacctaattgaacaggctcaactttccaaattctctccgcatactctttaattgtgcggtcagatgagaagaagcccatattcacgatattttgaatagtactttcaatccattggtcgcgttgtttgtatttttcatctacggctttttgaatttctacataactgcggaaatcagcaaaagcttgataataatcgtggtattgcaagccttgtaatagttgatgataacgttgaggttcttctggtgagaatttaccctcaataatttgatccacgactgtgcgtaattgagcatcgttttgatagtattcaaatgaacgatagccgtcgcgacgaagttgttccacttgttctaccgtattaccgaagatgaaaatgtgattttcgcccacattttccaagatctctacgttcgcaccgtcaagtgtaccgagtgtcaatgcgccatttaaggcaaacttcatattactggtgccagaagcctctgtgcctgcaagggatatttgctctgaaatatctgctgctgggatgataagctgtgcaaggctcacgctgtaatttggaataaatacaacttttaaacggcctttcaaacgctcatcattattgatgacattagcaacatcattaattaaatggatcgtttgtttcgcagcatagtaagccgaagccgctttacctgctaaaataaatacgcgaggttgccaatctttttcagggttggcaagcatttcattgtagcgagcaataatatgcaatacgttcaacatttggcgtttatattcgtgaatacgttttacttgcacgtcaaataaggcgtgcggatcaagctctacccctaactcgcgttttacgtattccgctaatttcactttattagcaaatttaatgtcagcaacagcctctttaaatgctttttcttgcgtaaatggtttaagtttttcgatttgacttaaatcacaacgccattctgaaccgatatatttatcaaacaatgcggctaattgtgggttcgccacggctaaccaacgacgcggtgtgataccgtttgttacgttggtaaagcgttctgggaaaatacgagcaaaatctgcaaaggttgaagttaccattaaatcggaatgaatttcggcaaccccgttgattttgtgtgaacctactacggatagccatcccatacgcactttgcgttggtagccttcttcgataagagaaacacggcggataaaatcgttgtcagtcgttacataagtgcggacatattctaagaagtgatcgttaatttcaaaaatcatctgtaaatgacgtggcaagatttttgccatcatttccacaggccaagtttctaacgcttcggacattaaagtatggcaggtgtaagagaaaatgttacgcgtcatctcccacgcttttttccactcgaaaccttcatcgtccactaaaatacgcattaattcaggaatcgctaacgctgggtgggtatcatttaagtggatcgccactttatccgccaagttttcaaggctgtcgtgggtgcgtttgtgacggcgtaaaatatcttgaagcgatgcagagactaagaaatactcttgacgtaaacgcaattcgcgaccattccaagtagaatcatcagggtaaagtacacgtgataaatttttatttgcggagtgctcttctaatgcggctaaatgttcgccacggttgaagtcggcaaggttaaacacttcgcctgcgtgtgccgaccataaacgtaatgttgctgcagaattattttgataacctgggatcatttgatcgtaagcaagtgcggttactttttcggtatcttgccaaatacattttttgccttcgaaatgaatgtttccaccaaattctacggtaaagcgtttagatggacgaataaattcccaaggtgctcctttttcaagccatgcatcaggacgctcgacttgctgaccattttcaattttttggcggaacataccatattcataacgaataccgtagcccatacccggtaaaccaagggtcgcaatagaatccataaaacaagcggctaaacgacctaaaccaccattgcccaagccaggatctacttctttttctaaaacttcttctaaatccacatttaattcagaaagtgcttcctgtgctaatccataaatgccttctgcaatcattgcattagatagcgtacgcccgattaaaaattccattgaaaggtagtaaacacggcgagaatcttctgctcgagtttggcgagcagtagtgatccaaccctctgttactaaatcacgcacagcgtgaagtgttgcattgagccaatcgcgttggctggcttcacgtggagagcgaccgattaagaaaataagtttgtaaacgattgattttttaatcgcttcaacggtcatttcaggacgattatattggaatggagaatcaaagttatccattatcataggtaaaacctctattagaatgctaagaaatgattaacgtagggtgtgtgaattttcaaaattcacgcacgtttgcaaaaatcaatcaaaatttgaccgctctttgaatgcgtgaatgttgtttacacagcctacaaaagtagttcgaattttatgcttatctttgcaaaaaacaagcacaaccacaccgcttgcaaaatattctttcacaagcggtgtgattgttaagaaagtttacgaataaaactacaagcgttcataaagtgttctatattgctctgcagccttacgccagctgaagtcttgttccattgcatctgtacgaaccatcgcccatgcacgcggtttttgccataaggcaaaggcacgttgcaagcaatggcggagagcttcaggcgttgcactttcaaacacaaaacctgttgcggtgcgagctttgatgctttctgaagtgctatccaccaccgtatccgctaaaccacctgttttacgaacaagtggcagtgtgccatattgcaaaccataaagttgggttaagccacaaggctcgaaacgacttggcactaaaatcacatcgccacctgccaccattaaatgcgaaagggcttcatcgtagccgatttttaccgcaatattttgcggataacgttcagcaagctcacgaataccttgttcaaagtgcggtgcacctgaacctaaaatcatcaactgaccgccttgtttgacgatttcgtctgcactttcgattaataaatcaacacctttttgctcggttaaacgggtaaccatcacaaatgccaaggcagattcatcttgtggcaaattgaaataggcttgcagttcggctttgtttttctttttgcctgccatatatttgagcttgtaatggtgcggaatgtattgatccacgttcggatgccaaatattttcgtccacaccatttaaaatccccaccaaacgaccttgagcttttaagccagaaagcaagccttgcaaaccgtaggcaaattctggtgtcgtgatttcttctgcataagttgggctaactgccgtgcttgcatcagaatagaacaaacctgatttcaagtaagaaatctgcccaaataattccaagccttctacgtggaacatccctgtcggcaagccgatttcatacaaatgatgataagaaaactgcccttgatatgccaagttgtgaatggtgaacaccgatttcgcagggcgacctttgttgaacagatatgctgcacacaaacctgcgtgccaatcatgagcgtgtaccacttctgcacgccaccagctatctaaacctgtggctaattctgcccccacccaaccgagcaaagcaaaacgtttgtagttgtcgccgtagtcgttgtaataggcatcgtgataaggattgccttcgcgaccgtataagtgcggtgcgtcaatcaaatagatcccgacaccattatattctccataacgcaacaccacgtgcccagcgaagttgtcaaattcggcaaccacttgagtattctgaatgcctgctataattgcgggataagcaggcaataaaacgcgagcatctagcccaatttggttctgtgcttggggtaatgcccctaaaacatcggcaagcccgcctgtttttaagagcggatagagttccgaacaaacgtgtagtattttcattgagttttttattttccctataaatatgaataatgctcgatcagccccccctctttgctaaagagggattcagaaagtgcggttaattttgaccgcacttttcctaactaatctaaatgaccttcttcgccaatctcgtgtccctcaagtatctttagcattttcggggttacaagaatgactttgcctgttgagctaatacggaagcgatttttatcttcttccatatccacaccaatttgcataccatcaggaatttcgcattcgcggtcgataatacaatttttcaacacgcaatttttaccgattttaacttgtggtaacaccacgcagtgatcgacttttgaaaaggaatcaattttaatgcgatcaaaaagcacggaattgctgatcgatgcatcggtaatcacacagcccccgccaatcaatgagttatctactgggtgcacgttagagtgtttatagaagaatttagacggataagcctgaaccggattaccacgaattggccagctttggtcgtaaatatctaattgtggattttcagagactaagtcgatattagattgccagaagctatcaagtgtccctacatcacgccagtaaatttcgccctcggtgttgcgtcccatgcaagaacggctaaatgggtgagcataaagcgcgccttcttctaaacattttggcaatacatctttaccgaaatcgtggctggtgttcggggtgccaacttcacgatctaacattttgtaaagataatccgcatcaaacacataaatccccattgaagtaagcgaaacatcaggtttacccaccattgctggcggatcttttggtttttccacgaaagcttttactttcaagttttcgtttacagccattacgccaaattcgtgtgcttcagaacggggcacttcaatgcaaccaatagtacattttgccccactattgacgtgatccattaacatcacgctgtaatcttgtttgtaaatatggtcgcccgctaagatcaaaatatatttcgggcgatagtgatttttaataatagccatattttgatataccgcatccgccgtgccacgataccaagtagaatcgtcaatttgctgacgagctggcaacatatcgacaaattcccctctctcttgtggtaaaaaagaccatcctgtttgcaaatgacgaagcaaggagtgtgccgcatattgagtcacgaccccaattcggtttaaacctgagttaatacaattagaaagtgcgaaatcaataatgcgacgattaccaccaaaataaagcgctggttttgcacgtttatctgtcaattcgtgtaaacgtgaaccacgtccacctgcaagtacaagcaccaaagtgtttttaactaaatcatatttgttaaggtcgccagatttcataaggatctccatagtcttattgttattcgtcattcagcatacaaaagcccattgaactaagttcggcttgttcttcaagggttacattatgtgtgccgatttggggcttccatttcccattaggcaagtgaaacacctgaccttcggctttggcattaatcaacaaaagccaacgattgtctaaaaccacctgtaatgctttggtttgttgattttgccaatcttcaactgtcatcggttcgcctgcaatgttaagccattgcacattctcatccgaccaccattgatcttggtttaaactgcccattcttttgcggagtgcgatcgtttgcttggtcagttcaaataattcttcgttaaaatttgcccatttcagccaagtaatctcgttatcttggcaataagcattattgttaccatattgagtgttgccgaactcatcgcccgccaaaagcataggtgcgccattcgccagcaataaactcattaataatccactttgtgcaaaagtgcggttattttccaccgcacttttttgcggttcagaaagggattctgtagaaccttctactccgtggttgtaactgtaattttcgtttctgccgtcgtgattttcttcgccgttcgcttcattatgtttttggttgtaactcactaaatctttaagcgtaaaaccatcgtgagcggtaataaaattaagtgtagtatgtggcaagcggtcatttttcttaaataaatcgatagagcctgcaaaacgttctgcaaatgcaccgatttcgccacttttccatagccagaaacggcagagatcatcacggaatcggtcgttccattcggcaaaataacttgggaaattgccgacttgataaccgtaatgtccaatatcccaaggctcggcaatcaatttaatattttgtaaacttggctcattttttatgtcagtaaaaagctgagctgacgaattaaaatctggtgtatcacgaccaagcacggaggctaaatcaaaacggaaaccatcaatgtggcattgctccacccaataacgcaggcaatccaccacccactttcgccctacatcagaggataaattgagcatattgccgcagcctgtccaattgatataacgcccttgatcgttgcgccaatagtaagtttgatcatcaataccacgctggcagaatgttgggtaagtttgctctgattctgcagaatggttaaacaccacatctaagataacttcaataccctcattgtgaaacgcctttaccatcgctttaaattcagctaatggattatttgttgccgcatatttaggttccaccgcaaacatcgctaagggattgtatccccaataattttgtaagcctcgtgcctgtaagtgcggttcatttatatggaaatttacaggcagcaactccaccacagttacgcctaattctttcaaatacgccaaattcacaggatgtgctaatccagtataagtaccacgcaacgccgcagggattttctcgtttaactggctaaaccctttaacgtgtaattcatacacaatggtttcagcccaaggcgtattgggtaaagtatcattttcccaattaaaatcttccgaaatcacaaccgctcttggggcaagatgcgcgttgtcgcgattatccgaaagcaagaaccaagaacaactttcttcgctacttaaatcaggtttaccatttacggctttcgcatagggatcgagcattaatttattcgggttggcaaattcgccgtgaatacgaaatccatattccgtaccagttttcacgccagttaccgccaaatgccacacattttcagtacgcaccatcggcaagcgtgtttcttgattttgttcgtcaaaaaggcaaagttctacgcctattgccgcagcggaaaacagggcgaaattggtaatttgcacgttgttttcgaccgcttgtgagtatcccattggaataggattgccgttgttgtagattttgaacatatttttatcgcttttgtaggggcaaatgacatttgcccaaaaacatcggtggtttatcagggcgaatgtaattcgcccctacaatttatctattcggattatttcgccttcaatctcaaataaactgttgctaacggcggaatggacactgaaatcgaattttctcgtccgtggctttcgattttttcacttgcgacacaaccaaaattgcccacgtttgaaccttcgtaatacatcgaatcggtatttaaaatttcttcgtattttcctgcaacattcacgccgatgcggtaattgtggcgaggcacaggggtaaagttactgacgacaataatacgttctccgtttgaactgcgacgttcaaaggcgaacacagaatttgccgcatcatcaacgacaagccaatcgaaaccctctggggagttgtcgagctcaaagagcggtcgatttttttgataaatttgattgaggtctttaaccagcttcaatacgcctttgtgccaacctccgccaatattttcatcaagcaagaaccagtccaaactttcttcataattccactcacgaccttgggcaaattcattccccataaagagcaattttttgcctgggtagccccacatataaccgtaatatgcacgcaagttagcgaatttttgccacgtatcgcctggcatcttgccaagaagtgaatatttaccgtgaaccacttcatcgtgagaaagtggtagaacaaaattttcgctgtattgatataccattccaaaggtcattttgttgtgatgatattggcggtaaatggggtcaagcttcatataagccagtgtatcgttcatccagcccatattccatttgaaattgaagcccaagccgccgtcttcgcttgggtgggttacgcctgcaaaagaggtagattcctccgcaatagaaattgctcccgccatttcgctgtgaattttccagttggtgtgttttaaaaactcaatggcttctaaattttcacgtccgccgtattggtttggaatccactcgccctccgcacggctgtaatcgcggtagatcattgaagccacagcatccatgcgaataccatctacgccaaagcgttcaagccagtaaagggcattgctggacaggaaatttttcacttcgttgcgtccatagttataaatcaaggtattccaatcttgatgatagccttcgcgagggtcttcatgttcatacaaggctgtgccatcaaatgcgactaaaccatgggtatcacttgggaaatgccctggcacccaatctaaaatcacgttgatgcctgcttcgtgagcacgttttactaaacggcgaaatgcctcaggtgagccaaaacgactggttggcgaataaagcccaagtggttgatagccccaagaaccatcaaacggaaattcagaaagcggtaaaaattctatatgggtaaagcccatctcttttacataaggaattaattcatcagcaatttgatcgtaatctagccaaaaattgttttctaaattacgacgccaagatcctaaatgcacttcataaatagaaatcggttgatttgcttgatttgcttgacgacgttgttccgtcatttccaccacatttggtaatgcactaatttgtgaagctgtatcagggcgaagttgcgaactaaaggcataaggatccgctttcaaacgaagattgccatagcaatcaatcaattcaaatttatagagctgaccaaggctggctttcggcaggaataattcccacacaccgcttttcgggtggaaacgcatcgggtggcggcgaccatcccaatagttgaaatcgcctacaatagaaactcgtcttgcattaggtgcccacaagcggaaattcaccccgctcacaccatcacattccataaaatgtgcaccaagcacttcatatgggcgaagcatagatccttcagaaagtagccattgttctaaatcgtcaatcattggatgaaaacgataaggatcttcgataatttgtgcttcattaccccaaaaaacctgtaattgataagcaaaaaattgacgacaatttggaataacaccaacaaaaaatccacgctcatcgacacaatccagttccgttatttctttaccactttcacgctcaatcaccaccattcgattggcatctggcaataacgtacggatttcaattccttgctcggtttcgtgcataccaagcgtagcaaaaggatcaccattgctcgcatcaaaaaaaccatcaatagttgcttgtgttactgcggttgtcatatttactccttatacatttcgcccttggttaatttgcacaaagaacgtttttaaagcttcattgctaaaaataaacgctaacggttgagcaagtttcttgcaccagtttgggtattcatttgaggtgcccggtaaattagaactgatttcttggctaagtaaattttctaattgcacaccaatcaatcggctgttactttccgctaaataataatggatcattcgatttaaataatcgtgcatcgccatagaaagtgcatcaccttcataatgcggcggtaaataattatcacgatgtaaactatttaataaggcttgtttatccataacacgttgatcatatttttgcttgagcacttccccattcagaataccgagttgattaaataattctaaatcacggcaatgccaaaaactttgtaatgagggaacatcatgtgtaccaatagtggcataagcatttcgaggataatcagatatacgaggaaattcgccatttcgttgggcaaaatacaatacaaaataagagaaaatttgaaactcgtttaatttccaccgcacttcatcaggcacagtgccgagatcttcaccaataatcaaacattcattgcgtacactttcaatggcaagaatcgccattaattcatcaaaaggataatgcacataagcaccgtcagccgcggtttttccttttggaatccaccacaaacggaataagcccataacatgatcgatgcgtagcacaccgaaatattgcatattggcacgtagcatatcgataaatggtgtaaagccacgtgcttttagcactgttggattataaggtggcaaattccaattttgcccgactgggcctaacggatcaggtggcgcaccaatagaggcatttacacaatataaatcaggatcgctccatacatcagcactgccacgagaactatttacggctaaatcgccataaatacccaacttcatgccagactgtttacaaagattttgtaatgcggaaagttgttcttctgtaagccattgcaaccaagcaaaaaattggatttgctcatggtgtatttttaatagggcttttctttttgccgcacttaaatgctgccattccttacgccagccaagccaaccaatggtattttcttctgcttgatggtcagcgtgttcttgtaaatccaagacattaaataagccctgtaacaacaaaggttcccctttgctttttaaataatcagcaaagatttttcgacgtgtcacaatttcaacggattgactacgctgaaagaaataaaacagggactcaagtgcggttaattttaaagccaaaattgaagaataatcgacgcaatcactttcacgtaaagcagcaatttttgctttaatatcctcacgcttaaaccaattttgtactgaacggcaacgcttaaattcgggtaaatcaggaatgtccaaatataagaaattcaaccaacgacgagaggatgaactataaggactagcccaatttggcacagcaggatatggcaaatgtaatggattaattcccacataatccgccccttgttttgcactttgttcaatcaaagcagccaaatcgccaaaatcgccaatcccccagttttgttctgagcgtaaactgtaaagttgcacattcacgccccacacttttttattttttaatacggatggttgaaaagctgttttaggagaaataagtaaacgaacgcgatactgttcagtgtcagaaaaaatagataattgataatagccaaaaggaagtggaggcaaagaaagtgcggataaatttgaaagtattttttctaacagaatagcattagattcatcaatcagctgataacgatattccgcagatggtgggagatctagacgattgagtcgataatcaatcggttcattttcaaatgcagccagtacatcgtcaaactgtcctttcgcttttggcggaggctgcaaaagctcaacaaaagttaaaaccgtcttttcatccgcaaaaataagatgcccatcaatatcatagtgagaaagcgcgataccgcatttttctgctttttgtttgagagaatccgagatttgcatagacaccacatgacaactgtataactattgttagggattatagctaagctgaaattgatgacaactggctttatttaaaagtgtgatcttcgtcaataataaattcaaaccaatcaatcacatcgcgttcgtggataccatttttaatcaaaatatccgcattttttacagaatggggagagccagaaataagcggatgccattcaggtagtgtttttccttcataaagcaaacgataggcgcaagtatcaggcagccaatgaaaatcaggtaaattctttttggtgagtttggtgcaatcggtttcaatgttaaaacgctctgaataattaccgcactttcctgtttccacatctaaaagattacaagcaattcgggtgtaatagagtttttggcgtttacttcgcccttgaatatatttgcgataacagcatttgccgcagccatcacataaggcttcccattcagattcagtcatttcaagcagggattttgtttgccagaaattgggttcaagttgcatattggattgcatagttgatacaaataaaaagtgcggtcaaaatcacgtttgttttgaccgcacttggttgattaaaattagaagccttcttttaagcttactgttaagttaaataccaaatgttcaggtcggctatctttactatctgcacagaaataaccctcacgttcaaattggtagcctttctctgcttctgcatttgcgaggctttgctctacaaaaccttgttttatcactaaagaatttgggtttaacacgctttcgatatcatcttcagcccctggatttggcacagtaaataagcgatcatacaaacggaattcagctggatgattattaaccgcagaaacccaatgaatgacacctttcactttacgtccatctgctggatttttacctaaagtttcaggatcgtaagtacagaagatcgtggtgatttcaccatttgcatctttttctacacgttcagctttaatcacataagcattacgcaaacgcacttctttgcctaatactaagcgtttatattgtttgttcgcttcttcacggaagtcagctcgatcaatataaagttctttcgtgaacggcaattgacgttcccctaattcaggacgatttggatgatttggggcagttaaaaccgcttcgctttcaaaattttcaattaccacacgaacaggatcaatcactgccattgcgcgtggtgcattttcatttaaatcctcacgaatgcaggcttcaagtgctgaatactctacgacgttatcttgtttagtcacaccgatacgacgacaaaattcacgtaacgaagctggtgtataaccacgacggcgtaaacctgaaatggttggcatacgtggatcgttccaaccatccacgatttcatcatttaccaatttcaataatttacgtttagaggttaaagtgccttctaaattcaaacgtgagaattcatattgatgcggtaatggacgttcaatactgatattttccaacacccagtcatataaacgacggttatcttggaattctaatgtacagattgagtgtgtaatacgctcaatcgcatcagagatacagtgcgtgaaatcgtacattgggtaaatacaccatttgtcacctgtttggtgatggctggcaaatttaatacgataaattactggatcacgcatgaccataaatggcgaagccatatcaatttttgcacgtaaacttgctttaccctcggcaaattcgccatttttcattttttcaaataacgctaagttttcttcaatagtgcggtcacgatatgggctgtttttaccaggttcggttaaggtaccacgatattcacgcatttcatctggagaaagctcatcaacataagccaaaccttttttaattaattcagcggcatagccataaagcgcatcgaagtaatcagatgcataacgcggttcgccctcccatttaaaacctaaccattccacatccgctttgatagaatctacatattccacgtcttcttttactggattggtatcgtcaaaacgtaggttacataaaccttggtattcttttgccaagccaaaattcaagcaaatagactttgcgtgaccaatatgcaaataaccattcggctctggcggaaaacgggtatgaacgcttttatgtttacccgaagctaaatcttcatcaataatttgggtaataaaattatgagtgcgggtattttctgcacccaaagatgtctctgtatggctcatcattttctctcgttaaaataaaaaaatattcggctattctatacaaatctaagggaaaataaaggttcatctcctgttcttgccatagaaatactagatttaaataaaagattgtaaaaacttgccataaaaaaccgccacgaaattatcgtggcgatgtataaatgcacaaagtgcggtaagttttttgaatgtttagcttaccaaacccagccagctcccatttgataggaaattttgctgtttttgcctgcattcacggcgataccgctttttaatgtgatgtagtggagggaggcgtatcaactaaagctgcctaattttacgtcatatagataaaatataaaggaaatattgtttttataaataaaaagtgcggtgaaagtctcaaaaatttttaccgcactttattgaaatagagtttacattacaaccacatcaaactgttcttggttataaaactgttctgtttttacttttactcgttttccaataaacatttccacttctggcagtaaaccgtgagattcttcattaataagatattctgaaactgctggcgaggcataaacaacaaattgttcactactgaataaatgatacacccgaataatttcacgcataatttcgtagcaaactgtctcaacagttttcacccgaccacgtccatgacaagttggacattcatcgcatagcacgtgttcaaggctttcgcgggttcttttacgagtcatttctacaaggcctaattgcgtaaagccattcacattagttttcatacgatctttagaaagcgcatcacataaagattgcaatactcgattgcgatgttcatctgtttgcatatcaataaaatcaataatgattatgccaccaagattacgtagttggagttgctgcgcaatggctttagttgcttcaatattggtattgaagatggtttcttctagattacgatgccccacaaatgcgcctgtattaatatcaatggtggtcatggcttctgtttgctcgataattaaatagccgcccgatttgagattaacacgtttatctaaggctgtttggatcgcattttcaaccccgtacacatcaaagataggttgattgccagaataaagaacaagtttatcgcttaattcaggcataaattcatcggtaaactcttttacttcgccaaagcaaagtttagagtcgatacgaattttttctaagtttgtgccgataaaatcgcgcaaaatacgttgtggaagtgctggctcgccgtaaatttttgatttggttgggtacttagatttacgttctaaaactttacgccataagcgttttaaaaattcagcgtcttgacgtaattcttcttcgcttgccccttctgtggcggtacgaataataaaaccgccgagttcatcacaaaaaggttcaactaatgcttttaaacgggcgcgttcttcttcgctttcaatgcgttgtgaaacgcctacgtggctattttcaggcataaaaacaagatgacgcgatggcaatgtgatatccgttgttaaacgtgcaccttttgtacctagcggctctttcaccacttgtacaacaatatcctgcccttctcgtactaattctgaaatgctcttaactttaaattgcttttgttcattttcatctacacattctgtatgggatacaatgtccgcagcgtgtaaaaaagccgctttttccaaaccaatatcaacaaaagccgactgcattcctggtaacactcgagtgacacgacctttataaatgtttccgacaattcctcgtttagcttggcgttcaatatgcacttcgcgcaacattcctgtttctactagcgcaatgcgtgtttcgttaggcgttacgttcatcaataactcgacagcatccattttatattcctaatttcttaaatttcatcaaatatttagtctaaatagaataatagcccgaaataaggtaaaatgcaccctttctgaaatttttaacccattttggacttatataatgtttggattcgacccaagtcttattacttttactatttatattttcgggatgttgctgattggcgtactcgcctattattacacgaataatttatcagattacattctcggtggacgtcgtttaggcagttttgttactgcaatgtctgcaggtgcgtcagatatgtctggttggcttttaatgggcttacctggtgcggtatatttatcaggcttagttgaaggctggattgctattggtttaactatcggggcttattttaactggcttttagtggctggtcgtttgcgtgtttatacagaattaaataataatgcgctcactctcccagaatattttcacaatcgttttggttcatcacacaaattattaaaacttgtttctgccactattattttagtgttttttactatttattgtgcttctggtgtcgtggctggcgcaaaattattccaaaatatattttctgtggaatattccaccgcactttggtacggcgcagcggcaaccattgcttacacgttcatcggaggtttccttgcggtaagctggacagataccattcaagccacattaatgatttttgcattaattttaacccctgtttttgtgttattgagtttcgccgataccgctcaattttccgcagtactagaacaagctgaggctgccgtaaataaagatttcacggatttatttacttctaccacaccacttggtttattaagtcttgcggcttggggattaggctatttcgggcaaccgcatattttagcacgctttatggctgcggattctgtcaaatcacttatcaaagcacgccgtattagtatgggttggatggtgctttgcttagcaggcgcaattggcattggcttattcgctattccgtatttctttgccaatccagctattgcaggcacagtcaataatgaaccagagcaagtatttattgaattagctaaacttttatttaatccttggatcgcgggcatattactttccgctattttagccgctgtaatgagtacattaagtgctcaattattaatttcttcaagctcaatcacagaagatttctacaaaggttttattcgccctaaggcttcagaaaaagagctcgtatggcttggcagaataatggtgttagttattgccgcacttgctatctggatcgcacaagatgaaaacagcaaagtattaaaacttgtagaatttgcttgggctggttttggtagtgcgtttggccctgtggtacttttctctcttttctggaaacgaatgacatcatcgggcgcaatggccggtatgcttgtaggcgcagtgacagtatttgcttggaaagaagttgttccagctgatactgattggtttaaagtatatgaaatgatcccaggctttgctttcgccagccttgcaattattgttatttcattactttccaataaaccagaacaagatattcttaatacctttgataaagcagaaaaggcttataaggaagcaaaatgatcgactttcgccctttttatcaacaaattgctactacaaatttatcggactggttagaaaccttaccactccaattgaaagaatgggaaactcaaactcatggcgattatgcgaaatggagcaaaattgttgattttctaccagatttacatgctgatgaaatcgatctaaaaagtgcggtgaaatctgaccgcacttttcccctttcagaaggtgaaaaacaacgaattatccatcatttaaaacaattaatgccgtggcgaaaaggaccttatcatcttttcggcattcatgtagattgtgaatggcgttcagattttaaatgggatcgtgttcttcctcatttagctccactgcaaggtcgcactattttagatgtgggctgtggcagcggttatcatatgtggagaatggtaggtgaaggcgcaaaaatggtggtagggattgatcctaccgagcttttcctttgccaatttgaagctgtacgcaaactgcttaataatgatcgtcgagcaaatcttatcccacttggtattgagcaaatgcaaccattagcggcatttgacactgtattttcaatgggcgtactctatcatcgtaaatccccattagatcatttaagccaattgaaaaatcaattggtaaaaggtggtgaattggtattagaaacattagtggtggatggcgatgtaaatactgtgctcataccagcagatcgctatgcgaaaatgaaaaatgtttattttatcccctctgtcgccgcactaattaactggctagaaaaagttggctttaccaacgtacgttgtgtggatgtagcgacaactacattagaagaacagcgtaaaactgattggttggaaaatgaaagcctgattgattttttagattcaaatgatcacagtaaaaccattgaaggctatcaagcaccgaaaagagcggtaattttagcaaataaataaaaaaggaaattatttcctttttattttactcgcgtttcatatttacaaagaataatactctaattctactgaagttaatgtggataataaggtttcagccatcgttttatggctcaattttaatgctttttcagccatcacaattcgctcaatatcactcaattttttatcatttaaatacgcaaaattaagtgcggtttgcaacgctggcaaactcggattaaatgcggcgttttctgcataacgtcctgtcaccacatcaccatttttaaataaaatcgcaatgccgtgcggactatttgaataaggacaatgagattgatttgccgctaaaatagcttgattaaccaaatcatcttgatgatcagcaactaaatcatgattttcttccgccaaaagatgcgctgcaatatcgagatcttttggcccaaacgcatccggtaaataagaatgtaatggattattttggctatgcggcaaatgaattgaaattttttcagcaccgtgcaattcattcataaattgacgacaatgtccgcacggcgtgtaattgaccaccatatctgaaatacggcgttcattacgcaaccaagcgtgagaaattgcactttgttccgcgtgaatcgtttgctgaatggctgaattagcaaattcttgattcgcgccgaaataaaaatccccttgttcgccaatagcaattgcccccacattaaaatgagaaatagcagtatgactataacttgcagcaagtggcaacaagtgcatagccaattttagtggggtaagttcaaaattatgacaaagctgctgcacttgggaataatttaaaaaaccagcccaattttgtgaacgaagttcattcacaatagcttgattaagtgcatcatcttgtggcaaggtgcgcttaataagttcttgcataacatatccttagaaaaaatattaaaaattataactgtacttattaaatcaaaatttattgttagctgcgatagtttgattaaatattcattaaaattgtgatcttgatcacttatttgatagcttctatttattacaatttcttaacaaataagactaaggctatcaattatattgaatagaacaatttcacttcaaattatagaaaggtataatacccatatcaaagggagggcattagctcaattattcaactagaaaaaggaaattattatgtcaaaaacatcaatcggactagataaagttcaatcagcagaattagccgataaacttaacgaattacttgcaacctaccaagttttctatactaatgtgcggggctaccactggaacattaaaggcgtaaacttctttgcattacacgcaaaatttgaagaaatttatactaatttagttgctagagtagatgaggtggctgaacgtattttaactttaggttacacaccaaataatgcttacagccaatacttaaaaatatctcgaattaaagaagatattgcagtaagtgaggcacaagaatgtttatcaggcacattacaaggtctaaaaacattactagatcaacaacgtgaaattcttgcttttgcaaataacgctaatgatgaaggtactgcatcacaaatgagtgactatattaaagaacaagaaaaattagtatggatgttccaagcagcgtgccaaacttgccataattaatgaataaatttcaacgctaacgaaaactaacctgcaattaatctaactcaataaagttagattaatttaatttgtctaagattaaatttgatccagcaaattacctcaaaagtaagagtttcctatttagaataagaatgtcaaattcagtctgaataaaggaaactcttatacctattattcacagtgatctctttaaactaatttagttaatttagccactaaatttaacgttttttaaatcagtaaataaatctatagaaataaatattgtagagcgttaaaaattttgattattaactatttttttagttgataaaatatattcttgagaatttagagttaaattaataggataaaaaataatttaaaatgaagaaatattaaatttgttagctattttattatttcttgtccaattagataaaaaaagcccctaaataattaggggcattaaaaaggaatttatgaataaaatctctaaagtttagcttcatcaaaggaatctcgataaaacgccaccattatattgagtaatctaaagaatagcaagaaaaatctttacatttctttacaaatctttacatttcagcatttcgataattacttggacagtattttccatgccttgtaaagaaaccaactcgtgtttactatggaaattatagccgccagtaaaaatatttgggcatgctaaacctttagaggctaaaaatgccccatctgtaccgcctcgaatcggcttatgatttggtttaattcccaccgctttcattgcgcgatcagcaagttcaattgattgaggaacgttttttaccacatcatacatattttggtagctatcttgaatttctaactctataggctttttcaaaccttttttagcattaaatttttccacctgatttttaataaaagcttttctttgtgcgaaattctgttcgtcaaaatcacgaatcaaataggtaagctctacttgctcaatatcgccagaaaaatcttctaaatgataaaagcccgctttcccatcggttttttctggtacttcatcaacaggaaaaacttgctgaaattcacaagctaaagtcagcgcattcagcatttttccttttgcataacctgtgtgaatatttcgcccgaaaaaccgcacttttgccgttgcagcattaaagttttcgtattctaattcccctacctctcccccatcaatggtatatgcccaatcacaggaaaacttttccattgggaaataatggattcccaaaccaatttcttcatcaggcgtaaaagcaacacgaatattgcaatggggaatattctctttttgaagaatggaaagtgcggtcataatttctgcaattcctgccttattatccgccccaagcaaagtggttccatcagtaacaataagcgtttgtccgactaatttttgcataaaagaataataaacagggctaataaattcctcgccaatacctaatgcaatatctccgccacgatattcttctatcacttctggacgtacatttttaccactacattgcggagatgtatcaagatgcgcaactaaaccaatggttttcgttaagttaggatcattagcgggtaaaaatgctgttaccactgcatatttacttacttcaacattctccaaaccaagttggattaattctttttgtaactgcatggctaacttcatttgcccaacagagctgggggaatgcttcgcattaggttttgattgggtgtgaaaagacacataatgtaaaaatcgttctaaaagttctgctttatctatttgagaaatcatattctcgctccttttaaaaatatcttttttagtttaacgagaaaaatagaaaacatcttgatatataacaatatttataaaattaacgaagtaaaattcatcgaaagtgcggttaaatttctcgttatttttatgaacggcagtttttttactttctaaggtattaagtccttttcattattaacaattcactatatcataggcgtctatttttatatgtcgcccctgcagtcttgcaggttttatttctactcagtaccaaatcattggtgaaattagggagaaaaccaaagctagtggaaaatcagcctcaaaacaagcctattattgagcttcgttcaatcaaaaaatcctatggttctaacaccattattaacgatttcaatcttgcaattaataacggtgagtttgtcactattcttggcccttcaggctgtggtaagaccacagttttacgcttacttgcaggcttagaagaattggattcaggtagcattattttagatggtgaagatatcaccaatgtgccagcggaaaaacgtcatattaatacggtattccaaagctatgcgctatttccacatatgacaatttttgagaacgtggctttcggtttgcgtatgcaaaaagtaccaaacgaggaaattaaaccgcgtgttttagaagccttgcgtatggtacaactagaagaaatggctgatcgtaagccaactcaactttctggcggacaacaacaacgtattgctatcgctcgtgccgtagtaaataaaccaaaagtgttgttacttgatgagtctttatctgcattggattacaaattgcgtaaacaaatgcaacaagaactcaaaatgttacaacgtcagcttggcattacctttatttttgtcacccacgatcaagaagaagcgattacaatgtctgatcgtattgtattattgcgtaaaggtaaaatcgcacaggatggttctccacgtgaaatctatgaagatccagctaacttattcgttgctcgtttcattggcgaaattaacgtatttgaagccactgtgattgaacgaaaatcagaacaagttgtactggcaaatgttgaaggtcgtatttgtgatatttatacggatatgcctgtggaaaaagatcaaaaacttcaagtactccttcgccctgaagatattgtgattgaagaattagatgaaaatgaacattctaaagcaattatcggtcatattattgaccgcacttataaaggaatgacattagaatcaacggtagagtttgatcataacggaatgcgtgtccttgtaagtgaattctttaatgaagatgatccacatatggatcatagcataggacaacgcgtaggtatcacatggcacgaaggctgggaggttgtactcaacgatgaagataatcaataataaattccagaaaattactgttgcgattatcttcagttggctaatcttctttgtgctgattccaaacttattggtacttgccgtaagttttctgactcgagatggtagcaacttttatgcattcccaattactattgaaaactatacaaacttgtttaatccgctttatgcacaagttgtgtggaattcattgtctatgtcgggcatcgccaccattatttgcttactaataggttatccatttgcttttatgatgagtaaaattcatcctaaatatcgaccgctcttattgttccttgtggttttaccattttggacaaactcgttaattcgtatttatggaatgaaagtgtttcttggcgtgaaaggcatacttaacacgatgttaattgatatgggaattttgagtgcgccaattcgtattttgaataccgaaattgcggtaatcattggcttagtttatttactattgccatttatgattttgccactctactctgccattgaaaaactagataatcgtttattagaagcagcacgagatttaggagcaaatacgttccaacgtttcttccgagtgattttaccattgactatgcctggtattatcgcaggttgtttattggtattattgccagcaatgggaatgttttatgtagcagacctactcggtggagcaaaagtcttgcttgttggtaacgtaattaagagcgaattcttaatttctcgtaactggccatttggttctgcagtcagtattggtttaactgttctaatggcattgttgattttcgtgtactaccgcgcgaataaactattgaataagaaagtggagttagaataatgagtcgtttactacgtaatgcatttatgtttgtggtatacgcttatttgtatatcccaattattattttagtcactaattcctttaacaaagatcgttatggtttgagttggaaaggttttagctggaactggtacgagcgtttatttaataacgacaccttaatacaagctgcgattcattcggtaactattgcattttttgcggctaccctagctactattgtaggtggattaactgcaatcgcactttatcgctatcgattccgcggtaaacaagcagtaagcggtatgctatttatcgttatgatgtctccagatattgtaatggcagtatctttacttgcattatttatggttgtgggtatttcattgggcttctggtctttactacttgcccacgtaactttctgtttaccgtatgtgaccgtaactatcttctctcgcttaaatggctttgattccagaatgttagaagcggcgaaagacttaggtgcaagcgaagtgactattttacgtaaaattatccttcctttagcattacctgcagttgtatctggttggttattaagtttcactatttcattagatgatgttgtggtttcatcatttgtcagcggtgtaagttatgaaatcttaccattgagaatattctctctagtgaaaactggtgtaacacctgaagttaatgctttagcaacgattatgatcgtgctttcattagctcttgtcgttttaagccagctaattacacgaaaaaataaccattaattaacaaaaggtttcacaaacctttgaatttaaaatagaatacgccttgacgcacaatcaaggcgtttttttatgcctgtcattcggcaggtggtttttttacgactctttaacaggagaacaaacaaaaatgaaaaaatttgcaggtttaattactgccagcttcgtagctgcaactttaaccgcttgcaacgataaagatgctaagcaagaaactgcaaaagctacggctgctgctaatgacactgtgtatctctacacttggactgaatatgtaccagatggtcttttagatgagtttactaaagaaactggcatcaaagttatcgtttcaagcctagaatcaaacgaaacaatgtacgctaaactcaaaactcaaggcgagtctggtggctatgatgttatcgcaccttctaactacttcgtttctaaaatggcacgcgaaggaatgttaaaagaacttgatcacagcaaattacctgttcttaaagaattagatcctgattggctcaataaaccttatgataaaggtaacaaatactctcttccgcaacttttaggtgcgccgggtatcgcattcaataccaacacttacaaaggcgaacaattcacttcttgggcagacttatggaaacctgaatttgcaaacaaagttcagttattagacgatgcgcgcgaagtattcaacatcgctttattgaaaattggtcaagatccaaatactcaagatccagccattatcaaacaagcctatgaagaattattgaaattacgtccaaatgtactttctttcaattccgataacccagctaactcgttcatctcaggcgaagtggaagtgggtcaattatggaatggttcggtacgtattgctaaaaaagaaaaagcacctttaaatatggtattcccaaaagagggtcctgtactttgggttgatacacttgcaattcctgtaacagctaaaaatcctgaaggcgcacacaagctgattaactacatgttagggaaaaaaacagctgaaaaattaaccttagctatcggttacccaacctcaaatattgaagcgaaaaaagcattaccaaaagaaatcactgaagatccagcgatttatccgtcagctgatatattaaaaaatagtcactggcaagatgacgttggcgatgcaattcaattctatgaacaatattatcaagaattaaaagcagcaaaataattggtcaattagcaaagaattaaaatctgattctgtgcaatatttcctctaaataaaaacgccctttcgggcgttattttttaagctttaccgtcagccaaatttttcttttcttctaattcttcccagcgtaaaaatgctgtttctaattcggcttcagtatctgccaatgcttttaatttagcgtcggtaatatcgtgagcttgttggaaaaatgctggatcggctatttcagcttgaagtacggtgattttagtttccaactcttccaatagttgtggaagttgttctagttctcgttgttctttataagaaagtttcacggatttcggcttagaagtgcggtcatttttcaccgcactttcttcttttagtggttcagatttcttcgccttagcctgttcttccaccgctttgcttgcccaaaaattggcttgttgctgtttcgcatcaaagaatcctcccacatacttattcaaatgcccttcaccttcgaataaataacattctgtcgcagtattatcgataaattgacggtcatggctcacaattaacaatgtgccttgataatccgtcaaaatttcttctaaaagctccaatgtttctacatcaaggtcattggttggttcgtcaagaatcaataaattatttggttggagcaacaattttgcgagtaataaacgatttcgttctccccccgataaggctttaactggggtcattgctcgttttggtgggaacaagaactcttgcaaataccctagcacatggcgttttacaccattgacttcaatatcttgtttgccatccgccacattatccattacagttttttcaggatctaaatcagcacggtattggtcaaaataagcaatatctaatttagtaccacaacggattttgcctgatgttggctgaatttcacccagcaataatttaatgaacgtggttttcccacagccatttggcccaacaagcgcaattttgtctccacgtaaaatcgttgttgaaaaatcttttaacaaggtttttcctgcgatttcatagctcacatcttccatttcaaagacaattttgccagaacgacttgaggtatctaactgtaatttggctattcccattacatcacggcgttggcggcgttcctcacgcatcgcttttaatgcgcgcactcgcccttcatttcttgtacggcgagccttgataccttggcgaatccatacttcttcctgtgcaagtcgtttatcaaataattcattttgcaaggcttcaacgcgtagattttcttctttcgtggttaaatataaatcgtaattgcctagataagactgcaattgaccgcgatctaaatccacaatgcgtgttgccattttgcgaataaaagaacggtcatgggaaataaatacaaggctaccttggaaatccagtaagaaattttccagccattcaatagcttccacatctaagtggttggttggttcatcaagtaataacacatcaggatcgcataccaatgcgcgtgcgagagccgctttgcgtaaccaaccgcccgaaagtgcggataattttgtgtttggattcaaacctagttttaacaacacttcattgattttattttcaaatcgccagccatcagcgtgttctaatttatcctgaacttgctctaattgacttaaaatttgatcactgtaattttcttccaattgaacagaaatctgatgatattctttcaataaatccgttaaatgcccgacaccttccgcgacataatcaaaaatattgccttgcgcattacgcggtgggtcttgttctaaacgagaaaccacaagatctttttcgtattggattttgccatcatccataagcacatcgcctgcgatgattttcaataaagttgatttacctgcgccgttacgcccaactaaacaaacacgttcattcggttcaatatgtagttctgcgtgatccaacaaaggtgcatcactaaaggaaaggtatccattggttaaactaattaatgccacagctgccccataaaaattcagtgaaaattaaccgcactattctatacggtttgcataaaaaatcccatcaattcaatgggattctctcttaaatcaaagttgttgatatacccgcaatgcgtgtgcatctgacatgcctgcaatataatcgcaaataattcgcttcttcccttcttttggtgcattacgccaacgattttctgtatttcttggtaataaacgctccggatcagattcaaaaatctggaacatttctgttagcattctctgccctttatattcgattcgttgggtatccacattgcgaataacataatcccaaacgaattttttaaatacaccaagcgcagcaatcacttcaggtggcaactctgcgttataacgtaacaaaggttcatcaaaatttgccgttaatttccaccgcacattagtaataaaaaagttcaccaatgcaccaatcgcctgtttgcgctcaaaatgtttatccgagaaaagtcgttggctaattgaatcaatattttcatgtaaccaagctgacggaatttgtttcaatgcaacatgtgccgcttgccattgatgaggatttaccacgccagttacaatcgcatcttctaaatcatgtacgccataggcaatatcatccgccaattccataatgctgcaatccagtgatttaaaccgagtatgtaaagattcagctggattttcccgcacttttttaaattgacagaataaagtgcggtcattttcagaaagattttccagcaaccaattaaacatttttaaatcatcgcggaaaatgccttttcctggaatccaatcatgaatacgcacaaaacgaggatcaatgttgcgagaaaaattaagttctgcatattgaggcgaagccacacctaacaacgcgggatatttcactacacccaatagtgttcggcgcgttagattcatccctgcattttcagtgtaaggctcaagtttcgttaaaattctaaaggtttgtgcattgccttcaaaccctccctgctctgccatcatataatttaatgccgtttcgccaccatgcccaaaaggcggatgcccaatatcatgagcaaaacacaaactctcaataagatcgttactcggcaataaaggttttaattgtttttgcaactcgtttttatcaatatttaatgtttgcgaaaggctttcaaaggtttctaaaaatttaagctgtgcaacgaggctgctgccaatctgtgcaacttctaaagagtgagttaagcgagtacggtaaaaatcattttcgccaattgcgtgaatttgggttttcgcttgtaagcaacgaaaagcggcagaatgtaaaattcgcccacgatcccgacgaaatggtgggcgattatctttttcgcgtggaggatcaggaagaaaacgttctgtccaagaagaatcaatgataagtggtttcatatcgctttgttttatttcgtttttctgcattatctaatcatttagcgcaaaaaacaaccgcactttatctataacaaacaaaatctagaatgaataaagtgcggttgaatttttattgatatttaaacaaagaaataaatcagcttaaatacaaatggcgcgagaatagaactaataatcccacaaagcacaagagaaatagaactgtaacttcccgctgttggattcgtttccatacaacttactgtaccgagcgcgtgagaaaccgaaccaacagaaagcccaatagcttcttgatgtttaacacccaatttttttaatacaagataaccaaatatcgatccttgcaaacctgcaaccacaacaccaactgcagttacggcaggaatgccgcctaaatgacgggaaacttccatcgcaataggcattgtgatggatttaggtaaaaccgtagcgaccatttcgggcgttgcacctaaaagaaatgctaaaagcccgccacttaacatcgccaaaaaagaggctataaccaccgttgaaagaataattttccattgtctggcaatttggcgaagttgttcataaagaggcaatgcgagagcaacgatactcaagccaagtaaattattaataggcgcatttcctgccatataatcatcataaggaatctttcctatcactaaaatcgccgccaaaattaatactgttaaaacaaaagtattaaaaatcattgacttccaacgtttgctaatttgtagtgcgagccaaaacccgaaaattgttaaaaatgtataaagataaataatgtactgctgcatataaactttcctaacatactaattcgcttgttttacctgattttctctacgttttattacttttttgcgtttatgtgtaaaagattgcatctgatacaaataatgacctaaaaatcctataacaagtaaagtgacacaagtactcacaatattaggaacaagcaaaatattaatttgctctatcaataaatcagaatatttgataattcccacgctcactggtacaaaaagtaccgccataaaacgaattagcaaacttgcgcctaaataaatccaatttaaatgaatcactcgtgttgttaaacctaaaaagagcaataacaatccccaaatacttcctggaacacctgatggaatgtaataagcaataagatttccgagatataacataatagataaaatgaccaacgaacgaactaataaaaataatttttgaatcatatacaaccttttcaactattttcataatatttcaaaattattttacgcttttttttgctaacttgagccattttttcggtaaaataaccagacttagatcaaaaactttgcaaaatgataaatcgaaaaatactattggcgagtttattacttatttttaccgtactttctgcttgttctcgcgaaaaaaatacgtgtcgtgtggttaaaattagtgatggcgatacgctcacttgcctcactaaaggcaataaatccattaaagttcgtttagccgaaattgatgcgccagaaaaatctcaagcctttgggcaaaaatcgaaaaaaaccttgtctgatctggtttatcaaaaaaacgtacgtctttcactaaaaggaaaagatcgctatcaacgaaccttcgcgattgtttattatcaagataaaaatattaatttagaaatggttaaacagggtatggcatgggcttataaacaatattcccatgatccgatttatcttcaagcgcaagaaaatgcacaagccaaaggaattggtctttgggcagataataatccgattgaaccaagtcaatggcgcagacaagagaaaaattaatatggcttttgattatcaaacgttccgtcaagaatttccctatttccaacgtgaagattctgttatttatttagataacgccgccaccgcgttaaaacctcaagtgttaattgatcgcaccgctgaattttatgcgtctgcaggttcggtgcatcgcagccaatatgatgctgcccaaactgtgcaatatgaacaggctcgcacacaggttaaagaatgggttcatgcagaagataaacacgctgttatttggacttcgggtacaactcacgcaataaacttagtggcaaatggattgctgccgcaattaaacgccgaagatgaaattctgattagccaagcagatcatcatgccaattttgtcacttggcatgaaacggcgaaaaagtgcggtgcaaaaattcgagttttaccgattttagataattggctaattgatgaaaatgtgcttatttctaccctttctgaaaaaacaaaactcgttgcgctgaattttgtttcaaatgtcacgggcacagaacagccgattaaacgcctgattcaacttattagaaaacatagtcatgcgttggttttagtggatgcagcacaagcgattagtcatattaaaattgatttacaagatttagatgccgatttcctcgcattttctgcccataaaatttatggcccaaatggacttggcgttttaacaggaaaattgaccgcactttctcaacttcaaccgctcttttttggcggaaaaatggttgaacgtgtgtcaaataatcgtattacttttgccgaattgccttatcgtttagaagctggcacacccaatattgctggggttattggctttaatgctgtgctggattggctacaaaaatgggattttaccgcagcagaacagtacgctatatccttggctgaatccgtcaaagtgcggttaaaatcttacgagaattgccgattattcaattctcctcaagcaagcactgtcgtttgctttgtatttgacggcattgactgttctgatctttctacacttttgagcgaacaaaatattgcgcttcgtgtgggcgaacattgcgcccagccttatttagcacgcttaggcgaacgcaccacattgcgtctttcttttgcgccttataatacgcaaaaagatgtagaggcattctttaccgccttagataaagcactggatttattacaatgatagaacaattaaaacaagctaaaaattgggaagatcgctatcgcctgattattcaagcaggcaaaaatttacctcgcccaagcgataatgaactcgctcaaatgcaacctattactggctgcgaagcacaaatgtggtttcaaattatgcctaaacatgaccgcacttttcaattcagcggatttagcgaagccagaattatgaatggcttgctttggattttattcaatcaaatcaatggcaaaacagcggatgaattgaatacatttgatattattgccttttttagcgaactcggcatttcacaacgtttaagtgaaatgcgtttaaacggcttaaaccaaatcagacagcaattaaaaaatttatgtatttaatcgaaacctattttcgcctgactgcactcgaaaataatattgaatcacaaagtcgtttactcaatgcagtgatcgatcaatggcggtataacgggcaaattatcggacgtgaaattcctttatatttagcggaagaagatggtgcacaaggttttgctatgcgtgtcatttgccctgagcaagatagtcttttcccacaaaataataacgcagaagtgaatcgtgcattacaagaagcagaaaagtgcggtgtaatttttgatggttttcaacttgtgggcgatgatttcaattcagatcaaacagcagaaaatacatcgccagcttggcaagtgctttacacaacccatttacaaagttgctcgccgattcatagtggagaaaatttcgcaccaattccgttgtataaacagttgaaaaatcaaccgcacttaagccaagatctgattaaatggcaagaaaattggcaagcctgcgatcaactacaaatgaatggtgcggtattagaacaacaatctttggcagaaatttcggagcaccaaagcacactttcaaaacacggacgatatttagctcaagaaatagaaaaagaaactggcataccgacttactattatttatatcgtgtaggtgggcaatctttaaaatctgaaaaatcccgttgctgcccttcttgtggtgcaaattgggcgttaaaaaacgcgatttttgatacctttcattttaaatgcgatacctgtcgattcgtttcgaatctatcgtggaatttttttgtaattaatttataaagtgtcgaaatttgcaaaagtcgaacacctaatcggagaaaagatgaattaccaagacaacagcttaaaatccttaaaactcggtcaaaaaacggaatacgcctctcaatatgaccgcactttattacagcctgtgccacgtgcgttaaatcgtgatggattaggcattactcaaaaccaaccatttactatcggcgccgatatttggacggcttatgaaatctcgtggctcaacgaaaaaggcttaccgcaagtggctatcgcagatatttatctggattatcaaagccaaaatttgattgaatcaaaaagttttaaactttatttaaatagctttaaccaaagcaaatttaccgacttcaacgccgttcaacaaactatgcaacgcgatttaatcgaatgtgcgcaaggcgatgtaaaagtgcggttaaatccagtggcagtttatgatgctcaaaaaattgagcatttacaaggcgattgcattgatgaacaagatattgaaattactagctacgaatttaacgctaattggctgaaagattgcgtatcggatgaaattgtcgaagaaaaattagtcagccatttattgaaatctaactgcctcattaccaatcagccagactggggcaccttgcatattcactatgttggtaaaaaaatcaatcacgaaaaattattgcgttacgttatatcgttccgtcagcataatgaattccacgaacaatgtgtcgaacgtattttttgcgatttaatgcactacgcaaaaccagaaaaactcaccgtttacgcacgctatactcgtcgtggcggattagacattaatccattccgctctaattttgagaatttacctgaaaatttaagattggcgagacagtaaaaaactgcggtgaaatttcaccgcacttttctctacccttgtttcaaatcatttgcctgctgtaatagctgacggctttcttttaagaattgttcagaataatcgccaaaccagtcacgcaccttgtggaaagcatcaataaaaccttgacgatcattcttttcaaagaaagttaaggcttcgtcgtaagtttgttttagcgtttcaattaccgctaaattttctggcttatccataataatatctgcgtaaagctctgcatcttgcgcaaataagcgaccgatcatcgcaagttctaagcgataaataggagaagaaagcgccaataaattagcgagattaatgggctgtttggaaaggtgtaaaccattcgcaaaagtcgaaaaatggcgcaaggcttgtatataagtcatattgtgatcgtgttctgtggcattggtttgataaatttttgcgccccaaatttgaatttgctcaagtaaccattcataacgttcaggaaaacgtccatcacaacgtacaaccacttgttttgccatacttgcaatgtctgcaccaaacattggatgtaaacctaaaactgcaccagaatgaacttcaagcattttcgctagcggttcacgcttaacagaagttaaatctgcaagcaacatattttctgttaaataaggttttagtcgctcaatcgtttccaaagtaatattgatggggacggaaacgatcacgacatcagcattcgctaaaatactttcagccaccgcccaatcttcgcgatctaaaatagaaattggatagccagatgcacgtaaataacgggcaaataagccacctaatttaccataaccgcccacgataacaattttgtgaatatcagaattgatagttttaaaaccaaattggttttcattggcataggattcacgcataaaacggcgtagaacatcttcaattaaatcggctgaaatgcctgctttttcagcctctaaacgacgtgcttggagcattgctatttcacgctctggcgcataaataggtaatccatgttgatgtttcactttaccgacttgagaaaccaactcaagacgtttagcaaaaagttggataagttcgcgatcaagcgaatcaatttcagaacgtaaatctttaaggacttccataaaacccacctgcaaaatttagtttacatatattgtaaaaaattaattacagatgagattactagaattttataagaaaggcaatgaagttatgcagattgtgtaattaaccgttgtgggcgaataatattcccgtcgattaatgccacgcctaagaataaattctccgctgaaaataaccgcacttggccacctaattgctgttcattagcaaatttcactcgctgaccaaaaccaatggctttactctgctctacatccaaatgcaaagcgggcaatttacttactgcggtatcggttggcagtaatagacgatctaattcacttaatggaaaactttcagcgagcagttgtaactcattgattggtatcatttctgctacggggtaatccgctacggctgtacggcgtaacattgtcacatgtgcgccacaacctagcacttcacccaaatcatcgactaaggtgcgaatataagtgccttttgaacaatgtacttctaaggttaaaaaaggtgcgtgatattcaataaaattaagttcaaaaatcgtaattggacgtgcctcacgctcaaccgtaataccttgacgcgcatattcataaagcggtttaccgttatgttttagtgcggaaaacatggtcggcacttgcaaaatatcgccacgaaattgttcaagtgcggtcaaaatttgcggagtttcaacatgaacttcacgagtttccacgacttgcccttccgcatcggaagtatcggtacgttcgcctaattttgccgtaacaagataacgcttatcggcatcaagcaaaaattgtgaaaacttagttgcttcacccaagcaaattggcaacattcccgtagccaacggatcgagcgcacctgtatgccctgctttattcgcttgaaataaacgcttcaccttttgcataatgtcatttgatgacataccttgtggtttatccaacaaaaacacaccatcaacatcacgccagcgtttacgaggtctagacattagttgctttcctcaacgtgttttttctcatcttcacgcacaacatttgtcacaagatttgacatacgcatcccttccactaaggattgatcataaataaagcgaatctctggcacgatacgtaaacgcatcgctttgcctagtaatgaacgaatataaggcgatgctttttctaagcctttcatgccttgctcaattgccgtttcatcgtgatcgaataaaaaagtcacaaagatttttgcgtaagataaatcgctcgacacttccacatcagaaaccgtcaccatcccaatacggggatctttcacttcgcgttgtaaaatgactgctatttctttttgtatttcttgagcgacgcgatcgctacgtttaaattctcttgccatagttattccttatttataaaagcacctcattctactggaaatcattgaatttagcacgcaaaaatccctttcaacccgatactgtttttcgatagaatgacacctgataatttgtttgaatattcaaacttccgataaaaatcactttacagagggcataatttatgcaagcgagacgagacaccaagattgtcgatgaaaatcacacattacaacaagcatttttaaacgatttagacgaaaaactttggtcatctgcggataaactccgccaacaacttgatgccgccaactataaacatatcgttcttggtctcatcttcttaaaatacatttctgataatttcactcatcaacaggaaaaaattcaggcagaactttctgatgctgaaaatcccctctatcttgaccgcactttttttgatactgaagaagaatatcaagaagctttaaccgcagaactagaaaaccgtgattattacaccgcggataacgtattttgggtgcccgcttctgcacgttggcaagccttacaagaagtctctattctcaacactggtgcagaattaccttggggtggtaaattctcaggcgtggcaaaactgattgatgatgcctttgatgccattgaaaaagacaacgaaaaactcaaaggcgtcctccaacgcatcagcggctatgccgtaaacgaagacaccctgcgcgggctgattatcctcttctccgatactaactttacccgcccgacttacaacggcgagcccgtacatttaggtgcaaaagacatactcggccatgtttacgaatacttcctcggtcgctttgcccaagccgaaggcaaacgcggcgggcaatatttcacgccgaaatccatcgtttccctgattgtcgaaatgctcgagccatactccggccgcgtgtatgacccagctatgggcagtggcggctttttcgtgcaaaccgaacgctttattaccgcccatcaaggcaacatcaacaacgtgtccatctacgggcaagaattcaaccccaccacatggaagctcgccgccatgaatatggcgattcgcggcattgattacgacttcggcaaacacaacgccgacagtttcacccagccgcaacacatcgacaaaaagatggatttcattatggcaaacccgccattcaatatcagcgattggtggagcgaatcccttgccgatgatccacgttgggcatacggcacaccacccaaaggcaacgccaacttcgcttggctgcaacacatgatttaccacctctcacccaacggcaaaatggcattattgcttgccaacggctccatgagcagccaaaccaacaacgaaggcgaaatccgcaaagccatcatcaatgccgacttggtcgaatgtatggttgccctgcccggtcagctcttcaccaacacccaaatccctgcctgtatttggtttttaaaccgcaacaaaaaacgcaaaggcgaagtgttgtttatcgatgcccgccaaatcggctatatgaaagaccgcgtattgcgtgatttcaccgctgacgacatcgccaaaattgccgacaccctccacacttggcaaaaatcagacggctatgaagaccaagccgctttctgtaaatccgctacgttagaagagattaaagacaacgacttcgtcctcacaccagggcgctatgtcggcaccgcagaacaagaagatgacggcgtgccatttgcagaaaaaatgcaaaatctgaccgctcttttgaaggagcaatttgcgaaaagtgcggaattggaagcagaaattaagaagaatttagggggattggggtatgagtaaaattccattaaatgaatttataactttacagcgtggatttgatttaccaagtaacaaaagaatttcaggaagtgttcccgttgttgcttcaacagggattgctggttatcacaatgaaattaaagttaaagcacctggagttgtaattggaagaagcggaagtattggtggtggacaatatattgaaaaagattttttccctttaaatacaacattatatgtaaaagatttcaaaggacattatcccagatttatttattacttattaaaaagtattgatttcacaagttttaatgtaggaacaggtgttcctacattaaatcgaaaccatttatcaagcattttaatttcagatttgggaattgagaaagaaaaagaaattgccaacatcttaggaagtcttgaccaaaaaatccaactcaacacccaaatcaaccaaaccttggaacaaatcgcccaagccctgtttaaaagctggtttgtcgatttcgacccagtgcgtgccaaagttcaagccctttcagacggcctgagccttgaacaagcagaacttgccgccatccaggcaatcagcggaaaaacacccgaagaactgaccgcactttcacaaacacagcctgaacgctacgccgaactagccgaaaccgccaaagcgtttccgtgtgagatggtggaggttgatggggttgaagtgccgaaggggtgggaggttaaagccttagatgaaattgcaaattatcagaatggtttagcattgcaaaaattccgccctgaagatgacgaaccatttttacctgttgtaaaaattgcccaattgagacaaggttatgcagatggcgatgaaaaagcaaaagcaaatattaagcctgaatgcattattgataatggtgatgtcattttttcttggtctggtagtttattagtagatatttggtgtggaggtaaagctgctttaaaccaacatttattcaaagtctcatccaaagaatatcctaaatggttctattatttttataccaaacatcatttaaccgaatttcagcgtattgcttatgacaaagcagtgacaatggggcatattaaacgtgagcatttatctgctgcaaaatgcatagtgccaaatgacgaattattagcaaataaaacattagaaaatattttagaaaaaattatttttaacaggctggaaaatttcaatcttcaaaacacaagagatttattattacctagattgttaaatggtgaactcaatggatagaactaccgattatttagaacgacttttcattgaggaactaaactctgaaggcgaaattattatcagcggaaacagttttttccgacatgaaattttatatactcttgatcctgaagcatataaagacgtttttgaattttggaaaacagaaagaaaacaaagaaacttaaatgaagccaatagaatattggatattacttcagataatcgaaatcgatttattcgattaaaagaactcttcaaagagaaaaagattatcccctttattggagctgggatgtccatgtctacaggtttaccttcttggagcgaatttcttcgtagtgttcaacaagaaactagaactgatcgtttctattttgaagatctcttatcgcaaggtgaatttgaagaagctgctcagtatctagatgactgtagtccttcacacttacaagagcagttagataatatatttggtagaaaatatctatttaatgaaataaatggtgtaatttgccttttaccaaaattttttaataatactcctattattacaacaaattatgacaatatacttagtactgtttatcaaaaatgcgattacccattttctgatgaactaaatggattatacctagaagacctttataataaacttcttgataaacaaaatttcttattaaagatacatggtacttttgataaaccacaaaatcgaatactaacaaaaaatgactacgataaacactacaatgaccaaactagtaaattgaaaaattgtgtagaaagcttattttcaagttctctattatttatcggttgtagtttaactattgatcgcttaattaaggcgctagccgagattgttcaagaaaaaggcagtgaaaatctacctagacattatgcttttttattttcagatcctaaaaaggacgtgaacagaattaacaaaaaagaagaattagcaaaatccaatatttttccaatttggtatgatggcgatcatgatgaaagcattgaagccttgctggaattattaaatgatggagaacaataaaatgctcaacgaaaacgacatcgaacaactcacccttcaacgcctgcaatccctcggttgggaatatcgctatggtaaagatttgcctgttcatgagggcgaattttcccgtggcaatttgagcggtgtagtttttattgagcaactgcgtgaggcggtgcgtaaacttaatccgcagctgcctgaaagtgcggttgattctgtggtgaaatccgcgacaaaaagcgatattggcgacttggttgtgcgtaatcagacgttttataaattgttgcgtgatggtgtacgggtagaatatcaagatgatggtgagcagaaaatcgagatggcgcgtttggtggattttgagcatggggaaaacaaccgctttgtcgccgtcaatcagctggaaatccgcagccgtaaaggaggtaaacggattcccgatattatcggctttgtaaatgggctgcctttggtggtatttgagctcaaaaatccgctgcgtgaatcggcggatttattgcaggcgtttaatcagtttgaaacctataaagatgaaattgccgagctgtttgtttacaaccaagccctgattatttcagacggcattgccgcccgtttgggttcgctttcggcagattttcaacgctttacgccgtggaaagtggtcgatgaaaaaaataaaagcgtgcggttatattttgacgatgagttgcaaagcctgctcaatggcttaatgcagcctgaggatttattggactatatccgctatttcgtcttgtttgaacgggattccgttggcaaaaccattaaaaaaatcgcggcataccatcaatattacggcgtaaatgaagcagtagaatccacgatttttgccacaagcgagcaaggcgataaacgcatcggtgtgatgtggcacacgcagggttcgggtaagtcgatttcgatgctgttttatgcaggcaaactgcttgcacagcctgaattgaaaaatcctaccattgtagtggttaccgaccgcaacgatttagatggtcagcttttccaaactttttcttcaggcaaagatttaatcaaacaaacaccgcagcaagtagaagaccgtgatcaactgcgccaactgctcgcacaaaatgaagtcggcggcgtgttttttactacgattcagaaattcgccctaaatgaggaagaaagccgcttccctattttaaatgagcgcaacaatattattgtgatcagcgatgaggctcaccgcagccaatatggctttacgcaaaagctgcataacggcaagtttcagacaggttatgctcgccatttgcgtgatgctttacctaatgcctcgtttattggttttacaggtacgccaattagccttgaagataaggacacgcaagatgtgttcggtcgttatgtgtccatttatgacttgcaagatgcggtggaagatggcgcaaccgtgccgattgtgtatgaagcacgccaaatcaagctagcggagaatgctaatcacgatgaattatttgcagaaattgatgaactgctggaaggcgaagaaaacccgaaattacgcttgcgagaaaaattgctcggctcagaagctcgattgcatgatttagcgatcgattttgtgcaacattttgcaaaacgcaatgaagtggtggacagcaaagcgatgatggtggtttccagccgtcagatttgcgtggatttgtataatcagatcatcgctctgcaccctgaatggcattcggacaatattaacgaaggggcgattaaaattgtgatgacaggttctgcttccgatgcgtctgaaatgcagaaacacgtttacagtaaacaggaaaagcaaacgttagaacgtcgttttaaagacccgaacgatccgctgaaagtggtgattgtgcgtgatatgtggctgacaggctttgatgcaccgtgctgtaacactatgtatcttgataagccaatgaaagggcataacctaatgcaagccatcgcacgagtaaaccgtgtattccgcaataaaagccgagaaaatggcggcttgattgtggattatgtaggcattgctgacgagctcgaaaaagccactcggcaatatacaaactcacaaggcaagggcaaactggctgatagcgtgattgatgtattctttaaaatgaaagagcatttagaagttatccgcagcctgtttgcaacgccagttgaggggaaaacctttgatgttcaggctgccttagaaaaagataatccgaatgatcttttgatggcgattcgttttgccgccaaccatattttaagccttgatcaattatcgtttgatggcaaagcgcacgagcagcattggtttaataaaaaagaaaccgagccacgcaaaaaagcctttttgaaaacggcaggcttggtaaaaaaaggctatatgctgtgcggcacattggctgaagttgagccgtataaccaagaaatcgccttttatgatgccgtacgggcaattttaactaaacgtgaacaaaaaggcacaggcacaaatgaaagacagattttattgaaaaaattggtcaatcaaactgtgtattctgaaggcgtgattgatttattcgatctgctagaaaaaccacaaccacaaatcagtttgctttccgaggaatttttacaaactgtaaaaaatagcccaactaaaaatttatgggttagcgcgatggagcgttatttggcaagtgaaattaaagttaaatcaggcacaaacttaaccttgcaaaaagattttgaacggcgtttgaaggaagcattgaatcaataccacaatcacaatttgactgtggtagagattttggacgaactctttaaaatgagccaagatttccaagaacgtttagcattagggaaaaaactaggattaaccaaggaagaactagccttctatgaagctctatctcaaaatcaaagtgcaaaagatttgatgggtgatgaagtgctttctaaactggcgaaagaaatcacggaaacacttagaaaatcggtcacaatcgactggcagtacaaagaagcggtgcgggcaagaattagattactcgttcgacgtgccttacaaaaatataaatacccgcctgataaacaggaagaagcggtaacttatgtgattaaacaagctgaagaaattgctgaggatttaactggtttataattttgatgcggtttatttaataacaaaagggcgattaaaaacactatgatttttaaccgccctttattttgttaaaggttagattgaacgcttaacctcaaccacttcaaacacctcgatttggtcgccaacttttacatcgttgtagtttttcacgccgataccacattccataccgttacgaacttcagatacatcatctttgaaacggcgaagagattctaattccccttcaaagataacgacgttgtcacgtaatacacggattgggttgttacgtttcactacaccctcagttaccatacagcctgcgattgcaccaaatttcggatgacggaatacatcacgaacttcagctaaaccaataatttcttgtttaaattcaggctctaacataccgctcattgctgctttaatttcattcaacaattcatagatgattgagtagtaacgtaaatcaatgttttcagcttcaatgacacgacgagctgttgcatccgctcgaacattaaagccaacaatgatggcattagatgcggtagctaaagttgcatcagtttcagtaataccacctacacctgaaccaacaactttaacttttacttcattggtagaaagttcatttaacgcttgaacaatcgcctctacagagccttgtacatccgctttcacaataacgttcaattcagccacatcgccttcagacatattgctaaacatattttcaagtttagctttttgctgacgagctaatttcacttcacggaatttaccttgacgatataatgccacttcacgtgcttttttctcatcacgtacaacggttgcttcatcacccgctgcaggcacacctgaaagacctaataattcaactggaattgaaggacctgcttcatccacttctttcccgttttcatcacgcattgcgcgcgcacggccatattcaaaaccacaaagtacgatgtcacctttacgtagtgtacctgattgaaccaagatagttgccacagggccacgacctttatccaagtaagattcaatgactacaccacttgccatgccgtcttttacagcagtcaattcaagcacttcagattgaagtaagattgcatctaataaatcatcaaccccagtacctttcttcgccgatactggaacgaattgcacatcaccaccgaatttctcagaaatgacatcatgttgtaataattcttgctcaacacgatctggatttgcttctggtttatcaattttatttactgcaaccactaaaggtgcacccgctgcttttgcgtgttgaatcgcttcgatagtttgaggcatcacaccatcatcggccgcaacaacaagaacaacgatatctgttgcttttgcgccacgtgcacgcatagaagtaaacgctgcgtgtcctggagtatccaagaaggtgatcattttgccatcatccatttctacgtgatacgcaccgatatgttgagtaataccacccgcttcgcctgcagcaactttcgctttacgaatatagtcaagtaaagaagttttaccgtgatcaacgtgtcccataatagttacaactggcgcacgcgttactttttccgcgtttacatcgcgatcacctaataccgcttcttcaagctcattttcattgcgaagaattactttatgaccaagttcttccgctactaattgagcggtttcttgatcgataacttggttgatggtgaccatttcacccattttcatcatcactttaatgatttctgtcgctttcaccgacattttgttcgcaagttctgcaacggtaatggtttcgccaatcacaacatctgcttttactacttgaactggtttagtaaaggcttgttgaagtgcggtgcctttttttccatttttacctttaccaaacttagcatctttttgatttttacgattagattcgcgctcgtttttcgagtttttgctattttcatcgtcacgaccgcctttttttgcttttgctactttatttttacctcgaccacgattttcattacgacgatcttcttcatcttctgcttcaagtgcatatcttgaacttaaattgtaatcagaatagtcttctgaagaagattcattgtctgaatcatctgcttcagcataacgtttagcttcttctgctgcacgacgagcttgttcttctgctttttgacgagccacttcttcagctttacgacgaagttcagcttcttctgctttacgtttctctttttcaggatcaacaaatttagctttagaatctaccgcactttttgctggcttagcggtttctgctttcgctttttcagcttttgatttttcatcagcttctttcttagttgccgctttttcagcttctaaacgagctttttcttctgctgctttttgttcagcaatttttttcgcttccgcttcttgctgtgcttttaattttgcttcttcttgttgagcaatatcagtttttactgtgcgttttttacgtacttctacttgtacttctttgcttttaccgccagttgtggtgctgctcactgttgtttttgttctgcgttgaatgcttaatttttttggcgcatcagccttaacatcttcagtcattactgctctccttattcttcgccaaaccaacaaatattacgtgcagccataattaaatctgcggcctgttctgcggttaattcttcaatatcagttaaatcatcaacgccttgttctgcgagttcttcaagggtggtaatttgtttttctgctagtttgattgcaacgtgacgattcattccctctaaattcaataaacgatcttcaacattcgcttttttcagtgcttcttcttcagctactgctgcggctgtaatcgcatttttagcacgagtttgaagctcttcaacaagatcttcatcttccaaaccatcaattgctgtcaattcattcattggcacataagcaatttcttctaaacttgtgaatccttcttctacaaggatttgtgcaaattcttcatcaagttctaatgcgttaataaataaatttaacactttattatcttctgcttgatgcttagcatttaactcatcagtcgtcattacgtttagtgtccaacccgttaattgtgttgctaaacgcacgttttgaccattacgaccaatggcttgagcaagattatcagcttcaacagcaatatccatagaatgattatcttcatcaacgataatagaagaaacatccgcaggtgccatcgcattaatcacaaattgtgctggattatcatcccaaagcacgatatctacacgctcaccaccaagttcattcgtaattgcctgaacacgcgcaccacgcattcctacgcaagcaccaactggatcaattcgcttatcatttgatttcactgcaattttagcgcgagagccagcatcacgagctgcaccacgaatttcaatcatttcttcgccaatttcaggcacttcaatacggaataattcgatcaacatttctggtttagaacgtgtcacaaataattgtgcagttttgccttcaggatttactttataaagcaccccacgaacacgatctcccggacggaagttttcacgtggtaacatatcttcacgtgcaatcatcgcttccgctttattgccaagatctaaaataatactgtctcgacttactttttttacagtgcctgttacaatttttccttcttcttcacgaaattgttcaaccacttttgcacgttcggcttcacgaattttagtgctaataacttgacgtgccgtttgcattgcaatacggtcaaatgcaatagattcaatttgatcttctacatactctccaagttgcaaatttggatcatcaaattgcgccgcttccaaagtaatttccttcgttggtacttttacttcatctacgactaaccaacggcgaaaagtatcaaattctcctgttttgggattaattgaaacgcgaatatccgtttcatattcaaacttcttcttagtagaaatcgcaatcgcactctctaatgcttcaaaaattttctcacgtggtaataatttttcattggatacagcttccgccgccagtaaaatttctttactcatttctctttttctccttttaaaattttgcaacaacattcgctttttgaatgtttccgaagactaaaatttgttcttgatcatcaacgattaaagtaatcatatccttttcaatacgctctaacttaccttgccatttacggcgttccatcactggaattcgcaaatgcacagcgatatcttgcccaatatagcgttcaaattgcggcaaggtaaatagcggacgatctaaaccgggtgacgacacttctagattatatttatccgcaattggatcttccacgtctaaaattgcgctcacttgacgacttacatcagcacaatcatcaactgtcacaccaccttctttatctataaataaacgaactgtcataaaacgacccacgcgctgacactcaattccccacaattcacagcctaaatcctttaccgcatcttgtagcatttcttgtaaattttgttctaatgtagccaatttctactcctatatagggtgtaattcaccgcactatatcataaccttatgaaaccttatcctaaacaatacttatccctctattttagtaatagtaagaagatagtttattaaatctcaggcataaaaaaagggttaggttcataagaacctaagcccagttactaaatttcttatagaaaaaaaccccaaaactggggttcttttactgaacttattattggttgcgggggctggatttgaaccaacgaccttcgggttatgagcccgacgagctaccaagctgctccaccccgcgtccgaaatatgtgctacattatagtgataaaaatttaatatgcaagaaattttataaaatcattgatgataaatactagaataagataacattttccaaaaagtttaggagctaattatagcatatatgctgtgttatatttttaggaattcgtaaatatctttaattttgccataatttacaaatctatagctcctatcatcaaaaataaagcgtgaaataatgccaattaattaacgccattatcaagcctcccgtccataaaaaatcaatgatcgtctccaatcaatttagagatgaattgttaataaggtaataagccaataataaatagacaatatttaaggttattctagctttcatacaaaaattcaatcaatctcgactttccctagctttctttttttgctagactaacacgcaattttggggctgattctggattcgacgggattagcgaagcccaaggtgcacgtcgaggtgcggtaggcctcgtaaataaaccgcaaaaaaatagtcgcaaacgacgaacaatacgctttagcagcttaataacctgcatttagccttcgcgctccagcttccgctcgtaagacggggataacgcggagtcaaaccaaaacgagatcgtgtggaagccaccgtttgaggatcgaagcactaaattgaatcaaactagcttaagtttagcgtgtctgtccgcatgcttaagtgaaattaaagacgagactaaacgtgtagtgctgaaggtagagtaatttcggacgggggttcaactccccccagctccaccaaattttaaataacatcgccataacaacaccaataaaaacaataccttagaggaaattcactaacggcgatataactaaataataacttaaaatgatccgtgaatgagccgcgggctgttctattccctaagtattaaatttcttggtaagaataatgcgtgaggcaaaatcataggagaatctatgaaaaccctatatttttgttcccttgatgggaatccaagaaaagtatttcaatcagaagaattagctaaacaatggaaagaacaggggtaactttatttttcaagcgaagttgtatatgacgaatcaaacaacattgtgaaaattgataatcaggattttatagactttgttgaaaattgttctgatgaacagggaatagaagagtttgagcaagcaaaagcaattgtggaaaaagacttcgcttttgtaactgtaacggacgattagatgcgttagaattaattcaagtaaacattaactttactgttaaacaagcaaaagaaggcggggctaaaacctcgccttttgcttttattgaaatgcgaaaatctgaccgcactttttagaatgttcgcggaatgaaagttgatgattgatactgtgtacgtttttgcgcccagtctttagcatccgctgacgctttggaaaactgcaaacgagcggcatcttcacttttctgtcttgcaatatctgccgcctgttgtggagtgagattatttacatcaatcatattgcgcacaggaggagcgacagaagatttaacatcctcagctaccgtttcgcgctccactggtttcggattgtacaaatccatattaccaccaccagtcatataaagcgcttgtcccatctggccagcccccttaaatgcagcgattgtatcagggcgtttaagataattctcgcgttcagcagaaacagcattgattcttgctgcaatcgcattttgttgctctttatcttctgttgcggacaatttttcttgcaaggaatgtaattggctatcataaataccaagcgtttgagttgcgccaagaagatttttttgcgcttctgattcaccaccatgagaataacgtgctgaaattcgagcttttgcagccgccgctgaaatttcattacgggttctatgatcttcaagctcaaactcgtgcttgtattttttatcaagcaattcactatcaaaagcacgttgtttgtcggcttctgccgttttccaatctaacaacttttgagtttcttcatctttccacccttgctcaacatttttgacaataccagttcccaatccttgtgtcatcgcacctaaaattccaccccatcccataaattatgccccttgttgcattggttttgattgaccgttttgcacttgcgcacgacgttggctttccatttcagatactttgttgatcatatcaacgtattgctgttcttcttcctgaggtaacgcaccgtgcgttgcttcgccaaattgctcaagcgcattcattaaaatatcaatcaatacatcatcaatttgctcttctggcacaccaacttgctgtaataattgcatagctaaatctttagcgacttgcatcatcacttgcggcggaatagtttttccattttgttgcgcggcctgaagatttgaaatcattgcttttgcgactaaatcggcaataccttcttcgggacctttttcttgaatacgttgttgcgcaacatttgcgatagcattaatggaattttgcatcaacatttgatacatctgcgccatacttccctgttgttgtgaaccctgtggattttcgaccgcactttgttctgttgtctgcggttgtgattgttgtgtcattgaatctaaaatgcccatgaatttctcctatgatacgatgatatttgcccaataatttcttaggttaggaacgtcactcgttttgacctgtttatcaggatctatattttgcatacgattatacatagtgttcagtatgccttttggttgtgtattgtcactgcgtaaatcacgcccagccataaattccttataggcttgacgttctttttcagctaattcattttgttgtgcgatgtggttatttaatgcgttagagttaagcgtctctgttaaatcacgtaatgattttgtcatcgtgtcttttttgttgatcgctttacctaataaaccaatcccagaccctagcattgcaccaggaggccctaaagcagataaaccgacttgtgcagctgtaatacctctatcaatccatttatcgttcgtttcatatttttcccgagcattcttataggacttattgatgaaatctactcttgtatcgtaatacgctttcccctctggagtgaggctatcataatacgcttgctcttggttgcttttgaattgtcgagataaatccccaacgtgggaaagcccaaaatttgccgcactttcagcaattttgccaactggcgttgttgctgccccgcccaccccactaaaaacgcctcctacagcacgaccaattaagttcaattcttcgccccgtttaatacggtcgtaactattgatgtccgcccgttctcgaacggatgaatattggggatcgcttgaccatacatcgccgttatttaatgtcattgaaccacgtatgtttctatcaaatatagaaggagtgcgttcagaataaggcgcattggagtaactttttccaaacaaaccgccagtgagtgttttctgatctttttcaggaacggcggcgctcatttgcccattagaaagtgaatgatatttttcactaattgttcggctaattgcgctatgaccaccgctccaactagagttatttcttcgctcattaaatgcatcagtatagactttgtcttttccgtatctagatttgtggtcattccatctatctgacgtactacgataactatcactactgttatcttctcgccaaccacctccaccggaaaaggatgaatcagaatcactagctcgctcatagccagctttttccattgactcaccaaaactatcatgcaactctgccattgttagcccctttagtttcagaacgtttcttcatttcagtcaaaataccgccatttgccaatccaggagaatcatccactgtcaaacttttatacgaccaatccgcatctggtacggctgaatattttgatttcatctgatcttgcagatttaataactcacgttgctgattgatcaaatctttaccagcttgtttttgcgcaaagtaaccaccagcaccagcaataacattaccgataatattacttgctgctttatggttgtccatccaatccattgcacttccagctgtttcccccagccatttaccagcgccactaattgcatcccatgcaccatcccaaaacgccataacctttctcctcttaactaatttgaattgacggaacacctaagctaggaaatgacgaccagttttgttgcgtggtcggaattccctgcataaacttactcataaattgaatctctgaatctcgacttgcttttagctgctcaatagcctttgttttatcctcagctttcatattcgagttattcaagatcgtggctatttgcgcatcaaagttattggtgatttgcatggtgaaatcaatggatttaccaatagtgttcgccgccacttgtgcatttaagttcttcatctcattttgatgattcaaattcgccatatctttttgttgttgccgttcaagtgcggcttgagacgcagtgaattgattttgtgcctgatttaatcgactttgattgctataagctaaatcagattgtaattgcgccattccacgctgatgaccgcgttctaattctgcctgcgatgcggtgaattgattttgttgctgattgagcttactttggttttggaaatttaaatcagcttgtaagcgagtttgtttttccgcaaacgcattttgcgtatcttggcttgcaattggtattgccgcatcaagcattgcacgttgagcagattccacaccaatggttgaattttgcaagccgcgattagctgccatacgttctcctttagcagccgcgctattcattaaaagtgaattgctatttaataaattagagacattacctgccattgtctgtgatgtatcttttgtcggagattgagtggaaattgttggggcttgcggtgttttagttttattcaccgcatccgtcatagaacctagaattgacatatattctcctaaaaaaaaaagaccgcttatttcgcagcctcttgttgaaaatttatttaattattacttacggtggtaaaagcaacagcaagctgattcggactaaaccgccagccttcattgctatttttaatgcaattaaaacaccattcactgcaaaaatattttgatcgtttttgtttgatgccgagcacaatcccgacagcaccccaccagtcgtatttacagcccaaagtgcggtcaaaataggctttgatttgtgcttcggttacaccgtcgagcggaattaaatcccatttttctctatcataaacatcaatttgcttgcaacgtacgccaccgtctcgaattgaagacgaataacactcgtacatcacttctgtttcatagtgatgcccactgacaaatacttctttcattactgcaatttcacaatgcgaatacacgccttttgtcaatttacgagtgagccagtcactcaaacgtgccaaaagtgcgttcgggtttttacccgtttttttacctttgtataatgcgagatagattttagtgcctatcattgttgtgcctccgctagttgtcgcatttttgaaacaatatcgtcatgaatgtttttcagttcttcatcactcaacgcctcatgctttaactcatacttacgcattctttgcactgctaattgttgttgcaatgcacgtaatctttctgcttgctgaagaatcaaaagtgacgcagactgattatcaagacctgcaaccgttgcaaaactgctgatataaacgcttacttctccagcaaaatttgcttctttaaaggcaatagcggcagcttctcgctccttatactcttcggcaaaccttatccatctagaactgatgttcgccgctgtatcatcaatgctatcaactagatttttaatgagttcacgcttaatttcagttttctttttttcatcgacaatccagctgtttccgttccatttgtgtaattctgttggttgtctatcaactagaatgtattgacttttaaaataaataagttgtttagtctcaagctctgattcgttttctacttccatttccacaaaatcatttaagttttgcggaatagggaaaatttgataactattcaaattttcttttaaaaaatagactttcattaatcactccttcatcgaatatcaatacgttttacaaaacgaccagcaagttcttcaatgtgtattgttgtaccgtttctatcaacagtcacagcgaattcctcgacttctacatgatacacactagttccaccagaactgtgtggaattacttgacgaatactactaaaataaactccaccgccccttttaccttcaatctctgcccctacttcaaaactgacaatttcaatattgttattatcatcaagcctgtggcctgatgatgactgaagatacaaaataagtgttttaccaaaacacttttctgaaatattaatactcccagaacttacattaccttgccacactgtttttaatgtgccaatttgagataaattcttttgtgcctgcaaaaattgctgatttatatcaacttttgcattgtttatttcttgtaaagtagattgtttattttcttttatttcttggtcaaccctcgcagataacgcttgcatattttgcacaagtgtacccgcatctaaaattcctgcgttctcaacaacgccgaatgctttaacccaaaattgcacgtcatcaaatgtgttttttgcttttatacaaagtttgagaataagcgatttagggcgagtttcatctccacctgttgccatcggggtatctaaaagcggatgcataaatccattatcactgagattatcatcggttgtagttgcagtgcataatcgtgaatctataacagttttcgttttgtcataaaaaatactactatcagatgaatcagcccagtgtgttctcactctgtgaacgtgctttttaatctcgtcactttgtgtctgaccgatatttaacccattccctgtatttctaataaatcggtcttccgcaagtggcacatttgaaatagaaccatatttaccgaccaagtgacgatataactcagggtaacgttgctcggtaacttgtgtggcaatctcgtcaaaggcaatccagcctgcagggatattatccacggcaaaataagccgtcatccccacatcgctacgggttaaatcagggagtttgttgctgttgcccaaagtgcggtataaatcgggaaaggtttgttggctgaatgttgaaccatcagcacgtaaaaaaccaacgggattggttaccgcacgagggaatgatacaactgcaccaataggcacgccgtcgccgcctgcatctttccattctgaccaacttgaaccattaaaaaagcgtgttttgattttgttatcattcgctttacgtgcaatttgacgcaccgcatttgttgccccaccgctaactacttcaatatgccattccccattttcgggtagattttgaccgcttgctaagtaataattgccatcggttttatagccattggcatcgccctgcccttgttctactttaaaattcccaataccatagcctgcaagtgtattaggcttgccttcaatatccgtattaaattggggttttgccccagcgtggtagattttttggcgtttgtaggttaaatcgccgttagcgtgcatacgaagcgtgccaatctctcggttgcttgatttatattcgaaccagcaatcgccattgtttgccccgatatttaaatagtctccgcgtgaagcataatgctggctgtctgaaatacggatatttctttttgccacaatacgattttcaaaggatttctcgccattaatgctttcgttaccatttaaaccaacctttccatctgcggtagttttggcttctactgctttgtcataggcggttttggctgctttacttgtcgctacgttatcttcgctttcgctatttactgcagaggattttttgctgttttggatgtaattttgcgagacatttaactgtaattgtgttgtttgttgagcgagttttttccctgcttttgcggtgagtgcaagagattcactttcaagccctgtgtcgttggtgagttggactataccttgttgtgtggtgcttgccttggctatttggtggctgtgtccgctttcattaaatccattttgcgttgtggcagtaatggtttttggtgtcatttgttgtcgggtgacaaaaatcacactgttatcaatagataatgtcaccgcactagaagattctacttttaagatcatccgcaatacttggactttaccacttccgctactttctgtcggtttaaaactttcaggacagtttgcgtaggcaatgagtttgttttgtgcgtcaaatacgcccatttctcttatgtaaaaaccgccgatattttcagggatggttaattcaacgatgacttgtttattattgcgagggtcgagagagacggcactgacaggtgcaatgtgcgtttgatgtacgagagctgttgcgttcgccgttggtgtgaccgctttcccattgccatcacccactgcaaattgggtgagctgtaacggttgcccttggcttaatgcgtgagcgatagcacgtgttccgtagtcggttaagattgcaaaatattgtgatgccataaatattcctattgtggatataccgtgatgatttcgccccattgctgaccaacaaaggcacaaagtgaccctgttggggagagggcgatagcgagctgattgagatgtcttgagacgggtttaacatcattaatcagtcgcactagttcgttataggtttgttcattcaagccactttcagacacttctacggttaggctaaatgttcctggtgtgccttgcggatttgtttgaaaccattctttcagttcaataagatagcctattggctcaaccacacgctttactgcgccaatcgtgcctttgtgtttgtgtacaaaataagactgtttaatcgcaatgcgtttaacttcttctgtccagttttcatcccatttatccactgaaaacgcccaagctaaataaggcagtaattcggtgggacaacgttcagggttgattaaatctgcaataacaatgggattttctaccgcactttttagaatttctgccgcacgtttttctaatggagttgcgcctatcggcagtaaatgattagtaatcatcacttgtcactatctccaaattaattgccgtgcagtaggctgattttgagcttggtagcacaaggtcggcggtaggtgagataagctctactcgttgtacaccttccaagtgtaatgcggcataaatacccgataggctaatatctcgccctaaacggtgtttttcttcggtgtaagtggtcaatttttttagagctgcagctttgattggctcgtattcagggccacgataaagatgtaatttggcgcggatttcgtaggattggatcaccgcactttggacaataacgcggtcgccaatagggcgaatgtcatcatcattaagtttggctctaactacatttaaaaggttttcgtttgtttcaccttgtccattacggcttaaaatcgtgacggtgacattggctggctgtggtgataccacagacacatctgcaacatcagggtgtgcagagagtgcgtggaagatataagcagagcgaggacccgccacagaaagcccctcaaaggctaattgcgtgcgcaatcttaatgaggtgtcatcttctaaaatttcggggattttaggcgtaacattattattcgcctcttgaatgacttgtcttttcacattgtaattggcggcaatcacatctaaatctgaaccgctggcataggctaacattgtggcttttgccgcattgttgatgcggtttctttccatcaactgtaagtaaaccacttcttgtaataatttcgtgatgggctcactttctaaacttaatcgtgcttgccaaaatgccctttcatcttgtgggaaaagtgcgataaattccgcttttctgtctgcgagcaaactttcaaaatctaaatcttctagcacttttggtgcatctagttttgataaatcgactaattcgctcattgtttatgtcctaaaaatagtttttcgttgtgcatttcttggttatctttacgactgcgtgcgacataacttgccacaatgccaccttcaaccaattcaggtttaaattgtgtgatctgtactcgaggttcccaacgattaatcgcagtgacggcacaagccgccagttgtaataacaatgtgtggctaattgggcggtctattagcattgggattaaactgccatattcacgccgctgaattcgtgaaccaactggcgttagcaaaatatcggcgatggattgtttaatgtggtcgctttcgttttttaatgtttcgccagtgtatcgattcatactatgcctttgcgttagaggttcgttggccatcgccttgttcaaggtggacgtggttttgtaaactaattgagccacctttaatatcaccgcttgcggtcacgctgccttgcgtgctgatattgccttttgtggtgcttgtgcctgtggttgataaagagccgtcaatattcacattacctttgatattgatagcggggcagtcaatatcaatttgattagcggcagtaatactggcggttttgatacctgtcacaaccaatgcaccacttgattggttgtaagtgattttggcaccgtcagcaaattcaatgacgtgttcgtcgggcgattggcttgggctattttgtgtgtaaagcccaactaatatgcaggcagtagtaaattcaccgctaacggataacatcacacattgttcgcccaccgtcggcggcgaccaagttttggttgtacccgctcgaaatgtaacgaagggtaaaaaatccgtcagaatgtcaccgctctttacgcgagctcgtgcagtggcgtgattcacttcagcgattaccccaaagcggataatgttgtctagttttcgttgtaattcagcagacataggcattcacagttaaagaaaatgccttattgttggcaatattgtgcggtgtggcgagtgtgggagtgtgtggaatagtaggtaacaaaaaagggctttcgccctttgattatgctctgtcaatgattgggtttggagtgtcccattcgcgtgggaacggttcgtgttgtggagaaaaagcgataatcacgatatgttcatctgatattttttgataatgaattacaggtcctgatgtttctccattcaaatttatttttagcccactcataggacaatatctagatcctttattgtaagggccgcagtgataatgccatatttcgttttgttgataaacctctgtatttggaatgtcattgagattatcatcaagccaagatggtttatttttacctcttaatagtttcccttgtttaatggattgcataaaatcaaagatgagctgcaattcttcatctgacatggcttgaatgtctttaaaaaagggcgtgtttaaacgcccttcttgaaattgtttcgataactcaatcttcatttgttatcctacatcatcactgcttttttaaaatcatcaaaagaatgtgatgatttgtaggtgtaccctgcatcttcagatttgcgataaaggcgtgataacactacttcatctgattgttgcttgtatttttctgatttcatcatattgcaaagcgtgtgcattttattgctgaatgattgtagcgttgttgataattctggagttttattattgaccataatattgttagctagatcatcatatttattaattttgctttctagtctcagaacgtcacttaaatcaatatagcttaatgattctgccgtaattgacgcaataacaaaatcagtgatagcagaaacagctttcaccatatcaataatcttttctatgtcttgttgattgatcgatttattttcatctgtttgaacactgaaaatattgactgtgtgtgtagtgtgacgaacaggatgatttatcgccaatggcgcaataaataacgcagacattgccacggtttttaattgcttaaaaattggcgcaaaactttcaaaaataggatttaatgatagatttgtcataagtcaccaaagaataaaagtttgcgaagtttacaactttttgaagaaatataaaactattttctacaatgtgcaacaaaaaagggctttcgcccttttattttttattacctaattgaataaaatcatcaatacgtttacgaatatctttcattcgttgttgaatgaatttttcttcttttgtcccgaataaggtatcatgatcaaccataaaacgaaccgacactgtggtttgttctgggttatcttcataattaaatgttagcaccacaagaggatcattttcttcataacttaatctagcgtgatataaaccaatataataaggcgatgcaccataggctaaactgctgtcttttgcacgtccgaatagacggtctttattttcaacataaacttcaacaaattcttgttgctgccataatgcgattaattcagcgagattagtcgaatgtttatcaatatcttgttctgtaaatcccaatgcaagactgatttgcgtaaaaagatgatggatttcgacaaatttaatatgtttgcgttctagcatttaattgtgtggctctaagttgtgcttttaaaatggtttgaacatttgccttgatttctttggcattgtcacccttcacacgttcgccttttatttgcgatgtgcggtcaataatttcacgaataaaaggtgcattttcgttcattgataccctcctatttttcgccgatcctagcacttctgtttacaataaacaacaaaaaagggctttcgcccttttattatgctctgtcccacattgaacttcttgctctggcttggcgttggttttcaatgcgttgtatttgttttgccacttgttgtgcaatggctcgttcgtccatgccttgtgcggcattgatggtgatatttacgctcattggttggctggtttgcgtcatcattggacgagcaaaaattggtgcacgagtatcaacttgcacaggggcggcagttgcaacgctgatccccaatccgcccgcaataagtgctcgtttgccgtaattaagggcgttgagcgtatttacaccaaggcgtgatgtggcttctttggtcatcacgtattcgccaccgtggacaatgcccatgggttcatatttgccaccgtttccagtgtagccgcctgaccaattttgactcggtaattttttgccatttgaaccaaagccagtgaaatccttaaatgattcccaagcacttcctgccgtttcttttgttgattgccaagcgttgctcgaagtgttttttgttctttcccatgcactagatacactatttttaattccctcccaacttggcatattttcagaaatccacttgataccatccattaatcttgttaatggggtcagaataaactcaatcgctttcgccattccatttccgaatctttcccctgcactgactgcagcatctaaatcttctttggtactttgtactggagacaataaatcagtaaaccatttcaccgctttttcaatccaaccgacgacaacaccaaatgcggtgcctagcggttggaatttttcaaggacgggggcgagacctgattttaaaccctcccaaaaaccgccaaaaaaggctttaataggttgccagaatttataaattaatgcagcaacggacaataaagctatccctagtggactgatagccagtgcaattaattttagcggagaaagtaatcctcttaatattagccgccctgcagatgataaatgtcctgaaaatttaggaataattacgtttaatttggataagcctaaaaatagccgtgcggctgggtaaagtataaaacttaaagcaaggcttaatgcacctaatagacttaaacttcccccgattgcaactgctgtttttgctatagtagaggttaatttaggatgttcatcaatccatgtctcgattttatcaagcaaattgccaaccccgtccattaagctagtcatcgaatcttttaaactggctcctacagaactatttacgttgaataaacgatttttaaataattgccattttgctgataaagtagtcattctggtttgaaattccctagccatactatttttagcttcttcgctatttgccagttcaatttgtctgcgccattcttcggtattggcaacaagccctgctaattgggtattataatttccgcctgcaatatcgctaattacgccagcctgtaaatgtttaggcaatttttttattttttcaacaatcatcattaatgtgccttgggcatcttttaccattgctttttgaatcgcttttggatctaaacctaacgcttttagtccgttattaacgggtttcattctagtggctttacttagacggttgaacgtactttcgattgctttggctgatgtactggcttcgtttcctgccgttaataaagttgaaccaagtgcagcaagattcttttcactaattttgactaaattaccaattcctgatgtgttatttaggaaattaataatatctgtcccctttgaaatggcattatcatctaaatagttaatagtatcggctagctctttggcatctttggtggttaatttaaagtttttctgtactttaccaaataactctactaattcatcggggttttctgcatcaaatgctgttgccatttgggtatttaagcgaataaaatcttctaattcattttcctgaatatccattctcgctgcagcagtaaccatgtcaccaatttgatttgtggtaagaggtaattcagttgaaagctatttaatcttgtttttccattcatcgtatttaggggtaaattgcccaaatttgtcttttagccctggaacttggcgagcaacccccgccataacatcttcaaacgacataaaatctcgaatggaattgacaattggtgcagtcattgttgtacctgcagctgttgcctgtgcaccaatgatttgtgctttaccactgatatctttaagtttctcaacttgcccacggtattgattataagcggcttgttttgcgttgagttttttcaatgcggcttcttgatttttaatttgatccgtcgcacttttggtgtttttctgtagttccctttgcttttgcgcgagtttttctgcagaaatgcctgattttgctaattcttggcgtgcttgctgtaatttatttgctgcatcaatttgttcttgcttgagtttttttaccgcactttttgctttctctacttccttttgaaatcctgcagtaggatgttgagcgttcttcatatattgagcataagatgcggctttttgttttgcttgctctaattcttgattcagcgaatctaattttgatttcaatgggttgatagcagaagcatattgtttcattgcagcttgatgctgcttattttgctgatttagttgtcgatgaatcgatttgctttcttttagttttgccgatagctcatgaacgcttttagatgcactgcgaactggagcagatattttatcaatggcatttaataagactgtaagctctaaatttttcatttttacccactttttcttgacattttaggaataaggaacaaataatgaacaaacttaacagggagagaacgatggaaatttttgttttgctcattggtttgccaattattgttggtttacttattgcatttggtactgcagtattagccgcatttagttatatttttgttggcgcattatctttagcgattaatttctggtatatcacgttagcagtaatgcttgttttgcttgcacctcttatttatttaaatagttggttattttggattttggctgcactcgttattttctttactgttgcttggttttttggtggcgataccgaacaaatcaaagcagaaattgaacgtaaacgtattgctaaagagcataaattgtaaattaacccaattaaaattctttacccgctatagctctaagcacaaatctttcaatcatttcaatatcttcttccgcaaagcccagtaattcacgctgggcatattgcactttgaaatctttattgttagatggtcgtgccgttaaaccgtattgatgcactgcgaactggagcagacattttatcaagggcatttaataagacggtaagttgtaaattattcattttttcgccttatttttattgacaaataaacgtatgattgctaataatgaagaaagagaataaggagcggatatgaaaaacaaaagaacatctcgcacgttgatcatgctaaacattgctatgtggagccttgttattatttccacctgtttacattatcaatttaatcctttttcatttatctggtttgatgttatcgcaccagttggtcatttttttgcagtcgttttttctgctttatctagttttactgtttcaatgtatgaactttttaaaccagaaacattttgggggtgggtatggtttgtaatgtttgtcgtgccaatcatttgtttgcctctttatgtggttttattggtattgtttgctggtaaactttcacatcatgatacggtggttccaccttcttatttaaagtaattagcttttgctaatttgttctatcaccaattcattcagcattgataaatcctgttctgaaatgcccaatagttcccgttgggcgtatctcactttaaaatccttttcttttgatggtcgtgccgttaaaccatattgatgcactgcagcaatggcagcacttgagccattaaaccccactgaaacttcgttaccatttgaccgcacttttaaatgacgggcggtgcggagtttggcgaacatggctttgcgtttgattcgccctttctttttgccaaattctttacgtggttttctcggttcaaaggctgaaccatcgggattttgttggcgtgcaattcggttcgattggctttttcgtaaggcttgcccgatttttcgcccaagctgtctgcgagcctgtggagaaagattggcaataagtgcggtcaattttgcctgaacttcttcgactgttgccattagactgtatccccctcaaaaattggcgaatccctgttttccaaatagacttttactcggtttggttcatcccatacgggttcttttgcgtaatggatctgcacgttattcccgtcttttttcgacacgacacgctcagtgagttggatttcaaaactaatatctgcggtgttgttattgttgtaatctatctggaatttaaatgcgttctctcgaatttgtggattttctaatatttcaggttgatttgtgcggaggtaagccatcattggcacaatcaaggtggcaatatcgcctgcataatcagtcactacaacattgagtgtgtaacgatattcaaaactaaatgatgcggctcccgttgcgacgatttgcccaccgtccacataaagttgtagatggtcgggattttttacaaaatcgggatggctttgttcaaggattttgcgcagttggttgggctttttcattttgcgtatctctgcaaattaatggtcggttgtctttatctacggcaacaatcaaatgtccagtgtccgtcatcaaatagcctacttgatgaatgcatacttctgttattcttccgtcaggataatttgaatatttacaaatggaccatctctaaatggcacggtgtaggtatttgctaaacaaggcaatgcggcagcgatagcaaggaaaagtgtggttcttctcattttctgaaattccgttgttgtatttcaaatctttgttggcaagtcacgcaacgtgttacgccttgaatcatttgtctgcgcttttctgggatgggggcatcacaatcttcacaataaaggcgacttactgctttaaaagtgcggtgttttttgagggcgatttcgcgttgcatttcttcaagctgttgtgctcggtcgaattgatctgtcatggctgttcctttttattaaattcatctatgcatttttttaaacttgagttctcgataatgcacaaatcaaggtggtgttgtgtctgtaaataggcttcggctaattcgccattggtgcgaatttgtggcgaatacgcactgcactctgtggtttgtggacaaagaatcggtgatttaatgacttcctgctgagttgagcacgcgtttaacatcatcaggcaaagggcggttagcccaatcttggtttgatttaagtacattttttaaatcctgtgtttgttgattttggtttgctttgaggttgtttacggcttggattagctgtgcttgctgttcggcaaaattttgaacgctatgatttaactcaatgtaagcgttttgccatttcagttttagctgttcttctttgagcatttcttttcgccaataattagccttaaatcccagaaaaacaatgaggagtacaagcagtattggcccgataaggaaaatgcctcgttctttggcggttaagaaattaaacataggtttttctccttttgacggcgttcaattaatccttttagcggttttcctgctgcataaatccaacgttcgaattgaccgcacatggctttgctgtagccttggcgtgccattttaaaaagtgagctattttttaatttgccgcatcctacgttaaaggtgatggagacgagggcatcaaatgcaccttgtggcatggttttcccgttggcatattgattaacgcatttttctgattgtttaatgccttttacgtataattcggcaatttcttgcaaggtgtaaattttattgcggtcaattttttcaacggcatcggttatgcctatgccgactgttaaaacatcggcagggcattgatagggctttttcatacaaccttctgcattgccaatcagtaacaagcctttttcggatgttcgaatttcatttccatgagaggcaatcacaagtccaacaacggcggatatggcgcagatgtatttggcggaacgtttaatcatgatgatggatccgttgtttgagttctttttcttttaattcaaaatcttttttcttgtaataccaatttacaagaaaggtggcgacaccaatcacaatacctgtaatcgatgcgacatcagcccaatttacatttgagaacatatcggcaatgcgtccaattaagaaggcgaatattcctgatgtgtaagatgcttttgatggtgcgtcgtgcatatcagctccaaagttgaattgtgtcatttgctacactgattttttctgtatcggcatctggcaatatgacaggggtaccaatgggaataatgggcttatccattaaatgcggattgagttcgcatgttatttcgagcaagccttcacttcgtccaaaatgtcgataaagaatggcatctaaattgtcattttgttgtgcgtaaacttgcattagattaactccgcatcgacgcgttttctgcccaatatgtcgctaatcgcaaagcgagcatcacgacgtaattcatcaatgctgtctttgagttgcgccattttcttttcgccatcgttagtgctgtcatagcttgcatagcgttcataaaggtttgccagtgccaagcaacttaccgcacgtttatagcgataaatcagtacgctttcgccattgattgatggggcgatgatttgttctaaactgtcacgtttgctttgcgttttaaacgtggagagttcggcattgacacttgccatgccctcaattaaggcatcttgtaaacgttgtgtagtaatggtgccgtctgcacggtattgattacgaaattgggaaagtgacatatcggggaagaaaccatcattactgataatgtcatctgacgtatcgtaatcatttaactgttgctgcacttcgcccatttcataatcaggggccagtttgactgatattgcgccgtcgctcattgatttacccttataaaaaaagtcgggtgaggattaaattaagcacggccaataaatccgtcagaatttgaccgcacttttaatccgcccgacggctgcgtggtttgctcggtttatattctttcttgtttgtgcaagaaagaaccaaagaacacaccccgattaaatcgcttttctgccctttgttgtcattttcttaacggaaaatttttaactcgctacgctcaaacaagaaaaattttcctaaaaatgccaagtcggtcaggcgatttagacggggcattaaaacaacatcaacattcagtcgctgataattgtttttttagtttcttgatgtcgcctttcacgccaattttttgatctaaacccaaagcacgttctaaatatgccagtgcttgctcagggtgtttttcaaccaataacaaacccaattcacgcaataatcgcgctcggctttcatctggcatatcgcaatcggcggtgatgcgttggacttgctctaagtaagccacttcgaacggtttattggcagcttgtgcggctttggcttggtcggcaaattcttctgctaacaaggtgccaagtgttcgagtgaatggctcgggcaagcgtaaatcatgaaatacggcataatcggcaatttgtaaggcgagatgatattcgccacagtcaatcgcccacacgcaccatgtcatcaagacattatcttgtttaccacttccgaccgataacgccccttcaatccatggtagatagtcaggcaaaatttgctttttaaatgcgcctttgcgttccgtcgattggatgtttttcaaatcctttcgatggcgagcaagaatacggcacattttttcatattccgtaaagtcgcttagatcttcggtttctgccgcattagcgatagcggcagaaacttccagaaagtggcgtttagttgggcgcataattgattccgttatgcagccactggcgaaataggcgtaggtgcttcaagaatggtgatatttttcgccatggcgactgcctcgtagttttccacaacataggcttcgtttgacgataaataatcttccacacgattgcgttctggtacatcttttaagtgacgacgtactttgccttcctgcacgtagattgacaagttatcaagcgatgtgactaacactgtgcctttcgggaagaatgggacagatacggcttgtaacccacccacacgtttttggctaatgacggtatcgcctgccaaaatttcgcttggtttttcttggttgattaatgggaagtatttatcggctaataagtcgctacccataattgcaaccagttttgtatcgtcacggtattgcgctggaatgaaatcttcttttaatgcaaagacaagggcatcaagatttttataggttttacctgcgccgatttcgattttgccactgctttcttcaatttcttttaacacacgggctttggctttatcttcgatttggactaaccaacccttattcacatcttgcaataatggatttgaggtacggtttgtggttgttgctgcacttgtgccattccaaccgatcatgatacggtctaatgcaatgcgttctgctttgagtttgcccacacgtgcggcaaaatcagggaatttcgcccaactgtctaaggttggataatttaaatgtgtgtcaaagttggtttgttcgcaagaataggtgttttcttgcaagctgtgaatatcagtggtttcacgtgctttggtgttggtgtcggtgcgacttgccactggtgaaagcacacctaaacgcaatgcagaacctttcatttcttgcaccatcactacattgatgcgtttcaagaaatcagaactttcaagcacagcattttctaatttttgttgaatagttggctcaacggtaaactgaccaccatttgcgataaaagcaacatcttcgccgttatcttgtgcaacaccagcaaggtaagtattaaatttttgtttggtaaatttattcattggttttttcctaagataaattaaaagaagcggccgtcagtttcaggttgttcaccgtaaactaaagggcgaggattttcgggttcaacaggcttttggagttctgcgaacgttgcttggatttctgcattacttgctttcatttcttcgatttcggctttttgtttggctaaatcgtcagaaagtgcggttaatttttccaaggtttctttggtttgctcggctaaaagctcaatggcttgtgtttgatcagaaaagcgttcatcgtctgatttttcttttttcgcaaacaagcctttgattttttcaaagatgctttgtgtttcttccacaaattccaattcagtttcaacggctgcagtgaaaatgttatcggctttttctttgcggttgttgagaggatttgcgcttgcaccggcagaaaataccaacatttctgtgccaagacttgcaggattgtccgttacagccaaaccgactaaataggcttcacctgtgtcagcaaaatttggatcgcactcaatagaggtgtagattttctgacggtctttattgagtttgattaaatcgtccgttgggtcgatttgagccagtaattgcaatttaccttcagcattttcttccgtttttaaaccaatcacatcaccatagcattttgagtgcggatcatcgttccacatataacgccatttaatgtgttcaagattaacgcgtgcaccgtattttttcgggtcataatttgccgccatttctgaaatccagttgcgctgaatagtgcgtccgtctgtggttgcgccttctgtcgccacaaccacccatttagatttttttgccattgcttatcctttggttggtttgattcaatgattgtcgctattctgaaaggtttaattttggtggtctatgagttgcttttgttgtatgccgattcacagagcaagcggaaagactaacattcgccccctttctattatgcggttgtaaatagaaaggattaggaatggacgaacaagttattaatcaaccttcccccgaagtgacagtggaaatcaaacgtaaagcacagcagatgtatttcagtggttataaaatcgctgaaatttcacgccagttaaatactcctgcctcaacaattgccagttggaaagacagagaaaaatgggacgatattgcgcctgttggtcgggttgaattggcattagagacaagattgaatttgctgattgcgaaagaagaaaagagcggttcagattacaaagaaattgatttgctcggtcgccaaatggaaagaatggcgagagtgaaaaagtattcttttggtgacggtaatgaagtagatttaaacccgaaactggcgaaccgcaacaagggcgaacggaagaaagccgaacccaatgccattgatcaggaacaagaggaattgctgataaatggctttcttgatgggatgtttaattatcaacgtatttggcacaaggcgaaagaacaccgcatcagaaatattttgaaaagccgacaaatcggggcgacttactattttgcccatgaagcctttattgatgctttgacgacggggcacaatcagattttcttatcagccagtaaaaaacaagccttacagtttcgctcgtacattgtgaattacgccaagcaaacggcagatgtagatttaaaaggcgaaaccatcaaattgccaaatggggcagaattgattttccttggcacgaactccgctacggctcaatcctaccacggcaatttgtatttcgatgaagtgttttgggtgcctaaatttgatgtgatgcgaaaagtggcatcaggtatggcagcacaaaaaatgtatcgccaaacttatttttccacgccgaccacaattgcacaccctgcttatgcgttcttttcaggcaaggcgtttaatcgcaatcgtgcgaaatcagaaaaaatcgaaatcgatatttctcacgaaaacttaaagagcggaaaactttgtgccgaccgtcaatggaagcagattgtgagtatttatgatgcaatggaaagtgggtgcaatctattcaatattgacgacctaatcgcagaaaacagcaaagaagaatttgaacaattgtttttgtgtcaatttgccgatgataacagttctgctttcaagttttcggacttacaactttgccaagtggatagtttggaagaatggcacgattataagccattttatcaacgtccattcggcaatcgtgaagtgtggttaggttatgaccctgcttttactggcgaccgtgcagcattagtgattgttgcaccgccgaaagtagaagggggcgattatcgcgttttacataaacaaacttttcacggtatggattacgaaacacaagcaagccgcattaagcagttttgtgatgattacaatgtgactcgcatcgtgattgataaaacgggtatggggtcgggcgtttatcaggaagtgagaaagttttatccaatggcgcagggcctagagtataacgccgatcttaaaaatgaaatggtgttaaaaacacaaaacttaattcagaaacgtcgccttaaatttgatagtggtgacaatgacatcgtgagtagttttatgaccgtgaaaaaacgcattactggcacagggaaaattacttatgtttcggaccgttcggaagatgcaagccacggcgatttatcatgggcaattatgaactgcattttaaatgtgccttatggtttaggcggcgatgtatcaagcaacaaatcaacaatatttacctttgaataggataacccaatgagcaaaaaaacaaaaaaatccaccgcactttctactggaaatcaagcacaggcgttcagctttggagagcctattccagtgattgaccgtgcagaagtactgaattatttcgaaagcgtggtgatgtatgaaaaatattacaatccgccaattaatttaagttacttggctaaagcgttaaatgcctcagcccatcataacagtgcgattacggtgaagaaaaacattttactttcaacgtgcaaaacaaccgcacttttacctcgaacccaattagaaaaactggtgcaagattacttggtctttggtaatgcttatgttgagaaaactgtaaattcctttggtaaggttgtttcgttaaaatcctctcttgctaaatatatgcgtgtcggtgttgaaacaggtgtgttttatcagattgtgaatggttttgatgaatatgaatttaaaaaaggttctgtctttaacttgattaatcccgatgtgaatcaagagatttatggtgtgccagaatatttggccgcacttcaatctgcttttttaaatgaaagtgccacattgttccgctgtaaatattatctgaatggcgcgcatgcaggttcgattatttacatgactgatccaacacaaaacaaagacgacattgaagcaatcaaaacacaaatccgacaaacaaaaggcactggcaactttaagaatttgtttgtgtatattccaaacggaaagaaagatgggatgcaagttattccattgtctgatgctatcgccaaagatgatttcctaaacattaagaacgcaagccgtgatgatgtgttagctgcgcaccgtgtgccaccgcaactaatgggcattgtgcctaataatacaggcggttttggtgacgttgaaaaggcaacgcgagtgttttttatcaatgagataatcccattgcaagaacgattgaaagaaattaatagttggataggggaagaagtgatcacattctccgattacaaattgctaaattagatccttttcaaaaataaacagcccgcagaaattcgggttttttttgctaaaagagctgtttttgtcctgtatagtattagcactgtcccagtgtattatatcaaatcaatcaatatgacaaatcttaaatccttatttcagctcgatttttcgcccaattgtacgcatgaaaaatcgcagtcaaaccctcgccacgcccgcacactaaagatgtcgatttcaacgcaattttagatccttgccgaagtcttttcagatctaccgacattcagatccttattatcaaattctttaacgcaaaattactcaagtaaatgcaaattttgatgatataatcattgtccctaaaaggcaaaaaatcatctgaattggcgtcttgttttttatggtagtaagcttggtagtaagctatttttaactatttaatatatcttttaaaaacaaagtgatatttatctagatcagctttccccagcaacgctaagccattgattctaatatgatcaaattgattaatccaatgtcacaatgttctgctggcaagttgaaaatgcctgcaggggaatcaacaatttttactattttgaagataaaactcaatgacttgttgcttgaaaaaaaattgtatttggtcataaaaaatctgcaccttagttggttatttaatccaacttttggagtgcagatcaaaagtgcggccaatttttttagaattcttttgaaattaaactttcggctaattgcaaatcaagtgtggagtcaatatcaatggaacgataagttggcattaaataaaaacgcattggcgcaataaaaaagcgtttttcttcaaagagactttcgatgtcattaatataaattgcgccatttgcacgataagatttgggtaatttttgacgaggggcttcaaaatccgttaattcgtgaataggctgaacttcggtaccttctaaagtgaaggatttataaggatgatgctcacattcgcaagcggaaaccactgacttatatttgccgccaaggaaaatttccattgcattacgaatatctaaagcattacgcaatgggctggttggttgcaaaagtgcagcggtgccttgtgaaatattaagtgtttctaagcaatgcaaaattgcatcaatggtgcgtgtatcactttgcgccaaactttcagggcgtgccactggttttgcgccgtattttgtggcttcttttaaaatattttcaccgtctgatgtcaccacaatttgatcaaacatacccgattcttgcgctgccaaaatcgcacgccccaccaaagaaacaccacccacaagctgtaaatttttgtctttaattcctttagaacccgctctcgcaggaataattgcaattcttgtcattattttcactctctgtgataaaagtgctgactattctagaatctttcccttgttttagcaaaaactaatctttaatatggcaccacatttttgtttaacaaagaggaaataaaatgactcaacttactcgtgaacaagttcttgaactcttccatcaacgcagctcaacacgttattacgaccccgcaaaaaaaatcagtgatgaagattttgaatgtattttagagtgcggtcgattatcgccgagttctgtaggctctgagccttggaaatttttagtgattcaaaataaaaccttacgcgaaaaaatgaaaccttttagctggggaatgataaatcagcttgataattgcagtcatcttgtggtaattctcgcgaagaaaaatgcccgttatgatagtccgttttttgtggatgtgatggcacgcaaaggcttgaacgcagagcaacaacaagccgccctcgcaaaatacaaagccctgcaagaagaagatatgaaattactcgaaaacgaccgcactttatttgattggtgcagtaaacaaacttatatcgcccttgcaaatatgcttactggagcctcagcccttggcatcgattcttgcccaattgaaggttttcattacgacaaaatgaatgaatgcctcgccgaagaaggattattcgatcctcaagaatatgcggtttctgtcgccgcaacctttggctaccgctcacgcgatattgcgaaaaaatcccgtaaagggttggatgaagtggtgagatgggtggggtaaaaatcccattaaaaaagggctgcaaatgcagccctatcttttttgattatttcacttctttaaataaaatctcgcttgggattacggaaccttgccagtaaagttctgtagagactttttctgcaagttgtaagaacgcttgtgaaatttcattttcaggcactcgcacaacggtcgggttgcctgcatctaaatcttcacggatacgaatatgcagaggaagttgagctaatactttcacattgtatttttccgccattttctctgcaccgcctgtgccaaaaatcgcttcgtggtgaccgcacttactacaaatatgcatcgacatattttccacaatgcctaacactggtacggatactcgctcaaacattgaaataccttttactgcgtcaagcagagcaatatcttgtggagttgtcacaaccactgcgccagtcacaggaatttgttgtgataaggtaagttgaatatcgccagtgccaggaggcatatcgataacaagataatctaaactatcccatagggtttcatttaataattggcttaatgcactactcgccattgggccgcgccaaattgttgcactatcttcattcattaaaaagccaatggaatttgcagataaaccatgtgctttaattggggtgatgtgttgattatctggcgaagttggacgttgattcgctgcgcctaacatgtgtggaatagaagggccataaatatccgcatctaaaattccaacacgtgcgccttgtgcttgtaatgctaaagctagattaacagaaaccgatgatttccctacgccgcctttaccagaactcacagcaataatatttttcacaccttttactgccggttgattatttgcacgtttaagtgtggcgatttgataagccaccgcccatttaattgatttacaatctgttgctttcaataacgcatctgaaaccgcttgttttaactgttctgcaccagaattccacgcaaaaggcaatttcaattcaatgcgtaacgtatcgccgcccttttccacttttttcaaagtattaagcacaatcagatccttttgcagagttggatgctgaaattgttgaataatctgctgaacttgattttgctggtcggcagtcaaattatcagaaaagtaggttgccataataacttcctgtttagtagagtaaatttgtcggacatatttaatcacggaaagtgcggtatgttaagttaaagtttttcaaactagaaaaaatcccctatttaaagtaagataagcacaatttttgtatgctaaaaaagagaataataaatgacaactcaaccccgtaaaattttagtcacttgcgccttgccttatgccaatggggcaattcatttaggccatatgttagaacatatccaagcggatatttgggtgcgttttcaacgtatgcgtggcaataaaatccattttgtctgtgcggacgatgcgcacggcacgccgattatgttgaatgctgataaacttggcattacacctgaagaattaattgctaaagcaaaagccgatcacattcgtgattttgcaggtttcaatattagttttgataactatcattccactcacagcgaagaaaacaaacagctcactgcagaaatttacaataaactcaaagccaatggctttattaagagtaaagttatttctcagttattcgaccctgaaaaaaatatgttcttgcccgatcgttttgtgaaaggcacttgcccgaaatgtaaagcagaagatcaatatggcgataactgcgaagtttgtgcttctacttacagcccaatggatttaattaatcctcgttcagctgtttctggcacaacacctatcgtaaaagaatctgaacactttttctttgacttgcctgcatttgaagggatgttaaaagaatggactcgttctggctcacttcaatctgaaattgcgaacaaaatgcaagaatggtttgagagcggtttacaacaatgggatatttcacgtgatgcaccttatttcggttttgaaattcccggcgcaaaagataaattcttctatgtttggttagatgcgccaatcggctatatggcttcattcaaaaatctatgtgagcgtgaaggcattgatttcaacgaattttgggctgaaggcagtgatgcggagctttatcatttcatcggtaaagatatcgtttatttccacagtctattctggcctgcaatgcttgaaggcagcggctatcgtaaaccgactaatgtgttcgctcatggctatgtaacggtggatggggcgaagatgtcaaaatctcgcggcacattcattcaagccagcacttatttgaatcatatcgatcctgaatgtttgcgttattactatgcagcaaaattaaatgatcgcattgaagatttagactttaaccttgaagatttcgtacaacgtgtaaatacagatatcgtaaacaaattagtgaatttagcttcacgcaatgcaggttttattgcgaaacgctttgaaggcaaactttcggataaactggaagacgaagcattatttgcagaatttaccgctcaagccgagcaaatcgctgcttattacgaaagccgtgaatacaataaagccattcgtgaaattatggcattaacggataaagccaataaatacattgatgaaaaagccccttgggtgattgcaaaagaagaaggcaaagaggcagaattgcaagccgtatgttcaatgggtattgagcttttccgcgtattgatgtcttacttaaaacctgttcttccaaaactggcagaacgtgcagaagccttcttacaagctgaattacgttgggataatattcatcaaccattacttggtcatacccttgcaccgtttaaagccttattctctcgtttagagaaaaaacaaattgatgccgtagtggaagaaactaaagccttatttgccgcagccaataaagcagcagaaaaaacagaagcaaaaccaaccgcactttctgccgttaaacctattgctgaaaccatcacgattgatgatctcgctaaacttgatatgcgtgtagcaaaagtactgaaatgcgaagcagtgccagaatctaataaacttttacgttttgaattggatcttggcgatcatactcgtcaagtcttctctggcattaaagcggcttacaataaacctgaagaattagaaggtcgttttgtgattatggtggcaaaccttgcaccacgtcaaatgaaattcggcgtgtctgagggaatgattctatccgcaggaacaggcggtagtgatttattcttgttatctgccgataatggtgtcaccgcaggtatgcaagtaaaataatcaattcaattaattagggcaacattacgttgcccttttattttcttgttgaaaatagatgacttataacctaccataacactcaactatttatctgtttggagaatattatgaaaaacgaattaatctgctataaacaaatgccagtgtggacaaaagacaaattgccacaaatgttccaagaaaagcacaacacaaaagtcggcacttggggaaaattaaccgtattaaaaggtaagcttaaattttatgagctaacagaaaatggcgatgttattgccgagcatatttttaccccagaaagccacattccttttgttgaacctcaagcatggcatcgtgttgaagctctttctgatgacctagaatgtaccctaggtttctattgcaaaaaagaagattatttcagtaaaaaatacaacatgactgccattcacggcgatgtggtggatgcagcaaaaattatctcgccttgtaaagtattagatttaggttgcggacaagggcgtaattcactttatttaagtttattaggctatgatgtaacctcttgggatcacaatgaaaacagcattgcctttttaaatgaaaccaaagagaaagaaaaccttaatatttctaccgcactttacgacattaacgccgccaacattcaagaaaactatgattttattgtttcaacggtggtgtttatgttcttaaatcgtgaacgtgtgccgtcaatcatcaaaaatatgcaagaacataccaatgttggcggatataatttaatcgttgccgcaatgtccacagatgatgtgccttgcccacttccattctcattcacttttgctgaaaacgaattgaaagaatattacaaagattgggaattcttagaatataacgaaaatatgggcgaattacacaaaaccgatgaaaacggcaatcgcattaaaatgaaatttgccaccatgttagcgagaaagaaataatctgctaatttaaaaaatcaccgcactttgtcctcacccaatattagaaaatatctttagctttgcgaagtgcggtaaattcttcaagtgtttttgcttgtaaaaacggattaatttctcgctcaagttttaaggttgtcggcaaacttggtttattttcagcccgttgtgtttcaacaaaaatacgttgtttttctaccgcacttttttccaccagcacagtttccgcaaatgctaaattccccaaggtatattcatgagctgggcaaacaatcgtctcgtcaggcaatgtattcaaacgctgcaaaccatcaaacatctgcgcataattgcctgtaaaaacacgtccgcaacctgcagaaaataacgcatcaccgcaaaataaatgattatccactaaaaaactaacgtgctgtttagtgtgtccccccgtcggaatgacatcaatttgataatgtgcggtaaggatcttcccttcgttcacaacttgagtcgcaccttttttctcacattcttgcggcccataaatcggcactgttggataacgttttttaaatgccgacacaccttgtgtatgatcctcatgttcgtgagtaagcaacaccgcttcaatcgttgcgttttgcttatctagccatgcaaacagcttgtccgtttcaggcaaatcgacaataataagcggcagattttctcgttgataaagccaaatgtagttatcattcagcgcaggtaaagcaaataacataatcgtccttttaattagtgatagaaaaataaattgattccacttgaaacattagatgcgatccacattccaccaaatcaacgcccattttttctgtccatgaaaaattagttcgttattggcttgtttacgatcgtaaaaggctttcaaaccttgtttttctttttcggacagttcgcctaaagaaaattccaccgaggctaataaatcctcgtagatttcaccttgaaaacaacccgattccgtttcaataaaattcaaatttgcctgaatgcctttttgatacaaccgattgagtaaataaatataagtggggaaaccaatatcttcacggccaattgcctcaaatacgccctcatctaagaaatggcgttgtgtgacagaagtcaaaaacacacgttttttcgctttggcacagagtttttcgatcatatcgtccaaatcgtccaccaacgttgaatgagatgccaacactacatcagcttgtggcacatcatcccaattatccgtccaagatttatgaaatgttgtgagattatgcaaccccaatttctgtttgaactgcgccaagcaatctaacattccattactataatctaaggcatataccgttgaaccttgttgtgcgagcggtacagcaaaagtaccaggcccacagccaatatccaacactgtttcatcggtttgcacattcattgcttgcaataattgctgattatatgctgaaggcttaccgaccaaattttctgccattttcacggcttttttatcccattttgtcggaggtaagttgtaatgatgacaagcgattaagtgttgttgatacagttcagcaaaattgatgtcgtaaatagtcatagtgatttttcaatgtaattattcaaatgttgatgtaaaagtttggacgaagtgcggttaaaatggtaagcgttttttcattttaacttttttaaaaacgagacattacaacaaattctacagcatcgatatattaattcaaatataacgtagcaaaaacaggcaaaatgtttctataatatttaacgttatatatttccttatacagatttatttcgtagaaaaggataattcaatgaaatttgaagtaatttataaatttttcttagtgtggggactagccttaagtttgcttttcgttgttgcaagtggcatttcaatgtggctaggatttccttttagtcaagccttagacattcatcttttctttgctggatttaccgtatttggtttgttactgcatttttatagccgtaagaagaaatgggtaaaaatcaacactcaatttgccgatctcatcacaaataatcgcatgccttcttactgcaatttagatcgcttgatgatgactttcgaacatttctctattcaacaaatcgccgagcaacttaatctttctctcccgattttattaaatgaattatcgcaagctcaaataaacataactgattcccaccgcactttatgcgaaaactttcctctcaacgatgaaaaaattttcgccgcaattacaattgccttaaaagtgcggttcaatccaactttactttaacgccaatcaaatatacgttaaaagtgcggtagaaaaccccgaagtttttcgggatttatttttgccgaaaaaatcttgccccgctattaaaactcccctattattcaccgcacttttttcttatttaggaacaaaaatgacagaacaaacctttattctcggcaaagatgctgcattagaagatagtattgcaaaatttcagcaaaaattgaccgcacttggttttaatattgaagaggcatcttggttgaatcctgtgccaaatgtgtggtctgtgcatattcgcgataaagactgtccgcagtgtttttctaatggtaaaggggcaagtaaaaaagcggcgttagcctctgcccttggcgaatattttgagcgtctttctactaattatttctttgccgatttctatttaggacaagaaattgcaaacggcgatttcgtacattatcccaatgaaaaatggttcccaattgaagacgatgctttactgcctaatggcattttagatgattatttattggattattttgatcccaatgccgagcttacgcctgaattattaatagatttacagtctggcaattatgatcgtgggatcgtggcgatgccttatgttcgtcaatcggacgaacaaaccgtttacattccacaaagtattattgccaacctttatgtctcaaatggcatgtctgcaggcaatacgaaatttgaagcacgcgtgcaaggcttgtcagaggtatttgagcgttatgtgaaaaacaaaattatcgctgaagcaattagtctgccagaaattccaaaatctgtgatggatcgctatccatctattcaggcttccattgcaaaattagaggaagaaggtttcctaatttatgcatttgatgcttcacttggcggaaaataccctgttatttgcgttgtgctactcaatccgaataacggtacttgctttgcctcttttggtgcgcatccaaatttccaagtggcattagaacgtactgtgacggagcttttacagggtcgtagcttgaaagatttggatgttttctctccgccctctttcaataacgatgatgtggctgaacacgctaatttagaaacccactttattgactcaagcggtttaatttcttgggatttactcaaaaaaacgcctgattatgaatttgctgattgggatttcagtggtaccacgcaagaagaatacaataatttaatggcgattttccgtgccgatgaaaaagaagtttacgtaatggattacaaccatttggatgtctatgcgtgccgtattattgtgccaggtatgtctgatatttatcctgcagacgatttaatttacgccaataacaatatgggaatggattggcgcgaaattttactggatttaccaaactggcatcacgatgcagaaacctatcaagaattattagatgaattagacggacaagatattgacgatgcgactcgcgtgcgtgaatttatcggcatcgttgcacctaaaaatagcggctggacaactttacgcgtcggtgaattaaaatctatgctccaccttgcattaggcgaattagaacaggcattagattgggcaaactggacgctgaatatgaacagttccgtatttaccacagaacctgtgaattattaccgcgcattaatttccatcattgaattacatttagatcaaaatcgtgaaccagcgcaatatcgtgcagtgtttgagaaaatgtatggtaaagatgcagttaaacaagcttgggcagctgtctctgaaggtggcaatccgttctacaatcttccagcaagtgatgaaaatttggaaaactttaaggaacatcaggcgttgttgggggcttatgggaagttgcagaaagcaaagcgagcacatcaaaaataaattaggcttatttcgtactttcaattcttgaaagtacgacctacttttctttgcttcgccaaagaaaagtaggcaaaagaaaagcgcccctgcttttccttatttcctttgtttcatacaatttgcttaacggaaattttctaaactcgccgcaagcggctcaaacagacgaaaattgcctgaaaattgaaagtcgcaaaggcgatttatatggggccccgaatttatcagagcattatttaaaaagtgcggttaattttaaattcattttaagaacaaaaaatattttgagttttgaccgcactttaaatcggataaagaacaaattgggttcccttcttttccacctttgtggaattgaatttgtaggaaattttcgtctgtttgagcgcagcgagtttagaaaatttccgtgaaacaaattcaatggaacaaagggaataaggaaaagcagggttgcctttctttttgcctactttttctttggcaaagcaaagaaaaagtaagtcgccatcaggcgaaatcctgatatcaaaaaccacatatccacaattttatgctataatccgccacaatttttgatcaaaaaaggaataccaatgacggattcaatccaatcatctatcacccctgtcaatatcgaagaagaacttaaatcttcctaccttgactacgcgatgtcggttatcgttgggcgtgcattacctgacgttcgagatggtttaaaaccagttcaccgccgcgtactgttctcaatggatcgcgaaggcaataccgccaataaaaaatacgtaaaatcagcgcgtgttgtgggtgatgtaatcggtaaatatcacccgcatggtgactcagccgtgtacgataccatcgttcgtatggcacaaccattctcacttcgctatatgttggttgatgggcaaggtaactttggttcaattgatggtgatgcgccagctgcaatgcgttataccgaagtgcgtatgcaaaaaattacgcaagcattgctcactgatttggataaagaaaccgtcaatttctcgccaaactatgatggcgaattaatgatcccagatgtattgccaactcgtattccagcacttttagcaaatggttcttctggtattgcggtggggatggcaactaacattccccctcacaacttaaacgaagtattaaatggttgtttggcttatattgacaacaatgaaattaccattgatgaattaatgcaacatattccgggcccagactttccaaccgctgcattaattaatggtcgtaaagggattgaagaagcctatcgcactggtcgtggtaaagtttatgttcgtgctcgtgcaaccgtagaaaccaacgaaaaaggacgcgagcaaattatcgtgtctgaattgccataccaagtaaataaagcaaaattagtcgagaaaattgccgaattaattcgcgagaaaaaaatcgaaggcatcagcaatattactgacctttcaaacaaagaagggatccgtattgaaattgatattaaacgtgatgcagtgggggaagtggtattaaaccatctttactcactcactcaaatgcaagtgacctttggtatcaatatggtggcattggatcacggtcagccacgtttatttaatcttaaagaaatcattgaatccttcgttttacaccgccgtgaagtggtgacacgtcgttctatctttgagcttcgcaaagcacgtgaacgtacgcacattttggaaggtttagcggttgctcgttctaatatcgatgaaatgattgcaattattcgcaactctaaaaaccgtgaagaggccgcaacagcaatcagttcacgttcttggacattacatagcgatattattaatcttcttgatgtttccgctcgtcctgatgagttagaagaaaatcttggtattcaaggtgaacagtattacttatcgccagcgcaagtaaacgcaattctagaacttcgcttacaccgtttaacgggcattgcgtttgaagaagttataaaagaatatgaagaattattagttaaaattgcggatcttcttcatattttaagtagcgcagaacgtttaatggaagtgattcgtgaagaattagaagaagtgaaagcacaatttggcgatgatcgtttaactgaaattaccgctgcttctggcgatattgatttagaagatttaatcgcacaagaagacgtggttgtgacgctttctcacgaaggttatgtgaaataccaaccactgactgactatgaagcacaacgccgtggcggtaaaggcaaatctgcaacgaagatgaaagaagaagatttcatcgaaaaattactggtggcaaatactcacgataccatcctctgcttctctagccgtggtcgtttatattggttgaaagtatatcaacttccacaagcaagccgtggtgcacgcggtcgtccaattgtgaatattcttccgttacaagaaaacgaacgtattactgcaatcttgccagtttctgcttacgaagaagataaattcgtagtcatggcaactgctggcggtattgtgaagaaaatcgccttaaccgaatttagccgtccacgttcaaacggtatcatcgcattgaatttacgtgacgaagatgaattaatcggcgtggatattactgatggcagcaacgaaattatgttgttctcatcgcaaggtcgcgtggtgcgttttgctgaaaatgccgtgcgtgcaatggggcgtttagcaacaggtgttcgcggtatcaaactggctttaacaaacgatatttctgacgatgaaagtgcggtagaaattgaagatatttctgatgacaacgctgaagcatcattagacttaaatatcgataaagtggtttctctcgttgtgccaaaaggtgaaggggaaattttaacagcaacacaaaacggctacggaaaacgcacacaattaagtgaatacccaactaaatcacgtaatacaaaaggtgtgatttcgattaaagtgagtgaacgcaatggtaaagtcgttgctgcaactcaagtagaagaaacagaccaaattatgttgatcactgatgcaggaacgcttgttcgcacacgcgtaagcgaagtgagcattgtagggcgtaacacgcaaggtgttcgcttaattcgtactgccgatgatgaacacgtagtaagtttagaacgtgtttgtgatgcagatgaagaagattctttggaagaaagcagttctgaagaataactggttataaaagaagaagtgcggtgaaatttcaccgcacttttttatgactaattaattacctgccaaaccatctcgaattcgtttttcaaactgatcataatccactaaaaacgcatcgtgtccgtaatctgatgggaattcataaaaatgtagatcgactccactttgctctaaaagctgtttacttttataaagatcaatgggtttaaaaagttgatccgttgtcacagaaaccaacgtatagcgtgctttaatacgtgataatgcctctttgacattctcataccccaaacttggatcatacatatccaacgcacgtaacaaatgcaaataactattggcatcaaaacgttctaagaattttttgccttggtaagaaagataggattccacttgaaagtaatcgccccaaaagctgccatctgattttgtagcacgcccaaaggctttggctagttgtaaatcggtgcggtaagtcagcatacctagcatacgcgcaatagataacccttgatctggcggtgtcccctcataataatcgccgccgttaaaattgggatcattaattaccgcttgacgcataacatggttaaagcctatggcttcagcactaaaataaatggatgagcaaagattcacgatattatccataaaatcaggataatcaatcgcccattgattcgcttgcataccgccaaaagatccaccaataatggcttttaaatggctaataccaagatgttcaagcaaggctttttgtactttaacaatatcttgcacaacaatattaggaaattggctgccataaggtttacccgtttgcggattaattgatgaaggcccagttgttcccttacacccacctaatacgttcgagctaataaaaaaataacgatccgtatccaatgctaaacctgctcccataaaattctgccaccagccatctcgaccatcatcgaaataaggctcagcatcgccagtcaaagcatggcaaattaataccgcattatttttttcggcattgagtgtgccataagtttgatacgcgacattaatatgggaaagtttgccgccaagcatcagagttaaaggctgtgtgtcaaaaagcactacattttgcacagacattgaaaacctatcgtaataatcagaatggcgtttaaactatcagtaagtcgattagcttgtcaagaaattttagccgtctaaacggctaaattatcgcacatcaatgcgattcacaaaatccatcaaattctccttgaagtgcggtcgatttttcattatgtttaccgctatgctagtaaaaaaattatctccaaaattcaccgtactttttcgcgcactactctacgcaatctttgcattgattatactttgcttgctagtggatcgaggcgtcagtttttatgttcgcgataaaatattcacaaatattgatgaactcccctttcgcccctgcgcccttgtgcttggcacatcaaaatacaccgtcagcggaaaaccgaacgtttattacgatagtcgcttaatggcagctaaaagcctaatcgaacaacaaaaagtgaattatcttttattaagtggtgacaaccgaactttgcaatataacgaaccaagagcaatgtttcgcgatttacgcaaaatgggcgtgccagaaactttaatgttccgtgattttgcaggttttcgcaccctagattccgttatccgcgccgataaaattttccaagtgaaaacatttacgattgtcagtcaaaaatttcattgcgaacgcgcgctattaattgcccaagcacataatattgatgccatttgctttgtggcaaaacagccagaattacatttttccacacaaataagagaagtttttgcccgcataaaagcggtttttgacttgatattaggtgttgagccttattttttaggggaacctcagccattgccaaacagcaccacattataaatattgttctaaatcatatttcttctatttttctaaaatcacactaatctaaacttgttaaataaacacaaactggttaaaatccaaccgataaggaaaatactgttttatgctaaagggtttactttaattgtcgttgaactcacaattgatataaaagataaaacagagaaaaaaatagtcacaaaggttaccaaggcaccgtgggtgtgaaatattcttggaaataatattccaaaaaataagggctgattttaaatatcagccctttgctttgatggtacattttattccaccacagcccaaaattcagcaacggtgtggaaagatccaaagactaaaaccacatcattttttaccgcacttttgagtgctgtacacacaccatccataacagaattatctgatgtagcttgaatatttgggaaatgacttttcaatttctctgctaattcatcgcctgactgcccgcgatagccgcctaaagttacacaatgccattcatcaataataggtgttaaatgctcaaataccccatttgcatctttgtctttgagcatcccacacacggcaatcattttaccctcgatgctacgtttaagtgcggtcaatttttcagataaatattttgcagcgtgaggattatgccctacatcaacgataattgttggcaaggtttcaactggtacgccaagataatccgctaatttttcacgtttatctgtttttatagcttgaaaacgaccaaccagttctacctcttgcaaagattttcgcaaagtctgttctgaaatatcaaaaggtaaatattgaacggcagccagagccgttgcggcattcgccaatggaatctgacaaaacggcaaattttctaaccgcacttttttattttgccattgccaattttcagcattttgctcaaataaccaatccacatcacgacgagcaacttggcaatgtaatttttcggcctgatctaacattgtttgcggcacattaggttcaccaatcacgacagggcaattttcgcggaaaattcctgctttttcaaaagcaatggcctctctggtatccccaagaaaatcggtgtgatcaatatcgatgctagtaatcacagcaagatggctatccacaatattggtcgcatctaaacggccgcccaaacccacttctaaaatcaccacatctaattttgcttgcttaaataaatgcaatgcagaaagggtgctaaattcaaaataagtcagcgattctgttttgttttcatcaataaaagcaaaagaggcggtatgtgcttcatcgggtaaatcttgattttgaatgcgtactcgctcgttataacgcaataaatggggcgaagaatacacgcctacacgtaatccgtgattaagcagaatcgtttctaacaagcgacaagtcgtgcctttaccattcgtcccccccacagttatcacataaggggcgggatgaagtaaatccaatttttctgccacggattgaatacgatctaaaccgagatcaataggtttaaaatggcttttttctaaataagaaagccactcagcgagtggcgaagtggctttaagttgcatattattcatcttctgaaatgagttcaggttctacaaaaggagaaggttgattcgttaatttactcagtacacttgctaaagtttgacgcatttctgaacgtttcacgatcatatcaattgcccctttctcaagtagaaactcactacgttggaaaccttctggcaatttttcacgcacagtttgttcaataacgcgtggccctgcaaaaccaattaaggcttttggctcggcaatatttaaatcccctaacatcgcaaaactggctgatacgccgcctaaagtcggatccgttaatactgaaataaatggcacacccttttcacgcatttgagcaagtacggcactggtttttgccatttgcattaaagagaataatgcttcctgcatacgagcaccaccactcgcagagaaacatacaaacggacaattcatttccatcgctttttcagccgctttaacaaattttgcaccaactacagaacccattgaaccgcccataaaagcaaagttcgatgcagccacaacgattggcatattataaagtgtacctgtcatagtaattagcgcatctttctcgcccgtttctttttgcgccgcattgatacgatctttatatttctttaaatctttgaattttaaaatatcttttggttctaaatctgccgcaatttcttggcttgaatcttcgtccaataaatttaataaacgctcacgagcatcaatacgcatatgatgaccacatttcgggcaaacatacagattacgtttgagttcttcactataaagtacttgttcacaagcagtacattttgtccacacgccttctggcacattggcttttcgagtggaagaagaaggacttttactaaaaattcggttaatccagctcattttttgacctttttattgactagaaaattgcgcgtattagaacataaatttatagaatttgctacttgtaagaccgtttttgtactgctccgatttccttttaaacaagataatttgctctcctcttattgaacattttttttatttttttgtcttacagaccacgttatctgaaatttattttggagtatttatgaaaaaaacacgttttgtattaaatagtattgcacttggattaagtgtattaagcacatcatttgttgctcaagccactttgccaagttttgtttcggaacaaaacagtcttgcaccgatgttagaaaaagtacaacctgccgttgtcactctttccgttgaaggaaaagctaaagtagattctcgttctcctttcctagacgatattcctgaagaatttaaattcttctttggcgatcgttttgccgaacaatttggtggacgtggagagtcaaagcgtaacttccgtggtttaggttctggtgtcattattaatgcaagcaaaggctatgttttaaccaataatcatgttattgatggagctgataaaattaccgtgcaattacaagatgggcgtgaatttaaagcaaaattagtgggtaaagatgaacaatcagatattgcattagtacagcttgaaaaaccaagtaatttaacagaaatcaaatttgctgattccgacaaattacgcgtaggcgatttcactgttgcaatcggtaatccatttggtttaggtcaaactgtgacatcaggtattgtttctgcattgggtcgttcaacaggttctgacagtggcacttatgaaaactatattcaaaccgatgcagcagtaaaccgcggtaattcgggtggtgcattagtcaatctaaatggcgaacttattggaattaataccgcaattatttctccaagcggtggcaatgcaggaattgcctttgcgattccaagtaatcaagcaagcaatttagtgcaacaaattttagaatttggtcaagtgcgtcgcggattgcttggtattaaagggggcgaactcaatgctgatttagccaaagcctttaatgtaagcgcgcaacaaggcgcatttgtaagtgaagttttaccgaaatctgctgctgaaaaagcaggacttaaagcgggcgatattatcacggcgatgaacggtcaaaaaatctcaagtttcgctgaaattcgtgcaaaaatcgcaaccactggtgcaggcaaagagattagcttgacttacttacgtgatggcaaatcccacgacgttaaaatgaaattacaagcggatgatggtagccaactttcctcaaaaactgagttgcctgcattagatggtgcaacattgaaagactacgatgctaaaggcgttaaaggaattaaaatcacaaaaattcaacctaattcgctggctgcacaacgtggtttaaaatcgggcgatattattattggtattaatcgtcaaatgatcgaaaacattcgtgaattaaataaagtgcttgaaactgaaccgtcagcagttgcacttaatattttacgaggtgacagtaatttctatttattagtgcaataatctgcttgatatatttaagaaaaaagtccgatcacaatgatcgggcttctttttatgcagcaatcgttcttaacaaatccaccacaaattctaaccgcactttgttatcggatagatctttcataaacttaaattttaatgggccatcaaatcgatacacaataggttctttttgaattaattgaataaatttatctggattcacttgtgcttttgctgaaaactcaataaaaccgccttgtgttccagcatcaattcgcacaacgttcaacggctcaaccaataaacgcaactctgtaatttgtaataaatttttcgttgcatcaggcaataatccaaatctgtcaatcaactcaacttttaattcatctaattctgctttactctctgctgcagcaatgcgtttataaaaggataaacgcatattcacgtctcctagataatcatcaggcagtaaagcaggcacacgcaattcaatatccgcttgttgttgcgtcaattcttctaatgatggttcacgcccttcttttaacgctttaaccgctgcatccaataattccatataaagcgaaaaaccgatgctttcaatttgtccactttgttcgtttccaagtaattcgccagcaccacgaatctctaaatcgtgggttgccaagataaaaccagccccaagattatcaagattttccaacgcatctagacggcgttcagcatcttttgtcatcattttaggtgggggcgtaagcaaataagcataagcctgatgatgtgaacgcccgactcgtccacgtaattgatgcaactgagccaaaccaaaatgatccgctcgttcaataataatggtatttgccgttggtacatcaatacccgtttcgataatggttgaacaaactaagacgttataacgctgatgataaaaatcactcatcacacgttctaactcacgttctctcatttgtccgtgccccacaattactcgcgcctctggcacaagcgtggtcagtttttctgctgtattttcaatgcttgcgacatcattgtggagataataaacctgcccacctcggagaatttcacgcaaaatcgcttctcgtacaacaagatcgccattctgacggacgaaggttttaatacttaatcggcgagcaggaggtgtggaaataatggaaagatcacgaatgccattcatcgccatattaagcgttcgaggaattggcgttgccgttagcgtaagaatatcgatattcgcacgaagctgtttgattttctctttttgccctacaccaaaacgatgttcttcatcaataatcaacaatccaagatcgttaaattttacatctgattgaattaatttatgggtaccaattaatatatcgacttttccttctgcaaggttttccagaatttgtttttgttcttttgcagttttgaaacgcgataacacttcgacattcacaggcaaattcgcaaaacgatctttaaaattctcataatgctgttgggctaacagtgtggttggcactagcactgctacttgcttatgattcatcacagccaaaaaggcagcgcgcattgccacttcagttttaccaaaacccacatcaccacaaacaaggcgatccattgccttaggctgacacatatccgaaattaccgcattaattgccatttcctgatcgtaggtttcttcaaaaggaaaggttgcggaaaattgttgaaattcttcacgatcatatttaaaggcaaagcctttcttcgcttcacgttgtgcgtaaacatctaataactctgccgccacatcacgaattttctccgcagctttttggcgtgatttcgcccaagcctcgttccctaatttatgtaatggcgcactttcatcagagccaccaacataacggctaatcaaatgtaatgaagtcactggcacataaagtttcgattcatttgcataatttagtagcaaatattcggctttaatgccgcctgtatctaaggtgaccaaaccgccataacgtcccacaccgtgatcaagatgcacaactggttgccctattttcagttcggcaagatttcgtacaagcgtatcaggattaattgttttacgtttgtctctagaacgttgttgaatgcgctcgccaagtaaattagcttcgccaataatcgcaacaggaagcgattgttcaattataaaaccttgttcaagagagctgactaacaagctaaatttttcattttcaatctgttctaaagattgaatttgttttggcttgagttttaacggtgaaagcaaatcaagcaaagtctctcggcgaccttccgtctccacagaaaacagtacatttcctttaaaatgctcaataaattgacgtaattgtcccaatggttctttttgctgggattgaatagtcacttctggtagagcggcaacaggtaaatttttctggcgtaccgatgaccgcactttttccgctttaaatgtaatacgtggataagatttcaatcggcgattgacttcatctacattaagccataatttttcaggcgataaaagcggacgcatcggatccactttacgttgttcataacgctgtttggcatcttgataaaaacgctcgccttgcgtttgattattttccatatctacaaacagcgtttgctccggcaaataatcaaataaagttgccatttcagcaaagaaaagtggctgccaatattcaatgccagaaatcaaggtacctttactgatttgctgataaatatgttcgggatctcggcgaatctccccaaaagtttcacgaaattgcgcacggaaaaattcaatccctttgtcgtccgttggaaattcgtgagctggcaaaagattaattgagttaatttcatcaagagtgcgttgcgtatccacatcaaaagtgcgaatagaatcaatttcatcatcaaaaaaatcaaggcgaaaaggcaccgcacttcccattgggaaaagatccaacaaggaaccacgaactgcgtactcgccgtgttctaatacttgctccacagctcgatagcccgctgcttctaattgtaagcacattttatcgatgaccaaacgatcgccttttttaatcagaagcacattgtgttgtaaatattgtggcgggcaaaggcgttgcattaatgtcgaaatcggcaataagaaaatgccttttttcgcattttgtaaatggaaaagcgcacttaaacgagaggaaataatttcttgatggggagaaaaagtatcgtaaggtaaggtttcccaatcagggaaaaggcatacattttgactgcttaattccgataaaacacgtgataaacgcaccgcacttcgtgtatctggagtcaccactacggttaaattttggttttgctctgcaatttcactaatcgccaatgcatcagcgcctggtaatacattgcctaaaattttgtgatcattgggttgggttggaatatcaggttggaaaaaagccgttttcataaatataaataatgcgtcaatcttgtgtaaaattgaggcatagtgtactggaatttgctctatctttcaataagttcactgtttaaaaaaacagttaatatttatttctttaaagaagattcttttgtcttcaaattaccattttcatcttctgttgctgacataggcacgcagctacaattcggttgatctaaaccccattctttaatgaagttgtcatatttttcaagtgcgcgtttaaaccagccttttggttttgcggtttgttctgtcataaagttcctcgctctaaatattgtttaatttctaaacgcaaacattctacgccttttttcttgttaataggaagttgtttttttgttaaataagcggaaattaatgggaaattttctttgcccgctaattttaataaacgcctcatcgcaggaacgctcgaaaataaagtgcggtgaaaattagcgaagttttttaagctcatccaatcaaaatcatcaagctgccaatcaagctgattttgctcaaaatttatggcaaacggatgaaaagataaagggagattacgctgaaattgtttgtacgcagtatcaactaaagccaagccttctttggaaagtcctttaagggcaatcgctgaataacaaccactactcgcttcttgatgctcgcctaaatgcaccaaaacaaaaccgcacttttgccaaaattttgccagttcgtcggtgtagccaaaactcactgaaagaaaatccacatcggcattttccatggcttgcatcaaattttgcccaatgcccttttgctgccaatttggctgaaccgctatacgagaaatacgtaaagatcgtaatttacaggcttgaggcaagttttcatagaaacataacgcctgtggaacaagattccctttcgggcggcgtttgccttgttgaatttgaataatcaactcatcatcagccatatttccttcttctaatgcccaaattgcaccgagcaaattctgttgatattcggcaaaataaaaacgttgattttctccatcaagtaaacggcgaagatcgagtggcgatgttcgataatgcgccaatgtcgttaagccataaaaatctcgaaataaaaattgacgattatattttcctttactacccttacttgtgaggggagcttccaaagcttgagggaggctggctatatctaaatcccccttccgcccttcgggcaccttcccccgcaagcaggggaaggaaagatttttagcgttttcctctatgttataagtaatattgttatagtcaaagtgctgaaaatcatcttcggcatttagcaacaaaagatcatcaataaaatgttctaacgggtcattttcttgccaacgtaggggctgtttaagctcaaaatgctgaaaagtgcggtgaattttccgtttaaattttaattcgaaaccacgccccgtaccttcatagctatgaattgttgtgctgaagacaatatgttgaaaatattgagaatattcttgcaataacggcaatgggattaccgccgcttcatctaccagcaaccaagctgattgactgaattctggttcatgttgtaaccgaatagccagttcatcaggcgcgataaattctatctctcgttctgaaaattcaataacggaatgcaccgcacttttattcggtgcggtgagataaactggtgcttgaatttggttagcaagcatacccaataatgcggattttcctcttccccgcttggaggttagaaaataaatatcctgctcggcttgtaaaatagtctcgataatttgttgttgcgctaacgtagcatttttgtgatgttcgttagaataaaaaaccgtaggaaattcaaccgcactttcctctcttaaaatggggaaatgataacgttcaatgcactgtttgaaatgatcaataaaattaggcgtggcgattgctgactgatttccattccaacgtaaactatcttgatcaggctgctgagataaattttcccaatcagataacactaaacaaagtgtgccgcccattttcagtgttccagctgcaatagccagcgcttcaagatgaatgccatttcgcgcatcaaataagatatgttcaaattcttgtccaagcaaattcgttgctttagaaaaagcaatgccactttcgccgataattaatacgttatcaggcacaagcggcaaagttttgcagattaaaatttgaagctggcgagatgacatcgttttattttaaataggcaattaacatcgcaccaataaaacttacgcaagcaagccaaaagaaaatgcttttgggttgagaaacttttttactgaaaaattttgcagcaaacacaatatacaaaatcagtaatgcgaatttagccactaaccaccattcaataccaaaagcaaagaggtataaaatgacgacgccagacacaatcagcaaggtatctgataagtgcggtaaaatttttaataattttatcgaacgccaatttttaccattaagctgcattgcaccacgaattactaacaatgccaaacttaaaaaggcgaaaaaaatatgtaaatcaactaacataatcactcccaaaaaagtaagaaaagtgcggtcaaaatccaccgcactttctcaatctaaattacttcgcaatacgtttatatttaatacgatgtggctgagtggctgcatcgcctaaggttttctttttccactcttcgtagtctgagaagttaccttcatagaacgtgactttaccttcatcgccgtagtctaaaatatgcgttgcgatacggtctaagaaccaacggtcgtgcgaaataaccattgcacagcctgggaattctaagatcgcattttctaaggcacgcaaggtttcaacatctaagtcattggttggttcgtccagtaatagcacgttaccaccacgttgtagaagtttcgctaagtgtaaacgaccacgttcaccgcccgataattcccccacacgtttttgttgatctacacctttgaagttgaaacgccccacataagcacggcttggaatttcaaagttgccgatagtaagaatgtcttgtccattagacacttcttcccacacagttttcttgtcatccattgagtcacggaactgatctaccgaagcaagcacaacggtttcgcccattgtcacagaacctgaatctggttgttcttgacctgacaacatacggaataaggttgatttacctgcaccgttcgctccgataatcccaacaattgccccttttggaatactgaatgataaatcatcaattaaagtgcggtcgccataagacttggttaagttttgcacttcaatcactttatcgcctaagcgtgggccaggtggaataaagagttcgttcgtctcgtttcgtttttgatattcgccagagttcaattcatcaaaacgagccatacgtgctttgcttttcgcttggcgaccttttggattttgacgaacccattctaactctttcgcaatggatttttgacgtgcgttttcagttgcttgttcttgttctaaacgtttctctttttgctctaaccaagaagaatagttgccttcccaaggaatgccctcgccacggtcaagctctaagatccaaccagccacattatctaagaaataacggtcgtgagtgattgctaccactgtaccctcgtagtcgtgtaagaatcgctctaaccacgccacagattccgcatctaagtggttagttggttcatctaacaacaacatatctggtttttcgagtaataagcggcaaagtgccactcggcgacgctcaccaccagataaatgttcaattttggcatcccaatcaggtaaacgtaacgcatctgccgcacgctctaattggttatctaaattatgcccatcatgcgcttgaatgatagcttcaagattggcttgttctgccgctaatttatcaaaatctgcatcaggatccgcataaagcgcatacacttcatctaaacgagtcagtgcatttttcacttcagaaaccgcttcttccactgcttcacgcacggtttgttgtggctcgagttttggctcttgcggaagatacccaattttaatacccggttgtggacgagcttccccttcaaactctttatctacgcctgccataatgcgtaaaagagtcgatttacccgcaccatttaaacctaaaaccccgatcttagcaccagggaaaaagcttaaagaaatatctttcaaaatatgacgcttcggcggcactactttgccgacacgatgcatcgtatacacaaattgagatgacattaataattcctcacaaaaaaattcgccctattctactggaaaatagggcgaaaatataggaaacaagtggacagattttgcaaaagtttggcgaaacctaaccacttgtcaatatttagagtgaagtattccctaaattaaatagacactttagggctcaaattacattgcaaatgtagaagtatcatgccgatgtagagcgggcttaacatttgcaagactttgttgaaaacgtttattgtgttcaaggtcccataaatcaatacgtgtttgcagattaagccaaaactcaggcgtagtatcaaatactttagcaagtttaactgccatttctagcgtaattcgtgaactattattaacaatattgcttgccgtattacgatgtacatctaaaatttgagctaaatcactaattttaagacttaaaggttctaaaaactcttcttgtagaatttcaccaacagaggtgggttttctcgtcatcatattatcctccttacaaattataagaatgtggatctaaatataaattatttacttcgttattttcatatttaaaaattaaacgatattgtttattcactcgaatagaataaattttattttcttttggctcaagcaactccaaatggttagctggtggagaacgtaaatcgttgatattttctgaggcacttatcatatctaattttcttgccaatactttatacaaattagaaggaatcttactatgagtatcaccatattgataaaacctataaagataatcatctctaaaatgctcacgctttaaattaaacatctattattctcttagttatactcgagctgatcataataagaataaatgcacaatgcaagagtgcatctttcgacttagataaaaaaaaccacccgaaacgggtggcaggaaagtagtttagctatatttatcattattttatttaggaactttatgaatatcaagcaatcacttgacgggagctatgttactgaatattgaaaggcaagggaaatgctattgagagtttttttgatttacatcaacatttttgacagaaaaattcgtttttgcgtgtagaataaacaacttcaaattctagcgttcaaaataataggattttttgtgaaaacgtattcattattactcggtttattcattagttttggtgttttagcccatcctcacgcatttattgatatacaaaccacgcccattatagaaaataatcaactcacaggtttttcaatgaaatggacgttggatgaaccaagttcgtctgcagttatttatgatatgaaacaagctagaactaaagcggaaaaacaaaaacttcttgatgatgtaatgggaaatatcgtcagtgagcattatttcagctatctatatgatgcccagaataataaaatcaaatattcccctcgcccaaaaaattacggcattaatgttcaaggcttacaactgcaatattattttgatgtgccactcgcccatccgcaaaagttagaaaaaaacacatttagcttacaaacttacgatcccacttattatgtggcgatgacttacgcttcaaaaagtgcggtagatttttccgcactttcgaaaaattgccaaggaaaattaattgaacctaatgtggatgaaaaaatccaagcctacgcatcttcacttgataaatcccaaaagaacgaagatgattccttaggcgtaatgttcgcgcaaaaaataataattcaatgtgagtagaaatgaaaaaatataaaactgggctcgtgttattagtgattgcactcgccttacttgtctatttttccccttggtttttcttacatattgccagttggcaaaaagagtttaatcagcttatttcggaaaatttacatcaaattcaaaataatagcatcaaggcaggcatcacacttattttcgtcagctttatttatggcgtactccatgccctcgggccaggacacggcaaatttattattgccagctatctttccacgcatgaaagccaattaaaacaaagcactatcttgagcttactttcatccttaatgcaaggcattgtcgcgattacagcaacaacattgcttgttgtagtgctaaatctttcatcacgttatttcaaattaagccagctttggttagaacgaactgccttgctattattggtatttctcggctgttattggatttggcaaggtctacgtgcctatcgtaaaaaagctaaattaaccattaaatccctcaatcccctccctctacacgaaaaaagtgcggtgaaaaataaccgcacttttcagccaaacacttgtagctgtggacaccaacatttgccaagccccacgcaaactgcacaagcaaccaatctaaaatcacaattcctcgtgattctaacaattggcatgcgcccatgtagcggtgcaattttcgttttatttttagcttatatgcttgatctttatagctggggaattttagctgtattagccatgtctttcggcacggggcttatgctgtcagccttcgcaggaattgtacgttatgcacgaaataccgcaatccacttagggcattggtatagttcaaaaaatacgaaaggaaaaagcgaaagcatcgtgaaactaatcgctggtggaataatgctattttttgccttgagcttgttatacggcacaaccatctcaactggcggaagcaaaatcctattttgaagttaaaaataaagcccatcaacatgatgggctaaaaatcttttggttgctaatttagaatttgtaaaaggagacaaacaaactctaaaccaaaagaaaaattggctcctcctgctggacttgaaccagcgacatatggattaacagtccaccgttctaccgactgaactaaggaggaataaactttgtatcacaaggaacagggcgcgaattttaatgatcgatagttagcttgtcaatgcaaaatttaaaaaaatttcataaaaaaataaaaattttctcatcttttatataccccctaatatttatttttctatccacagagcctgtggataactttgtggattaactttttaaaattttgcggatcccttgttcttacaaggattattcgatcttgattatagattagcctaaaattaaattttgatttaaaatcaataagttaagttttgtctagtaaaaatttaaagtttttttaatgaatttgtgacatcttcctcttgacatcgctaagtctgtgtaaaacttagatttttgcctgatcaattttacacattaaatatgctaaaatagacattattcaaaactatcaaaaaaccgaccgcactttatgtctgaaaaaatcaacacaaaaccgttcattctacattccgactttcgtccctctggcgatcagccacaagctatcgaaaaattggctgaaaatttaacggatggtttggcgcatcaaactttgctcggggtaacaggctcggggaagacgtttactatcgccaatgtaatcgctcaattaaatcgacccgcaatgttacttgcgccaaataaaacccttgctgctcagctttatgcagaaatgaaagctttttttccagaaaatgcggtggaatattttgtgtcttactatgattattatcagcctgaagcctatgtgcccagcagtgatacatttattgaaaaagatgcgtctattaatgatcaaatcgaacaaatgcgtctttctgcgacgaaatcttttctagaacgtcgagataccatcgtggtggcttccgtttctgcaatttatggtttgggcgatcctgatagctatttacaaatgatgttgcatttacaacaaggtgccattatcgatcaacgccaaattttagcgaagttagcggaattgcaatatacccgaaatgatcaagcatttcagcgtggaactttccgtgttcgcggagaaattattgatatttttcctgctgaatccgatgatcgtgcggtgcgtattgaattatttgatgatgaaatcgagcgtttaagtttatttgatccgctcactggcagtagttttggtgctgtcccacgttttacgatctatcctaaaactcactatgttacgccaagagaacgtattttagatgcgatagaaaacatcaaaaaagaactggtatcacgccgtgaatacttcattaaagaacataaacttttagaagaacaacgtatcagccagcgtacccaatttgatattgaaatgatgaatgaattgggctattgctcgggaattgaaaactactctcgctatttatcgggaagaaatgagggcgaacctccaccaacattatttgattatatgccctctgatgccattttaattattgatgaatctcatgtaactgtgcctcaaattggtggaatgtatcgtggcgaccgttcacgtaaagaaaccttagtcgaatatggtttccgtttgccatccgccttggataatcgtccgttacgctttgaggaatttgaacgcttagctccgcaaaccatttatgtttccgcaacaccagggccttatgaattagaaaaatcaggcactgaaatcatcgatcaagtggttcgccccactggtttacttgatccactcattgaaattcgtccagtgtcaattcaagtggatgatttactttccgaagctcgccaaagagcggataaaaatgagcgagttttagtcacaacactcactaaaaaaatggcggaagatttaacggattatttggatgaacacgggattcgtgtgcgttatctgcattccgatattgatactgtggagcgagtagaaattatccgtgatttgcgtttaggggaatttgatgtattggttggaattaacttattgcgtgaaggtttagatattcctgaagtgtctcttgtggcgattttagatgcggacaaagaaggatttttacgttctgaacgctctttgatccaaaccatcggtcgtgctgcgcgaaacttaaatggtaaagcaattttatatgcagatagcatcacaaaatccatggaaaaagccatcaccgaaactaatcgtcgtcgtgaaaaacaaataaaatacaatgaagaacatggcattgtgccacaagcattgaataagaaagtcggtgaattattagatattgggcaaggtgcaaaccaaaaagcgaaagccaataaacaacgtggaaaaatggcggcagaaccaaccgcactttataatgcaccgaaaaatgccaaagaatatcaacaacaaatcaaaaaattggaacaacaaatgtataaatttgcgcaagatttggaatttgaaaaagccgcagcaattcgcgatcaattacatcaattacgtgaacaatttgtttttgataactaaaaaaacgccagcttaagctggcgttccatttatttattttcacctgaagaatacaagcgatttttatataaataactacctaataaagcgtgagccaatgcctcttttttcattgcatcaggtacgtcttttggcgttaaagtttctgttgatttatcataatgataaccttgcgctgctttatttgacatttgaattaccacatcattattgcctttcatcattgcttgagtttgatcgtattgcataaaagcacgatctgggtttacatcttgcgttaaatcaaaaccaatcattggataattgccacttacgccagctaaagaaagcaatgtagttggcatatcaatttggctcacaagacggctatcacggcgtggcgtaatgccatcaccaagaatcaaggctggaatatggaaatgcttaatcggcacaagacttgctccgcctacacgagaatcgtgatccgcaacaattaagaaaatcgtatctttccaataattagactgttttgccattttaaagaaatgacctaaggcataatccgcatattttgctgcgttattacgagtggcttttggttgctcataaagctcaatcttgccatctggatattcaaatggatcgtgattgctggaactaaacactaaactaaaaaacggtttaccttcattttgtaatttcgtgaaagtttcattggctttatcaaataaatcctcatcactcacgccccaagtgccagtaaattttggattctgatagtcttgttgatcccaaatatctttaaagccattaccgtagaaaaaactcgccatattgtcgaagtgcttttcgccaccataaataaacgaagtgttatagccttgtttatgtaataaatccgcaatagtaaagaaaccactttgggcattattaagtttcaccactgcacgagctggtgttggcgtaaaacctgccgttgttgcttcaataccacgtactgaacgtgtgcctgttgcataaagattttcaaataaccacccttcttttgcgagctgatccacatttggagaaagtggtttgccaccaagtgttccaataaactgagcaccgagactttcttgtagcaaaatcacgatatttttaggtttaccctgataagtcgcgacatttttcgttaaagttgggtatttatctgaaatgtaatcactttctggacggccacgactggctttaacaatacgaaaaatttcatctgcatccatttttccgtacatttctgaagatttttcttcatctttaaattgctgtgccgcataaatcacggaatagccagaattaagcaccagagaattcactaacgcatcagaagaaaatgccaccatagcgggatttataccacggtgttgaaaacttgaacgtgccccaaggaagctcaagacaatcacaagcaaagcaatcacagggcgaagtttccaactgattgaacctaaatttttgactgcccaaccagaaattttccaataaatcacggcagctaaaatcgtgaaaacaaggctaaaaattaccgcacttaaatgtccttccgcaagcattgaaaaaacttctttcggataaatcaagtattcgataaataaacgatttgggcggtaatcgtaggtttcaataaaggcaggtgtggcaatttccataaagataataaacacactaccaagggttagccaaaggcgtaaaatttttacccaaactttactgctatggaacaatgttgtgagcaatgctggtacgccaaataaataacaaagtgccacaacatccattcgtacgccttgcaaaaataattgcaaccagccatctacggcggatacacgctctgattgccacacagcaagtcccaaacgggataaggaaaggatgatgagattaatcaacacgaatgtgaagatggggaataaaggaaaatgtgcttttttcattgtaaaaaccactaacacaacgacatccaagccgtattaaattaaagaaagataggcaactgtctatcggtcggttccttttcgacacaacaaaagtcttaaagtgcggtcaattttcgcatagttttactcaatctcaaatgtaaacacattcactagaaaataaagcctcgagaaaaatcgaggctttgttaagtaaacgacggaaatttaataaaaattcaccgcactttttttcgattactcttgttgtgctttcactgctgcataggcaatcatattgataatacgacgaacagatgcacctggattaagaatatgcgcagatttattcatacccattaagatcgggccaacggtaattgccgtagtggtgctgcgtaataagctataactaatacgtgatgcactcaaatcagggaacactaataaatttgcgcttcctttcaatgggctatcaggcatgacttcttttcggtgagcttcattcatcgctaaatcgccacgcatttccccatcaatcattaaatgtggattgcgctctttgacgatttgtaatacttcgcgcatttttggtgcgcctaatgaatcagacgaaccaaaattagaatgagaaagcaatgcaactgcaggttcaataccaaaacgatgaatttcttctgctgccattaaggtaatttcagctaattcttctgctgtaggattactgtttacgtgagtatctgttaagaatacgttacccgtcggtaatacaagactatttaaagcagcggcagttttcacgccgtcttttaagccaataatatcgcgaatagatgcaaggtgttttccgtatgaaccaaataaaccacatactaaagcgtctgcataacctaagctaagcaatgtagaagctaatacggtagtgttagaacgcacgacacgttttgcaatcgcaggtgtaatgcctttacgtttagtaagttcgtaatagtgtttccaacattcttcatagcgaggattatcttcgttatccacaatttcaaaatccacacctgcagttaaacgtaaaccaagttttttaattttttcttcaatcacactgcggcgaccaattaaaattggatttgccaagcccattgaaatcacttcttgggtagcgtgtaatgctttattttcttccccttccgctaaaataatgcgttgttttgccgattttgcttggctgaaaatagggcgcataaacaagttggttttgtaaacaaactgagtgagttggtcaatataaatatcccaattttgaatcggacgagttgccacaccagattccattgcagcttttgctaccgctggagcaatacgcacaatcaagcgaggatcaaatggacgaggaatcacataatccgcaccaaatgttgccccttctccaccgtaagcagaggttaccacttcgttttgctcttctaatgcaagatcagcaatggcataaactgccgcacgtttcatttcttcattaatagtggttgcgcccacatctaatgcaccacggaaaataaatgggaaacaaagcacgttatttacttggtttggataatcagaacgacctgtacatacaatcgcatcaggacgaaccgcttttgcttctggcggggtaatttcaggatttggattagctaaagcaagaataattggatgcgcagccatggttttcaccatatcttgtgtaagcgcaccagccgcagaacaacctaagaaaatatctgcatttggcatcgcatcaccaagtttacgccagccattatcttcaattgcataatcttttttggtttgatccattttgtcatcacgacctttatatactacgcctttcgagtcgcaaaccgtgatattttcacgtttcatacctaaagaaagcaataagttcaagcacgcaattgatgctgcacccgcaccagaagcaacaagtcgaacatcttcaatttttttacctacaatacgaagagaattgatgatcgcggcagcactgatgatcgctgttccatgttggtcatcatggaatacaggaatattcatacgctcacgtaatttttgttcaatataaaaacattctggtgctttaatatcttcaagatttactccaccgaaagttggctctaacgaggcaataatatccacaagtttatcgggatcatgctcattcacttcaatatcaaacacgttgatgcctgcaaattttttgaacaatacgccctttccttccattacaggtttgcccgctagcgcgccaatattgccaagtccaagcaccgctgtaccattggaaatcaccgctactaaattgccacgcgcggtatatttgtaagaggcggcaggatctttttcaatttctaaacaaggctctgccacacccggtgaataagctaaagccagatcgcgttgtgttgcgagtgattttgttggggtaacttcgatttttccaggaattggaaattcgtggaaatctaaggctgcttgacgtaattgttcgctcataataagtgctccattttcttgaaacaggattgaaatactgcgtcgattatatctgttttttattcaaaaaattgtgacgaactgcaaattcttacaactttataacaaaatttttttgatgcgaggcattagctagacttttcatttttcagtaaaaaaggtaggattttcgcaacaaaagcataaaggatgagaaaatgaatccatttcaaaaaattaaaagtgcggtgaataaatgccaaagattttttatcaatcgttcattacaacgtaaattgactaaccaaggcatgactgtcatttctgccaattgcgtgggggcttttatcttacatgatttacaccagccgtttaattccccttttgtgaatctctgtctctcgccacaggattttttgcgttatttacaaaatatggatttctaccgtactcaacctctcacattcgtacaaacagaaaaaagttatcctgtgggaaaacttgctgatcttgaaattcattttatgcattatcacagtgagcaagaagccaatgaaaaatggcaacttcgcacgtcacgaatgaagttagacaatctttttattatgatgacagatcgagacggcgtgaccgaaaaagacattcaactttttgatcaactccctttcaaaaataaagtgatttttactcacaagccctatccagcttttaaatcggcttattatataaaaggcttcgagaagcaaaatcaggtgggcgatatttttgaattttctggctggaatgggaaaaaatattacgatcaattcgattacctgaagtggtttaaccaagcttaatagataaaggctgcattgcagccttttttgtttcgttctaaaagcaaaaacctgtacaatgcctagcgaattttaacaagagaaaacataatgagattagataaatttattgctgaaaatgtgggattaactcgttctcaagcaacaaaagcgatccgccaaagtgcggtaaaaattaatggtgaaattgtcaaaagtggtgcggttcaaatttcacaagaagataaaatctattttgaagatgaattattaacttgggtagaagaaggccagtattttatgttgcataagccacaaggctgtgtttgttctaatgatgacggcgactatccaacaatttatcaattttttgattaccctttagctggaaaattacatagcgcaggtcgcttagatgtggatacgacaggtttcgtattgcttaccgatgatggacaatggtcacatcgcatcacttcgccaaaacatcattgtgaaaaaacctatttggtaacattagctgatcccgtagaagaaaattatgcagcggcttgttcggaaggtattttattacgcagagaaaaagagcccactaaaccagcaaaattagaaattttagatgattacaatgtgaatctgaccatttctgaaggtcgttatcatcaagtaaaacgtatgtttgccgcacttgggaataaagtcgttggattacatcgctggaaaattggtgatgtagtgttggatgaatccttagaagaaggcgaataccgcccattaactcaaagtgaaattgaaaagttagtaaaataatatgaatcaacaaaaatcgactttcatctttattcttaccctcggtattctctctatgctaccgccctttggcgtggatatgtatttgccgtcttttttagaaattgcgaaagatctcggcgtgagtccagaacaagtacaacacacgctcacctcttttgcttatggcatggcgtttggtcagcttttttgggggccttttggtgatagtttcggacgaaaaccgatcattttactcggtgttattgtgggtgcattaacagctttagtgcttaccgaaataaattcagttggaaattttaccgcacttcgttttgtgcaaggtttctttggtgccgcacctgtagtactttctggcgcattattgcgtgatttatttagtaaagatcagctatccaaagtgatgtccaccattacgttagtgtttatgcttgcgcctttagttgcgccaattattgggggttacatcgttaaatttttccattggcatgcgattttttacgttatttcgcttgtgggattattagccgctgcattggtctttttcatcattccagaaacccataaaaaagaaaatcgcattccgctgcgcttaaatattatcgctcgcaatttccttctgctttggaagcaaaaagaagtgcttggctatatgtttgccgcctcttttagctttggcgggttgtttgcttttgtgacggcaggatcaattgtctatatcggcatttatggcgttcccgtcgatcagttcggttatttctttatgatgaatatcgttacgatgatctttgcctcgtttttaaatagccgatttgttactaaagtgggtgcagaaacaatgttacggatagccctcgcaattcaattcctttctggaatgtggctaattttgaccgcacttttagatcttggtttttggccaatggcaattggcgtcgcctttttcgtcggtccaaacccagtgatttcatcaaatgcaatggcatcagctttagaaaaatgtcctcaaatggcgggaacaacaaattctttgattggtagcgtacgttttgcagtgggtgcaattatgggaagtttagtcgcgtcaatgaaaatggatactgccgcaccaatgctctttactatgggggcatgtgtcgtgatttccgtgttggcgtattactttctaaccagccgaaatcttaaaagccgtgggtaaattccccacggcgcaatgattgttttctttattaaacaaaaaccatccataacggcaagcaaacagcaataaataataggataaataaactattggtagataatatccacttttggaaactatgcagaatcagaatagccgcaatcacaaaatggcaaacaaaataaatgatgtaggcaaaaacactgtcagaattaaccgcactttccataccatttaaaagtaaaaataaaaacattgccaaagcatttagagcaagcaatataatcattgctaagggcaacaatgctataaaaccttgtaaacgatttcgtgcaataacaagcgcaagatttgctaaaatcacgccagataaaattggtgcaaaagggttatattcagcaaaatcactcgcaggaagcacggtaaaaatcattaaataactcaagcaacctaaacccgcaattaatgcagccatcaataaaaagctgttacgaattttttcagttttgggttgtttccaaataaaatacacgacagaaagaccacatacgctcattacgttagtaagcgtgtgattattttgtaataggcttatcagcaaccacactgcccaataaatagcaaaagtcatattcactttgattaaacgaccacgttgtcctgggcaaatttcgccgcgataaaacaccaacaacgaaattaactgtgcaaccaacacgcctacacctaaatgaggcattgtttgcttttcagattgcaaagaaaaaataaatagatcgatgccaagcaccattgagatcgataataccgcaagcaatgctgcgatatatttagaagattgttctgacataattttgacgtctgaaaaaataatgcgtcattatgctaaaaattcattaaattttaaagtaaaatgaaaccaattttaaccgcacttaggtacatgaatgttacttagtattttatatatcatcggtatcaccgctgaaggaatgacaggcgcacttgcggcaggtcgtgagaaaatggatatttttggcgtgatcattatcgcatctgtgactgccattggtggcggctctgtgcgtgatgtactgctcggacattaccctctcggctgggttaagcacccagaatattttttaatggtggcaagtgcggcggtaattaccgtatatgttgcaccatttatcaatcattttatgcgctactttcgcactattttcttggtgcttgatgcgatgggcttagtggtgtattccattattggcgcacaaattgcaatggatatgggacatagccttaccattgtttgtattgcaggctgtattactggtgcctttggcggggttctacgcgatatgctatgcaatcgaattcctctcgtgttccaaaaagaactctatgccagcattgcgctatttgccacgctgacttattacgcattaagtacacttcaagtagaacatacacttgccgtgttactcacacttattagcagctttactttacgccttttagctattcatttcgaatgggggttgccggtgtttaattaccaagaactcacatcggaagaacaagataagctgccaaataaaaagaaataaatacaataaagggaataactatgttagaacaaatgggtaaacaagccaaagatgctgcatttatcttggctcaactcaccactgctgaaaaaaattgtgcattatccattattgcagaacaactccaacaacaagcaccgcttatcttagccgaaaacgcaaaagatattgaacttgctaaacaaaatggattatcggatgccttgattgatcgcttactgctcacacaagaacgtttacaaagcattgctaatgatgtacgccacgttatttctctagcagatcccgtggggaaaatcatagacggcggtacattggatagcggacttaaaattgaacgcgtacgcactccgctcggcgtcattggtacaatttatgaagctcgcccaaatgtgaccattgatgtggcaagtctttgccttaaaactggcaatgcggtgattttacgcggcggtaaagaaacacaattttctaacaagattttaatcgaagttgtacaaaatgctttagagcaagcaggcttaccaaaatttgcggtgcaagccattaccgatccaaaccgtgaactcgttatgcaattattaaaactggatcgctatgtggatatgattattcctcgtggtggttcgggtttacatgaattgtgtaaacaacattcgactattcctgttattgtgggtggtgtgggtgtttgtcatactttcgttgaaaaaagtgcggatcaaaataaagcgatttttgttattgataacgccaaaacccaacgtccaagcacctgtaacacattggaaacattgttagttcaacattctattgctgaagaatttttaccaaaactcgtctctcacctcgctaccaaaaacgtaaaatatcacgcaaaatccaccgcacttaatatattgaaacaagcaggtgcgaatgtctgcgaagtgacagaaaaagaattgcgaaaagaatggggatcattggatttgaatgtggttgttgtggaagatattcatgccgctattgagcatattcgccaatatggtacgcaacattctgaaagtattttaacttcctcacaaaacctagcacgtcaatttatcaatcaagttgatgcggcagccgtttatgtgaatgcaagtacacgctttactgatggcggacaatttggattaggcgcagaagttgccgtgagtacccaaaaacttcatgctcgtggccctatggggttagaagcattaacaagttataaatgggtttgtgaaggcgaatacaccgttcgcaaataaaacccaaagtgcggtaatttttagaagagattatttgcatataaaaaagtccgcgaaatgcggactttttcattatctttatttgtcagatttacccaagttatcaaagaattttttcacaccgtctaaaaatcctgaagattttggtgcgtgtttacttaaatctttaccttgtaaactttcctcaagtttgtggagtaattctttttgttcgctggttaaattaacgggcgtttctaccacgatacggcaaattaaatcgcccgcataaccactacgtgtagaagcaacaccttttcctcgcatgcggaataattttcctgtttgcgtttcagcagggattttaagtttcactctgccatctaaggtcggcacttcaatttcaccgccaagggctgcagtagcaaagctaatcggtacttcacagtaaagattagagccatcacgttcaaaaatattatgttctctcacgtgaatcacaacatataaatctccagctggtgcgccattttcgcctgctgcacctttaccagctaagcgaagttggttgcccgtatctacgcctgcaggaatttttactgaaagattttctttcttatgaactcgtccttctccatgacaactgcgacaaggtttttcaattttcttaccgctaccgtgacaagttggacaaatactttcagatacgaagaaaccttgctgacgacgaattcgaccagaaccgtggcaatgcggacaagtttccactttagaacctttttcagccccagagccaccacagctatcacaatgtgcaagagtattgatttgaatatctttggttgtaccttttacggcttcttctaggctaatttctaagtcataacgtaagtcttcgccacgaacaacgcgctgacgaccacgtccaccaccgaaaatatcgccaaaaatatcaccgaacatatcaccaaaatcagcaccgccaaagccgccaccgaagccaccagtgccaccaccttgttcaaaggctgcgtggccatattgatcgtaggctgcgcgtttttgatcgtcgcctaatacttcataagcttcattaatttctttgaatttttcttctgcttctttactgccttggtttttatcgggatgatgtttagacgctaaacgtttatacgcacgtttgatgtcgtcctcactcgcccctttttgtaggccaaggacttcgtagtaatctttttttgccatagtaattttgtaatttgttgctgaaaataaatacaccaaaagggcgtgtttccacgccctttgtttatgctaagaagagcggtgaattatttattatctttcacttcttcaaattcagcatctaccacgccatcatcttttgctgatgattgttgtggttgctcgccaccagcttgttgagcttttgcttgcactgcttgcattaatggttcagaggctttaattaccgcttcaatttttgcttcaatttctgctttatcttcgccttttgctgctgtttcaagctcagcgactgcagcttcaattttctctttgtctgcgacactcaatgcatcgccagcttctgcaatttgtttacgtgttgcgtgagcaataccatctgcttggttacgagcttgaacaacttcttcaaatttacggtctgcatcagcatttgcttctgcatcacgcaccatttgttgaatttcttcatcagataaaccagatgatgcttgaatacgaatttgttgctctttacccgtatttttatcttttgctgatacgttgattacgccgtttgcatcgatatcaaatgttacttcaatttgtggcataccacgcggtgcaggattaataccttctagattgaattgacctaaagatttattgtctgccgcacgtttacgttcaccttgaagaacgtgaatagttaccgcactttggttatcttctgctgttgagaatacttgcgattttttagttggaatagtggtatttttctcaattaaagtggtcatcacaccgcccatggtttcgatacctaaagataatggagttacgtctaataaaagaacatctttcacatcaccttttaatacaccaccttgaactgccgcaccgattgccaccgcttcatcagggtttacatctttacgcgcttctttaccaaagaactcagcaactttttgttgtacaagtggcatacgagtttggccacccacaagaataatatcgtggatttcgcttacacctttatctgcatcttttaataccgctttcaaagactcaattgagcttgccactaaatcttctactaatgcttctaattttgcacgagtgatatttaatgctaagtgtttaggacctgtcgcatctgcagtgatgtacggaaggttcacttcagtagattgagctgatgaaagttcaatttttgctttctctgcagcttctttcacacgttgtaatgccattgcatcattacgtaaatcgatattttgttcttttttgaactcatcaataatgtaatcaattacacggttatcaaagtcttcaccacctaagtgagtgttaccaccggttgccaatacttcgaaagtttgttcgccatcaaagttatcaatttcgatgattgaaatatcaaatgtaccaccacctaagtcataaacagcgatcacttggttctctttgcttgaacctaaaccaaacgctaacgcagccgctgttggttcattaatgatacgtttaacatctaaacctgcgattttacctgcatcaatcgttgcttgacgttgtgcgtcgttgaagtatgcaggcacagtaattactgcttcagttacagattcacccaagaaatcttctgcagtttttttcatttttttcaacacttctgctgaaatttgcggtggggctaatttatcacctttcacgtttacccaagcatcgccattgtcggcacgagtaatttcgaaaggcataattttaatatcgcgttgaacttcttcactttcaaaacgacgaccaattaaacgtttaatcgcaaacaatgtattttttgggttagtgattgcttgacgttttgctggctgaccaactaaggtttcattatctgtatatgcaatgattgacggagtagtacgtgccccttctgcattttcaattacgcgcgctttatcgccgtccattacagctacacaagagtttgttgtacctaagtcaataccaataatttttcccattttgtactcctagtaaaaattttaaaattcggggtagggcttttagacctatttattacgaattgtaagatgtggatattctttcgcatttcaagagaaaattttaaaaattttttatttcttaaagtgcggtaatttccgttcttgtttttcaaaataagtctcaaatgatgaagttcaaagggaaaacaaaaattttcaggcaagaaaaagggatttgtgataaatttggcgaaaatttttactttaaaataggaaagaaataaatgaaaaaatcaaaaattgctgcaggcgtagtcatttctcttgctgccgtttggtgtgcaggtgcatggtttacagggaaaaaagctgaagaagaatatttacatcaactaaaacagttaaatcaactatttaccaaaactgaggcattagaagaaagtaaaattttttataaaaatataaaatttgaaagaggattatttgcctctcacattcaagatcaaatagaaattcacaaggcaaatgaaacgatcattattcctttatcatcaacactttatcacgggcctttgccgcttgatcgtgtggcaaaactgaatttcgttccagccattttttcaagccaaacattgttaggaaaaaatgcaacaactcaggcattctttgatatcacagaatcagagaaaccgttacaactgaatttcgcaatgaattattcattaagcggtaatgcggaattaaaacttgcatcggggcaatatcacaatgagcaatctaagacagattttgattggtcaaatgtcgtattaaatattgatttaaaccaaaatacaccaaataactatgtgctatctgtcgatacatttaattcaaatgcccctaatcatgcagtttcaaccgcttcatcaattaaaataaaagatcttgtcgtacaaggctcgttgcaaagcacaaaatggccatttatttatagtgggaatatcaatagtaaaataggctattttgagcaaaataccgaatctccagagactggcgaaaaattctctcttattcagaaaaatagccaagcaaatttaactacacaagttgagggtgatacagtaaatatcatcaataaaacgaatctggatgaattacatattaacggtaacaacttaggtaaagtgaccaacaatgtagaattcaaccatattgatggcaacgcattacaagaacttttaaatattttagttgcaataggcaaagccgactcagatatgcctttatctaaaacattggtgcaaaaattacaacaagcaggcatgatcattgcgaataatcagcctcaaattaaatttacccctctttctatttctgatgaaaaaggcaaagtggcattggatctaaatattgctttagtgccaaatcctaaatttgatttaatgcgcagtggcttatacaaacaattcaaagatttttcaatcaattttgatgtgaacaaagaaactgcgatttcattgttatctaaatttgtaccagaaaaccaaaagcaagatttcgttcaccgattgaatgaattagttaccgaaggtgaagtgaatgacattatcgtaaacacggacaaaaccgtaacattaacgcttgctctagaaaataacgacttgaaactaaacggcaagccaatcccagaagaacagttgaaagtggtactctttatacttgtaatggggggatttgggagataactgaaacagggcgataaattgtcgccctgttttgtatttaattaaaagtatcgtagggtgggcttcagcccaccgtttttattctattttttatggttaattggtgggctaaagcccaccctacaactataaagtgcggtaaattttcgttgcagtttaagctaaccgctcttttaaatacccttcataatctggtacgtcaatttccacatcttgttcaaataaaactgaagttaaaagaaaatctgcagagctttgattaatcgcaacagggatattccacactgttgcaatacgcataagggctttcacatcaggatcatgtggtgcagcattcattggatcccaaaagaagatcatcatgtcgattttcttttctgcgattaatccaccaagttgttggtcacctcccatcggaccacttaataaagattgaatgcttaaacctgtttctcgttctaaaatatgccctgttgtacctgttgcataaagtatatgaggcttaagtgcctctttgtgtttttgcgtccaattcagtaaattttttttacaactatcgtgagccacaagtgcaatacgtttgtgttgagtgagggttcgagttgttgtctgcattgctgagtcctttttgaaaaaaatctgaaaaaactttaaaacaaagcccgatggaatgcaatattttactggttattttagcgaacaaaaaaacacaaaaaaattaccgcactttcaaataattatttatggcaaagctgatttgatatgatgatttgatgaaaattcactatctttatctcaaaaaatcttctaaaatttacaagatttgttaaatgtttgtgaaaagcaaatattgccgtattcgtgtttagccttgtctaaactaatattcactcaaaacagattaaggaaaacctatgtctgagattttaaaaaatgacattgatccaatcgaaacacaagattggttgcaatcattagattcattaattcgtgaagagggcgttgagcgtgctcaatatattgttgagcaagttattggtcaagcacgtacaagtggtgtttcattgccaacaggagttaccactgattacgtgaatactattcctgtggctgagcaacctgcttatccaggtgatcacgccatcgaacgtcgtattcgttcagcagtacgttggaatgcgatcgcgatggttttacgcagtcagaagaaagatcttgatttaggtgggcatatttccactttccaatctgcagcaacaatgtatgaagtttgctacaaccacttttttaaagctgcaacagagaaaaatggcggcgatttaattttcttccaaggccatgcagcaccaggtatgtatgcgcgtgctttcttagaaggtcgtttaactgaagaacaaatggataacttccgtcaagaagcctttaccgacggtttatcttcatatccacaccctaaattaatgcctgaattctggcaattctctacggtttctatgggtttaggccctgtgaatgccatctaccaagcgcgtttcttaaaatatctcgataaccgtggtttaaaagataccaaagatcaaaaagtttatgcattcttaggcgatggcgagatggatgaaattgagtctaaaggtgcattaacttttgcggctcgtgagaagttagataacttaatcttcactatcagctgtaacttacaacgtttagatggccctgtgaatggtaatggtaaaatcgttcaagaattagaagggctatttactggtgctggctgggaagtgattaaagttttatggggcagcgattgggataaattattcgcgaaagatacttcaggtaaattaactcagttaatgatggaagtcgttgatggagactatttaacctttaaatctaaagatggtgcatatattcgcgaacacttcttcggtcgttatccagaaactgctgcattagttgctgatatgaccgatgatgaaatctgggcattacgccgtggtgcacatgatagcgaaaaattatatgcagcctatgcaaaagcacaaaatgcaacgaaaccagttgtgattttagcgcatcaagttaaaggttataaaattcctgaagcggaaagtaaaaataccgctcaccaatctaaaaaaatgtcttacgaaagccttaaaggtttccgtgacttctttgaattaccattaaccgatgaacaagtagaaaaattagaatacattaaatttgctgaaggcacacctgagtatgaatacttacatggtcaccgtaaagcattaaacggttatgttcccgctcgtcgtactaaatttgatgttgaatataaagttcctgcattagaagagtttaaagcattattagaagaacaacctcgtggtatttcaaccactatggcgtttactcgtgcattaaacatcttattaaaagataaaaacatcggtaaaactatcgttccaatgattgcggatgaagcacgtactttcggtatggaaggtttattccgtcaagttggtatttataacccacatggtcaaaactatgtaccttcagaccgtgatttagtggcttactatcgtgaagcaaaagatggtcaagtattacaagaaggtatcaatgaattaggtgcaaccgcatcttggttagcagcagcgaactcgtactctgtcaataaccaaccgatgattccattctttatctattactcaatgttcggtttccaacgtgtgggcgatatgatgtgggctgcaggcgaccaattagctcgtggctttatggtagggggtacttctggtcgtacaaccttaaatggcgaaggtttacaacacgaagacggtcacagccatattcaagcgggcgttattcctaattgcgttacttacgatccatcatttgcatttgaagttgctgttattatgcaagacggtatcaaccgtatgtacggcgaaaaacaagaagatgtattctattatatgactacattaaatgaagtgatggatcaacctgcaatgcctgctggtgcggaagaaggtatccgtaaaggtttatataaatttgaaacagtggaaggtaaaaaaggcaaaggtcacgttcaattattaggttctggtgcgattatgcgtcacgttcgtgaagcggcacaaattcttgcaaatgactacggtgtgacttcagatgtattttctgcgccttcattcaatgaattagcacgcgaaggtcatgatgcagcacgttggaacttattacacccaacagagacacaacgcgtaccatacgttgctcaagtattagctgatttaccaaccgttgcttcaactgactatgtgaaaggttatgctgatcaaatccgtgcatttgtaccaagtaagcactatcatgtattaggtacagacggtttcggtcgttcagatagccgtgcaaacttacgtgaacacttcgaagttgatgcacgttatgttgtggttgctgcactttctcaattagcgaaagaaggtacagtatctaaccaagtggttgcagatgcgattgcgaaattcggtttgaatgtagatcgtatcaatccgctttatgcgtaattgatgaaaactgcggtcaaaaaacattgtgttttatgaccgcactttaaaaggaacaaaaaatgtcaaaacaaattcaaattcctgatattggtagtgatgaagttaccgtaacagaagtgatggtaaacgtaggcgataccatttctgttgatcaatctatcattaacgttgaaggcgataaagcttcaatggaagtgcctgcaccagaagcgggtgttgtaaaagaaattttagtgaaagtgggcgataaagtttcaactggtactccaatgcttgtattagaagcggcaggtgctgctccagcagctgatgagcctactgctccagtagctgatgcgcctactgcaccagtggttgctaccgcaccaacggcttcagctattgtagaagtaaatgtgccagatattggtggcgatgaagtcaatgtaaccgaaattatggttgcagttggcgatacaatcactgaagaacaatctttaattagcgttgaaggcgataaagcctcaatggaagttcctgcaccattcggcggtgtggtaaaagaaattttagtgaaatcaggcgataaagtttcaactggttcattaattatgcgttttgaagtactaggtgcagctccagcagcatcagcatcagcttcaacatcagcaccacagacagcagctcctgctactactgcacaagcaccacaggcagcagctcctgctactactgcacaagcaccacaggcagcagctcctgatactactgcacaagcagctcaatcaaataacaacgtatctggattaagccaagaacaagtagaagcaagtacaggatatgcacacgcaacaccagttattcgtcgtttagctcgtgaatttggtgtaaatctagataaagtaaaaggtactggtcgtaaaggtcgtatcgttaaagaagatattgaagcttatgtgaagaccgcagttaaagcttatgaaagcggtgcaacagcacaagctactggcaatggtgtagcaaatggtgctggattaggcttattgccatggccaaaagttgatttcagtaaatttggcgaaattgaagaagttgaattaagtcgtatcaacaaaatttcaggtgctaacttacatcgtaactgggtaataattccacacgttactcacttcgataaagcagatatcacggatttagaagcattccgtaaagaacaaaatgcgttagcagaaaaacaaaaactcggcgtaaaaatcacgccagttgtgttcattatgaaagcggtggcaaaagcattagaagcgtatccacgtttcaatagctcaattaccgaagatgctcaacgcttaatcctgaaaaaatatattaacatcggtgtcgcagtagatacgccgaatggcttagtcgtgcctgtattcaaaaatgtgaacaagaaaggcattatcgaactttcacgtgaattaatggaagtatcgaaaaaagcacgtgaaggcaaattgactgcatctgatatgcaaggtggctgtttcaccatttcaagtcttggtggtattggtacaacgcactttgcgccaatcgtaaatgcgccagaagtagctatccttggtgtgtctaaatcatcaatggagccagtatggaacggtaaagaatttgcgccacgcttaattcttccaatgtcattatcattcgaccaccgtgtcattgatggtgcagatggagctcgtttcattagctatcttggctctgttttagcagatttacgtcgcttagtaatgtaatctgtaggtgggctttaagcccaccgattaatgaaatctttggtgggcagaaacccatcctataaagaccgtaaaagtgcggtcaatatttttaacgtttttacgaggtaaaaatgagtaaagaaattaaaacccaagtcgttgtacttggtgcaggtcctgccggttattcagccgcattccgttgtgcggatttaggattagaaactgttattgttgagcgttattcaaccttaggtggggtgtgtttaaacgtaggttgtattccatctaaagcgttattacacgttgcaaaagtaattgaagaagcaaagcacgctaataaaaatggtatttattttagtgaaccacgcattgagctagatgaagtacgtgcaggtaaagaagctgttgttgctaaattaactggcggtttagcaggaatggcaaaagcacgtaaagtgactgttgttgaaggtttagcgacttttaccgattctcacacattagttgcgcgtgatcgcgatggaaacccaacgactgttaaattcgacaatgccattattgcggcaggttctcgtccagttcaattaccctttatcccacacgaagatcctcgtatttgggattcaacagatgcacttaaattaaaagaagtaccgaaaaaactacttattatgggcggtggtatcatcggtttagaaatgggtactgtatacaatgctttaggttctgaagttgaagttgttgaaatgttcgaccaagtgattcccgcagcagataaagatgttgttggtatttacactaaacaagttgagaaaaaattcaagttaatgcttgaaaccaaagtgactgcagttgaagcaaaagatgatggtatctacgtttcaatggaaggcaaagcctgtaatgacaccaaacgttatgatgcagtacttgtcgctatcggtcgtgtgccaaatggtaaattgattgatgcaggtaaagcaggcgttgaagtagatgatcgtggttttattcacgttgataaacaaatgcgtaccaacgtgccacatatctacgcaattggggatattgtaggtcagccaatgttagcacataaaggtgttcacgaaggtcacgttgccgcagaagtcattgcaggacaaaaacactacttcgatcctaaagtaattccatcaatcgcttataccgaaccagaagtggcgtgggtaggtaaaactgagaaagaatgtaaacaagaaggcttaaactacgaagtggctaaattcccttgggctgcatcaggccgcgcgattgcatctgaatgttcagaaggtatgacgaagttaatctttgataaagatacgcatcgtatactgggcggtgcaatcgtaggttctaatggtggggaattattaggcgaaattggtttggcaattgaaatgggttgtgatgcagaagatatcgcattaactatccacgcacacccaacgttacatgagtctgttggcttagctgcggaagtatttgaaggctcaattactgaccttccaaatgcaaaagcgaagaaaaaataattcttattgaagaatttttaattctgcttagattaaaaattccagcctaaataaaaatccccaattggggatttttattttcctctctttctatttttttatgatagaatgccaatctaaaaacgtttcttttttttaccgcacttttgagcattatttatgactacacaacttgatttaatcaaatcttctatcaaatcaattcctaattatccaaaagaaggcattatcttccgcgacattacgacccttttagaagttccagcagcttttaaagcaacaatagatcttattgtggaacaatatcgcgataaaggaattaccaaagtgcttggaactgaatctcgtggttttatttttggtgcccccgttgccttagcactaggtttacctttcgaattagtacgtaaacctaaaaaattaccacgtgagactatttctcaatcttatcaattagaatatggtcaagatactttggaaatgcacgttgatgcaatttcagaaggtgacaatgttttaattattgatgatttattagcaactggtggcacagttgaagcgacagtaaaattagtgcaacgtttaggtggagcggtaaaacacgctgcatttgtgattaatttacctgaattaggtggcgaaaaacgcttaaataatttgggcgttgattgctatacactcgtcaattttgaaggtcattaattaaggattcgatgagctatcaagtcttagccagaaagtggcgaccaaaaacatttgctgatgtcgttgggcaagaacatattatcacggcattagcaaatggattaaaagataatcgactacatcacgcttacctcttttcaggcacgcgtggtgtaggaaaaacctctattgctagattattcgcgaaaggattaaattgtgttcacggtgtaacggcaacgccttgtggcgaatgtgaaaattgtaaaactattgagcaaggcaattttattgatttaattgaaattgatgcggcgtctcgcacaaaagttgaagacacgcgtgaattattggataacgtgcaatataaaccagttgtgggcagatttaaggtttacttaatcgatgaagtccatatgctatctcgtcattcatttaatgcgttgctcaaaactttagaagaaccgcccgaatatgtaaaatttttactcgcaacaacagatccacaaaaactacctgtaactattctttctcgctgtttacaatttcatcttaaagcattagatgaaactcaaatctcccagcatcttgcccatattttgacgcaagaaaatattccttttgaagagcctgcattagttaaacttgcaaaagcggcgcaaggaagtattcgtgatagtttaagtttaacggatcaagccattgcaatgggcgaccgacaagttacgaataatgttgtaagcaatatgttagggttgcttgatgataactattctgttgatattttatacgccttacaccaaggcaatggcgaactcttaatgcgaacactgcaaagagttgcagatgcggcaggcgattgggacaaattacttggcgaatgtgcagaaaaattacatcaaattgcactcatgcaacttcttccacaaaaatcttcagatgacaatgaacatttttcatttttagccaaacatatctctccagaagatgttcagtttttttatcaagtgattgtttctggtagaaaagatttatcaaatgcgccaaatcgtcgtattggagcagaaatgacattattgagggcattggcattccacccaaagttccttacggcagtaccaaagactaacactacaattactccaccgccatcaacgccaagtgcggttgaaaatactggtaattatgtagatgtgccagtactgtcgcaaagtataaaatcagcttattctcaagcaaaaccaaataaaacgagcattccaaatttggcaagcctttccgctttagatgcgctggaacatttaacacaactcgaaaaccaagaacgtcaagaacacaaagctgaatcattagctgtagtaagtgaaactttacatcacatccaagaactggatgaagaaaaatctcataaaaaaatgaccgcacttcccgtgcgagaaatgactgaaccaaagcccaagcacatagaaaaaccaacatcaccaccaaatgccgcacaagctccacaagaaaatagcacagaagaaaattcaagtgatgataatgcagaagttgctcaagatgaacaagaaatcttgagtgctgacacctatcgttgggaatggagcaatccagaacttgctaaagccgatacaggcgttcgtccttctgatataaaacaggcgattttaaaagatattacgcctgaattacgtttaaaaatcatcacccaaactcaacaacaagatgagtgggcagatatagttgaacgttctggcgtaacaggatttagcaaagaattagcgttaaattgtttcttacaaagcaaaaccgatgatgaaatcaatcttggactacattcagaaaaatctcatttacgccaagacagaagtataaaaaatttggttgaagctttaagtaaattgcaaggtaaagatattcgattaacaatcaatcttgatgatagcaatgtcgcgacgccaattgaatatcgccgtaatatttatcaagcattgcgggaaaaagctcaaaatgaattgcaaaaagatagcaaactacaaatgttgcttaatgaattcgatgcaaaattagatgtagagagtattcgaccagtttaaaaatattgtgttttcccctcaagatttccctgccaaatttataaaaccatcagaatatttttattaagctctaccattttgtatgtttttaatctaaaattcgtcaatttgttttttaagagccaaaaggagagtgaaaatgaaactagttgaagtaaaacacccacttgtaaaacacaaactaggtgtgatgcgtgaagctgagattgatacaaaaaaattccgtgaactggcaacagaaattggtagcctattaacctatgaagcaacctctgatttagaaactgaaaaagtaacgatcaacagttggaatggccctgtagaaattgatcgaattaaaggtaaaaaagtaacggttgtgccaattttacgtgctggtttaggtatgatggatggtgtacttgaacatgtaccaagcgcgcgtatcagtgtagtgggaatctaccgtaatgaagaaacccttaagccagtcccttattttcaaaaattagctagcgatttagaagaacgtcttgcaattgttgtcgatccaatgcttgcaacaggcggttctatgattgccaccctcgatcttttaaaagcaaaaggttgtaaacatatcaaagtattagtgttagtggctgcaccagaaggaattaaggctcttgaggctgcgcaccctgacattgaactctactgcgcttctattgatagccatttaaatgaacaaggttacattattccgggtcttggtgacgcgggcgataaaatttttgggacaaaataatccccaaaacaagacggcatttaagccgtcttttttccgtgcgtgaaacacaagaaaaactgaccgcacttttaagttaattcaaacagagagttgaaactaaatgacaaaccaaacttcttcttttccttcggaaaatcaaagcaaattaaaacaatctttcgttggcctacaaatgctcttcgtcgcatttggtgcgcttgttcttgtaccattaattacaggacttgattccaatacggcattattaacagcaggcgttggcactctacttttccaattttgtacaggcaaacaagtgcctattttcttggcatcatcttttgcctttatcgcgcccattcaatatggtgttcaaacttggggtattgcgactacgatgggcggtttagcgtttactgggcttgtttatttcgccttgagtacgttagtaaaattacggggagcagaagcactacaacgttttttcccaccagtggttgttgggccagtaattattatcattggcatggggcttgcacctattgcggtggatatgtcattaggtaaaaacagtaactatgcttataacgacgcagtattagtttcaatggtaacgcttcttaccactttatctgtggctgtatttgccaaaggattgatgaaacttattccaataatgttcggtattaccgtaggctatattttgtgtttgtttctgggtttaattaatttccaaccagttattgatgcaccttggttcagtttgcccaaattaacgacacctgaatttaacctagaagctattctttatatgttaccaattgctattgcccctgccgtagaacacgttggtggtattatggcgattagctctgtgacaggtaaagattttctaaaaaaaccaggattacaccgcactttattaggcgatggcgtcgctactgctgcagcttctttagtgggcggtccgcctaatacgacttatgcggaagttactggtgctgtgatgctaacacgcaactttaacccaaatattatgacttgggctgctgtttgggctattgcgatttcattctgtggaaaagtaggcgcattcctatcaaccattccaacgattgtaatgggtggaattatgatgcttgttttcggttcaatcgcagtcgtgggcattagcaccttaattcgtggcaaagttgatgttaccgaagcgcgtaatctatgtattatttctgttgtaatgacatttggtatcggcaatatgtttgtagatgtgggtaacgtatcactaaaaggtatcagcttatgtgcgattgttgctatcatcttaaaccttgttttaccgaaagcaaaaaatgaagtagaataatcctcatttcaaagggttaaattatcatttagccctttcttacttaatctgtactacataaacatttgaataaacagcttcccttacccattcatcaaattaatgatgccacattagaaaacttttacggcgataataatcttttattgcttgattctttacgcaaaaattcatctgatttaaaacaaccgtttttctacatttggggagataaaggctctggtaaaacccatttacttagagcattcagtaacgaatatttaatcaatcaacgtactgctatttatgtaccccttagcaaatctcaatatttttctaccgcagttcttgaaaatttagaacagcaagaattggtatgcttagatgatttacaaagcgtcataggaaatgatgaatgggaattagctatttttgatctattcaatcgaattaaagcaagcggaaaaacgctgttactaattagtgcagataaatcgccttccgcactttctgtaaaattacctgatttaaactctcgcttgacttggggcgaaatttatcaattaaattcattaacagatgaacaaaaagtcgaagtactacagcatacagcttaccaacgaggattccaattatctgacgaaactgcaaattttttaattacacgactagcacgagatatgcatactttatttgaagcacttgatctactagataaagcatcattgcaagcacaacgaaatctcacaattcctttcgtcaaagaaattttaaatctataacaaaaaaggcactaatgtgcctttttaatcatccacctgataatttaactttaaaccctttttgctctaataattgcttgagcaaatctcgtttttccccttgaattcaataataccatttttaactgatccgccacatccacaacgtttctttaattctgcagctaattttttcaaatcctcgtcagataaatctaaaccagttataaccgatacgccagcacctttcctaccacttgtttgtttttggatacgtacaacaccgtctccttttgggcgaactacagaagccttttcctctttaattcgccccacatctgtagaatacactaaaacaaaatctgacatttatgattacccaatagatacattaatagaacggagaacctccgcaggattatccgcttgagttatagggcgtccaataactaaataatctgaacctgcacgaattgctgcagtaggcgtcatcacacgtcgttgatcaccaaaatcagttcctattggacgaatccccggtgtaactaatttaaactctttaccacaagtattacgtaaaatttcaacttcttgaggggaacagactacaccatctaaacccgcccgttgggttaaatgagctaagcgtaaaacttgttccattggcgatgcattaatcccaatttgtaataaatccaaatcttccatactggttaataccgtcacggcaataagcaatggtgcatctttcccataaggttcaagaattttcttcgcctcttccatcatacgcaaaccaccacttgcgtgtaaatccaccatccatacgcctaaatcagcagcagaacgaactgctcttgctaccgtatttggaatatcgtgatatttaagatccaaaaaaacatcaaagttacgttgatgtaattgttttacaaaattaataccaagtgtagtaaacatttctttacccacttttaatcgacacaaacttggatcaatttgatcaactaaagcaagagcctctgcttctttctcataatccaatgccacaataattttgcttgtcataatgttacctcactgagtatcaattaattatgttcttgatttgaaaccggtttaatactttcccattgacggcaagatgggcaattccacaatagcttatgaatttgataaccacaatttgtacaacgataaggcgatgtttgcttaatcctttcgccaaccattttatgtaataaaattaagctttcttttccccgcccgtcttctgcatcatcaatttgatactgcataaaacgatggaaaattaaagtacttggattttttgtaagttgttgataaagcttagcttgcgcagcagacttaccatctttttcttcaattaatttgactagagctagttctacttcatcattattaataatttgacctgcacgaattaaaaataactcaaaattatctaactgatttaattcttcataacaatgttttaaaggtgacaaaatttcacccgtataatctggattttgctccaaaacattttctaaaatttctactgcttgttgatattgaccatcaagcattgctaaatttgcaagcaataaagaagcgcgaacacaagtcggagaaaccgacaaagccttttgtaaaacactgcgtttttcaaccgcactttcaggttctaaactttgtgaatattcacaataacattgcgcaagttcaatattattctcttgtggctttattttagcgagtttttcagcaatattgactgcttttttccattcttttgttttttgataaatcactaaaagttgctgtaaagcattttctgcaaattcaggttcatctactagtaaaatataaagattctcagctcggtcaaaaaaaccaaccaccataaaatctcgagcaagctgttgttttgcaagtaatttttgttcaaaagtataattaggactaagatctaaagcttgatgaatacgcaatgcacgatcaacttcgcctcgagaacgaaacagattaccaagtgtaagctcggcttcaaattgggagtggctttcgatttcattttcgatttcttgcttttgcaacatatctaaaaacaaatctacagctttatcagtttgattagaaagtaaaaaattcactcccgtaacataatctcgggagagtttattacttatgtcatcttgatctttcttcgcactacgccgccccatataccagccataggcagcagcaataggcaataatagaaagagtaattctatcattaagcgaccttatcgcgcgtagtcgtcaattcattgatttgtaaagtctgacgtttcacttgacgagctagtgccatattttttaattttaacttaatatagaaaaaagcagtaattaaccaaccaagaattaaacctaacccaaataaaattgcaacgaggcttgaaagctgaaactgactttctgccacaatataattaaatgtaataatctgatcgttattcgcaccaatggtaattgcaactaacacaatcgcaataaagatcacaatgcctaaaatatatttaatcatttcatttcctttaaaatatttgtaacccaaaataaactttttaatcaaaaatattttaattaaattttaatcaattaagcctgaacatccactctagcttttaattctttacccgctttaaaatatggaacagacttagctgataagtttactgaatcgcctgttttcggatttcttcccaaacgtggttgccgatgatgtaaagaaaagctaccaaaacctcgaacttcaacacgatcaccattttcaagagattgagaaataaactctaaaatatcttttaccatattttcaatttcttttgcagataaagttggctgttttgctgacaatttttccataagttctgacttagtcatcctctatacttccttaatattatttaaattaagatctattgataataaattacacaaatatattagcaataactcctaacaaataaggctggacatcagcccagccttattacgtgaattaattattcacctttagctgctttaaatgcttcagccattgcatttggaataacaatatcttcttgtttgttatttacacttgcaactgccgcagcttcttcagcttgatcttttgctttcactgataagtgaacaatgcgagatttacgatctactccagtgtatttcgcttcaaccacatcgccaatagctacttcacttgttaaatcagcagaacggatataaccttcaacaccacctgctaattcaactttagcacctttagcatctgcttcaacaacagttgcagatactaccgcaccttttttgttgattgcaacaaagttattgaatggatcttcttcaagttgtttaatacctaaagagatacgttcttttactgcatcaacagctaatacaacagctgacacttcgtcaccttttttgtattgacgaacagcttcttcgcctgaaatactccaagaaatatcagataagtgaactaaaccatcgataccaccttcaagaccgatgaagataccgaaatcagtgatagacttgattttacccgttactttatcgcctttgttgtgagtatcagcaaattgagtccaagggttagctttacattgttttaagcctaaagaaatacgacgacgttcttcatcaatttctaataccattacttctacagtatcgcctaagctaaccactttagatgggtggatatttttattagtccaatccatttcagaaacgtgaactaaaccttcaacgccatctaagatttcaacgaaacagccatagtcagttaagttagttactttacctgttaatttgctgtttactggatgattttcagcaattgcagcccaaggatcttgacctaattgttttaagcctaaagatacgcgagtacgatctttatcgaattttaatactttaacagttacttcatcgccaacatttacgatttcacttgggtgtttaacacgtttccaagccatatctgtgatgtgtaataaaccatcaacaccaccaagatcaacgaatgcaccgtactcagttaagtttttaacgatacctttaacttctgaaccttcaacaagattttctaatacttgttcacgttcttggctgttttcagattcaattactgcacgacgagaaacaacaacgttgttacgtttttgatctaatttgattactttgaattctaattctttaccaagtaagtgatctgcttcacgcgctggacgagtatcaactaaagaacctggtaagaatgcacgaacaccgtttaactcaactgtgaagccacctttcactttgccgttgattaaaccgataacggtcgctttttcttcgtaagctttttctaattcaatccaagattcgtgacgaacagctttctcacgagaaagtttagtttcgccgaaaccatcttcaactgcatctaaagcaacatttacagtatcgccaacttggatttcaagttcgccttgtgcatttaaaaattcagcaactggaattgcagactcagattttaaacctgcatcaacaagcacaaagcctttttggatagctactacagtaccgctaacgattgaaccttgacgagtttcaaggccttttaatgattcttcaaaaagttgagcaaaagattctgacatataaataatcttcttaatttaagttaataacatccacattaaaatccataaaatgcggggttgaggataaatgcttattcttccttgaacaaacagttaaatctaaactgataccttttcttgaatataagacaacgcctgatcgatcacttcattgatactcaaggctgtgctatccaataataaagcatcatccgctggttttagcggcgcaacttcacgatttctatcacgaagatcacgctcttttatctcggctaaaatctgtgcaaagttaccatttattcctttattttgcaactgtttatagcgtctttttgcacgttcttcagcacttgcatctaaaaataattttacttgtgcatttgggaatacaactgttcccatatctctaccatccgcaattaatccatcatttttcgcaaaatcttgctgaagttgtaataaagctgaccgcactttttgaaaaactgctacttttgacgcagcatctgccacttcttgcgtgcgaattaaacggctcacatccattcctgcaagcaaaatgtttacctcgccattttgaggaataaattgaatatctaaatgacgtgctaattctgctaaatctgtttcatttgttagatcagttttacgttgcaacgctgccaatgcagtaacgcgataaatcgccccactatccaacagtgcatagcccaacttttcagccaacgcgtaacaaagcgtccctttcccagcaccactaggcccatcaacagtaataatcattcccatacaaattatcctttcattatcaaaattttgcgcattatagagacaatttcccctcattaccatcctagagattattactagcttccatgttttgtatggcttatctaataaagttaatttcacaagctctaggaaagcgtaaactccctttcaagctttttcttaaatttcagaaaatctaaccacatagaaaaaggtttttaaaaacatttcaaggtttttttaataactattgtggcacttaaggacgaaattctttcagctaaagtagctcttttttctattattaaattggacaatccttctgacgttctacacttcgtttatacaaaaaactgaaattaagcacactagacattatgccttttaatatatacgcattttttcaaacttgttctaaagacttttctacattacaataaaaaacgtagctatcaatacaaataaccaaataatgaggacaaagaaatggctgaaaatcgttatgaactaaataaaaacttagcacagatgctcaaaggtggtgttatcatggatgttcaaaaccctgaacaagctcgcattgcagaagctgctggtgcagctgcagtgatggctttggaacgaattcctgcagatattcgtgctgttggaggtgtctctcgaatgagcgatcctaagatgatcaaggaaatccaaggagcagttagcattccagttatggcaaaagttagaattggacatttcgttgaggctcagattttggaagctattgaaattgactatatcgatgagagtgaagtgctttctccagctgacaaccgtttccatgtggacaagaaagaattccaagtaccttttgtatgtggtgccaaggatttgggcgaggccttgcgtcgtatcgctgaaggggcttcaatgattcgtacaaaaggagaaccaggaacaggagatatcgtccaagctgttcgccatatgcgcatgatgagtcaagaaattcgtcgcattcaaaatttacgtgaggacgagctctatgttgcggccaaagatttacaagttcctgtagaattggttcaatacgtccataagcatgggaaattaccagttgtcaacttcgcagctggaggaattgcaactccagcagatgcggccttgatgatgcaacttggcgcagagggtgtctttgttggttcaggtatttttaagtcaggagatcctataaaacgtgctagcgctattgtcaaagctgtaactaactatcgaaatccacaaatcctagcacaaatctccgaagatttaggtgaagccatggttggtatcaatgaaaatgaaatccaaattctcatggctgagcgaggaaaataaatgaaaatcggaatattagctctacaaggtgcctttgcggaacatgcacgaatgctagaaaaattaggaattgaaagtgtcgaactgagaaatttaaaaaattttcaacaacattacagtgatttatcaggtttgattctacctggcggtgagtccaccgccataggaaaacttttaagagagctgtatatgctggaaccgataaaacaagctatctcttctggctttcctgtctttggaacttgtgctggtttgattctgttggctaaagagattacttctcagaaagagagtcattttggaacaatggacattgtggttgagaggaatgcctatggacgccaattgggaagtttctatacagaagcagattgcaaaggggttggtaaaattcctatgacttttatcagaggacctatcatcagtagtgttggtaaaaaagtcaatattcttgcaacggtaaataataaaatcgttgcagcccaagaaaagaatatgctggtaacatcatttcatcctgaattaacaaataacttgagtttgcataagtactttatcgatatatgtaaagtagcataaaccattatctgcatatctgccctccctaggaaacaaaccatattgtagcaatgagagcagataattttcatcaaaaaaccgaacagttactagacttaaaaccgaatgcaaggtaggataaggttgaacaaaaacaaaatttcttgttgtattgacgagagcaaacgccacttcgtaattgggctttccccaaaacgaaccaaaatcaacaatcctaaagacattacacaccattgagtatttacaaggtttcaatgcggactgaatcatctatgaaagcaccgacggcttggatcttacgattgccaaaatattatatcaagcagcctttttcgtgctcattgccaatccacgacaaatcaatcactttacaatgtcacatttagtaaccaacaattactgtacaagtgtagactggaataagtcaaataattttgcggtaaacatcagataatttgctgaccttattttgatgagttggctctatctaagaagaggaaataataaacaagcggtcacatttgacatcttgtttgcattttagaggtttattccgcccagtattttttcctcgtcgttttaccaatacctggattaaagctattggttggatccaactctttatagaattttctcaaggttggtttagcctcgtataaatgccctacattgtgttcggctgggtattgcgcaccacgcttgtcaagtaatttcaacatttcgtattctagttcttcataatcataacctttttttacaatgtaatcttggtgaaagacatggcacataaaatgtccgtagtaaagtttagagataattctgttatcaatttctggcggtaacacttcaaaccaatcttgatcattgcgacgtaatgcaacatctaaagcaactatttcttctacttctttttcgtgaattgcacgataacgaattgcagcacttgcaacagcgaaacgatgaagcattgctgcttgggtttcgattgcattacattcaaaatagccaccttttgagccatctgcaatgtaggattccaaatattcacgggcttcttgaatgccttttccacccattttgataattaagtgatgctcgtatttgttgcgataatcccataagctttgtggaagatgttctgggatgaatttagacacagtttgcataagtttatcgcttaaatgttgtggtaaaaagaagaattttttgccgatgcgatccacgtttgattttaaggaaaagagttttggtagccaatgtgtaccaaactttttaatgacccaaaaggtatctttgccatattttgctgcgatgtcaaatgcatcacgatggatatattcacctgaaatgggtagcacttcgaagtttactaacatgtggcgacgaatatcgctcaacacagaagtttgattggtgccgatatagaaaacagccgtctctttttcaagcggaaaggtgtctaaacgaaccgcaaagacagcaagttttcctgcacagcctgaggcttcatagtggcgagctgggtcggcattaaaacgagcaggggagccttcatcaacttgacgaacatagttgcagtagtaatggtcgtgaccatgtccgcaatcttgtcgaatatctttaacctgataacgtttttcttgtagattagttaaaatttcttcaggagtttctcctaaatcaatgcctaaatgattttttagttctaattcacctttttcattaagttgagcgtaaagtgccatttctgtataggctggtccacgttgaactaatgctccacctgagttgttacaaatcccaccaataactgatgcgccaatgcaagatgagccaataacagagtggggttcacgaccaaacggtttaagttgattttctaattcattgagtgtagagcctggtaagcaaataacttgggaagcgttattgatgagtttgattccgtcaattcgcattgtattgatgacgacaatatcgcgatcataatcattgccatctggtgtagagccaccagttaaacctgtattcgccgcttggtttataacaataacatcatgttcaacgcaaacttttacaatgttccaaaactcaagtagagtggcagggcgaacaacagctagggcgtttcctgttccaaatcgataaccacttcgataagcttctgttttagttggatcagtaataatataacgagatccaacaatatcggtcagtcgtgaaatgagttgttgaacagacattttattatcctcttgttataagaattagtagtactataacagaataattcccatttggataaggacattttaggctttaatcggtgtttttttggaattgctctgcatataaagaaaattctctctttatgataggttcagtgctgtatgggtatttcaatcactcaatatcagcaatgcaaaatccgttgaaacctttaaagataaagaaaaatattatttaacaaacgaaacttttactgaaatacaacctattgatatgccaaacgaacgtaatattcaaaattatcactcgacttacaacaacattcgggattggcttggttatcaaaaagctggcgaggaaaaagcaaagtcgaccatcaattaggaattgggatgaggtagtttttgaagtgaattttaagcacaataaaaaaacatcagaatttttagccgcactttctaaagtatccgctaatttacataaatgatttaaccctacctatgctgctactcttttaattttatgaacagtattttctgtttctttcatattatcttttgataattgagtaagataattaggcatggtttgtttgaataaagataaattttttaaaatttacattccgaccaaggttggcaatatcagatgatagattatcaacacatactcagggagaatggcattcaaagtatgtgaagggaaattgtttagataacagtagaatggaaagcttctttagatgttttaataactggaaaaaaagctccatgagcgtattcagaagaggctaaagactgagtcctgtaaatgacagaactcagtccttgagctaaataagtctaactttttggggtcagatcatttatcaataaactgatcaaaaaaaccgaacttaatgttcggttttcttcttcattacataatacgacgcgattgagtgtaggttctagcccaatatttttcatcaagggaacttattgtcacgccttgccctgtacttgcgtgcataaattggttattaccaatataaacaccaacgtgattatttttacggaagaaaactaaatcgccttttttaagttctgatttattaatttttctacctaaatgacgctgttcagccgtagaacgaggcaattcaataccaaaaacttcagaaaaagtagtttgcataaatgctgaacaatcaataccacgtttagtcgtaccgcccatacgatagcgagtgccaacccattcattataaacactggctagagccttatcgcccatcaaagcagaggaacggtttgttctcactttgtgaaaaatgcctgttcgattatctttttctaaattattaattaaaccagttaattgaatatcatcattttctgaaataacctgatgacttaccgttcgtggtgcattagaacaagcggttgctaatacagctaaaccaataataactaaaattcttttcaacataatttcaaataattaaaagaaataaaatttcgcagcggctatcaaaatttgaataaaattgccagtaaaaatccaattctaatggaatttttgtgatcttttacacaatgacttaatttgttccaccaacagtaatttcatcaatttttagtgctggctgtcctacgccaacaggtacactttgcccctctttaccacaaaccccgatacctaaatcaagttctgatttatctgcaaccatagaaatcttttgcatcacttcaatgccactgccaattaaagttgcgcccttaactggtttcgtgatttttcctttttcaattaaataggcttctgaagtagaaaatacaaatttaccagaggtaatatccacttgccctccaccaaagtgcggtgcataaatcccctgttttacagaagcaatcaaatcatcaaactgactttgtccagcaagcatataggtgttggtcattctaggcattggtaaatgggcataagactcacgtcgtccatttcccgttggagcaacgcccatcaaacgggcattcattttatcttgcatgtaaccttgcaaaatcccgtctttgatgagtacattgcactggcttggcacaccttcatcatcaatagttagtgaacctcgacgattttcaatcgtgccatcatccacaatcgtacataacggtgaagtcacttgctcaccaatcttgcctgtaaaaagtgaactttctttacggttaaaatcgccttctaaaccgtgacctaccgcttcgtgtagcaatacgcccggccaacccgcacctaacacaacaggcatcaatcctgcgggtgctgcaactgcactaaggtttactaaggcttgacgaaccgcttctttagcaaaaagtactgctctaatatcgccatcaacaacttcaaagaaccaatctaaaccgaaacgcccaccagaaccacaacttcctcgttcacgttttccattttcctctactaacacagaaatagataagcgaactaaaggacgaatatctgcggctaatgtgccatctgtcgccataattaatacttcttcataaacagaactgaggcttgctgaaaccttggttacacgatgatcttctgcgcgtgctgtacgatcaaccaaatgtaatagctcaatttttttctctttagtcaaactttccaaaggattaatcgccgcataacgagcaataggatttacaacattaaaagcggatagcgaaatcaaattcccctgtttgacttgcgcaattccctttaccgcctccgcacattgctgcaaagaagcaagattaatttgatccgcataagcaaaccccgttttctcaccagaaacagcccgcacaccaacgccacgatcaatatgaaaaccgccttcttttataatgccgtcttctaatacccaactttcatcttggctaagttgaaaatacagatcggcataatcaatattgcgatgcgacataatgtcaaaaatattgagtaatgtttgagttgaaagattacttggtgtcagtaatgtatttgaaacttggtttaacatattttttccagtctaaagtaaatatcttgtgagtgcttgtatccgtttaatacaacagcacagattaaaatcggattaataaagtgcggttgattttgaggttatttttccaaatgcgctaatccaaattgatacaaagcattcttcttataaccatacaactcagcaactatagctgctgcttttttaagtggcaattcttctgcaattaactcaagtgcctttaccgcttgcggcgaaatttcatcgttattgtcagactttggtttgccttccacaatcaaaaccatctcgccttttgtacgattgggatcttctaaaagccattcgcgtaaatttttaatcgtattccctgtaatcgtttcccaagttttagtcatttcacgggctaacacaatatagcgtccttcccctagcaccgcttgcatatcttctagtgtatctaaaatacggtgagtggattcataaaaaatcaaagtgcggtcttcttctgcgatattttctaatttatctttgcgtgctttacttttcgcaggtaaaaagccttcaaaacaaaatctatcagaagcaatccccgatgcacaaagagcggtaattgccgcacaagctcctggcaaaggcacaactcgaatgccagcttcacggcattggcgtactaaatgaaaaccagggtcactgattaatggcgtccccgcatcagaaatcaaggcaatattactcccctgcttgagcttttccaccaaaatatgcgctttttcttgttcgttatgatcgtgcaaagcaaaaaatggcttcttaatgccgtaatggatcaataaaagtccactatggcgagtatcttctgctgcaattaaatccacttgagcaaaagtctctaaagcacgttgggtaatatcttgtaaattgccaatgggcgtggcaacaatgtataaaattccggttaaatcagtcatttttgtttgcttttaagttatgagataagtaagatttgctacaactattgtctgtttatgatggagcaaagatgtctattctattacaaggcgaacgttttaaaaaacgtttaatgccaattttattgtcaatggctttagctggctgttcaaatctacttggtagcaatttcacgcaaaccttacaaaaagatgcaaatgcaagttctgaattttatataaacaaattagggcaaacgcaagaacttgaagatcaacaaacctataaattgctcgcggctcgagtgttaatccgtgaaaataaggttgaacaatcggcagcgttattgagggaattaggcgaattaaatgatgcgcaaaaattagatcgtgcattaattgaagcgagaatttctgccgcaaaaaatgccaatgaagtcgcacaaaatcaattacgtgcattggatttaaataaactaagcccgtcacaaaaatctcgttattacgaaaccttagctattgttgccgaaaaccgtaaagacatgattgaagcggtaaaagcgcggatagaaatggataagaatttaacagatgtacaacgtcgtcaagataatattgataaaacttgggctttattgcgttcagcgaatactggcgttattaataatgcctctgatgaaggtaatgcagctttaggcggttggctaacattaatcaaagcctacaacgattatattcgtcagcctgtacaattaagccaagccttacaaagttggaaaaatgcttatccaaatcatgcagccgcaacgttgtacccaaaagaattgcttacattgcttaatttccaacaaacgaatgtgtcacaaattggtttactcttgccattaagtggagatggacaaattcttggtacaaccattcaatcgggttttaacgacgcgaaaggtaactcaaccattccagtgcaagtgtttgatacctcaatgaattctgtccaagatatcattgcgcaagcaaaacaagcggggattaaaaccttagtcggcccattactaaaacaaaatcttgatgtgattttagcggatcctgctcaaattcaaggtatggatgtgcttgcattaaatgccacaccacattctcgtgcgattcctcaactttgttattacggactttctccagaagatgaagctgaatctgccgccaataaaatgtggaacgatggcgtgcgtaatccacttgtcgcaatgccgcaaaatgatttaggacaacgcgtaggcaatgcctttaatgtacgttggcagcaattagcaggtactgatgcgaatatccgttactacaatttgcctgcggatgtgacctatttcgttcaagaaaataactcaaatacaaccgcactttatgccgtagcaagtccaactgaactggcagaaatgaaaggttatttaacaaatatcgtacctaatttagcgatttatgccagttctcgagcaagcgcaagtgcgacaaacactaataccgacttcatcgcacagatgaacggtgtacagtttagtgatattccattttttaaagataccaattctccacaatatcagaagttagcaaaatccacggggggtgaatatcaattgatgcgtttatatgcaatgggtgcagatgcgtggttgctcattaatcaatttaatgaattacgccaagtgccaggctatcgcttgagtggcttaacagggattttaagtgctgataccaactgtaatgttgaacgcgatatgacttggtatcaatatcaagatggtgcaattgtaccagttgcaaactaatgttttctttaaaacgtcagcaaggggcgagctttgagcatcaagctcgcctttttttagaatcaaaaggcttaacatttattgcggctaatcaaaatttcaaatgtggtgaacttgatctaataatgaatgacaaagaaactatcgtctttgttgaagttcgccaacgaagtcattccgcctatggttctgctatagaaagcgtagattggcgaaaacaacaaaaatggttagatgccgcaaatttatggcttgcaaaacaaaatatgagcttagaagatgctaattgccgctttgatttaatcgcttttggcaaaacacctcaagatattcaatggattcctaattttctcgattaatggctttttataatgttacaaaaagtaaaagatatttatagcgaaagtattcaaattcaaattgcagcatctagcatgctttctgaaaatattaccaatgccacacaaatggtaatgcaatgtttattaggcggtaataaggttatcgcctgtggcgtgtcgcgttcttatgccaatgcacagtttctcgtctcaaacttacttaatcgatatgatttagttagaccaagcttcccgtctgtgttattgagcttagaaagtgcagtgggttcttcacttgtttttgaacaaccgcctgaagaattgtattgtcatcaatttaatgccattgcaaaatcgggcgacttacttattgcttttgcacctttggggacagaaaaaatcgtgctaaatattatttctcatgctgtcagcaaagaagttaatgttattgtgctaactggctctaacaacgatgccattcaaggaattttagcagataaggatctagaaatatcaatcccagccaccaaagaaagtcgtatcttagagaaccatctttttgtgattaatgcactttgtgaattggttgatcagactttattcccaagtgcttgacaggaaaataaatcactttcaaactaatagtaatttaatctaaaaaggagttaattatgacattatccccgttaaaaaaactcgctatcctgcttggagcgactatttttctacaaggctgtgttgcagctgtgattggaggtggtgctgtagcagctaaagtagctaccgatccccgaacgacagggacacaaattgatgatgaaaccctcgaatttaaagtagaaaatgctgtagaaaaagatgcccaaattaaggctgaaggtcgtgtaaatgcagtgtcttacaatggccgagtacttttaataggtcaagttcctaatagtgatgtaaaagacactgccacagctcttgcaaagggtgttgaaggtgtcaatgaagtttataatgaactaactgttagcccaaaaatctcttttgcacaaatcagtaaagatagttggctcacaacgcaagtcaaatctaagatgttcgttgatggtcgagttaaagccacagatgtcaaagtgattagtgaaaatggagaagtatttttactgggtaacgtcacacaatctcaagccaatgcggcagccgacattgccagcaaaatcagcggcgtgaaaaaagtaattaaagtattcaaatacctagactaatccttcaaagtgcggtgaaaaattcaacaaatttttaccgcactttttcttatttttctaaataaaaaattttaatttttattctcacaaaaaccgtttatttttaaataagttatctattgtcaagaatcaaatcaaaaaatttattacttgcgatcttttctcaaacacattatcttgtgcatcgttttcataaaaacactatatcttgtgttttaaatcctgttttaaataacaacaagaaggctaatacaatgaataaaagtttaatggttacaaagcgtgacggtacgcaagaacaaatcaatcttgataaaatccatcgtgtgattacgtgggctgctgaaggactagacaatgtttctgtttctcaagtagaacttcgttcacatattcaattttatgaaggcattcgcacttcagacatccacgaaaccattattaaagcagccgcagatttaatcagcaaagattcgccagattatcaatatttagctgctcgtttagcgattttccatttacgtaaaaaagcctatggtcatttcgatccccctcgtttatacgatcacgtcaaaaaactagtacgtatggaaaaatatgatcaagcgttattagatgattatactcgtgaagaatgggacacaatggacggcttcatcgatcattggcgtgatatgacgttttcttatgctgcagtgaagcaattggagggtaaatatttagtacaaaaccgtgtgacgggagaaatctacgagtctgcacaattcttatatttgctggtttccgcaagtctattctctaaatatccaaaagaaacacgtttggattatgtaaaacgtttctacgatgccacatcgactttcaaaatttccttacctacaccaattatggcgggcgtgcgtacaccaactcgtcagttcagctcttgcgtattaattgaatgtgatgacagtttagattcaatcaatgcaacagcatcagctattgtaaaatatgtttcacaacgtgcagggattggtattaatgcaggggctattcgtgcattaggtagcgaaattcgtggtggagaagcattccatacaggttgtattccattctataaatatttccaaactgcagttaaatcttgctcacaaggtggcgttcgtggcggtgcagcaacactttattacccaatttggcacttagaagcagaaaacttgctcgtattaaaaaataaccgtggtgtagaagacaaccgtgttcgtcatatggattatggcgtccagttaaacaaattaatgtatcaacgtttaattaaaggtggcgagattactttatttagtccatcagatgtacctggactttatgaagcattctttgcggatcaagataaatttgaagaactttacgtaaaatacgaacaagatccaactatccgtaagcgtactgttaaagcagttgaaatcttttctttattaatgcaagaacgggcatcaacgggtcgaatttacattcaaaacgtggatcactgtaatacccactctccgtttgatccacaagttgcaccagttcgtcaatctaacttatgcttagaaattgcattaccaactaaaccgcttcagcacattaacgatgaaaatggggaaattgcactttgtacactttccgcttttaacttaggtaaaattgaaaacttagatgaattagaagaacttgcggatcttgcagtgcgttcacttgatgccttattagactatcaagattaccctgttgtggcagcaaaacgtagctcacttgcacgccgttcactcggtattggggtcattaactatgcgtattaccttgcgaaaaatggtgttcgctattctgatggttcagccaacgatttaacacaccgcacttttgaagccattcaatattatttattgaaagcctctatgaacttagcaaaagagcaaggtgcgtgtgaatacttcaatgaaaccacttatgcaaaaggcattttaccgattgatacctataagaaagatttagattccttaacacaagagcctctacattatgattgggaaagtttacgtaaagatattcaagaatttggtttacgtaactcaacattaactgccttaatgccatcagaaacatcatcgcagatttccaatgcgactaatggtattgagccaccgcgtggacacgtaagtattaaagcatcaaaagatggtatcttaaaacaagttgtacctgaatatgaaaatttaatggataactatgaattactttgggatattccaagtaatgacggctacttacacttagtcggtattatgcaaaaattcgtggatcaagcgatctctgcaaacacaaactatgatccaaaacgttttgaagacggcaaagtaccaatgaaagtgttgttaaaagatttattaaccgcttacaaatacggtttaaaaaccctttactatcaaaatacccgcgacggtgccgaagatgttcaagaagatcttgatgacggctgtgctggtggtgcttgcaaaatttaaacgcccctattgtcttccccaacttatggggaagatagcacgacataacgaattaggatactttcctcagtctttgatagtttcccctgataaacagggaaagctaaataaatgataagttctatttaaaggataaataaaatggcatacactactttttcccaaaataaaaacgatcaattaaaagaaccgatgttctttggtcaaaacgttaatgttgcgcgttacgatcaacaaaaatacgagacttttgagaagctgattgaaaaacaactttcttttttctggcgtccagaagaagtagatgtatcgcaagaccgtatcgactacgcagcattgcctgaacacgaaaaacacatcttcatcagcaacttaaaatatcaaaccttattggattctattcaaggtcgtagcccgaacgtggcattattgcctttagtgtcgattcctgaattagaaacttggattgaaacttggacattctctgaaaccatccactctcgctcttacacacatattattcgtaatattgtgaacgatccttctatcgtatttgatgacatcgtaactaacgaagaaatcatcaaacgtgcacaagatatttcatcttactacgatgatttaatccgtgatagccaactttatggcttatacggcgaaggcacttataccgtagatggcaaagaatgcgtcgtaactttacgtagtttgaaaaaacaactttacctttgcctaatgagcgtgaatgcacttgaagcaattcgtttctacgtttctttcgcttgttcatttgcttttgctgaacgtcgtttaatggaagggaatgcaaaaattattaaatttatcgcacgtgatgaagccttgcatttaacaggtacacagcatattttaaatattatggctgcaggtcaagacgatcctgaaatggcagaaattgcggaagaatgtaaacaagaagcctatgatttatttgttgcagcggcagaacaagaaaaagcttgggctgattatctatttaaagacggttctatgatcggcctcaacagagatattttagttcaatacgtagaatatattactaatatccgtatgcaagctgttggattgccactaccattccaaacacgttcaaatccaattccttggattaacgcttggttagtgtcagataacgtacaggttgcaccacaagaagtagaagtaagctcttatcttgtaggtcaaattgactcaaaagttgatacgaatgattttgacgatttttctctctaattaaaaacacataaaaaactaaccgcactttggaatattctttttaaatatttaaagtgcggttaattttttattcattttaaaaggctttctaacacagaaagccttttatttcttagatttctaataacaatcttgttggatcttccaataattctttaatcgttaccaagaaaccaacagattcacggccgtcaattaaacgatgatcgtaagataaagcaaggtacatcataggatgaatcacaacttgaccattaagcgcaatcgggcgttctttaatagcgtgcattcctaaaatcgcactttgtggtggattgataattggagtggacataagagaaccgaacacgccaccatttgtaatagtaaaattgccgccagtaagatcttctactgttaatttgccatcacgacctttttcagctaatgctttaatttgtttttcgatctctgccatactgagcttatcgcaatcacgaagcactggtgtgactaatccacgtggtgttgaaactgcaatactaatatcaaaatagttatggtaaacaacatcatccccatcaatagaagcattcacttcaggataacgttttaatgcttccacaaccgctttaatataaaaagacataaagcctaaacggacaccatactgtttttcaaatttttcgccgtaggttttacgcaaagtcattatcggctgcatatccacttcattgaaagtagtaagcattgctgtactatttttggcttcaagtaaacgttcagcaatacgtttacgcaaacgggtcattggcacacgtttttcagaacgtgcgctataagccaccgtactaattgtattttgctcagtggcagcttcttgtttcacttgctgtgcttgtcgttttgcaatttcacgttcaatatcttcacgtgttaaacgaccacccacacccgaaccttgaatttgatctgcttgtaaatcatgttctgctaataaacgacgaattgcagggctctgatccgcattatgattatgactattttcaatcgctgcattttgacgatcagatggtgtgggttcattcgttgcttttaacgtcgctgaactgacatctccttcttgagccgtagaaattttgcctagcaactgtttactcaccactgtttcgccctcagcttgaacaacttcagccagtacaccatcagaaagtgcgggaacttctagcacgactttatccgtttcaatttccacaataacctcatcacgtttcacagtatcgcccagttttttatgccaagtggcaacagttgcatctgcaactgattcaggtaggtctggaacaagaatttcgattgtcattttatttttccttttcttcttttttactatatcttaattatcttggctcccctatttacagaggaaagcaaagataaaaacctttattaaattaaccgcactttaaaaactcaacgcatcttccactaactgtttttgctgtttagtgtgaagcgacatataacccacagcaggcgaagcagaagctggacgccctgcatatttgagtttaacggattctggaattgctgattcaaaattatgtttgctgcaataccaagccccttggttaagtggttcttcttggcaccatacataatccgtgacatgcgcataaggctcaagcgctttcttcacatcctcatgcgggaatggataaagctgctcaatacgaataatcgctacatctttctgattatttgcacgacgttgttcaagtacatcgtaataaactttacctgaacacattaccacacgttttacatctttaggatcaagctcatcaatttctccgattaccgtttggaaagttccattaatcaactcgtctaaactggacactgccaatggatgacgtagtaaagattttggggaaatggcaatcaatggacggcgcattttacgtaaagactggcggcgcaacatatggtacacctgtgcaggtgttgatggcacgcaaacttgcatattttgttctgcgcaaagttgcaaataacgttcaagacgtgcggaagaatgttcagggccttgtccctcatagccatgaggcaataacataactaaaccacacattctgccccatttttgttcgccagagctaataaattggtcgataacaatttgcgcaccattagcaaaatcgccaaattgcgcttcccaaatggttaaagtttttggatctgttgttgcgtagccatattcaaaagcaagaacagattcttcagaaagtaccgaatcccatacttcaaaacgaccttgattggcgtgtaaatgtgttaatggtacataccccgtaccatcattttgattatgcacaacggcatgacgatggaaaaaagtacctcgtcccgcatcttcgcctgataaacgaacattaacaccttcatcaagtaaggttgcataagccatggtttcagccataccccagtcgagcaatttttcgccttgatacattgctttacgatcattatagattttttctacacgagggtgcgcacgtaaactttctggatattcacatacacgtttagcaagcgttaaaaaacgttcctgtgaaaatttgctttcatacggtgcagtccaatcataattgagatattgcaaccaatccatttttgccgtatccatttctcgccattcagataccacgcgatcgccattatctagcgcatcgcgataatcattcgccatctcggtaacttgttcttcagtcatcacgccttctgaaactaagcgatctgcataaactttacgcggtgtaggatgttttttgatgatgctatacatcattggttgagtggctaatggttcatctgcctcgttatggccatggcgacgataagaaattaaatcaataaaaatatctcgtttgaataaattacgatattccaccgccatacgcgcagtaaatgccaccgcttcaggatcatcgccattaacatgaataatcggtgcttgaatcattttcgcaatatcggtgcaatattctgtagagcgcgtgtcattcggattagatgtcgtaaaaccaatttggttattaatcacgatgcgaatagtaccgcccacactgtaaccacgggcatttgacatattcaatgtttcttgaacaaccccctgtcctgccacagctgaatctccgtgaacagtaatagcaagcactttgctatgttctgtatcattcatacgagtttgtcgagatcgaacagaaccaatcacaacagggcttacgatttccaaatgagatggattaaatgccaacgttaagtggactctcttatcatctacggcaaaatcagaagaaaaaccttgatgatatttcacatcccccgtacgttcgctggaatgtttacctgcaaattcatcgaataaattttcaggctttttacctaatacattcacgagcatattcaaacgcccacggtgtgccattcccattaccacatcatttaccccttgacgactagaatggcgaataatttctttcatcaatggaataaacgcatcacttccttctaaagaaaagcgtttcgccccagggaatttcgcaccaagataacgttctaaaccgtctgcagctgtcagttcacgaagaaaattgacacgttcttcagatgtaaaaagcggtttatctaacaggctttccatcttgctctggagccacattttctgctccatatcctgcacgtgcataaactccaagccaattgagccacaatatgtttctttcaacatttgagctaattcgccaagtttaatggtatcgcgtttataaacgtaatgatttatattgaaagtttcgttgagatcttgttcagtaaaaccgtgatggcgataatctaattcagggacagaagatactttccaacgataataattgagaggatcaagattagcctctaaatggccacgaaaacgataggcattgataaattgtagaactttcactaattttgcaccagcagcaggatctatcactgtcaccgcttcattatgattttctcgcgctaaacgacgaaaataatctcgcactggagtatggggctgttcaagtgcggtggtttttggcaaagaatcaaaggtttttcgccagctttcctccaccgactgtggatcactcaaatagctttcataaagttcttctatataggattgatttgcaccgcctaatgctgtgctggctaaccaatcatcaaatgccttgttctgctgcataattacctctttattatgatatttgaagcaatattttcgctccattttttacgcattatacataggattgcaacggaaataagcctcttatcagaaattgttacaaatttgtgatctagttcaaactctttagatttcaaacaataaaaaaccgcacttcatctcttaaacaaagtgcggttatttttacttgtattaaaatttaggatttagaatttaaaaatggattgctccgcttttcttgcccaatggttgtgtaagatccgtgtccagcaataataataagatcgtcattcaatggtaatagttttgttcgaattgaagaaatcaatgtttcataatccccgcgagggaaatcggtacgaccaattccgccttgaaataatacatcgcctgtaaatgccacttttttctcgtgttcaataaaaccaatatgcccaggtgtatgccctggtaaatgtaaaatctcgaaattaaagccatctaattttaagatttcaccttcttgattaaaccaacgatcaggtaaaaaggcttcaatatttggcaagccaaaacgttgggcttgttcgggtaaactctcaaataaaaatttatctttttcattagaaccccaaatttcaacgccaaaatgttgttttaattgcattgcagcaccaacgtgatctaaatggccatgggtaatcaaaatcactttgagatttaaatccagttcttcaatacgttgaattaggcgttcggcttcgccacctgggtcaataattgcggcatttttgtcatcatcccaaatcaaagaacaattttgttgaaatgcggtaacagggataatttcaatattcatttttgctccttataattgataaaactgttgagtattcaaaagcatttgcttttgaacagaatgtaatggcaaagactttaattcagctagtttttgcaagactgccaataattgttcagaaatgcccgcacgttcaaatccttcgtgttgccaagggctatccgtttcaatcatcaagcgatttaagggtaaatgttgtgcgacatattgggttttatggttccataaaatatcaggggttaggcttgcaaaatagggggtagagaaaaatttctgaaaagatttttcatctgtcttaaaccagtgaaagtgagcccgttgaattttgtgtttctgcaataattcaagggcaatttctacatcgttatgtacaatatgcaaatttaacggtaaatcccattttttcgctatcagaataaatcgttccagtaattcaatgtaaggcacgtaatctaaattcggattttctcgtttagaataatgtggcaagcccacctcgccaatggcagaaatcgatgaataatgttcgtcaatccattgaaataattctttttgttcttctaaactaggtaattgctgttcaggatgaaaaccagctgcaatataaagtttctttgggtaagtctgttttaaattcagcagttttttggcactgttgagattagtactcaccgcaagcatacctataatctttgaatgagcaagtgtttgctgaatattctcatcagagagttggtctaaatgaagatggctgtcaaataacatatcttttccaatgaaaaaccgcacaaaagtgcggttaattttacatttgttttacacgcctttccaagttctcacaggacctgtatctacgtgaatgaaattactagttggataataacccacgccaccatttcgcagactttccgcagaagatttcactttaatcaaaggcacacccgcaatacgaaaatcaatggcttttcctttaatgtgataactatttttcgctacgccacgactttggcgacgacgcattgcattagtagcgaccgaacgataaccacaaattacttcaatttcagcatcgcgtaagcctaaattagtttggatattataaaatttatggaataaatttggatccattttatgcacttgatttgtccttttatcacgcattaaataatccaatttttttaacatcgcaggcgaaaaaccttttgctaaagaaaactcgccacttaatctttcgcccgtattaatgttgcggaaagttaaaatacgaggtttaggtgttgaaaccattgctaatacagaatttggtaaaatagatattcctaacgcaataccgcccagcgataaccattttcgtttattttgatccacataattcattatagctcccttattttattgaagatatttttttacgagatcccaatttatctcagcaagattaatctgacgatcataaccataaatatcaggtaaatttacaatatttccgttttcaatccacgcagtaacataatataaaaaaacaggattatccgagcgtatcggcgcagaagtggtttttttacttgctaatactgtattttttcgagtttctgtccaacctgcttcttttaataaaatacttgccaattgatcagatttttcaacacgcacacaaccagaacttaacgctcgatttttacgattaaacaatccgcgatttggcgtatcgtgtaaataaattgcatcagaacttggcatattaaatttataattacctaacgcactatcgccagccgcttgtcgaactcgataaggaaatttattaccaatagattcccaatcaatagaagcaggatcaacaacattgccttgattatctaaaattgaataattatgctccgtaatataatttggatcggctttcatttttggcaataaatcttcattaattaagcgaattggcgcattccaaggtggatttacaaccacattacttaatttgctatacattacaggtgtcctgcgcgaatctgtgccaacaattacccgagattctaaaattaaatcgccatcacgataatactgtaatttatagcttggaatattcacaaaaattccattatgaaaatcaggaatcacacgtaaacgctgtgcattcattgccaatttttgagcaatatttgattctttagaagtcggaataaacatcggcaatgattgaactgtttggcgatataaatgattttctcccgctaaactttgtatgaaatcaagaagttgattattttccaccgcacttaaccagcgttgaatatgatcattttcaggctgttgtgcttgatactgagcagatgaatacaaccaattagatgcttgagaacgaacattttgtgtgtaatataagtaatctaacaaaatatcacttaataacacatcataaaccaatccgccttgttgttctaccaatgccaatgtttctagtgaagttgccgacgattttgaaataccgcttgccaccattgccgcataatcacgtaacaattgacgagctgccgcattgtcagtccataacggggcatatttacgagaagcatataaacgcgcgagtaaaggcttaaattgtaacttatgatcgcctatttcgtgtgttagcgtcatattaagcaatgtttgtttttcttccgttaaacgttgctgatccgcataaatggcttcttcaagctcttttctttctgcgagtgacaaatgggaaagattaatgccgtacaatgatttagattggtcatttttgctcaaacctactaaaacacaacccgacatcatcatagataatgataaggcgaataatgataactttaaggtgcttttaaacactaccatttcctaaacctttattaaaatcaccgcacttgttgcttttctcaaacaaagtgcggtcaaaaccatttagtatttattttttactttccgtttttgcttcggataggccgtttgcttgattaattttctgatctgaattaaaaataacgaaatcagctgctattttttcagcttcttttaagaagaaatctggtgcttcgtaatctttcggcaaatcatcaatatctttcaatgctttcttaccctcacgtttaaaacgttcgttcaaatcttttaaacgtcttgcatcatctttatcattctctgctttacgcattttataattcaacgatagaaattttcgatctcggcgttcatttcgcactttcaattcttcattcaatgcaacaaattcaggatctttagcaatacgagcaagatgtttttcatttagaatatttactgcattatcaatataatcgatatttcctacttccgtataactcgctgatgggattttatcccaagcaagcgcattatcttctttatcttccccatattctttcgcatctataatttcagggaaattaatatcggctgcaacaccttttaattgggttgaaccaccattaacgcgataaaatttttgaatagtatattgcaaaacacccaacggactctgatctaaatcatagataaaatttaacgaacgactctgttgcaccgtacctttaccaaaagtattttgcccgatgataatacctcgacgataatcttgcattgctgcagcaaaaatttctgatgcggaagcactgtaacgattaatcatcacaaataataaccccttatattgttgcgtagcatcatcatcttcatgaacacgaatacgctgataagcatcgcgaacctgcacaacagggccatcggcaataaataaaccacttaacgccaccgcttccgttaatgcaccaccgccattttcacgtaaatcaacaataagagcctcagctttttgattttctaatttaaccagtagttttttgacatcttcggttaatccaatataaaaacttggaatttttattaccgcaatgttttttcctgacactttttcaaaggttagtttagcagcttgatcttcaatacggactttatcacgaaccaaagtaataatacgtgattttccccctttagcaggctcaatttctaagcgaactttagtgccttttttccctttaattttttctaccaaatcttctaaacgccaaccaacaacgtcttcaatatcgcctgttgcttgcccaacaccaatgattttatccccaggatgcagctttttactacgttccgctggcgcaccaggtacaagagatttgatgctaatttcatcatcttctgattgtaaagtagtcccaatgccttccaaagaaagatttatactttcattaaaactttttgctgttcttggggaaagataactggtgtgaggatcaatttcacgcgcaaaagcattcaaataaatttgaacaatatcgtctgcttttgtttgcgttaaacgacgaatggctaaattatagcgttttgtaagctttgctttgatttctgaccattttttatcttttaatttaagattaataatgtcattttttacacgagcatcccaaagtttattcgcatcagcttcagtttgtggcgcagccgctttttcacgatcaatttcaatttgatcttgaccatttaaatcaggctctttatctaataaagataacgcataagtataacgttcatagcgacgtttcatcattacatcataaatgtcaaacgccgcagaaagatcgccttgactcaactgttcatctaacttagtaccatatttttgacgaagttcgtctatatcagactgcaaaaaagtattgtggctaaaatctaaatttttaatataacgatcaaaaattttctcggaaaaatcatcatctaatttaatcttacgataatgggattgagttaatcttgtcgttgcacgcttagttgccaactggctttcttcacttatcgctggaatactaatgtcacttggttttaatgtaggttgtacagcaaatgcaggaattgcactgctcaaacacaccgataaccacgcataacaaatcacattttttgacattttaaatttcataaccatttccgagtcaatttttatttattaagcaaataaacgatctgcagcaacgttcataatcaaaccgttttcaagttcaacacgtgctgaatcttttaatacttctaccactgttgcttttttagcattatctccagctttaactttcacaacagaaccaacagaaatttgtgaaaaatcaaccgcacttagtgataatttactctcttttttaaggtttttattcgcaggtttacgcggatgctttttttgttgtgcttttttagctacagcttctgctttacgtttttccgcaaaacgcgctttcgcttcagcaagttgctgtgcagcgtgagcaacgtgttctgcatctaatacacccgcaggattaccctgtaaatcaacacgcactgcaccttcacgacagccatataaataacgccaatttgatgtgtattggcgaagagcctgacgcaattgggttttacttacgcgttcatcatcttgtaatgcttcagctaaatcttgaaataaacctatttttaatggttttgcttcgccctctaaaacaaagcaaagaggaaatttttctgctaaataagtaatgatagcttttgcgttggttaatttttgcacttccgtttgcacatctgtaacttgagatgataattgtgtgtcagtcatagttatatccttgaggctattaataaaataaagatttgcctagtttatcgcactttttacaaaattaacaacggatcccgttatgctgaataaatttcacacaaaaataacgccaagacttcacaaatacgttaaaacaacgatagaatggcacgtttttgatttataaagaaagaccacaagcgtgcctaaaacaaagctaacttcgcctccatttaaaattttaaaatgcacagaatgtgatgcttgcattaacgtgccttctattcttcaatcaaatgaacaagccgaatgcccacgttgtcatcatctattagaaagtagtacgaggtggtcattacatcgttgtgcaatgattgcattatctattttgatattaatgcccttttccttgaattaccccttattaagtttacatttattgggtattaaaattgatgcctctatttgggatggcatttggaaaatggcagtgggtggttatgaatacactgcgtttatgatctttatttgtgcagtagtaatgccgattacgtttgcacttttagtgattatgctttggctggctaagatttttcagataaaacctcgtagtgttttactatttcttggttacattaaagcttgggtaatgtttgatgtttatttagtggcactcggagtaaccatatttaaagtacgcgaatatgcaacattagaaattaatatttatttaattccttttatttttaccgcacttttaactacgttgctttttatcaaacttaatctttccgccttatggcaggaattttatcctgaatgcacttcagtttatacaaaacaagctgttgaattatgtcctgcttgccactacacctttacgcaaaaatctatctattacgatcatcaacaaaagatttgttgtccccgctgccaatcgcctcttaatacatcggataagctaaaattacaagcaacttgggcaaccttaattgcagggattattatgctttttcctgcaaatttattacctatatctggcatttatttaacaggcgcattatctgaagatactttaatttctggggttatttcatttgttaaatcaggtagttattttgttgcttttgttgtattttttgccagtattttcgtgcctatcagcaaaatttttattatgctttacttacttgcttgcgtgcattttaaatggcaacattctattaaatggcaaatgcgtttattgcatctagtacattttgttggacgctggtctatgcttgatttatttgtattagccttaatgatgtcgcttgtcacacgcggagaaatcattaattttaccgtagggccaggtgcattttattttggtgcagccgtattttgcactatgctttccacctcacaatttgatagcaaattaatttggaaaatttatgacagagaaaaataattcctcctcaatagaagaaaaatatcaagaaataacagcgaacttacgtaaaacaaaacgcatttcgcctttttggctattgccttttatcgcattatgtatcggggcaattttattcttccaaattgtgaaagaacgtggtactagcattacgattacctttaccaatggttcaggtatcgttgcggataaaactcaaattcgttatcaaggattacaaattggcatagtaaaagaagttcatttcactgataacctgcaaaaagtggaagttgttgccaatatcaatcctgaagcatcaagtattttgcgtgaaaatacaaaattttggcttgtgcaaccaaatgtttctcttgctggcatttcaggattagattctctcgtgtcaggtaattacatcactcttcaaccgggtgatggcgatcgtgaagatgaatttatagcagaagaacaaggccctattgcacaagtttccgcaggagatttattgattcacttaatttctgatgatttaggttcgatttctattggtgcgtctgtgtattttaaaaaattacctgtaggaaaaatctatgattaccgtattaataaaaacaataaagtagaaatagatgtggtcattgataaagcctatgccaagtttgtgaaaaaagattcacgcttttggaatgttagtggcattaacgcgaacattagcccatcaggcttaaacctaaatgtagaaagtttaaatgccgttgtacagggggcggtttcttttgactctccagctgacagcccaaaagcagatgaaaatagtcatttcacgctctataccaatttaaaagcggctaaacgtgggattgaaattaaggtaacaattcctgcctcatccgctcttattgcagggcaaacggaagtttattctcaagataatgctatagggattctcgccaagctaagtgcggtggaaaataacgatgaaattttagaaggcagtttattgatcgatccaaaccaagcctctttgtttaaagcaaatagtaaaattgtcctacgcaataaaaaaatggatctaggcaatttagcagaaccaaaaaaattctttcgtgacgaatattttgatgtgattgcgggagacggcgaaactaaacatcaatttaacgtgattaaagaaaatgaattattactcaatgcgcctaacacgttagttttaaccctcactgcgccagagaattacggcgtcagcgaagggcaaaatgtgttttataacaatatgataattgggcaaattgtttcacaaacaattgatgtaaatggcgtgcaatttaaagcagcaattgcctctgaataccgtaatttaattcacgaagatactcaatttgtggctgcaaccaatttcgatataagcattggattagatggattgcgttttgaatccgcgacaccagaaaaatggttacaaggtggtgttcgagtactaacaaaacaagctcagggaaaagctaaaaccagttatccactttatcaaaatattagcaatgcagaacacggtattacaggcgatattcttacgccaacaataaccttacatacccaaacattaccaagtattgataaaggttctctcgtactatatcgtcaatttgaagtaggaaaaattttaagtattaaacctaaaacgaatagctttgatgtagaaatttatatttatcctgcctatcaacatttattgacagataaaagccgtttttgggtagaaagtgcggcaaaaatagatgtcagtccaaaaggtattagtattcaagcaacgccacttgcacgttccttaaaaggggcgattagctttgataatggcggttcaggcaataatcgaacactttatgcaaatgaaagctatgcaaaatccatcgggtttgtcatcacgttaatcacagatgatgcaactaatcttagcaaaggaatgaatctgcgctatcttggcttagatgtggggcaaattgacagcattcatcttgatgcaaaagcgaaacgcatcactgcaaaagccctaataaatccaaattatatgaatataattgcaaaagaaggggctaattttacgataatctcgccacaaatttcggctggtggaatagataaccttgatagtttattacagccttatattgatattgaaattggtaatggaaacacaaaaacacaatttaatttagcacaaacggcaccacaacgtaataaatttagcaatggcacgccgtttattttagaaacgcgtgatgcgatgaatttaagtgaaggttcgccaattctttatcgaggtgtagaagttggcacagtgaagaaatttgaacttaatagtcttggtgatcgtgtgttagtgcatattgccattatgccgaaatatagccatcttgttcgacaaaacacagaattttggatcgcatcaggctacgactttagcttaggctggaaaggtgcggtatttaatacgggtagcgttcagcagttgctaaaaggtgggatttctttctccacaccagcagaaaaagaaattcaaccgcaagcgcagcccaacaaacgtttcttgcttcaaataaaccgccctgaagaagtgcaaacttggggaagtggtgcgttatcaaaataacataaatgaaaatatttaatctgcaccttaatgaattagggtgcaggtaagcgattaccatttttctaatgcttctttatcgctctctcttgcttcaatccaacgctcgccttgattggtttgttcttttttccagaacggagctttggattttaaaaaatccataatgaattcattggcgtgataagcatctccacgatgtgcggaacttacccccactaaaacaatttcatcgccagtttgtaaaagcccaacacgatgaattaccgatacacgttgaatatcccaacgcgctgtcgcttgtgcaacaatttcattcaacgctttttcagtcattgcgggataatgttctaaatacaaactagatactgcatcgcctaaattaagatcgcgtactttaccaacaaatataaccgttgcaccaaccgaatgttgttcagaaagccattgataaacggcattttgatcaaaaggctgttcttgtaccgaaatttgaatatccgtcatttagccccctgttactggtgggaaaaaggcaatttcatcgccattttttaccgcactttctaaaggcattaaggtttgattaattgccactaaaagtttacctttttccagtgccaatgcccacttatcgcctttttgagcaaggtgttcacgcaccgcttccgcagtggcaaaatcatcttctaattgaatggcatcaacgccaattaattcacgagtttgagcaaaaaataaaatatttaacatcttatttttcctccgcaataaaatggcctgattttccaccgcacttttctaacaggcgaacttgctcaatcacaatgtctttctgcacagctttacacatatcgtaaatggttaaggctgctacgcttgcggcagttagtgcttccatttctacgccagtttttccagttaatttgcaaagagattgaatacgaacttgattggtttcaagtaacggttctaaatttacttccactttggaaagtaacaacggatggcaaagcgggataagctcccaagtacgttttgcagcttgaatacccgcaatacgagccgtagcaaaaacatcgcctttgtgatgtttaccttccacgatcatagcaagggtttctttagacatggtaacgatggcttcagcatgggcttcacgaactgtctctgcctttgcagaaacatccaccatattggcttcgccttgagaattgatatgtgtaaatgtagtcataatataataaaagtgcggttaaaatattaaatgttttaaataagcgacaaaaggaagcagatgaatattaccattcatctcactttgctttttatccaccaatagaagctaaatgatttcttacaccagtatcgccgatatgcaaataatgatgttcacgtttgccttgcagtgcggcaaaaatacgtgcttgtaaaatagcttgctgttcgtgtgactgcaataaatcacgtaattcaatgccttcttcgccgaataaacaaagatgaagtttgcccttcgctgacactcttaaacgattgcaacttgcgcaaaaattcttttcataaggcataattaaaccaatttcgcccgcataatcaggatgtgtaaagactttagcagggccatccgtgtgggatttatgctgtaatgtccaaccatttttcagcaatttatccgctaagatttgtccagaaagatggtatctatcaaagaaactatccatttcgcccgtttgcatcaactcaataaagcgcatttgaattgggcgatgttttacccaagcaaggaattgctcaaactctttgtcattcagatttttcattaaaactgaattaactttgactttattgtaacccacttcaaatgcacgatcgataccacgcatcacgtcatcaaatttattgatacctgtaatttgatggaacattttcggatcaaggctatcaacactaacgttaatagacgtaatccctgcttgcttccaatcagccacatcttttgccatgcgatagccgtttgtcgtgacggctaattgacgaatgccatcaatgttagcaatgctttcggcaatagaaataaaatctttgcgtaaagtcggttcgccacccgttaaacggattttctctgtgcccatttcagcaaacgcttgagcaagatggataatttcttttaaggttaagaaacttggtttgttagcttcgggttgataaccatcaggtaaacaataggtacaacgaaaattacactgatcagtaatcgacagtcgtagatagtaatattgacgttggaaaggatcgactaagcgagactctcctacgttcttgataggaatggattgcattttacacctttctaaatatggagaggataaaccgtttccagcgtatccctgaataacacacggcgttattggcttgccaccgtatttcttctgaaacttaggctaaacaagctcggagttatgcgttaaatttgatttgtcgtcattctaaaagatttcacttcataaacacaatcaataatattgatgaaaatcagtattttcctaaattcttaaaaatcaattatataaaaaaatacataatgaatttaaagctggctcattagtgataattaatcctatttatattaataaccataaatttttagctgattattatgaggtatttttattgatttaaatcataatttaatcaataaataaatttctctacttttcataatcagaaaaatatcctaccatttttatcggatttatttttactaatcaatataggagtgatttatgtcttttgcccaacaaaaacttagcgaactcgctgtttcaattccaggtgcaactaaaatttttcgtgaatatgatttagatttttgctgcggaggttctgtattattagaagtcgcagcacaacaaaagaatcttaaccttgctgaaattgaaaaacgtttaactgatttacaacaaaataaagcagaaaataatgataaagattggacttcggcatcttatgcggagatgatcgatcacattattactcgttttcataatcgccaccgtgaacaactccctgaattaattacattggcggagaaagtagaaaatgtacatagtgatcgtgatgactgtcctatcggcgtaaccgcacagttagaaaaaatttatgctgaacttagccagcatttaatgaaagaagaacaaattttgttcccaatgatcaaaatgggaattatgctatggcctcaatgccaattcgtgtaatggaaatggaacacgatgaagcgggacaagatgtggaagtgatcaaatcacttactaacaattgcacgccacctgcagatgcttgtttcagttggaaagctttatatagcggtattaatgaatttattgatgatttaatgcaccatattcatttggaaaataatattttatttccacgtgtattaaacgaaaaataattcaatattcatcaaaaaataaccgcactttaatctattccgaaaaacaaactaaagtgcggtcatttctataaaaattttgagttggtcgataagccgagttctgtcgtggacaatcattcctctaggcaacaaattactctgccgctcaagcaacctacccgaactctggacgggccacccattgagttcctatttggtcttgctacgagtggagtttaccctgctgccaaccgttaccggaggcacggtgcgctcttaccgcaccctttcacccttaccgtttacacggcggtctgctctctgttgcactggtcgtcggctcacgccgcccggacgttatccggcactctgccctgtgtagctcggactttcctctcgtttacttgtcccactaggtcgtataaatacggttaagggcttcaataaaccagcgattgtctaaccaactcggcgcgtagtataggggcaatcactagtgcggtcaataaaatccccaatttttgaatattgcttcatcaatcttataaacaataatgcctaatttttcattcgtatttttttatgattccgctaaaataacgccaatttcaaccgcacttttaggaagaaaaatgaactatctaaaaattgcacaggattccctttcagtggaaagtaacgcacttttgcaactcagccagcgtttaggcgaggattttaatcaagtcatcgatcttattttagcctgcgaaggacgtttggtaatcggagggataggaaaatcgggtttaatcggcaaaaaaatggtggctacctttgcctctacgggtacaccaagtttctttttacatcctacagaagccttccacggcgatttaggtatgttaaaaccaattgatatcgtgatgttaatttcctatagcggtgaaaccgatgatgtcaataaactgattccaagtttaaaaaatttcggtaataaaattattgctgtgacgagtaacaaaaattccacgctcgcacgccatgcagattatgttctagatataactgttgagcgtgaagtgtgtccaaataatctcgcgccaacaacatccgcacttgtcacactggcacttggtgatgcactcgccgtatcgcttattacggcacgcaatttccaaccagctgactttgctaaattccatccaggtggcagtcttggtcgtcgtttattatgtaaagtgaaagatcaaatgcaaactcgcctaccaaccattttacccaataccaattttacagattgtctgaccgtgatgaatgaagggcgaatgggcgttgccttagtgatggaaaatgaacaacttaaaggcattatcactgatggcgatattcgccgcgcgcttacagccaatggtgcagaaacactgaataaaacagccaaagactttatgacaagttcaccaaaaactattcatcaagacgaatttttatcaaaagcagaagactttatgaaagcgaaaaaaattcactcgctagtggttgttaatgatgaaaatcacgtggtgggtttagtggaattttcaagctaaggaatcccaatgcaacaaaaattagaaaatattaaatttgtcattactgatgtagatggcgtgctcaccgatggacaacttcattatgacgccaatggcgaagccatcaaaagttttcacgtgcgcgatggtttaggcataaaaatgctgatggatgcaggtattcaagtggcagtgctttctggtcgcgactcccctattttacgtcgtcgcattgccgatcttggtattaaattattctttcttggcaaacttgaaaaagaaaccgcttgttttgatcttatgaaacaagcaggcgtcactgccgatcagaccgcttatattggcgatgatagtgtagatctccccgcctttgctgtttgtggtgcttcttttgcagtggctgatgcccctatttatgtgaaaaatactgttgatcatgtactttccaccaatggcggcaaaggggctttccgtgaaatgtccgatatgattttacaagcgcagggaaaatcctctgtgtttgataccgcccaaggtttcctaaaatcagtgaaaaatatggggcaataataactcattcgtcagtgttattgcttagtaaaacgaagtaaccgcaaatattgcctatttaaattaactgtttaaatatacaatgcaatagaaataaatcaagatttttgtgatgacaaacaacaattacaacagcttctttgcaatctatatgcaaatattttaaaaaaatagtataaatccgccatataaaatggtataatctttcatctttcatctttcatctttcatctttcatctttcatctttcatctttcatctttcatctttcatctttcatctttcatctttcatctttcatctttcatctttcatctttcacatgaaatgatgaaccgagggaagggagggaggggcaagaatgaagagggagctgaatgaacgcaaatgataaagtaatttaattgttcaactaaccttaggagaaaatatgaacaagatatatcgtctcaaattcagcaaacgcctgaatgctttggttgctgtgtctgaattgacacggggttgtgaccattccacagaaaaaggcagtgaaaaacctgttcgtacgaaagtacgccacttggcgttaaagccactttccgctatattgctatctttgggcatggcatccattccgcaatctgttttagcgagcggtttacagggaatgagcgtcgtacacggtacagcaaccatgcaagtagacggcaataaaaccactatccgtaatagcgtcaatgctatcatcaattggaaacaatttaacatcgaccaaaatgaaatggtgcagtttttacaagaaagcagcaactctgccgttttcaaccgtgttacatctgaccaaatctcccaattaaaagggattttagattctaacggacaagtctttttaatcaacccaaatggtatcacaataggtaaagacgcaattattaacactaatggctttacggcttctacgctagatatttctaacgaaaacatcaaagcgcgtaatttcacccttgagcaaaccaaggataaagcgctcgctgaaatcgtgaatcacggtttaattaccgttggtaaagacggtagcgtaaaccttattggcggcaaagtaaaaaatgagggtgtaattagcgtaaatggcggtagcatttctttacttgcagggcaaaaaatcaccatcagcgatataataaacccaaccattacttacagcattgccgcacctgaaaatgaagcaatcaatctaggtgatatctttgctaaaggtggtaatatcaatgtccgcgctgcaaacattcgaaaccaaggtaaactttctgccgattctgtaagcaaagataaaagcggcaacattgttctttccgctaaagagggcgaagcggaaattggcggcgtgatttccgctcaaaatcaacaagccaaaggcggtaagttgatgattacaggtgataaagtcacattaaaaacaggcgcagttatcgacctttcaggtaaagaagggggagagacctaccttggcggcgacgagcgcggcgaaggtaaaaacggcattcaattagcaaagaaaacctctttagaaaaaggctcaacaattaatgtatcaggcaaagaaaaaggcgggcgcgctattgtatggggcgatattgcgttaattgacggcaatattaatgctcaaggtaaagatatcgctaaaactggtggttttgtggaaacgtcggggcattatttatctattggtaatgatgcggctgttgaggcgaaagaatggttgttggatccggataatgttaccattagcaatggtaacgatgatcaatctcaattaaaggacgatagaggcgattcacctaataaaattctagcagataataaacatactgttaataacaaaacattatctacagctttagctaaaggtattggagttaatatttctgctaaaaagaaagtaaatgttactgcagatattaatgttcataatggaacattaacgttacactcagaacaaggtggagttgaaattaacggtgatattacctcagaacaaaatggtaatttaaccattaaagcaggtagctgggttgatgttcacaaaaatatcacgattggtatggggtttttaaatattaccgctgggggttctgtagcttttgaaaaggcagggggtgataaaggccgtgctgcaagtgatgctaaaattgttgctcagggtgtaattactgcaggcagtggtcaagatttccgttttaataatgtatcactaaatggaactggtagagggttgaaattcattacagctaaaggaaataaaggtaatttctcagccaaatttgatggtgtgttaaatatttcaggtaatatttcaattaatcacactgctaataatcaattatcttattttcatcgccagggttatacatattggaatttgacgcagcttaatgttgattctgattctagtttttctttaacatcaataaaagacgcgattaaagttgggggatatgacaatgctaaagacaaaaaaaacacaggagggattggttttacacgagataccattttcaatgtaaaacaaggtgctagagttgatatttcctacaccctaccgatatctccagttaaaaattcaagaattgctgctgtcaattttgacggaaatattactgttaaaggaggaggagttgttaatttaaaatttaatgcgcttagcaataactacaaaactccaggggtgaacatttcctctagatttattaatgttaccgaaggttcgcagctaaacattactggtagtatgccatctacaaccttatttaatgtagcaaatgatttaatcataaacgcaaccaattcatttgtatccattaaagaaattgaaggtacagatactcatcttgatacaggtttaaaggtaaacggtaatgttaccattaaaggagggaatgtcaccctaggttcaaataaagctaaaaccaaatttgataaaaatgtaactgttgaaaagggtgcaaatcttactcttgcgtcagcaaactttggaaatcataagggtgctttaactgtagctggaaatatcaatactcaaggtaagcttgttgcaactggcgatactattgatgtatctggtgattttactgttggaaacgatgctacttttaatggtaatactaataacaacctaaacattaccggcaattttaccaacaacggcacctccataattgatgtaaaaaaaggggcggcaaaactaggtaatattaccaatgaaggtagtttaaatattactactcacgctaacactaatcaaaaaaccattattaccggaaatataaccaataaaaaaggcgacttaaacatcagggataataaaaataatgccgaaatccaaattggcggcaatatctcgcaaaaagaaggcaatctcacaatttcttctgataaagtcaatattaccaagcagataacaatcaaagcaggcgttaatggggagaattctgattcaggcacagaaaacaatgccaatctaaccattaaaaccaaaacgctagaattaacaaacaacctaaacatttcaggctttcataaagcagaaattacagctaaagataacagtgatttaattattggcaaggctagcagtgatagcggtaatgctggtgctcaaaaagtaatctttgacaaggttaaagattcaaaaatctcagctggcaatcacaatgtaacactaaatagcgaagtggaaacgtctaatggtaatagtaatgctgctggcgatagtaatggtaacaacgctggtttaactatttccgcaaaagatgtggcagtaaataataacatcacttctcacaagacaataaatatctctgccacaacaggaaatgtaacaaccaaagaaggcacaaccattaatgcgaccacaggtggcgtggaagtaaccgctaaaacaggtgacattaaaggtggaattgagtccaagtctggcggagtaacacttactgcaaccggagatactcttgctgtaggtaatatttcgggtaacactgttagtgttactgcaaatagcggtacattaaccaccaaagcagactctacaatcaaaggaaccgggagcgtaaccaccttaagtcaatcaggcgatatcggcggtacgatttctggtaagacagtaagtgttacagcaaccaccgacagtttaactgttaaaggtggcgcaaaaattaatgcgacagaaggaactgcaaccttaactgcatcatcgggcaaattaaccaccgaggctagctcaagcatcacttcagccaagggtcaggtagacctttcagctcgggatggcaatattggaggaagtattaatgctgctaatgtgacattaaataccacaggcactttaactaccgtgaagggttcaagcattaacgcaaacagcggcaccttggttattaacgcagaagacgctaagctagatggtacggcatcaggtgaccgcacagtagtaaatgcaactaacgcaagcggctctggtagcgtaactgcggtaacctcaagcagcgtaaacatcactggagatttaagcacaataaacggattaaacatcatttcgaaaaatggtaaaaacactgtagtgttaaaaggtgctgaaattgatgtgaaatacattcagccaggtgtagcaagcgcagaagaagtaattgaagcgaagcgtgcccttgagaaggtaaaagatttatctgatgaagaaagagaaacgctagccaaacttggtgtaagtgccgtacgttttgttgagccaaataatgccattacggttaatacgcagaacgagtttacaaccagaccatcaagtcaagtgacaatttctgaaggtaaggcgtgtttctcaagtggtgatggcgcagcagtatgtaccaatgttgctgacgatggacagcagtagtcagtaattgacgaggtagatttcatcctgcaatgaagtcattttattttcgtattatttactgtgtgggttaaagttcagtacgggctttcacccaccttgtaaaaaattacgaaaaatacaataaagtatttttaacaggttattattatgaaaaatataaaaagcagattaaaactcagtgcaatatcagtattgcttggcttggcttcttcatcgttgtatgcagaagaagcgtttttagtaaaaggttttcagctatctggcgcacttgaaactttaagtgaagacgcccaattatctgtagcaaaatctttatccaaataccaaggtacgcaaactttaacaaacctaaaaacagcacagcttgaattacaggctgtgctagataaaattgagccaaataaatttgatgtgatattgccacaacaaaccattacggatggcaatatcatgtttgagctagtctcgaaatcagccgcagaaagccaagttttttataaggcgagccagggttatagtgaagaaaatatcgctcgtagcctgccatctttgaaacaaggaaaagtgtatgaagatggtcgtcagtggttcgatttgcgtgaatttaatatggcgaaagagaacccgcttaaggttacccgtgtacattacgaactaaaccctaaaaacaaaacctccaatttgataattgcgggcttctcgccttttggtaaaacgcgtagctttatttcttatgataatttcggtgcaagggagtttaactatcaacgtgtaagtttaggttttgttaatgccaatttaactggacatgatgatgtgttaaacctaaacgcattaaccaatgtgaaagcaccttcaaaatcttatgcggtaggcgtgggatatacttatccgttttatagtaaacaccaatccttaagcctttataccagcatgagttatgctgattctaatgatatcgacggcttaccaagtgcgattaatcgtaaattatcaaaaggtcaatctatctctgcgaatctgaaatggagttattatctcccgacatttaaccttggtatggaagaccagtttaaaattaatttaggctacaactaccgccatattaatcaaacatccgagttaaacaccctgggtgcaacgaagaaaaaatttgcagtatcaggcgtaagtgcaggcattgatggacatatccaatttacccctaaaacaatctttaatattgatttaactcatcattattacgcgagtaaattaccaggctcttttggaatggagcgcattggcgaaacatttaatcgcagctatcacattagcacagccagtttagggttgagtcaagagtttgctcaaggttggcattttagcagtcaattatcgggtcagtttactctacaagatataagtagcatagatttattctctgtaacaggtacttatggcgtcagaggctttaaatacggcggtgcaagtggtgagcgcggtcttgtatggcgtaatgaattaagtatgccaaaatacacccgctttcaaatcagcccttatgcgttttatgatgcaggtcagttccgttataatagcgaaaatgctaaaatttacggtgaagatatgcacacagtatcctctgcggggttaggcattaaaacctctcctacacaaaacttaagcctagatgcttttgttgctcgtcgctttgcaaatgccaatagtgacaatttgaatggcaacaaaaaacgcacaagctcacctacaaccttctggggtagattaacattcagtttctaaccctgaaatttaatcaactggtaagcgttccgcctaccagttttataactatatgctttacccgccaatttacagtctatacgcaacccttttttacccctgtatatcaagcaaaccaagcaatgctaaaaaacaatttatatgataaactaaaatatactccgcaccatggcgatacaagggatttaataatatgacaaaagaaaatttgcaaaacactccacaaaatacgaccgtttcacttgtggaatcaaacaacaaccaaacttccccgcaaatgcttcaacaatcacccaaacctagcctattgcgcttggaacaacatatcgaaaaaaaagattatgagtttgcttgtcgtgaattaatggtgattctggaaaaaatggatgctaattttggaggcgttcacgatattgaatttgacgcacccgctcagctagcatatctacccgaaaaattactcatttattttgccactcgtctcgctaatgcaattacaacactcttttccgaccccgaattggcaatttctgaagaaggggcgttaaagatgattagcctgcaacgctggttgacgctgatttttgcctcttccccctacgttaacgcagaccatattctcaataaatataatatcaacccagattccgaaggtggctttcatttagcaacagacaactcttctattgctaaattctgtattttttacttacccgaatccaatgtcaatatgagtttagatgcgttatgggcagggaatcaacaactttgtgcttcattgtgttttgcgttgcaatcttcacgttttattggtaccgcatctgcgtttcataaaagagcggtagttttacagtggtttcctaaaaaactcgccgaaattgctaatttagatgaattgcctgcaaatatccttcatgatgtatatatgcactgcagttatgatttagcaaaaaacaagcacgatgttaagcgtccattaaacgaacttgtccgcaagcatatcctcacgcaaggatggcaagaccgctacctttacaccttaggtaaaaaggacggtaagcctgtgatgatggtactgcttgaacattttaattcgggacattcgatttatcgcacgcattcaacttcaatgattgctgctcgagaaaaattctatttagtcggcttaggccatgagggcgttgataaaataggtcgagaagtgtttgacgagttctttgaaatcagtagcaataatataatggagagactgttttttatccgtaaacagtgcgaaaccttccaacccgcagtgttctatatgccaagcattggcatggatattaccacgatttttgtgagcaacactcggcttgcccctattcaagctgtagccctgggtcatcctgccactacgcattctgaatttattgattatgtcatcgtagaagatgattatgtgggcagtgaagattgtttcagcgaaacccttttacgcttacccaaagatgccctaccttatgtaccttctgcactcgccccacaaaaagtggattatgtactaagagaaaaccctgaagtagtcaatatcggtattgccgctaccacaatgaaattaaaccctgaatttttggtaacattgcaagaaatcagagataaagctaaagtcaaaatgcattttcatttcgcacttggacaatcaacaggcttgacacacccttatgtcaaatggtttattgaaagctatttaggtgacgatgccactgcacatccccacgcaccttatcacgattatctggcaatattgcgtgattgcgatatgctactaaatccgtttcctttcggtaatacaaacggcataattgatatggttacattaggtttagttggtgtatgcaaaacgggggatgaagtacatgaacatattgatgaaggtctgtttaaacgcttaggactaccagaatggctgatagccgatactcgcgaaacatacattgaatgtgctttacgtttggctgaaaaccaccaagaacgtcttgaactccgtcgttacatcatagaaaacaacggcttacaaaagctttttacaggcgaccctcgtccattgggcaaaatactgcttaagaaaacaaatgaatggaagcggaagcacttgagtaaaaaataacggttttttaaagtaaaagtgcggttaattttcaacgagttttaaaatctctcaaaaatcaaccgcacttttatatttataacgctcccgcgcgctcacagtttatctctttcttaaaatacccataaaattgtggcaatagttgggtaatcaaatttaattgctgatacggtaaactaaagacggcgcgttcttcggcagtcatgtcttgtttttccaattcttttaaatgtgtttcgatactttcttgctgttggttaaaaatagcttcgggtatttcttcaatgtgttctaaggtataaataattttctttgccacaggataaaaaccagataaaaactgtgcggtctgttgcaaatttttcattctgtctcgataagctcccagtgctgaaatatagcttaatagagaataattcagtttgagtaaatcaaaacctttttgtaaatatgccttgtatttcactggttcattattcatattggaaagtgttgtactcagtgcggctgcatattgatgtgcattgcgacgtgctatgcgatatttaagatcgtcgcttttaccaaattgcaattgactaataatatgcaataaatacaccgcatcactacgcaatgcttgatggctcactttatcaagttgcaaatatttccaatctggccataagtaagatacggcaaaccatgaaatcgcggcaccaagtaaagtatcaagtaaacgaggcatcaacgcagctgccgtatcaaatcccatgacatcaaaactgagcaatacttgtagtgtgatgaaaaaggtcgagaaactataattattactacggaagaaaaagaacaaagtacttgtgagcaccacaagaccctgttttaattctaaggttggatttaaataaggtaatagagaccctaccactacgcctaatatcgtgccaataatacgctgacgtaaacgtactttagttgcagaatagtttggctggcacacaaatacagtggtcaataaaatccaataaccaagattaaattggaaaaactcaacaattgcacagcacagaaataccacaatagataagcgtaccgcatgtcggaacaacggtgactcaaacgtaaaatggctaaaaatcaccgcacttatattttttaacccagtgatttgttccgtatgaatttgagctaattgttctgtatccgtcgtttcttgtgctaactggcgaagttgccagttaatgctttgtaaattatctaacaaggtttgaatatcaatcagttcatcttgatcattgagatgttgtgttcgatacagttcaaaggaatgcaaggtgcctaaaagcgcacgttcgacacgttcattaaaatgataaggtttattttcacgcaaactcgccgtgatttctttacaggattgtgcttgtagttctaacaaacgttgaatacggaaaatcaaatctgtattttttagtttttccgttatttgttgataatcaaaatgcgtagaattggcgcgttcgtgaatatcttgcgcagcaaaataataacgtaacattctctgggtacgaggatggcgatgttgccctctaatacggtaaaaaagtgcggtacgcacaatattaaatgccgtgacaacattcgcatttttcatcgcaaaattgaggtgttttttttcaatctcagccacttcgtcaggatcaaaaaaacaggatttagtatctaaatattcgcccaacgcacaaaacgctttagcgacactttcttgcacggggcgatttgggaaaaacaggtaaacaatcagagtcaccacgctatacagcaaggtaccgcataaaatcattacagggttaataaaccatacatttacctctggtatataagttaatgtggtgtaaagcgcaaccactaatgaaccgaaagcaatggtgctataacgctgccccacggcaccaatcatagtgaaaataaatgtcagcaccgtcattaacacaatatattggataggcttgccaatatgtaactgcacaataaaggaagaaatagaaaaggcaataagggtaaaaaatacgtttttcaatcgtccagttaaacggttatccaaatccaccaaaccacctgcaataatccctagaatcaaaggcattgattgcgaagaaatatcaaaaaaccatattcccactgccgcaatatttacggcaataaaaacaggaattgtagaaattactttagcatttaaccgaatattcatttcaaatccttatcaaaatagaaaagtgagcaacaaggctcactttttattgtataaagtgcggtcattatttatgggattttgcccagtttaaaaaacgtgtttgagtttctttatccgcttgttggaaccaatattgaagttgttgctctgcaacgttttcgccctgaacaaccactttgcctttattcgcttttgcattacctgctggcacagcaaccattgaattagcagaagttgttgcagtaaatttagaaactgatgccgctgcaccagacgcattatattcagcaagatcatttagcacattaccacttgggaataaaccttcttgttttaacacatccactttcgctgaaatagcattacctgattttgttttcacagtaatatttggcatttgattgaatttatcgccactatcaagattacgaatagctggtgcggaaataactaaatcttcagcattaccttgaaatgtcacaatcacaggattagattcaaaaagagattgattcgatcctgaaccaacaatttcatttaaacgcacaacaacctgatggctttgggtatcatctacagtaaatgtcttagcttttccgagagatttagaggctttttgaccatcaatcgctaaaaactcaaggttagatgaagtggaaaccattccagcaaaggttgccgtacttgtgcataatgtggcaagacctaatacaacagcgcgtaatttcataattgctcctttgatataaatgaaatactcgcttatgctatgccaaattagccaaaatgaaaataaaaagtaagaattaatttaaaattttttgttataaatagcacaaacaatcacaatgttttattatgttggcgatctacacactaaaccagtgtcgtgaaaatttaatccattaaatatcaacgggagtaacaatgttgaacgatattttaacaggctatggaatttttattctggaaattttaacaattttattactcattcttgctattgttggtttgattatttcttatcgccaacataacaagtctaaagtgggagaattagaaattaaagatttatcagaagaatttaatgaacaagttcgtttattacgtgattttaatctttctgaagaagaacaaaaacaacgcactaaagctgaaaaaaaagcagaaaaacaaaatgctaaaaaacgcaaagaaaaattgaaaaaaggcgatactttagaagatgaaaagaaagcttgcgtatatgtattagatttttgcggcgatatttcagcctcagaaacaaccgcacttcgtgaagaaatttcagcaattttaaatgtagcaaaaccagaagacgaagtattactacgtttagaaagcccaggcggtattgtgcataattatggatttgcagcctctcaattgtctcgcttaaaacaaaaaggcataaaattaactgttgccgtcgataaagtggctgcaagtggcggttatatgatggcttgcgttgccgataaaattgtatccgcaccttttgctgttattggttctattggcgttgtcgctcaaattccaaatgttcatcgactattgaaaaaacacgatgtcgatgtagatgtaatgactgcgggcgaatttaaacgtacagtgaccgtattgggtgagaacactgaaaaaggcaaacaaaaatttcaacaagaattggaagaaacacataaattattcaaacaatttgtctcacaaaatcgcccttgcctagatattgataaaatcgcaacaggcgaacattggtttggacaacaagccattgcattacaacttgtagatgaaatctcaacgagtgatgatttaattttggaaaaaatgaaagaaaaacaggtacttaatgttaaataccgtttaaaaaaatccctaataaaaaaattcggacgacaagctgaagaaagtgcaattaatatcattcatcgttatagtacaaaacagtctagagactttatgtactaaacatttatccacaaaaaaagaagtttttatttctatgtttacaagacaaatctttgtcattaagatactcgccgatctttaggggttttattatatttaattcataaatcaagttgagtattgttaatccaaatattacgcagctaatcgtttaaatgattagctgcgttttttatttcaataacaaaatcgcaacttaccatttccccttagcaaaattttctattgttcttgcttccataaatagggataataacgcccctattcaaaaggcaaaaaaataatgacgcactatattttattgattatcggcaccgcattaattaacaattttgtattggtaaaattcttaggactttgcccttttatgggtgtatccaaaaaaattgaaaccgctgtgggaatgggattagcaacaatgtttgttttaactgttgcttccctttgtgcatatttggtcgatcactatattctaattcccttaaatgccacttttttacgtacattagtgtttattttagttattgctgtagtggtgcaatttaccgaaatggcaataaacaaaacaagtccaacattatatcgtttactcggcattttcttgcctttgataactacaaactgcgcagtacttggtgtcgcattattaaatgtaaatctcgctcataatttaacagagtctgtcgtttatggttttggtgcatctctcggtttttccttagtattggtactttttgccgcacttcgtgaacgtttagtcgccgctgatatacctgccacttttcgcggttcagccattgctttaattaccgcaggcttaatgtccctcgcttttatgggatttacaggacttgtaaaataataaaatgatttaccttttaatgataataactctgttaattttatttattgggttcactcagtatttttcaggaaaaagaaagaaataatgacctttttattcatcgtaattacgctactcgctttaattttcggtgcgattttgggctttgcatcaatcaagctcaaagtggaagctgatcctgtcgtagagaaaattgatgctattttaccgcaaagccaatgtgggcaatgtggttatcctggttgtaagccttatgctgaagccatttgcaatggcgatgaaatcacaaaatgtattccaggtggtcaaacaactatcgtaaaaattgccgaaattttaggggttgatgtaccaacaatggagggcatagaagaacctatcgagaaagttgcttttattgatgaaaatatgtgtatcggctgcacaaaatgtatccaagcctgtcccgttgatgccattattggtacaaataaagcaatgcacacgatcattcccgatctttgtacaggttgcgagctttgtgttgcgccctgcccgacagattgtattttaatgattcccgtgaaaaaaaatattgataattgggattggaaatttgatgcaaaactcgttattccagtaatgaatgtcgatggctctgaaaaaaaattggttgtgggggaataaatggcggacgtattatctcgtttcaattccggtaaattatgggatttcaaaggtggcattcatccaccagaaatgaaatctcaatctaattcacagccattacgccatctgcctctcggcacggatttttacattccactcaaacagcacctaggaacaacaggcaatcttttaataaaagagggcgattatgtcttaaaaggacaagccttaacaaaaggcgatggcttgcgtatgttgccagttcacgcgcccacttctggcacaattaaatcgattaaaccttatgttgccacgcatccttcaggtcttgatgaacccacaattcatttacaggcggatggtttagatcaatggatcgaacgtaatcctattgatgatttttcaacgctatcgccagaacaacttattcacaaaatctatcaagcaggtatagcaggtttaggcggtgcagtattcccaactgctgccaaaattcagtcagcagagcaaaaagtcaaactcttaattatcaatggtgcagaatgtgagccttatatcacttgtgatgatcgtcttatgcgtgaacgcgctgatgaaatcataaaaggcattcgtattttacgttatatattgcaccctgaaaaagttgtcattgccattgaagataacaaaccagaagccatatcggcaatccgcacagcactacagggagcaaatgatattagcattcgggttattccaacaaaatatccttcaggtgctaccaaacaactgatttatttgctcacagggatagaagtgccaagcggtgcacgttcatccagcattggcgtattaatgcaaaatgtgggaacaatgttcgcaataaaaagagcaattataaatgacgagcctttaattgagcgtgttgtcacccttactggaaataaaatcgctgaaaaaggcaattattgggtgcgtcttggcacacccatttcccaaatattgagcgatgcaggctatcaatttgacaagcattttcctatatttgcaggtgggccaatgatggggctagagcttccaaacctaaatgcacctgtgacaaaacttgtcaattgtttacttgcgccagattatcttgaatatgccgaacctgaagcagaacaggcttgtattcgttgttctagctgttctgatgcctgcccagtaaatttaatgccacaacaactttattggtttgcgcgcagtgaagatcacaaaaaatcggaagaatacgctctcaaagattgtattgaatgtggaatttgcgcatacgtatgcccaagccatattcctctaattcaatatttccgccaagaaaaagctaaaatctggcaaataaaagaaaaacaaaagaaatcagatgaagccaaaattcgctttgaagcaaaacaagcacggatggaacgtgaagaacaagagcgtaaagcacgttcacaacgtgcagcacaggctcgccgtgaagaattagcacaaactaaaggggaagatccagtcaaggcggcactcgaacgcttgaaagcgaaaaaagccaatgaaacagaaccaacgcagattaaaacactaacctcagaaaaaggagaagttttacctgataacacagatttaatggcacaacgtaaggcacgccgtttagctcgtcagcaagcagcatctcaagtcgaaaaccaagaacaacaaactcaaccaaccgatgcgaaaaaagcagcagtagccgccgccattgctcgagcaaaggcaaaaaaacttgcacaaacaaatagcaccagcgaagccatttcaaactctcaaaccgcagaaaatgaagtagaaaaaacaaaaagtgcggtagaaaaaacagaagaaaattcaactgcacttgaccctaaaaaagcagccgtagccgccgccattgcgcgcgcaaaagcaaaaaaacttgcgcaagcaaatagcaccagcgaagctatttcaaactctcaaaccgcagaaaatgaagtagaaaaacaaatagtgcggtagaaaaaacacaagaaaattcaaccgcacttgaccctaaaaaagcagccgtagccgccgccattgctcgggcaaaagcgaagaaactggcaaaaacacaagcaacattagaaaataatcaggaataaaataatgtttaaaatggttagctccccacatacccattcgggaaaactcacagcgcatattatgctttgggtcattttggcaatgatgcccgcttttttcacgcaaatttattattttggatttggcgtggtgcttcaatccgcattagccattggtacggcaatcattgctgaatttattgcaataaaattacgaggtaaaaaaccgctcaattatctttcagatttcagcgtagccctaactgcgttaattttggcaatggctattccaccttatgcaccttattggattatcatcattggaacactctgtgcagttttattaggtaaacaggtttatggggggttagggcaaaacccattcaatcccgcgatgattggctatgtaattcttctaatttcattcccattacaaatgacaacttggatgccaccaattaatttattacaggaaccaccgactttttcagatactttttcattaatattttcaggtttaaccacggatggatttaccctttcacaacttacacataacattgatggcatcacccaagcaacgcctttggatagcgcaaaaattttctataaaagtcacaatcaattaagtgatttttatgaattaattaaactgccgatttttatgggtaatggaaccgattttgctcaaggctggtggcaaatcaacgtggctttcttagcgggcggaattttccttattttaaaacgcattattcactggcaaattccagtggcgatgcttgtcacctttttctgtttagccactgcgaccgcttttactggtttcacgcatttaagtgcgattagccaactcgttagtggcgcaatgatgtttggtgcattttttattgcaacagatcctgtcacagcctccattacaccacgcggaaaaattatttttggcgcattagtggggttatttgtttatctcattcgttatcacggaaattatccagacggcgtggcattcgccattttattaagtaatatttgcgtcccacttatcgatcattacacacgtccgcgcgtatctggttatccaacaaaaggaagaaaataatgggtacagtaaaaatcacatcgcgttatggcatattgttaggctttattgccctactttgcacaataatttctacaggaattttcttcctaacaaaagataaaattgatgcggtaatcgcagcacaacagcgagaattacttctacaagttatcccacaagattatttcaacaataatttgctagaaagtgcggttattcctcaagataaaaattttgtgggtatccaaaaaatttattttgcgaaaaaagatggaaatatttctgcctatgcctatgaaaccaccgcgcctgatggctattctggcgatattcgcttgcttgtgggattagatccgaaaggcgaagtgttaggcgtacgagtaatcgaacatcacgaaacaccaggcttaggcgataaaattgaacgccgaatttctaactggattttaggtttcacaaatcaatcgattaatgaacataatttaagcgaatgggcggtaaaaaaagatggcggaaaatttgatcaattttctggtgcaaccattacacctcgcgcagtggttaatcaaactaaacgctcagcattaatcatgctaaataatcaagccttgttacaacagctttcaacacaagtgaaataatatgacagatttaactgaaaaaaataccgcacttgaagaagaaaaaatagaaagtgcggttgaaaatcaacaaaaatccatctggaaagaaatttttgctcaaggaatttggaaaaataaccctgcggttgtccaacttctcgggctttgtccacttttagcggtgtctagcacagccaccaacgcgcttggtttgggtttagcaacaatgcttgtactcacttgcacaaatacggtcatttcccttttccgtcaatatattcctaaggaaatccgtattccaatctacgtgatgatcattgcaaccacagtaacagcggttcaacttttaatgaatgcttacacttatacgctttatcaatcactggggatttttattccattaattgtgaccaactgtattattatcggtcgcgcagaagcattcgcctcaaaaaacagcttactccattccatctgggatgggttttcaatgggattaggaatggcacttagtctaaccattctcggcgcattacgtgaaattattggacaaggcacgatttttgagggcatagaaaatctattcggcgaacaagcaaaatttttaacgcaccatatttaccatacagacagtagctttttacttttcattctgccaccaggcgcatttataggcttaggcttgctcctcgccataaaaaatcgaattgataatgtaaaaaaataaagcaaccaaatctttccttcccctgcttgcgggggaaggtgtcacgaagcgacggaagggggcttacagtcttctaaacagataattccaataaattaaataggctaatttctacaaaaatatgaacaaaacaaaaagaatcgaaatactcacaagattacgagagcaaaccccccacccgaccacagaattacagtataattcgccctttgaattattaattgcggtcattctatcggcacaagcaaccgataaaggcgtgaataaagcaacagaaaaactattccccgtggcaaacacgcctcaagcgattttagatttaggattagatggtttaaaaagctatattaaaactatcggtctttttaatagcaaagcagaaaatattatcaaaacttgccgtgatttaattgaaaagcacaacggtgaagtgcccgaaaatcgcgaagccttagaagcattagctggtgtgggtagaaaaacagccaatgttgtgctaaatacggcatttggtcatccaactattgcggtagatacccatattttccgtgtatgcaatcgcactaattttgcagcgggtaaagatgtggtaaaagtggaagaaaagctgcttaaagtcgtgcctgatgaatttaaagtggatgttcatcattggttaattttacacggtcgatacacttgtatcgcgcgtaaaccacgttgcggatcttgcattatcgaagatctttgtgaatataaagaaaaagttgaattttaattttgcggtaaaacagcctaattatttaccgcactttttattaaaaataggataaaaaatgacaacaaacaataaacagcgacaaacttggtcgagccgcctcacttatgtaatgacggtcgcaggcgcaacggtcggtttcggtgcaacttggcgtttcccttatcttgtgggtgaaaatggtggcggtgcttacgttctacttttctgtatcgcaatgattgtaatcggtatcccaatgattttagttgaaaacgtgataggtcgccgtttacgtgtaaattccattgatgcgttcggcgataaaattctcgacaaaggaaaaggcatttctaaatattggaaaatattaggttatatgggcttactcggcgcatttggcattatggcgtattatatggtgcttggtggttgggttatttcttatatcattagcctaatcagcggtacattagacatttcaacccccatcacaaaagacattgccaaaaatttctacgatcttcatatcggcaatagcccttatgaaattatattctacaccctcttatttgttatcgtgaattacattatcttggcaaaaggtatcattggtggaattgaacgttcagtaaaatatttaatgccattactatttatcttcttaattggaatggtaattcgcaacgtaacattaccgggcgcaatggaaggcattacattctatttaaaacctgatttcagcaaaattaccccacaattatttatcttcgttttagggcaagtcttcttcgcattaagccttggttttggtgtattaattaccctttccagttacttaaataaagaagaaaacttaatccatactgcagttattacaggtttcaccaatacaattattgctgtacttgctggctttatgattttcccctcacttttcacttttgggattgaaccaaacgcagggccaactttagtattccaaagtttacctatcgtattttctcacttatgggcaggtaaattctttgcgattatcttcttcggcttattattaattgctgcgctgactacttccatcacaatttatgaagtaatcattacagcattacaagaaaagctcagaatgcgccgtggcaaagccattgtcttaacccttagtggcatttttctattaggcaatatccctgcaattttaggcgataatctatggaaaaacgtaaccattttcggcaaaagcatttttgatttctacgattacgccagtggaaatattctctttatgctgaccgctcttggctgtgctattttcgttggtttcgtgttaaaagatgaagccaaaaaagaactttcttcaacaaaatattcaactttcatcaaaatttggtttaactacgtgaaatttgttgtacccttgatcatcttagttatctttatcagcaacctgttctaaaaattaaaaatgcggtaaggcgactacatcaccgacaccgctttaatttgaacatagacatcttgcccaacagcaaaacgtagttcattttgcgcccatttactgatacttgcccaaatcttattcccttccactaatacggcaagatccactcgagaatcttgtatctcaatttgtgtaatcttgccacgtaaaatattacgaatgcttgtttgttctggcttttgcagtatgatagaaacatctgaactataaatacaaactagcactcgctcgcctacattcgcgggtacttgatgaatccaaagtgcttgttcgcctagcgaaagtgcggtcattttataaggtggattatgcaaatgaacaggcaaggcaagtacactgctctgttcgttttcccctttccaaggggcaaaaatagggctattccaaattttttctacgctgtcataggcttgcacaatgccgttttccatcaatacgacccgatcagctaaacgcaacagttcgtccaagctatgtgtaacatataaaatcgggatattaatttctttagaaagacgttccaaatattgcattagctcgcgtttgcggggaacatcaagggcagaaagtggttcgtccatcagtaaaatatcaggatcagtcagcagcgcacgccctattgccacacgttgtttctctccgccagaaagcgtaagcggataacgctttaataaatgagtaataccgagaagatcgacaatatagttaaaatcatcttgcgagacatgtttcatgccatagcgcaaattacctttcacagtgtagtgaggaaataaacgcgcatcttggaatacatagccaattttacgcaagtgggtcggcaatgattcttggctttccatatccactaaagtgcggtcatttaaacggatgaatccttcatctggttgtatcaatccactgactagattaatcagcgatgttttgcctgagccagacaaaccgaaaatggcggttacgccttgatctggcacttgtatattcgcttgcaaggcaagtttcccgagctgttttttcacattaatttgcaacatttccttgtcctaattttttctgcattcgcttgctcaaccattcagacagtaacaaagaaatcaatgaaagaatgatagcaaataaacataagcgagcagtttgttcttctgctgcgggtgtttgaataaaagaatacatcgcaaggggaatcgtttgagtttcgcctgcaatgttcgatacaaaggtaatggtcgcgccaaattcccctaatgatcgtgcaaaaccaagcacgagtccagctaaaaccccaggtaaagaaagcggcaaggttattgtaaaaaatacacgccaagcggaagcaccgagtgtttgcgccgcttgctccaatttaatatcaatattttctaaagaaagtcgaatcgcgcgaacaaccaatggaaaggccaccacggcagaggaaagcaccgcacctttccaactaaaaccaaaagataagccaaaccactgatataaatacttgccaatgaaaccattgcgccccattgctacaagtaatagataaccgataaccactggtggcaacactaaaggcaaatgaattacgccagtaatcagagatttgccatagaagtttttgcgcgctaagagccacgccacaaaaatggctaacggcaaactccaaagcatagaactgactgcaacactcaggcttaaattaattgctgagatttccattggcgtcagattgaaaaatgaaaaaaattgggtaagcaaaatgaatccttatctaaatagcctctctttaaatcccttgtttatgggaatatcccacattgatgagaggtaagatgctctataataacaaaagggcagaaatatccgcccttcatgactattaagattctatcttattttgcagagaaaccataccctacaagcactttcttcgcagcatctgattctaaatatttcaagaaatcgcgagaatccgcattatcatgaccttttacaatagaaacgggataaacaactggtttatggctatctgcagggaacactgcaaccgttttaacttgttggctaacttttgcatcagtgctgtacacaataccgtaaggtgcttctgcacgttcaactaaagctaatgcgccacgcacatctttagcacgcgctaaacgatcttgcactttatcccataaatttaatttggttaatgcttctgctgcgtattgaccagcaggtacgtgtgcaggatcgccaacagataaatagctatcttttaatgcattgatccattcaccttttgcaatatccacagaatttaccgcactttttgctggtgcgattaagactaaatcattgcccactaaaactttttctgtttcttttacggttaaatctttttcagaaagatatttcatccatttattgcttgcagatacaaaaatatccgctggcgcgccttcttcaacttgttttgctaaagttgaagaagaagcgaaagaaaacactacttcatttttcggattttgttttgcgtaatcttttgcaacttgttgtaaagcatctgtcattgaagcggctgcaaatacagtcactttagcggatgccgcaaaagaaaagcctaatcccgcgattaaaagtgcggttgaaattttagttaattttttcatgaataatctcctatgattaaacgttatttacttgattatatattgaaataaataacaatcatatagcaaaagaaaaattatttagtaaaatatataacgcttaggcttaccacttaggattacttagggacagcaaaatgaaaaacaccgaaattttactcacgattaaacttcaacaagcactttttatcgatccaaaacgagttcgtttactcaaagaaattcaacaatgcggttcgattaatcaagcagcgaaaaatgcaaaagtgagctataaaagtgcgtgggatcatttagaagccatgaataaaatcagccctcgcccattgctggaacgaaatacaggtggaaaaaatggcggaggcacggtgcttaccacttatgccgagcgtttgctccagctttatgatttattagaacgtacgcaagaacacgcgtttcatattctacaagatgaatccgtaccgttagatagtttactcacggcaaccgcacgtttttctttacaaagtagcgcacgcaatcaattttttgggcgagtggcacaacaacgaatcattgactctcgttgcgttgtggatgtgaatgtgcaaggattaccaacgccgttgcaagtttctattaccacaaaaagctcggctcgtttgaaactgattacggaaaaagaagtgatgctgatgttcaaggcaccttgggtaaaaatcagtgaacaaccattagtaaatcaaccgaatcagttctctgtaaatatcaaatcactcaatgaagaggaagccatccttcaatttgctgaaagcaacattgaattttgtgccacggtccaccagccaaatcaatggcaaatcgggcaacaggtttggattcacattgatcaagagcaaattatattagcgacgctgggataattcagagatataatacgtaaattcaatacttatatttattgttttctgaactaaaataacctcaaatcaaacaaaattttaaataaaatatttaatttcatcgtatttcctatttacgtaaaaaagtttgataaagttttttcaataacgaggttggcaataaacgagaaccaaaacgcaatgcaaaagtaaataatccagataacaaaccctgaattcccaaacggtatttcaatttgaacaaacgccattctgctttagcttgattgacgccacgacggcggcttaccatgccatttcctactcgagcataaactaaaatatctggcaaattcgccatatataaaccttgtgcgacaagtttgatccacaaataataatcttcttgaagatcttcatatccaccacaattaatgaccgcacttttttgatatgccaccgtcatatgattaaacggacaacgtttttgcgtgaatttaataatttcttgagcagaagttggcacattacgatatgccacaatatcatttacatttttaccaaattcagcaatttgtccgccaaaaatgatgctttcagggtgctgttcaataaacgctacttgcttttcaaaacgatcaggcacgcaaatatcatcggtatccatacggaaaacccagtcataagtacaatgcaataaaccttcattcaaggctttgcctaatcctcgattttgcggcaatttgactaattttaatggcaattttgtttcaaattctgtcacaacagattctaattctggcgttactacgccatcaaaaaccaatacaatttcatctgcttgacgagtttgtgcaacaagactttcaaaacactcccgcaagaattgaggattttccttaatatataaggacattaggactgaaaatttcattttattttcccaaccgttttaaattaatggctaattttggcgaaattaaaataaccaaagtaataataaattgcctaatgctttttgttttcttaaaaatatcaaaataatattttgccgctttacgcgataaattcatgatatggggataagccaaaatatagctcgcgttaatatcaaaattacgagcttgctccaccgttttcacataatgctcgcgaatataatcaatggctttttgcgtattagtggtatccgtagacacacttgagcgtttagtatggaaagtacagtaagttagtggttcattaattttataaggagtaaaacttggctcttgtaacagttttaacaagaaatcatagtcttccaaagaacgaagtgcggtggataatccacctatttttaaaaacatctcttttttaatcgcaaccattggcatgccaccaatcttattggctaacaaaatacgttctgtcgagatttcttggggttcaatcggttgagtcacataagtaaacccttcattgaccatttcacatttagcaggatgataaataaaattaatgtctggattttgctcaatcacttgtagtattttttcacatttttctggcataaaacgatcatcatcatcgagaaaaagcaaccaatcgccctttgatgtacgcgcaccaacattacgactttccgctgcaccttgattggtttcgttacgaatcactgtaactggaaaagaataactttgttcaacaactactctctctttggagcaatcatccacaataatcacttcaaaattactcgatgtttgttgagttaaactttctaataaagctggcacttctgcttttcgattataagaaggcacaataatgcttaacataattccttcctttaattagccaaatttttcttaatcgcaaagatttttttcaatggatatttcattaattttttaagtaaattattggataaagatccacgaacactttctaaattgcttatcaatacaggattttcaatgaccatgagagggcgaaccactttatttcttatattaaaattctgttcaaagagtaaaaaatcatccgctaaccaaaatggtttattttgggaaatttgctggataaatcttcttgcggctgatttttttataagatagcccaccgtgccagcaaaataacttttataagggaaagcgtaatttacattgcctgtttttttgcatagaaaagaaaaagttgtgggataattaatttctaaatcagtatcattgaaattattaatttttgactgtccaagcaatataatttcagcctcaagtttttctgataaaagtgcggttaaattttgctgaaaatctgagtggaataaagcatcgtcttcacagactagtgcatagctatcttcagcaatatcgttgtcttcaataattttttggtacacagaaaggtggcttaaagtacaaccgatctcgcccttagtgacattacgaaaataatgtgctttaaattgttcaatattaaaaatagaggctaattcatcccaatctttttgcatggtattaatggcagaaaaaatttggaaatcctcggtatttttttgagaaaagaataatttccgacgttgaatatctttatctaaagagatcaaatatttttttaacataaaattattccttataaaatccctttccattcttcaataattttctcaatgccataatcttcactcattaaacgagatttgtctgacatttgttgataaagttcaggattattgattaataaatctaaacctttaaccatttcttcaatattattttgttcacaaagaaaaccattttctttatgttcgactaattgctttacgccaggagaacaattaaaggcaacaataggtaagccaaatgccatcgcttcaataacgactaaaggcaacccttctgtttgtgaaggtaaacaataaattgaactgctttcataataaaaagcaacatcattagtacgaggaataaaattaactgaatcttcaatattcaatgctttagcaagattttttaaattttcttcttcctcgcctgaacccgctattttcaaattccaatctggatatttttttgccaaaacttgccaaacttttaataaataatcaaaacctttataagaaaataaatgacctacagataaaacagttttattttcccattttgctaatttattctttggcaaaagcgtatttggattagcaatactgattatattgttcgttttaaatttttcttgccacagcgttttttctgcttctgtcaatgtaactattttatcgcaagttgttacagctaaatatttaccgagcgtgcgaacgagacgattgcccgtaaaattaaaagaataatgctcccataaaatatgttttatatttaaattaaccaacgccaaagcagaaaaaagcataattgcaccatcaaccacaattaaggtatccagctgtaattctttaactaattctcttaattttttagtgatagaaaaataatcttttttcaatgaatatggcaatttattcattgggtaaatattaattttttcatcaacttggaaaaaaggcttgttaccgccaatgctaataaaagaaacatcatatccctgtttagcaagagcattaacaacattaatggaaactcgctccgttccacccgcactttcgatattcataataaagaaaccaatttttttcattttaaatttccttataaatctttaatccaaggtctggaaatgaatcgtaacagaattgccatcttggaatactcgttctaataaaacgaatttctacattaggatgacttaacaaattaaatgcaacagaactgaagaacgtataaataattattattttatttgataaatatttaaatacgtaatcttcaaaaattaattcagattcaacataatttaccccatcaactcgataatcttctgctggatgagggaaataataatcaaaagaaaattgttcttttaatttttttattaatgagatattttcctcttttgtatttaacaatggttgcccaataaaaaatgagacctcaccatctatctcgcaatctatttgattatcccataaagaaattggttcaatattagaaacaatatttttgtaattaggataaaccgtataatgtttttttatttttttaaataatttattcacactatatttatcgccaataaaagctttaatcagtttatatttaaatgtgtcaggctctctcaataaattaggatgtgggaaaatattatctgaaccatcatcaaaggtataaagctctttaaatgaaacatgactaagataagtttgtagccataatgaattaagattggcgagaaaaaccttatcaaaacctttgtgcgtaattttattcttaagctggcgcattaacttgagaaaatcgaaaccttttagatcttttcccgtatcaatattcatcgaatcactacaaacctccgctaatttactcgcatacaaggttctttttttatcccataccctaccaaacattacgccaaagaattgttcattaggatgtaattcaattatttttctcgcaattaatacttgcaatggtgtacaacaaagaatgagattcatagggttttactcactttagatgtcataaaataaagaataggaataatggaaagcgaaccaataattccagcataagggatatatttaatttctgtaaaagttaaagctacaaggcttgccacataaatgattgtagataaaacggaacattgggaaataagtttatttttcccataatagaaaagataattaactaaaatcaaataaggaatacttaatgtggtcgaaattaaaaataaaataaaataatatttcgttcccacaaattgactacctaaaatccaaactaacacatcctcaggaataatccacattattaaggcaggaataggtattagcaaaaaggaaaataacgcccatttatgtagctgttgaataactaatttcttttgttttaaggcttcataaaaatagggaataatcgctttattaagtgcttgaatagcaatagaaacaattaaagcaagttgagcccccatagcataaagccctaaatctgtttcactgaatttgtgataaataaaaatacggtctaactgcccttttaagaaaaaacttgcataatgtaaaataagcggtaatccaaatcctaaaatataaaatagtgcggattgataatgcttaaattgatattttttagatgtcgtactctttctgtaaagaaaataagaaaaaaaccaaacgactaaattactcaataaaattgccaaaattcttttttcaacaagattattttgataatactcaagcaatgcgaccgtaaatacagctcccgtaacagtaagtgaaaattgaataaaagcataagaccaagcctttttctggcattgtcttacacttagctgaacatttaagaaagattggaaaattgaggaaagtgcagcgtaaaataatatttcagactgagcaatccaacaacccattaaaataatactgccgattatcgtggtataagcatagccggtattcaccactaaatttaatgaacgttttccgtaaaaataaaaataacgggaaattgcgccttcttgagttaaagaaaccacaattaaaaataaacttaaaaaagtttgataataagaaagtgagccatacccttctacgcccaatttacgggataaataaggcaaaagtaaaaaaggaactaactttgacgataattccccaacaaggtaaatagcactatctttaaaaactttcataaatatcaccgcacttttgatgaattcgagcgttcgtttatcaaaaaataagggggcttattttaacaaaatcaacatagacaagctatgactaatcattataatgaaactgctctacatcaaggatcttatctatgttagaactcggaaaacttcttaccacacttatcgcaccacctcttaatacctttgtattactgattattgcagcgattatttattgtgttcatttcaaaaaattagccaaatttcttgcgattataagtttcacttggctttatatcatgagtgtgccttttactggtttattgctaacaaataatgatgattctccagcccttacgctagatgagtataaacaagctcaagccatcgtcatattaggcggtggatcttaccaaaccaaagagctgtatgcagaaacggcttctggtgcaccacaactagaacgtttacgttatgcggcatttttacaaaaggaaacgggcttgcctattttaaccacgggctattctttgataggcatttctgaaggcgatttaatggcaaaagaacttaaccaattctttaatgtgccaacacaatggatcgaaaataaagcccgtaatacggaagaaaatgccagtttcactaaaaatattttagtgaaagatcatattcaaaaaattattttagtaacaaatcaatggcatatgaaacgagccaaatatctttttgaaaaacaaggatttgatgttcttcctgctgcagcggcaagctatggcagcaaaggaaatctatctgcaaaatcttttattcctgacttaggtgcgttaaatagcaatatggttttattaaaagagtggattggttattggaaagcccattatgtagaataatttgcttataaaactcgatgacttgttgtttgaaaagaaaattatatttgctcataaaaaaatctgcaccttagttagttgtttagtccaacttttggggtgcagatcaattcaaggcttttttattatatttcaacattttatctataagaaaaaccgaatcccatagagattcggctttaattatgttgtgtttgaaaattattctttatgtattatgacttacgctaattccgcacgtaattttttggttacatccaccatcacttttaattggtcgatggtttctgtccagccacgcgtttttaaaccgcagtctgggtttacccataagcgttcttttggaattacatttaatgctttacgtaataaatgttccacttccgccgccgttggtacacgagggctgtgaatatcgtaaacacctgggccaatatcatttggatatttgaaatctgcaaatgccgttaataattccatatctgaacgtgaagtttcgatggtaatcacgtctgcatctaatgccgcaatggcaggtaagatgtcgttaaactcggaataacacatgtgagtgtgaatttgcgtatcatcttgcacgcccattgagcttaaacggaatgcttcgcctgcccattgtaagtatgcgtcccaatctgcacgtttaagcggtaaaccttcacgaatggctggttcgtcaatttgaatgactttaatgcctgctgcttctaaatctaacacttcatcagataatgctacgccgatttgtttacatacggttgaacgtggaatatcgttacgcacgaatgaccattgtaaaatagtcacagggcctgtgagcattcctttcattacacggtttgtgaggctttgtgcatattgagaccagcgtactgtcattggctctgggcgagttacatcaccgtaaatcactggtggttttacacaacgtgaaccatagctttgtacccaaccaaatttagtgaatgcgaaaccatctaataattccccaaagtattccaccatgtcgttacgttctgcttcaccgtgaactaacacatctaaatctaattcttcttggcgacgtactacatattcgatctcttttttcattgccgcttcgtaatctgcaagagataactcgccttttttgaaacttgcacgtgcgtgacgaatttcagtagtttgtgggaatgaaccaatgtttgtagttggcagaagcggtaaatttaaccacgcattttgcttaacgatacgttctgcaaatggcgatttacgttgatccgcaccttttggcaagtttgctaaacgttctgccacttcagggcgatgaatttcttttgaggttgcacgtgcatctgctgccgcttggcttgcatctaatgctgcttgtacagacgctctgccattatttaacgcttgttttaatacgtttaattcttctactttttgtagcgtgaaagataaccagctgtaaagtgcggtatttttttcttttaattgtacttccacttctaaatcaaatggggtatgcaataatgaacagcttggtgcaatccataaacgctcacctaattttgcttttaatggctctaatacatctaacactttgtttaagtttgcacgccagatattacgaccttcaatcacaccagctgataacactttgctgtaatcttcaaatgccgcaagttgttctggtgcacgaactaaatctaaatgcaagcctgcaacaggtaaggcttttaataattcagcgtgttctgcaactgaaccaaaataagtggctaataataattttgcgttcactttgcttaattcagcgtaaacagatttataggcttcaacccattctgctggtaaatctaatgctaatgcaggttcatcaatttgaatccattctgccccttcagccactaatgcatttaaaatttcaacataaacaggcactaattgatttaataaatcgaaacggttaaatgcttcgcctttttctttacctaaccataagaatgttaatgggccaacaatcacaggtttgaagtttaagcctaaggcttttgcttcacggatttggtttacataatgtgctggattagctttgaaagcggtcgatttttggaactcaggcacaagatagtgatagttcgtatcaaaccatttggtcatttcaattgcgaattgatctttgttaccacgtgcaagttggaaatattgatcaagggttaaattttggctatcaaaaccaaaacgagcaggaattgcccctgttgccacttgtaaatctaaaatatgatcgtagaacgtgaaatcgcccactgcaacgaaatccgcattggcagccgcttgatgtttccagttttttcacgcaatgctttcgctaaatctaataaatcttgctctgctaattctttacgccaataacgttcttgtgcaaattttaattcacgttttgcccctacacgaggaaagcctaaaatatgtgatgttgtcataataactcccaatttaaagtaatttttttaatcatttagacggctaaacttctataccaatatagaatgcttgatcttcatttattatgcaaacttattattttcaggatttacattaaataaattcataatcaagcattcttttatctatcaaataacgatgaatcaattcagctaacttatttccttaaaattaatctcgcttacgacttaataaccaccaaatcattacaatgaaaagcaagctcgggatcaatgcaccaaaaatagcaggaataccgtaaactacactcgtttgtcctaaaatttcattaacaacataaaataagaatcctacacaaatcccagtaactatccttgcacctgcagtcacactgcgtagcgagccaaaaataaaagataaggctaataacatcattacgccaacggatacaggctggaaaattttacgccaaaacgtgagttcaaaacgactcacatcttgccctgtttcacgcagaaatgaaatgtaatgatataaacctgagatagataatgatgtcggacgcaaagaaaccgcacctaatttatctggcgtcaaactagtttcccaagtttctgataaatgattcgttgtgatgatttcatctttcataatcgttgaatgattaacttgacgcaatgtccatttagcttcatcttcagaataactcgcctggtttgcatgttttaattttattaaattatgctgttgatcaaaggtataaatataaatatcgtctaattttgtatcatccgtcacacgcctaacaaatacaaaatgatgaccatctttcgcccacacaccatttttaattgaaagtattgaaccaccagaaagagccttagcgcgcatatctcgtgcaaattgttctgtttgtggaattccccactccccaataatcattgtaaatactactaatggtaatgcagttttcattaccgctatacctattttaaagcgagaaaatccagctgattgcataataacaagttcgcttctgctagcaagattacctagtgcaattaatgccccaagcaatgctgccataggaaagaaagtttcaatatctttcggtatagttaaaccagtaaaaattaccgcttgccaaatatcataagtgcctttacctacactacgaaattgttcgacaaatttaataatcgccgacaatcccactaaagtcattaaagtagcaaaaatcgtgccaagaatactttttccaatataacgatcaagggtatttatcattttgccgatcctttcttactgaataaatagcgaaatttatacattatttcactgtcccagctattcaacaccacagcaagtaagaaaaatccgatattaacaagcggcattaaaagttcagcctctaattttcccgctgaacctgcagatttaaaagagctttgtaacaagaaataaattaaatagagtaaaagtgcgggtaaaattttggcaaatctaccttgtcgaggatttacgcgacttaatggtacagcaatcaatgccattaatggcactgccaaaattaaggtaatacgccaatgcaattcagctttcgcagaagaagaatctaaatcgataagttgagacaatgttaattctgctacttcatcattggtattttctgcggattgataacctaaataggcgtgatattcatcaaaatgcgtaatgcgaaaatctggcaaagcggaggttccttcaacccgttttgtatttttcaaatttaagacttgatcaccatttggcaacgcaattaattcccctttttcagctgttatcactgaaggttttgtttgtttttgaggtgtcatttgaaataaataaacattgcggatttgattatctttaatcttatcaataaataacacaacgttattattgttggtagaaataaactgacctgaagacagcacgccaacggttggattagcctttgcatcttccaccatattcacttgtttttgaattgcccaaggcgaaagccataatgcgttataagcggcaatacctgccgttaataaagacataatcagtgccactttaaccaaaatccgttgccccacaccgcacgcgcgcatcactgtgatttcactttcagcgtaaaggcgaccaaaagtcagtaaaatcgcaataaataaacatagtggcaacatcaactgcgccattgtcggcattcctaagcctaataaagagaaaaccaaatcagctggcacattcccatttgccgccgcacctaatacacgcacaaactgctgactaaaaaaaatcaatagcaaaattagtaaaattgcgatttggcttttgaaaacttcttttattaaatatcgaattaaaatcatcttatttcgtttgtttttctaaatctaaaacggaggaaaactggataaaatcggtcgcatatgataacttattttcgctgaattaaacagaaatttaaggacaacaaatgaaatatcaagcaaaaaataccgcactttctcaagccactgattgcattgttttaggcatctatgaaaataataaattttcaaaaagttttaatgaaatcgatcaattaacccaaggttatttaaacgatttagtgaaatcaggtgagctcactggcaaattagcccaaaccattttacttcgtgatcttcaaggtttatctgctaaacgcctattaatcgttggctgtggcaaaaaaggagaactcacagagcgtcaatataaacaaatcatccaagctgtattaaagacactaaaagaaaccaacacgcgtgaagtcatttcttatttaactgaaattgaattaaaagatcgcgatctttattggaatatccgctttgccattgaaacgattgaacacaccaattatcaatttgatcatttcaaatctcaaaaagcagaaacctctgttttagaatctttcatctttaatacggattgtaatcaagcacaacaagctatttctcacgccaatgccattagctcaggcataaaagcagcacgtgacatcgcaaatatgccaccaaatatttgtaatccagcttatcttgctgagcaagcaaaaaatttagcagaaaattctaccgcactttcattgaaagttgtggatgaagaagaaatggctaaacttggaatgaacgcttatcttgccgtctcaaaaggctctgaaaaccgtgcttatatgtctgttttaacattcaataatgcgccagataaaaacgccaaacccattgtacttgtaggcaaaggattaacctttgatgctggcggtatttcacttaaacccgccgcagatatggatgaaatgaaatatgatatgtgcggtgcagcctctgtcttcggcacaatgaaagccattgcacagttgaacttaccattaaacgttattggtgttttagcaggttgtgaaaatctgccagatggcaatgcttatcgcccaggcgatattcttaccactatgaatggtttaactgtagaagttcttaatactgatgcagaaggtcgattagtgctttgtgatgcacttacttatgttgagcgttttgaacctgagcttgttattgatgttgcaaccttgactggtgcttgtgtggttgcactagggcaacacaatagcggcttagtttctacagataacaatcttgccaatgcactactccaagccgcaacagaaaccactgacaaagcgtggcgtttaccattaagcgaagaatatcaagagcaacttaaatcgcctttcgccgaccttgccaacattggtggtcgctggggtggcgcaattacagcgggtgcatttttgtctaacttcacgaaaaaatatcgctgggcacatttagacatcgcaggcactgcttggttacaaggcgcaaataaaggtgcaacaggtcgccctgtttcgctattaacccaatttttgattaatcaagttaaataaccacaaaactggcacacgttgcacctttaaatcgattactctgctagttcggtttgctcgtgtgccatcagttcctgacccacatcatcaagcaaacttagataacgttcatattgtttcaacatatcggcaatcaattcatcttgatccatatattgaacatcgtaaccgactcgtccatcaaaaaaataagtgtaaggctcgtaagtaacactatgctgaatgtgcggtaaattttcatcgttaattaattgctctgacacttctcgcccaacagatttaataccatacataaaatctcgcattgattctttatgaattaccaattccaaagctggctcttcttgttcaaataatgtgttgatttctacacttaaattatattttcctgttaattcttgacgtaattctcgcatagcgggtaacgccgtatttttaaggaaacgtaaaatatctttctcttgcgtttggttcatcatttgctctaaatgtgatttccatttatcgccgctccagaaaatactagttggattgactttagtagaaaaatattttttatccgcaattaagcctttccataaactaaaacacattaccaacatcaataaagcaaaaggcaaggcaacaattaatgtcattgtttgcaaattagcaagtccaccagattgcattagcacaattgcaacaactgacatcaaagtgccccacattatggcttgccacgcaggagaagctaaacttttatctcgagatgcaatgttatttaacacataaatacctgaatccgctgaagtgataaaaaacaatgaaatcactaataagctcacaaagcctgttattgttggtaaaggcagataatttaaaaatttaaataataaaatttctggggaagaaataaattcgccaagcccgcccgcagcaatgccatcatttagccatactgctgtattaccaaaaacagtaaaccataaaataccaaataaacttggaataactaatacgccaaaaataaattcacggatagttcgccctttagaaatacgcgcaataaataaacccacaaacggagcccaagaacaccaccaagcccaataaagcacagtccatccgctaaaccagctagtatgttcttgttcataagcataggttttaaaactgagttgcactaaattgctgaaataattaccaatattgtcgctaaatgcagataaaaggtataacgtagggcctgaaattaaaacaaaaagaagtaaacaaaatgctaaagttaagttaatttcacttaatattttcacgccttttccaataccagaaatagcagaaaacaccgctaaacacatcaccacaacaataacgccaacttgtaaggcaaagctgttctgacttatccaacctatttgttcaagccctgcaccaagctgtgatgaaccaaaacctaatgtagtaataatcccaaataatgtggcaagtaatgccataacatcaatcgcatcgccaattttgccattaatacgatcttttaataaaggataaaaacaagagcgcaacgctaaaggtaatttataacgaaacccaaaataagctaatgctaaagcaatggtgccatatactgcccacgcgtgaattccccagtggaacaaagtatgaagtaaagcctcttgttgtttatgttctgcagaacctactgtaatgtcagaaagataatgggttaatggttctgctacgccaaaaaacatcagcccaacccccattccagcggcaaataacatcgcaagccaagataagaaactaaattcaggttcttcttcatcttgccctagttttatattgccaagactacttactgataaaattaataaaaatcctaaaaacactgaaaaagtgagtacataaaaccaactaaaattagcaaaaataccacttttagcttgattcaataatgcttgagtttgctctggcgcaataaaaatcattgccatcagtaacaatataaaaaataacgtaacgccaattaccaaaggattaaatgacgttcgctttgtcataaattgagataaagacaaacttttccccttaacgattaaatgaatagattaaaaatagatttaataaacattgcctagaggcaaaaatgtgtaatggaaccactacaaaggacagcacatagaagtgcgattttgaaggaaacgttcagtaggaattgaaggattgtttccaaaaacttgtgtatattaacaaaatacagtcattatttcaaattagtgaaagctaaactaaaaaatgcggtaaaatttacaaaataatttaccgcacaaatatcatttattttaaagccatttctacaaggatattattgcttttaagccaattcttctcccctcttttacaacattttctaaccgcactttaaatccgtgtaattccgcaattcgcataacaatagaaagtcccaagccacttcccttttcattttgcccagctggacgataaaaacgctgtccaagttttttcaaatcttcaggttcaacgccaccaccattgtcctcaataataatctgtgaggatgaaatttttactgaaacgattgtatcttcaggacaatatttaatagcattgtcgagtaaatttctaagcatcaatgaaactaaaattgattgcccttgtttttgctttggttcagattctttctcaaaaaccaaggtaattttacgtttttctgccacaaaataacgctcagaaattaatgattgaacaatagcttcccaatcaagcagctgtagtgtttctaaggcttgcaaattatccaagcgggaaagcgttaataattgttcaatcaattgcgaagcccgatcaatgccttgcgttaaatgtaaaagtgcttgttctcgtaacgctacatcatcgccagctagttgcgcaacttcagtttgaatacgcaatgccgccaatggactacgcaattcgtgagctgcatcagaagtaaaacggcgttcgcgttgcaacatagctgaagtgcggtcaaaaaattgatttaaattttttactaagggtaaaatctcaacgggtagcccctccgtattcagcaatgacacatcgccagattttctcgtttgtacttcttggcttaaacgtttaatcggtcgaagttctttatgaatcaaccatcctaaaacaatgatcaaaataggcaaactggcaaaccaaatccacatttgccccaaaatcatttcttcaattaaatcttcacggtaatctaattcttgccctactgcgataactaattctccattagctgccatacgccaaaaaattcgccatttatcgtcatcatcataaatattcgcattataaaaccccgttttataattaaaaataaaatcttttccatttcgtccatcactgaataaaagtttcccagttttagaaaaaatagcaaaggctaaggcatcatcgtcataacttttttttaataccgactgtgaatttttatttagcgttgtgctagattccaacaaaatagtacttaaatctgaatttgcgagccgttcagcaaagagaacttgttgtgcatcaaaaactttattcacatcgtggcgaacttgccaccaagccacaagcgtagaacccagccaaacaaaaagtgcggttaaacaaagcacagaaataagacgcaacgtaaggcttctatttttcatttttcaacttgtcccaaagcatatccaacaccgtgtaccgtgcgaataaattgtttccccaatttttggcgtaaattataaatatgcacatccaatgcgccactgctaatttcctcatcccaactggataatttttcttcaatggatgagcgagacaatacgcaatctttattcagcataaataattcaagcaatttatattcacggcttgttaaagaaatgggttgattattcagccaaacagaacgttgattctgatctagcttaacaccagcctgttctatcacagaatgatgatatccataacgacgacgaataagggcttgtaaacgtgcggcgacttcagccaaagcaaaaggcttgcaaagataatcatctgcaccactttgtaaacctttaactcgttcatctaaagtatcacgagcagtcaaaattaatacgggaacatcttgatgattagatcgccattgttgcaatacatctaatccatcaagtttaggcaaggttaaatccaataccaccgcatcataagatgcagaggttaaagcagccattcctgtttttccatcggtaaaccaatccaccgcaaaaccaagtttagttaaaccaatctgcaacccattgccgattagattatcgtcttctatcaataaaattctcataaaaaattgaccgcactttatagacaaaaatagcgagctaacgcccgctatcttcaaagataattattctgctttttcaacgcgcaatacatcaagttctgctttctcaaaggcttcgttatccaattttccataaattttcactttatcctttgaatctacgtttaaaccattccaaacgcgttttttgatttcaatcttgatttgccctgtcccatcagtaaaccaaaattcatcgtcatcaatttgttgtgtaatattacccaccaaagtaatcattgaattatcagccgcagataaagcttgttttacgctaattgcagcaggggctgtttgttgaaaaccaccttgactattattgccattaaaaccagcaaatgctgaagtggttgctaatgcgaagattgttgctaatgcaaattttttcataacgtttcctttttaagttagttaatttcaagcaccattgcttggatgtgtgtattaaaacaaataaatcttaataaaagattaagaggactatacttttttggtaagactttatcaaggcaattttgcgaccactgcatagccttcaattaagccgtccacttcataagaagcatttgcagtaataaaagcaacctcaccttgtttcaaagaaagtgcggtcgtttctgagcgtaaatttaactgccctttcattactaataaaatactcgcactttgtgcttttaaatgatgtgtttcgccacattcatattgaatattttgcaaatcgaaatcttttgctggcgtggcgtaagtaaatatgcgtgcgtcttgaggggctgttggaataattttaggctccacttcacggcaatcgacaattttaagcaattctggaatatcgacatatttaggcgttaaaccacctcgaattacattatctgaacaagccatcagttcaatattttgcccacgcaaataagcgtgtggaatgccagcatcttgggaaattccctcgccttttttgagatgtacaatattaaacaaatagaaacaaattaaacctgcatctaatttatctaaagaaatattcatcgcatcaatagtgtaaagcacccaataatctggattaattaaatcaagattgttagcctcataagctgcttgattctctaacagaatcggggaaaaccattggtacaatagcgtttgatctgcctacataatatcagcataaaaatcaggtaaatcttgttcctgcaatttttttgcaagcttctataatatccgatttatttttaaaaccatgcaacaaccagaaatcagataaagcaatcatcatttcaggtttatgattgttatctttataagtacgtgttgatgcttttaaatcaatgcctttcgcattttcttccgcaaaacctatttcagcttgcgtttttgttggatgaagttgaatggaaagaggttgggcgacatcaagaatttttaataaatacggtaattcatcagcaggaatattcagtaattctggaatatattgatgccctccccatacgtaattttggagtgagcctgtaagtttataaatcattatttatttctattttaactagcgtaaccgtgggtaagtatacccacggctagttatagtcgttcctctttgaggaatctcacactaccccaacggggtagccttaaaattagcctaggatatacctaccctaggcaatttgtcttcccctagattatttatttaaccgcaggtaagtatacccacggttagttatagtagctcctctttgaggaatctcacactaccccaacggggtagtattgagattaacctagggtatacctaccctaggcaatttgtcttcccctagattatttatttaaccgcaggtaactataataaataaaaaatccgcacaaaggcggacttttttttatcgtaaacaaattatttctttaaggctaatactactgattctccagccactacttcgcctgatttttttacgatacaagaaatttcatccatatttgaaattacgattggtgttaagacagattttgcttttgattctaataaaggaagatcaaattcaatcacggtatcaccacgcttaatagattgaccttcttgtgcaatacgagtaaagccttcgcctttcaactcaacagtatcaataccaaagtgtacaaataattctacgccttcttttgattccattgaaaaagcgtgattggtttcaaaaattttaccaatcacaccatccactggcgcaacgattttgttaccaataggacgaacagcaataccatcgccaacgattttttcagagaaaaccacatcaggaacatcttcaatattaacgatctcgccagagatcggtgcataaatttcaacttccacagatttgttttcttttgaaccaaataacttgtcaaataagcccattttaatctcctatccattcaagatggatgctattttaacgtaaaatcaaatacttttgtttaatttaatgaattttccagcaaaaattcttcaattaattgatcaatttctgcagcggtcggtttttgtaatgcggcatcagcaagcgcttttgcatcttggaaatttacattacggattaattttttaatgcgaggtacagaaatcgcactcatgctaaattcatctaatcccataccaagtaacaataaagtcgcgcgttcatcccctgctaattccccacacattcccgtccattttccttctgtgtgagaggcatcaatcacttgtttaattaaaccaagcacagaagggtgcattggattataaagatgggaaataaactcattaccgcgatctacagccaaagtatattgagttaaatcattagttccgatactaaagaaatctacttcttttgctaaaaattttgcatttaccgccgcagagggagtttcaaccatgacacccacttgtatgttattatcaaaaactctcccttcttcacgtaattccgcctttaatgtttcaataaccgcttttaattctcgaatttcttctaccgaaataatcatcgggaacatcactgccaatttaccaaaagctgaagcacgcaataccgcacgtaattgtgcatttaaaatttcacgacgatctaacgcaatgcgaattgcacgccatcccaagaatggattcatttcttttggtaaatctaaatatgaaagctctttatcgccgccaatatccatcgtacgaagcacagttaagcgtccgttcattgcttctaccacttgtttataggcaataaattgttcttcttctgtgggaagctgttcacgatccataaataaaaattcagttcggtatagcccaatcccttccgctccattacgttctgcgccgtcacaatcacgaatcgtcccgatattcgcgacgatatcaaccttatgtccatccaatgtaatagctggaagatcttttaatttagctaactctgctttttcctcagaaattttcgcttcaagtgcttttaattcatcaatttgagatgccgttggattaatataaacttgattatttatcgcatctaaaattaagtaatcgcccgtattgactaatttagtcactttatttgtgccgacaatcgctggcaattctaaagaacgtgccataatcgaagtatgggaagttctgccaccaatatcagtgacaacccctaatactttttcgagattaagttgggcggtttctgagggagtcagatcataagcaacaagaatagattcttcctgaatatcgccaagatcaacaatgtgcatgcccaaaatatttttaactaaacggttagcaatatcccgaatatcgcctgcacgttctttcaaatattcatcatcaatttcagataacattgtcacttgttgatctaaaattttactcgctgcaacccctgcattcactttatttgaacgaagataatcaagaatttcttcttctaattcttcatcctcaagaatcatcaagtgaccttcaaagattgcggctttttcctcgcctaaagaaattaatgcacgttctctaattgaattaagttgttctaccgccgcagcacgcccttcataaaatcgagcaacttcttcatcaatttgatcatctgtaattttttgcgtatcaagaacaatcttttcttctttaagaacaagtgccttaccaaaggcaatacctggggatgcgagaatgccagaaatcatagataccttccgaaacaattaacaaagtaataaataaacaatagccataaaatttcacaattttatggctaagtaagaattattctaaagtaggaattaacgcaactaaatgttcaactgcctgttgctcgtcttctccatcagcagaaatggtaagtattgttccctgcgttaaaactaatgtttgcaacttaaataagctctttgcacttgcacttttcccccctgaggttactgtaatttcagaagaaaatgctttcgcttctttcacaaattgtgcagcagggcgcgtgtgtaaaccgtttggtgcaataatttccacatcttttgaatacataatgctacctcgactaatcaataattaaaaatataaaaccagaaaattgccctagtatcctttttcaaaacaaaataatcaagaataaacactaaaaagcctgaattaaatcataaaaataagctaaatagtttatttattattcacaatctcaatcgttaaactaatgaaaaatgacgttgtgattttgtttcacttaaactttcaattaatcgatgatagctatcataacgaacaggcgaaattttgccttgctcaacggcttcacgcaacgcacatccggggtcgctcaaatgtttacaatcacggaatttacaggtgcccaaaacatattgaaattctcgatagccttttgtgatttgctctgcatctaaatgccaaaggccaaattctctaattccgggcgaatcaattaaattaccgccttgtggcaaatggtaaagacgtgacgatgtcgtggtatgctgccctaagcctgatgtttcgctcacatcccctacttgagcgtttacgctaggcaaaatatgattaattaaactcgatttaccaacaccagattgcccaacaaaaatcgccgtgccttgtgccaaaagtgcggtcaatttttccatattttcaccgctctttgctgaaatcattaaaatttcatagccaatatcttggtaaattttaagttggtcttcaatttcttgacgctgttcttgtgccaataaatccactttattcaaaacaatgagaggcgtgattcccgcaatttcacacacaacaagataacgatcgataatatttaaggaaagcgttggcaacaccgctgatacaataataatacgatcaatattcgccgcaataggtttcaaaccatcataataatcagggcgggaaatttcattttctcggggatggatcgcctcaatcacgccactcacaccttgtaattgttcattgcctttacgccaaacaactttatctcccaccaccaaactcgacaaggtacgacgcaaattacaacgataaatttcgccttgttcattttcgacatctgcgtgaatagaataacgtgtgaccacaacgccttcttgtgattcgccaagcatttcatctgaccattcaatgtcttttttcttatggcgatgtaatgttttcgcattattcgattgaattcttctagtttggttttgagttaatttacgtttagccataaaagtgcggtcgttttttcccttgtttttggtaaaatgaaaaaaatttttgcataggatacctgatattatgccattcgataaacaaaatcttatttggattgatttagaaatgaccggtttagatccggaaaaagaacgtattattgaaattgcgactattgtgacagataaaaatttaaatattttggcagagggcccagtattagcggttcatcagtctgatgaattactcaataaaatgaatgattggtgccaaaaaacgcatagtgaaaacggcttaattgaacgcgtaaaagccagcaaacttaccgaacgagcagcagaattacaaaccttagactttttaaaaaagtgggttcccaaaggtgcatcgccaatttgcggtaacagcattgcccaagataaacgcttcttagtgaaatatatgccagatttagccgattattttcattatcgccatttagacgtgagcacattaaaagaacttgctgcacgttggaaacctgaaattttagaaggctttaaaaaagagaatacgcatttagcgctagatgacattcgagaatccattaaagagctggcttattatcgcgaacacttcatgaaattagattgacgaaaacttcaacaaaaaatttctttttatgaaattgcccttgcaagccctaaaaatatttgtataattcgggctcattcactgatgtgaactgcgggaatagctcagttggtagagcacaaccttgccaaggttggggtcgcgagttcgagcctcgtttcccgctccaatttcacattataaaagcattattgcgggaatagctcagttggtagagcacgaccttgccaaggtcggggtcgcgagttcgagcctcgtttcccgctccaaatttcaatccttagccaaaaggctggggattttttctatctacaaaaatagatcatcaaaatgttaaaaagtgcggtgaattttctcaaaaaataaaggcttgtgatttaataacacaagcctttatttttatgctttcttcaaccgtttggcacgacgtttcattcttcttacccaacgggtaattcgccatgcatgcgtaattgaatagacataaaggaaaaataaaatgaaaaagccaacaaacatcgcccattcattcacataataaacttcccctaaaataccgatagttgcacaaactgcagaaacaaacgtaatcaataaaaaggcttgtcttgatgttaaacccgctcttaccattaaatgatgaacatgtaaacgatctggacggaatgggcttttacctttacgtacacggcgataaataatcgcaaccatatcaatcaaaggaatcgcaataatccaaagtgcggttactggattcataggatgcccttttccttgcgtacttaataacaaaatccaaataatggtaaagccaattaatgtactcccggcatcccccataaacaccttatattttggtccaaatggaatccctagattgagcatcaaataaggtaaaatcgatacgattaaagcaaaactccaatgcgccatatccatttgcccatctcgatacattaaaataccaatcgccgcaaaagaaacacaagagagtcccccaagcaatccatcaataccatcaatcatattaaaggcattaataatcgcaatagtggcaaagacggtaataatcaaaccaattgaaccaagcgttaattggaaaggccctaaaatttgaccaagatgatcaagataaatattcccaagatcgatcattaaaatcgccaatattgcttgaatgcctgctcttaaaaaagggctaatatcaaagcgatcatctaaaatcccaatcgccaataaaacaaaaatactgaacaaataaagatacggtaatcgaagttgatcccattccatcagataatagcaaagattaccaacaaaaagcgatacgccaccgattagtggaattgtgccttgatgacgtttacgatagtttggtttatcgactaatccaatccaattggcaagtggtcgcatcacaatcaatgttaaaaacgcgccaagaaaagtaacaaaaatactcagcatagtgtgaccctaaaattttttgtaaaggataacataaggcaaatttacctagaaatatatttttataaaaaggactatccaatatttcgatacagcacgttacgtaatatttctctttgttgagaatccagagcttgcccaaattggttcgtcaaaataaaaaaatcctcggctttttcgcctacggtggtaattttcgcatttaataaatttagatttaactcagtaaaaatctggctcacttgggctaataaccctgctttatccaaggcaaccagttccatttgagtatgttcttttttgttttcctgtaaaaaacgcacgtcggtttgtacagtaaaatgttgaagctggcgattaggcacaatagaaagtgcgggcaatttttcactttgaagggctaatgttagggcttgctctaattctcggcgacgatcaaattcaaccaattctccgttaagttctgtgatgataaagctatcaaaaacataaccatcttgtgtcgtaataatctgtgcatcgtggatactgaatttttttgcgccaatggtactcaccactttattaaataagtgcggttggtcttggcaataaataaacacttctgtgccgccaagtgaaaagcgattactaattttcactaataatgcctcaacgaaatccaccagcaaacttgtatgccacgcaatttgttttggcgtattacgcacaaaataatcttctggacaacgagcccataattgctcaatcgaaattggcgtaatatcagaataatcccgcattaaaatttgttgtgcaagttttcggttttctgccgatttttctgaataatcaagcaattctttcatgccttgtgaaaattgccgtcctgtaaattcatataaagaggcaaaaagcgaacgtttccagctattccataaattaccattggttgcacaaatatccgccaccgttaaacaggtcagataatctaatcgaacttgattttgcacggcttccgcaaaattcatgacgacttcaggatcatgaatatcacggcgttgcgccgtaattgacatcagcaaatgggattttacgagccaagcaagggtatcaatttctcgacgatctaaaccatgtaattgtgcaaagtctgcaatatccacagcaccaagttctgcgtgatcaccacctcgcccttttgcaatatcgtggaacaacgccgcaatataaagcaaagtgcggtcagaaagttggctaaaaattcgatgagcaatgggatgttcttgcgcactttcctgtgacagaaaactttccaatttcaacatcacgcgcaatgtatgctcatccaccgtataaatgtggaacaaatcaaattgcattaagccctcaatggcttgccattgcggaagatacgcagttaatacaccatattggtgcatcggcataaacgcacgtttaattgcattaggttgattaaataaacgtagaaatttttcccgagcggcaggaatttcgcataatttttgtgataattgatctaaggaaatttgtaattgacgcaaagtatcagaatgaatattggcatgttcgtactgcgttaaataaaagaatagatctaaaattcgcgctggtttttcttgaaaaacaaagctattacgcaaacataagcattggttaatcagttgaaaatcatcgtctaattggtcaattacagtatcctgatttgatggaagcacattttctcgataatgctgaatcagtaaattactaatcagcgaaattcggtgcaatgcttggaaaaaacatttcatcattttttccacagctggattgccttcccctcggaaacccaataattcactgactttaatttgacgatcaaacaacagacgattatcgtaacgtttcaaaatcaaatgcaaagcgaaccgcactttaaataaaaatgcacgactttcttgtagttgctgatattcttgaggataaataaaaccactttgtaaaatagcctcaagggtcaaagccccagaatggcgcaacgccacccaatacaacaaatgcaaatcacgcaagcctccagggctgtacttaatatctggctcaaggttataagccgtattgtgataacgctgataacgttctatttgctcttgcactttggcattaaaaaaatcttctttcgaccaaaaatctgcacgttttaccaattcatttaatgcatcaaagtgcggtcgatttccagcaagaaatcttgcttctaataaattggtggcaatcgtaatatcttgtttcccttccgattcgcattgttctaaggttcgaacactatttcccacctcaaaaccgcaatcccataaaaactggataaattgagtaatcttttcttcaatctcagggcttggggtttgctcgactaaaatcaaaaaatctaaatccgacaaaggaaacatctcacgccgtccataaccgcccaccgcaattaaagcaatccccagttgttcacttaattctatttcctgccaaagttgaatcaataaggcatcataaaaatcacagcgattttcaataagctcaaaaatggaataacgagaaaaattctcgagctcaaattgcttgagattttctcgttcaattttgaccgcacttggcgttaaaggagaagatagtgtcggagaaaacagcatatgaattgccttttgttagatcgaagtcgttttattataaagaaaaacaaaaagggcgtatatctacgcccttatcttataattttatgtcaattacacattcaccataatccgcgaaattcgaccttctgcaatttcttcatcgcggatagtcattacttcacaaccagtttccgtgacaacaagttgatgttcgtattgtgctgaatggctgcgatctttggtttttactgtccaaccatctcccattacgcgcacttcttttttgcctgcgttaatcattggctcaatagtaaacaccattccgggttttaaaatcacgccgccatcatcggcgtaataatgcaatacttgaggttcgcagtgaaattccgtaccaacgccgtgtccgcaatattcacgcacaacgctgaaagtctggctttccgtatatttttgcacggctttacctatttcatttaaacgaatatcgggttttacagtgcgtatcccaacatataatgcttcttgtgccgcttccactaattttttactacgaatattcgtttcgccacccacgatatacatttttgagttatcgccaaaataaccgtctttaatcacggtaacatcaatattcacaatatcgccattttttaacactttatcgtcacttggaataccgtgacaaacgacttcgttaatggaaatacaggtcgcctttgggaaaccgtgataattcaaacacgcagggataaccttttgttcatttaccatatattcatggcaaatgcgatcaagttcgcctgtggttacgcctgcttttacgtaaggttcaatcattaccagcacatcggaagccaatttgcatgcctcacgtaactttacaatttctttttcagttctaattggaatagccatttttatctcacttttttgaaaaaactttgcgagattatagcacgatttctaggaaaaaactggattgcacttgaatggagtaaagggttattagataatggcgggattgaaattttaggaaagtaggaaatagttatgatagatgatatggcggtgccactgacatttactgatgcagcggcaaataaagtaaaaagtttaatcagcgaagaagaaaatactaatttgaaattacgcgtgtatatcacagggggtggttgcagcggtttccaatatggttttacctttgatgaaaaagtcaatgacggcgatttaaccattgaaaaatcaggggttcaacttgtgattgacccgatgagcttacaatatttaatcggcggtacagtcgattatactgagggtttagagggttcacgttttactgtaaataatccaaatgctaccagcacttgtggctgtggttcatcctttagtatctaagatggattttcaatttacacattatcaaggcaatgtatccgtcaaatgttcgatggaacacattgcccttgctaactggttcaacacagaagtgcggtcaaattcagacaagattttaaccgcactttctactgcaaaatcacttattgaaaatcaagaaaaagtcttagtcggtgcggaatatacgttatttttaaatgctgatgaagtaatggtgcgcgccaacaatctcgccattgaatcagatgaaattttagaacaagatttccattattatgatgaagaaagccttgctttttgcggtacgcaagattttattcattttctccaatcttatgttgattttattgcttaactcactatgacttctcaacactccgctaaaaaatcatcgaaaaacacgccaaaaaataaccgcacttttaaaggttttttacttaaatttagcttcactgcacttgtcttaacgattttttacggcggttatctcgattggcaaattcgttctaaaatggacggtcaaatttggcatttgcctgcggaagtttatagtcgcttagaaagtgtgaaaattgccgataatctcgcttttgatgaagtcattcaaattttattagataacgaatatcgccaaactacaatggttgccgcacctggcgatttcaaattagaagatgatagcattgtaatacttcgccgtgcttttcctttccccgataaagcagagcctcagcgagttttgcgcttgcgttttagccataataagttatctcgcattgaagatttagtcacagtcaaaactgttgatgaatttcgtcttgcaccaaagttgattgcgatgttgcaatcagacaacgaagatcgtttagctattcctttacaaaattatccccgtttattaattgatacattaattttaacggaagatcgccgcttttatgaacataatggcattaatccagtggggattttacgcgcattaattgcgaatattcgtgcaggtcaaacggtacagggcggaagtacgctcactcaacaattagtcaaaaatttatttttatcgcgcgaacgcaccattacacgtaaagccaacgaagccttgatgtcattggttttagattggcgttacgataaaaatcgcattctcgaaacctatcttaatgaaatttatctcgggcaaaatggcgatacgcaaattcacggttttgaattagccagccaattttattttggtcgttcgattcgtgaaattagcttagatcaaattgcccttttagtggggatggtcaaaggcccttcactttataatccttggcgtaatccacaaaacgcactcgaacgtcgcaacattgttttaaggctaatgcttgaacataaaatgatcggcgatgaactttatcaattattaagtcagcgacctttaggtgtgcaaaagaaagggcaaatctcgcgtaaataccctgcatttattcaaactttacaagcagatttacgccgtgaactgggcgaacacaaaatatccagtttacttggcgcacgtattttttccacaatggatttaaaacaacaagctcaagcagaaaatgcagtggtcaataccgtttcgcaattacaactgaaaatgaaaaatccccatttagagggagcgatgattataacggattatcgcacaggcgaaattcgtgcagtagttggcggtttacaaacgcaatatgcaggctttaatcgtgcattaatggcaaaacgtcagattggttctttagtaaaaccttctatttatttgaccgcactttctaacccagaacagttccgtttgaataccccaattaataaccaaccaataacaattaatgtcaaaggtagcccgccgtggcagccacgcaactatgacaaaaaatatagtgattcagtaatgttaatggatgccttagcccgttctttaaatattcccactgtaaatattggtatgaaagttggcttgagcaaagtcattgacacgcaaaaagcgatgggctgggacaacgtggaaattcctaaagtgcctgcgatgttgctcggttcttatagcatttcgccttatgatgtcacaaaactttatcaaacccttgccaatcaaggtgggagaattgcgcttacaaccgtcgatagtattgcagatcgtcaaggtaacctaatttttcaacacgataaaagtgcaaaacaagtggtgccacaagaagcggcattccaaaccttatttgcaatgcaacaaactgttgaacgtggtacagctcgcagtttgcaaaaggattacgctgatttacatttagcaggcaaaacaggcacaaccaatgaatcacgcgatacgtggtttgtgggaattgacggaaaaaatatcagcaccgtctggcttggtcgcgatgataatggcgaaacaaaactgactggtgcttctggcgcattgcaaatttataaagattatttaaaccgtacaaatattgaaaaattagcaattactccccctacaacagtgaaatgggtggggataaatcaatacggtgactgggattgtgagagttatcgaacaattcctgtttggctaaataatggtcagaatttctgtggcgaaacatcatctccctctctcacgccaacaactgaaacagaaacaccaccacaagaaagcctgtgggacgtattggataatcccaatccacccgctcaataattaagccgtaggatttactaaatttccaataataaacattttccccctatacttcccctaacatttcagaggatttttatttctttttaaaaaatagcaaacgtttgctttatttgatttaaaagtgcggtacaatacgcaccagtttttactttcatacaggtgcaaaacaatgacacaacaactccccattttaagtctaaaaaaaatatattcaggcaaagtacgcgatctctatgaaatcgatgataaacgcatgctaatggttgcttctgaccgcttatctgcctttgatgttattttagatgatcccattccacgaaaaggcgaaatcctaactcaaatttccaatttttggtttaataaacttgctcacattatgcccaatcatttcactggcgacagcgtttatgatgtgttaccaaaagaagaagcggatttaatcagaaatcgcaccgtcgtgtgtaaacgtttgaatcccattaaaattgaatctatcgtacgtggttatttaactggcagtggtttaaaagattacaaacaaactggcacgatttgcggattaaaattgcctgaaggcttggtggaagcgagtaaattacccgaagctattttcacgccatcaagcaaagaagaagttggcaaccacgatataaatattagctatgcagaatgcgaaaaacttatcggagctgatttagccgcacaagtaaaagaaaaagctatcgcactttataccgtggctgcagaatatgcactcactaaagggattattatttgtgacacaaaatttgaatttggtttagatgaaaatggcacgctcactttaatggacgaagtattaacgccagattctagccgtttttggtctgtggatacttaccaagcaggaacaaatcccccatcattcgataaacaatttgtgcgcgattggttagaaaatagcggctggaataaacaagctcccgcaccaaaagtgccagaaaatattattcagaaaaccgttgataaatatcaagaagcactggatttattaacaaaatgaaaattaggattttttatgcacaaagctaaataaagatttttgcttttaatgcacaaaacactagacaaagaggaaaagtgcggttatactctatcgaatttttattcacaaaaatcgattatttattcaattctaattattagtaaggaaaatatatgtcaaatactattctacagaatttacctaaaggacaaaaagtagggatcgctttctctggtggtttagacactagtgcagcattactttggatgcgtcaaaaaggcgcagtgccttatgcctacaccgctaatttagggcaacccgatgaagatgattacaatgcaatccctaaaaaagccatggcgtatggtgctgaaaatgctcgattaattgattgccgctctcaacttgctcatgaaggcattgccgcaattcaatgtggtgcattccatatttctacaggcggcattccttacttcaatacaacgcctcttggtcgcgccgtaacaggcacaatgcttgtagcagcaatgaaagaagatgatgtaaacatttggggcgacggctccactttcaaagggaatgatattgaacgtttctatcgttatggtttattaacgaacccgaatttaaaaatctataaaccttggttagatgtacaatttattgaagaacttggcggtcgtttagaaatgtctcaatttcttattgaaaatggttttgactataaaatgtccgttgaaaaagcctattccactgattccaatatgctcggcgcaacccatgaagcaaaagacttagaacaattaagcacaggaatgaaaattgttaagccgattatgggtgtcgcattttgggatgaaaaggttgaaattaaacctgaaacagtcacagtcacttttgaagatggcgtgcctgtggcattaaatggcaaacattttgataatgctgttgatcttattctagaagccaatcgtattggtgggcgtcacggtttaggaatgtcagaccaaatcgaaaatcgtattattgaagccaaatctcgtggtatttatgaagcaccaggaatggcattattgcatatcgcttacgaacgtttagtcacaggtattcacaatgaagataccatcgaacaatatcgtattaatggcattcgcttaggtcgtttgttatatcaaggtcgttggtttgatccgcaagcattaatgttgcgtgaaacagcacaacgttgggtggcaaaagcaattacaggcacagtaacccttgaacttcgtcgtggtaacgacttcacaattttaaataccgaatcgccaaacttaacctacgaagcagagcgtttaagtatggaaaaagtggaagatgcgccatttgatccagttgatcgtatcggtcaattaacaatgcgtaatttagatgtatcagacacccgaggtaaacttggcatctatgcacaaacaggtttattaagcgcaattaaagattccgtattgccacaattaggcaaaaaataaataataaaatctgcatttcaatgactgatatttaacatcatgaaatgcagatcctttcacaaaatattagttagctaaaaaaactagaaatataagaaataatcgtttttccacttaatattgccataataatcacaacaaaccagcctgaaaaagctaaaaaaacagggtgtttataagtgccaacaatatcacttctgtaagcagctaacaaaattaatgccaatgcaatcggcaatattaagccatttaatgttcccacaaagactaataccgcagcaggctttcccacagtgactaaaacaacagtagaaatcacaataaaagcaataatccaacgattacgattgcgttcaatggttggacaaagggtcgttaagaaagaaactgaagtataagccgcaccaataacagatgtgacagacgctgcccaaataaccactccaaataacacttgaccaaaattgcctgctacatattcaaaaggcgtttcagctggatttttaggattaagagacacaccttttgacaccacgccaagcaccgcaagaaataatacaacacgcattgttgaagcaattaaaatggctgatacagaactacggctcacttcagccattgctttttcgccttgaatgcccgcatctaataaacgatgcgcgcctgcaaaagtaatataaccgcctacggttccccccactaatgtaacaatagcaataggatcaattttttctggaataaaggaatgatacgctgcttcagccacaggtggttcagttttaaacattacataaaatgtgagcgcaaccataataaagcccattaattgcgcaaaacgatccattaataagcctgcttctttacgcaaaaaaatcaaaatagcaataataccactaatcactgcgcccatttctggtgctataccaaaaatagaatttaaaccaagccccgcgccgccaacattgccaatgttaaaagccagcccgcccatcacaatcagcgcagcaagaaaataccctgctttcggaaaaaccgcattagaaatatcttgcgcgcgtttgccagacacaataacaattcgccaaatattaagttgagccccaatatctaacaaaattgataataaaataacaaagccaaaactcgctaataaagtatttgtaaaggttgcggtttgagttaaaaatccagggcctatggcggatgtcgccattaagaaagctgcccctaaaaccgcatttcgtctgtgagtaattgatgccataaagcacctccattgttaagttgatgttatgtgtttattcggcttatgccgttattttgatatgatttttttctaattcttccacaatgcgtttagcaaattgtaaagaatgttgattatcgccgtgtaagcaaatactttctgcttttacaggcacaaggcttccatcaatggcattgacttgcccctttgttaccatttgtaacacttgttgaatggcttccttatcagattccaccattgcatttggttgagaacgaggcaccaaactcccatcaggcatataatgtcgatcggcaaaaacttcagaaatcgtttgcaatttttcttcctctgcgatgcgcaacattaaactgcctgctaaccccattaatttcaaattcggatcaaattgataaacggtttgtgcaattacacgcgctattttttcatcttttgctgcttggttatataacgcaccgtgaggtttaacataactaattaccgccccctcgccatcacaaatcgcttttaatgcccccaattgataacgcaaatgtgcgattaattcctgtgaagacaacgccattgccgtacgaccaaaattttcgcgatcaggaaaactaggatgtgcaccaatacgcaccttattttctttcgcaaatttgaccgcactttgcatttcctttgcgcccccagcgtgtaagccacaagcaatatttgcagaagaaagcaactgcaataaactttcatcaaaaggaaaaccctctgcaatatctgcatttaaatcaatttttttcatcaacaattctcctaatttgatcaaggtatatttcatttttacggcgtaatttagcagcctcttgtaagctaaccgcttcaaatttaatcgttgaacctaaacgtacctgtgccaaagccccaagatcagcatcaatcacattagcgattttaggataaccgcctgtggtttgcgcatcagccatcaaaataataggctgaccacttggtggaacttgcacactaccaaactgaatggcgtgagatagcatttccaacggctgctttaattctaatgtctgaccttgaaaacgataacccatacgatcactgttactttgcaacgtccattcatttcgccaccaataatattgggattttcgtttaaacgcctgatattcagaagatggcaaagcacgaataacatctcgaagcggaatcggtgcaataccaatttcgctacgcaaaatatgatcatttgccgtttgtagttgatcgcccgcctgcaaacaacgcccctcaatgccccctatttccgctctcaaatccgtgctgcaagaattcaatgcttgaggcaaaacaaaaccaccttgaacacataaataaccatacattccaatttttgcacgtgtcatttttaatatttgacctgctcgcacttgataacgccaataagcaaaaacgggcttatcatctaacatcatttcataaaaagcaccagtcacacaaaaattcatatcttgctgaaattgcaatgtaataccgcctaaaggcacttcaatggcaggaacattctctgcattgcccaataaaatattgcctgcgcgtaatgctaatttatccattgccccacaatggctaatgccaaatcggcgtaaaccaaaacgccctaaatcttgaatggtggcgcgggatttcacatcaagaatatcaatcatagttcaatcccatccacaataaatttcacagtatcgccagcttgtaataaggttggttgtgcttgatttttatcaaaaagtgcttgtttagtataaccgatcaactgccacccacctggcgaagaaaaaggataaatccccgtttgcgcacccccaataccaacagaaccagcaggaacaaccgttcttggcgtggcgcgacgcggcgtgtgtaaattttcaggtaaaccacccaaataaggaaagcccgcttggaagccaatcatatacacagtataaataggctcactgtgcatctgaataatccgctttggtgttgtctgatgaaatttcgctacatcagataaatcctgacctcgctctcccccataaataacaggaatttcaatatgacgcccttgaaaatccgatactttcaactcagcccaaagttgttctaaacgttgcacaagcggcttaaaatccacgaaaaaatcggtaaaaaccgtaagattattcattcccaagacaacttctacaatatcttgttctgattgcaattgacgagcaaacgcccataattggcgttgttgttgaatggaagctgggggtggcaaagagcaaaccaccgccgattcactgatcggaacgatattcataagataccctttatatgatgttatgtgatttgttatttttttgttacagctcttttaaaggatatttataggttttgtcaagtctttattttttatttaaaataaggtttaggtttgtttatcttttatttctttttagcaagaaaaaagattaatcttgacccattttaggtgttttttgttgaaaagtgcggtaaaaattaaaagaaaaacctgctttctggcattgaaagcaggttttaggcaaaagggaacggcaatttattgaagtatttcgcccacaatactgcgagttgcttctttcacttctgtgagtttcactttcacaatgtcgcctattttgtaagtgcgttcgcctttaatataaagggcaatctcatctgaattcacctgcatttcttctttattattatgtaaagtggacgcaggtataaacattgaggcgccattttctaataattgcacacgtaatccaccacgcattacatcttgcacttctgcattaaattccacattttcagccactttcggtgcaagataacggcaatatagccaatctgcaatatcacgttctacgaggcgattttggcggcgagcctcttgcaaacgtgccaacacgtcattttgtgttttttcataaggctgttttgccagcacggctttgattaagcgatgattaaccatatctgaatatttgcggatgggcgatgtccaagtggcatagccttctaaaccaagaccaaagtgcggtgctaattctgatttaaattcggcgaaagttaaataacggcgtaaacgcagttctaaataatcgctttcgatgggttcaatatcgtggcgcatttggcaatagccgtttaaggttgctaagttttctactgaataacgttctgccagttcagtttgattttgttcattggctaaatttgccattaagaaatggtgtgcgttctctaagaattttttatcaaaaccgctgtgggtgttgaaaatgcctgtttttgcctgttcgtgtaaaaattgtgcggcgcagatgttggcaataatcattgcttcttccacaatttgattggcaatgcggcgatattctgctttgatttcttgcactttgccgttttctgccagcacaaaggcataatcgggtttttctttaaagagtaaggaatgggttttgtgccattgaatgcgggctttggtaaattgatgtagccagtgaatttgttgtgctgtttctggcgtttctggctgccatgcattgtctgcctgttctaaataatccgacactttgttataagccagtttggctttagattgtacataagcggaaacaaaatgcggtttggctgtgatgttgcctgcaagatcggtttcgatataacagacaagtgcggggcgggtttcattggcgattaaggaacataattcatcggataattcacggggtaacattggaatgttaaagcccggtaaataatttgtgaagcaacgctgtttggcttcttgttcaatttgagaatctaaggcgatgtaagcggttgggtcagcaatggcgaccactaatttccagcctgtttgtgtgctgttttgtgctatgggttcgatatataaggcatcgtccatatccattgtgctttcggaatcaatggttacaaaatgaagtgcggtcagattttcgcgtgttttttgatctaacatttcataatgttctgcgccttgcacgggatagcgcgattgttcgtggcgtgccaatgtgacccaccaaggggctaattcatcgtcagctcggcaaataaactgattaattgtggcgtagaaaaagcgatcgtcacgtaatggatgggtttttaaatttgcgacgacccagtcgccctcttgcaattcttcttttaccgatttcgcctgttgtgcaccaatgggttgattaatgcttgggtgatccaccagcacttgtaatttcttgtctttattgaaccgcacttttgcgataaaacgtgtgagcattggctcaattaaggcttctggctcggcttgttctttgtcgccttgtttttcaatagtggctttgattttgtcgccgtgcatcacttttttcattgatggcggtgcgatgaaataggtttttttatcgcactctaaaaaaccgtaggctttatctgtgctttttaccacgccctcaacctgttctttgctgtcgtggatttgttgtttaagttgtgcgagtagaggattatcttgaaacataattatcttgaaacatagttattttgaaacatcgttatattttaaaaaagcgaaaaggcagactgaaaagcctgcctaaaaaagaatgtaagaaaaattattcttcgcctaattcgcccattgcagtgatgctgaaacctgcatcaacgtgaacgatttcgcctgtaatgcccgatgctaaatcagagcataaaaatgccgctgagttacccacatcttcgatagtgacagtgcgacgtaatgcagccgttttctcaaaggtggaaagcatttttttgaagtttttaatgcctgatgcggctaaggtgcggattgggcctgcagagattgcattcacacgaataccttctttccctaaatcagcagccatcacgcgcgttgcagcttcaagagaggcttttgctaggcacattacgttgtagttaggaattgcacgttctgcacctaaataagaaagcgttaataatgcggcatttggatttaagtaaggacgtgccgcttgtgccattgcaacaaagctgtatgcgctaatatcatgagcgatacgatagccttcacgagttgccgcatttacgtaatcgccgtctaattgatcacctggtgcaaatgcgattgcgtgaataaaaccatcaaatttatcccaacgcttacttaattctgcaaagcagttttggatgctttcatcggttgccacatctaaaggaagcacgatatcagaaccaaattctttggcaaattcttctacgcgcggttgtaatttatcgtttaaataagtgaaagcaagttctgcaccttgttctttcattgattttgcgatcccgtaagcgatggaacgattgcttgcaagacctgtgactaaaatgcgtttacctgttaagaaacccataatttttcctatgttgttagcgtaaaaaacttgcgtagtataagcgaaaatttgtctttgtacaaagcagaccaatatttctaagaaaaccaaccgcactttatttacaaattcgtttgagcaaaaacctaaaatcagggaaaatagcccacatttttaattgaacaaagaagaaacaatgagttatccattagaagaagttaataaacgtcgcacttttgcgattatttcccaccctgatgcgggtaaaacaacgattactgaaaaagtacttttatacggcaatgcaattcaaactgcaggttctgtaaaaggcaaaggctcggcggctcacgcgaaatctgactggatggaaatggaaaaacaacgtgggatttcgattaccacttctgtgatgcaatttccttataataattgtttagtgaatttgcttgatacccccggacacgaagatttctctgaagatacttaccgcactttaaccgctgtggatagctgtttgatggttattgactctgccaaaggggtggaggaacgtacgattaagttgatggaagtcacacgtttacgtgatacgcccattattacgtttatgaataaactcgaccgtgatattcgtgatccgatggaattgttggacgaggtggaaaatgtgttgaaaattcgttgtgcgccaattacttggccaattggctgtgggaagttgtttaagggcgtttatcatcttgcaaaagatgaaacctatttatatcaatcagggcagggttcaaccattcaggcagtgcgtgttgttaaaggcttgaataatcctgaattagatgttgctgttggcgatgatttagcacaacagcttcgtgatgaattggaattggtgcaaggcgcaagtaatgaatttgagcaagatgcctttattaagggcgagcttacccctgtatttttcgggacagcattaggtaattttggggtggatcattttcttgatggcttaacacaatgggcgccgaaaccgcaatctcgtcaagcggatacaagaacggtggaaagtgcggaagaaaaattcagtggttttgtgtttaaaattcaagccaatatggatccgaaacaccgtgacagagtggcgtttatgcgtgtggtttcgggcaaatatgaaaaagggatgaaacttaaacacgtccgtattggaaaagatgtggttatttctgatgcgctgacttttatggcgggcgaccgtgctcacgccgaagaagcttacgctggtgatattattggtttacataatcacggtacgattcaaattggcgatacgttcacgcaaggcgaaacgctgaaatttacaggcattccaaattttgcgccagagttgttccgtcgtattcgtttgaaagatccgcttaaacaaaaacaactgttaaaaggcttggtgcaactttctgaagagggtgcagtgcaagtgtttcgtccattattaaacaacgatttaattgtgggggctgtgggtgtgttgcagtttgatgtggtggtttcgcgtttaaaaactgaatataacgtggaagcgatttatgaaaatgtgaacgttgccacggctcgttgggtggaatgtgccgatggaaaaaaatttgaagaatttaaacgtaaaaacgagcaaaatttagccttagatggcggcgataatttaacctatattgcaccaacaatggtaaatctaaatttagctcaagaacgttatcctgatgtcgttttttacaaaactcgcgaacattaaaatgacaaagtgcggtaaaattctaccgcacttttccagaaaaaaagcgttgaaatttaattcaacgcttttcttttatttagagagattttcttgttttaatcgccaaagttgataaatatttaccacaactaaaaaggcatttaataatgcaacggggtatgctgtgataattacgctgtaaataacaaataaaatcgcgccgatactatttacaatgcgtaaatacacaatagatttaaataaaaaagatacagcaacaaaaaaagtcgccatataacctaaaaactcaataaaattaaaatccattattttgttctctttgattaaaaataaaaacggtgggtatgataaaagatttttaacgtaaggaaaagataagaaaaagaagcaaccgtttgcaagggaaatttatataaaaataagttgaacgagagccatatagaaaagcgtaccaacagcaatagatagaaacatatttttcttccagaaatgtaagccaagcacgactatccctgcaagcaaatcaggaataccgtgatagccagttaaaatctcaatatttttatagcaataaacgacaagcataccaaacattgcagggggtaaaacttttccaagataacggatatattgtggaatggggcgattaacaggaaatacaaaaaatggtaataaacgtgtaaattgtaccgccactatacaaattccaatggtaatgatttgttctgttaatgtcattttaaagattccaattttgtttctaatttagttatgcgcatagttagaattaaccaaatgccaattaatgttggaattaaaaaatattcttttcctataataagtaaaaaagcaaatgcaatccctaaacctaagagagagctttcgtgggatttttcttttagccaattttctgcaaaaataactaagaatagtgctgtcattgaaaattccacaccttttaaattaaaaggtaaaacagtaccaaataaattccccattgctgcgccaagtacccaataaatatgcaaatataagctcacaaaaaacatataccaacctttatctaagtgctgtgggatttttgccatataatttagggaaaaagattcatctacaagtgttgtgattaaataccaacgtttttttcctatatgtatgccatatttttctagcattgatatgccataaaaaatttggcgggcactaatcattaaggtaattaataatacgctgattggagagaaaggtgcaataagtgcgcctgctgcaataaattcaacagaacccgcataaataagtaaagccatcaaagtaggatataaaaatccgaaaccaagtgctttcatataaataccgtatgctatgccaagaaataaaaatcctgcaatcattggtacgctgtagggaaaagcagccttagccgcttcagtaattgggttagagtgttgattttgttgagataaattcattaattatgtctataaatttaaaacagaaagtccgggtaaagttgagaaactttgagatttgactgtttgataaaaatcttctaaataagaaagggattcatcttctttgcgaatcgccgcatatagattgctatataaaccttcttttgtgacttttcttgccacgacataacccttttccaaataaggcagcgcagcccaataagggatagtcgcaataccacgacgactcgcaacaagttgaatcattgcaatagtaagttctgttgtacggcgagtaggattaatgccttttgatttaagcactttacgccatagatctaacatatcgtcaggtacggggtaagttacccaagtttcatcaataaaatcttccgcttcccaaatatctttttctgctaaagaatgattttttgagcaaatcccaaccatttcataagaaaagagcggtttaaaaatgacatcatcattatgctctatttctgatactatcgcccaatctgctcgatgggaaagtaataaaccaacgggatcagtatgaaagccagatacaatatccagttctactagcccccaatgctgacggaattcatccatcgctggcattaaccaatcaaaacaagtatggcattccaccgctatacgtaactgtcctgcatcgccgtgttttacccttgcaagatcacgttcagcatcaatcactttcggcattacttcattcgcaagacgaattaaacgctctcccgctgaagtaaaacgaagtggattacttttacgctcaaataaaggcaagccaaattgttcttctattaatttaatttggtgagaaagggctgattgggttagatatacgtgctttgcagctagagaaacgctgcctgtctcttttaaagccaataaagttttaagatgtctaaattctagaaaggttggtttcattaataatattcatataaaattaagaattagggaaccagtataatacattaaaattagaaatatgctaattaataaaattaattatttagataattattttagttaaaatacaaaaccccagtccttaaactggggttctatatttattctttatctaatttgtttaattctgtttttacttaatttaattttatctatcttagataaatttatatttagattttttatttggtaacctggcggtgccctactctcacatggggaaaccccacactaccatcggcattacagcgtttcacttctgagttcggtatggtctcaggtgggtccaccgcactatcgccgccaggataattctttgataactcgtcttctcttttatctctcgtctcttttatctctcgttactcagtctttactctacctttcactcgttcttattggccacaagctgaactcaattttctctctattaagtcttctatatttacttttctttgtttagtcttttacttcggtttccgctctacttttatttgcttcgcttttcatctcttacttcacttagctcccaaaaacacttgagcgttgtatagttaagcctctcgggcaattagtatctgttagctcaatgtatcactacacttacacacctgacctatctacgtcgtagtctacaacaacccttactgacttaaagtcagggatgactcatctcttggcaagtttcgtgcttagatgctttcagcacttatctcttccgcatttagctacccagcaatgcctctggcgagacaactggaacaccagtgatgcgtccactccggtcctctcgtactaggagcagccccaatcaatcatccaacgcccacggcagatagggaccgaactgtctcacgacgttctaaacccagctcgcgtaccactttaaatggcgaacagccatacccttgggacctacttcagccccaggatgtgatgagccgacatcgaggtgccaaacaccgccgtcgatatgaactcttgggcggtatcagcctgttatccccggagtaccttttatccgttgagcgatggcccttccattcagaaccaccggatcactatgacctactttcgtacctgctcgacttgtctgtctcgcagttaagcttgcttataccattgcactaacctcacgatgtccgaccgtgattagcaaaccttcgtgctcctccgttacgctttgggaggagaccgccccagtcaaactacccaccagacactgtccgagaccacgtttcgtcatcttcgttagaacatcaaacgttaaagggtggtatttcaaggtcgcctccacaatgactggcgtcactgcttcaaaggctcccacctatcctacacatcaaaattcaatgttcagtgtcaagctatagtaaaggttcacggggtctttccgtctagccgcgggtacaccgcatcttcacggcgatttcaatttcactgagtctcgggtggagacagcctggccatcattatgccattcgtgcaggtcggaacttacccgacaaggaatttcgctaccttaggaccgttatagttacggccgccgtttactggggcttcgatcaggtgcttctcttgcgatgacaccatcaattaaccttccagcaccgggcaggcatcacaccctatacgtccactttcgtgtttgcagagtgctgtgtttttaataaacagttgcagccagctggtatcttcgaccggttcaaccttcgcccgctagggactacaatctacgccggcgcaccttctcccgaagttacggtgctattttgcctagttccttcacccgagttctctcaagcgcctgagtattctctacctgaccacctgtgtcggttttcagtacggtttagtaaagcctttcgcttagtggcttttcctggaagtgtggtatcagttacttcagctccgtagagcctcgtcatcatctctctgtgttaaggaagtccggatttgcctaaacttcccacctaccaacttaaacgcacatatccaacagtgcgataacctaacctactccgtccccacatcgcagctttaccaagtacaggaatattaacctgtttcccatcgactacgcttttcagcctcgccttaggagccgactcaccctgccccgattaacgttggacaggaacccttggtcttccggcgaacgggtttttcacccgttttatcgttacttatgtcagcattcgcacttgtgatacgtccagctaacctctcgattaaccttcatccgcttacacaacgctcccctacccaacaggcgtatcactaataatccttacttcaaaaataccccgactcaacgttcgggttgcttgaacaacctttcatgccgcttcgcgccattctagcttgttaatcgtaaggcgtattagtgatacgcctgatgccgcagcttcggtgctatatttcagccccgttacatcttccgcgcaggccgactcgactagtgagctattacgctttctttaaatgatggctgcttctaagccaacatcctagctgtctaagccttcccacttcgtttcccacttaatatagacttggggaccttagctggcggtctgggttgtttccctctccacgacggacgttagcacccgccgtgtgtctcctgagtatcactctttggtattcgtagtttgcatcgggttggtaatccgggatggacccctagccgaaacagtgctctacccccaaaggtgtcacctcaaggctctacctaaatagatttcggggagaaccagctatctcccggtttgattggcctttcacccccagccacaagtcatccgctaatttttcaacattagtcggttcggtcctccagttagtgttacccaaccttcaacctgcccatggctagatcaccgggtttcgggtctataccttgcaactagacgcccagttaagactcggtttcccttcggctcccctattcggttaacctcgctacaaaatataagtcgctgacccattatacaaaaggtacgcagtcaccccatcacttaatcccactgcttcttttgggtggtttgactcgcttcgctcctcttaccattgtttaagtgcggttgcttttcatcaccttccaatcggattaagtgatggggctcccactgcttgtacgtacaaggtttcaggttctatttcactcccctcaccggggttcttttcgcctttccttcacagtactggttcactatcggtcaatcaggagtatttagccttggaggatggtccccccttcttcaaacaggatatcacgtgtcccgccctacttctcgttagcttagtaccacaatatggtttttagatacgggattatcaccctctttgattgtgcttcccaacacattctcctcactatactgctatcacttactggctctttcgctttcgctcgccgctactgacgaaatctcggttgatttcttttcctcggggtacttagatgtttcagttctcccggtttgcctcaacaagctatgaattcacttgttgatagtagattcttcatctactgggtttccccattcggatatcttggattaaacgcctcttatcgactcatccaagcttttcgcagattagcacgtccttcttcgcctctgattgccaaggcatccaccttgtacgcttagtcacttaactatacaacctcaaatgttttcaatcactttacgttttcacttcaaagtgcggtcaatttgatgcgtattttcattcaactaaacacttgattgcttttgttcaatcaagattttatgcaaaacaggttttgtttttagagttcccttttcagttccctcctctcactttcctatcttgcctactcagactttctctcgaaaatctcttgttttcagcttgtttccaattttttaaagaacagttgataaaacttttcagttatcatcgttaaataaactaaaactaaaacaaaattaaatttaaaattaaacttaaaataacctaatatttaaaatagcttcatcactaccttaatactttattaatttgtctttttctaatttatttaacgatgataagtggtggagataagcgggatcgaaccgctgacctcctgcgtgcaaggcaggcgctctcccagctgagctatatccccatttcatcataatttaataactaattatttaccttttagttattatttatttacactacacctttcgcttcactcactctcagagtggtgggtctgagtggacttgaaccaccgacctcacccttatcaggggtgcgctctaaccacctgagctacagacccaagggtaatgttttcttctgctcatttgtctacaactatcagccaatctgtgtgagcactcgctgtctctcgtctttggtaaggaggtgatccaaccgcaggttcccctacggttaccttgttacgacttcaccccagtcatgaatcataccgtggtaaacgccctccaaaaggttaagctatctacttctggtacaacccactcccatggtgtgacgggcggtgtgtacaaggcccgggaacgtattcaccgcgacattctgattcgcgattactagcgattccgacttcatggagtcgagttgcagactccaatccggacttagacgtactttatgagattcgctccacctcgcagcttcgcttccctctgtatacgccattgtagcacgtgtgtagccctactcgtaagggccatgatgacttgacgtcatccccaccttcctccagtttatcactggcagtctcctttgagttcccgaccaagtcgctggcaacaaaggataagggttgcgctcgttgcgggacttaacccaacatttcacaacacgagctgacgacagccatgcagcacctgtctctaagttcccgaaggcacaagctcatctctgagctcttcttaggatgtcaagagtaggtaaggttcttcgcgttgcatcgaattaaaccacatgctccaccgcttgtgcgggcccccgtcaattcatttgagttttaaccttgcggccgtactccccaggcggtcgatttatcacgttagctacgggcgccagagttaaaccccaacccccaaatcgacagcgtttacagcgtggactaccagggtatctaatcctgtttgctccccacgctttcgcacatgagcgtcagtacattcccaaggggctgccttcgccttcggtattcctccacatctctacgcatttcaccgctacacgtggaattctacccctccctaaagtactctagttacccagtctgaaatgcaattcccaggttaagcccggggctttcacacctcacttaaataaccgcctgcgtgccctttacgcccagttattccgattaacgctcgcaccctccgtattaccgcggctgctggcacggagttagccggtgcttcttctgtatttaacgtcaatttgatgtgctattaacacatcaaccttcctcaataccgaaagaactttacaacccgaaggccttcttcattcacgcggcatggctgcgtcagggttccccccattgcgcaatattccccactgctgcctcccgtaggagtctggaccgtgtctcagttccagtgtggctggtcatcctctcagaccagctagagatcgcaggcttggtaggcatttaccccaccaactacctaatcccacttgggctcatcctatggcatgcggcctctcagtcccgcactttcatcttccgataatacgcggtattagcgacagtttcccgtcgttatccccctccataagccagattcccaagcattactcacccgtccgccactcgtcagcaagaaagcaagctttctcctgctaccgttcgacttgcatgtgttaagcctgccgccagcgttcaatctgagccatgatcaaactcttcaattcaagttcaatcgctcaataaactgcttagctatacataaaacactacttaaaaaagtaatgatgaattttcagttaagcacctattaagacttcaaaattaaaaatagttttaaaacaagtcaatcaacaagtgcccacacagattgtctgatatattgttaaagagcaaaaaataacgacgcacttggaaacttaaaaaacttcacaacagtgcgtcgttgtgtgcggtgcattatagggattttcaaatcccttgcaagtactttttgcaaaaatttttgaaaagctcgaccgtttgttgaaaatacatacgtaaaatacataattccgccaacaaacggttgatttttgatctcaatttataaattaaagtttacttagatcaaccaaagcctctggtttaatatcgacaatagtacgattgctggttaatgtcatcgctacgcgcatctcttttttgaaaatgtcgagcatattttcaacaccttgacgacctgctgcccctaaagcataaacaaatgctcgacctaacattgttgcatctgcccctaatgccaacatacggactatatctaaaccattgcgaatacctgaatcggcaataattttaatatcccctttcactgcatcggcaatcggtggcaacgctcttgcacttgaaagcacgccatctaactgacggccaccgtgatttgaaacgacaattccatcagcaccgaaacgcaccgcatctttcgcatcttcagggtcgagaatgcctttaatgaccattggaccttcccaaaactcacggatccactctaaatctttccacgaaattgatggatcaaagttttctgttagccagccaatatagtcatctaaacctatttgtctacccatataagttgaaacattacccaaggtgtgcggtttgcctttgatacccacatcatacgcccagaatgggtgtgtaaagccttgtaatacacggcgaatttctttgtaaggcccactcatacctgagtgcatatcacgataacgcgcacctggagtaggcatatcgaccgtaaacactaaagtagaacagcctgctgctttcgcacgctcaagtgcgtttttcataaaaccacgatcttttaacacataaagctgaaaccacattggacgcttaatcgcaggggcgacttcttcaattggacaaattgatactgttgaaagggtaaacggcacacctttattatctgccgcttgtgctgcttgtacttctccacgacgtgcatacattccgcacgccccaactggtgcaagaatagttggcattgaaagtttttcaccaaataattctatactagtatccaattcagacatatcttttaagacacgttgtcttaaagcaatattttccaaatcactcacattacgcgcaagtgtttgctcggcataagaaccgccatcggcataatggaacataaagggaggaacacggcggcgcgccgcttcacgataatcgctagctgatgaaataatcatttttacctcttattcaataaaatagtgagaaacctgagaggcattataacactattttaacaaattcaataaaaatcataattattttgagaactagatcacaatttattttaaaaaagtgacatatagaaatgatataagtagaaaaatcacctataaaattaggaaaaattgtgaatttatcaatatcacacaattaatctattaacttttaatctattttgattacttccaaagattcaaatccccatagatgtaaagcttttttaaattgagattcttcgggaaaatgtgcggtgcaaaacatttgattatatttttcattttgcacttgtagatttttatcatcaagtaaatatttgatccgtttagcaattgctgcgctcggatccataaaatatttaacttgtggcaagcataactgaatttcatctttgatgagaggaaagtgagtacaacctaaaactaatgtatccaaatctgccatgcctgcccacgaagataactcatcttttaaactaatgagatcaacggaatgaccacgaattttttgctccgcaatttcgactaattttgtcgttcccagtctctcaacaatacaatcttgcgcaaatttatcaatcaactcatcgatataatgacgctttactgtaccctttgtagctaataaaccaatatgttttgtctttgttatttctgatgcaggtttaatagcgggaacagtcccaatgataggaatctcaaaagcagctcgcaaaggcggaagcacaacagtactcgctgtattgcaagctatcacgattgcatctaatggataacgttgattaataagctgacacgccgctaaagtgcggtgaataatactttcttcttcgcgttctgaataagggaatcccgcattatcaaagcaatagagataatgccaattgggtaataattttttagcttcacggtatacgctaaacccacccactccagagtcaaaaaaaagtacagttgggcgtttttcttttttatccatttaaaactctttgaaaattgaccgcacttttaagcgttcgagtaaatttctttattattgagccagcgacagattaggctttctgccacatcagggtatttttggataagtgatttcgcataatgttgcaccgttggtatcatttttctatctcgcattaaatttgctattcgcaattcagcaattcccgtttgtttcgttccaagtacttcacctggcccacgaatttctaaatctttttccgaaataacaaacccatcttggctatctcttagcacttgcaaacgcttttgcgaaactttacctagcggaggtttatacattagtacacaaaaagaagccgtgctgcctcgaccgacgcgccctcgtaactgatgaagctgcgataaacctaaacgttctgcattttcgataatcatcaaacttgcattcggaacatcaacccccacttcgatgactgtcgtcgccaccaataaatccaattctgcatttttaaaacgcatcatgacatcttgtttttcttggggtttcatgcgcccgtgcactaaaccaatatttaacatcggtaacgctttcgttaaatcttcccaaatcgcttcagctgcttgagcttctaacacctctgattcatcaattaacgtacacacccaataggcttgacgtttttcattaacacaagcgttttttacacgcatcacaatttcagcgcgacgttcttcagaaaccactacggttgttatcggcgtacgacctggaggcaattcatcaataattgatgtatccaaatctgcatatacggtcattgccaacgttctcggaatcggtgtggccgtcataattaactgatggggatgaaatcccgctttttcgcctttttcacgcaacattaatcgttgatgcaccccaaaacgatgttgttcatcaataatcactaatgctaagtcggaaaactcgacttcttcttggaataaagcatgcgtccccaccaccatttgcacggcaccagttttgattttttcaagctctgcttgtcttgattttccttttactttacctgccaaccagccaacttcaataccgaaaggctcaaaccaccgtctaaaattattcgcatgctgttctgcaagaatttctgttggcgccattaaggcgacttgtttgccattatcaattgcagttaaagcagccaatgcggcaaccaatgtttttcccgagcctacatccccttgcactaagcgcatcatcggataatctttgataagatcttgttcaatatcggacactactcgcttttgcgcattagttggttgaaatggcaaggtggctaaaaatcgctgtttcaaatctgtttgataatgtagcggtaaggcagaaaattgttgcgttcctaaccgcactttttgcatagctaaattatgtgccagaagctcttcaaaaattaatcgttgttgtgcaggatgcttaccttgctctaacatttctaatgaaatatctggcggcggacgatgcaataatcgcaatgcctcttttaagctatattgatgtggattaaattcattaggcaaaatttctgcaatctgaaccttgtcgagtaatgtcaaagcctgatccgttaattttcgtaatgaattttgttttaacccctccgttgtggaataaatcggcgttagggtttcttccaatactatgggcgcattatctcgcacaatttgatattctggatgatgaatttctggcatatggcgaccacgtttcacttcgccaaaggcctttactcgcacacctgcttgaaaactattacgcattcccgcattaaaattgaaaaaacgtaacataattttcgatgtgccgtctgacaaacttaccgataaaatcgggcgacggccaaaagcgacttcacaggtttgtacaattccctctatagtaaaatattgttcagggcgaagattagcgattggcgtaattcgcgtacgatcttcatagcgaataggtaaatgaaagagtaaatcttgcagattctgaatgccgattttagccagtttattagaaatggcagcccccacaccagaaaggctggtcaaaggcacggcatcgagaagttcaaggctcatagctcattaatattgcgtttgacattaacgacgccagtgatgcctttaatacgatgaacgatattggcaaggtgtttgatatcttttacacaaacctgcaaaatcacaagcaataaattgttctctaattcttccgtccaaatattttggagactgctttcgctcgctgaaattgcggtcattaaactaagcaaggcattctgctcattcaatatttctatttgtaattcagcctcaaaattcaccgcactttgaacgttatcccatttagccaacgattgacgacaagcatttttcaaacttgcacaatgttgatggtgtaccacaactgtatttttttctgtacaacatcccacaataggatcacctaggattggatggcaacattgcgcaaattgtgttttacccacttgcattggtgcaatagtgagtatttttgattcaaattcgagattcttagtattagcagattctaacggcacgcccacaaattgatgcgcaatcatggaggctgactgattacctaaaccaatttctcgtaataattcatctaaagaagaaagggctaaagcatctaatacagtgctaatttgttgaatagaaaaatcacctaaattatgcggctgcaatgctacattaagctcaacttcgcctaatttcaccgcatcctcttcacaacgctgtttgagataatggcgaatccgtgttttcgcacgagccgttaccacaaaatttaaccatgcgacttcaggatgcgcatttggatcagtaataatattgactgtttgccctgattcaagggcttttgaaagtggataaggtttatgctcaacagtcacgccaacacaagtattccccacatctgaatgcacagcataagcgaaatctactgctgttgcgcccattggtaattcaacaattcgaccttttggcgtaaaaacataaatttctttcgggaaaaactctgattttacattctcaataaactcaaacgaattacctacactttgttgaatttcgaccaaactttgcaaccagcgttgtacgcggatttgtgcggttgtactatcgtttttaccattttctttataaacccaatgcgcagtaatgcccatttcagcgacttgttccatatcctcagtatggatatgaacttctacgggaactcctttcggcccaatcattgaagtttgcaaagattgatagccatttgctttaggtacggcgatataatccttaactcggcctggacgtggcttataaagattatgcatttgccccaaaatgcgataacaatcatcaacatttttcacaatcacacggaacgcataaatatccataatagagtggaattcttgatcctttatacgcattttttgatagatcttataaagatgtttttcacgtccccacactcgggcaaaaatgcctgcgttttctaaccgcactttaatctcttgtgaaatacgttcgattaaatcttgtcgattactccgtgccacatcaacgagtttttttaacacctcataacgatgtggatgcattgcttgaaaagataagtcttctaattcatttttgatatgctcaatacctaaacgatgagcaagcggacaatagatttcaagcgtttctttcgcaatacggcgacgtttatctggtcgtaacgaaccaagcgtgcgcatattatgcgtgcggtcagcaagcttgattaacacaacacgaatatcgcgcgtcatcgccaaaatcattttgcgaaaattctcgacttgtgcttcttggcgagtacgaaatttcaacttatcgagttttgatacaccgtccacaatttcagctacactggcaccgaactcttctttcagttggttttccgtataaggtgtatcttcaataacatcgtgcaaaagcgcagccattaccgcttcgtgatctaagtgaagttgagcaataatggaggctaccgccacaggatgggtaatgtaaggttcgccgctggagcgaaattgtccttcgtgcgcatctcttgcaatcacaaacgcacgcttgatgagttcaattttatctgcgggcaaatacccttgaataattcgatctaaatccgcaaacagttccaaaggagacctacttatcgttgaaagagaaagtgcagttaaaatatcgtgattttttaccgcacttttaaaagattattctgtaattaatgcaacagctgcttcttccgtttcttgcactttcgccattttttggaattcttgtgcatccataatatcttgattaatcaaacctttttcgatttcacgtaatgcgattactgttggtttgtcattatcttctggcactaatggtgcactttgattaagttgtaattgtcttgcacgacgtgcagccgttaaaattaaatcaaaacggttaccaattttttctactgcatcttgcacagtaacacgagccataatttactccgatttgtcaaaaattactctattgaaagggcgttataatactcaatttcgccctattttgctagtagctgttgaattaacattgcattttgtttttgttgataatctttagttaagcgttccgattgcaaaatactttgtaaatcttttaatgttttctcaaaatcatcattcacaatgacataatcatattcgtcataatgcgaaatttcacttatcgcttttgacattcgttcggcaataacctcttcactatcttgcccacgaccaattaaacgacgctctaattcaggcaatgaaggcggtaaaataaaaatgctttttactgaaggcacttttttacggatttgttgggcaccctgccaatcaatatctaaaaatacatcaatgccttttgctaaattttcttcaatcgcaggtaaagaggttccataataattgccaccaaaaactttggcatattctagaaataaatcttgttcaatgagtgattcaaactcttcttttgatacaaaataatagtgtacgccttcaacttcacctgggcgtggggcacgggtcgtatgtgacacagaaaccattttttgagttgaactatctgatgccaataacgcagaaattaatgaagattttcctgcgccacttggtgcagataaaatataaagattaccttgagacatagaatatttaaccttctctaacaacttcagtctattatgcagatttctctataaaaaatcatcaaaagtgcggtgattttttacggtactttttcattctaatgatgatttgatatagatcacaaaaaagtagtagggtttatagttttataaaaatgctcgtgctatactctgtgcgttgtcttactgagtgagcagtattactcaaagcaaacagatttgtttaacttaaataaaaggtgaaaatct

SEQ ID NO: 773 - DNA, 1020 bp, H. influenzae strain 86-028NP
atggcaattaaaattggtatcaatggttttggtcgtatcggccgtatcgtattccgtgcagcacaacatcgtgatgacattgaagttgtaggtattaacgacttaatcgacgttgaatacatggcttatatgttgaaatatgattcaactcacggtcgtttcgacggcactgttgaagtgaaagatggtaacttagtggttaatggtaaaactatccgtgtcactgcagaacgtgatccagcaaacttaaactggggtgcaatcggtgttgatatcgctgttgaagcgactggtttattcttaactgatgaaactgctcgtaaacatatcactgcaggcgcaaaaaaagttgtattaactggcccatctaaagatgcaacccctatgttcgttcgtggtgtaaacttcaacgcatacgcaggtcaagatatcgtttctaacgcatcttgtacaacaaactgtttagctcctttagcacgtgttgttcatgaaactttcggtatcaaagatggtttaatgaccactgttcacgcaacgactgcaactcaaaaaactgtggatggtccatcagctaaagactggcgcggcggccgcggtgcatcacaaaacatcattccatcttcaacaggtgcagcgaaagcagtaggtaaagtattacctgcattaaacggtaaattaactggtatggctttccgtgttccaacgccaaacgtatctgttgttgatttaacagttaatcttgaaaaaccagcttcttatgatgcaatcaaacaagcaatcaaagatgcagcggaaggtaaaacgttcaatggcgaattaaaaggcgtattaggttacactgaagatgctgttgtttctactgacttcaacggttgtgctttaacttctgtatttgatgcagaagcaggtatcgcattaacagattctttcgttaaattggtatcttggtacgataacgaaacgggttactcaaacaaagtattagacttagtagctcatatctacaactacaaaggctag

SEQ ID NO: 774 - DNA, 1824 bp, H. influenzae strain 86-028NP
atgaaatcaaaaaatagggttaatatgaatctcgatctccattttgttcatcgtattcaacaacaagccaagactcgtgcaaatatgaccgcacttcgctataaagaacacggcttgtggcgagacatttcttggaaaaattttcaagagcaactcaatcaactttctcgagcattgcttactcacaatattgacgtacaagataaaatcgccatttttgcccataatatggaacgttggacaatcgctgacattgcaaccttacaaattcgagcaatcacagtgcctatttactcaaccaatacagcccagcaagcagaatttatcctaaatcacgccgatgtaaaaattctcttcgtcggcgatcaagagcaatacgatcaagcattggaaattgctcatcattgtccaaaattacaaaaaattgtggcaatgaaatctacaattcaattacaacaagatcctctttcttgcacttgggaaagttttattgaaacaggttcaaacgcccaacaagatgaactgactcaacgcttaaaccaaaaacaattatcggatttatttacgattatttatacctcaggcacaacgggagagcctaaaggtgtcatgttagattacgctaatctcgcgcatcaattagaaacgcacgatctttcacttaatgtgacagatcaggatatttcactttcttttttaccattctctcatatttttgaacgggcatgggcggcttatattcttcatagaggcgcaatactttgctatttagaagacaccaatcaagtacggtcagctttaacggaaattcgcccaactttaatgtgtgccgtcccacgtttttacgaaaaaatttatgcagccgtgctggataaagttcaaaaagcaccaaaacttcgccaaataatgttccattggacaatttctgtaggacaaaaacattttgatttacgtgcgaataacaaagctattccgttcttattgaagaaacaatttgctttagcggataaattagtactctcaaaacttcgccaattattgggtgggcgtataaaaatgatgccttgcggaggagcaaaattagaaccggctattgggttatttttccacgccattggtatcaacatcaaattaggctatggcatgacagaaacaaccgcaaccgtttcttgctggcatgatttccaatttaacccaaattcaatcggcacactcatgccaaaagcggaagttaaaattggggaaaataatgaaatcctcgtgcgtggcaaaatggtaatgaaaggctattacaagaagccagaagaaacggctcaagccttcacaaaagatggtttcttaaaaactggcgatgcgggagagtttgacgaacaaggaaatttatttattaccgatcgtatcaaagaattaatgaaaacctcaaacggtaaatatatcgcgccacaatatatcgaaagcaaaatcggtaaagataaatttatcgaacaaattgcaatcatcgcagatgcgaaaaaatatgtgtccgcactgattgtgccttgctttgatagtttggaagagtacgctaaacagatcaatattaaatatcatgaccgtttagaattattaaaaaattctgacattctgaaaatgtttgagcaacgtattaatgcggtgcaaaaagaattggctcactttgagcaagtaaagaaattcacgctactctctcaagcattcagcattaaattaggcgaaattacaccaacattaaaattgcgtagaaaagtgattttggaacgttatcgcaagcaaattgaagcaatgtatcattcacaagaagcataa

SEQ ID NO: 775 - DNA, 789 bp, H. influenzae strain 86-028NP
atgatgtataaagcagtatttagtgattttgatggcaccttattaacctctcaacataccatttcccctcgaactgttgcggtaattaagcgtttaacggcgaatggcattccttttgtgccaatttcggcgcgttctcctctaggtattttgccttattggaaacagcttgaaacgaataatgtgcttgttgcatttagtggcgcgcttattttgaaccaaaatctcgaaccaatttatagcgtacaaatcgatccaaaagatattttagagattaataccgttttggcggaacatcctttgcttggcgtgaattattatacaaataatgattgccatgctcgtgacgtagaaaataaatgggtgatttatgaatgcagcgtgaccaaaattgagattcatccttttgatgaagtagcgacaagttcgccacataaaattcaaattattggggaagcagaagaaatcattgagattgaagttcttttaaagaaaaaatttccacatttaagtatttgccgttcccacgctaattttttagaggtaatgcacaagaatgcaaccaaaggaagtgcggtgcgttttttggaagattattttggcgtacaaaccaatgaagtgattgcatttggcgataattttaatgatttggatatgctacaacacgcaggacttggggtggcaatgggaaatgcgccagatgaaattaaacaagcggcaaatgtgattacggcaaccaataatgaagatggacttgcattgattttagaagaaaagtttcctgaataa

SEQ ID NO: 776 - DNA, 465 bp, H. influenzae strain 86-028NP
atgggaagtgtattggttgatttgcaaattgccacagaaaatatagagggtttgccaacagaagagcagattgtgcagtgggcaacaggtgctgttcaaccagaagggaatgaagtcgaaatgacggtgcgtattgtggatgaagccgaaagccatgaattaaatttaacttatcgtggaaaggatcgcccgactaacgtgctttcatttccatttgaatgccccgatgaggtggagttgccattgttaggggatctcgttatttgtcgtcaagtcgtggagcgagaagctgcagaacaagagaaaccattaatggcgcattgggcgcatatggtcgtgcatggttgtttacatttactcggttatgatcatattgaagacgatgaagcggaagaaatggaaagtttagaaacccaaattatgcaaggattaggctttgatgatccttatttagcagagaaataa

SEQ ID NO: 777 - DNA, 813 bp, H. influenzae strain 86-028NP
atgcagtgctggattcgacaaactatcaacttttttagaaagacaaaaaatacagaaaaattgaccgcacttttgcaacaaaaagaggacatactggctgttgagatgccagtttctttagtatataacgggatttctcacgcagttatgatgtgttccccaaacaatttagaggattttgctttaggcttttctataacagagggaattattgataaaccagaagatatttatggcattgatgttgtagaagtttgcaatggtattgaagtgcaaattgaactttccagccgtaaatttatggcattaaaagagcatcgtcgtaatcttacggggcgtacaggctgtggtatttgtggtacagaacaattgaatcaagtatataaaacttttccaaaattagactgtacttttcaatttgatttaaatttgctagatagttgtcttattgatcttcaaaaaaatcaattacttggatgtaaaactggtgctacccatgcttgtgcatttttcgatttatatggaaatatgttagctatttacgaagatgtaggtcgccacgttgcgttagataaattgcttggttggcacgcaaaatcgggtaagcctagaggttttattttagcctccagtcgagcgagttatgaaatggtgcaaaaaacagtggcttgcggggtggaaatgttagtcacgatttccgccgcaacggatttagcagtaacaatggcagagaaacataatttgactttaattggttttgctagggaaggaaaaggaaatatttatagtgggcatcaacgacttcacaattaa

SEQ ID NO: 778 - DNA, 3087 bp, H. influenzae strain 86-028NP
atgcaggtctcaagaagaaaattcttcaagatctgtgcaggaggtatggcgggaacgtcagctgcaatgttgggctttgctccagcaaacgtattagctgcgccacgcgaatataaattattacgcgcgtttgaatcccgtaacacctgtacatattgcgctgtaagttgcggtatgttgttatatagcacaggcaaaccttacaattcattaagcagccatactggcacaaatactcgttcaaaactctttcatattgagggtgatccagatcatccagtcagtcgtggtgcgctttgcccgaaaggtgctggctcactcgattatgtcaatagtgaaagccgttctttatatcctcaatatcgtgcgccaggttctgataaatgggaacgaatttcttggaaagatgccattaaacgtattgctcgtttaatgaaagatgaccgagatgccaactttgttgaaaaagattcaaatggaaaaacggttaatcgttgggcaacgacaggaattatgactgcatcagcaatgagcaatgaagctgcgttattaacacaaaagtggattagaatgctcggtatggtgccagtatgtaaccaagcgaatacttgacacggaccaacggtagcaagtcttgctccatcatttggtcgcggtgccatgacaaataactgggttgatattaaaaatgccaacttaatcatcgttcaaggcggtaaccctgcagaagcccatcctgttggcttccgttgggcaattgaagcgaagaaaaacggtgcgaaaatcatcgttattgatccgcgttttaaccgtacagcatccgttgctgatcttcatgcgccaattcgttctggttctgatattacgttcttaatgggcgtgatccgttacctattggaaacaaaccaaattcaacacgaatatgttaaacactataccaacgcatcattcttaattgatgaaggtttcaaatttgaagatggtttatttgtagggtataacgaagaaaaacgtaactacgataaatctaaatggaactaccaatttgatgaaaatggtcacgctaaacgtgatatgacattacaacatcctcgttgtgtcattaacatcttaaaagagcacgtttctcgttataccccagaaatggttgaacgtattacaggcgtaaaacaaaaactcttcttacaaatctgtgaagaaattggtaaaacctctgtgccaaataaaacgatgacgcatctatatgcattaggttttacagagcattcaatcggtacacaaaatattcgctcaatggcgataatccagttacttttaggtaatatggggatgccaggtggcggtattaacgcattacgtggacactccaatgtgcaaggtacgacagatatgggcttattgccaatgtctttaccaggttatatgcgtttgccaaacgatagagatacctcttacgatcaatacattaacgcaattacaccaaaagatatcgttccaaaccaagtgaactattatcgtcatacttcaaaattctttgttagtatgatgaaaactttctacggagataatgccactaaggaaaatggctggggattcgatttcttaccaaaagcagatcgcctatatgatccaattactcacgttaaattgatgaatgaaggcaaattacacggttggattttacaaggttttaacgtattaaattcactaccaaataaaaataaaacgttatctggtatgagtaaactgaaatacttagtcgttatggatccattacaaactgaatcatcagaattttggaaaaattttggtgagtcaaatgatgtaaatcctgcagaaattcaaacagaagttttccgtttaccaactacttgtttcgcagaagaagaaggatcaatcgttaattctggtcgctggactcaatggcactggaaaggttgcgatcaaccgggagaagccttacctgatgttgatattctttctatgctacgcgaagaaatgcacgaactttataaaaaagagggtggacaaggaattgaatcttttgaagcgatgacttggaattatgctcaaccacactcaccaagtgcggttgaattagccaaagaattaaatggttatgcgcttgaagatctttatgatccaaacggtaacttgatgtacaagaaaggtcaattactcaatggatttgcacatttacgtgatgatggtacaacaacatcaggtaactggttatatgttggtcaatggactgaaaaaggcaaccaaactgctaatcgcgataattcagatccatcgggtttaggttgtactattggctggggctttgcatggcctgcaaaccgccgcgtactttatagccgtgcatcattagatatcaatggtaatccttgggataaaaaccgccaattaatcaaatggaacggtaaaaactggaactggtttgatattgctgactacggtacgcaaccaccaggttctgatactgggccgttcattatgtccgcagaaggcgtaggacgtttatttgccgttgataaaattgcaaatggcccaatgccagaacactatgaaccagttgaaagcccaattgatacaaacccatttcatccaaatgtagtaaccgatccaactttacgtatctataaagaagatcgtgaatttattggttcaaataaagagtatccatttgtagcaacaacttatcgtttaaccgagcatttccacagctggactgcacaatctgcattaaatatcatcgcacaaccacaacaatttgtggaaattggcgaaaaattagcggcagaaaaaggcatccaaaaaggcgatatggtaaaaattacttctcgtcgtggctatattaaagcggtcgccgtggttacaaaacgtcttaaagatctcgaaattgatggacgtgtcgtacaccatataggtcttccaattcactggaatatgaaggcattaaatggcaaaggtaaccgtggattctctacgaataccttaacaccatcttggggtgaggcaatcacgcaaacaccagaatacaaaacattcttggtaaatattgaaaaagttggggaggcataa

SEQ ID NO: 779 - DNA, 939 bp, H. influenzae strain 86-028NP
atggctggaactgctcaaggcgttcaaacgcaagacgttattaaaatctccgcaacatctggtttaacaccagcaccacaagcgagagatcataaagttgaagtcgcaaaattaattgatgtttcaacttgtataggatgtaaagcctgtcaagtgggttgttcagagtggaatgatattcgctctgatatcaatgcacaatgtgttggggtttatgacaatccagttgatcttgatgcaaaagcatggacggtgatgcgttttaacgaagttgaagaaaacgatcgtttagaatggctgattcgtaaagatggctgtatgcactgcacagaacctggttgtttaaaggcttgtcctgcacccggtgcaatcattcaatatgctaacggtattgtagatttccaatccgataaatgtattggttgtggttattgtattgcaggctgtccattcaatattccacgaatgaatcctgaagacaatcgtgtatacaaatgtactctttgtgtggatcgtgtttctgtgggacaagagccagcttgcgtgaaaacctgtccaacaggtgctattcgtttcggctctaaagaagaaatgaaaatttacgcagaacaacgcgtggcagatttaaaatcccgtggttatgaaaacgcaggactttacgatcctccaggtgtaggcggtacacacgtaatgtatgtgttgcatcacgcagataaacctgagctttacaatggtcttccaaaagatcctcaaattgatttgagtgtgaccttatggaaagatgtattgaaaccagtcgctgcagttgcaatgggtggtctagctctagcagaagttgcgcactacttaaccgttggcccaaatgtagaagaagatgtggaagatcatcatcacgaatttgaagaaaataaaccatccaagggggaaaataatgagtaa

SEQ ID NO: 780 - DNA, 717 bp, H. influenzae strain 86-028NP
atgagtaaaattgaaattagcaacgatactcgcgttatccgccatagaaccccagcacgtatcagtcactggatgttggttatttgcttttttatgacgatgttcactggtgttgcatttttcttccctgactttgcttggctcacagaaattttgggtacaccacaaattgcacgcgccattcatccatttacagggattttaatgttcttcgctttcatctacttagcgttattgtactgggatcacaatattccagaaaaaaacgatattcgctgggcaaaaggtgttattgaagttcttaaagggaatgaacacgcggttgctgataatggcaaatataaccttggtcaaaaaatgctcttttggacattaaacttggcaatggtaacgttattagtcactggcatcattatgtggcgtcaatatttttcacattacttctcaatcccagtattgcgaattgctattttactccactctgcaagtgcttttatgttattcactggtatcttagtgcatatatatatggcattttgggttaaaggatcaattcgtggtattgttgaaggttgggtaaccgttcgttgggcgaaaaaacaccacccaagatggtatcgtgaagaagttttatcaaaacttgaggaagatttactcaacgagcaatctggcaaagtaggtaaaaccaaagtcttatttaaaggatttggcaaataa

SEQ ID NO: 781 - DNA, 909 bp, H. influenzae strain 86-028NP
atgagtatcaaaatcttatctgaatcagaaattaaacaagtagcaaattcatatcaagccccagcggttttatttgccaatcctaaaaatctttaccaacgcagagcgaaacgtttaagagacttagcacaaaatcatcctctatctgattatttattatttgctgcagacatagttgaaagccaactttccacgttagaaaaaaatcctttaccgccacaacagcttgaacagttaaatgctatcgagccactaaatgccaaaacctttaagagagacagtatctggcgtgaatacttaactgaaattcttgatgaaataaagcccaaagctaacgagcaaattgctgcaacaattgaatttcttgaaaaagcctcttctgctgaattagaggaaatggcaaataagctcttagcacaagaatttaatttagtcagcagtgataaagccgtctttatttgggctgcactttctctttattggttacaagcagctcaacaaattccccataatagccaagttgaaaacgctgaaaatttacatcactgccctgtttgtggttctttacctgttgcaagtattgtacagattggtacatcacaaggtttacgctacttacattgtaatttatgtgaaagtgaatggaatttggtacgcgcacaatgcaccaattgtaatagtcatgacaaacttgaaatgtggtcattaaatgaagaacttgcgcttgttcgtgccgaaacctgtggtagctgtgaaagttacttgaaaatgatgttccaagaaaaagatccttacgtagaacctgtagccgatgatttggcttctattttcttagacattgaaatggaagaaaaaggtttcgcacgcagcggattaaatccatttatttttccagcagaagacgcataa

SEQ ID NO: 782 - DNA, 441 bp, H. influenzae strain 86-028NP
atgtctattatttctcaaattgaagcctgtgatttcgagcgattgtatgaaatcgaacagcaagcacatctggtgccttggtcatttggtacgttaaaaaataatcaaggtgagcgttatctcaatttaaaattaatagagaataatcagattatcggttttgctatttgccaaaccgtattagatgaagcgactttgtttaatattgctattgtaccctctcatcaaggtaatggattggggaaattattgttgaatgagttaatcgctcgattgaaagaaaaaggtgtacagaccttatggctagaagttagagagtctaaccctgctcgtttcttgtatgaaaaaattggttttaatgaagtcgatattcgaaaaaattattatccaaagcccagcggtggacgagaaaatgccgtagtaatggcctgttatttatag

SEQ ID NO: 783 - DNA, 405 bp, H. influenzae strain 86-028NP
atgaacagacgcgatcttcttttacaagaaatgggcatttcccagtgggaattatatcgccccgaggtactgcaaggttcagtaggaattagtgtggcagagaatattcgctttatcactgtttccaatgaaaatatcagtagctcgcctttgttggctgatgtgctgttaagccttaatcttaaaaaagaaaattgtttatgtttgaattacgatcaaatccagcatatggaatgtaagcagcctattcgttactggttactatcagaaaataacgaccaaattgaccgcactttgccattttgcaagcaggctgagcaggtttatcgctcgccaagttggcagcaatttcaatctaatcatcaagccaaacgagcgttgtggcaacaaattcagcagccttaa

SEQ ID NO: 784 - DNA, 993 bp, H. influenzae strain 86-028NP
gtgatttctctagaaagccaagttttagaacgccatctttcattttttgatggtaaatcggtattatttgctggcggtatttctgataattttcctcaaacattagcctctaaatgctcatcaatccaaatttggagttgctattttgactatgcaagaacacaaagtgcggtcaatttttccgttgaatttcaaggtcaagccgatttaatcgtttattattggactaaaaacaaacaagaagtcaatttccaactgattcaactattagctcaagcatctattggtcaagaaatattaattattggtgaaaaccgttgtggcgtgcgttcagtagaaaaaacattagcaccctatggagaaatagcaaaaattgactctgctcgtcgttgcggtttatatcatttttcactccaaaataaaccgcactttgaacttaaaaatttctggaaaacctaccaacatcctacgatacaagacttaactatatatagtttacctggtgtatttagtgcagcggaattagatacgggcacagaactgttactttcaaccattgataataaaataaaaggaaaagtactcgatcttggctgtggggcgggagtaattggctctgtgataaaaaaaagctctactaacgcacaaattaccatgactgatattcatgcgatggcgttagaatcagcgcataaaacactttctgaaaatcaattacaaggcgaggtttacgccagtgatgtcttttctgatatagaaggaaaatttgatttgatcatttcaaatccaccattccatgatggtattgatactgcctaccgagcagtgacagaactcatcactcaagcaaaatggcacctcaatcaaggtggagaattacgcattgtcgccaatgcatttttgccttatcccgaattacttagacaacatttcggtgattacgaaattcttgctcaaacaggaaaatttaaagtgtattcagtgaaaaattag

SEQ ID NO: 785 - DNA, 909 bp, H. influenzae strain 86-028NP
atgaccgaacaattcgacaaaacctattgcggctttattgctatcgtaggtcgcccaaatgtgggtaaatcaacgctcttaaataaaattttaggacaaaaaatttcaattacatcgcgtaaagcacaaaccacccgtcaccgcattgttgggattaaaactgaaggtgcgtatcaagaaatctacgtggatacaccggggcttcatattgaagaaaaacgggcgattaaccgcttaatgaaccgtgccgcaagtagtgctattggcgatgttgatttaattatttttgtcgtagatggtacacactggaatgcagatgatgagatggtgctaaacaaactacgtaatgcaaaagcaccagttgtgttagctattaacaaagtagataacatcaaaaataaagatgatttattgccgtttattacagatcttagcagtaaatttaactttgctcacattgtgccaatttctgcacagcgtggtaataatgttcatgaattagagaaaattgtacgccaatctttacgcgaaggtgtgcatcatttcccagaagattatgtcacagaccgctcgcaacgttttatggcatcggaaataatccgtgaaaaattaatgcgttttaccggtgaagaattgccttactctgttactgttgaaattgaacaatttaaagtgaatgaacgtggcacttatgaaatcaatggcttaattctcgttgaacgtgaaggtcagaaaaaaatggtaattggtgcgggcggtcaaaaaattaaaactattggtatggaagcgcgtgctgatatggaacgtttatttgataacaaagttcacctcgaactttgggtgaaagtgaagtcaggttgggcagatgatgaacgtgcattgcgtagtttaggatatatggatgaataa

SEQ ID NO: 786 - DNA, 684 bp, H. influenzae strain 86-028NP
atgaatcatttagatcgacttgagcgtaaaatcggctattgttttaatgatattgcgctcttaaagcaggcacttacgcaccgaagtgcggcaactcaacataatgaacgcctagaattcctaggcgattccattcttaatttcactatcgctgaagcactttatcatcagtttccacgttgtaatgaaggagaactgagccgtatgcgtgctactttggtacgcgaacccactttagcgattttagcgcgccaatttgaattaggcgattatatgtcgcttggttctggcgagctaaagaacggtggttttcgccgtgaatctattcttgccgattgtgtagaagcgattattggcgcaatgtctttggatcagggattggctgtgacgacccaagtgatacgaaattggtatcaacagttattggcagaaattaaaccaggcgataatcaaaaagatgcgaaaacgcgtttacaagaatatttacaaggcaaacatttgccattgccaacttatgaagtggtcaatattcaaggggaagcccattgccaaattttcactgttgaatgcaaagtgaaaagtgcggggaaaattgaccgcacttttgtggcaaaaggatctagccgtcgtaaagctgaacaagcggcagcagaacaaattttaaaagaactggacatcaaatga

SEQ ID NO: 787 - DNA, 1050 bp, H. influenzae strain 86-028NP
atgtcaaatttattttttgtgattttattggctgtcggctttggtgtgtggaaagttttagattattttcagttgccaaatacttttagtattttgttactaattttgaccgcactttctggcgtattatggtgttatcatcgttttgtggtgctgccaaaacgtcatcgtcaagtggcacgtgcagaacaacgttctggtaaaaccttaagtgaggaagaaaaagccaaaattgaaccgatttctgaggcttcagaatttttgtcttcactttttcctgtgcttgcagtggtatttttggttcgttcttttttgtttgaaccgtttcaaattccctctggctcaatggagtccactttacgcgttggcgattttttagttgtgaataaatatgcttatggtgtgaaagatccgattttccaaaacaccattattgagggcgaaaaaccacaacgtggcgatgtgattgtgtttaaagcaccacaacaagcgttaattcgtactggtcttggggctactcgagcggcttttgcagaaaatttagcgttaagttcaaaagataatatgtctggtgtggattatattaagcgtattgttggaaagggcggagatcgcatcatttttgatgtggaacaaaaaacattaaaaattgtatatggcaaagatggtaaaccttgtgaagttgattgcgaaaccaaggcgtttgaatatacacaaaatccaacaaatcctgcttttccgaatgaattagaattgactgaaaaaggcgatgtaacacataacgtgttaattggtgagtatcgtcgttattcagaccttgaatttttcccacaagagggaatgcaaactgcagaatggcttgtgccagaggggcagtattttgtgatgggggatcatcgcgatcacagcgatgacagtcgtttttggggctttgtgcctgaaaaaaatattgtggggaaagccacttatatttggatgagcttagaaaaagaagcgaatgaatggccaacaggtttccgttttgatcgcttctttacagcaataaaataa

SEQ ID NO: 788 - DNA, 1797 bp, H. influenzae strain 86-028NP
atgaagaatattcgcaacttttctattattgcccatattgaccacggtaaatcgacactttctgaccgtttgattcaaacttgtggtggactttcggatcgtgaaatggaagcgcaagtgctagattcaatggatcttgagcgtgagcgtggaattaccatcaaagcacaaagtgtgactttaaattataaagccaaagatggcgaaacttatcaattaaactttatcgataccccaggacacgtggacttttcctatgaagtgtctcgctctcttgctgcttgtgaaggggcattgttagttgtggatgcaggacaaggagtcgaagcccaaactctagcaaactgttataccgcaatcgaaatggatttagaagtagtgccgattttgaataaaatcgacttgcctgccgcagatcctgaacgtgtagcggaagaaattgaagatattgttggaattgatgcgatggaagcggttcgatgctcagctaaaacgggtgtgggtatcgaagatgtattagaagaaatcgtggcaaaaattcccgcaccagaaggcgatcctaatgcgccattacaagcattgattattgattcttggttcgataactatttgggcgtggtatctttagtgcgtattaaaaatggggtattacgtaaaggcgataaaattaaagtgatgtccacagggcaaacttacaacgtagatcgtttagggatttttacgccaaaacaagaagatacgactgttttagaatgtggcgaagtgggttgggttgtttgtgcgattaaagatattctaggtgcgccagtgggcgataccttaacccatcaacataattctgcaactgaagtattaccaggctttaaaaaagtaaaaccacaggtttatgctgggctttttcctgtaagttctgatgattatgaagcgtttcgtgatgcgcttggtaaattaagtttaaacgatgcatcacttttctatgaaccagaaacttcgaccgcacttggttttggtttccgttgtggtttccttggacttctgcatatggaaatcattcaagagcgtctagagcgtgagtatgatttagatcttatcacaactgccccaacggtaatttacgaagtgcaattaacgaatggcgaggttgtttatgtggatagtcctgcaaaattgcctccacttaataatattgctgaaattcgcgagccaatcgcagaatgtaatatgctggtgccgcaagaatatttaggtaacgttattaccctttgcgttgaaaaacgtggcgtgcaaaccaatatggtatatcacggtaatcagattgcgctgacttatgaaattccaatgggcgaagtggttttagatttctttgatcgtttaaaatcaacctcgcgtggttatgcttcgttagattacggttttaaacgtttccaagcggcagatatggttcgcgtggatattatgattaacagcgaacgagtagatgcgttggctttaatcgttcataaagataattcacaatatcgtggccgtgaattggttgaaaaaatgcgtgagttaattcctcgtcagcaatttgatatcgctattcaagcagcgattggaaaccatattattgctcgttctacggtgaaacaattacgtaaaaacgtattagcaaaatgttatggtggtgacgtgagccgtaagaaaaaactcttacagaagcagaaagaagggaaaaaacgtatgaagtctttaggtaacgtagaagtgccgcaagaggcgtttttagcaattttacacgtaggaaaagataaataa

SEQ ID NO: 789 - DNA, 384 bp, H. influenzae strain 86-028NP
atgattaaaggtattcaaattactcaagcggcaaatgacaatttgcttaattcattctggttattagacagcgaaaaaaatgaagtgcgttgcttatgtgcaaaaggcgaattcgctgaagaccaagttgttgcagtgagcgaattaggtcaaatcgaataccgtgaattaccagtaaacgtagcaccaactgtaaaagttgaaggtggccaacatttaaacgtgaacgtattacgtcgtgaaactttagaagatgcggtaaataacccagataaatatccacaattaactatccgtgtttctggttacgcagtacgtttcaactctttaacaccagaacaacaacgcgacgttatcactcgtactttcactgaaagcctataa

SEQ ID NO: 790 - DNA, 660 bp, H. influenzae strain 86-028NP
atgaaaaactggacagacgttatcggaaaagaaaaagaacaaccttactttcaacacgctctacaacaagttcatcttgcaagagcaaacgggaaaacaatttatccaccacaagaagaggtatttaatgcattcaaatataccgcttttgaagatgtaaaagtggtaattttaggtcaagatccttatcacggtgcaaaccaagcgcacggcttggctttttcagtaaaacctgaagtagccattcccccttccctattaaatatgtataaagaactcacacaagatatttcgggatttcaaatgccatcaaatggttatttagtcaaatgggcagagcaaggggtattgctacttaacacagtgcttaccgtggaacgaggtatggcacattcacacgccaatttaggttgggaaaggtttacagataaagttattgcagtgcttaatgaacatcgtgaaaaactggtgtttttactttggggcagtcacgcacaaaaaaaaggacaaattattgaccgcactcgtcaccttgttttaacggctccgcacccttccccactttcagcccatcgaggtttttttggctgtcatcatttttccaaaacaaattcatatttggaaagtaatggaatgaaaccaattgattggcaaatctaa

SEQ ID NO: 791 - DNA, 1425 bp, H. influenzae strain 86-028NP
atgactcaaaaattacatattaaaacttggggctgtcagatgaatgaatatgattcatctaaaatggccgatcttttattaagcactcacggattagaactcacggaagcacctgaagaagcagacgtattattattgaatacctgttctattcgtgaaaaagcacaagaaaaagtgtttcatcaacttgggcgttggaaagaattaaagaaaaataatccaaatttagtgattggcgtgggcggctgtgtggcttctcaagaaggggagcatattcgtcatcgcgcgccttatgtggatattatttttggcccacaaactttgcatcgtctgcctgaaatgattaatcaaattcgtggtggtaaaagttctgtggttgatgtgagtttccctgaaattgagaaatttgaccgcttacctgaacctcgcgcagaaggcccaactgcatttgtttccattatggaaggctgtaataaatactgtactttctgtgttgtgccttatactcgtggggaagaagttagtcgtcctgtagatgatgtgttatttgaaattgcgcaacttgcggaacaaggtgtgcgagaggttaatttgcttggtcaaaacgtgaatgcctatcgtgggccaacgcacgatggtcaaatttgtagctttgctgaactgcttcgtcttgtcgcatcaattgatggtattgaccgtttacgtttcacaaccagtcatccaatagaatttacaaatgatatcattgatgtgtatcgtgacacgcctgaattagtgagtttcttgcatcttccagtgcaagcaggatctgaccgtgtattaacgatgatgaaacgtggtcataccgcattagaatataaatctattattcgtaaacttcgtgcagtgcgtccagatattcaaatcagctctgactttattgttggtttcccaggggaaactgcggaagattttgagcagactatgaatttgattgcacaagtgaactttgatatgagcttcagttttgtgtattctgcccgaccaggtacgcctgctgcagatatgccagatgatgtgacggaagatgaaaagaaacagcgtctttatgtgctacaagagcgtattaatcaacaagccgcacaatttagtcgtcgtatgcttggcacagagcagcgcgtgttagttgaagggccatcgaagaaggatattatggaattaacaggacgcactgaaacaaatcgtattgttaatttccaaggttctccagaaatgatcggtaagtttgtggatgtaaaaattactgatgtttatactaattcgttacgtggcgaagtggtgcgtactgaagatgaaatgggattacgtattgcacaatcgccacaagaagtgatgaatcgcacacgtaaagaagatgaattaggcgtagggcgttatcacggctaa

SEQ ID NO: 792 - DNA, 1440 bp, H. influenzae strain 86-028NP
atggcattatccaaaaatacaaaactggtgattttaatggctatcccattgatcactttcttactacctgctcctgatgggctttctttgatagcttggcgattacttggtgtttatatcgccactatcgttgggcttgtgcttaaaccttatggcgagcccgttatcttattggctgcaattgcggtttctggcgttatcatcggtaatactgaaggggcgaaagaattggttaaagtcggcaatatgttggatggttataaatctggcacaacatggcttatttttaccgcattcactttgagttcagcatttgtaatcacaggtctaggtaaacgtatcgcctatcatatgatcggcgcaatgggtagcacaaccctacgcttaggttatgttaccatgttcttagaccttttactctcgccagcaacgccctctaacaccgcgcgttcaggtgggattatctttccaatcattaatagcgtagtggttgctcttggttcagatccagaaaaaagcccgaaaaaagcagggcgttatttgatgatgaacgtatatatggtggttaaaactacctcttatattttcttaaccgcaatggctcctaatgccttagctctttcattaatggcaccaattcttggttttgaaaccacttggatcaaatggttcttagctgcatccgtacccggcttactctgcttattcttaattccgttaatttgttattgggtatctccaccagaattgaaaaaagtggataataaagccattgcgaaaaaaggcttagaagaattaggtccaatgtcttttcgtgaaaaagcactcagcgtgttattcgtaattgcattattcggctggattttctctaattcacttcatatcaatgctaccattgttgcaatcattgtaatggtgctttgtattgtattaagtatcgtcacctgggacgatatcttaaaaagcaaaggcgcatggaataccctagtatggtatggtggtatcatcggcatgtctggcttgcttgaaaaatctggctttttcaaatggttagcaaacaccttaagtaccatacttcagtttgagggacatggtatgatggcgttaatagtgattcttaccttaagtgtctctgtacgttatttatttgcatcaggcggtgcatatgtagctgcaatggtacccgtatttgcaacagtcggacatgtaacaggtgctcctactgaattgcttgctctaggcttagtctttgctaattcttatggtggttcagtaactcactacggaggcggaccaggtccaattgcattcggtgcaggttataatgatataaaatcttggtggattactggtgcgatcattgcttttggtagtttaattatccatctaactatcggtatggcatggtggaaattattaatgagtttaggctggttatag

SEQ ID NO: 793 - DNA, 1398 bp, H. influenzae strain 86-028NP
ttgcagcatttttttacgacattctctacaaagggttcagaaatttcacttgaagcattacttaatgctcgagaggaacgtgcaattttacaacaacagcttataacacaatatggacaaaccttactttgcatcactttaactgctgtgggtggagtaaaaaaaaatgctttgttggattatgtttttagaaaagctctagaaaatctgaccgcactttttactcagttaaacattacagcagtaaaagaaataatccgtccgttagaaacggggcatgaagcctattttgtattaccgatagatgctcgtacgctaaaagtgctgatgattgaattggaagaaagcattcctcttgctcgtttgtgggatttagatgtgtttaatgctaaaggcaatctactgagtcgtacagattttgatctttctccaagaacttgtttagtgtgcggagaaaatgcaaaaatctgtgcgagaacccgcaagcacgagattgatgagattgtagataaaattcaatctctcgcacagaagcatgatttcgcagaacatattggtgaacaagtttatctggcattaatacaagaggctcgcttatcgccaaaacctggtttagtggatgccatcaataacggttcgcacaaagatatgaacctacatacttttgagcaaagtgcgattagtttaaaacctttttttacgcagtttgttctcaaaggcatgatgaccgcgcatttgtctgaaaatcaaattctcgctgaaattcgtcctttaggtttattagcagaaaaagcaatgtttaaagttactgatggcgtaaacacccacaaaggtgctattttttcttttggtttagtgtgtacggcaattggacgattattggcacaaaaaagtttggttcaaagtgcggtagattttgatgttaaattaatctgctcacttgttgcacaatttactcaaggtttaacggatgaactgaaaaattatcctgaacacttgcctagtacggctggagtgcgtttattccaaaaatatggcttaacaggtgtccgtggcgaagcagaaaatggttttaatctcattcaaacgttgttgccacaatttgatgagtaccatcagttagaatgggaacatcgtttactgattttgttgttgaatttaatggcaattaactccgacactaacgtggttcatcgaggtggtttagcgggattacatttcatacagcaaacagcacaggatctgcttacagatcaacatcttgtgacagataaaacagcactgacacaagcattaatgaaatttgataccgcctgcattgaacgtaatttaagttcgggcggtagtgctgatttattagcactaacaattttctttttatcatttagaggtaattaa

SEQ ID NO: 794 - DNA, 1503 bp, H. influenzae strain 86-028NP
atgacaacaagagaacaacgtattgaaaaatatcacgctgatcgctcagtctatcaggcggtgcctaaatctgaatccctttctcgtacagcgaaagatcgcaaactttgtacctctctagaagaagcgattaaacgctctggcttaaaagatggtatgactgtttcatttcatcatgcttttcggggcggagattttgtggtgaatatggtgatgaataaaattgccgaaatgggtttcaaaaatctgacccttgcatcttcatctttaattgatagccacttcccgattgtcgaatatatcaaaaatggcgtggtcaccaaaatctattcttctggtttacgcggtgaacttgcagagcaaatctctcgtggtttattgaatgaacctgtaaatattcattctcatggtggacgtgttcacttagtaaaatctggcgaattaaaaattgacgttgcttttttaggcgtgccttgctgtgacacattcggtaatgccaatggatttactggaaaaagtaaatgcggctctctaggctatgcgcgtgtcgatgctgaatatgctgaccaagttgtgttgctcacagaggaatttgttgaatacccgcactacccaatcagcatagctcaagatcaagtagatttaatcgtgcaagttgaagcagtcggtgacccgaaaaaaattggtggtggtgcaacccgaatgactaccaatccacgcgaattactcattgcgcgtaaatgtgcagaagtaatttttgccagtggttattttaaagatggcttctcattacaaactggttctgggggggcagcattagctgttacacgctttctagaagaaaaaatgcgtcgtgaaaatatcactgcagatttcgcacttggcggaattactgcaagtatggtggcattacatgagactggtcttattaaaaaattattagatgtacaaagctttgattctgttgcagctgaatcacttgcccgtaacccaaatcatattgaagtctccgctaaccaatatgcgaattacagttccaaaggcgcatctgttgaacgtttagatatggtgattctttctgctttagaaatcgacactaaatttaacgtgaatgtattgactggctctgacggtgtgattcgcggtgcatctggtggtcattgtgataccgcagcttctgcacaagtagcaatcattgtggcaccattagttcgtggtcgtattccaaccgtggtggaaaacgtgattacctgtgtaacacctggtgaaaacgtcgatattctcgttaccgatcatggtgtagcagtaaatcctaaacgtccagatttgattgaagctttaagcaaaacagacattccattgtttactattgaacaactttgtgaacgtgcttacagcattactggtaaaccaaaagaaattgagtttactaataaacctgtggctgttgttcgttatcgtgatggttcggtgattgatacggtgtatcaagttaaagactag

SEQ ID NO: 795 - DNA, 876 bp, H. influenzae strain 86-028NP
atgaaattaagaagaagtatgttatttgtgccgggctcaaatgccgccatgttgagtaatagctttatttataaaccagattccattatgtttgacttagaagatgcggttgcgctcaaagaaaaagattctgctcgtttattagtcgctcatgcacttcaacatccgctttataaagaaattgagaccgtagttcgtgttaatccgctagattctgaatttggtttattggatttgaattcggtagtgcgtgcgggtgtggatgtggtacgtatgccaaaaactgaaagcgcgcaagatgtgttggatatggatcacgccattactgagattgagaaagcctgcggtcgagaagcaggttcgactaaaatgctagcagccatcgaatcgccattaggtatcactcaagccaaccaaatcgctttcgcttctaaacgtttaattggtatcgcattgggtgcagaggattacgtacgtaacttaaaaaccgagcgttcaccagaggggattgaactgctttttgctcgttgttctattttacaagcggcacgtgcggctggcattcaggcttttgataccgtatattctaacgcgaacaatgaagaaggcttcttaaaagaggctgcgttaattaaacagcttggttttgacggtaaatccttaatcaacccacgccaaattgaattgttacacaacttatttgcaccgacacaaaaagacgtggagcaggcaaaacgcattattgaagcggcagcagaagctgaacgacaaggggctggtgttgtttcgttaaacggtaaaatgattgacgcaccgattattgatcgcgcaaaacttgtattagaacgtgcgaaatcaggtattcgtgaagagtaa

SEQ ID NO: 796 - DNA, 288 bp, H. influenzae strain 86-028NP
atgaaaataacaaaagtagccgttgcagggacactggaatccagtgatgttcaagtacgggttcaaccttttgattcactcgatattgaaatcaatagctcagtagcaaaacaatttggtgaacaaattgaagcgacagttcgtgaagtattagcaaaactaggcattacagcagcacaagtcattgtagaagacaaaggggcgttagattgcgtgttacaagctcgagtaaaagctgctgcaatgcgtgcaactgatgaaacgattaactgggaggctgtgctatga

SEQ ID NO: 797 - DNA, 1008 bp, H. influenzae strain 86-028NP
atgcaatttgagcgaatttctactgaacaaaaaaaactttccctcattcagacatttttacatcaaaatgcgcttaaattagatgaacaaatcgagtattttgttgttggctataatgataacgaacaaatcgttgtctgtggcggtttagcaggcaatatcataaaatgtgttgcgattgatgagtctttgcgtggtagcggtgttgccttgcaattaattactgaattggttgatttagcttacacgctaaaacgcccacacctttttatttatacaaaacccgaatatgcaacgttgttcaaatcttgtggtttttatatcatctctgatgccaatccttatgtagtattgttagaaaatagtgctacgcgtttacaaaaacaatgctcattatgggagaaaatgcgtgtggatggtaatcgaattggctcgattgtaatgaacgcgaatccatttaccttaggtcatcgttatttaattgagcaagcattacaacaatgtgatcatctgcatttatttattgtcggtgaagacgcatcgcaattttcttacactgaacgatttgaaatgattcaacaaggtattttcgatttatccaatatcactcttcattctggctctgactatattatttctcgtgcaacatttccaaattatttcctaaaagatcaattaattacagatgaaagttattttgagattgatctgaagttattccgtttacatattgctcaagctttgggaataacacatcgctttgttggtactgagctaaattgtcccatcactgccgaatataatcgccaaatgcattattggttaatggatgccgaaatgaatgcaccaaaaataaatgttatcgagatacctagaaaaacagcaagcaaccacattatttctgcttctacagtacgaaagcatttggctgaaaaaaattgggctcaactcgcagagtttgtgcctatgactacgttaaattatttacaaaagtgcggtcgtttttaa

SEQ ID NO: 798 - DNA, 963 bp, H. influenzae strain 86-028NP
atgtctacgcctttcaaaatggaacgcggtgtaaaatatcgcgatgcggcaaaaacctcaattattcccgtaaaaaatatcgatcctaatcaagagttattaaaaaaaccagaatggatgaaaattaaacttccagcaagttcagctaaaattgaaagcattaaaaatggaatgcgccgtcacggattacattctgtttgtgaggaagcgtcttgtccaaatttacacgaatgttttaatcatggcacagccacttttatgattttaggtgcaatttgtacgcgccgttgcccattctgtgatgtggctcacggtaaaccattaccgcctgatcctgaagagccacaaaaattggcagaaacgattcaagatatgaaacttaaatatgtggtaatcacatcggtggatcgtgatgacttgcctgatcgtggtgctggtcatttttctgaatgtgtaaaagctgtgcgcgagcttaatcctaacattaagattgaaattttagtgcctgattttcgtggtcgcattacacaggctttagagaaattaaaagataatccgccagatgtctttaaccataatttagaaaacgtaccgcgcttatataaagaaattcgtccaggtgcggattacgaatggtcacttaaattattgcgtgaattcaaagaaatattcccaaatatcccaaccaaatctggtttaatggttgggttaggcgaaaccaacgaggaaattttgcaagtgatgcaagatttacgtgataacggtgtgactatgctcacgttgggtcaatatcttcaacctagccgccatcatttgcctgttgcccgttatgtgccgccaactgaatttgatgaattccgtgataaagccaatgaaatgggctttgaacatgcggcttgtgggccatttgttcgttcttcttatcacgctgatttacaagccagtggcggattagtgaaataa

SEQ ID NO: 799 - DNA, 639 bp, H. influenzae strain 86-028NP
atgaacaattcccttatcgttcgtcagttaggattgcaagattatcaagaaatttggcacaaaatgcaggattttactgatactcgaaatgctgaaacgcaagacgaaatttggttagtacaacattatcctgtttttacccaagggcaagcaggtaaaccagagcatcttttacaacgtagtgaaatccctgtggtgcaatcggatcgtggtgggcaaattacctatcacgcacccggtcagcaagtgatgtatgtgcttattgacattaaacgccataaaaacttaaatgtgcgtcaattagttaccgcacttgaacaaacggtggttaaaactttggctgaatatggcattgaaagctatccaaagcctgatgcgccaggtgtttatgtggatggaaaaaagatttgttctcttggattacgtattcgtcgtggttgctcttttcacgggttggcattgaatattaatatggatcttaatcctttccattatattaatccttgtgggtatgcagggcttgaaatgtgtcagttagcggattttgttaatcaagatgaagctgattgcgataatgtttcagcaaaattaattaaacacttcgccgatcttttaggctataatataacaactttataa

SEQ ID NO: 800 - DNA, 279 bp, H. influenzae strain 86-028NP
atgacaatagaaaacgattatgcaaaactcaaggaattaatggaatttccagcaaaaatgacttttaaagttgcgggaattaatcgagaagggttagcacaagatcttatacaagtggtgcaaaaatatattaaaggcgattatattccaaaagaaaagcgcagtagtaaaggcacttataattcagtttcaattgatattattgctgaaaactttgatcaggtagaaacactctataaagaactggctaaagttgaaggcgtgaaaatggttatttag

SEQ ID NO: 801 - DNA, 1182 bp, H. influenzae strain 86-028NP
atgttgaaaagaacaacaaaaatcgcatttttatcaagttttgtggcacttagtgctttttcggtatctgcagaggatatgcagtttggcgtaactccaccacaaattacggctcaaacgtatgtattgatggattataattcaggtgcaattttgaccgcacttaatccagatcaacgtcaatatccagcatcactgactaaaatgatgacaagttatgtagttggtgtcgcattaaaacaaggcaaaatccataataccgatatggttaccattggtgaaagtgcgtgggggcgtaatttccctgattcatcaaaaatgtttttagatttaaatacacaagtatctgtagcagatttaaatcgaggtgtgattgttgtttctggtaatgatgcgactgttgcattagctgaacatatttctggcaatgtaccgaactttgtagaaacaatgaataaatatgttcaacaatttggtttgaaaaatacaaatttcaccacgccccatggtttagacgatccaaatcaatattcttccgcgcgtgatatggcaattattggtgcgcatattattcgtgatttacctgaagaatataaaatttactccgaaaaagactttacatttaataaaatcaaacaagctaaccgtaatggactattatgggataaaactatcaatgttgatggaatgaagacagggcatactagccaagcaggatataacttagtcgcttcagcgactacatcaaacaatatgcgtttaatttctgtagtaatgggtgtgccaacttacaaaggtcgtgaagtagaaagtaagaaacttttacaatggggttttgctaatttcgaaacatttaaaactttagaggctggtaaagaaatttcagaacaaagggtttattatggcgataaaaattcagtaaaacttggtgctttaatggatcactttattacgatacctaaaggtaaacaaagtgaggttaaagctcgttatgaattagcagataaaaatttacaagcaccattagcaaaaggtcaagtgattggtaaagtggtttatcaactggatggtaaggatattgcaagtgccaatttacaagtgatgaatgatgtgggagaagcgggtatttttggtaaactatgggattggttagtattgactgtgaaagggttattctcataa

SEQ ID NO: 802 - DNA, 864 bp, H. influenzae strain 86-028NP
atgaaattaaaaactgggttaaatttgaccgcacttttgctatttatgataagcgtagcttttcctgcgcaggctgatacgcaaaaaatgtatggtattcgaggggataatctttctatcgcaactcaaatgcctgcaccaaggacttattcagtaaaagggcaaacttataccactaaaagtgggaatgaagccaaatcttatattaaagaaggtttagcaagttattatcatcttaaatttgatgggcgaaaaacagcaagtggcgatgtttataactcaaaacaatttactgcagcacataaaacattgccaataaattcttatgctttagtgacaaatttacataacaatcgtaaagttatcgtacgtattaatgatcgtgggccttttagtgataaacgtttaattgatctttcacacgctgcggcaaaagaaattggcttaatttcccgcggcatagggcaggtaagaattgaggcgttgcacgttgctaaaaatgggaatttatcaggtgcagccacaaaaacactggctaaacaagcaaaaactcaggaagctgccgatcgtttagtattaaaatctaacacgctttttgataacgcatctaagtcaataaatgctctaaaaggaaccgaattttactgtttgaaaatgcttgaattaacctctcatagccaagcaaataaattaattacgcagcttgcgttagcgaatattcagactgaagtaaatcgctcaggaaataaatatgaaatttatattgggccttttgatgacaaaacaaaaatggcacaagtgagaactaaattacaaaaaatggcaaataataagccattaattgtttatacgtataaaaattaa

SEQ ID NO: 803 - DNA, 1116 bp, H. influenzae strain 86-028NP
atggaagataaaatccctttttggttgcgtgtttggcaacgtttgcatattgatttttggctgtttatcggacttcttgcaataacggcttatggtatgctggtgttatatagtgcatcaggtgccagtgaaatgatgtttaataaccgaattattcaggttttacttggatttattgttatgttgttaatggctcaatttccaccaagattttaccaacgcatcgcaccttatctttatttaattggttttgtgttgttgatcttagtagatgctattggcacgacaagtaaaggtgcgcagcgttggcttgatctgggatttattcgttttcaaccctctgaaattgtaaaacttgctgtgccattaatggtggcggtgtatttaggtaatcgtccgcttccacctaaattaagtgaaacatttatagcgattgcaatgattctactgccaacattgcttgtggcgattcagcctgatttaggcacagcaattttggtcagtgcgtcaggtttatttgtcgtgtttttagcaggaatgagctggtggcttattttagctgcagtgattggcttagctggatttattccgatcatgtggttatatctaatgcacgattatcaacgcactcgcgttctcacattattggacccagaaaaagatcctctcggtgctggctatcatattttacaatcaaagattgcgattggttctggtggattaagcggaaaaggctggatgcaggggactcaatcacaattagaatttttgcccgaacctcatacagattttatttttgcggtaatgggtgaagagcacggaatgattggttttttgattttaatggcgatttacttgtttattattgtgcgaggtttaatgattgccgtaaatgctcaaacttcttttgggcgtattcttgctggtgcaacaacattaattttctttgtttatgtatttgtgaatattggaatggtaagcggaattttgcctgttgtgggtgtgccattacctttatttagttatggtggtacctcttatgttgcgattatggcaagttttggtttactgatgtctattcatacgcataaaagtcaatttatgaaaaggagctaa

SEQ ID NO: 804 - DNA, 1956 bp, H. influenzae strain 86-028NP
atgaatttaaaaaaatttttcaatacgccaactcatgagccgttccgcgataaaaaagcggagcgtaacctttttgcacgccgaacgttagtggcttttttggggattttgctactaacaggtgttttattcaccaatatttatcagctacagattgttaatttcgatacttaccgaacgcgttctaatggtaaccgaattaaattattacctttaccgccaacgcgtggcttaatctatgatcgttacggtaaattattagccgaaaatcttactttttttggtttatacattgtgccggaaaaaactgaaaatttagaccgcactttagatgaattacgctacattgtgggattgacggataacgatattgaacattttaaaaaagaacgtctccgcggaacgcgttatacaccgattttattaaagccgaatttaacagaagaacaaatttcacgctttgcggtaaatggctaccaatacccgagtttagaggtacgtccttatttcaaacgccattatttatatggcgaaacaatggcgcatattttgggctatgtaggtaaaatgaatgataaagatgtagaacgtttgaaacgagaggataaatttgcgaattatgcggggacgaacgatattggaaaattgggtattgaacgttattacgaggatatactgcaaggtaccacgggttttgaagaagtagaaattaataatcgcggcaaagtaatccgtactttgcgtagccgacctgctgtggcgggaaaaagtattcatttaactattgatttagcattacagcgttatattactgaacttttatcgggactaaaaggtgctgtagttgtgcttgatcctaaagatagtagtgtattagcgatggtatctacaccaagttatgacaataatttatttgttgatggtatttcctccgaagattataaacgtttattaaatgatcctgctcgtccgctttatagtcgtgcgacacaaggtgcgtatccgcccgcttcaacagtcaaaccttttattgcagtagccgcacaaactgaaaatgtgattacaccaaacacaacgatttttgatccgggatattgggtattacctaactccacaaaacgttttcgtgattggaaaaaaacaggccacggagatacggatttgaataaagcgattactgaatcctctgatacttatttttatcaagtggcttataatatgggtattgatcgtctttctaattggatgaaggattttggttttggtatgccaacggggattgaaattcaagaagaaacggctgccaatatgccaactcgagaatggaaacaaaaacgctataaacgcccttgggtacaaggcgatacgatttcggttgggattggtcaaggttattggacggcaacaccactacaagtagcaaaagcaacgacgatattggtcaataatggcaaagtaaatacgccgcatttgatgaaagcaattgagggggcagttctagagccttatgaagatccgttaatttatcctgatattagtacacctaaagtgacggcttgggaggcagcgaaacgcggtatgtacaatgttgttaatgctgcaaatggaactgggcgaaaagcctttgcagatgccaattatcgtgttgcaggaaaatctggtactgctcaagtgtttagtttaaaagaaaatgaaaaatacaatgcggtgggattgaaaaaagaattgcatgatcacgcatggtttaccgcatatgcgccttatgaaaaccctagattggttgtgacagtgattttagaaaatgcaggtggtggttcaagtaatgccgcaccgttagcgcgtaaagtgatggattactatttaaatcagcgtttaccacaagttgaaaaatataatgtacctattcagcaaaaaaaagatttgtcacaagagagcgaacaaataaatggaagataa

SEQ ID NO: 805 - DNA, 468 bp, H. influenzae strain 86-028NP
gtgaaaatcacgttaattgctgttggaacaaaaatgccttcttgggttacaacgggttttgaggaatatcaacgccgtttcccaaaagatatgccttttgaactgattgaaatcccagcaggtaagcgtggaaaaaatgctgatattaaacgtattttagagcaagaaggtaaggcgatgttagctgcctgtggaaaaggcaaagttgtgacgttagatattcctggtaaaccttggacgacaccgcagctagccgagcaattagaagcgtggaaaaatgatggttgcgatgtttgtttgttgattggtgggcctgaggggctttcgccagaatgtaaagccgctgcagagcaaagttggtcgctttcgccattgacattacctcacccacttgttcgtgttgtagtggctgaaagtttgtatcgcgcgtggtcgctcactactaatcatccttatcatcgagaataa

SEQ ID NO: 806 - DNA, 309 bp, H. influenzae strain 86-028NP
atggcgttagttgaatttttgatggaaaccttagatgggttaaagggaacagatattgtacattttgatgtacgtggaaaatcatcgattacggataatatgattatttgcacgggtacatcgagccgccaagtttctgcaatggcagataatttaattacagaatgtaaaaaagcaggttttgaaacttttggtgaagagggtaaaaatactgcagattggattgtagtggatcttggtcaagctatcgtacatatcatgcaacgtgacgcccgtgaaatgtatcaattagagaaactttgggcgtaa

SEQ ID NO: 807 - DNA, 1656 bp, H. influenzae strain 86-028NP
atgagtgatattgcgatcacgattagccttcttgccctcgtcgccgtaatcggcttatggatcgggcattggaagatccgcggggttgggcttggcattggtggcgtgctgtttggcggcattattgttgcccatttcactaatcaatatggcttgaaactggatgcgcatacgctgcattttgtgcaagaatttggtttaattttatttgtttatactattggtattcaggtggggccgggctttttttcttctttacgaaaatctggtttaaagctaaatgcctttgccattttgattattgtgctggggtcaattgccgtggttcttgtacataaaattgcggatgttccactggatattgccttaggtatttattctggtgctgttactaatacgccagcgttgggggcagggcagcaaattttagcagaattaggggtgcctcaaaccactgtgactatgggggtgtcttatgcaatggcttatccattcgggatttgcggtattttgcttgcaatgtggttaatccgcttattttttaaagtcaaagtggacgatgaagcggcacgttttaatgcggagagcagtcaagataaagaaagtttacataatatttctttaaaagtgacgaaccaaaatttagatggtctgacgttaattcaaattcctggatttagtgatgaagaagtcgtatgttcacgtttaaaacgcgatgatatggaaattgttccaaaggcaagtactgaaattcgtatcaacgatattttgcaattagtgggcgatgataattcgcttgccaaaatgcgtttaattatcggatacgaagttgatgcaccaactgttgcctatagtggcgaaattcgttctgagcgtgtggtggtaacgaatgaaaaagtattaggcaaaaagatccgtgccttaggcattcatcaaaaatatggggttgtgatttcacgtttaaatcgtgcagggattgagttagttccaacgggaaataccacactgcaatttggcgatgtgctacatatggtcggacgcagtgatgtactaaatcaggctatttcagtcattggtaatgcacaacaaaaattgcttcaagtgcaaatgttacctgtgtttatcggcattggtttaggagtactcgttggttcgattccattctatattccaggtttccctgttgcgttaaaattagggcttgctggcgggccattggtggttgcgttaatcttagcgagaattggcacgattggtaaactttactggtttatgccgcctagtgctaacttggcgttacgcgaaattgggattgttcttttcttggctgtggtcggtttaaaatcaggcggaagtttctttgatactttagtgaatggttcgggacttgaatggatgggatacggtatttttatcacctttattccattaatgattaccggtattttggctcgtctatatggcaaactgaattaccttacaatctgtggtttacttgcaggttcaatgacggatcctcccgctttagcatttgctaatgaaattaaagaagataacggtgctgcagcactttcttatgccactgtgtatccgttagtgatgttcttgcgaataatgtcgccacagttattggcagtgttattatgggcagcatag

SEQ ID NO: 808 - DNA, 1779 bp, H. influenzae strain 86-028NP
atggattacagccaagaagccattacttctcttatttggattttacaaacgctagccatcacctcagtcgtctttagttttggcatttttcttttggtgcgttttactcaatggggaagacaattttggatgtttgcaggtggttatctttcgcctaaacgtagcattaaacctatcttattctttctacttattgttgcaatgacgctacttagcgtacgtatcagccttgtacattctgagtggtacaaaaatatgtacacatcattgcaagaatttaatgaacatgtattttggcaacaaatgggcttgttctgtgtcattgccgcaagttctgtttcagcagcattagtaagctattatttagagcaacgtttcgtcatcaactggattgaatggcttaacgaacagcttgttgataaatggatggcacatcgtgcctattacaaaacacaatatttatcagaaaatcttgataaccccgatcaacgtattcaacaagatgtgcaatcttatgtaaaaaccacgctttctttaagcactggtgtcattgatgcggtaacctctatgatctcttatacgattttattatggggattagcaggtccaatgatggtacttggcgtggaaattccgcatatgatggtatttttagtgtttggttatgtcatcttcacaaccctcatcgcattttggctcggtcgtccattaatatccttgaattttattaatgaactcctaaacgcaaactatcgttattctttaattcgaataaaagaatatgccgaaagcattgctttttatgcgggcgaaaaagtcgaaaaaaatcagctttatcagcagttcaatgccgtcattcataatatgtggattattgtatttagaacactaaaattttcaggatttaacttagtcgtaagccaaatttccgtggtttttccattgttaattcaagttggacgttactttgaaaaacaaataaaacttggcgatctaatgcaaaccttacaagtatttggtcagttacacgcaaatctttccttcttccgcaatacttatgataattttgcaagctataaagcaacgctagatcgtttaactgggttctgttatgccattgaaaaagcaaataataaatcacaaacacagatccacaatcatccaacagatgtgattttcaaaaatttaagtattcaaaatccattaggtcatacactaattaaacatctaaacattaccttaccgcaaggaacaagtttgcttattcaaggaaaatctggagcaggaaaaaccacgcttttacgcaccattgcggggctttggagctatgccgagggggaaataaattgccctacgcacaatcagcttttcttgtcacaaaagccgtatgtgccacaaggaaatttaatgtcagcattagcttatccaaataacgctgacaatatttcacatacgcaagcggtagaaatattaaataaagtgcaactaggacatttggctgaacaattagaaaaagaacaagactggacgcgtattctttctcttggcgaacaacagcgtctggcgtttgcacgattaattctacacaaaccagcagtggcatttttagatgaagccacagctagtatggatgaaggtttagaattttcgatgtatcaattgttacaacaagaactaccacaaacgacaatcatcagtgtgggacaccgttcaacccttaaaaccttacatcaacaacaattaattctacaagacaaagggcaatggcaagtgctataa

SEQ ID NO: 809 - DNA, 1137 bp, H. influenzae strain 86-028NP
gtgcaattttttgtatgtttgacaaagtcattttctattttttgtcaaacaaaactaactttcattttaaacggtataattatgttatttaaaaaaattcgtgggttgttttcaaacgatctttctattgatttaggcacagctaatactttaatttatgtcaaaagacaaggtattgtacttgatgaaccctctgttgttgcgattcgtcaagatcgcgtaggcacattaaaaagcattgcagctgtgggtaaagaagctaaattaatgttaggtcgtactcccaaaagtattgtagcaattcgtccgatgaaagatggcgttattgcagacttttttgtgacagaaaaaatgttgcaatactttatcaaacaagttcatagcggtaattttatgcgtccaagcccgcgtgtattagtatgtgtgccagctggtgcaacacaagtagaacgccgcgcaattaaagaatcagcaatcggtgctggtgcgcgtgaagtatatttaattgaagaaccaatggcagctgcaattggggctaaattacccgtttctactgcagttggttctatggtaattgatatcggtggtggtacgacagaagtggctgtaatttccttaaatggtatcgtatattcttcttccgtgcgtatcggtggtgaccgtttcgacgaggcgattatttcttatgttcgccgcacttttggctcggttatcggagaacctaccgccgaacgcatcaaacaagaaattggttctgcttatattcaagaaggtgacgaaattaaagaaatggaagtacacggacataatttagccgaaggtgcgccacgttcatttactttaacatcacgtgatgtcctagaagccattcaacaaccattaaacggtattgtagcagcggttcgaaccgcacttgaagaatgccaaccagaacacgcagcagacattttcgaacgtggtatggtattaactggtggcggtgctttattacgtaatattgatattttactttctaaagaatctggtgtccctgttatcatcgcagaagatccattaacctgtgttgctcgtggtggtggcgaagcattagaaatgatcgatatgcacggcggcgatatttttagtgatgaaatttaa

SEQ ID NO: 810 - DNA, 1056 bp, H. influenzae strain 86-028NP
atgaaacccattttcggcaaagcccctcccctaggtattcgtctgcttatcgctatctttgcatctattgccttaattttagctgatggacgtaatagctcaataacgaaagcacgtagtgcaatggaaacagcaataggcggtttatattatcttgcaaatagccctagaagcatcttagatggcatttcagaaaatcttgttgataccaataaattacaaattgaaaacaaagtactacgccaacagcttttggaaaaaaatgcagatttacttttacttgatcaactcaaagttgaaaatcagcgattacgtcttttattaaattctccgttaagaaccgatgaatacaaaaaaattgccgaagttcttactgcagaaacagatatttatcgccaacaaattgttattaatcaaggcaaaaaagacggtgcttatgtaggtcagcctgtcattgatgaaaaaggcgtcattggacaaattatttccgtgggcgaaaatactagccgagtactgctactcacagacgtaacacactcaattccagtgcaagttctacgaaatgatgttcgtgttattgcgagtgggactgggcataccgatgaactaagcctcgataacgtgcctcgttccgttgatatagaaaaaggcgatcttctcgtaacctctgggcttggtggacgttttcttgaaggctatcccgtagctgttgtacaaagcgtttcgcgtgatagctctaattactttgcaatagttaaagctaaacctttagctttattagaacgtttacgttatgtacttttactttggccaagtaacctagatatatcaaaagtaaaatcaatgtcgccagaagaagttcgcaatctggtgcaaaaacgtttagaaagccaagctaatgaagcaaattatagagtgaaaaaaacacccttaacagaaaaagactttctagaaaatgaagaaaaaaccattattgaaccagatattccaacagattttcttcaaaatgaagaagatcttcccatagaacagcaagaagaaaggatagaagactaa

SEQ ID NO: 811 - DNA, 489 bp, H. influenzae strain 86-028NP
atgcaaacacgatttattttacaatggttcactattttaagcttctttgttattgcctttgtattagaacttgcaccttggccagttggtttccaaatgctaaagcctgcgtggcttgtacttgtattactttattgggtattagctattcccaataaagtaagtataggctggtcatttttactcggattaacttgggatttaatattaggctctacattaggcgttcacgctctcgtactttctacgagcatgtacatcattgccaaaaactatttaattctgcgaaatttatcactttggttccaaagtttattggttgtacttttcgtcttcattataagattacttattttcttagttgaattttcactccatactgccttttttcattggcaagccatcttaggcgcattcgcttctggtttactatggccgtgggtatttttattaatgcgcaaaatacgcagaaaagttaaattacattaa

SEQ ID NO: 812 - DNA, 777 bp, H. influenzae strain 86-028NP
atggatatggcaaattggcagaattatcgttctactgtgaatggtatgcctgccgtgtttaccgcaaatattgaagatgttgaaaaatatcacggtaaaggtctcgataaaatagtgcagtttactattgattatcaggctgatgatgaaacgggtttaccctcagaagttgaatacgataagttaattaaccgtgtatttaaaattttgacacaactaaccgcacttccaaatgtattttttgcggggcattttatttgtaattctcaaataaaaatacatttttattgtaagcacgaaaatcttattgtagaaactttacagcaaattgattttgttaaagatattaatgtgcaaaaggatttaatttgggatacttattttgactttttgctcgcttctccattggagattaagttaaatgcaacggaagaattgcttgatttattaaaaagtaaaggtcgtaatttaagtgatacctatttagtagagcatagttttcattttgatgaagagcagaaaatgttcccttttatggatgagcttagtttaggggattattctttcacgacattacaatattctgcacaagcgattcagtttaatgaagatgacgaaccttatttcttggtaaaattagagcaagaaatttcattagaaaatagcgaaatttttgaacaagtagaacgttttgaaaaattggctgaacaattttcgggagagtatatcggttgggaatgtgattctttactggatagcaataagccattgaattag

SEQ ID NO: 813 - DNA, 804 bp, H. influenzae strain 86-028NP
atgaaatttatttctttcaatataaatgggttacgtgctcgcccacatcaacttgaagccattattgaaaaatatcagccagatgtgattggcttacaggaaattaaagttgctgacgaggcttttccctatgaaattacagaaaacttaggttatcacgtatttcatcatggtcagaaaggtcattatggagtagcattattgactaaacaagaacctaaagtgattcgtcgtggttttccaactgacaatgaagatgcacaaaaacgcattattatggctgatctggaaactgaatttggtttattgaccgtcattaatggctatttcccacagggggaaagccgtgcgcacgagactaaatttccagctaaagagaaattttatgcagatcttcaacagtatttagaaaaagaacacgacagatctaatccgattttaattatgggcgatatgaatattagcccaagtgatttagatattggtatcggagatgaaaatcgtaaacgttggttacgcacaggtaaatgttctttcttacctgaagaaagagcgtggtatcaacgtttgtatgattatggattagaagatagttttcgtaagctgaacccaacagcaaatgataaattctcgtggtttgattaccgttctaaaggttttgatgataatcgaggtttacgaattgatcatattttgataagccaaaaattagctgaacgatgtgtcgatgtgggcattgcattagatattcgagcaatggaaaaaccgtctgatcacgcaccgatttgggctgaatttaaatag

SEQ ID NO: 814 - DNA, 675 bp, H. influenzae strain 86-028NP
atggaaatcgaggttgtttatcaacatagcgattttattattatcaacaagtctgagggtattagcgttcataaagatcaagaagagcaaggcttaacagaacttgttgcaaaacaactgaatgtgcctaaagtatggttggttcatcgcttagataaagtaacttcaggtttgttaattctggcgttaaatgctgaaagtgcggctgaattttcacgacttttttctgaacataaaatacataaaacgtatctggcattaagtaaccaaaagcctaaaaagaaacaaggtttgattatcggggatatgaagaaatcccgagagggtgcatggaaactttgtcaaaccaaagaaaatccagcaattacacgttttgcaagtgtaagctgtgaacctaatttacgtttatttattttaaaaccacaaacggggaaaacgcatcaattacgtgttgcgatgaaaagtttaggtagcccgattttaggcgatgggctttatggtaaaaacacagaaaaaattgaccgcacttatttgcacgctactcaattggaatttgattatctaaatgattttatttcggtcacttgtttaccttctcaaggtcaattttggattaagcctacagtatttgagcaaattcaggtttatctgacaaagccgtttttatcaaaatag

SEQ ID NO: 815 - DNA, 1065 bp, H. influenzae strain 86-028NP
atggaaaaacaaatttttgaacattcagttaatgtagaggaagaacactatcagcccaagcaagaattccataatatggaagcaaagctagatgaagcgttggatggagagttacttgatgctcaacttgaacaagcattgaaaccaaaatccagttttagaaaaactttattaaaatttaccgcacttttatttggcttggcgacggttgcacaatccatgcagtggatttgggatagctatcaacaacatcaatggatttatcttgcttttgctttagtcagtttgattatcattttattggggattaaagagattattggcgagtggcgacgtttagttcgtttaaaaaaacgtgagcaatggcaacaacaaagtcagcagatttggttagaaagtgcggtaaaaaatggcgatgttttttccgttcataacgcagaaaaaagtaaaattctttgcttagatattgcagaatctttaggtttggaaaatgattctccagcggtaattcaatggcaacaccaattaaatgaagcttattcggcgcaagaaattgctcatttattcagtcgtcatgttttgtcttcttttgatgcacaagctaaaaaattgattagtaaaatggcagctgaatcagctgtgattgtcgcgattagtccacttgctgtagtggatatgttttttatcgcgtggcgcaatcttcgattaatgaataagattgctgaaatttatgggattgaattagggtatttttcacgtattagattgttaagaatggtattggtcaatatcgcttttgctggagcaaccgaagtggcacaagatattggaatggattggctttctcaagatgtgacagcaaaattatctacacgtatcgctcaaggaattggtgtgggattactcactgctagattaggcgtgaaagcaatggaactttgtcgtccgttagcatttcaattaaacgaaaaaccaaaactctcacatattcaacaggaattacttagttcggtaaaagatattgttctcggtaaaaataaaatttacaaaaaggagcaaatctga

SEQ ID NO: 816 - DNA, 663 bp, H. influenzae strain 86-028NP
atgcaatcacgtcttattgtggatgctcaaaaagaatcgttactcagcacacataaagtgttgcgtaacacgtattttttactgggattaacaatggctttttcagcggttgttgcgtttatttcaatgagcttaaacttgccttatccaaatattattgtgttactagtgggtttttatggcttacttttcttaaccaataaattagctgatcgccctgctggtattttggcggcctttgctttcactggatttatgggatacaccatcgggccaattttaaatatgtatgtggcacgtggaatggaagatttgattatgcttgcattcgcaggaactgctatcgtattttttgcgtgttccgcttatgtattgactacgaaaaaagatatgtcatttttatcaagcgcaatgttcgcattatttattgtgttattgcttggtatggtggcgagtttcttcttccaaattcctgcgttatcggtcgcaattagtgcattatttgtagtgttctcaacaatgaccattttgtatgaaaccagtaatattattcacggtggagaaacaaattacattcgcgcaaccgtgaacatctatgtttcaatctacaatttattcttgagtttattaagattactttctatcttttcaagtgatgaataa

SEQ ID NO: 817 - DNA, 555 bp, H. influenzae strain 86-028NP
atgaaaaaacaaattcttgccttagtttgtggcgtaatgtttagtagttcaacttgggcacacaatttgcaattagagcaatctttaccagcagtgcaagtaacggagtacggtgaaattgtgctttcaggaaaagatactgcgtttcaaccttggggttctgcggaattagcgggtaaagtgcgtgttgttcatcatttagcgggtagaacggctgcaaaagagaaaaatcagtcgatgattgatgcgataaaagcatcccattttaatcctgtaaaataccaaacaaccactattattaatgcggatgatgcgattgttggtacaggtatgtttgtaaaaaatagtgcacaaaaaggcaaacaggaaaatccacatagtcaagttgtgttagatgataaaagtgcggtaaaaaatgcttggggattaaattctaaagatagtgcaattatcgtgttagacaaaacgggaaaagtaaaatttgtgaaagaaggaaaattgtttgatagcgatattcagactgttatttcactagtgaatggattgaccaaataa

SEQ ID NO: 818 - DNA, 363 bp, H. influenzae strain 86-028NP
gtgcgcctattatatgtaatcaagaaggaaaacccaatggatcaaatgcctaattgcccaaaatgtcaaagtgaatacgtttaccacgattcaattaattttgtttgccctgattgcggtaatgaatgggataataatgaaattcaagaatcagatgacgatcaactaatcgtaaaagacagcaatgggaatttgcttgcagaaggcgacaatgtacttttgattaaagatttaaaattaaaaggttcatcagaagtattgaaaaaaggtacaaaattcaaaaacatccgcttagtaaatggcgatcataatgtcgattgcggcaaaatcatgttgaaatctgagtttttgaaaaaggcttaa

SEQ ID NO: 819 - DNA, 639 bp, H. influenzae strain 86-028NP
atgtcatacacaactcaacaaattattgaaaaacttcgtgaactcaaaattgtgcctgtaattgcgttggataatgcagacgatattttgccgctagcagatacgttggctaaaaatggtttacctgtggcagagattacttttcgctctgaagcagcggcagatgcgatccgtttgttgcgtgcaaatagacctgactttttaattgctgccggtacagttttaactgcggaacaagtagttttagctaaaagtagtggggcggattttgtggtaacaccaggatttaatccaaaaattgtgaaattatgtcaagatttaaattttccaataacaccaggggtgaataatcctatggcaattgaaattgcattagaaatgggaatttcggcggtaaaatttttccctgcagaggcttcaggcggagtgaaaatgattaaagcattgctcggtccttatgctcaattacagataatgccgactggtggtatagggcttcataacataagggattatcttgctattcctaatattgttgcttgtggaggctcttggtttgtggagaaaaaattgattcaatccaaaaattgggatgaaattggacgattagtcagagaagtgattgagattattaaataa

SEQ ID NO: 820 - DNA, 1404 bp, H. influenzae strain 86-028NP
atgaagcaatttatggatgaaaatttccttctttcaacggatacagcaaaaattctctatcatgattatgccaaaaataaacctatttttgattatcactgtcatttaaatccaagagaagtggcggaaaatcgtcaatttaatgatttagctgaaatttggctagagggtgatcactacaaatggcgagctttgcgtacagctggagtaccagaagaattgattacagggaaggctactaactatcaaaaatatttggcttgggcgaaaacagtccccctttgtattggtaatccaatttatcactggacacatttagaattacgccgtccttttggtataaccaatatgttatttaatccgcaaaatgcggaaaaaatttggcatcaatgtaatgaaatgttgcaacaacctgaattttctgcgcgaggcattatgcagaaaatgaacgtgaaattagtggggacaacagatgatcccattgattctttgcaatatcatcaagcaatcaagaatgatgaaagttttgatattgatgttgtaccaagttggcgacctgataaagtattcaaaattgagttgccacaatttaatgactaccttgtacagttaagtgaaattgcagatgtagatatttatacgtttgcagatttaaaaaaagcgttgttaaaacgtctcgaatattttgatgctcaaggttgtaaatctgctgatcatggtatggaaattgtccgtttttcagctattccagatgaatcagtattgaatagtattttacaaaaacgtttgcaaaatcaaccgctcttggaagaagaagttgctcaatttagtactgcaattttagtctggttggcttcggaatattgtaaacgtcactgggtaatgcaaatgcatattggtgcaatacgtaacaataatagtcgaatgtttgctttactcggtgcagatagtggctttgattccattggtgatcgaacttatgcatatcccctctctcgtttgttagatgcaatggataaggaaaatcaactgcctaaaactattttatattgcttaaatcctcgagataatgaaatgatcgctagtatgatcggaaactttcaaggcgatggtattgcagggaaaatacagtttggttctggatggtggtttaacgatcaaaaagacggaatggaacgtcagttacaacagctttctcaattagggttactcagtcaatttgttggaatgctaactgattcacgtagttttttatcttacactcgccatgagtatttccgccgtattttgtgtgaaatgattggtggatgggttgaaaaaggtgaagctccaaatgacatttcattactgggtaaaatgattgaagatatttgtttcaacaatgcaaaaaattattttaaatag

SEQ ID NO: 821 - DNA, 858 bp, H. influenzae strain 86-028NP
atggagtttactatgaatattgcagcaaaccataacttagaaaataaactaattataatcacgggggctggcggagtgctatgttcatttctagctaagcagttagcgtatactaaagctaatattgccttgttagatttgaatttcgaggcagcagacaaagcagcaaaagaaattaaccaatcaggtggaaaagcaaaagcttataaaactaatgtgttagaacttgaaaatattaaagaagtgcgtgatcaaatagctattgattttggcacttgtgatattttaattaatggtgctggtgggaataatccaaaagcgacaacagataatgagttccatcaatttgatttaaatgaaacgacaagaacattctttgatttagataaatctggtatagaatttgtatttaatctcaattacttaggttcattattaccaacccaagttttttcaaaagatatgcttggtaaacaaggggcaaatattattaatatttccagtatgaatgcctttacaccacttacaaagatacctgcttactctggtgcaaaagctgcaatcagtaattttactcaatggcttgctgtatatttctcaaaagttggtattcgttgtaatgctatcgcaccaggatttttagttagtaatcaaaaccgcactttattatttgatactgaaggaaaaccaacagatagagcaaataaaatcctcactaacacaccaatgggacgttttggtgagtcagaagaattgctcggtgcattacttttcttaatagatgaaaattattctgcttttgtcaatggcgtagttttacctgttgatggcggtttttctgcgtatagtggagtatag

SEQ ID NO: 822 - DNA, 944 bp, H. influenzae strain 86-028NP
atgaaaaaaatagcatttatcggcgagtgtatgattgaactcaatgggaaaccctttgcggaaatgtggcaaagttatggtggtgataccttaaattctgcaacttatcttagtcgagtaagttcatcaaaagagattcaagttcattatgtctctgcattaggaactgataatttaagtaaacaaatgcttaaatattggcaagctgatggcatccaaacaaattgggttttacaggatgaacagcatcaaccaggtctttatctaatccaattagatgctcaaggcgaacgcacgttcctttattggcgtaatcaatctgcagcacattatatggttcaacatccggattttgctaaggttattgcagaacttcagcaagttgatgtgatttatttaagtggtatttcattagcaatcttaccgaaaaatgaccgcacttttttaattgagcaattatcttctttagctaaaaaaggcgcagaaattgtttttgatagtaattatcgccctgcactttgggattcattagaagaagcccaagattgttatttgcagctttacctagtgttaatatagctttggtgacttttgatgatgaacaagcattatggaaagataaaacatctagggatactttagaacgattacataaaattggtataccaaaagtgattgtgaagtgcggtaagaatggtgctattttttcagataggtatttatctcaatatgggcaagtgatgactgaacctattttaaatgtggtagatacaacctctgctggtgattcttttaatgctggatttctgaacggttatttacgaaataaacctctcgaaacttgttgtcagcaaggcaatcgtattgctggcatcatcattcaatataaaggtgcgattatagataaagtcgcaacgtctcatcttcaatctgaatttaattaa

SEQ ID NO: 823 - DNA, 1272 bp, H. influenzae strain 86-028NP
atgttactattatttttgtgtagtttattcttattgttatttcttggtgtacctgtagcactatcaatgctgttgagtgcgagtattatgctatatcatcttgatatgtttgatacgcaattaattacagaaaactttgtgatgggaacgaataattttcctttgatggctattcctttctttatgcttactggagaaataatgaagcatggtggaatttctgagcgaatcattaattttgcaacaagtatggttggtcatattaaaggtggtttaggttatgttgcgatcatttctgggttgatatttgcagggttatctggttctgcggtagcggatacggccgcgttaggtgcaatactaattcctatgatgatttctaaaaaatatgatggtgctcgttccacaggattaatttgtgctgcaggtattatttcagttgttattcctccaagcattcctatgatcatttacggtattactgctggagcatccatcactaaattatttatggggggaactgtaccaggcttattaatggtcgttggattatgggttacttggaaaattttgtatagaaataatgatacaagtctagaaagaaaacaaactggcaaagaaagatgggttgcttttaaaaaagcattttggcctttattattacctatcattattattgtgggattaagaggagggatttttactccaacagaagcgggagttgttgctgcaatttatgctggcatagtaagtattgcttataaaggcttaacattttctaaattaaaagacgtcttcattggcaccatcaaaacaacatcaatggtaatgtttgttgctgcatcagcaatgatatctgcttttgcgattacagttgctcaaattccaacagaattagtccaaacgattaaaggattaactgatagtccgacaattttaatgtttattataatgctatttttattacttgttggatgtgtaatggatttaattcctgcggtattaatttttgttccagtcttattaccagtgttaagagcatataatattgatattgcgtattttggaatcatgatggtgattaatttatctataggattaataacaccgcctgtgggaacagttttgtatgtaggctcagggatatcaaaattagggataggagcattatccaaaggaattgctccattcttatttgtgtacgcaattattatgatgttgatcgtattttttcctgaaattgtaattgttccaatgaattggttatcttga

SEQ ID NO: 824 - DNA, 498 bp, H. influenzae strain 86-028NP
atgggggataaagaaggagcttgttttatgaaaatagcaaagtatttagacaaagcattagaatatctttctatcttagcattagttattatgatttctctcgtgttttttaattctgtcttgaggtacttctttgattctggaattgcattttctgaagagttttctaggatttgttttgtatatatgattttctttgggattatccttgttgccaaggataaagctcatcttactgttgaaattattatttctgcgttacctgagcagtatagaaaaatagtcttaatagttgcaaatatatgcgttctgattgcaatgatttttatagcttatggtgcattacaactgatgtctttgacctatactcaacaaatgccagctacaggtatatcttcatcttttttatatttagctgctgttatatctgccgtatcttacttttttattgtcatgtttagcatgattaaagattataaagaatcctctgataaatag

SEQ ID NO: 825 - DNA, 987 bp, H. influenzae strain 86-028NP
atgaagtcaattaaaagcttaggtaaattattacttgcttcaagtatattgtttagtagcagtgcatttggaaaaacaattattaagttaggacattataattctgatatacatccatcacatattgcattacaggaatattttaagaaaacaattgaaaatgaaacaaatcatagatatgagattagactttatcctaataatcaacttggcggtgaagatcaaattgtaaatggattacgtaatggcactatagaagcaggtattacaggtttattattgcaaaatgtagatcctatttttggagtttgggaatggccttatttatttaaggataatcaagaggctaaaaaagtattggaatctccaatcgcaaataaaattggtcaaaaaatggagaagtatggaattaaattacttgcctatggtatgaatggatttcgtgttatttcatctaataaaaaattagagaaatttgacgattttaaaggtttacgtttaagagttccgctgaattcactttttgttgattgggctaaagcaatgaatataaatccacaaagcatgccgctcagtgaagtttttactgcattagaacaaaaggtaattgatggtcaagaaaatccgtatatgttaattaaagactctgggttatatgaagtacaaaaatatattatccaaagtaaccatattttctctccaggattattacaaattagcttaaaaacttggaataaaattccaaaagaagatcaaattatttttgaaaaagcagctaaattgtatcaagagaaagagtgggaattagcaattaaaacagaattagaagttaaagattatctagctaaacatggaaatgaaattatcgtaccaagtgaagcatttaaaaatgacatggtgaatgcatctaaggtgctttatgatagtttttataaaaaatatgattgggctaaggatgtagtccaaaaaattaacgaagctaaataa

SEQ ID NO: 826 - DNA, 1029 bp, H. influenzae strain 86-028NP
atgaaggagcgaatcaaagcaatatgcttagaaaaaccaaacaatgtagttgttaaagaagtgccttatcccgagaaaagtgataatgatgtacttattcaggtagaatcaatggggatttgtggttctgatattggtgcatatagaggaactaatccattagtaacttatccaagaatacttgggcatgaaattgtagggagagtaattgaaagtggaattggtatgccggatagggtgagggttggagaccgagtaattgttgatccttatgttttttgtggtcaatgctatccttgttcaattggtagaaccaattgttgtgaatcattaaaggtaattggtgttcatattgatggaggtatgcaagaggtaattagacatcccgctcatcttttaactaaagtcccagataacctaccgattcatcaattacctttagctgaacctttaacaatagctttacatgctttacatagaacaactttaaaatcaggggaacacatagtaattattggagctggtgcaattggattaatggcagcattagcagcggttcaatatggagcaatcccaattttagttgatatattagaacaacgtcttgagtatgcaaaatccttgggaattgaacatattgtaaatccgcataaggaggatgacattaaaagaattaaggaaattacaagtggtcgtatggcagaagttgttatggaggcatctggtgctaatatttctatcaaaaatactctgcattatacctcctttgcaggaagaattgctttaacaggatggccaaaaacagaaactccattaccaacaaatttaattacctttaaagaattgaatatttatggttctagaacaagcaagggggaatttgaggaggcattggatatgcttgctactaataaaattaatgcatctcatatcattactaagtgtatcaaatttgaagaaattcctagttttatttctgatttatctgatcatccagaaaattatttaaaaattaatgcagttttctaa

SEQ ID NO: 827 - DNA, 801 bp, H. influenzae strain 86-028NP
gtgagccgtatcacaaaaataaaaaattggaataccaatttaaggaaaaatatggaaaatatagtaaatagaacatatacccgaatcggtcaattgctaaaacaagatatttctcaaggaatttatagcattggagacaaactccctacagaacgagaaatttctgaaaaatttggtgtaagtagaactattgttagagaagcaatggttatgttagaagtagaaaaattagtagaggtaaaaaaagggtcaggcgtttatgtagtaagaacccccgaatcaatacatatggaacattcagatttaccagatgtaggtccatttgaacttttacaagctagacaactattagaaagtagtattgctgaattcgcagcgttacaagcgactaaaaaagatattttaaatttaaaacaaatactgaatcgagagaaagaattacttactcagaatcaagatgactatagtgcagacaaagattttcatttggcacttgcagaaattacacaaaatgatgtgttagtcaaattacaagaacaattgtggcaatatcgctttaatagtgcgatgtgggcacaattacattctcgtattttacaaaatgattatcatcatttatggatagaagatcatcaaacaattttatctgctattcaaaagaaaaatgctaatgaagctagaaaagctatgtggcaacacttagaaaatgtaaaagtaaaattatttgaattatctgatgtagaagatccacattttgatggatacctattcaatacaaatccagttgttgtaggtatctaa

SEQ ID NO: 828 - DNA, 1185 bp, H. influenzae strain 86-028NP; identical to SEQ ID NO: 627

SEQ ID NO: 829 - DNA, 714 bp, H. influenzae strain 86-028NP
atgtttgaatggattaccgatcctgaagcctgggtatcacttgcgacacttactgctttggagatcattttaggggtcgataatattatttttattagtatcctagttgggcgtttacctgaaagccaacgccagtctggtcgtattattggacttggtttagcaatgctgacaagaattttacttttaatgtcacttgcttggattatgaaacttactgcaccattatttactctgtttaatcaagcaatttctgggcgtgatttgattttattaatcggaggtttattcctgattataaaaagctttggggaaattaaagaggcaataaatcatcaagaacaccataattctgaaagcaaaaacaaagtgagttattttggcgtattaattcaaattgcagtgctagatattgttttttctttagattctgtgattacagcagtaggtatggcaagccaccttcctgtgatgattttggcgattattattgccgttggcgtgatgatgtttgcagcaaaaccaatcggcgctttcgtagatacgcatccaaccttgaaaattctagctttagccttcttggttttagttggaattagtttaattgcagaaagtttagatattcacatcccgaaaggttacatctattttgcaatgggattctctgttgtggtcgaaatgatcaatattcgaatgagaagattgataaaataa

SEQ ID NO: 830 - DNA, 1830 bp, H. influenzae strain 86-028NP
atgtttgatgctaaaaagttcttagcggatgtctctcacgaacctggtgtttatcgtatgtatgacgataaagatcaggttatttatgttgggaaagcaaaggatctaaaaaaacgtctttcaagctattttcgtaaaaatctgagtagtaaaaaaacagaggcgttggtagcatcaattcatcatattgacaccatgctaacttcatctgaaacggaagctttactgctagagcataattttatcaagctttatcagcctcgctataacgtattattgcgtgatgataaatcctatccatttattttattaaccaaagaacgccatccaagaatcacgtcctatcgtgggtctaaaaaatttgcgggtgaatatttcggcccttatcctcacgcaggcgccgtgcgtgaaaccttatcgcttttacaaaaacttttccctgttcgacaatgtgaaaattccgtttattccaaccgctctcgtccttgtttacaatatcaaattgggcgttgttctgcgccttgtgtacagggatatgtttccgatgaagaatataatcaacaagttgaattagcccgtttatttttacaaggcaaagatcaacaggtgttagattatttaatcgggaaaatggagcaggcaagcagaaatttagattttgaacaggcggctcgttatcgcgatcaaattcaggcggtgcgttcggttattgaaaaacaatttgtatccaatgaacgtttagatgatatggatattatgtccatcgcttaccaacacggtttagcctgtgtacaagtgatgtttattcgtcaaggaaaagtgctaggcaatcgcagttatttcccaaaagtccctgccaatacggatttatcggaacttaccgaaacttttgtggggcaattttatttacaaggtcatcaagggcgaagtatcccaaatagtattattgtcgatcgtcaattagctgaaaaatcagagcttgagcaacttcttacggagcaagcaggcagaaaagtgacgattcaagaaagtgtaaaaggcgataagagtaaatacttacagctcgcacaagttaatgctaaagcggctttaaatgtacaacttaaacaatcttcacgaatgtcagagcgttatcaagcgttgtgtgatctgttaaatctccctgaaattaagcgtatggagtgtttcgatataagccacacgatgggaaatcaaacggtagcatcttgtgttgtctttaatcaagaaggcccactgaaatctgattatcgtcgttttaatattgaaggcattactggtggggatgattatgcagcaatggaacaagcgttgcagaaacgttatgagcgtgatttagaagaagataaaattcctgatattatttttattgatggtggaaaagggcaattaaatcgtgcgctgaacgtgttccaacatcttcaagtaaaatgggataaaaatagaccgcacttaattggcgtggcaaaaggtgtggatcgtcgagctgggcaggaagtactgatcatcagcaaacaagaccgcgaaattcatttgcctgatgatagtttggcattgcatttgattcaacacatccgtgatgaaagtcataatcacgcaataagcggacaccgtaaaaaacgtcaaaaagcctttacacaaagtggtttagaaactattgaaggtgtgggcgctaaacgtcgtcaggctttactgaaatatcttggcggtttacaaggtgtgaaaaaggcgaccttagatgaaatagcctctgtaccgggaatttcccttaaacttgctgaaacgatttttgaaacgctcaaaaacgattaa

SEQ ID NO: 831 - DNA, 765 bp, H. influenzae strain 86-028NP
atgtcatttaccgttattatccccgctcgttttgcatcaagtcgtttacctggaaaaccgcttgccgatattgcaggtaagccaatgattcaacatgtatttgagaaagcgctgcagtctggggcgaaccgagtgattattgccaccgataatgaaaatgtggctgatgttgccaaaaattttggcgcggaagtgtgcatgacttcggttaatcataattctggtacagaacgtttagcggaagttgtagaaaaattagcgattcctgacaatgaaatcattgtcaatattcaaggcgatgagcctttgattcctcccgttatcgtgcgacaagtggcagataatttagcaaaatttaatgtcaatatggcaagtcttgcggtaaaaattcatgatgctgaggaattattcaatccaaatgcagtgaaagttttgacggataaagacggctatgtgctatatttttcccgttcggttattccttacgatcgtgatcagtttatgaatttacaggatgttcagaaagtacagcttgcggacgcttacttacgtcatattggcatttacgcatatcgtgcggggttcataaaacaatatgtgcaatgggctccgactcaacttgaaaatctagaaaaacttgagcagcttcgtgtgttatataacggcgaacgcattcacgtagagcttgcgaaagaagtgcctgcagtgggggtggatactgctgaagatttggaaaaagtgcgggcaattttagcggcgaattaa

SEQ ID NO: 832 - DNA, 999 bp, H. influenzae strain 86-028NP
atgcccttctggtattccaattccaaacttatttggctcttatcgcctttttctttattgttttggttgattagccaactgcgtcacgccttattttgtttggggataaaatcttcttatcgcgcaccaaaaccagtgataattgtgggaaatttgtctgttggtggaaatggcaaaacgcccgtggtggtgtggcttgtggaagaattaaaaaaacgaggtttgcgcgtaggtgtgatttctcgtggttacggcagtaaatctaaaacttatccgttattcgtcactgaaaatacgcgtccgattgaaggtggcgatgagccagtattgatcgctaaacgcaccaatgcgccagtcgtgatttccccgaatcgccagcaagcgattgaattactcttaagccaagcagagtgcgatattattgtttctgacgatggtttacagcattataaattacagcgtgatttggaaattgtcgtaatggacgctgagcgcgcattgggaaatggttttgtattgcctgcaggcccattgcgtgaattaccaagtcgattaaaatccgtagattttgtgatcactaatggtggaaaaaatcagtattcagatgcagttatgtatcttgtaccccatttcgcaattaatttaaaaaccaatgaaaaacgccaattaaaggaatttcaatctggtgttgccattgcagggattggcaatccacagcgtttttttactatgttagaaaagttagggattcaattagaacgaactcaagcatttcaagatcatcaacattttgaagcctctcaattagaaaaacttgctgaaaatcaaccgctctttatgacggaaaaagatgccgtaaaatgccaatcttttgccaacgataattggtggtatgtccctgtagatgcagagattattgaggctgaaaaacaatgtgaaaatttaccgcacttttgggacaaaatagacaaacttgtggcgcaatatagaaatggctga

SEQ ID NO: 833 - DNA, 1764 bp, H. influenzae strain 86-028NP
atgcaagagcaaaaattacaagaaaatgatttttcaaccttacaaacttttaaacgtttgtggccaatgattaaaccttttaaagcagggcttattgcttcaggtattgcgttagtttttaatgcattggctgattcaggcttgatttatttgttaaaaccgttgttggacgatggttttggcaaggcaaaccattcatttttgaaaataatggcttttgttgttgtgggaatgattattttacgtggcgtgactaactttatttctaattattgcttggcgtgggtatcaggcaaagttgtcatgacaatgcgtcgccgtttatttaaacatttaatgtttatgccagtgagtttctttgacagaaattcaacggggaaattactttctcgtatcacttatgattctgagatgattgcaagttcttcttcaggatctttgattaccattgtgcgagaaggagcatatattatttcgctattggcagtgatgttttatacaagctgggaattaacccttgttttatttgttatcggaccaattattgcagtgttgatcactatcgtttcaaaaattttccgtaagttgagtaaaaatttacaagattcaatgggggaattgacggcgacgacggagcaaatgctgaaaggacataaagtcgtgatttcttttggtggtcagtttgtcgaggaagagcgttttaataaagtgagtaacaacatgcgtcgtaaaggtatgaaaatggttactgcagattccatttccgaccctgttgtgcagattattgcttctcttgctttagttgctgtattgtttttagctaccacgccattaattgcggaagataatctaagtgcgggttcttttacggtagttttttcatctatgttggcaatgatgcgcccattaaaatccttaacgaatgtaaactctcaattccaacgtggaatggcagcatgtcaaacgctatttgccattttagatttagaaccagaaaaagataacggcacttataaagcagaacctgcgaaaggtgcgttagaatttaaaaatgtgagttttgcatatcagggaaaagaggaacttgcattaaataatatttcttttagcgtgcctgcaggaaaaaccgttgctttagtgggacgttctggatcgggcaaatcaaccattgctaatttagtgacacgtttttacgatattgagcaaggcgagattttactggatggcgtaaatatccaagattatcgtttatctaatttgcgtgagaactgtgctgtggtttctcaacaagttcatttatttaacgataccattgcgaataatattgcttatgccgcgcaggataagtattctcgcgaagaaattattgctgcagcaaaagcggcttatgctttagagtttatcgaaaaattaccgcaaggttttgatacggtaattggcgaaaatggtgcgagcctatctggtgggcaacgccagcgtttagcgattgctcgcgctttattgcgtaattcgccagtattaattttagatgaagctacatctgcactagatacggaatcagaacgcgccattcaatctgcattagatgaattgaagaaagatcgtactgttatcgtaatcgcccatcgtttatcaaccattgaaaatgcggatgaaattcttgtgattgatcacggagaaattcgtgagcgaggcaaccataaagcattgcttgaacaaaatggtgcttataaacagctatacagtatgcagtttagtggctaa

SEQ ID NO: 834 - DNA, 2367 bp, H. influenzae strain 86-028NP
atgaaattaaacttaataactttagctgtcttgttaattgtcgcggatttaacgttgttatttctaccgcaaccgttgctattgccttggcaagttgctctcgttattgcgcttgttttgatttttctttttattttcttgcgtagaaatttcttagttagccttgctttttttgttgcctctcttggctattttcattattcggctttgagtttatcacaacaagctcaaaatattaccgctcaaaatcaagtggtaacttttaagattcaagaaattttgcaccaacaggattatcaaacgcttatcgccacagcaacattggagaataatttgcaagaacaacgaattttcttaaattggaaagcgaaagaggtgcctcaattatcggaaatttggcaagctgaaatttctttacgtcccctttctgcgcgattaaattttggtgggtttgatcggcaacaatggtatttttcaaaaggaattacggctgttggaacggtaaaaagtgcggtgaaaattgcggatgtttcatcattgcgtgcagaaaaattgcaacaagtaaaaaaacaaacagaagggttgtccttacaaggtttattgattgccttagcttttggcgaacgggcttggttagataaaaccacttggtcaatttaccaacaaaccaatactgcgcatcttattgctatttctggcttacatattgggttggctatgggaattggattttgcttggcgcgtgttgtgcaagtcttttgccccacccgttttattcatccttattttcctttagtttttggtgttttatttgctttaatttatgcgtatttggctggttttagtgtgccaacttttcgtgccatttcagcacttgttttcgttttatttattcaaataatgaggcgacattattcgcccattcagctttttacgttggttgtcggattcttgcttttctgcgatccattaatgccgctttcggtcagtttttggctttcttgtggagcggttgggtgtttgctcctctggtatcgttatgtgcctttttcactttttcaatggaaaaatcgccctttttctccaaaagtgcggtggatttttagtttatttcatttgcaatttgggttattgctcttttttacgcctttgcaactttttctatttaatggcttatcgttaagtggatttttagccaatcttatggcggttccaatttatagttttttgcttgtgccattaattttatttgccgtttttactaacggcacaatgttttcttggcaactagcaaacaagttagccgaaggaattactgggttaatttctgtttttcaagggaattggtttaatgtttcatttaatttagcattggttttaaccgcactttgtgcaggaatttttatgttaattatttggagtatttatcgagaaccagaggtttcatcatcaacttggaaaattaaacgaccaagattttttacattgaatctcagtaaacctttgctaaaaactgatcgaatcaacgttttgcgatgttctttcggcattattcttatgtgttttatgattttgttgtttaaacaattgagcaagccaacttggcaggtagatactttagatgtggggcagggcttggcaacgctgattgtgaaaaatggcaaagggattctttatgatacgggttcttcttggcgaggtggaagtatggctgagttggaaattttgccttatttacaaagagaagggattgttttggaaaaattgattttaagccacgacgataacgatcacgcaggtggtgcttcgacaattttaaaggcgtatcccaatgtggaattgattaccccttcacggaaaaactatggggaaaattaccgcactttttgtactgctgggcgtgattggcattggcaagggttgcattttcaaatactttctcctcacaacgttgcgacacgagctgataatccccattcttgtgtgattttagtcgatgatggaaagaatagcgttttgctaactggcgatgctgaagcaaaaaatgagcaaatttttgcccgcactttaggcaaaatcgatgtgttgcaagtggggcatcatgggagtaaaacatcgacaagtgaatacttgctttctcaggttagaccagatgtagcgattatttctagtgggcgttggaatccgtggaaattccctcattattcggttatggaaaggcttcatcgctataaaagtgcggtagaaaataccgctgtttcggggcaagtgcgggtaaatttttttcaagaccgattagaaatccagcaagctcgcacaaaattttccccttggtatgcgcgtgtaattggattatcaaaggaataa

SEQ ID NO: 835 - DNA, 438 bp, H. influenzae strain 86-028NP
atgtcaaaagcatcattgagcttgctagatttagcaggcgttaagccttatcaaatgaaaaaagatgaagaatatatgaatgaagagcaaattcttcatttcagaaaaattcttaatgcttggcacgagcaaatcgtggaagaagcttctcgcaccgttgcacatatgcaggatgaagtaaccaatttccccgatcctgcagaccgagcaactcaagaagaggaatttagtctagaattacgtaatcgagatcgcgaacgtaaactaatgaaaaaaatcgaagcaaccttgaagaaacttgataccgatgattttggttactgcgattgttgtggtgaagaaatcggcattcgccgtttagaagcgcgcccaacagcagatctttgcattgattgcaaaactttagctgaaatccgcgaaaaacaagtcgctggttaa

SEQ ID NO: 836 - DNA, 1359 bp, H. influenzae strain 86-028NP
atgccaaaagcgcgagcaaaaaaatcggaacaaacacgtcgctatgataaaaatgtgattaaagcggctcaatttgatatttctccgagtgattttagccgtaatgctctcaatgtagtggaaaaactgcaacgtcaaggtttcgaggcttatatcgtcggtggatgtatccgtgatttattgctcggtaaaaaaccaaaagattttgatgttgcaacaaatgctcgcccagagcaaatccaaaacatttttcaacgccaatgtcgtttagtgggtcgccgtttccgcttagcacatattatgtttggtcgagatattattgaagtcgccactttccgtgctaatcacagtgatgctcgcaatgaaaatcaagcgaaacagagcaatgaaggcatgttactgcgcgataatgtttacggtacgatcgaacaagatgcagcacgccgtgattttacggtcaatgcactgtattacaatccgcaagataatacgttacgagattatttcgagggcattaaggatctcaaagcaggcaagctacgcttaattggcgatcctgttacacgttatcaagaagatcctgtgcgcatgctacgctcaattcgttttatggcaaaacttgatatgttccttgaaaaaccaagtgaacagccaattcgtgaacttgcacctttattaaaaaatattccaccagctcgcttatttgacgaaagtttaaaattattgcaggcaggacaaggggtaaaaacctatcggttattacgccaatatagtttatttgaacaacttttccctgcattaagcgcatattttacagagaaagaagatagctttgcagaacgtatgatcgttaccgcccttagttcgacagatgaacgtgttgcggataaacttcgtattaatcctgcattcttatttgcagcatttttctggtatccattgcgcgaaaaagtggaaattttaaaaaatgaaggtggtttaaataatcatgatgcttatgctttagcaggcaatgaagttttagacttattctgccgtgctttggctgcaccacgtcgtcatactgcggtcattcgtgacatttggttcttacaattgcaattattaaaacgtactggctcagcaccaatgcgtaccatggaacatccaaaattccgtgctggctttgatttactggctatgcgtgcagaaattgaaggtggcgaaaccattgaattagccaaatggtggcacgaatatcaatttagtaatggtgaacagcgcgaacagttgatacacgagcaacaacgcttacatcctaaaccaaagaaaaaatactaccgtccacgccgtcgtaaaataacacgttcagcagagtaa

SEQ ID NO: 837 - DNA, 483 bp, H. influenzae strain 86-028NP
atgattactgcatatattgctctaggtagcaatttaaacacaccagtagaacaattacatgctgcgcttaaagcgataagtcagttaccaaacacgcatttagtaacgacgagctctttttataaaagcaaaccgctcggcccacaagatcaacccgattatgtgaatgccgttgcaaaaattgaaaccgaacttagtccgctcaagctattagatgaattacaacgtattgaaaacgagcaaggtcgagtgcgtttacgtcgctggggcgaacgcacgttagatttagatattttgctctacggcaatgaaattattcaaaacgaacgcttaataattccccattatgatatgcataaccgtgagtttgtcattgtgccgttgtttgaaatcgcatcggatttagttttaccaaatagtcaaatcataacagagctggtcaagcaatttgctgaccacaaaatgataaaattaaatccctag

SEQ ID NO: 838 - DNA, 477 bp, H. influenzae strain 86-028NP
atggaaagcttaactcaatatatccctgatgaattttctatgcttcgcttcggcaaaaaattcgcagaaattcttttaaaattgcataccgaaaaagcaattatggtttatcttaacggtgatcttggggcaggaaaaacaacgctaacgcgcggaatgttgcaaggcatcggtcatcaaggtaatgtaaaaagcccaacttatacgctggttgaagaatacaatattgcaggcaaaatgatttatcattttgatttatatcgtctagcagatcctgaagagctcgaatttatgggcattagagattattttaatacagatagcatctgcttaattgaatggtcagaaaaaggtcaaggcatattgccagaagctgatattttagtgaatattgattattacgatgatgcacgaaatattgaattaatcgcacaaacaaatttgggtaaaaatattataagcgcattttctaattaa

SEQ ID NO: 839 - DNA, 1299 bp, H. influenzae strain 86-028NP
atgaaaactaaaattttattttttctttttttctcgacatttagcttttctatttttgcagcacctattacgattgcgattgacccaggtcatgggggaaaagatcctggtgcaatcagccgaaatttaggtatttatgaaaaaaatgttaccctttcaattgcaaaagaattaaaagccttattagataaagatccacattttcgtggcgtattaacacgtaaaagtgattattatatttccgtgcctgaacgttcagaaatcgcacgtaaatttaaagcgaattatcttatttccattcatgcggattcatctgaatcgcctgatcgtcgcggggcttctgtttgggtattgtcaaaccgtcgagccaatgatgaaatgggtcaatggctagaagacgatgaaaaacgctcggaattacttggtggcgcgggaaaggtgctttcacacaataatgacaaatatcttgaccagactgtacttgatctgcaattcggacatagccaacgtactggctatgtgttaggcgaacatattttgcaccattttgcgaaaataacaaccttgagtcgtagtacaccacaacatgcaagtctgggtgttctacgttcgccagatattccttctgtgttggtagaaactggatttctttccaattcagaagaagaaaaaaaacttaattcccaaacttatcgtcgccgcattgcttatatgatttatgaaggcttagttgcattccgtagcggtaaaaccaacactttagttaaagacaatttagtgcaaaacatcaaacaaaacgatataaaaaaatcagggaaaaataaccgcacttcagaacaaaatataaatgaagataatattaaagacagtggcattcgccatattgtaaaaaaaggagaaagtttaggtagcttatcaaataaatatcacgtaaaagtctctgatattattaaattaaatcaattaaagagaaaaacactttggctaaatgaaagtattaaaatccctgataatgtcgagataaaaaataaatcattaacaattaaagaaaatgattttcataaaaaacaaaatagctcagtaaataatactaataaagatttaaaaaaagagaaaaatacacaaactaataatcaaaaaaatataattccgctctatcataaagtaacaaaaaaccaaacactttatgctatttcgagggaatataacattccagtaaatatactattgagcctaaatccacatttaaaaaatggcaaagttattacaggacaaaaaataaaattaagagaaaaataa

SEQ ID NO: 840 - DNA, 1890 bp, H. influenzae strain 86-028NP
atgcctattaaaattctttccccacaacttgctaaccaaattgctgctggagaagtggtagaacgccctgcatcagtggtaaaagaattagtggaaaatagccttgatgcaggtgcaaataaaatccaaattgatatcgaaaatggtggggcaaatttaatccgcattcgtgacaatggctgtggtattccaaaagaagaattaagcctcgctttagcacgacatgctacgagtaaaatagccgatcttgacgatctcgaagcgattttaagtttaggttttcgtggcgaggcattagctagtatcagttccgtatcacgcctaacccttacttctcgtaccgaagaacaaactgaagcgtggcaagtttatgcgcaaggtcgtgatatggaaaccacaatcaaaccagcatcacatcctgtcggcacaacagttgaagttgccaatctttttttcaacacgccagcccgccgaaaatttttgcgcacagataaaacagaatttgctcatattgatgaagtcattcgtcgcattgctttaacaaaattcaatacggcatttacattaacgcataatgggaaaattatccgtcaataccgtcctgccgaagcaatcaatcaacaactaaaacgtgtcgccgcgatttgtggggatgattttgtcaaaaatgccttacgaattgattggaaacacgatgatttacatttatcaggttgggtggcgacaccaaattttagccgaactcaaaatgatttaagttattgctatattaatggccgaatggttcgagataaagtgatcagccatgcgattcgacaagcctatgctcaatatttaccaaccgatgcttatcctgcgtttgtgttgtttattgatttaaacccgcacgatgtagatgtcaatgttcatccaaccaaacatgaagtacgctttcatcaacaacgcctcattcatgattttatttacgaaggcataagttatgcactaaacaatcaagaacagcttaattggcacacagaccaaagtgcggtagaaaatcacgaagaaaatacagtgcgtgagccccaaccgaattatagcattcgtcctaatcgtgcagctgcggggcaaaatagctttgcgccaaaatattatgaaaaaccacagcaaaatcaaccgcacttttctaacacaccagtgttgccaaatcatgtaagtactggttatcgagattaccgttctgatgcaccgagtaaaactgagcaacgtttatatgctgaattgttacgcacgttaccgcctacagcgcaaaaggatatatcggatacagcacaacaaaatatttcagatacagctaaaatcatctcaactgaaataattgagtgctcatcacatctgcgtaccctttcacttattgaaaatcgcgcgctcttattacaacagaaccaagatttctttttgctttcattggaaaaattacaacgcttgcaatggcaattggctttacaacaaatacagattgaacaacaaccattgttgattccaatcgtatttcgtttaacagaggcacaatttcaagcatggcaacaatattcagataacttcaaaaaaattggctttgaatttatcgaaaatcaagcacaattacgcttaaccttaaataaagtgccaaatgtgttacgcacacaaaatctacaaaaatgcctgatggcaatgctgactagagatgaaaattcatcaccatttttaaccgcactttgcgcacaattagaatgtaaaacctttgacgctttagcggacgcactcaatttattaagcgatacagaacgtttactcacgcaaacgaatcgcacggcattcacccaattactcaaacctgttaattggcagcctttattagacgaaatttag

SEQ ID NO: 841 - DNA, 936 bp, H. influenzae strain 86-028NP
atgaaaccaaccgcaatttttttaatgggccctacggcctcaggcaaaacggatttagctattcaactacgaagctcgcttccagttgaagtgattagtgtagattcagcgctcatttataaaggaatggatattggcacagcgaaaccatcaaaagaagaacttgctcttgcgcctcaccgtttgattgatattttagatccatcagaaagctattccgcaatgaatttccgcgatgatgcgctacgcgaaatggcggatattaccgcacaaggcaaaatcccgttactagtgggtggtacgatgttgtattacaaagccttaattgaagggctttctcccttgccttctgctgatgaaaatattcgtgccgagcttgaacaaaaagcagctcaacaaggttgggcagcattgcatacagaactcgccaaaatcgatcccatttctgccgcccgaattaatcccagtgattctcaacgaatcaatcgtgctttagaggttttttatatcacgggaaaatcactcacagagctgactgaagaaaaaggcgaagccttgccttatgattttgtgcaatttgcaattgcgccgcaagatcgccatgttttgcatgaacgcatcgaacaacgctttcataaaatgattgaactaggctttcaagcagaagtggaaaaactttatgcacgtggcgatttaaatattaatctgccgtcaattcgctgtgtaggctaccgtcagatgtgggaatatttgcaaggcgattacgatcacgaggaaatgattttccgtggtatttgtgcaacgcgccaacttgcaaaacgccagctcacttggctgcgcggctggaaaacaccaatacaatggctagatagtttgcaacctcaacaagcgaaagaaaccgtattacgtcacttagattcctatcaaaaaggttag

SEQ ID NO: 842 - DNA, 2946 bp, H. influenzae strain 86-028NP
atgaccgcactttctgccctcattgaacaaaaattacaatctcttggcacaatcctgtgccaatcttttccagagctttccccagaaaaaattcacgaagctattcaacaaaattcaaatcatccagaactgcctgtttatcaattaggctatgccatagcaatgtctgactttgtggaaaaagtcttgcaaaaatacccgcacttagtgaaacaatggtgggaaaaatccccctgttttgcagattgcactgcctatattgaacgtttgaatagagagttagccaatgtacatgacgaaactgcactctatcaaacattacgtcaattccgtaacattgaaatggcaaaattaagtttttgtcaaagtttgaatcttgcgactgttgaggaaatttttgttcagctttcacaacttgcagagagtttaattatcgctgcccgcgattggctttatcatcaagcctgtgcggagataggcacaccaatggatgaacaaggcaatccgcagcagctttatatcctaggaatggggaaactaggcggctttgaactaaatttttcctcggatattgatttaattttcacttatccatcacaaggggaaacatctattgaaaatacgaatgctcgacgttctgtggataatggaaaattttttacacgtttagggcaacgccttatttctgccttagatgaatttacctctgatggttttgtgtatcgaaccgatatgcgcttgcgcccatttggtgacagcggcgcgcttgttctcagctttgcagcaatggaacaatattatcaagatcaaggtcgagattgggaacgctatgcaatgattaaagggcgagtattgggcgtacaaacaaaggatcccaacgtatctaaattgcaaaaaatgttacgcccctttgtgtatcgtcgctatattgactttagtgtgattcaatctttacgtgaaatgaaaggcaaaattgagcgagaagtacgccgtcgtggtttgaaagataatattaaactaggtgctggtggtattcgtgaagtcgaatttatcgtacaagtttttcaactcattcgaggcgggcgagaaatcaatctgcaacaacattcactcttaaagatcttgcctgaaattaccaaactaggattaattaccgaacaacaattccacgatttacgtgaaagttatatttttttacgccgcgtagaaaacattctacaagccattaacgatcaacaaacgcaaacactaccaaccgatgaaatagatcaaattcgtttagtcaaggcatgtaaaactttcacctgtttaaatgaaaataatcaaaccattgaaaaacattatccaatagaaaattgggacgatttttaccgcactttacaacaaaaacaagaaaaagtgcgggcagtatttactcaattaatcggtgatgaacaagatgagccttcacaaactgatagccaatggcaagattttttagaagcagattttgaggatattgaacaaacattattagagagtggtgtatcagaaaataatattgatgaagttttagaaaagcttgctcaattcaaagacggcctaaatcacagagtgattgggtcgcgtgggcgtgatgttttgagtcatttgatgccaacagtacttgcactcatttttgaacaagaaaattaccgcactttgctcccccgaatactgaacattattgaaaaaatttcgagtcgcacgacttatttagaattattattggaaaatcctcgcgcacttcagcaagttattgaactttgtgcacagtctcaacttatttcagaacaattggctcgctatcctattttattagatgaattgcttaatacggaagcactacgtcatccattgccatttacccaatatcctgcagagttacaccaatatttgcttcgtttaccccctgatgatgaagaacagattatcgatgctttacgtcaatttaaacaagcaaccctattaaaagtggcagcggcagatattttaggcgcattaccagtaatgaaagtaagcgatcatttaacctatcttgctgaatccattattgaagtggttgtgaatctagcttggaaacaagtgtcttctagatttggcgtgcctgaacatttacaaaataatgaaaaaggatttttagttattggttatggaaaacttggtggtattgaactcggttataaatccgatttagacctcgtatttttgtacgatgccgtagaaaatcaaacaacaggtggcaagaaagtgattgatagcaatcaattttacctacgcttggcacaaaagattgtgagtattttcagcataaatacttccgctggcgtactttatgaggcagatatgcgcctgcgcccttctggcgatgctggcttaattggctgctctctttctgcattttcccattatcaattgaatgacgcttggacatgggaaaaacaagcacttgtgcgcgctcgtccagtatttggcgaatcatctcttaaagctaaatttgagcatatccgccaacaagtgctttctgcatcacgagatattgaacaattaaaacaagatgttgttgagatgcggaaaaaaatgtttgcccatttatctcactcaaaacacagtgaatttaaccttaaaacagatcgcggtggcattacagatatagaatttattgctcaatatttaatgcttgccaatgccccgaaaaaaccacaactaacaaaatggtcagacaatgttcgtattttcgatgatatagcagaggctaaaattattagccaaacagactgcgacacattaaaacaatgttatgttgatttacgcaatgctattcaccatttaaatttgataggcaaatcccccgttgtggatgaaactgaatttgtcaaagagcggtcatttattcaagcattttgggataggttatttgtatcctaa

SEQ ID NO: 843 - DNA, 1677 bp, H. influenzae strain 86-028NP
atgcttactcaacttactatcaataattttgcgattgttcgtcagcttgatattgaattggcgaaaggaatgtctgttataacaggggaaactggtgctggaaaatctatcgccattgatgctttaggtttatgtttcggacaaagagtagaaacctcaatggtgcgtgaagggcaagagcgtgcggaaatttgtgcaactttccaactagaatcgcaaaatcctgcttatcactggttgagtgagcaagaattacaggatccagataatccaactgaatgtattttacgtcgtataattaatgcagacggacgttctaaggcttttattaatagtacaccagtatccgcttctcaattaaaagaaattgctcaatatctcgttcatattaatgggcaacacgcttctcaattattgttaaaaaatgactatcagcttcagttagttgataattttgccgctcatcctgaattacttgtgaaaatgcgtgaagattatcagacatggaaaaatcttcaaaatcaagttaaaacctttcaacaaaaagtggcggaaaatgaagcacgtaaacaacttttacagtatcaagtggatgagttagatgaatttaaccttcgaccaaatgaatatttggaattagaagatgaacaacgtcgtttatctagcagcgaacagctaacccaactttctcaatcggccctgcaaattttaagtgaaaatgacaccgtaaatatcgatagtttgctttatcgtgcgacacaatatattgatgaattagctgaacttgatccgcaatatgctgaagtgcaaaatatgttgaatgatgcgttgattcaagtgcaagaagcaaccagtgaagtgcaaaatttatcaagtaatatcgagcaggatcctcaacttttacaggaaatcgaacagcgaattagtcaggctttacaacttgctcgtaaacatcaagttaaacctgaagatcttgtagaacagcacaaaaaattaaaagcggaattaaccgcacttttggatttttctgaaagtgaagagatgttgattgagcaagaaaaacgagcatttgaacaaatgcaagcaacggctacagcattaacagcaagtcgtcagcaatctgcaacccgcttagcgcaaaatgtcacacagtcgataaaacaacttgcaatggaaaacgctgaattttatgtagagttgaatacggatttagataaagtgagtgcaaatggtgcggataatgtgattttcactttgcgtagtaatttaggacaacaaccgcagccattagctaaaattgcctctggtggtgagctttctcgtatttctttagcgattcaagttttaacttctgatcaatcggctattccaacgttaattttcgatgaagtggacgtgggcattagcggaaaaacagcaagtgttgtcggaaaacttttacgtcaattaagtgaacgctgccaagtattatgcgtaacgcacttgccacaggttgcttgtcatggccatcatcagttcaatgtagaaaaatttactgttgataataaaactgaaacaaaaatgaccgcactttcacaagctgaacgtgtaccagccttggcaagactcttgggcggaagtgaaatcacagaattagctctagccaatgcacaggaaatgttagatttggttcattaa

SEQ ID NO: 844 - DNA, 819 bp, H. influenzae strain 86-028NP
atgcacaaaaacttatttcattggttaatggaacgtggttatcaagtgttggtggaaaaagaagtcgccataacacttgagttaccttttgaacatcttgctacgttagaagaaataggccaccgagcccaattagccattgtgattggtggagacggcaatatgctagggcgcgctcgggtattagcaaaatatgatattccattgattggtattaatcgtggtaatttgggatttttaacggatattgacccgaaaaatgcctattcccagcttgaagcttgtttagaacgtggcgaattttttgtggaagaacgttttttattggaagcaaaaatcgaacgagcaagtgaaatcgtatcaaccagcaatgcggtaaatgaagcggttattcatcccgccaaaattgcacatatgattgactttcacgtatatatcaatgataagtttgcattttctcaacgttctgatggattaattgtttctactccaacaggttctacggcttattctctttccgctggtggacctattttgacaccaaaccttaatgccattgcattagtgccaatgtttccacataaattaacttctcgccctcttgttgttgatggggatagtaaaatatcgattcgttttgctgaacataatacctctcaattagaagtgggctgtgatagtcaaattaccttaccttttaccccagatgatgtggtgcatattcaaaaaagcgagcataaactccgattgcttcatctgaaaaattataattattacaatgtgttaagtagcaaattaggttggttaaaatcattttga

SEQ ID NO: 845 - DNA, 705 bp, H. influenzae strain 86-028NP
atgattcataaaatgaccgcacttgaatttaacattttcgtcattatatcgttttttgctacactatgcccaattacgattaatcaattttgttttacggagaaaaaaatgtcagaacaagaacaaaaagttgaaatcccagaagtagaaaatcaagaagaagtcgttgtggaagaagcacaacaagcagatccttctcaagaatttgatcctttagaagaagcaattgctcgcgtgcaagagcttgaagagcagctaaaaactcaaatagaagaagcggcaaacaaagaacaggatattttacttcgctctcgtgctgaaattgaaaatcttcgtcgtcgtactgaacaagacgtagaaaaagcacataaattcgctttggaaaaattttcaaaagacattttgaatactatcgataacctagagcgtgcgcttgccactccagcaaataaagaagatgaaagcgtaaaagccttatttgacggtgtagaactaaccttaaaagaattagtttcaaccgttgggcgttttggcgtggaagctgtgggagttgtcggtgaagcctttaatcctgatttacatcaagccatttcaatgcaaccagctgaaggctttgaaaccaatcaaattagcgtcgtattgcaaaaaggctacaccttaagtggtcgagtcattcgcccagcgatggtaatggtggcggcttaa

SEQ ID NO: 846 - DNA, 345 bp, H. influenzae strain 86-028NP
atgactagttttgcacagcttgatataaaatctgaagaattggcgattgtgaaaactattttacaacaattcgtacctgattataccgtatgggctttcggttctcgtgtaaagggaaaagcaaaaaaatattccgatcttgaccttgcgattatctctgaggagcctttagattttttagctcgtgacagattaaaggaagctttttctgaatcagatttaccgtggcgcgtagatcttctagattgggctacaacgagcgaagattttagggaaattatccgtaaagtttatgttgttattcaggaaaaagaaaaaacggtcgaaaaaccgaccgctctttag

SEQ ID NO: 847 - DNA, 441 bp, H. influenzae strain 86-028NP
atgatgactgataagctaaatttaaatgtattagacgctgcattttattcgttagagcaaaccgtagtacaaatttcagacagaaattggtttgatatgcaaccctctattgtacaagataccttaattgcaggtgcaattcagaaatttgaatttgtttatgagttaagtttaaaaatgatgaaacgccaacttcaacaagatgcaattaataccgatgatattggggcttatggatttaaggatattttgcgagaagcattgagatttggtttgattgaagatatgtcaaaatgggttgtttatcgtgatatgcgtaatattacatcacatacttatgatcaggaaaaagccatggctgtttatgcacaaattgatgattttttaatagaaagttgtttcctattggaacaattacgtcagagaaatcaatatgactag

SEQ ID NO: 848 - DNA, 2124 bp, H. influenzae strain 86-028NP
atgagtaactttggggtcatcaagcgcgatggttctcgtgcggagtttgagattcaacgtatcattaatgccattaaaaaagccgcaagtgcggtcaatatttccgatgaattttattgccaccaaattgggcaagaagtagggaatgaaattttcacccgtcatcaaggcgagattgatattaatcagattcaaaaagtcgttgaagataaattgatggcaagtcgttatcctgagattgctcgtgcgtatatcgaatatcgtcatgatcgtgatttagcgcgagaaaaacgtagccagctaacaaaagaaattgaaggtttgattgaacaaagcaacgtagaattacttaatgaaaacgccaataaagacgcgaaagtgattccaacgcaacgtgatttgcttgctggaattgtggcaaaacattatgccaagcaccatattcttccacgcgatgtggtagaggctcacgaaaaaggtgaaattcattatcacgatttagattacgcgccgttctttccaatgtttaactgtatgttagttgatttagaagggatgctttctcgtggtttcaaaatgggcaatgcggaaatcgaaccccctaaatctatcggcaccgcaacggcagtgacagcacaaattatcgcccaagttgccagccatatttacggcggcacaaccattaatcgtattgatgaagtgctttccccttatgtgcaaatcagttacgaaaaacatctcaaacatgcccaagaatggaacgtgcctgatgttgaaggttatgccaaagcattgattgaaaaagaatgtttcgatgccttccaatccttagaatatgaagttaatacactacatacttcaaatgggcaaacaccatttgtgacctttggttttggtttaggtacaagctggcaatcccgcttaattcagcaagctattttaaaaaatcggattcgtggactcggaaaaaatcataaaacgcctgtatttccaaaacttgttttcaccatcaaaaaaggtttgaaccaaaataaaggcgatccgaattacgatatcaaacaactcgcattagaatgcgcatcaaaacgtatgtatccagatattctcaattacgatcaagttgtcaaagtcacaggctcttttaaagccccaatgggatgtcgtagctttttaggtgcatacgaagaaaatagtcatgaaattcacgatgggcgtaataatcttggcgtagtgagtttgaatttaccgcgtatcgcgttggagtccaaaaacgaagaagatttctaccgcactttagatgaacgtttggctattgcgaaaaaagcattaatgacgcgtgttgcccgccttgagaataccaaagctcgcgttgctcccattctttatatggaaggtgcatgcggagtgcggttaaaagcggatgaaaatgtggcacaaattttcaaaaatggacgagcctctatttcgctcggctatatcggtattcatgaaaccattaatgcgctatataaaaaagggcatatttttgatgatgaacaattacgcgaaaaaggcattgcgattgttcgccaccttagcgaggcagtaaaacgctggcaaaaagaaactggctatgccttcagcctttactccacgccaagcgaaaacttatgcgaccgcttctgccgtctagataccaaaaaatttggcgtgattgaaggcatcacggataagggctactacacgaacagttaccacttagatgtagaaaagaaagtgaatccttacgacaaactggattttgaaatgtcatatcccccactcgccagcggcggttttatttgctacggcgaatatccaaatattcaacacaacttaaaagcattggaagatgtgtgggattatagctacgatcgcgtaccttactacggcacaaacacaccgattgacgaatgttatgaatgtggtttcactggcgagtttgaatgtaccagcagaggttttgtttgcccaaaatgtggcaatcacgacagcacaaaagtgtctgtcactcgccgcgtctgtggctatctaggcagccctgatgcccgcccatttaatgcgggaaaacaggaagaagtgaagagaagagttaaacacctttga

SEQ ID NO: 849 - DNA, 861 bp, H. influenzae strain 86-028NP
atgtcagatattctcaataacctcattcatcttcttaaacttgaaaaaattgatgatttaatctttcgtggtgaaagccaagatttaggttttcgtcaagtatttggcgggcaagtagtggcacaggcgttatctgcagcaatgcaggtggcgccagaagatcgcattttacattcttgtcatgcctattttcttgccccaggagacagccaatatccgattatttacgatgtggaaaccttgcgtgaagggcgtaatttttctgcattacgcgtaaaagccattcaacataaaaataccatttgtcatgtaaccacttctttccaagtgctggaaaaaggttttgaacatcaaaattcaatgccaaatgttggcgcgcctgaagactttacagatgaaaatgtgatgctacaaaaagtggctcaaaccttgccagaaccactcaatgaaaaatttgcggcagagcgtccatttgaggtacgtaccaaatatttgaataacccatttaacgggacaaaattgccagccgagcaatattcttggtttaaaaccaatggtgaaacgccgcttgatataaaaattcagcaatgtttattggcttatttttccgattttcactgtattttgaccgcacttcatccgcacgaaaaaggctttttacaaaaaggaatgaaagtggcaaccattgatcatagtatttggttccatcgtccgtttgatttaaatcactggcatttgcacgcaattgaaagcaataatgcttttggagggcgaggcttagctcgcgggcaaattttctcgcaagatggtcaattaatcgcgacaacacaacaagaaggtttgatccgttttaatgaataa

SEQ ID NO: 850 - DNA, 1380 bp, H. influenzae strain 86-028NP
atgctaaaaattttcaataccttaacgagagaaaaagaaatctttaaacctatccacgaaaataaagtgggaatgtatgtttgtggcgtcactgtttatgatttgtgccatatcggtcatggacgcacttttgtgtgttttgatgtgattgcccgttatttacgttctttgggttacgatttaacttatgtgcgcaatattacggacgtagatgacaaaatcatcaaacgtgcattagaaaacaaagaaacctgcgatcagctagtggatcgtatggtgcaggaaatgtataaagattttgatgcacttaatgtattacgccctgattttgagcctcgcgcaacccatcatattcctgaaattattgaaattgtggaaaaattgattaaacgtggacatgcttatgttgcagataatggcgatgtgatgtttgatgtagaaagcttcaaagaatacggcaaattatcccgtcaagatcttgagcaattacaagctggtgcacgtattgaaatcaatgaaatcaagaaaaatccaatggatttcgtgctttggaaaatgtcgaaagaaaacgaaccaagttgggcttccccttggggtgcaggtcgtcctggctggcatattgaatgttcggctatgaactgcaaacagcttggcgaacattttgatattcacggtggtggctctgatttaatgttcccacaccacgaaaatgaaattgcacaatcttgctgtgcgcatggtggccaatatgtgaattattggatccattctggcatgattatggtggataaagaaaaaatgtcgaaatctctcggcaatttcttcacaattcgtgatgtattaaaccattacaatgcagaagctgtacgttatttcttattaacggcacattatcgtagccagctaaattacagcgaagaaaacttgaatttagcgcaaggtgcgttggaacgtttatacacggctttacgtggaacggatcaaagtgcggttgtttttggcggagaaaattttgtggaaaccttccgtgaagcaatggacgatgattttaatacgccaaatgcactttctgttttattcgaaatggcgcgtgaaattaacaagttaaaaacagaggatgctgagaaagccaatggacttgccgcgcgtttgcgtgaattgggggcgattttaggattacttcaacaagatccagaaaaattcttacaagcaggttctgacgatgatgaagtggcaaaaattgaagcactgattaaacaacgcaatgaggcccgcgctgctaaagattgggctactgctgatgctgcgcgtaatgagcttatcgctatgggcatcgtattagaagatgggccgaatggaacaacttggcgtaagcaataa

SEQ ID NO: 851 - DNA, 510 bp, H. influenzae strain 86-028NP
atggttacattacacacaaattttggcgacattaaaattaaattggattttgataaagctccagttacagcagaaaatttcttaaattactgcaaagaaggtttttataataacacaatttttcatcgtgttattgatggctttatgattcaaggtggcggtatggaaagcggtatgcatgaaaaagcaaccaaagcaccaatccaaaatgaagcgaacaatcgtttaagcaacaaacgtggaaccattgcaatggcacgcacgtcagatccacattcagcgaccgcacaatttttcattaacgtggcagacaatgatttcttaaattatcgttcaaaagaaatgtttggtcgagaagtcgttcaagaatggggctatgcggtatttggtgaagtggttgaagggatggatgttgttgataaaatcaaaaaagtgaaaacaggcaacaaaggctttcatcaagatgttcctactgaagatgtagtgattacattggtttctattgagtaa

SEQ ID NO: 852 - DNA, 432 bp, H. influenzae strain 86-028NP
atgagcataaaacaacatcgccctaaagttggagaaattctagaatgtgattatggtcaattttcgcatacctgtcacgttgatggacatattccacctgaaatggttaaaaaacgtttagttgttgttttgaatgcgaaactgaacgggcttattttagttgcaccaatttcatctacaattaatttagatggtataaaaaatggctatcatattgaaatagattcagaattaataaaagcaacaagcttttatgataaaaggactcgctggattaaatctgaattaattcaatcagtaagtcgtctccgtctgtatcatatttatgataaaggaactaaaattactcaatatttgccaagggatgttgtaacaaaagttcaaagagctatcataaaagcaatcaatgcaagctcattacttgacaagtag

SEQ ID NO: 853 - DNA, 789 bp, H. influenzae strain 86-028NP
atgcacttcttcgacactcacacgcatcttgattatctccaacaatttactggggaaccgttgtcacaacttattgataatgctaagcaagccgatgtgcaaaaaatactggttgtggcggtgaaagaagctgattttaaaacaatccaaaatatgaccgcactttttcctgataatttgtgctatgggcttgggctccatcctctttatattcaagaacacgccgaaaatgatttgattctgttagaacaagccttaaaaaatcgtgatgcaaattgcacggcagtggcagaaattggtttagaacgcgcaattcctgatttgctcaccgatgaactttgggcaaagcaatgtcatttttttgaaagccaactttatttggcaaagcaatttaatttacccgtcaatattcacagtcgaaaaactcatgatcaaatttttacttttttaaaacgtattccattatctaaacttggcgtggtacacggtttttcaggaagttacgatcaagcaaaacgctttgttgatttaggctataaaatcggagttggcggcactatcacttatgaacgagccaataaaactcgtcaagcaatcgcgaagttgccgcttgatgccttagtgttggaaacagacagtccagatatgcctgtatttggttttcaaggccaacctaatcgaccagaacgtattgtggaaagttttaaagccctttgcaccttaagaaatgaacctgctgaattgattaaaaaacttacatggaaaaatgcttgccagattttttcttga

SEQ ID NO: 854 - DNA, 258 bp, H. influenzae strain 86-028NP
atggtcacatcgggcaattatgcctcttattatttagcgcttttgccttccgaaaatggcgaaactattgataactgggtgcttccacttggtactcaaggcttaacttttgaagctgatagctggaatagcttaggtatgcgtagcaatgtttcttgctttatgcgcatgaccgatatgccattagatcgtagctggcgtgtagcgtggaactctcccctaattacatgtatgccgtggcaactggagcaaagatga

SEQ ID NO: 855 - DNA, 276 bp, H. influenzae strain 86-028NP
ttgcgcgggccttatacatcattagtggatttatttgaatcggcattacctgatattttaatgctcgaattttctacgccaagagcgggagaattaagttcgttattagaaagtgaaatattaagacaaaaatgtattttaggcttaggcgtcatcaatcctcgttctgatgaagtggaaactgtaacacaaattgttcagcgcgcagaaaaagccttaaattaccttccaccagagcaaatatcaaaatttcagacaaaaaaattgccccattaa

SEQ ID NO: 856 - DNA, 324 bp, H. influenzae strain 86-028NP
atgagcgaagtattacacattaatgacgcagattttgaaagtgttgtagttaattcagatatccccgttttattagacttttgggcaccttggtgtggtccttgcaaaatgattgcaccagtgttagatgaacttgcacctgaatttgcaggtaaagttaaaattgtgaaaatgaatgtggatgacaaccaagcaacgccagcacaatttggtgttcgtagtatcccaacattattattgattaaaaatggtcaagttgttgcaactcaagttggtgcattaccaaaaactcaattggctaacttcattaaccaacatatttaa

SEQ ID NO: 857 - DNA, 996 bp, H. influenzae strain 86-028NP
atgaaaattgcaatctatagcactaaaagttatgacagaaaatatattgagctcattaatgcgaaatataatttcgatttagaattttttgattttatgctgaacgagagcactgtgcgtttggcagagcattgcgaagtagtatgcattttcgtgaatgataatggtagccgaaaagtattagaaaaattagccgcacttggtgtgaaaattgtggctttgcgctgtgccggtttcaataatgttgatttaaaagcagctcaagaattaggcatccaagtcgtccgcgttccagcttattcgcctgaagcggtggcggaacataccatcggtttgatgatgactctgaaccgtcgaattcatcgtgcttatcagcgtacccgagaagcgaatttctctcttgaggggttaattggtttcaatatgtacggacgcacagtcggcgtaatcggaacaggaaaaatcgggatcgcagtgatgcgaattttgaaaggttttggcatgaatattttggcgtacgatccttttaaaaatccactggtggaagagcttggtggacaatatgttgaattagatgagctttatgctaaatctcatgtcattacgcttcattgcccagcaacgccagaaaactatcatttattaaatcgcgaggcttttgcaaaaatgaaagatggtgtgatgatcgttaatacgagtcgtggctctttgattgatactcaggctgcaattgatgcgttaaaacagcgtaaaatcggggcgttaggtatggatgtgtatgagaatgaacgagatttgttctttgaagataagtctaacgaagtcattcaagatgatattttccgccgtttatcttcttgccataatgtattgctaacaggccaccaagcatttttaaccgaagaagcactaaccaatattgcggatgtgactttatcaaatgtttataaattgaaatcgggtaaagtgtgtgaaaatattgttttgccgtcttag

SEQ ID NO: 858 - DNA, 1146 bp, H. influenzae strain 86-028NP
gtgcggtcaattttttcattatttttagaggatgttatgacacaacaatatgctattgatactttattagctcaagctggcaatcgcagtgatgagcgtacgggcgcggtttctgcaccaatttttctttctacggcttatggtcattgtggtatcggtgaaagtacgggatttgattacacacgtaccaaaaatccaactcgcacagtattagaagaaacgatagctaaattagagaatggagatcgtggttttgcgttttcttctggtatggctgcaattcaagttttgatgacgctttttaccgccccagatgaatggattgtttctagcgatgtgtatggtggtacttatcgattattagatttttcttataaaaataacaatagtgtaaaacctgtttatgttaatacagcatctgcttcagcaattgaggctgccattaacccaaatacgaaagcgatttttattgaaaccccatcgaatcctttaatggaagaatgtgatgtggttgaaattgcaaaacttgcgaaaaaacataacttaatgttgatcgtggataatacgtttttaacgcctgtgctttctcgtccattagatttaggtgcggatgtggtaattcacagcggaactaaatatattgctgggcataatgatgcacttgttggtttaattgttgcgaaagggcaagaactttgtgatcgcattgcttatattcaaaatggtgcaggggcggtgctttctccttttgattcttggctgactattcgtggtatgaagaccctttctttgcgtatgaaacgccatcaagaaaatgcacaagccattgcggaatttttaaaagctcaaccacaagtggaatcggtgctttatccaaataaaggtgggatgttgtctttccgtttgcaagatgaagcttgggttaatacattcttaaaatccatcaaattgattacttttgcagaaagtctaggcggcacagaaagttttattacttatcctgccactcaaactcatatggatattccagaacccgagcgtgtagctcgtgggattactaataccttgttgcgtttttcagtcggtattgaagatgtagaagatattaaagcggacttattacaggcttttgcaaacttaaaataa

SEQ ID NO: 859 - DNA, 837 bp, H. influenzae strain 86-028NP
atggacttctcttctgtttctaaaaaaccttatattattactgtcgcttgtactaaaggcggttctgcaaaaagtacaaatgctgccaatattggggcgttctgcgctgaccacggtttaagaactcttcttattgatactgatactcaaccaaccttaagctcttattatgctttaactgaagaagctcccggtggtatttatgagtttttaacccgtcgtgatattgaaccttcccatatcatttcaaaaacatccattcctaatttggatttaattcaatcaaatgacccatcaaacaatgtaagtcaaactctacgtaatgcccctgatggtgcaattcgatttagtcacttaattaaaaacattgataattatgatgttattgtggttgatactcgaggtactagagacattactgtcgatatgtctgtcttagcagctgacatcctattctgccctattcttccacacattctttctgcgaaagaatttatccgtggaactatcggaatgtatcaagatttagaaacctttgaatcatttggcttcaaattaccacctctcaaagctatcgcaaattgcgttgataatactaatgacgtgaaatttgtactcaatcaattgcatgtcctatttgaaaccaattttgatgaaagcaaaaccttccttgatttttcaatccctgcgcatgtggcatatagagaagctgcaacttattcattgccagtttatcgccatagccaagctgaatatcctgttatcaaagaactgtgttgcttgttactccctcaatttaaaacactttttgataaaccaatgaaaaaggaaggctaa

SEQ ID NO: 860 - DNA, 1356 bp, H. influenzae strain 86-028NP
atgactgataaacttattgcttctattgaagcggaaagtgcggtcattggtgctctcattattgataatgacaaatttgatgagatcgcaactttactgcgctctgatgatttttatgtctcagctcataaagtattgtttgaaggtgttagccatctattaacacaaggaaaacccgctgatattttaactttggagcagtatttcaaagataaaaaactgattgatcagatagggggattagcatacttagctgacattattcacaataccccttctgcatctaatatcactgcgtatgctgagattatttctcgttatagcaaacaacgtcgttttttgactctgggccagtttattgtaactgaaatgcaatcttcaaaagatgagattgaattaacttcttttgaggaaagtgttgataagcaatataccaatattgtcatcgaacaagagacggatggtgttgctgatcttaatgcaagtttcgagcgaatcctttctcgcatggaaacgtcctctattaatgccgatccagttagtggaacaccaacaggcattattgaattagatagagcaacaacaggcggtcaaccaggagaacttatcattattgcagctcgtccagcaatgggtaaaacaacctttgcacaaacgattgccgcaagtacgttagataaatttcctgacagccctatccaattttacagtcaagaaatgccagctgatcaactattagaacgttttatggcaatgcgctctcgcgtcagcttgcaatctattcgtcaagcgactgagcttgaagaggaagaatggactcgccttgctaatgcaatggggacaattaaaaaagactggaaagatcgtttgttaattgatgatgaagcttctttaacacctcatcgtttacgcgccaaagtacgtaaaaacactcgtctatacggcaaacctaaagcgattttcattgattatatccaactaatgagaactggaaataaaactgaaaatcgcaatttagaacttgccgaaatatccaatgatttaaagaaattagccaaagaaactggatgcccaatttatgcattatctcaactaaaccgaggtttagaaaatcgagctaataagcgtccaatcaatgccgacttacgtgactccggctctcttgaacaagatgctgatgtcatcattcatctttatagagatgaaatctataaccctgacacagaagataaaggcattgcggaaatcatcattggtaaacagcgtaatggcccgttagccacagtaaaaacactgtttcaaggtcaatacagcatttttgagaatttaacgacacaggatagatattatgaataa

SEQ ID NO: 861 - DNA, 1701 bp, H. influenzae strain 86-028NP
atgaataatccatttattgctaaaaataaaaaacaacaaagtcaattagacgcgattgcgaaaggattaaatgttcaacctattaataatcagtctgctgcttatcaaacaacaacagcaacacattatcctgcgcaatctaaatacattaccgttacgttagataaattacgcccttatgaacacaaccctcgtaagacacgtaatcctaactttgaaatgattaaagagtcaattcgtcgtcgtggtcttgatcataaaccaaatatcactcaacgacctggcgaacctttttatatcatcgctgacggtgggaatactcgtattcaagcattaaaagaactgtttacagagactcaagatcaacgtttttggtctattgaatgcttatataaaccctggaaaggtgaaagtgctgatagtgtagaagcggaattagatttgcttattggtcatttaattgaaaatgatacacgtgcagatttaacctttattgagaaagcgttgggaattcagcaagcgaaagaatactacgagaaaaagttaggaaaatccctttctgctcgcgagctttcaagtgagttagaaaaagatgggtatatcattcaattttcaatgattgcgaagatgggacgttgcattgagtatctttatccttatatcccggatgtactttttaacggtttaggtaatgcgccaattgataaattgcttgcgattcgtaataacgccttagccatttggcaaaattatcaatttgaattggaagtgtcctttgatgaaatttggggacacagcctagctcgttgtaatgatgaccaaccgtttcatatcaaagtattccaagaccatctcattgatgaaatgtcatccatgttaggtgatcgtgtaagttatgaagtcctttaccttgaaattgatctcgatgagcaaaaattcaagaaaatggcgcaaaaacaacacgaaatacaacaaagcgtacaagaaagcatccaagatgttcaagcgtttaatacgccacagccacaagaaaccgcattagacacattatctcaacctagcgtagtcaatactccaaaaatgactacccctgaaaaaaaatcaatacctgcgccagtattaaagcaagcaagtgttgaaatttctccttcatttgagaatgaagcagatgataaaacagaggatgaagagtttgatgaaactaatgctagttcagatggcctttcttttgattttgctaaaaatttaactcaacaatttggtattactccaggcatgagcattcaggagcaacgccaacaacgtgcagaagaaaatggattaggctttgcttgcgtaggccgtcaaccagttgatgatatttggaaaatttatcctggtcgtcagcataaagtagaagcttattcactagcactcgacattgcggaaagtgttggattaactgactacattgaacatgtagtaaaagagcctgttgattacacttaccgcgtaaaaccattagataaagatgtgagcggtgtagcacagatgtgttatgacttcttaaatttattacaaacagatgtgcacccacagacatctttcaccttattaccggaatatttactcaatactcaagaaattgatgataccacgctagttaaattattccgtttaattcgcctcgttcgctatattcgttcagaaggagatgcataa

SEQ ID NO: 862 - DNA, 552 bp, H. influenzae strain 86-028NP
atgagcatgttcagcaatttaaaccaagtggtattgaatgagattttggttaatttacaagaaggcaatatcaatgtttgccggaactatggtttctcaaaacaagaattgcaagaaattgaaaaactcagcacagaggaagtttatgaactggctaacaccaaagctccctttgccaaagttgaaattaatcacgatgcattttggcgattagtggctcgagtacgcatgtcgtcacaagaacgtcgccttattgatcgcgcattaatgttaggtgcatccatccaaatgctcaattcctacttcggcttaaccacttcaaaagtatctgctcgtcgtagcctacttggaaaacaagaaccaatgggacgtaagccagctgcaaccgaagaggaagaaaaattaatttgggacttatggcaagagcataaaggtgatgttcaaacaattgaatcaacagaaggactagagctgttaattttaattgcggaagaaaccggtattaatttaactgaaatttggaaacttgttagccgctggaatgcagcttaa

SEQ ID NO: 863 - DNA, 1224 bp, H. influenzae strain 86-028NP
atggaaacaaaattacaagagcatgggttgctcttttttggcaaccagcatgaaacagttccaacccgtttgctatttgatccttatttaacatcaagagcaaaattggcatggcaacttataaaatacaaagcaagagaatttcaatcaggcatgttcccatcatacgaagtgcttgcaaaattactttcagataaaccttatgatgaagcagaactctcgcgtaagctagttagccaaacgttgttattacttagattaactcgttggctaacactttgtgaaactgtacgtaatgagcaaggtcaagtattgggtaatttttacatccttcatgatgaacctatgccaatcattgatacgattcaattaaaccatgattacatcgcactccttgaaaaatccattcagcatcgagataactttgtgcgaggtgtagcaaaccatattgtagaaaacctgctctcagataatactcagtggcattatatttctcacattgactggatgcgagctcgccttcaagactatcaaaaacgtccaaaaatggatatttcagagcaagaagaatcaacatttattcaagaaaacttactaagttccaataaggaactcagtgaaaaaacaggggaactcagtaaaaatcaccttagttccaaaatggaactcagtaaaatcaagcagagttccaaaaaggaactcagtacccaaaatgatgataagtcattgatttcaggcttagttccaaaagggaactcaggtttttcacagtacagtacaggtactagtatttatataaatacgtactgtactggtaatgcggatgaaattgactggccgactaatattcagttttcatcattggaaaaaacagcaattatgcaagcaatgcgtggacttgatttaggaatctgtaaagcgattttatttgagctagaacagcgtgtggcaaaaggtgaagtgaaaaaaccacaaggctatgtagtgacattaatccaacgtgcacaccgtggtgaatttaaaccatatttgtatgaacaatttttggctacacaagcgcaatcattatcatcaaaaaatcggttatcacaacatgatgaaactagcttagttaataatgtgaaagccgatagcacaataaaaccaatgcgagtgcaatctgaagaagagcgaaaagcgagagctgatcgcattcgacaatttaaggcttcaatttgcaattga

SEQ ID NO: 864 - DNA, 756 bp, H. influenzae strain 86-028NP
atgacaacaacatacaaccaacagcttgggccgttacgcagtgagattacatttacgcttcatactcagtatgcaacacgtctttggaatggtcgtgacttagttaaaaatgaagccggggaagtcgttacatcatcaattctcagtattcctaatgctctatctctattgagtcaaattcagcaagctgccgaacaagatgatccttatgctgatgattatcttcttcgttttgaacaaaaagtattagggtttcgtaaagaaatgcaagatatgacctggagaatggttaatctctacagtgagaaaattcctgaaaactttcaaattgagcgttgtgccaatattgctccgattcaataccctatttttgtgaatactcagctgggttatcaattattgtatcttttggctgactttgattcgttagctcgtacagtgatgaccgcttcacatattgcattacttacaaaagatgatgcgtatgattggttagaatccggagctaaattaattcgtcgtgcatttggtgtgcttgagaattacagaaattccggtattacacgccaagatgcgcttgaaaataacgctcgctatcaagctgctgtaaaacgtatgaaatataccttaacgcctgacgtgctttccggtacaacacgtgcaacatttgctccaacaattaaaaaatcatcacttgctgaatcagatgataatggctctgttgaagtccaaattacagcaaataaaactgaataa

SEQ ID NO: 865 - DNA, 489 bp, H. influenzae strain 86-028NP
atggagattgggattatggataacgtgctcattccttctgatatgtataaacaattaggacgcacaaccccacttaatgactcgctgaaacagttattcagtgagttagactcagtgcaacagtatgaattactagctgaatcccttgctacagtccgtgaagctttaatgttgcagcagaatgaaatgttgcagaacgttcgtaaaagtgaacttagtgtattacctattcacatgatccgagataaagcttcatcatccggtgggacgtttttacgctggcgcagttttcaagcctctaagactggtgatgctgtgttaaatccggtatttaataatcctcagttatcttcagacttacgacaaaaacttgtctcagctgagaaagaacgcattttgattaatctgcaggtctccgtactaaattttatgatgagacaggtatcaagtgcggtagataaaattaaagagatagaagatcatttataa

SEQ ID NO: 866 - DNA, 423 bp, H. influenzae strain 86-028NP
atggctggaattaataaagtaattatcgtgggacatttaggtaatgatcctgaaatgcgaagcatgccgaatggtgaagcagttgcaaatatcagtgtagcaactagcgaagcttggacggataaaaacaccggtgaacgtcgtgaagtgactgaatggcatcgaatcgttttttatcgcaaattagctgaaatttgcggccaatatctcaagaaaggagcgcaagtttatattgaaggacgcttgcgtactcgtaaatggcaagatcaaaacgggcaagatcgttataccacggaaatccaaggtgatgtaatgcaaatgttaggtactcgccctcaaagtgcagatggtgcaaataattctcagccaatgccacaacaagatgcatcggcaaatgcttttgatgattcaataccattctga

SEQ ID NO: 867 - DNA, 519 bp, H. influenzae strain 86-028NP
atgaaaaaaataatttttgttttatctgccgtcgctgctttaagtggttgtgctgaattaaactcattgaatgatgcggttggtaatgttgcaggtcaactcagcagtgttcttggcggggggaatagttcctctagttcttccggtgtggcttacactcaaagttctcgttctcatcgctataacgtagaggattcaattacatcatctaaaaatattgactctctttacgtaaaaattaaacgtaatttaaaattcaaaacacgggaggaagcattaagtggattatccgggtatgagcgtcaacgttacgaatcgcttttagatgaagaaggacatgctcatgaagcgactcctggggtctattatcacatggcaaatagctatgttggcggtcgaaaaattgacataacgcttgcaaaagaggatggcaaggttagaatttcctggattgcatcctcaaatgaatctgattttgctcaatttgttaaatcagaagtgataaaagcaattaaataa

SEQ ID NO: 868 - DNA, 558 bp, H. influenzae strain 86-028NP
atgataaaactgaccccttcatcaattggagtgatggttgatacgcttagatattcaggtcgagatagatatattatttttagaatgaaaacgagagagcagaaagtcgtgtatatgcgttatccacagcatattgaaaatatggctaatcaagagaacatgattgtcatcgtagatgctcaaaagtttctttctttatggcagcgatcaccgtatgaggtagataaaaatacatgtgcgggcgatgagtcaacatggagaaaagattataagtttcatcatgctgaaaacggatttgctaaaagtatggattctccagttccacttgcagatgtaaatgttcatattaaagatggagaaataagctgtagtcttaatgatggtatgacaagaacgctttggttgcttgcaaatggtgtaaaggagtttcctattttggttagaaaccataaagagaaagctaaaattctgtcaaagtatgcaagcccattatcttcacttcattttgagccacttaatttattttttgcaattacaggagaaaaataccccttgtag

SEQ ID NO: 869 - DNA, 2061 bp, H. influenzae strain 86-028NP
atgagagaaaacatcatgaaattatttttatgtgaaaaaccatcacaaggcaatgatattgcaaaagtattaggtgcgacaaagcgtggtgagggttgtttatcaacacctgacggtcagcttacagttacctggggaattggtcatctagtagagcaatttaatcctgaagaatatgatcctgcctttaaaaagtgggcatttgagaccttgccaattatcccgggtaaatgggggctttcacctaaaaaagaaacaaaaaaacagttcaatgtcgtcatgaaacttatcaaacaagctaaacttgttgtcattgcaaccgatattgatagagagggcgaaactatagcaagagaattgctggatttggcaggatttcgagggcaaataaaacgcctttggttgtctgcactagatgataccagtattcgcaaagccttgggcgcacttaaaaataatgaggagacactacctctttactatgcgggacttgcacgtagtcgagctgattggcttattggtatgaatttctctcgtctctataccttattagcgcaacaacaagggtatcaagggaaacctttaagtgttggtcgggtacaaactccaacattaagcttggttgttaatcgtgaccgtgagataaaaaacttcattcctaagcaacattttgctttgcaagtaatgctttctgatggaaatcagcattttgctacgcaatatgttattccggagcaatattgtgatcctgatggactttgtttgtctgcccaagttatacaagcagcaaatcagcaaattcgccaatttggccaagcgaaagtggaatcagttgaaactaaacgtgaaagacaaaatgccccactttgctttgcattaagtgacttacaatcagaagctaaccgcctttatggactgggtgcgcaaagagtattggatatagctcaatcactttatgagactcacaaagcgacaacctatcctagaacagattgtggttatttaccggagtctcagtttgcagaagcgcctcaaattatccaatgtttgttgcaatccgataatcgattacacccccttgcaggtatgttaaaccttaatcaaaaatcacgagtttggaatgataaaaaaattactgctcaccatggcattattccgactatgattaaagctgatattagcaaaatgtctgatgaagaattaaagctctatgatctcatacgtcgtcgttatttagctcaattcttacctgtttctgaaacagataagacacaaattattttgaagtgcggtcaacatatattaagtgcacgtgggaatgtgcttattgctccaggttggaaaattctatttggcaaatcacttgatgaagatgatgacgcacctcaagccttgccgacgttaaagcaaggacaaatctgtcagatttctgattcagaaataaaaaccttacaaacatcaccacctaatcacttcacggaaggtacattgctcaccgcaatgaaaaatgcagctcgctttgtaactgatgagcgtttaaaacaacgcttacgagaaactgaagggcttggaacagaagctactcgggcgggaacgattcaaggtttgattgataaaggtttcttgaaaaagaaaggtaaatcactattagcgacagatgaagcaatgacgctaattgataatttacctcagatgttaaaagatccgggtttaaccgcactttgggagcaagcgctcaatcaaattgctgaaagaacgctttcgctagaagtgtttatgcaaaaacaagaagtctttgtgcggcatttgatggctgattgccttaaaaagggaatgagtttggggaatattgaaattcgtaaatgccctaagtgcggtgcaccaatgattaaaagaaatggtaaaaatggggctttttttgggtgttctgcttatccaaattgccaacatattgaaaatattgatagcaagaagaatactaaaagtacaaaaaatttaaagaaaaagtcgagtaaaagtgtgagtgagcaaatttcatctttacgaagcttattgaactag

SEQ ID NO: 870 - DNA, 429 bp, H. influenzae strain 86-028NP
atgtctactcaaaacgcacaaccaaaatatttcaatcttcatacttctggcattggttatttaagcgatattcgcgaaatcaagccgaaaaaaggagatgcattttgggcttgtcgaattgctgctcttacaggttcttccgattctccggaatatcgtttttttgatatgaacgtatccggtgaagaaactgtaaatttaatcaaacgctgtcaagaagctgttgaagctaagaaaaaagtcttggtttcctttgtaatgagtgatttgtggtatgacacattcacttattcaaaagatagcgaatatcacaaaaaaggtgatactggcgtgtcgattaaaggacgactctatcgtattaactttattaaagttgatggtgagttgaaatatcaagcaaaacgccaagatgagcaagggaatgactaa

SEQ ID NO: 871 - DNA, 93 bp, H. influenzae strain 86-028NP
atgaaagccaacaacaaaatttgttggctttttctttaccctgaaggggaaactccccttatgggtggtttctccttttttatttctatttga

SEQ ID NO: 872 - DNA, 642 bp, H. influenzae strain 86-028NP
atgaatacttacgctaaattttgccctaatgtttttgttgctaaatgtccggatgctcaccaaaaaggtgacgttatcatcttaaccagtaaatacggtaaagagactgaagtggagattcataatctcgtaaaaacctctgaggatgcgtatttttattccttcacccggtgtgatggagtgaatagtcaagttcgtgcagaacaaaaagctgagcgttatcaaaacgcagctaataatgcattaaaacgcagtgaacaatattgtgaagctgctaatgaaggccgtgaatttcttagcttgggagaaccaattaaaattggtcatcatagcgaaaaacgccatagagccttgattgaacgtaatgcaagacgcatggataagtctattgaagaaatgcgtaaagcagaaagttatgacggtaaaatcgcttattgggaacagatggcagggaaaattgatttatccatgccggaaagtcttgagttcttcaagtttgaattggaaaaagccaaagaaaaacaccaagagcttaaagataaacctgaattgcgaacacatgctttttctctcacttatgctaaaaaagcagtcaatgagcttgagaaaaaagtaaaattagccgaattactttgggcgtaa

SEQ ID NO: 873 - DNA, 408 bp, H. influenzae strain 86-028NP
atgttttactatgtaaatagtggattagagctaattactttaacaacgcaagagtttataagtgagtttctaggaaaggcaactacccctaaagggattgagccaaatcatttctatgatcctcaaaccaagctagtttatgcatggtactctggcaaatgtgtagcaacttctgagtaccaatatacacctcaagaagcagaagctttacttgttgaattggcattggaaaatgctagtaataatggggatggatcaattatgttccaaccttcgccaacaaaagaagcactaattgctgatatgagtaattatttggaatattgtatagatgatgaatctgagcacgatttagaatttgcagcaaaaattaaacagattatcgacagtttaaaaacttctgattaa

SEQ ID NO: 874 - DNA, 471 bp, H. influenzae strain 86-028NP
atgtttaaattaaacgagcaacaacaagctattttagaacaggcacaggttattttaactaaagtgatggaagaaaagcccttttaccaaggtgcacaggaatttactgagccatcaatagctaaactctattttcaaaccattataggtaatgaggaaagagaaaatttcgtggtacttttcttggatagaatccacagattgattaaatctgaggtgatgtttcaaggatctgtttcagaaacttctgtgtcaattcgggagattattcgacaagcattaaagctaaatgcatcagcaattatcattgggcacaatcatccaactggaaatgttgagcctagtgatgctgataaatatataaccaagagattaaaggaagcttgtgaattaatggatattaaattacttgatcactttatcgtttctggttcagcatctttttgctttactgataatcatcttatttag

SEQ ID NO: 875 - DNA, 597 bp, H. influenzae strain 86-028NP
atgtgtaaggaaaatcgtattttagaacttggaaaaatcttcgtctctcgtcgtatcttagcggaattaactaccgaaaagatcaatgaggtcatctcgtggcatcaaaatggctgcattatcatgctggggaataaagattggattgaaaaaccgccacatccgctttcagaaattgttatgaatttctatcaagcagataatggtaaagacaccattcaactctctacttcagtagatgatgacgggaatcgaacaactaagatttctttttctgatgaaagtgaagatgagcaaagaggacactttgattgggatatatatcaatcaaaaagaacaccacttaagttaggggatgtttcgtgtactatctgcgctaaacagttattgggaatgccaaccattcatcgcttaattgaaaaacaattaggttatgattggggtgctacctgcgttgaagattggattgaaaacgatcatgccgtagagaaggataaacgcattgtgagccagcattttattgatggcgaaagtgtttttgtcatcactgaagcagatcgtagttctacaacgattatgctcggatatgaatattaa

SEQ ID NO: 876 - DNA, 765 bp, H. influenzae strain 86-028NP
atgataaataaaactctttttaacagtataacgatgccttatttaacttcttcacaaactgaatgcctaaaatggttagctcttatcacgatgattatcgatcacattggtgtggctttttcaaatgcttacccagccctatcctggtgtcgggtgataggtcgattttcctacgtggcgtttggatttatcatcgcgcttaatttatctcgagataaagtaaactttaaaagttatttcacttggatgatagcaaccgcatttttatctgaaatcagttttacgcttttcgagcctaattatgaccgtttaaatgtcctatttcagtttttgtctgtaatcggggtaatatgggtatataaaaaccgtcaagacttaaatagctgggtcatgttttttggattgggcttttttattattctttccgcactctctgattatggtttacctgggcttttatattgcattggttgttacctattcttgcaaacaaaagatactcaatttcgtcttattacgatgctaacctgtgtattgctcgcacttttcgtcaatcacagttttattgataatttcggggaaactattgttgaaacaatcagtgttgttactgttgtggtcggtacaatgatatttattcttcaccctaaaggccttcgtcaatgtaatatctcaatctctcgaatgcctaagcttttcttttatcttttttacccggtgcacttaacaattattattggcattaaatatatttttctcagctaa

SEQ ID NO: 877 - DNA, 630 bp, H. influenzae strain 86-028NP
atgaaaaaatttctattaaccacttttgcattggttgtgctttcaggttgtgcacataaacaacaaacagccgatgagcaacaagcactagaaaatccaaatattcaacaaggtcagcatcaagttttacaaccggaagatcgaattgttcgtccggatatttacacagactatcagcctgaacgtacagaagtgttacgtgaaggtcgatacactttaattaatttctctccagaagaaggtcaaaaataccttctagaccaaagtgtcactgtcaacatgttaggtaaaaagaaacgagccttaacggcaaccgttgagcagggattacgcacgacgttaaaagatacaggcctttcactttgtcatggttttggtcagaatgaaccaacactttctacgctttattcccgtccattaccaaaagtacattatcaatttggcccgatggctttacgtgatgcccttcaaatgttagcagggccggcttatgaaattactatcaatgacgtttctcgtaccgtttgttttaaattacgcccagctgtaccggaacgtgctacaggggaaaagccgaaagtagaaaccacaacaacgacaacaactacaacagaaatcatcgaggaataa

SEQ ID NO: 878 - DNA, 741 bp, H. influenzae strain 86-028NP
atgaatcatgtcaaaaaaatatcctatgtggcgatgatattagggatgttttctactgctgtatttgctgaagtcactgcggctaatacacttgctactcaatccctcaatcaacaaaacttggtgacaaataaattaaatcaacaagagttattagctaagtctcaagagtggggtttaactgagcaagaatggcaacgctaccaagagcttaatcaaggtgctcgtggtatatggtcgccaggtcttgaccctttaacctcgcttggtgtggagtctcgaaatgagcaggaaagagagcgttatgctcgactactggcaaaaaaaatgcacgaccgcatggagagagagctgcagttccaacgcacttatgatcgcgtatttgctgaaatgtatccaaatgagcaaccatttaaggttgaacctcatatttcagagcggtttggacgggtgatttattttactcgcctagaaaattgtgacaaatgtgaagcgaatgctgatcgtgtactgcaatatgtgaatgataaaacgcctatagatatttattttgttggcgtgaataataatgagcaaatctataattgggcgaaaaaacataacatcgacccaaataaagtgaatagaaaattaattacccttaatcatgataatggagcctggttacagtatgcagatggcaaaatgcctgctgcattccaaattcaacaggatgggcaatggcaacaaatcgtctattaa

SEQ ID NO: 879 - DNA, 759 bp, H. influenzae strain 86-028NP
atggcaacaaatcgtctattaaaaatcgtatttagcttaatcggtcttggcgttgcgactcactccgttgcatttaatggctttggaactgatattgatggctatattaaagatgcatctaatcgctaccaggtcgatgaagcgatgctacgtgggttagtaaaaattgaagatgggtggtatggaaatgtttccccaaccggggcaaccggtgtggggcaatttacccggggcacctggaattggcttgcaacaactgatgaggggcgagccttaggtatgactcaaatcactcgttacaatcgtgatacacctttcgaccctagaaaaaacaatcaacttaacactctagcaaccgcacttttagctagatggcatattaatcagttttttgagcgaggcataaaaccatcccatgaaaatttatatcttgctcataatatcggtatagatggtttacatcgagcgctacaaggtagagcaacacgtgaagatattctaaatatgaagcgtaacgggatgaaaaaaggaatgtcggtacaaggctttcttgtttatcaaagtgagcgttttaatgtcagtaaacaaatagctaacttccagcgcccttcagtatcaccacgttatcaaattgagaataaaccattaccagccaatttacattgggtttctccaacagaaaccgctatgcgttgggttgagccagcgtcaaatcaaacaaatcaacaagctattcgttggcaaaatccaaccaattaa

SEQ ID NO: 880 - DNA, 507 bp, H. influenzae strain 86-028NP
atgcagtataaatcctttttcctctctttggtctgcttaggagcagtagttcaggcgcaagctgaattaaaagttattggtgattttggcggagaaagtgcagtccgtttttatgaagcattacaaccggatgaatcaatggttcaagcctaccctaatagcgttccttcaacattgaccgaagcggatattttacctgttatctcacatagaatgacaccgggccaaatacaaccagtcagaatgaatcttcctggaatgttgcctatttttcttattggaacagataacttatctaaaaattggctacacgctaattataattaccttaaaaaaattggtgcaatgggacttgtagtaagcgttaaaacaacaaacgaattaagcgagttacgccaattagcaccggatttaaccttaatgccaacgccaggggatgacttagcttcaagattaaatcttgctcactaccctgctttattgacttcagaaggattgtcgcaatga

SEQ ID NO: 881 - DNA, 2250 bp, H. influenzae strain 86-028NP
atgagtcaaaaacatgtattagaaggtttacttagaccgcctgttgaattttttccagctgccgtccatggtacttgtgctttggtttgttgcggtgcgccttggtcgctcgcattaaatcctcttattggatatggattaggggccgctttcgcaggtatgggggttatgcgttttcgtcaaggcatggaaattgtacgctatcaccgaaatttacgcagactccctcactatgctttgaccagtcgtcaaattccagtaagtaaaaaagccttgttcttaggacgaggctttgaatgggaaccaaagcatacgcaacgtctttatgactgtttctctgcaaatgggcaaatttattggaaaaatgggaagtggtttaaagccgctcgtgattatgaaaaagtgcatgataattggttatctagactcacttcaatggactctccattaaatccagtcagaccgctaccgccagttggcggcattccagtgatgcatggtgtggagccgaatgaacgcgatattatgcttccgttaggcgaccgtggcggtcataccttagtatttggtacaactggcgtagggaaaacgcgttttgctgaagtgcttgttacacaagatatacatcgaggtaaaacacctgaagagcgtgaagtggttgtcttttttgatccgaaaggcgacccggatatgttaaaacgaatgtatgcagaagcaaaacgtgcggggcgtgaaaatgaattttatgtattccatttagggcatccggaaatttctgctcgatataacccagttggtcgcttcggtcgaatttctgaagtggcaggacgtatttctgggcaattaagtggtgcgggaaatagtgcagcatttaaagagtttgcgtggcgttttgtgaatattgtctcccgtgcattggttgaaatgggaaaacgcccggactatgtgcaaatctcgcgttttgtgcaaaatattgatgcacttttcttagattacgccaaacttcattttgatgccgtagataagaaaatatggccaacgttggcttcggttgcggctaacttagatgtaaaaaatttaccgttctcgatgaaagatagaccgctgattgctgttattaaccaatatattttagagaataagatttttgacccggtacttgaagggttatcaagtgcggtacgttacgataaaacctattttgataaaattgtggcatcgcttttaccgttacttgaaaaactcactacaggtaaaactgcagagcttctctcgcctgattacactgatattcatgatgagcgccctatctttgattgggaatctattattcgtaaaagagggattgtttacgttggattagatgcattatccgatgcgaccgtagctgcagctgtgggtaatagtatgtttgctgatttggtatcaatggctggtcatatttataaatttggcgtagatgaggggttgccagatgcatttaaaactaaaagcaaaccgcctaaaatcaaccttcattgcgatgagttcaatgaattgatgggggatgaatttatcccgctgatcaataaaggtcgtggtgcgggaatgcaggtaacagcctatactcaaacactttcagatattgaagctcgtattggaagtaaggcaaaaacgggacaaacaacaggtaacttcaatacacttttaatgttccgggtaaaagagccggccactgcagagtttttaacgcgtcagctcaacgatgtcacaatttatcaaagcatggtgacatcaagtacgacagataacagcaatccggatgatggcaaggcgtttacttctaatactggtgaacgtatttctgaaaaaatggtgccaatgctatcgccagcacatattacaaatttaccaaaaggacaggcatttgctcttcttgaagggagtacgctttataaattaagaatgcctttacctgcggttgataaagatgatgtgatgccggaatcacttcaagaattgacggcttatatgcgcaaaaactaccatatttctccaaattggtggcaatctgcattttctgattatgcgccaagtcaagatatagcaaccgcttttcagtcaatgtcattaaatcgagcgccttcacacgcaggagaagaaatgcttttcggggatgttgaagctccagttgctgaagatatggaagatgaagatattgatcagaatgatgatacagatgaggatgattttgatgacacagataattaa

SEQ ID NO: 882 - DNA, 687 bp, H. influenzae strain 86-028NP
atggcagaacaacaagtcaaaaaaaagaaaaagggtcttttttactacattaatgcggtattagccgccttattgggttccctgattttgagcattattcttgaatggttaggtattgcatttttatggcctgaagaaggtcatttacacagtcaaaaaatgatgctaactgagcttggatggctttctgatagtctaacgagaggtcttttctatcattctccaaaagagctggctgaaggtcttattttgtcattacatgaatggctttttgtgaaaacaggtgtaaaagattggttagccaaccctcgtgagcatagtggcgtaggtttgtgggtgtatcattatgggcgagcgtatattgagtcagtgatttatgtttttatcacctttgttattcgacttgtagtgattgtttttacttccccactctttttgttagccgcatttgcgggctttactgaagggttaatgatgcgtgaccgtcgtaaatttggtgcgggcagagagtctagttttctttatcatcatgcacgtcgattaattggcccgattatgttgtcggcatgggtattgtatctttctatcccaatttctatttacccgaatataattttggtgccagctgcatttctatttggactatccatctgtgtaacggcagcgagctttaaaaaatacctttaa

SEQ ID NO: 883 - DNA, 351 bp, H. influenzae strain 86-028NP
ttggaatctgtttcaagtaaggagttctccgtgactaaaaatattttcagtttatctctagcaatagggttattgtttggcgctataagtgctcaagcaacagagcaagagcatttagcgcaagcaattaaacagttggatgcagcaaaactctcattacagcgagcagctgcaagtgcaaaggtttctgcgaaaagtcgtgaatattttgattacgcttcagcacatcaagatattgctacggtacaggcagggattaagcaatatattaacccttcccgggcaatccctagaaatcctaaagctattcgtaacttaaaagaagattatctcaatcttcggagtcaatag

SEQ ID NO: 884 - DNA, 402 bp, H. influenzae strain 86-028NP
atgaagttgattaaatccttctttcagaatgtttcaagtcgttttcttgcggtagtaactttactttggttatccgttgaaaatgcgtttgctacaggcggtggtaatggtatcaatgcctctaaaatccctgattttaaaatcccaggcgtagatagcaataccaaagacccgatggaaatcatctatcttgttgctaaatcattggcaaccttgtgtgcaattttatttgcagcatggtcaatcatgacagtggttaaggcattaattaaaacctataacgcagcgactgacgaaaatgacaaaaaaggatggggcccatttattatcgctcttattcttggtttcattttaattttcttcagcctctggttggtgaaattggctatcggtctgttttaa

SEQ ID NO: 885 - DNA, 372 bp, H. influenzae strain 86-028NP
atgtcaagcgataaagaacaaacaatcccctttcttcctactcgattaaatcgtgaatcgagtgtgtatggcgggttatctgtaagtgaatttatgttggctgcagcaatgggatttatcttgggtgcagtgcttggcctcctttgttgttttgccttaggctttgatttttggttgttaattccgtctctcgccatgttgttttgcattctttctgtggtgattggcaaagtgattattgcgcgccttaaacgaggtaagccggaagcctacttgaatcgaatgattgaggttaaattagatggaatattaggggggaatcgctttatctcccgtcaaggcacttggtctattcgccgagttaaaaaataa

SEQ ID NO: 886 - DNA, 645 bp, H. influenzae strain 86-028NP; identical to SEQ ID NO: 708

SEQ ID NO: 887 - DNA, 870 bp, H. influenzae strain 86-028NP
atgaaaaaactcactttgttactaagcgcggcttttatcttttcaccaatgacggcatctgccgatgtgttaatgaaatgggcgcgcaaaccgttacctattgacttacaaatcgaaaaagaacgtattctattcgtagataaaaatgtaaaagtaggttatccacctgaattagatagcaagcttcgcattcaatcaactggcggtgcggtttatttaaaagcaactgcagatttcccaaaaacacgcttgcagcttatggatgttgcaactggagaaataatcttacttgatgtgcaagcgaagcattctgttgccaatgcaagtgagccaattcgctttgtttatgaaaataaagttgaaaaacaaacaactgcttatggccaagatgcaaatgcatataacgaaccaatgccaaatgcgcgtccggcactccccgctccagctgcattaacacgttatgccgcacaaatgttttatgcgcctttacgttcagttgagcctttggaaggtgtgcgccaagtttcacatcgccttcctacaccgcttaaaacgctcttacctgcattgcctgtgcgagctactccattactcagctggcaacttgatgagtatgttgtcactgcggttcgcttgcaaaaccaggggcaatctcgcattgatttagatcctcgagagcttcaaggtcgattctatgcagcaacatttcagcataattggcttggggggcatgatacacctgaagataccacaacgttatatcttgtgacagaaggttcacctaatcattctgttatccctcagtcaaattcatataaaccgaaaaaattgaaaaaagtcaccacaacagtgacaactcaaacaaaataa

SEQ ID NO: 888 - DNA, 1401 bp, H. influenzae strain 86-028NP; identical to SEQ ID NO: 698

SEQ ID NO: 889 - DNA, 408 bp, H. influenzae strain 86-028NP
atgaaagttttaatgatgatgggcgtgattttagccgcaagcagtgttttgactggctgctcaacttctcaaggtgatttattgccaacaggcgatgcaacaatgaaagatatttggaatcgaggcggtaatgatagcaatattacatcttatcggacaccgaatggccgtcttattgatgcaccaaattacgtttcatctcgtgaacaacaaacttatacccgtacagcagaaaacgaggtgaaaaatcttttccctcgtttaccaaaccctgatttagtgatgtatgtttatccgcacttaactgattcctcagagcaaatgcctgtaccaggttattcttcagtaattccattttatggacgtgtgcaatatgcccaaccgggtgagcgtacaagaatgtactag

SEQ ID NO: 890 - DNA, 2871 bp, H. influenzae strain 86-028NP
atggcattattccaagacgtgttagaggctttcttccctgctaaaaaaggtgataagcctcaacctaaaaaggaacctatcctaacatccattgcaccggaagaagcacagcaggatgataccaataacgtagaagagacgattgaaatcactcctgttatgcgtaatagaaaaatgaccagagagcaacatgttaaaatgctttatgggcgcgatccctcttttatctccaatcttccttatgcggaatatttggaagaagaaggcgtaatgctttttgatgatgctaaaagtgcaggtgcggtatttgatattaagcctataggaactgagggaagaagcagcgactatcttaatcgcgttcgcacattggttaaagatgccttacaggatagtttcgatgaacttgataccaacccttacgttgtacaattctattgccaggatgacaaggatttaagcggttatgttgagaatctgagacagtacattaaaaccacttcacctgaagcgagcggtagtgagtttacagaacagtggcttggtgaaatggagcgtcacttaaaagcagtaggtaaaccaggtgggctttttgttgatgaccgggtaacaaatacggcatgggctggaaaagtgcgtaaaacacgcatggttatttatcgttatgctggaaataatgagacagatacaatcgagaaattaaatacagcttgtgatcgtgttcaaagtgcttttatcacagctggattaaccatggaacgccaaaatgaaacacaaattcatcgttggttattagaatggtttaatccaaatccatcacgctattttaacggactcgatgataaagcttgctatgatcttttatcactctctaaggatgaatctgctctaccattacaagaccaagattttagtgaaaatctcttttttacgccaccggaaagtaaaaatggctattggtattttaatgagcaacctcacgaagtcattgtagttgataatattcgtaagcagccggatgttggccacatgacaggcgaagtcactcgaggtcgtaatattaatgcactatttgatttattgccggaatcaaccattatggctatcactgtagtcattcatcctcaagataaattacaggcgcatttagacaaattaagtagtcgagctgtcggtaataactatgagtctatctatttaaaacaagatgccctcacagtaacggaatatttaaaagacggacacaagctttatcaagctggcatggttttctatgtaagagggaaagacgatcaagagctacgcattcgctcaagagaattaagaacggttttactcagtaataatttagtgccggtaaaagaaggcaacgaagttgcgcctcttaatagctatttacgctggctaccgatgaattttaatcctcaattagatgcaaaatctcgtttttataccaaatattattgggtgcaacacattgcgaatatgttacctgtatttggccgtgagaccggaacgggacacccaggaatcacctattttaaccgcggtggaagcccattagattttgacccactaaaccctaaagaccggactaaaaatgcgcataagctcattttaggccctacaggttcaggtaaatcggcaacattaaccgcacaaatggcacaactgatggcggtgcaccgtcctcgcttgtttattgtagaagcaggtaactcttttggattgttttcagattatgcggagcgttacggtttaacggttaaccgggtatctcttgagccaagtagtaacatcgctttaccgctcttctctgaagcgcatcgtttattggaaatggatatcgatcttgaagttcaagatgatgacgataatgaagatgaaggcgaggaacaacgagacttacttgcggaaatggaattaaccgctcgcttaatgatcaccgggggagaagcgaaggaagatgagaaaatgagccgtgctgaccgctcggctattcgccaggctattttattagctgcagagaaaacttcacaagagaccccacctcgtcaagttttaaccggggatgtaaaagccgcacttgaggagttaagtcgtcgccaagatattcgcccggaacgtgcatctcgtcttgcagatatggccgaagcaatggatattttctgcactggggtaaatggtcgattctttaaccgtgaaggggaaatttggcctgaagctgatattacacttgtcgatttggcgatgtttgcacgtgatggctatgaagctgaattagcgatttcgtatatttccctaattaaccatatcaactcattaggtgaaaaatatcaacacagtttccgccctatcgtgaacattacggatgagtcgcatatcattaccgtaaatccacttctagctaagttcctggttaaaggttctaaaatgtggcgtaaattgggtatttggttatggttagctacacagaatatggctgacttccctgatgaatctgataaattactcagcatggttgaatggtgggaattacttaacctttctaatgatgaagtcgaacaggtaaaccgtttccgtcgtttatccgaagctcagaaaatgatgttgttatctgcgaaaaaagcagataagaaatatactgaaggtgtggtgctcgcaaccaatatggaagccttattccgtgttgttccacctagtctttacttagcactagggatgactgaaaaacacgagaaagcacaacgtaaacaattaatgatggaacataactgtactgagttagatgcggcattgatggttgctaaagacttagacaaaaaacgggggattgcagtcaatgacgaacttaactcaatcgcagcctaa

SEQ ID NO: 891 - DNA, 408 bp, H. influenzae strain 86-028NP
atgacttttcatcgtatttttgacattgggcctcgcatccaatcacttgcttttacctctgatgaggtgaaagcctacgtgctgcatttcattgcaaaaattaagacaaaaattggttcaaactgccaattaagcgcatttcctcagcgtgtatttactcaatcaagttggaaagtacacgctaaaggagataaaggtgaagtgcatttattatttaatatctccgggcgtttccaattacctgtgttttcttccgaaaactggccagctagacttaatgtggaattaaccgatcacgttgatgcatattggttaattcaatatttgctttggaaattagctgcaatttgggaatcccctgctgacttatccccagtttttggggataagactgtgggtaatgaataa

SEQ ID NO: 892 - DNA, 324 bp, H. influenzae strain 86-028NP
atgtctcaaggtaaaaagccacaatcaagaggatggcttaaaaatgtactccgttttattgctatccttttatttttatttttagcccttactgcaattggcatctttgcaactcaatatcttcagaatgttgatattcgtgcttggtttattaaaacgcagtggatatggtttgcagtacgattattactatatggtgcgattatgttgatggtctattccatttctcgtcgccaaccatcttctatgccggcaaaagcaaaatggttaattgcgatgattttaatttttgctgaagcgattacacagattactttagcttag

SEQ ID NO: 893 - DNA, 1494 bp, H. influenzae strain 86-028NP; identical to SEQ ID NO: 688

SEQ ID NO: 894 - DNA, 330 bp, H. influenzae strain 86-028NP
atggacgctcaaaagtttggccatactgtcggacaattttttaagaaaattgaccgcactttgtcatttctcccaggaaagcctcgtaaagctgttgtgacagctgctgctcttgctgcgagtccaattttggccggagttataatttccaaaaccaagccttctaaaaacattgaatatttagatgaagagccagtaagtgatacatctttgttgtcagaattacttgcaaatgatgattcatcagaagaaggaaagtgggattatggttttcaggggtttggctattatattaacggagtaaaagtttacggagatgatgacgattaa

SEQ ID NO: 895 - DNA, 117 bp, H. influenzae strain 86-028NP
gtgtttcttctttcagcaggtacgaacatgcgctggcgagcgccaatgcagatttatccagatccttcagcgagcggagccgttttttctgcccaatctttctggcgtcacggatga

SEQ ID NO: 896 - DNA, 3006 bp, H. influenzae strain 86-028NP
atgcccgttgactttctgaccactgagcagactgaaagctatggcagattcaccggtgaaccggatgagcttcagctggcacgatattttcaccttgatgaagcagacaaggaatttatcggaaaaagcagaggtgatcacaaccgtctgggcattgccctgcaaattggatgtgtccgttttctgggcaccttcctcaccgatatgaatcatattccttccggcgtccggcattttaccgccagacagctcgggattcgtgatatcaccgttcttgcagaatacggtcagagggaaaatacccgccgtgagcatgcagcgctgatacgtcagcactatcagtatcgtgaatttgcctggccctggacatttcgccttacccgtcttttatatacccggagctggataagcaacgaacgtcctggcctgcttttcgatctggcgacagggtggcttatgcaacatcgtattattctccccggagccactacgctgacccggttgatttcagaggtaagggaaaaggcgacgttgcgcctgtggaacaaactggcactgataccgtcagccgaacagcgttcacagctggagatgctgctggggccaactgattgcagccgcctgtctttactggaatcactgaaaaagggccctgtgaccatcagtggtccggcgtttaatgaagcaattgaacgctggaaaactctgaacgattttggcctgcatgctgaaaacctgagtacactcccggctgtgcgcctgaaaaatctcgcacgttatgctggtatgacttcggtgttcaatattgccaggatgtcaccgcagaaaaggatggcggttctggttgcctttgtccttgcatgggaaacgctggcgctggatgatgcattggacgttctggacgccatgctggccgttatcatccgtgacgccagaaagattgggcagaaaaaacggctccgctcgctgaaggatctggataaatctgcattggcgctcgccagcgcatgttcgtacctgctgaaagaagaaacaccggacgaatcgattcgtgctgaggtgttcagctacatcccaaggcaaaagctggctgaaatcatcacgcttgtccgtgaaattgcccggccctcagacgataattttcatgaagaaatggtggagcagtacgggcgcgttcgtcgtttcctgccccatctgctgaataccgttaaattttcatccgcacctgccggggttaccactctgaatgcctgtgactacctcagccgggagttcagctcacggcggcagttttttgacgacgcaccaacggaaattatcagtcggtcatggaaacggctggtgattaacaaggaaaaacatatcacccgcaggggatacacgctctgctttctcagtaaactgcaggatagtctgaggcggagggatgtctacgttaccggcagtaaccggtggggagatcctcgtgcaagattactacagggtgctgactggcaggcaaaccggattaaggtttatcgttctttggggcacccgacagacccgcaggaagcaataaaatctctgggtcatcagcttgatagtcgttacagacaggttgctgcacgtctttgcgaaaatgaggctgtcgaactcgatgtttctggcccgaagccccggttgacaatttctcccctcgccagtcttgatgagccggacagtctgaaacgactgagcaaaatgatcagtgatctactccctccggtggatttaacggagttgctgctcgaaattaacgcccataccggatttgctgatgagtttttccatgctagtgaagccagtgccagagttgatgatctgcccgtcagcatcagcgccgtgctgatggctgaagcctgcaatatcggtctggaaccactgatcagatcaaatgttcctgcactgacccgacaccggctgaactggacaaaagcgaactatctgcgggctgaaactatcaccagcgctaatgccagactggttgattttcaggcaacgctgccactggcacagatatggggtggaggagaagtggcatctgcagatggaatgcgctttgttacgccagtcagaacaatcaatgccggaccgaaccgcaaatactttggtaataacagagggatcacctggtacaactttgtgtccgatcagtattccggctttcatggcatcgttataccggggacgctgagggactctatctttgtgctggaaggtcttctggaacaggagaccgggctgaatccaaccgaaattatgaccgatacagcaggtgccagcgaacttgtctttggccttttctggctgctgggataccagttttctccacgcctggctgatgccggtgcttcggttttctggcgaatggaccatgatgccgactatggcgtgctgaatgatattgccagagggcaatcagatccccgaaaaatagtccttcagtgggacgaaatgatccggaccgctggctccctgaagctgggcaaagtacaggtttcagtgctggtccgttcattgctgaaaagtgaacgtccttccggactgactcaggcaatcattgaagtggggcgcatcaacaaaacgctgtatctgcttaattatattgatgatgaagattaccgccggcgcattctgacccagcttaatcggggagaaagtcgccatgccgttgccagagccatctgtcacggtcaaaaaggtgagataagaaaacgatataccgacggtcaggaagatcaactgggcacactggggctggtcactaacgccgtcgtgttatggaacactatttatatgcaggcagccctggatcatctccgggcgcagggtgaaacactgaatgatgaagatatcgcacgcctctccccgctttgccacggacatatcaatatgctcggccattattccttcacgctggcagaactggtgaccaaaggacatctgagaccattaaaagaggcgtcagaggcagaaaacgttgcttaa

SEQ ID NO: 897 - DNA, 639 bp, H. influenzae strain 86-028NP
atgagttgtccgatattcgatttaaggtacatttttatgcgactttttggttacgctcgggtctcaaccagtcagcagtctcttgatcttcaggtcagagcactcaaagacgcaggtgtgaaagcaaaccgtatatttaccgataaggcatccggcagttcaacagaccgggaagggctggatttgctgaggatgaaggtggaggaaggtgatgtcattctggttaagaagctcgaccgtcttggccgcgacactgccgatatgatccaactgataaaggaatttgacgctcagggcgtggcagtccggttcattgatgacgggatcagtaccgacggtgatatggggcaaatggtggtcaccatcctgtcggctgtggcacaggctgaacgccggaggatcctagaacgcacgaatgagggccgacaggaagcaaagctgaaaggaatcaaatttggccgcaggcgtaccgtggacaggaacgtcgtgctgacgcttcatcagaagggcactggtgcaacggaaattgctcatcagctcagtattgcccgctccacggtttataaaattcttgaagacgaaagggctaattttactgatttatctatcccctcaatgtaccttaacactgcaatataa

SEQ ID NO: 898 - DNA, 180 bp, H. influenzae strain 86-028NP
atgaaagctcgttttaaagaatggcttattagtttaaatgaaatagcaatgaatgaattaggaattgatgaaatgcttactcatcttgatgatgaactgaacatcattaacggaaatgaatgtgaacaggagattttaaataatttaatacaaatctttaaaaatagtgaataccactaa

SEQ ID NO: 899 - DNA, 408 bp, H. influenzae strain 86-028NP
atgaaaaaattactcactattggagcggtagctatgtttgcaacgccagcttttgcagctaataatattttttcttgtacagcagagaacggaagcccggtgtctgtaacaaaaaatggttcagattatgaattcacttatggccaggtttcttttaaaaatccggtaaaacaagtttttgctaatcaggattcttatgtagctactggttcaggatttattactagctcattagaaatgagaaataatggcacaagttacacgattcaatttgtgcaaccacacaatagtaacagtattgaagagccaatgctttatatcaccaatggcagtaaaatggatacggtgagctgtaaagcgggtagtgcaactcaaaactttgaacgtcgcagtatgaaagcttcataa

SEQ ID NO: 900 - DNA, 2001 bp, H. influenzae strain 86-028NP
atgaaattaaatcatgcactgaaagcatcttatattgctatatcgtgcgcaatcttatcctcaaccatgccagtatcagcttctaatagtaatccgtttggatttaataaagccgattctattttgtctgatatggtgttttatcaaattgggggcggtgtaggttatatggctcccccgagtcgaggtacgattcctgcagctgaatttgggattggttggaaagctaacttgatgtgcggtaattttgacattaagacgagtattaaaaatcagttaaatggtttaactgaaggatttaaagatctttatagtaacgttatcgaatcagccacaggagctgtggcgagtttacctgcaatggttattcaacgagcaaatcctcagttatacgatattcttacgaatggtttatatcaaggtaaaattgattttaatagcttaaaaaccagctgtgaagaaatgtctaagaagcttgcagacgcaactttaaatggtcgttggtctcaaagttcggatatggaatcctttaaagacattacttcaactgaaccagatgctactcgagctaaaaagagacttgaggaatctcaaggtaaggaaggtaaagagtgggtcgggggtaaaaaacgcggtggccaaggacaagaaccaatcaaaattgttgaggatgttgcaaaagctggctacaacatgcaaaacaagcgtaatgtattagaatcaggtcgaatctccggtagtagttgtagcggattactttgtcaaacttgggataatcctaaagatatgacagattggttaacgaatgtgatcggtgagaagcaattaactacttgtaaaacagattgtggtactgctagtagctctcgagctggtgttggtttaacacctgaaattgaaaaagaaaatattaagacggtaactcaattacaaaaagcgcttaacatgagcactccttccgttgaagtacttgcagaattaagttctacaacagttcctgtaactcgtggcttaattgagtctttacgagaagatcccgatgctcaagtattagggcagcgtttagccagtgaaattgctgtagctaaaacaatggagaaaatgcttcttgcacgtcgagctgttttaacgggtatgcgtgagccaaatgtggccaacaataaagatgctcaagaagagttagaaaagatcctcactttaattgaccgagaaataggtcaaattagaatggagattgatctacaaaaatcacttaccgggaattccgcagttgcaatcctacaaaataaagagctacgtgaatataacactggaaccggaaatgttacacgtgacagtgtagataaacggattagcgatttagctaatggtacgaatagcaatgctgctgaattggcagatgctgacaatatcaatattcctcgtaacaatgtcactttagaagtgcctcagatgtcaaactccctgtcttacaccgggactggcggtacatccggaaatagtagaggtaacacttcttattcatcagttccagcaattaaagggactgcacttgatcaagctacagggttgttgaaaaaatttgaagggtttagtgataaagcatattgggatgtcaatgcttatcgcactggatatggttcagatactatcacaaaagcggatggtacaattgtcaaagtaacgaaagatactgtagttagtcgcgctgacgcagagcgtgatttagcacgtcgaacacaagaatttgcaaatagagcgagaaataacgtatcatcttcaacatgggataagttaccgccaaatgcccaagccgcattaacatcttatgcctataactatggctcattaacaaaagatgtgattgctgcagcccaggcatctgcgcaatcaggcgatatgaacgcactagcaaatgcagtaagaaatcgtcaaaacaataataatggtgtaaatgctaaacgtcgtaaccaagaagcagattacattttaggaaaataa

SEQ ID NO: 901 - DNA, 942 bp, H. influenzae strain 86-028NP
atgaaattgaaaaaaatgacattatccgggctttgtattgcaattgcgttgaccagtatttcaggacaagcttcggagtccggtcaatcttctttaaacactgcatcgattatggcatcaagcgcttcgacaagttgtttagattataaggtcgttggtacttgtttttggctattttgtacaaaattcggctgtaaaatccggacatctacgaaaataaaacactatattcccgaggtagtggtttcaagttataaccatcaggctcaaaatccttgggtggaaatgaatttccttagcaatggggtaaaaggtggagattatcaatcaccacacaaagactatacgcaagcaacatttaaaaatgttgatgtaatcggtcatccgcagggagcgattagtcaaatgcttaatagtacagggtattactgcaaaagtcagacaacgccttttgtgccttattacttgagtggtttggactttttagcgtggcgatttggtgttccggaaatggtttatcctgaagcgcttattccaggtatgagagaaattagagcaaatggagacacttggggaaatatttatccacgagcgggtacagtaacacaagttcatgactataaagcttcagctgtaacagcgcatcgagtagcggatgttgtgacaaatactttccaaccacatgtatatataccgattgcgaaaaaagataatcaatcgaatggtgagtggtttccccctccagtgaaagaaggggatgaaaagacacataaatggcaacagcttcacccggttacttcacagtcttgtgctattttccctgataacccgccaagtatgctatctgaaaatggtagttatgcctgggcattatggcgcccttacaagtgctgtaaaaaacgcggacaaacatttttgtatagtattgattggtctaattaa

SEQ ID NO: 902 - DNA, 444 bp, H. influenzae strain 86-028NP
atggttatgtctataaaaaaatcactgtttcttttcggtttgttaccactatcagtgttcgcccaggggcctaatcccataattactgtttattcaacacaagattatccaattcttcacgcagagcttgcaagccaggtgtatttacttgatcaagttgagcaatgggaaaatttgattagtcagcgattgagtgcgaatcctagtgtagcagctcagcaagcatctcagatttttcagtctgctgaatggaaacagtctgaagagcaattaaagcgttcttatcagggccttataagtggttggcaaaatggaatcaagaaggtgcctgcagttttatttcaatatccgggaaaagaggatagtgtcatatatggtgaaaccaatattgctcaggcattaagtttatggcaacgagagattacaaaagaggggacaagatga

SEQ ID NO: 903 - DNA, 420 bp, H. influenzae strain 86-028NP
atgattcccttcgggcatgtcatttttccaaggaattttttatttcacattaggagaatgactatgtcctcatccactcaattggaacactatgatgttccatcaagtaaccctcttgaaactccaacattttcatttcgtgtgggaaaacacttgggccgttttttcgttgcagctaaaaacaaagcaaccgataaatacaaacaagtgacatctggtatcaatcaaagcattgaagacgaagaagctcgtcggctttgcgaattacaaatgatgctagatagccaagcggaagaatatgaggcaattattgatgatgtgcaaagaacgtggttaaaacgaacaacgttatttagcattttatttttgattgtcggtattgttggtacagtgggtactctttactaccttatgcattaa

SEQ ID NO: 904 - DNA, 234 bp, H. influenzae strain 86-028NP
atgaaagtgacattacataacagttgtttagcttatttagccaaacataatgactcagaatctctaatagaggaagttcgcactcaagcattaaatgcctgggaaaatcgaggaaaagatgtatcttctactcgtattatggtgaatatccctagtcaatacggacagaaatatcacttctttacagtttcgccatacgcaaaccgtaaagatttgttaagtgtaagggggtaa

SEQ ID NO: 905 - DNA, 249 bp, H. influenzae strain 86-028NP
atgattaagcgtttactcaagcttgttagttccaattgggacaaaaaaacaatgctgctggtttctgaagattttcgtaaaatcggcacttacatcttaggtattgcgtttgtcgcaatgtttgttcagaatgacaatattccgctacttcttgccattatcattatgatatttggcggaatagcttggttctgtggtgtgttgttagctaaatattgcaacaacttaatggagacagacggagcgtaa

SEQ ID NO: 906 - DNA, 159 bp, H. influenzae strain 86-028NP
atgaatattacgttaaactggaatgggttcctctttgcaattgtctttgtactgttttttatgggaacagttgcttttattggtgtgcgatcattaaaacgtcaacaagagcaaaaagcacaaagcaaaaaaacacattccattggtgttaattcataa

SEQ ID NO: 907 - DNA, 954 bp, H. influenzae strain 86-028NP
atgaaaaaaagaactcaacctgccaaagatttataccaacaaattacagaccaaattctcgaagcattagaacaaggtgtgatgccatggcaaaaaccttgggatagtggatggccacaaatggctattccatgcaacggtgaaagtggtcgtcaatactccgggatcaacgtacttctgctttggatgagcgctattagaaaaaactttactcaacgcaagtgggtaacttttcaaggagcaaatcatctaggtggccaagtccgaacaggtgagaaaagtacagttattattttctataaacaaaatatgtttgaagaaaaagacgatagcggaaacattgtacttgatgaaaacggtgatccgaaaatgaagtcatctgtatttattcgtggtcatcacgtgtttaatattgaacagtgtgaaggcttagaaaaatactatgaagaatatcctgaaccagaaaaatcttctgaaatgcaagctcgtccggatttagatgtattacccaataaaatgggtatgcagctgtataacaaagcacaagatcgtgcttgttatatgccgagaaaagattgcattgtgatgccggatttcaaaaaattcaatacagctgatgactactatgcaactctactgcatgaatgcggtcacgccaccgggcataaagaccggttaaatcgtgacggtgtagctaaatttgataaatttggttctgaacaatatgcatttgaagaattaatagctgaactcacaagcgcctttacctgtgcgcacgtgaatgtttgcaataatatttcacaaaatgcagcgtatattgaacattggattaacgcattaaaagccgataaaaaagctattttccgagcatcttctcaagcacgtgaagcaacacaattcttgttaaatgctctcgaattaacatcgaatgaagaagcaaaattagcggcttag

SEQ ID NO: 908 - DNA, 762 bp, H. influenzae strain 86-028NP
atggatttcgagaaaaaatttaccgcactttttaaatcgatagcaccacaatatcgacgctcagaagtgttttacgactttattacaatctttgccctggaattctatctcattatatatggtgcacaagcagatgaatcgttgagacaacgttatcagacagctggcgagcattataatgaagatgaaaaacaagctctcagtcgccttttcaacattattgttgaggctttggagcataaaacctatgatttcctaggatcagtgttcatgtcgttggatttaggtgatcaatataaagctcaatatttcacacctagtcacattgcacacttaatggcagccgtaactctatcagattgtcatagtttaattaaaaaacgtggctttttgacattgcaagagccaacttgtgggtcaggcgtaatgattattgaggcttataattatttgcgtgaagaggactttaaccctcagcaacaaatgtgggctcaagcaagagatttggattttactgcagcattaatgtgttatatacaaatgacactcttgcatataccgggagaagtcattattggtaacacccttaaagatgaggtgaattaccatttatacacacctgctcacataatgggaaattggaacaaaaaattggagagtgcagattcctatactgaagcagaatatcaagttattgaacctgaaccagtagaagaacccccgcttgacattgattgggaaaatgagccaatgttttactaa

SEQ ID NO: 909 - DNA, 567 bp, H. influenzae strain 86-028NP
atgtactatgtaacaaacgatcttgcgattgacaaaaatacttatactagacttgatttaggcgatgatgacgtgattttatgcgcaggcagacaagctgatgatgcagatacaatcattatattttttgagacaaacgcagaccctatttatatcggttgggctagtgtggacaccggtgatgtagagattacttatgatgattgggataattactttgccggtatcagacaagatgatgttattgacgagattaatatcctattagatggcattaaaatttatgacaatatgacaggccattttccgatttacgcgaatgatcacaacaacgttgtcggtgagcataaagtttactttaaaactgatgaggcatatcctgatccaagcattgataatgcaaatagagaggatggatatgtaacttataaggcgggcgctattactgaaatgggtcgtaaatgttatgtttattgggattttgttgcgtatgatgatgacggaaacgagattgattctgattattttgattatcagaacactgattgcattatcaaatattattaa

SEQ ID NO: 910 - DNA, 375 bp, H. influenzae strain 86-028NP
atggcaaaaacagcagtacacctatcaaaaaccgcattgcaatatgtgacagaccgtacaccacagggtgaacaaaaaggattgtcggctcatattaataatgcatttgagcagttagcacatttgacgcgcgcagaaaagccggaactatcaaaatcggagtgggttgagttatacaatgtctatgcgggcagtgatttaactcgacttgtaatgccgtttgatttggcagatgacttacgcacacactacggcactttaccgcaagatttgaccgcactttacaacaaattagcggggatgacacaggcgcaacaatttgctgtgcttgatgccgtccgagtgtattgggcgagcggcgaagatgggaattaa

SEQ ID NO: 911 - DNA, 678 bp, H. influenzae strain 86-028NP
atgggaattaaaaacaagccgataacaagaccatgcccgcagtgcggcagaaattatcaatatcggcgggcaagtgggcgtacttttgagctttgcgaatattgtcgcaatcttgattgtgtagtttgtggtaaaaaagtaccgccggaacgtgggcggaaaaatacttgctgtgcggagtgcgaaaaattgaagatacacaatatccaaaatgcgcactacgccaaacggatagcggaagaccctgagttaaataaacgcaaccacgccaaagcccgcgaaaaccgaaaagcagacccggaacgaatgcacgaacatttggaagcacaaagggaaaggcattatagacgtgtgcaagatccgaattatctagccactcggaaagtttatcaggctcaacgatggcaggataaaaaagatgagatactggctcaacggcgcgaattttgggatagtttaagcgatgttgagaaagcggagcgacttgagcgcaatcaagcaatacaacgtaaacataaagccaaaaaacgtgaccagttgaaattagatccgcaaaagtgggcggaatatcaagagtatcaacgcacaaagcggcgcgaacatagacagagaaaggcgcttaatgaattaatggtcggcacaaaggagttattaaatgttaccaacaaagacaaatag

SEQ ID NO: 912 - DNA, 618 bp, H. influenzae strain 86-028NP
atgttaccaacaaagacaaatagttttgatattgtcgccgttaaaagcatgacaatccaagatttaaaggcggaattagccaaaacactaagcattacggcggaatatctcatgtatattgcggcaatatggcgggagttagagtcgcgtggagaggacttgagcgagttacgccatggcgtgatgacttatatcccgttaatcgcaacaaatcaacttgacgcgcggcttgttgtcaattatgccgggcaaaaaacgctgttatccagcatggcaaaattaccattaagagagcaacaaaaactggccgaaaaaggcactttggatgttgttattttgggtgacgataatcaacagctaattaaagaagttaaaatatccgacctcacagcagcccaagtttatcaaaccatcggtgatggcaaaataaaaacaccagaacagcagtatcaaatcctgttagtccgcaataaagtgcggtcaaaatcaaagccgaaaaagacttaccgactaacgcaaaatttaaaaatagatggtaaaaatttagtgattgccggaaaacatgcggtatccattgagattttgaaaaaatatttagaggataacaatgagctatag

SEQ ID NO: 913 - DNA, 600 bp, H. influenzae strain 86-028NP
atggcattaataggatttgctcgagtatcaactcaacagcaggatctaagtgaacagattcaagtattaaaagaatacggctgtaagaaaattttttcagggaagcattccggtaaagctgagaaaaataaagcacaattggatgaactactggattatgtccgagagggtgatgttgttgcagtaactaagcttgaccgcctaggaaggagccttgctcagtgtttgaatacacttgaactatttaagaataaaaatattggttttgttgcaatacaacaaggaatagatacccgaacccaaaacaatcctatggggatggccttaattcaattgttaggtatttttgctgaattggaaagaagttttattgtcgagcgtactcaggaagggaagcgaacaaaacttgcttcaggtcataaaaatgcattaggcggccgcccacctaaagtgacagataaaatacgtaaaaagatttatgcggattttaaagctggtgattctatttcaacagtaatgaaacgatatgatttatctaaatcaacggtggcgagactaaaaggtatttataatagggaaaatttaatgtctgaagagtag

SEQ ID NO: 914 - DNA, 192 bp, H. influenzae strain 86-028NP
atggactatgattatcaaaaaggctttgaagaaggttatagaatgattatgggagcatccgcattgctacctttagcacctattcaaccattgacgccgcttggaagcactccatttagagagggtttaaaagctggtataaatttagctaaaagaaataaccaacagtcatttaataacatttttaaataa

SEQ ID NO: 915 - DNA, 255 bp, H. influenzae strain 86-028NP
ttgaacaaaggagtatttatgaaaggctatgaaattgaacttgaggacaaaggacaggatttcacaaagttaagaacggatgaacaaggtatagtgatagcagccgaaccatatcaaacagatgtatggaaaggggctttaattcctatttctcaacaaaaaataggtgatttatgtatgattcatcatttaccgcatattgaatatggttatctgaaatacaaagtgttagccattaaagagattaactattaa

SEQ ID NO: 916 - DNA, 714 bp, H. influenzae strain 86-028NP
atgaatttaagtattactaattttatcacatctttttctagagagcggatttctgtttatcaaaactacattcattcttctgaacctaatctatctcctgctgatattagcttgaaatcactaaaattatatttgtggaatattcagatttcatcagcactttttgaagtaataaacttatatgaagttacgttaagaaacaaaatctttgctgtagtgaatagtgaatttagcgattcaattaatgattactacttcaagaagcgcttaagctccttctttagagataagttgaatgaattgggagcttcaactatcagtgcaccaatgatcgtatctagattaaacttcgctttttggaccgaagtattgaataaacatttctattattctggtagtgtaggtaagtctgggcatccactataccctcgcttatataatttcaatagttccttgttttcaataaataggaagctaactagagaagattataacaagctaacccaaaaactaatcaaaattaatgatgaggtgaatgaattaagaaatagaatttgtcatcacgagcctattttcaagtctaaactaagagctatttatataaagatgctatttgttctcagatgtttggatacgaatgtctataaattggcaaaagaaattgaacgcgtaaataaattactaaaaaaatttgaagatgagataaatccctaa

SEQ ID NO: 917 - DNA, 1254 bp, H. influenzae strain 86-028NP
atggttataagtacaggattaaaatgtgagttatgcggacatcgctacagaataagggttggagttgggtttgattcttatcagaaacactattttgattgttctaattgcaatattaatatagtctttgctataaggactaagcctccaagagctgatgtagaagccgtagaaaattgctctcttttttcgggagagcctaatattgaactcgaagtcttaaattttcacccaaattgtgcatttaataaacatgatttacataatcctttttgttttcctacattaatttcggggcctctaataattccacatatgaggtatataccaggtagaatgcaaagttttgataatcaatttgatataccaaatgcaccacacaaatggtctttgattaaaggaatgataactaatatccaagataacaaaaaagcttcaaattttgttttgcaatacactaaacatagaaacaaggatatgaacccatcatcatctaattttatgcgcgataaagaaattatagtttataaatcaggtagtgtttatagtgaatttcatatcattcatgaattttttgattcccttttttaccctatgttagaaaacattgtagaaccgataattaatacgattaaaaatattcctgaaagcaagctttctagttttattaggtattggcagagtgagttaaaacaagaaaatcaatatcgctatttaaatacattctctgaatattttcgccatagagatcacttcggtcaaatagtaatgtattctagaatcggacataatgttgatgatttaatagtgtcatctaatgggtttgagcagataaagctatattatggagatgcctatgaagcgctaacttcaaatatgactattattgcttgtttgaataatatcatggacggtagagagtttgatgaatttaagtcaatgaagctatcaaaatacctagaaataaataaagcaaataaatcaaatccatttaaattaactcctatattttcggtctttgcagaaaatgatattgaatcttctattcgaaatggttctcatcatgcgtcaatatggcgtgatggtgaaaaaataatgtataaaagtggagggactggagctgaacattgcattccatacactcgatatctggattattgtaacaggttgaccattaaattagccgctttatttataatagaatgctaccttagtgaatacgttaatgattcaaaaagttttgtagtaaattaa

SEQ ID NO: 918 - DNA, 1917 bp, H. influenzae strain 86-028NP
atgggttatttttttatgttttcatcaattttttatcgattaaaagggaaaaaacaagattcctttactattccagttctagattcccataaccattcaatgtcaaagattgatagtgagggatggataactccgttctctgcgtcagaattactcaattctgaattacgccaaaaatacttaaatttactttggcaacaagtatcaatgacgcaagatatgtttaatgagctctataaaaaacctatcgagcgctacgctgaaatggttcaattactacctgcctcagaatcacatcatcactcacatttaggtggtatgcttgatcatggcctagaagttctttcatttgcagctaaattacgacaaagttatgtattgccacaaaatgctgctccggaagaacaatctaagcaacgtgatgcttggactgctgctgttatttatgctgcattggttcatgacattggtaaagttattgttgatatagatatacaattaaaagatggttctcgttggtttccttggttaggagtgccaactcaaccttataaattcaaatatattaaagggcgagattatgatcttcacccggttatgggtagttttcttgcaaactatttaattcctaaagaagcatttgcatggttagcagaatacccggaagctttttcagctttaatgtatgccatggctgatcataaagataaagctggtttattatctgaaatagtacaaaaagcagaccaaaacagtgtaactcttgcactaggtggagacgtatcaaaactgactcagaaacctataacatcatttgcaaaacagctagtcatggctttacgtcatttactgcaacataaatttaaaattaatacacctaaaggcccatctgatggttggcttacagaggatgcgctatggttaatgagcaaacccactgcagaccaaattcgagcttatttattggagcaagggatatcagctccagcagacaatcctaaattatttagtgaaatgcaatcgctggggattattgaaagtacaaatgatggtacagcaatttggcattgtcgaattaaagctgattcaggctggtgcccacctaaagcattttctttactcagaattaaaccggaagtagcttgggaaaatcttaatgacagacctggtatatttttaggtcgagtcgatattgaaaatgaagaacaattaaattcaggtgaagatactaaagaagaaaattcagtgattatggaatctgaaatgccacttcctgcaataacaggtacactgaataaaccggatttatctgaaaatacatcctctcaaaacactcaaatcaatacccaaaactcagaaaccgagacggatatgactgatttggtaatgaatttattttcacctgtagaagaatctcaagactctactgataaaaaaccatctcaagaaagtgaaataaataaaatcgcctctaccccatctatagcaacggatgatgatacaaaggaaactgaggctgtctcaggagagatttttgttgaatggctaaaatctggaattatcgggaataccctaactattaataattcaaatgctaaattacatatagtcaaaggcaaacttttccttgtaacacctggaatctttcagctatttttcaatagtaagggcattactaactttactaaaaaagatatcgaaaatttgcaatatagtttccaagaccttaaattacacaagaaataccgtcaatcaaacaatgatagtattaatttttggcgctgtaaggttattggcccaagaagaacctctcaattgattgggtatttgattgataaaaccgactattttttcggtaatagaattccaattgataatttgcatttatcacttattgaggaaaatgaaagtgaatag

SEQ ID NO: 919 - DNA, 843 bp, H. influenzae strain 86-028NP
attaaaagctatgaaaaagcaattagacaattacagaaaaattgtagtattcaatatcctgatgaaatatcagactcattaatactccaatggagaaagagagttgttggacaatctatcattgaagtgacttggaacagctatattcgtcagctaaagactattttcaaatttggaattgaaaaacaactcctcccatttacaaagaaccctttcgatggtttgttcattagagaaggaaagaagaaaaggaaagtatatacttcttcagatttaaaaaaacttagctttggaattactgaatcaaagcatcttccttctattcttcgcccattatggtttactaaaactataattatgactttccgctatacggcaattcgacgctctcagttaaataaattaagaattaaagatgtagatttgctaaatcaagttattcatattccatctgagataaataaaaatcacgagtatcatatacttcctatatcaactacactttatccttatctaaagaaattattaactgaactaagtaaattgaatcagcctgtagaatctcaactatttaacattaatttattttcaaatgcagttaaacgaaagggagagaaaatgaccaatgaccaggtgagctatatcttcaaagttatttcaaaatatacaggaattattagctccccacacagatttaggcatacagcagcaacaaatctaatgaaaaaacctgaaaacctatatatagccaaacaattactaggacataaagatgtcaaagttacattgagttatattgaagataatattgattcaataagagaatatacagaattactttag

SEQ ID NO: 920 - DNA, 1278 bp, H. influenzae strain 86-028NP
atgaatttatacaatatcaaacacccagaagaacaagtcactttttctcaggctgttcgtcaaggtcttgggtgggatcaaggtctattctttccagaagttattcctaaacttaataacattaatgaattacttgaattgcctcttgttgagcgtagtcaaaaaattctaggtgcattaattgatggcgagttaccacaagcaacgttagatgcaatggtaaaaaatgcgtttactttcactgcaccgttagaaaaagtggaagataatatttatgcacttgaattatttcacggtccaacgctagcatttaaagattttggtgggcgttttatggcacaggcacttgctgcggtacgtggcgatggcaaaattactattttaacggcaacctcaggcgatactggagccgctgtagcacatgcgttttatggattagaaaatattaatgtagttatcctttatccaaaaggcaaaattagcccattacaagaaaagctattctgtactttaggtgggaatattcgtactgttgcgattaacgctgatttcgatgcgtgtcaggctttggttaagcaagcctttgatgatgttgaattgcgccaagctatcgggctgaactctgcaaattctattaatatcagccgtttattagctcaagtttgttattactttgaggctgtcgcacaattgccaaaagaaaaacgtgataatgtcgtggtttctgtgccaagtggtaattttggtaacttaacggcgggattaattgcaaaaaccttaggcttgccgataaaacgctttgtcgcctcaacaaacgcaaatgatactgtgccacgttatttgaaatcgggtaattgggatcctaaaacgacagttgcaaccctttctaatgcaatggatgtaagtcgcccaaacaattggccgagagtggaagaattgtttaaacgaaatggttgggatttaactgatttaggttcggggatgctaagtgatagcgaaacagaagataccttaaaagcgatgcagtcgaaaggttatttatgtgaacctcacggtgcgatagcttatcaggtgttgaaagagcaacttaaagcgagtgaaacaggaatcttcttgtgtacggcgcatcctgcgaaatttaaagaatccgtagaacgtattcttggtattcagcttccattacctgaaacactggataaacataatcagctaccattgctttcagatgaaatggataatgattttgcacaactacgggcttacttattgaagtcataa

SEQ ID NO: 921 - DNA, 945 bp, H. influenzae strain 86-028NP
atgttaagaatttacgctcctgcatctagcgcgaatattagcgtaggtttcgatactttaggtgctgcgatctctcctattgatggttctttgttaggcgatgtggttcaaatagaatctatttcaagtggttttgagttagaaagtgcgggctattttgttcgtaaattaccgaaagaaccacaaaaaaatattgtttaccaagcttatgtgctatttagcgagcaattaaaattacgcggagcaaatgttaaacctttacgtttaacgctcgaaaaaaatatgcctattggctctggtttaggctctagtgcttgttctattgttgctgcattagtggcattaaatcagtttcataatgaacctttttcgaaaatggaattgcttgaaatgatgggagaattggaaggtcgtatttctggttcaatccattatgataacgtcgcaccttgctatcttggcggtgtgcaatttatggtgcaatcgctcggcaatatttgtcaaaaattgccattttttgataattggtattgggtgttagcctatccagggattgaagtttctactgctgaagctcgtgcaattttaccgaaaagctatactcgacaaaacgtgattgcccatggtcgtcatttaggtggctttgtgcatgcttgccatacccatcaggaaaatcttgccgcgattatgatgaaagatgtcattgccgagccttatcgtgaatctctgttacctaattttgctgaagtaaaacaagctactcgagacttaggcgcacttgccacaggtatttcaggctcagggccaactattttctctattgcccctgatttacaaactgcaattaaactttcaagttatttagaaagccattatttacaaaataatgaaggttttgtgcatgtatgtaaagttgataacgaaggcacaagagaaattaaataa

SEQ ID NO: 922 - DNA, 2448 bp, H. influenzae strain 86-028NP
atgcgcgtacttaaatttggcggcacttcgcttgcaaatccggaacgtttttcccaagcggcgaaattgatcgaacaagctcatttagaagagcaggctgcaggtgttttatctgcaccagccaaaataaccaaccatctcgtcgccctttctgaaaaagctgcattaaatcaatcaaccgatacgcatttcaacgaagcaatcgaaattttctataacatcatcaatggcttacatgccgaaaataatcaattcgacttaaatggcaccaaggcacttattgatgctgaatttgctcaaatcaaaggattattagaagaaattcgtcaggcaggaaaagtagaagatgcagttaaagcgaccattgattgccgtggggaaaaactttctattgcaatgatgaaagcttggtttgaagcgcgtggctatagcgtacatattgtggatcctgtcaaacaattattggcaaaaggcggttatcttgaatcttctgttgaaattgaagaatcaacaaaacgtgttgatgcagcaaatatcgcaaaagataaagtggtgctgatggcaggttttactgcgggtaatgaaaaaggcgagttggtattgctcggtcgtaatggctcagactattctgccgcctgtttagccgcttgtttaggcgcaagtgtatgcgaaatttggaccgatgtggacggcgtttatacttgcgatccgcgtttagtgcctgatgcacgtttattaccaacgctttcttatcgtgaagcgatggaactctcttatttcggtgcgaaagtgattcatcctcgtacgattgggccattgttgccacaaaatattccttgtgtcattaaaaatacaggaaatccttctgcgccaggttcgattattgatggcaatgtgaaatcagaaagtttgcaagttaaaggtatcactaacttagacaatttggcgatgtttaatgtgtcaggccccggtatgcaaggtatggtaggcatggcatctcgcgtattttcagccatgtcaggcgcaggcatttcagttattttaattactcagtcttcgtctgaatatagtattagtttctgtgtgcctgtgaaatctgcagaagtagcgaaaaccgtactagaaacggagtttgctaatgaattaaatgaacatcaattagaatcaattgaagtgattaaagatttatccattatttctgttgtgggcgatggaatgaagcaagcgaaaggcattgctgctcgtttcttctcggcattagcgcaggcaaacattagcattgtggcgattgcacaaggatctagcgaacgttcaatttctgcggttgtgccgcaaaataaagccattgaagcggtgaaggctacccatcaggcgcttttcaataataaaaaagtcgtggatatgtttttagtgggcgttggtggagtaggcggagaattaatagagcaggtaaagcgtcaaaaggagtatctagcaaagaagaatgttgaaattcgagtttgtgctattgcgaattccaaccgtatgttgcttgatgaaaatggattaaatttagaggattggaaaaacgatttagaaaatgcgactcagccatcagattttgatgtattgctttctttcattaaattacatcatgtggtgaatccagtatttgtagattgtacttcagccgaatctgtagcagggctttatgctcgtgcgttaaaagaaggtttccatgtggttacgccaaacaaaaaagcgaatacacgagaattagtttattacaatgagttacgccaaaatgcccaagcaagccagcataaatttttatatgaaaccaatgtaggtgcgggcttgccagttattgaaaatctccaaaacttacttgcagcaggtgatgagcttgaatattttgaagggattttatctggctcgctttcctttatttttggtaagttggaagaaggactttctctttcagaagtaaccgcacttgcgcgtgaaaaaggctttactgagccagatcctcgagatgatctttctggacaagatgtagcgcgcaaattattaattcttgctcgtgaagcgggaattgaacttgaactttcagatgttgaagttgaaggtgtattgccgaaaggcttctctgaaggaaaatctgcagatgagtttatggcaatgttgccacagcttgacaaggagtttaaaactcgcgttgccacagctaaagcagaaggcaaagtattgcgttatgttggaaaaattagtgaaggaaaatgcaaagtatccatcgttgcggtagatctgaataatccactttataaagtgaaagatggtgaaaatgccttggcattttatactcgttattatcaaccgattccacttttattacgtggttatggcgcaggtaatgcagttactgcggcaggtatctttgcagatattttaagaacattacaacattaa

SEQ ID NO: 923 - DNA, 714 bp, H. influenzae strain 86-028NP
atgaatatccagcataatctcaacctaattcagcaaaaaattgaaacggcttgtaaagaagaaaatcgcaatcaaaataccgtaaaattacttgccgtatctaagaccaaacctatttccgagattctttcagcttatcaagcgggacaaacggcttttggggaaaattacgtgcaagagggggtagaaaagatccaatattttgaatcgcaaggagttaaccttgaatggcattttatcggcccattacaatcgaataaaacccgtctcgttgcagaacattttgattggatgcaaacgcttgatcgagcaaaaattgcagatcgtttaaatgaacaacgaccgaccaacaaggctccattgaatgtattaattcagattaatatcagcgatgaagaaagtaaatcaggtattcaacctgaggaaatgctaacactagcaaaacacatcgaaaatttaccgcacttatgcctacgtggcttaatggcaatacccgcaccaaccgataaaatcgctgaacaagaagccgtgttcagaaaaatgtcagacctatttgaacaactgaaacaagccttacccaatcaacaaattgatacactttctatgggaatgacggatgatatgccgagcgcaataaaatgcggttctacaatggtacgcattggcactgcgatttttggtgcgagaaattattcaacatcacaaaataaataa

SEQ ID NO: 924 - DNA, 1137 bp, H. influenzae strain 86-028NP
atgaaatttgtgattgcacctgattcttttaaagaaagtttgaccgcacttgaagtcgctaccgccattgaaacaggcttcaaacgtgtattccccgatgcggactatgtaaaattgccaatggcagatgggggcgaaggtacagttcaatcccttgtggatgccacgcaaggcaagctcattgaatgtgaagtcaccgcgcctttgggtgacaaagtgaaaagtttcttcggtttatcgggagatggaaaaaccgcgattatcgaaatggcagcagcttctggtttacatcttgttccgcctgaaaaacgcaatcccttgcttaccaccagttacggcacaggggagttgattaaattggcattagatttaggcgtagagagtttcattcttggcattggcggtagcgcaaccaacgatggtggtgtaggaatgttgcaagctctagggatgcaatgtttagattcgcaagataagcctatcggttttggtggagcagagctagcaaatattgtgaagattgacgttcaacaattagatccacgtttgcaacaagttcacattgaagtagcgtgcgatgtgaataatccgctctgtggtgaatgtggtgcatctgccatttttggaccacaaaaaggcgcaacgcctgaaatggtgaaacaacttgatgctgcactttcgcattttgctgaaattgccgaacgcgattgcggtaaacaaattcgtgatcaggctggcgcaggtgctgctggtggtatgggtggtggcttgctattattaccaagcgtacaactgaaagcaggcatacaaattgtgttagagcggttacatttaattgaccatgtaaaagatgctgatgtagtgattacgggtgaagggcgaatagatgcacaaagtattatgggtaaaacgccaattggtgtggcacgtacggcaaaacagttcaataagccagtgatcgccatcgcagggtgtttgcgtgaagattatgatgtggtgtttgatcacggtattgatgcggtgttccctattattcaccaacttggcgatttatcggatattctcaaacaaggcgaacaaaatttaatttctaccgctcaaaatgtggcgagagtactggcatttaaatttcattaa

SEQ ID NO: 925 - DNA, 1260 bp, H. influenzae strain 86-028NP
atgacaacagtctcagcaataggtgcgttggtggcgttaatcgttgctatcttcctcattttgaaaaaagtctcaccagcttatggtatgttggtgggagctttggttggagggttaattggtggtgcggatttatcgcaaacagtgagcctaatgatcggtggcgcacagggtattactactgcagttatgcgtatcttagctgctggtgtgttggcaggcgtgctgattgaatcgggtgcagcaaattccatcgcggaaaccattactaataaattgggtgaaactcgagctttactcgccttggcactagcgacgatgattttaactgcggtgggtgtgttcgtggatgtggcagtgattactgtttcaccaattgctttagcgttatcgcgtcgcagcgatttatcgaaagctgcaattttgctcgccatgattggcggtggtaaagctggtaatattatgtcgccaaacccaaatgccattgcggcagcagatacttttcatttgccactcacttcagtgatgatggctggtataattcccgcgctatttggtttgattctcacctacttcttagcaaaacgcttaatcaacaaaggttctaaagtgactgacaaagaggtaatcgtgcttgaaacgcaaaatttaccttcatttctgaccgcacttgtcgcacctttagtggcaattttgctattggcacttcgtccattgtttgatattaaagttgatccattaattgcattgccgttaggtggtttgattggtgcgctttgtatgggcaaacttcgcaatataaatagttatgctatcaatggattgagtaaaatgacacccgtggcaattatgttacttggtacaggcgcgcttgctggcatcattgctaattctggtttaaaagaagtattgattcaaggtttggaacattcaggtttgccatcatacattcttgcaccaatttcaggggtgttgatgtctttagcgacagcttctaccacggcaggtactgcggtggcatccaatgtgttcagtagtaccttgttagaacttggagttagcagtcttgctggtgcagcaatgattcatgcaggggcgaccgtatttgatcatatgccacatggttctttcttccatgccacaggcggtagtgtgaatatggatatcaaagaacgtttaaaacttattccttatgaaagtgcggtcggtttgatgatgaccatcgtttctaccttaatttttggcgtatttaaattctag

SEQ ID NO: 926 - DNA, 1107 bp, H. influenzae strain 86-028NP
atgcaacttgacaaatacactgccaaaaaaattgttaaacgtgcaatgaagatcattcatcactctgtaaatgtaatggatcacgacggtgtgatcattgcgtcgggaaattcaacgcgtttgaatcaacggcacacaggagcggtgttggcgttgcgggaaaatcgtgtggtagagattgatcaagcgttggcacaaaaatggaattttgaagcgcaaccagggattaatttaccgattcattatttaggcaaaaatattggagtggtggggatttctggtgagccaactcaggtgaaacaatatgccgaactagtgaaaatgaccgcagaacttattgtggaacaacaggctttactcgaacaagaaagctggcatcgtcgttacaaagaagaatttattttgcaattattacattgcaatttgaattggaaaaagatggaacagcaggcgaaatttttttcttttgatttaaataaatctcgtgtggttgtattgattaagttacttaatccagccctggataatttacagcatctgatcaattatttggaacagtctgaatttgcacaggatgtggcaattttgtcccttgatcaggttgtggtcttaaagacttggcaaaactccaccgtactttctgctcaaatgaaaacgcttttacctgcagattattcaaaacaagattataaaattgctgtaggcgcttgtctaaatctaccgctttttgagcagcttcccttgtcttttcaaagtgcgcaaagcacgctttcttatggattaaaacatcatccacgcaagggtatttatgtgtttgatgagcatcgattgcctgtgttacttgctggattatcccattcttggcaagggaacgaattgataaaacccctttctccccttttctcagaagaaaatgcgacactttataaaacccttcaacaatattttttatcaaattgtgatctttatctcactgcggaaaaattatttgttcacccgaatactttgcgttatcgattgaacaaaatagagcaaataactggtttatttttcaataagatagatgataaattaacgctctatctcggaacgttgttagaacattga

SEQ ID NO: 927 - DNA, 321 bp, H. influenzae strain 86-028NP
atgagtgaattacttattaatgactatacaagaaaaggttttgttgatggtctctgtgttcgcctgctcacaatttgtatccgtccaggaaaaccaaataaagcgacttcttcctttgtaagtagcattattcgagaacctttacatggtgaaacttcaatctgcccagttgctgaaaaaatggcgttcagttttatcaaatttctaggtaagaaaaaggaagaatgggcattagccattacgggctatgtcgtgagtattcctattgtcttaccgattttacttattttcatcaaagctattcttgatttggggaaatga

SEQ ID NO: 928 - DNA, 210 bp, H. influenzae strain 86-028NP
ataatttctggtaaatcaccaccaaatacagcaagtgaactagaaaaaataaaacgaattttagtatcagattcatcaaaatatgagaaagtggcgacattccatatttgtccactaacaaattttgatcacataatttgcgacaaaaatcttgttgaatctgcacagaatggcattagagaattaaatattaatttaactatcgtataa

SEQ ID NO: 929 - DNA, 756 bp, H. influenzae strain 86-028NP
atggcaaaagatgaagtagggcataattttcttgcacgtttgggtaaaacgcgtttgcgtccaggcggtaaaaaagcgacagattggttaattgctaatggcgattttagccaagataaaaaagtgttagaggttgcctgtaatatggggacgactgcaattggattggcgaaacaatttggttgtcatattgaaggtgttgatttagatgaaaatgcgttagcaaaagcacaagcaaatattgaagcaaatggcttgcaagaaaaaattcatgtacagcgtgcgaatgcgatgaagttgcctttcgaggatgaaagttttgatattgtcatcaatgaagcgatgctcacaatgttacccgtggaagcgaagaaaaaagccattgcagaatattttcgagtgttaaaacccaatggtttattgcttactcacgatgttatgctggtggggaatgatcatcaaactattctagaaaatatgcgcaaagcgattaatgtgactgtcacgccattaacgaaagatggatggaaaggcatattccaagaaagtggctttagatatgttgatactttctctggtgagatgacattactttctccaaaaggaatgatttatgatgaaggaattttcggtacgttaaaaatcatccgtaatgcgatgaaagcggaaaatcgtgagcaatttaaaagaatgttcaaaacctttaatgatcctgaacataaattacattttattgctgtatgtagccaaaaataa

SEQ ID NO: 930 - DNA, 282 bp, H. influenzae strain 86-028NP
ttggtagaaggcgcaaatcagtatattggtgctggaaatatgtataacggcgacgtagaagatttgaataaaccgcatctttatatgatgtctcaaatggaaaaaccgacaactaaagctgagttgaaatcagcattacaaggctatttaattcaaaatgaatatcaagatatgaataacaatgataaattgattgatgaaacttatgattgcactgagttgtttaatgcactttgtgatgtattaacaagattaggctatatccagcctgtaaacctataa

SEQ ID NO: 931 - DNA, 999 bp, H. influenzae strain 86-028NP
atgcaatttaaacatttcaaacttgctacccttgcggcagcacttgctttttctgctaatagttttgctgatattaccgtttataatggtcagcacaaagaagccgctacggctgtggcaaaagcctttgaacaggaaacaggcattaaagttacgctaaatagcgggaaaagtgagcaacttgcaggtcaattaaaagaagaaggcgataaaacaccagccgatgttttctatactgaacaaacagcgacttttgccgatctttctgaagcagggcttttagcaccaatttcagaacaaaccattcaacaaaccgcacaaaaaggcgtaccacttgcaccgaaaaaagactggattgcattaagtggccgttctcgcgtagtggtttacgatcacactaaattatctgaaaaagatatggaaaaatcagtgcttgattatgcaacaccaaaatggaaaggcaaaatcggttatgtatcaacttctggcgcgttcttagagcaagttgttgcgttaagcaaaatgaaaggggacaaagttgcgcttaattggttaaaaggtttaaaagagaacggaaaactttacgctaaaaatagtgtggcattacaagcggttgaaaatggcgaagtacctgctgcgttaatcaataactattattggtataacctagcaaaagaaaaaggcgtggaaaacctaaaaagccgtctttattttgttcgccaccaagatccaggtgcgttagttagctattcaggtgcagcagtattgaaagcttctaaaaatcaagctgaagcacaaaaatttgttgatttcttagcgagtaaaaaaggtcaagaggcattagtggcagcgcgtgcagaatatccgttacgtgctgatgtggtttcgccatttaatcttgaaccttatgaaaaattagaagcaccagtggtgtccgcaacaacagctcaagataaagaacatgcgatcaaattaattgaagaagctggattgaaataa

SEQ ID NO: 932 - DNA, 1521 bp, H. influenzae strain 86-028NP
ttgcctcgcagaccgccattctggctcactttacttatcatcttaatcgggcttccgttatgtttgccgtttctgtatgtcattttgcgtgcgacagaagtgggattaacgcgaagtgttgagctattgtttcgccctcgaatggctgaattattaagcaatacaatgcttttaatggtttgtgtaactatcggtgctatttcacttggcacgctttgtgcttttttacttgaacgttatcgctttttcggtaaagctttttttgaagtggcgatgacgttacccctttgtattcccgcctttgtaagttgttttacttggatcagcctcacattccgcgttgaaggtttttggggaacaattggtattatgacattaagttcatttcctttggcttatttgcccgtttccgctatattaaaaagacttgatcgttctcttgaagaagtaagcctttcgctgggtaaaagccctgtgtataccttttggtatgttattttcccgcaacttaaacccgccattggtagtagtatcttactgattgctttacatatgttgatcgaatttggtgcagtgtcaattttaaattatcaaacctttaccactgccattttccaagaatatgaaatgtcttttaacaacagcactgctgcattattatccgccgttttaatggcgatttgtatacttattgtttttggggaaattttctttcgtggaaaacaaaccctttaccacagtggaaaaggtgttacgcgtccttatctcgtaaaaacactttcctttggaaaacaatgtttaaccttcggatttttctctagcatattcattttaagcattggcgtgcctgtgattatgttaatttactggcttatcgtggggacttcacttgaaagtgcgggcgatttttcagaatttttatcggcattcagcaattcatttatcatttcaggcttaggcgcattgcttaccgtaatgtgcgccttgccattagtttgggcagctgttcgttaccgtagttatttaacgatttggatcgaccgcttgccatatctattacacgctgtgccaggcttagtcattgccttatcattagtctatttttccatccattacgctaacgacctatatcaaaccttttttgtgattatcattgcctactttatgctctatttgccaatggcacaaactacattaagagcgtctttagagcaactttccgatcaaattgaaaaagtcggacaaagtcttgggcgaagccctttctatatttttcgcaccttgacgctaccagccatattaccaggtgtggccgccgcatttgctttggtttttttgaatttaatgaaagagcttaccgcgacgcttttgctcacatcaaatgatattaaaaccttatccattgctgtgtgggaacataccagcgatgcgcaatatgctgccgccaccccttatgcgttaatgctcgttcttttttcgggtattcctgtatttttattgaaaaaatatgcgtttaaataa

SEQ ID NO: 933 - DNA, 1056 bp, H. influenzae strain 86-028NP
atgataaataatccgttattaaccgttaaaaatctcaataaattttttaatgaacaacaagttctgcacgatatttcattcagcttacaacgcggagaaatcctctttttacttggtgcttcaggctgtggcaaaactacattattacgtgccattgcaggatttgaacaccccaatactggcgaaatttggctaaaagagcggttaatttttggcgagaattttaatcttccaacgcaacaacgtcatctcggttatgtggtgcaagagggcgtactttttcctcacttaaatgtctatcgcaacattgcttacggattaggcaacggcaaaggaaaaaatagcgaagaaaaaacgcggattgaacaaataatgcaactaacgggtatttttgaactggcggatcgctttccacatcaactttcaggcggacaacaacaacgcgtagcattggcgcgtgctttagcccctaatccagaactgattttattagacgagcctttcagtgccttagacgagcatcttcgccaacaaattcgccaagagatgctccaagcacttcgccaaagcggtgcttccgcaattttcgttactcacgaccgtgatgaatccttacgctacgctgataaaatcgccattattcagcaaggtaaaattttacaaatcgatacgccacgcaccctttattggtcgcctaatcatcttgaaacagcaaaatttatgggggaaagtattgttttgcctgcaaatctactcgatgaaaataccgctcaatgccaattaggcaatattcctataaaaaataaatcaatctcacaaaatcaaggtaggattttgcttcgtccagaacaatttagcctgtttaaaacatcagaaaatccaaccgcactttttaatggacaaataaaacaaattgaatttaaaggaaaaattacctccattcaaattgaaattaatggctacgcaatatggattgagaacgttatttctcccgatttatctattggcgataatttgcctgtttatttacatagaaaagggcttttttacgcttaa

SEQ ID NO: 934 - DNA, 681 bp, H. influenzae strain 86-028NP
atgaaattaaccctagaaatgcttacaggaaagtctcgtgagcatttagtcaatttacccacaactcattcatcaaatcattttttgcaaacacaagctatgcaagcatttcaagctttgcaacaaagtgcggcaaaaaatggctttaatttacagcctgcgagcagttttcgtgattttgaacgccaaaaacttatttggaacagtaaatttaagggcgagcgaaaagtacacgatgatgcaggaaaggcattagatttgaaccaattagatgactggcaaaaatgtcaggcgattttacgttggtctgcattgccgggggcgagccgtcatcattggggaacggaagtggatatttttgatcctgatcttttgccacaagggcaatctttacaactggagccttgggaatatgaaaaaggcggctacttctttgaattgagtgaatttcttgccgaaaatttaccgcactttgattttgctttgccttttatgaatatgcagtccaataagaaagtggggcgggagccttggcatatcagttatttgccgttagctgaattggcaagccagcaattttctccagagattttgcaacaggcgtggaaaggggaaaatattttaggcgcagactgtttaatatcacatcttgaacaaattttttccgaatatattgtttaa

SEQ ID NO: 935 - DNA, 1134 bp, H. influenzae strain 86-028NP
atgagagaaaaagtggtttcgttggcacaagatttaattcgtcgcccgtctattagcccgaatgacgaaggctgtcagcaaattattgccgaacgtttagaaaagctaggttttcaaattgaatggatgccttttaatgacacgttgaatttgtgggcaaaacacggaacgagcgagccagttattgcttttgcaggtcatacggatgttgtgcctactggcgatgaaaatcaatggtcgtctccgccgttttctgcggagattattgatggcatgctttatgggcgtggtgcggcggatatgaaaggctcccttgcagcaatgattgtggcggcagaagaatacgtaaaagcaaatcctaatcataaaggcaccattgcattattgattacctctgatgaagaggctgccgcaaaagatggaactatacgcgtggttgagacgttaatggcgcgtgatgaaaaaattacttattgtatggttggagagccatcgagtgctaaaaacttaggcgatgttgtcaaaaatggtcgccgcggctcaattacaggaaatctctatattaaaggtattcaaggacacgtagcctatccgcatttagctgaaaacccaatccataaagcagccccattcttgcaagaattaacgacttaccaatgggataaaggcaatgaatttttcccgccaacaagcctacaaattgctaacattcacgcgggtacgggaagtaataatgtaattcctgctgaattatatattcagtttaatttgcgttattgcacagaagtcacggatgaaatcattaagcaaaaagtcgctgaaatgctagaaaaacacaatttgaaatatcgtattgaatggaatttatcaggcaaaccctttttaacaaaaccaggtaaattattagattcgataacctccgctattgaggaaaccataggcataacgccaaaggctgaaacaggtggtggcacgtcagacggtcgttttattgcattgatgggcgcagaagtagtggaatttggtccgttaaattcaaccattcataaagtcaatgaatgtgtcagtatagaagatcttggcaagtgcggtgaaatttatcacaaaatgttagtgaatttattggatagctaa

SEQ ID NO: 936 - DNA, 345 bp, H. influenzae strain 86-028NP
atgattacagtttacggcattaaaaattgcgatacagtgaagaaagcgttgaaatggctggcggatcacaatatcgaacacaaacttcacgactaccgtgttgatgggttagatttgaattttttaacccaagcggaaactcaatttggctgggatgtgttagtgaataaacgcagtacaacttggcgtaatttggatgagcaagttaaaaattcccttgataaaaccaccgcactttccgtgttggctgagaatccaactttaattaaacgcccaattattttacaagatgaaaaggcattaattggctttaatgaaaaggaatatcaggctgtttttgcttaa

SEQ ID NO: 937 - DNA, 1896 bp, H. influenzae strain 86-028NP
atgaaggaaaaaattatgtcacaaaatcaagaaactcgcggcttccaatctgaagtcaaacaactactccaattaatgattcattctttgtactctaacaaagaaattttcttacgtgaattgatttctaatgcttctgatgcggcagataaattacgctttaaagcactttccaaccctgctttatatgaaggcgatggcgacttgcgtgtgcgtgttagctttgatgcggataaaggcactatcacaattagcgataacggcattggtatgactcgtgagcaagtcatcgatcatttggggacgattgcaaaatcaggaacaaaagaatttttaaccgcacttggccaagatcaagcaaaaaatagccagcttattgggcagtttggtgtgggtttttattctgcttttattgtggcagataaagtgactgtaaaaactagagcggctggcgaagaggcggataaagctgtgctttgggaatctgcgggcgaaggcgaatattctgtggcggatattgagaaaaaatctcgtggtacagatgtgattttacatttacgtgaagatgaaaaagaatttttaaatgaatggcgtttgcgtgaaattattggtaaatattctgaccatattggcttgccagtggaaatgctgacgaaagaatacgatgatgagggcaaagagtgcggcgaaaaatgggaaaaaatcaataaatctgatgccctttggacgcgttctaaaaatgatgtttccgatgaggaatacaaagcgttttacaaacacttaagccatgattttgttgatcctgtgacttgggcgcataacaaagtggaaggaaatcaagcatatactagtttgctttatgtaccagctaaagcaccttgggatttatttaatcgcgaacataaacacggcttaaaactttatgttcaacgtgtatttattatggatgatgctgagcaatttatgccgaattatctacgttttatgcgtggtttaatcgatagtaatgacttgccattaaatgtatctcgtgaaattttacaggataacaaaattacggctgcactacgcaaagcattaactaagcgttcattacaaatgctagaaaaattagcaaaagatgatgcagaaaaatatcttaaattctggaaagagtttggtttagtcttaaaagaaggccctgcagaagattttgctaacaaagaaactatcgcaaagttattgcgttttgcttcgacacataatgatggtagtgagcaaactgtctctttagaagattacatcttgcgtatgaaagaggggcaaaaagctatctattacattacagcggatagttatgttgcagcgaaaaatagcccacacttggaattattcaataaaaaaggcattgaggttttattactttccgatcgtattgatgaatggatgttaagctatttaactgaatttgacggtaaacaattacaaagtatcacgaaagcagatttggatttaggcgatttagcggataaagaatctgaaacacaaaaacaacaagataaagcctttggtagttttattgagcgtgtgaaaaacttgcttggcgaacgtgtgaaaacggtgcgtttaactcacaatttaacggatacaccagcggtggtttctacggataacgatcaaatgacgacccaaatggcgaaattgtttgcagccgcagggcaacctgtaccagaagtaaaatacacatttgaactgaatccagaacactatttagtgaaaaaagtggctgatattgcagatgaaactgaatttgctgattgggtggaactgttgcttgaacaagctatgttagcagagcgcggatctttggaaaatccagctgcgtttattaaacgtatcaataagttgttaggttaa

SEQ ID NO: 938 - DNA, 840 bp, H. influenzae strain 86-028NP
gtgcattcccccactcctttcgcactagccatttttttgggaattttgtaccatatcccgactttttccaatcaacgatccattatgaataatctcgaacttgaacaactcattaatcaaaaactttcttctgataaaatcaatgactatgcacccaacggcttacaagtcgaaggtaaaacagaaatcaaaaaaatcattactggcgtaacggcgagtcaggctttaattgattacgcaatcagccaaaatgctgatgctattttagttcatcatggctatttttggaaaagtgaaaccccttgtatccgaggaatgaaaggcaagcgaattaaagcccttttagtgaacgacattaatttatatggctatcatttgccattagatgtgcacccagaattaggtaacaatgcacaattagccaaactgctcgacattgaaaatttacaaccattagaaaaaggcactgtgagtattcctgtttggggcgaattaaaagaaccgatgacaggtaaagactttgcagaaaaaatagaaaaagtgttaaatcgaaaaccgttaatttgcattgaaaacggaccgcacttaatccgaaaaattggcatctgcactggtggcggacaaggttatattgatcttgctgcagaacaaggctgcgacgcatttattacaggggaagtgtcagaacaaacaatccattctgcccgtgagcaaggattgcatttcttctctgcaggtcatcacgcaacagaacgctatggcatcaaggcattaggcgaatggttggcgaaagaatatggctttgacgtagaatttaaagatatagataatccagcataa

SEQ ID NO: 939 - DNA, 2373 bp, H. influenzae strain 86-028NP
atggagcattctgttcataacaaactggtttcttttatttggagtattgcagacgattgtctgcgcgatgtgtatgtgcgcggtaaatatcgtgatgtgattttaccgatgtttgtgcttcgtcgtttggatactttacttgagccaagcaaagatgccgtattggaagaaatgcgttttcaaaaagaagaattggcattcaccgaattggatgaccttccccttaaaaaaattaccggtcatgttttttataacacctcaaaatggacattaaaatccctctatcaaaccgccagcaatacgccgcagtatatgctggccaattttgaagaatatcttgatggtttcagcaccaacattcatgaaatcatcaactgcttcaagctgcgtgaacaaatccgccatatgtcccataaaaatgttttgctgagcgtgttggaaaaatttgtatcgccctatatcaatcttacccctaaagaacaacaagaccctgagggcaacaaattaccagcgctgaccaatctgggcatgggctatgtatttgaagaactgattcgtaaatttaacgaagaaaataacgaagaagctggcgaacactttaccccacgcgaagtgatcgagctgatgacgcatttagtctttgatccgctcaaagaccaaattccggccattattacgatttacgacccagcttgcggcagcggtggcatgctgaccgagtcgcaaaactttattgagcaaaaatatccgctatctgaatcacaaggcgagcgttccatctttttgtttggtaaagaaaccaatgatgaaacctatgccatttgtaaatctgacatgatgattaaaggtgataatcccgaaaacatcaaagtcggctcaacccttgctacagatagcttccaaggtaatcactttgactttatgctttccaacccgccatatggcaaaagctggagcaaagatcaagcctatatcaaagacggcaatgaggttatcgacagtcgctttaaagttaccttaccagattactggggcaatgtagaaacccttgatgctaccccacgctccagcgatggacagctgctattcctaatggaaatggtcagcaaaatgaaatcgccgaatgacaacaaaatcggcagccgagtggcctccgtgcataacggctcaagcctgtttaccggcgatgcaggttcaggagaaagcaacattcgtcgccatattattgaaaaagatttgctcgaagccatcgtacagctgcctaacaacctgttttataacacaggtattaccacttatatttggttgctgtccaacaacaaacctgaagcacgcaaaggcaaagttcagctcattgatgccagcctcttattccgcaaattgcgtaaaaaccttggcgataaaaactgcgaatttgtacctgaacatatcgccgaaattacccaaaactatcttgatttcactgccaaagcgcgcgaaaccgacagccaaaatgaagcagtcggcctggcttcgcagatttttgacaatcaagatttcggctattacaaagtcaccatcgaacgcccggatcgccgttctgcccaatttaccgccgaaaatatctcgcctttacggtttgacaaggctttgtttgagccgatgcaatatctttatcggcaatatggcgaacaaatttacaacgccggatttttagcccaaaccgagcaagaaattaccgcttggtgcgaagcgcagggcatagccttaaacaacaaaaacaagaccaagctgctggacgtcaaaacctgggaaaaagccgccgcactttttcagacggcatcaaccttgctcgaacatttcggcgaacaacaatttgacgatttcaaccaattcaaacaagccgtggaatgccgtctgaaagccgaaaaaatccccctttctgccacagagaaaaaggccgttttcaatgccgtaagttggtacgacgaaaattcagccaaagtgattgccaaaacactcaagctcaaaccaaacgaattggacgccctttgccaacgctaccaatgccaagccgacgagctggcagactttggctattacgccaccggcaaagcaggcgaatatatcctatatgaaacgagcagcgacttgcgcgacagcgaatccataccgctcaaacaaaatatccacgactatttcaaagccgaagtgcaagcgcacatcagcgaagcatggctgaatatggaaagcgtaaaaatcggctatgaaatcagcttcaacaaatacttctaccgccacaaaccattacgcagccttgcagaagttgcccaagatattttggcgttagaaaaacaggctgacggcttgattagtgaaattctagaggcttaa

SEQ ID NO: 940 - DNA, 1410 bp, H. influenzae strain 86-028NP
atgcagccggaaaaccaatattttgagcgcaaaggactaggagaaaaagacatcaagccaactaaaatagctgaagaattagttggaatgctcaatgctgatggcggagttttggcttttggtgtggcagataatggcgaaatccaagacttgaatagccttggcgataaattagatgattatcggaaattggttttcgattttattgcaccgccttgtcggattggactggaagaaattctggttgatggaaaattagttttcttattccacgtagagcaagatttagagcgtatttattgtcgcaaagacaatgaaaatgtgttcttacgtgtagcagatagtaatcgaggccctctcaccagagaacaaatcaaaaatcttgaatatgataaaaatatccgtctatttgaagatgaaatagttcctgattttaatgaagaagatttagatcaagaattattagagctatataaaaagaaagttaattttacctccgataatatcttagatttattatacaagcgaaatttattaaccaaaaaggaaggttgttatcagtttaaaaaatcagccattttactcttttctaccatgccggaacgttacattccttcagcatcagtccgctatgttcgttatgaaggtacagtagcgaaagtcggtactgagcataatgtgataaaagaccaacgttttgaaaataatattccaaagctaattgaggagctgacctattttttaagagcctctttaagggattattactttcttgatgtcaatcagggaaaatttatcaaagtaccggaatatcctgaagaagcttggttagaaggtgttgtaaatgcgctttgtcatcgttcttacaatgttcaaggtaatgttatttatattaaacatttcgacgatcgtcttgaaattagtaatagtggccctctccctgctcaagtcaccattgaaaatattaaaacggaacgattcgctcggaatccacgtatagcacgagttttagaggatcttgggtatgtccgtcagcttaatgaaggcgtttcccgtatttatgagtcaatggaaaaatcattattggcaaagcctgaatatagagaacaaaacaacaatgtttatctaacattgcgcaaccgtgttaccgcacatgaaaaaacggtatctacagccactatgctgcagattgaaaaagaatggacaaactacaacgacacccaaaaagccattttgctttatctatttacaaatggtacggcgatattgtcagaattagttgactatacaaaaatcaatcagaattcgatccgagcgtatttaaatgcctttattcagcaaggtattattgaaagacaaagtgtaaaacagcgtgaccccaatgccaaatatgcttttagaaaagattaa

SEQ ID NO: 941 - DNA, 1251 bp, H. influenzae strain 86-028NP
atgagacgatacgagcgttacaaagattcaggtgtggattggctaggggaggtaccgagccattgggagttaaaacgcttgaaacaattatttgttgaaaaaaaacataagcaaagcctgtctcttaattgtggagccattagttttggtaaagttattgaaaaatcggatgataaagtaacagaggcaacaaaacgttcatatcaagaggtgttaaaaggcgagtttttaataaatcctttaaacttaaattatgacctaattagtttgagaattgctttatcagaaatagacgttgttgtaagtgccggttacattgttttaaaagaaaaacaaataattaataaaaaatacttttcgtatttattacatagatacgatgttgcatatatgaaattattaggttcaggtgtaagacaaacgattaactatgggcatatttcagacagtattttggttattccacctctctccgaacaacaaaaaatcgcgcaattcctagacgataaaaccgctaaaatcgatcaggcggtggatttggcggaaaagcagattgccctgttgaaagagcacaagcagatcctgattcaaaatgccgtaacccgaggcttaaaccctgatgtgccgttaaaagattccggcgtggaatggatagggcaagtgccggagcattgggatgtgcaacgttcaaaattcattttcaagaaaatagaaagaaaagtgaatgaggaagaccaaattgttacttgttttagggatgggcaagtaactctgagagctaatcgaagaactgaaggatttacaaatgcgctaaaagaacacggctaccaaggaattagaaaaggtgatttagttattcacgctatggatgcttttgcaggggcaattggtatttctgattcagatggtaaagcaacaccagtttattccgtttgtttgcctcatgataaacaaaaaatcgatgtctatttttacgcttattacttaagaaatcttgcattatcaggatttattagctccttagctaaaggaattagagagcgttcaacagattttcgctattctgattttgcagaattattactacctattcctccatatttagaacagcaaaaaattgccgactacctagataaacaaacctctaaaattgatcgagcaatcgcattaaaaacagcccatattgaaaagctgaaagaatataaaagcgtgttgattaacgatgtggtgaccggcaaggtgcgggtatag

SEQ ID NO: 942 - DNA, 3027 bp, H. influenzae strain 86-028NP
atggtttcaggaactaaggaaaaagatttagaaattgccatcgaaaaagccttaactggcacttggcgtgaaaacatggaaaataagctgggcgagccgaaggctgaatacctgccgcgccatcatggttttaaactggcattttcacaggattttgatgcgcagtttgccatcgacacacgtctgttttggcaattcctgcaaaccagccaagaggcagaacttgcccgttttcaacaactcaacccaaacgactggcagcgtaaaattttggagcgattagaccgccaaataaagaaaaacggcgtgttgcacctgctgaaaaaaggcttggatattgatagcgcccattttgatttgctctaccccgttccgcttgccagcagcggcgaaaaggtcaagcagcgttttgaacagaatttgtttagctgtatgcgtcaagtgccttattctgcctcaagcaatgaaacggtggatatggtgctgtttgccaatggcttgccgattattgcccttgagctgaaaaaccattggacaggtcagacagccattgatgcgcaaaaacaatacctcaaccgtgatttaagccaaacgttgttccatttcgggcgttgtttggcgcattttgccttagatacggaagaagcttatatgaccaccaaattggcggggcctgctacgtttttcttgccgtttaacttgggcaacaactgcggtaagggtaatccgcccaatcccaatggacaccgcacggcgtatttatggcaagaggtgttcggcaaagcaagccttgccaacattattcagcattttatgcgcttagacggttcaaccaaagatccgttggataaacgtaccctctttttccctcgctatcaccaattagatgtggtccgccgtttgattgctgatgtcagtgaacatggcgtgggtaaacgttatttgattcaacattctgccggttcgggcaagtctaattccattacttggctggcgtatcagttgattgaggcatatccgcgcaatgaaaaggcggcaaacggtagagaggcagaccgcccgatttttgattcggtgattgtcgtaaccgaccgtcgtttgttggataagcaactgcgcgacaatatcaaagatttttcagaagttaaaaacattgttgcgccggcgttgagttcggcagagttgcgccaatcgcttgagcagggcaaaaaaatcattattaccacgattcaaaaattcccgtttattgtcgatggcattgctgatttaggcgacaaacaatttgcggtgattattgatgaggcacacagctcacaatcaggttcggcacacgacaatatgaaccgggccatcggcaaaacggaagaccttgatgctgaagatgtgcaagatttgattttacaaaccatgcaatcccgcaaaatgcacggcaatgcgtcgtattttgctttcaccgccacaccgaaaaacagcactttggaaaaattcggcgaaaaacaggcggatggcaagtttaagccgttccacctttattctatgaagcaggcgattgaagaaggctttattttggatgtaatcgccaattacaccacctataaaagtttttatgagatcactaagtcgattgaagataatccggagtttgatagtaaaaaggctcaaagccgtctgaaagcctatgtggagcgttcgcaacaaacgattgatactaaagcggagataatgctggatcattttatttaccaagttttcaaccgtaaaaaactcaaaggcaaagccaagggaatggtggtaacgcaaaatattgaaaccgccatccgctattttcaggcgttaaaacatttgctggccgggcggggtaatccgtttaaaattgcgattgcgttttcaggcagtaaagtggttgacggtgtcgaatacaccgaagcggaaatgaacggctttgcagaaagcgaaaccaaagagtatttcgatcaagatgaatatcgtttgctggtggtcgccaataaatatctgaccggtttcgatcagccgaaattgtgtgccatgtatgtggataagaaactctccggcgtgctttgcgtgcaggctttatctcgtttgaatcgcagtgcgaataagttgagtaaacgcacggaagatttgtttgtattggacttttttaacagcgttgaagatattcagcaggcatttgagccgttttatacttctacttcgttgtcgcaggcaaccgatgtcaatgtcttgcatgatttgaaagaccggttggatgaaaccggcgtgtacgaacaagcggaggtcaacgattttactgaaggctattttgccaataaagacgcacagcaattaagcagtatgattgatgtggctgtccaacgttttgatgatgaattggaattggatttggatcgaaatgaaaaagttgattttaaaatcaaggcaaaacagtttttaaaaatttacgggcaaatggcctccatcatcaattttgaaaatatcgcttgggaaaagctctattggttcctcaaattcttagtacccaaattaaaagtacaagacccgatggatgaatttgatgaaattttagatgcagtggatttaagctcttacggcttggcgcgcaccaagctgaattacagcattaaattagatgatgaagaaacagagcttgacccgcaaaaccccaatccgcgcggtacgcatggtgaagataaagaaaaagatccgattgatgaaattattcgtgtatttaacgaaagatggtttcaagattggagcgcaacgccggatgagcaacgggtaaaatttatcaatattaccgagcgcatccgcagccataaagactttgagcagaaatatcaaaataacccggatattcatacccgtgaattggctttccaagccattttgcgcgatgtgatgagcgaacgccatagggatgaattagagctatacaaactttttgccaaagatgccgcatttagaaccgcttggacgcaaagtttgcaacgggctttggctggatag

SEQ ID NO: 943 - DNA, 1380 bp, H. influenzae strain 86-028NP
atgtttgagaatttatcggatcgcctttccaaaaccttacgtaatatcacaggaaaaggccgtttaacggaagataatattaaagaaaccttgcgcgaagtgcgtatggcattacttgaagccgatgttgccttgcctgtggtgcgtgaatttatcgcaaaagtaaaagaaagcgcgcttggggaagaagtcaataaaagtttaacgccagggcaagagttcttaaaaatcgttcagcgtgagcttgaaaaagccatgggcgaagccaatgaaagtttaaatcttgcaacccaaccaccagcagttatcttaatggcaggtttacaaggtgcgggtaaaaccaccagcgtgggtaaattggcaaaattcttgcgtgaacgccataaaaagaaagtgttagtggtgtctgctgacgtatatcgccctgctgcgattaagcaacttgaaaccttggctcaatccgttggcgtggatttttttccatcggatgttaaacaaaaccccgttgatattgctaaagaggcacttgctgatgcaaaactgaaattctacgatgtgttgattgtggatacggcaggtcgcctacacgttgatacagaaatgatggacgaaatcaagcaagtccatgctgcattaaatccaatcgaaacccttttcactgttgatgcgatgactggtcaagatgcggcaaatacagcaaaagcctttaatgaagcattgcctcttacaggggttattttgacgaaagtggacggtgatgcgcgcggtggtgcggcgttatcgattcgtcaaatcacaggtaaaccaattaaattcttgggtgtgggtgagaaaacggaggcacttgagccgttccatcctgatcgtgttgcttcccgtattttgggcatgggcgatgtgctttcattgattgaggatcttgaacgttctgttgatcgtgaaaaagcggaaaaaatggcgcagaaattcaagaaaggcgatgatttcactttagatgatttccgcgaacagctgatcgaaatgaaaaaaatgggtggcatgatgtctatgcttgagaaattaccaggtgcaaaaaatttgcctgagcacgttaaaaatcaagtggatgacaaaatgtttgtcaaaatggaagcgatcattaactccatgaccctaaaagaacgtgccaacccagatattatcaaaggatctcgccgtcgtcgtattgcattaggttctggcactcaagtgcaagatgtcaataaattacttaaacaattcgatgaaatgcaacgtatgatgaagaaaatgcgtaaaggcggcatggctaaaatgatgcgtggaatgcaaggcttaatgggcggaggcttaggcggtttaggcggaatgtttaaacgataa

SEQ ID NO: 944 - DNA, 1293 bp, H. influenzae strain 86-028NP
ttgttgattaacgaacaaaaggattttcccttggatagcattccccttagtactttatttattattcttattatctgtttagttttatcagcctatttttctggttctgaaactggactactctccctcaataaatatcgtcttcgttttctatctgaacaaggcaataaaggcgcgaaaaaagcggaaaaactgctagaaaagccagatactttgttaagttttattcttatttttaataaccttgtgaatatcagcgcatctgcaattgcaacagtaattggtatgcgtttatatggcgatgctggcgtggcgattgcaacgggtttgctcactttcgtaatgcttgtattttctgaaatattccccaaaacggtggctgcaatgcacgcagaaaaagtgagttttttttcaagtcatattttaacttcattgcttaaaatcttttatccgctcgtttggttaatgaatatttttactaaatccttgatgcaaatagtagggttaaaacttgatatgcaaaaacaagtaattagtagtgaagaactgcgtagtattgtgtcagaagcaggcgaagcaacaccaaatgaacaacatccacaaatgttgctgtctattttggatatggagacagtcactgttgatgacattatggttccccgcaacgaaatcggcggtataaatattgatgatgattggcgagctattatgcgccagctcaatcatgctgcacataaccgcgtggtgctttacaaaggcagccttgatgaacaagtgcttggcattttgcgcgtgcgtgaagcattccgcttactgcttgaaaaaaatgaatttaccaaagaaaccttaattcgtgccgcagatgaagtgtatttcattcctgaaagcacgccattaaaaacgcaacttgcaaatttccgtacaaataaagagcgaattggcttagttgtagatgaatacggcgatattaaagggcttgtgacgttggaagatattttggaagaaattgttggggattttaccacttccaccgccccaagcattgacaaagaagtaattcaacagtctgatggttcaatgattatcgatggctccgctaatctacgcgatctcaacaaaatgtttaactgggaattagatacagaagatgctcgtacttttaatggtttaatcttagaacacttagaggaaatacccgatgaaggcacgatttgcgaaattgatggtttgctaatcactattcttgaagtgggcgataatatgataaaacaggcgaaagtcgtcaaactttaa

SEQ ID NO: 945 - DNA, 879 bp, H. influenzae strain 86-028NP
ttgaaccgcacttttgacttggatcataagtgcggttctttttttgcgcattttttagaaaagatttttataattctttctaggtatattttgatagagaagaaagatatggaacacgaatatcaacgggcggtgactcgcgtgtgcgtacaaacggcactgctcttgttacaacatggggcagaaagtaccgtggtggtgcaaatggcacagcgtttaggcgtagcacttggcgtagaaagtgtagaatgtgcgcttacggcaaatgcagttgtgctgacgaccttatcagataatcattgcattactaccgcacgaaaaaatacagataaaggcattaatatgcaaatggttactgatgttcaacgcattgtgattgccgttgagcatcatttgtatgagttagagatcgtacaaagaaaactggatcaattaaaaccgcttaaatataaccgatggttagttgtattcatgattggcttatcttgtgcagcattcgcccatttatctggcggagactggataatttgtagcattacctttgtggcagccgccattgccatgtttgtgcgacaagaattttctaaacggcactataatccccttatcgtcttttccatcacctctttcgtcgcctctctgatttctggcgtgagcttaaaatataacttaggtaacgatcctcaaattgctttagcgtctagtgtgttattacttgtgccagggtttcctctgattaattctttggcggatatattaaaaggttatgtgaatatgggattaggccgttggacgattgcgactgttctcacttttggcgcatgtcttggtattgtattcgctttaagcctattacatattacaacttgggggcattaa

SEQ ID NO: 946 - DNA, 480 bp, H. influenzae strain 86-028NP
atgttatcagacatcacaatatttatcttgaaattactcgatgatatgctatgtgctgcgattccagcggtgggctttgctttagtatttaatgtgccgcccaaagccttaaaatattgtgcaattttagccgcacttgggcatgttacacgcacattattactgcatattaatatgcctattgtatttgctacattctttgccacttgtgtgattggatttttaggcgtgcatctttcccatcgttatttagcccatcccaaagccttcaccgttgccgcaattatccccatgatccccggtgttcatgcttataaagcaatgatttcaatggtacaaattcatcattttggcttttctgatgctttatttgaacagatgattagctcctttattaataccagttttatcctaggcgcaatagtatttggattagctttaccaggcttattgttttatcgacaaaaacctgtggtgtaa

SEQ ID NO: 947 - DNA, 342 bp, H. influenzae strain 86-028NP
atggtaaaaattgagcgtaaggcgacagattctgcgtatcatgaatttacaaaaattcttacttcatccgctcaattagtggcttttttaaatcaatctgattttgtgaaagcgagagctaaagttgaaaatgaaactgttcagcaaattgcctcacattttaagttttctcaagaaaataatcttaatcaattaattctatcctcttttgatcgtaaagaagaggatcaactttttgtggaatacattcgttatgtgaataatcaagcgcgccaaacattaaataatgaattgattacaaaatggaaatcgttatttgaaaaaagaaaaattacggattaa

SEQ ID NO: 948 - DNA, 1290 bp, H. influenzae strain 86-028NP
atgatcgatccaaatttactccgtaataatttagcagaagtcgcagaaaaattaaaagtaaaacgcaactttatgcttgatacggaaaaactcaccgcgttagaagatcagcgcaaaaacttacaagtcactaccgaaaacttacaagcggaacgtaatgctcgttccaaagccattggtgctgctaaagtgcgtggtgaagatatcgcaccattattggcagaaatggatgatatgggcaatcaattgactgaagcaaaagcacaattagatgcggtacttgcagaaatcaatcaaattgcattaagtattccaaatctacccgcagacgaagtgccattaggcaaagatgacacagaaaataaagaaatcttacgttggggtacaccgcatacatttgattttgaagtgaaagatcatatcactttgggtgaagaagcaaatggcttagattttgctgctggggctaaattagctggtgcgcgttttgccgtaatgaaaggtcaaatcgctaaaatgcaccgcgcattggcacaattcatgttagatcttcatactgaacaacacggctatttagaaacctatgtgccttatttagtaaatcacgcaacactttatggtacagggcaattaccaaaattcggggaagatttattccatactttagccttagaaggcgaacaaccttacgcattaattccaaccgcagaagtgcccgtcactaatttagtgcgtgatgtaattattgatgaagcagaattaccaataaaaatgaccgcacatacgccatgtttccgttctgaagctggctcttacggtcgtgatactcgtggtttaattcgtatgcaccaatttgataaagtagaaatggtacaaatcgttgatccagataaatcaatggaagcacttgaagaattaacaggtcatgcggaaaaagtattgcaattattaaatttaccataccgtaaagttttactttgcacaggcgatatgggctttggttcttgcaaaacttacgatttagaagtttggctgcctgcacaaaatacttatcgagaaatttcttcttgctcaaatatgtgggatttccaagctcgccgtatgcaagctcgctgtaaagcaaaaggcgataagaaaactcgcttagtgcacacattaaatggttcaggcttagcggttggtcgtactttagtggctgtacttgaaaactatcaaaatgccgatggttcaattaccgtgccagaagagctacgtccatatatgggcggattagacgttatcggaaaataa

SEQ ID NO: 949 - DNA, 630 bp, H. influenzae strain 86-028NP
atgaaattatatggtttaattggtgcgtgttcatttgttccacatgtggcattagagtgggtaaaaatacgtgaaaatgctgattatgaatttgaacctgtcactcgtgagttaattaaatcacctgaatttttatcattgaatccacgcggggcagtacctgtattagttgatggcgatttagttctttcgcagaaccaagcgattttgcactatttagatgaactttatcctaattcaaaattatttggtagcaaaaccgtacgtgataaagccaaagcagctcgctggttagcattttttaattccgatgtgcataaatcatttgtgcctctgttccgtttgccaaactatgcaaaagataacgaaacacttgcacacactattcgccaacaagcagtagagcaaattttagatcaacttgcagtcgcaaatgagcatttagaaagtcacatttattttggagaagatatttccgttgcagatgcctatctttacattatgctcaattggtgtcgagcagtgggtatagatttcagccacttaacacaactttcggcttttatgcaacgtgttgagactgatcaagctgtcgaaaatgtgagaaaaagtgaagaactaaaagtataa

SEQ ID NO: 950 - DNA, 297 bp, H. influenzae strain 86-028NP
atgataaaagcaagatatttttacttatataaattaattgtaagatgcagattttttatagccaaatacaacactcttttcaaacaacaagtcatcgaattttatattcaaaatggtaaaaattattcactcatcagtaaacattttcaacttgacagtagaacattgcgacattggattaaccagtttaatcatagtagaatcaattggttagctgtgttgggtaagaagcgaaattactcacttaaatttaaacttaacgtgatacaaacggttaaaaacgggcaatttttgtag

SEQ ID NO: 951 - DNA, 2238 bp, H. influenzae strain 86-028NP
atgaatattttaattaataaacgtatctttttattagttacccttgtaggtattcaactaaatgtaaccgcaaaacaaaattcttctaattctaatagagaggagttattacctattattgtgaacactaatgatgatagtaataaactacctggtcgttcagtattaaaacagaaaaatatcgaacaacaacaagctgataatgcagcaaacttaattaatatcttaccaggtgtgaatatggctggcggatttcgtcctggtgggcaaacattaaatattaatggaatgggtgacgctgaagatgttagagtgcagttagatggggctacaaaaagttttgaaaaataccaacagggttctatttttattgagcctgaattattaagaagagtaacagtagacaaaggaaattattctcctcaatatggtaatggtggttttgctggaacagtaaaatttgaaactaaggctgctagggatttcttgcaagaaaaccagaaaataggtggttttttaaagtatggaaataatagcaataataaccaaaaaacttatagtactgcactagttttacaaaatgaacaaaaaaatattgatttattattatttggttctgtaagaaatgctggcgattataaaagacccgataatagcaaaattcttttttcaaaaaataatcaaaaaaccggattaataaaagtaaattggcaaatttcacccgagcatttactcacattatcgagtgtttatggtattcataaaggctgggagcctttcgcagcaaaaagagatatcctacctaaaccaagttcgggtgatataatgcgttatggtgctgatattgcttggaaacgtaaactggtttatcgagatcaaaaagataaaaattacacattaaaatacaactatctacctgaaaataacccatggattaacttatctactcagttcagctacagtaaaaccacacaaaatgatactcgccccgaaaaagcccctcctgtatttctgggtacactcggtaatcaaagctggataacttattcagatcttacttttgatataaataacacaagtacttttaatatcaaaagtactcggcatgaactactatttggtttgcaatggttaaaaaacacaagaaatactttaatgtacgataaaagtaaagtgaaaaaagaggactataattatggctattttcaaccttattatatgccttctggacgtcaatatacacaggcactttatttacaagatcaaataacatggaagaatataatttttagcacaggagtgcgttatgaccatatcaataatatagggcagaaaaattttgcaccacaatataatgatatatctgtggggcagaattatagtcagaaaaattataatggctggtcttattatttaggtcttaagtatgatgtaaaccattatttaagtttatttacaaattttagtagaacttggcgtgcacctgttattgatgaacaatatgagacgcaatataagcaatcttctgggcctgtaacagcaacctctttaaatttagaaaaagaaatgattaatcaaacgagagtgggtggaattattactctcaatcatctatttcaggaaaatgatgtttttcaatttagaactacttatttttacaatcgcggcaagaatgaaatatttaaaaccagaggagttaattgtgtaggcaatgctgcagataccaatcatgtttgtcctaaaatcattggaaattatcgtaatttgccaggttatgttattcaaggtgcagagttagaagcttattaccaatctacttatttatttggtgagataacatattcttatgtaaaaggaaaacgtgacacctcaccaagaaacccatggggtaaaacctcaacatggattgcagaaataccccctagaaaagcaactactgctttaggttttaatattcccaaatataattttacagctggctggcgtgctgagtttgtaagaagacaagatcgatcaccattatctggtgaccctgaagcaaaatattggtcattgccagcttcaagaggatatagcctacataacctattcctttcttggagccctgcaaaaattaaaggtatgaatattaagattacagtggataatttattcaatcgagcatacaacccttatctaggcgaattggcttctggaacaggtagaaatatcaaatttagcctatctcagaaattttag

SEQ ID NO: 952 - DNA, 2136 bp, H. influenzae strain 86-028NP
atgaaacaattatttgcaacgacttctcgtggctttgaagaattattaaaagttgaactcactgaacttggtgcgcaagaggcaaaagtggttcaaggtggcgttcattatcaagcagatgacgaaactttataccgcactttactttggtcacgccttgcttcacgcattttatttcctttgattgaaactaaaatttacagtgatttggatctttatgcggctgtttcaggctttaattggttagggctatttgatgaaagagttacattctttgtcgattttaatggaaccaaccaagaaattcgtcatactcaatttggtgcgatgcgcgttaaagatggaattgtcgattactttgaacgtcaaggtaaagctcgtcccgatgtagataaaattcagccggacgtgcgtatccatgcttatttgaatcgtgaaaatttagtgatttctttagatttaagtggggaagcattacatttacgaggctatcgtgaagatgcaggtcaagctcctttacgtgaaactctagctgcggcaattgttctgcgttcaggttggcaagtgggttctccattagtagatccaatgtgtggctctggcacgcttttaattgaggcggcacaaatggaagccaaaattgcaccgcaactttatcgtttacattggggatttgatttttggaaagcgcataatcaatcggcttgggaaaaagtaaaaaatgaagcgattgaattagcagaagaaaaacaacgtgaaattcaaccgcacttttatggatttgacctcgatcaccgcgtattaaaaaaggcgcaaaagaatgcacaaaatgcaggtgtttcacatttaattaaatggcagcaaggtgatgttgcagcgttgaaaaatcctcgtttaaatgaagtcggtacggttatctgtaatccaccttatggggaacgcttaggcacaaccccagcattgatcgcgctctattctgtatttgggcaaagacttaaaaaagaattttgtggttggaatgtttctgtttttagtagcgaatccacattacttgattgtttgagaatgcgtgccagccgacagtttaaagccaaaaatggcccattagattgtgtgcagaagaattatcaagtttcagaacgaaaatctgacgaaattaccgctgaaaatgaactagaatttaaccgcacttcggaggttgcaaccgattttgctaatcgattacaaaaaaatattaagaaaattagtaaatgggcaaagcaacaaggattagacgcttatcgtttatatgatgccgatttgccagaatataatttagccgttgatcgttatgcagattacattgttgtgcaagaatatgcagcaccgaaaaatattgatgaaaataaagcgcgtcagcgtttgttagatgcggttactgcaactttgcacgttacaggtgtagaaacgaataagttgatcctcaaagttcgtcagaaacaaaaaggtactaaccaatatgagaaattagccaataaaggcgaatacttttatgtgaatgaatatggcgcgcagctttgggtaaatttgacagattatttagacacgggcttatttttagatcaccgtttaacaagaaaaatgattggagcgttggcaaaaggtaaagatttcttaaatttatttgcttatactggttctgcaactgttcatgcggcacttggtggcgctaaatcgacaacgaccgttgatatgtccaatacttatcttaattgggcggagcaaaatcttattttgaatgatattgaaggtaaacaacataaattaattcaagcagattgccttcaatggttagaaaaatgtgatcgtcaatttgatttgatatttgtggatccaccgacgttttcaaattctaaacgtatggaagacagttgggatgtgcaacgagatcatgtgaaattaatgcgcaatctaaaacgagttttgtcgaataatggcacaattgttttctcgaataataaacgtggattcaaaatgaatttagttgcgttggaagaattaggtttaagtgcggtagaaatttcgcataaaaccttaccgttagattttgaacgtaataaacaaattcataattgttggatgattcaacatatataa

SEQ ID NO: 953 - DNA, 1110 bp, H. influenzae strain 86-028NP
atgtcggtgtgtaaaccattttggttcaaaactttttctatctcaattattaccgcacttttggtgtcttgtacctctaacataaaaaacattcagattcccaccaccttaaatggtagtgatcctcaacaattcggtgcaaaatataccaatcgaacttatcagcaagcagcgcttgtgcctgtatccaacatagaaaaccaaagtgcggtaataaatcaaggcgattttttaacacagctttccaatataaaaaattattcgagtaaactttccaccaatttttacgacaattatgaaaagattacaaattgggttctttctggggcaaatattaatgaactcactcaatttaatatccatccgcaaattatgcgtggatttgatgggtatcaaaatgtactgatgacaggctattattcgcctatactttatgctcgtcataccccacaaggtcaatttaaaaatccaatttatcgtatgcctgtaaaaaaacgtctaagtcgagcacaaatttatgcgggcgcattaacgggaaaaagattagagttagcatatagcgattcaatgttagaaaactttttacttggtgtacaaggcagtggctatgtagattttggcgatggtaatcttaactattttgcttacgcaggacaaaatggttacccttacacggctatcgggcgtttattagtagaagatggcgaaattccaaaagaaaaaatgtctattcaagcaattcgagaatggggtaatcgtaatccctctcgtgtacaaagcttgttagaacgcaatgaagcttatgtattctttaaaaatgatccaagtggcaaagtgaaaggctctgcgggcgttcctcttgtagcaatggcttcagtggcatcagatcgcaatattatcccgtctggttctgtgcttttagtcgaagtacccgacattgataataacggaaactggattggcacacacaaattacacttaatggttgcacttgatgtaggcggtgcagtgaaaggtcatcactttgacttatatcgtggtatcggtgctagagcaggacatattgcagggctttcaaaacactacggtagagtatgggtattacggtaa

SEQ ID NO: 954 - DNA, 771 bp, H. influenzae strain 86-028NP
atggctagaatagataattacgaacaacgctttggtggcattgggcgactttatacgcctgatggcttagcgcgcttacgccaagcgcatatttgcgtaataggcattggtggcgtgggttcttgggtcgtggaggccttagcacgttcaggtatttgcgaactcacattaattgatatggatgatatttgcgtcacaaatatcaatcgccaacttcctgcgatgagcggcacaatcggcaaattaaaaactgaagtcatgtcagagcgagtaaaattaattaacccagaatgtaccgtcaatattattgatgattttatctcgccagagaatcaatcggattatctcaaccgaggctatgactacgtcattgatgccattgacaatgtgaaaactaaagcgtcgctgattgcttattgtaaacgtaacaaaattaatgtgattactattggcggtgctggcggtcaaactgatccaacccaaattcaaattgccgatctcagtaaaactattcaggatccgctgctcgccaaagtgcggtcagttttacgcaaggattacaattttagccaaaatccaaagcgcaaatttagtatcgatgcggtattttcaacacaacctttaatattcccacaaatgactgaaggctgttctacttctgccacaatgaattgcgcaaacggatttggtgcagccacgatgattacggcaacctttggtttttttgccgtttctcgtgtaatagataaattactaaagaaaaaatcttaa

SEQ ID NO: 955 - DNA, 1002 bp, H. influenzae strain 86-028NP
atgaaaaaacttttaaaaattagtgccgtttctgccgcacttttaagtgcgccaatgatggcgaatgccgatgtattagcatcagtaaaacctttaggctttattgtttcatctattgcagatggcgtaactggtacacaagtccttgttcctgcaggcgcctctccgcatgattacaatttgaaattatctgatattcaaaaagtaaaatctgcagatttagttgtatggattggtgaagacattgattcattcttagacaaaccaattagccaaattgaacgtaaaaaagtgattaccattgccgatcttgcggatgtaaaacctttattaagtaaagctcaccacgagcatttccatgaagatggcgatcatgaccataagcacaaacacaaacatgatcataaacacgaccacgaccatgatcataaacacgagcataaacacgatcacgaacatcatgatcacgatcatcacgagggtttaacaacaaactggcacgtttggtattctccagctatcagcaaaattgttgcacaaaaagtagcggataaattaactgcacaattcccagataaaaaagcgttaattgcacaaaatctttcagattttaaccgcactttggcagaacaaagtgaaaaaattacggcacaacttgcaaatgttaaagataaaggtttctacgttttccacgatgcttatggttatttcaacgatgcttatggtttaaaacaaacgggttactttaccatcaatccattagtggcaccgggtgcaaaaactttagcgcacattaaagaagaaattgatgaacataaagtaaattgcttattcgcagagcctcaatttacgccaaaagtgattgagtctttagcgaaaaatactaaagtcaatgtaggacaactcgacccaattggcgataaagttactttaggtaaaaattcttatgcaacattcttgcaatctactgcagatagctacatggaatgtttagctaaataa

SEQ ID NO: 956 - DNA, 507 bp, H. influenzae strain 86-028NP
atggctgatccacatattaaatcaccgatggattttttagattatctgactgttattatttaccgaactggttttgtgatagcggcgttggctgttcttacagtgagttggtatccagatttatcactcacatttatattaattgcggcaacctgttgtgcctcttcgttacacatttacttaaaatcttttcgattgctttttcaatttgctacttggataggattacttttttatattaatcattatcctgcgttggctcttggcggtgcgttacttactttaggtggcttgtgttttaaagaatatttttgtttccgcgtgcctttgctaaatttacagccgatatttgtggcttgcttgtggttttcgtgggtgttaaataatcttattgcactacgcattttttctattatttctggcgtattacttttagttttagcgatacaaaaatggcgaatgcctttgcattttgatattggagataaaactaaatatcaaatttag

SEQ ID NO: 957 - DNA, 1359 bp, H. influenzae strain 86-028NP
atgaaacatattcatatcttaggtatttgtggcacatttatgggcggtgtggcgatgattgctaaacaaatgggctatcacgtaacgggttccgatactaatgtttaccctccaatgaacacttttttagaagagcaaggtatcgagattattccaaattatgatgttgcacaattacaacctgcgcctgatatggtaattgttggtaatgcgatgaaacgtggtaatccttgcgtagaatatgtgttggaaaataatttgaaatatacatctggccctcaatggttacatgatcatttattgcgagatcgttgggtattggcgatttcaggtacgcatggaaaaacaaccacaacaggtatgctaacgtggatcttagaacaaaatggcttaaaaccaggttttttaatcggaggaattgcgggtaattttggcatttcagctcgtttaggagatagcccttattttgttattgaagctgatgaatatgatacagctttctttgataaacgttcgaaatttgtccattacaatcctcgtacacttatcgtaaataacattagttttgaccatgcagatatttttgatgatctcaaagcgatccaacgccaatttcatcatatgattcgaactatcccagccagtggcttggtattaagttcggcgagtgaacaaagtgcaaaagaaactttggcattgggatgttggtctcaacagcaatttttaggcaaagataacgagtggtttgctgaacgtattacaaatgatgcttcacattttgctgtcttccatcatggagaaaaagtggcagaagtaaaatggaatgtagtgggacaacataatatgcataatgcgttaatggcgatcgctgcggctcatcatactggcgttgctattgaagatgcgtgcaaagcgttgggatcttttgtgaatgctaaacgtcgtttagaagtgaaaggtgaagttaatggcattacggtttatgatgattttgctcatcatccagaagctattcttgctacgctaaccgctttacgagataaagttggtggtgttcgtattcttgcagtgcttgaacctcgttctaacacaatgaaaatgggtgttcacaaagatgacatcgcgcctgcacttggtcgagctgatgccgtgtttatgcttcaacctgaacaactttcttgggaagtggcagatattgcaaaccaatgtgtacaacctgcttattggaatgcaaatttagatcgattagtggatatgattgttgcagaggctcaacctacggatcatattttagtgatgtctaacggcagttttggtggcattcatcaaaaaattcttgataagctaaaactgaaataa

SEQ ID NO: 958 - DNA, 1188 bp, H. influenzae strain 86-028NP
atgcaacaacacaatctctcaacaacatttgtccatgcagggcgtcaaaaacgtttttcacaaggatcggtaaaccctgttttacagcgagcttcttcattactatttgacagtattgaagataaaaaacacgctactcaacgtagagcaaaaggcgaattattttatggcagaagagggacgctaacacattttgctttacaagatttaatgtgcgaaatggaggggggggcaggttgttatctttatccttgtggtacagcagcagtaactaattcgattctttcttttgttaaaactggcgaccatgtgttaatgagtggtgcagcttacgagccaacccaatatttctgtaatattgtgctgaaaaaaatgcagatcgatataacttattacgatcctcttattggtgcggatattgcaacgcttattcaaccgaatacaaaagtacttttcttagaagcaccgagttctattacaatggaaattcccgatattccgactattgtgaaggctgcaagaaaggtgaaccctaatattgtgattatgattgataatacttggtcggcaggtgttctatttaaagcgttagagcatgatattgatatttctattcaggcgggtacgaaatatttagtgggtcattcagatattatgattggtactgccgttgcgaatgcgcgaacttgggatcaacttagagaacattcctatttaatggggcaaatggttgatgcagattctgcttatacgactgctcgtggtatccgtacattgggggtacgattaaaacaacatcaggaaagcagtattaaagtggcaaaatggttgagtgagcaaccagaagtaaaaactgtgtaccatccagctttaccaagttgccctggtcatgaattctttttacgtgattttagtggaagcagtggtttattttcttttgaattaacccagcgattaacttcagagcaagtatcaaaatttatggatcattttcaactgttcgctatggcttattcatggggaggatttgagtctctaattctttgtaatcaaccagaagaaattgcacatattcgtccaaatattaaacgtaatcttacaggttcattaattcgtgtgcatattggttttgaaaatgtggatgaactaattgcagatttgaaagctggttttgagcgaattgcttaa

SEQ ID NO: 959 - DNA, 609 bp, H. influenzae strain 86-028NP; identical to SEQ ID NO: 702

SEQ ID NO: 960 - DNA, 558 bp, H. influenzae strain 86-028NP
atgaaattcaatatcccaattttcctaacgatctttcgagtcattttgattccttttttcgtgattgcattttatttacccattgaatcatctcctttcatcacaacactgattttttttattgcaggtgtcactgactggctagatggctatctagctcgtaaatggaaacagaccacgcgctttggtgcatttcttgatcctgttgctgataaagtaatggtagtggctgcactagttttaattgtcgaacatcaacatacattttggataaccattcctgccattattatgatttctcgtgaaattatcatctccgcattacgtgaatggatggcagagcttggggaacgtagcaaagtcgcagtctcttggtggggaaaatggaaaaccacagcgcaaatgttagcactaggcggattattatggcgttataacaactatatggaaatagcagcaattatcttactttatatcgccgctattttaactatatggtcaatgatccaatatttacaagtagcaaaaggaagcttgctagataatattcaattataa

SEQ ID NO: 961 - DNA, 531 bp, H. influenzae strain 86-028NP
atggctgattttaatcaaattttaacgccaggcgatgtagatgctggcattatcaatgtagtaaatgaaattccagaaggtagctgccataaaatcgaatggaaccgtaaagttgcggcattccagttagatcgtgttgagccagcaatttttgcaaaaccaactaactatggtttcattccacaaactttagatgaagatggcgatgagttagatgtgttattaatcactcgccaaccattagcaacaggtgtattccttgaggctaaagtaattggtgtcatgaaatttgttgatgatggcgaagtggatgataaaatcgtttgtgttcctgcagatgatcgtgatacaggaaatgcctacaattcattagcagatttaccggcaaacttaattaaacaaattgagttccatttcaataactataaagcgcttaagaaacctggctcaacgaaagtgacccattggggcgatgtagaagaagcgaaagaagtgattcgtgagtctattaaacgttggaatgagcgttaa

SEQ ID NO: 962 - DNA, 1317 bp, H. influenzae strain 86-028NP
atgccaactttagaaaaaacatttgaactcaaacaacgtggttcaactgttcgtcaagaaattatcgcgggtttaaccacgttcttagcaatggtttattctgtcatcgtggtacccaatatgctgggtgctgcaggttttcctgcggaatctgtctttattgccacctgtttagttgcaggattaggctctatcttaatcggcttatgggcaaatgcaccaatggcaattggttgtgcaatttctcttactgcttttacagcatttagcttagtgattggtcaaaaggtcgccattcccgttgcgctaggcgcagtattcttaatgggggttgtgtttaccttaatttctaccacaggtatccgtgcatggatcttgcgtaatttaccatccaatatcgctcacggagcaggcattggtatcggactctttttacttttaattgccgcaaacggtgttggtttagtcgtcagcaaccaagctggcttaccagtaaaattaggcgatttcacttcattcccagtcatgatgtccttgattggcttagcgttaattattggtcttgaaaaaatgaaaattaaaggcggcattttatgggtaattatcgctattactatcgtaggtttaatttttgatccaaatgtaaaatttggcggagagattttcaaaatgccaacctttggtgaaaattctctcttcttacaattagactttatgggcgcactacaacccgcaatcttgcctgtggtatttgctttggtgatgactgccgtatttgatgcaacgggcactattcgcgcagttgcaggtcaagcagacttgcttgataaagatggtcaaattatcaatggcggtaaagccttaacttcagactcaatcagtagcttattctcaggcttattcggtacagcaccagctgccgtttatattgagtcagcagcagggacagcagcaggcggtaaaacaggtattactgctatcgttgttggtgtgttattcctattaatgcttttcttccaaccattagctttcttagtgccaggctacgcaactgctccagcattaatgtatgttggtttattaatgttaagcaatgtaagcaaattagatttcgatgatttcgttggtgcgatgagcggattaatctgcgcagtgtttatcgtacttaccgctaacatcgtaacaggtattatgttaggttttgcggcattagtaattggaagaatcgtgagtggcgatattaaacgcttaaatgtaggtactgtgattattgcaatcgtacttgttgcattctatgcaggcggttgggcgatttag

SEQ ID NO: 963 - DNA, 642 bp, H. influenzae strain 86-028NP
atgtcaaatccctcttgtatcatcatcgccatcacaggtgcatctgcatcaggcaaaagttctatcgcttccactgttcacaaagagctctgtaatgaactaggctgccaagaaattggtatcattactgaagacagttactataaagatcaaagtcatttagaaatgactgagcgggtaaaaacgaattacgatcatccaaactctatggatcgcgatttacttatccaacatttaaaaaatctaaaaaatggcagtgcagtagatgtgcctgtttatagctatgtagaacatactcgcaccaacgaaacaacgcatttcacaccaaaacgaatcgtaattttagaagggattttattgctcacagacgaaagagtacgccaattagccgatatttctgtattcgtagacacaccacttgatatttgtttcatccgccgtttacaacgtgatatggaagaacgtggtcgctctctacaatcagtgattgatcaatatcgtgcaaccgtgcgtccaatgttcttacaatttattgagccatctaaacaatatgcggatattgtcattcctcgtggtggtaaaaaccgtattgcaatcaatatgttaaaagctcaaatccttcatttattgaatcaaaaatag

SEQ ID NO: 964 - DNA, 588 bp, H. influenzae strain 86-028NP
atgcgtctttgcgatactgatattgaacgctatctcgatgatggcattatttctttaacaccacgtccaaataatgacaaaatcaatggtgcgacaattgatgttcgcttaggtaattctttccgtgtatttcgtgaacactctgcacctttcattgatttaagtggcccgaaagaagaagtatccgcccagcttgaatcagtaatgagcgatgaaattcttattccagagggggaagcatttttcttacatcctggtactttagccttagcaaccacgcttgaatccgtgaaattgccagccaatattatcggttggttagatggccgttcttctttagcccgtttaggcttaatggtacacgtcaccgcacaccgaattgacccaggttgggaaggaaaaatcgtgctggaattttataattcagggaaattaccattagcattacgcccaaatatggtaattggtgcgttaagttttgaagtattaagtggcgaagcaaaacgaccatacagtagccgcaaagatgcaaaatataaaaatcaacaaagtgcagtagccagtcgtattgacgaagacaaggaataa

SEQ ID NO: 965 - DNA, 1176 bp, H. influenzae strain 86-028NP
atgaaaaagttcgcgcttatcgtagggatcgtcgctttggcgatcttttcttttttatatattcaactttaccgcgtgcaaagtgctattaatgaacaactggcacaacaaaacattgccgttcagtcaatcaatttatcattattttctcccgcactttcccttgaaaatctaaaaactacgcaattttcagctcaaaaaattgaagctaaatttagttttttgcctcttttgtatggaaacgcagcacttcattcactgaatattcaacagctcaaattaactcaaaacacacaaaatcctgccaatgtatcgatagaggtttcgcctttttcgttaaaacagcttttatcaaaaaaagtaatattaaatggcgaaaaccatattcgcattgaatttaataagcctatttatggaaaaacaaaaactttccatttttctttccataaagcgaatttagacttctcaacatcagaatcaaccccacttcaatttgtagatgcaagcctaaataatcagcctatcggttatattgaaagccacacagcccaccaacaaatagtgacttatataaaaccacaatgcgataacgattgtttagccgtattgaaatatcaacaaatagacaatcaaagtgcggtaaatttttcgggtaaatatttccctgttcaacgcttattcgcactattaaatttgccagaaattttaagtggacacgccgattttgatcttgatttcagcttttcatcttccgcgcttattcaaggtaaattaaattttttagcgcaaaatggcgaaattcttggtgtgaatctattggatatggtagcgcaatatttcccgattaattacaacaatgatctgttacaaaacaaagaattaaacactcgctttgaacaattttacttgcaattatttctccaacaaaatcaactcattgctgaaaaaatcgaattaaaaacgcccgcacttttggggcaaggaaaaggcatcattgatttaaatcgaatggaatgcaatgtggatattaatttaaattctacggatcaacgctatcaaaatttgacacttccaatcaatttttttggtaactgcaattctccacaatacaaaattaattttacgaagaaattccgccatcaattaattgatgcgattaaagaaaagttacgttaa

SEQ ID NO: 966 - DNA, 1209 bp, H. influenzae strain 86-028NP
atgtcgttatatttaaaagctgaaaaaatccaatcatggcgcgtgcttattatggcttgcgcaggatttatttttaatactacagaatttgtacccgttgcaatgttaagcgatattgcacaaagttttgatatgcaaactgctgatactggtttaatgatgacagtttatgcttggacggtgctaattatgtctttaccagcgatgcttgccacgggcaatatggaacgtaaaagtctgcttattaagcttttcattatatttattgttgggcatattttattggtcattgcatggaatttctggatattacttctcgctcgaatgtgtattgcattagcccattcggtgttttggtcaattactgcctcacttgtgatgcgcatctcacctaaacacaagaaaactcaagcattaggaatgctcgctattggcaccgcacttgccaccatcttaggcttaccgattgggagaatcgtcggacagcttgtcggttggcgagtcacttttggcattattgcggtactggcattatccatcatgtttttaattattcgattattgccaaatttacccagtaaaaatgctggctctattgcaagtttacccttgcttgcgaaacgcccattattactttggctttacgtaacaacggcaatcgtcatttcagcacattttactgcttatacttatatcgaaccatttatgattgatgtcgggcatttagatccaaattttgccacggctgtattattagtttttggtttctcaggcattgcagcaagcctattatttaacagattataccgatttgctcccacaaaatttattgttgtttcgatgagtttattgatgttctctctattgctcctgttattttcaactgaagcaataatagcaatgttcagccttgtgtttatttgggggattggcatttcttgtatcggactatctctacaaatgcgcgtactaaaacttgcgccagatgcaaccgatgttgccacagctatttactcgggcattttcaatgcaggaattggcgcaggcgcattatttggaaaccttgcgacaacctatttaggattaaatgaaattggttatacaggcgcagcattaggtttaatcggtttcatcatttttattacaacgcacttaaaatatcgccatacctttcttctgcaaaacaataaaaaaataaccgcactttag

SEQ ID NO: 967 - DNA, 1515 bp, H. influenzae strain 86-028NP
atggcaactccagtcgtcgcccttgttggtcgcccgaatgtgggaaaatccacattatttaatcgccttactcgtacgagagatgcgttagtcgctgattttccaggtttaactcgtgatagaaaatatggtcacgcacatattgctggctatgattttattgttattgatactggcggtattgatggaacggaagagggcgtagaagaaaaaatggcggagcaatctttgcttgctattgatgaagccgacattgttcttttccttgtggatgcgcgagcaggtttaacggcagctgatattggtattgctaattatttacgccaacgtcaaaacaaaattactgtggtggtggcaaataaaaccgatggtattgatgcggattctcattgtgctgaattttatcagttaggtttaggagaaattgagcaaattgcagcctcacaaggtcgtggtgttactcaattaatggaacaagtacttgcgccttttgcggaaaaaatggaaaacgccgatgaaaatgaccgcacttctgaggaagaacaagacgaatgggaacaagaattcgattttgattcagaagaagatacggcattaattgatgatgcgttagacgaagaacttgaagaagaacaagataaaaatatcaaaatagccattgtaggtcgtccaaatgtgggtaaatctactttaaccaatcgtattttaggcgaagatcgtgtagtggtttttgatatgccaggtacgacacgtgacagtatttatattccaatggagcgtgatggacagcaatataccttgattgatacggctggtgtgcgtaagcgtggtaaagtgcatttggcagtggaaaaattctctgtgattaaaaccttgcaagcgattcaagatgctaatgttgtattgctgactattgacgcgagagagaatatttctgatcaggatttatctttgctcggctttattttaaatgcagggcgttctttggtgatcgtcgtgaataaatgggatggtttagatcaagatgtgaaagatcgtgtgaaatctgagcttgatcgtcgtttagattttattgattttgctcgggtgcattttatttcagccttgcacggaagtggtgtaggtaatctttttgattcgattaaagaagcctatgcttgtgccactcaaaaaatgacgacttcgcttttaactcgtattttgcaaatggcaacggatgagcaccaaccgccgatgattggcggtcgtcgcattaaattaaaatatgctcacccaggtggttataatccgccgattatagtagttcacggtaaccaaatggataaactaccagattcttataaacgttatttatctaattattatcgtaagagcttaaaaattattggttcaccgattcgtctgcttttccaagaaggctcaaacccatttgcaggacgcaaaaataaactcactccgaatcaattgcgtaaacgtaaacgtttgatgaagtttattaagaaagcaaaacgttaa

SEQ ID NO: 968 - DNA, 768 bp, H. influenzae strain 86-028NP
atgattaatcccaatcgccaaattgtattagatactgaaactacaggtatgaatcagcttggcgcgcattatgaaggacactgcattattgaaattggtgcagttgaattaataaatcgtcgttacacaggtaataatttccatatttatattaagccagatcgccctgttgatcctgatgcgattaaagttcatggtattactgatgaaatgttagcggataaaccagaattcaaagacgtagcccaagattttttggattatattaatggtgcggaattgcttattcacaatgccccctttgacgttggatttatggattatgaatttcgtaaacttaaccttaatgtgaaaactgacgatatttgtttggtgacagatacgctacaaatggcgcgtcagatgtatcttggaaaacgcaataatttggatgcactttgtgagcgtttaggtattgataatagcaaacgtactttgcacggtgcgttactggatgccgagatcttggcggatgtttatttgatgatgacgggagggcaaacaaatttattcgatgaagaatctgttgagtctgaagttatccatgttatgcaagaaaaaacggcggaagaaataaaaagtgcggtagatttttcgcacaatttgaaattacttcaacctactaatgatgagttacaagcgcatttagaattcttaaagatgatgaataaaaaaagtggaaataattgcctttgggaaaaacgctttggcaataataatgtgcattaa

SEQ ID NO: 969 - DNA, 465 bp, H. influenzae strain 86-028NP
atgcaaaaacagattgaaatttttactgatggatcttgcttaggtaatccaggggcgggtggaattggtgccgtattgcgttataaacaacatgaaaaaatgctctccaaaggctatttcaaaaccaccaataatcgaatggaattacgcgctgtcattgaagcattaaatacattaaaagaaccttgtttaatcacgctttatagtgatagccaatatatgaaaaatggcataacaaaatggatctttaactggaaaaaaaataattggaaagcaagttctggaaagcctgtaaaaaaccaagatttatggatagccttagatgaatccatccaacgtcataaaattaattggcaatgggtaaaaggtcatgcaggacacagagaaaatgaaatttgcgatgaattagcaaaaaaaggagcagaaaatccgacattggaagatatggggtacatagaagaataa

SEQ ID NO: 970 - DNA, 1098 bp, H. influenzae strain 86-028NP
atgaaaaaaacacttgcagcattaatcgttggtgcattcgcagcttcagcagcaaacgcagctgttgtttataacaacgaagggactaacgtagaattaggtggtcgtttaagcattatcgcagaacaaagtaatagcactataaaggatcaaaaacagcaacacggtgcattacgcaatcaaagttcacgtttccacattaaagcaactcataacttcggtgatggtttctatgcacaaggttatttagaaactcgtttagtttcagctcaatctggaaccgagtcagataacttcggtcatattataaccaaatatgcttatgtcactttaggaaataaagcattgggtgaagtaaaacttggtcgtgcgaaaactattgctgatggcataacaagcgcagaagataaagaatatggtgttctcaacaatagcaaatatattcctactaatggtaataccgttggctacacttttaaaggtatcgatggtttagtattaggtgctaattatttattagcacaagagcgtcataagtatactactgctgctggtactcgtgctgttactgttgcaggagaagtttatccacaaaaaatcagcaatggcgttcaggttggtgcaaaatatgatgcaaacaacattattgcaggtattgcttatggtcgtacaaattatagagaagatattgttgacccagatttaggtaaaaaacaacaagtaaacggtgcgctttcaactttaggctatcgttttagtgatttaggcttattagtgtctctagatagtggctatgcaaaaactaaaaactataaagataaacacgaaaaaagctatttcgtatctccaggtttccaatatgaattaatggaagatactaatgtctatggcaacttcaaatatgaacgcgattctgtagatcaaggtaaaaaaacacgtgaacaagcagtgttattcggtgtagatcataaacttcacaaacaagtattaacctatattgaaggtgcttacgctagaactagaacaactgagcaagctaaaggcgtaaaaactgaaaaagaaaaatcagtgggtgtaggtttacgcgtttacttctaa

SEQ ID NO: 971 - DNA, 1146 bp, H. influenzae strain 86-028NP
atgaaatacgcattaaccaacagtgtgatctacactaaatacgaaattctacgagattatgcggtagtaattgatagcgaaactattgaagcagtgatcccccaagctgaattagaaacaggtatcaaaaccattgatttacaaggtaataatttaacggctggttttattgatctgcaattaaatggctgtggtggcgtgatgtttaacgaccaaactagcgttgaaaccttggaaattatgcaggaaactaacttaaaatcaggttgtacaagtttccttcccacttttattaccgcgcctgatgaaaatataaaaagtgcggtaaaaattatgcgtgaatatttaaacaagcataaaaaccaagcacttggtttacatattgaagggccttatctcagcattgagaaaaaaggcgtacaccgccccgaatatattcgtgaaattacgcctgaaatgaaagattttctctgtgaaaatggcgatgtgattacaaaaataaccattgccgcagaaaacccaaccattaactatacgcctgattttgtgaaagcgggcattattgtctctgtaggtcattctaatgccacttatgaagtggctaaagccgcattccacaaaggcgcaacatttgcaacccacttacataatgcaatgtcgccaattagttctggacgtgaaatgggcgtagtgggcgcagtattagattctgatgtttacactggcattatcgtggatggtgtgcatatcaattatggcaatgttcgcattgataaaaaaatcaaaggcgacaaactttgtattgtgactgactctattgcagcggcaggcgcaccgccagaactagaaaattttacctttgtgggaaaaacaatttatatcaaagatgggcgttgctatgatgctaatggcacgattgcaggggcatcaatcacaatgatggaatccattaaaaatgcggtagaatatgttgaaattcctcttgctgaagccattagaatgagtaacctttatcctgcacgagcaattggtatagatgatcgtttaggttcggtagaaaaaggtaagatagcaaacttagcagtgtttacgccaaattaccaagtaatcggcacagtagtaaacggaaagtggaaagagaattaa

SEQ ID NO: 972 - DNA, 813 bp, H. influenzae strain 86-028NP
atgcgttttattccattacaaacagaacaacaagtcagttgttgggctgcacaacatatcatcaatcgtatcaacgattttaaacctaccgccgagcgtccttttgtattggggttacctactggtggtacaccactaaaaacttatcaagaactgattcgactttatcaagcaggcaaagtgagtttcaaacacgtagtgactttcaatatggatgaatatgtggctttaccagaggaacaccctgaaagttaccacagctttatgtataacaattttttcaatcatatcgatattttacctgaaaatatcaatattcttaacggcaataccgatgaccataatgcagaatgccatcgttatgaagaaaaaattaaatcctacggcaaaattcatctgtttatggggggggttggcgtagatggacatatcgcatttaatgaacctgcttcttcattaagttctcgcacccgtattaaaacgctaacgcaagatacattaattgcaaattcacgcttctttaataacgatgttactcaagtgccgaaatatgctttaaccattggtgtcggtacattattagatgcagaagaagtgatgattttagcaacaggacatcaaaaagcactggcagtgcaagctgccgttgaaggcagtattaaccatttatggacagtcagtgcattacaaatgcaccgtcatttcgtgcttgtttgtgatgaagctgctcaacaagagttaaaagtgaaaaccgtgaaatattttactgaattagaaggctcggttgctggtacggattatcaggataaatag

SEQ ID NO: 973 - DNA, 882 bp, H. influenzae strain 86-028NP
atgcgtgatttaaaaggtattttcagtgcattattagtgtcatttaatgaagatggcaccattaatgaaaaaggtttacgccaaattatccgccataatatcgacaaaatgaaagttgatggcttatatgtgggcggttcaacaggcgaaaactttatgctttcaacggaagagaaaaaagaaatcttccgcattgcaaaagatgaagcaaaagatcaaatcgcactaattgctcaagtgggcagcgtaaacttaaaagaagcagtggaattaggtaaatatgcaacagaattaggctacgactgcttatctgcagtgacgccattctattacaaatttagcttccctgaaattaaacattattacgacaccatcatcgctgaaacgggcaacaatatgattgtgtactcaatcccgttcttaactggcgtgaatatgggcattgaacaattcggtgaactttacaaaaacccgaaagtattaggggtaaaattcacagcaggtgatttctacttattagaacgtttgaaaaaagcttatccaaaccacttaatttgggcaggttttgatgaaatgatgttaccggcagcctcacttggtgtggatggtgcaatcggttcaactttcaacgtaaacggcgttcgtgctcgtcaaatttttgaattaaccaaagcgggtaaattagccgaagcgttagaaatccaacacgtaaccaacgatttaatcgaaggcattttagcgaacggtttatatttaaccatcaaagaattgcttaaattagaaggggtggatgcaggttattgccgtgaaccaatgacatcaaaagcaacagcagaacaggttgcaaaagcaaaagacttgaaagcgaaatttttgtcataa

SEQ ID NO: 974 - DNA, 867 bp, H. influenzae strain 86-028NP
atggctaaattgggaaatgtgttaaacaaaattggctcactttaccagagtttaactaaatcagagaaaaaaattgccgatacgattttgcgttcgcctgatttagtctctcaatgctccctttcagaaatcgctaaacatttgcaagttggagaagctacgctcgtccgtttttgtcgaaccattggttttaaaggtttcagcgagttcaaactagagctttctattgaacttgcgacgaaagataatcaagatgaaagcatacttgaaacagaaattatgccaagtgatgattcgctcactattgcacaaaaattgcaaacggcggttgctaatgtaatggaagaaacgattaatttacttgatttaaaacagcttgaagaagtcgttaaagtacttaaaaaagcacgccgtatttttttatttggtgtgggttcatctggcgtaacggctgaagatgctaaaaataagctgatgcgtattggttttcaagtggatgcttcaggtaataatcattttatgtatatgcaggcggcattattgacctcttctgatgtggcaattggtttaagccattctggttattctgctgaaacggcacataccatcaaaatcgcaaaacaaaatggtgcaacaacagtggcattgacgcatagtttgcgttcccccgtgacagaatatgctgattatgttttggtaaatggtaataaacaaggcaagttacaaggcgattctattggcaccaaaattgcacagctttttgtattagatttaatttatgctttgttagtgcagggcgaagaagaaattgccgctcaaactaaacaaaaaactctcaatgtaattcttgaacaacgtataaaatag

SEQ ID NO: 975 - DNA, 903 bp, H. influenzae strain 86-028NP
atgcgttgtttagcactagatattggtgggacaaaaattgcagcggcgattgtaaaaaatggcgaaattgagcaacgtcagcaaattcatacaccacgtgaaaatgtcgtggagggaatgcaccaagcgttaggcaaattgcttgctgattatgaagggcagtttgattatgtagcggtagcatctacggggattatcaataatggtattttaagtgcattaaatccgaaaaacttaggtggcttggcggaatttccacttaaagcgagtattgcaaaacatacggataaaccgattggtttattaaatgatgcacaagctgcgacttatgcggaatatcaattgcaaaattttgaacaggtatcaaattttgtttttattaccgtttcaacaggagttggcggagggattgtgctgaaccaaattttgcagacaggttctcgtggtattgcagggcatattggtcatacattagctgatccaaatggtgcgatctgtggttgtggtcgtcgaggttgtgtcgaagcgattgcttcagggcgagcaattgaagcagtttcttcccaatgggaagatccgtgcgatccaaaagaagtgtttgagcgttttagaaaaaatgatgaaaaagcgaccgcacttgtcgagcgttctgcgaaagccattgctaatttaattgctgatttagtgattagtttagatattcaaaaaatcgcgattggtggcagtgtgggattagctgagggatatttatctttggttgaaaaatatttacaagattttccttcgatatattgttgtgaaattgaaaccgctaaatttggacaagatgcaggtttaattggcgcagcttattgggtaaaagatgttttactggataagcctgaaggaacaatttatggctaa

SEQ ID NO: 976 - DNA, 687 bp, H. influenzae strain 86-028NP
atgtctaaattatcttatcaagaagtactttctcaaattcaatatggtctcatttcttcttgccaacctgtcgatgatggcccaatggataaacctgaaatcgtttctgctatggctcaggcttcagttatgggcggcgcttctggcttacgtattgagggtgttgataaccttaaagcaacccgtccttttgtgaatgttccgattatcggaattgtaaaacgtgatttgcctgatagtcccgtgcgtattacgccgtttttacaagatattgaagatctagccaatgcaggtgcggatattattgcagtagatggcacgagccgcccacgtcctgtggatattgaaagtgcggtgaaaaaaatccacgaaatgggctgtttggcaatggcagattgttctaatttagaagaaggcttgtattgtaaagcgcttggttttgatattgtcggcagtacgatgtcgggttatacaggtggcgcagtgccagaagaaccagattatcaattagtgaaagatttaaaatcagcgggttgttttgtgatggctgaggggcgttataacacaccagaattggcaaaagtggcaattgaaattggtgcagattgcgtgactgtaggttcagccttaactcgtcttgaacatattgtgagttggtttgctaattcagtgaaatctgcaagatag

SEQ ID NO: 977 - DNA, 990 bp, H. influenzae strain 86-028NP
atgatgaaattgacaaaacttttccttgccacagccatttctttaggcgtatcttctgctgttcttgccgctgattatgacttgaaattcggtatgaatgctggaacttcatcaaatgaatataaagcggcagaaatgtttgccaaagaagtcaaagaaaaatcacagggtaaaattgaaatttcactttatccaagttcacaattaggtgatgaccgagcaatgttaaaacaattaaaagacggttctcttgacttcacctttgcagaatctgctcgcttccagttgttttaccctgaagcagcagtatttgccttaccttatgttattagcaactacaatgttgcacaaaaagccttattcgatacagaatttggtaaagatttaattaaaaaaatggacaaagatcttggtgttactttactttcccaagcttataacggtactcgccaaacgacttcaaaccgtgcaatcaacagtattgcagatatgaaaggcttaaaacttcgtgtaccaaatgctgcaacaaacttagcctatgctaaatatgttggtgcatcgccaacaccaatggcattttctgaagtttatcttgcattacaaacgaatgccgtcgatggtcaagaaaacccgttagcagcagtgcaagcacaaaaattctatgaagtgcaaaagttcttagcaatgactaaccacattttgaatgaccaactttatttagtaagcaacgagacttataaagaactccctgaagatcttcaaaaagtcgtaaaagatgctgccgaaaatgcagcaaaatatcacactaaattattcgtagatggggaaaaagatttagtcacattctttgaaaaacaaggtgtgaaaattacacatcctgatcttgtcccatttaaagcatcaatgaagccatattatgctgagtttgtaaaacaaacgggtcaaaaaggtgaagcagctttaaaacaaattgaagcaatcaatccataa

SEQ ID NO: 978 - DNA, 1851 bp, H. influenzae strain 86-028NP
atgaaatatattaataagcttgaagaatggctgggtggcacattatttattgccattttcggtattcttatcgctcaaattctttcacgccaagtttttcattctccgttaatttggagcgaagaactcgccaagctcttatttgtttacgtgggtatgttaggtatcagcgttgctgtaagaaaacaagaacacgtatttattgattttttaactaatctgatgcccgaaaaaatcagaaaatttaccaatacttttgtacaattattagtctttgtatgtattttcttgtttattcatttcggtattcgtacttttaatgacgcatcattccctattgatgccttagggggcatttctgaaaaatggattttcgctgcactacctgttatcgcaatattaatgatgtttcgctttatccaagcgcaaaccataaactttaagacagggaaaagctatttacctgcgactttctttatcataagtgcggtcattttatttgcaattttatttttcgcgccagattggttcaaagtattgcgaattagcaattatataaagctcggttcaagttcagtctatattgccttactcgtttggctcatcattatgtttatcggtgtccctgtaggttggtccttatttattgctaccctactttatttttctatgacacgttggaacgtcgtaaatgccgcaactgaaaaattagtctatagcctagacagctttccattacttgccgtgccgttttatattttaacgggtattctaatgaatactggtgggattaccgaacgtatttttaatttcgctaaatccttactcggtcattacacaggaggaatgggacacgttaatatcggcgcaagtttattattttcaggtatgtcaggatccgcattagctgatgcaggcggtttaggtcagcttgagattaaagcaatgcgtgatgctggttatgacgatgatatttgcggaggaattactgctgcttcttgtattattgggccattagttccaccaagtattgcaatgattatttacggtgtcatcgccaatgaatctatcgcaaaactctttattgcaggttttattcccggtgtattaattactttagctttaatggcaatgaattatcgcattgcaaaaaaacgaggttatccacgtacaccaaaagccacaagagaacaactttgcagcagctttaaacaatctttttgggcaatcttaacgccattattaattatcggcggtattttttcaggcttattcagtccaacagaatctgccattgttgcagcagcatactctataattattggtaaatttgtgtataaagaattaaccttaaaaaccttatttaatagttgcatagaagcaatggcaattacaggcgtggtcgccttaatgattatgaccgtgactttctttggcgatatgattgcccgtgaacaagtcgcaatgcgtgttgctgatgtgtttgttgccgttgccgattcgcctttaaccgtattggtaatgatcaatgcactgttactttttcttggaatgttcattgatgccctagcattacaatttttagtattaccaatgcttattcctatcgcaatgcaattcaatattgacttaatcttctttggtgtaatgaccacattaaatatgatgattggtattcttaccccaccaatgggaatggctctctttgttgttgctcgtgtaggaaatatgtcagtttccacggtaaccaaaggcgtattaccgttcttgattcccgttttcgttacattagtattaatcacgattttcccacaaatcatcacatttgtgccaaatctattgataccataa

SEQ ID NO: 979 - DNA, 1140 bp, H. influenzae strain 86-028NP
atggggtttattatgaaactaaccaaaacagcattatgcaccgcactttttgccacctttactttttcagcgaacgcacaaacttatcctgatttgccagtgggaatcaaaggaggaacaggtgcattaattggcgacaccgtttatgtgggattaggctctggtggcgataaattctataccttagacctaaaagatccttcagcacaatggaaagaaattgctacatttccgggtggcgaacgtaatcaacctgttgcagctgcggtagatggcaaactttatgtattcggtggtttacaaaaaaatgaaaaaggcgaacttcaactcgttaatgatgcttatcgctataacccaagcgataatacttggatgaaacttcctactcgttctcctcgcggtttagtaggatcaagtggtgcatctcacggagataaagtttatattttaggcggctctaacctctctatatttaatggcttcttccaagacaacgttgcagcaggagaagataaagggaaaaaagatgaaatcgttgcagcttacttcgatcaacgtccagaagattatttctttacaacagaattattgagctatgaaccctcaaccaacaaatggcgcaatgaaggtcgcattccattctctggtcgtgctggtgctgcctttacaattcaaggtaatgatctagtggttgtcaatggcgaaattaaacctggacttcgcaccgctgaaacccatcaaggtaaattcactgctaaaggtgtgcaatggaaaaacttacctgacttacctgcgccaaaaggcaaatcacaagatggtttagctggtgcacttgcaggctatagtaacggttattatttagtcactggtggcgcaaattttccaggttcaatcaaacaattcaaagaaggaaaacttcacgcacataaaggtttaagcaaagcttggcataacgaagtttatactttaaataatggtaaatggagcatcgttggggaattaccaatgaatattggctatggtttttctgtatcttacaataataaagttttactgattggcggcgaaactgatggaggtaaggctttaactagcgtcaaagcaatcagctatgatggtaaaaaattaaccgtcgaataa

SEQ ID NO: 980 - DNA, 435 bp, H. influenzae strain 86-028NP
atgttatttattccaccaccactactctgtttattcattgccatagcaatgtattttttgccaaagattgctagttattctgtccatttttcagtgattgtttttgttatttccctttcatttttgattgctttaagcagcgttatgcaattctttatatgtaaaacctccattaatcctcgtgactttaaaggcacaacaaaattagtttccacaggcatatttcgatttagccgtaacccaatgtatttaagtttgctgttaattttgcttgcttggacgctttggttaggtaatagtttagcttggttaggcgtaattgtctttatactagttatgaaccactgtcaaatagcccgagaagaagcctatttggaaaataaatttggcgatgaatatcgtcgttacaaacaaaaagtaagacgttggctataa

SEQ ID NO: 981 - DNA, 888 bp, H. influenzae strain 86-028NP
atgcgtagatttttattacctgttattttcgtgattgcggcagtggtttattctagtatcgtcgttgtaacggaaggtacccgtggcattatgttacgatttaacaaagtacagcgtgatgctgataacaaagtggttgtatatgaaccaggcttgcattttaaagtgcctttaattgatagcatcaaagttttagatgcgcgtattcgtactttagatggctctgcaacacgttttgttactgttgagaaaaaagatttgctagtggattcttatgtgaaatggaaaatcagtgattttggtcgattctacacatctactggcggtggcgattatgctcaagctgcaaatttattaagtcgtaaagtaaacgaccgtttacgttctgaaattggttcacgcacgattaaagatattgtttctggtacacgtggagaattaatggaaggggcaaaaaaagctttaagttcaggacaagacagtacggcagaattaggtattgaagtgatcgatgtgcgtgtaaaacaaattaatttaccagatgaagtctcttcttcgatttaccaacgtatgcgtgcagaacgtgatgcagtggcgcgtgaacatcgttctcaagggaaagaaaaagcagcatttattcaagctgatgtagatcgcaaagtgacgttaattcttgctaatgcaaataaaactgcacaagaattacgaggttcaggcgatgcagctgcagcaaaattatattcagatgcttttgctcaagaaccacaattctttacttttgtgcgtagcttaaaagcctatgaagcgagttttgcaaattctgacaatataatgattttaaaaccagatagtgatttcttccgctttatgcaggcaccgaaaaaatag

SEQ ID NO: 982 - DNA, 1233 bp, H. influenzae strain 86-028NP
atggagaatgaaatgtcacagaacggttcagatcgcgatccttggagtaaaccagggcaaagcaacgaccaacagccgggaaattcatccaataataatggatggaataacaatcaaaatcgtggaaatcaagagcaatctccgccagatattgaggagatttttaataatctgcttaaaaaattaggtggtggaaataaaaagagcggtcaaaataatggcagttctcaaggcaatacgccatttcattttggcaaagttattccacttgctgtagcgattggtgcaattatttggggcgtaagcggtttttacaccattaaagaggctgaacgcggtgtggtgcttcgttttggcgagttacattctattgttcaacccggtttgaactggaaaccaacatttgtagataaagtattgccagtaaatgtggagcaagtaaaagagttgcgtacacaaggtgcaatgctgactcaagatgaaaatatggtaaaagtggaaatgaccgtgcaatatcgcgtgcaagatcctgcaaaatatctttttagcgtaacaaatgcagatgatagtttgaatcaagcgacagatagtgcattacgttatgttattgggcatatgtctatgaatgatattttaaccacaggtcgctctgtcgtgcgtgaaaatacttggaaagctttgaatgaaattatcaaatcctatgatatgggacttgaggttattgatgtgaacttccaatctgctcgtccacctgaagaagtaaaagatgcgtttgatgatgcaattaaagcgcaggaagatgaacaacgttttattcgtgaagcggaagcctatgcgcgtgagaaagaaccgattgcacgcggtgatgcacaacgtattcttgaagaagcaacagcttataaagatcgtatcgtgttagatgcaaaaggtgaagtggaacgtttgcaacgcttgttgccagaatttaaggctgcaccagatttactgcgtgagcgtttatatattcagacgatggaaaaagtgatggcaaataccccaaaagtaatgcttgatggcaataatggtaataatttaactgtgttaccgctagagcaaattatgggcaaaaaatcggtaacaagtgcgccaagtgcggtcaattcttcgcctgcttttactgcaccagaacgtcaaaattcttatcagcctcagccgactaccgttgcgccgattcgtcaagggagatttaactaa

SEQ ID NO: 983 - DNA, 708 bp, H. influenzae strain 86-028NP
atgacaacctacatcgcctacggcaatataaatcaacctttttctttggaatccttacccgatgaactgattccagaaaatctatatcaaattgaaacggatagctcccgtgtttttcagcgtcatcagtgtcgtcggcttgcgcatttattacttttccaacttctaaaaatagcaggaaaatccaccgcacttttatctcaaattcatcgtactgaaagtggcagaccttattttcttgatgagcgaatagattttaatattagccattctggtgattgggtggcggtaatattagatattagaaaagaagaaaaaagtgcggtgggaattgatattgaatttcctaaaataagaaattttacagcgttgatggagcatattgcaccaaaagaagaaattgattggtttcatcatcagcaggattctttgaacgctttttatcgttgttggtgtttgcgagaggcggtattgaaatctcaaggatttgggatcgtaaaattatccaatgttcgtcattttcctgaacaacaaaaaattttttcagattattgtccgcaggggcagttgtggtttactgatgaacttcctatttatttagccgcttttgtcaatcatcaagaaaaattaccgcacttttatgaatggaatagagaaagtttacagataaaagaacttgaaaaatatgttctttatgaagtgaattaa

SEQ ID NO: 984 - DNA, 1332 bp, H. influenzae strain 86-028NP
atgctttacttagaatttttatttttactattaatgctttatatcggtagccgttacggcggtatcggattaggtgttgtttctggtatcggtcttgctatcgaggttttcgtatttcgtatgccagtggggaaagcaccgattgatgttatgcttatcattcttgcggtggtgacttgcgcatccgtacttgaagcagctggcggtttgaaatttatgttacaaattgctgaacgcattctccgtaaaaatccaaaacgtgtcactttactcggcccattagtcgtctatttattaacctttatgcttggtactggtcactctgtttacacaattatgccaatcatcggcgatgttgcattgaaaaacaaaattcgtccagaacgtccaatggcagcgtcttcggtagcatcgcaattagccatcacatcaagcccactttctgcagctgttgtattttatctaggtaaaattacagcaatgcccgcttttgagcatattagtttattagatattatttgtgtaaccgttcctgctactttagcgggtacgattgcgctttctttatacagtatgcgtcgtggtaaagagttagaacaagatcctgaatatcaacgtcgtttacaagatccagtatggcgcgaacgtattttaaatactaccagtacaacattgaatgaaacccttccgcaaggggcaaaaaaatctgtttacctatttttacttgctttagttgtgattgttgcgattgcgatgattcctgaaattcgcactatcggtagcggaaaagcaatttcaatgtcacttatcattcaaatgatgatgctttgttttggtggtgtgattttacttgcaacgaaaacgaatcctcaaatcgtacaaaatggtgtggtatttaagtcaggtatggtagcagcgattgcaatttatggtattgcgtggatgagcgacacttacttcaaatatgcaatgccagaatttaaagccgcgattactgatatggtgcaaacttacccttggacattcgcattggcattatttgcagtttctgtcgtaattaatagccaagcagcaacagccgtaatgttattacctgtgggtattggcttaggtattcctgcaccaatcttagttggtttaatgcctgcaacttatgcctatttcttcattccaaattatccgtcagatattgcaacagtaaactttgacgtaacgggtacaacaaaaattggtaaatattattttaaccacagttttatggtgccaggtttaattggggttgttgttgcttgcttggtcggtgtttctgtggcggaattagtgattcgctaa

SEQ ID NO: 985 - DNA, 231 bp, H. influenzae strain 86-028NP
atgagtattgaagaacgcgtgaaaaaaatcatcgttgaacaattaggtgttaaagaagaagatgttaaacctgaagcttcttttgttgaagatttaggtgcagattcattagacacagttgaattagtaatggctttagaagaagaatttgatattgaaattcctgatgaagaagctgaaaaaattaccactgttcaatctgcgattgattacgtgcaaaacaatcaataa

SEQ ID NO: 986 - DNA, 729 bp, H. influenzae strain 86-028NP
atgcaaggtaaaattgctttagtgacaggggctagccgtggtatcggtcgtgcgattgcagaagaacttagttcaaaaggtgcatttgtaattggtaccgcaacctctgaaaagggtgcagaggcgatctcggcttatttaggggataaaggtaaaggtttagttttaaacgtaacggataaagaatctatcgaaactttacttgagcaaattaaaaatgattttggcgatattgatattctcgtgaataacgcaggtattactcgcgataatttattgatgcgtatgaaagatgaggaatggtttgatattatgcaaactaacttaacttctgtgtatcatctttctaaagccatgttacgttcaatgatgaaaaaacgttttggtcgtatcatcaatattggttcagtggttggttcaacgggtaatccaggacaaactaactattgtgcggcaaaagcgggtgtggttggtttttctaaatctttagcgaaagaagtagctgcacgtggtgttactgtaaatgtggttgcaccaggttttattgcaacagatatgacagaagtgcttacggatgaacaaaaagcggggatcttatctaatgttccagctggacgtttaggcgaagcaaaagacatagctaaagccgttgctttcttagcttctgatgatgcaggttatatcacgggtacaacgttacacgtgaatggtggcttatacttaagctaa

SEQ ID NO: 987 - DNA, 939 bp, H. influenzae strain 86-028NP
atgaaaaaattcgcaatggtcttcccaggtcaaggctcccaaactgtcggtatgcttgctgatcttgccactgaatatccaatcgttattgaaacatttaaacaagcatctgatgcgcttggttatgatttatggtatcttgttcaacaaggtccagctgaagaacttaataaaacttggcaaactcagcccgcacttttagctgcttcagtcgctatttatcgcgtatggcaagaaaaatttcctcaattaaaaccagaagtgatggcaggccatagcttgggtgagtattctgccttggtttgtgctggggtgttggatttccaagatgcgattaaattagtggaattgcgcggaaaattaatgcaacaagctgtgcctgaaggcactggcgcaatgtatgcaatcattggtttagataatgaagcaattattaatgcttgcaaacaagcagaggaaggcgaagtcgtatctgcggtgaactttaactcaccgggtcaagtagttattgcgggtgcgaaagctgcagttgagcgtgcggctgcattatgtaaagaagcaggggcgaaacgtgcattgccgttagctgtgagcgtaccttctcactgtgcattaatgaaacctgcagccgagcaattagcggtaacacttgagaatattcaaattaatacaccaacaatatcggtattaaataacgttgatgtgaaagctgaaactgaaggcaccgaaattcgtaccgcacttgttcgtcagttatatagtccagttcgttggactgaaacagttgaaaaaatggcgcaagatggtgttttagcgcttgttgaagtggggccaggtaaagtattaaatggtttaaccaaacgcattgtgggtgatttacaagcaatatctgtaaatgatgttgcatcattcaatgcggtagaagaatttttagcgtaa

SEQ ID NO: 988 - DNA, 951 bp, H. influenzae strain 86-028NP
atgaatagtagaattttatccaccggtagctatctgccgagccatattcgcacaaatgcggatttagaaaaaatggttgatacatcagatgaatggattgtcactcgttctggtatccgtgaacgtcgtatcgcagcggaagatgaaactgttgcaacaatgggatttgaagcggcaaaaaatgcgatcgaagctgctcaaattaatcctcaagatattgaactgattattgttgcaactacaagtcactcacatgcttatccaagtgcggcttgccaagtgcaaggtttattaaatattgatgatgcgatttcttttgatttggcggcagcttgcacaggctttgtctatgctttgagcgtagctgatcaatttattcgtgcaggcaaagtgaaaaaagccttagtgataggctcggatctcaattctcgtaaattagatgaaacagatcgcagcactgttgtgctatttggtgatggtgcgggtgctgtaattttagaagcgagtgaacaagaaggaattatctccacccatttacacgcttcagcagataaaaataatgcccttgttttagctcagccagaacgtggtatagaaaaatctggctatatcgagatgcaaggtaacgaaacgttcaaattggcagttcgtgaactttcaaatgtggtggaagaaacacttttagcaaataatttagataaaaaagatttagactggcttgtgccacaccaagcaaatttacgtattattacagcaacagctaaaaaattagaaatggatatgtcgcaagtggtggtaacgttagataaatacgctaacaacagtgcagcaactgttcctgtcgctttagatgaggctattcgagatggtcgtattcaacgtgggcagttactattattagaagcctttggcggtggttggacttggggttcagcgttagtgagattttag

SEQ ID NO: 989 - DNA, 171 bp, H. influenzae strain 86-028NP
atggctgttcaacaaaacaaaaaatctcgttcacgtcgtgatatgcgtcgttcacacgatgctttaacaactgctgctgtatcagtagataaagcaagcggtgaaactcacttacgccaccacgtaactgcagacggttattatcgtggtcgtaaagtgatcaataagtaa

SEQ ID NO: 990 - DNA, 525 bp, H. influenzae strain 86-028NP
atgcaaaaggtaaaactacccctaaccgttgatccagtaaaagatgctcaaagacggcttgattatgttggttattattcggcaaatcagcttgagcgtttggcggaatcagtggtaaacgtgctcagcgatgcacaggtaacattatcgttttatgttgatccacaaaaattagtggtgatgaaaggtaaagtacagattgatgtcgatcttgaatgtcagcgttgtaacgaaccttacaaacaaacattggaatgtgagtttacttatagtccagtggctaattgggatcaggctgatgacttgcccgaaatttatgagccaatcgagttcaatgagtttggcgaaatagatttaattggcacggtggaagatgagctaattttagctttgccgcttgtcccaatgcattcatctgaacactgtgaagtgtccgcgcaggaacaggtttttggcgaattgcctgaagaattggcaaaaaaaccgaacccgttcgctgtattagctaatttaaagcaaaagtaa

SEQ ID NO: 991 - DNA, 873 bp, H. influenzae strain 86-028NP
atgatgacttcaaattcttattggcaacgcttaaaagtggcatttcaatatgtcatgccacaaatttatttaactcaaattgctggctggtttgctaaacaaaaatggggcaaaataacacattttgtaattaaagcttttgcgaaaaaatacaacattgatatgagcattgcgcaaaaaggacaattttctgattacgcaagttttaatgaattttttattcgtccgttaaaagaaaacgcacgtccaattaatcaaaatccaaccgcactttgtttaccagcagacgggcgcattagtgagtgcggtcatattgacgataatcttttattgcaagctaaggggcattttttcagtctagaagacttattggcagaagataaagaattagtggaaacctttaaaaatggtgaatttgtaactacttatctttctcctcgtgattatcaccgagtacatatgccgtgcgatgctacgctacgcaaaatgatttatgtgccgggtgatttattctctgtgaacccatttttagcccaatatgtacccaatttatttgcacgtaatgaacgtgtgatttgtgtatttgatactgaatttggcacaatggtacaaattttagtgggtgcaaccatcactgcaagtattggcacaacttgggcaggcgtaattaatccaccacgccacaacgaagtgaaaacttggacttatgaaggcgaaagtgcggtcaaattattgaaaggtcaagaaatgggttggttccaacttggttcaacagtaattaatttattccaagccaatcaagtgcgtttggctgatcatttaagcgtaaatgaacctgttcgcatgggcgaaatcttggcatataaaaaataa

SEQ ID NO: 992 - DNA, 1371 bp, H. influenzae strain 86-028NP
atgactaaacattatgattatattgctattggcggtggcagtggcggtattgcgtctctaaatcgagcagcaagctatggaaaaaaatgtgcaatcattgaagcaaaacatcttggaggcacttgtgtaaatgtaggttgcgtacctaaaaaagtaatgttttatggcgcgcatattgcagaagcaatcaacaattatgcgccagattatggttttgatgttgaagtgaaaaaatttgatttttcaaaactgattgaaagtcgccaagcctatattagtcgtatccatacatcttataataatgtattagcgaaaaataatattgatgtaattaatggtttcggaaaatttgtcgatgcccatactattgaagtaacacttgctgatggtacaaaagagcaagtaaccgcagatcatattttaatcgcaactggtggccgcccatatcgtccaaatattaaaggacaagaatacggcattgattcggatggtttctttgcattaaccgaattaccaaaacgtgctgttgttattggtgcaggctatattgctgttgaactttctggcgtattaaacagcttaggcgtggaaacacatttattagtgcgtcgccatgcgccaatgcgtaatcaggatccattaatcgtagaaacattagtggaagtgcttgcgcaagatggaattcaattacataccaattctaccccatctgaaattgtaaaaaatgcagatggttcacttactgtaaaatgtgatggtcaatctgatgttaccgtagattgcgttatttgggcggcaggtcgtgttccaacgacagataaaattggcttagaaaatgcaggtgtagaaacaaatgaacacggctatgtcaaagtagataaatatcaaaatactaatgtgaaaggcatttatgcggtaggcgatattatcgaaaacggtattgaattaacaccagttgcagttgcagcaggtcgccgcctttcagagcgtttatttaataataaaccgactgaatatttagattacagtttagttccaaccgttgtatttagccatccgcctatcggcactgtaggtttaactgaaccgcaagcgattgagcagtacggcgcagaaaatgttaaagtatataaatcttctttcacagcgatgtacactgcggtaactcaacatcgccaaccgtgcaaaatgaaattagtttgtgtgggtaaagatgaaaaagttatgggtttacatggtattggtttcggtgtagatgaaatgattcaaggatttgcagtagcaatcaaaatgggcgcaacaaaagctgattttgacaatacggtggcaattcatccaacaggttcagaggaatttgtaacaatgcgttaa

SEQ ID NO: 993 - DNA, 600 bp, H. influenzae strain 86-028NP
atggcattagtaaacaaaattaaaacattatcatcagtaggtattctagctgctacattatttcttgcaggctgccaagcacaatcaaatatattagcatttacaccgcctgtgccaagtgcttcaatgaatgttaatcgaactgccgttgtatctgttacaacaaaagatagccgcacaatacaagagattgcgagttatacgaaacacggggaactgattaaattaaatgcatccccaagtgttacacaattatttcagcaagtgatgcagcaaaatttaattagtaaaggctttagaattgggcaattaaatggttcaaatgcgtgggtaactgtagatgtgcatgaatttggtacgcaagtagaacaaggtaatcttcgttataaacttaatactaaaattcaagcgacagtttatgtacaaggtgcgaaaggttcgtataataaatcatttaatgtcacgcgttcacaagagggcgtatttaatgcggacaatgatgaaattcataaagtgctatctcaaacttttaatgatattgtgaacaatatttatcaagatcaagaagttgcggctgcgattaaccaatattctaattaa

SEQ ID NO: 994 - DNA, 312 bp, H. influenzae strain 86-028NP
gtgtcaattcaacaaattattgagcaaaaaattcaaaaaaaatttcaaccgcactttttagcaatagaaaatgaaagccatttacatcactctaatcgaggttctgaatcacattttaaatgcgttattgtcagcgcagactttaaaaatattcgaaaagtacaacgtcatcagcgtatttatcaattattgaactaagaattaaatcatagtattcacgcattagcattacatttattcactccagaagaatggaaagcacaaaatgaaactgtaccgcactcaacaaaatgtgcaggtattgggcgttaa

SEQ ID NO: 995 - DNA, 1344 bp, H. influenzae strain 86-028NP
atgattacaattaagaaaggtttggatctcccaatcgcgggaaaaccagcacaagtaatccatagcggcaacgctgtgaatcaagttgcgattctaggtgaggagtatgtggggatgcgtccttcaatgaaggtacgcgaaggcgatgttgtgaaaaaaggtcaagtactttttgaagacaaaaaaaatcctggtgtaatttttacagcccctgcaagcggtaccatcactgcaatcaatcgtggcgaaaaacgggtattacaatctgttgttattaatgtagaaggtgatgaaaaaatcacttttgcaaaatatagcacagaacaattgaatacactttcttctgaacaagtaaaacaaaacttgatagaatctggcttatggacggcattacgtactcgtccatttagtaaagttccatccattgaaagtgaagcatcttctatttttgtaaacgcgatggataccaatccattagcagccgatccctctgtcgtattaaaagaatattcgcaagacttcactaacggtttaaccgtattaagtcgtctattcccttcaaaaccattacacttatgtaaagcgggcgattctaatattcccactgctgatcttgaaaatttacagattcatgattttactggtgttcatccagctggtcttgtagggacgcatattcactttattgatcctgtcggtattcaaaaaactgtatggcatatcaattatcaagatgtgatcgctgtaggtaaattatttacaacaggcgaactttattcagaacgagtaatttctcttgcaggtcctcaagtgaaagaacctcgtttagtacgtacaataatcggtgctaatctttctcaattaacccaaaatgaattaagtgcgggtaaaaatcgtgtaatttctggctcagttctttgtggtcaaatagcaaaagattcacatgattatttaggtcgctatgctctgcaagtatcagtaatcgctgaaggtaatgaaaaagaattttttggttggattatgccacaagccaataaatattctgtgactcgtaccgtattaggccacttcagtaaaaaattgtttaattttactacttcagaaaatggtggcgaacgtgcaatggtgccaatcggtagctatgagcgcgtaatgccgttggacattttacctacattattattacgtgatttaatcgtgggcgatactgatggcgctcaagagttaggttgtctggaattagacgaagaagacttggcgttatgttctttcgtttgtccaggcaaatatgaatacggttcaatcttgcgtcaagtcttagataagattgagaaggaaggttaa

SEQ ID NO: 996 - DNA, 1236 bp, H. influenzae strain 86-028NP
atgggtttgaaaaatctttttgaaaaaatggaacccgcgtttttacccggtggtaaatacagcaagctttatccgatctttgaatcgatttataccttgctttatacacctggtacggtaacgcacaaaaacactcacgttcgtgatgcgttagattcaaaacgtatgatgattacggttttccttgcgttgttccctgcgattttctatgggatgtacaatgtgggtaaccaagcgattccagcgttaaatcaattaggcaatttagatcaactaattgctaacgattggcactatgctcttgcaagttcattaggtttagatttaactgccaatgcaacttggggctctaaaatggctcttggagcaattttctttttaccaatttacttagtggtatttaccgtttgtactatttgggaattgttattctctgtggttcgtggtcacgaagtaaatgaaggaatgttcgtttcaaccattttatttgccttgatcgttccaccaacattgccactatggcaagccgcattaggtattacttttggtatcattgttgcaaaagaaatttttggtggcgtaggtcgtaactttatgaaccctgcacttgctggtcgtgcgttcttattcttcgcatatccagctcaaatttcaggcgatacggtttggactgccgcagatggtttctctggtgcaaccgcactttcacagtggtcacaaggtggtcaaggtgcattgcaacataccgtaacaggcgctccaattacttggatggatgcttttgttggtaacttacctggttcaatgggggaagtttctacccttgcaattttaattggcggtgctgttattgtattcactcgcattgcagcttggcgcattattgctggtgtgatgattggcatgattgcaacctcaaccttgtttaacctaattggctcagagactaaccctatgttctcaatgccttggcattggcactttgttttaggtgggtttgcattgggtatggtatttatggcgaccgatcctgtttcagcatcttttactaatactggtaaatggtggtacggtgcattaattggcgtaatggctgtattaattcgtactgtaaacccagcctatccagaaggaatgatgttagcgattttatttgcaaacttatttgcaccgattttcgactacatcgttgttcaagcaaatatcaaacgtcggagagcaagaacaaatggctaa

SEQ ID NO: 997 - DNA, 735 bp, H. influenzae strain 86-028NP
atggctaagtttaataaagacagcgtaggcggcacaatccttgttgtgctactactgagtttagtttgttccattattgttgctggttccgcagtaatgttaaagcctgcacaagaagaacaaaaattgcttgataaacaaaaaaatattttaaatgtagctggtcttttacaagcaaatacgaatgtaaaagaaacttatgcaaaatttattgagccgcgtttcgttgatttagcaacgggtgaatacacacaacaagcagatgatagccaacaagcaattcctgctgatgcggataaagcacgtattcgttctcgtagcaaaacaactgaagtttatcttgtaaaagatgaacagggtcaaactcaacaagttattttaccaatttatggcactggcttgtggtcagtgatgtatggcttagtatctgttcaaccagatggtaatactattaatggaatcacttactatcaacacggagaaacaccgggattgggcggagaaattgaaaatccaaactgggcaagtctatttaaaggtaaaaaattatttgatgagcaacatcaacctgccattcgtattgtaaaaggtcaagctccacaagatgaacatagcattgatggtttatctggtgcaactttaacaggtaatggtgttcaaggtacctttaattattggttcagcaaagatggctttggtccatatcttgaaaaacttcattcaggagcaaactaa

SEQ ID NO: 998 - DNA, 627 bp, H. influenzae strain 86-028NP
atgtctggaaaaacaagttataaagatctgttgttagcgccaattgctaaaaacaaccctattgcattgcaaatcttagggatttgttctgcattagctgtaacaacaaaattagaaactgcttttgttatggcgattgcagttaccttagtaactggattatcaaacttatttgtttccctaatccgcaattatatccctaacagcattcgtattattgtacagctcgcaatcatcgcttcgcttgttatcgtagtggatcaaattctaaaagcctatgcttatggtttatctaaacaactttcagtattcgttggtttgattattactaactgtatcgtaatggggcgtgctgaagcatttgcgatgaaatcccctccagttgaaagttttgtagatggtatcggaaatggcttaggttatggttcgatgttaattatcgtagcatttttccgtgaacttatcggttcaggtaaattatttggtatgactattttcgaaactattcaaaatggtggctggtatcaagcaaatggtttattcctacttgcaccaagtgcattctttatcatcggatttgtgatctggggattaagaacttggaaaccagaacaacaggagaagtaa

SEQ ID NO: 999 - DNA, 597 bp, H. influenzae strain 86-028NP
atggaacattatattagcctatttgttaaggcagtcttcattgaaaatatggcactttctttcttcttaggaatgtgtactttcttagcggtatctaaaaaggtgtccactgcgtttggtcttgggattgcggtaactttcgttcttggtatcgcagtgccagtaaaccaattaatttatgcaaatgtactaaaagaaaatgctttaattgaaggtgtagatttatcattcttaaacttcatcactttcattggggttattgctggtttagtgcaaattcttgaaatggtgttagataaatttatgccatctctttataacgcattagggattttcttacctttaatcgcagtaaactgtgcgatctttggtggggtatctttcatggttcaacgtgattacaatttccctgaatctatcgtgtatggtttcggctcaggtttaggttggatgttagcgattgtagcgcttgctggcttaacggaaaaaatgaaatacgctgatattcctgctggattaaaaggtttaggtattacctttatctctgttggtttaatggcactaggctttatgtctttctctggtattcaattataa

SEQ ID NO: 1000 - DNA, 1236 bp, H. influenzae strain 86-028NP
atgagcgattcagtaattcttgcactcggtattgccgcattcacggttattgtattagtgttagtggcaatcatcttatttgcgaaatcaaaattagtcgattctggtgatattactatcgacatcaatgacgatcctgaaaaagcgatcacattacctgcaggtggcaaattattaggggctttagcaagtaaaggtattttcgtgtcttctgcttgcggtggcggtggctcttgtggtcaatgtattgttaaagtgaaaaatggcggtggagaaattcttccaaccgaactttctcacattaacaaacgtgaagcaaaagaaggttatcgtctagcttgtcaagttaatgtaaaaggtaatatggaagttgaacttccagaagaaatcttcggcgtgaaaaaatgggaatgtactgttatttctaacgataacaaagcaacttttattaaagaacttaaattagcgatccctgaaggcgaggaagtgcctttccgcgcaggtggttatatccaaatcgaagctgagccacatgtggtgaactataaagatttcgatattcctgaagaataccacgaagactgggataaatacgatttatggcgttatgtctctaaagtggacgagcatattatccgtgcttactcaatggcttcataccctgaagagaaaggtatcattatgcttaacgttcgtattgcgactccaccaccacgccaacctgatgcgcctccaggtcaaatgtcttcttacatttggtcattaaaagcaggagataaagtcacaatttctggtccatttggtgaattcttcgcgaaagaaactaatgcagaaatggtatttatcggtggtggtgcgggtatggctccaatgcgttcacatatcttcgaccaattaaaacgtttacattctaaacgtaaaatgtcgttctggtatggtgcacgttctaaacgtgaaatattctatcaagaagactttgaccaattacaagctgaaaatccaaactttgtatggcacgtggcactttcagatgcattgcctgaagataattggactggctatacaggctttattcacaatgtactttatgaaaactacttgaaaaatcatgaagcaccagaagactgtgaatactatatgtgtgggcctccagtgatgaatgcagctgtaattaaaatgttgaaagatcttggtgttgaagatgaaaacattttattagatgactttggtggctga

SEQ ID NO: 1001 - DNA, 1041 bp, H. influenzae strain 86-028NP
atgaaaaaattaataagcggtatcatagcggtagcaatggcattaagtcttgctgcttgtcaaaaagaaacaaaagttatctctttaagcggtaaaacaatggggacaacttatcatgttaaataccttgatgatggttcaataaaagcaacatctgaaaagacgcatgaagaaattgaagcaatcttaaaagatgtgaatgcgaaaatgtccacttacaaaaaagattcggaattgagccgcttcaatcaaaatacccaagtgaacacaccgattgagatttcagcagattttgccaaagtattagctgaagcgattcgtttaaataaagtgaccgaaggcgcgttggatgtaactgttggtccagttgtaaatttatggggatttggtcctgaaaaacgccccgaaaaacaacctacaccagaacaattagctgaacgccaagcctgggttggcattgataaaattgcccttgatatgagtggtgcaaaaccgacattaagcaaagcacttcctcaagtttacgtagatttatcgtcaattgctaaaggttttggcgttgatcaggtggctgaaaagttagaacaactaaatgctcagaattacatggttgaaatcggcggtgaaattcgtgcgaaaggaaaaaatattgaaggtaaaccttggcagattgccattgaaaaaccaactacaacaggcgaaagagcggctgaagctgtcattggattaaacaatatgggaatggcaagttctggcgattaccgtatttactttgaagaaaatggcaaacgctttgctcatgaaattgatccgaaaacaggttatccaattcagcatcatttagcctcaattacggtacttgcaccaacctcaatgactgcagatggcttatctacagggttatttgtgctgggggaagacaaggcgttagaagtggctgagaaaaataatcttgccgtttatttaatcattagaacagataatggttttgttaccaaatcatcctctgctttcaaaaaattaacagaaacaaaagaatag

SEQ ID NO: 1002 - DNA, 261 bp, H. influenzae strain 86-028NP
atgcaaactttattttttactttaatcgctttcgtcgcaattatattgttgatgtctatcggctttattatcaaaaaacaaagtttaaaaggcagctgcggtggtttatctagccttggtattgacaaagcttgtgattgtgataaaccttgcgacacgcttcaatcaaaattagatgcaggcgatgaacaagcaaaagctgaatatgagcaaaaatttgcgaaaaaagatgataactcgcaattttatgaagtgaaataa

SEQ ID NO: 1003 - DNA, 1194 bp, H. influenzae strain 86-028NP
atgaccaatgtgcttcgccttaaccgaagttacgggagaactatgttaatttcaaatacttataatcaacactttcctcaactgacgcaagaacagcttgcgagaaatgcgacaaaaaaagtgatttgtggtatgtctggtggcgtggattcttctgtgtcagcttttattcttcaacagcaaggctatcaagtggaaggcctgtttatgaaaaactgggaagaagatgacgatactgattattgtactgccgcagctgatcttgcagatgctcaagcagtatgcgataaattagggatcaaactacataaaattaattttgcggcagaatattgggataatgtctttgagcattttttaactgaatataaagcaggacgcacgccgaacccagatattctatgtaataaagaaattaaatttaaagcatttttagaatatgcagctgaagatctcggtgcagattatattgcaacagggcattatgtacgtagagcgggagataatgaaaatgcaaaactattacgtggtttagatgccaataaagatcaaagttattttctttatactttaagccataaacaagtggggcaaagtttattccccgttggtgaaatcgagaagcccattgttcgcgctattgctgaagatcttggcttaattacggcgaagaaaaaagattctaccggtatttgttttattggtgagcgtaaatttaaggatttcttagcacgctatttaccagctcaaccaggtaatattcgcactgtagatgatgaaattattggtcgtcatgatggattaatgtatcacacattgggacaacgcaaaggattgggcattggtggtctaaaaaatgcgggagatgaagcttggtatgtagtagataaagatgtagaaaataatgaacttattgtcgcgcaaggtcacgatcatcctcgtttattttcaaaaggattgattgctagccaattacattgggttgatcgcgaaccaattcgagagtcattacgttgcacggtgaaaacacgttatcgccaacaagatattccttgtgtgattgaaccaattgatgatgaaactattcgagtgatttttgatgaacctcaatcagcagtaaccccagggcaatctgccgtattttaccttggcgaagtttgtttgggtggcggtattatcgcagaaagaatataa

SEQ ID NO: 1004 - DNA, 735 bp, H. influenzae strain 86-028NP
atgcaagcaattaacccaaattggaatgttccaaagaatattcatgcctttaccactactcgtgaagggggcgtgagcttagcgccttatttgagtttcaacttaggcgatcatgtcggtgatgataaaagtgcggtaaaaactaaccgcactttattagtcgaaaaatttggcttgccacaaaaacctatatttttaacgcaaacacacagcactcgagtacttcaattaccttattcaggacaaaatcttgaagcggatgcagtttatacaaatgttcccaatcaagtttgcgttgttatgactgcagactgtttgccagttctattcactacaacatctggcaatgaagtggctgcaacacatgctggctggcgtggtttatgcgatggcgtactagaagaaacagtgaaatattttcaagctaaacctgaagatattattgcgtggtttggccctgcaataggtccaaaggcctttcaagttgggattgatgttgtagaaaagtttgttgcagtagatgaaaaagccaaactcgcctttcaacctgatgcaatcgaagaaggtaaatacttgagtaatctttatcaaattgcaactcagcgattaaacaatctaggtattacgcaaatttatggtggaaatcactgtacattcaacgaaaaagaaaagttcttttcttatcgcagggacaatcaaacgggacgaatggcgagtgtcatttggtttgaataa

SEQ ID NO: 1005 - DNA, 975 bp, H. influenzae strain 86-028NP
atgccacaaattaccctttcggctgaagtgcagccagaacaaatgggacaacgtttagaccaaacacttgcagagttgttccctgaatattctcgttcccgattaaaaacatggattgaagccgatctcgtaaaacttaacgaccgcattactaatattccgcgtgagaaagtgtttggaggagagagaatagagattattgttgaagtggaagatgaaacacgttttgaagcagaaaatattccattgaatattgtgtatgaagatgatgatattattgtgattaacaaaccaaaagatcttgtggtacaccccggtgctggcaatccaaatggaactgtactcaatgcgttactctatcattatccaccgatatcagaagtaccgagagcaggaattgtgcatcgattagataaagatacaacaggtctaatggttgttgctaaaaccattccagcacaaactaagttagtgcgagacttacaaaaacgcaaaattacgcgcgaatatgaagcagtcgcttcaggcattatgactaaaggcggcacagtagatcaacctatggctcgtcatgcaaccaaacgtactttaatggctgttcatccaatgggaaaaccagctgttactcattatcgtattatggaaaattaccgtaactacacccgtttacgtttacgtttagaaacggggcgcacgcatcaaatccgcgttcatatggcacatattgcccatccattgctaggcgatcaaacctatggcggacgccctcgtccacccaaaaatgcgagtgaagactttatggaagtattgcgtaatttcaaacgccaagctttacatgcggtcatgttacgcttagctcatccaatcacaggggaaattatggaatggtatgcaccattaccagatgactttgttgaattgcttaatgcactcaaagccgactatctcaaacatcaagatgagttagattattaa

SEQ ID NO: 1006 - DNA, 789 bp, H. influenzae strain 86-028NP
atgcgtaaaataaaatctttggcattgcttgccgtggcagcattggttattggatgttcaagtggttcaaaagatgttgaacaagcatcggtaaatgaattatacacaaaaggtacaacatcattacaagaaggtagttactctgaagccattcgctatttaaaagcgacgactgagcgttttccaggtagcgtttatcaagaacaagcaatgttagatttaatttatgcaaattataaaactcaagattatacgcaagtattattgatggtagatagctttttacatcaatttccacaaagcccaaatcaagcctatgcggtatatatggctggcttaactaatgcagcaacaggcgataatttcattcaagatttttttggaattgaccgtgctacacgtgaaacaacctctatgcgtaccgctttttctaatttccaaaacttagttcgtgtattccctaatagcccttatgctcaagatgctttagcgcgtatggcttatattaaagatgcactggctcgtcacgaattagagattgcaaaattctatgcaaaacgtaaagcgtgggtagcagttgcaaatcgtgtggtaggaatgttaaaacaatatcctgatactaaagcaacttatgaaggattatttctgatgcaggaagcttatgaaaaaatgggtttaaccgcattagcaaatgatactcaaaaaattattgatgcgaataaagataaaacttttgcaccaattgaaaaaccaaacgagccagacttaaaagtgccagcagtaaaatag

SEQ ID NO: 1007 - DNA, 483 bp, H. influenzae strain 86-028NP
atgaaaaaaattattttaacattatcacttgggttacttactgcctgttctgctcaaatccaaaaggctaaacaaaatgatgtgaagctggcaccgccgactgatgtacgaagcggatatatacgtttggtaaagaatgtgaattattacatcgatagtgaatcgatctgggtggataaccaagagccacaaattgtacattttgatgcagtggtgaatttagataagggattgtatgtttatcctgagcctaaacgttatgcacgttctgttcgtcagtataagatcttgaattgtgcaaattatcatttaactcaagtacgaactgatttctatgatgaattttggggacagggtttgcgggcagcacctaaaaagcaaaagaaacatacgttaagtttaacacctgatacaacgctttataatgctgctcagattatttgtgcgaactatggtgaagcattttcagttgataaaaaataa

SEQ ID NO: 1008 - DNA, 741 bp, H. influenzae strain 86-028NP
atgtcagttcttggacgaattcactcttttgaatcctgtggcactgtagatgggccaggtattcgttttattttatttatgcaaggctgcttgatgcgctgcaaatattgccacaatcgtgatacttgggatcttgaaggggggaaagaaatcagtgtcgaagatttaatgaaagaagtcgtgacttatcgccattttatgaatgctactggcggtggtgttacggcatctggtggcgaggctgtgttacaagcagagtttgtacgcgattggttccgagcttgtaaagcggaagggattaatacttgcttggatacaaatggttttgtacgtcattataatcatattattgatgaattattagatgtaacagatcttgttttactcgatttaaaagagcttaatgatcaagttcatcaaaatcttattggggtacccaataaacgtacccttgaatttgcaaaatatttgcaaaaacgtaatcaacatacctggattcgttatgttgtggttcctggttatactgatagcgatcacgatgtgcatttattaggtcagtttattgaaggtatgaccaatattgaaaaagttgagcttcttccttatcatcgattaggtgcacataaatggaaaacccttgggttagattatgagcttgaagatgtattaccgccaactaaagaatccttagagcatattaaaacaatcctagaaggttatgggcacactgtaaaattctag

SEQ ID NO: 1009 - DNA, 2319 bp, H. influenzae strain 86-028NP
atgactatgtcagaacttaatgaaatgcaaaaattggcgtgggctggttttgctggtggcgattggcaagaaaatgtcaatgtacgtgactttatccaaaaaaactataccccttatgaaggcgatgactctttcttagcaggtccaaccgaagcaacaaccaagctttgggaatctgtaatggaaggaattaaaattgaaaaccgtactcacgcgccattagattttgatgaacatacaccatctaccattatctctcacgcacccggttacattaacaaagatttagaaaaaatcgttggtcttcaaactgatgaacctttaaaacgtgccattatgccattcggtggtatcaaaatggtggaaggttcttgtaaagtttatggtcgtgaacttgatccaaaagtgaaaaaaatcttcactgaataccgtaaaacacataaccaaggtgtattcgatgtttacacgccagatattttacgttgccgtaaatctggggtattaactggtcttccagatgcttatggtcgtggtcgtatcatcggtgactaccgtcgtgtagcactttatggtgtagatttcttaatgaaagataaatatgcacaattctcttctttacaaaaagatttagaagatggcgtaaatcttgaagcaacaattcgtttacgtgaagaaatcgcagaacaacaccgtgcattaggtcaattaaaacaaatggcagcaagctatggttatgatatttctaacccagcaactaatgctcaagaagccattcaatggatgtactttgcttatcttgctgcaataaaatcacaaaatggtgctgcaatgtcattcggtcgtaccgcaacctttattgacgtgtacattgagcgtgatttaaaagcaggaaaaattactgaaactgaagcgcaagaattagttgaccacttagttatgaaacttcgtatggttcgtttcttacgtacacctgaatacgatcaattattctcaggcgacccaatgtgggcaactgaaaccatcgcaggtatgggtttagatggtcgtacattagtaaccaaaaatacattccgtattttacacaccctttacaacatgggtacttccccagagccaaacttaaccattctttggtctgaacaattacctgaaaacttcaaacgtttctgtgcaaaagtatcgattgatacctcatcagttcaatacgaaaacgatgatttaatgcgtccagacttcaacaatgatgactacgcaatcgcatgttgtgtatcaccaatgattgtgggtaaacaaatgcaattcttcggtgcacgtgcaaacttagcgaaaacattgttatacgcaatcaacggcggtattgatgaaaaattaggtatgcaagtaggcccgaaaactgcaccaattactgatgaagtattagatttcgatacagtaatgactcgtatggatagctttatggattggttggctaaacaatatgtgactgccttaaacgtaatccactatatgcacgataaatattcatacgaagccgcattaatggcattacatgatcgtgatgtataccgtaccatggcttgtggtatcgcaggtctttctgttgcggctgactcactttcagcaatcaaatatgcaaaagttaaaccagttcgtggcgacatcaaagataaagatggcaatgttgttgcaactaacgtagcaatcgactttgaaattgaaggtgaatatccacaatatggtaataacgataaccgtgttgatgacatcgcttgtgacttagttgaacgtttcatgaagaaaattcaaaaacttaaaacttaccgcaatgcagtgcctacacaatctgtattaaccattacttctaacgtagtttatggtaagaaaacgggcaacaccccagatggccgtcgtgctggtgcaccattcggaccaggtgcgaacccaatgcacggacgtgaccaaaaaggtgcggtagcatcattaacttctgtagctaaacttccatttgcttacgcgaaagatggtatttcttataccttctcaatcgtaccaaatgcgttaggtaaagatgccgaagcacaacgtcgcaaccttgctggcttaatggatggttacttccaccacgaagcaacggttgaaggtggccaacacttaaatgtgaacgtgttaaaccgtgaaatgttgttagatgcaatggaaaatccggataaatatccacaattgactatccgtgtatctggttacgcagtacgttttaactctttaactaaagagcaacaacaagacgtaattactagaactttcacagagtcaatgtaa

SEQ ID NO: 1010 - DNA, 855 bp, H. influenzae strain 86-028NP
atggcatcagaaaatcaaaaactatcttctgttgcgctcacacctgttgaagcaacggattatgcagaaaatacagcaacttataaagcaaataaacgtccatttttatcgtttatgtctggtattagtgctggtgcttgtattgccttagcctttgtattttacacgacaacacaaactgctagtgcaggcgcaccttggggattaaccaagttagtaggtgggttagtattctccttgggcgtaattatggtggtgattttaggatctgaattattcacttcttctactttaactttagtcgcccgtgtaggcggtagaatcaccacgacacaaatgattcgaaattggatcgtagtatatttgggcaacttcgttggtggtttatttattgcggctgttatttggtttagtggacaaacaatggcagcaaatggtcaatggggtttaacaattcttgcaaccgcccaacataaaattcatcacacttggtttgaagcttttaacctaggtattttatgtaacattatggtgtgtgtggcggtttggatgtcttattctggtaagactgttacagacaaagcatttattatgattatgccgattggtttgtttgttgcatcaggatttgaacactgtgtggctaatatgtttatgattccgatgggaattattaccgcacattttagtacacctgaattttggcaacaaatcggcgttgatccgatgaaatacgcagatttagatttgtaccatttcatcgtgaagaatttaatccctgtaacgttgggaaatattgtcggcggggcaatttgtattggtgtattccaacgttatttaaccaaaacgcattaa

SEQ ID NO: 1011 - DNA, 915 bp, H. influenzae strain 86-028NP
atgtattatggtttagatattggtggcacgaaaatagagcttgccgtattcaatgaagaattagaaaaattatattctgaacgggtgccaacacctaaaaccgactatgaagaatggcttaacacgattgtggatttagtgaatcgtgctgatgaaaagtttggtgaagtgggcaccgtaggtttgggcgtacctggttttgttaatcaacaaactggattagccgaaattaccaatattcgtgtggcagataataaaccgattttacgcgatttgtctgtgcgtttaggccgtgaagtgcgggcagaaaatgatgcaaattgttttgcattatctgaagcgtgggatacggaaaatcagcaatatccgactgtacttggtttaattcttggaactggttttggtggcggctttgtcttaaatggtaaagttcattcaggtcaagtgggaatggcgggagagcttggtcatttacaactaaattatcatgccttgaaattattgggatgggataacgcccctatttatcaatgtggttgtggcaacaaggcttgtttggataattatttgtctggtcgcggttttgaaatgctttatcgagatttgaaaggcgaaacattatctgctcgtgaaattattgatttgttctatcaaggcaatgaaagtgcggtagattttgtgaatctttttgttgagttggcggcgatttctattggcaatatcattacggcatttgatcctcatatgattgtactcggcggtggattatctaattttgattacctttatgaggctttaccaaaagcattaccgcctcacttgatgcggacagcaaaagttccaccaattaaaaaagcgaaacacggcgattctggtggtgtgcgtggcgcggcagcgttgtttttaaccaaataa

SEQ ID NO: 1012 - DNA, 1446 bp, H. influenzae strain 86-028NP
atgattatggactttgaattttcaaaaatgttagaagaagtgctaacttggatagtcgcacaccttgacgggcctttatgggatgtcacaattattattttgcttgggactggtctattttttaccattacaacaggatttgtgcagttccgtttattcccagcaagtcttcgtgaaatgtggtttggtcgtgcggtggagggtagttcgttaacacctttccaagcatttacgacaggtcttgcgagccgcgttggtgtgggtaacattggtggggttgcaacggcaatcgccttgggaggcgaaggcgcagtgttttggatgtgggtaacggcatttattggtatgtcgagtgctttcgctgaatctacccttgctcaattatttaaaattcaagataaagatggatcattccgcggtggccctgcttattatattgttcaaggtttaaaatcacgttgtatggcagtggcttttgcacttgcattaatttttacatttggttttgcctttaattctgtgcaggcaaactctattgttgaagcaacgagtaatgcgtggaattggaaaggggaatatgtcggtatttcattagtaatttttaccgcacttattattttcggtggcgttaagcgtattgcgattatttcgagcaaccttgtaccaatgatggcacttttctatttgattatagcagtaattattcttggcatgcatattgatatgatcccttccgtgattcatcgtattgttcaaagtgcatttagttttgatgctgccgctggcggaatgtttggtgcattggtatcgaaagcaatgatgatggggattaaacgtggtttattctcaaacgaagcggggatgggatctgcgcctaattcggctgcagcagctcacgttaagcatccagttagccaaggtttagtgcaaatgctcggtgtgtttgttgatacaatgatcgtttgtacttgtactgccgttattattttgctttcgaataattatggtagcgaaacgctcaaaagtatctcacttacgcaaaatgctttgcaataccacataggtgaatttggggtgcatttcctggcgtttatcttattgttattcgcttattcttctattattggtaactatgcttatgcggaaagcaatatccgttttataaaaaataaaccttggtttgtatttttgttccgtttaatggtgctatttttcgtgtatttcggtgcggttcgctctggcaatgtggtgtggaatttcgcagatacggtgatggctgtcatggcaatcattaacttgatcgcaattttgatgttgtcgccaatcgtatggaaattaatgaaggattatcaacgccagcttaaagaaggaaaaacgccagagtttaaaattgatgaataccctgaattacgtaagaaaatatttgattcccgcatttggaaataa

SEQ ID NO: 1013 - DNA, 828 bp, H. influenzae strain 86-028NP
atgaaactgattgaacaacatcaaatttttggcggttcacagcaagtttgggcgcataatgcccaaatgttgcaatgcgaaatgaaatttgccgtctatttgccaaataatccagaaaatcgaccgcttggcgtgatttattggctttctggcttaacttgtacagaacaaaatttcattaccaaatcaggctttcaacgttatgccgcagaacatcaagtgattgtggttgcccccgatactagccctcgcggagagcaagtgccgaatgatgcggcttacgatttagggcagggagcgggcttttatcttaatgcgaccgagcagccttgggcgacgaattatcaaatgtatgattatatcttgaatgaattgcctgatttgattgaagcaaatttccctactaacggcaaacgttccattatgggacattcaatgggcggacacggtgcattggtattggcactgcgaaatcgggaacgttatcaaagtgtttctgccttttcgcctattttatcgccaagccaggtgccttggggagaaaaagccttttctacctatttaggggaagatcgtgaaaaatggcagcaatatgatgccagctcgctcattcaacaaggctataaagtgcaaggtatgcgcattgagcagggcttggaagatgagtttttgcctacacaattgcgtaccgaagattttatcgaaacctgtcgagtggcaagtcagcctgtcgatgtgcgcttccataaaggctatgatcacagctattacttcatcgccagttttattggcgagcatattgcctatcatgcggaatttttgaagtaa

SEQ ID NO: 1014 - DNA, 1137 bp, H. influenzae strain 86-028NP
atggaaattaaacaaatcaactcaaccatcaaatctcgtgcggcggtagcattcgccccaaatcaacccttacaaattgtggaaatcgacgtagaaatgcctcgcaaaggcgaagtgttaattcgtaacacgcacacgggcgtttgccatactgatgcgtttacgttatcaggaagcgatcctgaaggggtattccctgtggtgctaggacacgaaggtgcgggtgtggttgttgcggttggcgaaggtgtgttaagcgtaaaaccgggcgatcacgtcattcctctttatactgctgaatgtggcgaatgtgagttttgtcgctagggtaaaaccaacctatgcgtctcagtgcgtgacacgcaaggtaaaggcttaatgcctgattgcacgacacgtttttcttatcaaggtcagccgatctatcactatatgggctgttcgactttcagtgaatactcagttgttgcagaagtttcactggcgaaaatcaacccagaagccaaccacgaacaagtatgtttacttggctgtggcgttaccacaggtattggtgcggtacataatacggcaaaagtgcaagaaggcgactctgttgccgtgtttggcttgggtgcgattggtttagcggtagtgcaaggtgcacgtcaagccaaagccggccgtattatcgccattgataccaatcctgcaaaatttgagttggcaaaacagtttggtgcaacggattgtttaaaccctaatgattacgataagccgatcaaagatgtgttgttagatattaataaatggggcattgaccatacctttgaatgtatcggtaatgtaaacgtaatgcgtcaagcattagaaagtgctcaccgtggctggggacaatccattatcatcggcgtagcgggtgcaggacaagaaatttcaacgcgtccgttccaattggtaacaggccgtgtttggaaaggctcggcatttggtggcgtgaaaggtcgctctgaacttccgcaaatggtggaagattcaatgaaaggcgacatccagttagaaccgtttgtgactcacacaatgccacttgatcaaattaatgaagcctttgagttaatgcacgaaggtaaatcgatccgcacagttattcattactaa

SEQ ID NO: 1015 - DNA, 408 bp, H. influenzae strain 86-028NP
gtgacttacaccaccgctaaagctgctgaaaaaataggcatttccgcctacaccttacgcttttatgacaaagaaggcttgttacctaatgtcggacgtgatgaatacggtaatcgccgttttaccgacaaggatttgcaatggttgagtttattacaatgcttgaaaaatacaggaatgagcttaaaagacatcaaacgctttgcagaatgtaccatcattggcgacgatactattgaagaacgcctttccttatttgaaaatcaaacaaaaaatgtaaagtgtcaaattgccgaattaaaacgttatttagatttgcttgaatacaaattagcgttttaccaaaaagcgaaagcactaggctcggtaaaagctgtgaatttaccgcaaattcctgaaacgagctaa

SEQ ID NO: 1016 - DNA, 288 bp, H. influenzae strain 86-028NP
atggctaaaaagagtatattccgagccaaattttttcttttttacagaacggagtttattatgtttggtttatcccccgctcaactgattattttattagtcgttattttattgatttttggcacgaaaaaattaagaaatgctggctcagatcttggtgcagcagtgaaaggtttcaaaaaggcgatgaaagaagatgaaaaagtaaaagatgcggaatttaagtctatagataatgaaacagcgtctgcaaaaaaagaaaatataaaagagaaagagcaggcttaa

SEQ ID NO: 1017 - DNA, 561 bp, H. influenzae strain 86-028NP
gtgtttgatattggtttttcagaacttattttactaatggttttgggattggttgtattaggcccgaaacgtttgcctatagcaattcgcactgtaatggattgggtaaaaacaattcgtggtttagctgctaacgttcaaaatgagttgaaacaagagctaaaattgcaagaattacaagatagtattaaaaaagcggaatcccttaacttgcaagccctttcaccagaattgagtaaaacggtggaagaattaaaagctcaagcagataagatgaaagcggagctagaagataaagcagctcaagctggtacaacggtggaagatcaaatcaaagaaatcaaaaatgcggctgaaaatgcagaaaaacctcaaaatgcaatctcagttgaggaggctgcagaaactttatctgaagcagaaaaaacacctacagatttgaccgcacttgaaactcacgagaaagtagaactgaacacacatttatctagctattatcctcctgatgatattgaaatcgctccagcgtcaaaatctcaatcttcaaaaactaaatcatag

SEQ ID NO: 1018 - DNA, 771 bp, H. influenzae strain 86-028NP; identical to SEQ ID NO: 738

SEQ ID NO: 1019 - DNA, 1350 bp, H. influenzae strain 86-028NP
atgtcaaaagttgcttccttagacgcatttttaacaaaagttgctcaacgcgatggttatcaacctgaatttttacaagcggttcgcgaggtattcacatcaatttggccttttttagaagccaatcctaaatatcgttcagaagcattattagaacgtttagttgagcctgaacgtgcatttcaattccgtgtggcgtggactgacgataaagggcaagtgcaagtaaacagagcatttcgtgtacaatttaatagtgccataggcccatttaaagggggaatgcgtttccatccatcagtaaatttatctatcttaaaattcttaggttttgagcaaatctttaaaaatgctttaacaacattgcctatgggcggagcaaaaggcggttcagattttgatcctaaaggcaaatctgatgctgaagttatgcgtttttgccaagcattaatggctgaactttatcgtcacgtaggagctgatacagatgttcccgcaggcgatataggtgttggtgggcgcgaagttggctatttagctggctatatgaaaaaattatcaaaccaatcagcctgtgttttcactggtcgcggtctttctttcggtggtagtttaattcgtccggaagcaacgggatatggattaatttattttgctcaagcaatgcttgctgaaaaaggcgatagttttgcaggtaaagtagtttcagtttctggttctggtaatgtagcacaatatgctattgaaaaagcattatctcttggtgcaaaagtagtaacttgttctgattcatcaggttatgtttatgatccaaatggatttactactgaaaaattagccgcacttttagaaattaaaaatgtaaaacgtggtcgtgtgaaagattatgcagaactgtttggtttgcaatattttgaaggtaaacgcccttgggaagtgcaagttgatattgcgcttccttgtgcaactcaaaatgaattagaactttctgatgcacaacgtttaattaaaaatggtgtgaaattagtggctgaaggtgcgaatatgccaacaacaattgaagcaacagaagcattattagctgcagatgtattatttggcccgggtaaagctgccaacgctggtggtgttgctacttctggtttagaaatggcacaaagttcacaacgtttatattggacagcagaagaagtggacgctcaattacatcgcattatgttagatattcacgcaaactgtaaaaaatacggcacaattgaaggtcaagaaaacattaactatgttgttggggcaaatgtagcaggctttgttaaggtggctgatgcaatgttagcccaaggcgtttattaa

SEQ ID NO: 1020 - DNA, 441 bp, H. influenzae strain 86-028NP
atgtctgaagaaaatattaaattactcaaaaaagtgggattaaaaattacagagcctcgcttaactattctcgctttaatgcaaaatcataaaaatgaacatttttctgcagaagatgtttataaaattttgctggaacaaggttgtgaaattggattagccacagtttatcgtgtgcttaatcaatttgatgaagcacatattgtaatccgtcataattttgagggaaataaatccgtttttgagcttgctccaacagaacatcacgatcatattatttgtgaagattgcggtaaagtatttgaatttacggataatattattgaacaacgtcagcgtgaaatcagtgaaaaatacggcataaaattaaaaacgcataacgtgtatctttacggcaaatgcagtgatattaatcattgtgacgaaaacaattcaaaataa

SEQ ID NO: 1021 - DNA, 525 bp, H. influenzae strain 86-028NP
atggcaatagttggtcttttttatggtagtgatactggaaacactgaaaacatcgcaaaacaaatccaaaaacaattaggtagtgatttaattgatattcgtgatattgccaaaagtagcaaagaagatattgaagcatacgatttcttgcttttcggtattccaacttggtattacggcgaagcacaagcagactgggatgactttttcccaacactcgaagaaatcgattttacagataaacttgtaggtattttcggttgtggcgatcaagaagattatgcagattatttctgtgatgctatcggaactgtgcgcgatattatagagccacacggtgcaattgtggtaggaaattggccaacagaaggctataattttgaagcttcgaaagccttattggaagatggcactttcatcggattatgtattgatgaagatcgccaaccagagcttaccgcagagcgtgtagaaaaatggtgtaaacaaatttatgatgaaatgtgcttagctgaattggcttag

SEQ ID NO: 1022 - DNA, 606 bp, H. influenzae strain 86-028NP
atgaagatcattgaagtagatgaagaattataccaatatattgcgagccaaacccgctctattggggaaagtgcttcggatattttacgccgtttgcttagtttacctgtgcatacttcaagtgttgatgatttagttcttacttcagcagaaactaacaaatccgcagatcaaaagccagaacaggctattaatgtgaaagaagtaaatatcaaaacaacaaaaaagcaatcaataaccgcaattaatcagatagtagaaaaagtccaaactttattaaattcaactgaatttcaagaagaaagtaaggcggtggtgcgtttcttagcgattttacgtgtgctttatcgtacaaatcctgaaagttttgcgcaagcaacggaatctttacaaggacgtactcgagtttactttgcacgtgacgaagcgacattattaatggctggcaatcatacaaaaccaaaacaaattccagatacgccttattgggttattaccaatacaaatagtggacgaaaaatgttgatgctagaaggtgcaatgcaatctatggaattacctgaaacattgattgatgaagtgcgatcatatttcacggtaaattaa

SEQ ID NO: 1023 - DNA, 864 bp, H. influenzae strain 86-028NP
atgatcttcatttttatctctctgtttgctaaaatttttttcaattataacgacttctttacaaattctcacgtaaaaattatggcaaaatcattactcaattatcaatttcatcaagtaaaacaaacgattaatacacctgttttaatttttattcacggtttattcggcgatatggataatctcggcgttatcgcgagagcttttagtgaacattacagtattttacgtattgatttacgcaatcacggccatagttttcattcggaaaaaatgaattatcaactgatggctgaagatgttatcgcagtaatccgccacttaaatttatccaaagtgatattaattggtcattctatggggggaaaaaccgccatgaaaatcaccgcactttgcccagaattagtcgaaaaattaatcgtaattgatatgtcccctatgctttatgagggatttggtcataaagatgtttttaatggcctatttgcggtaaaaaatgcaaagcctgaaaatcgtcagcaagccaaaccgattttaaaacaagaaattaatgatgaagacgttgtacaatttatgttgaaatcttttgatgttaattcagctgattgttttcgttttaatcttaccgcactttttaacaattatgccaatattatggattgggaaaaagtacgtgtatttacgccaactctttttattaagggtggaaattcctcttatataaaaatagaaaatagcgaaaaaattctagaacaatttcctaatgcaactgcctttacgattaatggcagtggacactgggttcacgccgaaaaacctgattttgttattcgtgcaattaaacgatttctaaataagaattaa

SEQ ID NO: 1024 - DNA, 1359 bp, H. influenzae strain 86-028NP
atgtatccttggcaaaattttgctattcaacctgatttctcagataaaatcgctttacgtactacgcagagcgatgcgcttacttggatagaattaactacaaagattaaccaaacggtggcttttttacaaaaaaaaggcgtaaatgcggaaagtgcggttgcttttgtgggaaaaaattcagagaaaattttatttttatatctggcgacaattcagcttggcgcaaaagttttaggcatcaatcctgcttttccacaagaaaaaattgcagaattatgtgagttttatcaaattgatttttgtttttatgataaagatttgctgaatttgcaagaaattgatgcttttacacaaaaagctaatttttttcgtcctgcgacgatgacgctaacctctggttctacaggcttaccaaaagcagttgtgcataatgtccaagcgcatttggataatgcaaaaggggtatgtaacttaatgaagtttgattgtaatcaatcttggttactttcattacccttatatcacgtttcaggacaaggtattgtttggcgttggttatattgtggtgcacaattacatttcccaaaagatgatttttatgcttcattattagaaacgacccacgtttctcttgtgccaacgcaattacaacgtttgttagattatttacaggaaaattcgattatttcattttctacacgtcatattttacttggtggtacgcatattcctgctgaactcacgaaaaaaatagtgaaatatggtattgaaacttattctggctacggaatgacggaaatggcttcgacagtttttgccaaaaaatctgatgaaaaacaaggtgtggggcaaccgctcttaggcagagaatatcgcttagtaaatgatgaagtttggctgaaaggtgcgggtttggcgatgggttattggaaggatcgacaaattgtttcattaacgaataaccaaggttggcttccgacaaaagataaaggtgtttggcaagagggcgaacttgttattatcggacgacttgataatatgtttatttctggtggcgaaaatattcagccagaagaaattgaacaagtgattattcaacattcttcagttaatcaagtgtttgttttaccacaaaaaaacaaagaatttggtcagcgtcctgtcgctttagtggattttaatgaatcctttagcaaaagtgcggttgaaaatttaatgttttttttacaagataaactcgcacgttttaaacaacctattgcatattatcctttaccactgatgcttgggaaaggcattaagatctcacgtaaacagcttgccgattggctggcaaagcaagataagataaattaa

SEQ ID NO: 1025 - DNA, 3339 bp, H. influenzae strain 86-028NP
atgattaggaaacttatgaaaacacctccattttttaccgtactttttgcctcggcaatgtttacccttagtgtttcacaaggggcattaggggcaaattcaacaaatgtattaccaacggagcaatcgcttaaagccgatttggctaacgctcaaaaaatgagtgagggggaagcaaaaaatacgttgttagcagaattacaaacatcaattgatttattgcagcaaattcaagctcaacaaaaaatcaatgatgcattgcaaacaacattaagccattcagagagtgaaattagaaagaataatgcagaaattcaagcattaaaaaaacaacaagaaacagcaacaagtactgattataatgcacagtcacaggacgatttacaaaatagtctcgctaagttaaatgatcaattacaagatacgcaaaacgcattaggcgcggcaaatgcacaattggcagggcaaaattctatttctgaacgagctcaagcggcattaacggaaaatgttgtacgcactcagcaaattaatcaacaattggccaataatgatattggtagcgcattacgaaaacaatatcagattgaattacaactgattgatttaaagaatagttataatcaaaatttattaaaaaataatgatcagctttctttactttatcaaagtcgttacgacctattgaatttacgtttgcaggtgcaacaacaaaatattattgcgattcaagaagtcattaatcaaaaaaatcttcagcaatcacaaaatcaactagaacaagctcagcagcaacagcaaaaaactgtgcaaaatgattacattcaaaaagaacttgatcgcaatgcacagcttggtcagtatctattacaacaaacagaaaaagcgaattcattaactcaagatgagttaagaatgcggaatattttagatagcctcactcaaactcaacatactattgatgaacaaattagtgcattacaaggcacgttagttctttcacgtattatccagcaacaaaaacaaaaattaccgactaacttaaatattcaaggtttatcaaaacaaattgccgatttgcgtgtgcatatttttgacattactcaaaaacgcaatgaactttatgatctaaataactatattaataaagttgaaagtgaagatggaaaacaatttactgaggcagaaagaacgcaggttaaaacgctattaactgagcgtcgaaaaatgacatctgatctgattaaatctttaaataatcaattaaatctcgcgatttctttggaattaacgcagcagcaaattacacaaatcagtgatcaaattcaatctaaattagagcagcaaagtttttgggtgaaaagtaataatcccattaatttagattggataaaaatgctgccaagagctttaattgaacagtttaatggtatgttgaaaaaattaggttttccaactaattatgacaatttaccttatttacttatgtatttcttagggttatttattgtaggtggtgcaatttttaaatttaaaaatcgtattaaacaacaattaaacaaaattaatcgtgaaatacatcgcttagatacagatagtcagtggagtactccacttgccctgttattaactgcgtttttaacgctttctagtacactttggtttttagccgtttgccaaatgatcggcttctttttcttcaaaaatccagaagaattttggcattggtcatttagtatggcaggttattggtggttctttacattttggatttcattgttccgtccaaatggtatttttgttaatcattttgaatcttcaaaagagaatgcacaacgttttcgtggtgttatccaacgcattattattgtgattgtattgcttttaaatacttctgtgtttagcaatgtcactgatgcaggtttagctaatgatgtgttaggtcaaattaatactattacagctctaattttctgtgcggcgattattgctcctcgctttaatcgagtacttcgctcttatgaacctgaaacaaataaacatcattggttaataagaattgtacaaattggtttaagattaattcctgtgggactaatcgtacttattgttttaggctattattacactgctttaaatttaattgagcattttattcattcttatattgcttggtgtgtatggtggttagtacgtaatacgatttaccgtggtattacggtttcttctcgtcgtttagcacatcgccgtttagcagaaaaacgtcgtcaaaaagcacttgaaaataattatgaaaatatttcctctgatgatgtggttgcagtgggagagccagaggaaggtttagcgttaaatgatgtgcgtagccaattattacgttttgtagatctctttatttggacagcattattggggattttctactatgtatggtcagatttagtcacagtagtgagctatttacgtgaaattacactttggcaacaaaccacgacaaccgatgctggcactgtaatagaaagcattactttatttaatcttcttgttgctttggttatcctaggaattacttatgtgttggttcgtaatatttcaggtattttggaagtattaattttctctcgcgtgaatctttcacaaggtacgccttatacgattacgacattgctcacttatatttttatcgccattggtggtgcgtgggcatttgcaaccttaggaatgtcttggtcaaaattacaatggttatttgccgcactttccgttggtcttggttttggtatgcaagaaatttttgcaaactttgtgtcgggcattattttgctatttgaacgcccaatccgagttggcgatgtcgtaaccattaatggagtgagcggtactgtagcgaaaattcgtattcgtgcaattacattaattgattttgatcgcaaagaaattattgtgccaaataaatcttttgtgacaggtcaagtaaccaattgggcattatctagcacgatgacacgtttagtgattagtgttggtgttgcttatggttctgatttaacactcgttcgtcaattattacttcaagcagctgatgaacagccgactgttttacgcgatcctaaaccatctgcttattttttaacttttggtgcaagtactttggatcacgaattacgtgtttatgtagaacaagttggagatcgtaccagtactacagatgctattaatcgccgtattaatgaattatttgcagaacataatattgatattgcctttaatcaattagatgtatttatcaaaaataatgacactggcgaagaaattccctttgttgatgtaaaaaaataa

SEQ ID NO: 1026 - DNA, 1074 bp, H. influenzae strain 86-028NP
atggcaggtaatacaattggacaactttttcgtgtgacgacctttggggagtcacatgggattgcattaggctgtatcgttgatggggtaccgccaaatcttgaattatctgagcaagatattcagccagatttagatcgtcgtaaacctgggacatcacgatataccacgccgcgtcgtgaagacgatgaagttcaaattttatctggtgtgtttgaaggaaaaactacaggcacaagtattgggatgatcattaaaaatgctgatcagcgttctcaagattatggcgagattaaagatcgttttcgccctggtcatgcagactttacctatcagcaaaaatatggcatccgtgattaccgtggcggtgggcgttcttcagcgcgtgaaacagcgatgcgagttgcagcgggagcgattgcaaaaaaatatttacgcgaacattttggtattgaagtccgtggttttttaagtcaaatcggtcatgtgaaaatttcgccacagatcatcggagaaattgattgggaaaaggtaaacagcaatccattcttttgccctgatgaaagtgcggtagaaaaattcgatgaattgatccgtgaacttaaaaaagaaggagattctattggtgcaaaacttactgttattgcagaaaatgtacctgtaggattgggcgagccagtatttgaccgtttagatgcagatcttgctcacgcattaatgggaattaatgcagtaaaaggcgtcgaaattggtgatggttttgcagtggttgaacaacgtggttcggaacatcgtgatgaaatgacacctaatggctttgaaagtaatcacgcaggcggcattttaggcggaattagttcaggacagccaattatcgccacgattgcgttaaaaccaacttcaagtattacaatttctggtcgttcaattaatcttaatggcgagccagtagaagttgtgacaaaaggtcgtcacgatccttgtgtgggtattcgtgctgtacccatcgcagaagccatgatggcgattgtcttattagatcatctattacgttttaaggcgcagtgtaaataa

SEQ ID NO: 1027 - DNA, 861 bp, H. influenzae strain 86-028NP
atgaataaaattttattaaaaacaaccataatttttaccgcacttttctctctgaacgttgttgcgtctcctctagattggcaaaaagtgaaacgtcctattccaagtgacgatgggaaagcaaaacctattggtagctataccaatgggtgtattattggggcgcaagcactaccgccgaaaggagacggttaccaagttattcgtatgaatcgcaatcgttattatggtcatccaaatatgattcagtatattgaacgtttggggcagcgagctaaagctgctgggttaccaactatgttagtgggtgatattgccatgccgggtggcgggcggtttttaacgggtcatgctagccatcagatgggattagatgcggatatttggttaagaatgggcgaaatgtcagacgccgatgcgctgaattctgatggtaaaggtttattagttgtagatagaaaggcgcaacgagtggatgaacgagtatggaatagcaatcatgcgacgttaatcaagttagccgcacaagatccaaatgtgacgcgtatttttgttaatcctgcgattaaggtaaaattatgtcaaaccgctggcaatgatcgcggttggctacacaaagttcgtccttggtatggacacaactctcattttcatgttcgtttaacttgccccgcagatgcatcttattgtgaaaatcaagcgcctgtgcctgctggtgatggttgtggagacgaattatattcttggtttgaaccgccaaaaccaggtgcttcagtgagcaaacctaaagttacaccgcctgagccgtttttgtgccaacaaattttaaattccccgaatcggagtgaatggttagaatag

SEQ ID NO: 1028 - DNA, 768 bp, H. influenzae strain 86-028NP
atggatatcggcattgatcttttagcaatattgttttgtgttggttttgtcgcatcatttatcgatgcaattgctggcggtggtggattaattactattccagcgttgcttatgactggcatgccaccagcaatggcgttaggcaccaacaaattgcaagctatgggcggtgcattatccgcaagcctttatttcttgcgaaaaagagcggtcaatttacgcgatatttggtttattttgatttgggttttcttaggttcagccctaggtacattattaattcaatcaattgacgtggcgattttcaaaaaaatgctgccttttttgattttagctattggtctatattttttatttacccctaaattaggtgatgaagatcgaaaacagcgtttaagttacatgttatttggtcttttagttagcccatttttaggtttttatgatggcttctttggaccagggactggctcaatcatgagtttagcctgtgttactttgctaggatttaatctcccgaaagcgacggcacatgcaaaagtgatgaacttcacttcgaaccttgcttcttttgcgcttttcttattgggtggacaaattctttggaaagtgggtttcgtgatgatggctgggagcattttaggtgcaaatttaggtgccaaaatggtgatgacgaaaggtaaaaccttgattcgaccgatggttgttatcatgtcttttatgatgacggctaaaatgatttacgatcagggttggtttcatttttaa

SEQ ID NO: 1029 - DNA, 957 bp, H. influenzae strain 86-028NP
atgtcggataatcaacaaaatttacgtttgacggcgagagtgggctatgaagcgcacttttcatggtcgtatttaaagcctcaatattgggggatttggcttggtattttctttttattgttgttagcatttgtgccttttcgtctgcgcgataaatttgcgggaaaattaggtatttggattgggcataaagcaaagaaacagcgtacgcgtgcacaaactaacttgcaatattgtttccctcattggactgaacaacaacgtgagcaagtgattgataaaatgtttacggttgttacacaagttatgtttggaattggtgagattgcaatccgttcaaagaaacatttgcaaaaacgaagcgaatttatcggtcttgaacatatcgaacaggcaaaagctgaaggaaagaatattattcttatggtgccacatggctgggcgattgatgcgtctggcattattttgcacactcaaggcatgccaatgacttctatgtataatccacaccgtaatccattggtgaattggctttggacgattgcacgccaacgtttcggcggaaaaatgcacgcacgccaaaatggtattaaaccttttttaaatcatgttcgtaaaggcgaaatgggttattacttaccagatgaagattttggggtggaacaaagcgtatttgttgatttctttgggacttataaagcgacattgccagggttaaataaaatggcaaaactttctaaagccgttgttattccaatgtttcctcgttataacgctgaaacgggcaaatatgaaatggaaattcatcctgcaatgaatttaagtgatgatcctgaacaatcagcccgagcaatgaacgaagaaatagaatcttttgttacaccatctccagagcaatatgtttggattttgcaattattgcgtacaaggaaagatggtgaggatctttacgattaa

SEQ ID NO: 1030 - DNA, 972 bp, H. influenzae strain 86-028NP
gtgttagggacaattttacattcagaactggaaaaattttatgatccaaatttgctcgttggcaatgaaactgcagacgatgcggcggtgtatgatcttggtaatggaactgcaattatcagtaccacagacttttttatgccgattgtagatgatccttttgattttggacgaattgccgcgaccaatgccattagtgacatttttgctatgggcggtaagccgattatgggaatcgctattttaggttttccaaccaatgtattacctgcagaagttgcacagaaaattgttgatggtggtcgttttgcttgccatcaagcgggtattgctttggcgggtggacattccattgattcgcctgaacctatttttggtttagccgtgacaggtgtgattgacactgaaaaagtaaaacgtaatgcttctgcaaaatcaggttgtaagctttatatgacaaaaccgcttggtattggtattttgacgacggcggagaaaaaaggaaaacttaagccagaacatcaaggtttagccactgccgctatgtgccaaatgaattctattggcagtcaattttcccaagtggatggcgtcacagcaatgacggatgtcactggatttggtttacttggccatttaattgaaatctgtgaaggttcaaatctaagtgcggtagttttttcggacaaaattaaaaccttggacggagtaaaagattatattgctcaaggttgcgtacccggtggaacagggcgtaattttgaaagttatggacataaagttggcgcattaacggaagaacaaaaagcgattttgtgcgatcctcaaacatcaggtggtttattagtggctgttgagcctaatagcgttcaaactataattgaaatagccaaagatactggcattgatttatatgaagtgggtaaattgaaacctaaatcagaatccgatatcgttgttgaagtaaaataa

SEQ ID NO: 1031 - DNA, 351 bp, H. influenzae strain 86-028NP
atgtctaacattatcaaacaacttgaacaagaacaattaaaacaaaacgtacctagcttccgcccaggtgatactttagaagttaaagtatgggtagttgaaggtagcaaacgtcgtttgcaagcattcgaaggcgtggttattgcaattcgtaaccgtggcttgcactcagcatttactttgcgtaaagtatctaacggcgtaggcgttgagcgtgtattccaaactcactctccagctgtagattctatcgcagttaaacgtaaaggtgcggtacgtaaagctaaactttactacttacgtgaacgttcaggtaaatcagctcgtattaaagagcgtttaggcgcataa

SEQ ID NO: 1032 - DNA, 741 bp, H. influenzae strain 86-028NP
atgtggataggggtaatttcattattccccgaaatgtttaaagcgattacggaatttggggttacaggtagagccgtaaaacataatcttctgaaagttgaatgttggaatccaagaaattttacattcgacaagcataaaactgtggacgatcgcccttatggtggtggcccaggaatgctgatgatggtgcaacctttacgggatgcgattcatactgcaaaagcagcggcaggagaaggcgcaaaggtgatttacctttcgccacaaggacgtaaacttgatcaagacggcgtaaccgagcttgctcaaaatcagaaattgattttagtatgtggacgttacgaagggattgatgaacggttgattcaaactgaaattgatgaagaatggtcaatcggcgattacgttctaactggtggggaattgccggcaatgacattaattgatgctgttgcacgttttattcctggtgtattaggcaaacaagcctccgcagaagaagattcttttgcagatggtttattagattgcccgcattacaccagaccggaagtgttagaaggattaactgtaccacccgtgctgatgtcgggacatcacgaagaaattcggaaatggcgattaaaacaatcgctacagagaacgtggttccgacgccctgagctcttagaaggcctagctctgactgacgaacaacgtaagctgttaaaagaggcgcaagccgagcataacagttag

SEQ ID NO: 1033 - DNA, 528 bp, H. influenzae strain 86-028NP
atggaacaacaacatattgaagttgtgggcaaattaggctcaacctacggtattcgtgggtggttgcgtatttattcatcaacagaacaagctgaaagcatttttgattatcaaccttggtttttaaaaatcaaaggtgaatggcaatcaattgaattagaaaactggcgttatcataatcacgaaatcatcgttaaattaaaaggcgttgatgaccgtgaaactgcacaaattttagcgaatgttgaaattggtgtagatttatctgttttcccagaactagaagagggcgattattactggcacgatttaatcggttgtacagtcgtaaacttagaaggttatacaatgggaacagtaacagaaatgatggaaacgggttctaatgatgtattagtggttaaagccaataccaaagatgcttttggaaaacaagagcggttaattccgtttttgtatgaacaagtagttaaaagagtcgatctcaccacaaaaacaattgaagtggattgggacgctggtttctaa

SEQ ID NO: 1034 - DNA, 249 bp, H. influenzae strain 86-028NP
atggtaaccattcgtttatctcgtggcggagctaaaaaacgcccattttatcaaatcgtagtcgctgacagtcgttcacctcgtgacggtcgcttcattgaacgtgtaggtttcttcaatccaattgcacaaggtaatgcagaacgtcttcgcattaatcttgagcgtgtaaatcactgggttgctcaaggtgcttcactttctgatcgtgttgcgagcttggtaaaagaagcacaaaaagcagcataa

SEQ ID NO: 1035 - DNA, 786 bp, H. influenzae strain 86-028NP
atgaggtttattatgaaaattagttttcattctgtgttaattggattagcatcatttattggtgttcaacaaggtgtaatagctagtccatcttctcatcaatcaatatccactgaatcagctgaggctttgaagcaacaattttcaatggctttagctaaacaagacaaacaacaaattacaaatttacaaaaaaaacttaccgcacttttttctttacctccccaatttcttgataatcagatccaaataagcgaaaaaatcctcactcgcatttttaaaacagataaaaatctcacgcctaaatttcttgattacttatactttgagccaataaatactgttgatgctaatttaattcaggaaatgaagaaaaacttactggtgtcttttttagcaaatgatcaggcaaaaatttatattcgtcaaacagataattcagagcaatttgttcagactttaatggagcggggagcaaaagcagatcaaattatattactgtctttgaatgccaaaggtatatttcaaaaaattattgaacaaatacgtcaagattttccgaatcagactattttttcgattactgaaaatcgtattagtttgattactccttcttcagaaattaagtctcgccttgctttagcaaatatgatgttcaatcgccaatttaaaggtgtggaagttgatgatttctcgtatttagatcaacctcgagaaaatttacagcacaataatgatgcaattcgttacaaaacctttcaagcaatgctagaaggtttaaattaa

SEQ ID NO: 1036 - DNA, 1812 bp, H. influenzae strain 86-028NP
atgcttttatccaaaaaatcagctacctttgcactcagtgcatttgcgatgcttttcactagtgtagctcttgccaaagaggcaccacaagctcacaaagctgtggaattaagtattttgcacatcaatgatcaccattcttatttagaaccgcacgaaacacggattaatttaaatggtcagcaaaccaaagtggatattggtggtttttctgctgtcaatgcaaaacttaacaaattgcgtaaaaaatacaaaaatccattggtactgcatgcaggcgatgccattactggtacgctttacttcacgctgtttggtggttctgcagatgcagctgtgatgaacgcaggtaattttcattattttactttaggtaatcatgaatttgacgcaggtaatgaagggttattaaaactgcttgaaccattaaaaatccctgtgctttcagctaatgtgattcctgataaaagttcaattttgtataacaaatggaaaccttacgatattttcactgtggatggagaaaaaattgccattatcggtttagataccgtgaataaaacagtgaattcctcttctccgggtaaggatgtgaagttttatgatgaaattgctactgcacaaattatggcaaatgcgctaaaacagcaaggaattaataaaattatcctactttcacacgcaggtagtgaaaaaaatatcgaaattgctcaaaaagtaaatgatattgatgtgatcgttactggcgattcacattatttatacggaaatgatgaattacgtagtttaaaacttccagtaatctatgaatatccacttgaatttaaaaatccaaatggagagcctgtatttgtaatggaaggctgggcttattctgccgtggtgggggatttaggtgttaaattcagtcctgaaggtatagcgtctattactcgtaaaattcctcacgtgttaatgagttctcataaacttcaagtgaaaaattcggaaggtaaatgggctgaattaactggcgatgaacgtaaaaaagcacttgatactttaaaatcaatgaaaagtatttcacttgatgatcacgatgcaaaaaccgataagcttattgctaaatataaaagtgaaaaagatcgcttagcacaagaaattgtgggcgttatcactggttctgcaatgccaggtggttcagcaaaccgtatcccaaataaagcaggatctaatccagaaggttctattgcaacgcgttttattgcagaaacaatgtataacgaactcaaaacagtggatttaactattcaaaatgctggcggtgtacgcgcagatattttaccgggcaatgtaacctttaacgatgcttatactttcttacctttcgggaatacgttatatacctataaaatggaaggttcgttagtgaaacaagtgcttgaagatgcgatgcaatttgctttggttgatggctctacaggcgcattcccttatggtgcaggtattcgttatgaagcgaatgaaacaccaaatgcggaaggtaaacgtttagtgagtgttgaagtcttgaataaacaaacccaacaatgggaaccgattgatgataacaaacgttatcttgtcggaacaaatgcttatgttgcaggcggtaaagacggttataaaacctttggtaaattatttaacgatccaaaatatgaaggcgttgatacctacttgcctgatgcagaaagtttcataaaatttatgaaaaaacatccgcactttgaggcttacacttcatcaaatgtgaaatttaatgcttcaactgatgcattacctaaaaaataa

SEQ ID NO: 1037 - DNA, 543 bp, H. influenzae strain 86-028NP
atggcggaaaaacgtaatatttttttagtaggaccaatgggtgcaggtaaaagtactatcggtcgtcaattagcacaacagcttaatatggattttattgattccgatgcagtgattgaagaacgtacgggcgcggatattagctggatttttgatttggaaggcgaagacggcttccgaaaacgtgaagaacgcattattaacgaactcacacaaatgcaaggtattgtactttcaactggtgggggagcagtgctttctaaggaaaaccgtaattatttatcagcacgtggtattgtaatttatttagaaacaacggtggaaaaacaattccaacgcactcaacgtgataaaaaacgtccattgctccaagatgcagagaatcctcgtcaagtattggaagatttagcaaaaattcgcaatccgctttatgaagaaattgcggacatcactttgccaactgatgaacaaaatgccaaagtaatggtaaatcaaattgttgatttaattgataatatgaatggattaaatggtgcgctttaa

SEQ ID NO: 1038 - DNA, 1089 bp, H. influenzae strain 86-028NP
atgttgtgcgtcaatgtggaattgcaagagcgtcgctatcctattttaattggtagcggattgttacaagatgaacgtagttacccgattaaacgtggggatcgcgtgatgattgtaacgaatcccacggttgcacagttttatcttgatacagtcatctatgcgttggaaaaacgtggttgcgtagtcgatcatgttttattgccagatggcgaaaaatacaaaacacttgaatctttaaacttaattttcaccgcacttttgcaagataatcatgggcgagataccacgattattgcattgggcggcggcgtaattggcgatgttgctggctttgtggcggcaagttatcagcgcggtgtgcgtttaattcaaatgccaaccacattgctttcacaagtggattcttcagtgggcggtaaaacggcggttaatcatgaattaggcaaaaatatgattggcgcgttctatcagccatcaatggttattattgatacgctcacgcttaatacgcttcctaaacgtgaagtaaacgcggggcttgccgaagttatcaaatatggtgccattttagattacgaattttttgaatggctagagcaacatattgatgaacttgtcgctttgcatcctgaggcgcttcaacattgtatttctcgttgttgccaaattaaagcagatgttgttgcgagagatgaaacagaaaaaggcgatcgtgcattgcttaatcttggacatacttttggacatgccattgaaactcacttaggttatggaaactggcttcatggtgaagctgtttcgacgggaatgatgatggcagcggtgctttcggaagaacttggagatatttctattgcagatgtgtctcgccttgaaaaattacttgctcgtgccaatttgcccaccgtatcaccggatacgatgcagccagaagactatttaccgcatatgatgcgtgataaaaaagttctatcgggtaaattgcgtctggtgttactcaaatctctaggccaagcttatgtggcgaatgataccgatcataccctcgtgttaaacgcaattcgtcgttgtactcaaacggattaa

SEQ ID NO: 1039 - DNA, 861 bp, H. influenzae strain 86-028NP
atgttacgtccgaaaaaacaatctttaaaacctaagttaaaacaccgtccatttttaaaatgggcggggggaaaatttcgtttaacggacgagataaataaagcctttccaaacaaaaaaaactgcttaattgagccatttgtgggtgctggagcgatatttctgaattctaattttgaacgctatattttggcagatatcaaccctgatttaatcaatctattcaatattgttaaagaaaatgtagagggttatattgaagattgtaagccgattttcttcgctgatgatgccaatacacccgattattactatgctaaacgtcgccaattcaatgcatcaacagatcctttcgaacgttcgattatttttttatatttgaaccgttttgggtttaacggattatgccgttataacagcaagaatgaatttaatgtgccttttggagcttacaaaactcattattttccagaagatgaattacgttatttcgctcataaagcgcaaagtgcggtatttttatgctgtgattttcaaaaaacttttgaatttgccgataaggattcggtgatttattgtgatccaccttatgctccgctacaacaagagactaattttactggttatgcagggaatgagtttggactagtgcagcaacgtgctttggcagatttagcgaaatctatacaaaaagaaaaacaaatttcgatattgatctcgaatcacgatactaaatttacgcgtgaaatttataacggtgctaaatttaaacgggtaaaagtccaacgttctattagccaaaacccagaaaaacgcgtaaaagtgaaagaattgattgcgatatttggtgctcgtaaataa

SEQ ID NO: 1040 - DNA, 108 bp, H. influenzae strain 86-028NP
atgaattatttcatcatggataaaactttcttagaacaagaaatattacttccccaatttattattcaaaatatagaacggtggtttaaaacacacaattttgtatag

SEQ ID NO: 1041 - DNA, 726 bp, H. influenzae strain 86-028NP
atgttcaaaaggctgtcattatatacgttattactttgtcttgtaccattttttatttggggtatttcctatcaatggcatggtaatagccaattaactcaagctgattattggctttatttgctcactgaaacgggtagcgtaccttatgcgttgattacctgtgtgttatttacgcttttgtttgcgtttttatttaaaaatccaaaacaatggctattaggcgtaattgtgatggggatttcagttattgcaactcaagcggcaaaaacaggggcaaaagcattatttgaagaacctcgtccgtttaccgtttatctagctgagcaaactcattcaacgcctgaaaacttttataaaaatgaccgcactttgcgtgctgaaatagctaagaatttttattcgatggatgctatcacaccagcttggttagttcatcattatgagaatgaaacggggtattcgttcccttctggacatacgatttttgcggcaacttggctaatgcttgctgttggctttacccaattattgggtaaccgttcttttaaagcaaaattgctggtggtgggtattgcagtgtggggcttattgatgttgattagccgtgtgcgattaggcatgcattacccaatagatttattggtggcgacattactggcatggttgattaatggcattatttttgcctttttaaagaaaaaggcgatcttcgtcatgaaatag

SEQ ID NO: 1042 - DNA, 675 bp, H. influenzae strain 86-028NP
atgactacgaataaggatcactttatggcaaaaattcagctagttgcgcaagccaatttacccactgaatacggtattttcaaaatggtgggatttgaattcccagatacaaaaaaagaacatgtagccttagtgatgggcgatatttctaatgctgatgaacctgtattagcacgtatccattctgaatgtttaactggcgatgcgcttcacagcttaaaatgcgattgtgggttccaactggcgacagcattaaaacaaattcaagaagaaggtcgcggagtcttaatttatcatcgtgaagaaggtcgcggaattggtttgattaataaaatccgtgcttattctttacaagataaaggaatggataccattgaagctaatcttgctttaggtttcaaagcggatgaacgcaactttgaagtctgtgccgatatgtttgagctacttggtgtaaaaaaagttcgcttaatgaccaacaacccagaaaaagtagaaaccatgaaaaaagcaggtatcaacgtggttgaacgagtaccgcttaatgtaggcgaaaaccgctacaacacaaaatatcttgatacaaaagcgaaaaaaatggggcattacattgtgcataacaatgacgaacaacatttaatgacctgtccacattgccaggaagagattatttaa

SEQ ID NO: 1043 - DNA, 1545 bp, H. influenzae strain 86-028NP
atgaataatttgttcgccttgtgccaacgaagtgcggttattttttctattatttttacggtggtggcttgtgataaattggatagtcctaagcctatttcgccacaaattgagacacaaaaaaatactcaattagaatctaaccgagttgaattaaaacgtggcgtttatagcgatttgactttgcaaccttggcaagcacaaagcgaagaacaaactcaattattacgagatctttttgaaggattaacggcttatgatgtgcaaagtaatcttgttccagctgtagcagaaaattggcaaaccgaagacaataaaacttggattttcactttgcgtgaaaatgctaaatggtcaaatggcgagcctatcactgcatcagattttgtacaatcttggcaaacactttctcaatctgaaagcccacttaaaaattatttggcttttatgaatctgaaaaatgcgaaggcagtattggaaaaagcgttacctgttgaatccctaggattgtttgctgaaaatgaccgcactttacgcatcgaattagataaagcatcgccatatttaccttctatgctggcacatgtcagtcttttgcctcactatgctaaatcgactgaaatatttatcagtaatggcgcatatcagttacaaagtcaggctgaaaatcagcatattttaactaccaatccttattattgggcgaaagaaaaagtgatatttcagcaagtgaagtatcaaaaaattgcagcagatgcagatttgtctgattttgatgttgtaatgaatccgaaaaaagtcgatcagaatatccaagattatccgcaactttgtacttacttctatgagtttaatctttccgatcctgtgttacaaaaaagtgcggtaagaaaagcgattgtttcgatgatttctaccaataatttggttgcagatattgctcatctttatcctaacaatacttttttgccaaaatctatgctaggtgagcaagaatctgtttgggagccagttgttgcagaacagctcttttcccaaaatcaaattagtgaaactcgtccattgaaattacgtattcgttatgatgattcatctctgaatcaaaccattgcaatgcgattaaatcatcaattatcacaatctgatttattacgagttgaaaatcaagggatgagctggcaagaattgcaaacggcccgcacaaaaggcgattttcaattaattcgttctggctggtgtgctgattttaatgatcctgcagcatttctaaatttattctattcaaaaagcccagataacaaaaatggctataaaaatgcggaatttgatcgtttatttgaaagtgcaatgacgacgacatccggaaaagtgcggttagaaaattacgcaaaattaaaagggatagttcaacaagagcatttagtgttacccatttttcaatatagtacgcctgtttatcttgcaccgagtataatgggtgctcaagtaaattctgtcggtgtcatttacagtaaagatttgtggagaaaggttcaaagtcaataa

SEQ ID NO: 1044 - DNA, 363 bp, H. influenzae strain 86-028NP
atgaaaattatttacattattttaggttttctttcacttgcaattggcatcattgggatttttcttcctcttttgcctaccacgccttttttattacttactttatttttcttcacaaaaggttcaaaacgcttagaacaatggtttttaggcacaagtatttatcaaaaacatctcaagtcctttcatgaaaatcgatcattaaagaaaaataccaaaatttttattttgacttttgctaccacaatgctactaattggtttttatttcacgccaagtgtaatagggcgtagtgttattgttgcgttgatttgtattaagttttggttcttcttattttggattaaaaccgaaaatgaataa

SEQ ID NO: 1045 - DNA, 2046 bp, H. influenzae strain 86-028NP
atgtctatgtcaaatccattacttcacattcaaggcctaccgccattttcacaaatcaagccagaacacattcaaccagctgttgaaaaattaattcaagattgtcgcaatacgatagaacaagtgttaaaacaaccgcactttacttgggaaaatttcattttgcctttaacggaaactaatgatcggttaaatcgtgcttggtcgcccgtttctcatctcaattcagtaaaaaatagcactgaattacgtgaagcctatcaaacgtgcttaccgttactttctgaatacagcacttggattggtcagcataaagggctttataatgcttatttagcgttaaaaaatagtgctgaatttgccgattattcgattgcacaaaagaaagccattgaaaattcactgcgtgattttgaactttcaggtatcgggctttccgaagagaaacaacaacgttatggcgaaattgtggcacgcttatcggaattaaattcacaattcagcaataatgtattagatgccacaatgggttgggaaaaactcattgaaaacgaagctgaacttgctggcttacccgaatccgcactgcaagcagcacaacaatctgccgaaagtaaaggattaaaaggttatcgttttacgttagaaatcccaagttatttgcctgtgatgacttactgcgaaaatcgtgcattgcgtgaagaaatgtaccgtgcttatgcaacacgcgcctctgaacaaggccctaatgcgggcaaatgggacaacagtaaagttatggaagaaattcttacattacgcgtggaattggcgaaattactcggttttaatacttacaccgaactctcacttgccacaaaaatggcagaaaacccacaacaagtgcttgatttcttagatcatcttgccgaacgtgccaaaccacaaggcgaaaaagaactgcaagaattgaaaaattactgcgaaaaagaatttggtgtcacggaacttgcaccttgggatattggtttttacagcgaaaaacaaaaacaacatttatacgccattaatgatgaagaacttcgcccatattttctagaaaatcgcgtgatttcaggattgtttaaattaattaaacgcattttcaatattcgtgcagtggaacgcaaaggcgtggatacttggcataaagatgtgcgtttctttgatttaatcgatgaaaatgatcaactccgaggcagtttctatcttgatttatatgcgcgcgaacataaacgtggcggtgcgtggatggatgattgtatcggacgtaagcgtaaactggatggcagcattgaaacgcctgtggcttatttaacttgcaacttcaacgcccctatagggaataaaccagcgttatttactcacaatgaagtcaccacgctattccacgaatttgggcacggaatccatcatatgctcacgcaaattgatgtatccgatgtggcgggtataaatggcgtgccttgggatgctgtggaattaccaagtcaatttatggaaaactggtgctgggaagaagaggctttggcgtttatttcagggcattacgaaacaggcgagccgttgccaaaagaaaaactcacgcaattattaaaagcgaaaaatttccaagctgcaatgtttatcttacgtcagcttgaatttgggatttttgatttccgcttgcatcacacctttgatgcggaaaaaaccaatcaaattttggatacacttaaatcagtgaaatcacaagttgccgtcataaaaggcgtagattgggcaagaacgccacacagcttcagccatatttttgcagggggctacgccgcaggttattacagctatttatgggctgaagtattatcagcagacgcttattcacgctttgaagaagaaggtattttcaacccaatcaccggcaaatcattcttagatgaaattctcacgcgtggtggctcagaagaaccaatggaactcttcaaacgcttccgtggccgtgaaccgcaattagatgcgttgttaagacataaaggaattatgaactaa

SEQ ID NO: 1046 - DNA, 1545 bp, H. influenzae strain 86-028NP
atggctgctgcaattcaacaacgtgccgaacttcaacgtcgtatttggcaaattgctaatgatgtgcgaggctcagtcgatggctgggatttcaaacaatatgtacttggcacacttttttaccgttttattagcgaaaattttgccaattacattgaagcaggcgatgaaagcgtaaattatgcccaattacctgatgaaatcattaccccagacattaaaacagatgccattaaaacgaaaggctactttatttacccaagccaattatttaagaatgttgcggctaatgctggcaacaatcctaatttgaatactgatttaaaacagatttttactgatattgaaaactcagcgacgggctttccgtctgaacaagatattaaaggcttatttgccgattttgataccaccagcaatcgcttaggcaataccgtaaaagataaaaacgaccgcttaacggctgttttgaaaggcgtggctgaacttgattttggcaaatttgaagataaccacattgatttatttggcgatgcatacgaatatcttatttctaactatgctgccaatgcaggcaaatctggtggtgaattttttaccccacaaagtgtttccaaactcattgctcaaattgcaatgcacgggcaaacctcggtcaataaaatttatgatcccgcagcaggttctggctcacttttgcttcaagccaaaaaacaatttgatgaacatattattgaagaaggctttttcgggcaggaaattaaccataccacatataaccttgcccgtatgaatatgtttttgcataacatcaactacgacaaatttgatattgctttaggcaacaccttaatggaaccacaatttggcgatgataaacctttcgatgccatcgtttctaacccaccttactccgtgaaatgggctggctccgacaatccaacactgattaacgatgaacgatttgcccccgcaggcgtgcttgcaccaaaatccaaagcggattttgcctttattttacacgcattaagctatctttcaggcaaaggcagggcggcgattgtctccttcccaggcattttttatcgtggcggtgcggagcaaaaaattcgtcaatatttggtggataataattttgtggaaaccgtgattgcccttgcacctaatctattctacggcaccagtattgccgtaaatattttggttttgtccaagcacaaaccaaatacccaaactcaatttatcgatgccagcggtttatttaaatctgccaccaataacaacattttagaagaggaacatattgagcaaattctcaaactgtttgccaataaagaagatgtgccgcatttggcaaaatccgtatcctttgaagaaatcgcccaaaatgaccacaaccttgcagtaagttcgtatgtggaacaaaaagatacccgagaagtaattaatattgatgaactcaatgctcaaattcgtgaaactgttaccaatattgaccgcttgcgtgccgagattgataagattgttgcagaaattgaggggtaa

SEQ ID NO: 1047 - DNA, 1173 bp, H. influenzae strain 86-028NP
atgaaaaacaaccgcacttttttagaaaaattattggatgggtctgaggttgagtggaagcctttagatgaagttgccaatatcgtcaataatgcaagaaaaccagtcaaatcatcctcacgagtgtcagggaatattccatattatggtgctaataatatccaagattatgtcgaaggatatactcacgagggcgaatttgtattaattgctgaagatggttctgctagtctagaaaattactctattcaatgggctgtaggtaaattttgggcaaataaccacgtccatgtagtaaatggcaaagaaaaattaaataatcgttttttataccattatttaactaatatgaatttcattccattcttagctggaaaggaacgtgcaaaattaacaaaagctaaactgcaacaaattccaatccccatccccccactctccgtccaaacagaaatcgtaaaaattttggacgcattgacagcacttaccagcgagcttaccagcgagcttatactacgtcagaagcagtatgaatactatcgggaaaaattgttaagtgaagaagaacttgggaaggttgggtttgagtggaaaacaattgatgaaatctcaaagaaaatttcttcaggcggaacgcctacaacatcaaataatggctattatgacaacggtactattccatggttaagaactcaagaagtagattttaaagaaatttgggataccaacataaaaattactgaagatgctctaaataattctagtgcaaaatggattcccgcaaattgtgtaattgtagcaatgtatggagcaactgtaggcaaaactgctattaataaaattccactaacaactaatcaagcatgtgctaatatcgagattaatgataagttagcttgttatcgctatattttccattatttaactagtaaatatgaatacattaaatcattaggaagtggctctcagaccaatattaatgctcaaattatcaaaaaactcaaagttccagttcctccaatcgaagaacaataccgcatcgtttcaatcttagacaaatttgaaaccttaaccaattccatcaccgaaggcttgcctttagcgattgaacaaagccaaaagcggtatgaatattaccgagaattattattgaatttccctagcagagaataa

SEQ ID NO: 1048 - DNA, 1155 bp, H. influenzae strain 86-028NP
atgactaaaagtttagacaaaattgcaaaacaattaagagattctgataaaaaggttaatctaatttacgcctttaatggaagtggaaaaacccgtttatcaaaagtctttaagaatcttattgcacctaaagaaaatcatgacaatgaagaagatctaacacgaagaaaaattctttatttcaatgcctttaccgaagatttattctattgggataatgatctacttaatgacacagaaccaaaattaaagattcaaccaaattcttttattcgctggttgattagagatcaaggggatgaaggtaaagtaattggaaaatttcatcattattgtgatgaaaaacttatgcctaaatttgatatagaaaataatcaaattacattcagttttgcacgtggagatgatacgcctgaagaaaatataaaactatcgaagggggaagaaagtaattttatttggagtatttttcatacgttaattgaacaagttgttgcagaattaaatatctcagagcctagtgaacgcactactaatgaatttgatgaacttaaatatatctttattgatgatccagtaagttcattggatgaaaatcatcttattcaattagctgttgatttagcagaattagtcaaagatagtcccgatactataaaatttattatcaccacacacaatcctttattttataacgttttatacaatgaacttggagcaaaaaatggttatattctaagaaaagatgaaaataagaatgaaaacgaaagatttgatcttgaggtgaaacaaggtggttcaaacaagagtttctcctatcatctttttctaaaaaatctacttgaagaagttaaatctaaagatattcaaaaatatcatttcatgttactgagaaatttatatgaaaaaactgctaactttcttggttattcaggatggtcaaatctattacccaatgatgatgcaagacaaagctattacactcgtataatcaattttactagtcactctacgttatcaaatgagataatcgctgaaccaacagatgccgaaaagaagattgttaaatatttacttgaacatctaattaataattatggtttctatatagaagaaaatattaaagagccacaaactgataatataacagagtaa

SEQ ID NO: 1049 - DNA, 999 bp, H. influenzae strain 86-028NP
atgaacgacttaatcatctacaacaccgatgacggcaaatctcacgttgctttattggttgtcgaaaatgaggcttggctgactcaaaatcagcttgcggaactttttgacacctctgtaccaaatataaccactcatataaaaaacatattacaagacaaagagttagatgagttttcagttattaaggattacttaataactgcccaagatagcaaacaatatcaagtaaaacattattcccttgatatgattctcgccatcggctttcgtgtgcgcagccctcgtggtgtacagtttcgtcgttgggcgaatacgcaattacgtacttatttagataaaggttttctattagataaagagcggttgaaaaatcctcaaggtcgatttgatcattttgatgaattactggaacaaattcgcgaaattcgagccagtgaattgcggttttatcaaaaagtacgagagttatttaaattatccagtgactacgataaaacagataaagtcactcaaatgttttttgcagaaacacaaaataagttgatttatgccattacacaacaaaccgccgcagagcttatttgtacgcgtgcaaatgccaaattgcctaatatgggtcttacctcttggaaaggtgctgttgtacgtaaaggcgatattattaccgctaaaaactatttaactcatgatgaattagattctttgaatcgtttagtgatgatctttttagaaagtgctgaattacgcgttaaaaatcgtcaagatctcacattaaatttctggcgtaataatgtcgataatttaattgaatttaacggttttccgttgcttatcggtaatggaacccgaaccgtaaaacaaatggaaacctttaccaaagaacaatatgccttatttgatcaggtcagaaaacaacaaaaacgcatacaagctgataatgaagatttagaaattttagaaaactggcagaaagatctgaaaaagcaaaagcattaa

SEQ ID NO: 1050 - DNA, 3084 bp, H. influenzae strain 86-028NP
atgacccaatacaaaactatcgctgaatccaataattttatcgttttagatcaatataataaatttgtggaagaacctaatgctggttaccaaacggaagggagccttgagcgtgagtttattcgtgatttacaggctcaaggctatgagtatttacaagggcttaataatcacgatgaactgattaaaaacttacgtgttcaattacaacggttgaataatgttattttctccgatgcagaatggcaacgttttttagaggaatatttggataaaccgagcgataatctgattgagaaaacccgcaaaattcacgatgattatatttatgattttgtgttcgataacggacgcattcagaatatctatttgctagataagaaaaatcttgccaataattctctgcaagtcatcaatcaatttgagcaaacaggcagctatgataatcgttatgatgtgacaattttggtgaatggtttaccccttgtgcatattgaactgaaaaaacgtggcgtggcgattcgtgaagcctttaaccaaattcaccgttacagcaaagaaagtttcaataaagaaaattctctctttaaatatattcagatttttgtcatttctaatggcacggatactcgctattttgctaatacgactaaacgcaataagaatagctacgacttcacaatgaattgggcaacggcaaaaaatactctgattaaagatttaaaggattttaccgcaactttcttgcaaaagaatactttgctcaatgtgttggtaaattactgcgtgtttgatgtttccgacactctattgattatgcgtccgtatcaaattgccgccactgagcgtattttatggaaaatcaaaagttcatatcacgccaaaaattggagcaacaaagaaagtggtggctatatttggcataccacaggctcaggcaaaaccctcaccagttttaaagcatctcgtcttgcgactgaacttgattttattgataaagtcttttttgtggtcgatcgtaaagacttagactaccaaacgatgaaagaatatcagcgtttttcgcctgatagcgtgaatgggtcggaaagtaccgctgggcttaaacgcaatattgaaaaagatgataacaaaattatcgtaaccaccattcaaaaattgaataatttaatgaaaagtgaagaaaacctgtctatttatcaaaaacaggtggtctttattttcgatgaagcacatcgctcccaatttggcgaagcacaaaaaaatctaaaacgtaaattcaaaaaattctatcaatttggttttactggcacacctattttccctgaaaacgcattaggtgcggaaacgacaacaagtgtgttcggtacggaattgcattcttatgtgattaccgatgctattcgtgatgacaaagtactgaaattcaaggtcgattacaacgatgtccgcccacaatttaaagccttagaaacagaaaaagatcctgaaaaattaaccgcacttgagcagaaacaagcctttttacaccctgagcgtattaaagaaatctcgcaatatttgcttaacaattttaaacaaaaaacccaccgcttgaatgccacaggtaaaggctttaatgcaatgtttgcggtaagcagtgtggaagcagcaaaacgttattacgaaaccttacaaaatttacaggcagagcaggagcatccgttaaaaattgcaacaatcttttcgtttgccgccaatgaagaacaagatgcaattggcgatattccagatgagacctttgaacccactgctctaaacagtacggcaaaagaatttttaacaaaagccattgatgattacaatcactactttggcacgaattatggcgtagatagtcaatcattccaaaattactatcgcgatcttgccaaacgtgtgaaaaatcaggaagtggatttactgattgtagtcggaatgttcttaacaggctttgatgcccctacgttgaatactcttttcgtggacaaaaacttgcgttatcacggattaatgcaggctttttctcgcaccaaccgcatttatgacacaactaaaacctttgggaatatcgtcactttccgcgatttggaacaaaataccattgatgcaatcacgctatttggcgatgacaataccaaaaatatggttttagagaaaagctacgaaacctattttaatggtgatgaaaatcaacgtggttatttagaggttgttcaagagctacaaaatcgctttcctaatccaacagaaatcgaaacagagcaagataaaaaagagtttgtaaaattatttggcgaatatctacgtgtcgaaaatattttgcagaattacgatgagtttgcagcattgcaagccttacaagcggtcgatttaaatgatccgattgcaatggagaaattcaagcaagtacattatgtgaatgatgaacaaattgcagaaatgctgaaagtacccactttaccagtaagagcggagcaagattatcgttcaacttataatgatattcgcgattggctacgccaaagaaaagaagggaatgataaagataattcgccgataaattgggacgatgtcgtatttgaagtggatttattaaaatctcaagaaatcaatttggattatattcttgcgttaattttcgagcatcataagaaaaaccaagacaaagaggtgttaattgatgaaatccgccgcacagttcgttcaagtttaggtaaccgtgctaaagagagcttgattgtcgattttatcaaccaaacaaatttagatgatattcccgataaagcgactttaattgactcattcttcctatttgctcaagcagaacagcgaaaagaagcagaatccttaattcaagaagaaaatttgaatgtcgatgcagcaaaacgctatatcagcacttcattaaaacgcgaatatgccagtgaaaacggcacagcgttaaatgaagtattgccaaaaatgagtccacttactccacaatatctcactaaaaagcagacaattttccaaaaaattgctgcatttgtagagaaatttaaaggggttggtggaaagatttaa

SEQ ID NO: 1051 - DNA, 630 bp, H. influenzae strain 86-028NP
atgtcagtatttaatacatttgttgaatttgtcgcgagaattgttgcaccaatgcagcgtcaatttattaattttatccgtattgctatttttattgtaatggcatggatcggtggtttgaaagtttgtcaatatgaggcagatggaattgcccactttgtatcaaatagcccattttttagctatatgtatgaaaaagggccaaatttagtgccgaatgataaaggagagttagtgatggaatatacactacacaaaaatcctgaaggaaagatggttgcaaaaaacatcgaatggcataaagaaaatggcacctatacggcttcttacattattggagcaattattgttactgttggtattcttactttagctggtatttggaatgcaacggcaggtttagcaggaggcctactgacatttggcatgtcaatagtcacgctgtcatttttaatcacaacgcccgaggcttgggtgcctaatctaggtggagatttaccaacgccagcctatggtttcccttatttatctggagttggtcgtttagtgattaaagatattattatgatggcaggtggcttaacagctgcagcagagtgtgcaaatcgaattttagcacgtaaaaaataa

SEQ ID NO: 1052 - DNA, 1842 bp, H. influenzae strain 86-028NP
atgcacaggtttttttataacgataataatgttttaggagatttgatgaaaaatttcaaatattttgctcagagttatgtggattgggttattcgtcttgggcgtcttcgtttttctcttttaggcgtgatgattctcgcggttttagccctttgtactcagattttatttagtctatttattgttcatcagatatcttgggtagatatttttcgttctgtaacttttggcttactcactgcgccttttgttatttattttttcactttattagtagaaaaacttgaacattctcgtcttgatctttctagctcggttaatcgattggaaaatgaggtcgccgagcgaattgctgctcagaaaaaattatcccaagcattggaaaagttagaaaaaaatagccgtgataaaagtaccttacttgccacaataagccatgaatttcgcacgccattgaatgggattgtcgggcttagtcaaattttacttgatgatgaattggatgatctccagcgtaattatttaaaaactatcaacataagtgcggtcagtttaggctatatttttagcgatattattgatttggaaaaaattgatgccagccgaattgaattaaatcgccagccaacagatttccccgccttattaaacgatatttataattttgctagtttcctcgccaaagaaaaaaatcttattttttctttagagcttgaacctaatttgcctaattggttgaatcttgatcgtgttcgcttgagccaaattttgtggaacttaattagtaatgcggtgaagtttacggatcagggaaatattattcttaaaattatgagaaatcaggattgttaccattttattgtgaaagatacaggaatggggatttcacctgaagaacaaaaacatatttttgaaatgtattatcaagtgaaagaaagccgtcagcaaagtgcgggtagcggtattgggttggctatttctaaaaatctcgctcagttaatggaaggggatttaacagttgaaagtgagcgaggaaaaggcgcgactttccatcttactctccacgctcaggaaatttctgaaaaagaatctgttaagaaaaatataccatccttgaatattcttttagtggaagatgttgatctcaatattatggttgcaaaaactattttagaaaaacttgggcatcatgttgatgttgcgacaaatggcaagcaggcgattactttatttgagaaaaatgtttacgacattctattgctcgatattaaattaccagatatgagtggttttgaaattgcccaatatttgcgagagaactatgaaaacggtatttatgattttttaccgccaatgattgcttttaccgcgaatgttatgcaaagcgagcaagaatatttagaaatgggcatggatggcgtattacgtaaacccatttcaattaaggatttacaccattgtctacagcaattttttgcagatgaaagcgaatctattatagaaatgaatgatgataatgagctttcagaacagtttgatttagcgctgatagaaacacttggaaaaaaacaaattttagaaaatttatctttattcaaacaaactatgccaaattatctggctcaattatcaaaagataatatgaaagaaacagaagataccgcccataaaattaaaggcgcagcggcatcggtagggttaaatcatttacgtcaattagcggatactttagaaagtgcggctaaaaattctgatgtttttaattgtggagaattgattgatgaaattggaaatctttggttagaagatgtggaggatttgcttaaattttgtaaattttaa

SEQ ID NO: 1053 - DNA, 645 bp, H. influenzae strain 86-028NP
ttgatttttcatatttttcaaatagactttatatattcatttctaatctccttcattatgcttaaaaatttagacgaaataacttcaagtattatcgctgatcctcaaaataaagattttacagaacgtggaattttccctttattttcggcgcctaaaacagctcgaattaatattgttggtcaagctcctgggttaaaagctgagcaatctcgtttgtattggaatgataaaagcggtgatcgtctgcgagaatggttgggagtagattacgattatttttataattctgggatatttgcggttcttcccatggatttctattatcctggaaaaggtaaatcgggtgatttaccacctcgtcaaggttttgcagaaagatggcatccaatgattttagggaatctacctaatattcagctcactattcttattgggcaatatgcacagaaatattatttacccgaaaataaagataatgtaactaacactgttaaaaattatcgtcaattcttaccgcactttatgcctctcgtgcacccttccccacgtaatcagctttgggcaacaaagaatccttggtttgaagagcaagttattcctgaattacaaattttagtcaaacagataattaataaagattaa

SEQ ID NO: 1054 - DNA, 909 bp, H. influenzae strain 86-028NP
atgatgaattttacgttattgacatatttagcggattgtcagacaaaagtgcggtctgaattggaaaaattttctaaaaatctagaggaagatattcaacaattacgtgaaattggtttggatattctcgttgatggacaagattatcgcttagtgccaatgcttcctttattaaatcctcagcaaatatcaaccgcactttttccttatggcatccattatcagccgataatttcctctacaaatgagtggatactacaaaatattccttccttaaaaaaaggtgatctttgtgtggctgaatatcaaactgcagggcgcggtcggcgtggtcgccaatggttatcgccttttgctgggcaaatcatgtttagtttttattggacgtttgatcctaaaaaatcaattgaggggttaagtttagtcatcggtttggcgattgcggaagtgctaaatgtacaagtgaaatggccaaatgatattttgtttgatgaaagaaagttaggtggcattttagttgaaattgctaatcataaaaatggcatgctcaatttagtgattggcgtaggtattaatgcgtcgttgtcaaaacaaacagaaattagtcagccttatgcggaagtgtgtgaaattgatcctgatgtagaccgacaaaccttattacccaaacttatacaacatttatatacacgtttaaatatctttgagcaaaatggtattgatgaggaatttcaacaagcatggcaatcatataatgcgttttcaaatagtgaagtaaaggtgcttactgagcaaggcgttatttcaggtattgaacaaggcatagatgaacgtggtcatttaaaagtattatgtggcaataaaattcagatatttaatggtggagaagtttcattacgtaagaaataa

SEQ ID NO: 1055 - DNA, 1467 bp, H. influenzae strain 86-028NP
atgtcattacgcattaaacaagaagcccttacttttgacgatgttctactcgtcccagctcactcaacagtgcttccaaatactgccaacctttcaactcaacttaccaaagaaattcgcctaaatattccaatgctttcagcagcaatggataccgtaactgaaaccaaacttgcgatctctttagcacaagaaggcggtattggctttattcataaaaatatgacgatcgaacgccaagcagatcgtgttcgtaaagtaaaaaaattcgaaagtggtatcgtttctgaaccagtaactgttttaccaaatttaacgcttgccgaacttgctgaaatggtgaagaaaaacggatttgcgggctaccctgttgtagatgaggaaaataacttaatcggtatcattactggccgtgatacacgtttcgtaaaagatttaagcaaaacagtttcacaagtaatgacgaaaaaagaagacttggtgaccgtaaaagaaggggcgagtcgcgaagaaattttggaattaatgcatcaacaccgtgttgaaaaagtattagtggttaatgatagtttcaaacttaaaggtatgattaccgttaaagacttccaaaaagcagaacaaaaaccaaatgcgtgtaaagatgaatttggtcgtttacgtgtcggtgcggctgtaggtgcaggcccaggtaacgaagaacgtattgatgcattagtaaaagctggggtggatgtgttgttaatcgactcttctcacggtcactcagaaggcgtattacaacgtgttcgtgaaactcgtgcaaagtatccaaatttgcctatcgttgcaggtaacgtagcaacggctgaaggcgcaattgcattagcagacgcaggcgcaagtgcggtaaaagtaggtattggtcctggttcaatttgtacaactcgtattgtaactggcgtaggtgttccacaaatcacggctatcgcagatgcagcagcagcattaaaagatcgtggcattccagttattgctgacggtggtatccgtttctctggtgatattgcaaaagccatcgctgcaggcgcaagctgtgtaatggttggttctatgtttgcgggtactgaagaagcaccaggtgaaatcgaactttatcaaggtcgtgcatttaaatcttaccgtggtatgggctcattaggtgcgatggctaaaggctcttcagaccgttatttccaatcggataacgcggcagataaactcgtaccggaaggtattgaaggtcgtattccatataaaggttacttaaaagaaatcatccaccaacaaatgggtggcttacgttcttgcatgggcttaactggctgcgcaactattgatgaactacgcaccaaagcggaatttgttcgcattagcggtgcaggcattaaagaaagccacgttcatgatgttgctattactaaagaagcaccgaactatcgtatgggctaa

SEQ ID NO: 1056 - DNA, 1572 bp, H. influenzae strain 86-028NP
atgacaaatatccacaatcacaaaatcctaatcctcgacttcggttcacaatatactcaactgattgcgcgtcgtgtgcgtgaaatcggtgtgtactgtgaactttgggcttgggatgtaaccgaacaacaaatccgtgaatttgctccaacgggtatcattctttctggcagccctgaaagcacaactgaagaaaacagccctcgtgcacctgaatatgtgtttaatgctagtgtaccagtattaggcatttgctatggaatgcaaactatggcgatgcaacttggcggtttaaccgaaacttctgaccaccgagagttcggctatgcttcagtttctcttgaaaattccaccgcactttttgcaaatttaaacgataattcgaccgcttctgagccgaagttagacgtttggatgagccacggcgataaagtaacgcgcttaccagaaaacttcaaagtaactggcacaacgccaacctgcccaattgctgcaatgtcggatgaaaatcgtcgtttctacggcgtacaattccaccctgaagtaacgcatactaaaaaaggcttggaattattaaccaacttcgtagtaaacatctgtggttgcgaaaccaaatggacagcagaaaacattatcgaagatgccgttgctcgcattaaagagcaagtaggcgatgatgaagtgattttaggtttatctggtggtgtggactcttctgtggttgcattacttttacaccgtgctatcggcaaaaacttacactgcgtatttgtggataacggtttactccgcttacacgaaggcgatcaagtcatggaaatgtttggcgataaattcggtttaaatattacccgtgttgatgctgaaagccgtttcttaggcgaacttgcaggcgtatctgatcctgaagcaaaacgtaaaattatcggtaaagtatttgttgatgtatttgatgatgaatcgaaaaaactcactaatgtgaaatggttagcacaaggtacgatttaccctgatgtcatcgaatctgcagccagcaaaacaggcaaagcccacgtcattaaatcacaccataacgtaggtggcttaccagactatatgaaacttggcttggttgaaccattacgtgaattgtttaaagatgaagtacgtaaaatcggtttggcattaggcttgccagctgaaatgatcaaccgccatccattccctggccctggtttaggcgtgcgagtattaggcgaagtgaaaaaagaatactgtgatttattacgccgtgcggatgcgatctttatcgaagaattacgcaacagcggttggtatgaaaaaaccagccaagcattcagtgtgttcctgcctgtgaaatctgttggagtgatgggcgatggtcgtaaatacgattgggttatttccctacgcgcagtagaaacaatcgattttatgaccgcacattgggcacatttgccttatgatttattaggcaaagtgtctaaccgcatcattaacgaagtgaacggcatttcccgcgtcgtgtacgacatcagcggaaaaccaccagcgacaatcgagtgggaatag

SEQ ID NO: 1057 - DNA, 903 bp, H. influenzae strain 86-028NP
atgaggttcaaaatgaaagtagttactcaaggtgtattattgtgcattttttcacaatgtttatttggcatattgtatttatttagtatatggctccaaccacttagcggaacggatgtttttgcgtggcgtatgctgaccatgatctttgggttacttttaattttattcccgactattggttgccgctctcttttgtctcttatcacgacaacgttaggaaaaagttggacgcgttgggttttatttttactggggacattagatgcgggaagtcaattctggctctttatgtgggctccgctaaatggtgaagggataaatattgcgatgggatattttctttttccgctgattatggctgttttaggatgggcttggttaaaagaacgtttatcatttattcagaaaatcgcgcttttactggctgcctgcggtgttgcacatgaattatggcacactcaaagtttttcatggacaagtttgtgggtttgtacggtttatccattttattatctaagccgtaaattgatgaaaatccctgctctacaaggaattacattggatattattttaatttcgattccttgttttatttatattctttctcaaagcgatacgctttctttggttacgcaagaatatcgttattggttattgctaccagcacttggtattgtgagtgcgatttcgctttcagccaacttaaaatccagccaacaaattccagttagtatttttgcggtgttgagttatattgaacccatactgctttttttaatagctgtctttgtgctggataatcaaataaccacaagcgactattttacttatgtgcctatttggttaagtctcattgtgattggcatagaagggcttttaaacaaaaataaagtgcggtaa

SEQ ID NO: 1058 - DNA, 507 bp, H. influenzae strain 86-028NP
gtgataatatttttctcgatagttacatttttgagaaattatcttatgcaaacactggataaattagatcgtcatattttgaatgtattacaacaagatgccatgattccgttaaaagaactgtcagagaaagtgaatagttccgttgcaacctgtcaacgacgtgtgcaatcattaactgattcaggcgttattacaaaacgagttgcagttgtttccccaaaagccgttgggcgtacgattagcgtatttgtcatggtcgaaatggataatcaacattcttattatcaagagcaatttgaacggaaaatgcgtcaagaagacgaagtggtaagctgttacgaaatctcaggggactatgattttatgttgctactccatgcaaaagatatggaaagctatcacgcattcacacgccgagtattgacgggtgaatttcatgtaagaacttataaaagtttatttgtaatgaattttaccaaagcagatagtggaattatcttatag

SEQ ID NO: 1059 - DNA, 1203 bp, H. influenzae strain 86-028NP
gtgaattttttgctatgtatttttaaaggggtttatgtgataaaactgatccaacgtttttttaaattagaatctgctggcggtatattattgcttttttcagctgttgttgcgatgttgctggctaattcgccgttaagcaaccaatataatgattttttaaatttgcctgtaagtttacaaattggtagtttctcaattaataaaaccttaattcactggattaacgatggttttatggcggtgttttttgtattagtgggaatggaagtcaaaaaagaattatttgaaggcgcgctttctacctatcagcaagctattttccctgctattgcagctattggcggaatggttataccggctgtagtttattggtttatcgctaaacaagatccaagtttagctaatggctgggcaattccaatggcaacagacattgcttttgcactgggaattatggcgttattgagtaaacaagtgccacttccactgaaaatatttttacttgcccttgctattattgatgacctcggtgcgatagttgttattgcattatttttctcgcacggattgagtgtacaagcactaattttttctgccgtggcaattattgtgctgatattactaaatcgtttcaaagtttccgcactttgcgcttatatggtcgtaggtgcaattttatgggcttccgtattaaagtctggtgtgcatgctactttagcaggcgttattattggttttagcattccattgaaaggtaaaaaaggagaacgcccattagatgatttcgagcatattttatcctcttggtcatctttcgttattttaccacttttcgcatttgccaatgctggtgtgagttttgctggcatagatgtgaatatgatttcgtcgccattattattggctatagcaagcggtttaattattggtaaaccagtcggtatatttggatttagttatctttctgttaaattgggattagctaaattaccagatggaattaattttaaacaaatttttgctgttgcggttttatgtggaatcggttttacgatgtcaatgttcttagcaagccttgcgtttgatgctaatgcgggggaaagtgtcaatactctttctcgtttaggtattctacttggatcaactgtttcggcaatacttggttatttattcttaaaacagacgacaaaactaagttaa

SEQ ID NO: 1060 - DNA, 1311 bp, H. influenzae strain 86-028NP
atgttttcacgcaaagatattattattttaggaatgatgatcttcgccttatttttaggtgcgggtaatatcatttttccgcctatggaaggattttcctcaggacaacattggacgagtgcttccttaggctttgttttaactggcgttttaatgccatttattacgcttgttgtggtagcgattttaggtcgtggcgaagaacttactaaagatttaccaaaatgggctggcacaggtttcctcgttatactttatttaaccattggctctacctttgcaatgccccgcatcactaatgttgcttatgaaatggcgtggttgcctttaggcttaacagaaaataatgcgaatgttcgttttgtattctcactaatttttaacttaatcgcgatgggctttatgattagcccaaatacgatcatttcaagcgtgggtaaatttatgacaccagctttattagtgttacttattgctgtggcaattaccgtatttatttcgcctttatctgaaattcaagcaccaagtaatgcttatgaaaatagccattctttattaatcggcttaaccagtggttatcaaaccatggatgtacttgcagccatcgctttcggtggaattgtcgcccgagcattatcagcgaaaaatgtgacaaaaaccaaagatattgtgaaatacaccatttcagccggatttgtttctgtcattttactcgccagtttatatttttcgcttttctatctaggtgcaactagtgctgcagttgcagaaggggcaacgaatggtggacaaattttctctcgttatgtaaatgtcttattcggttcagctgggacttggattatggcgggtattattgtattagcgagcttaacaacacttgttggtgtaactagcgcatctgctgattatttttcaaaattctctgtgcgtttttcttatccattctgggccgcactttttaccgcaatgacaatcactgtttcacaatatggtttaacggatctacttcgcataacgatcccagctttgttattaatttacccagtagctattgtgcttgttttattgcaattcttacgaaaaaaacttccatcaataaaatttacatacaatagtacattgctcgttacggtttgttttagtttatgtgacagcttaaataacgttaaaatgttaccagaaagcatcaattcattattgaaacacttccctctttcatctgaaggaatggcttggttggttccgactttagtaatgttagttgcaagcatttttattggaaaagcattgcataaaacccattcttaa

SEQ ID NO: 1061 - DNA, 468 bp, H. influenzae strain 86-028NP
atgattattagcagtttaaccaacccaaattttaaagttggtttgccaaaagtgattgctgaagtatgtgattatttaaatacgttagatttgaatgcgttagagaatggtcgccatgatattaacgatcaaatttatatgaacgtaatggaaccagaaactgcagaaccaagcagtaaaaaagcagaattacatcatgaatacttagatgtacaagtgcttattcgtggcacggaaaatatcgaagtgggcgcaacctatccgaatttatctaagtatgaagattacaacgaagcggatgattatcaactttgtgcagatattgatgataaattcaccgtcacaatgaaaccaaaaatgttcgctgtattctatccttatgaaccgcacaagccttgctgtgtagtgaatggaaaaacagaaaaaattaaaaaattagtcgtaaaagtacctgttaaattaatttaa

SEQ ID NO: 1062 - DNA, 447 bp, H. influenzae strain 86-028NP
atgaaatataatgtaatgatggctagtgatgctaattatcttccttatgtagaaatcacactgaaatctttattaatgcacaatgaaaatctctctgtttttattttacatacaggagatatttctgaatcgtggcaaaatgatcttcaactttattttgctaaacgctattcaacattacaattagttcatatgatttcaattaatactcttgatatttctcttgttatttttcattttacaggtcctcataagcctcttgataatattttttctgaaaatgcttgtgttaatgccgtaatttcattgtttagactttatgcgtcaataagttggcaaatatttgctctctttcactcggtactacaagagctaattggattaatcaagagagatgatgtaatcggtggctttatttcatttaaccgacttggtatcatagtgtaa

SEQ ID NO: 1063 - DNA, 2130 bp, H. influenzae strain 86-028NP
gtgaatccaattgttaaacaatttaaatacggtcagcataccgttactctagaaactggcgcgattgcacgtcaagcaacggctgcggttatggcaagcatggacgataccacggtattcgtgactgttgttgctaaaaaagatgtgaaagaaggtcaagacttcttcccattaaccgtaaactaccaagagcgtacttatgcagcgggtaaaatcccaggtggtttcttcaagcgtgaaggtcgtccatctgaaggcgaaactttaattgcacgtttaattgaccgtccaattcgtccattattcccagaaggtttcttcaatgaaatccaagttgtggcaactgtggtttctgtaaacccacaaatcagccctgacttagtggcaatgatcggtgcttctgcagcattaaccttatctggcgtgcctttcaatggtcctatcggtgcagcgcgtgttggttttatcgacaaccaattcgtattaaacccaactatggctgaacaaaaacaaagccgtttggacttagtggttgcaggtactgacaaagccgtattaatggttgaatctgaagctgatattttaactgaagaacaaatgttagcggcagtcgtattcggtcatcaacaacaacaagttgtgattgaagcagtcaaagaatttgcaaaagaagcgggcaaaccacgttgggattgggttgctccacaaccaaacacagatttaatcaacaaagtaaaagcgattgctgaagcacgtttaggcgatgcataccgcattactgaaaaacaagctcgttacgaacagatcgatgcgattaaagcggatgtaattgcgcaaatcacagctgaagatgaagaaatcagcgaaagtaaaatcgtggatatttttaccgcacttgaaagccaaatcgtgcgtggtcgtatcattgcaggcgaaccacgtattgatggtcgtaccgttgatactgttcgtgcattagatatttgcactggtgtattaccacgtactcacggttctgcgatttttactcgtggcgaaacgcaagcattagctgttgcaaccttaggtaccgaacgtgatgcacaaatcattgatgaattaacgggtgaacgtcaagatcacttcttattccattataatttccctccatattctgtaggcgaaacaggtatgatcggctcgccaaaacgtcgtgagatcggtcacggtcgtttagcaaaacgtggtgtagcggctgttatgccaagccttgcagaattcccgtatgttgtgcgtgtagtatctgaaatcactgaatctaacggttcttcttctatggcatctgtatgtggtgcgtctttagcattaatggatgcaggcgttccaatcaaagctgctgttgcaggtatcgcaatgggtttagtgaaagaagaagagaaattcgtggtgctttcagatatcttaggtgatgaagaccatttaggcgatatggactttaaagtagctggtacacgcgaaggtgtaaccgcccttcaaatggatatcaaaattgaaggtatcacccctgaaattatgcaaattgcattaaaccaagcgaaaagtgcacgtatgcacattcttggtgtcatggaacaagcaatcccagctccacgtgcggatatttcagattacgcaccgcgcatctatacaatgaaaatcgatcctaagaaaatcaaagatgtgattggtaaaggtggtgcaacaatccgttcactaactgaagaaactggtacatcaattgatattgatgacgatggtacagtgaaaattgctgcagtagatagcaatgcagcgaaaaacgtaatgggacgtattgaggaaatcgttgcagaagttgaagctggcgcaatttacaaaggtaaagtcactcgtcttgctgattttggtgcattcgtcgcaatcgttggaaataaagaaggtttggttcatatttctcaaattgctgaagagcgtgtagaaaaagttagcgattaccttcaagtgggtcaagaagtaaacgtaaaagttgttgaaatcgatcgtcaaggtcgtattcgtttaacaatgaaagacttggctccaaaacaagaaactgaaattaaccaagaagatcctgtcgaagaacaggaataa

SEQ ID NO: 1064 - DNA, 945 bp, H. influenzae strain 86-028NP
atgcggtgttttcgcttatctcgccattttatagtctatttatttagcttatgtgcgatcttactccttgctggctgtgttcagtctaggggcggttttgtgtctaaaaatcatgtcgtgttggctgaacaaaacccgaatactcactttgaacaagaagtgatgatcgtgcgattaagccaagtactactggttggaaaaatgagtaatgaagaacgtgcatcgctacattttgaacgtggcgtactctatgattctcttggattatggggacttgctcgttatgatcttactcaagcccttgcattacagccgaaaatggcatctgtgtacaattacttagggctttatttattgcttgaagaagattatgacggcgcattggatgctttcaatacggtgtttgaattagattcaggttatgactatacccaccttaatcgtggtttaaatttttattatgtagggcactaccatcttgctcagcaagatttcttacagttctaccaagccgataaaaaagatccctatcgtgtcttatggctatatttgaacgaacaaaaattaaaaccacaagaagcccaaacaaaccttgttgaacgagcaaaagggctatcagaggacttctggggtacacacatcgttcaatattacttaggacacatctctgtagaagaattacaacaacgtgcaagtgaatttgccgaaaattcacaacaatatgctgaaattctcacagaaacctatttttatctagcaaaacaaaaactcaatgtagggctagtagatgaagcagcagctttatttaaactagccatggcaaatcaggtttataactttgttgagtatcgttttgccgcgtttgaactcatgaaattaaaaccggttcaaacagaagacgaaaaagaagagaaaagtgcggtaacaaaagcgattgttttctaa

SEQ ID NO: 1065 - DNA, 1842 bp, H. influenzae strain 86-028NP
atgactgacaaaattacttttaatgacttaggcttacctgagttcatcttaaaagctgtttctgacttaggttttgaaaccccttctccaattcaacaagcttgtatcccacatttgctcaatggcaatgatgtgctaggtatggcacaaacgggtagtggtaaaaccgctgcttttgcactgcctttattagcgcaaatcgatccaagtgaaaaacatccacaaatgttagtgatggcgcctacacgcgaacttgctattcaagttgccgatgcgtgtgaacaatttgttaaatatgcacacggcactcgcattgttaccttatatggtggccaacgttatgacatccaacttcgtgcattaaaacaaggcgcacaagtggttgtgggtacaccaggccgtattcttgaccatattcgtcgcagaacattaaatctttctgaacttcgttttatcgtattagatgaagccgatgaaatgctacgcatgggtttcattgatgatgtagaaaccgtcatggcagaattaccagaaaatcatcaaactgcgttattctctgcaacaatgcctgaaccgatccgtcgtattacgaaacgttttatgaatgatccacaagaagtgaagatcaaagtgaataacgaaaatgccccagatatcgaccaaagttgttggtatgtacacggcgtgcgtaaaaacgaagctcttcttcgtttcttagaagtggaagattttgatgcagcgattatttttgctcgcactaaaactggtactttagacattacagaactacttgaaaaaaatggtttccgttctgccgcacttaatggcgatatgacacaacaattacgcgaacaaaccctcgatcgcttacgtaacggcagtttagatattgttgtggcaaccgatgtggctgcacgcggtattgatattgaacgtatcagccttgtggtgaactacgacattccgcttgatgcagaatcttatgtacaccgaattgggcgtactggtcgtgctggtcgttctggtcgtgctttattatttgttgaacctcgcgagcgtcgtttacttcgtaatattgaacacctaatgaaaaaaggtatcaatgaagtagaattgccaaatcatcttgtgttacaagaatgccgccgcaaaaaatttgtcgccaaaattacgaaacaactcgagcatcacgatttagaacaatatcgtagtttattagaagacttattcacagccgatcaggatcaagaagatattgctgcagcaatgttgatgctgcttcaaggcaaacaaaaattaattcttccacctgatccgccaatggaaaaacgtcgtcgtgaacgtaatgatcgcggtgatcgccgtgaaaatccacgttcagctgaacgtcgtggcgaacgtaaaggctatggaaatccacaaccaatggatttatatcgtatcgaagtcggtcgtgcagatggtgtagaagttcgccatatcgttggtgcgattgctaacgaaggcgatattaacagccgttatattggtcatattaaactttatgatgactacactaccgttgaattgccacaaggtatgccgaaagaattattgcaacaattcgctaaaacacgcgtattgaataaacaaatgcaaatgtctttcttaggtgcagtaaaatccgataattcccgtggcagcgatgattttaacggtaaacgtaaaggtcgtggtggcgatttccgtggagagcgcggacgtgaacgaggcaatgataatcgtggcaatcgtaaatttaatgaaaaaagtaaccgcacttttagcgacaaaccacgccgtgatcgtagatcatcattctaa

SEQ ID NO: 1066 - DNA, 1389 bp, H. influenzae strain 86-028NP
atggtgttcccatggcaatttttacgtcatactgaagaaaatcattatactgcaattcaagctaggggatcactttatgtaggaacaataaataaccagatttcttattttattaataaagatagcgaacgaggctttgaatatgaattagccaaagcatttgctgatactttaggcgtagaactcgaaatgaaaattttcgataatcaagagcagttatttgatgaacttgataaacacaatattgatttagctgccgcccaccttttataccatcctaaaaatgcagaacgtttccaaataggtcctgcatatcattctgcttcatggcaattagcttatcgaaaaaatgaaaatcgtcctaaaaatttaggtaacgtaaagaaagatatttatatctcaaataatttagcattagaagaaacgctaaaagaattacaaaaacaatatccacaattaacttggaaaagaaatcaagcacttactcaagaagaactattactacaactggctgaaggcaaaattccttacgttattgcaaattctattgatattgctgcaattcaacaaatcaaaccagaattagccattgcctttgatattactgatgaagcaaacgttcactggtatttacccaatagcccctaccgcgatctacaaacggctttactcaattttatgaataatgccgaagaaacgggacttttagataatttaaaagaaaaatatttaggacatatttcacaatttgattacgtggatacgcgctcttatatgaacgcaattgaaaataccctgccacaattctcaccgctctttgaaaaatacaaaggtgaattagattggcgactactcgcagcagtggcttatcaagaatctcattggaatcctgacgcaacatcgccaactggagtacgtggcataatgatgctcaccaaaaataccgcacaacatatgaaaatcagtgatagaacagatcctgaacaaagtattaaagctggttcagaatatttacactggttgattagtcagcttcctgaaagcattgaaaaggaagaaagaatttggtttgccttagttgcctataacataggactcggtcacttaattgatgcacgccgtttaactcaaaatcttggaggaaatccagataattggctcaatgtgaaaaaaaatctgcctttattagcagaaaaacgctattattcccaactgaaatacggctatgcaagaggctatgaagcctatcaatatgtagaaaatattcgccgctatatgaatagcatcgtaaattatcatcgagtccaagaaaatcaaacaacgaatgataatgccaacaacgaaagtgcggttaaaaatttagaagaaataaaagaaaataaggattaa

SEQ ID NO: 1067 - DNA, 153 bp, H. influenzae strain 86-028NP
atgttaaaacgtaaaacttttcttaaaaagaaagctaatttacaacaaagttctttatcacgtaatctacgtttaagacgtttaaaacaccgcaaacaacaacaattttcgagacattcattacaatttgtcgtacaagaaatttgttgctaa

SEQ ID NO: 1068 - DNA, 297 bp, H. influenzae strain 86-028NP
atgtcaaaacagcctcaaattctacttaataatacgtggaatgtgcgtattagtgatcccggagaggagggggccaaaagccatttctttgaaacgatttatttaactctaacagcttattttgaagaaaataacatacgctatgaatttgtgcgtaaagtggaggatcaaataaaaattcagcgttcttttacagagttaaatgaattgttcaaatttttaggggattattttgatcccgtctcgattggtctagtcggtgtgaaaattggaaacttagggataaaattagaataa

SEQ ID NO: 1069 - DNA, 210 bp, H. influenzae strain 86-028NP
atgagaaagaaacaaaaaagtgcggttgaaaatgaaaccgtttatttgcacactcgaggcgtgataaaagataatgcagtgatggcattgctaggcgataaattatttcgtcagcgtgttgagaaaaaacgtaaagggaaaggcagttaccaacgtaaggcgaaacacccagggaaaatatttgaaaagcccgattataaatttttttga

SEQ ID NO: 1070 - DNA, 351 bp, H. influenzae strain 86-028NP
atgtctgttattatttatcacaacccacattgctcaaaaagccgtgaaacgctagcattattagaaaataaaggtattcagccgattattgaactgtatttgcaaaagcagtattccgttaatgaattacaaagcattgccaaaaaattaggaattgatgatgttcgccaaatgatgcgcacgaaagatgaactatataaaagcttaaatttagataatttagatctttctcaagcagaattatttaaagcgatgagtgaacattcagcacttattgaacgcccaattgttattaatggcgataaagctaaaatcgggcgtccgccagaaactgtacttgagattttgtaa

SEQ ID NO: 1071 - DNA, 1050 bp, H. influenzae strain 86-028NP
atgctagaaatgttaaaaagctggtactctcgccgtttaagtgatcctcaagcgatgggactattagcaatattattatttggctttatctccatttatttttttggagatttaattgcgcctttgttgattgctctagtactatcctatttacttgaaatgccaatcaattttttaaatcaatatttaaaatgcccaagaatgttagcgacaattcttattttcggtagttttattggtctagcagcagttttctttttggtattggtgccaatgttgtggaatcaaactatttccttattaagtgatttgcccgctatgtttaataaatctaatgaatggctactcaatttacccaaaaattatcctgaacttattgattattcaatggttgattctattttcaattctgtgcgagaaaaaatccttggttttggcgaatctgctgtaaaactttctttagcctctattatgaacttggtttctttagggatttatgcctttttagtgccattaatgatgttttttatgttgaaagataaatcagaacttttacaaggggtaagtcgattcttaccaaaaaatagaaatctcgcatttaaagtatggaaagaaatgcaacagcaaatttctaattacattcacggaaaattattagaaatactgattgtcactttaatcacttatattattttcttaattttcgggctaaattatccactcttattggcttttgcggtgggtctttcagttctcgtcccctatattggcgcagttattgtcacgattcctgttgcattggttgctttattccagtttggaatcagcccaacattttggtacatcattattgcttttgctgtaagccaacttttagatggaaatctccttgtgccttatttattttctgaagccgtcaatttacatccactaattattatcatttcagtattaatttttggcggtttatggggattttggggtgtattctttgccattcctttagccactttagtaaaggccgtaataaatgccttacctcaagattaa

SEQ ID NO: 1072 - DNA, 978 bp, H. influenzae strain 86-028NP
atgatgaaactttttacaaaagataaagacggacattttatccgtgaaatcaatgggataaagctcccgttcccattgactgaatttatgaaagtgcgtaaatggggttatatattatccgcacttttaatggtaatttctctattttttattattaccaaaggatttaactggggcttagattttactggtggagtggtatttgatactcacttctcgcagtccgctaaccttgaacaaattcgtagtaaacttcacgaaaatggaattgaaagtccagttgttcaaaccacaggatcggttcaggatgtgatgattcgtttacctgcaagtaataatgattctaccattggtgaacacgtcaaaagtatgctacagaatgtagataaagacattcaaattcgcagtattgagttcgttggcccaaatgttggtgaagaattagcacaaggtgcggtatatgcgactttagcgacattagcaatggtgcttatttatgtggggtcacgttttgaatggcgtttaggctttggcagtatcgcttctcttgcgcacgacgtaattattacgctaggggtattctctgcattacaaattgaaattgatcttacttttgtcgcagcgattttatctgtggtgggttactccatcaacgatagtattgtggtatttgaccgagttcgtgaaaatttccgaaaaattagacgattggatacgattgatattattgatatttctttaacgcaaactttatcaagaactatcattacttcggttactacattagttgtcgtgatggcattgttcttctttggtggtccttccattcataacttttcacttgctttactcgtaggtattggatttggtacttattcctcgatttttgttgccatcgccattgcatacgatgttggtttacgtcgtgaacatatgatcccacctaaagtagataaagaaattgatgaattaccttag

SEQ ID NO: 1073 - DNA, 1851 bp, H. influenzae strain 86-028NP; identical to SEQ ID NO: 720

SEQ ID NO: 1074 - DNA, 294 bp, H. influenzae strain 86-028NP
atggaagcacaaagtccaatgtccacgctatttattttcgtgatctttggtttaattttctactttatgatttatcgcccgcaagctaaacgcaataaagaacacaaaaaattgatgtctgagcttgcaaaaggtactgaagttttaactgctggtggtttaataggcaaaattactaaagtaaccgaaggtagtgatagcatcgtgattgcgttaaacgacacgacagaaattacgattaatcgtaactacattgtgagcgttcttcctaaaggttcattaaaatcactttaa

SEQ ID NO: 1075 - DNA, 222 bp, H. influenzae strain 86-028NP
atgaaatatcagctcaatttaaccgcacttcgatgccccattcctcttttaagtgccaaaaaagccttaaaaaatttgaataaaaatgatgagctaatgttgatcttaaaccttgaaagtgcggtggaaaatttttctatttttgccgaagaaaattctgttgctttagtcgagcaatattacgcttcggaaaaagaatttatcgttatcttgaaaaaataa

SEQ ID NO: 1076 - DNA, 519 bp, H. influenzae strain 86-028NP
atgcaaattcttgaacctcaacaattcgccacatggaatgaacctattgaaatgctttatgcttgtcatagtaaagtaaaacgtttttgtcgtcagttaagcattttgcctgattatctagaaaaacacggctatactcaggctgtgttaaatgatgttgagcaaattttaacttatttcaatcgtgccgcaccgttacatcacgatgatgaagaatcagattttttccctcaattagtcaaagtggctccgcaagcacaaacttccattgatgaattagaaaaacagcacgaatatttgcatgaaaattggaatgcattatctgtgcagttagaagagcttatttctgaacaacgtcaaaatattgatgaatatttaattgaacgctttattcaaggttatgatcgtcatattgcgttagaagagccgttatttgaaatggggcgtgaatgcttaagtgcggatattttgactgaaatgggcaagcgcatgagtgctcgtcgtcaagttaaagaatga

SEQ ID NO: 1077 - DNA, 1149 bp, H. influenzae strain 86-028NP
atgaagtatgaattagataaaacaagcggcaatgctcgtcgtggtcgcttggtgtttgaacgtccacaaggcacgttcagtgtagaaacccctgcgtttatgccagtgggtacttatggcacggtaaaaggcatgacaccagaagaagtgcgtgcgacaggtgcagaaattttactgggtaacaccttccatttatggcttcgtccaggtcaagaaattatgcgtaaacacggtgatttgcacgattttatgcaatggcatcgtccgattttgactgacagtggcggtttccaagtattcagtttaggtaaattacgtaaaattaccgaagaaggcgtaaaattccaaaacccaattaacggtgagcgaatcttcctttcgcctgaaaaatccatggaaattcaatatgatttgggttctgatatcgtcatgatttttgatgaatgtacgccttacccagcgactttcgattatgcgaaaaaatctatggaaatgtcacttcgttgggcaaaacgcagccacgatcgctttgatgaattaggcaataaaaatgccctatttggtattatccaaggcggtgtatttgaagaattacgtaaagtctcattagaaggcttagtcaatattggttttgacggttatgcggtgggcggtttagcggtaggcgaaccaaaagaagatatgcaccgcattttagaatacatctgcccacaaatcccagctgacaaaccacgttatttaatgggcgtgggtaaaccagaagatttagtggaaggcgtgcgtcgtggcattgatatgtttgactgcgtaatgccaacccgtaacgcacgtaatggccatttatttgtgacagacggcattgtcaaaatccgtaatgcaaaatatcgtgatgataccagcccgttagatcctgaatgtgattgctacacctgtaaaaactacaccaaagcgtatttatatcatttagataaatgcggtgaaattttaggtgcacgcttaaataccattcacaatttacgctattatcaacgtttaatggcggaaattcgtcaagcgattgaagatgatcgttttgatgattttgtggtggaattctatgctcgcatgggcaaacctgttccaccattacaattagcggataactcataa

SEQ ID NO: 1078 - DNA, 1092 bp, H. influenzae strain 86-028NP
atgcgtgtttcagactttaactttgatttacccgatgaattaattgctcgttatcctaaaactgatcgtgtttcttgtcgtttattacagttaaatggtgaaaacggagaaatttttcaccgcactttttctgatgtattagatttaattgatcaaggcgatttattgatttttaataatacgcacgttattcctgcaagaatgtttgggcgtaaagccagtggtggaaaaattgaagttttagttgagagaatgttagatgaacatcgtttcttagcgcatattcgttcatcgaaatcccctaaagaaggggctgaattatttttaggggaagataaattaggcgaaaataatggcattaaagcagtaatgaaagctcgtcatagctcgttgtttgaagtggaattaagtgataaatcaaccgctcttttagatgtgttgcaaaccattgggcatatgccattaccgccttatatcgatcgtccagatgaagaagccgataaagaatgttatcaaacggtttatagtaaagtaccaggtgcggtagcagcaccaacggctggtttgcattttgataaaaatttacttgaaaaactcaaagcaaagggtgtgaattttgaatttgttacattacatgtaggcgcaggaacattccagcctgttcgtgtggaaaatattgaagatcatgtgatgcatgcagaatacgtagaagtttctcaagaagtttgcaatgcgattatcgcaacaaagaaagcgggcaaacgtgtaattgcagtgggaactacttctgttcgttctattgaaagtgcggcactttctgcggaagaatttggcaatccagatttaattgagccttatttttctgatacctctatttttatttatccagggaaaaaattccgagtggtggattgcttaattactaatttccacttacctgaaagcactttgattatgttagtttcagcttttgctggttataaaaataccatgaatgcgtataagcatgcagtgcaagaaaaatatcgtttctttagttatggcgatgcgatgtttattaataaaaattctaatgtgagagagttggaataa

SEQ ID NO: 1079 - DNA, 447 bp, H. influenzae strain 86-028NP
atgaatttaactaaaattttacccacatttgctgctgtagtcgtattatctgcttgtgcaaaggatgcacctgaaatgacaaaatcatctgcgcaaatagctgaaatgcaaacacttccaacaataactgataaaacagttgtatattcctgcaataaacaaacggtgactgctgtgtatcaatttgaaaaccaagaaccagttgccgcaatggtaagtgtgggcgatggcattattgcgaaagattttactcgtgataaatcacaaaatgactttacaagtttcgtttctggggattatgtttggaatgtagatagtggcttaacgttagataaatttgattctgttgtgcctgtaaatttaattcaaaaaggtaaatctagcgataacatcatcgttaaaaattgtgatgtaaacgtaaaagcaactaaaaaagcaaatttataa

SEQ ID NO: 1080 - DNA, 4179 bp, H. influenzae strain 86-028NP
atgaaaaaaactgtatttcgtctgaattttttaaccgcttgcatttcattagggatagtatcgcaagcgtgggcaggtcacacttattttgggattgactaccaatattatcgtgattttgctgagaataaagggaagtttgcagtcggtgcgaaagatattgaggtttacaacaaaaaaggggagttggtcggcaaatcaatgacaaaagctccgatgattgattttgcatctgttgctcgtagtggttatgctgcattagtaggcgatcaatatattgtaagtgttgctcacaatgggggatacactaatgctgattttggtgcggaaggacaaaatcccgatcaacatcgttttacttatcaaatagttaaacgtaataattataaacctgatcagaagcatcattataatggggattaccatatgcctcgtttacataaatttgtaactgaaagttctccttttgatatgacaggaagtatgaagggacagacctatgcagacaaagaaaaatacccgatgcgtgtgcggattggttctggtgatcaatattggagaaatgaacaagataaaggaactcaagtagctgaagcttatggatatcttattgcggggaatacccatatgcaaactggtgcaggaaatggagatgttagtttaagtggcgatgtacgtaaaggaaatgattatggacctatgccgacagcaggatcatttggagacagtgggtcacctatgtttatttatgatgctaccgagaaaaaatggcttataaatggtgtattgcgtactggaaacccatccttaggtagagagaatacttttcagctagtccgtaaaaattattttgatgaaattttctctgctaatcttaaaacgaccatatttgatttcagaactcctaaaaatcaacaaaatcagcactacacatttcattcaaaaaatgatgggtcaggcactattacatctggagctggtaaaatttataaagtcaaacttgctaattacaatttatctatgaaaggcacggagcctgtctatactaatggtggtgtaaacaattattctcccgcattaagtcacggcgaaaacctttattttattgattacggaaaaggggtgctaacttttagtaataatatcgatcaaggtgcaggcggtttgtattttgagggagattttatagtttcgcctacccataatgaaacgtggaaaggggcggggatatctatcagtgatgaaagcaccgtaatttggaaagtcaatggcgtagaaaatgatcgcctttctaaaattggtaaaggaacgttacatattcaagcaaaaggtaaaaacttaggctcaattagcgttggcgatggtaaagtaatcttagaacaacaagaggacgatcaacataaaaaacaagcctttagtgaaatcggattggttagcggcagagggactgtccaattaaacgatgataaacaatttgataccgataaattttatttcggctttcgtggtggtcgcttagatcttaatgggcattcattaacctttaaacgtatccaaaatacggacgagggggcgatgattgtgaaccataatacaactgaagtcgctaatgtcactattactgggaacgaaagcattgttctacctaatggaaataatattaataaacttaattacagcaaagaaattgcctacaacggttggtttggcgaaacagatgaaaataaacacaatggacgattaaaccttatttataaaccaaccacagaagatcgtactttactactttcaggtggcacaaacttaaaaggcgatattactcaagaaggcggcactttagtgtttagtggtcgcccaacgccacacgcttacaatcatttaaatcgcccaaacgagcttgggcgacctcaaggcgaagtggttattgatgacgattggatcaaccgcacatttaaagctgaaaacttccaaattaaaggcggaagtgcggtggtttctcgcaatgtttcttcaattgagggaaattggacaatcagcaataacgccaacgccacatttggtgttgtgccaaatcaacaaaataccatttgcacgcgttcagattggacaggcttaacgacttgtaaaacagagaatttaaccgacacaaaagttattaattctataccaacaacacaaatcaatggctctattaatttaactgataatgcaacggcgaatgttaaaggtttagcaaaacttaatggcaatgtcactttaacaaatcacagccaatttacattaagcaacaatgctacccaaataggcaatatccgactttccgacaattcaactgcaacggtggataatgcaaacttgaacggtaatgtgcatttaacgaattctgctcaattttatttaaaaaacagccatctttcgcaccaaattcagggcgacaaaggcacaacagtgacgttggaaaatgcgacttggacaatgcctagcgataccacattgcagaatttaacactaaataacagtactgttacgttaaattcagcttattcagctagtccaaacaatacgccacgccgtcgtcgccgttcattagagacggaaacgacgccaacatcggcagaacatcgtttcaacacattgacagtaaatggtaaattgagcgggcaaggcacattccaatttacttcatctttatttggctataaaagcgataaattaaaattatccaatgacgctgagggcgattacatattatctgttcgcaacacaggcaaagaacccgaaacccttgagcaattaactttggttgaaagcaaagataatcaaccgttatcagacaaactcacattcacgttagaaaatgaccacgttgatgcgggtgcattacgttatgtattagtgaagaataatggcgaattccgcttgcataatccaataaaagagcaggaattgcacaatgatttagtaagagcagagcaagcagaacaaacattagaagccaaacaagttgaaccgactgctgaaacacaaacaagtaaggcaaaagtgcggttaagaagagcggtgttgcctgataccctgcctgctcaaagcctgttaaacgcattagaagccaaacaagctgaaccgaatgctaaaacacaaaaaagtaaggcaaaaacaaaaaaagcgcggtcaaaaagagcattgagagcggtgttttctgatcccccgcctgatcaaagccagttagacgtattaaaagccgcacttgaggttattaatgcccaaccgcaagtgggaaaagaacgtcaagctcaagagaaacaaggcaaacaaaaagacttgatcagccgttactcaaatagtgcgttatcggagttgtctgcaacagtaaatagtatgctttccgttcaagatgaattggatcgtctttttgtagatcaagcacaatctgctgtgtggacaaatatcgcacaggataaaagacgctatgattctgatgcgttccgtgcttatcagcagaaaacgaacttgcgtcaaattggggtgcaaaaagccttagataatggacgaattggggcggttttctcgcatagccgttcagataatacctttgacgaacaggttaaaaatcacgcgacattaacgatgatgtcgggtttcgcccaatatcaatggggcgatttacaatttggtgtaaacgtgggcgcgggaattagtgcgagtaaaatggctgaagaacaaagccgaaaaattcatcgaaaagcgataaattatggtgtgaatgcaagttatcagttccgtttagggcaattgggtattcagccttatttgggtgttaatcgatattttattgaacgtgaaaattatcaatctgaagacgtgaaagtgcaaacaccgagccttgcatttaatcgctataatgctggcattcgagttgattatacgtttaccccgacagataatatcagcgttaagccttatttcttcgttaattatgttgatgtttcaaacgctaacgtacaaaccactgtaaatagcacgatgttgcaacaatcatttgggcgttattggcaaaaagaagtgggattaaaggcagaaattttacatttccaactttccgcttttatctcaaaatctcaaggttcacaactcggcaaacagcaaaatgtgggcgtgaaattggggtatcgttggtaa

SEQ ID NO: 1081 - DNA, 2832 bp, H. influenzae strain 86-028NP
atggaaaatatcgatattcgcggggctagaacccataatctgaaaaatattaatttaactattccacgcaataaacttgtggtgattactgggctttcaggttcgggaaaatcctctttagcctttgatacactttatgcggaagggcaacgccgctatgttgaatctctttcggcgtatgcgcgtcaatttttgtctttaatggaaaagcctgatgtggattctattgaagggctttcccctgcaatttccattgaacaaaaatctacctcacacaatccacgttctacagtgggaacaattacggaaatttacgattatttacgtttattgtttgcacgagtaggggagccgcgttgtcccgatcataatgttccattaacggcacaaacaattagtcaaatggtggataaagtattaagtttgccagaagacagtaagatgatgttacttgcgccagttgtcaaaaatcgaaaaggcgaacatctcaagattttagaaaatattgctgcgcaaggttatattcgtgcgcgtattgatggcgaaatttgcgatttatctgatccgccaaaattagacttacagaaaaaacatactattgaagtagtggttgatcgttttaaagtgcggtcagatttagcaacacgtttagccgaatcttttgaaaccgcattagagctttcaggtggcactgcgattgtggcagatatggataatccgaaagcggaagaattaattttttcagcaaattttgcctgtccgcattgtggttattctgtgccagaattagagcctcgtttattttcctttaacaatcctgcaggtgcttgcccaacttgtgatggcttgggtgtgcagcaatattttgatgaagatcgtgtggtgcaaaatccgactatttctcttgctggtggtgcggtaaaaggttgggatcgtcgtaatttctattattatcaaatgctcacctcattggcgaaacattatcattttgatgttgaagcgccctatgaatctttgccaaagaagattcaacatatcattatgcatggctcaggcaaagaggaaattgaattccaatatatgaatgatcgtggcgatgtggttattcgcaagcatccttttgaaggtattttgaataatatggctcgccgatataaagaaacggaatcaatgtcggtgcgtgaagaattagcgaaaaatattagtaatcgaccttgtatagactgtggcggatctcgtttgcgacccgaagcacgtaatgtgtatattggaaaaaccaatttgccgataattgcggaaaaaagcattggcgaaacccttgaattttttaccgcactttctctcactggtcaaaaagcacaaattgcggaaaaaattcttaaagaaatccgcgagcgtttgcagtttttagtcaatgttggtttgaattatctttctctttctcgttctgctgaaactctttcaggtggggaggcgcaacgtattcgccttgcgagtcaaattggtgcgggacttgttggcgtaatgtatgtattagatgaaccctctattggcttgcaccaacgtgataatgaacgcttacttaatacgttaattcatttgcgtaatcttggtaatacggtaattgtcgtggagcacgatgaagacgcgattcgtgcagctgaccatattattgatattgggcctggtgctggcgtgcatggcggacaagttattgcacaaggaaatgccgatgaaattatgctcaatccaaattccatcacgggaaaatttttatcgggcgcagataaaatcgaaatcccgaaaaaacgcaccgcacttgataagaaaaaatggctcaaacttaaaggtgcatcaggtaataacttaagaaatgtgaatttagatattcccgttggtttgtttacttgcgtaactggtgtatctggttcgggaaaatccacacttattaatgacaccttatttccacttgcgcaaaatgcgttaaatagagcggaaaagacggattacgcaccttatcaatctatcgagggattagagcatttcgataaagttattgatattaaccaaagcccaattggacgtacgccacgttcaaatccagccacttatacaggtttatttactccgattcgtgaactttttgcaggggtgccagaggcacgtgctcgtggttataatccaggacgttttagttttaacgtacgaggtggacgctgtgaagcctgtcagggcgacggtgtactcaaagttgaaatgcattttttacccgatgtttatgttccttgcgaccaatgtaaaggcaaacgctataatcgcgaaaccttagaaattcgttacaaaggcaaaacgattcatcaagttttagatatgacggtggaagaagctcgcgagttttttgatgcgattccaatgattgcaagaaaattacaaaccttgatggatgtgggattatcctatattcgattaggtcaatcttccacaacactttcaggcggcgaagcacaacgcgtgaaactagcaacggaactttctaaacgtgatacgggtaaaactttgtatattctagatgaaccgacgactggtttgcatttcgctgacattaagcaattacttgaagtattgcatcgattacgcgatcaaggaaatactatcgtcgtcattgaacacaatcttgatgtgattaaaaccgcagactggattgtcgatcttggcccagagggaggcagtggcggcggacaaattattgcgacgggtacaccagagcaagttgccaaagtagaaagttcccacaccgctcgcttccttaaaccgattttagaaaaaccttag

SEQ ID NO: 1082 - DNA, 507 bp, H. influenzae strain 86-028NP
atggctggaattaataaagtcattattgtaggtcatttaggtaatgatcctgaaattcgtactatgccaaacggcgatgccgttgcaaatatcagcgtagcaaccagtgaaagctggaacgaccgtaatactggcgaacgccgtgaagtaacagaatggcaccgcattgtattctatcgtcgtcaagcagagatttgcggcgaatatttacgtaaaggttctcaagtatatgtggagggtcgtttaaaaacgcgtaaatggcaagatcaaaacggtcaagatcgttacgccacagaaattcaaggcgatgtaatgcaaatgcttggtggacgtaatcaaaacgcaagtggttctggtaatgatatgggcggtacgccacaatcttcttaccaagctcgtcaaactaacaatggtaatagttatcaatcatctcgcccagctccacaacaatctgcaccacaggctgaaccaccaatggatggatttgatgacgatattccgttctaa

SEQ ID NO: 1083 - DNA, 795 bp, H. influenzae strain 86-028NP
atgcagcaaacaaaacgttcgctattgggtttgcttatttctttgatcgcacacggtattattataggatttatcttatggaattggaatgagccaagtgatagtgcaaatagcgcacaaggcgatatatctacaagtatttctatggaactattacagggcatggtgttggaagaacctgctccagagccagaagatgtacaaaaagagccagagcctgagccagaaaatgtacaaaaagagccagaaccagaaaaacaagaaattgtagaagatccaacaataaaacctgaaccgaaaaaaatcaaagaaccagaaaaggaaaagccaaaaccaaaagaaaagccgaagaataaacctaaaaaagaggttaaaccacaaaagaaaccaatcaataaagagctaccaaaaggcgatgaaaatattgattcaagtgccaacgtaaatgataaagcaagtacaacaagtgcagctaatagcaatgcacaggtagcaggaagtggaacggatacgagtgaaatagcggcttaccgttctgcaatccgccgtgaaattgaaagccataaacgttatccaactcgagcgaagataatgcgcaaacaaggaaaagtgagtgtatcttttaatgtaggagctgatggttcattaagtggtgctaaggttacaaaatcctcaggcgatgaaagtttagataaggcggcattagacgctattaacgtatctcgctctgttggaacaagacccgcaggattcccttcgagtttaagtgtgcaaattagttttactcttcaataa

SEQ ID NO: 1084 - DNA, 444 bp, H. influenzae strain 86-028NP
gtgaaaaaattcgatgaaatcaacattatccctttcattgatattatgttggtgctacttactgtggtgcttattactgcatcttttatctctcaaggtaaaattcaagtaaatgtaccaaaagctagtacagcggtcgcatttaaatctgacgagctagctaaattattgacagtgacagcggataaacaactctattttaatgataaacctatttctcaagaagctctagaggcagaaattgctcaatggaataaagatcagaaagtaactttaaaaattgatgccgaagcctctttccaagattttgtgacgattacagatatgctttctaaaaatgaaatcaaaaatgtggcaattgtttctatgaaagataagggaaaaagtgcgggtgaaaattctcaagaatctactccttcccaatctgtaccaactacgccgtaa

SEQ ID NO: 1085 - DNA, 453 bp, H. influenzae strain 86-028NP
atggtacaactttttgattttttacaacagtacagtgattattttatcatcggtttattattactgatgagcattattatgcttgcgatggtaattgaacgttatctttttttaagaaaggtaagcgtggcacattattctactattcatgcattagatattgatttaaaccgtaatatgacagtgatttctaccatcggtgcaaatgcgccttatgttggattacttggtacagttatcgggattttattaactttctatcaaatcggtcacggcggtggcgacattgatccaagtgtaattatgttgcacttatctttagcattaaaagcaactgcattaggtattctagtggctattccctctatggtgttttataacggtttggggcgtaaagttgaagttaatcgtttaaaatggaaagtattaagcgaacaaaaagataaggaataa

SEQ ID NO: 1086 - DNA, 468 bp, H. influenzae strain 86-028NP
atgaatccattatctgttggtaatcaagcacctgcttttaccttattaaatcaacaagaaaaatttgtttctttaagtgattttcgtggtaaaaaagttttaatttatttttatccaaaggctctcactccaggctgtaccacacaagcctgcggattgcgcgacagtaaatctgaattagatgcactaggcttagttgtacttggtattagtcctgatgccccgaaaaaattagctcaatttattgagaaaaaagcacttaatttcacattgctttctgatcctgatcatcaagttgcggagcaatttggcgtatggggcgaaaaaaaatttatggggagaacttacgacggtattcatcgaattagttttttaatcaatgaaagcggaactattatgcaagtatttgataaatttaagataaaagaccatcatcaaatgatcattgattatcttcgttccctataa

SEQ ID NO: 1087 - DNA, 897 bp, H. influenzae strain 86-028NP
atgtcagcgcaaaatcctttattttcgggtagcatagttgcccttgttacgccaatgaatcattatggcgaagtcgatttttcctgtttagaaaaattagtagaacatcacattgaagctggttctaatgcgcttgtttctgtgggtacaacgggagaatccgccacgctaagtattgaagaaaatgtaaaagtcattgaaaagactgttgaatttgccaaaggacgtattcctattattgcgggagcgggtgcaaatgcgacgagtgaagcaattacaatgaccaaattattacgagacagtggtgtagcaggatgtttatctgttgtgccttattataataaaccaacccaagagggaatgtatcaacattttaaagccattgcggaatgtactgatttaccacagattctttataatgttcctagtcgcacaggcagtgatatgaaaccagaaacagttgctcgtttagctgaaattgaaaatattgtaggcattaaggaagcaacgggagatgttagccgaatagttaaaattaagcagcttgcaggtaagaattttattgttttaagtggcaatgatacaacaggcttagaagcaataaaattaggtgctgaaggagtaatatcagtaacaaataacattgcagcaaaagatatggctgatatgtgccgttatgcacttgcgggagattttgataaagcggaagaaattaatgctcgtttaatgcgtttacatcacgacctgttcattgaatctaatccaattccagtgaagtgggcagcttatcgcttaggcttaattaaatcgccacatttacgcttgccacttacaacacttagtgaagaaattcaaccaaaagtagaagatgcgctaaaaatcgcaggattgttataa

SEQ ID NO: 1088 - DNA, 630 bp, H. influenzae strain 86-028NP
atgaaaaaaataatattgaatttagtaacggctattattctagctggttgttcgtctaatcctgaaaccttaaaagcaaccaacgattcatttcaaaaatctgagacgagcattccccatttttcccctttggctactggaggtgtacagttaccaaaagctgatgatgcctattcattacctaatattgaagtgaaaaaaggggaagatattgatattcgcccaccattaatccctctcgctattattcaaaattcaataacaaaatttgatggcgaacgttcgttgattgtctatccaaaacaacaggcaaaactatataatcttcagcaagttaagcgtttattgaaagatgagggtatttcatcaacaacagatggttcgattttaacaactgattgggcaaaaacagaacgaattggcgataaatctatagaaataaaatatcaaatagaacaagttatgacagctgatgtaagtgtgcttaccgtatctattttacatatgcgccgagatggtattatttttacaccaaatgtatcagataaacaatattatacttcggaacgtttaaatcgcattgttttaacactcactaccgcgtataacaaacaattacaggatttataa

SEQ ID NO: 1089 - DNA, 324 bp, H. influenzae strain 86-028NP
atgacacttaatattaccagtaaacaaatggacatcactcctgcaattcgtgaacacttggaggaaagacttgcgaagttaggtaagtggcaaacgcagttaattagcccacattttgttttaaacaaagtacctaatggatttagtgtcgaagcctctattggcacacccttaggcaatttattagccagtgcaacttcagatgatatgtataaagcaattaatgaagtggaagaaaaattagaacgtcagcttaataaacttcaacataaaagtgaatctcgccgagctgatgaacgtttaaaggattcttttgaaaactaa

SEQ ID NO: 1090 - DNA, 939 bp, H. influenzae strain 86-028NP
atgacagacagacagacagacagacagacagacagacagacaataaatattatattttcatctgacaaccattatgcaccttatttagctgtaagtatttttagcattattaaaaatacacctgaaaaaataaatttttatattcttgatatgaaaataaatcaggaaaataagacaataataaataatttagcaactgcatatttttgtaaagtatttttcttgcctgtcagtgaggcagattttcaaaactttccaaaaacaatagattacatatctttagcgacttacgctagactaaatttaactaaatatataaagaatatagaaaaagctatttatattgatgtggacacattaacaaactcttcacttcaagaactttggaatatagatataatgaactattatttggcaggatgtcgagatacttttattgatgtaaaaaatgaagcttataaaaaatccattggtttagaaggatattcttattttaatgcaggtatattattaattaatttaaataaatggaaagaagaaaatattttccaaaaatcaataaattggatgaataaatacaataatgttatgaaataccaagatcaagatattctaaatggtatctgtaaaggaaaagtaaaatttattaataatagatttaattttacaccaacggatcgaggtttgattaaaaagaaaaatttattacacgtaaaaatgccaatagttatttctcattattgtggtccaaataaattttggcacaaaaaatgcagtcacttaaattgtcatataggaaatttacttttaaaagaaatggataaaattattgatataccatcatcttggtatgatcattttgagaaaatcccttttttaattaaaataaaaagattaagaaagagaataaaagataaattaatatatggtatttattaa

SEQ ID NO: 1091 - DNA, 588 bp, H. influenzae strain 86-028NP
atgaaacaaaaaatcgtacttgctacaggcaataaaggcaaagtgaaagaaatggctgatgtcctatctgattttggctttgaagtgattgcgcaaacagatttaggcattgaaagcccagaagaaacaggcttaactttcgttgagaatgcgttattaaaagcacgttatgcatcagaaaaatcaggtttacctgctattgcggatgattcaggcttggtggtttccgcacttaatggcgcaccaggtctgtattctgctcgttatgctggtgaagagggcaatgatgctaaaaaccgtgagaaattattggcagagcttgctcatgttgcaaaagatcaacgccaagctaaatttgtgagctgtatcgtgtttttacagcatccaacagatccatcgccaattatagccgaaggcgagtgttgtggcgtgattggttttgaagaaaaaggcgaaaatggttttggttatgacagtttattctttagtccagaacaaggttgcacatttgctgaattagaaacagctgagaagaaaaaaatttctcatcgagcaaaggcattgaatattttaaaaaataaattataa

SEQ ID NO: 1092 - DNA, 726 bp, H. influenzae strain 86-028NP
atgcaccaattccaacaagataaccaatattttatctttaattttgaccgcacttttgagcaagcaaccgagtttttccaagcggaattttggcaaaaacaagaacgagtgataggaagtgcaaaaggtcgaggcactacttatttcttgcaaacggaagattggtttggcgtaaattgtgcgttgcgtcattattatcgcggtggactttggggtaaactgaacaaagatcgttatcgtttttctgctcttgaaactacccgtagttttgctgagtttcatttgttgcaacgtttgtatgaagcgggtttacctgtgcctaaacccattgccgcacgtattcaaaaaggcaagttaggtatttgctatcaagcggatattttgactgagaaaatcgaaaacgcgcaggatttaaccgcacttttacaaacacaaacattgccaaaagaaacttggaggcaaattggtcgtttgattcgaaaactacatgatttacagatttgtcatactgacttgaatgcacacaatattttgcttcaacaagctgaacaagagcaaaaatgttggttgattgattttgataagtgcggtaaaaaatcaggggatttttggaaagcacaaaatctgaaccgtttaaaacgttcctttgaaaaagaagttggacgaatgaatattcaatttaccgagcaaaactgggctgatttaacggcagcttatcatcaataa

SEQ ID NO: 1093 - DNA, 1044 bp, H. influenzae strain 86-028NP
atgccattttttaccgaagctccaaaatctctttgtattctccgattgtctgctgtaggcgatgtttgccacgccttagcggtggttcagcacattcaggcatattatccacaaacagaaatgacttggattgtaggcaaaactgaaatgggtttgctttcgggcattcctaatatcacgctcattccttacgataaaaaagcgggatggaaaggcgttttattattctggaaacaattaaaaaataaacaatttgatgcactattaaatatgcaaacagcatttcgtgcatcaatcctttctttaggaattaaagcaaaattcaaaattggatttggagaaaaacgttctcgcgaaggacaatggttatttgtaaatcgtcgtattacagatcctttttcccctcacgtattggatggatttatggctttcgctgaatatatcggcgtaccaaaatcagaaccgaaatgggaattagctatctcacaagatgatgataaatttgccgatcaatttattgatttttctcgtaaaaatttattgatttccccttgttctagcaaagcagaaaaagattggctaattgaacgttatgcagaaattgccaatattgcccatcagcataatatcaatgtgattttctgcagttcgccagcgaaacgtgaattagaaatagtcgaaaaaattaccgcactttgccatttcacgccaaccaatattgcaggaaaaacaaacctaaaacagcttaccgctttaatttctaaggtcgatctggtactttcgccagattctggccctgcccatattgcgacaacacaaggtacacccgttattggcttgtatgcctatcacaatcctttgcgtactgcaccttataataatttagataacgtggtatcagtatatgaagaaaatgcccaaaaagaatttggcaaaccgtcttctgaactaccttgggcaaccaaactaaaagggaaaaatttgatggcagagattcaagtcgaacccgtcattgaacaaatgaaaaaattgggattattttga

SEQ ID NO: 1094 - DNA, 2130 bp, H. influenzae strain 86-028NP; identical to SEQ ID NO: 756

SEQ ID NO: 1095 - DNA, 1698 bp, H. influenzae strain 86-028NP; identical to SEQ ID NO: 754

SEQ ID NO: 1096 - DNA, 2766 bp, H. influenzae strain 86-028NP; identical to SEQ ID NO: 732

SEQ ID NO: 1097 - DNA, 357 bp, H. influenzae strain 86-028NP
atggatcgtgtttttattgaggaattgactgtttttgcacaaatcggtgtatatgattgggaacagcaaataaaacaaaaacttgtgtttgatttggaaatggcgtgggattgtaaacaagcggcagaaacggatgatgttgtatattgtttgaattatgctgaagtgagccaagcgattattgattatgtggaaagtaaatctttcttgttgattgagcgagtggcttatgaagtggcggatttgcttgagtcacgttatcaacttcaaggattaaaaattaaactgagtaaaccaaaagccgtcgcgcaagctcgaaatgttggcgtattggttatacgtggatgtttaaaataa

SEQ ID NO: 1098 - DNA, 600 bp, H. influenzae strain 86-028NP
atgagccttttcgcccttttttatatgctttttgcctatcttttaggctcaatttccagtgcgattttaatttgtcgcattgcaggcttgcctgatcctcgtcaaaatggctcacacaaccctggggcgacaaatgtgttgcgcattggaaatcgtaagtctgccttggcggtgcttatttttgatatgttaaaagggatgattcctgtatgggcagggtattatttaggtttaacccaatttgaattgggaatggtcgcacttggtgcttgtttagggcatattttcccaattttctttcaatttaaaggtggcaaaggtgttgcaactgcctttggggcaatcgcaccgatttcttgggctgttgcaggttcaatgtttggtacgtggatctttgtttttcttgttagtggctattcttcattaagtgcagttatttctgcattacttgtgcctttttatgtgtggtggtttaaacctgaatttacttttcctgttgcactggtatgttgcctattaatttatcgtcatcacgataacattcaacgcttatggcgtggtcaagaagataaagtttgggctaaatttaaaaagaaataa

SEQ ID NO: 1099 - DNA, 1704 bp, H. influenzae strain 86-028NP
gtgtatactaaaggttccgtttccacccgtattgcgaaatatttatttatcattcttatcgttgctggtgtgattagttctctaagtttggcaattatgagcagtaataaatatgatgccgaagccattaatatttcaggttctttgcgtatgcaaagttatcgcttactttatgaaatgcaagaacaaccagaaagcgtggaaacgaacttacgccgttatcatataagccttcattcatctgctttactagaagttcaaaatcaatttttcacaccgaatgtattaaaacattcctatcaaaacattttgcaacgttggacgaacatggaaaaatatgcacgccaacaggatgtaaaaaactatagtaagcagcttactaactatgttgcagatgttgattattttgtgtttgaattacaacgttttagtgagcagaaatggattttaggcgtttcagtattaggttttgcgatgttgttaattttgctgatggtgtcttatgtgatttggtacacaaaccgagaagttgtgaaacctttgcatttaatgacaaaagccagtatgcaagtgcaaatgcgtcaattcaatcatattccacttgacacaaggaaacaaaatgaacttggcacactggctcgcgtatttacacaaatgtccacagaactgggacagctttattcgcgtttagaagaagcggtaaacgaaaaaacgcaaaagttgcgtcaaactaaccgcactttaagcactctttatcaaagtgctcaacttctgaatacaaacacaattaacgataaaattttaaatcaagttttgcattacatttttattagcgaccatttgaacttcgttaaagtggaagtgatgggggctgaacattgggatattacattgggtaagcaagatgctaataatgaactacaaatcgaaaccctttctgtggataacgaagaattaggtgtactgtcttggcaagcaggattaccttgtccagatccccgaattatgcaaaatttagcgcaaatgcttgctcgtgcgctttatttccataaaaatttacgtcagaaagaacagattttattaatggaagaacgctcaattattgcgcgagagttgcacgattctttggctcaagtcttatcatttttacaaattcaacttactttgctcaaacataacctgaagaaagaagacgaacaatcaaaagaaaagagtttggcaattattgccaattttgaacaagccctttctggtggttatgcacagttacgtgagcttttagccactttccgtttaactatacaagaagcgaatttacagcttgcactaaaacaagtgattgattcattacgctcacaaacaacaatgcaaatgaatgtgaattgtcaattaccatcgcaaagtttgaaccctcaacagctggttcacgttctgcaaattgtacgtgaagccaccaccaatgcgatcaaacattctcaaggcacggtaattgaaattagcgcaagaattaatgcggaaggcgagtatgaaattttagttgaagatgatggggttggcattccaaaccttgaggagcctgaagggcattacggcttgaatattatggcggaacgttgccgtcagcttaatgcacaattgcatattcatcgccgagaacaaggcggcacacaagtcaaaattaccttgccacatacattatattag

SEQ ID NO: 1100 - DNA, 1026 bp, H. influenzae strain 86-028NP
atgcaaaatttacaaccttttcacactttccacattcagtctaatgctcgtgaaattattgaagcacatagtatcgaacagctacaacaagtgtgggcgaattctaaatcagaaaatttacccgtactttttttaggtcaaggcagtaatgttctgtttctggatgattttaatggcgtggtggttttaaatcgtttaatggggattacgcacgaacaagatgcaaattttcactatcttcacgtcaatggcggcgaaaattggcataaattggtggaatggtctattaataatggtatttatggcttagaaaatctggctttaattcctggctgtgcaggatctgcgcctattcaaaatatcggtgcttatggcgttgaatttaaagatgtgtgcgattatgtggatgtacttaatttaaacacgaatgaaacctttagactcgacacagaacaatgtgaatttggttatcgtgaaagtacttttaaacatcgttatcagcaaggttacgtgattacagcggttggattaaagcttaaaaaagattggcagcctattctaaaatatggttcgcttgtagacttcgatccaaaaactatcacggctaaacaaatttttgatgaagtctgtcatatccgtcaaagtaaattacctgatccaaatgaaacgggtaatgcagggagtttctttaaaaatccagttgtcagttcagaacattttgaggaaatcaaaaaacatcacaaaaatctaccgcactttccacaagcagatggctcagtgaaattagcggcaggctggctgattgatcaatgtaatcttaaaggttttcaaataggaggggctgcggttcataaaaaacaagcattagtgttaattaacaaaagtggggcaacaggacaagacgtagttaaacttgcccatcacgttcgccaaactgttgcagaaaaattcggtgtatatttgcaacctgaagtaagatttatcagtgcaactggcgaagtaaatagcgagcaaattatcacgtaa

SEQ ID NO: 1101 - DNA, 846 bp, H. influenzae strain 86-028NP
atggataaagaaacacaaatgatgttagttcctcaaggcagtatcgaaggttatattcgtgcagcaaatgaatatccgatgctgaccgcagaggaagaaaaggaattggcagaacgtttgtattatcacgaggatttagatgcagcgaaaaaactcattttgtcgcatcttcgtttcgtgatccatgttgcacgtggctattctggctatggtttgccacaagctgacttaatccaagagggcaatatcggtttaatgaaagcggtcaaacgttttaaccctgaagttggtgtacgcttggtgtcattcgccgtgcattggattaaagctgagatccacgaatatgttcttcgtaactggcgtatcgtaaaagtcgcaaccacgaaagctcaacgtaaattatttttcaacctacgtaaaactaaacaacgtttaggttggttcaatgaaaatgaagttgatatggtcgcaaatgaattgggtgtttccaaagaagatgtgatcgaaatggagtctcgaatgagcggtgcggatgtcggttttgatttacctactgatgatgcagaaacagagacctattctccagccctttatttggaagataaaagttctaatttcgcagcagagcttgaaaatgaaaactttgaaagccaagcaaccgagcaattaggtgcagcgttacaaagtctagatgcacgtagtcaggatattatcaaagctcgttggttagatgataacaaagccacattgcacgatttggcagcaaaatataatgtctctgcggaacgtattcgtcaattagaaactaatgcactgaaaaaattaaaaagtgcggtgaatttttaa

SEQ ID NO: 1102 - DNA, 428 bp, H. influenzae strain 86-028NP
gtgcgtgttattcttgcgcctatgcaaggggttctagatccctttgtacgccaacttctcaccgaagtgaatgactacgatttatgtataacagaatttgttcgcgtagttgatcaatttctccctgaaaaagtattttatcgtttatgccctgaattaaaaaatcagggctttacttcttctggtacgcctgtgcgagtgcagttgctagggcagcatccagaatgccttggtatgagattcaaaaaatcttgcaaaaatatgctaatgtcgaaaatgaatatgacagcggtttttaccatgtggcacgaattaaacagtggttacgttatttgaataaggaatatgacgaggcgaaccaagtgtttgataagattaagacctgccaaactgctgaagatttgaaattacggttaaatgagaaataa

SEQ ID NO: 1103 - DNA, 867 bp, H. influenzae strain 86-028NP
atgggatttattgggaaaattataggcgtatttttaggttggaaagttggtggattttttggtgcgattgctggtctcattttaggctctattgcagataaaaaattgtatgagcttggctcggtaagttctagtttctttaaaaagaaaacaacacgtcaagacttgtttatgcaaaccacctttgcggtgttaggacatttaagtaaatcgaaagggcgtgtaacagaagaagatattcaattagctaatcaattaatgattcagcttaaactggatgatgctgggcgtaaattagcgcaagatgcgtttcgtcgtggtaaagaatctgatttcccgattcgtcaagttatccgtgaatttcgcattggttgtgggcaacgtgctgatttattgcgaatgttcttacaagtgcaagttcaagcggcttttgccgattcagaacttcacgaaaatgagaaagaagtgctttatgtgatcgctgaagaacttgggctttctcgtatgcaatttgaacaaatgattgcgatggaaatggctgctcgagcttttactcaaggcggtttttatcagcaatatcaacaaggtgcatatcaaggtggctaccaatatcaacaacaaaatagtggtggttaccaacatgcttctggcccaactttaaatgatgcctataaagtattgggtgtgactgagtccgacgagcaaagcacggttaagcgtgcttatcgtcgtttaatgaatgaacatcatccagataaacttgtggcgaaaggtttaccgccagaaatgatggaaatggcaaaagaaaaaactcaacagattcaagccgcttacgatttaatttgtaaagcaaaaggctggaaatag

SEQ ID NO: 1104 - DNA, 642 bp, H. influenzae strain 86-028NP
atggaacaatataaacgcgattttatcgaatttgctttaagccgaaatgtattgaaattcggcgagtttactttgaaatcggggcgtaaaagtccgtatttctttaatgcaggtttgttcaatacgggggcagatttagcgcgtttaggcgagttctatgctgcggcaattcaagcaagtgcggtagattttgatgtggtttttggccctgcttacaaaggcattccaattggcacttcagtttcggtggcgttatttaatcgttatggtattgataaacccgtgtgttttaatcgcaaagaagtgaaagatcacggagagggcggcaatttaattggtagcccattgcaaggaaaaattttgcttgtggatgacgtgattacggctggcactgcaattcgtgaatctatggaattaatcagtgcaaataaggcagagcttgcggcggtattgatcgctctaaaccgtaaggaacgaggaaaaggcgagctttctgcaattcaagaagtagaacgtgattatcaatgccaagtgctatcaatcattgatttagatgatttgatgcaatttatcgaacaagatcctcgatacagtagccatttgccagaaatgcgtgcttatcgtgccgaatttggcgtataa

SEQ ID NO: 1105 - DNA, 717 bp, H. influenzae strain 86-028NP
atgcgtccaaataatcgagaaaataatcaaccccgccaaattaaaattacccgtaactacaccaagcatgctgaaggttctgtgcttgttgaatttggggacaccaaagtgctttgtactgcaacagtggaagatgctgtgccacgtttcttaaaaggacaagggcaaggttgggtaacggctgaatatggaatgttgccacgttcaacacatagtcgtatgcaacgtgaggcggctaaaggtaaacaaggtggacgcacaatggaaattcaacgcttaattgcccgctctttgcgcgccatggtggatcttaaagcactgggtgaacgtgcgattactttagattgtgatgttattcaagcggatggcggcacacgaactgcatccattactggtgctgcagtcgcattatgtgatgcgatcaatggtttaattgagaatggcacgttaaaaactaatccaattaaagggctagtttcggcaatttctgtagggattgttgatggtcaagctgtttgtgatttggaatatgtggaagattctgcagcggaaaccgatatgaatgttgtgatgatggaagatggtcgaatgattgaggtgcaaggcactgcagaaggcgagccatttagccatgaagaattattaacattattagatttagcgaaacaaggctgtaatcaaatttttatcgctcaacgcgaagcgttaggcttataa

SEQ ID NO: 1106 - DNA, 1443 bp, H. influenzae strain 86-028NP
atgaaactagatgctccttttaatttagatccaaatgtaaaagtgcgtactcgttttgctcctagccctacaggttatttacatgtaggtggcgcacgtaccgcactttattcttggttatacgcaaaacataataacggcgaatttgtattacgaattgaagacactgatttagagcgttcaacaccagaagcaacggctgccattattgaaggcatggaatggttaaatcttccgtgggagcatggcccttattaccaaactaaacgctttgatcgttataaccaagtgatcgatgaaatgattgaacaaggcttagcatatcgttgttattgtactaaagaacacttagaagaacttcgtcatactcaagaacaaaataaagaaaaaccacgttatgaccgtcactgcttacacgatcacaaccattcacctgatgaaccccatgttgtacgttttaaaaatccaactgaaggctcggtagtatttgatgatgccgtacgtggccgtattgaaatcagcaacagtgagcttgatgatcttattattcgccgcacagacggttctccaacttataacttctgtgtagttgtagatgactgggacatgggtatcacacatgttgtacgtggcgaagatcatatcaacaacacgcctcgtcaaattaacattttaaaagcgattggtgccccaattccaacctatgcacacgtttctatgattaatggcgatgatggtcaaaaactctctaaacgacatggcgcagtgagcgtaatgcaatatcgtgatgatggttacttacccgaagctttaattaactatcttgttcgtttaggctggggacatggcgaccaagaaatttttagtcgcgaagaaatgatcaactatttcgaattagatcacgttagcaaatcagctagcgcatttaataccgaaaaattacaatggttgaatcaacattatatccgcgaattaccgccagaatatgtggctaaacatcttgaatggcattacaaagatcaaagcattgatacaagcaatggtcctgcattaactgatattgtctccatgcttgcggaacgttgcaaaaccttaaaagaaatggcaagttcaagccgctacttctttgaagagtttgaaacctttgatgaagccgcagcgaaaaaacatttcaaaggcaatgctgctgaagcgcttgcaaaagtgaaagaaaaattaaccgcactttctagctggaatttacattctattcacgaagccattgagcaaacagctgctgaactagaagtgggcatgggtaaagttggcatgccattacgtgtcgctgtgacaggttctggtcaatcgccatcaatggatgttaccctagtcggtatcggcagagatcgcgtacttgtgcgtattcagcgcgctattgattttattcatgcacaaaacgcttaa

SEQ ID NO: 1107 - DNA, 1656 bp, H. influenzae strain 86-028NP
atgatcgcttatattttcttagctttattcacgattgcggcagtgatttttattgtaaactcccattatcgttggacttatttctttgctattacgctttttacttttttatttggcggcatgcttatggtttccagccaatggcaacgtgctttaaatttttcatcagtgctttttgtagtgctgatgttatttcatcgtttaaaaattcattattacaaacagcctttgttaatttcagatttctttcttgtggtggattggcgaaattgggaaaccttaattcattataaaggtgcgttgtttggcgttattgggctactggcgttattaggttatgcgatttttggttttaatgatgtcgagtctttaggggtattgggtaacagcattggtgctttattgtttatcgttagctttagcttgatgtggcattattctaaaaatccaagtgcggtgcaagtttggttagattctttgcctgatgatggtcgtgatgtgtttttaaatttaccaatgtcttgtcgcggtatttttttcaaagtgccaaattttgatggcaatagccaaaattttattgaaaaaatgaccgcactttcatctgatacaaacaacctatctgaaacaaaacccgatattgttgtaacattaatggaatccacgctgaaccctcatcaatttgcttttagtcagcaatctattccaccactttccatgtttgagtctcaaagtgatacagtatttgcttcgccgttgcgtgtacatacttttgctggtgcaacgtggaaatcagaatttgcttttttagccggtgtaccttcaaccgattttggtgcgttagcaagtggcgttttttattctgttgtaccgcacttgcaatcaggtttagtgaaaaatctaaaagcacaaggatatttttgtgttgctttgtcgccttttacaaaaggtaattacaatgcgaaatccgcttatgatcatttcggttttgatttaatgttacagccgcaagatcttggttatcctgcgcctattagtaaaaatctttgggatattagtagtgaagaaatgatgaagtacacccgaatgattttagaaaagcagcatcctgcactagaaaatgtagatcagccaatgtttgtttatgtattgactatgcgagaacatggcccatacgaattgggcatggaaaatatatttaatcttcaaatgcctaatttaggggctaaaagtatttctgcattgaatgactatactcaacgtattgttgcattaaatgatgcgattgaaggaatgaataactatttacaagaacgtaaaaagccttttgtgctaggttatttcggtgatcaccaagtggcatttgataatgctatccctccgaagaaaggggattatgcacagcccgattatgtgacgcaatttgttgtaagaagtaattatgcaagtcaatttaagcaagaacaaaagtttttagatcttgcttttgctggaggcgtcttgatgaatgtagctggattatcagcagaagatgaatttatgaaagcgaatatggcaatgtgtaaactaagtcacggaaaattagaagattcttctgatattcagctactcaatgattatcgccattatttatatcaaacattggcgattgccagataa

SEQ ID NO: 1108 - DNA, 810 bp, H. influenzae strain 86-028NP
atgatttcattaaaaaattttggattattattttggaaacgtttttcagaaaataaacttaatcaagtcgctggtgcattgacttatagcacaatgttagcaatagttcctttagttatggttattttttctattttctctgcttttcctgtattcaatgaagtgacgggagaattaaaagaaatgatttttactaattttgcaccatcagcgagtgatatggtgggcgaatatatcgatcaatttgtatcaaactcaaagaaaatgagtgcggtgggaattgtgagtttaattgccgttgccttgatgctaattaataacatcgaccgaacactaaatagtatttggcacaatagtcaatctcgctctccgctttcttcttttgcgatttattggatgattttgacacttggcccacttattattggcgtgagtattgggattagttcgtatattaaaataatgtttgagcaatcggaacatttatcattaggcttaaaattgctcagttttgtgccttttttatttacttggtttatttttacgcttatttatacggttgtaccgaataaaaaagtgaaaattaagcattcagcttacggtgcatttcttgccgcgatttttttcactcttggtaaacaagcatttacttggtatgtcgtcacttttccctcttatcaattaatttacggtgcaatggcaactttaccaattatgttattgtggattcaaataagttggcttgtggtattagttggtgcacaattagcttcaaccttagatgaaattggcgagcagatcgagcaataa

SEQ ID NO: 1109 - DNA, 486 bp, H. influenzae strain 86-028NP
atgtcagaaatttcaaccgcactttctttagaaaattgtccatgtcaatctagtcatcattacgcagattgttgtggcaaatttcatttgagacaagcatttcccgaaacggcagagcaacttatgcgttcacgttatacggcttatgtgttaaaaaatattccctatattgttgtaacaactgcgccaagccaacaaactttattaaagcctaggttattgcaagaatgggcggacaacactacgtggctaggattagaaattctaaaaacggaaagccttacaaaaactcaaagtgcggtagaatttaaggcgatttttcaaggcgaagagggagaactagcccatcaagaacggtcaatttttgtaaaaattgaaaaccgttggtattttgttgatccgaccgtatcattaccgacaatgaaacaaccttgtgtatgtggttatggtaaaaaatttaaacattgttgtgggggatttctatga

SEQ ID NO: 1110 - DNA, 663 bp, H. influenzae strain 86-028NP
atgaatgcaaaaattttagttataaaagtgggacaagttgaaaccctaaccttttccgatggaagccagtatgaaagcgcgattcgtaaaaaagttgtgccatcggtaaaaattcattctcttggtgcggaaggaaacgatgttggtttaaaaaaacatcacggtggtgtagataaagctctcttttttatgtcggcagattcttttaatgaattaaatactttattaaataaagatttttcttatatggatactgcgatatacggagaaaattttgtcgtgtcaggcttgaatgaagacaatgtatgtattggcgatcgttatcaaatcggctcaaccattttagaagtatctcaaccacgtaaaccttgtgagcgtttatcaaaaaacacggaaaacgaagatactcgcgatattgtttatcaaactgggcttagtggatggtatgttcgtattattgaaacaggaacaattaagcaaaaggatgaactaaaattactcgcccgtccttatccgcaaataacaattcgtcatttaaatcgcttgttatctgcgcccgaaaatgaagctgaattagatgcagcattagagattgaagtattagctgaagcctttaaacgctcaattcgatcgcaaatatcgaaattcaaacaacagggataa

SEQ ID NO: 1111 - DNA, 780 bp, H. influenzae strain 86-028NP
atgataataaggagatttattatgtcagacgtattccacctaaacctcactaaagcacaacttaaaggtgcaacactcgctattgttcctggcgatcctgcgcgtagtgagcgtattgcgaaacaacttgataatccagagtttcttacaagcacgcgtgaatttacatcgtggttaggttatatcaatggtcagcctattgttgtatgttctacgggtattggtggcccatcaacatcaatttgtgtggaagaacttgctcaacttggtgttcgcactttcttacgtattggcacaacgggggcaattcaaccgcacattaatgtaggcgatgttcttatcacaactgctgctgttcgcttagatggtgcaagctgtcattttgtaccattagaatatccagctgtggcaaactttgaatgtacaaccgcactttataatgcagcgaaagcaaaaggtattgagccttatgtaggtgtaaccgtatcatctgatacattctatccaggtcaagaacgttacgatacttatagtggtaaagtatatcgtgattaccaaggtttgcttaaacaatggcaagatttgaatgtcatgaattacgaaatggaatcttcaacattgtttactatgtgtagcgcattaggtttgcgtgcaggaatggttgcaggcgtgattgtaaaccgcactcaacaagaaattccaaatgaagcaacgataaaacaaacagaagaaaaagcggtgtctgttgtgatcgcagctgcacaagcgttgttaagttaa

SEQ ID NO: 1112 - DNA, 1317 bp, H. influenzae strain 86-028NP
atgtctacacaacttcgtaataatccgatgaaagtggcgttagcctcgatggtcggtacggcaatcgaattttttgattattatatctatgcggctgccgctgtattagttttcaatacgcaattctttcatagcgatgatccgctttctaatgatttactttctctttctacgcttgctttagcattttttgcgcgtcctattggttcggcattattcggtcactttggcgataaaattggtcgtaaaaaaaccttggttgcctctcttgttttaatgggtggttcaacggtagtaattggtttacttcctaattatgctcaaattggtatctgggcgccgattttgctttgtgtatgtcgcgtaggtcaaggaattggacttggtggagaatggggaggtgcagcgttagtcgcaacagaaaatgcaccagaaggaaaacgagcttggtacggtacttttcctcaattaggcgcaccaattggtttatttgtcgctaatggaacgttcttcttagctagctatttacttggtcataatgcacttgttgaatgggcgtggcgtattccatttgtatcttccattttattagttgcagttggtttatatgttcgcttaactttgcacgaaagccacgtatttgtggaagcagagcaaaaaggcaaaaaattgaatgcaccagtgagtgttgtgtttaccaaacacttaaaaccaatgatcattggtacatttattatggtggcaacttattctttgttttacattatgacggcttttgcacaggcatattctcgaaccgtgccaaagctttctgaagcaggttatgcgcttggtttaggaatcccagcaaatacatttactggcttgttattaattagtgccattgtatttggtatttttatcagtatttccggtttttatgcagataaaatcggtcgtcgtaaatggttgatttgggtgactattgctatcggcgtgcttggtttagcaatgccgttattcttagaaaatggcactccagttagcgtatttgcatttttagtgattggtatggcgattatgggaatgacatttggtccaatggctgcgctattaccagaattattcccaacagaagtccgttattcaggtgcctctcttgcgtataatttagcatcaattattggtgcaacaattgcagcaatgatttctttaaaaattaacgcgtcattcggtgtaatgggcgtaggaatttatttagcaatcaatgcattaatgactttcttggcattattagcctcaaaagagactaaaaatgtagatttaacagaaatctaa

SEQ ID NO: 1113 - DNA, 744 bp, H. influenzae strain 86-028NP
atgataaacatcatttttcttcacggacttcttggtacaaaaaatgactggcaaaaagtcattgaaaatctaccgcactttaattgtattgcgctagatttgccttttcacgggcaagctagagatattgaagtcacaaattttgaagaaacggctgagtatttggctaagcaaattaaaagtgcggtgaaaaatgaaccctattttcttgttgggtattctctaggtggaaggatcgctttgtattatgcgctgaaagctcaggtggaacgatctaatttgcaaggcgttattttagaaggagcgaatctaggtttaaaaactgacgaagaaaagcaggctcgttttcagcaggattttgcttgggcgcaacgttttatacaagaaccaccagaaaaagtgttgaatgattggtatcaacaacctgtgttttctcatttgactgcagaagaaagattacagttggttgaaaaacgaaaatcaaattgtggggaaaatattggcaaaatgctgctggcgacaagtctatccaaacaacctgattttagtgaaaaagtgcggttaagttctttgccatttttttatttttgtggcgaaagagatcataagttccaagtattagccaaagaaaatcaaattgatttagtgacaattccctgcgctggacataactcacatttagaaaactcaaaatatttctctaaaaaaatagaaaattgcatattaaaaattgttagaccttag

SEQ ID NO: 1114 - DNA, 1707 bp, H. influenzae strain 86-028NP
atgtcggtaagcgtgtttaatcgttgttggtcgaaagtgattttagaaaccttggtgcgccaaggcgtttctcacgtttgtatcgcgccaggttcgcgttcgacacctttaactctagaagccgtacgtttgcaaaatgcaggttcagtcacttgtcatacgcattttgatgaacgcggtttaggtttttttgcacttggtattgctaaggcaactcaatcacctgttgccattattgtgacatcaggcacggcgactgcaaacctttatccagcaattattgaagcgcgccaaaccggtgtgaatttatttgttttaactgctgatcgtccaccagaactttgggagtgcggtgcaaatcaagctattttgcaacaaaatatgtttggtcagtatccagttgcaaatgttaatttacctaaaccgaacgctgattattctgcgcagtggttgatttctctacttgaacaggcagctttccaacaaaaacaacaaggtggcgttgttcatattaatgtgccatttaccgagccactttatgatgcaactgatgaggaagtaaattcccatagttggctacagccgttacaacgctggttaattcaaaacaagtcttggataaatgtagaagtccaacaaaacgaagtattaatgcatgaaaattgggatcattggcgtaccaaacgtggtgtcgttgtggttggtcaattacctgcagaacaagcgatgggcattaattcttgggcaagtgctatgggctgggtgttactgacggatattcaatctggtgttgttccaacgacgccttatgaagatatttggctagcaaaccaaactgttcgtgaaaaacttctacaagctgatattgtgattcaatttggcgcgcgttttattagtaaacgcattaatcaattcttgcaggcgtttaaaggggaattttggctagttgaacaaagcggtaaagcactagatccttaccatcattcattgacaagattcaatgctaaagcgcatcattggttacgtgcgcatccacctttacgccaaaagccttggttgcttgagccgttagctttatctaagttctgtgcgacctttattgaacagcaagtgggcggaaatttaacggaagcctcgctagcattacgtttaccaacacttttaccttataacggtgttttatttttaggtaatagtttacttgttcgtctggttgatgcgctaacgcaattacccgaaagttatcccgtttataccaatcgtggtgcgagtggaattgatggtttgttggctactgctgctggaataggtattggttcaaataaacctgttgttgcggtgattggcgatacgtccactttatatgatctaaattctttcgcattattcaaaaatgttacgcaaccaacgctaatctttgtgatcaataataatggtggtgcgatttttgatatgttacctgtggatgaacaagtcaaagatcagttctatcgattaccgcataatggcgatttttctcaaatcgcggcaatgttcgatctcaaatacgctcatccttatacttgggcggatctcaattccgttgttaaacaggcttatagtcgtcgcaaggcaacgttaattgaaattaaaacgaatccgagtgatggtagtagtttgtataaacgcttaatcgatcaaattagtcacgccgtgattggtgcttaa

SEQ ID NO: 1115 - DNA, 1272 bp, H. influenzae strain 86-028NP
atgagttatttagcgcaggcaataggggagttaaaatcgcaaattcacgcatatttacagcaatcaacgaatgaacttgtccgttttcaggtgaaactggacaaggtcgatttgttggcgtggctgaaaggtcaatctgcgtatcctcaattttatttacattttcgtgatgaagaaaaagcactggctgcgcttggggcagtgcagtcattttcacagttaaatttagcgcaagagtttattgaagaaagtggttttccactggtaggcggtttgcaatttcaaggcactgcacaatttgtattacctaaaatgcttgttgaacaggataataaaggcacgttggtatccttttttgtgaaagatgagcaaagtgcgaatgatactttagcccacctcaaaacttttgaaaatctcaccgcactttctgcgttaccaaaacaaattcctttgcatacagagcctcgagctaatgaaagaacttggtgtgattgggtaaatcaggctttggtggaaattaaaagtggagagctgacaaaaattgtgttagccaatgaaaccacttttcatttaaagcaagcgattaatgcgtacgattttttagcagaaagcgaaaaacaaaatcaaggttgttatcattttttatgggctgaaaattctcattcggtttttgttggttctacgccagaacgcctatttgctcgtgagtataatttgttgctaaccgaagctttggcggggacagcatcggtttctgaaagtgaggaagaaacgcaatctcaagccaattggttgttaaatgatgagaaaaatttaaaagaaaattggttggtcgtagaagatatttcgcagaatttacgtaagcaagtagaaagttttgatgtaagcaatgtggaattgaaaccgttacgtaaagtacaacatttgattcgtaaaattcgcgcaaatttgaccgcacattatgcagatgtaaatatattaaaagcgattcatcctacagctgcagtatctggtttgccacagcaacaagccaaaatgattttgtcagaaatcgaaacctttgatcgaggctggtatgcgggaacattgggcgtgatgagcgatgtatgttcagagttttgtgtggcgattcgttctgcttttattgaaggtcatcgtattcgtgtatttgctggcgcgggcattgtggcaggctcgcagccattggaagaatggaaagaaattgaacgtaaagcagcagggttaatttccttgtttgcagaagaaaaatga

SEQ ID NO: 1116 - DNA, 1215 bp, H. influenzae strain 86-028NP
atgcgattattcccaaaatccgacaaattagaacacgtatgttatgacattcgcgggcctgtgcataaagaagcactacgcttagaagaagaaggcaataaaattttaaaacttaatatcggcaacccagcccctttcggttttgaagcaccagatgaaattttagtggatgtgctacgtaatttgccatcagctcaaggctactgtgattcaaaagggttatattctgctcgtaaagccattgttcaatattaccaatcaaaagggattctcggcgcgaccgtcaatgatgtgtatattggtaacggcgtatctgagcttatcacaatggctatgcaagcactgctcaatgatggcgatgaagtactcgtgccgatgcctgattatccgctttggactgctgcggtaaccctttctggcggtaaagcagtgcattatctctgtgatgaagaagcaaattggtttcccgctattgatgatattaaagcaaaggtgaatgcgaaaactaaagcgattgttatcatcaacccgaacaacccaacgggtgctgtgtatagcaaagaattattacaagaaatagtggaaatcgcgcgtcaaaataatttgattatcttcgcagacgaaatctacgacaaaattttatatgatggcgcggtgcatcatcacattgccgcactagctcctgatttattaaccgttacgctgaatgggttatcaaaagcttatcgagttgcaggcttccgccaaggctggatgattttaaacggtccaaaacataatgcgaaaggttatattgaaggcttggatatgctggcatcaatgcgtttatgtgccaacgtaccaatgcaacatgcaattcaaaccgcacttggtggctatcaaagtattaatgaatttattttaccgggcggtcgattacttgagcaacgaaacaaagcctatgatctcatcactcaaatacccggcattacttgcgtgaaaccaatgggggcgatgtatatgttcccgaaaattgatgtgaaaaaattcaatattcgcagtgatgaaaaaatggtgctggatttactccgccaagaaaaagtgctacttgtgcacggtaaaggatttaattggcattcgccagatcacttccgtgttgttactcttccttatgtaaatcaacttgaggaagccattacaaaattagcaagatttttgtctgattaccgtcaataa

SEQ ID NO: 1117 - DNA, 1257 bp, H. influenzae strain 86-028NP
atgacacaacaaagatccccttctctcttaggcggtgcgatgatcatcgctggtacagctattggtgcaggcatgctggctaacccaacttcaacggctggtgtatggtttattggttcgattctcgctttaatttatacttggttttgtatgaccacatcaggattaatgatcctagaagctaatctgcattatccaacaggttcaagttttgacaccatcgttaaagatttattaggaaaaagttggaatattatcaacggcctttctgttgctttcgtcttatatgttttgacttatgcctacataacctcaggcggaggcattacacaaaatctgctcagccaagcattcagttctgctgaaagtgcggtagatattggaagaacttcaggatctttaattttctgccttattcttgcagcctttgtatggctttcaaccaaagcagtggatcgtttcacaaccgtgttaattgtcgggatggtggttgcttttttcctttctactactggtttattaagctctgtaaaaacagcagttttattcaataccgttgctgaaagtgagcaagcatatttaccttatttattgaccgcacttccagtttgtctcgtgtcgtttggtttccacggaaatgtccctagtctcgtcaaatattacgatcgtgatggtcgtcgcgtgatgaaatcgatctttattggtacgggcttagcattagtgatttacatcttatggcagctcgctgtacaaggtaatttaccacgcactgaatttgcaccagtcattgaaaaaggcggcgatgtttctgcattattagaggctttacataaatatattgaagtggaatacctttccatcgcattaaatttctttgcttatatggcaatttctacttcattcttaggcgtcactttagggttatttgattatattgcggatctatttaaatttgacgatagcttattaggcagaacaaaaacaacacttgttacttttttaccgccattattgctaagcctgcaatttccttatggatttgtgattgccattggttacgctggattggcggcaacaatttgggctgcaattgtccccgcacttcttgccaaagcaagccgtcaaaaattcccacaagcaagttataaagtatacggcggaaattttatgattggttttgtaatgctatttggcatattaaatattgtggcgcaaattggggcaaacttaggttggtttgcaagttttactgggtaa

SEQ ID NO: 1118 - DNA, 1368 bp, H. influenzae strain 86-028NP
atgattagcgtatttgatatgtttaaagtgggaattggaccatccagttcccacacggtcggtccgatgaaagcgggtaaacaatttatagacgacttaattaaacgaaatcagtttgaacaaacagctgaaattcatgtggatgtgtatggctctctttcgatgacagggagaggtcacagtacagatatcgccatcattatgggattagcgggttatttaccacataatgtggacatcgatatgatttcaggtttcatcgagaaagtgaaacaaactgcgcttttacccattaatgtcggtcaaaagatagtaaaatttgattttgaaaataatctcattttccaccgcacttttttaaaattgcacgaaaatggcatgacaattaccgctcttgatgaaaatcgcacagagctttatcgccaaacctattattcgattgggggtggttttattgtcgatgaagcccattttggcaaagaagaaaaaaacacagtccaagtgccttatccttacaaaaatgccgaagatattttgaaacattgtagtgataacggcttaatgctttccactgtgatgttggaaaatgaaatcgcattgaatggcaaagaggctgttagtgctcatctagagaatgtctggaaaacgatgcaggcttgtattgaacacggtattcacacagagggtattttacccggcccattaagagtaccacgtcgtgcagcttcactttatcgtgcgttgcaagcaaatacgaatttatctaacgatccaatgcgcgtaatcgactgggtcaatatgtttgcgcttgctgtcaatgaagaaaatgcagcgggcgggcgcgtggttacggcaccaactaacggtgcgtgcgggattattccagcggtattagcttactatgaaaaattcatctcgccattaacacctgaaatcattgaacgctatttattagccgcagggatgattggttcactttataagatgaacgcttctatttctggtgcagaagtgggttgtcaaggcgaagtgggtgtagcctgttcaatggctgctgcgggactagctgaaattttgggtggcaatccactacaagtatgcatcgcagctgaaattgcaatggagcataatttaggattaacttgcgaccctgtcggcggtcaagttcaagtaccttgtatcgaacgcaatgcaattgcttcagttaaagcgatcaatgcatcgcgtatggctttacgccgcaccaccaatccaagagtaagcttagataaagtgattgaaacaatgtacgaaacaggtaaagatatgaacgccaagtatcgcgaaacatctcaaggcggacttgcagttaaaattgtttgtaactaa

SEQ ID NO: 1119 - DNA, 1239 bp, H. influenzae strain 86-028NP
atgaaatcaacagaaaaactcaaatggaacaaatttgatgcaacgtggatgttaaaccttttcggtacggcggttggcgcgggcgtattgttcttgccgattaacgcagggatgggtggattttggccgttagttttaatggcaattatcgtcgggccaatgacttattttgctcaccgtggcttagcctactttgtactttcatcaaaaaatcctggcagcgatattactgaagtagtggaagaacactttggtaaaacagcgggtaaacttattaccttactttattttttcgcgattttccctattctgttgatttacggtaacggtatcacgaacaccgtagattctttcattgtaaatcaacttggtatggcatcaccaaatcgagtcattctctcttttgtattaattgcggtattgatttccgtgatgttatttaatgaaaaagtgatgttaaaaatcacagaatggcttgtttatccgttagtcttaattttatttgttctttctatttacttaattcctgaatggaatagtgccgtattatatgaatttccaacaacaggtggtttcttaaccactttatggctaaccattcccgtattagtattttcatttaaccattcgccagcgacttcatcgttcacttgctcacaattccgtgaatacaaaacgtttgagggtgcagaacgccatatcagccatacagaaaaaggcgcttcaacgattttattattcttcgtaatgttcttcgtatttagctgtgtattaacactaacacctgaagaattagtggcagcaaaagaacagaatattagtatcttgtctttcttagcaaataaatttgataatccatatatctcttattttggcccgcttgttgcattcttagcgattacaagttcattcttcggtcactatatgggggcacgtgaaggattagaaggcttatatttgaaaatgaaaggcgaatctgtaaatcgtaaaaaactcaattatgcgaccgcacttttcttcttattaaccttatggggcgttgcgattattaatccaagtatcttaggcttaattgaatctcttggcggcccaatcattgcgatgattttattcattatgccaatgtatgcgattcgcaaaatcccagcaatgaaacgctacagcggacgtttcagtaatgtatttgtaacaattatgggactaattgctatttctgcagttgtttatggattattataa

SEQ ID NO: 1120 - DNA, 2169 bp, H. influenzae strain 86-028NP
atgctggatttgacgccacagagtaaaaaaatttcaattcagattggtgggatgacctgccaatcttgtgccaatcgcattgaaaaagttttaaataaaaaaccatttgtgcaacaagcgggagtgaattttgccgtcgaagaagcacaagttgtatttgacgctacgcaagcaagcgaaactcaaattatcgagattatccataaaacaggtttttctgctcatatcaaacaagccaatgaattaccaatagaagaaaatacatcaatcccttggcgattaatcatactttggataatcaatattccatttctgattggaatgcttggtatgataggtggctcccatcacttaatgttaccgccgatttggcaatttgcattagcaagcattgtgcaactttggttagccattccattttattgcggagcaatcggtagtattcgtggtggacttgccaatatggatgtccttgtcagcacaggaacgctcactatttatctttattctgctttcatgttgttttaccacgccgatcatgcaatggggcatgtgtattttgaagcttctgtaatggtaattggttttgtcagtcttggaaaatttcttgaagatcgcactaaaaagcatagcttaaatagcttgagtatgctcttgcaactgacaccgaaaaaagtcactgttttacgtaatgaaaaatggactgaaattgctcttgaccaagtcaatatcggcgaaatcattcgtgcgaatcaaggcgaacgtattgcggcagacggcataattgaaagtggaaatggatggtgtgatgaaagccatttaacgggcgagtctcgtccagaagaaaaacagaaaggtggaaaagtattagcgggggcgatggtaacagaaggttctattatctatcaagcaaatcagcttggtagccaaaccttacttggcgatatgatgaatgcattatcagatgcacaaggttcaaaagcacccattgctcgatttgctgacaaagttgcttccgtgtttgttcctgtcgttttagtgatttcacttgttactttcgcactcacttatattctgacgaatgatagtgtgtcttcactaattcacgcggtatccgtgcttgtgattgcttgcccttgtgccttgggattagccacaccagcagccataatggttggtttaggtaaagcagtcaatgctggcgtatggtttaaagatgcggctgcaatggaggaaaccgcccacgtggataccgttgtacttgataaaactggcacattaacaaaaggagagcttgaaatctctgctttatggcagccacaaagtgcggtgtattctgaagacgatttgtatcgttttgcagcagcagttgaacgacaagctaaccacccaattgcaaaagctattgtgcaagcagcagaacaaaaaatgttagaaattcccaccgcacttttttcaaagatggaagtgggtcaaggcattcaagccgaattagaacaagtgggaacaataaaagtcggtaaacctgattattgcggtttaatcttgcctaaaaatttagaggatatttggcaaattgcgagcattgtcgcagtatccataaatgatgaacccatcggtgcatttgcactgacggatactttaaaaaacgatagcttgcacgccattcaacgcttacaacagcaaaatattgatgtcgtaattatgagtggcgatcaacaatctgtcgttgattacatagcaaaacagctcggcattaagaaagcctttggtggactcagtcctagagataaggcggaacaaatccaaaagctgaaagctcaaggtcatattgtcgcaatggtaggcgatggaataaatgatgcgcctgctttagcttctgcaaacgtcagttttgcgatgaaatcaggttcagatattgcagaacaaacagcctctgcaacgcttatgcaacattcggtgaatcaacttgtggatgcgctttttattgcaagagcaaccttgaaaaatatcaaacaaaatctattttttgctttgatttacaatattctcggcataccccttgccgctttcggttttcttagccctataatcgctggtgctgctatggcgttgagctcaatttccgtattgatgaacgccttaagattgaaaaaagtgcggttctaa

SEQ ID NO: 1121 - DNA, 789 bp, H. influenzae strain 86-028NP
atgaaaactatcacattaaacataaaaggcatacattgcggctgttgcgtaaaaagtcttactcaagttttaactgaattagatggtgtacaatctgctgatgtgcaattagagggtaaagcaaatattacttttgatgaaaatcgagtcaatgttgcacagctgattgaggtcattgaagatgctggatttgacgccacagagtaaaaaatttcaattcagattggtgggatggcctgccaatcttgtgccaatcacattcatcaataaaacaactaacaaggagtaaaaatgaaaactatcacattaaacataaaaggcatacattgcggctgttgcgtaaaaagtcttactcaagttttaactgaattagatggtgtacaatctgctgatgtgcaattagagggtaaagcaaatattacttttgatgaaaatcgagtcaatgttgcacagctgattgaggtcattgaagatgctggatttgacgccacagagtaaaaaatttcaattcagattggtgggatgacctgccaatcttgtgccaatcgcattcatcaataaaacaactaacaaggagtaaaaatgaaaactatcacattaaacataaaaggcatacattgcggctgttgcgtaaaaagtcttactcaagttttaactgaattagatggcgtacaatctgctgatgtgcaattagagggtaaagcaaatattacttttgatgaaaatcgagtcaatgttgcacagttgattgaggtcattgaagatgctggatttgacgccacagagtaa

SEQ ID NO: 1122 - DNA, 387 bp, H. influenzae strain 86-028NP
atgaatattagtgaagccgcaaaattagtaggtttatctacaaaacaaatccgtgattatgaaaaaatggggttaattaaacccgctgttcgcagtttgtcaggctatcgaaattatggagaaagtgatttagaaaggttgcattttattcgacactcacgcaatgttggattttcgttacatcaaatcgcacaattattagcactacaagataatcctaagcgtagctgccgagaagtgaaagtgctaactgctcaacatattgcgacattaaatcaacaaatagaacagttacaaaaaatggtacaaaaattgcagcactggcacgacagttgtcaaggcaatggcaaccctgaatgttcaattttgaatggcttgaacggataa

SEQ ID NO: 1123 - DNA, 318 bp, H. influenzae strain 86-028NP
atggcggattgggacggaaaatatatcagcccttatgcagaacatggcaaaaaaagtgagcaagtcaaaaaaattacagtatccattcccattaaagtactggaaattttgacgaatgaacgcactcgccgccaattgaaaagtttacgtcacgcaactaacagtgaattgctttgtgaagcgttcttacacgcattcacagggcagcctttgcccactgatgcagatttaatgaaagagcgtaatgatgaaattcccgaagatgccaaagtgcttatgcgtgaattaggcgtcgatccagaaagttgggaatattaa

SEQ ID NO: 1124 - DNA, 1263 bp, H. influenzae strain 86-028NP
atgcatttaacagaacttaaaaatacgcctgtttctgatcttgtgaaactcggcgaggagcagatgggcttagaaaatttagcgcgtttgcgtaaacaagatattgtctttgcaatcttaaaacagcacgccaaaagtggcgaagatattttcggcggtggcgtgctagaaattttaccagatggttttggtttccttcgttctgccgacagttcctaccttgcaggccctgatgatatttatgtttccccaagtcaaatccgtcgttttaatcttcaaactggggataaaatcgaaggcaaaattcgtccaccaaaagaaggcgaacgttattttgcacttttaaaagttgatcaagttaatgacgacaaaccagaagtttctcgtagcaaaatcttatttgaaaacttaacaccattacatgctaactctcgtttaagaatggagcgaggcaatggatcaacagaagatttaaccgcccgtattttagatttagcctcgccaattggtaaaggccaacgtgggttaatcgtagcaccaccaaaagcgggtaaaacaatgttgttgcaaaatattgcgcaaagtatcacgcataattaccccgatgtggaacttatcgtattattgattgatgaacgcccagaagaagtgacagaaatgcaacgttccgtaaaaggcgaagtcattgcgtctacttttgatgaacccgcaactcgtcacgttcaagtggcagaaatggtaatcgaaaaagcgaaacgttctgtagaacataaaaaagatgtggtcattttgcttgattctattactcgtttagcgcgcgcttacaatacagtcactccagcttcaggtaaaattttgtctggtggtgtggatgctaatgcgttgcatcgtccaaaacgtttctttggagctgcacgtaatgtggaagaaggcggcagtttaacgattattgcaacagcactagttgatactggttcgaaaatggatgaagtaatttttgaggaatttaaaggtacgggtaatatggaattgcacctttctcgtaaaattgcagaaagacgcgtattcccagccattgactttaaacgctctggtactcgtaaagaagacttactcacaacagcggacgaattacaaaaaatgtggattcttcgtaagattcttaatccaatggatgaagtggatgcaatggaattcttgattgataagctgatgatggcgaaaaccaacgaagagttttttgaagtgatgaaacgttcgtaa

SEQ ID NO: 1125 - DNA, 693 bp, H. influenzae strain 86-028NP
atgatttacttcacaatgtttttattaggcggcatcttagggatcgcattgtggttctacctatctggttttattacgcatttgcagcaagagatttatgcgacttacgttgaattatttccacaaaacagttctccatttcaaccgcactttgcctctattcaacaaaaaaagtgcggtcatattttgaggtatttttttagtattggggttggatttatatttttacaaattgccttcaaagattctatttttactgtatggatcggactcacacttattattctttggacaatcagttatcttgattggcactatcaacttatttctacgacaccctgtttatggttacttactctcggtttatttggcgcagacaataacttttcattgctaacgttatctgaaagcataaaaagtgcggctagtttttttattgttttctacgcaatctattggattgcaaaatgttattatagaaaagaagcctttggacggggagattattggctagcaatggcattaggaagttttattcatttagaaaccttaccgcactttttattattagcctcagtgcttggaatatgtttttcgcttattcataaaaagaaaaaagaatttataccttttgccccttttatgaacttatcggctatcattatttatctcgtcaaatattacggatattaa

SEQ ID NO: 1126 - DNA, 1221 bp, H. influenzae strain 86-028NP
atgactaaaaaactcttttattatcaaggtagtaacgcattaaatcagaaacaaaaaggctcaattattgcggatacgaaacaacaagcgcactttcagttaataagccgcgggcttactcacatcaaattacaacaaaactggcaatttggggcaaaacccaaaaattcagaaatcagtgaattactcaatcaattagcgacattgctacagtccgtaattccgttaaaaaacagcctacaaattttgcaacaaaattgtactcaaattatgctcaacaaatggcttgaacgactgcttcaatccattgaatctggcttagcattctcacaagccattgaacaacaaggaaaatatctcacacaacaagaaattcaactgattcaagtgggagaaatgacaggaaaacttgccgtagtttgtaaaaaaatagccacgcaccgtagtcaatctttggctttacaacgcaaattacagaaaattatgttatatccctcaatggtattgggaatttctctattattgacactcgcattactgctttttatcgcgcctcaatttgctgaaatgtacagtggcaataatgcggagttaccaacaataaccgcaatattgctctcaatatctaatttccttaagcaaaatattggcattttgctatttttcgttttgagtttttttctattttattatttctatctaaaacgccagacttggtttcatcaaaagaaaaatcaacttatttctatcacgcctatttttggcacaattcaaaagctttcacgtttagtgaactttagtcaaagtttacaaattatgttgcaggccggcgtaccgcttaatcaggcactagacagttttcttcctcgcacacaaacttggcaaaccaagaaaacgcttgtaaacgatatggtattagataaagaagtgcggtcaattttgcaatgggtttctcaaggctatgcgttttctaatagcgtaagtagcgatcttttcccgatggaagcacaacaaatgctacaaattggcgaacaaagcggaaaactcgctttgatgctagagcatatcgcagataattaccaagaaaaacttaatcatcaaattgacttactctcacaaatgctagaaccattaatgatggtaatcatcggcagtctgattgggattattatgatgggaatgtatttacctatctttaatatgggatcagttattcaatga

SEQ ID NO: 1127 - DNA, 1395 bp, H. influenzae strain 86-028NP
atgacgagctatgctttacttcatactcagcgtgtaaccgctcaaaatggcgagatctttacgatctcgccagatttatgggaacgcaatcagcagcaacaatccttgctcttgcggtattttgctttgccacttaaagaagaaaataatcgtctttggctaggggttgattctctctccaatctttcagcttgtgaaaccattgcgtttataacaggaaaacctgtcgaaccaattttgttagaaagcagccaactcaaagaactgttacaacaacttactccgcaccaaatgcaagtggaagagcaagttaaattctatcaacatcaagaaacccattttgaacaagaagatgatgaacctgttatccgcttacttaatcagatttttgaatctgccttacaaaaaaatgcctctgatattcatttagaaaccttggctgatcagtttcaagtgcggtttagaattgatggtgttttacaaccacaacccttaataagcaaaatattcgccaatcgtattatttcacgcttaaaattactggctaaattagatattagtgaaaatcgacttccacaagatggacgatttcaatttaaaaccactttttccgatattcttgattttcgcctttcaaccttaccaacccattggggcgaaaaaatcgtgttgcgagcgcaacaaaataaacctgtagaacttagctttgctgaactgggtatgaccgaaaatcagcaacaagcatttcaacgctcacttagccagccacaaggattaattttagtaaccggccccacaggaagtgggaaaagtatctcgctttacaccgcacttcagtggctaaatacgcctgataaacatattatgaccgctgaagatcccattgaaattgaacttgatggtattattcaaagccaaattaatccgcagattggattagattttagccgtctattgcgtgcttttttacgtcaagatcccgacatcattatgctaggtgaaattcgagatgaagaaagtgcaaggattgcactacgtgccgctcaaacgggacatttggtgctttcaactttacataccaatgatgcaatatctgccatttctcgcttacaacaactcggtattcaacaacatgaaattgaaaacagtttactactcgtcattgcacagcgtcttgtacgaaaaatctgtccaaagtgcggtggaaatttaataaattcttgtgattgccatcaaggttatcgagggcgaatcggcgtgtatcaatttctacattggcaacagaatggctatcaaacggattttgagaatttacgagagagtggtttggaaaaagttagccaaggcataacagatgagaaagaaattgaacgtgtgttaggtaaaaactcatga

SEQ ID NO: 1128 - DNA, 450 bp, H. influenzae strain 86-028NP
atgaaactaacaacacagcaaaccttgaaaaaagggtttacattaatagagctaatgattgtgattgcaattattgctattttagccactatcgcaattccctcttatcaaaattatactaaaaaagcagcggtatctgaattactgcaagcgtcagcgccttataaggctgatgtggaattatgtgtatatagcacaaatgaaacaacaaactgtacgggtggaaaaaatggtattgcagcagatataaccacagcaaaaggctatgtaaaatcagtgacaacaagcaacggtgcaataacagtaaaaggggatggcacattggcaaatatggaatatattttgcaagctacaggtaatgctgcaacaggtgtaacttggacaacaacttgcaaaggaacggatgcctctttatttccagcaaatttttgcggaagtgtcacacaatga

SEQ ID NO: 1129 - DNA, 561 bp, H. influenzae strain 86-028NP
atgcaaaaactaaaagatattgaacaaggtatattggattgtcggcaaattcagtcacctcacttcgataaacgcccaaatccacaggatatttccttattggttattcattatattagtctgccgccagaacaatttggcggcggatatgtggatgatttttttcaaggaaaattagatcctaagattcatccttattttgcagaaatttatcaaatgcgtgtttcagcacattgtttgatcgaacgaaatgggcgaattacgcaatatgtcaattttaatgatcgcgcttggcacgcaggcgtatctaattttcaaggacgagaaaaatgtaatgattttgccattggaattgagctggaggggagtaatgaacagccttttaccgacgctcaatatttttcattgcaagagcttactaacgtaataatgaaaagttacccgaagattacaaaagatcgaattgttggacattgcgatatttcgccaggacgtaagatcgatcctggtcaatattttgattgggaacgttatttatccagtgtaaaacaaactgtataa

SEQ ID NO: 1130 - DNA, 900 bp, H. influenzae strain 86-028NP
atgaacgacgaacagcaaaattcaaaccaacctgaaaatacgaaaaaaccttttttccaatctttattcggtcgcttttttcaaggcgaattaaaaaatcgtgaagaacttgtggaagtgattcgcgattcagaacaaaacgatctaattgatcaaaatacgcgtgaaatgattgaaggcgtgatggaaattgcggaacttcgtgttcgtgatattatgattcctcgttcacaaattatttttattgaagatcaacaagatttaaatacttgtttaaacacaattattgaatccgcacattctcgttttcctgtgattgccgatgccgatgaccgcgataatatcgtgggcattttgcacgcaaaagatttattaaaatttttacgtgaagatgccgaagcatttgatttatcttcattattgcgccccgtcgtgattgtgccagaaagcaaaagagtggatcgtatgttaaaagattttcgctctgagcgtttccatatggccattgtggtggatgaatttggtgcagtgtcggggcttgttactattgaagatattttggaacaaattgttggcgatattgaagatgaatttgatgaagaagagattgcggatattcgtcagctttctcgtcatacttatgcagtgcgtgcgctcaccgatattgatgatttcaatgggcaatttaatacggattttgatgatgaagaagtagataccattggcggtctgattatgcagacttttggttatttaccaaaacgtggggaagaaattattttgaaaaatcttcaatttaaagtgacttctgcagatagtcgtcgattaattcaacttcgcgtgacagtgccagatgaacatttggcagaaatgaataatgtagatgaaaaatctgaatag

SEQ ID NO: 1131 - DNA, 1569 bp, H. influenzae strain 86-028NP
atgaaaaatctgaataggattttattatcaattaaatttatgaataaatatttaacttattttattgcttttatatcgggtttagtcggtgtttttgccttttcgccatttgattattggcctttagcctatgtgtctttactcggtttactttatgtcgctaaaaatcctaaaaaatccaccgcacttttatccactttcttgtgggcgatgggatttttctgctttggagtaagttggcttaatgttagtatccatcaatttggtggcgcgtcgttaggagtgagttatttccttgtcggtttgcttgcggcttatcttgcgctatatccaatgctctttacctatttagttcagcgtttcaaagtgcaaagtgcggtaatttttgccgtgatttggacattgacagaatttttacggggttggatttttactggttttccttggcttcagtttggttatacacaaattgacagcccattttatggtctcgccccgatttttggggtaacaggattgacattctttaccctttgggcaagtgcggtcatttttaatctcgtttcatctttgtttaaaacgaaaaattttaaattagttttagcgaatgctttgttattgattattgtagggggattaagtgcttattcatcgcgaattcactttgtaaaatctgttgaaaataaggcaatttcagtcacgcttgcgcaaggcaatattgaacaaaatcttaaatgggatcctaattatttctattctactttggcaatttatcaaaaattaatcgcagaaaatcttggtaaaaccgatttaattattttgcctgaatcagccttaccaacccttgaaaatgcaattacaccattttttgaaaaattagagcatgctgctaaagaaactaaaacggagattatgattggaacggtattccaagatacaaaatctggtaagttattaaattcaattatgactactggaaacccagattttccttatcaaccagatacgccaaatcgttataataaacatcatctcgtgcctttcggggaatatgttccgctagaaagtattttgcgaccgcttaattcagtgtttaatttaccaatgtcagcatttcaaagtggagaggctgttcaaccctctttaatcgcaaaaaaacgtgctttttcgccagcaatttgttatgaaattattttcggcgagcaagtgcgacaaaatttgaaacaagatacggattatttgctcaccttatctaatgatgcgtggtttggcgattctattgggccttggcaacatttacagatggcaagaatgcgcgctttagaattaggcaaaccgcttattcgtgcaacaaatacggggatttcagtttttgttgatgcgcaaggtaaggtattagcacaagccccgcaatttattgaaacaactttgacttataaaattgcacctgcggaaggcaaaaccccttattctgtgttaggaaatatgcctttgtatgctttatctttattgtttttactcttgcacagtatgatggcgtttattcgtcgtaagatgaatatcttataa

SEQ ID NO: 1132 - DNA, 738 bp, H. influenzae strain 86-028NP
atgcgcataccaagaatttatcatccaatatcccttgaaaatcaaactcaatgttatctttcagaagacgctgcaaatcacgttgctcgagtgttaagaatgacagaaggcgaacagcttgaactctttgatggttctaatcatatttatccagcaaaaattattgagtcaaataaaaagtccgtaaaagtagagattttggggcgtgagcttgcggataaagaatcccatttaaaaatccatttaggacaagtgatttctcgcggagaacgaatggaatttactattcaaaaatccgtagaattaggggtaaatgtgattacgccattatggtcagaacgctgtggcgtaaaacttgacactgagcggatggataaaaaaatccaacaatggcaaaaaattgcgattgcagcttgtgagcaatgcggtcgtaatagcgtgccagagattcgtccactgatgaaattacaagattggtgtgcagaaaatgatggtgcattgaaattgaatttacatccacgcgcgcactattctattaaaaccttaccgactattcctgctgggggtgttcgcttattaattggctcggaaggtggattatcagcacaagaaattgcccaaactgaacagcaaggatttactgaaattttattaggaaaacgtgttttacgcactgaaactgcatcacttgcagcgataagtgcattgcaaatttgttttggggacttaggcgaatga

SEQ ID NO: 1133 - DNA, 561 bp, H. influenzae strain 86-028NP
atgatggaattacaaggaaaatttttgatcgcaatgccacatttagacgattattttaatcgcacggtggtgtttatgtgtgagcataatgaacagggttcaatgggtttggtaattaatcagccgacagatttaagcattgcggaactttattcaaaactcaattttatgatgaaaaatgaccgcacttttggtaatgaaatggtggttgcgggtgggcctgtgcatacagaaagagggtttattttacataagaatacgcttaatgcttttcaacatacttacaaagtcacaaaggaactttcaatgacaacctccgctgatgtggtggaaacgctaggttcaacttttgcacctgaaaaatatcttgttgcgctaggatgttcaagctggggggctggtcagttagaaaaagaaatcagagataatgcgtggttggtggtgtcatctaacgatcaaattttatttgatatgccctatgaagatcgttatgctgcagccaatcagttacttggtattcatccttataattttgcgttagcgcaagtggggcatagttaa

SEQ ID NO: 1134 - DNA, 420 bp, H. influenzae strain 86-028NP
atgggaattaccgctctggcttttgattttggcactaaaagtatcggttgtgccataggacaaagtattactggcacagcacaagccttgcccgcttttaaggcgcaagatggcatcccaaattgggaagcgatcgaaaaatgtttgaaagaatggaaaccagatgttgtcattgttggtcttcctttaaatatggacggaacagaacaagatctcactctacgtgctcgtaaatttgcaaatcgtttacaaggtcgttttggcgttaatgttcatttacaagatgaacgattaaccaccacgcaagctcgtagtgagatttttgaacgtggtggttttaaagcattaaaaaaaggcaaaatcgatggagtgtcagcttgtttaattttagagagctggtttgaatacgctgaatattag

SEQ ID NO: 1135 - DNA, 926 bp, H. influenzae strain 86-028NP
atgagttataaagttaatttttggttcaaaaatttaatgacttatagactgactaaaccgctagattgggatcttacacaactacaaactcaactagaagattgtcaattccatccctgcggtgctcaagatcaaagtaaatttggctggtcagccccattacgaggttctgatttactctatttttctgttggaaaacaaattctattaatcgccaaaaaagaagaaaaaatcttgccggcaaatgtggtcaaacgtgaacttgatgaacgcattgaaagccttgaaaaaaagaaaatcgcaaacttaaaaaggtagaaaaacaaacattaaaagatgatgtcgtgatgaatttattacctcgtgcatttagtaaaaatcagcatacggcactatggattgatatggaaaataatcttattcatattgatgccgcatcaagtaaacgcgcggaagatgcgctcgcattactgcgtaaatccttaggttcgctccctgtcgtgcctttagcctttgctaatgaacctagcacgattttaaccaattggatccttcaagataatttgccgcattggttacttgcattagaagaagccgagcttcgtggcagtcaggaagacagcgttatccgttgcaaaaaacaacctttagaaaatgaagaaattctcgctcttctgcaagatggcaaaaaagtagtaagtaaattagccttagaatgggaagataccttaactttcgtttttaacgaagattgcacaatcaaacgtttaaaatttgcagatactgtacgggaaaaaaatgatgatattctgaaagaagattttgcacagcgtttcgatgcagattttgtactgatgactggtattttagccaaactcaccgaaaatttattagatgaatttggtggcgaaaaagcaagattataa

SEQ ID NO: 1136 - DNA, 1212 bp, H. influenzae strain 86-028NP
atggctaaaaaagtaaaaccacttgttgacactgaaatcaagaaagcaaaagcatcaaacaaaccatatacattgactgatggttatggactatttctaatcatttcaccaacaggttcaaaatcttggcggtttaattactatcgacctataacaaagaaacgagcaaaaatttctttaggcctatatccagcaattacactatcaaaagcaagggagttgagagaacaatatcgtcaattactagctaataagattgatccgcaagaatacataaaacagcatgaattactgcaattacaacgacaaaacaatacattttttgccatatcaactcaatggaaacaaaaaaaagtttctgaaatcaagtctgtaacacttaaaagccgatggagaacgctagaaaaatatgcatttccatatttaggcgataaccctattgctgaaattacaccacaacagttacatgatacagttataccattatttgaacgaggagtttctcacactgggaagcttgttattgcattagttaatgaaatcatgaattttgctgttaacaaaggtattattgagtttaataaatgcatcaatgtatcaaaggcttttaatgtaaacagaacaacacatcatccaactattagacctgaaaaactacctgaattcatgtctgcgttacgtcattcacatattgaccttatggtgaaatatcttattgaattctcccttttgactatcacccgtccaagtgaagctgcaaatgcacaatggaatgaaattgattttgagaaatcgctatggaatatccctgctgaacgcatgaaaatgaaaaaagctttcaccattccattatcactacaagtgcttaaaatacttaataagctaaaaaacatttcaggccgtagtcgttttatttttcaaagccaacgttatcctgaaagaccattacattcaagctctgccaatgcagcaattaaacgcgttggttataaagatcaattaacatcacatgggctacgttctatcgcaagcacctatcttagcgagacatttaccgaaatgaatctggaaattcttgaagcttgcctttctcatcaaagcaaaaatcaagttcgtaacgcctacaatcgctcaacctatcttgaacaacgaaaaccattaatgaatgcttggggagattttgttgaagaatgtatgaaaaaaagtatctaa

SEQ ID NO: 1137 - DNA, 435 bp, H. influenzae strain 86-028NP
atgggtataagaatgaacgtacatgaaaagatcagaaaactacgtgaaacaaagcattggtcacaagaagagatggctgaaagaatgagtatgtcattgaatggctatgcaaaaattgaacgtggtgaaacgaaattacatctggataagctagagcaaattgcacagattttagatatagatattgttgaattgattaattctggtgaacgaaatgtcttcgttcaattcaatgagaattctcattttagttcgtcatttcagggagacaatgagaaatctctattgattgagattgaaaaactaaaattatcgttatcacattgtcagcaattattggaagaaaaagaaggtttgttgaataagctagtagagcaaaaagataatgaaataaagctactgagagaaatggtagagttactgaagaaaggttag

SEQ ID NO: 1138 - DNA, 423 bp, H. influenzae strain 86-028NP
atgcttaaatctatacttaaaccaataggacatatactaaaacttctaataaaaactgctttattcttactttcattattattcatactaatgctaattatcggattcgttgataacaaaaaaattccaaccgaatttattgtttttgggattctaggtatttgttacatttgctacacatttaattcttgggcaaataagcctgaagtctgtccagtctgtaaatcaggcaaaattgaattggattcaattaaagaaattgaccgctggctgggaaaaactaaagtgcgtgaaagaatggcatctggaaaaacacgagaacgatatattcaatgcacgaaagtaaaaaaacgatatacatattgttgccaaaatcctaattgcaagcatacatatactaaaatacgggaagaagaattatag

SEQ ID NO: 1139 - DNA, 774 bp, H. influenzae strain 86-028NP
atgttttcaaccgctataattgaaaaaattaattattacatctattgtcttgttgaccctagaaatcaaaatatcttctatattggtaaaggtattggcaatagagtttttcaacatgcacaaggtgcattaacttgcaaaactaatgaaaatgataaaatatcactaatcaatgatatacataaagatggacttgaacccttatactatattttaagacataatatcaaggaggaaaaacaagcacttgaatatgaggctttagcgatcgatttattatccattgttaaacctaatcaacaaccattaaccaatattcaaggtggcacacattcttctgaaaaaggtttaatgtcattatcagaactaaaacatatatatgacccacaagaattaaaaacagatttacctgttgttttaatcacaattaataaaaactataaaaaattaaaacaacaaataaaatcaggcgaaattgataaatcgcaaattgaaaaagaaatttacgaacgcactcgcggctattggaaaacgggttcacgccgtgaaaaagccaaatatgctattgcagtttatcgtggctggacattagcagcctacgaaatttcatactggattgaagcacctattgagcgtcaaggtcgttggggttttatcggtaaacttgtgccgaaagattctccaatttatcaagaacttgttaataaattaacctattcatcaaataatgattacaaggcgccacaaaatccaataacttatcgtaattgttaa

SEQ ID NO: 1140 - DNA, 192 bp, H. influenzae strain 86-028NP
atgatgaaaaaatttccaaattttaaaccgcattctgacacggaaactgaagaattaattagcttactatttagaaaactcgatattgatgaactaatctttctgctacgtgttttacaacgtgatatccgtgcaaaatatacactcacaaaaataattaaaaaaaatatcaatttaaagttagattcataa

SEQ ID NO: 1141 - DNA, 153 bp, H. influenzae strain 86-028NP
atgaaaatacaagataacgtcggctattacttcacaattcaagatcttcaagatcgtttacgtgtaagtcgttcaactattctgcgattaattgaatcgaaaaaattaacatctatcaaatttggacgacaagttcgtattcctgaatcttag

SEQ ID NO: 1142 - DNA, 891 bp, H. influenzae strain 86-028NP
gtgcagttataccctaaagatgttgcattaactcataagtatattcagtttaatgatctgtttattaaatttatggtgttagatctagatcgggaaaattctgcaatggattgggaattgttaggacttccaagtcccaatatagtggtacaaaatagattaaacggtcgatgtcattatatctatgcgttggaggtacctatttgtaacacaaagaatgctcgatttaagccaataagttattttaaaaagatacaacgagcttatattgataagttaggagcagatcaacactatgttggtgtattcactaaaaatccaaactcaaatttttggagaacatttgtatttaatgtacctaaatatactctggattatttagctgattttgttgatttatcaaataaacctgtattttatctaaatgataatgaagatattgaaggtcggaattgttctttatttaatcagatcaaaaaaattggttatcgtgaggttctgaagtttaaatgttcaggtaaacaattagaacaatttaatcagtatttattatcttcattagagttattaaatcagaatcataatccaccattaccatacagggagttaaaaggaattgctagaagttcatctcgttggatttgggaaagattttctgaatcatcgtttcaacaaattcagtcaaatcgttctcgaaaacgatgggaaaagcaacaaattatcaagaaagagttgtttaatcaatttggagctaataaacctaatatgtcgttaaagcaaatagcagaacaatttagtattagtgtaagctcattgaatcgttggtcagaagaattcggatgggtgaaatcacaaaatgacttaaaaagtaaatatgagaaaatagtatag

SEQ ID NO: 1143 - DNA, 816 bp, H. influenzae strain 86-028NP
atgcaacacaaattgattgcctttattggtggcggcaatatggcacaagctattattcttggattattgaaacaaggttatcctgccgagcaaattattgtgaatgatccaaatgaagaaaaaagagcattttttgccaatcttggcgtggcaacttcagaaaataatgtggaaagtgcaatcaaagctgaggttgtgttgcttgcggtaaaacctcaaatgatggctgatgtttgtttgccactaagtgcggtggatttttccgataaattgttaatttccattgctgcaggtatttcaactgaacgcttgaacgcattaattccaagcgtaaaatcgatagtacgcgtcatgccaaatacacccgcattagtgggggaaggcatggcggggttatttgcaccgaaaaatacgagtgaaaattaccgcacttttgcacaagatttattgggagcagtgggaagaacggtttgggtggatgatgaaactcaaatgcacgcagtcaccgctgcttcaggaagtagcccagcctatttctttttaatgctggaagcgatgcagcaagccttaatcaaaatgaatatagatgaaaaaacagcacgtgaattagtccagcaatctatgcttggtgcagcaaaaatggtgaccgaaaatccgcaaattgcactttcaactttgcgtgaaaatgttacctcgaaaggtggcactactgcggcagcgttagcagtatttgacgcacaacattttaatcaaacaatagagcaagctatgcaggcttgtttgtctcgttcacaagaaatggaaactttattctga

SEQ ID NO: 1144 - DNA, 1167 bp, H. influenzae strain 86-028NP
atgcaagttcgtcctttttattggctcgcactgagctttctaggttactactgcgcttatggcgtatttttgcctttctttcccgcatggttaaaatcacaacaatatggggaggaaatgattggtttggttatcggcagtgcttatattttccgatttgcgggcggattatttttttcatcgctgattaaaaaagccaatcatattattatttccttacgcctattggcgttagcatcggcaattattatggcggctatgagtttagttgcgcataatttttggttgttgtttattgctatcggtttgtatgcttctgtgaattcagcaggaatgccgattggggattcgttggcatccacttggcaacgccaaatcggcttggattacggcaaagtccgtttgattggttctgctgcttttattcttggtgtagtagtatttggtggcatgattggctgggttggcgagcaaaatatcgtgtggattttaaccgcacttttatctttctataccatcattcagcttttaaaaccgaccattcccccaaaagatgaaatacctgaaggtggcgttcaaaatgatgttggttttattgctttactgaaaaatccgatgacattacgagtcatggttgcagtagggctgattcaaggctctcatgcggcttattatgtttacagcacgatttattggacaagtattgggatctccgtttctcaaactagcttactttggggcattggcgtattagcggaaattgtattatttttcttctctcgtcgtttatttcaaaatatttctatcagcgtactgctttatatttctgcgcttgcgtgcatcggacgctgggctgtaataggatatattgacgatttctggttgatattcttattgcaacttatacacagtttaacctatgccgtttgccattatgcgattgttcgctatatcaccacgcaaccgcaaagccatattgcgaagttacaaggtttgtataatggtttatccaatggtgtgctcattgctattttcactgcgattgctggcatgatttatccaacgtcgccagcgatgacatttgtatttatgagtatcattgcagctgcagcattttttgtgattccacgcaagttaaatgcctttttgattgttcagcataaatag

SEQ ID NO: 1145 - DNA, 894 bp, H. influenzae strain 86-028NP
atgaaaaatcttgcgctcattgatttgtttcttaacgaatattggattgaaaaagggctttcagaaaatactgttcaatcttatcgtttggatttaaccgcactttgtgattggttggataaaaacgacttgtctttggaaactttagatgctgttgatttgcaaggttttctaggagagcgtttggagaaaggttacaaagccacgagcaccgcacgaatgttaagtgcaatgcgtaaacttttccaatatttatatcgggaaaaatatcgagtggatgatccaagtgcggtgctaagttcgcctaaattacccagtcgcttgccaaaatatttaaccgagcaacaagtgtcagatttgctcaatacgccagatgttaaagtccctttggaattgcgtgataaagcaatgttagagttgctttatgcgacggggcttcgtgtaacagagttagtttcgcttacgattgaaaacatgagcgtgcaacaaggcgtggtgcgagtgattggtaaagggaacaaggaacgtattgtgccaatgggggaagaagctgcttattgggttcgtcaatttatgctttatggtcgtcctgtgctattaaatgggcagagttctgatgttgtgtttccaagtcagcgcgcacagcaaatgactcgtcaaactttctggcatcgtgtaaaacattatgccattctcgcggatattgatgctgatgcactttcccctcacgttcttcgccatgcttttgccacccatttagtaaatcacggtgcggatttacgcgtggtgcaaatgttgttgggtcatacagatttatctacaacacagatttatactcacgtggcaaaagaaagattgaaacgattgcatgaaagatttcatcctagaggataa

SEQ ID NO: 1146 - DNA, 288 bp, H. influenzae strain 86-028NP
atgaaaaaaatcacgcttttttttaccgcacttttatgcttattttcaacttctgttttagccgaacctaattcaatacctaaacaatgtgaacaactatttaaagaaacagagaatttgattgcccaagcagaaaaacaacctggaacccacattcaagtaaataaaatcaaaagtaaactaaaccaaagcaaacaacaaattcttcaaatggaattagcgactcagttaaaaagttgtgaagtgggtttagcaaaattaagtaacttgaaaagttatagtgagtaa

SEQ ID NO: 1147 - DNA, 1008 bp, H. influenzae strain 86-028NP
atgattgaagcagatagaattattagcgggcaagctaaggttgatgaagatgttatcgaccgtgctattcgtcctaaactattagcagattatgttgggcagccgcaagtacgcgagcagatggatattttcatcaaggcagccaaactacgtcaagatgccttagatcatttattgatttttggccctccaggtttgggaaaaacaacgcttgctaatattgtggcaaatgaaatgggcgtgaatattcgtacgacatcagggcctgtattagaaaaagcgggagatttagccgcaatgctaaccaatcttgaaccgcatgatgtgttatttattgatgaaatccatcgactttcccctgctattgaagaagtcctttatccagcaatggaagactatcagttggatattatgattggcgaaggacccgctgctcgttccattaaattagatttgcccccttttactttggttggtgcgaccactagagcgggttctttgacttctccattgcgtgatcgttttggtattgtgcaacgtttggaattctattctgtagaagatttaacatctatcgttgcaagaagtgcggactgtttaaatcttgaattagaacaacaagccgcttttgaggtggctcgtcgttcacgaggcacgcctcgaattgcaaaccgtttattacgacgtgtgcgtgattatgcagatgtacgtaatggcggtattatttctataaatgtggcaaaacaagcgctttcaatgctagatgtagacgatgctggatttgattatttagatagaaagttgttgtctgcagttattgagcgttttgatggtggccctgtggggctagataatcttgctgctgcaattggcgaagaacgtgataccattgaagatgttttagagccttatttgattcaacaggggtttctacaaagaacgccgcgtggccgtattgcaacatcgcaaacttatcgtcattttggtttgcagaaattatcagactag

SEQ ID NO: 1148 - DNA, 615 bp, H. influenzae strain 86-028NP
atgatcggtcgcttacaaggcattcttttagaaaaacaacctccagaaattttactcaatgtgcaaggcgtaggctatgaattgcttttgccgatgacgagtttctatgatttaccagaaattggacaagaaactactttattcacccatcttgttgttcgggaagatgctcacttactctttggatttgcccagaaaacagaccgcactttatttcgtgaattaattaaaacaaatggggttgggcctaaattagccttagcgattttatccgccatgtcggtcgaacaatttgcttacgcaatagagagagaagaactttctaaactcactaaaattccaggtgttggcaaaaaaacagctgaacgtttgttagttgaactcaaaggtaaatttaaaggcataaaacaaagtgatttctttgtagaaagtacgcatattccattatccccatctattgaatcccactcggaaagttcatctgatgaagcaatttcagccttgattgctttaggttataaacctgcagaagcagaaaaaatggtaaaacgcgttgctaaacctgaattaaccagtgaacaagttattcgtgaagcattaaaagccgcattgtag

SEQ ID NO: 1149 - DNA, 573 bp, H. influenzae strain 86-028NP
atgagcattattttaggtattgaccccggctctcgcgtaacgggttacggtgtgattcgccaaacagggagacatttagaatatctcggtagtggcgcaattcgtactcaagttgaagatttacccacccgtttgaaacgcatttatgctggagtaactgaaatcatcacgcaatttcaacctaatatgtttgcgattgagcaagtgtttatggcgaagaatgcggattcagcattgaaacttgggcaggctcgcggcacggcgattgttgcagcggtaaataatgatttacctgtttttgaatatgccgcacgtttagtaaaacaaacggttgtgggcattggttctgctgataaagtacaagtgcaagaaatggtgactcgtattttgaagttatcagataaacctcaagccgatgccgcggatgcgttggctattgcgattacacacgctcattctattcaacattctttacatattgccaattctgtgaaaatgacagaaacgcaagaaaaaatgaccgcacttttaaagaccagatatagccgaggacgctttagattaaaaatttaa

SEQ ID NO: 1150 - DNA, 741 bp, H. influenzae strain 86-028NP
atggcaggtcatagtaagtgggctaatattaaacaccgcaaagcagcacaagatgcacaacgcggtaaaatttttactaaattaattcgtgaacttgttaccgcagctaaaattggtggtggcgatgtgagtgctaacccgcgtttacgtgcagcagtagataaagcacttagcaacaatatgacgcgcgatactatcaaccgtgctattgatcgtggcgtaggtggtggcgatgataccaatatggaaaccaaaatctatgaaggttatggcccaggcggtacagcggttatggtggaatgtttaagtgataatgcaaaccgtacgatctcacaagtacgcccaagttttactaaatgtggtggtaacttgggaacagaaggttctgtgggttatttatttagcaaaaaaggtttaatcttaatcgcagaagcggatgaagatgccttaactgaagcggcaatcgaagcgggtgctgatgatattcaaccacaagatgatggttcatttgaaatctatactgcttgggaagatttaggttcagtgcgcgatggcattgaagcagctggttttaaagtacaagaagctgaagtaacgatgattccatcaacaaccgtcgatcttgatattgaaactgcaccaaaattacttcgtttaattgatatgttggaagattgtgatgacgtacaaaacgtatatcacaacggagaaatctgtgacgaagtggcatctcaactttaa

SEQ ID NO: 1151 - DNA, 474 bp, H. influenzae strain 86-028NP
gtgcggtcagatttgaccgcatttttaatgatgcaatacaaaaataatcaatctgttcttgttgtaatttacgctaaaaatacaaaccgagttttaatgctccaacgccaagatgatcctgatttttggcagtctgttactggcaccattgaaagtggtgagacaccaaaaaaaacagcaattcgtgagctatgggaagaagtgcggttagaaatttcggaaaattccaccgcgctttttgattgcaatgagagcatagaatttgaaatttttccacatttccgctataaatacgcaccgaatattactcactgcaaagaacatttgtttttgtgtgaggcggaaaaagaatttattccagtattgagtgagcatttggcatatcaatgggtttcccctgaacaagcaatccaaatgacaaaatcttccaataatgcggaagcaattagaaaatatattcttaaagataaatag

SEQ ID NO: 1152 - DNA, 1767 bp, H. influenzae strain 86-028NP
atgatgcgtacacattattgcggagcattaaaccgtaacaatatcggacaagacgtaacattaagcggttgggttcatcgccgtcgtgatttaggtggcttgatttttattgatatgcgcgatcgtgatggcattgtgcaagtttgttttgatcctaaatatcaagatgcattgacagcggctgctgggttacgtaatgaattctgtattcaaattaaaggtgaagtgattgcgcgtcctgaaaaccaaatcaataaaaatatggctacgggcgaagtggaagtgttagcgaaagaattacgcatctacaatgcttctgatgttttaccattagacttcaaccaaaataacaccgaagaacaacgtttaaaataccgttatttagatttacgtcgtcctgaaatggcgcagcgtttgaaaacccgtgcaaaaatcaccagctttgtgcgtcgctttatggatgataatggtttccttgatattgaaactccaatgcttaccaaagcaacgccagaaggcgcgcgcgactatttagtgccaagccgtgtgcataaaggcaaattctatgcattgccgcaatcaccacagcttttcaaacagcttttaatgatgtctggttttgaccgctattatcaaatcgtaaaatgtttccgtgatgaagatttgcgagcagaccgtcagcctgagtttactcaaatcgatgtggaaacttctttcctaactgcgccagaagtccgcgaaattatggaacgtatggtgcacgacttatggcttgataccattggtgtagatttaggtaagttcccagtgatgacttggcaagaagcaatgcgtcgttttggttcggataagccagatttgcgtaatccattagaaatggtagatgtagcagatattgtcaaagatgttgaatttaaagtatttaatgagccagcaaacaatccaaatggccgtgttgcagtcattcgagtaccaaatggtgcagaaattactcgtaaacaaattgatgaatatacacaatttgtaggcatctacggtgcaaaaggtttggcttgggcaaaagtaaacgatattaatgctggtcttgaaggcgtgcaaagtccgattgcgaaattcttaaatgaagaggtatggaaagcgttagcagaacgtgtgaatgcacaaactggcgatattttattcttcggtgcagacaaatggcaaacgaccactgatgcaatgggtgcgttacgtttgaaattaggttgtgatcttggcttaactcgtttagacgaatggcaaccgctttgggtcattgatttcccaatgtttgaacgtgatgaagaaggtaatcttgcagcaatgcaccatccattcacttcaccaaaagatttcagcccagagcaattagaggctgatccaacaagtgcggtagccaatgcttacgatatggtcatcaacggctacgaagtgggtggtggttctgtgcgtatttttgatccgaaaatgcaacaaactgtgttccgtattcttggtattgacgaagaacaacaacgcgagaaattcggtttcttattagatgcattaaaattcggtactccaccgcatgctggtttagcattcggtttagaccgtttaaccatgcttttaactggaacagaaaacattcgtgatgtaattgccttcccgaaaaccacggcagcagcgtgcttaatgacggaagccccgagttttgtaaatccgcaagcattggaagagttggcaatttctgtcgttaaagcagaataa

SEQ ID NO: 1153 - DNA, 519 bp, H. influenzae strain 86-028NP
atgttatttatcaatattacttttgcctgtattttagcgatccgtttttacagtctgtctatttcaattcgtcatgaaaaagcactcattgcaaagggtgcaatacagtatggtaaacgcaattccacactgttgtccattgcccatgttgcattttattttgcggcgatcattgaggctaataagcaaaacctgtcatttaatagcacttcacaaatagggttggcgattttaatttttgctattgcaatgctattttatgtgatttatgagctaaaagagatttggacagtaaaaatttatattttaccagaacatcaaattaatcgctctttcttgtttaaatacgtacgtcacccaaattatttcttaaacattattcccgaattaattggtttatcgcttttctgtcaggctaaatataccgcattggttggactacctatttatttgcttatcttagccgtgcgtattaaacaagaagagagtgccatgtcgcatttatttcctaaatcataa

SEQ ID NO: 1154 - DNA, 726 bp, H. influenzae strain 86-028NP
atggtaaaagatactctattttctacccccattgctaaattgggggatttcatctttgacgagaacgttgctgaagtctttccagatatgattcaacgttccgtgcctggctattccaacattattacggcaatcggtatgctggcagaacgtttcgtcacggctgatagtaacgtttatgatctaggttgctcacgaggagctgccacactttctgcacgtcgaaatattcatcaacccaacgtaaaaattattggtatcgataattctcaaccgatggttgaacgttgtcgccaacatattgcggcatatcatagtgaggtacctgtagaaattctctgtgacgatattcgccacgttgaaattaaaaatgcctcaatggtcattctcaacttcaccttgcaatttttaccgcctgaagatcgcgtggcattgctcacgaagatttatgaaggattaaatccaaatggcgtattagtactttctgaaaaattccgttttgaagatactaaaattgatcatttactcattgacttgcaccaccaattcaagcgagccaatggttatagcgaattagaagtgagccaaaaacgcaccgcacttgaaaatgtgatgcgtacagattctattgagacacacaaagtgcggttaaaaaacgtaggattttcacaagtagaactttggttccaatgctttaattttggctcgatgattgcggttaaataa

SEQ ID NO: 1155 - DNA, 237 bp, H. influenzae strain 86-028NP
atgcttactaaagtgtttcaaagtggtaacagccaagctgttcggatcccgatggactttcgttttgacgtcgataccgtagaaattttccgaaaggaaaatggggatgtggtattacgcccagtttctaaaaaaacagatgattttcttgcgttatttgaaggatttgatgagacctttattcaagcacttgaagcgcgtgatgatttaccgcctcaggagcgagaaaatttatga

SEQ ID NO: 1156 - DNA, 405 bp, H. influenzae strain 86-028NP
atgatttatatgttagacaccaatatcattatttatttaatgaaaaatcgccccaaaattattgccgaacgagtatcacaattattgcctaatgatcgcttagttatgagctttattacttatgctgaacttattaaaggcgcctttggtagtcaaaattatgagcaatcaatacgagcaatagaattacttactgaacgagtgaatgtactatatcccaatgaacaaatctgtttacattatggcaaatgggcaaatacactcaaaaaacaagggcgacctatcggaaataatgatctatggatcgcttgtcacgcattgagtttaaatgccgttcttattacacataatgtaaaagaatttcagcgaattacagatcttcagtggcaagattggacaaaatag

SEQ ID NO: 1157 - DNA, 408 bp, H. influenzae strain 86-028NP
atgcaaattttacacactatgttacgcgtgggcgatttagatcgttcaatcaaattttatcaagatgttttaggtatgcgtttattacgcaccagtgaaaatccagaatacaaatatacgctggcttttttaggttacgaagatggcgaaagtgcggcagaaattgaattaacatacaactggggcgtagataaatatgaacatggcacagcatatggacatatcgctatcggcgtagatgatatttatgccacttgtgaagccgttcgcgcgagcggtggtaacgttactcgcgaagcagggccagtgaaaggtggatcaaccgtcattgcttttgttgaagatccagatggttataaaattgaatttatcgaaaacaaaagtactaaatctggtttaggcaactaa

SEQ ID NO: 1158 - DNA, 690 bp, H. influenzae strain 86-028NP
atgtccgattctcaagaaatcccttatcacaaccaattaaaaaatcgctttcgtggctatttccccgtcattattgatgttgaaactgcaggttttgatgcaaaaaaagatgcgttactcgaactagccgccatcacattaaaaatggatgaaaacggttatttgcatcctgatcagaaatgccattttcatatcaagccttttgaaggcgcaaatattaatccagaatccttgaaatttaatggtattgatattcacaatccactacgtggcgcggtgtctgaacttgatgcaatcacgggattatttcaaatggtgcgtcgaggacaaaaagatgcagattgccaacgttctatcattgtggcgcacaatgccacttttgaccaaagttttgtgatggctgccgctgaacgtactggcgtaaagcgtaatcccttccacccttttggcatgtttgataccgcaagtttagcaggattgatgtttggtcagactgttctcgttaaagcctgtcaagccgcaaaaattccttttgatggtaaacaagcccattcagcgttatatgataccgaacgcacggcgaaattattctgctatatggtcaatcatttaaaagatttaggtggtttcccacatattgcttctgaactagaacaggaaaaaacaactgaaaaagagaccgcactttaa

SEQ ID NO: 1159 - DNA, 1353 bp, H. influenzae strain 86-028NP
atgttatcaaaccctgttgttatctcaatcatcgttttgctggcacttagtttgctacgcatcaacgttattatcgcactggtgattgctgcgcttaccgcaggatttatcggtgatttaggtttaactaaaaccatcgaaacctttacaggcggcttaggtggcggtgctgaagtcgcaatgaactatgcaatacttggagcgttcgccattgctatttctaaatcaggaattactgatttaatcgcttataaaatcatcacaaaaatgaataaaacaccaactgctggcaatttaacttggtttaaatatttcatttttgcggtattggcattgtttgccatctcctctcaaaacttacttccagtgcatattgcttttattccaatcgttgtaccaccactactttcaatctttaaccgtttaaaaattgaccgccgtgcagtagcttgcgtacttacatttggtttaactgctacctatatattattaccagtaggctttggaaaaatctttattgaaagtattttagttaaaaacattaatcaagctggcgcaaccttaggtttacaaacaaatgtagcacaagtttctttagcaatgttgttacctgttattggaatgattttaggcttactcacagccatatttattacctaccgtaaaccacgtgaatacaatatcaatgttgaagaggcaacaactaaagatattgaagctcacattgctaatattaaaccaaaacaaattgttgcaagtttaatcgcgattgtcgcgaccttcgcaacacaattagtcacaagttcaactatcattggcggtttaattggcttaattattttcgtactatgtggcattttcaaactaaaagaaagcaacgatatttttcaacaaggcttgcgcttaatggcaatgattggctttgtaatgattgctgcttcaggttttgcaaatgtgattaatgccaccactggcgtaacagatttagtacaaagcctaagttctggtgttgtgcaaagtaaaggtattgccgcattattaatgcttgtcgttggtttattaattacaatgggtattggctcatcattctctacagtaccgattattacatcaatttacgtaccactctgtttatcttttggtttttctccattagcgacaatttctattgtaggcgtagcagcggctttaggagatgcaggttcgcccgcatcagactcaacattaggcccaacatctggcttgaatatggatggcaaacacgatcacatttgggattctgttgtacctacctttattcactataatattccattattggtattcggctggattgcagcaatgtacctttaa

SEQ ID NO: 1160 - DNA, 588 bp, H. influenzae strain 86-028NP
atgactgttcaacaacttatccaacgcttagatcaaaaagttcaacaactttatcaagctcatttatccaaacgagaagaaaaaatcttcgccaaatttgaccgcactttatttagtgaaaatggacaaaatgtttccttttatctaaaagaaatcaatcaaacgctagatagaataaagacattagagtctaacgattctaatcactataattttctagctgagcgtttactcgcccaatgttccgttctttcggaagctttagttcgcaaaaatactcatctaactgaatcccaaacaacaacgaaacaaaccattcaaaaatctcaacatagcattcataaattaccaccaagagaacgcctagaaaaatattacgaagcacgagaacaattgaataatctttatcgacagcataaagatttagcacaagctgaaaaaaataatgatgagaaaatacgttatgctcaacttgcagaagtttataaaaaacgccagcaaaaatgccaagatgcaatcgatcttttagaagaatatttggtgtttaaagaagaagtggaaaaccgtgaaaatacggaaaacaaatga

SEQ ID NO: 1161 - DNA, 567 bp, H. influenzae strain 86-028NP
atggctacatatactaccagtgatttcaaaccaggtctaaaatttatgcaagacggcgagccttgtgtcatcgttgaaaatgaatttgtaaaaccaggcaaaggtcaggcattcactcgtactcgtattcgtaaattaatttcaggcaaagtattagacgtaaactttaaatctggcacttcggttgaagcagctgatgttatggatcttaacttaacttattcatacaaagacgatgcattctggtactttatgcacccagaaacatttgaacagtactctgcagatgcaaaagccgtaggcgatgcagaaaaatggttattagaccaagcagattgtatcgtgactttatggaatggcgcaccaattactgttacgccaccaaactttgttgaattagaaatcgtcgatacagacccaggtcttaaaggcgataccgcaggcactggcggtaaacctgcaacattaagcacaggcgcagttgtaaaagtgccgcttttcgtccaaatcggcgaagttatcagagttgatacccgctctggcgaatacgtctctcgcgtaaaataa

SEQ ID NO: 1162 - DNA, 1017 bp, H. influenzae strain 86-028NP
gtgcgtattttaccccaagaacccgtcattagagaagaacaaaattggctcacaattctaaaaaatgccatttcagatcctaaattattactaaaagccttaaatttaccagaagatgattttgagcaatccattgctgcgcggaaacttttttcgctccgcgtgccacaacctttcattgataaaatagaaaaaggtaatccgcaagatccccttttcttgcaagtgatgtgttctgatttagagtttgtgcaagcggagggatttagtacggatcccttagaagaaaaaaatgccaatgcggtgccaaatattcttcataaatatagaaatcgcttgctctttatggcaaaaggcggttgtgcggtgaattgtcgttattgctttcgccgacattttccttacgatgaaaacccaggaaataaaaaaagctggcaactggcgttagattacattgcggcacattctgaaatagaagaagtgattttttcaggtggcgatcctttaatggcgaaagatcacgaattagcgtggttaataaaacatttggaaaatataccgcacttacaacgtttgcgtattcacacccgtttgcctgttgtgattccgcaacggattactgatgaattttgcactttattagcagaaactcgtttgcaaacagttatggtgacacacattaatcacccgaatgaaattgatcaaatttttgctcatgcgatgcaaaaattaaacgccgtgaatgtcacgcttttgaatcaatctgttttgctaaaaggcgtgaatgatgatgcgcaaattctaaaaatattgagcgataaactttttcaaacaggcattttgccttattacttgcatttgctggataaagttcaaggggcgagccattttttgattagcgatattgaagctatgcaaatctataaaaccttgcaatctctgacttctggctatcttgttcctaaacttgcacgagaaattgcgggcgagccaaataagactttatacgcagaataa

SEQ ID NO: 1163 - DNA, 1296 bp, H. influenzae strain 86-028NP
gtgaattctatggataaaaatcaacaatcatctcaaaatgaattggatttagggcttaatcaagagccaattacaccaaagaaaacaattcagccaagttcgtcaattttaggtaaagcaaaagggttatttgccaaaaaaaatcacgtgcaaactaactttcagcaacgtaaagaacctacttttggcgattcatcaacgcaagaaaatgatcctttaattccgagtgaaaatttgaaaaaagtgcaaaagcctgttcttcaaacttcttccacagaagaaaatatttctgcggttgatgaagaaatcagtgctgaaaataacgcggatgaacccgtcgaaaaggctgaaaaacctattttagctcaaccagaaaaatggaaaatattacaagtattgccagcaaaacatcgccgtttatttatggctatttttgtgttggttattttattgattattttcttcgcattaaaaccaagttctgacaccgttgagtcttttactcaatctaacagcaatgaagttcctgtgcagttccaatcgttagatcaaagtcagccactggaaaccacgattttagataatcctcctgcacaaaatcaaatggctgtagaacaagctaaccaatctgaatttgcaccaaaagcagaggaagcggcgaataatacgacggctcaaaacccattagtagaaaatgcgccaatgcaacaaaatgttgttcaatctccaagtcaaatgccaaatgaaatggctgcggcatctgttatgcctatgcaaccagctcaagcggaacagccaaaagcaactgtgccagttcagccgatgaaaaaagcggtagagccacaagttgcgcataaagatactgtgaaaaaagaagtgaaagtggcggagaatgcacaggctccatcaaaagcaacggaacaaaacgtcgctaaaacagcaggaaacgcaccgattgttgaagccaaacctgttcaagtaaaaaaagaaaagaaagttcaaatcgttgatgcaaaacctgtgagtaaatctgcagcctctcgtctttctgcgaaaacattaactgtgccgaaaggtgtttcgctgatgcaagtcttccgtgataatcaacttaatatttccgatgtaaacgcaatgagcaaagcagcaggggcgggcaatgttttaagtagctttaaatctggcgataaagtaacggtatctgtgaataatcaagggcgagtaaatgaaatgcgtttatccaatggtgcgcgttttgtgcgtcagtctgatggttcttatcaatataaaaaataa

SEQ ID NO: 1164 - DNA, 405 bp, H. influenzae strain 86-028NP
atgttgaaaaaaacatctcttatttttaccgcacttttactggctggctgtgcgcaaaatgcgaatgtgacaacacctcaaacgcaaaaaatgcaagtagaaaaagtggataaagccttacaaaaaggcgaagctgaccgatatttatgtcaagatgataaagttgttcgtgttgtacacgccacgcataaaaaatacaaaaaaaatttgcattatgttaccgtcacttttcaaggcgtatcagaaaaactaaccttaatgatttctgaacgtggtaaaaattacgccaatattcgttggatgtggcaagagcgtgatgattttagtacgctaaaaacgaatctcggcgaaattttagcaacgcaatgtgtctcacaaacaagtgaacgcttatctggacaataa

SEQ ID NO: 1165 - DNA, 711 bp, H. influenzae strain 86-028NP
gtgcaaagcgaacttcaacgtggttttgttttgcatcgtcgcccttatagtgaaacgagcttattggtagatttattcactgaagaaagtgggcgtttaaccgtgattgcaaaaggggcgcgtgcaaagcgttcatcttggaaatcggttttgcaacctttcacacctttattgttgcgttggacgggaaaaagcacattgaaaaccctcactaaagctgaacctgccgcaattacactgcctttacaacaaattgccctttatagtggattttatgtaaatgaattactcactcgtgttattgagtctgaaactccaaatcctgcgctttttcaacattatttaaaatgcttaactggcttggcaacggaaactaacgttgagccaacgttgcgtctttttgaatttcaacttttacaaatgctcggttacggcgtggattttctgcattgtgcggggtctggcgagccagtggatttctcaatgacataccgttatcgtgaggaaaaaggtttcgttgcgtctttagtgaaagataatctcacgttttacggcagagatttgttagcctttgaagccctcgatttttccgatgatgcggtacgtcaagcagcaaaacgcttcactcgtattgcgctgaaaccttatcttggcgataaaccgctaaaaagccgagagttattcactcaaaatattttacttttaaaataa

SEQ ID NO: 1166 - DNA, 1317 bp, H. influenzae strain 86-028NP
atggttcttctttataccccaaagcaaaaaacaaacaatgttcaaaccattacggctgatattcttgatttagattatcaaggtttaggcgtggcgaaaattaatggtaaaacttggtttattgaaaatgcgcttccgcacgaaaaagtggaatgtcgtattttggaagataaacgccaatatgggcatgctacggcaaaaaaatggcgagtaaaaagttctgaacgtttagaacctaaatgtgctcattttatgcgttgtggtggttgccaaggacagcatattcctattgaaatgcagaggaaagcgaaacaatccgcattgtttaagcggttaagtaaattacagtcagaaccgatttcatttcaacctatgatttgtggcgatgcttgggcgtatcgtcgtcgtgtgcgtttgagtttatggtttaatccaaacacaaaacaaatcgacatgggctttcgtcagaaaaataccaacgatttaatacccgttcaatcttgcgaagtagcagaacctgcaattaattatttactgcctaaattaaccgcacttttagaaaaattttccacaccgaaacagcttgggcatattgaattggtggctgccgataatggcgtcgcaatgttgttacgttacacgaaaaaccttgcggaaattgaccgcactttattgctcaaatttgctgaacaagaaaaattaatgctgtttttacaaagcgacaaaggcattgaacaaatctatggcgatgcgccttattatcaattttctgatggcataaaattacattttgatattcgtgattttattcaagtaaatagtgcattaaatgaacgtatgatcaatacagcgttggattggcttgaattgagccaacaagattgcgtgttagatttattttgcggcatgggaaattttacgcttcctcttgccaaacgcgtgaaaagtgcggtaggaattgaaggcgtttttgaaatggtacaaaaagcggcgcaaaatgccgcaagaaaccaaatcaaaaatattgaatttttccaagccgatcttgaccaatcctttgttgaacaaccttgggctaatcagtcgttcaataaaattttgcttgatcctccacgcagtggcgcagctttcgcgttaaatgctttgtgcgagctgaaagcagagaaaattttatatgtgtcttgtaatcctgcaacattagtgcgtgatgcggaaattttatgtgattttggctacaagattgaaaaaagtgcggtgatagatatgttccctcatacggggcatttggaatcgataaccttattcactacaaaataa

SEQ ID NO: 1167 - DNA, 2232 bp, H. influenzae strain 86-028NP
atggttgctgttcgtggttctcatttgttaaatccgcagaattttgtgattgaacaatggtgcactggcttaaaactagcagaacaaacagaaaaaagtttgatcgatgcgtggtattacgcacgtgatttaatgaatgcctatcccgatgaaatgaagaatgcgaccttaatgctgcagtctggcgtggaaatggtagaaattttgcacgaacttaatatggatgcggaaacattgcttactgccatgttgtttcctattgttgcaaataaattaacagactgggaaagtctaaaagaaaaatttggtgcgaaaattactaaattacttaaaggcgtgttggagatggataatattcgccaacttaatgccagtcattccgctaacgctctgcaagtggataatgttcgccgtatgttgttggcaatggtggacgatttccgctgcgtgatcatcaaacttgccgaacgtattactttcttgcgtgatgcagagtatcgttgtgcagaggaagacaaagtccttgccgtcaaagaatgttcttatatttatgcccctcttgccaatcgtcttggaattggtcagctgaaatgggagttagaagattactgcttccgttatcttcatcctgaacaatatcgcgctattgctaaattattgcaggaacgtcgtcttgatcgtgaacattacattgctgatttcgtcagtgagttgagcagttatttacgtgaaaatatcaagcaagtggaagtctatggccgtccgaaacatatttacagcatttggcgcaaaatgcagaaaaagaatcttgagttcagcggtttatatgatgtaagagcggtcagaattatcgtgcaaaaattgcaagattgttacaccgcacttgggattgtgcatactcaatttaaacacttacccaaagaatttgacgattatgtcgcgaacccgaaaccgaacggttatcaatctattcatactgttgttttaggtaaaggtggcaagccaattgaagtacaaattcgaacccaacaaatgcatgatgatgcagagttaggtatggcggcacactggaaatataaagaaggcaatacaggcagtatgtctgcctatgaagaaaaaattgcgtggttgcgtaaattgttagcttggcaagatgatattacggattcaggcgaagtgctggcagagttgcgtagccaagtgtttgatgaccgtgtatatgtgtttacgccaaagggcgaagtggtggatttgccaacgggatctacaccattagattttgcttacgccattcatagtgaaattggtcatcgctgtatcggggcaaaagttgcggggcgtattgtgccatttacctatcagctacaaatgggtgatcaaattgatattattacccagaaaaatccgaacccgagccgtgactggctaaacccaaatttaggatttactcacaccgcaaaatctcgagccaaaattcaagcgtggtttaaaaaacaagatcgcgataaaaatattccagcgggtaaagaattactcgataatgaactcgcgcttttgaatttaagtattaagcaagtggaaccttatgcgttaccacgctataacttgaaaaatttggacgatctttatgcgggcattggcagtggtgatattcgtttaaataacttaatcaatttcttgcaaagtaaattgattaaagtgactgctgaagaagcagatcaagagattttacgtcatgttgctaacaaaagtgcggtcaattctcagcagaaatctgaaaagaacaatggctatgtgattgtggagggtgtggacaatcttatgcatcatattgcgcgttgctgccagccgataccaggcgatgcgattgttggctatattacaatgggacgtggtatttctattcaccgagcggattgtgaacaattcttagatttgcaagcggctcatccagaacgcgtagtggaatcaatttggggcgaaaattacgcaagtggtttccatattaatatccgtattgtggcaggcgatcgcaatggcttattgcgtgatattacgacggttctagcaaatgaaaaaattagcgtattaggggtctcaagccgtgctgataccaaaaaacagcttgctactattgatatggaaattgaacttcataatgttgaaagtttgagtaaaatattggctcgattagcaaaattagatgatgttatcgaagcgaagcgtttataa

SEQ ID NO: 1168 - DNA, 357 bp, H. influenzae strain 86-028NP
atgtataaaacgacggggctaacccatttaatcaattccacgaaatattcattacaaggcttaaaaagtgcgtttaaaaatgaaacggcttttcgccacgaatgttttttagcctgcattttaattcctcttactttctttttaggcgaaacaaaaattgaaattatattgatgatttcttctgttttgcttgtgatggcgttagaacttttaaacagtgcggtagaggcagttgttgatcgcattggtacagaacgccacgaactttcaggacgtgcgaaagatcaaggctctgcatcggtatttattgccctttgtattgtcggtatcgtttggggcggaattttattcttctaa

SEQ ID NO: 1169 - DNA, 594 bp, H. influenzae strain 86-028NP
atgaccgcacttttaaaaattggtctggtgtctgtttctgatcgcgcatcagcaggcgtatatcaagatcaaggtatcccagaattacaggcttggttagaacaagcgttagtagatcctttccatttggaaacaagattaatccctgatgaacaaccgattattgaacaaaccttaaaagagctggtggatgaacaaggttgccatttagtgctgacaactggtggaactgggccagcaaaacgcgatgtaacgcctgatgcaacccttgcggtagcagatcgagaaatgccaggttttggcgaacaaatgcgtcaagtgagtttgcattttgtgcctaccgcaattttatcccgccaagtgggtgtaattcgtaaggaaagcttgattttaaatcttcctggtcagcctaaagcgattaaagaaaccttggaaggcgtgaaagataaagagggaaatgtgcttgtaaaaggcatttttagcgcagtgccttattgtttgcaactgattaacggcttatatattgataccaagcctgaaatcatcgaaagtttccgtcctaaatccgcaagacgcgaaaatctggagaaatag

SEQ ID NO: 1170 - DNA, 339 bp, H. influenzae strain 86-028NP
atgaaaaaaatcgaagcaatgattaaaccctttaaattagacgatgtgcgagaaagtctttcagatattggtatttcaggtatgacaatcacggaagtacgcggatttggtcgccaaaaaggtcatacagaactttatcgtggtgcggaatatatggtggattttctgccgaaagtgaaattggaagtagtggttcctgatgaacttgtggatcaatgtattgaagcgattgttgaaacggcacaaacaggcaaaatcggtgacggcaaaatttttgtttatcacgttgagcgagcgatccgcattcgcacgggcgaagaaaacgaggatgcgatttag

SEQ ID NO: 1171 - DNA, 1047 bp, H. influenzae strain 86-028NP
gtgcaaaataatttaaatttacaccgcactttgcttggcattgctgcggtgattattatcttagctggcgtaaaattggcggcagaaatcgtggtgccattcttgctatcactctttatcgcgataatttgttcgccgataattaaggcgatgacccaacgccgcgtcccgcattggttagccattactttgctttttgtcttgatttctttggtatttttcttcttagtcgggttgattaacagcacggcaagagaatttacccaatctattccacaatataaagttttgctttcacaacgtgtgagtgatttaactggattgttgcaacgtttcaatctgcctttcacgctttcgcgtgaaaccatccaagaaaattttgacccaagcatcattatgaattttgtaagccgagtattgctgaatttctctggtgtagtgagtaatgtgtttgttttagtgttggttgtgatttttatgcttgccgaagcaccaacgatgaaacataaatttgcaatggtaattagttcaacccctcatgatgcagccaaagaagaacgccatattgatcgcgttttgcaaggcgtaattggttatcttggcatcaaaagcatcacgagtttactgactggcgtcggagtgtttattttgttggaagcctgtggggttcaatatgccattttgtgggcaaccttgagtttcttgctgaattatattcccaatataggttctatcatcgcggctattccgattattgtgcaagccttattactgaatggttttggcattggctttggcgtagcaatcggtgttattgcgattaatatggttgtcggtaacattattgaacctaaaatgatggggcaacgattagggctttcaaccttagtggtgttcctttcattattgttttggggatggctgcttggaacagtgggaatgctactgtctgttcctttgacgatggcattaaaaattgccttggagtccagtcccaatacagcgaaatatgcctgtctattaggagatgtcgaagatttcaaatag

SEQ ID NO: 1172 - DNA, 2193 bp, H. influenzae strain 86-028NP
atgaaaattgtccgagtggcactggctgtgccgcttcctcgcttatttgattatttcgtccccgatgatgtttcattacaaatcggtatgcgtgttcttgtgccttttggcactcaaaaacgtgtcgccattgtggctgattttccgacaaaatcggacgtgccagaggataaactcaaggctattcttcaaccattggatttagccccactttttacgcccatttattgggattggcttcactgggcagcaaattattatcaagcgggattaggcgatgtgttatttcaagccttgcctgtgaaattgcgtaacggcgaaagtgcggtaaaaaatgaccgcactttttggcgaattacggatgcggggaaaaatgcccttgaacaaggcgaattaaaacgctcgaaaaagcaagctgaagccctacaatgcttatctgaaactgatcttgaaaaaggcaataataatttttcctctgccatttggtctgccttaaaagccaaagggtttattgaagaaattactatccaaacaaatcccctaagctggcaacaaagattaggcaataacccaatagtcaatgctgaaaatcgtttaaccttaaataagcagcaagccttagccttcagccaactgctcttccattctggtttcaatgtatggctgctcgatggcgtgactggttcaggtaaaacagaaatttatctgcagtatattgaagaaattttaaaatcgggtaagcaagtattagtgcttgtacccgaaatcgggctaacacctcaaacggtgcaacgttttaaagcacgttttaatgtagaaattgatgtactgcattctaatttaaccgatacgcaacggctttatgtatgggatcgcgcccgctctggacaaagtgccattgtgattggcacgagatcggcattgttcacgcaattttctaatcttggtgcaattattttggacgaggaacacgattcgtcttacaaacaacaagacagttggcgttaccatgcgcgagacttggcgattgtgctggctcaaaaactaaatattgcggtattaatgggctccgccacgccaagtttagaaagtattaataatgtacaaaacggcaaataccaacatttagttttatcaaaaagagcgggaaattctaccgcacttcgtcatttcgttattgatttgaaaaatcaaaatatacaaaacgggttatcaaaacccttgttggaacgaatgaaagcccatctcgaaaaaggcaatcaagtgttgcttttcttaaatcgtcgtggctttgcacccgtattgctttgccatgaatgtggttggatcgcacaatgccctcattgtgaaaaaccttatacctatcatcagcatcaaaatgtattgcgttgtcattattgtggcgcacaaaaaactattcctcgccaatgtggcgattgcggttctacccatttagttactactggtctaggcacagaacaattagaagaaaccttgaaaacgctatttcctcattattctgtagcgcgaatcgaccgcgatagcacggcacgtaaaggaaaattggaaggttatttagaagatattcaacaaggcaaaagccaaattttgattggcacacaaatgctcgcgaaaggacatcattttccgaatgttactctcgttgccttagtgaatgtagatagtgcattattttcactggattttcgtgcagaagaacgtttagctcaactttatattcaagttgctggacgtgcaggacgtgccgataaacaaggtgaagttgtgctacaaacacattatcctgatcatcctttgcttaccactttattggcaaatggctaccaagcttttgcaaaagaaaccttacaattacgccattcaatgggattgccgccttttacttttcaggcgttattcaaagcacaggctcgacattctgatcttgcagaaaattgcttaagccaaattgcagatttttttcaatcgaagcaaattacgggattacaaatgcttggcccaatgcctgcaccgttcagcaaaaaagcggggcaatatcgctggcagttattattgcaacatccgtcaagaatgacgttgcaaaaagcattaagagaatatcaacaagccgaacttgaaaaaaacagcctagtgcggttaattttggacgtcgatccgcaagacttatcataa

SEQ ID NO: 1173 - DNA, 741 bp, H. influenzae strain 86-028NP
atgacacaaacttttgccgatcaaaaacgtaaaaccgttgaaaccgcagaatttaccgaagatggccgctataagcgcaaagtccgtagttttgttctccgcacaggtcgtttgagcgaatttcaaagaaatatgatgaatgataactggggaacacttggtttagattatcaaacggaaccttttgattttgctaagatttatggcaatgataatccaattgtattagaaattggctttggaatgggaaaatcgcttgtggatatggcttttgctaatcctgacaaaaattaccttggcattgaagttcatactcctggcgttggtgcttgtattgcttatgcagtggaaaaaggcgtaacgaatttacgcgtgatttgccacgatgcaacggaaattttacgagacagtattgctgatggtgcgcttggcggtttgcagttatttttccccgatccttggcataaagcaaaacatcataaacgtcgtattgttcaaccgcactttgtgacacaagttatacaaaaattaggtaaaaatggttttatccatatggcgacagactgggaaaattatgcagagcaaatgctagaagtattaagcgcaaacaccgatttagtgaacacctcgaaaaatggcgattatattccaagaccagattttagacctttaactaaatttgaagccagaggttacaaacttggacatggtgtttgggatttatattttgtgaagaaataa

SEQ ID NO: 1174 - DNA, 345 bp, H. influenzae strain 86-028NP
atgtctaaatcttacaatcaacgccaacgcaaaaaacttcatcttgcggaatttcaagaactgggttttcttgtaaatttccaatttgcagaaggcactgcgattgaaactgtagatgaaatcgttgatcgttttattaacgaagtgatccaaccaaatggtctagcttatgaaggtagcgggtatttacattgggaaggtttagtttgcctagaaaaaattggcaaatgcgatgaaagccaccgtgaaactgtgaaaaaatggttagaaacaaatggtttgcaacaaattgaagtaagcgaattatttgatatttggtgggaatatccagcaaaagctgaataa

SEQ ID NO: 1175 - DNA, 531 bp, H. influenzae strain 86-028NP
atgaccgttgaaaatttacctcgcagacaatttttacgcggtaaattttcaacattgagctgtttagaaaataatcaaaaacagaattttgtgggtattagaccgccttggtctgtggaaaattctatttttgtagcacaatgtacgcgctgtggcgactgtctttctgtctgtgaaaccaatattttggtaaaggacgatgctggttttcctgaagtgcgctttgataatggcgaatgtactttttgtgggaaatgtgtagatgcctgtaaacagcctattttttatcctcgtgaccagttaccttggtcacataaaatcgacattggcgtagcttgtttaacattgcaccgtattgaatgccgaacttgccaagataattgtccagctaatgcgattcgtttcaaattacaaatgggtggcgtagcacaacctttagttaatttcgatgcttgtaatggctgtggggcttgtgtacaaggctgccctgtgaatgcaataacaatgaacgatctaaaacaaaatgaataa

SEQ ID NO: 1176 - DNA, 282 bp, H. influenzae strain 86-028NP
atgaataatacaaatttaatattagaaaatgcgagggattggcacgttgttggattgatcgtgcaaggtaatccaaaaaaattatcagcaattcaaaccgcacttttagcgattgagcatactgaaattccgacttttgatgaaaaacttggaaaatttgtggtggtaatgcaatcgaacgatcagcatctcttgcttgaaaaaatggaaagtgtgaaagatatcgacggtgtgattaatgtatcgttggtgtatcacgagcaagatgaacaaaataaataa

SEQ ID NO: 1177 - DNA, 2499 bp, H. influenzae strain 86-028NP
gtgggggaaaacgcgatgaatttaagtcgtcgagactttatgaaagccaatgcggctatggcagccgcaacggcagcggggctaaccatcccagtcaaaaatgtggttgcggctgaatccgaaattaaatgggataaagcagtatgtcgtttctgtggtactggttgtgcagtattagttggtactaaagatggacgtgttgtggcatctcaaggcgatcctgatgcagaagtaaaccgtggtttaaactgtattaaaggttacttcttgccaaaaattatgtacggtaaagaccgtttaacgcagccgcttttacgtatgacaaacggaaaatttgataagaacggcgattttgcgccagtttcttgggattttgcgttcaaaacaatggctgaaaaattcaaagaagcgttcaaaaagaacggtcaaaatgcagtaggtatgtttagttctggtcagtctaccatttgggaaggctatgcgaagaacaaactttggaaagcaggttttcgttctaacaacgtagacccgaatgcgcgtcactgtatggcatctgcagcggttgcatttatgcgtacttttggtatggatgaaccaatgggttgttatgatgatattgaacaggcagatgcttttgttctttggggctcaaatatggcggaaatgcacccaattttgtggtcgcgtattactgatcgccgtatttctaatcctgatgttcgtgttactgtgctttctacttacgaacatcgtagttttgaacttgccgatcacggtttgatatttacaccgcaaactgatttggcaattatgaactacatcatcaattatcttattcaaaataatgcgattaattgggattttgttaataaacataccaaatttaaacgcggagaaacgaatattggctatggtttacgtccagagcatccattagaaaaagacacgaatcgtgcaacagctgggaaaatgcacgattcttcttttgaagaattaaagcaacttgtatcagaatatacagtggaaaaagtatcgaaaatgtctgggttagataaagtccagttagaaactttagcgaaactttatgctgatccaacgaagaaagtggtttcctactggacaatgggctttaaccaacatacacgtggtgtgtgggtaaaccaattaatctacaatattcatttacttactggaaaaatttcaatcccaggttgtgggccattttcattaactggtcagccttctgcttgtggtacggcgcgtgaagtaggttcattccctcatcgtttacctgccgacttagtggtaactaatcctaaacaccgtgaaacagcggaacgtatttggaaattaccaaaggggacggtttctgaaaaagtggggttacacacaattgcacaagaccgtgcaatgaatgatggcgaaatgaatgtgttatggcaaatgtgtaacaataatatgcaagcaggaccaaacattaatcaagagcgtttgccaggctggcgtaaagaaggcaacttcgtgattgtttcagatccttacccaactgtatccgcactttctgctgacttaattcttccaacggcaatgtgggtggaaaaagaaggggcttacggcaatgcagaacgtcgtacccaattctggcgtcagcaagtcaaagcaccgggcgaagcaaaatcagacttatggcaattaatggagttcgcaaaatacttcacgacggatgaaatgtggacagaagacttacttacacaaatgcctgaatatagaggtaaaactttatatgaagtgcttttcaaaaatggtcaagtagataaattcccattgagcgaacttgctgaaggccaattaaacgatgaatcagaatattttggttactacgttcacaaaggtttatttgaagaatacgctgaatttggtcgcggtcacggtcacgatttagctccatttgatatgtatcataaagcgcatggtttacgttggccagttgtggagggtaaagaaaccttatggcgttaccgtgaaggctatgatccgtatgttaaagaaggggaaggcgtggctttctacggttatcctgataagaaagcgattattcttgcggtgccttatgaaccaccagctgagtcacccgataatgaatacgatttatggttatcaacaggtcgtgttcttgaacattggcatacggggacaatgacacgccgtgtaccagaattgcatcgagcatttccaaataatttagtatggatgcacccattagatgcacaagctcgtggtttacgtcatggcgataaaattaagatttcatctcgtcgaggcgaaatgatttcttatttagatactcgcggacgtaataaaccacctcgtggcttagtatttaccactttctttgatgcaggtcagcttgcaaatagcttaacactagatgcgacagacccaatttcaaaagaaaccgacttcaaaaaatgtgcggtaaaagtggaaaaggctgcgtaa

SEQ ID NO: 1178 - DNA, 840 bp, H. influenzae strain 86-028NP
atgaaagtgcggttaaaatctaaaaagaaaatgaagaaacccgcccttaatcctgaacgtagaaaatttcttaaagaagcaacccgtactgcgggtggtttagctggcgttgggattttgttgggattgcagcaaaatcaaagtcttgcgcgcgaaggtgtgccattacgccctccatttgctttgcaagatgcgaaagcgttttctgccgcttgtattcgttgcggacaatgtgttcaagcctgtccttatgacatgctgcatttagcctctttattatcgccagtagaagcgggaacgccgtattttattgcgcgtgataaaccttgtgaaatgtgtcctgatattccttgtgcaaaagcctgtcctagtggtgcattagatcgtcaagcaacagatattaatgaatcgcgtatggggctgtcagtactgttagatcacgaaacttgcttaaattatcaaggattacgttgtgatgtttgttatcgagtttgtccattaatcgataaagcgattacattggaaacacaacataatccacgttctgataagcatgccttatttattccaacagtacattctgatgcctgcacgggatgtggaaaatgtgagcaagcttgtgtgttagaagaagcagcgattaagattttaccaatggatctggcaaaaggtatgttaggtaaacattatcgtttaggttgggaagaaaaagcgaaagctggccattctcttgcacctaaagatatgatttcattgccaactcgaacaccagaagggacaactgtaattcctgaaccagcagaacccgtgctcgcaccaattttagggggcggaaaataa

SEQ ID NO: 1179 - DNA, 864 bp, H. influenzae strain 86-028NP
atggcaaatgcaccaaaatttgcagggaaagaggctcgagaaaaatggggctggtggtatgcaaaccgctttttgttttggcgtcgattaagccaacttagcattcttgcgatgtttttgagtggcccttattttggcgtgtggattttaaaaggtaattatagtggtagtttattactcgatactattccactaagtgatcctctaattaccgctgaaagcttggctgcaagacatttaccagatgctctcactttaattggtgctgcaattattgtgttattttacgcagtacttggtagtaaagtgttttgtggttgggtatgcccactaaatgttgtgactgactgtgcagcgtggcttcgccgtaagttaggcattcgccaaacagcaaaaatttcgcgcggtttacgttatggtattcttgtgcttattttactaggcagtagtgtcagcggaatgttgctttgggagtgggttaatccagtggctgctcttggtcgcgcctttgtatttggttttggtgcaacaggctggttattacttgttatttttctttttgatttattgattgctgaacacggctggtgtggacatctttgcccaattggtgctgcttatggtgtgattggtgcaaaaagtttaatccgtattaaagtgattgatcgtgctaaatgcgataattgtatggattgttacaatgtttgtcccgaagcccaagtgttacgttcgcctttacacggaaaaaaagacgaaagcctactagtgctttccaaagattgcatcagctgcggacgttgtattgacgtttgcgctgaaaaagtttttaaattttcgaccagattcgatcattcaggggagtga

SEQ ID NO: 1180 - DNA, 453 bp, H. influenzae strain 86-028NP
gtgattaatatgactaaacaggtatctaaaattttagcgggattatttaccgcactttttgctggctcactgatggcatctgatgcaccagcagtgggaaaagatttaactcaagcggcagaaaatattccacccgcatttcataatgcaccgcgtcaaggcgaattacccgcattgaactatgtaaatcagcctccaatggttccacatagtgtggcaaactatcaagtgacaaaaaatgtaaatcaatgtttaaattgccacagcccagaaaattctcgtttgagcggtgcaactcgaatcagcccaactcactttatggatcgtgatggaaaagtaggttcaagttcatcgccacgtcgttatttctgtttacaatgtcacgtttctcaagcaaacgtagatcctattgttccaaatgatttcaaaccgatgaaaggttacggaaactaa

SEQ ID NO: 1181 - DNA, 603 bp, H. influenzae strain 86-028NP
atgtctgagaaaaaaccaaatatcttaaagcgtttctggcaatggtttagaaaaccaagccgtatggcgataggtacaattattatcttatcggctattggcggtattctttcttgggttggttttaactatggtttagaaaaaaccaacactgaacagttctgtgcaagctgccatatgcaagatgcttatccagaatatttacatagcgtgcattatcaaactcgtactggtgtgggggcaagttgtccagattgtcacgtaccacacgaatttggtgcaaaaatgaaacgtaaaattattgcagctaaagaagtatatgcgcactatactggaaaagtggataccttagaaaaattcaatgcgcatcgtttagaaatggctcaaaatgaatgggcgcgtatgaaagctaacgattctaaagaatgtcgtaattgccataatgtagatcgtatgaacttcaatgatcaacgttctgtggcggcacgtatgcaccaaaaaatgaaaactgaaggtaaaacttgtatcgactgtcacaaaggtattgcacaccaattacctgatatgagtggcgttgagtcaggcttcaaagacgagaagtga

SEQ ID NO: 1182 - DNA, 645 bp, H. influenzae strain 86-028NP
atgaaaattattcttttaggtgcaccgggtgcaggtaaaggcactcaagcacaatttattatgaacaaatttggtatcccgcaaatttcaactggtgatatgttccgtgctgcaatcaaagcggggactgaacttggcaaacaagctaaagcattaatggatgaaggtaaattagtgccagatgaattaaccgttgcccttgtaaaagatcgtattgctcaagctgactgcacaaatggtttcttgttagatggtttccctcgtactattccacaagcggatgcactgaaagattcaggtgttaaaattgactttgttttagaatttgatgtgccagacgaagtgattgttgaacgtatgagtggccgtcgcgtacaccaagcgtctggccgttcttaccacatcgtttataatccaccaaaagtggaaggtaaagatgatgtaacaggcgaagatttaattattcgtgcagacgataaaccagaaactgtattagatcgtttagccgtatatcataaacaaactagcccattaattgattattaccaagcagaagcgaaagcggggaatactcaatatttccgtttagacggtacacaaaaagtagaagaagttagccaagagttagataaaatcttaggctaa

SEQ ID NO: 1183 - DNA, 1278 bp, H. influenzae strain 86-028NP
atgtcaaattccctttcttctcaaatttttacgcgcaagatgttaatttgcgccttcacaggttttaattctggtttgccattatttgtattgtcgcaaatgttgcctgtttggctgacagataaacatctttcaattgagcttattggtgcagtaacgggtgtgatgttgccttatggattgaaatttttgtgggcaccattattagatcgttatttcccgagttttttagggcgtcgtcgtagctggatgttgctttcacaagtggcattattgattttactttacatcattagcctgtttgatccgctcacacaactgggtacagtagcaaatattgcgttgcttatcgcctttttttcagctacacaagatatcgtgttggatgcgtatcgtcgtgaaattttgagtgatcatgaattaggtttaggaaacactattcatattaatgcttatcgaattgcgggattaattccagggggattatcgctatatttggcggcgatttatccttgggaaaccgtctttttatggaccgcactttgtatgttagcaggcatcttcatgacattatttttagcaaaagagccgaaaatcaacgtgcagcaaactaatcagccgttctatcaagcattttggattccattacaagaatttttccagcgtaagggcgtcattcaggctatcggttttttactatttttgtttttgtataagttcggggattcttttgccacaacgttacaaaccaaatttatttatgacatgggatttagcaaagaggatattgctattgttgtaaaaagtaacgcactttggtcaagcattttatctgggcttgctggtggtatgataatgctaaaactgggtattaaccgtgcattgtggctatttgggcttgtacaaatggtaacaattggtgggtttatttggttgtctgctttcggtcattttgatgttattacatctgccgagttatggaaactaggtgttgtgattgccgcagaatatatcggcgttggacttggtaccgcagcttttgtggcttttatggcacgtgagagtaatcctctttatactgcaacacagcttgcactttttacaagcctttcagctttgccaagtaaagttttaggtatactttctggttatgttgtgggagcagtggggtattatcagtatttttggttttgtttatttttagcgattcccggcatgctttgtttattttgggtagcacctttgaagcaagaaaataataagaccagctcagtataa

SEQ ID NO: 1184 - DNA, 1017 bp, H. influenzae strain 86-028NP
atggccattttagtgacaggtggcgccggttatatcggttctcacacagttgtagaattattaaatgctggcaaagaggtggtggtattagataatctttgcaattcatcgccaaaatcccttgagcgtgtaaaacaaattacaggcaaagaagcaaagttttatgaaggcgatattttagatcgtgctttgttacaaaaaatttttgcagaaaatgagattaactcggttattcactttgcagggttaaaagccgtaggggaaagtgttcaaaagccgacagaatattacatgaacaatgtcgctggcacccttgtattaattcaagaaatgaaaaaagcgggtgtttggaactttgtatttagctcatctgcaacggtttacggcgatccaaaaattattccaattacagaggattgtgaggtcggcggtacaaccaatccttatggtacatctaaatatatggttgagcagattttatgcgatacagcaaaagcggaaccaaaatttagcatgactatcttgcgttattttaatccagttggggcgcatgaaagtggcttgattggtgaagatccaaatggtattccaaataatttattaccttatattagccaagttgctatcggtaaattagcacaactttctgtatttggtagtgattacgacactcatgatggaacaggtgtgcgtgattatattcatgtagtggatttagctgtggggcatttaaaagcgcttcaacgtcatgaaaatgacgctggcttacatatttataaccttggtacgggccatggttattccgtattagatatggtaaaagcctttgaaaaagccaacaatattacaattgcatataaacttgtagaacgccgcgctggcgatattgctacttgctattctgatcctagtttagctgcaaaagagcttggttgggtggcagaacgtggtcttgaaaaaatgatgcaagacacgtggaactggcagaaaaataatccaaaagggtatagagattaa

SEQ ID NO: 1185 - DNA, 963 bp, H. influenzae strain 86-028NP
atgtcaatcaatcaatcaatcaatcaatcaatcaatcaatcaatcaatcaatcaatcaatcaatcaatcaatcaatcaaagtctgtcattattgcaggtaatggaacaagtttaaaatcaattgactatagtttattacctaaagattatgatgttttccgttgcaatcaattttattttgaagatcattattttcttggcaagaaaataaaaaaggtattttttaattgttctgtaatttttgaacaatactatacgtttatgcaattaattaaaaataatgaatataaatatgaatatgctgatattatcttagcatcttttctgaatttaggggattcaacattaaagaaaatccagcatttagaaaaattactgccacaaattgatcttggtcattgctatttgaaaaaactacgagcttttaatgctcatttacaatatcacgaattatatgagaataagaggattacatcaggcgtttatatgtgtgcagtggcgactgcaatgggttataaagatctttatttaacaggtattgatttttatcaagaaaaagggaatccttacgcatttcatcatcaaaaagaaaatattattaaattattaccttctttttcacaaaataaaagtcaaagcgatatccattctatggaatatgatttaaatgcactttattttttacaaaaacattatggagtaaatatttattgcatttcgccagaaagtcctctatgtaattattttcctttatcaccactgaataacccaattgcttttattccagaagaaaagaaaaattacacacaagatattttaattccgccgaagtttgtatataaaaaaattggtatatattccaaaccaagaatttaccaaaatctgatttttcggttgttctgggatatattacgtttacctaatgatataaaacacgccttaaaatcaagaaaatgggattag

SEQ ID NO: 1186 - DNA, 723 bp, H. influenzae strain 86-028NP
atggtgcgtattcaagatttgagtcttgcctttaatgggcaaacgttatttgagcatcttaatttaaccctgttgccgaacgaatgggtgagcttattgggcagttcaggcgtgggaaaatcgacacttttgcgactactggcgggcattgaaacgcaaggtgtggtgcaggggaaaatcctatttgaaccgaaaattcgtattgcgtggttgcctcaaaaagagaccctttatccgtggttgtcaattgtcgataacgtgcagttgcaagcggtcttatttgggcgaaaatctgcaaaaaccactgaaaaagctaaaatgttgcttgaaaaagtgggaatggcagcacattggcacaagccttgttcgcagctttcgggcgggcaaaaacagcgggttgccttggcacgcaccttaatgcaagaggcggatttgattttgcttgatgagcctttttccgctcttgatgccatcagtcgccatcaacttcaagatttagcctttgaactgctagaagataaatcagtgctgctcgtgacccacgatccgcaagaggcattacggctaagtcagcgtatttttgtgttgcgttcgcctgaatctcatcaaacagcattatcggcggtgattctgcccgaaggtaacgcccctcgtgagttgcatcaagccaatttatgggcgttgcagcaacaattattgcaggaattagggggcgaacaatga

SEQ ID NO: 1187 - DNA, 738 bp, H. influenzae strain 86-028NP
atgaaaattcgcctacttaaaccgcttttaattgttggcgtgttgttgatgatctggcaaatggtcgcaaccttgggcagcttcccacactacatttttccctcaccgcaagctgtagggcagcagttattcacacacgctgaactgctttggcagcatacgcaagtcacgttgttagaaatttgcttagggctgttgttaggctttctatttgggttgatttcggcgttgttgctctcattttctcgtcaaatttctgccgtcttattgccgattttggtcatttcgcaagcgattcccgtgtttgctattgcgccgttgttggtgttgtggtttggctatggaatggcatccaaaattgtgatgtcggtgctgattatctacttccccgtcacggcagcttgttatgatggactacgcaacaccccacaagcgtggctcgatttggcgaaaacctttaacatttcccccttgcgtttattgcttaaagtgcgattacctgcggctttgcctgcttttgcttcgggcttgcgaattgccgtttcggtcgccccgattggtgcggtggtaggtgaatgggtcggttcatctgaaggcttggggtatttgatgattcacgccaatgcccgaatgcaagtcgatttaatgtttgccgccttactgattttagtgtcaatttcactctgtttatatttcagcattgattggctattacaccgttttatttggtctgtttaa

SEQ ID NO: 1188 - DNA, 945 bp, H. influenzae strain 86-028NP
atgaagacaatcatccgttatttcagctttgtaatggggctaatgctcacgcttcctagctttgcaaaagagaaaatcagcgtaatgctagattggtatgtaaaccccgatcatgcagccatcattgtggctcaacaaaaaggcttttttgaaaaaaataacttggaggttgaaattatcgaacctgctgatcctgcattaccgccgaaattagcggcggcaggaaaagttgatttagccgtgagttatcagcctcagctttatcaacaagtggcagaaggcttacctttagtacgagtggggtcactgatttcaaatccattaaatagcgtagtggtactaaaaaagagcaatttggaaacccttgctgatttaaaaggtaaaaaagtggggtattctgtcagcggttttgaagatggattgcttgacaccatgcttcattctattggtttaagcaataaagatgtggaattagtgaatgtaaattggtcgctttcgccttctcttttaactggacaagtggatgctgtgattggtgcatttcgtaattttgaactcaatcagcttgctttagaaaagcaagaaggcgtcgcattcttccctgagcaatatggcgtgcctgcttatgatgaattgattttagttgccaataaaaacagcgtaacagataaaaaaacatccgcctttttgaccgcacttgaacaagccacaagctatctgcaagctcaccccaatgaagcgtggcaagcctttgtcagctataaaccgaacgaactcaacacgccattaaatcaactggcgtggaaagacacgctccccttcttagccaataaacctcgtcaattagacgctaaacgttatcaacaaatggcagaatttatgcaacaaaaaggcttaattccaaaagccttagcgttgaaagaatatgcggtagaaattgaataa

SEQ ID NO: 1189 - DNA, 648 bp, H. influenzae strain 86-028NP
atgattgaacaactcattcaacaagcccagccttattggcaacaatatattgaacacgaatttgtgcaacagctcgcaaaaggtacgctgccaaaagcttgttttcagcattatttaaagcaagattatctctatctttttcattacagccgagcttttgccttgggcgtgtataaagcaaaaaatttcgctgaaatggaaatacctcgcaaaaccttagagatactctgccaagaaattcaactacatttaaattattgccgtgagtggggaattagtgagcaagagatttttgctactcaagaaagtcccgcttgtattgcttatacccgctatttgcttgattgcggcatgacgggcagtttggctgagctttatgcagctgtgactccttgtgctttgggttatgctcaagttgctcgttacattactcagcattatcctcgcttaccgaacaacccttatcaaacgtggattgacacttatgcgagcgaggaatttcaacaagccgcccaagaaaccgttgattttcttaccgcactttgtaaaccgctaaactcaagccagcttaccgagattcaacagatttttaccaccgccactagaatggaaattgcgttttggcaaatggggttggatttggcttag

SEQ ID NO: 1190 - DNA, 816 bp, H. influenzae strain 86-028NP
atgtttgattggcttttagaaccgctacaatttgagtttatgcaaaatgccttattgaccgcattgattgtttcgattatctgtgcgttactttcttgctatttagtcttgaaaggttggtcattaatgggtgatgcaatttctcacgctgtattacctggtattgtacttgcttatttggcaggaattcctttagccattggtgcatttttctcaggtattttttgttcgcttggtgtgggatatttgaaagaaaatagccgtataaaagaagatacagcaatgggtattgtattttctggaatgtttgctattggtttggttatgtttaccaaaattcaaacagaacagcatttaacccatattttgtttggtaatgtgttgggtgtaagtcatcaagagctgattcaaagtgcggtcatttctgcgataattttttgtttgattgttttcaaacgtaaagactttctgctttattgttttgatccaagtcacgcccgtgttgcaggactttctccaaaagttttacattatggcttgctaatattacttgctttaaccattgtaagcacgatgcaagtggtaggtgttattttggtggtggcaatgttaattgcaccaggaattaccgcacttacgcttaccaaatcttttgataaaatgttatgggttgctattgcaagttccattgcatcaagcctaattggcgtaatattgagctatcattttgatgcctcaacaggtgcttgtatcattcttctgcaagctgcattttttgttatagcattagcttatagcaaaattagaacaagataa

SEQ ID NO: 1191 - DNA, 849 bp, H. influenzae strain 86-028NP
atgttagatttattgctcgaacctttttcctatgattatatgctcaaggcgatgattttgagtaccgcagtgggtggcatttgtgcttttttgtcttcatatttaatgcttaaaggctggtctctaattggcgatgcgctttcccattctgtcgtgcccggtgttgcaattgcctatgcttttgcgttgccttacgcacttggtgcattttttgccggaattttagccgcactttccattctttggattaaatccatttctaaactgaaagaagatgctgtgataggttttattttcagtactttctttgcattaggtttgttaatcgtttctttaaatccaaccgcagtaaatgtgcaaaatatcattttaggtaatattttaggcattgccgatgacgatatttaccaagtcgcaattattatcggtgtttgtttagtattacttttattattttggaaagatttactactgatttttttcgatgaaacacaagcaagaacggtagggctttcgccattattttataaagttttattttttactttattaagtgcttgtgtggtcgctgcattacaaactgtgggggcgattttagtgattgcgatggttattacccctggtgcaacagcatatttactgacggataaattcaaaaccttgtcaatcatcgccattattttaggagcggtgacaagttttgttggtgtttatattagctattatttagatggtgccacaggcggtgtgattgtgacattgcaaacattattgtttttagtcgctttcttattttcaccaaaatatggcttattaactcgtaataaaaaggcggtagaaaatgtttga

SEQ ID NO: 1192 - DNA, 921 bp, H. influenzae strain 86-028NP
atggactctttctcgacatcaatttgggttaatgatgtaactgttcgttacaacaatggtcatactgctattcacaatatgacgttctcactcaatagtggaactatttgtgcgttagttggcgtgaatggaagtggcaagtccacattatttaaaagcataatggggcttgtaaagccacaacaaggcgaaattaaactttgtgatttgccaatttcccaagcactgaaacgtaatttggttgcttatgtaccacaatcagaagaagtggactggcaatttccagtatcagtgtatgatgtcgtgatgatgggacgttatgggtatatgaattttcttcgtatccccaaagcgattgataaacaaaaagttcaagaggcgatgcagcgagtaaatattgaacatcttgcgcatcgtcaaattggcgagttatctggcgggcagaaaaaacgcgtgtttttagcccgcgctttagcacaacaaagtcccattattttattagatgaaccttttactggcgttgatgtgaaaactgaaaatgccattgttgatcttcttcaacagcttcgagaagaaggtcatcttattcttgtttcaacccataacttaggttctgttcctgatttttgtgatcaagtggtaatgattaatcgcacagttatcgccgcaggaaaaacagaaaacacctttaaccaacataatttggaaattgtatttggtggggtattacgtcatattaaattattgggcgaaaatttacataatgatgaagataaacgttctgttactgtcttaacagatgatgaaaaagccgttgtattctatggcgaaactaagcaagatccacctgcgccaacaacacaaaattgtcattttgaagattgtccttataaaagtgcggttaaaaataagagggattag

SEQ ID NO: 1193 - DNA, 882 bp, H. influenzae strain 86-028NP
atgcgaaattcattcaaaattatgaccgcacttgcacttggtttatttgcaatgcaagctaacgcaaaatttaaagtcgtaaccacttttaccgtgattcaagatattgcgcaaaatgtggcaggcaatgcagcaacagtggaatctattaccaaaccaggtgctgaaattcacgaatatgaaccaacgccaaaagacattgtaaaagcacaatctgccgatttaattttatggaacggcttaaatttggaacgttggtttgagcgtttcttccaaaatgttaaagataaacctgctgtggtagtaacagaaggtattcaaccattatctatttatgaaggcccgtataaagatgcgcctaatccacacgcttggatgtcgccatctaatgctttaatttatattgaaaatattaagaatgcgttagtgaaatacgatccacaaaatgcagctgtgtatgaaaaaaatgccgctgactatgctcaaaaaattaaacaacttgatgaaccgcttcgtgcaaaattagcacaaattccagaagcgcaacgctggcttgtaacaagtgaaggtgctttcagttatttggcgaaagattacaacttaaaagaaggttatttatggccaatcaatgcagaacaacaaggcacaccacaacaagtgcgtaaagtgattgatttagttcgtaaaaacaatattccagttgtgtttagtgaaagtacaatttcagcgaaacctgcacaacaagtagctaaagaaagtggtgcaaaatacggtggcgtattgtacgttgattcactttctgcgaaaaacggccctgtgccaacttatattgatttgcttaacgtcactgtatcaaccattgttaaaggattcggaaaataa

SEQ ID NO: 1194 - DNA, 465 bp, H. influenzae strain 86-028NP
atgaaaaaagcattttggttagtattaagttcagcaatagtcttggctgcttgtgatgataaacctaaaatgacggagcaaactaaaacaactgaccaagcgaaaatggctgcagaacaacctgatcaaaagcccgtattgatcaattataaacaaattgccttagacaaatcccagcaagcgattgatacagcgaaagtcgctcaagacaaatcagttcaagctaatgaagccgtgaaagtagcaatgcaaaaacaacaagaggctgaaattgcgctaagtcaaggtggcgaagaggctgaaaaattgtctaaacaaaaaatggacgaatctaatgcagctgcagaattagctttaaaattgtcggaagaatccaaagctgcttctgcactttcaatccaactttccaaagaagcggaagatgcggctaataaggcgaatcaacaagctcaagctgagaaatag

SEQ ID NO: 1195 - DNA, 879 bp, H. influenzae strain 86-028NP
atgtttaaaaaagctttatttattttatctttgtgtccttcttttttgctggcacagtcttatgttgtgtatgattttacccataatcgagtattggaaagctatgcgcctgatagtattcagcctattgcctctgtaacaaaattaatgacggctaatgtatttttagagaataataaaaatcctaattgtcgaatcgcaatcacaaaagaggatacggatcgaattaaaggtacaggaacaaaattacctaaaaatattcctatctcttgtaacgaattattgaaagcaatgcttgtccattctgataactatgctgcccacgcgctttctcgtgcagcgggaataagtcgtcgccaatttattaataaaatgaacgaaaaagcccatcaacttggtatgtattctactcgttttcacgatagttcagggttatctagctacaatatttccagcccgatggatttggttaaactcgctaaatattcattaaataaatcggacattaaacttttatctaatcttagtgcaacttatattcaagctgggaaacataaactttatattaaaaatactaataagttagtgcgtgatgaaatctttgatgcggcagtgaataaaacgggctacattcgagaatctggttataatctcgttttcattaataaacacctatgcaaaaatgcaactattggcgtaattagtttaaataacacttcctctgcgtatcgttctagttttactaaaagcaaattagaaaaattcggctgcacagcattaaatggaagaacaattcgtgatgtagctggagaagctcaatatgaagatggctatgatgaagtgggatttaatacgctaattcagaaattatcaagataa

SEQ ID NO: 1196 - DNA, 1173 bp, H. influenzae strain 86-028NP
atgtgtaataacgaggctaaaatgtcagaattattgtctgtgcaatcagatgcacccgctaaaaaaattaatctaatggatttaacgcgccaacaaatgcgcgaattttttaaagaactcggcgaaaaaccattccgagcagatcagttagtaaaatggatttatcattttggcgaagataacttcgacaatatgacaaacattaataaaaaattacgtgaaaaacttaaagcggttgcagaaattaaagccccagaagttgccgttgaacagcgttcagccgatggcacgataaaatgggcaatgcaagtgggcgagcagcaagttgaaactgtgtatattcccgaagcagatcgcgcgacgctttgtgtatcttcccaagttggctgtgccttagcttgtacattttgttcaacagcacaacaaggatttaatcgcaatttaacggtttcagaaattatcggtcaagtatggcgagcctctaaaattattggtaactttggcgtaactggcgttagacccattacaaatgtggtaatgatgggaatgggcgaacccttattaaatgtcgcaaacgttgttcctgcaatggaaattatgttagatgactttgcttacggtttatcaaaacgtcgtgtcactttatcaacttctggggttgtgccagcactagataatttgagcaaaatgatcgatgtggcactggcaatttcattacatgcaccaaatgatgaattacgtgatgaaattgtgccaatcaacaaaaaatataatatcaaaaccttgattgactcagtaaatcgttatttaaatgtatcaaatgcaaaccacggcaaagtgacgattgagtatgtgatgctcgatcatgtaaatgatggcattgaacacgctcatcaacttgcagaagtattaaaaaatacaccttgtaaaattaatttaattccgtggaatccgttcccagaggcaccttatgcaaaaagctcgaatacgcgtatcgaccgcttccaaaaaacattaatggaatatggctttaccgtgattatccgtaaaacccgtggcgatgatattgatgcggcttgcggacagctagctggagatgtgatcgatcgtactaaacgtacggcaatgaaacgccaatttggacaaaatattggggtaacagaagttaattaa

SEQ ID NO: 1197 - DNA, 540 bp, H. influenzae strain 86-028NP
atgcaaacaataagtaaacaactaagtgcggttattttccctttcattttttctgcctgcgtttcacaatctgcgtctagcttagatcatcaagctgccgccaaagcgcgagtggaactcgctttgagctatcttcagcaaaataatcctcaactggctaaaatcaatttagacaaagcacttcaacacgataaaaattactatctcgtacattcagcacttgcacattattatcaacaacaagggcaaatagaaaatgcctttcgtgagtatgaaatagccgtaaaacttaatcataaacaaggcgatgtacataataattttggtacgtttctatgtagtcaaaagaaatttgagcaagcccagcaacaatttgaattagcccttaattcgccgaattattatcatcaagcagatacatttgaaaatatcgcgctttgtgcttattccgcgaaaaaaatggatatttatcagcaaacattagaaaaattacgtcaaatcaatggaaaacgtgcggaaaaattcaatagtctaaaataa

SEQ ID NO: 1198 - DNA, 912 bp, H. influenzae strain 86-028NP
atgaatccaactactgagcaagtgctttctcctggtgagatttttcgtcaaacacgcgaagccttaaatctttctcttgaagatgtcgctaaagaaatcacgctacgcccttctatattagagcaacttgaaaataatgaatttattcaaaaatcaacgccttctatatttgtcaaaggttatgttcgcagctatgcaaaattcttacgtttgccagattctgtgtgggaaaatattgtttttgctgaaaccgaaaaaaatgatttagggaaaaatgcacgttcaacccgtgccgttaatcaatattcttctcacaatcgttggatcgggcgtttaaccgcaatagtattcgtgatggtaattggtatgactgggctttggtggtggcaaagttatcaacaaaatactcaagaacgcgatgatttagtgcaaagctatgttgcctctaccgaaaacaatcagcccaccaccgctcttgtgacaacagaagaaactaataaatctgcaccagaaacagcagcaccagtctcacaaccagtagaaataacaaataatctgttaccagaaatagcacaagaaaatagcgtttcacaacccaaaaacgatgaaaaatcagtttcagacattcaaagtgcggtcgaaaatccaagtatttctccaacgttacctatagcaaaaggcgatttagtgattgaaatactagcaaatagcagttggattagtgtaaaagataacgctcgccacgtattagcacaaaaagaatataaacaaggcgaaatattaacctttaatggcaatgaattttcattaattgtaggcgcaccaagcaatgtgcgtatcacttacaaaggcgagaattatcctctcaaagtggatggtcgcgtagcaaaattcaagctttcacaaccttag

SEQ ID NO: 1199 - DNA, 1107 bp, H. influenzae strain 86-028NP
atgtcagcttttcagccaactattaagcgtcgtgaatcgacaaaaatttatgtgggaaatgtaccaattggtggggatgcaccgattgccgtgcaatcaatgacaaatactcgcaccactgatgtggaagcgacagttgctcaaattaaatcattagaacgtgttggtgcagatattgttcgtgtatctgttccaacaatggatgctgcggaagcatttaaacaaattaaacaacaagtgaatgtcccgctcgtagcagatattcattttgactatcgtattgcgttaaaagtcgcagaatatggagtggattgtttacgtatcaatcctggcaacattggtcgtgaagatcgcgtccgtgccgttgttgattgtgcgcaagacaaaaatattccgattcgtattggtgtaaatgcaggctctttagaaaaagatttgcaagaaaaatatggcgaaccaacgccagaagccttgttagaatccgcattgcgtcatgtagaaattctagatcgtcttaacttcgatcagtttaaagtgagcgtaaaagcctccgatgtattcttagcggttgaatcttatcgtttactggctaaagcaattaaacagcctttacatttaggcattacagaagcaggtggcgcacgcgctggcgcagtaaaatctgcggtgggtttaggaatgttattagctgagggcattggtgatacactgcgcatctctttggcggcagatcccatagaggaaatcaaagtcggttttgatattttgaaatctttacggattcgttcaagaggaattaactttattgcttgcccaacctgttctcgccaagaatttgatgtaatcggtacagtaaatgcgctagaacaacgccttgaagatattattacaccaatggatgtatctattatcggttgtgtagtgaatggtcctggcgaggcactcatctccgatctcggcgtaacgggcggtaacaaaaaaagcggttattatcttgacggcgaacgccaaaaagagcgttttgataacgaagatatagtgaaccaattagaagcaaaaattcgtgcgaaagtcgcacgacaagatccaaaaaacagaattatttaa

SEQ ID NO: 1200 - DNA, 1272 bp, H. influenzae strain 86-028NP
gtggcaaaaacaattcaagcaattcgtggtatgaacgattgcgccccaacagaatctccattatggcaatggattgaagcacaagtacgcaatgtattaaatagttatggctattcggaagtgcgtatgccaattgtagaaagtacgccattgtttgcgcgtgcaatcggcgaagtaactgatgttgtctcaaaagaaatgtacaccttttgggataacgatgaacaattaaccttacgccctgaaggcacagcaggttgtgtgcgagcagccattgaacacggttggatctataataatgaacaacgcttatggtatatcgggccaatgttccgtcacgaacgtccacaaaaagggcgttaccgtcaattccatcaagtaggtgttgaggtattcggtattgcgaatccagaaatcgatgccgaattaatcatgcttacctatcgtttatggaaagcgttaggtatcgatcaacatgttacacttcaacttaactcaattggttctttagaagctcgagcaaattatcgttcagctttagttggattcttagaaaaccatcaagatttaatgagcgatgaagaaaaagagcgtttagtaagaaatccgcttcgtattttggatacaaaaaatccagaattacaaaaagtattagataacgcgcctaaattacttgattatttagatgatgaaagccgtgcgcattttgaacaattatgttcattattagatgctgttggtattcaatatgaaattaatcctaaactcgttcgtggtttagattattacaacaaaactgtatttgaatgggtaacctccgctcttggtgcacaaggtaccgtgtgtggtggcggtcgttatgacggtttagtggaacaacttggcggacacgcaacgccaagtatcggatttgcgatgggattagagcgtttagtcttgttggtacaagaagttaatccaaatgttcctacgaaaagtgcggtggatatttatgttgtttatcaaggcgaaggcgcaacattagtcgcttttgaattagcggaaaaagtacgctcggaattaccgcacttaaataccatgttgcactgctctggcggtaattttaaaaaacaatttaaacgtgcagataaatctggtgcaacattggcattagttatcggcgaaagcgaagtacaaaataaacaagtcgttgttaaacacttacaaggtggcacagatcagcaaaccttagatttagtgaatataatcgactatcttcaaactcaattttaa

SEQ ID NO: 1201 - DNA, 615 bp, H. influenzae strain 86-028NP
atggcttattccattgaagaagaacaagagattaaccagttaaaagactggtggaaagagaatggcaaaacaattattgtcgcttttatcttaggtgtgggtggtatgtttggatggcgttattggcaatcgcaccaagcagaacaaatcgctcaagcttctgcacaatacgatactttaattaattctgtgcaacaagacgaacaggctaaaaaagcaaatatagaacaatttgtgcaagcgaatagcaaaactgcatacgctgtatttgctttgttagatgaagcgaaaaaagccactcaaaaacaagatttttcagcagcagaagcaaatttaaaccaagcattaacccaatctcaagatgaagtattaacatctattgttgcattacgtctcagtgcagtacaatttcaattgggtcaattagacaatgctttaaccaccttaaaccaagtgaaaggcgaaagttttaatgctcgcaaagcgattttaacgggcgatatccaagttgcaaaaggagataaagttgcggcgaaaaacagctttgagcaagcacaacaaagtggtagccaattagaacaacaaatggcaaaaatgaaattaaacaacctttaa

SEQ ID NO: 1202 - DNA, 195 bp, H. influenzae strain 86-028NP
atgaaatggacagacgcccaattaattgcagaagaactttacgatcgtaatccagatttagatccaaaaacagttcgttttactgatttacataaatggatttgtgaacttgaagattttgatgacgatccgaataaatcaaatgaatcaattcttgaggctattttattaaaatggctggatgaatttgaataa

SEQ ID NO: 1203 - DNA, 342 bp, H. influenzae strain 86-028NP
atgccaaaagtgatttttttacctaatgaagatttttgtcctgaaggtatggtcgttgatgctgcaacaggagataacttattagaagttgctcacaatgcgggagtagaaattcatcacgcttgtgatggttcttgtgcttgtacaacttgccacgtgattgttcgtgaggggtttgattctttaaatgaaacgagtgatcaagaagaagatatgctagataaggcttggggattagaaatggatagccgtttatcttgtcaatgcgtcgtgggaaatgaagatcttgtggtagaaattccaaaatataaccttaatcacgcaaatgaggcggctcactaa

SEQ ID NO: 1204 - DNA, 1860 bp, H. influenzae strain 86-028NP
atggcattattacaaattgcagaaccaggacaagctgcggcaccgcatcaacatcgtttagccgttgggattgatttgggaacaaccaattctttggttgcatccgtgcgtagtgggcaatccgtgattcttaatgatgaacaagaacgcagtcttgtgccgtcagttgttcattatggcgttgaagagaagaaagttggtttagaagcctttgagcaagcctcacttgatccaaaaaatacggtgatttcagtaaaacgcttaattggtcgcagccttcctgatgttcagtctcgttattctagtttgccttatgaatttgtggcgagtgaaaatggattacctttaattattacggcacaggggcctaaaagtccaattgaagtgtcttcagatattttatcgcgcttaaatcacattgcagaacaacgccttggaggtgagctttctggggttgtgattacagttccagcttatttcgatgatgctcaacgtcaaagcactaaagatgctgcgcgtttagctgggctaaatgtattacgtttattgaatgaacctactgcagctgcacttgcttatggattggatagtgggcaagaaggcattattgcggtttatgatttaggcggtggcacatttgatatttcaattttacgtttatcaaaaggtatctttgaagttttagcaacggggggagacactgcattaggtggagatgattttgatcatttaattgcagattgggtaatagaacaaactaagctaaaaccacaaacagcaaatcaacagcgtgagctaataacccttgccaaccaagctaaaattaccttgactaatgaaaaaagtgcggttatttcttggcaagatttttcagtagagatttcgcgggaacaattcaatgaattaatttatccgcttgtaaaacgttcattgctaacttgtcgtcgggcattgaaagatgccaatgtggaatccgaagaagtacaagccgtagtaatggttggtggttcaactcgcgtgccttatgtaagagaacaagttggcgagttttttggtaaaacaccattaacctcaatcgatcctgataaagttgtggcacttggtgctgcaattcaagcagatattttagtcgggaataaaactgattctgatatgttattacttgatgttgtcccgctttccttaggcattgagacgatgggcggattagtggaaaaaattattccacgtaatacaacaattcctgtggctcgtgcgcaagagtttactacttttaaagatgggcaaacggcaatgagtgttcatgtgctacaaggcgaacgagagctagtcgatgattgtcgttctttaggacgctttactctacgaggtattccgccaatggcggcgggggcagcccatattagagtgacttatcaagtggatgcagatggtttattaagcgttacagcgatggaaaaatcgacaaaagtacaggcttcaatacaaattaaaccatcttatggattaactgatgaagaagtaaccgcaatgattaaatcttcttttgataatgcacaagaagatttacaagcacgtgaattggcagagcagcgtgtggaagcagatcgtgttattgaaagcgtgattgttgcactacaagcagatggggctgaattgcttagcacagatgaatttcatcatattgaaactgtgttaaaacaattaatggatgtaaaacaaggttcagatcgcgatgcaattgcgcaaggaattaaagccttagacactgctacccaagaatttgctgctcgccgaatgaatgcatcaattaataaagctttgacaggtaaaaatctgtcagacattgaaaatccgtaa

SEQ ID NO: 1205 - DNA, 687 bp, H. influenzae strain 86-028NP
atgcaaactcttgaacagctcactagtccagaacattctgcttggataaccctttcccaatggattgataacgctcgcaatcattgtgaagtaattaaaaaagatcaatccagtgcggagcgtgagctttttactatgcaaatgccaacatcctcgccaatgggtgcagtaatctatgaaacaggtggaattttaattcattatggttggttacgtattttaggttctggaagttttaaattaccgcgtggcttgatggattggaatttcagtaaatcttttagtgagtcaggcgaaaaaccaaaatatttattagttgcagatgatgtgattggtggttattttgcgttaaatggtggttcgttaggcaataatattggaaaaatttattactattcatcaaaagatcttacttggcataatttaaattttacttacacagaatttttagcttgggcattgaatggcgatgtagaggccttttatcaagggctattttggaaaaattggcaagatgatgtaaaacaattagatggtaaccaagtttttgtatttacgcctgatttaaaccaagacagaaaaatagcaattgatgaacgtcaaaaacaggaagtcaatattgaaacccattaccaagcaaactttgcagaaaaaaataaatttgatttggcgtattccgtcgcataa

SEQ ID NO: 1206 - DNA, 525 bp, H. influenzae strain 86-028NP
atgttcaatccttttcaaatttttgatttgccagttgattttcagctggatgaaaaagtactaaatgcacgttatttaaaattacaaaaggccctacatccagataattttgtctcaagtagtgctttagagcaacgtgttgcgatgcaaaaatctaccgaagtgaatgatgccttaaaaacgttaaaagacccaattttgcgagctgaagcgatcattgctcttaatactggtgagcagttagatcttgaacaaaaaagcacgcaagatgtggcgtttttaatgcaacaattacaatggcgcgaacaattagaagatgttgaaagccagcaagatgaaagagcattaaatgtttttgcgaaagaaattaaacaagaaactcaatcattattgaccgcactttttgagagtttgaaatctcaacaatgggcgagagcatctcaatactgtgataaattacgttttacccataaactttctgaagaaattgaacgtgtggaagaacgaatttttgaattagattaa

SEQ ID NO: 1207 - DNA, 324 bp, H. influenzae strain 86-028NP
atgggtattacattaacagaaaaagcagctcagcgagtgaaagcctttttggataatcgtggtaaaggtattggattacgtttaggtgtgaaaacatcaggttgttcaggcttagcttatgtacttgagtttgtagatgttttaaattccgaagatcaagtttttgagcagcacggtgttaatattattgtcgatccaaaaagtctcgtttatctcaatggcattgagctggattatgtaaaagaaggcctaaatgaaggctttaaatataataatccaaatgtaaaagaatcttgtggttgtggcgaaagtttccacgtttaa

SEQ ID NO: 1208 - DNA, 381 bp, H. influenzae strain 86-028NP
atggcttatagcgaaaaagtaattgatcattatgaaaatccacgtaatgtgggatcattggataaaaaagatagcaatgttggtactggaatggtcggtgcgccagcttgtggtgatgttatgcaactacaaatcaaggtagatgataatggcattattgaagatgcaaaattcaaaacttacggctgtggttctgcgattgcatctagttcattaattactgagtgggtaaaaggtaaatctttagaagaagctggggcaattaaaaatagccaaattgctgaagaattagaattgccgccagtgaaagtgcattgctctattttagcagaagatgcaattaaagcagcaattgctgattataaagcaaaacaaggctaa

SEQ ID NO: 1209 - DNA, 1221 bp, H. influenzae strain 86-028NP
gtgaaaatgaaattacctatttatttagactacgcagcgacctgtccagtcgatgaacgtgttgcgaaaaaaatgatggcgtttctaaccatcgatggcacatttggcaatccagcctctcgctcacataaatttggttggcaagcagaagaagctgttgatattgcgcgtaatcaaatcgctgatctcattggctcagattctcgtgaaattgtctttacttctggtgcgacagaatctgacaacctcgcaattaaaggtgcggcgcatttctatcaaactaaaggtaaacacattattacctgtaaaactgaacataaagcagtgttagatacttgccgtcaattagaaagagaaggttttgaagtcacttatttgtctccagaagctgatggtttaattgatttagaaaaattcaaagctgcgcttcgtccagatacaattctagcttcaattatgcacgctaataatgaaattggtgtgttacaagatattaaagctattggcgaactttgtcgtgcaaataaaacaattttccatgtggatgcaactcaaagtgttggtaaagttgaaattaatttggaagaattagctgttgatttaatgtcgatgtctagccataaactttacgggccaaaaggtgttggcgcattgtatgttcgtcgtaaacctcgcatacgtttagaggcgattattcatggtggtggtcacgaacgtggcatgcgttcaggtacattacctgttcatcaaatcgtaggaatgggagaggcatatcgaattgcaaaagaagaaatggcatcagaaatgccgcgtttaaaagcacttcgtgatcgtttatataatggcttaaaagatattgaagaaacttatgtaaatggttcaatggaacatcgtttagatagcaatttaaatattagttttaactatgttgagggagagtccttaatgatggcgttgcgcgatattgctgtctcttctggttctgcttgtacatctgctagcttagagccatcttatgtattgcgcgcacttggcttaaatgatgaattggcgcacagttcaattcgtttcacattaggtcgttatactactgaagaagaaattgattacacaattaatttaatgaagggtgcggtagaaaaacttcgtgcattatcgccattatgggatatgtttaaagaaggtattgatttaaataccattgagtggtcagctcactaa

SEQ ID NO: 1210 - DNA, 453 bp, H. influenzae strain 86-028NP
atgaaacttacatcgaaaggtcgttatgcagttacagccgttttagatattgctttaaatgcagatggcgggcctgtaagccttgcggatatttctgaacgccaacatatttccttatcttatttagagcaactttttgctaaattacgtaaagacggtttagtcaaaagtgttcgcgggccaggaggtggttatcagttagggctaccaagtgaacaaatttctgtaggaatgattattgcggcagtaaatgaaaatattcacgtaacgaaatgtctggggcgtgaaaattgtaaaaatggtgtggaatgtttaactcacgaactttgggaagatttaagtttacgtattgaaagttttttaaatgagattacgttagcagagctggtaaataagcgtaatgtaaaacgtcaatctcatcgtgattttagtaatttattagttaatcaataa

SEQ ID NO: 1211 - DNA, 726 bp, H. influenzae strain 86-028NP
atgttggaaaatattcgtattgttttaattgaaacttcgcacagtggtaatattggttctgcggctagagcaatgaaaacgatgggattgacccagctttgtcttgtttcacctaaatctgttgatgaacaatcttatgccctttcagctggcgcagaaaatattgtaaaaaatgctagggttgtcgatagttttgatgaagccgtcgatgattgctctttggtaattggaacaagtgctcgcttacgtcatttacaaaatacattgatcgagcctcgagaatgcgcggagaaagttgtagcgtataaaggcaagatagctattgtgtttggtcgtgagcgtattggattaaccaatgaagaactgctgaaatgtcattatcacttgaatattccagcgaatcctgattattcttctttaaatttagcaatggctgtgcaactggtaagttatgaattgcgtatggctttcttagttcaaaataataagaaaaattcactttctttaatagagaaaaactatccaacaacagatcagttagcttatttttttgactacacagaacgtatatatcagtctcttggatttattcaaaatcaaggagttatgcgtaaattaaagcgtttatactatcgtgcaaaattagagaaaaacgaattaaatattttaaatggtatgctaagtgcggttgaaaaacgaattgatttaacaaaagagaataattga

SEQ ID NO: 1212 - DNA, 462 bp, H. influenzae strain 86-028NP
atgaacaaatttgttaaatcattattagttgcaggttctgtagctgcattagcagcttgtagttcatctaacaacgatgctgcaggcaatggtgctgctcaaacttttggcggttactctgttgctgatcttcaacaacgttacaataccgtttatttcggttttgataaatatgacattactggtgaatacgttcaaatcttagatgcgcacgctgcatatttaaatgcaacgccagctgctaaagtattagtagaaggtaacactgatgaacgtggtacaccagaatacaacatcgcattaggccaacgtcgtgcagatgcagttaaaggttatttagctggtaaaggtgttgatgctggtaaattaggcacagtatcttacggtgaagaaaaacctgcagtattaggtcatgatgaagctgcatattctaaaaaccgtcgtgcagtgttagcgtactaa

SEQ ID NO: 1213 - DNA, 1284 bp, H. influenzae strain 86-028NP
atgaaattattaaaacgtttagtgagcgtatttgcgattgtacttgctgttggaagcaatgcattcgctggcgatgaagtacgcattgtcattgatgaaggggttgatggtgcgcgccctattgctgtcgtgccatttgttggttctgcaccagaagatattagcaaaatagttgcagatgatttacgtaacagtggtaagtttaatcctattgcggtgtctcaaatgcctcaacgcccaacttcagcagcagaggtaaatcctgaggcttggtcgaatattggaattgacgcaattgtaattggacaagtggttccatcgggtaatggttatagtattacttatcaattaattgatacggttggtgcatcaggtacgccaggggctgtattaatgcaaaatagctatacagtgacaaataaatggttacgctatggagcgcatactgtgagtgatgaagtttttgaaaaattaactgcgatccgtggtgcctttagaactcgtatcgcttatgttgtgcaaaaaaatggcggttcgcaaccttatgaagttcgtgtagcagattatgatggctataatcaatttatcgtcaatcgtagtgcccaaccaattatgtctccagcttggtctccagacggccagcgtttggcttatgtatcgtttgaaaataaaaaatcacaacttgttgtacaggatttaaattctggcgcacgtaaagtagtggcatcttttcaagggcataatggcgcaccagccttttcgccagatggttctcgtttagcttttgcttcttctcgtgatggtgttctgaatatttacgttatgggagcaaatggcggtacacctactcaattgacgagtggtgcgggtaataatactgaaccagcgtggtcgccagacggaaattcaattttatttacatccgatagaagtggttcgccacaagtttatcgaatggatgcaagcggaggtagtgcaacagcagtgggtggtcgcggcagcgcgcaaattagtgcagatggaaaaacacttgtgatgattaatggtaacaataatgtagttaaacaagatctcacaacgggcgtttcagaggtacttagtacatcttttctaggcgaaagtccaagcctctctccaaatggaattatgattatttatagttctacacagggcttaggaaaggtgctacaattggtttctgcagatggtcgctttaaggcgagccttccaggaagtgatggtcaagttaaatttccagcttggtctccatacttaactaaataa

SEQ ID NO: 1214 - DNA, 1227 bp, H. influenzae strain 86-028NP
gtgcaaaataatcgacaaaagaaaggaatcaatgcttttgctatttctatccttttgcactttatcttgtttggcttattgattttaagttcgctttatcacaccgttgaaattatgggtggtggagaaggtgaaggagatgtaataggggcagtgattgttgatactggtacggctgctcaggaatgggggcgtattcaacaacaaaaaaaagggcaagcggataaacaaaaacgcccagaacctgttgtggaagaaaaaccacctgagcctaatcaagaagagattaagcatcaacaagaagttcaacgacaagaagagattaagcatcaacaagaagttcaacgacaagaagagttaaaacgtcagcaagaacagcaacgtcagcaagaaataaaaaaacaacaagagcaagctcgtcaagaagcgttggaaaaacagaagcaagctgaagaggctagggctaaacaagcggctgaagctgcaaaattaaaagcagatgcagaggctaaacgtttagctgctgcggcaaaacaagctgaagaagaggctaaagcgaaagcagcagaaattgctgctcaaaaagcaaaacaagaggcagaaactaaggcgaaactagaagcggaagctaaggcaaaagccgctgctgaagctaaagcaaaggctgaagcggaggcaaaagcgaaagcagcagctgaggcaaaagcaaaggctgaagcggaggcaaaagcgaaagcagcagctgaggcaaaagcaaaagctgatgcagaagctaaagcgaaagccgctgctgaggcaaaagctgctgcggaagcaaaacgtaaagcagatcaagcaagcctagatgatttctttaacggcggagatgttggtggcggtagtgcatctaaagggggaaacacaaataaaggtggaactcaaggtagcggtgctgcacttggctctggcgatggtggtaaggttggggatcaatacgcaggtgtaattaagaaagagattcaacgtcgtttcttaaaagatccaaattttgcaggaaaggtttgtcgtattaaaattcaattaggtcgagatggcacaatcttggggtatcaaaaaatttcaggctctgatgatatttgttcagctgcattaagtgcggtggctagaacgaaaaaagttccagctgcgccatcagatgaaatttatgaaaaatataaatcaccaattattgactttgatattcgataa

SEQ ID NO: 1215 - DNA, 420 bp, H. influenzae strain 86-028NP
atggctcgtcgtcagcgtaaagcaattaaatctgaaattaatattgtgccttttttagatgtgcttttagttttagtgttaatttttatggcaaccgcccctattattagtcaaagcgttcaagttgaattgcctgattctgtgcaaagccaagaggtttctaatgaagataaagtgcccgtcattcttgaagtggcaggcattggaaaatatgcgatttctattggcggagaacgtcaagaaggtttaacagaagaaatggttactcaattatctagacaggaatttgataaggataataatacactatttttagtaggcggagctaaagaagtgccttatgaagaagtgattaaggcattgaatttacttcatcttgcaggcattaaatctgtaggtttaatgacaaatcccatttag

SEQ ID NO: 1216 - DNA, 687 bp, H. influenzae strain 86-028NP
atgactgcagaattgaattttttagatctttttctaaaagcaagtattgttgtgcaactggtaattgtgattttgatttctttctcaatcatatcttgggcaattattattcaacgtagccgtattttaacgaatgccttaaaagaagcgcgtacgtttgaagatcgtttctggtcaggagaagatttaaataaactttatgaagggctatctaatcgtcgcgatggattaacgggcagcgaacaaattttttgcgtgggatttaaagaattttcacgtttaaaacaagtaaatccagacgcacctgaagcgattattaaaggcacaatgcgtgcgatgaatcttgcgatgaaccgtgagattgaaagtttggaaaaccgagttccatttttagccacagtggcatctgttagcccttatattggtttattcggcactgtttggggaattatgcacgcttttatggcattaagtggtgcaaaacaagcaacgttacagatggtagcaccaggtatcgccgaagcgttgattgccactgcgattggtttatttgccgcaattcctgcagtaatggcttataaccgtttaagcttacgagtgaatgccattgaacaagattacggtaattttattgatgaatttacgacgattttacaccgtcaagcctttggtaaagcccctcactaa

SEQ ID NO: 1217 - DNA, 411 bp, H. influenzae strain 86-028NP
atgttggataattgcttttcttttcctgttcgtgtgtattatgaagatactgatgcaggtggcgtagtgtatcacgctcgctatttgcatttttttgaacgagcaagaacagaatatttgcgtacattaaattttacgcaacaaaccttactagaggaacaacaactcgcatttgttgtcaaaacgctcgccattgattattgcgtggcagcaaaattggatgatttacttatggtggaaacagaggtttcagaagtaaaaggggctacaatcctttttgaacagagactgatgcgcaacaccctgatgttatcaaaggctactgttaaggtagcctgtgttgatctaggcaagatgaaacctgtggcgtttcccaaagaagttaaagcggcgtttcatcacttaaaataa

SEQ ID NO: 1218 - DNA, 1923 bp, H. influenzae strain 86-028NP
atggattacgaaaatcaaattgccaatattttctcactaaatggcgaattaagccaaaatatcaaaggttttcgtcctcgagctgaacaacttgaaatggcacatgctgtaggtaaagcaattcaaaataaatcttctcttgttattgaagctggaacgggtacaggaaaaacctttgcatatctcgcgccagctttagtttttggtaaaaaaaccattatttctacaggatctaaaaatcttcaagatcagctttttaatcgagatcttcctgctattaaaaaagcccttaatttcacgggaaaaattgcgttgctaaaaggtcgggcaaactatctttgtttagagcgtttagatcaagtgattgctcaaggtgtgcttggagataagtctgttttagctgaattaagtaaagtacgaaaatggaataatagtactaaaacaggcgatttcacagaatgtatcgagcttgcagaagatagcccaattattcctcaactgacgagtacagctgaaagttgtttaggcaccgattgccctaattattcagaatgttatgtagcaagtgcgcgtaaaaaagcattaaatgctgatttggttgtagttaatcatcatttattttttgctgatatggctgtgaaagaaagtggttttggcgaacttattccaaatgcagaagtgattatttttgacgaagctcatcagctgccagatattgccagtcagtattttggtcaatctttaacatcacgccagctttttgatttatgcaaggatattaatattgtctatcgcacagaacttaaagatatgcagcagcttggcacaacatctgataccttactgaaagtggtacaagattttcgtttattactgggtaatgggagtaatgttcgaggaaattggcgtgagctttacaagcaaagtgcggtgaaaaaatcctttgaattattacaagagaaaatagattttttagctgaggtaattaaattagcacttggtcgttcccaaactttagacagtatttttgagcgtgttgagtccattaaaatccaactcaaacgtttatctgaaacaaatattgtgggttattgttattggtatgaaggaaatggtcgccagtttggtttacatattacgccattgacggtagccgataaatttggtgctcagctcgaagcgaaagaagccgcttggatattcacatctgcgacattagaagtggggggaacttttaatcatttctgccaacgtttaggcattgaaaatgcgacacaaaaaattttatatagtccctttaattattctgagcagtctttgctttgtgtgcctcgatatttgccgaatactaatcaagtgaatacattaaattcactaggcgaaatgttattacccgtgattgaagcaaacaaagggcgttgctttgttctttgcacttcttattcaatgatgcgtggtttagctgaatatttccgtgaaaaaagtcatctttcgattttattacaaggcgaaacctcaaaaggcaaattactcgaacaatttataaaagaaacgcatagcgttttggtggcaacttctagcttttgggaaggtgtagatgtacgcggagatgcactttctttagtgattattgataaacttccctttaccgcaccagatgaacctttgttgaaagctcgcattgaggattgtcgtttacaaggtggcgatccattcaatgatattcaaattcctgaagcggtaattaccttgaaacaaggcgttggacgtttaattcgtgatgttacagatcgtggcgttgtgattatttgtgataatcgattagtgatgcgcaattatggcgaaacttttttgaaaagtttacctaactcaagtcgtacccgtgatctcaacaaagtgatacaattcttacaaaataagtaa

SEQ ID NO: 1219 - DNA, 711 bp, H. influenzae strain 86-028NP
atgcaaaatttaactttattggcgttggacacctctactgaagcctgttctgtcgctttattgtatcgtggtgagaaaacacatattaatgaacttgcccaacgtacacacactaaacgaattttacctatgatcgatgaaattttggtaaattcgggtttaggtttaaatcaagttaatgctttagcttttgggcgtgggcctggtagttttactggtgttcgtgttggtgctgggattgcacaaggtttagcgtttggtgcggatttgcctgtcattccaatttcaaatttaaccgcaatggctcaggcagcatttgaattacatcaagcagaaaatgttgttgccgcaattgatgcgagaatgaatgaagtctatttttctcaagtagtgagagaaaaagtgcggtcagattttggagaagtttttcaatggcgagaaatcattagagaacaagtttgttctccagaacaagcgattaaccagcttcaaaatgataacgcatttagagtcgggacaggttgggctgcttattctcaatttactaaaaaaaatctaactggctcagatatagcattacctaatgccttatatatgttagaacttgcgcgagtagaatttttgcaaaaacacacaattccagctttagaaattgaaccgatttatttgcgaaacgaggttacttggaaaaaattaccagggcgtgaataa

SEQ ID NO: 1220 - DNA, 552 bp, H. influenzae strain 86-028NP
atgaaaggaaaaatcaccttattttttaccgcactttgcttgggattaacgggctgtattgcaccaccaaaagggttagaaaaagagcgattctcaattaattcctatcgcgagatttctcctcaggatttgacctgtcattgtaaaacagttcgacttggaggaaaaattatcaatactaccgttttagcaaatcaaacaaaaattgaagtgttaagtttacccgtatcatcaatttcaggtaaaccatttgttgaattgcaatccgatggtcgctttatcgtgtatttcaacggttttgttgagcctgaaaatttaaaagaacgttatattactgtaggtggtcaattagctggaacagagaaaggcaaaatagaacaagctgattatacttatcctgttgttcaagcggataaataccgtatttggacactcagtaccatctatgagtatccaacagatgattgggatgaagatgatgattggggattttttagatggagatatcgcccttggtatgttcagcctgaaattcgctattatttgaattaa

SEQ ID NO: 1221 - DNA, 1689 bp, H. influenzae strain 86-028NP
atggaaaaaatttggtttcaaaattatccagaaggttctgaaaaatttctagatacctcaaaatatgaatctattttggatatgttcgacaaagcagtgcgcgaacatccagatcgccccgcttacattaatatggggcaagtacttactttccgtaaattagaagagcgcagtcgtgcatttgccgcatatttgcaaaatgaatttaaacttcaacgtggagatcgcgtggcattgatgatgccaaatttattgcaatatcctatcgcactttttggtattttacgggctggcttaattgcagtaaatgtcaatcctctttatactccgagagaattagagctccagttgcaagatagtggtgcggtagcgattgtcgtggtatcaaattttgcttctaccttggaaaaagtcgttttcaataccaatgttaaacacgttattcttacccgaatgggcgatcaactttcttttggtaaacgtactttagtcaatttcgtcgtaaaatatgtgaaaaaactcgtgccgaaatataaattaccgcacgcagtaacattccgtgaagtattgagtattggtaaatatcgccaatatgttcgtccagaaatatcgcgtgaggatttagcctttttacaatatactggcggtacaactggcgtggcgaaaggtgcaatgctgacacacggaaatattataaccaatgtcttccaagctaaatggattgcagagccatttattggcgatcattctcgcactcgttcagctattttagccttgcctctttatcacgtatttgccttaacggtaaactgcttattatttttagagttaggtatcacggcgattttaattactaatccgagagatattgaaggatttgtgaaagagttgaaaaaataccgttttgaagcaatcactggtgtaaataccttatttaatgccttgttaaataatgaaaatttcaaagaagttgatttttctgcgttgaaactttctgtgggtggcggtatggctattcaacaatcagtggcaacacgttggcacgaattgacgggctgtaacatcattgaaggttatggaatgacggagtgttcgccattaatcgccgcttgtccaattaatgttgtgaaacataatggcactattggtgtgccagtgccaaatacggatataaaaatcattaaagatgatggctctgatgcaaaaattggcgaagctggcgaattatgggtgaaaggcgatcaagtaatgcgaggttattggcaacgacctgaagcaacgagtgaagtgttaaaagacggttggatggcaactggcgatattgtcattatggatgaatcatatagcttacgcattgtggatcgtaaaaaagatataattttggtttctggctttaatgtctatccaaatgaaattgaagatgtcgttatgctgaattacaaagtgtctgaggctgtggcaattggtattcctcacgcagtttctggcgaaacgataaaaatctttgtggtgaaaaaggacgatagtttaactcgtgatgaacttcgcaaccattgtcgtcaatatctcacaggctataaagtgccaaaagaaattgagttccgagacgaactgccaaaaaccaatgttggcaagattttacgtcgggttttacgcgatgaagagatcgcaaaacgtccaaaacattaa

SEQ ID NO: 1222 - DNA, 1143 bp, H. influenzae strain 86-028NP
atgataaaagaatgtcaaaatccaccgcactttagagtcatttcagataatgctgcactattggaaatttgtaatttggctcagatgaaaagtgcggttgccctagatacagaatttatgcgtgtttccacttattttcctaagttgggattaatccagctttatgatgacgagcgcgtctctttaattgatcctttagcgattacggatttttctccttttgtcgcattgttatccaaccctaaggtattaaaaatcttacattcttgtagtgaagatttattggttttcttacaagaatttgatcagcttccacgcccaatgattgatacacaaattatggcgcgctttcttgggcttggcacatcagcaggattggcaaaattagcacaacaatatttaaatatagaaatcgataaaggcgcaactcgcaccaattggatcaaacgccccctttctgatattcaacttcaatatgccgcaggcgatgtttggtatttgttaccgctttatcatattcttgaaaaagagttagcgaaaacaccttgggaacaagcagtaagagatgattgcgaactggctcttgctaaaacacataaattacaagagcgagattcagaaaaagcttatttagatattccaaatgcttggaaattaaatccatttgaattgtctcgtttaagaattttggctcagtggcgacaaaacgtcgcaatagagcgtgatttagcactttcttatattgtgaaatccgataatctttggaaagtggcaaaaaataatccacgtaatacatctgaaatgttagaaatgggattaactgaaaatgaagtacgcgtgcgtggtaaaaagattttacaattgcttgctcaagcaagacgcgtttcgcctaatgattacccaaaacctattgaacgtatttctgaagatcctcgttataaaaaaacaattcgattgttacaagaaaaagtgaatagcttaacaccagcaggtttaacccctgaaatccttgcgagtaaacgcactttggatgaattaattaaatgggtttggaaatatgattgttctcaagacaaactccccgagctgctgattggatggcgtaaacctattgctgaaaagttagtggatatacttaaataa

SEQ ID NO: 1223 - DNA, 1869 bp, H. influenzae strain 86-028NP; identical to SEQ ID NO: 667

SEQ ID NO: 1224 - DNA, 1092 bp, H. influenzae strain 86-028NP
atgggattcaaatgtggtattgtgggattgccaaatgtgggcaaatctactctttttaacgcactcactaaagctggcattgaagccgcaaactatccattctgtactatcgaaccaaatacgggtgtcgtgccaatgccagatccacgtttagacgcattggcagaaatcgttaagcctgaacgcatattacctactacgatggaattcgtggacatcgcaggcttagttgcgggagcaagtaaaggcgagggcttgggtaataaattcctcgctaatattcgtgaaaccgatgcgataggtcacgtagtgcgttgttttgaaaacgatgacattgtacacgttgcagggaaaattgatccgcttgatgatattgaaactatcaacactgaattagctttagcagacttagacagctgtgaacgagcaatccaacgtttacaaaaacgtgcaaaaggtggcgataaagaagctaaatttgaactttccgttatggaaaaaatccttcctgtgcttgaaaatgctggaatgattcgttctgttgggttagataaagaagaattgcaagcaatcaagagttacaacttcttaacgttaaaaccaacaatgtatatcgcaaacgtaaatgaagatggttttgaaaataatccatacttagattgcgttcgtgaaattgctgaaaaagaaggggcagtggtcgttccagtatgtgctgcgattgaatctgaaattgcagaacttgacgatgaagaaaaagtcgagtttttacaagatttaggcattgaagaaccaggattgaaccgagtaattcgtgctggttatgcacttttaaatcttcaaacttatttcactgctggcgtaaaagaagtacgagcttggacagtttcagtcggtgcaaccgcaccaaaagcagcagctgtaatccacactgactttgaaaaaggctttatccgagcagaagttatcgcttatgaagactttatccaattcaacggtgaaaacggtgcaaaagaagcaggtaaatggcgtttagaaggcaaagattacatcgtgcaagatggcgatgtaatgcatttccgattcaacgtataa

SEQ ID NO: 1225 - DNA, 585 bp, H. influenzae strain 86-028NP
atgtcagaaataaaactcattgttggtttaggcaatcctggcgaaaaatatgccgatacacgccataatgcaggcgaatggcttattgaacgcttggctcgtcgttttaacgtttcactaaatccagaaagtaaattcttcggaaaaactgcccgcactttagtgaatggaaaagaagtacgccttttagtgccaacaacttttatgaatttaagcggtaaagcagttggcgcgttggcaagtttttaccgtattaaacctgaagaaattttggttattcacgatgaactagatttgcctgctggcacagcgaaactcaaacaaggcggtggacatggtgggcataacggcttaaaagatattgtggctcaattaggcaataacaataatttctaccgtttacgtattggcattgggcatcctggtcatcgtgatttagtggcaggttatgttttaaataaaccatctccagcagatcgcgatgcacttgaaaaagtgttagatgaggcaactgattgtgtagaaataattttcaaagatggaatgatcaaagcgaccaatcgtttaaacagttttaaaatttaa

SEQ ID NO: 1226 - DNA, 309 bp, H. influenzae strain 86-028NP
atgaatcagattaacattgaaatcgcttatgcttttcccgaacgttattatttgaaatcttttcaagttgatgaaggaatcaccgtgcaaacggcgattacgcaatcagggattttaagccaatttccagagattgatttgagcacaaataaaattgggattttcagtcgtccaataaaattgactgatgtattaaaagagggcgatcgtattgaaatttatcgtccattacttgctgatccgaaagaaattcgccgtaaacgtgcagcagagcaagctgcagccaaagacaaagaaaaaggagcttaa

SEQ ID NO: 1227 - DNA, 1215 bp, H. influenzae strain 86-028NP
atgaccgcactttcatccgttgatttttgtttacctgaacatatcacgccagaaatttttctacgtgattattggcagaaaaagccacttgtgattcgtaacggtttgcctgaaattgttgggcagtttgagccacaagatattattgaacttgcacaaaatgaagatgtcaccgctcgtttagtgaagacattttctgatgatgattggaaagttttttttagccctttgagcgaaaaggatttccaaaaattgccagaaaaatggtcggtgttggttcaaaacttggagcaatggtcgcctgaattaggacaactttggaacaaatttggctttattcctcaatggcaacgtgatgatattatggtgtcttacgcaccgaaaggtggctctgtcggcaagcattatgatgagtatgatgtatttttagtgcaaggctatggccatcgtcgttggcaagtgggtaaatggtgtgatgcaagcactgaatttaaacccaatcaatcgatccgaatttttgatgatatgggcgaattagtcattgatgaagtaatgaatccaggggatattctctatattccagcccgtatggcgcattatggcgtggctgaagatgattgtttaaccttttcttttggcttgcgttatccaaatttaagcaatttgattgatggcataagcaaaggtttttgtcatcaagatcctgatttgaatttaagcgagtttgatttaccgctacgtttaagccagtctgaacaacgtacaggtaaacttgcagatgaaaatattcaagcgatgaaacagcttttattagataaattggctcattcagaagcttttgatacgttgtttaagcaagccgtagcaagtgcggtaagttctcgtcgttatgagttattagtctctgatgaaatgtgtgatcctgatgaagtgcggtcaattttagaagaagatggcgcattcctttctcaagacaacaattgtaaattgctttacaccgaaaatccgttgcgaatttatgcgaacggcgaatggttagatgaacttaatataattgagagcgaagtattaaaacgcttgtctgacggcgaaagtttagattgggcgtttttatctgatttagccaataaaacagaagatcccgaaacctcaatggatttgctgttagattcaatttgtaactgggttgatgatggttgggcgttaattgaataa

SEQ ID NO: 1228 - DNA, 1320 bp, H. influenzae strain 86-028NP
atgtcagacaatatttattccgtctctcaactaaattctgccgcacgtcagatgttggagggtaatttttcccaaatttggctaacgggggaaatttccaattttacccaacctgtgtctgggcattggtatttaacgctgaaagatgaaaatgcacaggtgcgttgtgcaatgtttcgtatgaaaaatttgcgtgtagcttttcgtccacaaaatggaatgcaagtgcttgtgcgtgccaatgtgagtttatatgagcctcgcggcgattatcaacttattattgattctatgcacccagcaggcgagggattattgcaacagcaatttgaagcgttaaaaatgaagttggctgcggaaggattgtttgctcaaaatcttaagaaaactctaccgcactttagtaaagcagtggggattataacttcttctacaggtgcggcattgcaagatattttgcatattctggcacgccgtgatccaagtttaaaagtcgtcatttatcccactgcggttcaaggcaaagaggcaactgcagaaattgtgcaaatgattgaacttgctaatgcgcgacaagaagtagatgtattaattgtggggcgtggtggtggttcattagaagatctttggtgttttaatgaagaagaagtggcgcgagcgatttttcgttcaaccttacctattatcagtgcggtgggacacgaaacagatgtgacgattgccgattttgttgcagatcttcgtgcgccgaccccttctgctgcggctgaattagttagtcgtaatcaagatgaattattgcaacaacttcgccatcaacagcaacgtttagatatggcatttgatcgtttatttacgcgaaaaagccagcgtttgaaacagcttgccttacgattgcaaaatcaacatccacagaatcagctacgtgctcaacaagcgaaaaatgaacagcttacacatcgcttgcaacttgcaatattgcgtcagtttgaaaatacacaacaaaaattcaccgcactttctgttcgtttaaaacaaaatccattgccatatcgcatacaacgttatcaacaaggcttagagcagttaaaagtgcggttaaatttttgcgtaaatcgccaagtgacggaacgtcaaaataaactggcaacattatgcggaaaactggatggcttaagcccattaaaagtcttggcgagaggttattccattgcggaaaatccgcaaggtaaagccattgttagcgtgaaagatgtcaatcaaggggacttcattacaactcaagtggctgatggaaaaattgtgagtaaggttttgtaa

SEQ ID NO: 1229 - DNA, 654 bp, H. influenzae strain 86-028NP
gtgcagttttggagaaaacagatgtcagaaattcaacattttagccaacaagatatagaaatattgggcgaacaaactttgtatgaaggttttttcacgcttaaacgaatccaatttaaacataaactttttgctggggggcaaagtggcgtcgtaacccgagaattactgattaaaggcgcagcctcagcggttatcgcttatgatccaaaagaagattcggtgattttagtcgaacaagttcgtattggtgcggcttatcatccagaatctaatcgttcgccttggttactcgaactaattgcaggtatggtggaaaaaggcgaaaagccagaagaagttgctttgcgtgagagtgaagaagaagcagggattcaagtcaaaaatttaacacattgcttaagtgtgtgggatagcccaggtggcatcgtggagcggattcatttatttgcaggcgaagtggatagcacacaagcgaaaggcattcacggtttggctgaagaaaatgaagacattaaagtgcacgtagtaaaacgtgaacaggcgtatcaatggatgtgcgaggggaaaattgataatggcattgcagtgattggattgcagtggcttcaattaaattatgctcagttacaacaaagttggaaacgtagttag

SEQ ID NO: 1230 - DNA, 825 bp, H. influenzae strain 86-028NP
atgaaaaatacgtttgtttatcaggcggaaaagcctgttataaagttattacaaattaccgatccccatttatttaaagatgaaagtgcggaattattgggggtaaatacacaagcaagttttgctcaagtattaaaggaaattcagcaagaaaataaccaatttgatgtgattcttgccacaggcgaccttgtgcaggatagtagcgatgaaggttacattcgttttgtagaaatgatgaaacctttcaataaacctgtgttttggattccaggaaatcacgactttcagcctaaaatggcagaatttttaaatcagccaccaatgaacgcagcaaaacatcttctattgggcgagcattggcaagccttattgttggatagccaagtttatggtgtaccacacggacaactaagccagcatcaactcgatttattaaaagaaaccttagaaaaaaatccagaacgctataccttggttgtattacaccatcatttattaccaactaattccgcatggcttgatcaacataaccttcgtaattctcacgaattggcagaagtgcttgcgccttttagtaatgtgaaagctattttatatgggcatattcatcaagaagtaaatagtgaatggaatggttatcaagtgatggcaacgccagcgacttgtattcaatttaaacctgattgccagtatttttctcttgatacgttacagcctggttggcgtgaaattgagttatactcagatggttcaattcgtacggaagtaaagcgtattcagcaagcggaatttttaccgaatatgcaagaagaaggatattaa

SEQ ID NO: 1231 - DNA, 288 bp, H. influenzae strain 86-028NP
atgaccgtaaaatgcaaagcagaagaatccttaacttgcagctgtgttgatgtaggcacgattattgatggctctgactgtagcgtagaagtacatcaagtttatagcacagaagcagatgccaatgccgcacttgaacgattaacgaagaaagcgcgcgatatagaaagcgatccttgcgaaattaaaagcgaaatcgtggcagttgaaaacggtgttcaattaaatgcctctttcacttttagttgccaagcagaagcgatgatttttgaactggcgaatcgttaa

SEQ ID NO: 1232 - DNA, 1377 bp, H. influenzae strain 86-028NP
atgaaaaaatttaatcaatctctattagcaactgcaatgttgttggctgcaggtggtgcaaatgcggcagcgtttcaattggcggaagtttctacttctgggcttggtcgtgcctatgcgggtgaagcggcgattgcagataatgcttctgtggtggcaactaacccagctttgatgagtttatttaaaacggcacagttttccacaggtggcgtttatgttgattctagaattaatatgaatggtgatgtaaattcttatgctacaataacatcagcaagtagtggagtgagaacaataaagcacggctcagcttcacagcgtaatgttgttcccggtgcttttgtgccaaatctttatttcgttgcaccagtgaatgataaattcgcgctgggtgcaggaatgaatgtcaatttcggtctaaaaagtgaatatgacgatagttatgatgctggtgtgtttggtggaaaaactgacttgagtgctatcaacttaaatttaagtggtgcttatcgagtaacagaaggcttgagcctaggtttaggggtaaatgcggtttatgctaacgcccaagttgaacggaatgctggtattattgtggagactattgataaccaagtaaacacagcactctcagcactgcaagaaccattcagagatcttaagaagcatttgccctctaaagacaaatctgttgtgtcattacaagatagagcagcttggggctttggctggaatgcaggtgtaatgtatcaatttaatgaagctaacagaattggtttagcctatcattctaaagtggacattgattttactgaccgcactgccactagtttagaagcaaatgttatcaaggcaggtaaaaaaggtgatttaacctttacattgccagattacttagaactttctggtttccatcaattaactgacaaacttgcagtgcattatagttataaatatacccattggagtcgtttaacaaaattacatgccagcttcgaagatggtaagaaagcttttgagaaagaattgcaatacagtaataactctcgtgttgcattaggggcaagttataatctttatgaaaaattaaccttacgtgcaggtattgcttacgatcaagccgcatctcgtcatcagcgtagtgctgcaattccagataccgatcgcacttggtatagtttaggggcaacctataaattcacgccgaatttatctgttgatcttggctatgcttacttaaaaggcaaaaaagttcactttaaagaagtaaaaacaataggtgaaccacgtgcattgacatttaatacaactgcaaattacacttctcaagcacacgcaaatctttacggcttaaacttaaattatagtttctaa

SEQ ID NO: 1233 - DNA, 570 bp, H. influenzae strain 86-028NP
gtgcttttcttttataaaacaaggcgaaaaatgaccgcactttattacacttattacccctcgccagtgggacggcttttgattttatctgacggcgaaagcattacacatattgattttgaaaaagagcaatatgcgcctaatccaaaatggctcaagcaagatgaattgcctgtttttcaaaaagtgcggttagcttttgaacgatattttaatggggaagttgagcgatttgcagacattcccttaaaaccagaaggcaccgcatttcaacaagccatttggcaagccttgcgagaaattgcttatggcgagctttcaacttatggcgagctggcgttacggattaataatcctaaagctgttcgtgccgtgggcggtgcggtaggcagtaatcccattagtattattattccttgtcatcgcattttaggtaaagatcgtactttaactggttttggcggtggcttagaggcaaaacgttttttattgcagttagagaaaattccctatattgataaaggcactgaaaacactaagcctcgcttttttaagaaatatcacgaatga

SEQ ID NO: 1234 - DNA, 672 bp, H. influenzae strain 86-028NP
atgattccacaaactcttgaacaattactttcccaagcgcaatcaattgctggcttaacttttggggagttagctgatgaactgcatattcctgttccgattgatttaaaacgtgataaaggctgggtgggcatgttattagagcgtgctttaggcgcaacggcagggagtaaagctgaacaggatttctctcatttaggtgttgaacttaaaacattgccgattaatgcggagggttaccctcttgaaaccacctttgtgagccttgccccgttggtacaaaattcagggattaaatgggaaaattcccacgttcgccataaactttcttgtgtactttggatacccattgaaggcagccgtcatattccattacgtgaacgccatatcggtgcgccaattttctggaagccaaccgctgagcaagaacgtcaattaaaacaagattgggaagaattgatggatttaattgtacttggcaaattggagcaaattaccgctcgaattggtgaagtgatgcaacttcgcccgaagggcgcaaatagtcgtgctgtgacaaaaggcattggcaaaaatggcgaaattatagataccttgcctttaggtttttatctaagaaaagaattcaccgctcaaattttgaaagcgtttttagatgtaaagccgctttaa

SEQ ID NO: 1235 - DNA, 1293 bp, H. influenzae strain 86-028NP
atggatttactttcagacattgaaaaacaactccaaaaagccaccgctcaagggtttcttatcgccttgagtggtggtttagattccactgtacttctttctttatttgcaaaactttgtcaaaaacaaccgcacttaccgcctttatcggtacgagcaatccacattcatcacggcttaagccccaatgcagatagttgggctaaacactgccaaaacttgtgcgatcaatttcaaattccattgattatcgagcgagtacaagtagataaaaccaatggcattgaagcaggggcgcgtgaagcacgctatcaagccataaaaaaacatcttcaaatacaagaaatgttagttacagcgcatcatctaaacgatcaaacagaaacatttttcttagccctaaaacgtggcagtgggctacaaggcttaagcgcaatgcaacaacaaagtgtattattcggaatgccaatttttcgccctttgttaggttttactcgcccacagttagaagattatgcgcaacaagaaaagctcaactgggttacagatgaaagtaatgaggataatcgatacgatcgtaatttcttacgcaatgaaattttgccaaaattacgtgaacgctgggcgcattttgatttagccgtacaacgttccgcacaacattgttttgagcaacaacagttaattaatgatttattgagcgaaatttttacagaacattgtcaaattaaaaaccaatttaaactgctccaatttcgccaatattctctcgcaaaacagaccgcacttttgcgtatgtggcttgccaaaaaccaacttgaaatgccaagtaaacgccagcttacacagcttattaatgatgtcatttttgcaaaagaagaggcaaatcctcaatttcagcttgtaaataaagttattcgacgttatcaagatagtttatatttaactaagccgttttctgatctaaccaaatgcaccctaaaattagaacaaaacatgctaaatttacccgatgatttaggcaatctcactgttcacgaaaatgaacataatctgattttctactggcaggattactctgttacgctggaaaaaacgaacttgcctatttctattcgttttggctattcgggcaaagtgaaacatcatccgaaacgcccaagagaagatataaaaaaaatctggcaagaattaagcgtaccaccttgggaacgaaatcggatccctttaattttttatggcaatgagctaaaaagtgcggtcggttttttccgtgtttttgacgaatattaa

SEQ ID NO: 1236 - DNA, 105 bp, H. influenzae strain 86-028NP
atgaaaaccacctttgaactgggttcttacgagttacaaaccattgctgcacgttttgaaattcttaatccaagcagtaactataaagctgaaaaagttgcctaa

SEQ ID NO: 1237 - DNA, 948 bp, H. influenzae strain 86-028NP
atgaaccaagaatatttagattttgaattgccgattgctgaattagaagcaaaaattgaagcattacgagcagcatcagatgataaagttgatttaactgatgaaatcaaacgcttacaaaagaaaagtaacgaactcactaaaaaaacctttgctaacctcgatgcttggcaagtttcacgtatggcgcgtcatccaaatcgtccttatacattagattatatcgaacatatttttacggaatttgaagaacttgcaggggatcgcgcttttgctgatgataaagcgattgttggtggcttggcgcgtttagatggtcgtccagtgatggttatcggtcatcaaaaaggtcgttctgtaaaagaaaaagtacaacgcaattttggtatgcccgcacctgaaggctatcgtaaagcgttacgtttaatggaaatggctgaacgttttaaattgccaattatcacatttattgacacaccaggggcttatccaggtattggcgcagaagaacgtggtcaagcggaagctatcgcccgtaacttacgcgaaatggcacagcttaccgttcctgttatttgtaccgttatcggcgaaggtggttcgggcggtgcattagctattggcgtgggcgataaagtgaatatgttacagtattcaacttattctgttatttctccagaaggctgcgcttctattctttggaaaagtgcggaaaaggcatcaacagcagcagaagtaatgggattaactgcaagccgtttaaaagaattaaatcttatcgacagcattatgcaagaacctttgggtggcgcacatcgcaattatgcgaaaatagctgaaaacttaaaacttcgtttaaaagaagatttagctgaactcgatgaactaagcaaagaagaattattaaatagacgctatgaacgtttaatgtcttatggttattgctaa

SEQ ID NO: 1238 - DNA, 786 bp, H. influenzae strain 86-028NP
atgtttgaaattttatttcctgcccttttaacaggcattgtgctttcgcttattaccgcgccacttggcgtatttgtggtgtggcgtaaaatggcttattttggcgacaccctttctcattctgccttgctcggtgtagcattaggtattttcttacaagtcaatccttacattgcgattgtggtgcttaccttaattcttgctatcgcaatggtgtggttagaaagcaatacgcaattttctattgataccttgctcggcattatcgcccatagctgtttatctcttggcgttgtgacagtaggattattacggaatgtacgggtagatttaatgaattatttatttggggatttactcgcaattaattatacggatttaatttatatcgggattggcgtaataattgtgctttcaacattaatttacttttggcaatccttactttccaccaccgtatcgccagaactcgcacaagttgaaggcattaatatcaaaaaaatgcgttttattttaatgatattaaccgcattgacgattgccttgagtatgaaatttgtcggtgcattaattatcacatccttattaatcattcctgcggcaaccgctcgtcgctttgcgagaacgccagaatctatggtgggctgggcgattattatgagtatgttatcgattataggtggattaatattatcagccttttatgatactgctgctgggccttctgttgtgatttgttctgcgtttttatttgtcttatcactcttcaaaaaagagcgattataa

SEQ ID NO: 1239 - DNA, 807 bp, H. influenzae strain 86-028NP
atgaatatcacagccattcgcaacgagcaaaacccacaaccgctcattcaattaaaaaatatcaatgtggttttcgcacaaaaaaccgctctgcaagatattaatttaaatatctatcccaattctattattaccattgtggggccaaatggtggtggcaaatctacgttgttaaaaaccttattaaaactacaaatgcccacttctggcgaagtcatttatagtaaaaatgttcgcattggttatgtaccacaaaaaatccatttggatcatagtttgcctattacggttgagcgatttctttcgctaaaaaaaggcattaaaacccaagaaatatccaccgcacttgagcaactttcgatttcacatttacgcaaaagcaatatgcaaaaactttctggtggcgaaatgcaacgtgtattattgacgcgtgcaattttaaataaaccgaatttacttgtgctagacgaacccactcaaggcgtagacattactggtcaagctgagctttatcagctaattcatcaaacccaacaaaaattaaattgtgccgtattgatggtatcacacgatttacatattgtgatggcggatagtaaagaagtattgtgtattaaccaacatatttgttgtgcaggtacgcccgatgttctctcaaatgatccaacatttatgcgtttatggggaaatcagatcgcacaaaatgtcggcttttatacccatcatcacaatcatcatcacaccttgcacggcgatgtgtgcggttgtaattcatcagcagtgcattgtcaaaataaggataaataa

SEQ ID NO: 1240 - DNA, 1428 bp, H. influenzae strain 86-028NP
atgccagtgcaacacgtaaaattagctcgagatagacgaaaaaaacgcacatatataaaagtaggcgtgttttttgttgctattctgcttattttgacaggcattttacttacaataaaagacaaatctgaagaaaatcccatattttccacctctgacagtggggaatatcacgagttaaatacatcgccaaataaaaattccaccgcacttcaacctgatgaagatgccacctcttatgatgatgaactgcaagcaaaagatgatgaagttgatgaagtaaaactatcttcagatgatctcggtactttacctcaacacgcacaagacgcactcaatggtttattagacgcggccgatcaagccataagaattactgatcaatttagctatacggtaaccgaaggggatacgttaaaagatgttttagttttatctggtttagatgattcatcagtacaaccgttgattaagcttgatcccgaattagcccacttaaaagcaggtcagcaattttactggattttaaataaaaatgataacttggaatatttaaattggctggtttctgaaaaagaagaacgtatttatgaacgtctcgaagatgggaaatttaaacgccaagttattgaaaagaaaagtatttggcgaaaagaagtattaaaaggcgagattcaaaattctttaaatagtagtttaagagaacaaggtcttgatacgcgacaaattagccaacttagtaacgccttacaatggcaagtgagtttacgaaaactaaaaaaaggcactcaatttgccattttagtttctcgtgaatatttaggcgataaacttacaggtcaaggtaatgttgaagcgttacgtatttcatctggtggtaaaaattattatgcagtgcaagcggcaaatggtcgttattataatcagcaaggggaaactttaggcaaaggttttgctcgttatccattgcagcgacaagcgcgagtttcctccccttttaatccaaatcgtcgccatccagtaacaggacgtgttcgtccccataaaggcgtggatttctctgtttctcaaggcacaccagttattgcaccagcagatggtacagttgaaaaggtcgcttatcaggctggcggtgctgggcgttatgttatgttgcgtcacgggcgtgaatatcaaactgtttatatgcacttgagcaaatccttagtaaaagcagggcaaaccgttaaaaaaggcgaacgtattgcgctttctggtaacacgggcatttctacggggccgcatttacattatgaatttcgtattaacggtcgagcagtgaatcctcttactgttaaattacccggtactagcagtggtatgacttcagctgaacggaaacaattccttgttcgtgttcgtgaagctgaaaaaatgttaaaaccttag

SEQ ID NO: 1241 - DNA, 957 bp, H. influenzae strain 86-028NP
atgacgatttctaaatttaatccacaaaaacctttcgagtgttttattgtacaaagtgaagcgatgaaaagtgcggtagaaaacgcgaaacgttttgctatgtttgatgtgcctttgttaattcaaggcgaaacggggacaggaaaggatttgttagcgaaagcctgccattatcagagtttacgtcgtgataaaaaatttatcgcagtaaattgtgctgggttgcctgatgaagatgccgaaagtgaaatgtttggtcgaaaagttggcgacagcgaaaccattggtttttttgaatacgcaaatgagggtacagttttactcgatggtattgctgaactttcattgggtttgcaggctaaattattgcgttttttaacggatggatctttccgtcgagtaggcgaagaaaaggaacattatgcaaatgtacgtgtgatttgcacatcacaggttccactccatttgcttgttgagcaaggtaaagtacgtgctgatttatttcatcgcttaaatgttcttactcttaatgtgccgccattacgcgaacgcatgactgatattgagccactggcacaaggttttttacaggaaatcagcgaagaattaaaaattgcaaaaccaactttcgataaagattttcttctttatttgcagaaatatgactggaaagggaatgttcgtgagctttataacaccctttatcgtgcctgctctctggtacaagataatcatttgactatcgaaagtttaaatcttgctccgccacaaagtgcagtaatttctttggatgaatttggaaataaaaccttagatgaaatcatcggttcttatgaggcacaagttctaaaattattttatgcagaatatccaagcacgagaaaattggctcaacgtttaggcgtttcccatactgcgattgcgaataaattgaaacaatatggaattggaaaataa

SEQ ID NO: 1242 - DNA, 276 bp, H. influenzae strain 86-028NP
atggcaaaaggacaatctttacaagatccttatttaaatgcgcttcgtcgtgaacgcattcctgtatcaatttaccttgtaaacggaattaaacttcaaggtcagattgaatcattcgatcaattcgtgattttattaaaaaacacagtgaaccaaatggtatataaacacgcaatttcaacggttgtgcctgctcgttcagtttcgcatcacaataataaccatcataccactccaacagaagcagttgaaaacgtggaaactcaagcagagtaa

SEQ ID NO: 1243 - DNA, 996 bp, H. influenzae strain 86-028NP
ttgcaccgattttcaaaaggaaaaaaaatgacaaaacaaaatgaaaaaatcattaattcatccgtaaaaatgctgacaattagtgaagatgaaagtggacaacgaattgataattatttattagcaaaactcaaaggcgtacctaaaagtttaatttatcgcattgtgcgtaaaggcgaagtgcgagtaaacaaaggcagaattaaaccagaatataaactgcaaacaggcgatgttgtacgcattccacctgtgcgtgtcgcagaaaaaaatgatgcgccgatttcaaaaaatctcaataaagttgccgcacttgaaaaccaaattttgtttgaagatgattgcttgattattttaaataaaccctcaggaatcgcggtgcacggcggaagtggtttaaattttggtgtgattgaagccttacgagcattacgcccagaagcacgctttttagaactggttcatcgtttagatcgcgatacatcaggcattttattaattgccaaaaaacgttcagcattacgcaatttgcacgaacaacttcgcgtcaaaaccgttcaaaaagattatttagcgttagtacgtgggcaatggcaatcccatataaaagttattcaagcccctcttttgaaaaatgaattatctagcggagagcgtattgtgcgtgtcagcgagcaaggaaaaccatctgaaactcgctttagcattgaagaacgctatataaatgctacgcttgtgaaggcttcaccagtcacagggcgaacccatcaaatccgtgtgcatacacaatatgctgggcatcctattgcattagatgataaatacggcgataaagattttgataaacaaatgaatgaattaggattaaatcgtttgtttttgcacgctttttcaattcggtttgaacaccctaaaaatggcgaaacactacgtttcaatgcgtcactagatcatcaaatgaaagcaattttgcaaaagttgcgggaaagcaaatag

SEQ ID NO: 1244 - DNA, 2856 bp, H. influenzae strain 86-028NP
gtgcggtttattttgaggttttttaaatatttaataagagaattgacaatgaaaagaatgttaatcaatgcgactcaaaaagaagagttgcgtgtcgcgcttgtcgatggacaacgcctttttgatttggacattgaaagtccaggacacgaacaaaaaaaagcgaatatctacaaaggaaaaattactcgcgttgagccaagcttagaagcggcttttgtggattatggtgcagaacgtcacggttttttacctttaaaagaaattgcccgtgaatattttcctgatgattatgtttttcaaggtcgtccgaatattcgcgatattttgaccgaaggacaggaagttatcgttcaagttaataaagaagaaagaggaaacaaaggtgcagccttaactacttttgtttctcttgctggcagttatttggtgcttatgccgaataatccacgggcaggaggaatttctcgccgtattgagggcgatgaacgtactgaactaaaagaagcattaagttcattagatgtgcctgaaggtgtaggcttaatcgtccgtactgctggtgtgggaaaatcgccagaagaattacaatgggatttaaaagtattattacatcattgggaagcgatcaaacaagcttcacaaagtcgtccagctccatttttaattcatcaagaaagcgatgtgattgtacgcgctattcgcgattatttgcgtcgtgatattggtgagatcctgattgatagcccaaaaatttttgagaaagcgaaagagcatatcaaacttgtgcgtcctgatttcatcaatcgcgtgaaactttatcaaggcgaagtgccacttttcagtcactatcaaattgaatctcaaattgaatccgcattccaacgtgaagtgcgtttaccttctggcggttcaatcgttattgatgtaactgaagcattaaccgccattgatattaactccgcacgttctactcgtggtggcgatattgaagaaaccgcattaaataccaaccttgaagcggcagatgaaatcgcgcgtcaattacgcttacgtgacttaggtggattagttgtcattgatttcattgatatgacaccaattcgccatcaacgtgaagtagaaaatcgtattcgtgatgcggttcgtccagatcgtgcccgtattcaaattagccgaatttctcgttttggtttgttagaaatgtcacgtcagcgtttaagcccatcattgggcgaatcttcgcaccatatttgccctcgttgtcaaggaacaggcaaagtgcgtgataatgaatctctttctttatctattttacgtttgctggaagaagaagcattaaaagagaacaccaagcaagtacataccattgtgccagtacaaattgcctcttatcttcttaacgaaaaacgcaaagcaatcagtaatattgaaaagcgtcataatgtcgatattattgttgccccaaatgaagcaatggaaacaccgcactttagtgttttccgtttacgtgatggcgaagaagtaaatgaattaagctataacttagcgaaaattcactgcgctcaagatgaaaatactgaagaatcactgctttctcgtaatgtggaaacaacagctgttattgaacaaccagcggttgaaagtgcagtagttgcactttctatttcagaagcagccccaacgccagttgagcgtaaatcaaatgaaccctctttgttagctaaaattattgcgaaaattaaaggtttatttgcgactaaatctgaagaaaacaaaccgaaaaataaccgcacttcgcgcaatcctaatcgtaatcaacgccgttcacaggatcgtcgttcttctcgtcgtccacgttctgaaaataacgaaacagaaagaaccgaagaacaggttcgtaatgtccgtgagcgtaatcaacgccgtccgcgccgtaacttagtggaagaaagtatcgctgaaagtgcggtaaattctacacctgtttttgaggctaaagaagaaagaactgagcctgtaactcaacgccgccaacgccgtgatttacgtaaacgcgtgcgcgttgaagataatgaaacagttgttgaaaataacttcagcacgactgaaaaaatgccagaagtggatgtaattacggttcaaaataatgatgaaaaacccgttcatcagaaccaacgttctgaacgtcaagagcgtcagcgtcgtactccacgtcatttacgtgcagcgaataatcagcgtcgtcgccgtaatcaagagccaaaatcgccaatgccattatttgctgcggtggtttcgcctgaattggcaagtggcaaggcttggattgattattcaacggtaaatctgccaaaagaaaatcatttcttatctgtggatgaattgcttgagcaagagaaaactaaaaaagggtttatcacgccagcaatgggaattgtcgttgaagaaaaatcccctgatgtaaaacctgcattagattttattactcaaccagctaatgaatcggtacagaaaaaagtacaagaatctttagaccgtttaagttcatataaacctcaagaagttgttgaatctattgatccagcaattaatgtagatgaacctgaaacgctcgagaaagtatcaaaatttgtccgcacttatgaatttaatggacgtttaggtacaatttcttcagtaccccatacaaaagcggagatgactttagcgaaagcaaatgatgaaatgccagaggctttcccaattagggcttggcaggattctcgttattatttctatggaaaaggtgcggcaggacatcattgtgcaattagccacgtttattctgaaccaacccgcgcaaaatcagaataa

SEQ ID NO: 1245 - DNA, 213 bp, H. influenzae strain 86-028NP
atgccaataggcggagatgtgaaggcggatcaggaaacatcaggttctagaagcataaaacgcattggctttggttttattggtggtattggctatgacattacaccgaatattaccttagacttagattatcgttataacgattggggacgcttagaaaacgtgcgttttaaaactcacgaagcctctttcggtgtacgttaccgtttttaa

SEQ ID NO: 1246 - DNA, 798 bp, H. influenzae strain 86-028NP
atgcttatgcaatcaatttatctctccaaaatccgtgagcagaatccgctcattcataacatcaccaacattgtggcagcaaattttagtgccaatggcttgttggcattaggagcttcgcctttgatgtcggcgaatatcgaagaaatgcaggaagtaccgaaaatcagtcaagtattggtcattaatattggtacgctgattggtaaagatcgggaggcaatgttgcaggcaggaaaaacggcaaatgaggttggaattcctgtagtgttagatcctgttggtgtgggggcaacgagctatcgccgtgagaccattcgccaattgctggcagaagtaaaattcgcacttattcgtggtaatgcaggtgaactggctgccattgcaggcgagacgtggcaggcaaaaggtgtagatgcagggcaaggcgaagtggatttaaaagccgttgccgagaaagtggctcaacgctatggctgtacggtgttgattagcggggcggtggatattgtcagcgatggcacacaaactgcgaccgttcacaacggcacgtcattgttcccgaaagttacggcttcgggctgtttattgagtgccgtgtgtgcggcttttttagcggtaagtgaaggaaattatttttctgcgacattagaagcctgtgtagcatacaccattgcaggcgagtgtgcggcgcaaggcttaaccacacaagtgggacagttccaaatccgtttgttggacgagcttgctgccctttcccctgaaaccattggacaaagagggcgcatcaatgagtaa

SEQ ID NO: 1247 - DNA, 810 bp, H. influenzae strain 86-028NP
atgagtaatgtgaaacaagttttaaccatcgcagggtcagacagtggcggtggtgcaggcattcaagcggatcttaaaaccttccaaatgcgcggcgtgtttggtacatccgtaattacagctgttactgcacaaaacacacttggcgtatttgatattcaccctattccactgaaaacaattcaagcgcaactggaagcggtcaaaaatgatttccagattgcaagttgcaaaattggtatgttgggcaatgcagaaattattgaatgcgtggcagattttcttgctgataaacctttcggcacgctggtgctagatcctgtaatgattgccaaaggtggtgcacccttattgcaacagcaagcggtaagtgcattaagccaaaaattgctgccgttggcggacgtgattacaccgaacattcccgaagcggaagcattaacggggattgcgattgtggacgacatcagtattcaacaagccgcaaaagcgttgcaaaaacaaggagcgaagaatgttattattaagggcggacattcgctcaattcgcaaagtgagctgtgccaagattgggttttacttgcagatggtcgtcattttactttgcaaagcccccgtttcaacacgccgcatacacacggtacgggctgtaccttttctgcctgtttaaccgcagagttggcgaaaggcgaaccgttgcaaagtgcggtaaaaacagcgaaagattttattaccgctgcgatttctcacccattgaatattgggcaaggacacgggccgacaaatcattgggcttacagtcgcctttaa

SEQ ID NO: 1248 - DNA, 681 bp, H. influenzae strain 86-028NP
atgaaaaatattcaaaaaatcttaccgctttactttgtggcaggcacgcaagattgccgtcatttgggcgagaacttgtcggaaaatttattattcgtgctaaaacaagcgttagaaggcggaattacctgctttcaatttcgggataaaggcaaattttcgttagaacatacgccctcagcacagaaggcactggcgatgagttgtcgtgatttgtgccgtgaatatggcgtaccgtttattgtagacgacaacgttgatttggcgttggaaattgaggcagatggcattcacgttgggcaaagcgatatgcctgtgcaagagattcgagctaaaacagataaaccgctaattattggttggtcggtgaatcgtttagacgaggcaaaaattggggaaaatttagcggaaattgattattttggaattggcccgatttttccaacgcaatcgaaagagaatccgaaaccaacactaggaatggcgtttattcaaactttgcgaaatgtgggcataactaaaccgcttgtggcaattggtggggtgaaattagctcacgttaaaaccttacgagaatttggggcggatggtgtggcagtgattactgcaattacgcacgccgataatgtgcaagccgcaacaaaagcattacgggaggcaagtgatgaatacgcaaaatag

SEQ ID NO: 1249 - DNA, 1305 bp, H. influenzae strain 86-028NP
atgaatacgcaaaatagtttaaagcaagtagcaacagcgacgatggtcggcacggcgattgagtatttcgataactacatttacgcaatagcagcggtattggtatttaaccatcaattcttccatgtagcagatccactttcagggcagattgcggcactttccactttagcacttacttttattgctcgccctttgggagcaatattgttcgggcatttcggtgaccgtttcgggcggaaaaatacttttgtgatgagcttgctgttgatgggcgtttccactgtggttatcggtttgttgccaacctatgacagcatcggtatttgggcgacaattttgctctgtttatgccgtattgggcaaggtatcggtttaggcggagagtggggcggtgcagcgttagttgcggtcgaaaatgctccagaaggtaaacgaggttggtatggtactttcccacaactgggagccccgcttggcttgttgttggcaaatggcgtattcttaggcattacggcaattttcgggcaagaagctatgactgaatgggcgtggcggataccgtttttatcttccgttatcttagtggcaattggcttatatgttcgcctaaaactgactgaagccccgattttccttgcggcactcaataaaccgcagccaaaacgcttaccaatgttggaagttgtcactacttatttcaagccgtttttcttggggatgttaatttgtattgcaggctatgtgctgttctacattatgattgcctttagccaaatttacgccaaatctgccccaacggtttcagaggcaggatacgcaatgggattaggactttccccgcaaatttttaccgctttattgatggcaagtgcggtttctttggctattaccatcgccgtttcgggcaaatatatcgacaaaattggtcgccgtatttggctcatttggacaaccgttggcgttgcgatttttggtttatccttgccgttatttctcgaaaacggtacaactaccagtctgttttggtttttattcatcggtatggggttaattggaatgggctatggaccattagcgagttttttacctgaactcttccctactcacgcccgctattcaggtgcttctttaacctataatattgcaggtttattcggggcaagtgttgcagcaatcattgccttaccgctgaatgctcactacggcttaaaaggtgtggggatttatttaaccctaaacgctgtgttgagcttggttggattatggtttatttcagaaacgaaagataaattactatcctaa

SEQ ID NO: 1250 - DNA, 102 bp, H. influenzae strain 86-028NP
gtggggtattgtagagaaaatatttggcttgtaaaggaaagtgcggttaaattcttagtagaattttatgtaaaatttaaccgcttaatagattgtatttaa

SEQ ID NO: 1251 - DNA, 1380 bp, H. influenzae strain 86-028NP
atgacaacccaattcaaaccagaattactttcccctgcaggctctcttaaaaatatgcgctatgcgtttgcttatggtgcagatgcggtttatgcaggacaacctcgttatagcttacgtgtacgcaataatgaatttaatcacgccaatttgaaaatcgggatcgatgaagcccattcccttggcaaaaaattctatgtagtggtaaacattgcaccccataattccaaactcaaaacttttattaaagatttacaacctgtcatcgatatgaaaccagatgctttaattatgtctgacccaggcttaattatgttggtgcgtgaaaatttccctaatattgatattcatctttctgtgcaagccaatgcggtaaactgggcaacagtgaaattctggaaacaaatgggattaactcgtgtgattttatcgcgcgaactttcaatagatgaaattgctgaaattcgccaacaaatgccagatattgaactcgaaattttcgtacatggtgcgttgtgcatggcgtattctggccgttgcttactttctggctatatcaacaaacgcgatccaaatcaaggcacttgcaccaatgcttgccgttgggaatacaaaatggaagaaggcacgacggatgaagtaggcaacatcgtgccgaaaatcgatcctgctcaacaaatcgaagtgaaaaatgtagcaccaaccttaggcgatggcacagtaacagataaagtcttcctttataccgaatcacaaaagcctgacgaacaaatgacagcgtttgaagatgaacacggcacctactttatgaattcaaaagatctacgtgccgtacaacatgtggaaaaactgaccgcacttggtgtgcattctttaaaaatcgaaggccgtactaaatcattttattattgtgcaagaacggctcaagtttaccgcaaagccattgatgatgcagccgcaggcaaaccatttgatgaaagcttaatggatacgttagaatcccttgcgcatcgtggttataccgaaggtttcttacgtcgccatacgcacgatgaataccaaaactacgaatatggctattctatttctgatcgtcagcaatttgtcggtgaatttacgggcaaacgtaacgaacaaggtatggctgaagtagcagtaaaaaacaaattcttacttggcgacaatgtagaaatgatgacaccacaaggcaatattaatttcaaaattgaaaaaatgctaaatcgtaaaaatgaaacggttgatgcagcactaggtgatgggcattttgtattcttaaatgtaccacaagatattaacttaaattacgctttattaatgcgtaatttagttaataccaatacaagaaacccacattgctag

SEQ ID NO: 1252 - DNA, 1320 bp, H. influenzae strain 86-028NP
atgaatttatcccaatttgaacaattcgatctttctccagaacttttaaaggcacttgagaaaaaaggttattcccgcccaacagctattcagatggaagccattcctgccgcaatggaagagcgtgatgtattaggctctgcaccaacgggaacagggaaaaccgctgcttttttattacctgcgctacaacatttattggattatccacgccgtaaaccagggccaccgtgtattttgatattaacaccaacccgagaactggcaatgcaagtggctgaacaagcggaagaattagcgcagttcacccatttaaatattgcgacaattacaggtggtgtggcgtatcaaaatcatggtgatgtattcaataccaatcaagatttggtggtggctacgccaggtcgtttattgcaatacattaaggaagaaaattttgattgccgttccgttgaaatgctgatttttgatgaagccgatagaatgttacaaatgggatttgggcaagatgcggaaaaaattgcagctgaaacccgttggcggaaacaaactttgttgttttctgcaaccttagaaggagagttattggtcgattttgcggagcgtttgttgaatgatcctgtgaaagtagatgcggaaccaagtcgccgtgaaagaaaaaaaatcaaccaatggtattatcacgcagacagcaatgaacataaaatcaaattgctcgcgcgttttattgaaactgaaaaagtaacccgtggaattgtatttgttcgccgtcgtgaagatgcgcgtgaagtttctgaaacattgcgtaaacgaggcattcgttccgcatatttagaaggcgaaatggcacaaactcaacgtaacaatgccattgataaattgaaatcaggtattgtgacggtattggttgcaacagatgtggctgcgcgtggtattgatattgatgatgtaagccacgtgatgaattttgatttgccctatagtgcggatacttatttgcatcgaattggacgtaccgcgcgagctggcaaaaaaggcacggcagtctcttttgtcgaagcgcatgattacaagttgctaggtaaaatcaaacgttatactgaggaaattttaaaggcgcgcattttagcaggtttagaacctcgcactaagccaccaaaagatggcgaagtgaaatctgtcagcaaaaaacaaaaggcacgcattaaaaaaaaacgtgaagaaaagaaaaaaacagaggcaaagaaaaaagtaaaattgcgtcataaggatacgaaaaatatcggcaaacgacgcaagccaagtaacagtaatgtttaa

SEQ ID NO: 1253 - DNA, 723 bp, H. influenzae strain 86-028NP
gtgcggtcaatttacgaaaaatttatgagcggatttacctttaaacaattccatatcaatcaagattcttgtgccatgaaagtcggcactgatggcattttgttaggtgcttgggctgatgtaaagcattgtaaaaatattttagatatgggcagtggcacaggattattgactttaatgttagcacaacgaactgaagaaaactgtcaaattcaagcggttgagttggatcccattgcagcaaaacaagcacaagaaaacatcaataattcagtgtggaaaaatcgcattcaacttactcaagcggatatacaacattttttacaaaccactgaacaaacctttgatttaattgtggcaaatccaccttattttgaacaaggtatcgcttgtaaaaatgaagaacgagaattggctcgttataccaagcaaagccacttaaattggttagaatgggctgcaacacgcttgtcggaaaatgggaaaataagttttgttttgccttatgatgcaggcaaaacgctcacaaaatccaccgcacttttttgcataaaacagacgaatgtcatcactaaaataggaaaaacgccccagagaatgttgcttacctttgccaaacaacccgaagttttaatgcaagatcaattggtaatttatgatgcggataatcaatacactgaagcgtttattgaattgactaaagacttttatttgaaattttaa

SEQ ID NO: 1254 - DNA, 606 bp, H. influenzae strain 86-028NP
atgaacgacaaacgcaaaccgtcttttcaatccgcaggcaaaacctttcaagaacgctcagtaggtgaaaaatacagagaaaaaccaagccaaaatcgaccgcactttaatgataaatttaatggaaatagaaacgaaaaatctcgttttcctcgtgataaacaagaagtgaaagaaactagaattaagcaactttctttatctcgcgcaccatcaaataaaaatacagaacaacctaaggttcaagtgacaataaaaagtacgggtacggtttataaaacgaaagaaaagaaaactggtgcgctttctcctcgtgcgcctgaaaaaattaagaaaaaccgtgcggaagaaatgaaggtttacggtgaaaatgcctgtttagctttatttgcagagcgtcctgaaagtattgttcgattgtgggcaaccgtgcaaatgtcacacaaaattggcgaggtattgagttatttagccgaaaacaagaaggcttatcacgttgtagatagtgaagaattagcccgagtgagcggaacagaacatcacggtggcatttgcttattggtgaagaaaccgcgtgctttcacgttgcaagggtattttagatag

SEQ ID NO: 1255 - DNA, 1368 bp, H. influenzae strain 86-028NP
atgttaatcaataaaaccaaacgagctgaacaaaatttaaataatttgccattccttgctttgcaagctgagcaaattgaatttttgggtagctcggctgaatttaaaactcaaattattgaattaatcagaaacgcaaaaaaacgtatttatgtcaccgcactttattggcaaaaagacgaagcgggacaggaaattctcgatgaaatttatcgcgtgaagcaagaaaatccacacttggatgtaaaaattctcatagattggcatcgtgcacaacgcaatttattaggggcggaaaaatctgccactaatgcagactggtattgcgagcaacgccaaacttatcagttacctgatgatccgaatatgttctttggcgtgccaattaatacgcgagaagtttttggtgtattgcatgtcaaaggctttgtatttgatgatacggtgctttatagcggtgcaagtattaataatgtctatcttcatcaatttgaaaaatatcgttacgaccgctatcaaaaaatcactcatgccgaattagctgattcaatggtaaatttcatcaatgattacttgttagatttcagtgcagtttatccacttgatgtgaccaaccgccctcgtactaaagagatccgcggtaatattcgagcttatcgtaaagaccttgctcaaaatggagaatattcattaaaaagtgcggtgaaattaccgaatgttttaagcgtatcgccactgtttggcttaggcgcatcgggcaacgaattaaatcaagtaattgaagatttattcttacaagtacaagaaaaattggtgatttgtacgccatattttaatttcccacgcacattgcaacataaaatagcaacattattggaaagcggtaaacaagtagaaattattgttggcgataaagtcgcaaacgatttttacattccaccagaacaaccattcaaaatggcgggggcattaccttatctttatgaaagtaatcttcgccgtttctgtgaaaaatttgagactcaaattgaaaatggtcagcttgtggtgcgtttatggcgtgatggcgataatacctaccacttaaaaggtgtgtgggtagatgaccgttatattttattgacgggcaataatcttaaccctcgagcatggcgtttggatgcagaaaatggcttattaatttacgatccacaacaacagcttttagcccaagtggaaaaagagcaaaaccaaattcgccaacatacaaaagtattaaaacattactctgaattagaagaattgaatcaatacccagaaccagtgcaaaaacttttgaaaaaatttgcacgaattaaagcagataaattggtgaaaatgattttgtaa

SEQ ID NO: 1256 - DNA, 726 bp, H. influenzae strain 86-028NP
atgcaaaacaataacgacattttaaaagcccaaagtccagcagctttagcagaggaatatattgtaaagagtatttggcaagatgtttttccttcgggcagtaatttgccatcagaacgtgatttagccgataagattggtgtaactcgcaccaccctacgtgaagttttacaacgtttggctcgtgatggttggctaacaattcagcacggcaaacccaccaaagtaaataatatttgggatgctgcagggccgaatattattgaaaccctaattgctttggatatgcagtccgcgcccttaattattgataatatgctctctttacgtagtaaaatgtcggaatcttacatttatgaagcagtaaaaaattcccctcaaaaatcaaccgcactttttgctgaattagagcaattacaaaacacagcacaagattacacagaatttgattaccaattatttcgtcaatttactgttgttgccaacaaacccttttatcgtttaattttcaatagtttaaaaggtgtttatcagcgaatagggttgttattttttaaagaaaaaaaacaccgtgaattaacaaagcaattttatttagaaatgcaacaaatttgtcttgagggaaatgcagatgcagtagtggattgcatccgtaaacataatttacgttcttcaacctattggaaagccattttagaacgattgccacaaaatttatcagattaa

SEQ ID NO: 1257 - DNA, 1569 bp, H. influenzae strain 86-028NP
gtgataaaaataatggagttcactatgacaaacattcaggcttttatgaaaaactttcttggggcaagtccagaatggtacaaacttgccattgtggtttttcttattataaatccaattgttttcttttttattagtccttttattgcgggttggttactggttgcagaatttattttcacattggcaatggcattaaaatgctaccctcttcaaccaggtggtctattagcaattgaagctattattattggaatgacaaatgccaaacacgtcaaagcagaaattatggcaaactttgaagtgatcttgctactgatatttatggtggcaggtattttctttatgaaacaattactgctttatgtatttactaaattacttgtcaaaattcgttctaaaattgcactttctattgccttttgttttagtgctgcttttttatcggcttttctcgatgctttaacggttgttgctgttatcattagtgtcgcaatgggattttatggtgtgtatcacaaagttgcatcaggcaataatttaattgatgcggttgatatttcagacgatagaaaaattattgaacaacagcacgaaatcttagaaaaattccgtgcattcttacgtagtttaatgatgcatgcgggtgtaggaactgcactcggtggtgtaatgaccgttgttggagaaccacaaaacttaattattgcagaacaagcaaaatggaactttatggaatttttcctccgtatggcacccgtgactattcctgtgtttatctgcggattactcacttgtttcttggtcgaaaaattcaaattatttggttatggcgagaaattaccagacgaagtgtggaaagtcttatcagacttagatcgcactaattcagaaaaaatgtctaaacaagataaaattaaattaggtatgcaagcgttaatcgcaatttggttaattcttggattagcattccatcttgccgcagtcggtttaattggtttaagtatcatcatttttgctacgtctttcactggtgtgacggatgaacatactatcggtaaagcctttcaggaatctttaccctttactgcattgctcgttgtattcttttctgttgttgcagtaattattgatcaaaaacttttttcaccaattattcacttcgttctttctgcggaagaaaatacacaacttgctttattctatttgtttaatggcttgctttcttctatttctgataatgtatttgttgcaacggtttatattaatgaagctaaagctgcactgacaaatggagtaattgcaccgcatcaatttgaattgctttctgttgccattaatacaggtacaaacttaccatcagttgcaacaccaaatgggcaagctgctttcttattcttattgacttcatcaatttcgccattaattcgcctttcttatggcagaatggtttatatggctttaccttacacgattgtactttcaatcattggtttactggctattgaatttattttaccagctgccacaatttggttagcaagtttaggtttaattttgccaatttaa

SEQ ID NO: 1258 - DNA, 534 bp, H. influenzae strain 86-028NP; identical to SEQ ID NO: 629

SEQ ID NO: 1259 - DNA, 1833 bp, H. influenzae strain 86-028NP
atgtgtggtattgtcggtgcagtagcgcaacgagatgtagcggaaatcttaattaatggtttacatcgtttagaatatcgtggttatgattcagctggtgttgcagtaatcaataaacaaaatgaattacaacgtattcgttgtttaggcaaagttaaagctttagatgaagccgtatcagaaaaaccattaattggtggaacgggaattgcacatactcgctgggcaactcacggcgaaccatcagaaactaatgcgcatccgcattcatcaggtacttttgctgtagtacataacggtattattgaaaatcacgaagaacttcgcgaattattaaaatctcgtggttatgtctttttatcacaaacagatactgaagtgatcgctcacctcgttgaatgggaaatgcgtagcacggattcccttttagaggctgtgcagaaatcggtaaaacaactcacgggcgcatatggtatggtggtaatggacagccgtcatcctgaacatttagtggcagctcgttctggtagtccacttgtgattggcttaggtatcggtgaaaatttcttagcttcagatcaacttgcgcttttaagtgttactcgccgttttatctttttagaagaaggagatattgcagaaattacacgtcgtacagttgatatttatgatactcacggtaataaggctaaacgtgaaattcacgagtctaatcttgaaaatgacgctgcagagaaaggtaaattccgtcattttatgcagaaagaaatttacgaacagccaactgcacttattaatacaatggaagggcgtattaatcacgaaaatgtgattgttgattcaatcggtaatggtgcaaaaggcattttagaaaaagttgagcatattcaaattgttgcttgtggtacatcttataatgcaggtatggtggcgcgttattggtttgaatctttagctggcgtgagctgtgatgttgaaattgcatcagaatttcgttatcgcaaatttgttacccgtccaaatagcttattgattaccctttctcaatctggcgaaacagccgatactttagctgcacttcgtttagcgaaagaaaagggctacatggcagcattaacaatttgtaatgttgctggctcttcgctcgtacgcgaatcagatcttgcatttatgactcgtgctggtgttgaagttggggtggcatcgacaaaagcatttacgacacagctcgctgcattattaatgctggtaacggcacttggtaaagttaaaggtcatatttctgtagaaaaagaacgtgaaattattaaagcaatgcaatctttacctgctgaaattgaaaaagcgttagcctttgatagagaaattgaagctttagcagaggattttgctgaaaaacatcatgcgcttttcttaggccgtggtgcgttttatccaattgcggtagaggcttctttgaaattgaaagagatttcttatattcacgctgaggcctatgcggcaggagaattgaaacacgggccattagcgttaattgatgctgatatgccagtgattgtcgttgcaccaaataatgaattattagaaaaagtaaaatcgaacattgaggaagtgcgagctcgtggtggtcaattatacgtatttgccgataaagaagcaggatttacgccaagtgaaggaatgaaaatcatcacgatgccaaaagtcaatgatattgttgcaccgattttttataccattccaatgcaattactttcttattatgtggctttaattaaaggcactgatgtagatcaacctcgtaacttagcaaaatcagttaccgttgaataa

SEQ ID NO: 1260 - DNA, 411 bp, H. influenzae strain 86-028NP
gtgagatttgtcacaatttttataaatcatgcttttaattcatctcaagttagattatcctttgcacagtttttgcgacaaattcgcaaagatacttttaaagaatcaaactttttatttaacagaaggtacaaatttatgaacaaaacagatttaattgatgcaattgcaaacgctgcagagttaaacaaaaaacaagctaaagcagcgttagaagcgactttagatgcaattactgcgagcctaaaagaaggtgagcctgtacaattaatcggcttcggtacatttaaagtaaatgaacgtgctgctcgtactggtcgtaacccacaaactggtgctgaaatccaaatcgcagcatctaaagtgccagcatttgtatctggtaaagcattaaaagatgcaatcaaataa

SEQ ID NO: 1261 - DNA, 591 bp, H. influenzae strain 86-028NP
atgcgaaatccgattcataaacgcttagaaaacttagacagttggcaacatcttacttttatggctgctttatgtgaacgtatggcaccaaattttaaattgttctgtcaaatgaacgagcttagcgttgaaaccaaaacgtatcaaaatattctcaatttggtgtgggaatatttaacaattaaagatgtcaaaatcaactttgaaaatcagttggagaaattagaaagcattattcctgatgtgaatgattatgatagttttggtgttgtgccagcgttagatgcctgtcaggctttagctgaaattttacacgccattattgcgggcgaaaccttagaaaaagcggtggaaataagcctaatttcgttgggaacagtaagggcattattggaaacagaaactggacgagattggtcagaaagtaaactaaaagaaaatgaagatattcaaacagaacttgatgtgcaatggcaagtttatcgtttgcttaaagaatgtgaaaaacgtgatattgaattaattttagctttaaaaaatgaaattcggactgagggtatatctaacattggtatagaatttcatcaataa

SEQ ID NO: 1262 - DNA, 795 bp, H. influenzae strain 86-028NP
atgaaaatacttcaacaagatgattttggttattggttgcttacacaaggttctaatctgtatttagtgaataatgaattgccttttggtatcgctaaagatatcgatttggaaggattacaggcaatgcaaattggagaatggaaaaatcatccgttgtggcttgtggctgagcaagaaagtgatgaacgagaatatgtgagtttgcgtaacttgctttcactgccagaggatgaattccatatattaagccgaggtgtggaaattaatcattttctgaaaacccataaattttgtggaaagtgcggtcataaaacacaacaaactcaagatgaacttgcagtgcaatgtattcactgtgggtatcaaacttatcctgtgatttgcccatcaattattgttgcggttcgtcgtggtcacgaaattctattggcaaatcataagcgacattatagtcctaacggaggaatatacacgacgcttgcaggttttgtcgaagtaggggaaacatttgaacaagcggtgcagagagaggtttttgaagaaacagggatttcaataaaaaatcttcgttatttcggtagccaaccttgggcatttccaaattctcaaatggtcggttttctggctgattatgaaagcggagaaataacattgcaggaaagtgaaattcatgatgcacaatggttttcttatgatcaacccttgccagaattaccgccaacgggtactatcgctcgcaaattaattcatgtgacgcttgaactttgtaaagcggaacataaatgcgattaa

SEQ ID NO: 1263 - DNA, 597 bp, H. influenzae strain 86-028NP
atggaacaagcaacccagcaaatcgctatttctgatgccgcacaagcgcattttcgaaaacttttagacacccaagaagaaggaacgaatattcgtattttcgtcgttaatccgggtacgcctaatgcggaatgtggcgtatcttattgccccccgaatgccgtggaagaaagcgatattgaaatgaaatataatactttttctgcatttattgatgaagtgagtttgcctttcttagaagaagcagaaattgattatgttaccgaagagcttggtgcgcaactgaccttaaaagcaccgaatgccaaaatgcgtaaggtggctgatgatgcgccattgattgaacgtgttgaatatgtaattcaaactcaaattaacccacagcttgcaaatcacggtggacgtataaccttaattgaaattactgaagatggttacgcagttttacaatttggtggtggctgtaacggttgttcaatggtggatgttacgttaaaagatggcgtagaaaaacaacttgttagcttattcccgaatgaattaaaaggtgcaaaagatataactgagcatcaacgtggcgaacattcttattattag

SEQ ID NO: 1264 - DNA, 687 bp, H. influenzae strain 86-028NP
atgaatttttttaattttcgctgtatccactgtcgtggcaatcttcatattgcaaaaaatgggctatgttcaggttgccaaaaacaaattaaatcttttccttattgcggtcattgtggtgcggaattgcaatattatgcgcagcattgtggtaattgtcttaaacaagaaccaagttgggataagatggtcattattgggcattatattgaacctctttcgatattgattcaccgttttaaatttcaaaatcaattttggattgaccgcactttagctcggcttttatatcttgcggtgcgtgatgctaaacgaacgcatcaacttaaattgccagaagcaatcattccagtgcctttatatcattttcgtcagtggcgacggggttataatcaggcagatttattatctcggcaattaagtcgctggctggatattcctaatttgagcaatatcgtaaagcgtgtgaaacacacctatactcaacgtggtttgagtgcaaaagatcgtcgtcagaatttaaaaaatgccttttctcttgttgtttcgaaaaatgaatttccttatcgccgtgttgcgttggtggatgatgtgattactactggttctacactcaatgaaatctcaaaattgttgcgaaaattaggtgtggaggagattcaagtgtgggggctggcacgagcttaa

SEQ ID NO: 1265 - DNA, 1338 bp, H. influenzae strain 86-028NP
atgaagaaatattttttaaagtgcggttattttttagtgtgtttttgtttgccattaatcgtttttgctaatcctaaaacagataacgaatgtttttttattcgtttatcgcaagcacctttagctcaaacactggagcaattagcttttcaacaagatgtgaatttagtgatgggtgagaggttagaaggcaatatttctttgaaattaaacaatattgatatgccacgtttgctaaaaataatcgcaaaaagtaagcatcttactttgaataaagatgatggggtttattatttaaacggcagtcaatctggcaaaggtcaagttgcaggaaatcttacgacaaatgaaccgcacttagtcagccacacggtaaaacttcattttgctaaagcctctgaattaatgaaatccttaacaacaggaagtggatctttgctttcttctgcggggagcattacctttgatgatcgcagtaatttgctggttattcaggatgaacctcgttttgtgcaaaatatcaaaaaactgattgctgaaatggataagcctattgaacagatcgctattgaagcgcgaattgtgacaattacggatgagagtttgaaagaacttggcgttcggtgggggatttttaatccaactgaaaatgcaagacgagttgcgggcagccttacaggcaatagctttgaaaatattgcggataatcttaatgtaaattttgcgacaacgacgacacctgctggctctatagcattacaagtcgcgaaaattaatgggcgattgcttgatttagaattgagtgcgttggagcgtgaaaataatgtagaaattattgcaagtcctcgcttactcactaccaataagaaaagtgcgagcattaaacaggggacagaaattccttacatcgtgagtaatactcgtaacgatacgcaatctgtggaatttcgtgaggcagtacttggtttggaagtgacgccacatatttctaaagataacaatatcttacttgatttattggtaagtcaaaattcccctggttctcgtgtcgcttatggacaaaatgaggtggtttctattgataagcaagaaattaatactcaggtttttgccaaagatggggaaaccattgtgcttggcggcgtatttcacgacacaatcacgaaaagcgaagataaagtgccattgcttggcgatatacccgttattaaacgattatttagcaaagaaagtgaacgacatcaaaaacgtgagctcgtgattttcgtcacgccgcatattttaaaagcaggagaaacgttagaggcgttgaaacaaaaaagtgcggggaaaaaataa

SEQ ID NO: 1266 - DNA, 414 bp, H. influenzae strain 86-028NP
atgaaacattggtttttcctgattatattattttttatgaattgcagttggggacaagatcctttcgataaaacacagcgtaaccgttctcagtttgataacgcacaaacagtaatggagcagacagaaataatttcctcagatgtacctaataatctatgcggagcggatgaaaatcgccaagcggctgaaattcctttgaacgctttaaaattggtgggcgtagtgatttctaaagataaagcctttgccttgttgcaagatcaaggtttgcaaatttacagcgttttagagggcgttgatgtggctcaagagggctatattgtagaaaaaatcaaccaaaacaatgttcaatttatgcgtaagctcggagagcaatgtgatagtagtgaatggaaaaaattaagtttttaa

SEQ ID NO: 1267 - DNA, 522 bp, H. influenzae strain 86-028NP
atgaaagctttttttaacgatccttttactccttttggaaaatggctaagtcagcctttttatgtgcacggtttaacctttttattgctattaagtgcggtgatttttcgccccgttttagattatatcgaggggagttcacgtttccatgaaattgaaaatgagttagcggtgaaacgttcagaattgttgcatcaacagaaaattttaacttctttacagcagcagtcggaaagtcgaaaactttctccagaactggctgcacaaattattcctttgaataaacaaattcaacgtttagctgcgcgtaacggtttatctcagcatttacgttgggaaatggggcaaaagcctattttgcatttacagcttacaggtcattttgagaaaacgaagacatttttaaccgcacttttggctaattcgtcacagctttcagtgagtcgcttgcagtttatcaaacccgaagacaacccattgcaaaccgagatcatttttcagctagataaggaaacaaaatga

SEQ ID NO: 1268 - DNA, 507 bp, H. influenzae strain 86-028NP
atgtcgatgaatttattgccttggcgtacttatcaacatcaaaagcgtttacgtcgtttagctttttatatcgctttatttatcttgcttgctattaatttaatgttggcttttagcaatttgattgaacaacagaaacaaaatttgcaagcgcagcaaacatcttttgaacaacttaatcagcaacttcacaaaactaccatgcaaattgatcagttacgcagtgcggtgaaagttggtgaagttttgacatctattcccaacgagcaagtaaaaaagagtttacaacagctaagtgaattaccttttcaacaaggagaactgaataaatttaaacaagatgccaataacttaagtttggaaggtaacgcgcaagatcaaacagaatttgaactgattcatcaatttttaaagaaacattttcccaatgtgaaattaagtcaggttcaacctgaacaagatacattgttttttcactttgatgtggaacaaggggcggaaaaatga

SEQ ID NO: 1269 - DNA, 798 bp, H. influenzae strain 86-028NP
atgcaattctccctgaaaaattaccgcactttacaaatcggcattcatcgtaagcagggttattttgattttgtgtggtttgatgatcttgaacagccacaaagttatcaaatttttgttaatgatcgtgattttaaaaatcgttttttacaacagctaaaaacacaatatcaagggaaaacctttcctttacagtttgtggcaagcattcccgctcacttaacttggtcgaaagtattaatgttgccacaagtgttaaatgcgcaagaatgtcatcaacaatgtaaatttgtgattgaaaaagagctgcctatttctttaaatgaattatggtttgattatcgttctacctcgttaaagcaaggttttcgattagacgttactgcaattcgtaaaagtactgctcaaacttatttgcaagattttcagccatttaaaattaatgtattggatgttgcgtcaaatgctattttgcgtgcatttcagtatttgttgaatgaacaagtgcggtcagaaaataccttatttttatttcaagaagatgactattgtttggcgatctgtgaaagatcgcagcaatcgcaaattttacaatctcacgaaaatttgaccgcactttatgaacaatttaccgaacgttttgaaggacaacttgaacaagtttttgtttatcaaattccctcaagtcatacaccattacccgaaaactggcagcgagtagaaacagaactcccttttattgcgcttggcaacgcgctatggcaaaaagatttacatcaacaaaaagtgggtggttaa

SEQ ID NO: 1270 - DNA, 2595 bp, H. influenzae strain 86-028NP
atgcggatcgcaaaattaatattaaacaccctattaactttatgtattttaggtttagtggctggcggaatgttgtatttccacctaaaatcggaattgccctcagtagaaacattaagaaccgttgaattacaacaaccaatgcagatttatacggctgacggtaaattaattggcgaagtgggcgagcaacgccgtattccagtgaaattagccgatgtgccacaacgcttaattgacgcatttttagcaacggaagacaatcgtttttacgatcatcacggattagaccctatcggcattgctcgtgcattgtttgtcgcagtgagtaatggcggtgcatcacaaggtgcaagtacgattactcaacaattagcgcgtaactttttcttaaccccagaaaaaaccattattcgtaaagcccgtgaagcggtgcttgcggtagaaattgaaaataccctcaacaaacaagaaatcttagagctttatttaaacaaaatctttttaggctatcgttcttatggtgttgcagcagcggcacaaacctatttcggtaaagcattgaatgaattgaccttatctgaaatggcgattattgctggtttacctaaagcaccttcaacaatgaatccgctttattcgctaaaacgttcagaagaacgtcgcaatgtggtgctaagccgtatgttagatgaaaaatacatcagcaaagaagaatatgatgctgcattgaaagagccgattgtggcgagttatcacggcgcaaaatttgaatttcgtgctgattatgtcactgaaatggtgcgtcaagaaatggtgcgtcgttttggcgaagaaaatgcttacaccagtggttataaagtatttaccactgtactttcaaaagaccaagctgaagcccaaaaagctgtgcgtaataacttgattgattatgatatgcgtcacggttatcgcagtggcgcgccattatggcaaaaaaatgaagccgcttgggacaatgatcgcattgtcggttttctacgcaagctacctgattcagagccatttattcctgcggcagtgattgaaattgcaaaaggcggtgctgatatattgctcgcttctggggaaaaaatgaccttatcaaccaatgcaatgcgttggacaggcagaagcaatcctgtgaaagtcggcgagcaaatttggattcgtcagcgtgctaatggggaatggcaattaggacaaattcccgcagcaaattcagcattagtttctcttaattcagataatggcgcgattgaagcagtggtgggcggatttagttatgaacaaagtaaattcaatcgagccacacagtctttagttcaagtgggttcttctattaaaccatttatttacgcggcagcattagaaaaaggcttaacgctttctagtgtattacaagacagcccgatttctattcaaaaaccgggacaaaaaatgtggcaaccgaaaaactcgcctgatcgttatgatggcccgatgcgtttacgcgtaggattaggtcaatccaaaaatatgattgctattcgtgcgatccaaacagcaggtattgatttcacagcagaatttttacaacgttttggttttaaacgtgatcaatattttgctagcgaagccttagcacttggcgcagcctctttcacaccattagaaatggcgcgagcttatgcggtgtttgataatggcggtttcctcattgaaccttatatcattgaaaaaattcaagataacacgggtaaagacttatttattgcaaaccctaaaattgcttgcattgaatgtaatgatatacctgtaatttatggcgaaaccaaagacaaaatcaacggctttgccaatattcctttaggcgagagtgccttaaaaccaacagatgacagcaccaatggcgaagaattagatcaacaacctgaaactgtgcctgaactgccagaattacaatcaaatttcaccgcacttaaagaagatgcgattgatttaatggctgctgcaaaaaatgcctcgtcgaaaatagaatatgcgccacgtgtcattagtggcgaacttgcttttctcattcgtagtgccttaaatacggcaatttatggcgaacaaggtttagactggaaaggcaccagctggcgcattgcacaaagtattaaacgtagcgatataggcggtaaaacaggtactaccaacagttcaaaagtggcttggtatgcgggatttggtgcaaacttagtcactacaacttatgttgggtttgatgataacaaacgagtacttgggcgtggagaagcgggtgcgaaaacagccatgccagcttggatcacttatatgaaaatggctttgagtgataaacctgaacgtaaattgccactgccgccaaaaattgtggaaaaaaacattgatactttgacaggtttgctttctccaaacggtgggcgcaaagaatattttattgtgggaacagaaccgacacgtacctatctttcggaaatgcaagagcgtggttattacgttcctacagagttacagcaacgcttaaataatgaaggcaatacgccagcgacgcaaccacaagaactcttctaa

SEQ ID NO: 1271 - DNA, 846 bp, H. influenzae strain 86-028NP
atgctgagttatcgtcactcatttcacgcaggcaatcatgctgatgtcttaaaacatatcgtcttaatgcttattttggaaaaccttaaacttaaagaaaaaggctttttttatttggatacgcactctggtgtaggtcgttatcgtttatcttcaaacgaatcaaaaaaaacgggggaatataaagaaggtattggacgcttgtgggatcaaacagacttacccgaagatgttgcccgttatgtaaaaatgatcaaaaaactcaattatggtggcaaagaactacgttattatgctggctcaccgttaattgctgcagaattgttgcgcccacaagatcgcgcactattgaccgagcttcatcctagcgattatccaattcttcgcaataattttagcgacgacaaaaatgtcaccgtaaaatgtgacaatggttttcaacaagtcaaagcaacgcttccgccaaaagaacgccggggcttagtactcatcgatccgccttatgaattaaaagatgattatgatctcgttgttaaagccattgaagagggctataaacgttttgccactggcacttatgcgatttggtatcctgttgtattacgccaacaaactaaacgtatttttaagggtttagaagcaacgggaattagaaaaattctaagaattgagctcgctgttcgcccagatagcgatcaacgaggaatgactgcgagcggtatggtggtaattaatccaccttggacattagaaacccaaatgaaagaaattttgccttatctcacaaaaacattagttccagaaggtactggaagctggactgtcgaatggattacccctgaataa

SEQ ID NO: 1272 - DNA, 366 bp, H. influenzae strain 86-028NP
atgcacgcaatttttgacttaataaaggataacattatgtttggaaaaggcggtttaggcggcttgatgaaacaagcccaacaaatgcaagaaaaaatgcaaaaaatgcaggaagaaatcgcacaactagaagtaacgggtgaatctggtgcaggtttagtgaaaatcacgattaatggtgcacataactgccgccgtattgacattgatccttctttaatggaagacgataaagaaatgttagaagatttaatcgcagctgcttttaacgatgcggtgcgtcgtgcagaagaattacaaaaagaaaaaatggcatcagttaccgctggaatgccattaccaccaggaatgaagtttccgttttaa

SEQ ID NO: 1273 - DNA, 603 bp, H. influenzae strain 86-028NP
atgcaaagcagtccacttttagaacaccttattgaaaacttacgttgtcttccaggcgtagggcctaaatctgcgcaacgtatggcttatcatcttttacagcgtaatcgtagcggtggaatgaatttagctcgagcactcacagaagctatgtctaaaattggtcattgttcacaatgtcgagactttacggaagaagacacttgcaacatttgcaataatccacgccgtcaaaattcaggtttgctttgtgtcgttgaaatgcccgcagatattcaagcgattgagcaaacggggcaattttcaggacgttattttgttttaatgggacatttgtctccacttgatggtattgggcctcgtgaaattggcttagatttactgcaaaaacgcttagtagaagaatctttccacgaagtgattcttgcaacaaatccaacagtggagggcgatgcgacggcaaactacattgctgaaatgtgccgccaacataatatcaaagtgagtcgtatcgctcacggtatccctgtcggtggtgaactagaaactgtggacggcacaacgcttactcactcttttctaggtcgtcgtcaaatcgactaa

SEQ ID NO: 1274 - DNA, 1956 bp, H. influenzae strain 86-028NP
atgcgtttatttatcgccgaaaaaccaagcctagctcgtgctattgcagatgtgctacccaaaccccatcaacgtggggatggttttattaaatgtggcgataatgatgtggtaacttggtgtgtagggcatttgctcgagcaagcagaacccgatgcctatgatcctaaattcaaacaatggcgtttagaacatctccctatcattcctgaaaaatggcaacttttaccgcgaaaagaagtaaaaaaacaactttctgtggtagaaaaactaatccatcaagcggatacacttgttaatgcaggagacccagatagagaaggacaattacttgtagatgaagtcttcagttatgccaatttatctgccgaaaaacgcgataaaattttacgctgcttgattagcgacctaaatccaagtgcggtagaaaaagcggttaaaaaattacaacccaaccgtaattttattcctcttgccacatccgcactcgcacgagctcgtgccgattggctttatggcattaatatgaccagagcttataccattcgaggtagacaaactggctatgatggcgtgctttctgttggacgagtgcaaacccctgtgctaggtttaattgtacgtcgagatttagaaattgagcatttccagcccaaagacttctttgaagtacaggcttgggttaatccagagagcaaagaagaaaaaactccagaaaaatcaaccgcacttttcagtgccttatggcaacctagcaaagcttgcgaggattaccaagatgatgacggcagggtgctctctaaaggattagcagaaaacgttgtaaaacgtattacaaatcaaccagcagaagtcaccgaatacaaagacgttcgtgaaaaagaaacggcgcccttgccttattcactttctgcgttacaaattgatgcagcaaagcgattcggtatgtccgctcaagccgtattagatgcatgccaacgcctgtatgaaactcatcgtttaattacttatccgcgttctgattgtcgctatttacccgaagaacattttgccgaacgccacaatgtattaaatgcaatttcaacccattgtgaagcttatcaacgcttaccaaatgtcatttcaactgaacagagaaatcgctgttggaatgataaaaaagtagaggctcaccacgcaatcattcctactgccaaaaatcgtccagtaaatctaacacaagaagaacgtaatatttacagccttatcgctcgccaatatttaatgcaattttgtcctgacgcagaatatcgtaaaagtaaaatcacattaaatatcgctggcggtacttttatagcccaagcgcgaaatttacaaacggctgggtggaaagaattgttaggcaaagaagacgacacagaaaatcaagaacccttattaccaatagtaaagaaaggtcaaattttgcattgtgaacgaggagaagtgatgagtaaaaaaactcagccgccaaagcctttcaccgatgcaaccttgctttcagcaatgacgggcattgcgcgatttgtgcaggataaagaactcaaaaaaatcctgcgagaaaccgatggattgggtacagaggctactcgtgctggcatcattgaattactttttaaacgcagttttttaactaaaaaagggcgaaatattcacagtacagaaactggaagaattttaattcaggcattaccagatattgccacccaaccagatatgacggctcattgggaatcgcaactcacagacattagtcaaaaacaagcaacctatcaacaatttatgcataacttgaatcaaatgttacctgatttagtccgttttgtagatcttaatgcattaagacaattaagccgcattaaaatgattaaatccgatagagtgaaacctaaaagtgcggtaaaaaaatcgagtaaatcaaacggtgaaactgattaa

SEQ ID NO: 1275 - DNA, 342 bp, H. influenzae strain 86-028NP
atgtatcaagttcttttatttatttatgttgttgttgcgattgccttgatcgggtttattctcgttcaacaaggtaaaggagcgaacgctggtgcatcttttggtggtggcgcatcaggtacaatgtttggctctgctggtgcaggtaactttttaacacgtactagcgcgattttagcaaccgcattttttgttattgctcttgttttaggtaatatgaattcacataaaggcaatgttcaaaaaggtacttttgacgatttatcacaagctgcagagcaagttcagcaacaacaagcagctccagcgaaagacaataaaaatagcgacatcccacaataa

SEQ ID NO: 1276 - DNA, 1671 bp, H. influenzae strain 86-028NP
atgaagttatttttaacccaatcagctaatgtaggcgatgcgaaagcctatttattacatgaagtttttcgagcagctgcacaaaaagcaaatgtctctattgtagaaacaccagccgaagcagatcttgttcttgtatttggttctgtattaccaaataaccctgcgttagttggtaaaaaagtctttattatcggcgaagctatcgccatgatttctcctgaagtaacattggcaaatgccttagcgaatggggctgattatgttgcaccgaaaagtgcggtgagttttacaggtgtttctggtgtaaaaaatattgttgcggtaacggcttgtccaactggcgttgcacatacgtttatgtcagccgaagcgattgaagcctatgcgaaaaaacaaggttggaatgtaaaagttgaaacccgtggtcaagttggggctggcaatgaaattactgcagaagaagtcgcggcggctgatttggtatttgttgcagcagatattgacgtgcctttagataaatttaaaggtaaaccaatataccgcacttcaacaggattagccttgaagaaaactgagcaagaatttgataaggcatttaaagaagccaaaatttttgatggtggaaataatgcgggaacgaaagaagaaagccgtgagaaaaaaggtgtgtacaaacacttaatgactggtgtttctcatatgttaccgttagtggttgctggtggattgttgatcgcgatttcctttatgttcagttttaatgtaattgaaaatacaggagtttttcaagatcttcctaatatgttgattaatatcggtagtggtgtggcgttcaagttaatgattgccgtgtttgctggttacgttgcattttctatcgctgatcgtccaggacttgcagttggtttgattgcagggatgctggcaagtgaagcgggtgcagggattcttggcggtattattgcaggtttcttagccggctatgtggtgaaagggctaaatgtgattattcgattgccagcaagcctgacttcattaaaaccgattttaattttaccgctcttgggttcgatgattgttggtttgacgatgatttacctcatcaatccaccagtggctgaaattatgaaagagctaagtaattggcttacttcaatgggcgaagtgaatgcgattgtgttaggcgtaattatcggcgcaatgatgtgtatcgatatgggcggaccagtaaataaagcagcgtacactttttctgttggattgattgcctcccaagtttatacaccaatggctgcggcaatggccgcaggtatggttcctccaattggtatgacagttgcgacttggattgctcgcaataaatttaccgttagccaacgcgatgcggggaaagcatcatttgttcttggtttatgttttatttctgaaggtgcattaccatttgtggcagcagatccaattcgagtcattattagctctgtgattggtggtgcggtggctggtgcgatttcaatgggattaaatattaccttacaagctccgcacggcggattatttgtcattccatttgtatctgagccgttgaaatatcttggtgcaattgcgattggtgctttatcaacaggtgtggtttacgccattattaaatcgaaaaacaatgcggaataa

SEQ ID NO: 1277 - DNA, 942 bp, H. influenzae strain 86-028NP
atggcaagcgtcgtaaccattaccttaaatgccgcctatgatttagttgggcgtttaaatcgtattcaacttggcgaagtaaatacggtagaaacattgggcttattccctgctggaaaaggcattaatgtcgcaaaagtactaaaagatttaggcgttaatgttgcagtaggcggtttcttgggcaaggataattcagctgatttcgagcaaatgtttaatcagcacggtttgaaagataaattccaccgtgttaatggcaaaacacgtatcaatgtaaaaattaccgagactgaagcggatgtgacagatttaaatttcttgggatatcaaataagcccacaaatttggcaacaatttgtgacggattctttggcttattgtttagattatgacattgtcgcagtttgtggcagtttacctcgaggtgtgtctcctgaattgtttgctgattggttaaatcagcttcatcaagctggcgttaaagtggtgcttgatagtagcaatgctgcgcttaccgctggattaaaagcgaaaccttggctagtaaaacccaatcatcgagaacttgaggcttgggttggtcattcattaaatagtcttgaagaaattattgccgctgcacagcaactcaaagcggaaggcattgaaaacgtgattatttcaatgggcgcaaaaggttctttatggattaataatgaaggcgtgcttaaagccgaaccagcaaaatgtgaaaatgtcgtgagtaccgttggagcaggggattcaatggtagcaggcttaatctatggttttgaaaaaggtttatcgaaaacagaaaccttagcttttgctacggctgtgtccgcttttgcggtatctcagagtaacgtcggtgtgagtgatttgagtttacttgaccccattttagaaaaagtacaaataacgatgattgaaggatag

SEQ ID NO: 1278 - DNA, 1500 bp, H. influenzae strain 86-028NP
atgttagaactttcggaaagcaacattcatttaaatgctaatgcaattgataaacaacaagcgatcgaaatggcagcgtccgcattggttcaagcaggcaatgttgaaaatggttacttgcaaggaatgttagcgcgcgagctgcaaacctcaacctttttaggcaatggcatcgctattcctcatggcaccttggatactcgtttgatggtaaagaaaacgggcgtgcaagtgtttcaatttcctcaaggcatagaatggggcgaaggaaatattgcttatgtcgtgattggtattgcggcgcgatctgatgagcatttgtccttattacgccaactaacccatgtattgagcgatgaagatactgcagcaaaattagcaaaaataactgatgtggctgaattttgcgcgattttaatgggcgagacaattgatccatttgaaattcctgctgccaatatcagtttagatgtaaatacccaaagtttattaactttagttgcgattaatgcggggcaattacaggtgcaaagtgcggtagaaaatcgctttatttctgaagtgataaataatgcggcattaccacttggcaaagggttatgggtaacggactctgtcgtaggaaatgtgaaaaatgccttagcatttagtcgtgccaaaacgatttttagccacaatggcaaggccgtaaaaggcgtgataaccgtttcagccgtcggtgatcaaattaatccaactttggcgcgtttattagatgacgatgtccaaacaaccttgctcaatggaaattcaacagaaattttgaccgcacttttgggttcatcgagtgatgttgaaactcaatctgtagaaggtgctgttgtaggaacctttacgattcgtaatgaacacggcttacatgcacgcccaagtgcaaatttggttaatgaagtgaaaaaattcacttctaaaataaccatgcaaaatcttactcgtgaaagtgaagtcgtcagcgcaaaaagtttgatgaagattgttgcgcttggtgtaacacaaggacatcgtttacgttttgtggcagagggggaagatgcaaaacaagcaattgaatcattgggcaaagcgatagccaatggcttgggcgagaatgtttcggtagtgccaccgtctgaacccgataccattgagattatgggcgatcaaattcacacacctgcggtaacagaagatgataatttgccggcaaatgccattgaagccgtatttgtgattaaaaacgagcaaggtttgcatgctcgtccaagtgcaatattggtaaatgaagtgaagaaatataatgcttccgtagcagttcaaaaccttgatcgtaattctcaattagtcagtgctaaaagtttgatgaaaattgtagcattaggcgtagtcaaagggactcgtttacgttttgttgcgacgggcgaagaagcgcaacaagctattgacggaatcagcgctgtgatcgaatcgggtttaggggaatag

SEQ ID NO: 1279 - DNA, 537 bp, H. influenzae strain 86-028NP
atgactatgtttaaaaaaatctctgttttattttttacgttaatattggcaggttgttcttcttggtcatcggttactaaccatattccatttatggggaacgataaaaaagtgattgatttagataaagataaaatcgatcaaaaatcttatgcagctgcttatgaagcgactgtggcgacatataaaggtcgcgtgaatgaaaatttctttgtagataattttgcaagtggtgcgaatgactggtatttaggccgtattttagttccagtgaaacaaattcaggataaactttacactggcggccatgattctgatgtatatgcctattatagcggcgtgttacatgcggaagcattgcaagcgaaccttaaacgtttgagcgcaaattgttgggaaaaagtggattcgcaaagtatggctcaaggtatttatgatgcgatgcgtgatttacaaaaaggcgaagcgcgcggagaaaatgatgaatatattgtgcaaggtagtgaagcgctgctgaaagcctgtacatctaaataa

SEQ ID NO: 1280 - DNA, 279 bp, H. influenzae strain 86-028NP
atgtacgcgattgcttttgatttagttgtaaaagacactcaagattatcatccaaagggcgttcaagaggcttatacagacattggcgcagttttagcaaaatttggttttgttagaacacaaggaagtttatataccaacatgaatgaagatatggcgaatctctttcaggcaatgaatgcactaaaacagttggcgtggatttctcagtcggtacgagatattcgcgcttttcgtattgagcaatggtctgattttactgattttatacgaaattaa

SEQ ID NO: 1281 - DNA, 192 bp, H. influenzae strain 86-028NP
atggaactaagacaacaaattccaacaggctgtattaagcaattcgggcaatttggcgtgccttatgtggttggcgaggttgcggaatttttgccagatggtgatgtgttggtaaatatcacattgttacaatctggagaaaaagacatttatcgcttatcttacctacttgaagatcccgaagctgaataa

SEQ ID NO: 1282 - DNA, 1299 bp, H. influenzae strain 86-028NP
atgattatggaattatttcatactattttggcaattgtggctttaattttaagtagtgcagttgtttcttctgctgaaatttctctggcgagttctcgtaagttaaaattgcaatctcttgcaaataaaggcgacgtgcgtgcgcttcaagtgcttaaattacaagagcatcctggtcgttttattacggtggttcaaattttgttgaatatggtggcgattttgggtgggggaattggcgaaagtgcactaagtccttacattgcagatattttaaatcgttcttttgaaggaagttggattgagccaaccgcctctacaatcgcttttatattagtgacttgtttgtttattttatttgctgatcttattccaaaacgtattgctattacttatcctgaaatggtggcgttgagcgttgtgggtattatgaattttagtatgtatgtgtttaaaccgcttgtgtggttttttgatactattgctaatgtatttttccgcttatttcgcatttctactgtgcgtgaagatggcatgacctctgaagatattttcgccgtagttgaagcaggcgcagaagctggtgtattaaaaactcaagagcattatttgatcgaaaatattttcgatatgcaagcccgtacggtaacttccacaatgacaacccgtgaaaacatcgtatatttagaccgcactttttctcgccaagaagtgatggatacgctttctcgtgattctcattctaaaattgtgatttgtgacaatggcctcgacaaaatcttaggttatatcgaatcccatactttgctaactatgtatttgcagaatgaaaatgtggtgctcacagatcctaaactactccgtaaagccttatttgtgcctgatacgctttctctttacgaagtgttggaattgtttaaatctactggcgaagattttgcgattattgtgaatgaatatgctcttgtggtgggtattgttacgctaaatgatgtgatgagtattgttatgggggaattggtttctaacgaagaagaatatattgtgagccgtgatgaaaactcgtggctgattgatggcgcaacgccattaaaagaggtaactcgagtattagatattgcttattttcccgatgaagaaaactacgaaactatcagtggttttatgatgtatatgttacgtaaaatcccgaaaaaaaccgattctgtggtttacggaaaatacaagtttgaagtgattgatacggaaaactttaaaatcgatcagattttggtgtctttagtaaaagagcaggagtag

SEQ ID NO: 1283 - DNA, 525 bp, H. influenzae strain 86-028NP
atgcgaaagttttttaaatatttcttatttattgttgtttttttattccacggttttatgttttctgtggtgaattatgtgttccctcattatgatgtgacgcgtgttactggcgtagaagttaaacgtgttgataaagatggcccaatcacaaaatcgaatccagctgatggcccaacacgcgatgtatattacatcaatacgcaaaatgacgatggcaaaattatggtgtatcgcaatgaagatacacgttggggtttcccgttctatttcaaatttggatcggccaatttacaggctgaagcgcaggctttgggtaatgacaacaaacttgtgcaaattaaatactatggttggcgtattacgatgatggatgaatatcgcaatgcaacctcaattaaagaaattactgctgatgatacaccaagcaatccgattgtttcgtggattttatatgtatttttgctggcgacattatttttgtctatccaatttattcgcggctggtttgacagcgataagtaa

SEQ ID NO: 1284 - DNA, 783 bp, H. influenzae strain 86-028NP
atgttcattgttgactcccactgccatttagatgcgttggattatgaaaatttacataaaaatatctcggatgtggtggaaaaagcacgtgcgcgtgatgtgaaacatttgctcgcgattggtgtaaccttaagccgttttgagcaggcttatgactctttacgggaatttaataatgtctcgcttgcttgcggtgtccatcccctcgattttgaagaggaaccttatgacgcagaacgcttattgcgtttatcgcaagatccaaaagtgattgcgattggcgaaattggcttagattattattacagtgcggacaataaagcggcacaacaagcggtgtttggtagccaaatcgatattgcaaaccaattagataagcctgtaattattcatacacgttctgcaggcgatgacaccattgcaatgttacgcgaacatcatgctgaaaagtgcggtggcgttattcattgttttacggaaaccatggaatttgcgaaaaaagcgttggatttaggattttacatttcttgttctggcattgtaacctttaaaaatgccgaagcgattcgtgaggttattcgttatgtgccaatggatcgcttattggtggaaacggattcgccttatcttgcgccagtgccttacagaggaaaagaaaatcaaccagcgtatacgagagaagtatgtgaatacgtggcaaccttaaagggcgtttctgcagaggcgtttgctcaaatcactacacaaaatttcgagcgtttatttaaaattcgtgtagaataa

SEQ ID NO: 1285 - DNA, 984 bp, H. influenzae strain 86-028NP
atgaccgcactttacccttggctaatgccaatttatcatcaaattgctcaaacctttgacgaagggttggggcatcatgctgtgctgattaaagctgattctggtttaggcgtagagagtttatttaatgcacttgcacagaaaataatgtgtgtagctcaaggcgataaaccttgtggtcaatgccattcttgtcatttaatgcaagcccatagccatccagattatcacgaattaagccccattgacggtaaggatattggcgtcgatcaagtacgcgacattaatgaaattgttgcgcagcacgcacaacaaaatggtaataaagtggtgtatgtgcaaggagcggaacgtttaacggaagccgctgccaatgcgttattgaaaacattggaagagcctcgttcaaatacttattttttacttcagacggatagttcagcaagtttattagcaaccatttacagtcgatgccaagtgtggaatctgtctgtgcctaatgaacaaatggctgttgattggttgaaatcagaaagtgcggctgaaaatcaggaaattttgaccgcacttgcgatgaatcttgggcgtccgcttttagcattagaaactttacaacaagggctgattgaacagcgtaaaaacttcttacgtcaattttgggtgttctatcgccgacgttcgccattggaattgcttccgttgtttgataaagaacgctatgttcagcaagtggattggattttggcttttctttctgattgtttaaaacataaacttgaaattgatagtcatcgacaagtggctgatcttggccgtggcatcgaacaattcagcgatgagcaaactgcccttggtttattacaagccattaaaattatgcaaaaagtgcggtcagatttgcttacaattaatggtgtgaatcttgaattaatgctattagatggcttgacgcgattagtcacagaagtatttgaaacgcaataa

SEQ ID NO: 1286 - DNA, 129 bp, H. influenzae strain 86-028NP
ttggttcaaattttttctatttatttcttatttattaaaagtaaacgtttgctttttgctattttgtcaagccagtttgaaaatgtgtataattgccctcgttatttacaaaaatttcaggaaaaatga

SEQ ID NO: 1287 - DNA, 2124 bp, H. influenzae strain 86-028NP
atgaaactcgaagcaagcaagcaagcaagcaagcaagcaagcaagcaagcaagcaagcaagcaagcaagcaagcaagcaagcaagcaagcaagcaagcaagcaagcaagcaagcaagcaagcaagcaagcagaagtttaaaaaatcatttattataagtctatttttttctattctttatacctctccgcttttggctgttgttgattatacttatgacaattctaaattaacaaatgagcaaattgaacgattaaaaaaactccgcgatagaaatagtgaatattggaaaaaggaaacttatctcctgaaaagtcccccctcaaactttccagacattccagtattattccctaaagattcttccgttccattcgaaaacatcgataactcaaaagcgatttctttttatgatcaaaaatatactgaagattaccttgttggttttgcccaaggtttcggggttgcaaaaagaaatggggatacagaagagccggtacgaaaatattttaaggaatgtctaaatactgggaactataacaatgacaattgtaaggctaatccattagcttccagcgtatccataaaaagcgatattttcaccccacggccaacaataaaaaatagccatatcaacagcgaaattttggctgtcggtaattatacagaattgatgttagctgcccaaccttctgcttcttcgtgggcagagcatctctattccgatccaggattatctcttactgttcaagataactcacacgttatcggacaaacgattgatttgggattcttacaattaacaaattctctttgggagccacgttggaattctaatatcgattatttagtaacagaaaatgctgaaattcgttttaatactaaaaatgaaagtttactcgtagaaggttattatgccggcggagctcgttttcgttttgcttacgatctaaaagataaagcccctgaaacaccagttttaacttttgaacaaaatataaccggcacctccgacatcatcttcgaaaatccaatagacgatttaaaaagcctagacggacatcaaattgtcaaagtaaatggcaccgcagataaaaatgcatttagactttctggtaaataccgaaaagggatttatacgctctctttacaacaacgcctagagggcttttttaccaaattgcaagaacgcgatgatattgcgatttatgcacaacaggctcaagccgccaataccttattcgctttgcgtttaaacgacaaaaacagcgatatttttgaccgcactttgccgcgcaaaggcttgtggttgcgtgtgattgacggacactccagccaatgggtgcaaggcaaaacggcacctctagaaggctatcgaaaaggtgtgcaactcggtggcgaagtattcacatggcaaaacgaaagtaatcaattttccgttggcttaatgggtggacaagcagaacaacgcagcactttccgcaatccagatacagataatcttacaacgggaaatatgaaaggcttgggcgcaggcgtttacgccacttggcatcaacttcaggacaaacagacaggtgcgtatgttgatagctgggcacaatatcaacgcttccgccaccgcattaacactgaagatggcacagaacgctttacttcaaaaggtatcaccgcctcaattgaagcaggttacaatgctttattagcagaacacttaacggggaaaggaactcaaattcgtttttacctacaaccacaggcacaattgacttatttgggggtaaacggaaaattcagcgatagcgaaaattcccaagtgaatctacttggctcccgccaattacaaagccgagtgggcgttcaagctaaagcgcaatttttactcaataaaaatatcgtcattcagcctttcgccgctgtgaacacgctttaccacagcaaaccgttcggcgtggaaatagacggagagcgtcgagtaataaacaacaaaaccgcgattgaaagccaatttggtatagcagtgaaaatcaaatctcacttaactttacaagccacattcaatcgccaaacaggcaaacatcaccacgctaaacaaggtgcactgaatttacagtggacgttttaa

SEQ ID NO: 1288 - DNA, 660 bp, H. influenzae strain 86-028NP
atgccaaataaaagtgcggaagaaaatatgaaaggaaagtttattgtcattgagggcttagaaggtgcggggaaaagctccgctcatcagtctgttgtgcaagtcttgcatgaacttggtattcaagatgtcgtgtttacacgcgaaccgggtggaacgccactggctgagaaattacgtcatctcatcaaacatgaaaccgaagaacccgtgacagataaagcagagttattaatgctttatgcggctcgtattcagttggtggataacataattaaacctgcgttaatgcaagggaaatgggtggtgggcgatcgtcacgatatgtcatctcaggcgtatcaaggtggcggacgtcaattagatccgcattttatgcttactttgaaagaaaccgtattaggtgattttgagccagatctcacaatttatttggatatagatccaattgtcggtttagcgcgagctcgtggacgtggtgaattagatcgtattgagcaaatggatttagattttttccatcgcactcgagcacgctatttagcgttagtaaaagagaatccaaaagcagtcgtaattaatgctgagcagagtattgaacttgttcaagctgatatcgaaagagcggtaaaaaattggtggaaatcaaacgaaaaatga

SEQ ID NO: 1289 - DNA, 1044 bp, H. influenzae strain 86-028NP
atgaagaaatttttaattgcgattttacttttaatttttattttagcgggcgtggcgagttttgcttattacaaaatgactgaatttgtaaaaacaccagtaaatgtgcaggcagatcaacttttaactattgaacgtggcacaacaggtttaaaattagccgcactttttgagcaagaaaagttaattgatgatgggaaattattgccttatttgcttaagttgaaacctgagctaaataaaataaaagcagggacttattctcttgagaatgttaaaactgtgcaagatttactggatttgctcaattccggtaaagaagtgcagttcaatgtaaaatggattgaaggaaaaacctttaaagattggcgaaaagatcttgaaaatgcaccgcacttggtgcaaaccttgaaagataagagtaacgaagaaattttcacattacttgacttgcctgatattggtcaaaatcttgaactaaaaaatgtggaaggttggctttatcctgatacttataattatacgcctaaatccacagacttagagctacttaagcgatcggctgagcgaatgaaaaaggcgttaaataaggcttggaacgagcgcgacgaggatttacctttggcgaacccttatgaaatgttgattttggcttctatcgtggaaaaagaaacgggtattgctaatgagagggcaaaagtagcctctgtatttatcaaccgcttaaaagcaaaaatgaaattacaaacggatccaacggtaatttatggtatgggtgagaattacagcggtaatattcgtaaaaaagatttagaaaccccaacgccttataatacttatgtgattgatggattgccgccaacgcctattgctatgccaagtgaaagttcgttacaggctgttgcaaaacctgaaaaaacagatttctattattttgtggcagatggttctggtgggcataaatttacccgaaatttgaatgaacataacaaagcggtgcaagaatatttacgctggtatcgcagccagaaaaatgccaaataa

SEQ ID NO: 1290 - DNA, 942 bp, H. influenzae strain 86-028NP
atgaaaatgaaaaaatttattctaaaatcttttttattggctactttaggttgtgttgcttttacttctatggcacaagcggaggaacgtgttgtcgcgacagtagatggtattcctattttagaaagccaagttcgtgccaatatgggtaaaaaaggcgatcgccaaagtgcacttgataaaattattgatgatcttttagtgcaaaaagcgattcaagaatctggtgtgaaaattgatcctcgtgaaatcgatcgtgttgtggaagacactgcagctagaaatggcttaacttatggtcaatttttggatgcgttagattatcaaggcatttcattaaatacattccgtcagcaaattgccaatcaaatggtgatgggggctgtacgtaacaaagctattcaagaaagtattgatgtaacgcgtgaagaagtggttgcacttggtcaaaaaatgttggatgaggcaaaatcacaaggcactgcacaaaaagttacaggtaaagaatacgaagtgcgtcacattttgttaaaacttaatccattgttaaatgatgctcaagcaaaaaaacaattagctaaaattcgttctgatattattgcaggtaaaacaacttttgctgatgcggctttaaaatattctaaagattatttatcgggtgcgaatggcggtagtttaggttatgcgttcccagaaacttatgcaccacagtttgcgcaaaccgtcatgaaaagtaaacaaggtgtgatttctgcaccatttaaaactgagtttggttggcatattttggaagtaactggcgtacgtgatggcgatcttacagcagaagcctacacacaaaaagcatatgaacgtttagtaaatactcaattacaagatgcgacgaacgattgggttaaagcattgcgtaaaagagcgaatattcagtattttaataaataa

SEQ ID NO: 1291 - DNA, 540 bp, H. influenzae strain 86-028NP
atggaaaaaattattattgatcatgatcgttttcttcgcacaatttcgcgtatttctcacgaaattattgaaaaacatcaaaccttagatgatcttgttattgttggaattaaacgccgtggcgcggaaattgcagaattattacaacgtcgagttgaagagttaagtggtataaatttaccttcaatggaactggatattaccttttatcgagatgatttaactttggttgatcaggaagataaaatgccagtttatagtggttcatcacaatatttgaatattcaagataaaaccgtcattttggttgatgatgtgttgtttactggtcgaaccattcgagcggcaatggatgcgcttactgattttggtcgtgctgcaaaaattgaattagtgatttttgttgatcgtggccatcgtgaattacccattcgtgctgattacgtaggtaaaaatgtgccaacaagccgtgatgaacttgtacaagttcgtactgaaaaacaagatggctgttacgaagttgctattctagggaaataa

SEQ ID NO: 1292 - DNA, 792 bp, H. influenzae strain 86-028NP
atgcactactctattcaagattttattcaactcatcgcccaacttcgcaatccaaatggcggatgcccttgggatttaaaacaaaattatgaatccatgattccttgtttaacggaagaaacttacgaagtaatcgaagccattgagaaaaaagacataccaaatttacgtgaagaattaggggatttattgttgcaagtcgttttcttcagccagcttgcaacggaagataaatactttacttttgacgatgtgttacaagatatcgctgaaaaaattgtacgccgtcatcctcacgtgtttggtgatgcaaaagcgggggacgaaacagaagccctttcccgttggaacgaaatgaaagccaaagaaaaacaaggtaaaagtgaagaaacctctattttagataatgtgcctcgtgctttgccttctcttacgcgagcggcaaaattacaaaaacgttgttcaaaagtagggtttgattgggaagaaatttcacccgtatttgacaaagtgcgggaagaattagaagaagttcaagctgaaattaaccgcacttcgattgaacaaaataaagtggaagaggaaatcggcgatttattgttcgcaaccgtcaatcttgctcgccacttaaaatgtgatcctgaagatgcattgcggaaagcaaatttaaaatttgaacgtcgttttcgagcagtagagcaagcggttcaacaacaaggtaagcaagtgaataatgtgccacttattgaattagatttgttatgggatgaagtgaaaaaacaagaaaactaa

SEQ ID NO: 1293 - DNA, 876 bp, H. influenzae strain 86-028NP
atgtccacgaaaaatcattttattttccccacttacgttcaaatgtatccttattctaaggatcgcccttttcttaaacaagtgcgggaaaaattacgctattatggctataaatggttatatcaaaagcaatgtcatcaattagtggatttccttaatacagaaacgcaatggcagtctttatttacacaagattattatcgtactaatacaattctgacgaccttttgcgataaacgtttttctgcttcagaacgtttaacggcgattacggagaatttacgtttggcagaagaaaaaatgggacgttcgctttgccaacaattattagatcaacaacatatcgtgctaacccaattaactgaggatttgcgtttatcgttgagtattaatcatatcgatccctttgaaggatatttttctattaatattcgcaatcaaaataacgaacgagtatatgatgcgtctttcacttttttaagcccgaataaattgcttatcgcctcaattcaaggcccctcaagcgacaatgcacaagaacttgtgaaacaggctacgaaagcattacacggtatgcgaccaatgtttatgttggttaatgcgttcaaaatgcttgctgaaaaatggcaatgtgagttagtgggcattccgcacaaagcacaaggaaaataccgtctttctgctcgcagtaagattttgtttaattacgatgaattttggcaagaaaaccaaggagaatatcgccataactattggcaattacctttgcatattgaacgcaaacaattagaagatatcgcaagtaaaaaacgttctatgtatcgtaaacgttatgaaatgctagaccaaatggcactggatattcagcaactttaa

SEQ ID NO: 1294 - DNA, 2412 bp, H. influenzae strain 86-028NP
atggcgaagaatacccaacgtacaatgcccgtattgccattacgcgatgttgtcgtttttccttatatggtgatgccactttttgtagggcgcgtaaaatcaattaatgcccttgaagaagcgatgaacgatgacaaacagattcttttggtatcccaaagagaagctgatttggaagaacctacccctgaagatttatttgatgtgggtaccattgctaacattattcagttattaaaattacctgatggcacagtaaaagtgctagttgaaggtcaaaatcgcgcgaaaattaacagtcttgaagacggcgaaaagtgcttttccgcccaaattacccctatcgaaaccacttatggcgatgaacaagagttagtggtggcaaaaagtgcggtactttctgagtttgaaaattatcttaccctcaacaaaaaagtgcctacagatattctcaatgcccttcaacgtattgatgatgttgatcgcttagctgacacaatggctgcccatctccctgtaagcattcgccataaacaaaatgcgttagaactcgctaatgtgcaagaacgtttagaatatttgcttggtatgatggaatcagaggctgatattctccaagtggaaaaacggattcgcggtcgtgtaaaaaaacaaatggagaaaagccagcgtaactattatttgaacgagcaaattaaagccattcgtaaagaaatggatggtggcgaaaatgaagataccattgatgaagttgaacaactgcatcaaaaggtggaagcggcaggcatgccagctgatgtgcgtgacaaagtagaaaatgaattacaaaaacttaaaatgatgtctgccatgtcttctgaagcaacggtaatacgcagttatattgaatggatgatccaagtgccttggcatcaacgttctaaagtgaaaaaagacattgttaaagcacagcaagttttagataccgatcactatggtttagatcgcgtaaaagaacgcattcttgaatatttagcagtacaagcgcgtttaaacaaagtgaaaggcccgattctttgtttagttggccctccaggtgtaggtaaaacttctcttggtcagtctattgccaatgctactggtcgtaaatatgtacgtatggcattaggcggcgtgcgtgatgaagcagaaatccgtggtcaccgtaaaacctatattggtgcattgccaggtaaattaattcaaaagatggcaaaagtgggcgtaaaaaatccattattcttgcttgatgaaatcgacaaaatggcatccgatatgcgaggtgatcctgcatcagcgttgcttgaagtattagatcccgagcaaaacaccacgtttaacgatcactatttagaagtggattatgatctttctgatgtgatgtttgtggcaacatcaaactctatgaatattccaggcccattattggatcgtatggaagttattcgtctttctggttatacagaagatgaaaaacttaatatcgcaatgcgccatttattagcaaaacaaattgaacgtaatggtttgaagaaaggcgaacttaccgtaaaagaaagtgcaattttagatattatccgctattacacacgtgaagcgggcgtacgtggattagaacgtgaaatttcaaaaatctgccgtaaagccgtgaaaaatttattagtaaatccaaaacttaaatctatcacggtaaattcagataatctgcacgattatcttggcgtaaaacgttttgaatttggtaaagctgacacgcaaaaccgtattggcgaagtaactggtttagcttggacagaagtgggcggcgatttactcactattgaaactgcctctgttgtgggcaaaggaaaactttctttcactggttcattaggcgatgtgatgaaagaatccattcaagcggcaatgaccgttgtgcgtgctcgtgcggataaactgggtatcaatgctgaattccacgaaaaacgtgacattcacattcacgtgccagatggtgcaacaccaaaagatggcccaagtgcaggtattgcaatgtgtactgcattaatttcttgtttaacaggtaatcctgtgcgtgctgatgtggcaatgacaggagaaatcagtttacgtggtaaagtattaccaatcggtggattaaaagaaaaacttcttgcggcacatcgtggcggaattaaaaccgtattaattccaaaagagaacgttaaagatcttgaaaaaattccagaaaacgtaaaacaaaatcttgcaattcatgcggtagaaaccattgatgaagtgcttggttttgcattggaaaatccaccagagggcattgagtttgttaaagtgaaggctaaacctaaagcaccacgccgtaaagtgacgagtaaatcagaaagagcggtcaattaa

SEQ ID NO: 1295 - DNA, 1152 bp, H. influenzae strain 86-028NP
atgctaaaacttcccccactttccctttatatacacattccttggtgcgttcaaaaatgcccttattgtgattttaattcgcacgcacaaaaaggcgatataccagaacaagactatatttatcatcttctgcaagatttgcaggctgatttgcaacgctttaaagattctattcaacaacgaaaactccattcaatttttattggtggcggtacaccaagtttgttctcggcagaaagcattgcgtatctcttaaaagaaataaaaaaacagattgattttgaagataatattgaaatcacattagaagctaatcctggcacggtagaagctgaacgttttaaaggttatgtatccgcaggcattatgcgaatttctatgggaattcaaagtttcaatgatgataaattacaacgtcttgggcggattcataatgcagcagaggcaaaaagtgcggtcaatttagcgaaagtttctgggctaaaaagtttcaatttagatttaatgcacggtttgcctaaccaaacgttggaagaagccttagatgatcttcgtcaagcaattgagctatctcctccccatatttcttggtatcagctgactattgaaccaaatacgatgtttgcttatcgcccacctaaattaccagatgatgacgcactttgggacatttttgagcaaggtcaccaacttttaacgatggcaggctaccagcaatatgaaacgtctgcttacgcaaaagcgggttttcaatgtaaacataatttgaattattggcgatttggggattatttagccattggctgtggcgcacacgggaaattgacgtttccgactggcgagattactcgcttttctaaaaccaagcacccgaaaggttatttgcgtggcgaatatctttacgaagaaaaaaacgtgccagaaattgaccgcccttttgagttttttatgaatcgctttcgtttgttagaagcggttcccaaacaagaatttgaagattacacaggcttgtcgcaaagtgcggtgaaaaatcaaattgattttgccattcaacaaaactatattgtggaaaacgctgattcttggcaaatcactgagcacggcaagttatttctcaatgaactattggaattatttttaactgaagaatag

SEQ ID NO: 1296 - DNA, 660 bp, H. influenzae strain 86-028NP
atgaatcaattagaaatgaaaaaactcgccgcacaagctgcattagaatatgtaacagctgacacaattgttggcgtgggcagtggctccacagtgaactgctttattgaagctttgggtacaatcaaaaataaaattcaaggcgtagttgcggcttcaaaagcatcagaagaattattacgtaaacaagggatcgaagtatttaatgcaaatgatgtctctagcttagatatttatgtggatggtgcagatgaaatcaatccacaaaaaatgatgattaaaggcggcggtgcggcacttactcgtgaaaaaatcgttgcggcattagcgaaaaaatttatttgtattgtagattctagtaaacaagtagatgtgttaggttcgactttcccattgccagttgaagttattccaatggctcgttcacaagtgggcagaaaattagtcgcacttggtggcgcacctgagtatcgtgaaggcgtggttacagataatggcaatgtgattttagatgtacacaacttcagtattttaaatccagttgaaatggaaaaagaattaaacaatgttgcaggtgtcgtcactaatgggatattcgcattgcgtggcgcagatgttgtaatcgtcggcacgcctgaaggtgccaaaattattgactaa

SEQ ID NO: 1297 - DNA, 1233 bp, H. influenzae strain 86-028NP
atgacaaacaaagtttcactcgacaaatcaaaaattaaatttgtattgtttgaaggtgtgcatcaaagcgcacttgatacgctccacgcggcaggctatagcaatattgattactataaaaaagcactggatggtgatgaattaaaagaagccattaaagatgcacattttatcggattacgttctcgcacccatttaaccgcagaaatgattgaagccgcacccaaattaatcgcagtaggctgtttctgtattggcaccaaccaagtggatttaaatgcagcaaaagcacgtggtattcctgtatttaatgcgccattctcaaacactcgttccgtcgcagaacttgtattaggcgagattttattacttatgcgtaatgtgccacaggctaatgccgaagtacatcgtggtgtttggaataaatccgcgactggctcttatgaagtgcggggtaaaaaattaggcattattggttacggccacattggttcacaattaagtattattgccgaatcattaggcatggatgtgtatttctatgatattgaaaataaacttccgctcggtaatgcaaaacaggttcgtagccttgaagaattactcagttcttgcgatgtggtttcattacatgtgccagaactgccctccaccaaaaacttaatgaacgcaacgcgtatcgcacaattaaaacaaggggcaattttgatcaatgctgcgcgtggcactgtggtagatattgatgctctcgctcaagccttaaaagacgggaaacttcagggtgccgcaattgatgtattccccgttgaacctgcttcaattaatgaagaatttgtctcgccattacgcgaatttgataatgtgattttaacgccacatattggcggctcaacagcggaagcacaagaaaatatcggttttgaagtggcaggcaaatttgttaaatattcagataatggctcaaccctttcttcggtaaacttcccagaagtctctttaccagagcacgagggaacaaaacgcttattgcatattcatgaaaatcgccctggtatattgaacaaactgaaccaaattttcgtcgaagccaacctcaatattgccgcacaatatttacaaactgacccgaaaattggttacgttgtcgttgatgtagaaacgaatgatgcatcaccattactgacaaaattgaaggaaattgatggcacaattcgtgctagagtactttactaa

SEQ ID NO: 1298 - DNA, 843 bp, H. influenzae strain 86-028NP
atgtctcaatttatttctcttactcaatatcaactgattgaagtacagggtgcggatgtagaaaaatatttgcaagggcaattaacttctgatgttgtgcgattagcgagtggcgcaacgacgcttacagctcactgcgacccaaaaggtaaaatgaatgcaatttaccgtttgtttaaagtaagtagtgaacaagtctttttgctcgttaagaaagatattttgccaagcgctctggatgctttgaaaaaatatgcggtattttccaaagttagttttgatttacgtgattggcaaatcatcggcgtaataggtgaaaaatgtggaaaaattacaccgcacttttcattggaaattgatggacagcgttcaattttattaaatgaaactgaattacccgtgaattttaatggcgatgaaaaaatttgggaagtagccgatattcaagcaggattgccaaatttaagtccgcaaacacaaaatgaatttatcccacaagcactaaatttacaggccgttgagcaagcaatttcttttaccaaaggctgttatattgggcaagaaaccgtggcacgtgcgaaatatcgtggggcaaacaaacgtgcaatgtttatttttaaagcgcaaactcagcaggaagtggaaattggcagtgaaatcgaaatgcagcttgaagccaattggcgtaagactggcacgattacaagtgcggtcaatttagacggtattttatggttgcaagttgtgatgaataatgacatggattcagagcaacaatttagattgccgagtaatgaaatactgttagagcgagtgcagttaccttattcgattactgaataa

SEQ ID NO: 1299 - DNA, 864 bp, H. influenzae strain 86-028NP
atgatttacagtatgaccgcttttgcacgccttgaagtgaaaaaagattggggcgatgcggtatgggaaattcgttccgtcaatcaacgttatttagaaaactttttccgtttacccgagcaatttcgcggattagaaaacacgttgcgtgagaaacttcgtcaaagtcttactcgcgggaaaattgaatgttctttgcgtattgaaacaaaaaaacaaacaaatgctgaattgaatttaaataaagaacttgcgaatcaagtcattcaatctttgcaatggattaaaactcaagctggagaaggtgaaattaatttgacagacgtgttgcgttatccgggggtggtggaagcgcaagagcaagatttagatgcgattagtcaagatttattgacagcctttgatgatttactgaccgattttattgcaatgcgtggtcgtgaaggggaaaaactgaacgatattattcaacaacgcttagatgccattgcagtagaagcggataaagtgcgatcacaaatgccagcagttttacaatggcagcgtgaacggttattgcaacgttttgaagatgctcaacttaatcttgatccacagcgtgtggaacaagaaatgattttactcgctcaacgtgttgatgtggcggaagaactcgatcgtttacaaatgcacgtgaaagaaaccacgaatattttgaaaaaaggcggtgcagttggtcgtaaattagattttatgatgcaagaattgaatcgtgaatccaatacccttgcgtctaaatccattaatgcggatatcacggcttctgcggtggaattaaaagtgcttatcgaacaaatgcgtgagcaaattcagaatttagaatag

SEQ ID NO: 1300 - DNA, 912 bp, H. influenzae strain 86-028NP
atgacaaacacaacaatgcaaccaaaccgccttcgtattgctttgcaaaaaaaagggcgtttaagccaggattgtgccatattacttaaacaatgtggcgtgaaaattaattggaatgaacaacgtttaatcgcttatgcggaaaatttgccgattgaaattcttcgcgtacgtgatgatgatattcctggattgatttttgatggcgtagtggatcttgggattattggcgaaaatgtgttagaagaggaagagcttggtcgccgtgcagcaaatgaaacagttacatacaaaaaacttcgccaacttgattttggtgattgtcgtctatcacttgcggttgatcgcgattgtcattatgagaatgtgaaagatcttgctaataggcgtattgcaacttcttacccgcatttgctcaaacgttatatgaatgagaatggggtgtcgtttaaaagttgtttattaaatggttcagtagaagtcgcacctagtgcgggtattgcttatgcgatttgcgatttagtatcatcaggggcaacgcttgaagcaaatggcttaaaagaagtggacgtgatttatcgttctaaagcttgtttaattcagcgtgctgaaccgcttgaatcaactaaacaagctcttgtggataaactactcactcgtattcaaggtgtacagcaggcagcagaaagtaaatatattatgctccacgctccgaaagaaaaacttgaaaaaatcactgcgcttttacctggcgttgaaaatccgaccattttaccattagccagtgatacaactcgggtagcaatgcacgtagtgagccaagaaaatttattttgggaaacaatggaacagttaaaagaggcaggagctagttcaattttagtgttaccaattgagaagatgatggagtaa

SEQ ID NO: 1301 - DNA, 1284 bp, H. influenzae strain 86-028NP
atgcaaacaattatttggaatcatttatcagaaactgaaaaacgcaaagtcattatgcgtccagtccaacaaaatggggaaaacattcagcaggcagttaatgccattcgtgaaaatgtggcatacaatggcgatcgggcgttatttgaactctgtgaaaaatttgatggcgtgaagttagataaactcattgtttcggcagatgaaattcaagcggcaagcagtcggatttctgtaaaacttcgcaatgcgattgagcaagccaaaacgaacattgaagcctttcacaaagcacagcaaaatcaggaaattgacctagagatccaagaaggcgtgcgttgccaagttgtgactcgtccaatttcttgtgtagggctttatattccgggtggttcagcaccgctgttttccaccgtattgatgttagctattcctgctaaaattgcaggttgtaaaaaaatcgtgctttgttcaccgccaccgatctcagatgaaattctctacactgctcatctttgcggtgtggaaactatctacgctataggtggtgctcaagcagtttttgcgatggctcaaggcacggaaagtgtggcgaaagtagataaaattttcggacctggaaacgcatttgtgacagaagcaaaacgtcaggtagcacaaaatagtacggcgattgatatgccagcgggaccttcagaagtgttagtaattgcagatgaatcggcagatcctgaatttgtggcaagcgatttactctctcaagcggaacatggggcagatagccaagtgattttggtggcgacctgtgaaactctggcaaaagagaccgcacttgcgattgaacgccaacttgctctattacctcgtgctgaaaccgctcgaaaagcgttaaaccacagccgtatttttatagcagaaagccttgaacaagcggtagaaattagcaatgaatatgcccctgaacatttaattgtgcaaacaaaaaacgcccgtaaattattaccatatttagataacgcaggctcaattttcttaggtgcatattcgcctgaaagtatgggcgattatgccagtggcacaaaccacgttttgcctacttatggttacaccaaaacttattctagtctaggattagctgattttagtaagcgaatgacagtacaagaactcacaccaaaaggttttaaaaaccttgctgaaacggtggaagtgatggcagaagctgagcaattggcagcacataaaatggcagtaagtgtaagattggcgaaactcaatatctaa

SEQ ID NO: 1302 - DNA, 1104 bp, H. influenzae strain 86-028NP
atgaatgattacaattcgcacattttacaatggaagaaaacaataatgacaatcacaactttatcccgacaaaatatacaagccttaacgccatatcaatccgctcgaaaactcggcggcaatggtacgatttggctgaatgcaaatgaatatccaacctcgcctgaatttcagctttcgggtaaggatttaaaccgctaccccgaacctcagcctcaaagagtggtacaggcttatgcgaattatgcgggcgtttcaactgaaaatgtactcgttactcgtggcggtgatgaaggcattgaattgataatccacactttttgcgaacccaaacaagatgccattttattctgtcctccgacttacggaatgtatgcagtgagtgctgaaacggcaggtgtgctaagtaagagcgtgcctttaactgacgattttcagcttaatttgccagaaatcaaaaatcatcttaatgatgtaaaagtagtctttgtatgcagcccaaataatccgacaggtaatttgctcaagcaatcagatatactcgatcttttgcaaatcacggcaggcaaagcgattgtggtggtggacgaagcctatattgagttctgtcctgaagcaagcgttattaatttgcttaaaaattacccgcacttagcaattatccgcacgctctctaaagcctttgctttagctggattgcgttgtggttttgtgttagcaaaccctgagctaattgacatcttaagtaaggtaatcgctccatatcctatccctgtgccgagtgctgatcttgcggaacaagcgttaagacctgcgaacatcgccactgttcaagctctcacacaagaacttctttccaatcgtcaatggcttgctaaagctcttttagttttacatcaagtggaaaaagtgtatgaaagtgaagctaattatctgttgatcaaatgtcaaaacgggcaagctgtgtttaaggcattgtgggaacaaggaattattttaagagaccagaataagacattgcatttacaaaattgtattcgcattactgtgggaacaaggaatgagtgtgagaaagttgttgaagcaattaaggaggtaaaatga

SEQ ID NO: 1303 - DNA, 1089 bp, H. influenzae strain 86-028NP; identical to SEQ ID NO: 615

SEQ ID NO: 1304 - DNA, 600 bp, H. influenzae strain 86-028NP
atgacaaacatcacgattatagacacaggttgtgccaacctttcttctgtaaaattcgcctttgaccgattaggttacaataccgagatcacttttgatctcaataaaatcaaatctgccgataagctgattttacctggcgtaggcactgcaaatgcagcaatgtataatttacaagaacgtcaattgatcgaaaccattcaaaatctaactcaaccagtgctaggaatttgtttgggtatgcagttaatgaccgaattttccgaagagggtaatgtgccgaccttaaacctaataagcggaaaaactaatcgaattcccgatacgggtttaccgttacctcaaatgggatggaatcgcgtgcaatttgtaaaaaactgtccgttatttgatggtattgtgcaaaatagtcacttctattttgtgcatagttatgcagttagcccgaatgaacattcggtggcaataagcaattatggtgtgaatttttctgctgcgatagcgaaagagaatttttacggtgtacaatttcatcccgaacgttcgggtaaaaatggtgcgttgttgctaaaaaattttgtggaaaaagtaccgttttaa

SEQ ID NO: 1305 - DNA, 750 bp, H. influenzae strain 86-028NP
atgaaacaatctattattatccctgctcttgatcttatcaatggtcaagttgtgcggttacaccaaggcgattatgccaagcaaactacctattctgacaatccaattaagcaatttgataattatgtacgtcaaggagcaaaacaactacatctagtcgatttaacgggagcgaaaaatccccagtcaagacaaaccgcacttattggaaaaatcgttgaagcaacacaatgtaaagtacaagtgggaggaggcattcgtacagagcaagatgtggcagatttattggctgtgggtgcgaatcgcgtggtgattggttcaaccgccgtaactcatcgttcaatggtgaaaaactggttcatcaaatatggtgcggaaaaatttgttctagcattagacgtgaatattaatgcaagcggtcagaaaatcgttgcgattagcggttggcaggaagaaagtggtgtactattagaaacgttgatcgaagatttccaaaccgttggcttacaacaagttttatgtaccgatatttcacgcgatggcaccttgacaggttcaaatattggactttatcaagaaatttgtgagaaatatccacctattcagtttcaatcttctggagggattggttcactggctgatattgaggctctaaaaggcacaggtgtgtcaggtgtaattgtaggtcgcgctttattagaaggaaaatttacgctttcggaggcaatcaaatgttggcaaaacggataa

SEQ ID NO: 1306 - DNA, 777 bp, H. influenzae strain 86-028NP
atgttggcaaaacggataattccttgtttggatgtacgtgatggacaggtggtaaaaggggtacaattccgtaaccacgaaattattggcgatattgtgccacttgctcaacgctatgcgcaagaaggagctgatgaattggtattttatgatattacggcttcatcagacggtcgtaccgtggataaaagttgggtagaacgaatcgctcaggtaattgatattccgttttgcgtagcaggtgggattaaaaccattgaagatgcggaaaaattgtttgcatttggggcggataaaatttcgattaattcccctgctctcgctgatccaacgctcatttctcgcttagcagatcgttttggcgtacaagcgattgtagtaggtattgatagttggtttgaacaggaaacaggtaagtattgggtaaaccaatatacaggcgatgaaacacgtacccgacaaactcattggcagttgttagattgggtaaaagaagtacaacaatgcggtgcaggagaaatcgtgctaaatatgatgaatcaagatggtttacgaaacgggtacgatttagcccagctcaagctggtgcgaggagtatgtagagtacctctaattgcatctggcggtgcgggtaaaatggtacattttcgtgatgcttttattgaagcaaaagtagatggggcattagctgccagcgtattccataaacagattattgaaattggcgagttaaaatcctaccttgtgcaatcagccatcgagattcggagtgaataa

SEQ ID NO: 1307 - DNA, 666 bp, H. influenzae strain 86-028NP
atgaatattactaaaatagactggcaaaaagttaatggtcttcttcctgttattattcaaaatataagtactcgtgaggtactaatgcttggctatatgaatgaagaagcccttacaaaaaccatcaaagaacgtaaagtaactttcttctctcgtaccaaacaacgattatggacaaaaggagaaatctcgggcaattttttaaatgtggaagaaatgagcttagattgcgataacgacactttgctcattttagttgatcccattggggcaacttgccacacaggtgaatacagctgcttccatcaatttacctctccacaatcagagaacaagaagcaacaatttgcaaattgggcgtggtttataaaattagaacaacatttaaaagaaaagaaaaatgcagatccttctaattcttatactgcaacattacacgcaaaaggtaccaaaaaaatcgcccaaaaagtgggggaagaaggtgtggaaactgccttggctgcggtcgcacaagataaagcggaagtcatttctgaagctacagatttggtctatcacttaaccgtattattacacaatcaagatcttcagtggtacgaaattatcgcaaaactacaagaacgccatcaagggattggattacatccagaaggaggaaataaataa

SEQ ID NO: 1308 - DNA, 153 bp, H. influenzae strain 86-028NP
atggtaattaaatgtattgataaacaacaaaatttaggaaatatcattttattccttcttcttaagcaacaatatagcaaggaagatagtaaaaaattcacaatttataaattttatttacagactgtaaattatacaatacaattatcgtaa

SEQ ID NO: 1309 - DNA, 1203 bp, H. influenzae strain 86-028NP
atgaacaaaactgtaggcagcacacttcttgttgctggtacgatgattggcgcgggaatgttggctatgccactcacttccgctggcattggcttcggctttactttagtcttgttattggggctttgggcattattaacttttagcgcacttttattcgttgaactctatcaaactgcggaaagtgatgcaggtatcggcacacttgcagaacaatattttggtaaaacaggacgcattattgccacagccgtgctaattattttcttatacgcattaattgccgcttatatcagcggtggcggttcactactaaaagatttattaccagaaagttttggcgataaagttagcgtcttattatttaccgtgattttcggttcatttattgtcatcggcacacatagcgtagataaaattaatcgcgtgttatttttcgttatgcttgctgcctttgccgtggtgttaagcttaatgttgccagaaatcaaatttgataacttaatggcgacgccaattgataaggctttaattatctctgcaagccctgtatttttcacggcgtttggtttccacggttccattccaagtttaaataaatacttagatggcaatgtaaaagcattgcgcttctctattttggtcggctctgccataacactttgtgcttatattctatggcaactatccacgcacggcttgcttacacaaaatgaatttttacaaatcttaaaagaagatgcgactttaaatggcttagtaaaagcaaccttcgccatcactggaagcaatgtgatcgcaagtgcggtaaaattattttctacattagcacttatcacttctttcttaggtgtgggattaggattgttagaatgtattgaagatttactaaaacgttcatttaacgttacagcaggcagaatttcacttggtttactgacttttattccaccacttgtttttgcattattttacccagaaggttttattttagcactaggctacgcaggtcaaatgtttgcattctacgccgtagtattgccagttagccttgtttggaaagctcgtcgtgcccacgctaatttgccatacaaagtgtggggaggaaatctgactttaattatcgtattggtattaggcgtgatcattacatccattccatttgcgattcgtgcgggttatttaccctttgttgtaggttaa

SEQ ID NO: 1310 - DNA, 429 bp, H. influenzae strain 86-028NP
atggcgacatttaatttaacaatagtaagcgcagagcagaaaatctttgaaggtgaagtaaaacaaattcaggtaactggtgtggaaggggagcttggtattttgcccggacatacgccattgctaacagcaattaagcctgggattgttaaatttactcttaaagatgggaatgaagaagttatctatgtttctggtggttttttagaagttcaaccaaatattgtgacagtattagcagatattgctattcgaggtagtgaattagatgcagatcgtattcacgaagcaaaacgtaaagcagaagaaaatatagtatctcgcggatctgatgcagatcacgacttacttgttgcaaaactttctaaagagttagcaaaacttcgagcttatgaactcactgaaaaactattgaaaacaagacgataa

SEQ ID NO: 1311 - DNA, 1374 bp, H. influenzae strain 86-028NP
atgtcagcaggaaaaattgtacaaatcatcggtgcggtgattgatgttgaatttccacaagatgcggtgccaaaagtttacgatgcattaaaagttgaatcaggtttaacacttgaggtgcaacaacaattaggtggcggagtagttcgttgtattgcattgggtacatctgatggtttaaaacgtggcttaaaagtagaaaacacaaataacccaattcaagtaccagtaggcacaaaaacacttggtcgtattatgaatgtgttgggcgaaccaattgacgaacaaggagcaattggtgaagaagagcgttgggctatccaccgttcggcaccgagctatgaagaacaatcaaacagtacggaattattagaaactggtatcaaagtgatcgacttaatttgtccattcgcaaaaggtggtaaagttggtttattcggcggtgcaggtgtaggtaaaaccgtaaatatgatggagttgattcgtaatattgcgattgagcattcaggttactctgtatttgcgggtgtaggcgaacgtactcgtgaaggtaatgacttctatcatgaaatgaaagattctaacgtattagataaagtatctttggtttatggtcaaatgaacgagccaccaggtaaccgtttacgtgttgcattgactggtttaactatggctgaaaaattccgtgatgaaggtcgagatgtattattctttgtggataatatctatcgttatacccttgctggtacggaagtatctgcgttattaggtcgtatgccatccgcggtaggttaccaaccgacattggcagaagaaatgggtgtgttacaagaacgtatcacttcaaccaaaacaggttctatcacttctgtgcaagcggtgtacgtaccagcggatgacttaactgacccatctccagcaacaactttcgcacatttagactcaactgttgtattaagtcgtcaaatcgcatctttaggtatttaccctgcagttgatccattagattcaacttcacgtcagttagacccgcttgttgttggtcaagaacattatgatgttgctcgtggtgtacaaggtattttacaacgttataaagaattgaaagatattatcgcaattcttggtatggatgaattatctgaagaagataaactagtggtagcacgtgcacgtaaaattgaacgtttcttatcacaaccattctttgttgcagaagtcttcacaggttcaccaggtaaatacgtgacattaaaagacaccatccgtggcttcaaaggtatcttagatggcgaatatgaccatattcctgaacaagcgttctatatggttggttcaatcgatgaagtgttagaaaaagccaaaaatatgtaa

SEQ ID NO: 1312 - DNA, 870 bp, H. influenzae strain 86-028NP
atggcaggtgcaaaagagataaaaaccaaaattgccagtgtacaaagtacacaaaaaatcactaaggcaatggaaatggtggcaacctcgaaaatgcgtaaaacgcaggatcgtatggctgcatctcgtccgtattctgaaactatccgtaacgttattagtcatgtgtctaaggcaagtatcggttataaacatccgttcttagttgagtgcgaagtgaagaaaatcggtatcttggttatttcaacagatcgtgggatgtgtggtgggttaaatgttaatttattcaaaaccacacttaaccaaataaaaaattggaaagaacaaaatatttctacagatttgggcttaataggttcaaaagggattagttttttccgttcctttggatttaatatcaaaggtcagctttctggtttaggcgatacgcccgctctagaagagttaattggtgtggcaaatacaatgtttgatgcttatcgtaatggtgaaattgatgcagtttatattgcatacaataaatttgttaatacgatgtcgcaaaaacctgttgtgcaacagttagttcctttaccagaatctaaagacgatcatttaaatgaaagacaacagacttgggattatctttatgagccagaaccaaaggcacttttagatagccttttagttcgttatttagagtcccaaatttatcaagcggttgtagataatttagcttcagaacaagcggctcgaatggtagcaatgaaagcagcaacggataatgcaggtaatttaattaatgatctgcggttggtgtacaacaaagctcgtcaagcaagtatcacaaatgaattgaatgaaatcgtagccggtgcggcggcgatttaa

SEQ ID NO: 1313 - DNA, 1542 bp, H. influenzae strain 86-028NP
atgcaactaaattcaactgaaattagtgaattgattaaaaaacgcatcgctcaattcgacgtggtcagtgaagcgcgtaatacagggacaattgtttctgtaagcgatggtattattcgcatccacggtttaagcgatgtgatgcaaggtgaaatgatcgccttaccaggtaatcgttatgcgatggcacttaaccttgaacgcgattctgttggtgctgtagttatgggaccttacgcagatttagcggaaggtatggaagttcaatgtacaggtcgtattcttgaagtaccagttggtagtggtttattaggtcgtgtagttaatacgcttggtcagccaatcgatggtaaaggcgaaattgaaaatgatgatttctcaccagtagaagtgattgcgccaggtgttatcgatcgtcgttctgttgatcaacctgttcaaactggttataaagctgtcgattccatggtaccgattggtcgtggtcagcgtgagttaatcatcggtgaccgtcaaacgggtaaaactgcgttagcaattgacgctattattaatcaacgtaattcaggtattaaatgtatctatgttgcgattggtcaaaaagcctctactattgcaaacgtcgtgcgtaaattagaagaacatggtgcgcttgcaaatactatcgtggtagctgcatctgcatctgaatcagcagcgttacaatatttagccccttatgctggttgtgcgatgggggaatatttccgtgatcgcggcgaagatgcgttaattgtttatgatgatttatcaaaacaagccgtagcttatcgtcaaatttcattattattacgtcgtccaccaggtcgtgaagcctatccaggtgatgtgttctatttacattctcgtttactagaacgtgcttctcgtgtaaatgaagattatgtagaaaaattcactaaaggcgaagtaaaagggaaaacaggttctttaaccgcacttccgattattgaaacccaagctggtgacgtatctgcgtttgttccaaccaacgtaatttctattaccgatggtcagattttcttagaatctaacttgtttaactcaggtattcgtcctgcggtaaacccaggtatttcggtatctcgtgttggtggttcagcgcaaactaaagttattaagaaattagcgggtggtattcgtactgcactagctcaatatcgtgaattagcagcgtttgcacagtttgcatcagatctagatgatgcgactcgtaagcaactttctcacggtgaaaaagtaactgaattattaaaacaaaaacaattcgcgccattatctgttgcagaacaagcggttatattgtttgctgttgaatttggttatttggatgacgtggaattatcaaaaattgcaagttttgagaccgcacttttagattattctaaccgtaatcacgctgaatttatgcaagagcttaataaaaccggtaactataatgatgaaatcaaagatacgttaaaaagtattttagatggttttaaagcgaatagtgcttggtag

SEQ ID NO: 1314 - DNA, 534 bp, H. influenzae strain 86-028NP
atgtcagaattaactacaatagctcgcccttatgcaaaagctgcattcgactttgccattgaacaaagtgcggtcgaaaaatggactgaaatgttaggttttgctgctgccgtagctgaagatgaaacggtaaaagcttacttaagtagttctctttctgcacagaaattagctgatacagtaatttctatttgtggcgaacaattggatcaatatgggcaaaatcttattcggttaatggctgaaaataagcgtttgagtgctattcctgcggtgtttgaagaatttaaacatcacgtagaggaacaccaagctattgcagaagttgaagtaacatctgcgcaaccattgaatgcaacacaaatcgaaaaaattgcagctgcaatggaaaaaagattagctcgcaaagtgaaattaaattgcaacgtggataacgcacttattgctggtgtgattgttcgtactgaagactttgtgattgacggaagtagccgtgggcaacttactcgtctcgcaaacgagttgcaattataa

SEQ ID NO: 1315 - DNA, 471 bp, H. influenzae strain 86-028NP
gtgaatttaaatgcaacattgattggtcaacttatagcattcgcactttttgtgtggttttgcatgaagtttgtttggccaccaattattaatgcgattgaaacacgtcaaagccaaattgcgaacgctttagcgtcagctgaagcagctaaaaaagagcaagcagatacgaaaaatcttgttgaacaagaactttcagctgcaaaattacaagctcaagacattttagatgctgcgaataaacgtcgcaatgaagtattagacgaagtgaaggcagaagccgaagaactaaaagcaaaaattattgcacaaggttatgctgaagtagaagcagaacgtaaacgtgttcaagaagaattacgtcttaaagtagcttcattggcagtagctggtgctgagaaaattgtgggtcgttctattgatgaagcggcaaacaatgacattattgataaattagttgcagagttataa

SEQ ID NO: 1316 - DNA, 255 bp, H. influenzae strain 86-028NP
atggaaactgtaattacagcgacaatcatcggtgcatcaattcttcttgcatttgctgcattaggtactgcaattggctttgctattctaggtggtaaattcttagaatcatcagctcgccaaccagaattagcatctagcttacaaactaaaatgtttatcgtagctggtcttttagatgcgattgcaatgattgctgttggtatttcattacttttcattttcgcaaacccattcatcggtttattaaactaa

SEQ ID NO: 1317 - DNA, 789 bp, H. influenzae strain 86-028NP
atgtctggacaaacaacatcggaatacattagccaccatttatcctttctcaaaacaggggatggattttggaatgttcatatagatacgttgttcttttctattcttgctgcggttattttcctatttgttttttctcgagtagggaaaaaagcaacaactggcgttccaggaaaaatgcaatgcttagttgaaattgttgtggaatgggttaatggaatcgtgaaagaaaattttcatggtccacgtaacgtagttgcgccacttgcattaacaattttctgttgggtattcatcatgaatgctatcgacttaattcctgttgatttcttacctcaatttgcaggtttgttcggtattcattatcttcgtgcagtgccgacagcagatattagcgcaactttgggtatgtccatttgtgttttctttttaattcttttttatacaataaaatctaaaggattcaaaggtttagttaaagaatatacgcttcatccattcaatcattgggcgtttattcctgttaattttattcttgaaacggtgactttattggctaaaccaatttcacttgctttccgtttgttcggtaacatgtatgcaggggagttgatctttattcttatcgctgtaatgtattccgctaatatggccattgcagcattagggattccgttacatcttgcttgggctattttccatattttggttattaccttgcaggctttcatctttatgatgttgacggttgtttatttaagtattgcttataacaaagcagatcattaa

SEQ ID NO: 1318 - DNA, 375 bp, H. influenzae strain 86-028NP
atgtcgcgcattttatctcacgctaaaaaaaactacagaaaagctattattattgagagtcttttgcttgtagttttttatttgcttatttatggatggcaacgccaaagtgcggtagattttagctacggttttttaagtgcctttttgcctttttgtacatttatatttatcattttttacagaaaacaaaatttttcaacaaaactgaccgcactttatcgtgctgaagcaataaagtttattttaacgatggtttttatcattattgccatcaaatggttattcgttatcaattttattgcgttttttgttggttttttattggcattagtgctgaataatattattccacttattctcaataaaatttaa

SEQ ID NO: 1319 - DNA, 612 bp, H. influenzae strain 86-028NP
atgaaagccaaattagtcagtttacttgcgcaagcaaatataaaaataagtgatcaacaaattcagcagttgattaatctggtcaatttactcaataaatggaataaagcttataatttgacgtcagttcgtgatccgcaagaaatgttagttaaacatattttagatagtcttgttgtaagtccttatttacaaggtgatcgttttattgatgtcggtacagggcctggtttgcctggtttacctttggcaattattaatccttccaaacaatttgtcctccttgatagcttaggtaagcgtattagttttattcgaaatgctatacgtgagcttagactaactaatgtaacccccgttttaagtcgagtagaagaatatcaacctgaagataaatttgatggtgtattaagccgtgcttttgcttcactaaaagatatgacagattggtgccatcatttaccaaaagaaaatggatatttttatgcattaaaagggatttatcaggaagatgaaattaatgaattgaataaaaaatatactattcaaaaagtgattgaattatctgttcctgaacttataggcgaacgacatttaatcgttttacgttaa

SEQ ID NO: 1320 - DNA, 378 bp, H. influenzae strain 86-028NP
atgcggttatttaagcaactagaacgttggaaaactcgcaggcaaataaatcaatctattattgatgtggtatttcgtttacgagatcgattagctcattactggcaagctgatgtgaatacgcctcaagtggattttatgctgctacacattgcttgcagcttaggtcggatagaacgaggaggttgtgtttcttcgctttattcagaaatgctcgaagaaatgcaaagtgcggtcatttttccacaagttttagctattcatcaagatttactcaagttaatgccattttccattcctgaagcagaacaaacttattttttagcgaacattcattctttggttcttgaacagaagcaattaaagcctttgaaatga

SEQ ID NO: 1321 - DNA, 603 bp, H. influenzae strain 86-028NP
atgttagattacgagatcttcaatccatatgaaggattgatttttgatatggatggaactttaattgatacaatgcccgtgcatgcgcaggcttggacaatggtgggaaagaaatttggctatgaatttgattttcaaattatgtataacttcggcggggcgacggttcgaactatcgcgggggaaatgatgaaagcggcgaatatgccactagatcgaattgaggatgtgctggctgcaaaacgtgagttgtcttatcaacttattccgacccaatcaaagttattgccaacctttgaaattgttaaatccttccatcagaaaaagccgattgctttaggttctggctcacaccgtaaaattattgatatgttgatggataaactggctatcgcaccttactttaatgccattgtcagtgcagatgatgtaaaagaacataaaccacatccagaaacttttttacgctgtgcggagttaattcaagcaaatccaagtcgttgtatcgtatttgaagatgcggatttaggcgtgcaagcaggattaagtgcgggaatggatgtgtttgatgttcgcacacgagaaattatttcgccaagataa

SEQ ID NO: 1322 - DNA, 474 bp, H. influenzae strain 86-028NP
atggatattttttcattttttagtgctgatttttggcaggctaatagcttatgctttatgtttatcagcgcgtttttgagtgcaacagtattaccaggtaattcagaagttatatttgttgcgcttgctgtacctaaattaatgttaggttctttatttaacgcagatatattagctctaatattgattgcaaccgctggaaatagcttaggaagtttaaccacttacggaattggacgatggatgccaaaattcgatcccaaaaattaccgcactttatgggcaataaatcagctacggcgttatggggcgattgttttacttttgagctggctgcctgtagttggcgatttattttgtgccatagctggttggttaagattaaattttgtaacgagtagtctctttatctttctgggaaaaatggttcgttatgttgcgttattgtttttgagtacaccattcttattataa

SEQ ID NO: 1323 - DNA, 504 bp, H. influenzae strain 86-028NP
atgccattacttgatagttttaaagtggatcacacaaaaatgaacgcacctgcagtacgcattgcaaaaacgatgtgcacgccaaaaggcgataatattactgtttttgatttacgtttttgtattccaaacaaagaaattctttccccaaaaggcattcatacacttgaacatttatttgctggatttatgcgcgatcatttaaatggcgatagcatagaaattattgatatttctccgatgggatgtcgcacgggattttatatgtctttgattggcacaccaaatgaacaggaagtgtctgaggcttggttagcttcaatgcaagatgttttaggtgtacaagatcaagcttctattcccgaattaaatatctatcaatgcggaagctatacggaacattccttagaagatgcacacgaaattgccaaaaatgttatcgcacgcggtataggtgtaaataaaaatgaagatttgtcactcgataattccttattaaaatag

SEQ ID NO: 1324 - DNA, 708 bp, H. influenzae strain 86-028NP
atgaaaaacggcataaaattatctgtcatcgcacttttaactgcagctgcagttccagcgatggcaggcaaaacagaaccttatactcaatctggcactaatgctcgtgaaatgttacaagagcaagcaattcattggattagtgttgatcaaatcaaacaaagtttagaaggtaaagcaccaattaatgtaagctttgatattgatgataccgtgcttttcagtagcccttgcttttaccacggacaacaaaaattctcaccaggtaaacacgattatttgaaaaaccaagatttctggaatgaagtaaatgcaggttgcgataaatattctattcctaaacaaattgccatagatttaattaatatgcaccaagcacgtggcgaccaagtttactttttcactggccgtactgctggcaaagtggatggtgtaaccccaattttagaaaaaacgttcaatattaagaatatgcacccagttgaatttatgggcagccgtgaacgtacaacaaaatataacaaaacgcctgcaatcatttcacataaagtgagtattcactatggcgacagcgatgatgatgtactagcagctaaagaagcaggtgttcgtggtattcgtttaatgcgtgccgcaaactctacttatcaaccaatgccaactttaggcggctatggcgaagaagtgttaatcaattcaagctattaa

SEQ ID NO: 1325 - DNA, 528 bp, H. influenzae strain 86-028NP
atgacaacgattgtaagcgtacgtcgcaatgggcaagtcgtcgtaggcggtgatggacaagtttctttaggcaataccgtaatgaaaggtaatgctcgtaaagtacgccgtttatataatggtaaggtacttgctggttttgcgggtggaacggcagatgcatttacactttttgaattatttgaacgtaaacttgaaatgcatcaagggcatttgctaaaaagtgcggtggaattagcgaaagattggcgtacagatcgtgcacttcgtaagttagaagcgatgttaattgtggcggatgaaaaagaaagtttaatcatcacgggtattggcgatgtggttcagcccgaagaagatcaaattttagcaatcggatcgggtggtaactatgcgttgtctgcagcacgtgcgttggtggaaaacaccgaactttctgctcgtgaaattgttgaaaaatctttgaaaattgcgggtgatgtttgcgtgttcacaaataccaatttcactattgaagaattaccgaattaa

SEQ ID NO: 1326 - DNA, 1335 bp, H. influenzae strain 86-028NP
atgtctgaaatgactcctcgcgaaatagtttctgaattagatcaacatattattggtcaagccgatgcaaaacgtgctgtggcgattgcgttgcgtaaccgttggcgtcgtatgcagcttcaagaacctctgcgtcacgaagtaaccccaaaaaatatcctgatgattggcccaactggtgtgggtaaaactgaaattgcgcgccgtttagcaaaattagctaatgcgccatttatcaaagtggaagcaacgaaatttaccgaagtgggttacgtggggaaagaggtggattccattattcgtgatttaacggatagtgcgatgaaacttgttcgccaacaagaaattgcgaagaacagagcaagagctgaagacgcggctgaagagcgtattttggatgctttacttcctccagcaaaaaatcagtggggcgaagttgaaaaccatgatagtcacagcagtactcgccaagcgttccgtaaaaaattacgtgaaggtcaattagatgataaagaaatcgaaattgatgtgtctgctggcgtgtctatgggggttgaaattatggctcctccaggcatggaagaaatgacaaatcaactgcaatcattgttccaaaatttgggttcagacaaaacgaaaaaacgcaaaatgaaaattaaagatgcgttgaaaacgttgattgatgatgaagcagcgaaattaattaaccctgaagaacttaaacaaaaagccattgatgctgtggaacaaaatggtatcgtctttatcgatgaaatcgacaaaatttgtaagaaaggtgaatacagtggtgctgatgtatcgcgtgaaggtgtgcaacgtgatttacttccgttagtggaaggctcgacagttagcaccaagcacggaatggttaaaactgatcatatcttatttattgcatctggtgcattccaagttgctcgtccttcagatttaatccctgaactacaagggcgtttgccgattcgtgttgaacttaccgcattaagtgcggcggatttcgagcgcattttaacagaacctcacgcctctttaaccgaacaatataaagccttgatggcaacagaaggggtgaatattgaatttacaacagaggcggttaagaaaattgctgaggctgcattccgagtgaatgaaaaaacggaaaatatcggtgcacgtcgtttacatacggtaatggaacgtttgatggataaaatttctttcagcgcaagcgatatgaatggtcaaacggtcaatattgatgcggcttatgttgcggatgcacttggcgaagtggttgaaaatgaagatttgagccgttttattctttaa

SEQ ID NO: 1327 - DNA, 1053 bp, H. influenzae strain 86-028NP
ttgaaaaaattctttgctcactcactcaaaaatcttttcctttccaccaccgcactttttgcggcttccgcttttgccaataacaaactttacgtctataactggacagactatgtgccttctgatttagtcgcacagttctctaaagaaactggcatcgaggtaatttattctacctttgaaagtaacgaagaaatgtatgcgaaacttaaacttactcagaatactggttctagctatgatttggtgtttccatcaagttactacataaataaaatgattaaggaaaagatgcttcaaccgattgatcaaagtaaattgaccaatattcatcaaatccctaaacatttattaaataaagaattcgacccagaaaataaatattcattaccttacgtttacggcttaactggtattgaagttaatgcggatgagattgatcctaaaaccatcactagctgggcggatttatggaaacctgaatttaaaggcaaagttctcatgaccagtgatgcgcgtgaagtgttccacgtagcattattactggatggtaaatcgccaaataccaccaatgaagaagacatcaaaacagcttatgagcgtttagaaaaactgttaccaaatgtagcgacttttaactctgattctcctgaagtcccttacgtacaaggcgaagttgcaattggtatgatttggaatggttcagcttatttagcgcagaaagaaaatcaatctcttcaatttgtgtatccaaaagaaggcgcaattttctggatggataattatgctattccgaattccgctcaaaacgtggaaggggcgtataagttcatcgactttttacttcgccctgaaaatgcaaaaattgttatcgaacgcatgggcttttctatgccaaataatggggcgaaaacattgctaagcgcggaagttgctaatgatccaaaattatttccaccagcggaagaagtagaaaaaggaattatgcaaggcgatgtaggagaagctgttgatatttatgaaaaatattggagtaaattaaaaactaattag

SEQ ID NO: 1328 - DNA, 1296 bp, H. influenzae strain 86-028NP
atgcttaattttgcctatcaagaacacgttcgctcttattatttcgactctcgtaaccaagattttcaattcccgccgctcactcaaattgaacatgctgatgtatgtgtgatcggggctggattttttggtttatctgcagcattagaactggcggagaaaggaaaaaaagtcattgtcttagagggtgcaagagtaggctttggtgcttctggtcgcagtggtgggcaggcaattaatggctttgaagaaggcattgatgaatacgttaaacaagttggcgaagataaagcacataaactttggaatatgtcattagagaccattgatattattgatgaacgtattgaaaaatatagcattcaatgcgactggaaaaaaggctatgccacattagcattaaatgaacgccgaatggatgacttaattgaaatggaaaaagaaagtcataaaaattttggctatcagaatatgcaactttgggataaaactaaattaaaacagcacttaggcagtgatatttatgtgggggggctatttgatagtaattcagggcatttgcatccacttaattattgcttaggtttagcgaaagcttgtgtcgatctgggtgttcagatttttgaacaatctcctgtcgtggatatggttgagaaaaatggttgcattgaggttaaaacagctaaaagtgcggttatttctcaagacgttattttagccaccaatgcttatattgatgcgctcccgaaatctattcatcacggcattaatcgtaaaatattacctgtggaaagttttattatcgccacagagccgttaagccaagcggttgctgattctgtcattaataatggcatgtcggtgtgtgataacaatttattattagactattatcgtttaagtgctgacaatcgcttgctttttggtagtgattctagctcagaaaaagatatggtcgcgattatgcggaaaaatatgttgtgtgtattcccgcaacttgaaaatgtaaaaatcgattatggctgggctggcccgattgatatgaccttaaactcaacgccacattttggtcgtatttctccgcatatttattttgctcatggttattctggtcacggtgttgctttgactggtcttgcggggcgaattgtagcggaggcgattttgggtgacgatgaacgtttatctatttttgaaggactgaaagtcccttctgtttatggtggtcgaattatcaaagatcttgcgacaaagattggtgtgcggtattacaagtttttagataaataccgttaa

SEQ ID NO: 1329 - DNA, 1443 bp, H. influenzae strain 86-028NP
atgtcagaaaatttgttacttttcagcttgttagctgttgttattatattgattttattacttattctacgccagcaaaaatatacacatcttcatcaagaattatcgaaaacgactcaagattataatcagcttgccagtaaatttgatgaactgagtagcattaaaaaccagtttgaacaacaaacaattaaagtacagactgaaaatcaaggactgcaatatcgtttaactgaacgtgatgaacaaatacatcatctcacacaagaacgacaaaatttgactgaaaaattgaccgcactttctcaagaattaacggggttacaaacaaccttaacagagaaagaaaaatatttttccgcacaacaacagaactttgaacaatctaagctgcagttgagtgtggaatttcaaaacctagcaaatcgtattttggatgaaaaaagtcgatcatttagtcaatcaaatcaaacggcattggaaaccttgctcaagcctttccgtgagcaaattgaaggtttccaaaaacgggtcaatgaaattcactccgaatccgtgaaaggcaatgctggattggaagcggaaattaaaaaagtgctggaaattggtctgaatatgtcgcaagaggcgagtaatttaacttctgcgctgaaaggcgaaaagaaaacgttaggcaactggggcgaagtgcaattagaacgagcattgcaactggcaggacttgaagaaaatgtacattaccgtgctcaagctcattttaaagatgaacaaggcgggcgtaattaccctgattttgtgttgaatttacctgatgaaaaacacttaattatcgacagcaaaatgtcgctcgtggcttacgaaagtgcggtgaattctgaggatgattttgaacgagagcgtttactcaaagagcatatttccgcattaaaaacccatattaacgatctgcataaaaaagattacagcaatctgattggcatgcgtagtccgaattttgttcttatgtttattgcggtggaacctgcgtatattgaggctttaaaagctgatcctgccttatttaattacggttatgaacgcaatgtaattatggtttctcacactacgctaatgccgattttacgcaccgtggcaaacctctggcgtatcgaacgtggtaatgctgaagccaaagaaattgctgaaaaagcgggcgaaatctataaccaaatttgcttggtggcagaacgtttaagtaaactcggcaatacgctttccactgtcagcaaccaatacaacagcaccgtcaccgcacttgttggccaacaaggtttagttggcaaagtagaacgatttaaaaccctttccgcaaaagccaataaaacaatgcccgatgtggacttattgaataatcagctggatttggctagattgaatgtcttaaatcaagaaaatcttcaataa

SEQ ID NO: 1330 - DNA, 420 bp, H. influenzae strain 86-028NP
atgaaaaaaacaatgttattaaatgcacaactttctcgttgtatcgcttctgttggtcacacagaaagtttgacgatttgcgatgcgggacttccaattccgttaagtgtggaacgtatcgatctcgcattaactgcgggtgtaccaagttttctacaaacgttgaatgtagtaacgaatgaaatgtatgttgaacgcgttgttattgcagaagaaattaaagaaaaaaatccagaaatattgaccgcacttttaacacaacttcaacaacttgaaagccatcagggtaatcaaatacaagtggaatttgtatcgcacgaaacttttaaaaaattcaccctcgaaagtaaagctattgttcgtactggcgaatgttcaccttatgccaatgtgattttatattctggcgtgccattttaa

SEQ ID NO: 1331 - DNA, 1482 bp, H. influenzae strain 86-028NP
atggaaactttactcaaaattagtggtgttgataagtcatttccaggtgtgaaagccttgaataatgcctgtttatctgtttacgctggacgcgtaatggcattgatgggggaaaatggggcgggtaaatcgactttgatgaaggtgcttactggtatttattctaaagatgcaggcacaattgagtatcttaatcgatcagttaatttcaatggacctaaagcctcacaggaagctggcattagtattattcaccaagaactgaatttggtcggtaatctcacgattgcagaaaacattttccttggtcgtgaatttaaaacctcgtggggagcgattaactggcagaaaatgcaccaagaagcagacaagctacttgcgcgtttgggggtaactcacagcagtaaacagctttgcgctgaactttctattggtgagcaacaaatggtggagatagccaaagccttaagttttgaatccaaagttatcattatggatgaaccaaccgatgcgctcacagatacggagaccgaagccctattcaatgtgattcgtgaactcaaagcagaaaatcgtggcattgtttatatctctcatcgtttaaaagaaattttccaaatttgtgatgatgtgacggttttacgcgatggtcaatttatcggtgaacgcattgtggcagaaattacagaagatgatttaattgaaatgatggttggtcgtcgtcttgatgaacaatatccgcatttatcacaagaaaaaggcgaatgtgtattggatgtgaaaaatgtgagcggaagcggtattgatgatgtttccttcaaattgcatgccggtgaaattgttggtgtctcgggcttaatgggtgcgggtagaacggaactcggcaagctactttacggtgctttgccaaaaacggcgggaaaagtgcggttaaaaaatcaagagattgagaatctcagtccgcaagatggtttggataatggtattgtatatatttctgaagatcgtaaaggtgatggcttggttttaggaatgtcagtaaaagaaaatatgtcgctcacatcgctcgatcatttttcacaaaaaggcagtattcgtcatcaagcggaaaaaatgacagtagatgactttattctgatgtttaacattaaaacacctaatcgtgatcaacaagtaggtttgctatctggtggaaatcaacaaaaagtggcaattgctcgtggattaatgactcgcccaaatgtgttgattttagatgaaccaactcgtggcgtagatgttggcgcgaagaaagaaatttatcagttgattaacgaatttaagaaagagggcttgagtattttaatgatctcatctgatatgccagaagtgcttggtatgagcgatagagtgttggtaatgcgtgaaggtaaaattagtgcagaattttctcgcaaagacgcaactcaagaaaaattattagcagcagctattggtaaataa

SEQ ID NO: 1332 - DNA, 972 bp, H. influenzae strain 86-028NP; identical to SEQ ID NO: 619

SEQ ID NO: 1333 - DNA, 879 bp, H. influenzae strain 86-028NP
atgaaaaaactaaccgcacttacttctgctgtattattaggtttggctgtttctggctctgcttctgcacaagacacaatcgctttggcagtatctacattagataacccattttttgtaacgttaaaagatggcgcacagaaaaaagcggatgaattaggttataagttagtggtgcttgattcacaaaatgaccctgctaaagaattagctaatgtcgaagatttaactgtgcgtggtgcaaaaatattattgatcaatccaactgattctgaagcagttggcaacgcagtggcgattgcaaaccgtaagcatattccagtaattacattagatcgtggcgcagctaaaggaaacgtagtgagccatattgcatctgacaatatcgcaggtggtaaaatggcaggtgattttatcgcacagaaattaggcgataatgccaaggtgattcaacttgaaggtattgcaggaacatctgcggcacgcgaacgaggtgagggtttcaaacaagctattgatgctcataaattcaatgtgcttgccagtcagccagcagattttgatcgaacaaaaggtttgaatgtaacggaaaatttgttggcatctaaaggtgatgttcaagcaatttttgcgcaaaatgatgaaatggcattaggtgcattacgtgcggtgaaagccgcaaataaaaaagtccttatcgtaggttttgatggtaccgatgatggtgttaaagcggtaaaaagtggcaaaatggcagcaactatcgcacaacaacccgagcttattggttcattaggtgttgttaccgctgataaaatcttaaagggcgaaaaagttgaagcgaaaattccagtagatttgaaagtaataagtgaataa

SEQ ID NO: 1334 - DNA, 921 bp, H. influenzae strain 86-028NP
atgaaaaaaaccctcacggttctcggtagtatcaatgctgatcacgttatttctgtgccttactttgctaaacccggtgaaacgctaacaggtcaaaattatcaaattgcctatggtggcaaaggtgccaatcaagcagtggcagccgctcgtttaggtgcaaaggtagcgttcattagttgcattggatcagatagcataggcaaaacaatgaaaaatgcgtttgagcaagaaggaattgatacaacccatattaataccgtttcacaggaaatgacaggaatggcatttattcaagtcgccaagtctagtgagaacagtattgtgttggctagcggtgcaaatgcacatttgggtgagatggtcgttcgtcaaagtgaggcgcaaattgcacaatcggattgcttgttaatgcaattagaaaccccactttctggtgtggagctggctgctcaaatcgctaagaaaaatggtgttaaggttgtgctaaatcctgctccagcgcagattttatcggacgaattattgagtttgattgatattattacaccaaatgaaacagaagctgaaatcctgacgggggtagcggtagccgacgagcaaagtgcggtgaaagctgcgagtgtttttcacgataaaggcattgaaaccgtaatgattacccttggcgcgaaaggtgtgtttgtcagtcgaaaaggtaaaagccgcatcattaagggcttttgtgtgcaagcaatagatactaccgcagctggtgatacatttaatggcggttttgttacggctttattggaagaaaaatcctttgatgaagccattcgttttggtcaagctgccgctgcgattagtgtgacgaaaaaaggggctcaatcctctattccaacgcgtcaagaaactttggaatttcttgaacacgcttaa

SEQ ID NO: 1335 - DNA, 999 bp, H. influenzae strain 86-028NP
atggcgacaatgaaagatattgcacgactggcgcaagtttcgacttctacagtttcacatgtcattaatggatcgcgttttgttagcgatgaaattcgtgagaaagtgatgcgtattgtcgctgaactgaattacaccccttcagctgttgcacgaagccttaaggtgcgcgaaaccaaaactatcgggctacttgtcaccgcaacaaataatcccttctttgcggaagtgatggctggcgtggagcaatattgtcagaaaaatcaatataatcttattattgctacaacgggtggagatgccaaacgcctacaacaaaatctgcaaactctaatgcacaaacaagtggatggtttgcttttgatgtgtggtgatagccgttttcaggctgatatagagttagccatttcgctgccactggttgtgatggactggtggtttactgagttaaatgcagataaaatactcgaaaattcagcacttggtggctatttggcgacaaaagcattaattgatgcaggacatcgtaaaattggcattattacgggaaatctcaaaaaatctgtcgcacaaaatcgtttgcaaggttataaaaatgcgctgtcggaagcaaaaattgcgttaaatcctcattggattgtcgaaagtcattttgactttgaaggcggtgtacttggcatacaatctttacttactcaatcttcacgtccaacagcagttttttgttgtagtgacaccattgctgtcggtgcataccaagctattcagcaacaaggcttacgtattccgcaagatctttcaattatgggctatgatgacattgaattggctcgttatctctcgcctcctctctccaccatttgccaaccgaaagctgaacttggcaaactcgctgttgaaacactattgcaacgaattaaaaatcctaatgaaaattacctcactttggtgttagaaccgacttgtgtgttaagagagtctatttacagtttcaaataa

SEQ ID NO: 1336 - DNA, 552 bp, H. influenzae strain 86-028NP
atgaaagaaaacaaacctgttgatccttatgcgaaatataacgaacaatcgaatattatcgcgaaaataatttttgctagtcgctggttgcaagtgccgatttatttgggcttgattgtcacccttgcaatctactcttataaatttatcaaaggattatgggagttagtgattaatgtaaatgatatggattccaacacaattatgttaggcgtgttgaatttgattgatgtcgtgatgatcgccaacttacttgtgatggtgactatcggtggctatgaaatctttgtatctaaattgcgtacacgtaatcaccccgatcaacctgaatggatgagccacgtaaatgccaccgtgttgaaagttaaactttctatgtctattatcggcatttcatctatccatatgttgcaaacttttgtgaatgcaagcaatatgccagaaaaaacgatgatgtggcaattattgttgcacttgggctttttagtgtcggcaattgctttagcttatacggacaaaattttgtatagcacaagccataaaacacattaa

SEQ ID NO: 1337 - DNA, 489 bp, H. influenzae strain 86-028NP
atgtttattgatacttcagaactttgcgatctttatgcagaacaagtggatgtcgtggagccaattttttcaagctttggtggcgtaagtcatttttacggtaaagtcactacagtaaaatgctttgaaagtaatggattaattgctgaagtattagaagaaaacggcgaaggtcgagtgcttgtcattgatggcggtggtgcggtacgccgtggtttgattgatgcagaattggctcaacttgccgttgataatggttgggaaggcattattgtatatggtgcagtacgccaaattcagcaattagaaaacctcgatattggtattcatgcccttgcgccaattccagtcagtgcagatgaaagcagtgctggcgagagtgatattccagtgaattttggtggcgtaacctttttcccagaagattatatttacgcagatctgacaggaattatactttcgcaagagcctctagatttagaagattaa

SEQ ID NO: 1338 - DNA, 933 bp, H. influenzae strain 86-028NP
gtgcggtcaaaaaaaatgataaatgaaaaattgaaaatgtggtgggaaacggctcgaccgaaaactttgcccttagcgttggcatcgattttcacgggttcggcattaggttattgggcgaatccacaaggttttaatgggcttgtaatggtgctttgtttactcacgacaattttattgcaggtgctttctaattttgccaatgattatggggatcatcaaaaaggttcagatactgaagaacgtattgggccattacgtggcattcaaaaaggcgcaatttcagcaaaagaactgaaatggggattaattctaatggtgatggcaagttttctttcaggaagtttcttgattggaatcgcttatgaaaatctctcagatttattcgctttcgctgggcttggaattttagctattgttgctgccattacttacactgttggggcaaaaccttatggctatatgggattaggcgatatttctgtattagtattttttggtttgcttggcgttggcggcacttattatttgcaaactcacagtattgctagccacattattttgcctgctattggttctggcttattggcaagtgcggtattaaatatcaataatttacgtgatattgaacaggatgcgaaagctagcaaaaataccctagccgttcgtttaggtgcatataaagggcgtgtttatcattgtattttattaagtgtggcggctctatgttatttggcatttgcggtggcaacggccacggccacttcttggacaaattatttatttgtattagcaatgccattgttagctaaacacgcgatctttgtttatcgtagtcagcagccaagtgaattgcgtccaatgttggctcaaatgtctatgatttcgttattaatcaatatcttgtttagtttaggcttgcttatcggctaa

SEQ ID NO: 1339 - DNA, 720 bp, H. influenzae strain 86-028NP
atgaatgatttaaccttatcgcctatcgccattatccacacgccttataaagaaaaattctccgtaccacgccaacctaagttagttgaagacggagtaggcattgtagaactcttaccgccttataattcgcctgaagccgtgagaggattagaacaattcagtcatctttggttaatttttcaattcgaccaaatccaacaagggaaatggcaacccaccgtacgccctcctcggttaggcggtaatcaacgaattggagtgtttgcttcacgcgcaacgcaccgcccaaatcctcttggtttatccaaagtcgaattacgtcaagtagaatgcatcaacggtaacatttttctccatttaggtgcggtggatttagtggatggcacgcccattttcgatatcaaaccctatattgcctatgcggatagtgagccaaatgcacaatcgagctttgctcaagaaaaaccaccagtaaaactgactgttgaatttaccgagcaagccaaaagtgcggtaaaaaaacgagaagaaaaacgaccgcacttaagtcgttttattcgccaagtgctagagcaagatcctcgcccagcctatcaacaaggtaaaccgagtgatcgtatttatggaacaagtttgtacgaatttaatgtgaaatggcgaattaaagcgggtacggtaaattgtgtagaagtgattgaaatagaaaaagacaaatag

SEQ ID NO: 1340 - DNA, 987 bp, H. influenzae strain 86-028NP
atgttacactttgctcatatttttcaaaataaggatcatactatgaatataacaaagccttttcctcttccaacaggatatttcggtattcctcttggtttagcagccttatctttagcttggtttcatttagaaaacttatttcctgctgcgcgaatggtaagtgatgttcttggcattgtagcaagtgtggtctggattttatttattttaatgtatgcgtataaacttcgttattactttgaggaagttcgtgcagagtatcatagcccagttcgtttttcctttattgcattgattcctattacaactatgttggtaggcgatattctttatcgttggaatcctttaattgctgaagttttaatttggattggaacgattggtcaattacttttctcaacattacgtgtcagtgaattatggcaaggtggtgtatttgagcaaaaatctactcatcctccgttttatttgcctgcggtagctgctaattttaccagcgcaagttcattagcattacttggctaccatgatttagcctacttattctttggcgcaggaatgattgcttggattatttttgaacctgtattattacaacatttacgtatttcatctcttgagccacaatttagagccacaatagggattgttttagcacctgcgtttgtgtgtgtatctgcttatttatcgatcaatcactgcgaggtggatacgttagctaaaatcctttggggatatggatttttgcaattatttttcttattgcgattattcccttggattgtggaaaaaggacttaacattggcttatggacattctcattcggattagcgtctatggcaaacagtgctaccgctttctatcatggcaatgttttacaaggcgtgtctatttttgcctttgttttctcaaatgtaatgattggcttattggttttaatgacaatatataaattaactaaagggcagtttttcctaaaataa

SEQ ID NO: 1341 - DNA, 4251 bp, H. influenzae strain 86-028NP
gtgaaagacttagttaagtttttaaaagcacaatcaaaaaccagtgaagattttgatgtgattaaaattgggttagcttccccagatatgatccgttcttggtcatttggtgaagtgaagaaacctgaaaccattaactaccgtacgttcaaacctgaacgtgatggtcttttctgtgcgcgtatcttcgggcctgtaaaagattacgaatgtttatgtggtaaatataaacgtttaaaacaccgtggtgtgatttgtgaaaaatgtggtgttgaagtcactcaaactaaagttcgtcgtgaacgtatgggtcatattgaacttgcatcgccagttgcacatatttggttcttaaaatcattgccgtctcgtatcggtttacttttagatatgccattgcgcgatatcgaacgtgtactttattttgaaatgtacatcgtgaccgaaccaggtatgacggacttagagcgcggtcaattattaacagaagaacaataccttgacgctgaagatcgctggcaagatgaatttgaagcgaaaatgggtgccgaagcgattcaagatctcttaaaaggtatggatcttgaagctgaatgtgaaaaattacgtgaagaattacaagaaactaactctgaaactaaacgtaaaaaaatcactaaacgcttaaaattattagaagcatttgttcaatctggtaataaaccagaatggatggtgatgacggtattgccagttcttccaccagatttacgcccattagtaccacttgatggcggtcgttttgcgacttcagatctgaacgatttatatcgtcgtgtaatcaaccgtaacaatcgtttaaaacgtttattagatttaattgcgccagatattattgtgcgcaacgaaaaacgtatgttacaagaatctgttgatgccttattagataatggtcgtcgcggtcgtgcaattacgggttctaaccgtcgtccattaaaatcattagcggatatgatcaaaggtaaacaaggtcgtttccgtcaaaatttattaggtaaacgtgttgattactctggtcgttctgtaatcactgttggcccatacttgcacttacaccaatgtggtttaccgaagaaaatggcattggaattattccgtccgtttatctatgcgaaattagaaagccgtggttatgctacgacaatcaaagcggctaagaaaatggttgagcgtgaagaggcgatcgtttgggatattcttgcagaagttattcgtgaacacccaattctattgaaccgtgcgccaacacttcaccgtttgggtatccaagcgtttgaaccgatcttaatcgaaggtaaagcgattcaattacacccactcgtttgtgcggcgtttaacgcagacttcgatggtgaccaaatggcggtacatgttccattaacccttgaagcgcaattagaagctcgtgcgttgatgatgtccaccaataacgtgctttctccagcaaacggtgatcctattatcgttccatcacaagacgtggtattaggtctttactatatgacccgcgaaaaagtgaacggtaaaggcgaaggtatgttattgcaagatcctcgcgaagctgaaaaagcatatcgtacaggcgaagcagaattacattctcgtgtgaaagtacgtattactgaatatgtgaaaaatgaagcgggcgaatttgatgcgaaaaccacgctgactgatacaactatcggtcgtgcaatcttatggatgatcgcgccgaaaggcatgccttattcattgttcaaccaaacattaggtaaaaaagccatttctaaactgattaacgaagcatatcgtcgtttaggtttaaaagaagcggtaatgtttgctgaccaaattatgtataccggttttgcgtatgcggcacgttctggttcatcagttggtattgatgatatggaaattccagcgaagaaatacgaaattatttctgcagcggaagaagaagtagctgagatccaagaacaattccaatcaggtcttgtgacggcaggcgaacgctataataaagtaatcgatatttgggctgccgcgaatgagcgcgtagcgaaagcgatgatggaaaacttatctcaagaagaagtcatcaatcgtgaaggtaatcctgaaaaacaagcgtcctttaacagtatctttatgatggctgattctggtgcgcgtggttctgcagcgcagattcgtcagttagcaggtatgcgtggtttgatggctcgtccagatggctcgatcattgaaaccccaattacagcaaacttccgtgaaggtttgaacgtattacagtactttatttcaacccacggtgctcgtaaaggtttggcggataccgcattaaaaacagcgaactcaggttacttaactcgtcgtttagttgatgtggcacaagacttagtgattgtagaagatgactgtggtacgcacgaaggcttagtcatgaccccattaattgaaggtggagatgaaaaagtgccacttcgtgaattagtattaggtcgtgttgctgcagaagatattttaaaaccgggtgcagaagaagtattaattccgcgtaacaccttattagatgaaaaactctgtgatgtgttggatgcaaactctgtagatagcgtaaaagtacgttctgttgtaacttgtgatactgactttggcgtgtgtgcgaaatgttatggtcgtgatcttgcgcgtggtcatttaatcaaccaaggcgaagcggtgggggttattgccgctcaatctatcggtgagccgggtacacagctaacaatgcgtacgttccatattggtggtgcggcatctgcggcagcgaaagaatctagtgtgcaagttaaaaacactggtacagtgcatttaatgaatgcaaaattcgtgactaacgatgaaagcaaactagtattaacttctcgtaacacggaattaactattactgatgcatttggtcgtactaaagaacattataaagtgccttatggtgcggtattaagcaaaggtgacggtcaagaagtcactgcaggcgaaactatcgcaaattgggatccacatacaatgccagttgtctctgaagtatctggttttgtgaaatttgtagacattattgatggtttaactgtgacgcgtcaaacagatgaattaacaggtttatcatcaatcgtggttcaagatgtgggtgaacgtgcaactgcgggtaaagatttacgtccaactattaaattagttgatgcaaatggcaacgatattttcttacctgaaactgatgttcttgcacaatacttcttacctggtaaagcaattgtaagtttagacgatggcgcagcagtgaaagtaggggaaccattagcacgtattccacaagaatctgtgggtactaaagatattactggtggtctaccgcgcgttgcagatttatttgaagcacgtaaaccaaaagaaccagctatcttggctgaaatttctggtatcgtgtctttcggtaaagaaaccaaaggtaaacgccgtttattaattactcctgcggaaggcgaaacttacgaagaaatgattccaaaatggcgtcagctcaacgtatttgaaggcgaaatggtacaacgtggcgatgtaatttctgatggtgctgaaacaccacacgacattttacgtttacgtggcgtgcgtgcagtaactgaatacatcgtgaacgaagtgcaagatgtttaccgcttacaaggggtaaaaatcaacgataaacatatcgaagttatcgttcgtcaaatgttacgtaaagcggtaattactaaagcttacgactcagaattccttgagggagaacaagtcgaagtggctcgcgtgaaaattgttaatcgccaacgtgaagcagaaggtaaaccaccagttgaatttgaacgtgaattattgggtatcaccaaagcgtctcttgcgactgaatccttcatctctgccgcatcgttccaagaaactactcgtgttcttaccgaagcagcagtggcaggtaaacgtgatgaattacgtggcttgaaagagaacgtaatagtaggtcgattaattcctgcgggtacaggttttgcgtatcatcaaaatcgtcacaaacatcgtttagttgatgatgtcgtagcgaaattatctgaagaagatgaagctgctatcgctgatgaatttgttatgactgcagatgatgcaagtgcgaacttagctgaaatgcttaacatggcagatgatgcggaataa

SEQ ID NO: 1342 - DNA, 4032 bp, H. influenzae strain 86-028NP
atgggttactcctattctgaaaaaaaacgaattcgtaaagatttcggtaaacgtccgcaagttttaaatgttccttatttattaaccattcagttggattcttttgataaatttattcaaaaagatcctgaaggtcagcaaggtttagaagcggcattccgttctgtatttcctattgtaagcaataatggctatacagaattacaatatgtagattatcgtttagaagagccagagtttgatgtacgtgagtgccaaattcgtggctcaacttatgcagcaggcttacgtgtaaaattacgtttagtgagctacgataaagaatcttcttcacgcgcagttaaagatattaaagaaaatgaagtttatatgggggaaatcccattaatgactgataacggtacttttgtaattaatggtaccgagcgtgttatcgtttcacaattacaccgtagtccaggtgtattctttgattctgacaaaggtaaaacccattcttcaggtaaagtgctttataacgcacgcattattccttaccgtggttcttggttagattttgaattcgatccaaaagataacttatttgcgcgcattgaccgtcgccgtaaattaccggcaacaatcattcttcgtgcattaggctacaccactgaagaaatcttaaacttattctttgataaaattacctttgaaatcgctggcgataaattgttaatgactttagtgccagaacgtttacgtggtgaaacggcttcttttgatattgaagcaaatggcaaagtgtatgttgaacgtggtcgtcgcatcactgctcgtcacattaaagcattagaaaaagataatatctcacaagtggttgtgccttctgaatatattttaggtaaagttgcgtcgaaagattatgttgatttagagtctggcgaaattatttgtcctgcaaatggcgaaatttcgttagaaaccctcgcaaaattagcacaagctggttacaccacgatcgaaactttatttactaatgatttagattacggtccatatatttctgaaacgctacgtgtcgatccaacttatgacaaaactagtgcgctttacgaaatttatcgtatgatgcgtccgggcgagccaccaacaccagaatcttcagaagcgttattcaataatttattcttctctgcagaacgttatgatttatctacagtaggtcgtatgaagttcaaccgttctttagcttttccagaaggggaaggtgcgggtattttaagcaatgaagatattattgcggtaatgcgtaaattgatcgacatccgtaatggtcgtggcgaagtagacgatattgaccatttgggtaaccgtcgtatccgtagcgtgggcgaaatggctgaaaaccaattccgtatcggtttagtgcgtgttgaaagagcggtcaaagaacgtctatctttaggcgatttagatgcgatcacgccacaagacttaattaacccgaaaccgatttctgcggcagtaaaagaattctttggttcttcacagctttcgcaatttatggatcaaaacaacccattgtcagaagtgacacacaaacgtcgtatttctgcattaggtccaggcggtttaacgcgtgagcgtgcaggctttgaagtgcgtgacgtacataatactcactatggtcgtttatgtccgattgaaacccctgaaggtccaaacatcggtttgatcaactcactttctgcttttgcacgtactaatgattatggtttcttagaaacaccatatcgtaaagtggttgatggtcaagttactgaagaaattgaatacttatctgtaattgatgaagcaaactacatcattgcacaggcaaactcaaacttagacgaaaataaccgttttactgatgctttcgttactgctcgtggtgaacgtggtgaatctggtttatataaacctgaagatattcactatatggatgtttcgacacaacaagtggtatctgttgcggctgcattaattccattccttgagcatgacgatgcgaaccgtgcgttgatgggtgcgaacatgcaacgtcaagcagttccaacattacgtgcggataaaccattagttggtacaggtatggaaaaaccaatcgcacttgactcaggtgttgcggttgttgcaaaacgtggtggtaccgttcagtacgttgatgcgtctcgtattgtgattaaagtaaatgaagatgaaaccattgcaggtgaagctggtattgatatttataatttaattaaatacacccgctctaaccaaaatacttgtattaaccaaattccttgtgtgaatttaggcgatccaattaatcgtggcgaagtattagcagatggtccttcaactgatttaggggaacttgcattaggtcaaaatattcgcgtggcgttcatgccttggaacggctataacttcgaagactcaatgttagtttctgaacgtgttgttcaacaagaccgtttcactacgatccatattcaagaattatcttgtgttgcgcgtgatactaagttaggtgcagaagaaattactgcggatattccaaacgtaggtgaatcagcgttaagcaaacttgatgaatctggtatcgtttatgtcggtgctgaggttaaaggtggcgacatcttagtaggtaaagtaacccctaaaggcgaaactcaattaaccccagaagaaaaattgttacgtgcaatctttggggaaaaagcttccgatgtgaaagattcttcattacgcgtgccaaatggtacatcaggtacggttattgatgttcaagtcttcactcgtgatggcgtagaaaaagataaacgtgcattagaaatcgaagaaatgcaacttcgtgaagcgaaaaaagatttaactgaagagttagagattttagaagctggtttatttgctcgtgtgcgtaatcttcttatttctagtggtgcggatgcagcacaattagataaagtagatcgcactaaatggttagaacaaaccattgcagatgaagaaaaacaaaaccaattagaacagcttgctgagcaatacgaagaacttcgtaaagagtttgaacataaacttgaagtgaaacgtaagaaaatcattaaaggcgatgatcttgcaccgggcgtattaaaagttgtgaaagtttaccttgcagtgaaacgtcaaatccagccgggggataaaatggcgggtcgtcacggtaacaaaggtgttatctcgaaaattaacccagttgaagatatgccatacgatgaaaatggtcagccagttgaaatcgtattaaacccactgggcgtaccgtctcgtatgaacatcggtcagatccttgaaactcacttaggtttagctgcaaaaggtattggtgatcaaatcaatgcaatgcttaaacaaaaacaagaagtggaaaaattacgtagctatatccaaaaagcatacgatttattaggtaatggttcacaaaaagtggatttaagcacttttactgatgaagaagtattgcgtttagcgggaaatttacgtaagggcttaccagttgcaacgccagtgttcgatggtgcagacgaagcggaaatcaaagagctattaaaacttggtggattaccaacttcaggtcaaataaccctttacgatggtcgtactggcgagaaatttgaacgtccagtaaccgtgggttatatgtacatgctaaaattgaaccacttagttgatgataaaatgcacgctcgttcaacaggttcttatagccttgttacacaacagccactgggtggtaaagcacaatttggtggtcagcgtttcggtgagatggaggtatgggcacttgaagcatatggtgcagcctacaccttacaagaaatgctaactgtgaaatccgatgatgtgaatggtcgtacgaagatgtataaaaatatcgtaagtggcaaccaacatatggagccaggcacaccggaatctttcaacgtaattatgaaagaaatccgctcacttggtttaaatatcgagttagacgaagagtaa

SEQ ID NO: 1343 - DNA, 690 bp, H. influenzae strain 86-028NP
atggctaaattgactaaaaaaatgaaagcaatcaaagctggcgtagattctactaaagcatacgaaattaacgaagcgattgcggtattaaaacaattcgcaacggctaaattcgttgaaagtgttgatgttgcagtaaacttaggtatcgatcctcgtaaatctgaccaaaacgttcgtggtgcaactgtattaccacacggtactggtcgtgaagtacgtgtagctgtgttcactcaaggtgctaacgcagatgcagctaaagaagctggtgctgatttagtaggtatggaagatttagcagagcaaatcaaaaaaggcgaaatgaactttgatgttgttatcgcttctcctgatgcaatgcgtgttgttggtcaattaggtcaagtattaggcccacgtggtttaatgccaaaccctaaagttggtactgtaacaccaaacgttgctgaagcagttaaaaatgctaaatctggtcagatccgttatcgtaatgataaaaacggtatcatccacaccactatcggtaaagcaaacttctctgaagttcaattaaaagaaaatcttcaagcattattggctgctttaaataaagcaaaaccaactactgctaaaggtattttcatcaagaaagtaagcatctctaccactatgggtgcaggtgttgctgttgatcaagcttctttataa

SEQ ID NO: 1344 - DNA, 429 bp, H. influenzae strain 86-028NP
atggcaaaaaaagtccaagcctatgttaagttgcaagttgcagctggtatggctaacccatcaccaccagttggtcctgcattaggtcagcaaggtgtgaacattatggaattctgtaaagcattcaacgctcgtactgagagcttagaaaaaggtttaccaattccagttgttatcactgtatatgcagaccgttcatttactttcgtcactaaaactccaccagcagcagtattattgaaaaaagctgcaggtatcaaatctggttctggtaaaccgaacaaagataaagtgggtaaagtaactttagatcaagttcgtcaaatcgctgaaactaaagcagcagatatgactggtgcgactatcgaaacgaaaatgaaatcaatcgctggtactgctcgttcaatgggcttagtggtggaggaataa

SEQ ID NO: 1345 - DNA, 717 bp, H. influenzae strain 86-028NP
atgactccacatattaacgcgcctgaaggtgcatttgctgatgttgttttaatgcctggcgatccacttcgtgcaaaatatattgcagaaacttttttacaagatgttgttgaagtaacgaatgttcgtaatatgcttggttttactggaacttataaaggtcgtaaaatttctattatggggcacggtatggggattccatcttgctctatttacgcgaaagaattaatcactgaatatggcgtgaaaaaaattatccgtgtaggttcttgtggcactgttcgtatggacgtgaaagtgcgcgatgtgattatcggtttaggtgcatgtactgattcaaaagtaaaccgtattcgtttcaaagataacgactttgcagctattgctgactttgatatggcacaagccgctgttcaagctgcaaaagcaaaaggtaaagtcgttcgtgtaggtaatttattctcggcggatttattctatacacccgatgtggaaatgttcgatgtaatggaaaaatacggcattttaggtgtggaaatggaagctgctggaatttatggtgtggctgcagaatatggtgcaaaagcattaacgatttgtaccgtgtctgaccatattcgtactcacgaacaaaccacggcagaagaacgtcaattaacattcaatgatatgattgaaattgcgttagattcagtattaattggtgatgcactataa

SEQ ID NO: 1346 - DNA, 1254 bp, H. influenzae strain 86-028NP
atgagtgtgttaagcagcattttgggaatggtcgtattaatcgctattgccgtgttactttctaataatcgtaaagcgattagtattcgaaccgtagtaggggcgttagcaatccaagtaggatttgccgcccttattttatatgtgccagcaggtaaacaagcgttgggtgccgctgcggatatggtatccaatgttattgcctatggtaatgacgggattaatttcgttttcggcggattggcagatccaagtaaaccatccggtttcatttttgcagtgaaagtattaccgattatcgtgttcttctctggcttaatttctgtgctttactatctcggcattatgcaagtcgtgattaaagtattaggtggcgcattacaaaaagcattgggtacgtcaaaagcggaatcaatgtcagcggcggcgaatatcttcgtcggtcaaactgaagcaccattagttgttcgcccttacattaaaaatatgacccaatctgaattatttgccattatggtgggtggtacagcgtctattgcgggttcagtaatggcaggttatgctggaatgggcgtgccattgacatacttaatcgctgcgtcatttatggcggcaccagcaggtttattatttgcgaaattaatgttcccacaaaccgaacaattcacagataaacaaccagaagacaatgattcagaaaaaccaactaacgtacttgaagcaatggcgggcggtgcgagtgcaggtatgcaacttgcgttaaacgtaggtgcaatgttaatcgcattcgttggtttaattgcattaattaatggtattttaagtggcgtaggcggatggttcggctatggcgacttaaccttacaatctatctttggtttaatttttaaaccattagcatacttaatcggtgtaactgatggtgctgaagcaggtattgcaggacaaatgatcgggatgaaattagcggttaatgaatttgtgggttatcttgaatttgcaaaatatttacaaccagattctgcaattgtattaactgaaaaaaccaaagcgattattactttcgcactttgtggttttgctaacttcagctcaattgcaatcttaattggtggtttaggtggtatggcaccaagccgtcgtagtgatgttgctcgtttaggtatcaaagccgttatcgctggtactctcgctaacttaatgagtgcaactattgctggtttatttatcggcttaggtgctgcagcactttaa

SEQ ID NO: 1347 - DNA, 789 bp, H. influenzae strain 86-028NP
atgaccgcactttctgagatttttgtgccgttgcatcggattattcctttttcaaatgtagagggacaaggcaatcgttcgagtatttttctgcaaggttgcaagctaaattgcttgtattgccataatccggaaaccatacctcgttatacggaaagtgcgaaattggtcagtttgcagtatttgtatgaacaggttatggaggcagttccatttattcgcggtgtaacggtttctggtggagaacccactattcatcacaaaaaacttgtgccactctttaaggctttacgttcgcaaggattgacttgttatttggatagtagtggcttttttgagtttgatcgtgtttgttcgttaattgatgtcactgacaaatttttatttgatctcaaaggcgagggcattggcttgcaaacactttgttttgatcggaaaaatcaagcaggtattgtatcacagcaagtgatactagagcgtttgcatataaaaaacgataaactggagcggaatttgcaaaatttagctgccttattgccattaaataaagtggaagaagtgcggttggtttttttaaagcatttttttgatgctgaacatttggtgggcaaagttgctcaactactacgaaattatcctgatgtggcattaaaaattatctgcgtgcatagcaaaggcgtacgtgatgaagctgggttatcagcgtatatcccaagtgtggaagaaactaatgcgctatctgcttatgcgcgtcaatgtggaattaacaagattttgactattttatag

SEQ ID NO: 1348 - DNA, 1545 bp, H. influenzae strain 86-028NP
atgttagcttcacttcaagatattctcgatacggttaaagccaataatctgacttatcatcaaaaattaatgacattaggcaatattgccgagcgtttatttgatcctcgcgatttacttggctataccgatgaagaatggggctttttacagaatcagatgatttgtgatttatgtgaaggctacgcgatttatcgtcctcgttatatcctgcctgattacaatgtgtatatccaaaagggctgcgaatttttagagttgccgcctccaaaagatcttgatgaggcacttgatggattattgattctttactcccgcgtgccatccattacgacttatcctgtttatgttgggcgtcttgatgtgttgctcgaaccgttcattactgatgaagaaaaagattacataaaaattaaacgtttcttaaatcatattgataaaactgtgcctgactcattctgtcatgccaatattgggccttatgatacgaaagcaggtcgcttgattttacgcgccgtgattgagcttgaagcgccaacaccgaatatgactattcgttatgacaaatcgaaaacaagccgtgattttgctgaacttgcagcaaaagcctgtttgttggtttctaaaccatcttttgccaacgatgcttactatatttccgatctaggcgaagaatacggcgtagcaagttgctataacgcactgcctgaatgtggcggcgcctacaccttaacgcgtttacgtctagggacaattgctcgcacctgtaaaagtgcggatgaaatgctgaatgaattattaccgcgtgtggcgaaatgtgctctttcaaccatggataaacgccacaaatttgtagtggaagaaagtaatttctttaacagttcattcctcgaaaaagagggatttatcaaacgcactaattttacggggatgttcgcaattgtgggcttggcagatgcagcaaaccacttattgcaatgtgaaggcttaaatgaaacctttggtaagagcgttcgtggcgatgaaattgccactgcgattatggataaattgaaagaaattactgatgcgcacgaaggagtttatgccgaacgtactggcaatcgttatttattacacgcacaagtgggcgcaagtaaccacgaagaagacaagcgtaacgcaccggctcaccgtattcgtgtaggcgaagaaccaacgttacttgcacatttgaaacaatctgcaccgttccataaatatttcccatctggtacaggggatttattcgcctttgatcaaacctatgtagatcactgcgatgcagtggtggatattattgatggcgcattttccttaggctatcgctacattaccacctatttgaaaaatacagatttaattcgagttacaggttatctagtgaagaaaagcgaagttgaaaaataccgtaaaggcgaagttgcattacgcgatacaacttggtatggctcgggtacggatgaatgtgccaatgtgtttgatcgccaattacgcaatgaaaaagatgtgatcgctgaaaaataa

SEQ ID NO: 1349 - DNA, 657 bp, H. influenzae strain 86-028NP
atgaagaaaaaagtacgcgttatacctcgcacatcttgggctgccacatcattatggaccgcgcaatataaaaccatttcaatcttactttttgctctttctattttaggtattggagatgggcttattgtattatcaggtttaggatcgacaccttggactgtactttcacaaggtatagcaatacagacaaattttgatattggctggtcatcttttttaattagttgcgcagtaatgttggtatggaaacctctcaaattacgccttgggcttgggacattattaaatattatcgttattgctctatttctagggatcacaacaaaaatactgacgccgccaaccgcacttttttcacgaatgatcttctgtctgatcggtatattactctatggttttggaactgcgttatatctcacttgtcacttaggtgcaggccctcgagacggattaatggttggtatttgccaacgttttcatttaagcatcaacgtggtacgctcaagccttgaaatctcggtttgtttacttggttttttacttggtggtgtcgttggcttgggtactgtccttttcgccaccagcataggcagcgttgttcaattcttcttaaatattattgctcgtttgccacatattccgtatgaaaagtga

SEQ ID NO: 1350 - DNA, 1071 bp, H. influenzae strain 86-028NP
gtgcggtttttttattttagcggagaaattatggaaaagatcttagttattcgtaacgataaattaggcgattttatgcaagcatggcctgcttttgcaatgttgaaagcctcaaatccagagctaaaattaaccgcacttgtgccgagttacactgcgcctttagcggaaatttgtccatttattgatgatgttattattgatagcaaaaaaaatgacaaaacggatttcaaacgtcttgtgcaggaaatcaaagcgcagcagtttgatggcatgattagtttcttttccaatacccataatggaaaactcgcttggaaaagtggaattaaatatcgccttgcacctgcgactaaatgggttcaaattctttataatcaccgtctaacacaacgtcgttctcgttcagaaaaatcagaagcggaatacaatcaagatttagtccgcacttttttgcaaaagcataatatgccagttgttgaacctaaaccgccttatttaatctttgagaaaagtgcggtggaaaaccagcgcgtttttttacaagagagtttagggctttccgcaaataaaaaatggatctttgtgcatagtggttctggtggttcagctacgaatctttctttagcgcaatatgcggatttaattaaaggcttattggctgagtttgattgcaatattgtgctgacagcagggcctggcgaaagagaaaaagcctatgaattagcaaatcttgtgaatgatttacgcgtagccatttacgataagaataaaggtttagtggattttgctcattctttagcttgtgcggatttatttattgcaggatctactgggccattgcatttgagcagtgcgtttaatattccgactatcggattttatccaaatagtcgttcttctcagccgagacgctggaaaccgattaatgatgtcgataagcatcttgcattttgcccacccgcgggaaaagagactcaaatgaatttagagttaatttcaatagacaatgcgttagctgaaatatcacttttcatacggaatatgtggcaaacgagcaataatatttaa

SEQ ID NO: 1351 - DNA, 1080 bp, H. influenzae strain 86-028NP
atggctaaattattagatatcgtgaaacccggtgttgtaacaggcgaagatgtgcaaaaagtttttgcttatgctaaagagcataactttgctattcctgccgtaaactgtgtgggttcagactccgttaatgccgtgttagaaactgctgcacgtgtaaaagcaccagtgattatccaattttcaaatggtggcgcagcgttctatgcaggtaaaggtatcaaaccaacgagtggtactcgtccagatgttttaggggcgattgctggagcgaaacaggttcatactttagcgaaagaatacggtgtgcctgttattcttcatactgatcacgcagcgaaaaaattattaccttggatcgacggtttattagatgcaggcgaaaaacattttgccgaaacgggtcgtccacttttctcttcacatatgatcgatttatctgaagagtcaatggaagaaaatatggcaatctgccgtgaatatcttgctcgtatggataaaatggggatgacccttgaaatcgaaattggcattactggtggcgaagaagacggcgtagataactctgatgttgatgaatcacgtttatatacacaaccgtctgatgtgctttatgtttacgatcaattgcatccagtaagccctaactttaccgttgctgctgcattcggtaacgtacatggtgtttacaaaccaggtaatgtaaaattaaaaccatctattttaggtgcatcacaagagttcgtttctaaagaacgcaatcttcctgcaaaaccaattaacttcgtcttccacggtggttcaggttctagccgcgaagaaatccgcgaagcaattggctacggtgcaatcaaaatgaacattgatactgatacgcaatgggcgtcttggaatggtattttgaatttctataaagcaaatgaagcttatcttcaaggtcaattaggtaaccctgaaggcccagatgcaccaaacaaaaaatactacgacccacgtgtttggttacgtaaaatggaagaatcaatgtctaaacgcttagagcaatctttcgaagacttaaattgtgttgatgttttataa

SEQ ID NO: 1352 - DNA, 1161 bp, H. influenzae strain 86-028NP
atgtcagtaatcaaaatgaccgatttagatttagcgggtaaacgtgtatttatccgtgcagatcttaatgtgccagtaaaagatggcaaagtgacctcagatgcgcgtattcgtgcgaccattcctactttaaaattagccttagaaaaaggtgcaaaagtgatggttacctctcacttaggtcgtccaactgaaggagaattcacaccagaagattctttacaaccagttgttgattacttaaaaaacgcaggctttaatgtgcgtttagaacaagattatttaaatggtgtggatgttaaagatggcgaaatcgttgttttagaaaacgtacgcataaacaaaggcgaaaagaaaaatgatccagaattaggtaaaaaatatgccgcactttgcgatgtatttgtaatggatgcctttggtacagcgcaccgcgcgcaagcatcaacttacggcgttgcagaatttgcaccgatcgcttgtgcaggcccattattagccgctgaattagatgcattaggtaaagcattaaaagaacctgctcgtccaatggtcgcgatcgtaggcggttctaaagtttcaactaaattagaagtattaaattctctttcaaaaatcgctgaccaaattattgtgggcggtggcattgcaaatactttcatcgcggcagctggtcacaatgtaggtaaatctttatatgaagctgatttaatgccagttgcgaaagaattagccgcaaatacagatattccagttccagttgatgtgcgtgtaggtttagagttctctgaaacggcagcagcaacagaaaaagcggtaaatgaagtgaaagatgatgaatctatttttgatattggcgataaatcagcagaacaattggctgaaattatcaaaaatgcaaaaaccgttttgtggaatggcccagttggtgtgtttgagttccctcacttccgtaaagggactgaaatcatttctcacgccattgcaaacagcgatgcattctctattgctggcggcggcgataccttagcggctatcgatttatttggtattgctgataagatttcttacatttcaacgggtggtggtgcattcttagagtttgtagaaggcaaagtattacctgcagtagaaattcttgaaaaacgtgcgaaaaactaa

SEQ ID NO: 1353 - DNA, 795 bp, H. influenzae strain 86-028NP
atgaaaaaacttacttccattctttctcttattgttctcgttatattagcaatttggcaatattttaccgatacaaccaaaactaaacatcaatcatcctcgcccgtaattgagcagacgaagcaaacaaaagtatctgagcctaaatttgaacctaaattcgagcctcaatttgagacaaagcggacggatattgaaaaaagtgcggtaaaaaatccagatgtttttgcaaactatgatgtgattatgcgcaatgatcatattgggcaaaacgcaaaggcaccggtcgattattatatgttggcattatcttggtcgcctggattttgtgatattcagcgtgaaaaatatggcgatcagttgccttattcctctcaatatcaatgtggaaataaccgcacttttggttgggttgtacatgggctatggccacaaaatgcaaatgctcgcgctgtttcagatcatcctcgtttttgcaaaggcgatttacccgccttgccaaaaggtttattagcacaatatttggcgatttctccgggcgagaaattattgcaaggcgaatgggaaaaacacggtagttgcgcctttgattctgcccagcaatattttgctaaggagcaggaattatttaacgcattaaaattaccgaatcaaaaattaagtcgagatgaactttttggttggatgaagcaacataatccacaattaaaaaatgcgtatttgagggctagtcgaaatgaattatttatttgttatgataaaaaatggcaggtaatgaattgccaaagcaaataa

SEQ ID NO: 1354 - DNA, 261 bp, H. influenzae strain 86-028NP
atggcattattcatcactagcaaatgtaccaactgcgatatgtgcttgcctgaatgcccaaacgaagccatttccattggcgatgagatttatgtgatcgatcctatactttgcacggaatgtgtcggccattacgacaccccaacctgccaaaaagtttgcccaatcactaactgtattaagcccgatcctgaacatcaagaaaccgaagaacagctttgggaacgctttgtaatgattcatcattcggataaattgtag

SEQ ID NO: 1355 - DNA, 1221 bp, H. influenzae strain 86-028NP
atgctaaaaaacaaaacttttgggagtgcgctgattattgcaggcacaaccattggagcaggtatgcttgctatgccgcttacatcagcgggtatgggctttggttataccctgttattgctcgttggcttgtgggctttgttggtttacagcggattgttgtttgtagaagtgtatcaaacagcggatcagttggatgatggtgtcgccacgctcgctgaaaaatattttggggttcctgggcgaattttcgccacgttgagtttgttagttttactttatgcactttcagccgcttatattactggtggtggatctttactttcaggcttgccaacggcttttggaatggacgcaatctcacttaaaacggcgattattatctttactgttgtattaggttctttcgtggttgtaggaacgaaaggcgtggatggtttaactcgcgtgttatttattggtaagttagtcgcttttgcttttgtactgtttatgatgcttcccaaagtggcaacagataatttaatggcattgcctttggattatgcttttgtggtttctgcggcaccaatattttttacttctttcggtttccacgttataatggcgagtgtgaatagctacttaggtggaagtgttgataaatttcgtcgtgccattttgattggtactgcgattccattagctgcttaccttgtatggcagttagcaactcatggtgtattaagtcaaagtgaatttgtgcatattttacaagctgacccaacgctaaatggcttagtgaatgcaacacgtgaaattacaggttctcattttatgggagaggttgtacgtgtgttctcatcacttgctttaattacttcattcttaggcgtaatgcttggtgtatttgaaggcttaggtgatttattcaaacgctatcatttgccaaataatcgctttgtattaactgtagccgcatttttaccgccacttgtatttgcattgttttatcctgaaggatttattacagcattaagttacgcaggtttgttgtgtgcgttctattgcttaattttaccaattagcttggcatggcgtacacgtattgaaaatccaacattgccatatcgtgtttctggcggtaatttcgctttggtgtttgcgttattaattggcgtcgtgattatgctcattccatttttaattcaatggggatatttaccagtggtggcggggtaa

SEQ ID NO: 1356 - DNA, 582 bp, H. influenzae strain 86-028NP
atggcgaaactctacttctattactccacaatgaacgctggaaaatcaacgacgttgctacaatcttcctataactatcgtgagcgtgatatgagcacattagtttatacggctgcgattgatgatcgttttggcgtgggaaaagtcacatcgcgtattggcatttcgcaagatgcctttttatttcgctcggaaaccaatttgtttgatgaaatcaatgagcacttaaaaaaagaaaaagtgcattgcgtgttggtggatgaagctcaatttcttagcaaacaacaagtttaccagttgagtgatgttgttgataaactcaaaatccctgtgctttgttatggcttgcgtacagatttccaagcggaactttttgaaggaagtaaatatttactggcttgggcggatcaactcgaagaattaaaaacaatttgttattgtggccgcaaggctaattttgttttgcgtttaaatgatcagggcgaggtcattaaagaaggtgcacaaattcaaattgggggcaatgattcttatctttctgtttgccgtttacactataaagaaaagtgcggtcaaatttaa

SEQ ID NO: 1357 - DNA, 1029 bp, H. influenzae strain 86-028NP
atgaaaatcttaggcattgaaacttcctgtgatgaaacgggcgtggcgatttatgatgaagaaaaagggttaattgctaatcaactttatactcaaattgccctgcatgcagattatggtggtgtggttcctgaattagcatcacgtgatcatattcggaaaacagcgcctcttattaaagcggcattagaggaagccaatttaaccgcaagcgatattgatggtattgcttatactagtggccctgggcttgtcggcgcattgcttgttggtgctacgattgcacgttctttagcctatgcttggaatgtgccagcgattggtgttcatcatatggaagggcatttacttgcgccaatgcttgatgaaaattcaccgcactttccttttgttgctctgttggtatcgggtggccacactcaattagtgcgtgtcgatggtgtaggaaaatatgaagtgataggagaatctattgatgatgctgctggcgaagcctttgataaaacagcaaaattacttggattagattatccaggcggcgcggcactttctcgtttagcggaaaaaggcacgccaaatcgctttatatttccacgtccaatgacagatcgtgcaggccttgattttagtttttctggtttaaaaacatttgccgcaaatacagttaatcaagcaattaaaaacgagggcgaactgacagaacaaactaaatcggatattgcttatgctttccaagatgcggtggtggatactcttgccattaaatgtaagcgcgcattaaaagaaactggctataaacgtttagtgattgcgggaggagtgagtgcaaataaaaaactccgagaaacgcttgcgcacttaatgcaaaatttaggtggcgaagtgttttatcctcaacctcaattttgtacagataatggcgcaatgattgcttacacaggttttttacgtttaaaacaaggtcagcatagcgatctggctattgatgttaaacctcgttgggcaatgacggaattaccggcaatttag

SEQ ID NO: 1358 - DNA, 216 bp, H. influenzae strain 86-028NP
atgcctgtaattaaagtacgtgaaaacgaatcatttgacgtagctttacgtcgtttcaaacgctcttgcgaaaaagcgggaatcttagctgaagtacgcgctcgcgaattttacgaaaaaccaactacaattcgtaaacgtgaaaatgcaacacttgcaaaacgtcacgcaaaacgcaacgctcgcgaaaacgcgcgcaatacccgtttatactaa

SEQ ID NO: 1359 - DNA, 1782 bp, H. influenzae strain 86-028NP
atgaaaggttctattccacgcccctttattgatgatttgctgacaaagtccgatattgtcgatgtgattaacacgcgcgtaaaactaaaaaaagctggccgcgattatcaagcctgctgccctttccatcacgaaaaaacaccatccttcacagttagccaaaagaaacagttttatcattgctttggttgtggtgcacatggtaatgcgatttcctttttaatggattatgacaaacttgaatttatagaggcgattgaagaacttgcagcaatggcagggcttgaaataccttacgaaaaacgcgctaatcacagcggaaaacctcaagctaattaccaaaccaaacgaaatctctatgaattaatgcaagagattgccacgttttatcaaaaccaattaccattaaatactcaagcacaagaatatttacaacaacgtgggctttcacctgaaattattgagcgtttccaaattgggtttgtgccgaatgcaatggatactgtactgcgtaaatttggtgttaatcgtgaagaacaacaaaaactcattgaattaggcatgctttctcgaaatgatcgtggcaatatttacgataaattccgaaatcgcatcatgtttccgattcgtgataaacgtggtcgcacagtggcttttggtgggcgtgtattaacagatgaaaaaccgaaatatctgaattcgccagaaaccattacttatcataaaggtaaggagctttatggtttgtatgaagccttacaaaccaacgatgaacccaaacaattacttgttgttgaaggttatatggacgtggtggcattagcacaatttggcgtggattatgcggtcgcttctttaggtacgtccacgacatcagaacaaattcaacttatttttcgttcgaccgaacaggttgtttgttgttacgatggtgaccgtgcaggacgtgatgctgcttggcgagcactagaaaatgcgttgccttacttagaagatggcagacaactcaaatttattttcttgccagatggagaagatcctgatacttacattcgtcaatacggcaaagaaaaatttgaagaatacatcgaaagtgcgcaatctttaagcgagtttatgtttgcacatttaagtcctcaggttgatttttccactaaagaagggcgcggaaaattagttgcgctagctgcgccgttaattcaccaaattccaggagaaatgcttcgcttatcgctacgcaatatgcttgctcaaaaacttgggatttttgatcaaactcagctggaaaatcttattcccaaacaattagaacaagccaatacacaacaaaaagtcactcataataagatcaagaagacaccaatgcgaatggtcatttcattgcttctgcaaaatcctgagttagtaaaacgtatgtctgaaagcggcgtgcaagcattacgtgcagaagcagggtttgaaattctggaaaaattgaccgcactttgtcgccaacgagagggcattactacggggcaaattttggaatacttccgcaatacatcttacagtaatccccttgaaatactggcaacttgggatcatttattagacgaatccgacataatcaacgcattttctcaaaattaccgtcgcttaaatattcaagctattgagcgcgatattgaaatgcttattgctaaagaacgaacagagggtctcactaatgaagaaaaaacggtacttgtacatcttttagctggtaaagaacagcagaaaaaacagttagtgaatccgctataa

SEQ ID NO: 1360 - DNA, 1872 bp, H. influenzae strain 86-028NP
atggaaaaaaatcaacaatctacggctgaacaatattcagaacaaattgagcaattgatggagctaggtcgtacacaagggtatttaacttttgctgaaatcaatgacttattgcccgaagatgctattgatcctgaatattacgacaaattgctacaaacgttgcaaaatgatgcaggtatccctgtattagatgaagcaccagaaagcgatgatatgatgttgagtgataccatccctgatgaagatgcagtggaagaagcaactcaaattctttcaaatgtagaatctgaaatcggtcgaacaacggatcccgtacgcatgtatatgcgcgaaatgggaacggtggatcttcttactcgtgaagatgaaattagcattgcaaaacgtattgaaggagggattgatgaagttcaaacctctatcgcagcctatcctgaagcattaaatggattactaaaaaactatgatgatgtagaaaaaggtaatttccgtttgaccgatttaattacgggttttgttgatccaaatgccgaaatagaagaacacaacggacttgatgaagacttttctgacgaagatgatgaagaagaatctagtaatgcagatgtggaagacaatgaatcagaatctacatcagattcaagcgactctgataacagtattgatcctgaagttgctcgcgaaaaatttcagcaattaagagaacagcactctaaaacccttgctgttattgaaaaacacggtcgctctggaaaacgtgcccaagatcaaattgcactacttggcgaaatttttaaacaattccgtttagtaccaaaacaatttgatttactcgttctatcaatgaaagaaatgatgaaacgtgtgcgctaccaagaacgtcagctacaaaaaatattagtggatatagcaggaatgccaaaggatgattttgaaaaaattattaccgctaatggcagtaacagtgaatgggtagcaaaagcattaaaatctagcaaaccttgggctaaacgtttaattaaatatgaagatcgtatttatgaagccttaaacaatctagcgataacagaagaaaatactaaacttaccattactcaaatgcgtgacatttgcgatgcagtcgcacgaggcgaacaaaaagcacgtcgagctaaaaaagaaatggttgaagctaacttgcgtttagtaatttccatcgcgaaaaaatacacaaatcgaggtttacaattcttagatttaattcaagaagggaatatcggtttaatgaaagcggtagataaatttgaatatcgacgtggctacaaattctctacatatgctacttggtggattcgtcaagcaatcactcgctctattgcggatcaagcgcgtacaatccgtattcctgtgcatatgattgaaacaatcaataaacttaatcgtatttctcgccagttactacaagaaatgggacgtgaagcaacaccagaagaattggcagaacgtatgggaatgccagaagataaaatccgtaaagtactgaaaattgcaaaagagccgatttcgatggaaacacctattggcgatgacgatgattcacatttaggcgattttattgaagattcaaccttagaacttcctcttgattctgccacagcacaaagtttaaaagttgcaactcacgaagtgctagaaggcttgacgccacgtgaagcaaaagtattacgtatgcgttttggcattgatatgaataccgaccatacgcttgaagaagtgggtaaacaattcgatgtaacacgcgaacgtattcgtcaaattgaagcaaaagcattacgtaaattacgtcatcctagccgttctgaaacactgagaagttttttagatgaatag

SEQ ID NO: 1361 - DNA, 1428 bp, H. influenzae strain 86-028NP
gtgattaaaatgactcaatttagaaaagaagtagatttacttggcgaacgtgatgtgcctgcagaagcatactgggggattcatacattaagagcggtagaaaatttcaatatttctaacgtaaccatttctgacgtgcctgagtttgtacgtggtatggtaatggtaaaaaaagcaacggctttagccaatggcgaattaggtgcaattccaagtgatattgcaaaagcgattgtagcagcttgtgatgaaatccttaccactggaaaatgcttagatcaattcccatcagatgtatatcaaggtggtgcaggtacgtctgtcaatatgaatactaatgaagtggttgctaatcttgcccttgaaaaaattggtcataaaaaaggcgaatataacgtgattaatccgatggatcacgttaatgcaagccaatcaaccaacgatgcgtatcctactggtttccgtattgcagtgtataacagcatcttaaaattgatcgataaaattcaatatttacacgacggttttgataataaagcaaaagagtttgcaaatatcttaaaaatgggtcgtacccaattgcaagatgcggtgccaatgactgttggtcaagaattcaaagctttctccgtattacttgaagaagaagtgcgtaacttaaaacgtacagcaggtttattacttgaagtaaaccttggtgcgactgcaatcggtactggtttaaatacgccacaaggctatacagaattagttgtaaaacaccttgctgaagtgactggattagcttgtgtaccagcagaaaacttaattgaagcaacatctgactgtggtgcttatgtcatggttcacggtgcattaaaacgtactgcagtgaaactttctaaagtatgtaatgacttacgtttactttcttctggccctcgtgcaggtttaaaagaaattaatcttcctgaattacaagcaggttcttctattatgccagcaaaagtaaacccagttgttccagaggtggtaaaccaagtgtgctttaaagtaattggtaacgataccactgtgactttcgcatctgaagctggtcaattacaattaaacgtaatggaaccagtgattggtcaagcaatgttcgaatctatcgacatcttaaccaatgcttgtgtgaacttacgcgataaatgcgtggatggcatcactgtaaacaaagaaatttgtgaaaactacgtgtttaattcaatcggtatcgtgacttacttaaatccatttattggtcaccacaacggcgacttagtgggtaaaatctgtgcgcaaacaggtaaaggcgtacgtgaagttgtgttagaaaaaggtttattaacagaagaacaattggatgacattctttctgtagaaaacttaatgaatccaacttacaaagcgaaattaaataaataa

SEQ ID NO: 1362 - DNA, 816 bp, H. influenzae strain 86-028NP; identical to SEQ ID NO: 631

SEQ ID NO: 1363 - DNA, 678 bp, H. influenzae strain 86-028NP
atgagcaacacagttgctacgatgataaacaaaaggaacattatgcgtaactacattaaaattggcgtagcaggtcctgttggcgcaggcaaaaccgcgttaattgaaaaactcactcgtgaaatagcgtcaaaatatagcgtagcagtcattactaacgatatttacacccaagaagatgcggaatttttaacgaaaaatagtttgcttccaccagagcgaattatgggcgtggaaacgggcggttgcccgcacacagcaattcgtgaagatgcctcgatgaatttagaagccgtggacgaaatggtgactcgtttccctgatgtggaaatcgtgttcattgaatcaggtggcgataacctttcagcgacttttagccctgatttggcagacgtgacaattttcgtgattgacgtggctcaaggggaaaaaatccctcgtaaaggtgggccgggtatcactcgttcagatttacttgtgatcaacaaaactgatcttgctccattcgttggtgttgacttaagcgtcatggaacgtgatgctcgtcgtatgcgtaacggtcagccgtttattttcactaacctgatgaaaaaagaaaatctggatggcgtgatcggttggatcgaaaaatatgcgttgttgaagaatgtggaagaacctgcatctttggttcgttaa

SEQ ID NO: 1364 - DNA, 708 bp, H. influenzae strain 86-028NP
ttggcacaaacattaaaccgctctttaacggatttaggtgcgttgttgcacttggtcgatcccaccttgccgattggtggatttaaccattccaatggcttggaaaccttcgtccagcaacgtgtggtagaaagcaaagcgaccctagaagaatatgtgcaaacccagcttttacaaaactggatttacaacgacggggcgtatctttctcttgccttcgatgcaatgtgtgaggggaattttgaccgcttgtgcgaactggattggcaactttccgccaccaaagtggcacgcgaaagtcgtgaagggagtttcaaactcggcgtacgattgttgaaaatttttattcgctatgaaacacatacgttgctcacagcttaccagcaagcgattgcagaaaaacgcgtgcagggctatttcccgatagtgtttgcaatggttgctcaagccatgggtttaagcaaagccgatacgctctatgcgttctactacaacgcagcagtcggtgcgatcactaacggcgtgaagctaattcctctcagccaaatggatgggcaagatattctgtttgacttgcgtggctcgctcgtacaagcggtggaattaagctttgaccctgacgaagaatggcttggtgcggcaacgctggcgaatgatattcgggctatgcaacacgaagtgctttatacgcgactttatatgtcgtaa

SEQ ID NO: 1365 - DNA, 558 bp, H. influenzae strain 86-028NP
atgaaaataattaacccaattctccctattatagaaaatatcttgggaaatttaaccgcacttcaagcagagggcaaaattaccacacagcccattgaacgcgtggcattgcagtggtatgaaagcgaacgcaatattttgcgtaaaactacaaatacggggcgtgaagtagcatttcgcttgctaaaagaggggcaacgcttgaaacacgatgatgtagtgtttatcagcgatgaattagtgattgcgattgaaattttaccgagtgacgtgattgtgctgtcgccgaaaaccttgcctgaaatggctcgagcttgttatgaaatcggcaacaaacattcgccgctttttttagatggcgatgaagtaacattaccttacgataagccgatgtttgaatggctgcaagctgcgggatttcatccgcaaaaagcagaacgccgtttaagccaagcgttaagagcaaattctgcacaagggcatggacattctcatagccattcgcatgatcatcatggctatcatcatcacggagatggacattggcacaaacattaa

SEQ ID NO: 1366 - DNA, 1719 bp, H. influenzae strain 86-028NP
atggcattaacaatttcaagagcacaatatgtagcaacttatggcccaaccgttggcgataaagtccgtttaggcgataccaatttatgggcaaccattgaacaagatttattgaccaaaggtgatgagtgtaaatttggtggcggtaaaagcgtgcgtgatggtatggctcaaagcggtacggcaactcgcgacaatccgaatgtattggattttgtgattaccaacgtgatgatcattgatgctaaattaggcattatcaaagcagatattggtattcgtgatgggcgtattgtgggcattggacaagcaggtaaccctgacaccatggataacgtcacgccaaacatgattatcggtgctagcacagaagttcataacggtgcacatttaattgcaaccgctggcggtattgatacccacattcactttatttgtccgcaacaagcacaacatgcgattgaaagtggcgttaccacgttaattggcggtgggactggccctgctgatggtacgcacgcaaccacttgtacccctggcgcatggtatatggaacgtatgtttcaagcggcagaagccttgcctgtaaacgtcggattttttggtaaaggcaactgttcaaccctagatcctctgcgtgagcaaattgaagcgggtgcattaggtttaaaaatccacgaagactggggtgcaacgcctgccgtgattgattctgccttaaaagtagcagatgaaatggatattcaagtggccattcacacagacacgctaaatgaaagtggctttttggaagacacgatgaaagcgattgatggacgtgtcattcatactttccatacggagggcgcaggtggtggtcatgcacctgacatcattaaagcagcgatgtattcaaacgtattacctgcttcaaccaacccgactcgtccgtttaccaaaaacaccattgatgaacatttggatatgttgatggtttgccatcacttagataaacgcgtgccggaagacgtagcttttgccgatagccgtatccgccctgaaaccattgcagcagaagatattttgcatgatatgggcgtcttctccattatgagttcagactctcaagcaatgggacgtattggagaagtcgttattcgtacatggcaaactgcagataagatgaaaatgcaacgtggtgagctaggtaatgaaggaaacgataacttccgtattaaacgctacattgcgaaatatactatcaacccagcaattgcacatggtattgcggagcatattggctcgttagaagtgggtaaaatcgcagatatcgtgttatggaaaccgatgttctttggggtaaaacctgaagtcgtcattaaaaaaggttttattagctacgccaaaatgggcgacccaaatgcctcaattccaacgccacaacctgtattctaccgtccaatgtacggtgcacaaggcttagcaacggcacaaacagcggtattttttgtttcacaagccgctgaaaaagccgatattcgtgaaaaattcggtttacacaaagaaaccattgctgtgaaaggctgccgcaacgtaggtaaaaaagatctggttcataatgatgtaacaccaaacattactgttgatgctgaacgttatgaagttcgagtggatggagagttaattacctgtgaaccagtggatagcgtaccattgggtcagcgatatttcctattctaa

SEQ ID NO: 1367 - DNA, 306 bp, H. influenzae strain 86-028NP
atgatcccaggcgaataccaattagccgaaggcgatattctcgctaatgtcggcagaaaaaccgtaaaaatcgaagtaacaaattcaggcgaccgcccaattcaagttggctcgcattaccatttttttgaaaccaataatgcccttaaatttgaccgcactttggcgcgtggaatgcgcttaaatgtgccatcaggcaatgcggtgcgttttgaaccaggtgaagtgaaatcagtagaattagttgcttttggtggtaaccaaatcatttatggtttccataatcaaattgatggcaaattataa

SEQ ID NO: 1368 - DNA, 303 bp, H. influenzae strain 86-028NP
atgcacttaacttccagagaacaagaaaaactgatgcttttcctcgcgggcgaacttgcggcaaaacgcaaagcacgcggcgttaaattaaattatccagaaaccattgcttatattgcgagccatttacaagaggctgcaagagacggaatgagtgtagcggaagtgatgcaatatggcgcaacacttttaactgttgatgatgtcatggaaggtgtggcagaaatggttcatgaagtccagattgaagctactttccccgatggcacgaaacttgttaccgtgcataatccaatcagataa

SEQ ID NO: 1369 - DNA, 291 bp, H. influenzae strain 86-028NP
atgaatattcgtcctttacacgatcgtgtaattattaaacgtgaagaagtcgaaacccgttcagctggcggtatcgtattaaccggttcagcagcgactaaatcaacccgcgcgaaagtattagctgtgggtaaaggtcgtattttagaaaatggcaccgttcaacctttagatgttaaagttggcgataccgtaattttcaacgacggttacggcgtgaaagcagaaaaaattgatggtgaagaagtgttaatcatttctgaaaacgatattttggcgattgtggaataa

SEQ ID NO: 1370 - DNA, 1638 bp, H. influenzae strain 86-028NP
atggcagcaaaagacgtaaaatttggtaacgatgcacgcgtaaaaatgcttaaaggcgtgaatgtattagcggatgcagtaaaagtaacccttggcccgaaaggtcgtaatgtaattttagataaatcatttggcgcaccaactatcactaaagatggtgtgtctgttgctcgtgaaatcgaattagaagataaattcgaaaacatgggggcacaaatggtgaaagaagtggcatctaaagcaaatgatgctgcaggtgacggtacaactactgcaactgtacttgcgcaagctatcgtaaatgaaggcttgaaagcagtagctgcaggtatgaatccaatggatttaaaacgtggtattgataaagcagtaagtgcggttgtttctgaacttaaaaatttatctaaaccttgtgaaacagcaaaagaaattgaacaagtaggtaccatttctgcaaactctgacagcattgtgggtcaattaatctcacaagcgatggaaaaagtgggcaaggaaggggtaattactgttgaagatggtacgggtcttgaagatgaattagatgtggttgaaggcatgcaattcgaccgtggttacctttctccatatttcatcaacaaaccagaaactgcaacggttgaattagataatccatatcttcttcttgtagataaaaaaatctctaacattcgtgaattacttcctgtgttagaaggtgtagcgaaagcaggtaaaccgttattaatcatcgctgaagatgtggaaggcgaagcacttgcaaccttagtagtaaacactatgcgcggtatcgtgaaagttgcagcagtgaaagcaccaggttttggtgatcgtcgtaaagcgatgttacaagatattgcaattttaacagcgggtactgtgatttctgaagaaattggtatggagcttgaaaaagcaacattggaagatttaggtcaagcaaaacgcgttgttatcaataaagataacacaaccattattgatggtatcggcgatgaagcacaaatcaaaggtcgtgtggctcaaattcgtcagcaaatcgaagaatcaacttctgactacgacaaagaaaaactccaagaacgcgttgctaaattagctggcggcgtggctgtaatcaaagtgggcgcagcaactgaagttgaaatgaaagagaaaaaagaccgtgtagatgacgcattacatgcaactcgtgctgcggttgaagaaggtatcgttgccggtggtggcgttgcattagttcgcgcagcagcgaaagttgcagcaagcctaaaaggtgacaacgaagaacaaaatgtgggtatcaaacttgcattacgtgcgatggaagcacctttacgtcaaatcgtcactaactcaggcgaagaagcatctgttgtggcaagtgcggttaaaaatggagaaggaaactttggttataacgcaggtacagaacaatacggcgatatgatcgaaatgggtatcttagatccaactaaagtcactcgttctgcattgcaattcgcagcttctgtagcaggcttaatgattaccactgaatgtatggtaactgatcttccaaaagatgataaagccgatttaggtgctgctggaatgggcggtatgggtggaatgatgtaa

SEQ ID NO: 1371 - DNA, 450 bp, H. influenzae strain 86-028NP
atgcaagtaattcttttagataaaattgctcacttaggtcaagtgggcgatcaagtaaatgttaaatcaggttttgcacgtaacttcttaatcccacaaggtaaagcagttatggcaactaaagctaacattgaacactttgaagcacgtcgtgcagaattagaagcgacagcggcagcaaatcttgcagcggctcaagctcgtgcagcagaagttactgcattaggttctgtgactatcgcatctaaagcaggtgatgaaggtcgtttattcggcgcaatcaccactcgtgatgtggcagaagcagtaactgcagcaggcgttaaaattgcgaaaagtgaagttcgtttaccaaacggtccaatccgtactcttggtgaccacgatgttcgtttccaacttcacggtgaagtatttgcaacattagatgtaatcgttgttgcagaataa

SEQ ID NO: 1372 - DNA, 228 bp, H. influenzae strain 86-028NP
atggcacgttatttccgtcgtcgtaagttctgccgtttcacagcggaaaatgttgttgaaatcgattacaaagatatcgctacattaaagaactatatttcagaaagcggcaaaattgtacctagccgtattaccggtactcgtgcgaagtaccaacgtcaattagctcgtgcaatcaaacgcgctcgctatttagcgttacttccatacactgacaatcatcagtaa

SEQ ID NO: 1373 - DNA, 327 bp, H. influenzae strain 86-028NP
atgctgaagagtaatttgaaaattgataatcgtttttcggttatgggagtcgtttctcagttaccaaagcgattaaaaagccctagtggaattgagcattgcaagtttttgttagaacatcgttctgatcagattgagagtggttttacacgtcaagcttggttaaaaatgccagttcaaattagtggtaatcaattgatagaaaaaactcaaagcattacggtcggtagtaaaattttggtggtgggatttattacctcacataaaacccaaagtgggttatgccaattagttttacatgccgagcaaatcgaatttatagattag

SEQ ID NO: 1374 - DNA, 378 bp, H. influenzae strain 86-028NP
atgcgtcactacgaaatcgtgtttatggttcatccggaccaaagcgagcaagtaccaggtatgatcgaacgttacaccggttctgtaaaagaagctggtggtcaagttcatcgcctagaagattggggtcgtcgtcaattagcgtacccaattaataaattacacaaagcacactatgtgcttatgaatgtagaagcgcctcaacaagtcatcgacgagctagaaacgactttccgttataacgatgctgtattacgcagtcttgttatccatactaagcacgccgtaacagaagcgtccccaatgaaagcggctaaagaagaacgtaaacctttagctgaagttgaaaacaacgattttgaggatgctgaagagtaa

SEQ ID NO: 1375 - DNA, 255 bp, H. influenzae strain 86-028NP
gtgcggataaaaaatcgattatttttagaggatacaatggcgaaagaagattgcattgagatgcaaggcacaattttagagactttaccgaatactatgttccgcgtggagttggaaaacggtcacgtggttactgcacatatttccgggaaaatgcgtaaaaactatattcgtattttgactggggataaagtgaccgtagaaatgacgccttatgatttaagtaaaggacgtattattttccgcagccgttaa

SEQ ID NO: 1376 - DNA, 1075 bp, H. influenzae strain 86-028NP
atgaataaaacattactaagtaataataatcacccaaatatttcattaacctgtcaaaaatttcaatacggtggaggtatggaacgatatcttattgatattgttaatggattatctcaggctaacattacacctaaaatttactctgccaagtttgatactgcattacctgaatataatctaattatatccaattaagattaatctttcttttgttcctaaaaaatggagaacctcgtttctttcctatttttcaaataaatataaagaaacatcagaaatctctctgacaacctcttacaccctatctgacgtggtcatttgtggtggaaatcataaaggatatttacaagcatcaaagaaaaagcccagcatatcagatcgatttaaaatcatgggtgaacaaaaatccttaaatcagtccaaatatgtcatcgctcattctgcattaatgaaaaaagaactcgttgagttatatcatgtctctgaaaacaaaattgatgtgatttatccccctattaatacagataaattcacacaaatcaatgaagaagaaagagtaaagctcagagaaaagttaggtttcaaaaaagatgaaatcatttacctattcccttctactggccatacgcgaaaaggtttcgatattttgaaaaaatattttgaaaaaactcagttacctattcgcttagtggtcgcaggaacgcctgtagaagaaaatcctaaaatttcttcacttggtttttgcaaaaatatgcctgaattatatcaagcggcagatttcactattatggcatctcaatatgaaccatttgggcttgttggactagaatctatattatctggtacgccagttattttttctgaaaacatgggatgcctagaagtattaaaaaacgaatttggctatacattttctagagaaaacataagtactttagatgaggcaattcaaaaatcagtaaaacaagcatctgaacagctacaccgtattctcaatccaatggattgtattcgttataatccaagtttgagtcatcatattaaagctatactggaactcatcgctaaatga

SEQ ID NO: 1377 - DNA, 864 bp, H. influenzae strain 86-028NP
atgaattcaaaaaaacacttaggccatacggcgcgtaaacgctttggtcaaaactttttacatgatacttctgtaattcaaggtatcgtggcggcgatttacccacaacccaatcaattcttagtggaaattggtccgggacttggcgcattaacagagcctgttggtgaacttgtcgatcatctgactgtggtagagcttgaccgagaccttgcggaacgtttacgtcaccatccatttttacatcaaaagctcaccgttattgaaacagatgcgatgcaatttgattttgatgagctttatacaacagagaatttagcagaaaaagggcaaaaattacgtgtatttggtaacttgccttataacatttctacgccattaatgttccacttatttaagtatcatgatgtgattcaagatatgcacttcatgctgcaaaaagaagtggttaaacgcttatgcgcagggccaaatagcaaagcttatggtcgcttaaccattatggcgcaatatttctgccaagtgatgcctgtacttgaagtacctccttctgcattcaaaccagcaccgaaagtggattcagccgttgtgcgtttaattccgcataaagaattgccgcaccctgtaaaagatttatattggttgaaccgtgtttgctcccaagcgttcaatcaacgccgcaaaacattgcgtaatgcactttcaacactattttcacctgaaaatctgaccgcacttggtattgatttaaatgcacgtgcagaaaatttggctatcgcagattatgcgcgcttagcgaactggctggcagataatccaccagcagatgttaataacgatgaaatattagattcagaagagtaa

SEQ ID NO: 1378 - DNA, 939 bp, H. influenzae strain 86-028NP
ttgttgatttattcttttcgtatagtagaatgcaaaaaatttagttatttccatttttatttaaatatgagtgctattgaaaatattgtcattagtatggaaaatgcaactgaacgtcgcaaacatattactaagcaatttgaatcaaaaaaactttcatttagtttctttaatgcgtacacttatcaatcaatcaatcaatcaatcaatcaatcaatcaatcaatcaatcaatcaatcaatctccatattacataatatagaggaatctagaatacttactaaaggagaaaaaggctgtttaattagccatttcttattatggaataagtgtgtgaatgaaaatttggaatatctcacaatttttgaagatgatgtaattcttggcgagaatgcggaagtgtttttggcacaagatgaatggttaaaaacacgttttgattttaatgatatttttattattcgtttagaaacttttttacagccagttaaacttgagaaacaaactaaaattccacctttttattctaggaactttgatattttaaaatcgactcactgggggacggctggttatattatttctcaaggtgcggctaaatatgtaattgaatatttaaagaatattccttctgatgaaattgttgcagttgatgaacttatttttaataaattagttgatgttgataattatattgtctatcaacttaatccagcaatttgtattcaagaactccaagcgaatcaaagtaaaagtgtattaacaagtggattggaaaaagaacgagaaaaacgtccaaaaatccgtaagaaaaagacattgaaacagcgtttaactcggataaaagaaaatattatacgagctttaaatagaaaaaaatggaaagaacaacaacgtattaaagaaatgcaaggtaaagaaattgtccgttttatgtag

SEQ ID NO: 1379 - DNA, 828 bp, H. influenzae strain 86-028NP
atggcaacctatttcgttggtgatttacaaggctgttatgatgaattacagcttttattagaacgtgtgaacttcaatccaacgcaagataaactttatcttgtgggagatcttgtggctcgtggggataaatcacttgaatgccttcgtttcgtaaaatcacttggcgattcggcacaaaccgtgctaggcaatcatgatttacacttaattgcgactgcactgggtattaaaaaagtaaaaccgcgtgatcgtgttgatgctatttttaatgcgcccgattttgatgaactgattcattggttacgccatcagccattacttgtacataataaaaagttaaacttcctgatggtgcatgcaggtatttcgcctgattggaatttggaaactgcgaaatcttgtgcggctgaagtggaacagattttacaaaatggggattttcattatctcattgaaaatatgtattccgaacaacctgatcgctggtcgcctgatttacagggcttagcgcgtcatcgttacattattaatgcttttactcgaatgcgtttttgctatttagatcatcgcttggattttgcctgtaaatcccctttaaaatatgcacctacagagctcacgccttggtttaatttaggtaatccactttataaacaaattcccattgtctttggacattgggcaagtttagtggatgagcctaccccaaaaggtgtttatgccctagatactggttgtgtgtggaataatcgaatgactatgttacgctgggaagacaagcagatcttcacacaaagtgcggtcaaaaattacagtgatttttaa

SEQ ID NO: 1380 - DNA, 624 bp, H. influenzae strain 86-028NP
atgctctcgctcactgctgaatcttgtgaactgttcaatattcctttctatcaattcgcccaaatgaaaaaattctgcccagaagatattccagcgattaaagcggattacaaattacattgggataattggaaagcgataattcaatctgtttcagcacaactcggtacgccttttgcgaaaccgcatattgaaagctggaccaatggttggcaggtacgggcgcatttcttcgcttattttaaatacgagtttaaccaaaattctgccgcaatcttttctgtgctattaaatcgtcgccgactaagagtgtgtttagattggcattgctatcgtgcagatcgctcacaaattaatgtgcaacaatataatcagtggcttgatcaatttgatttcaaacaatttgctgattttgagatttggcgagaggatgaaagtgaatatgatgattttcgccaagtgaaggtcatttctgaaaaaaatctgatcttacgttcagatgaggatttttggtgcattgggaaaagtattgaaaaagccgagttaaatcaaatagatcccattttatttattacacacaccattcaacaattacaaccgctttacgatcgctgccatcaataa

SEQ ID NO: 1381 - DNA, 1455 bp, H. influenzae strain 86-028NP
atgtcagtaaaaggcgacatcggtgttatcggcttagccgtaatggggcaaaacctcattttaaatatgaatgatcatggctttaaagtggtggcatataaccgtaccacttcaaaagtggatgaatttttacaaggtgcagcaaaaggcacgaatattattggcgcatactctttagaagatttagcttctaaattagaaaaaccacgtaaagtgatgttaatggtgcgcgcgggtgatgtggtggatcaattcattgatgcgttactaccgcacttagaagaaggcgacatcattattgatggtggtaactcaaactatccggatacaaatcgtcgtgtaaaagcattggctgaaaaaggcattcgctttatcggttcgggagtttctggcggtgaagaaggtgcacgtcatggaccatctatcatgccaggtggtaatcaagaagcatggcaatatgtgaaaccaattttccaagcaatctcagctaaaacagaacaaggcgaaccttgctgtgactgggttggcggtgaaggcgctggccactttgtgaaaatggttcacaacggtatcgaatatggcgatatgcaattaatctgtgaagcttaccaattcttaaaagaaggtttaggcttgagctatgacgaaatgcaagccatcttcgcagaatggaaaaatactgaacttgatagctatttaatcgatatcaccactgacattcttggctataaagatgcaagtggagaacctttagtcgaaaaaatcttggatactgcgggtcaaaaagggacaggtaaatggacaggtatcaatgcgttagattttggtattccattaactttaatcactgaatccgtttttgcacgctgcgtgtcttcctttaaagatcaacgtgttgcggctaatcaattattcggcaaaactattacaccagttgaaggcgacaaaaaagtatggattgaagcggtacgtaaagcattattagcgtcaaaaattatttcttacgcacaaggctttatgctgattcgtgaagcctctgaacaatttggttgggatattaactatggtgcaactgcgttgttatggcgtgaaggttgtatcattcgtagccgtttcttaggtaatattcgcgatgcttatgaagcaaatccaaatcttgttttcttaggttcagatagctacttcaaaggcattttagaaaacgcattaagtgactggcgtaaagtggtggcaaaatctatcgaagtgggtatcccaatgccttgtatggcgtctgcgattactttcttagatggctatacttcagcacgtttaccagcaaacttattgcaagcacaacgcgactacttcggtgctcatacttatgaacgcacagataaacctcgtggcgagtttttccacaccaactggactggtcgtggcggtaatacagcatcaactacttatgatgtgtag

SEQ ID NO: 1382 - DNA, 543 bp, H. influenzae strain 86-028NP
atgactacgaaatataatgcaggtattcatcatcgaagctcgattcgtttaaaacattataattatcgttctgaaggattttatttcatcaccatttgttgtaaaaataaagaatgtctatttgggcatatcattaatcaacaaatgcaattaaatgatttagggaattacgtaaaacagtgttgggaaaatattccaatgttctttccacaagtacgaattgatgaatttgtgattatgccaaatcatttacacggtattattgaaattattgaacaggtaaagggcaaatgtaatttgcccctacaatcgagagtaacgcagttgccacaaaagggaacatctcaaacaattggctcaatagttcgtggatttaaagcaggtgtaacatcttgggcaagaaaaaatagtgaaatttttgatgtttggcagcgaaattattatgaacatattattcgtgatgaaaaatcctatttgcagatttatgaatatattcaaaataatcctattttatgggaacaagatcaattatatgtagattaa

SEQ ID NO: 1383 - DNA, 189 bp, H. influenzae strain 86-028NP
atgttcaccattgaaagcaaaagtggtgttcgtcaatcgagggttatacaacggcttttggcagcagggattatttttggttatgccatcaaccaaatttcggtgatttatttctttttaggttgtgtgattatcgccgcagtttttggggcggttacgacgaagaataaggggatattggtaaagtag

SEQ ID NO: 1384 - DNA, 738 bp, H. influenzae strain 86-028NP
gtgggtatatttacttacgacatcataaacggaacagcaatgaataccatcactttcccaactgctcaacacgcagtcgaaaaaatcgcgcaagaatttgtgatttacagtcagttaaatcgtcctgtacatatttctctttctggtggatcaacacctaagttgctatttaaaaccttagccaaattgccttatgctgaacaaattaactggaaaaatctgcatttttggtggggagatgatcgtatggttccgccatctgatcctgaaagtaactatggcgaagtacaaaaacttttattcgatcatattcaaattccagcagaaaatatccatcgaatttgtggcgaaaatgaaccgcactttgagttaaaacgctttgaagaagaattaagtgcggtcattccaaacggtatttttgattggattattttaggtatgggaacagatggtcataccgcttctctcttcccacatcaaaccaattttgatgatgaaaacctagctgtcattgcaaaacaccctgaaagcggtcaaattcgcatttctaaaacagctaaactcattgaacaagccaaacgcattacctatttggtaacgggtgaaagcaaagcagatattttaaaagaaattaaaactaccccagcagaaaacttgccttatcccgctgcaaaaatcaaagcaaaaaatggggtgacggagtggtatttggataaagccgcggcaaggctgctctaa

SEQ ID NO: 1385 - DNA, 1485 bp, H. influenzae strain 86-028NP
atgcaaactgataataattgtatcgtcatttttggcgcgtctggtgacttaactcatcgtaaactcattccagccctttataatctctacaaaatcgggcgtttgagtgaaaacttttccgttcttggtgttgcacgttctgacttgaacgatgaaactttccgcaaaaaaatgcgtgaggcgttaattcataatgaagaaacaacacctgacactttagatgctttctgctctcatctttattaccaagcagtgaatacttcggatgctcaagattacggcaaacttgttccacgtttagacgaacttcacgataaatatcaaacctgtggtaacaccctttactatatgtccactccgccaagtctttatggcgtgattcctgagtgtttggctgcacatggtttaaatacggaagaatatggctggaaacgtattatcgttgaaaaaccttttggttacgatgaaaaaacagcgcaagcattagacgtacaaatccaccgtttctttgaagaacaccaaatttatcgtatcgaccattatttaggtaaagaaaccgttcaaaacttgctcgtattacgtttttcaaatggttggtttgaaccgctttggaaccgtaatttcattgattatgtagaaattactggtgcagaatctattggcgtggaagagcgcgggggctattatgatggttctggcgcaatgcgagatatgttccaaaaccatttattacaagtccttgctatggttgcaatggagccgccagcgattattaacgcgaattcaatgcgtgatgaagtggcaaaagtgatgcatagtttgcgtccattaacttcggaggatatggagaataaccttgttttgggtcaatacactgcggctgaaattaacggcaaaatggaaaaaggctatctagaagaaaaaggtgtgcctgcagattctcgtactgaaacctacatctcattgcgttgtgaaattgaaaactggcgttgggctggcgtgccgttctatgttcgtacgggtaaacgcttaccagctcgtgtgactgaaattgtgatccattttaaaactacgccacatcctgtattcagccaaaatgcaccagagaataaattgattattcgtattcaacctgatgaagctatttcaatgcgttttggtttgaaaaaaccaggtgcaggttttgaggcgaaagaagtatcaatggatttccgttatgcagatttagcaggcacgcaagtattaaccgcttatgaacgtttattgttggatgcgatgaaaggcgatgcaaccttgtttgcgcgtactgatgctgttcacgctgcatggaaatttgttcagccgattttagattacaaagcgaatggtggtcgtattcacgaatatgaagccggcacttgggggcctgtggcagccgataaattaatcgcaaaacaaggcaaggtttggcgtaaaccaagtggattgatgaagaaaaaagtgtaa

SEQ ID NO: 1386 - DNA, 810 bp, H. influenzae strain 86-028NP
atgctgacgctaaacgaacatttacttaaccaagtattgctgattgcttaccaagcgggtaagcatttgcaacagttttatcaaaaacaggttcatgttgaattgaaagaagacaacacgcctgtgacggaagcggatctttttgtgagccaatttttaaccgaaaaattgaccgcacttttccctaatgtccctgttctttcggaagaaaattgccatatttcctttgaagaacgtaaaaattggaaagaatattggttgattgatcctcttgatggcacacaacaatttattaatcgtaccgatcaattttctgtgttgataaccttagttcgtaaaaataaacccgtgttaagcattattcatgcgccaattttatcaataacttattatgcaatgcgtgatttcggagcgtttaaaaaacaactggatcaggtaaaaaaactcactaaaaacacgacgaattttgaccgccctttacgaattgcggtaggtgcaaccacttcacaagaaaaagtgcggtcgattttgccgaaggattttacttgtgaatttgttgtggttggttcaagtagcttaaaaagcggtttggtggctgaaggtgcagtagattgttatgttcgtttaggacaaacaggcgaatgggataccgctggcgcagaagtgttgctgaatgaaactcacggtgccatttttgactctcattttgagcctttaacctataaccaacgcgaaacattgattaatccgcattttgttatggtgggcgatcaatcgttcgattggcgttctgtctttcaatttaattga

SEQ ID NO: 1387 - DNA, 417 bp, H. influenzae strain 86-028NP
atgaaatcttacttaaaaacacttattttttttcctctgattttacagatagtcgtcaccgcacttttgatttggttcgatgatgactcaagtggcgttatcgttcctttttctagctatgctctcacagcatttcttctcgccacaattcccgcatttttaaccgcacttttagccgcaaaattccgttacacacgttataacattgcttcgattgtattagtttcatcgatcatttcatttgtttattgcaatatggcatcttatttttatttgttattactcggcgaacaagacacttccttttggggctggttgaccgaagggggattgtccctcgggttaataagcacatgcggaatggttttttatgctctatttgtaatgccttggttgctgccaaaaacaagagaataa

SEQ ID NO: 1388 - DNA, 1983 bp, H. influenzae strain 86-028NP
atgcataacgaaaacttaaaagaattgaccgttcgaggaattattctcggtgcattgattacggtaattttcactgcatccaatgtgtatctcggtctaaaagtgggggtgacatttgcgtcatctattccagcggccgtcatttctatggcagtactcaaatttttcaaagattctagcattcttgaaaataatatggtgcaaactcaagcatcttcagcaggtacgctttcttctgtgatcttcgtcttgcctggtttattaatgatgggctactggcaagattttccattctggcaaacgatgttgatttgtgcagctggtggtacattgggcgtgttattcactattccattacgccgtgcaatggtggtaaatagtaatttaccttatcctgaaggggtagctgctgcagaaattttgaaagcaggtaatcatgcagatggcgacagcggtgtgaaagatattgcttacggtggtgttttagcgggattagtggcatttttaactaacggtttacgcgtgatggctgatggtagtgcttggattcaaacaggaaaagcggcgttccaattaccaatgggcttttcacttgccttactcggtgctggttatttaattggtattgtcggcggtattgcgatgttaatcggtgttattttgacttggggtgtggcagtgccatatttcacaatgtcagaagatattgccgcggatgcaagtttaattgattctgcgatgactgtttggaaaaccaaagtgcgttatattggtgtgggtacaattggtattgctgcgatttggacattgctgattttaatgaaaccaatgattgaagggatggttcattctttccgtatgctgaaaggtgggcaagaggcatcagaacatcgtattgatattgacctttctccaaaaacaatgatttatatcttaattgcgacggttgcgttaattgttatttcattacatcactttattgcggcggcaccaatttcgcctgagctttccattttattagtggtagtttgtactttcttagcggtatttatcggcttctttgtggcagctgcttctggttatatggcaggtttagtgggttcatcttcaagcccaatttctggtatcggaattatttctgttatcgtgatttcattagtattggtgtcaatcggtaatgcctcgggcttatttgaaactgtagatggtcagaaatttttaaccgcacttacattgtttacggcatctatcgtaatcactacagcttgtatttctaatgataatctacaagatttaaaaacgggtttattagttgaagcaacaccttggcgacaacaagttgcattaattatcggctgctttgtcggtgcacttgttattgcgccagtattagaaatcttatatcacgcgtatggtttcagtggtgcattgccacgtccagatatggatccttcacaagccttatctgcaccacaagcaacgttaatgaccgccatttctcaaggtattttcacaaataaattggaatggacttacatcttaactggtgtgggtttaggtgctgtgttaattacgattgatgcatttttgaaaaaagtcagcaacaaagtctttagcttgccagttattgctgtggggattggtatttacttaccaccatcaattaatacgcctgtgattgttggtgcattcctagcgtggattatggctcgccatattgcaaaacttggtaacaaagaagtgtcagctaaagcagaacgtttcggtacgcttttctctgcaggtttaattgtaggcgaaagtttaatgggtgtcattttagcattcattattgcggcttctgttaccactggtggttctgaagcgccattatccttaaatcttgaaaactgggatacaattggcgagtggttcggtttaatcgtatttatcgtgggcattgtgatttttgcatctcgcgtattacgtgcgaaaaaaatctga

SEQ ID NO: 1389 - DNA, 396 bp, H. influenzae strain 86-028NP
atggcagaaaaagaagtcagattagataaatggttgtgggctgcccgattttacaaaacacggagcattgctaaagcgatgattgaaagtggtaaagtgcattacaacaatcaacgtgcgaaagtaagtaaaattgtggaagtgggcgcaatgttaaaacttcgccagggaaacgaagaaaaagaaataaaaattatcgccttaagcgatcaacgccgaggtgcgccagaagcacaattactctatcaagaaaccgaaagtagcgtgaaaaaaagagaagaaatcgcgtgggcaagaaaaaataattccctttcaatgccccatcctgatcgtcgcccaaataaaaaagagcggagagatttattgaaatttaaacaccaagataaatttgaataa

SEQ ID NO: 1390 - DNA, 453 bp, H. influenzae strain 86-028NP
atgcacaacattgatagtttagatcaaaaaatattacgtgtactcactaaagatgcgagaacaccatacgcagaaatggctaaaaattttggtgttagtccaggaacgattcacgttcgggtcgaaaaaatgcgtcaatcgggcattattaaaggcacaaaagtaattattgatgaacgtaaattaggctatgatgtatgttgttttatcggcattattctaaaaagcgcaaaagattatgaaaaagtgatcaaaaagctagaaagttttgatgaagtagtcgaggcctattatacaacgggcaattactcgattttcttaaaggtgatgacacacacaattgcagaattacattccgttttggcgaccaagattcagttaattgatgaaattcaatccactgaaaccttgatttcaatgcaaaatccaattttgcgagatattaaaccttaa

SEQ ID NO: 1391 - DNA, 993 bp, H. influenzae strain 86-028NP
atgaaaaagacatttattttacaacaacaagaaatcagctttgtgaagaacacttttacccaaaatcttattgagcaacttggcattattgaagtgcaaggcccaattttgagccaagtgggtaacggaatgcaagataacttatcaggcattgaaaaagccgtacaggttaatgtgaaatgtattccaaatgccatatttgaagttgtgcattctcttgcgaaatggaaacgccatacattagctcgtttcaactttaaagaagacgaaggcttgtttgttcatatgaaagcattgcgtcccgatgaagattctcttgatccaacgcactctgtttatgtagatcaatgggactgggaaaaagtgattcctgaaggtcgtcgtaattttgcatacttaaaagaaacggtaaattctatttatcgtgctattcgtttaacagaattagccgtagaagcacgttttgatattccttccattcttccaaaacagattacctttgtgcatagcgaagatttagtaaaacgctatccagatttaagcagtaaagagcgtgaaaacgcaatttgtaaagaatacggtgcagtattcttaatcgggattggcggcaaactttcagatggcaaacctcatgatggtcgtgcacctgactatgatgactggacaacagaatctgaaaatggctacaaaggcttaaatggcgacattttggtatggaacgaccaattaggcaaagcctttgaactatcctcaatgggtatccgcgtagatgaaagtgcattacgtttacaagttggcttaacaggcgatgaagaccgtttaaaaatggattggcaccaagatttattaaacgggaaattgccattaactatcggcggtggtatcggtcaatctcgcttagcgatgcttttacttcgtaaaaaacatatcggtgaagtgcaatcaagcgtatggccaaaagaaatgttagaagaattttcaaacattctttaa

SEQ ID NO: 1392 - DNA, 354 bp, H. influenzae strain 86-028NP
atgttagtgcaagaaatgttgttacaagcggtgaaaaaattacagagaaatgcgaatttgatattacattcagaccaaggaatccattatcaaatgcttagctatcaacgcttattagcgaaaaataggatttctcaaagtatgtcgagaaaagggaattgcttggacaatgccgcgatggaaagtttctttgggcgattaaaaacagaatgtttttatggtagggaatttaacagcagagaagagatagttgatgccgtcagggattatttggattactataaccaccgacggattcaactaaaattaaaagggctgagtccgatacaatatcgaaaacaatcctttaaataa

SEQ ID NO: 1393 - DNA, 858 bp, H. influenzae strain 86-028NP; identical to SEQ ID NO: 673

SEQ ID NO: 1394 - DNA, 117 bp, H. influenzae strain 86-028NP
ttgccaggtgtgaatcatatcgtcgaatcttggctgaacatggcatcattcaaagtatgtcgagaaaagggaattgcttggacaatgcagcgatggaaagtttctttgggcgattaa

SEQ ID NO: 1395 - DNA, 141 bp, H. influenzae strain 86-028NP
ttgggtggcggtggcattctggcatatttgggtttcattggcggtcgtcctgatggtttacggggaatcagtccatttatgccacttttttcaaaccgtttcaaccatgtcccgactaaggcgttggaaggaatattgtaa

SEQ ID NO: 1396 - DNA, 675 bp, H. influenzae strain 86-028NP
atgaacacacaatttaaacttattggctttgatttagacggcaccttggtaaatagcttgcctgatttagcgttatccgtaaattctgccttggctgaatttaatttaccgaaagcgccagaagaattagttttaacttggatcggtaatggcgcgcctgtattaattgctcgagcgttagattgggcgaaaaaacaaacaggaaaagtgctaactgaaacagaggttaagcaagtaacagaacgttttaatttttattatggcgagaatttatgtaatgtcagccgcttgtatccaaatgtaaaagaaactttagaaaccttgaaagaaaaaggctatgtcctagcagttgttaccaataaacccacaagacatgttcaacctgtgttggcagcatttggcattgatcatttatttagtgaaatgttgggcggtcaatccttacctgccattaagccacatccagctccactttattatttatgcggaaaatttggttttgaaccacgccaagtgcttttcgtgggcgattctaaaaatgatattatcgcggctcacgctgcgggctgtgcagttgttggtttaacttacggctacaattacaatatccctatcactgaatccaatccagattgggtgtttgatgattttgcccagctattaacgattctttaa

SEQ ID NO: 1397 - DNA, 705 bp, H. influenzae strain 86-028NP
atgcactcattttctcaacggagaacctttatgaaaccttatcttatcgccccatcaattctttctgccgatcttgcacgtcttggcgatgacgtacaaaacgtacttaatgcaggcgcggatgttattcattttgatgttatggataatcattatgtacctaatctcacttttgggcctgcagtatgtcaagctttacgtgattatggcattaccgcaccgatagatgtgcatttaatggtaaaaccgatcgatcgcattattcccgattttgctaaagcgggtgcgaactacatcacttttcacccagaatctagcgaacatattgaccgctctttgcagcttattcgcgattgtggttgtaaatctggattagtttttaatcctgcgacgccgttgagctatttagattatgttttggataaagtggatgtggttttattaatgtcagtgaatcctggatttggcggacaatcttttattccagcaacattgaagaaattacaacaggctcgtaagatcattgatgaaagtggttatgacattcgtcttgaagtagatggtggcgtgaaggttgataacatcgcagaaattgccgcggcgggtgcagatatgttcgtggcaggttctgcaatttttggtaagccagattataaacaagttattgaccaaatacgtacacagttagcaagtgttagcgcataa

SEQ ID NO: 1398 - DNA, 2421 bp, H. influenzae strain 86-028NP
atgtcagaaacgaccaatgataactatggtgcatcgagcattaaagtattaaaaggccttgatgcggtgcgtaaacgtcctggtatgtatatcggcgataccgatgacggtactggtttgcaccatatggtatttgaagtggtggataatgccattgatgaagccctcgctggccattgttccgatattatcgtgacaattcacgatgataattctgtatcggtgcaagatgatgggcgcgggattcctgtggatattcatcctgaagaaggcgtttctgcagcagaagtgattatgactgtgcttcacgcaggcggtaaatttgacgataactcttataaagtatcgggcggtttacacggcgtgggcgtatcagtggtgaatgcgctttctgataagttacaattaaccattcgtcgtcaaggtcacgttcacgagcagttttatcatttaggggagcctcaatcgccattaacagtgattggcgaaacagaggcaacggggacaacggttcgtttctggccaagctcagatatttttgctatcacaacctttgattacaaaatcttagcaaaacgcttacgcgagctttctttcttgaattctggcgtatctattcgtttaatcgataaacgtgatggatctgaagatcatttccattacgaaggcggtattcaagcattcgtagaatatttgaacaaaaataaaaacccaattcatccaaagccattttattttaccgctgagaaagatggtattggcgtagaagttgcattgcaatggaatgatggtgtaaatgaaaacgtgtactgctttaccaataacattcctcaacgtgatggcggtactcacctagctggtttccgtggggctttaacccgtagcttaaatagctatatggaaaacgaaggcatgctgaaaaaagaaaaagtggcgacttcaggcgatgatgcgcgtgaaggtttggtggcgattatttccgttaaagtgcctgatccaaaattctcatcgcaaacgaaagacaaactcgtgtcttcagaagttaaaagtgcggtggaatcagcgatgaatgaaaaaatgcaggaatatttattagaaaatcctgcagatgcaaaaatcattgtaaatcaaattattatggctgctcgtgcgcgcgaagccgcacgtaaagcgcgtgaaatgacgcgccgtaaaggggcattagatattgcaggtttaccgggtaaacttgcagactgccaagaaaaagatcctgcgctttctgaactttacttggtggagggggactccgctggtggttctgcaaaagttggtcgtgatcgtaaaactcaagcaattttgccattgaaaggtaaaatcttaaacgtagaaaaagcacgtttcgacaaaatgttgtcttcccaagaagtgggcacattaattactgctttaggctgcggcattggtcgtgatgaatataacccagataaattacgctatcatcatattattatcatgactgatgctgatgtggatggttctcacattcgtacgttgcttttaacgtttttctatcgtcaaatgcctgagctgattgagcgtggttatgtttacattgctcagccgccactttacaaagtgaaaaaaggaaaacaagaacgctacattaaagatgcggatgaaatggagcaatatgaattaacccttgctttagatggcgcagaattacatatcagcgcaaatgcaccagcaatgaatgcccttgtatttgaaaaattggtggcagaatataacagcgtacaaaaacttatcggtcgtttaaaccgtcattacccagtgcctgtattgcaaggattaatttatcagtcgccaatttctattgaaatgatgaaagaggaaagtgcggttgaaaattggggtaaatcttttgttgaacaactgactgcaaaagaaacagaagcgcatcaatattcagtgcgtacacaatttaatgcggaacgccaagtgtatgaagcggtgattactgttcgcaaacacggtattgataccgattatttcttgaattttgattttgttcacggcaatgaatacgcaaaaattgtttctcttaataaacaactcaatggtttattagaagaaggcgcttatgtcacacgtggtgaaaaagtacaaccagtgcgtagttttgaacaagccgttgaatggctagtgaaagaatctcgtaaaggtcttgaagtacaacgttataaaggacttggggaaatgaatgcagatcaactttgggaaaccacaatggatccaaattcacgtcgtatgttgaaagtttctattaaggatgctgttgcagcagatcaactcttcacgaccttaatgggagatgaagttgagccacgtcgtgagttcattgagctgaatgcgttaagagcaaatttagacgtgtaa

SEQ ID NO: 1399 - DNA, 2313 bp, H. influenzae strain 86-028NP
atgttaaatcaacaaattagccaaattattgcggcagaattaaccgttcaaccccaacaaattcttgctgccattcaattattagatgatggcaacaccattccatttatcgcccgttatcgtaaagaagccacagggggcttagatgacacccagcttcgccattttgaaacccgtttaatttatttacgtgaattagaagaacgtcgtcaaaccatcttgaaatctattgaagagcaaggaaaattgaccgatgaattgcgtgacaaaattcatgcgacacaaagcaaaaccgaattagaagatttatatttgccgtacaaacctaaacgtcgcaccaaagggcaaattgccattgaagctggtcttgagccattggctaatttactttggaatgagccaaaaaatgatccagaatcaaccgcactttcctttgtggatgctgataaaggcgtgacagacaccaaagtagcccttgatggtgcacgctatattttaatggaacgttttgctgaagatgcaggtttattagcgaaagttcgtgattatttagcgaaaaatgccgttatcgtatccaaagtgatcgaaggcaaagaaacggaaggggcaaaattccaagattatttcgatcatcaagaattattgaaaaatgtgccttctcaccgtgcattagccatgttccgtgggcgtaatgaaggcattttacaacttagcttaaatgcggatcctgatgcagaagagggaagtcgccaaagttattgtgaagagattattcgtgattatttagatgtacgtttcactagccagcctgcggataaatggcgtgagcaagtgattgcgtggacatggaaaatcaaagtttcgttgcatttagaaacagaattaatggcgagtttacgtgaaaaagcggaagaagaggccattgatgttttcgctcgaaatctgaccgcacttttaatggctgcccccgctggcgcaaaaagcactatgggcttggacccaggcttgcgtacaggggttaaagttgcggtggtggataacacaggtaaattattagataccaccaccatttatccacacacggggcgtgaagctgaagcgcaagtggcgattttcagcttaatccgcaaacataacgtagaattaattgccattggtaatggtacggcttctcgtgaaaccgaacgctttgcgaaagaagtgattaaagaaattaaagaaaataaacctcaaaccgttgtagtgagcgaagcaggtgcatccgtttattctgcttctgaatttgccgcaaatgaattccctaatttagatgtatctttacgtggtgcggtatcaattgcgcgtcgtttacaagatccattggcagaattagtgaaaatcgaacccaaagccattggtgtagggcaatatcagcacgatgtaaaccaaagccaacttgcacgtaaacttgatgcggtggtggaagattgtgtaaacgcggtaggtgtggatttgaatacagcatccgcgccattgcttgctcgtgtggctgggatgactaaaaccttagcgcaaaacattgtggaatatcgtgatgaaaatggtcgttttgaaagccgtagagaattgaaaaaagtgcctcgtttagggccaaaagcctttgaacaatgtgcaggttttatgcgtattgcaggcgggaaaaatccacttgatgcttcaggtgttcacccagaggcttatcctgtggtcgaaaaaattttgcaagctaccgcgcaatctattcaagatttaatgggtaatgcgggtgtggtacgtcagcttgatgcaaaacaattcattgatgagcaatttggtttaccgaccgtccaagatattttcaaagagttggaaaaaccagggcgtgatccacgtggcgagttcaaaaccgctgtatttgctgagggcgtggaagaaataacggatttaaaatctggaatgattttagaaggaacagtgactaatgtaactaattttggcgcatttgtggatattggtgttcatcaagatggtttagtgcatatttcatcattaagcgataaattcgtggaagatcccctccaagtggtaaaaacaggcaacattgtaaaagtcaaagtgttagaagtggatgtgctgcgtaaacgcattgcattgacgatgcgattagatgaaagtgcggtcaaaaatgacggtaaatctgaccgcactttatccgcaagacctcgtggaaatacgcagcgagaggcgcgtagttcaagaggtaataatgcgatgggcaatgcctttgctgatgcgctaaaaaattggaaaaaataa

SEQ ID NO: 1400 - DNA, 477 bp, H. influenzae strain 86-028NP
atggcaaaatcaaattatattacccgtcaaggctggcttgtgcttgaccaagaactcaagtttttgtggaaagaagaacgcccaaaagtcactcaagccgtttcagatgcagctgcgctaggcgatcgtagcgaaaatgccgaatatatttatggtaaacgtcgtttacgtgaaattgatcgccgcgtgcgttttttaactaaaagattggaagtgctacaaattgtcgattacaacccaaagcaagagggaaaagttttcttcggtgcgtgggtggaattagaaaatgaagaaggtgaaattaagcaataccgtatcgtcggttgtgatgaatttgcccctgcgaaaaattggatatccattgattccccagttgctcgagctttaatcggaaaaacattagacgacgaagtgcgggtagaaacgccatcaggatttattaccctttatataaataaaatttggtatgaaaaataa

SEQ ID NO: 1401 - DNA, 618 bp, H. influenzae strain 86-028NP
atggctggtgttcgtgctgttcaaaaagaaaagactcgtcgcgctttagtggatgcagcatttaatcaacttagcgcagaaaaaagtttttctaatttaagtttacgagaagtggcgcgcgaggctggtattgcgcctacctctttctatcgccattttagtgatatggatgaacttggcttagaaatggtggatgaagcaggtttgatgttgcgccaattaatgcgtcaagcgcgtaaacgtattgatgcgggcggtagtgttatttctgtttctgtggatacattttttgaatttattactaatagcacgaacgtttttcgcttgttattacgcgaaagttcaggcacttctcaagcttttcgtactgcggcagcacgcgaaattaagcattttgttgatgagttagcagaatatatttcctacaaacatcaatattcgcaatatgttgcttatgttcaagcggaaggcatcgtaacaatcgtattcactgcaggggcgaatgctttagatatgagtaaagctgagcgtgagcaacttaaagctcgtgtgattttgcagttgagaatgcttgcaaaaggtgctgattttgcagcgaataaggaaagaggcaagtaa

SEQ ID NO: 1402 - DNA, 906 bp, H. influenzae strain 86-028NP
atgaatatccgtgatctagaatatcttgttgccttatctgaatataaacatttccgccgtgctgccgattcttgtaatgtgagtcaaccaacattaagtgggcaaattcgtaagttagaagatgagcttggtattattttgttagaacgtactagccgtaaagtgttgtttactcaatctgggatgttattggttgatcaggctcgtacagttcttcgagaagtaaaattattgaaagaaatggcgagtaatcaaggtaaagaaatgaccgggccattacacatcggtttaattccaacggttggtccttatttgctcccttatattgtgccaatgttaaaagcggcattccctgatttagaagtgtttctttatgaagcgcaaacgcatcaattattagaacaattggaaacggggcgtttagattgtgctatcgttgccactgttccagaaactgaggcttttattgaagtacctattttcaacgagaaaatgttactcgccgtatcagagcatcatccttgggctcaagaaagtaaacttccaatgaaccaattaaatggtcaagaaatgttaatgcttgatgatggtcattgtttgcgtaatcaagcgctagattattgcttcactgctggtgcaaaagaaaattcccatttccaagcaactagtcttgaaactttgcgcaatatggtggcagcgaatgctggtatcacttttatgcctgaattagcggtactgaatgaaggtacgcgcaaaggtgtgaaatatattccttgttattcgccagagccatcacgcaccattgcgttggtttatcgtcctggttcgccattacgtaatcgttatgagcgtgtggcaagtgcggtcagcgatgaagttaaatctattctagatgggttgaaataa

SEQ ID NO: 1403 - DNA, 726 bp, H. influenzae strain 86-028NP
atgtctagtatggaaggaaaaaaagtccctcaagtgacattccgcactcgtcagggtgataaatgggttgatgtaactacctcagagttatttgataacaaaacagtgatcgtgttctcattaccgggcgcattcactccaacttgctcatcatcacacttaccacgttacaacgaattagcgccagtattcaaaaaatacggtgtagacgatattcttgttgtatctgtaaatgatactttcgtaatgaacgcatggaaagaagatgaaaaatctgaaaacatcactttcattccagatggtaatggtgaatttaccgaaggcatgggtatgttagttggtaaagaagatttaggcttcggtaaacgttcatggcgttattctatgcttgtgaaaaacggcgtagttgaaaaaatgtttatcgaaccaaacgaaccaggcgatccgttcaaagtatccgatgctgacactatgttgaaataccttgcaccacaacaccaagtgcaagagtctatttcaatctttacaaaacctggctgtcctttctgtgcaaaagcaaaacaacttttacacgataaaggcttaagctttgaagaaatcatattaggtcacgatgcaacaatcgtgagcgtacgtgcagtttcaggtcgtgctactgttccacaagtgtttatcggtggtaaacacattggcggtagcgacgatttggaaaaatactttgcataa

SEQ ID NO: 1404 - DNA, 222 bp, H. influenzae strain 86-028NP
atgcaaattcaacaaatgttagaaaatcgcatcgaagaacttgaaatgaaaattgcatttcaggaacagttattagatgaattaaatcacgctttagttcaacagcaatttgatattgataaaatgcaagtccaattgcgttatatggcaaataaattaaaagactttcaaccgtctaacattgcaagtcaatctgaagaaacgccaccgccccattattga

SEQ ID NO: 1405 - DNA, 726 bp, H. influenzae strain 86-028NP
atgttaaaaattcaaaaattatctatcgcagcattaatggtaagtgcggtaatttctggtcaagtttttgcagaagataacacattcgatgaaaaagcggcatcttatgcagtaggtacgctcatgggcagtcaaatgaaagatcttgttgattcccacaaagaagttattaaatatgataatgcgcgtattttagatggcttaaaagatgctttagaaggcaaagtggatgttcgtaaagatgaaaaaatccaaaaaaccttagaatctattgaagcaaaattagtggctgcatcaaaagcaaaagcagaagcgattgctaaacaagcaaaagaagaaggcgataaattccgtgctgaatttgctaaagggaaagatgtaaaaacgacgcaatctggtttaatgtataaaattgaaagtgcaggtaaaggcgatacaatcaaatcaacggatacggttaaagtacattacacgggtaaattaccaaatggaaaagtatttgatagctctgtcgagcgcggacaacctgtagaattccaacttgatcaagtaattaaaggctggactgaaggtcttcaattagtgaaaaaaggcggaaaaattcaattagttattgcacctgaattaggctatggcgaacaaggtgctggcgcatctattccaccaaattcaacattaatttttgatgtggaagtattagacgtcaatccgaaatctgaaaaataa

SEQ ID NO: 1406 - DNA, 666 bp, H. influenzae strain 86-028NP
atgacattaaacgataaatatcctttcactgatgaagatcaagctatcataaattcctacaaagcagtcgttgatggtgtcagcgcactgattggcgagcactgcgaaatagtgcttcattctctggaaaatattgaacattctgctatttgtattgccaacggacataacactaatcgacaagttggttcgccaattactgatcttgccttacgttcgctacgaaatatgcaaagcgaaagtgtttcaaaaccttattttacacgagcaaaaggcagcgtactgatgaaatcagttactatcgctattcgtaataaaactcaacgtattattggtttgctttgcatcaatatcaatttagatgtacccatgtctcaatttttgcaatgctttatgccaacggagcatacgaatgaaacatcttcagtgaactttgcgaattcagtggaagacttggttgcgcagactattgaaaaaacaatagaagaagtcaatgcggatcgcgctgttgccaataatactaaaaaccgacaaatcgtcctttctctttacgaaaaaggtatttttgatattaaagatgcgattaatttagtcgctgaacgtttagatatttcccgacatacggtttacctgtacatccgtcaaatcaaacaagagcaagaataa

SEQ ID NO: 1407 - DNA, 381 bp, H. influenzae strain 86-028NP
atgcgctatgttatcgccgtcaaaagccctatttacggaaagcaaggggcatttttagcttatcaatttgcaaatgccttaatcaaaaaaggacacgaaatctcacagatttttttcttccaagatggagtgagtaacggaaatgcattagtgtatccagccaatgatgaagttaatttacaaaaacattggcaaatgttttccatcacccacaatgttcctttacatttatgtgttgcagcatctcaacgacgaggtgttgttgataacttaactacaccaactacagctcactacaatcttgcagaaggatttataattgcaggtcttggagaatttatagcagcaagtttaaacgcagatcgagtaataaccctatga

SEQ ID NO: 1408 - DNA, 360 bp, H. influenzae strain 86-028NP
atgaagatagcctttttatttcgcacatctccacatggcacatccatttcacgagaaggcttagatgcaattcttgccgcgacagctttttgtgaacccaatgatattgggatattttttatcgatgatggcgtattaaatcttatcgataaccaacaacccgaaatcattcaacaaaaagatttcattagagcctttaaattattagatttatatgatgtagaacaacgctttatctgcacagcgtctttgcagaaatttaaattagataatagagaacttatcctatcttgtgaaaaaattgaccgctctttattgctagaaaagcttaatcaagcagaaaaattgtttactttctaa

SEQ ID NO: 1409 - DNA, 288 bp, H. influenzae strain 86-028NP
atgctttatacattttctcaatcagattatcccaaaactgaactagatgactatttttcatatattacagaaaaagatgcggtagtactatggcaagacggtgtgttattggcaataaaatatcctgattattttgccaaatgtaaagggaattgcatgatattaaaacaagatattttagcaagaaatctcaccgcacttttacctcaaagtagcaagataaaattaatatcaatagaagaacttgttggaatcactgaaaattatttaccacagctatcactataa

SEQ ID NO: 1410 - DNA, 1185 bp, H. influenzae strain 86-028NP
atgtctaaagaaaaatttgaacgtacaaaaccgcacgtaaacgtgggtacaatcggccacgttgaccacggtaaaacaactttaacagcagcaattacaaccgtattagcaaaacattacggtggtgcagcgcgtgcatttgaccaaattgataacgcaccagaagaaaaagcgcgtggtattaccatcaacacttcacacgttgaatacgatacaccgactcgccactacgcacacgtagactgtccgggacacgccgactatgttaaaaatatgattactggtgcggcacaaatggatggtgctattttagtagtagcagcaacagatggtcctatgccacaaactcgtgaacacatcttattaggtcgccaagtaggtgtaccatacatcatcgtattcttaaacaaatgcgatatggtagatgatgaagagttattagaattagtagaaatggaagtgcgtgaacttctatctcaatatgacttcccaggtgacgacacgccaatcgtacgtggttcagcattacaagcattgaacggcgtagcagaatgggaagaaaaaatcctagaattagcaggtcacttagatacttatattccagaaccagaacgtgcgattgaccaaccgttccttcttccaatcgaagatgtgttctcaatctcaggtcgtggtactgtagtaacaggtcgtgtagaacgtggtatcatccgtacaggtgatgaagtagaaatcgtcggtatcaaagatacagcgaaaactactgtaactggtgttgaaatgttccgtaaattacttgacgaaggtcgtgcaggtgaaaacatcggtgcattattacgtggtaccaaacgtgaagaaatcgaacgtggtcaagtattagcgaaaccaggttcaatcacaccacacactgacttcgaatcagaagtgtacgtattatcaaaagatgaaggtggtcgtcatactccattcttcaaaggttaccgtccacaattctatttccgtacaacagacgtgactggtactatcgaattaccagaaggcgtggaaatggtaatgccaggcgataacatcaagatgacagtaagcttaatccacccaatcgcgatggatcaaggtttacgtttcgcaatccgtgaaggtggccgtacagtaggtgctggcgttgttgcgaaaatcatcaaataa

SEQ ID NO: 1411 - DNA, 924 bp, H. influenzae strain 86-028NP
atgaatctaaccccttttttaagttttaaccgcaaacaatgggcagaattgcgtaaatctgtccccctaaaacttacagaacaagatcttaaaccgcttttaggttttaatgaagagctatctttggatgaagtcagtatgatttatttaccattagctcgtttaattaattattacattgacgaaaaccttcgcagacaagctgttttacaccgttttttagggcgtaataaaacaaaagtaccttatatcattagcattgcaggtagcgtagcggtagggaaaagcacttcagcacgaatactccaatcacttctttcccattggccagcggagcgcaaagtagatcttataactactgatggttttttatatccattagaaaaactaaaaaaagatcatcttttacacaaaaaaggtttccctatttcttatgatacgcccaaacttattcattttttagctgatgtgaaatctggcaaaactgaggtggaagcaccaatctattcgcatttaacctatgatattattcctgataaatttaatgtgataaataaacctgacattcttattttagagggcttgaatgtacttcaaacaggtaataataaaaccaatcaaacattcgtatcagattttgttgatttctctatttatgttgatgcagaagaaaaattattgaaagaatggtatatcaaacggtttctgaaattccgcgaaagcgcattcaacgatcctaattcttactttaaacattatgccaatttatcgaaagaagaatccattaccaccgctagtaaaatttgggatgaaattaacgggttaaaccttaatcaaaatattcttccaactcgtgagcgagcaaatctaattctaaaaaaaggtcacaatcaccaagtagaattaataaaattaagaaaataa

SEQ ID NO: 1412 - DNA, 948 bp, H. influenzae strain 86-028NP
atgaaaaaaatcgcattaaaatttaccgcactttctctttctttgctattaagtagcattgcttctgctgaagagctttctgcgaagcagtctttagataaaatgacacaagcattggataatctcaattatgaaattgcctttgtgcaaactactccagcaaatatggattcatttcgttatcgacatatcaaacaagataacaaaacctacgcacaattagttactttagatggtcgccagcaagaaattattcaacgtgataatttagtcagttattttcagccaaatgctcaagcatttacgcttaatagtggcaatatagttgatgcgatgcctgcggttgtgcgtgcaaattttgataagctttcttctgattatgatttcgtaaaattaggtaaagatcgcgttgctgggcgtttcgctgatacgattagaattgttcctaaagatgattttcggtatcaatatttggtgtttatcgatgaagaaaatggcttgttattacgcagtgatatgcttgatcgcgaaggcaagctacttgatcaatttagagttgtaacactttacatcgatgacagattgagaggattaacggattatattaacaaggtatcattgccccctttattgaaagaaagtaaaaatgaacaaagttcagatataacttggtctgcaggttggttgccacaaggtttttctttaattcgatatactcaagaaatattagaaaatgaaatcatagatagcgcattatatagtgatggcttatttacttttacgttgtttgtctctaatgtaagctctaatgacctaccagaaaatacttggaaacaaggggcttatacgatttatagcgaggtcatcggaggaaaagaaattacttttattgggcaattaccaatctcgacggcaaaacgcattgtacaagaagtcaaatttagataa

SEQ ID NO: 1413 - DNA, 576 bp, H. influenzae strain 86-028NP
atgcaaaaagagcagctttcagcctatatggatggcgaacaagtcaaaactgacttgacagatgctttattaagagacgaagaattacaagcgtcttggcattcatttcataccgttcgttcagtaatgcgtaaagaaagtgcggtctttttagggggggattttaccgctaaaatggcagatttgattgagttagaagacgtgaagaaagtcgatgtcattgcggtgtctcaacctgaaccagaagatgcacataattctgcatttatgcaaaaattaaaggcattttttgcgccaatgacgcaagttgctgttgctgctggtgtatgtttagtggcagtacttggtgttcaatctttcaatagtaaaaacgaagcgtctaatttacctgaggctccagtattgcaaaccttgccatttaataatgcggttcaagaggttagctataatgcgccaagtaaagatacattgacttcagatcagcttgagaaaaaaagtcgtcgtattggtgcaatgttgcaaaactatgaattgcaacgtcgtatgcactctgatgctagcagtcaagtaagataa

SEQ ID NO: 1414 - DNA, 570 bp, H. influenzae strain 86-028NP
atggctgaacagctaacagatcaggctttggtagaaagagtgcagcaaggggataagaaagccttcaatttgttggtttcgcgttatcagaataaagtggcggggcttttgactcgctatgtatcacgtaacgatattcctgatgtggtgcaagaatcctttataaaagcttatcgctcaattgaatcttttcgtggcgaaagtgctttctatacatggctttatcgaattgccgttaatacggcaaaaaattatttaacggctcaaggtcgccgtccaccaaatgaagatattttggcagaagatgctgaaaattatgatgtgggtacgcacttgcgggatgtggatacacccgaaaatgaaatgttgtctagtgagttagaaagaattgtttttgatactattcataacttaccagaagatttaaaaaccgcgattacgttacgagagctagaaggtttaagttacgaagagattgcagaaattatggattgtcctgttggtacggttcgttcccgaatcttccgagcaagggaaatgatcgaaaataaaattcaacctctaatgtag

SEQ ID NO: 1415 - DNA, 258 bp, H. influenzae strain 86-028NP
atggaaaaatataataaacttcgcattgaatgggattgtcgccgaggaatgttagagttagataaaatcataatgcctttttatttgaagcattttgatgaattaacagatgacaaaaaagatatatttattcgtttattagcaagtacagatctgcagctgttttcttggttttttaatcgtggtaaatcatcagattcagaaattcaatctatggtagagtatatccaaaacgtacaaaaaatcacaactaattaa

SEQ ID NO: 1416 - DNA, 387 bp, H. influenzae strain 86-028NP
atgaattttattaaagaatttcgcgaatttgcaatgcgtggcaatgtcgtagatatggctatcggtgtgattattggtagcgcatttggcaagatcgtaagttcacttgttagtgatatttttacgcccgtgttggggattttaactggtggtattgatttcaaagacatgaaatttgtattagcacaagcacaaggcgatgttcctgctgttactttaaattatggtttgtttattcaaaatgtgattgattttattattattgcttttgcaatctttatgatgatcaaagtaatcaataaggtaagaaaaccagaggagaaaaaaactgcaccaaaggcagaaacattgcttactgaaatccgtgatttattaaagaataaataa

SEQ ID NO: 1417 - DNA, 1377 bp, H. influenzae strain 86-028NP
atgaaaatcatcattttgggtgcaggtcaggtaggaacgacgcttgcagaaaacttagtcagtgaagataacgatattaccttagtggataatgaatctcctcagttacaaacattgcaagaaaagcacgatttgcgtgtggtacaaggctctccatcatctccaaaagtgcttcgtgacgcaggcgcggcagatgccgatttaatggttgccgtgacagcctccgatgaaatcaatatggtcgcttgccaaatgggctatacattatttaatacgccaacgcgaattgcacgtatccgtaattcagaatatttacgtgaaaaagacaagttgttcaacaatgaaaatatacctattgatcatttaatttcgcctgaaaatcttgtcactgatgaaattacgcgtttaattgcttatccaggcgcattacaagttgcccattttgccaataatcgtattagtattgttgtagtgaaagcttattatgggggggctttggttggatatgcactttccgcatttcgcgaacatatgccacatattgattgtcgtattatgtctattttacgtaatggcaaaccgattcgtccacaaggctcaaccattgtagaagctggcgatgaaatcacgtttatttgcgctactgaacatattaaggcggtaatgggagagttacaacgtttggagaaaccttataagcgagtaatgattgttggtggaggaaatgttgcttttggcgtagcaaaacgtttggaaaattcttgtactgtaaagcttattgaacgagattcaaacagagcgcaagccttagcagaaaagttgccaaaaacgttagtatttaatggagatgcctcagaccaaaacttgctttttgaagaacatattgaaagtgtggatgtatttctttcattaagtagcgacgatgaagcgaatattatgtcagctttgttagccaagcgtttaggtgcgaaaaaagcaatggtactgattcaacggattgcttatattaatcttattcagggaggcacgattgatattgcggtttctccacaacaagtaacgatttctgctttgttaggtcacgtgcgtaaaggcgatgtaaaaaatgtggcaacattacgacatggcattgccgaagccattgaaattgttgcacacggtaatgtgaatacttcaaatatagtagggcgaaaaattggtgagttgcgtttgccgatgggaaccattattggtgctttattacgagggaatgatgtaattattgctcgtcgtcaagtgattattgaagaaggcgatcatatagtgatttatttaagtgataagaaaaatgtgccagaaattgagaaattattccaaccaagcgcattctttatttag

SEQ ID NO: 1418 - DNA, 1353 bp, H. influenzae strain 86-028NP
atgaaaaaattttcttctaaaactatcaaagtaaaaaattcagtaaaaatgaccgcactttcgaccagggctattgcagcaaacttaattttgcaagcattggatgaaggtaaatccttgtcggcgttaattccagaagtgcaactttctgtaaaagcccaagatttgcccttgctacaagaaatttgttttggcgtgtgtcgagtattgcctcgcttagagcaaattatcaaacgtcttgtggataagccgcttaaaggtaaaactcgcattgttcattgcctgttacttgtagggttataccaattgctttatatgcgagtgcctgctcatgcggcagttgatgaagttgtgaacgcaacaaaatcattaaaatctgatagttttagaggattagtgaatgcggttttgcgtagatttttacgtgaacaagatgaaattttggcaattatcgataaaaattggcaaacgcttcatcctgaatggttcgtgaataaattaaaaaaagcctatccgaattggcgtgagatcattgaggcgaacaatcagaaaccaccaatgtggctacgtgtgaattcacaaaaaaatgccctcgaaacttaccgcactttacttgaggaacaaggtatttctgcaaaaacaagtcaccatcctaatgcgctatgtttagatataccgattgcggtgcaaaaattaccgcactttgaagaaggtgctgtaacggtacaagatttgagtgcgcaatgggcggcaatgttgcttgagcctaaaaatgaggaatggatccttgatgcttgcgctgcacccggtggtaagacgacccatattttagaactggcacctcaagctaatgtgattgcattagatgtagaatctcatcgcttaaaacgagtagaagaaaatcttgcacgtttaaatcagcaagcgatagtggtttgcggcgatgcgagtaaacctgacgaatggttagctgaaattggtaaaagtgcggtgaaatttgaccgaattttacttgatgcaccttgttctgctacaggggtaattcgacgccaccccgatataaaatggttacgcaaagaaaccgatatcgctcagcttgtcgaattacagaagaaaatcctgagtgcactttgggaaaaactgaagccaaacggtgttttgctttatgcgacttgttctgtattgccagaagaaaattgcgaacaaatccaagcatttttaaatgctcacgcagatgcggagttattgccattacctgttagtgatgataaaagtgcggtgggttttcaattcattccgcaaccaaatagtggcgatgggttctattatgctaaattgcttaaacgagcataa

SEQ ID NO: 1419 - DNA, 957 bp, H. influenzae strain 86-028NP
atgaaatcacttaatattatttttgcgggtacgccagattttgctgcacagcatttacaagccattctaaattctcaacataacgtgatcgctgtttatacgcaatctgataaaccagctggtcgcggtaagaaattgcaagcaagtcctgtcaagcaacttgctgagcaaaataacattcccgtttatcaacctaaatccttacgtaaagaagaagcacagtctgaattaaaagcgttaaatgcagatgtaatggttgttgtcgcttatggattaattttaccgaaagctgtattagatgcccctcgtttaggttgtttgaatgtgcatggttctattcttccacgttggcgaggtgcagcaccaattcagcgttcaatttgggctggcgatgtacaaacgggtgtaaccattatgcaaatggatgaaggtttagatacaggcgatatgttacataaagtctattgtgatattttaccgactgaaacttcaacgagtctttataacaaactggcagagcttgctccatcagtattaatcgatgttttagataatcttgaaaacagtaaatttatagcggaaaaacaagatggcagccaaagtaattatgcagaaaaactttccaaagaagaggcacaattagattggtcacttcctgcaatgcaacttgagcgtaatatccgcgcttttaatccttggccaattgcctatttttcaacagaagacaaggatggcaatgcacaaactttaaaagtgtatcaagcggaagtgttgcctcatcaagataaaccagcgggaactattttaagtgcggataaaaatggcattcaaattgcgactgtcgatggcgtcttaaacttattgcaattacaacctgcaggtaaaaagcctatgtctgcacaagatttattaaatggccgtgcagaatggtttactattggtaaggtgcttgcataa

SEQ ID NO: 1420 - DNA, 510 bp, H. influenzae strain 86-028NP
atgaccgcacttaatgtattaatttatcctgatgatcacttaaaggttgtctgtgagcctgttactgaagttaatgatgcaattcgtaaaattgttgatgatatgtttgatacgatgtatcaagagaaaggtattggtttagctgcacctcaggtggatattttgcaacgtattattactattgatgttgaaggcgataaacagaatcagtttgttttgattaaccctgaaattttggcttcagaaggcgaaacgggaattgaagaggggtgtttatccattccagggttccgtgcgttggttcctcgtaaagaaaaagtgacagtgagagcgttagatcgtgatggtaaagaatttactttagatgcggatggtttgcttgcgatctgtattcagcacgagatcgatcatcttaatggaattttatttgttgattatctttctccacttaaacgccaacgtattaaagaaaagttgattaaatacaagaagcagattgcgaaaagctaa

SEQ ID NO: 1421 - DNA, 438 bp, H. influenzae strain 86-028NP
atggagggggaatttatgagtaatttctttaattctttattttctgataaaggagaaattaaaggtattgataatcaatattctgtatctgaaatcgtagatattcttaaggaagaaggttattctattaatgtaatacaagataattttttggtgtttagattacaaggtacgaatgttgtagttgttccccatgatggaggtgatattcaattttttatcatgtatgacgatgatgagaaccgcttttcattaagaaaagtgaataaaataaatattgattatagactcggaaaattttatttaacagatgatgataaattaggaatcgagcttcttttgcgcaatgatggtaatggtgtaactaagtctcaaattattcaaggactatcagatatttctttattaaatggattagctaagaaagaattttggtaa

SEQ ID NO: 1422 - DNA, 186 bp, H. influenzae strain 86-028NP
atgcttatcccaatttttgaaaatggtaagaaaatatatcaagatagctctggtaataagtaccagtatgatttaaccaattcaatggatcaattctcttattctacagatctcagtgcacaaatgcgtgataaatcatctattacggcaacacgaaatccaaatggagggggaatttatgagtaa

SEQ ID NO: 1423 - DNA, 654 bp, H. influenzae strain 86-028NP
atgaatataaaggatgagcatatagatagcgtttgctccttgttagatcagttagtaggaaatgtttcctttaaaaatctttttactggttacggtttgtttcacaaggaagagacaatgtttgctatttggcaaaataaaaaactttatttacgcggtgagggtgttctcgcaattcaattaactaaattaggttgtgaaccttttacaacgaatgaattgaataaacggtttgtgctttcacaatattatgcactttctgatcagattttacgtagtaatagattgtgtagaaaattgattattctttctattaagcagattcttgagcggaagctagaatgtacgttaagaaaattgaatcgattaaaggatttacccaatttaacgattaaacatgaaagagctttaataaaagttggtattacaaatgttgcgatgctaagagagattggcgcagaaaatgcattggtggaattaaagaaaagtggcagtggtgctacgcttgatttttattggaaattagtatgtgctttgcaaaataaaaatagtcagatgttaagtcaagctgaaaaagagcgtttattgaagaaattaaacgaagttttgagaaaaaatggcttaaaaggctatagaaaattagatgatgaataa

SEQ ID NO: 1424 - DNA, 1065 bp, H. influenzae strain 86-028NP
atggcaactcaagaagaaaaacaaaaagccctagcggctgcactagggcaaatcgaaaaacaatttggtaaaggctcaattatgaaattaggcgataccaaaacgttggatgtagagtctatttctactggatcacttgggttagatgttgcgcttgggattggtggtttgcctatgggtcgaattgtagaaattttcgggcctgaatcatcgggtaaaacaacattaactctttccgtcattgctcaagcgcaaaaagcaggaaaaacctgtgcatttattgatgcagaacacgcacttgatcctatttatgcagcaaaacttggtgtagatgtaaaagaactttttgtttctcaaccagataatggggaacaggcacttgaaatctgtgatgcattagttcgctcaggtgcaattgatgtaattattgtggactccgttgccgcactgacaccaaaagctgaaattgaaggcgatatgggcgattctcatatgggtctgcaagcacgtttaatgtctcaagctttgcgtaaactcacaggtcaaattaaaaatgcaaactgtctagttgtgtttattaaccaaatccgtatgaaaataggcgtgatgtttggtaatcctgaaaccaccacaggcggtaatgcattaaaattctattcttctgttcgcttagatattcgccgtacaggttctgtaaaagatggcgaaaatattattggaaatgaaactcgcgtaaaagtagtgaaaaacaaattagcggcaccgttccgccaagtggatttccaaattctctatggagaaggcatttcaaaagcaggagaattattagaacttggtgtaaaacacaaacttgtagaaaaatcaggcgcatggtattcctataatggcgaaaaaattggtcaaggaaaggctaattcaatgaaatggcttaacgaaaatatagagaaatcagatgaattagaagctcgtttacgtgctgaattagtggccaatccagaacaagccttaatggcggatattgaacaatctgaaaataatactgaatcagaaagtgattttgaataa

SEQ ID NO: 1425 - DNA, 459 bp, H. influenzae strain 86-028NP
ttgtcatctcttgcttttaattacatagttaatcttctttcccgcagagaatatagtgaattcgagctccgcaataaaatgcaggaaaagaacttttcggaagaagaaattgatgatgcattatctttatgccaagcaaaaaattggcaaagcgatcgtcgtttttcagaaaattatctaaattcacgctcacaaaaaggttgtggtgtaggaagaattcgacaagaattacgccaattaaaaggtgtgtcttctgatattattgatgaagttttaatggaatcagaaattgattggtatgaaatggctgagaacttgttacgtaaaaaattcccaaattataacgaacagcaaacgtctaaaatgaaacaaaaaatttggcaatatatgctatcacacggatttcgtagcgatgaatttgctgatttaattgggcaaaaccaaagtgaatgggattaa

SEQ ID NO: 1426 - DNA, 387 bp, H. influenzae strain 86-028NP
atgcaggcattattattcataagttatggtgcaatattaggcgcgtcattgcgttgggctataggattgttatttaatcctttattttcctcatttgcttttgggactttaatcgctaatttgcttggttgtttaattattggtgtattacttgggtttttttggcaatttccacaaattagttctgaatggcggttatttttaattacgggttttttaggatcgctaaccacattttcgtctttttcttccgaagttgtggaattattttttaatgacaagtggttaaatggattttgtgtattaatgatgcatttattcggatgtttagctatgactgtgttaggcatttggatatataaaatttgttctcaacttttatcttaa

SEQ ID NO: 1427 - DNA, 819 bp, H. influenzae strain 86-028NP
atgaatttaccttttcgagcaatggtgtctgatttagatggcacgcttttaacacctgaacatttagtgggtgatcttaccattgatacgctgagagcattagagcaaaaaggcgtagatattattttggcaacaggacgcaatcataccgatgtgtcatccattcttggaaaaattggtgcggaacgtgcggttatgattacatcaaacggtgctcgtgtacgggatttacagggtaatttgctttatagcaatagtttgcctgaagaattagttcttgagctttacaaaacgccatttgatacttccaaagtatgcatgaatagctatcaagatgaaggttggtttactaataaagatattcctgcaatgcgtcagttccataaagaatctggattcgattataacgttgtcgatttttctaaacatcatggacgtgggacagaaaaagtcttttttattggtaaaactccagaggatttagttgcagtagaaacttatttacgagataagtttggtgacgtaacgacaattgtttattcagcattagcttgtttggaagtaatgaataagaatgtttcaaaaggggatgcattaaaacatttactcgaatcacgcgagtatcagttaaaagactgtattgcttttggtgatggaatgaatgatgtagaaatgctttcttgggctggaacaggttgcattatgaaagatgctgatattcgtttaaaaatggcttgtccagagttagaagttattggctcaaataaagaagaatcagtcgctcgttatttgcgaaccctatttggattagattattaa

SEQ ID NO: 1428 - DNA, 1005 bp, H. influenzae strain 86-028NP; identical to SEQ ID NO: 625

SEQ ID NO: 1429 - DNA, 933 bp, H. influenzae strain 86-028NP
atgagaatagtgattgcattaggcggtaatgcattattacgacgcggagaaccaatgacagccgaaaatcaacgacaaaatgttcgcattgcttgtgagcaaattgctaagatttggccaaataatgaattagtgatagcacacggtaatggcccacaagtgggtttgctcgccttacaaggtgctgcctatactgatgtgccaacctatcctttagatgtattgggagcagaaacagctggaatgattggttatatgattcaacaagaactcggtaatttagttccatttgaagtgccatttgcaacgttattatctcaagtagaagttgatatcaacgacccagctttcaaaaatccaactaagccaataggtcctgtttatacaaaagaagaagctgaacgtttggcaaaagaaaaaaattggtctatcgcacaagatggtgataaatatcgtcgcgttgtgccaagcccattaccaaaacgtatttttgaaattcgtccggtcaaatggttgcttgaaaaaggcagtatcgtaatttgtgcggggggcggtggcattccaacctattatgatgaacaccataatttacaaggtgttgaagccgttatcgacaaagatttatgttcagctttacttgcagaaaatcttgacgctgatttattcatcatcgcaactgatgtttccgcaactttcgtagattggggtaaacctaatcaaaaagcaatttcagttgcctcacctgaagccatttcagaacttggtttcgcttcaggttccatggggccgaaagtacaagccgcgatcaactttgcgaaacaaacaggaaaagatgcagtaataggatctttatctgatattgtggacattgtgaaaggcaaagctggtactcgtattacgaaaaaagctgaaggcatatcctattatgcttaa

SEQ ID NO: 1430 - DNA, 1530 bp, H. influenzae strain 86-028NP
atggatgcgtccaaaaagaagaaaacgtttaatttcccatcagcgtttacaattttatttgcaatcttaattctcgctgttggattaacctgggttattccatccggttcatattcaaaattaacatataactctactgataatgtttttgtcgtcaaagcttatggcgttgatgataaaacttatcccgccacaacagacactcttgataatctcaatatcaaaattaaactctccaacttcaccgaaggcgtgatcaaaaaaccaatcgctattcctggcacttatcaacgtgtagaacaacaccataaaggcattgaagatatcaccaaaagtatggtagaaggtaccattgaagccgttgatgttatggtctttatctttgtattaggtggtatgattggtgtcattaaccgtactggttcttttaatgctggtttgatggctctcgtgaagaaaaccaaaggcaatgagttttttattgtattctgcgtatccgtcttaatggtgttaggcggcacaacctgtggtatcgaagaagaagcagtggcattttacccgattctggtgccagtattcttggctctgggatatgatgcgatagtctgcgtaggggctatattccttgctgcatctatgggaactgcattctctacaattaacccattctccgttgttatcgcatcaaatgcggctggtattcaatttactgaaggtattggtttccgtgctctaggtttagttttaggggcaacttgcgtaatcgcatatctttattggtactgtaaaaaaatcaaagctgacccaagcttttcttatacttacgacgatcgcgaagaattccgtcaacgttatatgaaaaactttgatccaaacacaactatcccattctcagctcgtcgcaaattaatcttaacgcttttctgcatctcattccctattatgatttggggtgtaatggttggcggatggtggttccctcaaatggctgcatctttccttgccattactatcatcattatgtttattagtggcttgtctgaaaaagatgttgtggaatctttcactgaaggtgcatcagaattagtaggcgtatccttaatcatcggtcttgctcgtggcgtgaacttagtgctcgaacaaggtatgatttctgacactatccttgattatatgtctaatgtggttagtggtatgccgggtagcgtatttatcttaggccaattagtcgtatttattttcctaggtttaatagtgccgtcttcttctggcttagccgtactttcaatgccaattatggcgccacttgctgactcagtgggtattccacgcgatatcgtggtttcagcttacaactggggacaatatgcaatgctattcttggcaccgacaggattagttttggtgacactccaaatgttgcatattccatttgatagatgggttaaattcgtcatgccaatgattggatgcttattgctaattggttccattttattggtagtacaagtatctttatatagtgtttaa

SEQ ID NO: 1431 - DNA, 3155 bp, H. influenzae strain 86-028NP
atgaccaattttagattaaacgtgcttgcctattccgttatgcttgggctaacggcaagtgttgcttatgcagagccaaccaaccaaccaaccaaccaaccaaccaaccaaccaaccaaccaaccaaccaaccaaccaaccaaaatagtaatgcttctgaacaactagaacaaataaatgtatctggctctaccgaaaatactgatacgaaaactccgccaaaaattgccgaaactgtaaaaacggctaaaacgctagaaagagaacaagcaaacaacattaaagacatcgttaaatacgagactggcgttactgttgttgaagctgggcgttttggtcaaagcggttttgcgattagaggggtagatgaaaatcgtgttgcaattacggttgatggcgttgctcaagcagaaacattatcttcccaaggttttaaagacctgtttgaaggatatggtaattttaataacacgcgtaatggaattgaaattgaaactttatctgatgccaaaattaccaaaggtgcagattctctcatgtctggtagtggtgcattgggtggctccgtcatctataaaactaaagatgcaagagatcttctgcttaacaaaaactacgcgtttaaatataaaactggttttaccagcgagaatgatgaaagattaaattctattacttttgcaggaaaagcaagtatattcgatgtacttgctgtcggcacttggcgtaatggtcatgaaatcaaaaattatgattacaaatctgcagacgacattctaggaaaactcagagaaaagaccgatccttataataaaaaagaccgcagtcttttattgaaaattggtacaaatcttggtgaaaataatcgcattgccgtagcctatgatagaagacgggttgaaaataaaggtctagacaaatcttactcattacatggatgcacgaaatatgtttgtgatgataatgaaatagatactcgccatactcatgatgaaagcattagaaccagtaaatctatagcatttgaaaatacaaatataaacccactttgggataccctaaaactctcttatacagatcaaagtattactcaacgagcaagaagtgacgaacattgtgatggtgaacggtgtcctggggtacaaaaccccataggactacattataacaacgataataaacttgttgataaaaataataatcctgtaacctataaattagaaaatcgttctgtaacatactattcttacattgatgaatctatctttaatcgatacagtaactttaaagaagaagttcctgtagaactcgctaaggaatggaaacttaaagaatatggtggaaaatattatattgactcgcctcgctgctttaaaaatcacggtgatgctaatcacgaggggatgtgtagactaagatctgatgtaaaagaggaaaaggaaacattagtagctaataacatcacttatgatttaaaaaaggagtattttattaactcaaggctcacgaatagtgataatttattatcttgtgatggaattaactgtgataaaggtacaattcaaggtttcgaagctgatggaacgcctaaggatttaccaataaaaataatcccaaaagaaggtaaaaaatttgcacttattgaaaaaatttcagatcaaaatggctacaatattggcccagagaaagcatctcgttttctagtacctaattcacctggttataatagaaacatttggaaaaaacgtgaccttgatactcgtactcaacaaattaatttggatttaacaaaacattttgaactaggaaaaagccaacatgatttatcttatggtttagtttggagtaaaacaacaaaatcaatgataaataaagaagggttaaaagttaatagtggaaaatggtggattgattatccaaaagactgtgaatctagtacatcagatttatgtacaaaaaatagtacagcatcatttcttattcctgtagaaacaaaagatggttctctctattttaaagatgaatttagagtaaatgatcgtcttggcttagatatcggttatcgatatgacaaagtcaaatacaaaaccaattatcaaccgggtataacgccaaaaatccctgatgatatgttagttaatttatttataaaagaaccttttgtaaaaaacacacggagtctaaaccctaatgatccaaatgaaattaatcgacgaaaaaatgcagaagctaatattaattatatttctcaacccaaaaaatttaatgcgagttcttatgctttaagcacaaaattcgatccattggattggttacaagttcaagcaaaatatagcaaaggtttcagagcaccaacagctgatgaattatacttcacattcaagcacccagaatttactgttcttccaggctctaaattaaaacctgaaattgcaaaaactaaggaattatcattaactttacatgatgatgaaatcggttttatttctggtggatatttcatcacaaattataataattttattgattttagttatctaggaacaaaatcatttggttctcaagcaactaagcatgaattatatcaatctgttaatttagataatgctaaagtgacaggatttgaattgaaaaccaaatttacattaggaaaatggatatcatggttgaagaatgttgattttggttaccaattaactaaacaaaaaggtaaagcaagcgataaccgcccacttaatgctattcagccaatgacacaagtgatgagtttagcctatacgcatcctgataatctgtttggggcaaatttatatcttactcatgtttcccaaaaagaagcgagtgacacatataacatttattcaaaagatgctacagcaggagataaagaatatgttcaaaataaacatattaaatggcgtagtaaagcttacacagtgacagattttactttcttcgtgaaacctatgaagaatttaactttacgagcgggtgtttacaatttatttgacaaaaaatatatgacttgggattctgctcgttcaattcgtatgtttggtacaagtaatttgattaatcaagaaacaggtgcaggtattaatcgtttctatgctccaggcaaaaactatagaatgtcagttcagtttgaattctaa

SEQ ID NO: 1432 - DNA, 705 bp, H. influenzae strain 86-028NP
atgaaaaatatgttactgctcagtagctcaaaatacaagaacacaggttatcttgaacacaccctaccttggttacaaaatttcttggctgattatcgtggtaaaacaattgcttttgtaccttatgctggggtaagccgcacttttgatgaatatgaaaaaactgtgcaaaatgcactttccgatttagggatgaatattgtttccgttcatcatggtaaacagcatcgggatattattgaacaagcagatgtcatctctattggcggtggaaatacattttgtttgttaaaacagctttatgaacacaatttgattgatatcattcgtgaaaaagtaaataacggtacgccttattttggttggagtgctggggcaaatgtagctggcgcatctattatgacaactaatgatatgccgattacttatcctccttcatttcaagcattacaactttttcctcatcaaattaatccgcactttatttcaggtaaaatgcaaggccacaatggtgaaagccgagaagaacgtttggcagaatttttactcgttaatccaaccgcacttgtatatgcattacctgaaggttctgcgcttcatatacaaaatgaaatggcaactgtattgggcgaaaatcctattttgtgcttcagtgaaaatatggaatgtggcacatttgatatcaatacaactttttcttattaa

SEQ ID NO: 1433 - DNA, 1296 bp, H. influenzae strain 86-028NP
atggaattatttaaatccatcgttgcagtgattggcattattgccacaatttattttctgattaaaaaagccgaaacccgaaccgttttgattggtgtcggtttaataatgtccattctaacgcttaatccaatgggtgcattagatgcttttgccaaaagcatgacatctggcggattaattatggctatctgttctagtatgggttttgcttatgtaatgaaatacactcaatgtgatactcatctagtgcatttacttaccaaaccattaagcggattaaaattcttcttaattccaattgcaacagtcattacctttttcatcaatattgctattccttctgctgctggttgtgctgctgcggttggcgcaacattaattcccgttttaaaaagtgcgggtgttcgaccagctactgctggtgcagctattttagcagggacttttggatcaatgatgagtccgggttcttctcactcagcaatgattagtgaaatgtcaggattaactatcactcaagtaaacctttcacatgctccatataacatgattgcgggagcaataggtgctgttgttttaaccattcttgcgcttgtttttaaagattatggtgaacaacatcgccaagcttatcttgcagaacaaaaagaaagtgaaattaaagttgttgaaggcgtcaatgtactttatgcccttgcaccattaataccattagttattttagtgattggtggaacatcattacaacaagtaccgggtcttgaatggactaaaatgggcgttcctcaagcgatgctaattggtgcaatttacggcattatcgtcactcgtatttccccagtaaaaatcactgaagaatttttcaatggtatgggaaattcttatgcaaacgtacttggtattatcattgcagccagtgtatttgtggcaggattaaaatctacgggcgcagtggatgctgcaatttctttcttaaaagaatccaacgaatttgtacgttggggtgcaacaattggaccattcttaatgggcttaattacaggctctggcgatgcagcagcgattgcctttaacactgccgtcacgccacatgctgtagaactcggctacacccatataaatcttggtatggcagcagccattgctggtgcaattggtcgtacagcttcaccaattgcaggcgtaactattgtttgtgcaggccttgcgatggtaagcccagtagaaatggtaaaacgtaccgcaccaggcatgatacttgctgttttattcttagcattatttatgttgtag

SEQ ID NO: 1434 - DNA, 1272 bp, H. influenzae strain 86-028NP
atgaacttagatttaaatcaacttgttaaatggcgtcgtgaatttcatcgttttccagaaattggctggagtgaattttggacaacttctcgcattgcggattacttggaagacttagattgttttgaaatttttcttggcaaacaaattataaatccagactttgttcgtggacgaaaacaagccgtagtagataaaggcttagctaatgcaaaagcctatggagccaatgaaaaatggctcgaaaaaatggaagggtacactggttgtgtggcattatttgattcaggtaaaccagggaaaactattgcattacgttttgacatagactgtgtgaatgtaacggaaactcgctcaccagagcatattccaaataaagaaggttttgcctcaattaacgatggttttatgcatgcttgtggacatgattcacacattacaataggtttaggtgttgcattatggatcgctcagaacaaagataaactcactggaaaagtaaaaattgtatttcaaccagcagaagaaggtgttcgtggtgcagctgccattgcacaaagtggcataattgatgatgcagattattttgcttcttcacacattagtttttgcgcaaatacaggcactgttattgctaatccaagaaattttctttccactacaaaaattgatattcgctataaaggtaaacctgcgcacgcaggtgctgcgccccatttaggtcgtaatgctttattagctgcagcgcatacagtcactcaacttcatggtattgcacgccatggtgaaggcatgacaagaattaatgtgggtgtgctaaaagcgggtgaaggacgaaatgtcattccatcctctgctgaattacaattagaagtgcggggagaaaataaagcaattaatgaatacatgactgaacaagtcatgcaaatagccaaaggtatctccataagttttgatgtcgcatatgaaactgaaattgtaggtgaagcagtggatatgaataacgatgttgaacttataaaactcatcgaagaaatatctcttaaacaaccacaaataaataacgtaaattcagattatgctttcaatgcaagtgaagatgcgactattttaggtagacgtgtacaagaacatggaggcaaagctatttacttcattcttggcgcagatcgcacagcaggtcatcacgaagctgaatttgattttgatgaaaatcaattacttactggggttaatatttatacttccttagtacagaaattattatcttaa

SEQ ID NO: 1435 - DNA, 1974 bp, H. influenzae strain 86-028NP; identical to SEQ ID NO: 686

SEQ ID NO: 1436 - DNA, 408 bp, H. influenzae strain 86-028NP
ttgcttgaggaaataatgaaaattaatgaattaagtaaatctacacatactaatattgaaactattcgctactatgagaaacaaggagtattacctccacctaagcgattggctaatggttatcgattttatgatgaagagagtatagagcaattaaactttattaaaaaatgtcgaatgttgggcttctctttagagaatattcgggaactcaatcgtattagatttagtacgaaagatcattatcaagcagatcaattagtacttaatcagcttattcaagtagaaaataaaatatctcaattattagaaattaaagcttttttgcagtctattgttaccgaaaatgaacataatgaagaagaatgtaaagcaatagaagggttgaaaagcgaatgcaatttgtaa

SEQ ID NO: 1437 - DNA, 678 bp, H. influenzae strain 86-028NP; identical to SEQ ID NO: 716

SEQ ID NO: 1438 - DNA, 1890 bp, H. influenzae strain 86-028NP
atgttttacactgaaacttatgatgtgattgtgatcggtggtggccatgcgggtacagaagctgcgcttgcaccagctcgaatgggattaaaaacccttttattaacacataatgtagatactttagggcaaatgtcttgtaatcctgcaattggtgggatcggtaaaggtcatttagtaaaagaagtagatgctatgggtggtttgatggcgcatgctgcagataaagcaggaattcaatttcgtactttaaatagtagtaaaggtccagcagtacgtgctactcgagctcaagctgacagagttttatatcgtcaagctgttcgtacagcattagaaaatcaacctaatttagatattttccaacaagaagcgacagatattctaattgagcaagatcgagttacaggcgttagcacaaaaatgggattaatttttcgtgctaaatcagtggtattaactgcaggtactttcttagccggtaaaattcatattggtttggaaaattatgaaggtggtcgtgctggagatcctgcttctgtaaatctttcatatcgattaagagatctcggattacgtgtagatcgccttaaaacaggtacaccaccacgtattgatgcacgcacgatcaattttgatattttagctaaacagcatggtgatgcggtgttacctgtattttcttttatgggatcggtatctgatcacccgcaacaaattccttgttatattactcacaccaatgaacaaactcatgaagtaatccgtaataatttggatcgtagtccaatgtatactggtgtaattgaagggatcggtccacgttattgcccatctattgaagataaagtgatgcgttttgcggatcgtaattcacatcaaatctatttggaaccagaaggattaaccagtaacgaagtgtatccaaatgggatttctaccagtttgccgtttgacgtacaaatgggcattgtgaattccatgaaaggtttggaaaaagctcgcatcattaaaccgggttatgccattgaatatgattattttgatccacgtgatttaaaaccaacgttagaaacaaaagctatttcaggtttattcttcgcaggccaaattaacggtacaaccggttatgaagaagcagcggcacaaggcttattggcggggattaacgcaggtctttatgtacaagagaaagaggcatggtatccacgtcgtgatcaatcttatactggagtattggttgatgacctttgtacgctcggtacgaaagaaccgtatcgtgtattcacttctcgtgctgaataccgtttgttattacgtgaagacaatgcagatattcgtttaacgccaattgcccatgaattaggtttgattgatgaggctcgctgggcacgctttaatcaaaaaatggaaaagattgagcaagaacgccagcgcttacgcagcatttggctgcatccgcgttctgaatatttagaagaagccaataaagtgcttggcagtccacttgtgcgtgaagccagcggtgaagatttattacgccgtccagaaatgacctacgatattttgacttctttaacgccatacaagcccgcaatagaagatagagaagccgtagaacaagtggaaattgctattaagtatcaaggctatattgagcatcaacaagaagaaattgaaaaacaaaaacgccatgaaaatacggctattcctgctaattttgattatagtaaagtgtctggattatctaatgaagtacgtgcgaagttagaacaacatcgtccggtttccattggacaagcgagccgaatttcaggtataacgcctgctgctatttcaattattctggttaatttgaaaaaacaaggcatgctaaaacgtggggaataa

SEQ ID NO: 1439 - DNA, 375 bp, H. influenzae strain 86-028NP
atggcaactatcaaccagctagtacgcaaaccgcgtgtgaaaaaggttgtaaaaagcaacgttcctgcattagaggcttgcccgcagaaacgtggtgtatgtactcgtgtatatactacaactcctaaaaaaccaaactcagcgttacgtaaagtatgtcgtatccgcttaactaacggttttgaagtaacttcttatattggtggtgaaggtcacaaccttcaagagcacagtgttgtattaatccgtggtggtcgtgttaaagacttaccgggtgtgcgttaccacacagtacgcggtgcattagactgtgcaggcgttaaagatcgtaaacaaggtcgttctaaatacggcgttaaacgtcctaaagcttaa

SEQ ID NO: 1440 - DNA, 471 bp, H. influenzae strain 86-028NP
atgccacgtcgtcgtagtgttgaagcacgcaagattcttccagatccgaagttcggttcagaattacttgcaaaatttattaatgtaatcatggtagacggtaaaaaatccgttgctgaatcaatcgtttatggtgctttagaaactttagcacaacgcacaggtaaagagcctttagaagcgtttgaagttgcacttgaaaacgtacgtccaactgttgaggttaaatctcgtcgtgttggtggttctacttaccaagtaccagttgaagtgcgtccagtacgtcgtaacgcattaggtatgcgttggatcgttgaagcagcacgtaaacgtggtgacaaatcaatggctttacgccttgcaaacgaattatctgatgcttcagataataaaggtgcagcagttaaaaaacgtgaagacgttcaccgcatggctgaagctaacaaagcatttgctcactaccgttggtaa

SEQ ID NO: 1441 - DNA, 2103 bp, H. influenzae strain 86-028NP
atggctcgtacaacccctattgaaagatatcgtaatatcggtatcagtgcgcacattgatgcgggtaaaaccactactactgagcgtatcttattctatactggtgttagccacaaaatcggtgaagtgcacgatggtgcagcaacgatggactggatggaacaagaacaagagcgtggtattaccattacctctgcggcaacaactgcattctggtctggtatgtcacaacaattcccacaacatcgtatcaatgttatcgatactccgggacacgtggactttactgttgaagtagaacgttctatgcgtgttcttgatggcgcagtaatggtttactgtgcggttggtggtgttcaaccacaatctgaaaccgtatggcgtcaagctaacaagtatgaagttccacgtattgcgttcgtaaataaaatggaccgtactggtgcgaacttcttacgtgttgttgaacaattaaaaacccgcttaggtgctaatgcggttccacttcaacttccaattggtgcagaagaaaacttcactggtgtagttgatttgatcaaaatgaaagcgatcaactggaatgaagcagaccaaggtatgactttcacttatgaagaagtgcctgcaaatatgcaagcagactgtgaagaatggcgtcaaaatcttgttgaagcggcagctgaagcgtcagaagaattaatggaaaaatacttaggtggcgaagacttaactgaagaagaaattaagtcagcattacgtcagcgcgtattagcaaatgaaattattttggtaacctgtggttctgcgttcaaaaacaaaggtgttcaagcaatgcttgacgcagttgttgaatacttaccagcaccaactgatatccctgcaattaaaggtatcaacccagatgaaactgaaggtgagcgtcatgcaagtgatgaagaaccattctcttcattagcatttaaaattgcaactgacccatttgtaggtaacttaacattcttccgtgtatattctggtgttattaattctggagatacagtattgaattctgtacgtcaaaaacgtgaacgttttggtcgtatcgtacagatgcacgctaataaacgtgaagaaattaaagaagttcgtgcaggtgatatcgcagcagctatcggcttaaaagatgtaactactggtgatacattatgtgcaattgaagcaccaatcatccttgagcgtatggaattcccagagccagtaatctctgttgcggtagaaccaaaaactaaagctgaccaagaaaaaatgggcttagcattaggtcgtttagcacaagaagacccttcattccgtgttcacactgatgaagaatctggcgaaaccattatttctggtatgggtgagttgcacttagatatcattgttgatcgtatgaaacgtgagttcaaagtggaagctaatattggtaaaccacaagtatcataccgtgaaactatccgtactcgtgttaatgatgtcgaaggtaaacatgctaaacaatctggtggtcgcggtcaatatggtcatgttgttatcgacttatacccattagatccagaaggccctggttatgaatttgtaaacgaaatcaaaggtggtgtaattcctggtgaatacattccagccgttgataaaggtattcaagaacaacttaaatctggtccattagctggttacccagtagttgatcttggtgtacgtttacacttcggttcataccatgatgtggattcatctgagttagcatttaaacttgctgcgtctttagcatttaaagcagcattctcaaaagcaaacccagtattacttgagccaattatgaaagttgaagttgaaactccacctgaatatgttggtgatgtaattggtgatttaagccgtcgtcgtgctatggttaacggtcaagaagcgaacgagtttgttgttaagatcgatgctgaagttccactttctgagatgttcggttatgcaacagatttacgttcacaaactcaaggtcgtgcatcatactcaatggaaccgttaaaatatgctgaagctccaacaagtgtggcagctgcagtaattgaagcgcgtaaaaaataa

SEQ ID NO: 1442 - DNA, 1185 bp, H. influenzae strain 86-028NP
atgtctaaagaaaaatttgaacgtacaaaaccgcacgtaaacgtgggtacaatcggccacgttgaccacggtaaaacaactttaacagcagcaatcacaaccgtattagcaaaacactacggtggtgcagcgcgtgcatttgaccaaattgataacgcgccagaagaaaaagcgcgtggtattaccatcaacacttcacacgttgaatacgatacaccgactcgccactacgcacacgtagactgtccgggacacgccgactatgttaaaaatatgattactggtgcggctcaaatggatggtgctattttagtagtagcagcaacagatggtcctatgccacaaactcgtgaacacatcttattaggtcgccaagtaggtgttccatacatcatcgtattcttaaacaaatgcgacatggtagatgacgaagagttattagaattagtagaaatggaagttcgtgaacttctatctcaatatgacttcccaggtgacgatacaccaatcgtacgtggttcagcattacaagcgttaaacggcgtagcagaatgggaagaaaaaatccttgagttagcaaaccacttagatacttatattccagaaccagaacgtgcgattgaccaaccgttccttcttccaatcgaagatgtgttctcaatctcaggtcgtggtactgtagtaacaggtcgtgtagaacgtggtatcatccgtacaggtgatgaagtagaaatcgtcggtatcaaagatacagcgaaaactactgtaactggtgttgaaatgttccgtaaattacttgacgaaggtcgtgcaggtgaaaacatcggtgcattattacgtggtaccaaacgtgaagaaatcgaacgtggtcaagtattagcgaaaccaggttcaatcacaccacacactgacttcgaatcagaagtgtacgtattatcaaaagatgaaggtggtcgtcatactccattcttcaaaggttaccgtccacaattctatttccgtacaacagacgtgactggtactatcgaattaccagaaggcgtggaaatggtaatgccaggggataacatcaagatgacagtaagcttaatccacccaatcgcgatggatcaaggcttacgtttcgcaatccgtgaaggtggccgtacagtaggtgcaggcgttgttgcgaaaatcatcaaataa

SEQ ID NO: 1443 - DNA, 345 bp, H. influenzae strain 86-028NP
ttgaattcagccaaactatttggaaaattcctcttacctttttggctatgcttatcggtgtatcagttgggcgtattagctactggttttattcttgtcgcgattcaaggaaacagcccttattttccacgttatcaaggggcaacatcggtttcttgtctctatctttggcttgcaatttgtggggtgggttatggcattctaggtggcatatttggacgattattagcaaaaggtatcgcaggattatcacctgaaaaatggcgtggctgggttcgccaacatcctatttatattgctttattattgggtttagtgcttgccgcactgttggagtggaaatga

SEQ ID NO: 1444 - DNA, 183 bp, H. influenzae strain 86-028NP
gtggaaatgacaggcgcgcaactcgttctcatttggctcttgatttccagcattattgcatccataatctcgcgccaatttagtcctaaaccattttaccactttgctgcaggccgttttcgccagcaaatgcaagctcgtcaagccgaagaattacgcagcaaaaccaaacaagagaaataa

SEQ ID NO: 1445 - DNA, 984 bp, H. influenzae strain 86-028NP
atgcctcaaaatctaccgcacttttaccgcggccgtttttctgttgcgccaatgttagattggacaacacgccattgtcgttattttcatcgccaattttcaaagcacgcattactttacaccgaaatggtcactgcgcctgcgattatccatgccaaatacgatcacttggattttgatttacaagaaaatcccgttgcgttacagctgggaggaagtgatcctgaacaactcaaatattgtgcaaaacttgctgaggaacgaggttatcacgaaattaatcttaatgtaggatgcccttctgatcgcgtacaaaatggaatgtttggcgcctgcttaatggcgaaagcagatttggtggccgactgtgtagaacaaatgcaaagtgcggtcaaaattccagtcacagtgaaaacacgtattggtattgatgaattagacagctatgaatttttatgtgattttattgagaaggttcaaggaaaaggttgccaagagtttattatccatgcacgaaaagcttggctttcagggttaagtcccaaagaaaatcgagaaattccaccattagattatgctcgagtgtatcaactaaaacgtgattttccacatctaactatcgcaattaatggcggcataaaaaccattgaagaaatgaaacaacatttgcaatatgtggacggcgtgatggttgggcgagaggcctatcaaaatccaagtttacttgggcaaattgaccaagccttatttgatcctaacgctgcaattgttaccgctcatgaagcggtacagtcaatgcttccttatattgaacaacaacttaaccaaggaatacaccttaatcatatcgtccgccatatgctaggcgcattccaaaattgcaaaggtgcccgtcaatggcgacgctatttaagtgaaaatgcgtttaaacaaggtgcgggagttgaagtaattgaaaccgccttaagctttgtagaacactaa

SEQ ID NO: 1446 - DNA, 291 bp, H. influenzae strain 86-028NP
atggcaattcaaactgaaaaaccgattgaatgtgtaggttgtaacacatttgatatgaaatcacttttcgataatcgtgattgtagtcaggttattgaatatatttatgacagtgaagaacaagcgcaagaagcactcgcattttttactcagaaagcgcgtgatgtagaaagtgaaccttgtgaaattcaatctgaaattacaaaactggatgatggctatttattaaaggcagatttcactttctgttgccaagctgaattggtgatttttcaaatgcgtattgcgtaa

SEQ ID NO: 1447 - DNA, 1011 bp, H. influenzae strain 86-028NP
ttgattatggcaaaaccaattgtttttagtggcgtgcagccttctggtgaattaactatcggaaattatttgggtgcgttgcgcaactgggtgaaaatgcaagaagattatgaatgtattttttgcgtagttgatttacatgcgatcactgttcgtcaagatcctgttgcccttcgtaaagcaacgcttgatgtgcttgcactttatttagcgtgcggaattgatccaaataaaagtactatttttgttcaatctcacgttccagaacacacgcaattaagctgggtgttaaactgttacacctatttcggtgaaatgagccgaatgactcaatttaaagataaatcagcgcgttatgcagaaaatattaacgtgggtttgtttgattaccctgtgttaatggcggcggatattttactttatcaagcaaaaagcgtgcctgttggcgatgaccaaaaacaacacttagaaattacgcgtgatattgcaaaccgctttaatgcgctttatggcaatattttcactattcctgaaattttcattggaaaagcaggcgcgcgtattatgtcattgcaagatcccgaaaagaaaatgtcaaaatcagatgataaccgcaacaatgtagtgacacttttagaagatccaaaatctgtggcgaagaaaattaaacgtgccgtaacggattcagatgagccgcctgttgttcgttatgatgtgcaaaataaagcgggggtatctaatcttttagatattctttctgcggttacggataagccaattgctgatcttgaaaaagaatttgaaggtaaaatgtacggacatttaaaaactgcagtagcggatgaagtctcaactttacttgctggtttacaagaacgtttccatcaatatcgcaatgatgaaactttattagataatatcttacgacaaggtgcggaaaaagctcgtgcaaaagcacaagaaaccttggcgaaagtgtatgaagctgtaggttttgttgctgcaaaataa

SEQ ID NO: 1448 - DNA, 618 bp, H. influenzae strain 86-028NP
atgaaaaactaccacgatattgttcttgcccttgctggcgtgtgccaatcagcaaaattggttcatcaacttgcaacagaaagtcgagcagattcagatacatttttaaccgcacttaatagccttttcattacccaaccacaacgaattgaagatgtttttggtggcgaagttcgtcatttaaaattaggtctagaaaccttaattcaccagctcaacgcgcaaggcgatcaaaatttaactcgctattggctaagccttttagcattagaaggaaaattatcgaaaaactccgatgccaaacaaacattgggcaatcgaatttctcgcctaaaagaacaagaaattcattacgctcgcgatagtgaaacaatgttatctattatggcaaatatttacagcgatattattagcccattgggtaaaaaaattcacatcctaggctcgcctgattatttgcgacaagaactcgtgcaaaataaaatccgtgcagttttacttgcaggcattcgctctgccgtgctgtggaaacaaatgggcggaacaaaatggcaaattttatttttccgcagaaaattacttgccaccgcaaaacagatttattcttctatttattaa

SEQ ID NO: 1449 - DNA, 1371 bp, H. influenzae strain 86-028NP
atgcaactctctacactgaccgcactttcccctcttgatggtcgttatcaagataaagtaacgccattacgtgctatttttagcgaattcgggttaatgaaattccgtgtagttgtggaagttcgttggttacaaaaattagcttcaacggcagatattaccgaagtaccgccattttctacgcaagcaaatgcttttttagatggaattgtggctaattttaatgaggccgatgctgcgcgtattaaagaaattgaacgcacaactaatcacgatgtgaaagccgttgagtattttctgaaagagaaaattcaaaacgaagtggaactagtgaacgtttctgaatttattcacttcgcttgcacctcagaagacattaacaatctctctcacgcattaatgttaagcaccgctcgtgacgaagtgattttaccagaatggcaaaaactgattgatgaaatcactcgtcttgcagaagaatataaaacgattccattactttctcgcacacatggccagccagcttcaccaagcaccgtgggcaaagaaatggcgaatgtcgtttatcgcctaaaacgtcaatttaaacaactccaaaatgcggagatcttaggtaaaatcaatggtgcagtaggtaactacaatgcgcatttatcggcatatcctaatattgattggcataaattcagcgaagaatttgtcacttcattaggtattcaatggaatccttataccacacaaattgagccgcacgattacatcgctgaattttttgatgctgtagttcgctttaataccattatcattgattttgatcgtgatttatggggatacattgcattaaatcactttaaacaacgaactatagcaggcgaaattggttcttctaccatgccacataaagtcaatccaattgattttgaaaactcagagggcaatctaggattagccaatgcagtgatgacccatttaggtcaaaaattaccaatttctcgctggcagcgtgacttaacagattcaaccgtattacgtaatttaggcgtaggattaggttattgtttgatcgcttatgcttcaacacgcaaaggcatgagtaaacttgaagtaaatcaaccgcacttattagaagaactcaatcaaaactgggaagttttggctgaaccaattcaaaccgtaatgcgtcgctacggaatagaaaaaccttacgaaaaattaaaagaattaacgcgaggtaaacgagtgacagaacaggctatgcgtgaatttattgataagttggatattccacaagaagaaaaattacgtttacaaaaattaacacccgctacttatattggggctgcagtggaattagtagagaagctatcatag

SEQ ID NO: 1450 - DNA, 492 bp, H. influenzae strain 86-028NP
atggcattaaatcttcaagacaaacaagcaattgttgctgaagtaaatgaagcagccaaaggtgcactttcagcagtaatcgcggattctcgcggtgtaactgttgagaaaatgactgaattacgtaaatcagcacgtgaagctggcgttacaatgcgtgtagttcgtaatactttattacgtcgcgcagttgaaggcacagattacgaatgcttaaaagatacgtttgtaggtccaacacttatcgcgttctctaacgaacacccgggcgaagctgctcgtttgttcaaagagtttgctaaagcaaacgataagtttgaaattaaaggtgcagcctttgaaggtaaaatccaagatgttgaattcttggcaacattaccaacttacgaagaagcgattgcacgtttaatgggcacaatgaaagaagctgcagcaggcaaacttgctcgcaccttcgcggcattacgcgacaaattacaagaagcagcttaa

SEQ ID NO: 1451 - DNA, 372 bp, H. influenzae strain 86-028NP
atgtcattaactaacgaacaaatcattgaagcgattgcttcaaaaactgtaactgaaatcgttgaattaatcgcagcgatggaagaaaaattcggtgtttcagcagcggcagcagtagcagcagctccagcagcaggcggcgcagcggcagcagaagaaaaaactgaattcgacgttgtacttaaatctgcaggtgcgaacaaagtagcagtaattaaagcagtacgtggtgcaactggtttaggcttaaaagaagctaaagatttagttgaatctgctccagctaacttaaaagaaggcgtttctaaagaagaagctgaagcacttaagaaagaattagaagaagcgggtgcagaagtagaagttaaataa

SEQ ID NO: 1452 - DNA, 1371 bp, H. influenzae strain 86-028NP
atgacaaaaaaagcattaagtgcggtaattttagcagctggaaaaggaacgcgcatgtattccgatttacccaaagtgctacatacaatcgctggtaaaccaatggtaaaacacgtgattgatattgcccatcaattaggctcagaaaatattcatttaatctatggtcacggtggggacttaatgcgtacccatcttgcaaatgaacaagtaaactgggtattacaaacagaacaacttggcacagcacatgcagttcaacaagcagctcctttttttaaggataacgaaaacattgttgtactttacggcgatgcaccattaattactaaagaaacattagaaaaattaattgaagcgaaaccagaaaatggcattgcattgcttaccgtaaatttagataacccaacaggctatggacgaattatccgtgaaaatgggaatgttgtagccattgtagaacaaaaagatgcaaatgcagagcaactaaatattaaagaagtcaatactggcgttatggtatctgatggtgcaagtttcaaaaaatggctagctcgtgtaggtaataataatgctcaaggcgaatattacttaacggatcttattgctctcgcaaaccaagataattgccaagttgttgctgtacaagcaacagatgtcatggaagttgaaggcgcaaataatcgcttacaattagccgcacttgaacgttatttccaaaataaacaagcctccaaattattacttgaaggcgtaatgatctacgatcccgctcgttttgacctacgtggaacattagagcatggaaaagatgtggaaatcgatgttaatgttattatcgaaggtaatgttaaactcggtgattgcgtaaaaattggcgcaggttgcgtattgaaaaatgttgttattggcaatgatgtagaaataaaaccctattcagtgctagaggattctatagtaggagaaaaagccgcaattggcccattttctcgtttacgcccaggtgcagaactcgcagctgaaacgcatgtcggtaactttgtagaaattaaaaaatctaccgttggtaaaggttctaaagtaaatcatctaacttatgttggcgattcagaaatcggctcaaattgtaatattggagcgggtgtcataacctgcaactacgatggtgcaaataaatttaaaacgatcatcggtgatgatgtgtttgtgggatctgatacacaattagtcgcgccagtgaaagtcgcaaatggcgcaactattggtgctgggactacaattacacgtgatgttggcgaaaatgaattagtgattacaagagttgctcaacgacatattcaaggttggcaacgaccaataaagaaaaaatag

SEQ ID NO: 1453 - DNA, 312 bp, H. influenzae strain 86-028NP
atgaaaaaacaatctttaccaactaaatttagtccatttgcttggggtcttgctgccttttgttcgcctatattattgtgtccaatggcattattaatttctacagcatttagtaaaaatccctatctatcaagctggcaaatcaatttattttcaacgcttttttgggtttatccctttattctagctgttacagctagaatgctataccgtcttcatcaacataaacctaaactagcaaataaattattaacattaagtgcggtcattttttatgtgattttaattacgatttgtaaaattggtttataa

SEQ ID NO: 1454 - DNA, 936 bp, H. influenzae strain 86-028NP
atgatcagagaaccttattttcatcaatttgctcttgcagaattattgcctttttttgagcaatttcctacccaatatctttctggtaaacgaaatataaaattagcttatcgtcatttgattcaacctgaaagtgcggtcagaaaattgatgattttagtaaatggtcgtgcagaaaatatgttgaaatggtcagagctcgcttatgatttttatcatcaaggttatgatgtattgctatttgatcatcgcggtcaaggctattcacagcgtattattcctcaaaaagggcatttagacgaatttcgtttctatgttgatgatatggcgaaaatcatcgaaaaagtaaccgcacttttcagctattcaacgcagcatttgcttgctcattcgatgggcgcattgattgcaacctattatttggcaaattatgatcatcacattaataaagcggtactttcttcgcctttttacggtattcttttaaaacatcccattagagatgaactgattattgccctaatgaatattttaggacaaggcgagcgttatgtttttggtaaagggccttatcaacaagcccacttggaatacaatgaattaactttctgtaaaaccagaatgaaatggatgaatcgtgtaaatcgtaaaaatccagcaattaatcttggcgggccaacattccgttgggtacatttgtgtttgaacgcaattaaacgcttgccgaaagttattcctaagattgaaattccaatcctaattttacaagccgaaaaagaaaaaatagtagataacaacaatcttgaaaaattaaccgtactttttccgaatgctagatgtgaagttgtattcaatgctaaacacgaaattctatttgaacaggacaaattaagaaaggaaacaatctttaaaatattagaatttttaaataattag

SEQ ID NO: 1455 - DNA, 1116 bp, H. influenzae strain 86-028NP
atgaaaaatgtaggctttatcggctggcgcgggatggtgggttccgtattaatggatcgtatgtcgcaggaaaatgattttgcaaatcttaatcccgtattttttacaacttcacaagcaggtcaaaaagcacctgtttttggtggcaaggatgcaggcgacctgaaaagtgcattcgatattgaagaacttaaaaaattagacattatcgtgacttgccaaggtggcgattacaccaatgaagtctatccaaaattaaaagcaacaggctgggatggttattgggttgatgccgcttctgcgttgcgtatgaaagatgatgcaattattgtgcttgatccagtaaaccaacacgtgatttctgaaggtttgaaaaaaggcattaaaactttcgtgggcggtaactgtactgtaagcttaatgcttatggctatcggcggtctatttgaaaaagatttggtggaatggatttctgtggcaacttaccaagcggcttcaggtgctggcgcaaaaaatatgcgtgaattactttcacaaatgggtttattagaacaagcagtttcaagtgaattaaaagaccctgcttcatctattttagatattgaacgtaaagtgacggcaaaaatgcgtgctgataacttcccaacagataactttggcgcggcattgggcggtagcttaatcccttggattgacaaacttcttcctgaaacagggcaaactaaagaagaatggaaaggttatgcagaaaccaacaaaattttaggtttaagcgacaatccaattcctgttgatggtttatgtgtgcgtatcggtgcattacgttgccacagccaagcgtttaccattaaattgaaaaaagacttaccattagaagaaatcgaacaaattattgcatcacataatgaatgggtaaaagtaattccaaatgacaaagaaaccacattacgtgaattaacgccagcgaaagtaacaggtacattaagcgtgccagtggggcgtttacgtaaattggctatggggcctgaatatttggcagcttttaccgtgggtgaccaattattatggggtgcggcagagccagttcgccgtatcttaaaacaattggtggcgtaa

SEQ ID NO: 1456 - DNA, 717 bp, H. influenzae strain 86-028NP
atggaaaattcatctttacttttaaccgcacttttcaatcctgatcacttaattatttttagcaaaatgctattagcgatggtgcttggcagtgttattggcttagaacgtgaacttaaacgtaaacctgtgggtgtaaaaacttgtgccattattgccgttaccacttgtgtgctaaccattgtttcaattcaagccgcagagcattatgcacaagtttcagaaaatattcgtacagatccaatgcgtcttgcggctcaagtgattagtggcatcggttttttaggtgctggtgtgattttgcataagaaaaatgatgcgatttcaggtttaaccactgcggcgattatttgggcttctgcggggatcggtattgctgctggggcgggtttcgtgtttgatgcggtcatcgccactgtgatgattttggtgtctattcgattaagtccgttggttcaacgttgggttcatcgtaaatcacaacgtcgtcggacgaaattcaatattcttgtcaatgatgcggaaagcatagggaaagttacccaattgttagtaaataatcagtatcgtattgaacatatacaagtcaaagatcaaagtagtggagaagtgcggttacaaattcgttgcttttccattgattccacaatgttgaaagatgcgtatgctttacttaaagcagaagatggcgtaataagtgttgaagtagataactag

SEQ ID NO: 1457 - DNA, 657 bp, H. influenzae strain 86-028NP
ttgcccaaaaaacttggcatttgggttcgcttacattatgtgtatccctatccccatgtggatgatttaattccattaatggctgacggtacgctattgccgtatttagacattccattacaacacgccagccctaaaatcttaaaagcaatgaaaagaccaggcagtattgaccgcactttagaacgcattaaacaatggcgtgaaatttgcccagatttaacattgcgctcaacctttattgttggtttccctggcgaaacggaagaagatttccaattattactcgatttcttaaaagaagcccaacttgatcgcgtaggctgtttcaaattcagccctgttgaaggtgcacccgcaacagatatggctgaccaagtaccagaagatgtaaaagaagaacgtttccatcgcttcatgcaattacaacaagaaatttctgcaaaccgtttaaaacaaaaaattggtaaaacccttgatgtattagtggatgaaattgacgaagatggtattattggtcgttcaaaagccgatgcccctgaagtagatgggttagtttacgtagataatttaagcggaatcaatgtcaaagtcggtgacgtgattaaagtaaccatcacaaattctgatgaatatgatttgtggggcagttgttaa

SEQ ID NO: 1458 - DNA, 579 bp, H. influenzae strain 86-028NP
atgaatattttattattagacggcggtaaggcgtttggtcattctcacggcgagttgaaccattcgcttcacaaaaaagcgaaagaagttttgaccgcacttggacacaatgtcaaagaaactgtaattgatgctggttatgacgttgaagctgaaatcgaaaaattcttgtggatggatgccgtgatttggcaaatgccgagctggtggatgcatgagccttggacagtgaaaaaatacatagacgaagtattaaccagtgggcacggcaagttatatcacagtgatggcagacacagcgttaatccaaccgagggctatggcacaggcggcttgttgcaaggcaaaaaacacatgctttcactgacttggaatgcaccgattgaagcctttactcgcgaaggcgatttctttgaaggcaaaggcgtggatgttttgtatatgcatttccacaaactcaacgagttcatcggcttgactcgcctgccgacattcttatgtaacgatgtggttaaaagtccgcaagtagaacaatacttagcagactaccaagcacacttggaaaaagtgttcggctaa

SEQ ID NO: 1459 - DNA, 2013 bp, H. influenzae strain 86-028NP
atgaaactcaatcctcaacaacaacaagccgttgaatatgtgacaggcccttgccttgtgcttgctggcgctggttcaggcaaaactcgcgtaatcattaataaaatcgcccatttaattgaaaagtgcgggtattctccgaaacaaattgccgccgtcacttttacgaataaagccgcacgcgagatgaaagagcgtgtggcacattccattggcaaagaacaatccaaaggattgcttgtttccacttttcatacgctcggttttgacattattaagcgtgaatataaagcgttgggctttaaatcaaatatgaccttgtttgatgagcacgatcaatttgcgttgttaaaagagctaaccgctgatgtgttaaaagaagataaggatttattgcgcgagttaatttcagtgatttctaactggaagaacgatttgatttcgccaaaacaggcatttgccttggcacgtgatgctaaatatcaaactttcgcaaaatgttatgagcgttacgccacacaaattcgagcttacaacgctctcgattttgatgatttgattatgctgccgacattattgttcaagcaaaatgaagaagtgcggtcaaaatggcaggcaaaaattcgttatttgttggtggatgaatatcaagacaccaacaccagtcaatatgaactgattaaacttttagtgggtgagcgtgcttgtttcactgtggtgggcgatgatgaccaatctatttattcgtggcgtggcgcacgaccagaaaatatggtgcgtttacgcgatgattttcctcgtttgaacgtgattaagctagagcaaaattaccgttcaacccagcgtattttgcattgtgccaatattttgattgataacaatgagcacgtgtttgataagaaacttttttcaaccattggtacaggggaaaaattgcttgtcatcgaagcaaaaaatgaagaacacgaagcagagcggattgtcgccgagttgatcgcccatcgttttagccgtaaaaccaaatataaagattatgcgattttgtatcgaggcaatcatcaatcccgattactcgaaaaagtactgatgcaaaaccgtattccttacaaaatttcgggcggtacttcttttttctctcgtgcagaaatcaaagatatgatggcgtatttgcgcttggtggtaaatcaagatgatgacggagcattcctgcgtattgtgaatacaccgaagcgtgaaattggcaccgcaaccttacaaaaacttggagagttggctcaagaaaaacacatcagtttgtttgatgctatttttgagtttgaacttattcaacgcattacaccaaaagcctatgattcattgcaaaaatttggccgttggattgtagaacttaatgatgaaattcaacgttctgaaccagaacgtgcggtacgttctatgttatctgcgattcattatgaagaatatttgtacgaatacgcaacaaaccctaaagcagcagaaatgcaaagtaagaatgtcgccacgttatttgactgggttgcggatatgttaaaaggcgatgaaaccaatgagccgatgaaccttaatcaagtggtaacccgcctgacattacgcgatatgttggagcgaggcgaagacgatgacgacagcgatcaagttcaactgatgacattacacgcatctaaaggattggaatttccttatgtttatttgattggtatggaggagggcattttaccccaccaaaccagcattgatgaagacaacgtggaagaagaacgccgcttggcttatgtgggtatcacaagagcacaaaaagaacttactttttctttatgtcgtgagcgtcgtcaatatggagaattagttcgcccagaacccagccgatttttagctgaattacctaatgacgatgtgctatgggaacgcgataaaccaaaactcaccaccgagcaaaaacaagaaaaaacacaaaaccaacttgatagattgagggcgattttgaaaagttaa

SEQ ID NO: 1460 - DNA, 213 bp, H. influenzae strain 86-028NP
atgataaaaacctttatttttttaaccgcacttatcgttttatctggttgtggttccgtggtcaaacttatcgatccaacagaaaaatataccgcctatgcaggggttgcttatgatcttgaaatggcgcaacaatggggattgccaatcttagatttgcctctctcatttttattagacactgtattactgccctatgcgtgggctcaataa

SEQ ID NO: 1461 - DNA, 471 bp, H. influenzae strain 86-028NP
atgacgagcgtgatttatcctggtacttttgatccgattacgaacggtcatttagacattattgaaagaagtgcggtaatttttcctcgtgttttagtggcggtggcgaatagcccaagtaaaaagccactattttcgttggaggaacgcgtggagcttgttcgtcaatctgttgcacatttatccaatgtggaggtgtttggcttttctgatttgttggcaaatgtgattaaacagcacaatatttctgccattattcgcggcgtacgcacaacaacagattttgaatatgaactgcaattggccgcccttaatcgtttactcacaaaaggcgtagatagtctgtttttcccaccagcagaaaaatgggcgtttgtttcttctaccattgtgcgtgaaatttatttacatggcggagatgtcgctgagctagttcctgagcctgtattcaatgcgttaaaagcacgatga

SEQ ID NO: 1462 - DNA, 1284 bp, H. influenzae strain 86-028NP
atgtggcgttttttttataccagcttgcttttaatttgccagccgttgatattgtgttttattggcttgctcagtgttaaatctccacgttatcgtcagcgtttggctgaacgttatggtttttatggcaatgtgccttgtccaccaccacaaggaatctttatccacgcagcctccgtaggggaagtgattgctgcgataccgctggttcgtcaattgcaacaagattatccgcatttatccattacttttacgacttttacgccaacaggttcagagcgcgtcaaagccacttttggagacagcgtttttcattattatctcccccttgatttacctttttcgatccatcgttttattaattttgtacaacctaaattatgtatcgtgatggaaacagaactttggcctaatcttattcatcaattatttttacgcaatattccatttgttatcgctaatgcacgtttatctgcgcgttctgcacatcgttacggaaaaataaaagcgcacttacaaacaatgtggtcgcaaattagcttgattgcagcgcaggataacattagtggaaaacgctatgccactttgggctatccaaaggaaaaattgaatatcacgggcaatattaaatatgatctcaatacgaatgatgaactattacgtaaaattgattcattgcgaacgctttggaaacaagatcgcccaatatggattgctgccagcacgcataatggagaagatgaaatcattttaaaatctcaccgcgctttgttagcaaaatacccgaatttattgttattgctcgttccgcgccatccagagcgttttaatgtggtggctgatttacttaaaaaggaaaaatttcaatttattcgtcgttccacaaatgaattaccaaatgaaaatacccaagtgattttgggcgatagtatgggcgaactgatgttgatgtatggcatttccgatattgcttttgtgggtggaagccttgtgaaacacggggggcataatccactggaacctcttgcgtttaaaatgcctgtaattactggcaagcatacttttaattttcccgagatatttagaatgttggtggaagtgcaaggtgtgttggaagttaattcaaccgcagattccttagaacgcgccgtagaagccttattaaactcaaaagaagcccgcgaacgtttaggcaatgctggctatgaagtgctgatggaaaaccgaggggcattacagcgtttgttagatttattaaaaccttatttggagcgcaatgtatga

SEQ ID NO: 1463 - DNA, 765 bp, H. influenzae strain 86-028NP
atgcctacaattagcgttgcgatgattgtaaaaaatgaagcacaagacctcgccaattgcttagacaccgtaaaagattgggtggatgagattatcattctagattctggtagcacagataacactaaagaaattgcgctcagttatggggctaaattctatgaaaatagcgactggcaaggatttggtaaacaacgccaattagcccaacaatatgtaaccagtgattatgtactctggttagatgctgacgaacgcgttacgcccaagttacaacaggctatcttaagtgcggttaaaaatgatcgagaaaataccgtttatgaaattccacgagtgagtgaagtatttgggcgtgaaattcgccattcaggctggtatcccgattatgtagttcgtctctatcgcacaaactatgcgcaatataatgattcacttgtacatgaaaaagtggaatttccagctggcacaaaagtagaaaaattgacaggggatttagagcatttcacttataaaagtattcatcattatctagtgaaatccgcaggttatgccaaagcctgggcagaccaacgccaagctaaaggaaaaaaagccacactttggcaaggaatttcgcacgcgcttggttgttttgtgaagatgtatttgttaaaagcgggttttttagatggcaaacaaggatttttattagcggtgttatcagcgcattcaacctttgtaaaatacgccgatttatgggagcgagatcagcataaacactag

SEQ ID NO: 1464 - DNA, 564 bp, H. influenzae strain 86-028NP
atgcaacaaataaccagatgcccttgggttggcgaacaacctatttatattgattatcatgacaaggaatggggaaagcctgaattcgacagccaaaagctatttgaaaaaatttgtttggaagggcagcaagcgggactttcgtggattacggttttgaaaaaacgtgaatcttaccgtgcagcctttcatcaatttgatccgaaaaaaatcgcaaaaatgaccgcacttgatattgatgcttgcatgcaaaattcaggattaattcgccatcgagccaagttagaagccattgtcaaaaatgcgaaagcttatttggcaatggaaaagtgcggtgaaaatttcagtaattttatttggtcatttgtgaatcataaaccgattgtcaatgatgtgcctgatttgcgatctgtgccaactaaaacagaagtatcgaaagcactttctcaagccttaaaaaaacgtggtttcgtctttgttggcgaaaccacgtgctatgcgtttatgcaatctatggggctggtggacgatcatttaaatgattgtccttgcaaaactcgctag

SEQ ID NO: 1465 - DNA, 753 bp, H. influenzae strain 86-028NP
atggaaaataaatacagcgattttatggtgtatgtcgatgaaagtggagatcacagtttacagtcaattgataaaaactatcctgtgtttgtacttgcattctgtattttttataaagaccattatcgaaataatattgttccacagatacagaagataaaatttgattattttggtcatgatatggtgatattgcatgagcatgaaatccgcaaagaaaaaggcgattttaatattttcacttctcgtgaacagcgtgaaggttttatggaacgtatttcatctattattgaaaatactaattttattcttgctgcctgtgtgattgataagcgaaaaacgccacaaaatgaaacaacacacccttatcatttttcactcaaacattgtttagaaaccctatacgaatttgtttgtgaaaagcatcaagaagataaaatcacttttgttgccgtggaaagccgtggacgtaatgaggatagagagttagagctggaatttttacgtatttgtgatggacaaaataaatttaaaaagtccttgccttttcaagtaaagattgtgccaaaacaaattaattctgtggggttgcaagttgcggatttagtggcaagacctatcgggagacatattttagatagtaatcaaccaaatcgagcctttgagatccttaaaaagaaattttattgtgaaggtggaagaaaaatactgggggaaaattttgatcaaaaaggactgaaacatttcccttag

SEQ ID NO: 1466 - DNA, 807 bp, H. influenzae strain 86-028NP
atggatctttatgctgtatggggcaatccgattacgcaaagtaaatcgccattaattcaacgtcagttagccgcgcaaacccatcaaactatggaatacatcgcaaaattaggcaatcttgattcttttgaacaacagcttttggcattttttgaggagggtgcgaaaggttgcaatattacttcgccttttaaagaacgtgcctatcaactggcagacgaatatagccaacgagcaaaattggcggaagcctgtaatacgctaaaaaaactcgatgatggaaaactttatgcggataacaccgatgggattggtttagtgacggatttggagcgtttaaattggcttcgtccaaatcaacacgtattaatcttgggggcaggcggagcaacaaaaggcgtattattgccacttttacaagctcaacaaaacattgtgcttgctaaccgcactttttcgaaaaccaaagaattagctgaaagatttcagccttacggcaatattcaagctgtctctatggattcgattccactacaaacctatgatgtagtgattaatgcaacttccgctggattaagtggtggaactgctccagttgatgttgaaattttaaaattaggcttagctttttacgatatgcaatatgcgaaaggcacagacacgccatttatcgcattatgcaaaagtttaggtttaaccaatgttagcgatggctttggaatgttagtcgcgcaagcagcacattctttccatttatggcgaggcgtaatgccagattttgtcgcggtttatgagcaattaaaataa

SEQ ID NO: 1467 - DNA, 552 bp, H. influenzae strain 86-028NP
atgaatagagaacaaatcgccgaagcccttcgacaaaatcaagtggttgcttatcccactgaagctgtgtttggtttgggctgtaatccgcaaagtgaaagtgcggtaaaaaaattactcgatttaaagcaacgtccagtggaaaaagggctgattttagtcgctcctagcttggattttttccgtccttttgtcgattttgagcagattaacgatgaacagctttctcatctgcaaggtaaatatgaacgtccaacgacttggattgtgccagctaaatccaccacctcgcattttctcacaggaaaatttgatagcattgcaatacgtttgtgcgatcacccatctgtgaaagccttatgtgaactcacgggttttgcattaacttcgactagcgcaaacctaacaggagagccaccttgccgtaccgccgatgaagtgcggttacaattcggtgcagattttcctgtattggatgaaattgtgggagatgcacgcaatccatctgaaattcgagacttacgcacaaatcaactttttagacagggataa

SEQ ID NO: 1468 - DNA, 537 bp, H. influenzae strain 86-028NP
atgaatcaaagcctttttcatcatagcaaacaacaggaatattgccctcaatgtggtgcgcttttgcaaattaaacaaggcaaaaaagggctgtttttaggttgctctgcttatcctgaatgtgattatttgcgtcctttgcaacgatcggagcataaagtattaaaaacatttgatgaaatttgcccgaagtgcggtaatttattgcagttgaaacaaggcagttttgggatgtttattggttgtagccattatcctgaatgcgattttgtggtgcgggaagaatctgaatctgaggaaaaaattacttgtcctgaatgtaaaacggggcatttgatttctcgtcgtggtcgccaaggaaagattttttacggctgtgataatttccctaaatgtaaattttctttgcctgccaagccttattccgtgccttgcccaacgtgccattttcctctttctttgttaaaaagcgaaaatggggaaaaacaaattttccagtgtgcaaataaaacttgccgtcatatttttgagcaataa

SEQ ID NO: 1469 - DNA, 1917 bp, H. influenzae strain 86-028NP; identical to SEQ ID NO: 722

SEQ ID NO: 1470 - DNA, 297 bp, H. influenzae strain 86-028NP
atgaataaaatcagcccattaggttcaaattggaatgagtttgaacagcaaattttcaatgaagaagaaatccgcgaaagtaatttacgtgtagccttaattaaagaattgattacttctcgccagcaacttgggatttcccaaaaacaacttgaaaccttaagcggtgtgaagcaacctatgattgcacgcattgaaaaaggacaaacgaatcctcaacttgaaacgttgttaaaattgctcgctcctttagggaaaaccctgtcgattgtgcctctaagggtaaaaaatgcctaa

SEQ ID NO: 1471 - DNA, 183 bp, H. influenzae strain 86-028NP
atgtacgagattctcttttacagagaccaaaatgacattgagccagtgaaagaatatctgctatcgctggctcaaaatgaaagcaaagatagtcgaattaaactgaataaaattcgagattatgtaatccaaacaacccaacaacgcttaagtgaattaaaagagagattgaaaaatgaataa

SEQ ID NO: 1472 - DNA, 2979 bp, H. influenzae strain 86-028NP
atgggattaaatatgaccaattttagattaaacgtgcttgcctattccgttatgcttgggctaacggcaggtgttgcttatgcagctcaaccaaccaaccaaccaaccaaccaaccaaccaaccaaccaaccaaccaaaatggtaatgtttctgaacaactagagcaaattaatgtatctggttctaccgaaaatagtgatacaaaaacaccaccaaaaattgctgaaacggtaaaaacggctaaaacgctggaaagagaacaagcaaacaatattaaagacatcgttaaatacgagacgggcgttactgttgttgaagctgggcgttttgggcaaagcggttttgccattcgtggtgtagatgaaaaccgtgtagcgattaatattgatggattacgtcaagctgaaaccctatcttctcaaggctttaaagagctttttgagggttatggtaacttcaataatacgcgtaatggtgcagaaattgaaactttaaaagaagtaaatattacaaaaggggcaaattcaatcaaaagtggtagtggttccttaggtggatctgtaatttataaaacaaaagatgcgagagattatctccttaacaaggattactatgtaagctacaaaaagggatacgctacagaaaataatcaatcattcaatacccttactcttgcaggacgttataaaaagtttgatgccttagtggttacaacaagcagaaatggacacgaacttgaaaactatgattacaaaaatgcaaatagccttactcaaggtaaaaaaagagaaaaagcagacccatacaaaattgaacaagatagtacattattaaaattatcttttaaccctacagaaaatcatcgttttacccttgcagcagatttatatgaacatcgttctcgtgggcaagatttatcctatacactaaaatatcaaaaaacagatcctaatttactcgaggttgattctagacacaccaatgataaaacaaagagacgtaatatttcctttagctatgaaaatttctctcaaacgccattttgggatacattaaaaatcacttattcagatcaacgtattaaaactcgcgcacgtacagatgactattgtgatgcaggtgtaagatattgtgagggaactgcaaatcctgcgggactaaaattaacagatgggaaaataacacgtcgagatggttcagaacttcaatttgaaaaaaaagataaaaatattgataacaacatctatgacttcgataaatttattgatactgatgatcgagtaatagaaggtaaactaggcctaaggagatcctctggaacttggtatgattgttcaatatttgattgtaaagataaaacaaaaatgaaaatttttgaaactgaacatccttatggctatggcactactggaacgtggaaaaaagactttgaacttgaaataaaaaaattaaatgacaaaaatttcgctagagtaaaggatgcgaataataaaacatactctattcttccctcatctccaggttatttagaacgcctctggcaagagcgagatttagacaccaacacccaacaattaaatttagatttaaccaaagacttcaaaacttggcgtgttgaacataatctacaatatggtagctcatataatacaacgatgaagcgaatggttaatcgtgctggtaatgatgcttctgatgtgcaatggtgggcagagcctacacttggttacagtttgttgtatgataaacctcacacttgtaaaaccgcttatggggggtggaaagctaacctttgccctcgagttgatcctaaattttcattcttattacccattaaaacaaaagaaaaatcagtctatctctttgataatgttgttataactgattatttatcttttgatttgggttatcgttatgacaatatccattatcaaccaaaatataaacacggcgttacaccgaaattacctgatgatattgtgaaaggattgtttattccattaccaagtggtaaaaataataatgatgatcctgaagttaagaaaaacgtacaacaaaatattgactatatcgctaaacaaaacaaaaaatataaagcacattcttacagttttgtttcaacgattgatccaacgagttttcttcgtttacaactaaaatattcaaaaggttttagagcaccaacttcagatgaaatgtatttcacctttaaacaccctgatttcactattttgccaaatactaatctaaaaccagagatagcaaaaacaaaagaaattgcttttacattacataatgatgattggggttttatctccacaagtctatttaaaaccaactataaaaactttatcgacctaatatttaaaggagaaaaagattttaaattagttagcggaggtagcacattaccattttctctttatcaaaatattaatagagatagtgcggtagtaaaaggaatagaaattaattcaaaagtattccttggtaaaatggcaaaatttatggatggatttaacctaagctataaatatacctatcaaaaaggaagaatggatggcaatattcctatgaatgcaattcagcctaaaacgatggtgtatggcttaggctatgaccacccaagccaaaaatttggatttaatttctacactacccacgtagcaagtaaaaatccagaagatacttatgatatttatgcgaaagataaaaaccaaaccaacactagcataaaatggcgcagtaaatcttatactattctagatttaattggatatgtgcaaccaattaaaaatttaaccataagagccggcgtatataatcttacaaaccgtaaatacatcacttgggattctgcgcgttcaattcgttcatttggtacaagtaatgttatagatcaaaagacaggtcaaggcattaaccgcttctacgcaccaggtagaaattataagatgtcagttcaatttgagttttaa

SEQ ID NO: 1473 - DNA, 1746 bp, H. influenzae strain 86-028NP
atgatgatagataaacgcctaattaacacggtggctgacagcaaaaaatggattggcgtcacggtgttgtggaattgggtggcgttagttggcgggattattagtgccgtcgtgttttcttatattttacaggcggcttattttcacaaattgagcctgttaagtgcggtcattttgggcatcgttttgattgcagcattggcattgcgtgcttttgcagggaaaaaatctgtgcaggcgtcttattttgccagcacaaaagtgaagcatgaattgcgtagccttatctatcgtaaattggcttctatgccgcttaaccaagtgaatcaacaatccacctcaagcattattcaagtggcatcagaaggtgtagaacagcttgaaatttactttgggcgttatttaccgcagcttttttatagcttgcttgcaccgcttaccctctttgttttcttgatttttttcagttttaaaactgccgtgattttgttgatttgtgtgccgcttatccctatgtcgatcattgcagtgaataaaattgcgaaaaaactcttggcaaaatattggtcgatttatgtgggattaggcagcagctttttagataacttgcagggtttaattacgctaaaaatctatcaagatgatggttataaagcgaaagcgatggataaagaggctgagcatttccgcaaaattaccatgaaagtgcttactatgcagcttaactcggtttcactgatggatttactcgcttatggtggcgcagctatcgggattttaaccgcactattgcaattccaaaatgcacaactcagcgtgttaggcgtgattttatttattctactttcctccgagttctttattccgcttcgtttgcttggttcattcttccatgtggcgatgaatggcaaagcggcttcagataagattttcacattgttagatacgccagtggaaacccaacaaagtgcggtggattttgaagcaaaaaataacgttcaagtggaaattaaagatctgcatttttcttatagtgaagaaaaatcagcaattacaggtttagatttgagtattttaccaaatcagcttacggtatttgtgggtaaaagtggttgcggtaaatcgaccttagtttcgttgttgatgggttttaatcaagcgcaacaaggtgagattttgtttaatggacaaaacgccctcaatattgaccgcacttctttctatcaaaaagtatcattagtaagccacagcagttatgtgtttaaaggctcgctgcgtgaaaatatgacgatggcgaaaattgatgccacagatgaacaaatttatgcttgtttagaacaagtgaatctcgcccaatttgtacgcgaaaatggcggcttagatatgcagctattaagccgaggtgcgaatttatcgggcggtcaaattcaacgtttagctttagcgcgtgctttgttacacaatgccgagctttatatttttgatgaagcgaccagtaatattgatgtggaaagcgaagaaattattttgcagtttattcaacaatttaaacaacaaaaaaccattgtgatgatttctcaccgtttggcaaatgctgtgaatgcggactgtattaatgtgcttgaccaaggcaaattgattgagcaaggcacacacgaaagcttaatggcaaaacaaggtgcgtatgctgaaatgttccaacaacaaaaagatttagaacaaattagagaggtggcaaatgcgtaa

SEQ ID NO: 1474 - DNA, 1659 bp, H. influenzae strain 86-028NP
atgcgtaaaaatggttttgttgtaatggggcatttgttgaaattagtgactccacttgcacacattatggcgtttaccattactatggggacgctcggtttccttgctgccatctttattatggtgtttggtgcaatggggttagtaaatctcttaaactttgacacccatttaagtttttctggcattttgaccgcacttatcgtattagcggtggctcgtggtgtattgcgttatttagagcaaatgtctgggcattatattgcttttaaattactcgcattattgcgtgacaaagtgttttcttctttgcgtcgtttggcttttgtgaagttgcaagataaacaagcagggcaattagtgtcattagtaaccaatgatattgaattgctcgaagtattttatgcacacaccattgcaccaattatgattgcgttctttacctctgcgattctattgttggtctttgcccatctttcaggttggtttgtagttgtcgcattagccgcttatttaacggtaggtgtgattttaccgattatcaccaccaaattggctcgtgaagatggcagacgctatcgtgaattagtcggcgaaatgaatgatttcttccttgacagcgtgcgtggtatgaaagaaattcagctttttggctatgcacaacaacgtttagcagaaatccaacaacgtagccaaaaaattgataccgcctttgaacgcattaaagaccaagaagcgaaagttcgtgtttatactgaagtggcagtatctgttttcaacatcattatgctgtttactggcttaattttgtttagcttagataaaattgatttcgctgcctttttaatcggcgttattttattaatgtcgagctatgggccagttatcgccttaagtaacctttcaagcaacttattacaaactttggcttctggcgaacgagtattaagtttattagcggaagagccagagttaaaagatgtagaaagtgcggtagatttaaaagatgtttctcgcattgatgtagagaacctaaacttcgcttacggcgaagaacaaattttatcggatgtcagcttatctgtgaaaaaaggcgaaattttaggtattcacggcagaagcggcagcggtaaaagtaccttattgaaattgctgatgcgtttttatgatccaaaatcaggtagcattaaaattaacggcgaaaccttaccgaatatcaacacttgcagtttgcgtgacaatatggcgtacattactcagcaaacctatattttcaacgaaaccattgaagaaaatattcgccttgcgcgccgtgatgcaaccttagaagaaattatggaagcggcgaagaaagcctcaattcatgattttattttgagtttgccacaaggttatcaaacaaaaatgaccgaattgggcggcaatctctctgacggtgaaaaacaacgtatcggtattgcccgagcattcttgcataatgcaccgattatcttgcttgatgagccaaccagtaatttggatagcttaaacgaagcaatgattttgaaatcattactcgatgctaaagctgagaaattgattattctcgtcagccatcgccaatctaccatggctatttgcgatcaggtaattggtatagaaaacggcagaatgtcctaa

SEQ ID NO: 1475 - DNA, 1032 bp, H. influenzae strain 86-028NP; identical to SEQ ID NO: 655

SEQ ID NO: 1476 - DNA, 321 bp, H. influenzae strain 86-028NP
atgcgcgatttagtccgctcgggcaaagtatttctctacggcgaatttattggcttacttagagaagatcatcgaggttttcattttgcttacaatcccgattatcaaggaataccgctctctctcagctttcctattgagcaaagtccttttcattctgacaccttattcccttattttgcatccctcgtcccagaaggctggctaaaacacaaatatgcacttcatcaacgaattgatgaaagcgatatgtttcgctttttacttaataacggggaaaatatgttaggcgcagtgcaaattcaggaagaaaaacaatga

SEQ ID NO: 1477 - DNA, 309 bp, H. influenzae strain 86-028NP
atgaataaccttagtgcgcaattagaaaatcaaattgatgaattaaaaaagcttcagaaatctgtcattacctatgagcaatcgcaaagacaacagctttacgcaggaaaaattaccgatctcaaagcctttggaaaaatgctcaatgataagcgtaaatcacttggtattgagcttagtatgctagaactgcaaactggcgtgtctatttctaccttgaatcgcttatttcaagatccaagccaagttcgatttacaaccgtgtttcttgttgctaaaacattaggggtttcactatgcgcgatttag

SEQ ID NO: 1478 - DNA, 1002 bp, H. influenzae strain 86-028NP
atgaatcgagcattagccattgaattttcacgagtaacagaagcagccgctctagcagcttacacgtggcttggtcgaggagataaaaatgcggcagacgatgcagcggtaaaagcgatgcgttatatgctgaatttgattcatatggacgctgaaatcgttataggagagggcgaaattgatgaagccccaatgctttatattggcgaaaaagtcggttctggcttaggggaattagtttctatcgcagtagatcctattgatggtacacgtatgaccgcaatggggcaatctaatgctatttctgtcttggctgcaggtggcaaaaatacctttttaaaagcacctgatatgtatatggaaaaattagtggtgggttcaaatgtaaaaggcatcattgatttaaatttaccactggaacaaaatcttcgccgcatcgcatctaagctaggaaaatccctttctgaccttaccgtaatggtattagcaaaaccacgtcacgatgccgtaattaaacaaatacataacttgggcgcgaaagtattggcaattcctgatggcgatgtggcaggttccgtattgtgttgtttacctgatgctgaagtcgatcttctttatggaattggtggtgcgccagaaggcgtggcagctgctgcagccattcgagcattaggtggcgatatgcaagctcgtttaatcccacgcaatgaagtaaaaggcgacaccgaagaaaataaaaaaattgcagctaatgagattcaacgctgtgcagcactgggcataaaagtgaatgaagtgttaaaacttgaagatctcgtgcgtgatgacaatcttgtatttactgcaacaggcattaccaatggcgatttgcttaaaggtatctcccgcaaaggcaatttagccagtactgaaaccattttaattcgaggaaaatcccgcacaattcgtaaaattcaatctattcattatttggatgacctttataaaattttgaatatttag

SEQ ID NO: 1479 - DNA, 219 bp, H. influenzae strain 86-028NP
atgtctttagaaattttagaccagcttgaagaaaaaattaaacaagcggtagaaactatccaattacttcaattagaagttgaagaattaaaagagaaaaacgcagaatctcaaagaaatatcgaaaacttacaaactgaaaatgaacagctgaaaaacgaacatcgtaactggcaagagcatattcgttcattacttggtaagtttgataacgtttaa

SEQ ID NO: 1480 - DNA, 441 bp, H. influenzae strain 86-028NP
atgcacatttgtattctttcaggcagcactttaggtggggcggaatatgttgccgagcatttaaacgatgttttagaaactcaaggtttttccaccgcactttttcacggaccaaatttatctgacattgaaaacgagaaaatttggctgattgtcacttcaacgcacggtgcaggcgaattgccagacaatttaaaacccctatttgatgaattagcgaatagccaaaaggatttttcagatgttcgctttgcggtcgttggattaggtagttctgattatgatactttttgctatgcagcggacaaagtggagcaaacacttcaagcaaaaagtgcggtaaaaatttgtgagactttaaaaattgacgtgttaaacgtggatgatcaagaaagttatgctgaagaatggttaccgagttttattgagggattgaaatga

SEQ ID NO: 1481 - DNA, 435 bp, H. influenzae strain 86-028NP
atgatcgccctaattcagcgtgtgtctcaagcaaaagtgaatgtaaagggcgaaacaatagggaaaattggcaaaggtttgttagttttgcttggtgtagaaaaagaagataaccgagaaaaagcggataaactcgctgaaaaagtgcttaattatcgaattttcagtgatgaaaatgacaagatgaatttaaatgttcaacaagcgcagggggaattacttatcgtttcgcaatttacattagcagcggatacgcaaaaaggtttacgcccgagtttttcaaaaggtgcgtccccagcattggctaatgaattatatgaatactttatccaaaagtgcgcagagaaattacctgtttcaacagggcaatttgcagcggatatgcaagtgagcttaacaaatgatgggcctgtgacgttttggttaaatgtataa

SEQ ID NO: 1482 - DNA, 477 bp, H. influenzae strain 86-028NP
atgatcagaattggacacggctttgatgttcacgcttttggcgaagatcgaccattaattattggtggtgtagaagtgccttatcatacgggctttattgcgcactcagatggagatgtggcattacacgcattaactgatgcaatcttaggggctgcagctttaggcgatattggaaaacttttccccgataccgatatgcaatataaaaatgcggatagtcgaggtttactgcgtgaagcgtttcgccaagtacaagaaaagggatataaaataggtaatgttgatattaccatcatcgctcaagcacctaaaatgcgcccacatattgatgcaatgcgtgccaaaatagctgaagatatcctatgtgatattgagcaagttaatgtaaaagcaacgactaccgaaaaattaggctttacaggaagacaagaggggattgcttgtgaagccgttgctcttttaattcgacaataa

SEQ ID NO: 1483 - DNA, 678 bp, H. influenzae strain 86-028NP
atgactcgttcaattattgcggtcttgcccgcggctggtgttggttcacggatgcaagcggataaaccgaaacaatatttaacgctgcttggcaaaacactgcttgaacatacactcgatgtgatgctttcttatcctgctgtatctaaaattatcttggcggtaagcaaagatgatccttatatttctacactatcgctcgatcctaaaattcagttagtggaaggtggcacaacgcgagctgaatctgtcttaaatggtttaaatgcaattgcggaaaaaaatgcctgggtgcttgttcatgatgctgcccgcccttgtttacaacatgctgatattgataaattgttagctattgaagataaacaaggtgcgattttggcaatcccagtaacagatacgattaaacgagcggacaatcagcaatgtattgtaaaaacagaagatcgtagccagctttggcaagcaatgacaccgcagtttttcccagtagatatattaagagatgcgctttccacaggaattcaacaaggtgcgaatataacagatgaagcatcagcgatagaacttgctggatttagaccgcacttagtggctggacgtagcgataatttaaaagtgactcgtccagaagatttagcattagcagaattttatttaacaaggaataaattatga

SEQ ID NO: 1484 - DNA, 279 bp, H. influenzae strain 86-028NP
atgcgacttcttattttaatccttctttctgtattagtattgtttcaatataatttttggtttggcagtaacggttttttagattatcgtcaaaatgctgagaaaattaaggaaaatcaagcagaaaatgaaaagctatctcaacgtaatcagcgtattaatgcagaaattcaaggattaacaaaaggttttgaagcgatcgaagaacgcgcacgaatgcaacatggcttagtgaaagaaaatgaagtgttctatcatattgtaaaagagagtaaataa

SEQ ID NO: 1485 - DNA, 468 bp, H. influenzae strain 86-028NP
atgagcgaaaaatatgtggtaacttgggatatgtttcaaatgcatgcccgcagattatcagaacgtttacttccagcttcccaatggaaaggtattattgcggtgagtcgcggtggtttgtttccagcggctgtattggctagagaattgggtcttcgtcatattgaaaccgtttgtatcgcaagttatcacgatcataacaatcaaggtgaactacaagttcttcatgcagcccaagtgccaaatggcggcgaaggatttatcgtggtagatgatttagttgatacgggtaatacggcacgtgcgattcgtcaaatgtaccctaatgcaaaatttgtcactgtatttgcaaaacctgcaggtgcggaattagtggatgattacgtaattgatattccacaaaatacttggattgagcaaccttgggatttaggtttaacctttgttccacctctctctagaaaataa

SEQ ID NO: 1486 - DNA, 1455 bp, H. influenzae strain 86-028NP
atgtctgaaattacaacacttcaaccttcactgttatggaaatggttcgatcaaatttgtgcaatccctcatccttctcattatgaagatacgttagctaactttattgtaaattgggcaaaagaaaagcatttttttgttgaacgcgatgaagtggggaatattctcattcgtaaacccgcgacgaaaggaatggaaaatcacacgcctgttgtgctacaagcccatctagatatggtgccacaggctaatgaaggcaatccacatgattttaccaaagatccaattcaaccttatattgatggagaatgggtgaaagcacgaggtaccacattaggagctgacaatggtatcggtttagcctctactttagcggtgttagaaagcaatgatttagcccatccacctcttgaagtgcttttaacaatgacagaagaaacaggcatggatggcgcaaaaggcttacgtcatagctggttacaatctgaaattttaatcaatacagataccgaagaaattggcgaaatttacattggttgtgcgggcgggattaacgcaaactttgaaattcccgttcaatatgaaaccaatacgtttgagcgcagcgcacaaatcacccttaagggtttacgtggcggccactctggcggcgatatccatacagggcgtgcaaatgcaattaaagtgttagcgcgagtattagcaaaactttctcaaaatcaaccgcactttgctctctctgatattcgtggtggctcaattcgtaatgcaattcctcgagaagcagcagctgtgttagcctttaatggcgatgtaaaaaccatagaaagtgcggtagaaaatctcgcggttgtgcttaaagaagaattagcaattgcagaacctaatttcacactttttgtagaatccgcagaaaaagcccctaccgtattcaccgcacaaagcactcaaacggttattaacgcactcaacgtattaccaaatggcgtaatccgcaatagtgatgtagttaaaaatgttgtagaaagttcattaagcgttggcgtattgaaaacagaaggtaatgttgtaaaaagcactattttagttcgttcattaattgaaagcggtaaatattacgtaactgaaatgctcagctcacttgcaatcttagcaaatgcaaaagtcgagttttctgcaccttatccgggctggcaacctgtaaatgactcaactatcttagacgttactcgcaaacattatgctgaagtgctaggcgagcaacctgtagtgaaagtcattcacgcaggattagaatgtggtcttttaaaagaacattatccaaacattgaaatgatttctgttgggccaacaatccgaaatgctcactcaccagatgaaaaagtggaaatcgcaacagtacaaacctattgggatttattgacaagagtacttgccgatattcctgcgaagtaa

SEQ ID NO: 1487 - DNA, 888 bp, H. influenzae strain 86-028NP
atgctaacagcgttaaatcgttattgggattatttgcggattgaacgccaaatgagtcctcacacaatcactaattatcaacatcagcttgatgccaccatcaaaatcttagcgcaacaagatattcattcttggacacaagtgacgcctagcgtggtgcgctttattttagcggaaagcaaaaaacaaggcttaaaagaaaaaagcttggctttgcgtttatccgcattacgtcgatttctcagttttttagtgcaacaaggcgaattaaaagtaaatcctgccacaggcatttctgcaccgaaacaaggctggcatttaccgaaaaatatggatggcgagcaaattcaacaattgcttgccaacgatagcaaagaacctattgatattcgtgatcgtgctattttggaattaatgtatagttcaggtttgcgtttatctgaattacaaggcttagatttaaacagcattaatacccgtgtgcgggaagtacgcgttattggaaaaggtaacaaagaacgagttgtgccgtttggacgttatgcttcgcatgctattcaagaatggttaaaagtgcgggcattatttaacccaaaagatgaggcattatttgttagccagcttggaaatcgtatttctcatcgagccattcaaaaacgtttagaaacttggggtattcgtcaaggcttaaatagccatcttaatccgcacaaattacgtcattcttttgcgacgcatatgttggaagccagttctgatttacgcgccgtgcaagaattgcttgggcatagcaacctttccaccacacaaatttatactcacttaaatttccaacatctagcagaagtgtacgatcaggcgcacccaagagcgaaacgaaaaaaataa

SEQ ID NO: 1488 - DNA, 441 bp, H. influenzae strain 86-028NP
atgaaacttttcaaagctgaacaatggaatattgaagtgcttcttcctctttttgaagcctatcgccaagcctatgggcaagcagagaatccagaacgtaccttagcttttttaactaatcgtatgcgttttaatgaaagcctgttttttattgcggtggatgaaaatgaaaaggctattggctttgtgcagcttttccctcgcctttcttctttacaattgcaacgttattggcaaatcaccgatatttttgtgttggaacatgcgcaacaaacagaaatttatgcggcgttgatttctaaagcaaaagactttgtgcatttcacgcaatccaatcgtttagtggcagaattagcgcaaaatcaatattcaatgttggaatcggaagggtttaaattgaacccaaaagaacgtttatttgaattgagtttgtcatgctaa

SEQ ID NO: 1489 - DNA, 792 bp, H. influenzae strain 86-028NP
atggcacgtcgtcctttagttatgggtaactggaaattaaacggtagcaaagcattcacgaaagaattaatcgagggattaaaagcggaattacatgatgtaacaggttgtgatgtagcaattgccccccccgttatgtatttaggtacggctgaagcagcactttctggttgtggttgcagctgtggcggtaaaagtgtgattcaattaggtgcacaaaacgtagatatcaatgtgaaaggtgcatttactggtgatatttctagcgaaatgttaaaagatttcggtgcaaaatatatcattattggccactctgaacgccgcacttatcataaagaaagcgacgaatttgtggcgaaaaaatttggtgcattaaaagaagctggtttagtgccagtattatgtattggtgaatctgaagcagaaaacgaagcaggcaaaacagaagaagtatgtgcgcgtcaaattgatgcagtcatcaatgcattaggcgtagaagcattcaacggtgcagtgatcgcatacgaaccaatctgggcaattggcacgggtaaatctgcaactccagcacaagcacaagccgttcatgcatttatccgtggtcacatcgcagcgaaatcacaagccgtggcagagcaagtaattattcaatacggcggttctgtaaatgatgcaaatgccgctgaattatttactcagccagacatcgatggtgcattagtgggtggcgcatcattaaaagcccctgcatttgcagtaattgttaaagcagcagctgcagcgaaaaactaa

SEQ ID NO: 1490 - DNA, 318 bp, H. influenzae strain 86-028NP
atgtcatttaaagaaataactccacagcaagcttgggaaatgatgcaacaaggcgcaatattagtcgatattcgagataatatgcgctttgcttattcacatcctaaaggtgcttttcatttaacaaaccaaagttttttgcaatttgaagaactagcagattttgattcgcctattattgtgagttgttatcacggcgtgagcagtcgaaatgtagcgacttttctcgtggaacaaggctataaaaatgtatttagtatgattggcggatttgatggatggtgcagagcagaattgccgattgataccacttactaa

SEQ ID NO: 1491 - DNA, 879 bp, H. influenzae strain 86-028NP
atgtttaaaggtattctcgtttcattattagcctcgtttttatttggctatatgtattatttttctacgttactaaaacctttgagtggcacagatattttcggttatcggatgatatttacttttccttttgtcctgttgtccgtcacattatttaaacaaaaagcagctttaattgaacgtttaaaacgcattcaaaaacgaccgcacttagcattgtcatatttactttgcggattattaatgggttttcaaatgtggctttttctttgggcaccgaataatggcagttcattaagtgtatcttttggttatttacttttaccaattgtaatggtggcggcaggtcgcgtgttttttaaagaacgcatttcaacattcaaatttattgccgttatcattgcaacattaggcgtaatttctaatattgtgctaaaaggcggtctttcttgggaagccattgttatctgtttaggttacaccgcatatttttctatccgaaaagcattaaaaaataccgatcttgcctccttttgtttagaaatgttaagccttatgcctgtcagtatttattttgctttacaaacagatttcgcgacagtacaacaaaccaatccgtttatttgggggctgcttgtattactaggattaatcagcggtactgcgttaattgcctatgtaatagccagtaatatgcttcctatgaatttactcggtctgcttggttatgttgaaactattatgatgctatgcgtatcatttttgatcggagaacaaattgatagcggaagctacccactttttatttgtttagttatcgcgatgattcttgttatggttgatggcgtttacaaacaacacgcaaaaggaagtttataa

SEQ ID NO: 1492 - DNA, 879 bp, H. influenzae strain 86-028NP
atggaatttaccgacctacaaatattcatccacctcagtgatacaaaaaacttcgccaaaactgccacccaaaaccacatgtctccctctaccctttcccgtcaaattcaacgattggaagacgagttagggaagacactttttatccgtgataatcgccaagtcaaacttactgaatatggcgagaaatttttgcaatttgctaaaacagaatggcaaaactggcaacaatttaaacaacaactgaaagataaatccgatgaattttgcggtgaaattaaacttttttgttctgtaaccgcatcttatagccatcttcctcacgtacttaaagaatttcgccagcgttatcctaaagtggaaattcaactgactacgggtgatccagcgttagcactagaattaattcaagcgcaacaagtcgatctcgcgcttgcggggaaaccaaataatctgccttctagtgtagtgtttcataaaatagatgatattagtttgtccctaattgccccgcgagtggcttgtttggcgacacaattattgcaagaaaaacctattgattggcagcaaatgccttttatttttcccgttgaaggtcacgcacggcagcgaattgaacaatggttaagggagaaacaaattaaacacccgaaaatttatgctactgttgcaggacacgaaggaattgtgccaatggtgggattaggatttggattagcaatgttgcctgatgcagtaattgacagcagcccaatgaataaccaaatttccagacttaatcttgataaacctattgagccttttgaattaggtatttgcacccaaaaaagaaatctcgaacagcccctagtccgtgcattttgggcgatgttagaatag

SEQ ID NO: 1493 - DNA, 1479 bp, H. influenzae strain 86-028NP
atggctaactatttcaacacattaaatttacgtcaaaaattagaccaattaggtcgttgtcgttttatggatcgcgaagaatttgcagatgaagcaaacttcttaaaaggcaaaaaaatcgttatcgtgggctgtggtgcgcaaggtttaaaccaaggtttgaatatgcgtgattctggcttagatattagctatgccttacgtcctgaagcaattgctgaaaaacgtgcgtcattccaacgtgcaactgaaaatggttttaaagtgggtacttatgaagaattgatcccaactgcagatttagtcgtaaacttaacaccagacaaacaacactctaaagtggttgctgatgtgatgcctttaatgaaaaaagactctgcatttggttattcacacggtttcaacattgttgaagttggcgaagaaatccgtaaagacattacggttgtgatggttgcaccaaaatgcccgggtactgaagtacgtgaagaatacaaacgtggtttcggtgtgccaacattaattgcggttcatcctgaaaatgacccgaaaggcgaaggcttggcgatcgcgaaagcttgggctgctgcaacaggcggtcataaagcaggtgttttagaatcttcattcgtggcagaagtaaaatctgacttaatgggtgagcaaactatcctttgcggtatgttacaagcaggttctatcgtatgttatgacaaattagtggctgacggtaaagatcctgcatacgcaggtaaattaatccaatacggttgggaaaccattaccgaagcgttaaaacaaggtggtatcacattaatgatggatcgcctatcaaacagcgcaaaattacgtgcatttgaacttgctgaacaaattaaagaaagccttggtttcttatattacaaacacatggatgacatcatcagcggtcacttctctgcaaccatgatggcagactgggcaaatggcgataaagatttattcgcatggcgtgaagcaacaggtaaaacagcctttgaaaatgcaccaaaatatgatggcaaaattagcgaacaagaatactttgataacggtgtattaatgattgcaatggttaaagctggtgtagaattagcctttgatgcgatggttgcaagcggtatttatgaagaatcagcttactatgaatcacttcatgaattaccattaattgcgaacaccatcgcacgtaaacgcttatacgaaatgaacgtagtaatttcagataccgcagaatatggtaactacttattctctaacgtagcaaccccaattcttgcaaaagaaattatacccaaccttcaaaaaggtgacttgggcgagcctactccagcagtggaaatcgataacatcaccttacgcgatgtaaacgatgcaattcgtaaccaccctgttgaattaatcggtcaagaattacgtggttatatgacagatatgaaacgtattgctgttgcaggttaa

SEQ ID NO: 1494 - DNA, 1281 bp, H. influenzae strain 86-028NP
atggataataatattcaacgactcattgatagtgcaaaacaatcccttaattcgcctgaaagccataaatatatcgacgaaagttttgaaagctgtattaaatgtacggcttgtactgctgtttgtccggtttcacgcaacaatccgctttatcctggtccaaaacaatcagggcctgatggcgagcgtttacgcttaaaatcagcagaactttatgatgaagcacttaaatattgcaccaactgtaaacgttgtgaagtggcttgtccgtctgatgtgaaaattggcgatttaattgtacgtgcgcgtaataatcacttagcgcagtctaaaaaaccgttaatgaataaattgcgtgatgcgattttaagtaacacagatgttatgggtaaaattaatacgccattagcaccgattgtaaacaccatcacaagcctaaaagccaccaaatttatgttggaaaaaacgcttaaaatcagtaaagaacgtactttacctaaatatgcgtttggcacgttccgtagttggtatatgaaaaatgcgttacaagaccaacaaaaatttgagcgaaaagtagcatatttccacggttgttatgttaattataataatccacagcttggcaaagaatttcttaaagtgttcaatgcaatgaatattggggtaatgttattagaaaaagaaaaatgctgtggcttaccattaatggtaaacggttttcctaatcgcgctcgtaatattgcacaattcaataccgattacattggaaaaatggtagatgaaaatggaatagatgtgattagtgaggcatcaagttgctcgcttaatttacgcgacgaataccatcatattttaggtatcgacaacgccaaagtccgtccgcatatccatatggtaaccccatttttatatcagcttttcaaagaaggtaaaacattaccgttgaaaccacttaaacttcgagtggcttatcacaccgcttgtcacgtagataaagctggttgggcaccttatactttggaagtattgaaaaaaattccgggtttagaaatcattatgttaccaagccaatgttgtggtattgcggggacttacggttttaaatcagaaaactatgaaatttcacaatctattggtaaaaatctattcgataatattaacgagggtggatttgattacgttatatctgaatgtcaaacctgtaaatggcaaattgatatgtcatctaacgtaacttgtattcatccattaactttactttgtatgtcgatggatgcttaa

SEQ ID NO: 1495 - DNA, 1299 bp, H. influenzae strain 86-028NP
atgaattttgatgtagccattattggcggtggtttggcgggtttaacctgtggcatcgcccttcaacaatgcggcaaacgttgcgtgattatcaacaacggtcaagcggccattgattttgcatctggctctttagatttattaagccgtatgccatcaacgacatatggggaaaatcgcgcagtagaaaatttaaaagaaaatattaccgcacttcgcaatgaattacctgcccacccttatagtttattgggtgcagagaaagtgcttgctaaagcacaagattttgaacgtttagccaatgaattaaatcttgatttaattggttctacggaaaaaaatcactggcgtgtaacaggcttaggcagtttacgcggtgcgtggctttcgccaaatagcgtgccaactgtgcaaggtaatgaaccttttccgcataaacgtattgcagtgcttggtattgaaggttatcacgattttcaacctcaacttttagcggcaaatttagtgttaaacccacaatttgaacattgtgaagtaacgagtggtttcttaaatattccacaattagatgaacttcgcaaaaatgctcgtgagttccgtagtgtaaatatctctcaacttctagagcacaaacttgcgttcaatgatcttgttaaagaaatcattgaatcagcacaaggtgcagaagcggtctttttacctgcttgctttggtttagaaaaccaagaatttatgaccgcacttcgtgatgcaactaaacttgcattatttgaattaccaacactgccaccatcattacttggtatgcgccaacgtattcaattacgtcataaatttgaatcccttggtggtttaatgattaatggcgacagtgcattgaatgcaacatttgaaggaaataaagtacgttgtatcaacactcgtttgctagaaaatgaagaaatcactgcagataattttgtactagcttcaggaagtttcttcagcaaagggcttatttccgaatttgataaaatttatgaacctgtttttgaatctgatattatcggtgttgaaggtttcaaccagaaagatcgtttcacttggactgttcatcgctttgcacatccacaaccttatcaatcagcaggcgtagcaattaatgctcaatgccaagtgcaaaagtgcggtcaatttttaacgaatttatatgccgtcggtaatgtgattggtggttttaatgcccttgagcttggttgtggttcgggtgtggctgttgtaactgccttggcagtggcagatgaaatcttagcgaaataa

SEQ ID NO: 1496 - DNA, 1692 bp, H. influenzae strain 86-028NP
atgggattatcgcctagtatctataaagatgttggagatctttcgtcacttagcactgatgtgatcattatcggtggtggcgcaacaggagcaggtattgtgcgcgattgcgcacttcgtggcattgattgtattttattggaacgtcgagatattgcgacaggagccacaggacgtaaccacggattattacacagtggtgcacgttacgccgtgaacgaccaagaatctgctgaagaatgtattaaagaaaaccgcattttgcgcaaaattgcgcgtcattgcgtagatgaaacggaaggcttatttatcactttgcctgaagattcgctcgactatcaaaaaaccttccttgagagctgtgcaaaatctggaattgatgcacaagctattgatcctgatttagctaaaattatggagccttctgtaaaccctgatttagtgggcgctgttgttgtgccagatggttctattgacccattccgtttaaccgcctctaatatgatggacgccacagaaaacggcgcaaaaatgttcacttattgcgaagtaaaaaatttgattcgtgaaggtggaaaagtgattggcgtgaatgtgtacgatcacaaaaatcgcagagaacgccaattttttgcaccgcttgttgtaaatgctggtggtatttggggacaagggattgcggaatatgccgatctcaaaattaaaatgttccctgcaaaaggcgcattactcgtaatgggtcatcgcattaataaacttgtaattaaccgctgccgtaaacctgctgatgcggatattctcgtccctggcgatacaatttgtgtgatcggaacaacatctagccgcattccttatgatcaaattgataatatggaagtaacaccagaggaagtggatattcttttccgtgaaggtgaaaaactcgcacctagcttgcgtcatactcgcgtattacgtgcttatgctggggtgcgaccattagttgcaagcgatgatgatccatcaggtcgaaatgtgagtcgtggtatcgtgctacttgaccacgcagaacgtgatggcttagatggctttattactatcactggcggtaagttaatgacttatcgtttaatggctgaatgggcgactgaccttgtttgtaaaaaactcaataaaacggcacgttgtgtgactgcagagcaacctttgccaggctctactgaaagtcgtcaagagaccaatcaaaaagtcatttcattaccaagtactattcgttattctgccgtatatcgtcacggttcacgggctactcgtttgcttgaaaaagaacgtttagatcgttcaatggtttgcgaatgtgaagcggtaacagcgggggaagttcgttacgctattgatgaactggatgtaaataatctcgtcgatttacgtcgtcgctcccgagttggaatgggaacttgtcaagctgaactctgtgcgtgtcgtgccgcaggactaatgaatcgttttgaagtggcaacaccacgtcaatcaactactcaactttccgcctttatggaagaacgctggcgtggtattgaaccgattgcttggggggaagctattcgcgaagccgaatttacctcttggatgtatggtagtgtattaggtttaaatgatgtgaaaccgcttgatgaacaagcacaacaagggacggatagcaatgaattttga

SEQ ID NO: 1497 - DNA, 1443 bp, H. influenzae strain 86-028NP
atgtttggaccattcaaacccgctccgcatattgcggaacttccagcggaaaaaattgattccacgtataaacgcttacgttggcaagtgtttgcagggatcttcttcggttatgctgcatattattttgtgcgtgcaaactttgacttagcacaacctggtttaattcaagctggcttgtactcaaaagcggaattaggtgttatcggctcagcggctggtcttgcttacggtttatcaaaattcgttatggcaggtatgtctgaccgttctaaccctcgtgtattcttaccatttggtttattgctctctggtttatgtatgaccttaatgggtttattcccatgggcaacttcaggcattgccattatgtgggtaatgatcttcttaaatggttggttccaaggtatgggttggcctccatgtggtcgtactatggtgcattggtggtctaaatctgaacgcggtactatcgtgtcaatttggaatacggcacataatatcggtggtatggtgcctggtgcaatggtgttattagctagtgcaattttcttcagtactcacggtattgaagcgcaggcgaaagatgtttggcaacaatcattatacttccctggtattgctgcgatgatctttgcaattcctgtgtacttcgtgatgcgtgatactccacaatcttgtggtttaccatcaatcgaaaaatggcgtaatgactacccagatgactataacgaaaaaacttacgaaaacgatttaactgcaaaagaaatcttcgtaacttatgtattaaaaaacaaattgttatggtatatcgcgattgctaatgtgttcgtctatttaatccgctacggtgtattaaaatggtctccagtttacttgagtgaagtgaaacacttcaacatcaaaggtactgcatgggcatacacaatctatgaattagcagcggttccaggtacattattatgtggttgggtatcagataaagtgtttaaaggtaaacgtggtttaactggtttcatctttatgatcttaaccactgcagcggttgttgcgtactggatgaacccagctacaccagaagcagagcttgcaaactactcagcttggtatgaaaacccatatcaattaactgatttcgtattaatgaccttaatcggtttcttaatctacggtcctgtaatgttaatcggtttacatgctcttgagcttgcaccgaaaaaagcagcaggtactgcagcaggtttcactggtttattcggttacttaggtggtactgtatcagcttcagcagttattggttgggcagctcaacattacggatgggacggtggtttctacgtaatgatcggcggtggcgtattagcggtgttattactcttaatcgtaatggttgaagaaggaaaacacaaagcgaaattaggcgatacttacggtactaaataa

SEQ ID NO: 1498 - DNA, 1095 bp, H. influenzae strain 86-028NP
atgaaacttaaaactttagccctttctttattagcagctggtgtactagcaggttgtagcagccattcatcaaatatggcgaatacccaaatgaaatcagacaaaatcattattgctcaccgtggtgctagcggttatttaccagagcatacgttagaatctaaagcacttgcgtttgcacaacaggctgattatttagagcaagatttagcaatgactaaggatggtcgtttagtggttattcacgatcactttttagatggcttgactgatgttgcgaaaaaattcccacatcgtcatcgtaaagatggccgttactatgtcatcgactttaccttaaaagaaattcaaagtttagaaatgacagaaaactttgaaaccaaagatggcaaacaagcgcaagtttatcctaatcgtttccctctttggaaatcacattttagaattcatacctttgaagatgaaattgaatttatccaaggcttagaaaaatccactggcaaaaaagtagggatttatccagaaatcaaagcaccttggttccaccatcaaaatggtaaagatattgctgctgaaacgctcaaagtgttaaaaaaatatggctatgataagaaaaccgatatggtttacttacaaactttcgattttaatgaattaaaacgtatcaaaacggaattacttccacaaatgggaatggatttgaaattagttcaattaattgcttatacagattggaaagaaacacaagaaaaagacccaaagggttattgggtaaactataattacgattggatgtttaaacctggtgcaatggcagaagtggttaaatatgccgatggtgttggcccaggttggtatatgttagttaataaagaagaatccaaacctgataatattgtgtacactccgttggtaaaagaacttgcacaatataatgtggaagtgcatccttacaccgtgcgtaaagatgcactgcccgagtttttcacagacgtaaatcaaatgtatgatgccttattgaataaatcaggggcaacaggtgtatttactgatttcccagatactggcgtggaattcttaaaaggaataaaataa

SEQ ID NO: 1499 - DNA, 795 bp, H. influenzae strain 86-028NP
atggataaatcattaaaagcgaactgtattggcgagtttttaggtacagccttattgattttctttggtgtgggctgcgttgcagcactaaaagtagcaggcgctagttttggcttgtgggaaatcagcattatgtgggggatgggcgttgcacttgcagtatatgcaacagcgggtttatctggcgcacatttaaaccctgcagtaaccattgccctttggaaatttgcttgctttgatggcaaaaaagtaattccttacatcatttcacaaatgctcggcgcattctttgctgccgcattagtttatgccttataccgcaatgtttttatcgattatgaaacagtccacaatattgttcgtggtacacaagaaagtttaagccttgcgggtacattctccacttatcctcatccaagtttaagcattggtggcgcctttgctgtggaattcgtgattactgcaattcttatggcattaattatggcattaactgacgatggaaacggagtacctcgtggtccgcttgccccattattaatcggtatcttgatagccgttattggtggtgctatgggaccattaactggttttgccatgaatccagcacgtgacttcggaccaaaattctttgcttatctcgctggctggggcgaactcgctttaactggcggacgcaaaatcccttattttatcgttccaatggttgcacctgttttaggcgcattagctggtgcatggttatacaaaaaagcaattggcggcaatttaccttgtaattgcggctgcgaataa

SEQ ID NO: 1500 - DNA, 1512 bp, H. influenzae strain 86-028NP
atgacagacaaaaaatacatcattgcattagaccaaggcacaacaagctctcgcgcagtattattagatcataatgcgaatgtggttgaaattgcacaacgtgaatttacccaaatctaccctcgagctggttgggtagaacataacccaatggaaatttgggcaactcaaagctcaaccttaaacgaagtcgttgcaaaagcgggcattacatctgatgaaatcgctgctatcggtatcaccaaccaacgtgaaaccaccattgtatgggaaaaatcaaccggtacacctgtttacaacgcgatcgtttggcaatgccgccgtactgcagacattaccgataaattaaaagccgatggccatgaagaatatattcgtaataccacaggcttagtggttgacccttacttctctggtacaaaagtaaaatggattttggataacgttgaaggcgcacgagaaaaagctgaacgaggcgaattattatttggtaccgttgatacttggcttgtatggaaattgactcaaggccgagtgcacgtaaccgattataccaacgcatctcgtaccatgttatttaacatccatactaaacaatgggatgacaagatgcttgaaatcttgaatattcctcgttcaatattacctgaagtacgtaattcttctgaaatttacggccaaaccaatatcggtggtaaaggtggtgtgcgtattcctgttgcagggattgctggtgaccaacaagccgctctttacggacatctttgcgtacatgcaggccaagccaaaaacacttacggcacaggttgctttatgttactccacacgggtaacaaagctattacatccaaaaatggactactcacaaccattgcttgtaatgcaaaaggcgaaccagaatatgccttagaaggttcagtatttatcgcgggtgcatcaatccaatggctccgtgatgaactcaaaactgttcacgatagttttgactctgaatactttgcacaaaaagtgactgatagtaatggcgtatatgttgttccagctttcacaggcttaggtgcaccatattgggatccatatgcgcgcggtgcgatttttggtctttctcgcggtgcaaactgtaatcatattgttcgagcaaccttacaatctattgcttaccaaacccgtgatgtcttagaggctatgcaatcagattcgggtgaacgattacaatatctccgtgtagatggtggtgcgacaaacaataacttcttaatgcaattccaagctgacattttagatgtaaatgtagagcgcccagttgtgaaagaagtgaccgctctaggtgcagcttatcttgctggtttagcaacaggcttctggaaagatttagacgagcttcgcgataaagcccgtgtagaacgcactttcagcccagacagcgacaatgaaaaacgtgaacgtcgctacaaaggctggaaaaaagcagttaaacgctcattagaatgggcaaaagaagatgaagaataa

SEQ ID NO: 1501 - DNA, 468 bp, H. influenzae strain 86-028NP
atgagcgaaaaatatgtggtaacttgggatatgtttcaaatgcatgcccgaaaattatcagaacgtttacttccagcttctcaatggaaaggtattattgcggtgagtcgcggtggtttatttccagcggctgtattggctcgtgaattgggtcttcgtcatattgaaaccgtttgtatcgcaagttatcacgatcataacaaccagggagaactacaagttcttcatgcagcccaagtgccaaatggtggcgaaggatttatcgtggtagatgatttagttgatacgggtaatactgcgcgtgcgattcgtcaaatgtaccctaatgcaaaatttgtcactgtatttgcaaaacctgcaggtgcggaattagtggatgattacgtaattgatattccacaaaatacttggattgagcaaccttgggatttaggtttaacctttgttccacctctctctagaaaataa

SEQ ID NO: 1502 - DNA, 138 bp, H. influenzae strain 86-028NP
ttgcataaagatgcactacccgcgtttttcacagacgtaaatcaaatgtatgatgcattattgaataaatcaggggcaacaggtgtatttactgatttcccagatacttgcgtggaattcttaaaaggaataaaataa

SEQ ID NO: 1503 - DNA, 825 bp, H. influenzae strain 86-028NP
atgaaaacaacgttaaaaatgaccgcacttacggctctttctgctcttgtcttagctggctgtggtgcacaccaaatgaaatcagaagaacaagcaaatatgcaattacaacaacaagctgttcttggcttaaactggatgcaagattctggcgaatataaagcattagcttatcaagcgtacaatgcggcaaaagttgcatttgatcacgcaaaagtggcaaaaggtaagaaaaaagcggttgtggctgatttagatgaaactatgttagacaacagcccttatgctggctggcaagttcaaaataacaaaccattcgatggtaaagattggactcgttgggtagacgcacgtcaatctcgtgccgttccgggtgcggtagaatttaataattatgtaaacagccacaaaggtaaagtgttctacgtaacaaaccgcaaagacagctctgaaaaagcaggcactattgatgatatgaaacgcttaggtttcaatggcgtggaagaatctgcattttatttgaaaaaagacaaatcagctaaagcggctcgttttgcagaaattgaaaaacaaggctatgaaatcgtactttatgtaggcgataacttagatgacttcggtaataccgtatatggcaaattaaacgctgaccgccgtgcattcgttgatcaaaaccaaggcaaatttggtaaaactttcatcatgttacctaacgcaaactacggtggctgggaaggcggtttagctgaagggtatttcaaaaaagatacacaaggccaaatcaaagctcgtttagatgcagtacaagcttgggatggtaaataa

SEQ ID NO: 1504 - DNA, 684 bp, H. influenzae strain 86-028NP
atgaagaagaatttttcagtggggaaattgccgtttaaaggaaaaagtgcggttaattttcaccgcacttttaaaccaaaattaaaacccaaaacgttgtcgttggatgaaaccaaagttgtgttattcaataaaccttttgatgtactcacgcaatttaccgacgaacaagggcgcgctaccttaaaagattttatttcaattccaaatgtttatgcggcaggtcgattagatagagacagtgaaggattactgattttaaccaataatggcgaattacaacatcgtttatcagatcccaaatttaaaacagaaaaaacctattgggtgcaagtggaaggtatccctgaagaaaccgatttagcacaactcagaaaaggtgtagaacttaaagatggtatgactaaacaggctcaagtgcggttaatttcagagccaaatttatgggaacgcaatccacctatccgagaacggaaaaatattcccacaagctggttagaaattaaaattagtgaagggcgcaaccgccaagtgcggagaatgactgcgcatattggcttccccaccttacgattagtgagagtgagtatgggctcattatctattgatggattagcaaatggctcatttagattattatcattggatgaaataaaagtattatttcagaccgtcaaattataa

SEQ ID NO: 1505 - DNA, 1015 bp, H. influenzae strain 86-028NP
ttgatttactttataaatttgaattttaggaatgttatgaatgacgctattttagaacccaaacatcgtggcaatgtacgtgaaattgccgcaattgatcttggctcaaacagctttcatatgattgttgcgcgtattgtaaacggctcaatccaagtgctttcgcgcttaaaacaaaaagttaaactcgcggaaggcttagatgaaaatgcggtgcttaatcaagaggctatcacacgtggcgtgaattgcttagccttatttgccgaacgtttacaaggttttcctatggaaaacgtcaatgtagttggcacttatacgttacgaagagcggtgaataatgacgaatttttacgtcaagcagccaaagttttcccctatcccattaatattattagtgggcaaacggaagctaaaaccatctacgctggcgtatgccatactcagccagaaaaaggcagaaagcttgttatagatattggtggcggctcgacagaaatgattatcggcgatgatttcacgccgcttatggctgaaagccgacatatgggatgcgtgagttttgcgactcaatttttttaccgatggcatcatttccccagaaaactttcaacgcgtgcgccaaagtgcggtcaataaaatcgaagatttaggctttgaatatcgcaaattaggttggcaatctgtgctcggctcatcggggacgattaaaactgttgcgcaagtcattgcgactaatctcgatccaaatggaaccattacagccgagcgattaaatgctctaattgaacaaacactacaagccaagcattttaccgagctaaatattaacggtttaaaccaagaccgtgtggatgtttttgtacccggtttagcgattttaagtgcagtgtttgaggtttttcatattcaacaaatgcgctattctgacggtgcattgcgcgaaggcgtcatttatagcctagaaaaaacttccaagttgcagatattcgagcgtgcaccgcttgagggttaa

SEQ ID NO: 1506 - DNA, 3885 bp, H. influenzae strain 86-028NP
atgacagaacaactacaaccatcagaaacttcaccaaaattacctgagaaacctaataaaaaacattgggtacgcaaggctgtttgtatcggaagtgcggtcatttttatacctgttttaggtgttgctggagtgctttctttcgatgcggggcaaagaggtttaattcaacttgtcgataaaatgcttgatagtttttccgttgagcaaattgaaggcggattacaaaatggcttggtgttaaagaatgttcgttatcaaaccgctgggattgagacacatattgcacaagcacgtttacagctcgattttggttgtttgctttcacgtgaagtttgtttacgagacttcaccttaaataaaccgaccattgcgattaatactgcattattgcctccatcggcacctgataattcaaagtctggctcaatgaagcgtatttccttgccaattagtatcaatgcagaaaatttggtggtgcaagatttatctgtaaacattgatcagactaatattacgcttggaaattttaaaagtgcggtaagtttaaataatgaaaaaggcttaactattgcgccgactgaaattaacgatatttcagtgattgcaaaaaaattgcccgaaggtaaacctgagctgaaagccaaacagccgaataaacctgtagattgggctgcgattgagcaatctttaacgcctgcttttttaggcaatgtatcagacataattcttccttttgatttacatattcctgaaatttcaggcaaaaactggcagtatcaagcagtgaatgaaaaagacgaaacgcttcaatctgttgaaatgtctagtttaattgcacaggcggataccgtcgataaccaactgcaattacaaaaattagcggtagaaagctcgttgggtaatctttcttcacaaggtaaattacaactcgatggcgatatgccgctagatttaactttaaaatcccatttggagccgttgaaatccgctggaaaagaaattctgccagagagtgatgtggatcttacgctttcgggatcattgaaaaaatccaccgcactttctgtgaaaacaaaaggcgtattagatgctgaactgaatggcaacgtgcaattagcacaagataaaatgcccttaaacctcacattaaacgtggcaaaaggacaatacacttttgtaaacacaatgacgccactcaaaattaatgatgtgacgcttaaactcacgggggatttactgaattatcacgccgaatttaagggcaatgtggcaggaatgaattatattcccgcatctcaagtagactttaatgccgacggcaaactttatgaaataaccgtaaataaattggggatagcttcattagacggtaaaagtgaatttgtgggtaatgcaaattggaaaaatggtgcaaactgggatattcaagccgatttagaaaaaatgaatattggtttttttgttccagttatgcctgccatattatcgggtaaattacattctcgcggttttgcggactctcaaggttggcaagtggaagtgcctacagctgatttaaatggaatattgtctgcaaaaccaattagcttgaaaggttctgcaacgcttaatcaaaatgtacttctaaccgtgcctgatttacagattagatatggcgaaaattatcttaaagccagtggcgtattagatgatcattctgattttgtgctagatatagatgcaccaaatttacgtggtttatggtcagatttaaaagggcgagtagcgatttctggtcaaattacgacacctaatcttgatcttgatttaacttcatccaatttacatttacaaggttttcagttagctaaagcaagtataaaaggtcatataaacaataccccactctcgagtggaaaattgaatattaaatcagaacaacttcattatggcgaaaatattaaactccatttacttgatcttgatttatcaggcgatgaacaaaatcacaaattaatcctaaaatctcaaggcgagcctgttgctgcaaatttacaaattaacggccattttgaccgcactttggaacagtggaaaggcacactttcccaagcaaaatttgaaaccccaattggcgatgtaaaatctaaccaagctattgcggtgtcttacgataacaaacaaacacaagccaatattgccgcacattgctggcaaaacacagatatagaattatgtttcccacaagcattcaatgcaggcaagcaaggtaatatccctttccaattcaaacgtgttaatttggatttaatgaataaacttatcgaacaagatagcctcaaaggaaacttgcaagcgcaaggtaatgtggcttggtttacggataaaccattccaatttagcacaaaagtagatggcaatcatttagctttctctcaaaaattggattaccgcacgtttaaattagatattccaaaattaacccttaatgccgacattcaaaataataatttggttttaaaaacagacatcaatttgcataatcaaggcagaattgtaggcgatattcgtttaaatgattttgttaaaactcgccaacttggcggaacccttgcgatagaacgattaaacttgtcgatcgcaaatcagctacttactagcggtgaatcagtgaatggtaaggtagtctcgaagttgagtttcggcgggaatttagagaaaccattattaaatggtgacttcaatattcgtaatattcgtaccaaattgaaatctatgccagtcaatattacagatggcgatattgccctacgctttaatggtaaccgttcaacattgcaagggaaaatcgaaacagtagatagtcacttaaacttaactggacgtgcaaactgggcgaatattgaacattggacgacagaattgaatgcacaagcaaataatttcaacgtggatattccatctatggcgaagctacgtttcagtccagatatcacgataaaagccaatcctaaggaattgaatttaagcggaacagtggatattccttgggcgcgtattaaaattgacagtctgccagatactgctgagccagtcagcgaagatgaagtgattttaaacggcccgcacaagagcaaagaagaactgattaaacgtgaatttgccgcaaaaacgaaatcaggaatggatattcgctctgatttacgcatcaatattggtaaagacgtcagccttgatgcctatggcttaaaaaccaatcttgatggtttactttctgtgaaacaagacaaaggcaatttaggtttattcgggcaaatcaatttaaccaaaggtcgctatgcttctttcggacaagatttactcattcgtaaagggcttattagtttttctgggcaagcggcacaacctacgttgaatattgaggctattcgtaatcctgaaacaatggaagacagcaaaattactgctggagtgagagtgattggcatagccgatagcccagaagtcactattttcagtgaaccaagcaaaccacaagatcaagcactttcttatttattaacaggtcgttcgttagaaagtagtggagaagtgggttcaacgggatcagttggtgcagcattaattggtttaggcatttcaaagagcggtaaattagtgggcagtattggcgaagtttttggtattcaagacttaaaccttggtacatctggcgtgggcgataaatctaaggttacagtaagtggcaatattaccaatcgcttacaaataaaatatggcgtaggtttatttgatgggttagcagaagttacattacgttatcgcctaatgccacagctttattttcaatccgtttctagcacaaaccaagtgtttgatttactttataaatttgaattttag

SEQ ID NO: 1507 - DNA, 1737 bp, H. influenzae strain 86-028NP
atgaagaaaaaatcgctaaaactcaccgcactttttttagcattaagttgctttcccgcatttgctgaacaaactgttgatattgaagttcaaggcattcgtggtttccgtgctgtgcgtaatacagatctcaatgttaatttgattaataaagaagaaatggatggctccgaacgctatcaacatttggtaaccaaagccgtggatcgtggtttgcgtgtgtttggttattatgaatcttccgtgcgttttgaacgaaaacagcgtcaaggcaaacgcgatttattgattgctcatgttacaccaggcgagccaacaaaaattgcggggactgatgtgcaaattgagggggaagccgcacaagatgaaaattttaatgcattgcgtaaaaacttaccgaaagatggcgttttggttgagcaccaaacttacgatgattacaaaacagcgatttcacgcttggcattaaatcgtgggtattttgatgggaactttaaaatttcacgtttagaaatcagccctgaaacccatcaagcatggtggcgaatgttatttgatagtggtgtccgttatcattatggcaatattacttttagccattcacaaattcgggatgattacttaaataatattcttaacatcaaatctggtgatccgtatttaatgaataatttgtcggatttaaccagcgatttttcatcttcaaattggtttagctcagtattagttcagcctaatatcaatcataaaagtaaaacggtagatatagaaatcattctttatccacgtaaaaaaaatgcgatggaactcggtgtgggctttgctactgatggcggcgttcacggacaaataggctggacaaaaccttggattaatagccgtggacatagtttgcgttcaaatctttatctctctgcaccaaaacaaactctagaggcaacttatcgaatgccactgcttaaaaatccattaaattattactatgattttgccgtcggttgggaaggggaaaaagagaacgataccaatacgagagtgcttacgttgtcagcgttacgttattggaataatgcgcatggttggcaatattttggcggacttcgtacgcgatacgacagttttacacaagcggatatcactgataaaaccttacttctttatccaactgttggatttactcgtactcgattacgtggtggttcctttgccacttggggcgatgtgcaaaaaattacttttgatttaagcaaacgaatttggctatcagaatcttcttttataaaagtgcaagcatctagcgcgtgggttcgtacttatgcagaaaatcatcgtatcgttgctcgtgctgaaatcgggtatttacatacaaaaggtattgaaaaaattccgcctacactgcgtttctttgctggtggcgatcgtagtgtgcgcggttacggctataaaaaaattgcgcctaaaaataaaaacggaaaattagttggtggttcgcgattgcttaccgcttctttagaatatcaatatcaagtctatccaaattggtgggcggcaacttttgcagatagtggattagctgccgataattacacggcaaaagaattgcgttatggtgcaggcgttggtgtgcgttgggcatcgccagttggtgcgattaaatttgatattgccacacccattcgtgataaagataacagcaaaaatattcaattttacattggacttggtacagaaatttaa

SEQ ID NO: 1508 - DNA, 573 bp, H. influenzae strain 86-028NP
atgaaagtagaaaaaaatgtagtggtgagcatttcttaccaagttcgcacacaagatggcgtattggtagatgaagctccagcaaatcaaccactagaatatttacaaggtcacaataatttagtagtcggtcttgaaaaagcacttgaaggtaaagaagttggcgacaaatttgaagtacgtgtacaacctgaagaaggttatggtgcgtacagcgaaaatatggttcaacgtgtaccaaaagatgtattccaaggtgttgatgaacttgaagtcggtatgcgtttcttagcggatactgacattggcccagttccagtggtgattactgaaatcgatggcgatgaagttgtagttgatggaaaccatatgttagcggggcaagaattacatttcacggttgaagttgttgcagcgcgtgaagcaacgttagaagaaattgctcacggccacgttcacggtgcacacagccacgatgatgacgaagaaggtcacggttgtggctgtggtggtcatcatcacgaacataatcacgaacataatcacggcagctgtggttgcggcggtcactaa

SEQ ID NO: 1509 - DNA, 423 bp, H. influenzae strain 86-028NP
atgtcaaaattggctgaattacaagcagaaacccgtgaaattatcgaagatttacttaatgatggcagtgatccaaatgcgctttacattattgagcatcacatcgcacaccacgattttgatttgttagaaaaaattgcggttgatgcgtttaaagcgggctatgaagtttccgaagcggaagaatttaaagatgatgacggtaaaccaattttctgttttgacatcatcagtgaagtagaattaaaagctgaaattatcgatgcacaacaaaaacaaatccttccattgttagaaaaacataaaggcatttatgatggttggggcacctattttgaagacccaaatgccgatgacgatgaatacggtgacgatggggaattttttgatgatgaagatgaagaagagcctcgtgttcattaa

SEQ ID NO: 1510 - DNA, 1020 bp, H. influenzae strain 86-028NP
atgctcgaacaactcccttatttggcattaaaaactccgccaaaaaccaccgcacttttaaaggctgaatgcgcggattttattgtaaaagagcatttaggctatgaaatgtcgggcgatggagagtttgttgcattgtatgtacgaaaaacagattgcaacaccttatttgttggcgaaaaattagctaaatttgctggtgtttctgaacgcaatatgggatatgcagggttgaaagatcgtcgagcggtgacagaacaatggttttgcttgcaaatgccaggaatggaaacgcccgatttcagtcaatttgaattagatggcgtagagattttaacggttactcgacataaccgaaaaattcgcacgggtagccttgaaggaaattatttcgatattttattacgcggtgcagaagaatctgatgagcttaaagtgcggttagattttgtggcaaattttggtttcccaaattattttacggaacaacgttttggtcgggaaggtcataacctcacgcaagcattgcgttgggctcaaggggaaatcaaggtaaaagatcgcaaaaaacgcagtttttatctttccgccgcgcgcagtgaaatttttaatctggttgtggctgcgcgtattgcaaagggcgcaacaaatcaagttttaccaaatgatattgtgcaattagcaggttcgcacagttggttcaaagcggatgaaaaagaagacttaactgtcttgcaagtgcggttagaaaatcaagatattttactcactgctcctttaattggcgaagatattttagcagcaagcgatattgaaaatgaaatcgtaaatcaacattcagctttcgattctttaatgaaacaagaaagaatgaaagcagtgcgtcgcccattgttaatgaaagcaaaagggttttcttgggcatttgagccagaaggcttgcgtttaaaattttatttgccagcaggcagttatgccacggcattagttcgtgagttagtaaattacacagaagaataa

SEQ ID NO: 1511 - DNA, 750 bp, H. influenzae strain 86-028NP
atgcgaattttagttagtaatgatgatggttttcatgcggaaggcattcaagttttagcaatggaattaagaaaaattgcagaagtcattattgttgcacccgatcgtaatcgaagtgcagcatcaagctcgctcacattggttgagccattgcgcccacgccatttagataatggcgattattgtgtaaatggcacacctgcagattgtgtacatttagcgttaaatggatttttatctggccaagtagatttagtggtatcgggcattaatgcgggttgtaatatgggcgatgatacgatttattcaggcacattagctgcagcccttgagggtcgtcatttaggtttgcccgctattgcagtttcgttagatggtcgtcagcattatgaaacagcagcacgagtggtatgtgatctcattccaaaattacatcatcaattattaaaccctcgtgaaattattaatatcaatgtgcctgatttgctttttgaagaattaaaaggctacaaagtttgtcgcttgggttaccgtgcatcttcagcagaagtgattaagcaaaaagatccgcgtgatgaaaccatttattggattggcccttcagcattacccgaagatgaaagcgaaggaacagatttttatgccgtgaagaatggttatgtgtctatcacaccaattcaagcggatcttaccgcatatcattcattgctttctttgcaaaattggttagagcaggaatttaccaaatag

SEQ ID NO: 1512 - DNA, 579 bp, H. influenzae strain 86-028NP
atgaaaattttcggcacgatgtacgataaaacgatggaatggtcaaaacatcgttttgctgttttttggctctcttttgtaagttttatcgaggcgatattttttcctattccgcccgatgtgatgctgatcccaatgtctatgtcaaagccaaaaagtgcggtgaaatttgcattttatacggcaattgcgtctgtaatcggcggaattatcggttatgctattggtttttatgcaacgggctgggtggaaaacattgtgcaacaatggggatatgctgcgcattgggcaaaagccgtcagttggtttgagcaatggggcgtattagttgtgtttgtggcgggttttagcccaattccttacaaggtgtttacgctctgcgctggagtaatgcaaatggcatttttcccttttgttatcaccgcatttgtttcacgtttagcacgtttcttgctagtagcaaaattagctgcatggggcggtgaaaaattcgcagcaaaattgcgaaaatctattgagattattggctggtcagtggttgtactggctataatcgcttactttatactgaaaaactag

SEQ ID NO: 1513 - DNA, 186 bp, H. influenzae strain 86-028NP
atgaacaaattaagtcttgttttagtagctggatttcttttggttggatgtgcatcagaaccagttaaagatccagatgcattaccaaatggcattatgcaaccagtagaaggcacaggtgccgttgctggcggtagttttatgccagaaattcaaaaaaatacgataccaacacaaatgaaataa

SEQ ID NO: 1514 - DNA, 1218 bp, H. influenzae strain 86-028NP; identical to SEQ ID NO: 740

SEQ ID NO: 1515 - DNA, 1419 bp, H. influenzae strain 86-028NP
atggaaaattttaaacatttacctgaacctttccgcattcgtgttattgaaccagtaaaaagaactactcgtgagtatcgtgaacaagcgatgttaaaatcaggcatgaatccatttttattagatagtgaagatattttcattgacttacttacagatagcggtactggtgccgttacacaagatatgcaagctgcaatgttacgtggcgatgaagcctatagtggcagtcgcagttattatgcgctagctaaagcagtgaaagatatttttggttacgaatatacaatccctactcaccaaggtcgcggtgctgaacaaatttatattccagtattgattgctaaacgtgaacgtgagaaaggtttagatcgcagcaaaatggtggttttctctaactatttctttgataccacacaaggacatagccaaattaatggggcaacggttcgcaatgtttatatcaaagaggcatttgatacaacagcaaaacatccatttaagggtaatttcgatttagaaaaattagaaaaaggcattcaagaggcgggagcacataatgtaccttacattgtatgtaccattacttgtaactctgcgggtggtcagccagtttctattgcaaacttaaaaggcatgtatgaaattgcgcgtaaatacgatattccagtcatcatggattcagctcgttttgcagaaaacgcctattttgttcaacaacgtgaagaagcttataaagactggactattgaacaaattacttacgaaagctatcgctatgctgatggtttagcgatgtccgccaaaaaagatgcgatggtgccaatggggggtattttagcgtttaaagataaatcaatggaggaagtctatcacgaatgtagaacgctttgtgttgtgcaggaagggttccctacttatggtggtttagaaggtggtgcaatggaacgtttggctgttggcttgcatgatggtatgcgccaagaatggctggcttatcgtattgcgcaaattgaatatttggttgcaggcttagaaaaaattggtgtgccttgccaacaaccaggtggccacgcggcgttcgtagatgcgggtaaattattaccacatattccagccgaccaattcccagcacaagcactttcttgcgaactttataaagttgcaggtataagagcggtagaaattggctcatttttattaggacgagatccgaagacgggtaaacaactaccatgtccagcggagcttttacgcttaactataccacgtgcaacttatacgcaaacgcatatggatttcattattgaggcattccaaaaagtgaaagaaaatgcagagaatattaagggtttaacctttacttatgaaccaaaagttctccgccactttacggcacgtttaaaagaagttgaataa

SEQ ID NO: 1516 - DNA, 1233 bp, H. influenzae strain 86-028NP
atgaaaaaacaaccttccatctttggtggtgcgtgtattattgctagtgtttgtgttggggcaggaatgcttggtttgccgacatctggcgcgggtgcttggacaatatggtcagtattagtaatttgcttaacaatgatagtcatgacattgtcaggctggttattacttgaggcctactctacttatgatttaagagcttcatttagtactgtaactaaagatatgctcggttcaactgtcaattctattaataatcttgcggtatattttgtcgggggtattttactttatgcttataccactgcatctggcggtatactagaaaaccttattaaaccgtggattgattttggttcatctacattggcaatttgttccactgtatttgtattagttttttccttctttgtttggcactccactcgcattgtagacagaatatctgttttattgattgtatgcatgggttttacttttatttttagtacttatggattagcaactaatattagtttagacactttattagatattggtggaaaggagacaaattatgcaaaatatgcggtaggaatgtttcccgttgcattaacatcttttggctatcatcattctgtttgtacgatgcgagcttactatggggaagaaaaaaaagcaaaatacgctatcttaggtggaacagcaattgctcttacgctttatttactttggattttctctatttttggcaacttaccgcgagatcaatttgctccagtaattgccagtgatggtaatttagatattttacttaacacattaggtggagtaatcgaatctaacacggttaaacaaatgattaatgccttttctatcgccgcaattttatcatcttttattggcgtaggattaggcgtatttgattatttggctgatttctttaaatttgataattgtaaaattggacgaacaaagtcatgggctgtgactttcctacctccactaattatgtcaattttatttccattgggtttcttaaaagctattgggtatgctggtgcggtagctacgatttggacaagtataattcctgctcttcttgcctataaatcccgcaaaataaatacagctgcaacattccgagtgtgtggtggaaatggtttaataatctttattgcattatttggtgtttttgtagctattttccattttcttgcaatgtttggctgcttacctttctttaagttctaa

SEQ ID NO: 1517 - DNA, 2586 bp, H. influenzae strain 86-028NP
atgatttccgaagaaaatttccaacagcacacgccaatgatgcaacaatatctaaaactcaaagcagagaatccagatattttgttgttttatcgcatgggggatttttacgagttgttttatgacgatgcgaaaaaagcggcggcattgttggatatttctttgacgaaacgagggcaatctgcaggacagcccattccaatggcaggaatgccttatcacgcggtggaaggttatttagcaaaattagtgcagttaggcgaatctgtggcgatttgtgaacagattggtgatccatctacaagcaaaggacctgtagaacgtcaaattgtgcgaattgttacgcccggtacggtcagtgatgaagcactgttgcctgaacgccaagacaatctgattgctgcggtatatcaagaaaaagaaaaatttggattagccactttagatatgacttctgggcgttttcagctttgtgaacctgcagataaagaaacattgcgtgcggaattgcaacgtattgtgcctgtagaattgctgtattgtgaagaatttaatgaaatggcagccatagaacattgtaaaggattacgccgtcgcccgatttgggaatttgaacttagcactgccattacgttattaaatcgtcaatttggcacaaaagatttacgcgcctttggtgtagaaaaatcccctctcggcttaagtgcggcaggttgtttattgcaatatgcaaaagaaacccaacgtaccgcattacctcatattcaaagcattagcttaattcaaaaccaagactgcattcagttagatgccgccacgcgcagaaatcttgaattaacacaaaatctttcgggtggcacagaaaatacgttagcctctgtcttggataaatgcgttacgccaatgggcagtcgtttgctgaaacgttggattcatcagcctattcgtgatgtggaaaaattaaaacaacgccaacaagcgattgcggaaattctgaattttgatttagtcgatgaactccaaccttatttgcaattagtcggcgatatggaacgtattttagcgcgtgtggctctgcgttcagcgcgtcctcgcgatctcactcgcttacgcacagccttagaacaaattcctgcattacgcacgattgtgcaacaaaaaacatcgccatttttaaccgcacttttcagccaaattgccgatttcagtgagcaatgggatttattgcaacgtgcattgattgaaacgcctccgcttttaattcgggatggtggtgtaattgctgaaggttaccatgcggagttggacgaatggcgtatgctgtctgatggtgcaacgcaatatttggaaaatctcgaaaaacgtgaacgtgaaagtacaggtattgatacgctaaaaatcggttttaatgcagtgcatggttattacattcaaattagccaaggccaagcgcataaagcacccattcattatgtacgtcgccaaaccttgaaaaatgcagagcgttacattattcctgagctcaaagaatatgaagacaaagtactgaaatcgaaaggtgcagcgttagcattagaaaagcagctttacgatgaattgtttgatttattattaccgcacttaggttcattacaactggctagccttgcactctctgaattggatgtgttagtcaatcttgctgagtgcgcagataccctcaattacgttatgccaacattctgtgatgaagtgagtgtgaaaattgaaaatggtcgccatcctgttgtggaacaagtattgaaagatcctttcattgccaatccagtggagttaaatcacaaccgtcatttgttaattatcactgggccaaatatgggtggtaaaagtacttatatgcgtcaaaccgcattaattacattgcttgcgtatatcggtagctttgtgccagcagacagtgcgcgaattgggccgattgatcgtatttttactcgaattggtgcgtctgatgatttagcctcggggcgttcaacctttatggtggaaatgacggaaatggcaaatattcttcaccaagccactgagcaaagtctcgtgcttattgatgaaatcggtcgtggcacatccacttatgatggcttatccttagcttgggcttgtgcggaatggttagccaaaaaaatccgctcgcttacattatttgccacccattattttgaattaaccgcattgccggaacagctagaaggcattgccaatattcatttagatgcccttgagcataacaacagcatcgcctttatgcacgccgtacaagatggcgcagcaagtaaaagttatggtttggcagttgcggctttggcaggcgtgccacaatccgtcattaaactagcaaaacagaaattgacacaattagaaaaaaactcaagctattcagccgaacagcaaattcaagcgttgcgtgaagccaatcacaatcagggcgaattattgtttgaacaagaaacggatgcactaagagaggctattgaaaagctggatcccgatgatttaagccctaaacaagccttggcgtatttgtatcagttaaagaaaatggtggggtaa

SEQ ID NO: 1518 - DNA, 1386 bp, H. influenzae strain 86-028NP
atgaccgcactttttcaacaacttccttccgttgataaaattctcaaaacatctcaaggtctacaacttattaccgaatttggtcacactgcagtcgtggcaacatgtcgagaattattaacccaagctcgtcaatttataaaaaaaaacaatcaacttcctgaatatttttctaattttgaccgcacttttgtagaaattcattctcgcctacaaaaacaaaaccaagtacaaatcaaagcggtgcataatctgacaggtacggtattgcacacaaatcttgggcgggcactttggtctgaagcagcacaacaagcagcgctttctgtgatgcaaaaaaatgtttcgcttgaatatgatttagataaaggtaagcgtagtcatcgcgataattacatcagtgaattattatgcaaactcacaggtgctgaagctgcctgcatagtgaataacaacgctgctgcggtattgttaatgttagcgacctttgctcaaggtaaagaagtaattatttctcgtggcgaattaattgaaatcggcggtgcatttcgtattccagatattatggaacaagctggatgctatttagtggaagtgggcaccactaatcgtacccatctgaaagattatcgtaatgctatcactgaaaatacggcttttttaatgaaagtgcatagcagcaattatcaaatttgtggttttacctcttcagtttcagaagaagagcttgcggaactaggccgagaaatgaatgtaccagtagtcactgatttaggtagcggcgcattgatagatttaagccaatatggcttaccaaaagaatcaactgtgcaagaaaaagtcgcacaaggtgtgggtttggtctctttctctggcgataaattgcttggtggcgtgcaagcaggcattattgtgggtaaaaaagaatggatcgaacaattacaagcccatcctctcaagcgtgcattacgttgcgataaagtcattttagctggcttagaagccacattacgtttgtatttaaatcctgaaaaattaactgaaaaattaccaactttgtacttactcacgcaaccattaaaacaactcaaaataaatgctatgcgtctcaaagagcggttagaatctcgcttaaattcacaatttgatattcaaattgaagctagccaagcacaaatcggtagtggctcacaaccaatggaaagaatcccttccgtggctgttactattgcagaaaaaacaaacgtaaaactttccgcactttcagctcgttttaaacaactttcccaacctattattgggcgaatggaaaacggaaaaatttggctagatttacgtagccttgcagctattgaaacattattaaatacattggatgaactatga

SEQ ID NO: 1519 - DNA, 1860 bp, H. influenzae strain 86-028NP
atgattattgttacttcaggtcacgttgatcacggcaaaacagcattattaaaagcattaactggcacaagtaccgcacatttaccagaagaaaaaaaacgcggaatgaccattgatttggggtatgcctatctgccgttagaaaacaaagtacttggctttattgatgtgccggggcatgaaaaattcttgtcaaatatgctggcaggtttaggtggtgtgcattatgcaatgttaattgtcgctgcggatgaaggggttgcgacgcaaacaaaagaacatttagcgatattacgccaacttcaattccacgaaattattgttattatcacaaaagcagatcgtgcaaattcagcgcaaatagaatcgttaatccaagaaattaaacaaaattatagttttttacgtggtgctaattacttcgttacctcagcagaaacgggacaaggaattaatgaattacgtcattacttagctaatctacctgaattatctgatacccaaaaacctttccgttacgcaatagaccgagtattcaacgtaaaaggggcgggtaccgtcgtgacaggcacagccttttcaggaacagtgaaagtaaacgatgaaatttacctttccactggacagaaagttcgtataaaagcgattcacgcacaaaatacatcaagcgaacaaggtattgcggggcaacgtttagcgttaaatttaaatgctgatttagaccgcacatcaatgaaacgaggtgattggttattgcagaatgagccacttccaccaacagatcgcatcagtgtacaaattttggctgaagtaccattaaatgaaaaccaaccagtgcatatttatcacggtgcaagtcgcactacgggtaaactcactttattacagggaaaaaatgccgcaaaaaatgaccgcactttagctgaaatcatattggattcaccattattcttggcttttggagacaaacttattttacgcagtggcgatacaaaaaccttaattgccggcgcacgagtattggaaattaactcgccaaaacgtcataaacgcactgaagtgcggttaaatttcttagcgaatttagcattggcagagaacgcttcgcaacgtattgcgcttacccttaaacataatgcgacaacagcacgccaattaatgtggacggaacaactgacttccttgcaattagataaagcactcgtcgagcgagacgccgtacgttatcaagattggtgttttaatactaattacatacaagaaaaaacgcagcaaattttaaccgcacttaatacttatcacgagcaacataatgatcaacttggtgtaagcaaagccagattatatcgaatgaccgccttaaaccagcctgaaaacttgatcaatcattttattgatgaaatgttaaaagagggaagattacagcaaactcgaggttggcttcacttacccgaacataaaatccaatttagccaagaagaacaaaaatattggtcaagtgtattcgatgaatttgaaaaagcccaaggtcaagccatttgggtacgtgatatggcaaatgctctcgctattgatgaatcaattatgcgtaattttatgtataaagctgggaaattgggttacctcacgccaatcgtgaaagatagatttttcttaactgaaaccatctatgcttatgcgagactcatcaaacaaatcgcagaagaacaaggaaaagtttccgtaaatgaagtacgtgataaattgaatttcggacgcaaacttaccgttcaactgatggaatattttgaccgaatgggatttttacgtcgcaaaggcaatgaccatattctacgcgataagaatgtttttgatttatga

SEQ ID NO: 1520 - DNA, 855 bp, H. influenzae strain 86-028NP
atgaaaaaaacgctcgttgctgcattaattagttctgtcatcttgctcacaggctgccaagataaagatactgaagcaaaaataaaacaactaaatcaaacggtagcacaactcagtgctgaaaataccaaattaaaagagcaaatagaaaaaacagttccagcaattattgtggaaaatgatgaaatatttaatcaatctgaaattattaaacatcctaaatcgaaagaagattaccagcctgaagaaaccaaaattgagtattcaatttcaacaataaaaaccaatattgattggcttaatgatctattgtggaaaaaattgactgaaaatgaagaaacgaaaaatatttctcgcgaacaatttgtagcacgttatcaaaccgcttttgaggaagacaaaaaagaggcaaaagaaacaccatcttttggaatttctcattctatatggacaaattttatcgggcaaaaagaaaaacttgcaacctttgcgattagtttttatgactatgaaggtggtgcgcacggtattgaaggtaatcgctatttcacaattgatctaactacacgccatattttgacattaaatgatttatttaatgaaaaagatttaccgaaagtaaaaacgcttttatgggaacaatataataatagcaataaggaatatgaacctattattgaagccgatagttttaatttatcaaacaatatttacttagattcaaaaggtgtacattttatttatgatgtttatgaaatagccccttacgcagcaggagagcaagatttaatgctacattttgggcaactagaagaattatttaaaccagaatttagacagggtaatgatatttaa

SEQ ID NO: 1521 - DNA, 297 bp, H. influenzae strain 86-028NP
atggcacttacgaattcctctatcagctttagaacagttgagcaaacaaaatcagaagcttatcaagttattgaacaatatggacttaccccatcacaagtattcaatatgtttttggctcaaattgccaagactcgctctatccctattgatttgaattatcttcgcccaaataaagaaaccctagcagctattgatgaattagatagtggtaacgcagagagcttctttattgaagctagtgaaaattattctgccgaagaatttacaaaacgcattcttaatggtggtcaataa

SEQ ID NO: 1522 - DNA, 309 bp, H. influenzae strain 86-028NP
atgtcagaagagaagccattaaaagtaagctattcaaaacaatttgtaagagatttaactgatttagctaaacgctcccccaatgtgttaattggctcaaaatacattactgcaatatactgtttattaaatcgtttacctttacccgaaaactaccaagatcacgcattagtaggagagtggaaaggttatcgagattgccatattcaaggcaatttggtactgatttaccaatacgttatacacgatgaatttgatgaattgaaattttctcgtttaaatacacactcacaaaccgctttaaaatag

SEQ ID NO: 1523 - DNA, 3193 bp, H. influenzae strain 86-028NP
atgaccaactttaaattcagcctgcttgcttgctctattgcatttgcattaaatgcaagcacagcttatgctgcccaaccaaccaaccaaccaaccaaccaaccaaccaaccaaccaaccaaccaaccaaccaaccaaccaaccaaccaaccaaaatagtaatgtttctgaacaactagaacaaattaatgtttcaggaagtacagaaacaattaatgtgaaagagaaaaaggtaggtgaaacccaaatttctgccaaaaaattagcgaaacagcaggcgtctgattctcgtgatctcgttcgctatgaaacaggtattacggtggttgaaacaggtagaacgggcgcaagtggttatgctgttcgaggggttgatgaaaaccgtgtaggtattatggttgatgggcttcgtcaagctgaaaccttaagctctcaaggatttaaagaattatttgaaggctatggcaattttaataatactcgtaatagcattgaaattgaaaatgttaaaacagcaactattaccaaaggtgctgactccttaaaatccggtagtggtgcattgggtggctctgttatatttgaaactaaagatgctcgagattatctgatagataaagattattatctttcctataaacgtggctatcaaacaatgaataatcaaaaccttaagacacttacattagcaggacgttctaaaaaatttgatattttagtcgttgatacaaaacgtgatgggcacgaaatagaaaactacgattataaaatttatcccaataaacaggcggatttaagtgcggttggtcctacccgtgaaaaagccgatccttatcaaattacccgccaaagcacattaataaaattgggctttcagcctaatgaaaaccatcgcttgagcgtggcattagatgattccactttagaaacaaagggtatggatttgtcttatattttcaatcaatgcaaaaatactaaatgtgaggaaaaatatggcgagcgagttattaatgatcaatctaaaagaaaaaatattcaatttagttatgaaaatttcagtcaaacccctttttgggatcatattaaactaagttattcctcacaaaaaattaccaataaagcacgctctgatgagtattgtcatcaatccacttgtgctggtgtacgtaatccacaagggctacatttagtagaagaaggtggaatttataagattaaagataaagacaatcaagaatttacaggaaaatataattatggcttagaactacaaaacaaaaagggtgaagatgttagtaatgatgtagatacagaaggaggctcacttgattcggtcttaattaattgtgaaaaattaaattgtaataaaaaatttcaggtttttgttggaaaagatgaaaatgggaatgacaaatataattatgaagaccgaaatattaccattaaagaattaaatggcaaaaaatatggtgaaatctcactaaaatcagcagaaggtaattatggattaacccaatatgaaagtgctaaatttttatttccaaaaagccatggctacagcacagacttcgttaatgaccgtgatttaaacacccatacccaacaaattaaacttgatttagacaaagaatttcacctatggcatacccaacaccaactaaaatatggtggactttatgaaaaaacactaaaaagtatggtgaatcatcaatactacactgttgccaatgtgcaatggtgggctggcaattttttctgtaacaaacctgtagatggcacatatcctgtggagcatactcctgcacctgatcatagtgcttacagatgtagcttaatgaattccaataaaggtaaagatacctatttaatccctgttaccactaaaaataatgtgttgtattttggagataatgtgcaacttacctcttggctaggactagatttaaattatcgttatgaccacgtaaaatatttgcctagttatgacaaaaacattcctgttcctaatggattaattactgggctatttaagaaatttagctcaaaggaatatgtttatggtagtaaatactcaatacctccaggatatgaaaattgcacttacgacacaccgtgttataaaaaaaattttgaagacaatcttgccctgttattacgcaaaactgactataaacatcattcttacaatttagggttaaatcttgatcccacaaattggcttcgtgtacagcttaaatacgccaatggttttcgtgcgccaacctctgatgaaatttatatgacatttaaacatccacaattttccattcagcctaacacagatttaaaagctgaaacctccaaaacaaaagaagtcgcgttcactttttataaaaacagtagttatattacgttaaatgcgtttcaaaacgattaccgtaattttattgacttagtagaagtgggcgaacgtcctattgaagaaggctctgcaataaaatatccgttccatcaaaaccaaaatcgagatcgagcaagagtcagaggtatcgaaattgcttcacgtcttgagatgggcgatttatttgaaaaactacaaggtttccatttaggctataaatttacctatcaaaaaggcagaatcaaagacaatggattacatccaaaatataaagaatttttggaattgaataaagatgaacatccagaatacgaagccattgctcgtaaacctcaaccaatgaatgccttacaaccaaccacatcggtatacaatattggctatgatgcaccaagccaaaaatggggcgtggatatgtatatcactaatgttgcagcaaaaaaagcaaaagatagctttaattctcaatggacaagtatggtcgccagaaaagaaaagcaatatactgacaatgcaacagatatacctgctacaaaagcaaacggcaaagatgtaaaagattctcgcggattatggcgtaataatcgctatacagtgatcgatacgattgcctattggaaaccaattaaaaatcttacatttaccgctggtgtatataatttaaccaacaaaaaatatctcacttgggactctgctcgctctgttcgacatcttggcacaattaaccgagtaaaaacagaaactggtgaaggcttaaaccgcttttatgcacctggcagaaattacagaatgtctgttcagtttgaattttaa

SEQ ID NO: 1524 - DNA, 1299 bp, H. influenzae strain 86-028NP
atgtcattaaatattgaaacaactcaaggtttagaacgccgcgtagcgattaccgttccaactgaaattgtctctaaagccgttcgtgaagaatttaaacgtgctgcaaaaaatgtgcgcgtagatggtttccgtaaaggtcatgttcctgcccatatcattgaacaacgttttggtgcgtcaattcgtcaagatgtattaaacgatttattaccacgtcatttttttgatgctgttattgcagaaaaaattaatattgcaggtcgtccaacttttgctattgaaacttttgaagaaggtaaagacttagttttcactgcaactttcgaggtttatccagaagttaaattacaaggtttagaaaatatcaaagttgaaaaaccaactgttgaaatcacggaagctgacattgataaaatgatcgatgtgttacgtaaacaacaagctacttgggctgaaagtcaagatgttgtaaaagcagatgatcgtgtcactattgattttgttggctctgtagatggcgaagaatttgaaggtggtaaagctactgactttgtattatttatgggtcaaggtcgtatgattccaggttttgaagaaggaattgttggtcataaagcaggtgagcaatttgatattgatgtgactttcccagcggaataccacgcagaaaacttgaaaggtaaagcagcaaaatttgcgatcactttgaaaaaaatcgaaaatatggtgttgcctgaattaacagatgaatttgttgctaaatttggtcctaatactaagtctgttgctgatttgcgtgcagaaatccgtaaaaatatggaacgtgaattgaaaaatgcgttagtttctcgtgttaaacaacaagtaatcaatggtttaattgaacaaaatccgattgatgtgccagcttctgcagtagaagaagaaattaatgtattacgcaatcaagcagctcaacgttttggcggtaatgcacaacaaactgcacagttaccgcgtgaattatttgaagctgaagcaactcgtcgtgtacaagtgggtttattattctctgaagtgattaaatctaatgaattaaaagctgatgaagaacgcgctaaagcaatgattgcagatattgcatcagcttacgagcagccagcagaagttgtggaatattacagcaaaaacgaagagttaatgaataatattcgcaatgtagtattggaagaacaagctgttgatgcagtacttgcaaaagcacaagtaacagaaaaagtttcttcattcgatgaaattatgaatccacaagcataa

SEQ ID NO: 1525 - DNA, 582 bp, H. influenzae strain 86-028NP
atgagtgtaattcctatggtcgttgaacagacttcgcgtggcgaacgttcgtacgacatttattcccgtttattaaaagaacgtgtgattttcctaagtggagaagtggaagatcgtatggcaaatttaattgtggcacagcttctttttttagaatcggaagatccaactaaagatattaatatttatattaactctccaggcggttctgtgaccgcaggtatggcaatttacgacacaatgcaatttattaagccagatattcgcactctttgtattggtcaggcttgttcaatgggcgcattcttacttgctggcggaaccgctggcaaacgagctgcgttacccaatgcgcgagtgatgatccatcaacctttgggtggtttccgtggtcaagcatcagatattcaaattcacgcacaagaaattttgaaaattaaacacaccttaaatgatcgtttagcattccatactggacaaggtattgagcgtattgagaaagatactgaccgtgataattttatgtcagctgaagaagcacaagcgtatggtttggtggatgaagtcttggttaaacgttaa

SEQ ID NO: 1526 - DNA, 1236 bp, H. influenzae strain 86-028NP
atgacagacaaagataaagatttgcactgctctttttgcggaaaggaaaaaggcgaagtagatagattaattgctggcacagacggttatatttgtaatgaatgtattgaactttgtcactcaatgcttgaagaaagtcatgataaaaatttagaggaaagtgcggtagaaaatgaagaaaaattaccaacacctcacgaaattcgcgctcatctagatgattatgttatcggtcaagattatgcgaaaaaagtgctttctgtggcagtttataatcattataaacgcttgcgaactaactatgaaagcaatgatgtagagcttggtaaaagtaatattttacttataggccctacaggtagcggaaaaacgttacttgcgcaaacattagctcgtcgtttaaatgtaccctttgcgatggcagatgcaaccacattaacggaagctggttatgtgggagaagatgtagagaatgtattacagaaacttttgcaaaattgtgaatacgatactgaaaaagcagagaaaggcattatttatattgatgaaattgataaaattagccgtaaatcggaaggcgcatcaattactcgagatgtttcaggagagggggtgcaacaggctttattaaaacttattgaaggtacaatagcttccattccacctcaaggcggtcgtaaacatccacaacaagaaatggtaaaattggatacgtctaaaattctctttatttgcggcggtgcatttgcaggattagataaaattattgataaacgcactcaaaccagtacgagtattggttttaatgccaaagttgaaaaagatgaaaaacaacaatctctttctgaattattccgtcaagttgaacctgatgatttgatgaaatttggtttaattccagaatttatcggacgcttgccaatgattgccccattaagtgaattagacgaagatgcgctgatacaaattctcacaaaaccaaaaaacgcattaattaaacaatatcaagccttatttggattggaaaaagtagaattggatttcacaccagaagcattaaaagcaatggcgaaaaaagcacttgaaagaaaaacgggtgcgcgtggcttacgttctatcgtagaagcagtgttgttagatacaatgtatgatctaccgtctcttgagaatttacaaaaagttatcgttgatgaatcgacaattgtagataatcttgcgccaaaattagaatattag

SEQ ID NO: 1527 - DNA, 417 bp, H. influenzae strain 86-028NP
atggcaaccgaaattgttgataaaaagaaaaatacgcaagaagtgatcgttgaaggcaaatctaaaggtttaaatacattcctttgggttttagttgtgatcttttttgctgctgcggcaattgggaatatttatttccaacaaatctattctttaccgattcgtgttattggtatggctattgcattagtcattgcatttattttagcggcaattactaatcaaggaacaaaagcacgtgcgttctttaatgactctcgtacagaagcgcgtaaagtcgtatggccaacccgtgctgaagcgcgtcaaacaacattgatcgttatcggggtaacaatgattgcttctctcttcttttgggcagtagattcgattattgtgacagtgattaatttcttaactgatttgagattctaa

SEQ ID NO: 1528 - DNA, 558 bp, H. influenzae strain 86-028NP
atgactgaagaaacaacagtatcaaaaaaacgttggtatgtattacaagcgttttctggctttgaaagtcgtgtagctctaactttacgtgaatacataaaacaacaacaaatggaagatcaatttggtgaagttttagtgccaactgaagaagtggtggaaaatgtagcaggtaaacgtcgcaaaagtgaacgtaaattttttccaggttatgtacttgtagaaatggaaatgaatgatgaaacttggcatttagtaaaaagtgtgccaagagtgatgggttttatcggtggtacaccagataaacctgcacctatttccaaacgtgaagcggatactattttaaatcgtcttgaacaaaatactgataaacctcgtcatcgtaatgaatatcatccgggagaggaagttcgtgtgactgaagggccatttgctgattttaatggtacagtagaagaagtggattatgaaaaaggtcgcttaaaagtgtctgtatcaatctttggccgtgctacaccagttgagcttgaatttggtcaagttgaaaaaatacactaa

SEQ ID NO: 1529 - DNA, 753 bp, H. influenzae strain 86-028NP
atgaaaacaaaggtaattttgaccgcacttttgagtgccattgcactaacaggttgtgcaaatcacaacgccacgaaacaagcaagtgagcgtaatgattcccttgaagacttcaatcgaacaatgtggaaatttaactataatgttatagatcgctatgtgctagaacccgctgcaaaaggttggaataactatgtgcctaagccgatttcttctggtcttgctggcatcgcaaataatcttgatgagccagtcagtttcataaaccgattaattgaaggtgaaccgaaaaaagcatttgttcactttaatcgcttttggattaacactgtatttggactaggtggttttattgattttgcgagcgcaagcaaagaattacgcatagataatcaacgtggatttggggaaactttaggtagctacggcgtagatgctggcacttatattgtgctaccgatttataatgcaacaacaccacgccaattaacgggtgcagtggttgatgcggcttatatgtatccattctggcaatgggttggtggtccgtgggcattagtgaaatatggtgtgcaagcagtggatgcccgtgcgaaaaatctcaataatgcagaattgttacgtcaagctcaagatccatatatcacgttccgagaagcttattaccaaaatttacaatttaaagtaaacgatgggaaattagtcgaaagcaaagaatcacttcccgatgacatactaaaagaaattgattaa

SEQ ID NO: 1530 - DNA, 393 bp, H. influenzae strain 86-028NP
atgatgactcaaattattcatactgaaaaagcaccagcagccattggcccttatgttcaagcggttgatcttggcaatctagttttaacctcagggcaaattccagtgaatcctgcaacaggcgaagtgccagctgacatcgttgcacaagcacgccaatctttagaaaacgtgaaagcgattatcgagaaagcaggtttaaccgcagccgatattgtaaaaacaacggttttcgtgaaagatcttaatgattttgctgcggttaatgcagaatacgaacgtttctttaaagaaaataatcatcctaacttccctgctcgttcttgcgtagaagttgcgcgtttaccaaaagatgtgggattagaaattgaagcgattgctgtaagaaaataa

SEQ ID NO: 1531 - DNA, 852 bp, H. influenzae strain 86-028NP; identical to SEQ ID NO: 750

SEQ ID NO: 1532 - DNA, 282 bp, H. influenzae strain 86-028NP
gtgcggtatgatatggctctgtttttcaaaagaaaaaagaatatgtctgaaatttccgtcacacaaaccctaaatactttaggattacgttgcccagaacctgtcatgcttgttcgtaaaaatattcgtcatcttaacgatggagaaatacttttgattattgctgacgatcctgcaacaacaagagatattccaagtttctgtcaatttatggatcacacattactgcaaagtgaagtggaaaagcccccgttcaaatattgggtgaaaagaggaaaataa

SEQ ID NO: 1533 - DNA, 621 bp, H. influenzae strain 86-028NP
atggcggaatacctcgttcctaaaagtgcggttgtttttgaagaagaaattaagaaaagccgttttattacttatttacagcacaccgaaggtttagaagacgcaagagctttttgggcaaagattaaacaagaacatccaaatgctcggcatcattgttgggctgccgtagcaggcaagccaacagattctctacaacttggtttttctgatgatggcgaacctgctggaacggcaggaaagccaatgttgagtgcattgcaaggtagtcaattaggtgaaatcagtgcggtggtggttcgctattatggcggcattttgcttggaacgggcggattagttcgtgcttacggcaatggcgtacaacaagcgttaaagctgattgaaagcgaaattaaagttgaacgaacccctttcaaacttgattgtgactatggtcagttaaggttggttcaacaactttgtgaaaaatatcaggttgagattttatctcaaggttttcaggcaaatattcatttgattttaggtattagtgaaaaaacaatagaggcgttttcttcagaattaacggaaaagtcttcaggtagattggttattcaacttttagagataggcgaatag

SEQ ID NO: 1534 - DNA, 1464 bp, H. influenzae strain 86-028NP
gtgcgtattttatcgattatccgaattattggtattcttgtgatgtgtttttcaggtacgatgctagttcctgcatttgttgctctgatttatggtgatgggggcggcaaggcatttatgcaggcttttatgttgagcttgacagcgggcacattgctttggtggccatgccatcaccataaacaagaattacgatcccgtgatggttttttgattgttgtggctttttggttagttttaggaagcttggcaacattgcctcttttattgttcgattcaccacatttaactattgcttcagccgtatttgaagcattttctggcttaactactactggtgcaacggtaatgacggggctggataatttacctaaatctattttgttttatcgtcagtttttacaatggttaggtggtatggggattatcgtattggctgtggcgataattccgctgttgggaattggtgggacacaattatatcgagcagaatcttcaggccctcttaaagatcaaaaatctttgcctaaaatttcagaagtggcgaaagcgctatggattatttatgcttcattaactgttctttgtgccattgcatattggctatcaggaatgaatctttttgatgccattgggcatagtttttcaacaatttcaaatggcggattttcaacgcacgatgcaagtattggctattttaatcaagcttccatttattgggttacaacaatttttatgctgattggtggtgttaattttagtttacatatttccgcttttcttgcactaggtaaaagaaatatttggcgaaattattggaaagatcccgaatttcgtttttttctaacgatgcaaattatttttattggtattgtatctctatctttatatggttatggtttagtttcagatataaacgaggcagtaacaaaaggtgcattacaattaacatcaatgtcaatgactgctggttatacgatttttgatattgataatcttccgccttttattgggcttttactggtaatttctgcggtaattggtggttgtggtggttcaacaactgggggattaaaagcgatacggacacttatattgtggaaacaaatcgatcgagaactgcatagtttaatccatccaaatttagtacaaccaattcgaataggtaaaaatcgtctagcaccaagaatgatagaaagtatttgggcatttttcattatttttatactggtttattgggggtgtgtttttgctgttattctttgtggaatgaatacttttgatgcgatgggagccgtattcgccacattaacgaatgcaggaccgggacttggttttattcacgaaagttttattggtgttccagaaagtgctaaattagtctttagttttgctatgatctgtggacgtttagaaatgttttcattaatcgtgctgtttattccaagctattggaaaaaataa

SEQ ID NO: 1535 - DNA, 420 bp, H. influenzae strain 86-028NP
atggaagagtccctagaattagaaaaattgccacgaatcattactgatgtattgaaaattgtgctttgtacagcgttgattgcgctagcgattgtgcttattattgcccttgtaaaaataacttatactttatctatgatggtgcttaacacttcgtctgttgtaccttatgatgttgctgaacaagcagtaatgtttttcttatatttcgggtttattggtttgattgtgcagtattttaaaagcggatatcacttccctttacgctattttatttatgctgggatcactgcgatgttgcgtttaatcattgttaatcatgaaagctcggtggataccatcttatttgcaggcgcaattttgattatggtgatcgcactctgtttggtgttatattctaataaactgaaaaatatatag

SEQ ID NO: 1536 - DNA, 1287 bp, H. influenzae strain 86-028NP
atgtttagagtgctctttttaatgctgacattgcttgtaggacttgtagcagggccttatatttctggtcagcaaggttatgtgcgcattgagacagcaaatcgtattatagaaatgtccatcactaccttagtgatttttttcattatttctttagcaataatttatgcttttgaatggggcatcactcgtttctttcgtttaagtcgtagctcttatcaatggttttctaatcgcaaacgtgtaaaagcgcaaaaacaaacccttgaaggcttggtaaaaatgaatgaaggggattacgctaaagcagaaaaattaattggcaaaaatgctaaacattctgctgaacctgtactaaatctcatcaaagcagcagaagctgctcaacaacgtggcgacgaatttagtgcaaatcgctatttaattgaagcgacagaattagccggctctgataatttgctcgtggaaattgcccgtactcgcattttattgcaacaaaacaagttacctgcagcacgcagttctgtagatagcttattagaaatggctcgtcgcaataaagaagtattaaaactcgcggtagaaatttatcttcgctctaaagcctatcaagctctagataaaattttagacaatgttgcgaatagcggtttattcaatgatgaagaattcaaagatcttcgatctaaaaccgaaaatggtttactcgacgagaaaatgaacgaagaaggaattgatggcttactaacttggtggaatcagcaacctcgtcatcgccgtaacaatattgaacttaaaattagccttattcaacgtttaattgactgtaatgatcatgaatcagctactgaattgacatttgaaatactgaaaaaactcggtgacaatacagcaatcagtttacctctttgtactcaaattacacgtttacaaccagaagataacagtaaacttctcaagctaatagaaaaacgtgcaaaacgtgtggatgaaaaacaaaaatgctgtatcaatcgtgctttgggttatttatatgttcgtaacaatgaatttattaaagcagcagatgtattcaaaaacgtgatcgcttgccctgaacaattagaacaaaatgatttgatgatggcatcttatgtatttgaacaagcgggcgataaagcattagctgaacaagttcgccaagagagtttgaaatcagtgatggcaattcaggatgtcattccagaaagtgcggaagaaaaaacagaagaaaattcaaccgcacttttagaaagcaaatctgagtag

SEQ ID NO: 1537 - DNA, 1212 bp, H. influenzae strain 86-028NP
atggcaaaagagcaacctaacgacctcactgaacaacttacagatacgcccaaaacagctgttgaacaagctgaaacaatgcagtctgttccgcaaactattgtgaaaaaaacgggtacagcattgagtttattagcaatacttgttgcgctaggtattggtggagctggatactattttggtcagcaacaaatagctgaaattcaacagaaattaaccgcacttgaaaatcaaacgggagcaaatctttcctcaaataacaccaataacaataaacgacttacacaattagaacagagtttaaaaactgcacaagaaaatatagctcaactggaacaattaattgtaagcaaaacaggggaaataacatccttacaaactcaaatgaaacaagtaagtcagcttgccatcgcacaacaaccaagcgattggttattttccgaagctgattttttactaaataatgccctgcgtaaacttgttttagataacgatgttgatacagcggtttctttattaaaattagctgatgaaaccctcgtcaaggttaataattcacaagcaaatgaaattcgtagtgcaatcaatcaagatttaaaacaacttctttcgctttcaagtgtggatcaaaatgcgataatgcaaaaactgtcacagcttgcaaacacagtcgatgaattacaggctttgaatgtaaattttgatgaaacatctaaaaataatgataaattatccaacaacattactgactggcaacaaaatattgaaaaaagtgcaacctctttcctaaatcattttattcgtatttcgccaaaacaaaattcaaataaaaaagaattacttgcaccaaatcaagatatttatcttcgtgagaacattcgtctacgtttacagcttgcgattatggcagttcctcgtcagcaaaatgaactttataagcaatctctagaagctgtttcttcttgggttcgtagctattttgatacaaacgctgaagtaacacaaaatttcttaaaattagtagatggattgactgatacttctatttatgtagatgtaccagagcaattaaaaagtttaacattacttgacaaatatcttaatcgtacagctttagatctacaaaaagtggaaattgaagcagacaaggcgattgatacaatgcctaaagtagaagctgttaaaccaacacaatctgaatcacaacaataa

SEQ ID NO: 1538 - DNA, 2532 bp, H. influenzae strain 86-028NP
gtggaatgtaatctagcacaagcaaaacaatgggttagcgccttggatcaacgccgttttgagcgtgcattacaaggttcaggcgatgcattccaacacgttttagcgattgcacctttacttctacacctaaaccatccgcaacttcccggctatgttattcacgccccctctggcattgcgaatttccttgcttctgattatcaaaaaaaatggctcaccaatgaatacagtattcactatgccgatcataagccatcaacactcaaaagtgcggtaaattttcacgaagttttaccaccaattctaggcgtttatgtaatgggtagctttggctcaataagtcaaacctcttcttcagatcttgatacttggatttgtgtccgtgatggcttgagtccagatgaatatacacttcttactcaaaaagccaagcggattagtgaatgggcaatgcaatttaatgtggaaattaatttttatttgatggatcaacaacgtttccgcaatgaacattatgctgacccactgactattgaaaatagcggctctgcgcaatatatgttattgcttgatgagttctatcgctccgccgtacgcttggctggtaaacctctactttggttgcatttatgggtggaaaatgaaaaagactatgaaaaacaggtggcgcgtttaattactgaaggggaaatagatccaaatgattgggtggatttcggcggtttaggacaattttctgcaaacgaatatttcggtgccagtttatggcatctttataaagggattgattcaccttataaatctgtgctcaaaattttgttgttggaagcctattccaaggaatacccaaacacttgcttaattgcccgcacttttaagcgagatttactttcaggcaataccaatcctgatcaccattttgatccttacattgccattcttgcaaaagtaacccaatatttaaccgcactttctgaatttaaacgtttggattttgtgcaccgttgtttctatgtgaaagcaacggaagattttgcacgttaccaagccaataattggcgtattcgttatatggaaatccttgcgcaagaatggggatggtctgcagaaacggtaaaacatctcaataagcgtccattttggaaaattaaggcagtaaaagaaaaccacgataacataatgaaatttttaatgttgagttatcgtaatttagtggaatttgctcgaaagcatcatattcactcgagcgtcgtgccacaagatatcaacattctttctcgtaaactttatactgcttttgaagaacttcccggcaaagtgtccttactcaacacacagatatctcacaatttatcagaagcacacctgacttttgtggaagttcgtggcaataaacattttaaagatagttggtaccttatcaatcaaccaatacaccatattatgttctccaaagaacgggtgatcgaatacggagaaagcctgaataaattagtttcttgggcttatttcaatcatttactcacagaaaaaaccgaattgtcaatttttagcaagaatgtgactttaagcacattgcaacgctttgtcactaacttacgtcagtcttttccaagcaccatcgccaaacaacctaaaaatagcgatttattgaatcaatgtgaaattcgtagcttgtttattgccataaatctcacgaccgatccaacatccaaagtagaagaagtattaacgggtatttcatcgcgagatttatttagttttggatcgcttgagcaaagccttgtgggcagtattgattttacttatcgtaacgtgtggaacgaaatccgaacgctccattttgaagggcaaaatgccattttgcttgcactaaaagtgctttctaacaaaatttatcgtggcgttaatcgcccagattccatccaagtctattgttatagtgaacgttatcgccaagatttacgtcaattagtgatgggattagtcaatcgatgcgttagcatccaagtcggcgatattcaacaaccttgccaaacgtcacgtttacgcgtagcgggtaaaaactggcaattattttttgaagatcgcggcatcagcttacaagaaatcggaaatgaatcggtctgtaatgacgctgaaagtgcggtggattttgacgaagttttacaaacaccaattgaagatggcgagacaaaccaagaaagtcgtcgctatccaccagaaatggatgccttcgcaagtgaaggattcctacaattcttttttgaagataattctgatcacagcttcaatgtttatattttagatgaatctaatcatctcgaaatctatcgccactgcgatggtgaaaaagatgaaaaagtgcgggagattaatcaactttatcaaaacgccaaacaggaaggcgataaaaatccttacaatatcgttcaacataattttaactaccctcaattttatcaactacaaaatggaaaaaatggcatatccatcgtgccgtttaaattccgccaaatgaataagtaa

SEQ ID NO: 1539 - DNA, 1008 bp, H. influenzae strain 86-028NP
atgataacttcgcaaacaccaatcactgtgctaggtgcgggatcttatggaactgcgctggcaattaccttttctcgcaatggttctcccactcacttatgggggcacaatcccgtccatatcgcacaaatgcagacagaacgacaaaattatcgttttttgccggatgtcatctttcctgaggatcttcatttagaaagtaatcttgcacaagcaatggaatattctcaagatattttaatcgtggtgccaagccatgctttcggtgaaattcttataaaaattaaaccgcacttaaaagcccatcaccgattaatttgggcaacaaaaggtctggagcgtaacacagggcgtttactacaaaccgtagttgaagaacaactcggaacgcaatatccactagctgtactttctggcccaacttttgcaaaagaattagcgcaaggtctaccatcagctattacgcttgctgccaataacgagcaattcgcgcgggaatttcagtctcgtattcattgtagtaaaggtttccgagtttatataaattcggatatgactggcgttcaacttggtggtgcaattaaaaatgtgatcgcaattggtgcgggtatttcagacggtatgggatttggcgcaaatgctcgcacagcactgattactcgaggtattgcagaaattacccgcttaggtatctcgctcggtgcaaataccaatacatttatgggaatgtctggattgggcgatttagtgctaacttgcaccgataatcaatcgcgcaatcgacgttttggattaatgctaggtaaaggattagatgcccaaatggctatggaaaatatcgggcaagtcgtagaaggtttttataatacaaaagaagcctatttgcttgcacaaagacaaggtgtggaaatgccgattacagaacaaatttatcaaatgctgttttgtggcaaaaacgcacaagatgtagcaatcagccttttggggcgagcatgtaaaggcgaataa

SEQ ID NO: 1540 - DNA, 804 bp, H. influenzae strain 86-028NP
atgacattagatgtgtggcaacatattcgccaagaagccaaagaacttgctgaaaacgaacctatgcttgctagtttttttcactctacaattttaaagcatcaaaatctgggtggtgcgctaagttatttattggctaacaaattagccaatcctattatgccagctatttctctccgtgaaattattgaggaagcctatcaatctaatccttcgattattgattgcgctgcttgcgatatccaagctgtccgccaccgagatcccgctgtagaattgtggtccactccattgctttatttaaaaggtttccacgcaattcaaagctatcgaattacccattatttatggaatcaaaatcgtaaatcccttgccctttatttacaaaaccaaatttcagtagctttcgatgtagatattcacccagcggcgaaaattggccacggaatcatgttcgaccatgcaacaggtattgttgtgggtgaaacatctgtaatcgaaaatgatgtttcaattttgcaaggggtaacacttggcggtacgggaaaagaatcaggcgatcgtcatcccaaagtacgcgagggtgttatgattggggcgggtgcaaaaattctcggtaatattgaagtgggtaaatacgccaaaattggggcaaactctgttgtgcttaaccccgttcctgaatatgccacagcggctggcgtgccagctcgaattgtaagtcaagataaagcagcaaaacctgctttcgatatgaaccaatattttatcggcattgatgatggaatgaatttaaatatataa

SEQ ID NO: 1541 - DNA, 816 bp, H. influenzae strain 86-028NP
atgatcaacaaagatacccaactctgcatgtctttatcaggtcgtccgagtaatttcggtactacctttcacaattatttgtacgacaagctagggttaaatttcatttataaagcattcaccacgcaagatattgagcacgccatcaaaggcgttcgcgcattaggcatccgtggttgtgctgtttcaatgccattcaaagaaacttgtatgccatttttagatgaaattcatccgtcagcacaagccattgaatccgtaaataccatcgtgaacgataatggctttttgcgtgcatataacactgattacattgccatcgtaaaattaattgaaaaatatcatttaaataaaaatgctaaagtcattgttcatggcagtggtggtatggcaaaagccgttgtggctgcctttaaaaattcaggttttgagaaattaaaaatttacgcacgcaacgtaaaaacaggtcaatatctcgccgcactttatggctacgcatacattaattctttagaaaaccaacaggcagatattttagtcaatgttacgccaatcggcatgaaagggggcaaggaagaaatggatttagcctttccaaaagcgttcattgataatgctagtgtcgcgtttgatgtagtggctatgcctgttgaaacgccctttattcgttatgctcaagcacgaggaaaacaaactatttctggtgcagaagtgattgtacttcaggctgtagaacaatttgaactttatacgcatcaacgcccaagcgatgaattaatcgctgaagctgcggcgtttgctcgaacaaaattttga

SEQ ID NO: 1542 - DNA, 1386 bp, H. influenzae strain 86-028NP
atgggtgagatggcatctttaagaagtcataaaaatggcattatttttattttagatattgtgctgttttttgtgttattaaatgtattaccttttgaaccaaaagctaattctggtttggcattattagcttttatcgcggtgctttggttaagtgaagcattacacgttactattactgcattattagttccacttttggctgtggcattgggattagttagtaccaaacaagctttagttggttttgctgatccgacaatatttttattttttggtggcttttccttggcgacggcattgcatattcaaaaacttgataaattgattgccaataagattatggcactagcacgcggtaatttatttatcgcagttatttatctctttttgattacagcctttctttctatgtggatgagtaacacggcaactgctgcaatgatgttacccctcgccatgggtattttaagccagcttgatcgcgaaaaagatcataacacctatgtgtttgtgctgttagggattgcttacagtgcatcaattggtggtatgggaacccttgtaggaagcccaccaaatgcaattgtagcaagtaatttaaatttaactttttctgattggttatggtatggcttaccaataatgattattttgttgccgttgatgattgggattctttatattattttcaaaccaaaacttcatctcaattttgaacagacctttgaaaatattgaaatgaatcctatgcgtatattgacgtttattattttttcagtcattgctttaacgtggatatttagcggtaaaattaatccgtttatttcaggattactaggattacaaaaaaacattgcaagttttgatagtatcgtagccttattggcggcaattgttatttgttcaacaggcgttgcaagttggaaacaaattcaatcaaataccgattggggcgtattaatgcttttcggtggtggattaacattaagtgcggtgttgaaggattctggtgcaagtaaaattttagcggatagtattgtttttatgattgatggacaacatttctatcttattggtttattagttgcggcgttcattattttcttaactgaatttacttctaatacagcgagtgcggcgttacttgtacctatctttatttctatcgctcaatcattgggtatgccagaaattggtttagcattaattattggtattggtgcatcctgtgcctttatgctaccagtagcgacaccaccaaatgcgattgtatttggctctggtcaagtaaaacaaagtgaaatggtcaaagttggtttcttactgaatttagtctgtgttgtagttattgccactatgggttatatgttctggcttaaataa

SEQ ID NO: 1543 - DNA, 849 bp, H. influenzae strain 86-028NP
atggccgcaaaaatcatctctggtactgaactttcaaaacaaattaaagctaatttagcagataaaataacccattatattgaacaaggaaaacgcgctccaggacttgctgtaatcctcgttggtgctgatcctgcttcgcaaatttatgtgggcaataaacgtaaaagttgcgaggaagtcggtattctctctaaatcttatgacctccctgaaacaaccacgcaaaatgaattattagcgattattgaccaacttaacgcagataaaaatattgacggtattttggtgcaactccccttgccaaaacaaattaatgcggaagctattattgaacgtatcgatcctaaaaaagatgtagatggctttcatccttataatgttgggcggttatgccaacgtattccaactttacgtgcttgtacaccttatggtgtgatgaaactattagaaacaacgggtattgatttacacggcaagcacgcagtaattgtaggcgcatccaatattgttggccgcccaatgtctttagaattattattagcaggggcaaccgtcacagtaacacatagattcactaaaaatttggaaaatcacgttcgccaagcagatatacttgtcgttgcggtaggtaaaccaaatttaatttctggcgattggatcaaagaaagtgcggtcgtaattgatgttggaattaaccgagtagatggaaaattagtaggcgatgtagagtttgataaagcagccgaaaaagcggcttacattacaccagtccctggtggcgttgggccaatgaccgttgcaatgttgatgagcaatacgctttatgcttatgaacacaataaatag

SEQ ID NO: 1544 - DNA, 1287 bp, H. influenzae strain 86-028NP
atgaacgccaaagttttagaaaagaaattcatcgtcccctttgtgcttattactagcttatttgctctttggggatttgccaacgacattaccaatccgatggttgcggtatttcaaacagtaatggaaattccagcctcagaagcggcattggtacaattagctttttatggaggatacggcacaatggctattcctgcggcattatttgccagtcgctatagctacaaagcggggattcttctggggcttgctctttatgcaataggtgcatttttattttggccagctgcgcaatatgaaatatttaatttctttttagtctccctttatattttaacctttgggctcgcttttttggaaaccactgccaatccttatattctcgcaatgggagatcctcaaacagctactcgacgtttaaatttcgcacaatcatttaatccacttggttcaattacaggtatgtttgttgcttcccagttagtcctaactaatcttgaatctgacaaacgtgatgctgcaggtaatttgattttccacaccctgtctgaagcagaaaaaatgagtattcgcacccatgatttagctgaaattcgcgatccttacatagcactcggttttgtcgtggttgcagtgtttattatcattggattgaaaaaaatgcctgctgtaaaagtagaagaaagtggacaaattagctttaaaagtgcaataagcaaactggctaaaaaagctaaatatcgtgagggtgtgatcgcacaagccttttacgtgggtgttcaaattatgtgttggacatttatcgtacaatatgctgaacgtttaggcttcactaaagctgaggggcaaaactttaacatcattgctatggctatttttattagcagtcgctttattagcacggcattaatgaaatatttaaaagcagaatttatgctgatgctctttgctattggtggttttttaagtattctcggagttatctttattgacggtgtatggggtctatactgcctaattttaacctcaggttttatgtctttaatgttccctaccatttatggtattgccctctatggcttaaaagaggaatcgacattaggagctgcaggtttagtaatggctattgtaggcggcgcattaatgccaccactacaaggaatgattattgaccaaggcgaagttatgggacttccagcagtaaatttctcctttatcctaccattaatctgttttgtagtaattgccatttatggcttcagagcttggaaaatacttaaatag

SEQ ID NO: 1545 - DNA, 651 bp, H. influenzae strain 86-028NP
atgaacagagcagaattatcacaaaaaatcattgatacttgtcttgaaatgacaaaattaggtttaaatcaaggcacagcgggaaacgttagtgttcgttataaagatggaatgctgattaccccgacaggtatgccatatcacttaatgaagacagaaaatattgtttatgttgatggaaatggcaaacacgaagaaaataaattaccatcaagcgaatggcaatttcacttgagtgtttatcatactcgccctgaagcaaatgccgttgtccacaatcattccattcactgtgcaggcttatccattctcgaaaaacctattcctgcaattcattacatggtagccgtaagcggcacagatcatattccttgtgtaccttatgcaacatttggtagtcacgaattagctagttatgtcgcaacgggaatcaaagaaagcaaagccattttactagcacaccatggtttaatcacttgcggagaaaacctagataaagccttatggctcgcacaagaagtagaagtattagcgtcttggtatttgaaattactctctacaggcttagaaattccactgctcagcaaagagcaaatgcaggtagtgttaggtaaattccacacctatggattacgtattgaagaatcctaa

SEQ ID NO: 1546 - DNA, 435 bp, H. influenzae strain 86-028NP
atgctaaaaggtattcacccagctctttctcctgaattactaaaaaccctcgccgaaatggggcatggcgatgagatagttctagctgacgcccattttcccgcacattcactacataaaaatgtaatacgtgcagatggtatatctatagatattttacttgaagcaataactcccttattcgaatttgacgcttatgttgatgcccctctgttgatgatgaaagcagttgagggagattctttagatccgaatgttgaaactcgttacttaaatgcgattgaaagtgcggtcggtttcacaccaaatttaaccagtctagaacgcttcgatttttatacacgtgctaaacaggcttatgctgttgttgtcagtggtgagatcgcaaaatatggcaacattatcattaaaaaaggggttactcccattttataa

SEQ ID NO: 1547 - DNA, 1413 bp, H. influenzae strain 86-028NP
atggctatcgcattgatttttgactgtggtgcaacaaatttacgcaccattgcgataaatgaaaaaggacaaattcttgcctctcatcaccttgctaataatacaaaacaaggaatcgaatcatctgattatcatatttgggatattgaagaaatctggcaaaaattaatctcttgtgcaactcaaaccttcaatcaattaatacaacaaggcattgatttaaaagatattgtaggaatatctgttaccactttcggcgtggatggcgcaccttttgataaaaatgatcaacaactttatccgattatttcatggaaatgcccacggaccataccagtaatggaaaatctatctaatcaattagatatcaaatctctttatcaacgtaacggcattggtcaatacagttttaatactttatttaaattacattggttaaaaacacacaagccagatgttttccaaaaaatggctaaattcgtttttatttcgtcaatgctcactcaacgcttaactggtcaattcactacagatcacacaatggcgggaacatcaatgatgacaaaccttactagcggtaattgggatccatcgattttagcatcgctgggtttaagtaataaccatttccctcctatgcgttatgcaggtgaaaaagttggaaaattacgtacaccgttagcccagaaatggggattaaatcccgtacctgtcatttcttgtggacatgatactcaatttgctgtgtttgggtctggtgcagggctgaatcagcctgtgttaagttctggcacctgggaaatcttaatggctagaacccagcacgcagaacctagatttgagtttgtttctcaaggcttaaccactgaatttgatgcacaatccaattgctttaatccagcggtacaatgggtgggttctggcgtcatagaatggttaggtaaattattattttccgatgtttatggtagcgatcactattacaccacaatgatcaaagagggagaaaaagcttttaatgcgggaaaaagagcggtcaattttgaaggtatttttagccaaaaaggacaaggtaatatcagtggactttccatgtttgctactcgtggagaaatttatgtcagcgcattacaacatatggcaaataaactcaaaaacggtttatccgtgctacatcaagtcagtcagttccaagctaaaagcttaatttgtgttgggggtggttcaaaaaatgtattgtggaatcaaatccgtgcaaacaccttaaatttaccgattgatgttgtggacatttctgaaagtactgtacttggtgccgcaatgtttacctttgcaggcgtaggcatttacgaaaatgtaaacgcggcacagcaagcgatgcaaccaacaagaaaacgaatttacccaaactag

SEQ ID NO: 1548 - DNA, 1815 bp, H. influenzae strain 86-028NP
gtgatttcatcattcttacttaagcacaaacaaaggagtgtaactatggctcttgctactcaattaaatcgcataaaaatcggtattcgtccaactattgatggtcgtcgaatgggagttcgagaatctcttgaaacccaaacaatgcgtatggctcaatctgttgctcaattattacaaacacatattcgtcatacagatggtactttcgttgaatgtgtagttgcagatagcactatcggtggtgtagctgaagcagccgtctgtgcggataaatttaaacgcgaaaacgttggattaaccattaccgttaccccttgttggtgttatggatcagaaaccattgatatggatcctcacatgcctaaagcaatttggggatttaacggcacagaacgcccaggcgcggtttacttagctgctgcccttgctggtcattctcaattaggactaccagccttttccatttacggtacagaagttcaagaagctgatgacacaaacattcctgaagatgtaaaagaaaaattattgcgttttgctcgtgctgggcttgctgttgcaagtattcgaggaaaatcctatttatctattgggtcagtttccatgggaattgcaggctctattgtaaatcaagctttcttccaagaatatttaggtatgcgtaatgaatatgtggatatgatggaaattaaacgccgtttagaccgcaaaatttatgatcaagaagaagttgatttagccttgagttgggttaaacaatattgcaaagaaggggttgatgtaaatagcctagagaatcaacgcaatgcagaagagcgtgcagaactttgggaaaatgttgtgaaaatgaccattatcactcgtgatttgatggtaggaaatccaaaattagcaacattaaattatgcagaagaagccttaggccataatgccattgcagcaggttttcaagggcagcgtcattggactgatcatttgccaaacggagattttatggaggctatgctcaattcaacttatgactggaatggcgtgcgtccaccttatattcttgccacggaaaatgatagtttaaatgcaataggaatgttatttgggcatcaattaactggcaaagctcaaattttcgcagatgtgcgtacttattggagtcaagattcggttgagcgtgttactggatggcgacctgaaagtggattcattcatttaatcaattcaggttcagctgcacttgatggaacaggagagcatcaagatgctcaaggcaatccaaccttaaaaccggcatgggatgtcaccgaagaagaagcaaaacgttgcttagaaaatacgcgttggtgtcctgctgttcacgaatattttcgtgggggcggtttatcttctcaattcctaaccaaaggtggcataccgtttacaatgcaccgcattaaccttattaaaggtctaggtcccgttctacaaattgctgaaggatggtcaatcgacctacctcaagatgtacataataaattaaatcaacgtactaatgaaacttggccaacaacatggtttgttccacgtttaactggaaaaggtgcatttactgatgtgtattcagtcatggcaaattggggagcaaatcactgtgtagcgactcacggtcatgtgggggctgatctaatcactcttgcttcaatgttacgcattccagtctgtatgcataatgtatcagagaaaaatattttccgccctagcgcttggaatggatttggtcaagacaaggaagggcaagattatcgagcttgccaaaactttggtccgctttataaataa

SEQ ID NO: 1549 - DNA, 750 bp, H. influenzae strain 86-028NP
atgaattatcgtgatgaattaattttacaatgggtaaatcaacaaggaaaagccagcgtaatagaacttgcacagcattgtgatatttcggtggaaaccattcgtcgcgatttgaacaaattagcgaacaaaggcttattgcaccgaacacacggaggagcagtgagtaataaaaccaaagatttaggttcatttttccaaactcgaaaacatattaatgcaacagctaaacgacatattgcccaaaaagccttggatttgctatatgaaaatgccgttataggtttagatgcaagctcaacaagttggtattttgcttatttaatgcccgatattccttgtacagtagtaaccaactcaatgtttaacattaatgccctagttaataaatccaatgttaaaactattgtcactggcggagtttattcagcaaaatatgaagcattttacggtcccttatctgagtatttattacaacgattacatattaatttttccgtgttttcttgttcaggaattgatcaaaacggtaatatctgggaatcaaatgagctgaatgcctctttgaaacgaaaaatgatagaggcttcagaacgtgcttatttgttaattgattcttctaagtttgaaaagaaaagtttgattcaacttaccgatttaagcaaaattaatacgattttttctgatcaaccacttccagataacttacaaaaatattgtgagctacacgatataatgaccgttttataa

SEQ ID NO: 1550 - DNA, 2772 bp, H. influenzae strain 86-028NP
atgccctttgctattggtcagcgttggttgagtgaaagtgaaaacgctttaggattaggtgttattaccgcattagatcaacgaaccgtcacgatttatttccccgcagcagatgaaacgaggatatatgctgctgcacaagcacctttaagtcgaattgtgtttagcaaaggcgaaacattatcccatcaagctggctggcaaggcgagattttagacgttcaaaatatgaacggtttgttgttttatttagttaaaaccccacaagatgaagatgtcattgtgcaagaacgtgatatttcgccgattatttcttttagccaagcgaaagatcgtttgttttcagcgcaaattgatcgcagcagtcattttgcattgcgttatcgcacgctttgtcatcagcaagcacaatttaaatcgccattgcgtggtttacgcggaacgcgtgcgggtttaattcctcatcagcttcatattgcagctgaagtcggtaatcgagttaatcctcgcgtgttattggctgatgaggttggtttagggaaaaccattgaagcaggaatgattttgcagaatcaactttttgctgagaaagtgcaacgtgttcttattattgtgccagaaacgttgcaacatcaatggctggtggaaatgcttcgtcgttttaatttgcatttttcactttttgatgaagaacgttgcaatgattttgatcttgatgctgttaatccattcatgactgaaagcttaattatttgttctctaaattggttagaaacgcatccaaaccgagtagaacaggcacttgatgctcaatttgactgtttaattgtggatgaggcacatcatctggtatggtcggaaagcgcgccaagtgcagcttatttattagttgaacagcttgctcgcatcattccctctgtcttgttactcactgcaactccagagcaacttgggcaagaaagtcattttgctcgtttgcgtttactggatccagaacgtttctttgattatcaaacttttgtgaaagagcagaaacgctaccaacctgtggttaatgctattgaatctttgctggcaaataaggcattaagtgcggtagaaaaaaatcatatttctgatttgttgcttgaacaagatgttgagccactttttaaagcgattgcatcaaataatgatgaagaacagcatcgtgcccgtcaggaattgattcaagccttaattgatcgtcacggcacggggcgaatgttattccgcaatacacgtcaaggcgtgaaaggtttcccccaccgtgtttaccaccaaattacactctcggaagagaatgataaaattgattggctgattaatttcctcaaactacatcgcgatgaaaaaatttttgtgatttgccagacagcggcaacagcgattcagttagaacaaattttgcgtgaacgtgaggcgattcgtgccgcagtgttccacgaaaaaatgtcgattatcgaacgggatagagccgccgcttattttgcggatttagaaaacggcgcacaggttttactgagctcgagtattggctcggaagggcgaaatttccaattcgcagcaaatttagtgttatttgatttaccgacaaatcctgatttattggaacaatgtattgggagattagatcgtattggacaaaaacgtgatgtgcaaatttatgtgccttgtgcgaaagattcgcctcaaattcgtttagcgcgttggtacaatgaggggctgaatgcttttgaacaaacctgcccaatgggaatggcattattttcgcagtttgaggacgagttggaaaaagtgcggtcaaattctaccgcactttcagagaatgaattttctgaattattaaaacaaactaaaactgtgcgagaaaaactcaagattgagttagaaaaagggcgagatcgcttgttagaactaaattctaatggtggaaagcaagcacaagcgttagcggatcaaattgctgatgaagataattcgcctgagcttgtgaattttgccttaaaattatttgatattattggcgtagagcaagaagatcttggcgcaaatagtattgtaattagcccaacagggacaatgcttgtgccagatttccctggtttaaaagaagaaggtgtgacggttacctttgatcgagaacttgcccttgctcgcgaagaaatggaatttttgacttgggatcatcctatgattcgtcaaggtattgatcttgttgcttcgggagatattggcaaagccgcaatggcattgcttgtaaataaacaactgcccgctggaaccttattaattgaattgatttatatagtggaaagtcaatcgccaaaagggttacagctcaatcgtttcttgccgccaacgcctattcgtctgctgcttgataacaaaggaaataacattggtgagcaggttgcctttgaaacattgcatagcaaattaaaaccacttggtaaaaatattgctaatcaaatggtaaaaatggcgcggggtaatattgaagccttgattacacgaggcgatcaactcgtaaaatctttagctgaaccgattattaccgaagctaaaaatcaggcagatcaacaattaagcgcagaaattaatcgtttgcaggctttgcgagcggtaaatcaaaatattcgccaaagcgaaattgatattttggaacaacaacgaacacaatcactggatgagctttctaaagcaaattggcgtttagattgtttgcgtgtcattgtgacgaacaaggaataa

SEQ ID NO: 1551 - DNA, 660 bp, H. influenzae strain 86-028NP
atggcattgattgaatacaatccgccccttgaaccttatttagatattatttatcaagataatcatttgtgcgtagtgaataaacctagtggtttgctttctgtgccgggtaatcaaccacaatattacgatagtgcaatgagccgagtgaaagaaaaattcggcttttgcgagccagctcatcgtttggatatggcaacgagcggtattattgtgtttgctttaagtaaggctgctgatcgtgaattaaaacgtcaatttcgcgaacgtgaaccgaaaaaacattatcaagcgattgtttgggggcatttggagaaagattatggcgaggtaaatttgccaatgatttgtgattgggaaaatcgtcctcgccaacgtttggatttcgttttagggaaaagagcggtcacaaaattcgaagttttagcacgtttgcccaataacagtactcgcgtgaaactgacgcccgtgacaggcagatctcatcaattacgattacatatgttggctttagggcatccaattttaggcgataaattttattcacatcctcaggctaaagctatgtcgccaagattatgcttgcacgcagaagaattgacgattacccaccccattacaggggaaacaatgacttttaatgcgaagtcagatttttaa

SEQ ID NO: 1552 - DNA, 579 bp, H. influenzae strain 86-028NP
atgaaaaactttttagctcaacaaggaaaaatcacgctaattctcaccgcactttgtgcgcttatttatattgctcaacagctgggttttgaagacgatattatgtatttgatgcactaccccgcttacgaagagcaagatagcgaagcgtggcgttatatttcacatacattggtacatttatctaatttgcatattttgtttaatctgtcttggttttttatttttggtggaatgattgagcgcacttttggttcagtcaaattattgatgttgtatgttgtagcatctgtaataacaggatatgtgcaaaattatgtgtctggccccgctttctttgggctttctggtgttgtatatgcggttctaggttatgtatttatacgtgataaattgaatcatcatttatttgatctgccagaaggttttttcacaatgttattggtggggatcgcattaggttttattagccccttatttggtgttgaaatgggaaatgctgcacatatttcaggcttgattgtcggcttgatttggggatttattgatagcaaattgcgcaaaaattcgctagagtaa

SEQ ID NO: 1553 - DNA, 768 bp, H. influenzae strain 86-028NP; identical to SEQ ID NO: 643

SEQ ID NO: 1554 - DNA, 822 bp, H. influenzae strain 86-028NP
atgaaattaaaacaactttttgcaatcactgcaatcgcatcagctctcgttttaacaggctgtaaagaagacaaaaaacctgaagctgcagcagcaccgcttaaaatcaaagttggtgtaatgtctggtcctgagcatcaagttgcagaaattgcagcaaaagtcgctaaagaaaaatacggtttagacgttcaattcgttgaattcaatgactacgcattaccaaatgaagctgtatctaaaggtgatttagatgcaaacgcaatgcaacataaaccttatttagatgaagatgcaaaagcgaaaaatttaaataacttagttatcgtgggtaatactttcgtctatccattagcgggttattctaaaaaaatcaaaaatgtgaatgaattacaagacggtgctaaagttgttgttcctaacgatccaacaaaccgtggtcgtgcattaattcttcttgaaaaacaaggtttaatcaaattaaaagatgcaaataaccttctttcaactgtattagatattgttgaaaatccgaaaaaattaaacatcactgaagtagatacttctgttgcggcacgcgcattagacgacgttgatttagctgtagtaaacaatacttatgcgggtcaagtaggcttaaatgctcaagatgacggtgtatttgtagaagataaagattcgccatatgtgaacattatcgtttctcgtaccgataacaaagacagcaaagctgttcaagatttcgtaaaatcttaccaaacagaagaagtttaccaagaagctcaaaaacactttaaagatggcgttgtaaaaggttggtaa

SEQ ID NO: 1555 - DNA, 690 bp, H. influenzae strain 86-028NP
atgttcaatgatttcttggcaacattcagccagcaattaacacctcaaatgtggggtgttgtcgcaacagcaacttatgaaactgtttatatcagctttgcatctactttacttgccgtagtagtcggcgtgcctgtgggtgtatggactttcttaactggaaaaaatgagattttacaaaacaaccgcactcattttatgttaaacacgattattaatattgggcgttccattccatttattattttgctcctaatcttattacctgtaactcgtttcatcgtgggaaccgtattaggtacaacagcagcaattattccattgagtatttgtgcaatgccattcgtggctcgcttaactgctaatgcactaatggaaattccaaatggtttaaccgaagcagctcaagcaatgggggctactaaatggcaaattgttcgtaaattctatttgtcagaagctctacctacgctaattaatggcatcacgctcacgctagtcactttagttggttactcagcaatggcggggacgcaaggcggcggtggtttaggtagcctcgctatcaactacggcgtatatcgcaatatgccttatgtcacttgggtggcaaccattattattgtgctattcgttatgattagccaaaaactcggcgatacactggctagaaaagtggatcatcgttaa

SEQ ID NO: 1556 - DNA, 1038 bp, H. influenzae strain 86-028NP
atgattaagctaaataatattacgaaaatttttgagctaccgaacaaaaaattgactgcgcttgataatgtttcgttgaatatcgaaaaaggtcaaatctgtggcgtaattggtgcatctggtgcaggaaaaagtacattaattcgctgtgtgaacttattagaaaaaccgacaagcggttccgttattgttgatggcgtagaattaacaaaactttctgatcgcgaattagtacttgctcgtcgtcaaattggaatgatttttcagcatttcaatttactaagttctcgcaccgtatttgaaaacgtggcattacccttagaattggaaagtgagtcaaaagcaaaaatccaagaaaaaattaccgcacttttagatcttgttggtttaagtgaaaaacgtgatgcttacccaagcaatctttctggcgggcaaaaacaacgcgtagccattgcacgtgccttagcgagcgatcctaaagtcttattatgtgatgaagcaacgagcgcattagatcctgcaacgacgcaatctattctgcaattattaaaagaaattaaccgcactttaggtattacaattttgttgattacccatgaaatggaagttgttaaacagatttgtgatcaagttgctgtcattgatcaaggtcgcctagttgaacaaggtactgtcggtgaaatttttgcaaaccctaaaacagaattagcacaagagtttattcgttcgaccttccacatcagtctacctgatgaatatttggaaaatcttactgatacaccgaaacacagcaaagcgtatccaatcatcaaatttgagtttacgggtcgctcagtcgatgcaccgttactttctcaagcatcaaaaaaatttggcgtggagctcagtatcttaacctcacaaattgattatgctggaggcgtgaaatttggttataccattgctgaagtagaaggcgatgaagatgccattacgcaaaccaaagtttatttaatggaaaacaacgtgcgcgtggaggtgcttggttatgttcaatga

SEQ ID NO: 1557 - DNA, 555 bp, H. influenzae strain 86-028NP
atgaataaggctatttttttagatcgcgatggcacgttaaatattgattatggttatgtacacgaaattgataactttaaatttattgatggtgcgattgatgcattgcgagaattaaagaaaatgggatatatgttggtattagtgaccaaccagtcgggcattgcacgtggttatttttctgaggatcagtttttacaattaacagaatggatggattggtcgttagctgaacaagatgtggatttggatggcatttactattgtccacatcattctgagggaaagggcgaatataaagaagattgtgattgtcggaagcctaaatcgggaatgttattgcaagcgatcaaagaattaaagatcgatcctacgcaatctattatggttggagataaagttgaagacctaaaagcggggattggtgcgaaggtaaaaatgaacgtattagttcgtactggtaaaccagtaacaggggaaggagaaggaatagcggattatgtgttagattctatcgtagatcttccgagaattttaaaacgcttaaaaaaatag

SEQ ID NO: 1558 - DNA, 561 bp, H. influenzae strain 86-028NP
atggctcgtaagaaaaaaacacgtcgaattacagatattatgccaattcgcaaagcagataaaaaaatagatataacaaaagcacgctctggtaaaaagcttactcgttatgaattggatgctaaagctcgtgaagataagaaaaaacgtaagcataaaggtttagcttcaggatctcgtcatagtgcggttgaagaaaaagcgaataaacttcaaaatgaaattaaagatccaaaaattggtagtaagaaaaagataccgttggttgttgaatttgttaataagcctgaaaaaggtcaagtaattcctgtaataaaacaggtgaaaaaacaagatccaatgaaagagcttgaaaatctggaaaataatgaaattcttaatgaattattggatgctttagatgcgggtaaaactattagtaaatcagatcaacaatttgtagatgaatgcttagatcgaatttctgagttaatggaagaacttggcattgaagacgaagatgaaagcgaagatgatttataccgcactttcgagcgtatggatattaatcaatttaggtaa

SEQ ID NO: 1559 - DNA, 441 bp, H. influenzae strain 86-028NP
atgatttggatattttttgtcatcgcacttttcttggtaactggattgactctatatgcaatccgtttattaaagcagttaaaagttcaaaaggaattgattgctaaagctaagaataatcgggttatacgattaaaagagagcattgatattattgctcgtgcaatgcagtctggagaatgtaatctttctgaaggcgtaattcgtcttactatgctattaaggccttttggtaagaatttatcatcttatcctgcgatggctaatttatatgaagtggtgcgtgatatgcctacacatgatgaccgtaaactacttgagaaaagagaaagaatgcgtctggatttagctcgagaaagtgcagaagcacagtttgaaaaaaatattaaacaagaattgtatattttattagaagatattaaatctattgagctaatttaa

SEQ ID NO: 1560 - DNA, 627 bp, H. influenzae strain 86-028NP
atgcaagataagctaaaagttttattgattgacgaccatccgttaatgcgtcgtggcattaaacaacttgtagaattagacgataactttgaagtagtggctgacgtaagcagcggcacagaagggatttctgtggcattacaaacatcacctgatgtgatcattttagatctcaacatgaaaggactttctgggttagatacgctcaaaggattacgtgcagaaggcgttgatgcgcgaattttaattttaacagtgtctgatgcaaaaaatgatatttatactctaattgatgcaggtgcagatggttatttgttaaaagatactgaacctgatacattgctagaccaaatcaagcgcatagcacaaggcgaagtcattctgagtgattctattaaaaatttattattagaacgtactcacgaagataatccgttagacagcttaacggatcgtgaaatgggcgtacttcgtcaaattgcaactggcttatcaaacaaacaaattgcagcacaactgtttatttcagaagaaaccgtaaaagtacatatccgtaatttattacgtaaattaaatgttcattctcgtgttgcagcaacggtattattttttgaacaaaatcgttaa

SEQ ID NO: 1561 - DNA, 1248 bp, H. influenzae strain 86-028NP
atgaatttcttccaatataaacataacaaactttatgccgaagatatgccagttcaacaacttgctgaacaattcggtacacctctttatgtatattctcgcgcgacactagaacgtcattggcacgcttttgactcagctttcggtaagcgtcctcacttaatttgctttgccgtgaaatcttgctcaaatattggcgtgttaaatattatggcaaaacttggttcaggtttcgatattgtctcacaaggcgaacttgagcgtgtactggcagcaggtggcgatgcgtcaaaagtagtcttttctggcgttgcgaaatctcgagaagaaattatgcgcgcattagaagttggaatccgttgctttaatgtggaatcagtttctgagctcaagcacattaaccaaatcgcgggagaaatgggtaaaatcgcacctatttctttacgtgtaaatccagatgttgatgctcatacacacccttatatttcaacaggattaaaagaaaataaatttggtgtaagcgtaaatgaagctcgagaggtatataaattagcctcaacgctaccaaacataaaaataacagggatggattgccacataggctcacagctcaccgaattacaaccattcttagatgcaacagatcgattaattgtcctaatggaacaattaaaagaagatggaattacattaaaacatctcgatctgggcggtggtttaggcgtgacttatacggatgaaacaccaccgcatccaagcgattacgcaaatgcgttattagaaaaactaaaaaattatcccgaacttgaaattattcttgaacccggcagagcaatttctgcaaatgcaggaattctagtagcaaaagtacaatacttaaaaagtaatgaaagccgtaatttcgccattaccgatacaggaatgaacgatatgatccgaccagcattgtatgaggcttacatgaacatcgtcgaaattgaccgcactttagaaagagaaaaagccatttatgatgttgtagggcctgtttgcgaaacgtctgatttcttaggcaaacaacgggaactttcaattgctgaaggggattatattgctcaatgttctgctggtgcctatggagcaagtatgtcatcaaactataattcaagagcccgcactgcagaagttttagtagatggcgatcaatcctatctaattcgtcgtcgagaaaccttacaggaactttgggcattagaatcgaccatttaa

SEQ ID NO: 1562 - DNA, 132 bp, H. influenzae strain 86-028NP
gtgagagagagaaaaatgaaaaaactactatcaattttagtgcttagtgcaatttgcattgtgacaacaggatgcggcgtaaaaggttctttatattttcctgaaaaagatcaagctcaacaaactcaataa

SEQ ID NO: 1563 - DNA, 306 bp, H. influenzae strain 86-028NP
atgaatattgcagaatttcaccaaaatattgaacaagtttggcaaaaaattgaagaagaattggaaaaccaaggtgcagatgtagattgtgaaacgcaaggttcagtatttacaatcacctttgataatcgcacacaaatagtgattaacaagcaagaaccgctgcttgagctttggattgcaagtaaattaggcggtttccattttgcttttaaaaatggcgactgggtttctaatgacggacaacgtttttgggattgtttcgttgaagcctgtgctgcacatggcgagaacgtgcagttctaa

SEQ ID NO: 1564 - DNA, 1860 bp, H. influenzae strain 86-028NP
atgctggattctcctttaccatcaaaaataatagaaaaaccgaccgcactttctgttttgaaatcggttttcggttatcaatctttccgtaaagggcaggaagaagttattaatgctgctttaaatggacaagatgcgttggtggtaatggcaacggggaatggcaaatcgctttgttaccaaattcccgcactttgttttgatggtttaactttagtgatttctccgctgatttccttgatgaaagatcaagtggatcagctgcaagctaatggaattgaggcggattttcttaattctagtcagactttagaacagcagcaacaagtacaaaataagcttatttctgggcaacttaaactactttatgtgtcgccagaaaaagtgatgacgaacagtttctttcaacttatttcttatagcaaagtctgctttattgcgattgatgaagcacattgtatttctcaatgggggcatgactttcgccctgaatatacccagcttggcggtttaaaagccagtttccctgatgcgccgattatggcacttacggcaacggcagattatgcgactcaaaaagatattctgcggcatcttaatctgaaaaatctgcacaaatatattggtagttttgatcgaccaaatattcgttataccttggaagaaaaatacaaacctatggagcaactgacacgttttgtgttggctcaaaagggtaagagtgggattatttattgcaacagcagaaataaggttgagcgaattgcggaaagtttacgcaataaaggtgtctctgctgctgcttaccacgcaggaatggaaacggcaattcgtgaacgtgtgcaacaggattttcagcgtgataatgttcaagtagtagtcgcaaccattgcttttggaatggggattaataaatccaatgtgcgctttgttgcccattttgatttaccacgtagcattgaatcttactatcaagaaacaggtcgagcaggacgtgatgatttgcctgccgaggcggttttgttttatgaaccagctgattacgcttggttacaaaaaattctcttcgaaaaaccagaaacgccacagcgtcagattgagcagcataaattagaagctattggggaatttgcggaaagccagacttgtcgccgtttagttcttctcaattattttggcgagcatcgacaaacaccatgtaataactgtgatatttgccttgatcctcctaaaaaatatgatggcttagtcgatgcgcaaaaagtaatgtctactatttatcgagtgggacaatgttttggtgcacattatgtgattgcggtgttgcgtggcatgcacaatcagaaaattattgaacgccaacaccataaactttcagtatatggcattggaaaagataaaagcaaagagcattggcagtctgttattcgtcagcttattcatttgggttttgtgcaacaggttattagtgaattaaatccaacgttgcaacttactgaaagtgcgaaagtgattttgaaaggcgaagaaccgttagaattggcaatgcctcgtatttcttcaatcagtaaaattgcccataatccacaacgtcaaggtgttgcaaattacgataaggatttatttgcacgcttgcgtttcctacgcaaacaaattgccgataaagaaaatattccgccgtacattgtctttaatgatgcgacgttgcaagaaatggcacaatatatgccgacaagcaatattgaaatgttgcaaattaatggcgtgggctctatcaaattagagcggtttgggcagccgtttatggcattgattcaagaacataaggcaattttggcgaatgcgcaaaataatgactaa

SEQ ID NO: 1565 - DNA, 1719 bp, H. influenzae strain 86-028NP
atgcgtacaagtcaatatttattttccaccctaaaagaaacgccaaatgatgctcaggttgtgagccaccaattaatgttgcgtgcaggtatgattcgcccaatggcatcaggtttatataactggttaccgacgggtattcgcgtattgaaaaaagtggaaaaagttgttcgcgaagagatgaacaaaggtggtgccattgaggtattaatgccagttgtgcaacctgcggaattatgggaagagtctggtcgttgggatcaatatggccctgaattgcttcgttttgaagaccgtggaaaccgtaactttgtacttgggccaactcacgaggaagtgattacagatttagtccgccgagaagtttcttcatacaaacaacttccacttaatttataccaaattcaaactaaattccgtgatgaagtgcgccctcgttttggtgtaatgcgttcgcgtgaatttattatgaaagatgcgtattctttccacacgacacaagaaagtttgcaagcaacctatgatgtgatgtatcaagtatacagtaacatttttagacgtttaggcttagatttccgtgcggtgcaagcggatacaggttcaatcgggggttcagcttctcacgaattccaagtgttagcttcaagcggggaagatgatgttgtgttctcaacggaatcggattttgccgcgaatattgagcttgcagaagcaattgctataggcgaacgccaagctccaaccgctgaaatgtgtttagttgatacaccaaatgcgaaaactattgcggagttggtggagcaattcaatttaccaatcgagaaaaccgtaaaaactttgattgtgaaaggtgcagacgaaaatcaaccgcttgttgcgttgattattcgcggcgaccatgaattaaacgagatcaaagcacaaaaacacccgttagtggcagatccccttgagtttgcggacgaaactgaaatcaaagcgaaaattggtgcgggcgtgggatcgttaggcgcggtaaatcttaatattcctgcaattattgaccgcactgtggcgttaatgtctgattttagttgtggtgcgaatattgatggaaaacattatttcaatgtgaactgggtacgcgatgtagcaatgcctgaagtatttgatttacgtaacgtagtagaaggcgatcctagtccagatggcaaaggcacgcttcaaatcaaacgtggtattgaagtggggcatattttccaactgggtaaaaaatactctgaagcgatgaaagcgaccgttcaaggcgaagatggtaaaccacttgtgatgacgatgggttgctacggtattggtgtaactcgtgtggtggcttcagcgattgaacagcatcatgatgatcgcggtatcatctggccatcagacgaaatcgccccattcactgtggcgattgtgccaatgaacatgcacaaatctgaagccgtgcaaaaatacgctgaagaactttaccgcactttacaatcgcaaggcgtagatgtgatttttgatgatcgtaaagaacgcccaggcgtgatgtttgcagacatggaacttatcggtataccgcatatggtggtaatcggtgagaaaaacctagacaacggtgaaattgaatataagaatcgtcgtaccggtgaaaaagaaatgattagtaaagataaattgctcagtgttttaaacgaaaagttaggtaatctctaa

SEQ ID NO: 1566 - DNA, 2349 bp, H. influenzae strain 86-028NP
atgaataaaaaacacactttaatttcacttgctattttgaccgcactttatagccaacaaagtttggcagatttgcacgaacaatgtttaatgggcgtgccaaaatttagcggtgaagtcgtgacgggtgatgtgaattctctgcctgtatatattgaagcggataacgcagaaattaatcagccaaatgatgcgacctatcaaggtaatgtagatttgaaacaaggcaatcgccatttgttagcacaatccgtgcaggtcaaacaatctggaaaccaatcaacacctttacgcatggcttatgtccgcaatggatttgattataaagataatcagatcaatatgttgggtaaagatgcagagtttaatttagatagtcacgatggtaatttaacaaattcagaatatgaatttgtcggtcgtcaaggacgtggtaaagctgataatataacactgcataataattatcgtgtaatgaagaatgcaacctttacgtcatgtttgcacggcgacaatgcttgggctgtagatgcgtcagaaattcgtcaatacgtgaaagaagaatatgctgaaatgtggcatgctcgctttaaaatacatggtgttcccgtcttttataccccttacttacaattacccattggagatcgtcgtcgttctggtttattgattccaagcgcgggaacatctaaccgagatggtctttggtatgcacaaccaatttattggaatatcgctcctaattatgatcttactttcaccccgaaatatatgtctcgccgtggttggcaagcaaatggggaatttcgctatttaacctccattggcgaaggtaaagtggcaggagaatatttaggtaaggatcgttactctgaatatgctagtgataatcgaaaacgtcatttgttctattggaatcacaattctagctttttacaaaattggcgtctaaatattaattacacccgagtaagcgataaacgttatttcaacgactttgattctatttatggacgcagtaccgatggttatgcgaaccaatatgctcgcatagcttattatcaaccaaattataatttttctctttctgcacatcagttccaaatttttgatgatattgtaaacatcggcccttaccgtgcagtaccacaattagatttcaactatcacaaatatgatttagcgaatggatggttaaatttcaaattacattcacaagcagttcgttttgataatgacagtaaattgatgccaactgcatggcgtttccatgcagaacctagcctaaattctttaatgtcaaataaatacggcagtttgaatattgaaacgaaactttatgcgactcgttacgagcagaaaaaaggttcaggaaaaaatgcagaggacgtgcaaaaaacggtaaatcgagttattccacaatttaaagttgatttacaaagtgtattatcacgcgatataacgttcttaaaagagtatacacaaaccttcgaaccgcacgtgcagtatttatatcgtccttaccgaaatcaaagcaatattggttcaacacttaataatgattatttgggatttggttacgattcagcattagtacagcaagattactattcgctattccgtgatcgccgttatagtggtttagatcgaatttcatcggcaaatcaagttaccttgggtggcacaacgcgtttttatgatattgctggcgaagaacgatttaatttatctgcaggtcaaatttattacttaagtaattctcgtattgatgaaaaccctgcgaataaaacaccaacttcatcatctgcttgggcattagaatctaattggaaaataagtaataaatggtattggcgtggtagctatcaatttgatactcataccaattcaacatcattagcgaatacatcactagaatataatcctgaaaaaaataatttaattcagttaaattatcgatatgtgaaccaagaatatattgaccaaaacttaggtaaatcggctaacgcctatcaacaagatatccaacaagtgggattagttgtaggctgggaaattgccaataattgggctgtagtaggacgctattatcaagatctcgccttacaaaaaccagtagaacaatatctaggcgttcaatataacagttgctgttgggctgcaagtgttggtgtaaaacgcaatgtcacaaaccaccaaaaccaaacacgtaatgaaattgtttatgataatagcattggcataaccttagaattaagggggttaggcagcaatgaccatcaaagcggtattcaagagatgttagaaaaaggaaaactaccttatattcgagcatttagtttggattaa

SEQ ID NO: 1567 - DNA, 1410 bp, H. influenzae strain 86-028NP
atgccacgcctttcccgccgtcaattattaaaaacagctgcgatttctaccgcactttccaccgtgccagcaccattgttagcggcaagccgtgaaaaactagttgtgccgccactaattgaagttcgtcgcggtcgcccgattgtattaaccatgcaggaaacgaattatccgttagatggctcacacaatgtgacggtatggggattcaacggtaattatcttggcccaaccattaaaatcaaatcaggtagctttgccaaacttaattatcataacaatttgccacaatccgttgccttgtctattcaaggtttacaagcatcaggcgaactgtttggcggggcagctcgagttctcaaaaaaggcgaatcttgggcacccatcgtgcctattgaacaacctgcagcaagctgctggtatcgttccgcgacattagccaactcagcctatcaaacctatcgtggcttagctggaatgtggttaattgaagatgagcaaagcctaaaagctaatcttcccaataaatacggcgtagatgatattccattgattttacaagatatggaatttaacaatgatggtctccaattattcaaacaaaatcaaccgcactttgtaggcaatcgcttattagtgaatggtattgaagcaccatatttagatgttgcacggggttggattcgtttacgtttgctcaatgcctcattagcgcgtgcttatgatttacgcttggataatgatcaagaaatgctacttattgcacaagatttaagtttcttacccaaagcgaaatcagtcaaatctttggttctctcgccaggagaacgcgcagaaatactggttaatatgaatgaaattgacaacgtatctctcattagcggaagtaaacgtagcttgtacgaaaaaataaaaaatatgttgttctcaggcgatgaactcgctaataacaccgtccttgaattacgtgctcaaggacaactatccgcatttaacaaacaaccgaatctaactttcgaaacggatgcaccagcaatattacaacaagccgttgcacaaactcgagaatttaatattgatgtcacaaacggtttaattaatcaaagacgttttgacccgcgcaaggttgatgttatggctcgtaaaggcaccattgaacgctggattttaaatgcaagtttacctgttggatttactattcaaggtgccaaatttgtggtggaaagccaaggagaacatcaattacaagctgaagaattagcttggaaagataccgtttgggtaaaaaacaaaactcaaattttagtgaaatttgatcaagcatcttctggcaacttcccattcttatttggggtatcgaatttaatgttagaagatatgggctgtcttggcgtattgatggttcaatag

SEQ ID NO: 1568 - DNA, 723 bp, H. influenzae strain 86-028NP
atgttaaaactacttcgaattttcctcgtattaatctgctgtattctaatttgtgtactgggtacgatttattcttttatccgctttaaaaatccaagcaacgtaggcattgttgctcgttggtttggacgcttatatccactttttggcttaaaggtagaacatcgtattcctcaagatcagaagcaaattagccgcgccatttatatcggtaatcatcaaaataattatgatatggtaacaatctcttatatggtgcaacctcgcacagtaagtgtgggtaaaaaaagcttaatttggatacccttcttcggcattttatattgggtaacgggtaatattttcttggatagagaaaaccgcacaaaagcgcataatacgatgtcacagcttgcacgacgaattaatgaagataatttatcaatttggatgttcccagaaggcactcgcaatcgcggtcgcggtttattaccctttaaaacgggtgcattccatgcggcgatttcagcaggtgtaccaattattccagtggtgtgttcaagcacgcataacaaaattaatttaaatcgttgggataatggcaaagtgatttgcgaaataatggatccaatcgatgtttcaggctataccaaagacaatgttcgcgatcttgcggcttattgtcatgatctaatggaaaaacgcattgccgaacttgatgaagagatagcaaaaggaaactaa

SEQ ID NO: 1569 - DNA, 714 bp, H. influenzae strain 86-028NP
atgaaacatagctattttatttctgatttgcatttaagcgaaactcagccagaattgaccgcactttttgtcgattttatgcagaatcttgccccacaggctgaacggctttacattttaggtgatctttttgatttttggattggtgatgatgagcaatctgcattgattcaacaagttaaagatttaattaagtctgtaagtaatcaaggtgtgcaatgttattttcagcacggtaaccgtgatttcttaattggtgaacgttttgcgaaagatacaggtgttcagcttttacctgattatcaattaatcacactttatgataaaaaaatcttactttgtcatggcgatacgctttgtattgatgatgaggcttaccaacaatttcgccgtagagtgcatcaaaaatggctgcaacgtttgtttttgtgcttgccattaaaagtgcgggtgataattgcggagaaaattcgagcaaagagcaatcaagataaacaagcgaaatcacaggaaattatggatgtaaaccaagccttcacggcagaaaaagtacaagagtttgatgtaaatttattaattcacggacacacacaccgtgaggcgattcatcaacaagaagaatttacccgaattgtattaggggattggcgaaaaaattacgcatcaattttaaaaatggatgaaagcggagaatttggttttattaaagattag

SEQ ID NO: 1570 - DNA, 1527 bp, H. influenzae strain 86-028NP
atggtgcactcagctccaaaagcacaaaagcgtgagactttttctggtcgtcgcgcatttattctggcagcaattggttctgccgttggtcttggtaatatttggcgttttccttacaccacttatgaaaacggtggtggcgcatttatcatcccttaccttattgcattattaaccgcagggattcctcttttattcctagattatgccattgggcaccgtcatcgtggtggtgcgccactttcttatcgtcgtgttagcccgcactttgaagtgtttggctggtggcaaatgatggtgaatgtcatcatcggattatattacgctgtagtgttaggctgggcagcaagctacacatatttttctttcactggtgcgtggggcgataaacccattgatttcttcatcggtgaatttttaaaaatgggcgatattaaaaacggtatcagctttgaatttgttggtatggtaaccgcaccattaattgcgatgtggattgttgccttaggcgtgctttctatgggtgttcaaaaaggaattgctaaggtctcttccgtattaatgccagtgctcgtcgtgatgtttatggtgcttgtgatttattccttattcttaccaggtgcggcaaaaggtttagatgcattatttacaccagattggacaaaattatccaacccgagtgtgtggattgccgcctatgggcaaatcttcttctctctttcaatcggctttgggattatggtgacttacgcctcttatcttaaaaaagaatccgatttgacgggtagtggcttggttgtaggttttgctaacagtagctttgaagtgttagcaggtatcggcgtatttgcagcattaggttttattgcaacagcgcaaggtcaagaagttagcgaagtagcaaaaggcggaattggtttagcatttttcgcattcccaaccatcatcaacaaagcaccatttggcgaagtgctaggcatgttattctttggtgcattaacctttgccgcattgacttcattcatctcagttatcgaagtaattatttccgcaattcaagataaaattcgtattagccgtggaaaagtgacattcatcgtgggtgtaccaatgatgctagtttctgtcatcttattcggtacaacaactggcttaccgatgttagatgtgttcgataaatttgtgaactatttcggtattgttgccgtagcatttgcgtctttaattgcgattgtagcaaatgaaaaactcggtttattgggtaatcacttaaatgaaacgtcatctttcaaagtgggtttcttctggcgtttatgcattgtattaacgagtggtgttttagcatttatgcttttcagcgaaggggcaaaagtcttctctgaaggttacgaaggctatccaaactggtttgtaaatacctttggttggggaatgtcgattagcttacttgtcgtggcatttttcctttctcgcttaaaatggaaaagcgaaaccaaattaacgattgatgaaactaaaggagaataa

SEQ ID NO: 1571 - DNA, 627 bp, H. influenzae strain 86-028NP
atgacaggtgcacaacttatcatggcgtgcttgaaagcacatcatgtcacgactcttttcggctatcccggtggcgcaattatgccaacctacgatgccctttatgacgcaggcttagatcacttactttgtcgtaatgaacaagggactgcaatggctgcgattggctatgctcgctccacgggaaaagtgggcgtctgtattgcagcatcaggctctggtgccactaatttagttattggattaggcgatgccatgatggactccattccagttgtcactattgaaccttggcgtgaacaaatcagaaatttcaaagcaaaattagatttcacttatgttgaaaatcaaggcaatcgcccgattgatccttgggcattactcaacagcctatctaatcgcaaaccaaataatgcgataatttgtactgatgtgggtcagcatcaaatgtggtcagtgcaacacattttacgcgtagcacgtcactgcggatttaccgttacaacaatggaaatgacactcattgaaacccaagtgcggttaaaaatcactgtaaaatctgaccgcactttagatctattagtgaatcagttggttaagctgccggatgttttaatggttaattaa

SEQ ID NO: 1572 - DNA, 1839 bp, H. influenzae strain 86-028NP
atgcccaaactacgttcagcgaccagcacacaaggtcgtaatatggcaggcgcacgtgccttatggcgtgcaacaggaatgaaagaaaatgactttggtaaaccgattattgcggtggtgaactctttcacgcaattcgtaccagggcatgtgcatttaaaagatatgggacagcttgttgccgcagaaattgaaaaagcgggcggcgtagcaaaagaatttaacaccattgcggtggatgatggtatcgcgatgggacacggtgggatgctttattccttaccaagccgtgatttaatcgctgatagcgtggaatatatggtcaatgcgcactgtgctgatgcgatggtgtgtatttccaactgtgacaaaatcactccaggaatgttaatggcggcaatgcgtttaaatattccaactatcttcgtttcaggcggcccgatggaagcaggtaaaactaaactttctgatcaattaatccgcttagatttagtagatgcgatgattgaggcagccgatccaaatgtaagcgatgagcgtattgatgcgattgagcgtagcgcttgcccaacttgtggttcttgctctggcatgtttaccgctaactcaatgaactgcttaactgaagccttaggtttatctttacctggtaatggttctatgttagccactcacgcagaccgcaaagaattattcttaaaagcaggtcgtcaaattgtcgagctttgcaaacgctattatgaacaagatgatgcaagcgtattgcctcgttcaatcggtacttttgatgcctttgaaaatgcaatgagcctcgatatcgcaatgggtggttcaagtaacactgttttacacttattagcggcagcacaagaagcaggcgtggattttaaaatggaagatattgaccgtttatcgcgcaaagtgccttgtttaagcaaaattgcaccaaacaccaataaatatcatatggaagacgtacaccgtgcaggcggtattatgggattgttgggtgaattagatcgcgctggattaattcataaaaatacacacaccgtgcttggaatgagcatgggagagcaactagaccaatacgatattattcgcaatcaagatgaagaattacataaattcttccgtgcaggccctgcaggtatccgcacaactcaagcattctcacaagattgccgctgggataccgttgataatgatcgtgtaaacggttgtattcgcaataaagaaaatgcgatttcacaagaaggtggcttagccgtattattcggtaatctcgctgaagacggatgtatcgttaaaaccgctggtgtagatgaatctatttggaaattcactggcacagcaatcgtatttgaaagccaagaagatgcggttgcaggcattttaggtggcaaagtcaaagaaggtcatgttgttgttatccgttacgaagggcctaaaggcggaccaggtatgcaagaaatgttatacccaaccagttacttaaaatcgatgggcttgggcaaaaaatgcgctttattaacggatggtcgcttctctggcggtacatcaggcttgtctattggacatgcttcaccagaagctgcttctggcggtgcaatcggcttagtacgcgatggcgatattatcaacattgatattccaaatcgtgcaattaacttagaaatcagtaatgatgaactcgcagcacgcagagccgaacaagatcaaaaaggttggcagccagctaaccgtgaacgtgaagtatctttcgctttaaaagtattcggtcactttgcgacctcagcggacaaaggtgcggtacgcgataaaacattattaaaataa

SEQ ID NO: 1573 - DNA, 1542 bp, H. influenzae strain 86-028NP
atgaaaaatctactcaccaatcctcaaccctctcaatcagattatatcaatgccattgttaaacttggttcgcgcgtatatgaagctgcacaagtgacccctttacaaaaaatgggaaaactttctgaacgactgcacaataatatctggattaaacgagaagaccgtcagccagtaaatagctttaaactacgcggtgcttacgcaatgatttctagcctttcagaggaacaaaaagcagcaggcgtaatagcggcatctgcaggtaaccatgcacaaggcgtggcattatcagcgaaacaattaggcttaaaagcattaattgttatgccacaaaacaccccaagcattaaagtggatgcagtgcgtggttttggtggtgaggtgttgttgcacggtgctaatttcgatgaagccaaagcaaaagccatcgagctttcaaaagaaaaaaatatgacatttattccaccattcgatcatccattggtaatcgctggacaaggcacgttagcgatggaaatgctacaacaagtggcagatttggattatgtgtttgtacaagtcggtggtggtggcttagctgcgggtgtggcaattttgcttaagcaatttatgccagaaattaaaatcatcggtgtagaatcaaaggattctgcatgcttaaaagccgctctcgataaaggcgaaccaacagatttaacccatgttggattatttgccgatggcgttgccgtaaaacgcattggcgacgaaacattccgcctatgccaacaatatcttgatgatatggtattggtcgatagtgacgaagtatgcgcagcaatgaaagatttgtttgagaacgttcgtgctgttgcagaaccatcaggtgcattaggtttggctggtttgaaaaaatatgcgaaacaaaaccatattgaaggcaaaaatatggcggcaattttgtctggcgcgaacttgaatttccacacattacgttatgtatctgaacgttgtgaaattggtgaaaatcgagaggctttattagccgtgaccatgcctgaacaaccaggtagtttcttaaaatttgcttatgtattaggtaacagagctgtaaccgaattcagttatcgttatgcagatgataaacgtgcttgcgtgtttgttggggtaagaacgacaaatgagcaagaaaaagcagatattattgcagacctcacgaaaaatggttttgatgttgaggatatgtctgatgatgatattgcgaaaacgcatgttcgctatttaatgggtggtcgagcatcaaatgataacgaacgtttatataccttcgaattcccagagcaaaaaggtgccttattaaaattcttggaaaccttgcaaaatcgttggaatatttcattatttcactatcgtgcccacggtgcggactatggaaatatccttgctgggttccaaattgaagaacgcgaacaagcagaatttgaacaggcacttgcccaactcaattatgtttttgaagatgtaacagaaagcaaatcttatcgttatttcttacgttaa

SEQ ID NO: 1574 - DNA, 3480 bp, H. influenzae strain 86-028NP
atgtcattccaacctcgcttcgtccatcttcgcacacacacagatttttcgatgattgacagtatcgtcaaagtaaaacctcttgtgaaagcttgtgctgccaatgaaatggttgctatgggattaacggattttactaatttttgtggtgtggttagtttttatagcgaaatgctttcttcgggtatgaagcccattatcggggcagatgtaaaagtaaaaagcccattatgtggcgatgaatactttgatcttactttgctggctaaaaataatgaaggctatagaaatattactttattgttatcaaaggcttatcaacgcggttataacgatttaccttatattgatcaagattggttaattgaacatcgcgacggcgtgattattttatcagggggaacgcaaggcgatgtgggtaaaaaattgttgaaagaaaacgtagccgaaattgaaagtgcggtcgctttttaccaagaattttttgccgatcatttttatttagcattaagtcgtacaggtcgcccaaatgaagaacgttacattcaagcagcgttgaaattagcagaacgttgtgatttaccattggtcgcaactaatgatgtgatgtttttgaatgcagaggattttgaagcccacgaaattcgcgtagcgattcacgatggctatactttagacgatcctaaacgtccgaaatgttatacctcacagcaatattttcgtagtgaagaagatatgtgtaagctgtttgcagacattccttccgctctcgaaaataccttattaattgcgcaacgttgtagtgtgactttgcgccttggtcaatatttcttacctcaatttccaactggcgatttaagtacagaagatttcttagtgcaaaaatccaaagagggcttggaagaacgtttagtttttttattccctgatgaaaaagtgcggttagaaaaacgaccaaaatatgatgaacgcttgcaagttgagctagatgtaattaaccaaatggggttcccaggttatttcttgatcgtaatggaatttattcaatggtctaaggataacgatattccagtagggccaggtcgtggttctggtgcgggttcattagtggcttatgcattaaaaatcactgatttagatccgttagagtttgatttgctatttgaacgtttcttaaatccagaacgtgtgtctatgcccgatttcgacgtggatttctgtatggatggtcgcgatcgcgtgattgagcacgttgcagaaacctatggtcgtggcgcggtatcacaaattattacctttggcacaatggcggcgaaagcggttattcgagatgtagggcgagtgctggggcatccttatggtttcgttgatcgtatttctaaattgattccgccagatccaggtatgacgcttgccaaagcgtttgagaccgagccgcaattacagactgcctacgatagcgatgaagaagtgcgagcattgattaacatggcgcgcaagctggaaggtgtgacacgtaatgcaggtaaacatgcaggtggcgtggtcatttcgccaaccttaattactgatttcgcaccactctattgtgataatgaaggcttacatccggttactcactttgataaaaatgatgtggaatatgcagggcttgtgaaatttgacttcctaggcttgcgtactctcactatcattaaatgggcattggatataattaatgttcgtatggtgcgtgaaggcaagcctcgagtagatattgccgccattccacttgatgatcctgaatcttttgaattacttaaacgttccgaaaccaccgctgtgttccagttggaatcacgaggtatgaaagatttgatcaaacgcctgcaacctgactgttttgaagatattatcgcattggtagcattgttccgtccgggtccgttacaatcgggtatggtagataactttatcgaccgtaaacacgggagagaagaagtatcttaccctgacgcagaatatcaacatgcaagtttgaaacctattcttgagccgacttacggcattattttgtatcaagaacaagtgatgcaaattgcgcaggtgttggctggctatacgctgggtggggctgacttattgcgtcgagcaatgggtaaaaagaaaccagaagaaatggcaaaacagcgtttagtgtttaaagagggggctgagaaaaacggtgttgatggcgagctatctatgaagattttcgacttggtggaaaaatttgctggctatggttttaataaatctcactccgctgcttatgccttggtgtcttaccaaactctttggcttaaaactcatttccctgcagaatttatggctgcagtgatgacatctgaaatggataatacggataaaatcgtaggtttgtacgacgaatgtttgcgtatgggcttaaaagtgacgccaccagatattaatatcggaaaacaccattttagtgtcaatgaacaaggcgaaattgtgtatgggattggcgcgattaaaggcgtgggggaaggcccgattgaagcacttgtggcggcaagaaatgaaggggggattttcaaagatttattcgatttatgcgctcgtgtagatttgaaaaaaattaaccgccgtacttttgaaagcctaattatgtcgggtgcctttgataaattaggcccacatcgcgccgcactttctaagaatttggaagatgcacttagagcttccgatcagcatgcgaaagatgaagcaatgggacaaacggatatgttcggtgtgctgactgaaacccatgaagacgtggaaaatgcctatgctaatacaccaccttacactgaaaaacaaatccttgatggcgaacgagaaaccttggggctttatttaagtagccatcctgttagccgttatttgaaagaactttctcattacacatcaacgcggttgaaagatctcgcaccaaatcgccgtggacaaattagcactgtggcggggctagtcgtggcatcgagaattgcgatgacgaaaaaaggcaatcgtctaggtattgcaacattggacgatcgttcaggtcgcttagatttaacattatttggtgaaagcctagaacaatttggtgagaaattacaaaaagatacagtgattgttgcttcagggcaggtgagctttgatgatttctctggtggcttgaaaatgacggtgcgcgagttaatgaccttagatgaggcacgttctcgttatgtcaaatccttggctattagtctttctgagcatcaaattacaccaagtttcattaaacaatttaaagcattacttgagccagtgagtggtggaacattgcctattaacgtgtattatcaaagtccgaaaggtcgtgcgttgttacgtttaggcgtgcaatggtcgatcattccaacagatgaaattctgacggaattggtgaatttactcggcgaaagtgcggtggaattagagtttgaataa

SEQ ID NO: 1575 - DNA, 1644 bp, H. influenzae strain 86-028NP
atgacaacactttttgaggttgcacaacattggttaaaccaagatcctgacacagaaactcgtgcagaattaaccgcacttttagatgcagcaaaaggcggagataaagcggcagaagcagaattacatgcgcgttttgatggtcgcttacaatttggtacggcaggtttacgtggtcgtttacaagctggctcaatagggatgaaccgagttttagtttctcaagctgctggtggtttagcggaatatttaaaaggttacgataaagaaccctcaatcgtcattggttacgatggccgtaaaaactctgacgtttttgcccgtgacaccgctgaaattatggcgggtgcaggcgtaaaagcttatttattaccacgcaaattaccgactccagttttagcctatgctatccaatattttgataccactgcaggtgtaatggtaacagcaagccataacccaccagaagataatggctacaaagtgtatttaggtaaagcaaatggtggcggtcaaatcgtttcaccagcagataaagacatcgcagcattaattgataaagttgcggctggcaatatccaagatttaccacgtagcgataattatgtggtgttaaatgatgaagtggtagatgcgtacattacaaaaactgcatcattagctaaagaacccgcttgcgacattaactatgtttataccgctatgcatggtgttggctatgaagttttaagtaaaacactggcaaaagcaggattaccacaaccccacgtagtcgcagatcaagtttggccagatggcacattcccaacggtgaatttcccaaatccagaagaaaaaggcgcattggatttagcaattaaagtggcaaaagaaaagaacgctgaatttatcattgcgaatgacccagatgcagaccgtttagccgttgctgtgcctgatgcacaaggcaactggaaatcactacacggtaacgtggttggctgtttcttagggtggtatttggcaaaacaatatcaaggcaaacaaggtacattggcttgctcacttgtttcttccccagctcttgctgaaattgcgaaaaaatacggtttccaatcagaagaaaccttaactggtttcaaatacattggtaaagtatctggcttattgttcggttttgaagaggcattgggctatctagtggacccagacaaagtacgcgataaagacggtatttctgcagcaatcgtgttcttagatcttgtgcgtaacttgaaaaaacaaggcaaaactttagcagattatgctgatgaatttaccaaagaatttggtgcttatgtgagtggacaaatctctattcgagtcagcgatctttcagaaatcggaaaattaatgaccgcacttcgtaacaatccaccagcagaaatcgctggcgtgaaagtggcacaatttatcgaccatattaaaacagatcgtcaaagcgatatccttgtatttaacttggaaaatggcggacgcttaattgctcgtccttcaggtactgaaccaaaaattaaattctacttagatgcgcgcggtaaagatccaaaagatgcagattgcgtattggcagaatttgatgaaggtgttcgtcacattcttcgccaagatacttatggcaaataa

SEQ ID NO: 1576 - DNA, 510 bp, H. influenzae strain 86-028NP
atgtcagaacaaaaacaagacgttgcagcaacagaagaacaacaacccgttctccaaattcaacgtatttatgtgaaagatgtgtcttttgaagctccaaatcttccacatattttccaacaagaatggaaaccaaaacttggttttgatttaagcaccgaaacaacccaagttggcgatgacttatatgaagtggtattaaacatttctgttgaaactacacttgaagatagtggtgatgtcgcatttatttgtgaagtaaaacaagcgggcgtattcactattagcggtttagaagatgttcaaatggcgcattgtttaacctctcaatgcccgaatatgcttttcccttatgcacgtgaattagtgtctaacctagtcaatcgcggtacgttccctgcattaaacttatctccagtaaactttgatgcattgtttgttgaatatatgaatcgccaacaagcagaaaatgcagaagaaaaatctgaggaagaacaaactaaacattaa

SEQ ID NO: 1577 - DNA, 447 bp, H. influenzae strain 86-028NP
atgcaagaatttatctcaatggcaacagagtttgctcaaaaacatacgcttttagcagtttcttggtttgcgattttcgtgatggtgatttataccttctacaaaggcgcaacgagtaaatttaaagtaattacgcacaatgaagttattcggttaataaattccgatgaagccattgtggtagatttacgtagtcttgaagaatttcaacgtggacatatcattaatagtattaatgtgcttccaagcgaaattaaaaatcaaaatatcggaaaattagagtcgcataaagagaaagctcttatattagtcgatacaaatggtacttcagcctctgcttctgcagtatttttaaccaaacaaggttttaattctgtatttgtgttgaaagaaggcctttccgcgtgggtagcagcaaatttacctttagttaaaaaacataaataa

SEQ ID NO: 1578 - DNA, 1323 bp, H. influenzae strain 86-028NP
atgtctgcaatgtttttactacaatttgccatcgtattattgtgtatctttgtgggtgcacgtgtaggtggtatcggtttaggtgtatttggtggtttaggtcttgccattctttcttttggctttggcttgaaaccagcaggtttacctattgatgttatgtttatgattatggctgtagtggcagccgcggcagcaatgcaagcagctggcggtttagactacatgatcaaaatcgcaaccaaaatcttacgtcgtaatcctaaacacattacgtttattgcgccagcagtaacttggttattcactctcttagcgggtactggtcacgtggcatattctgtattgccagttatcgctgaagtgagccgtcaaaacggtatccgtcctgaacgcccaatgtcaatggcggtaattgcatcacaatttgctatcgtagcaagcccaatcgctgcagcagtggtggctgtggttgcttaccttgagccacaaggtattcatcttggcgatgttttaatggtaaccattccttcaactattctaggacttttccttgcttgcttatttgttaataaaatgggtaaagaattaaaagatgatccagaatatcaacgtcgtttgaatgatccaaaatatgcagatatttttgcttctaccactttagtcaaagaagtagaagtgagcaaaacagctaaaatttctgtttctttattcttatttggagctttacttgtcgtgttaatgggtgcagctccttctattcgacctgtttttgatggaaaaccaatgggaatggcacataccattgaaattattatgctttctattggtgcattgattatcttaacttgtaaaccagatggcacagcgattaccaaaggttctgtattccatgcaggtatgcgtgcagtaatcgcaatcttcggtattgcttggttaggtgacactttaatgcaggcacacattactgaagtaaaagaaatggtgaaaggcttagttgaaactgcaccatgggcatttgcttttgcgctatttgtactttcagtattagtaaacagccaaggtgcaacagtagcgacattgttccctcttggtatcgcattaggtatccctgcacctgtattaatcggtgtatttgttgctgtaaatggttacttcttcatccctaactatggtccaatcattgcatctcttgacttcgataccacaggtacaaccaaaatcggtaaatacattttaaaccacagctttatgcttccaggtttattgagcatgtttttctgcttattaatcggtttaggtctttctcacgttattctttaa

SEQ ID NO: 1579 - DNA, 1335 bp, H. influenzae strain 86-028NP
atgaaaaacgtcgtgatcgttggtgggggtgctggcggtattgaattagcaacatttttgggtaataaattaggtcgtcaaaaacaagctaaagtaacgctggttgatcgcaatgccacccatttatggaaacccttattgcatgaaattgcaacaggcgtaatggatgatggcgttgattctttaagttatcgtgcgcacggtaaaaatcattttttcagttttgagcaaggttcaattatacgtattaatcgcgagcaaaaatatgttgaacttgcacctgtttatggacaagagggcgatatgcttgtcattgctcgtcgaattccttacgattatttagtgattgccattggcagtaaatctaatgatttcaacacaaaaggggtggctgataattgtatttttttagatagttcaaaacaggctttacgttttcaacataaactgttggaattatttttaaaattttcagaaaaccgtgcattagatgacattggcgaagaagaatttaaacaaaagttagtggatgaaaataaagtaaatattgctattgtgggaggtggtgctactggtgtggaattaaccgcagaactttatcatgcggctgaagatttgtcttcttacggttatggtaaaattgatagttcttgcttacaagttactttagtcgaagcaggaacacgtttattgccagcattacctgaaaatttatctgctgcagtgttagatgaattaaaggaaatgggcaccaatgtgcaattaaacacaatgattactgaggcgcagccaaatacacttattaccaaagatggcggggagattaaagctgatcttattgtttgggcagcaggagttcgcgcctcaacagtaacgcagcaatttgatggattagaaattaatcgtatcaatcaattagtggttaaagatacacttcaaactaccgttgatgatagtatttttgcgattggcgattgtgctgcattaatacaatcaaatggtaaattggttccgccaagagcgcaagctgcacatcaaatggcaaaggcttgtgcaaaaaatatttttgcattgtttgaaaataaaccactgaaatcttttaaatataacgataaaggtactttagtttctctgtcaaattttaccgcacttggtagtctaaccaataagtttggtaaaaatccacttaccgttcaaggtaaatttgcgcagtttgcttatgtgtctttgtatcgaatgcaccaacatgctttgcacggttgtattaaaattggtttgattattctcgttgataaattgaatcgttatttaaaaccaagattaaaattgcattga

SEQ ID NO: 1580 - DNA, 2433 bp, H. influenzae strain 86-028NP
atggcaaattttataaatatgtatcgccaattattgagcttgccgctgtctgcattggtgaaaaataatcctattcccgccaatccaatagaagagctttcacttaatattcatcaacctattgtttatgttttgccttatacatctcaaactgatttcgttattttccgccgaaattgcttagcgttaggcttgcccgatcccgcagagaaaaatgaaattaatggcgttaagttaccacgttatgtatatttagacgaaggtcgccgaatttttaaatcaaaaggtgcaaaagacgaaaccactaccattttcaataaatatcttgaattacaccgcacttctgaaagtttagatgtgcaacttattcctgtttctgttctttggggacgttctcctggacaagaagataaatcagatttgcctaatttgcgtttattaaatggtatacaaaaaacatttgcagcaatttggtttggacgtgatacttttgtgcgtttttctcaagcggtttcattacgttatatggtagttgaacatggctcagatgaaaaaattgcacaaaagctggctcgagttgcaaaaatgcacttcgcaaaacaacgtatttcagcgacaggccctcgtttaccaaatcgtcaagcaatgtttaataaattattgcaatcagaagcaatccgacgagcaattgaagatgaagcaaaatcaaaaaatatcagtattgaaaaagcacaaaaagaagcatataaaattttggatgaaattgcagctgatgtcagccattcaagtttacgtgcagtagatcgttttttacgttggctttggaataaactttattcaggtattgatgtacaaaattcgaatcgtgtccgtaaattagcgttagaaggtcatgaaattgtttatgtgccttgccaccgtagtcatattgattacttattgctttcttatgtgctttatcatcaaggtcttgttccgccacatatcgcggcagggattaacttaaatttctggcctataggtagaatgtttcgtagttggggggcattctttattcgccgcacttttaagggaaatcgactatattctgccatttttcgcgaatatttatcagaactattccatcgaggctattccgtcgaatattttattgagggcggtcgttctcgtacaggtcgtttactggcaccaaaaacaggtatgatgtcaatgacacttcaagcattgcaacatagtcaaactcgccccatttcgattgttcctgtttacgttggttatgaacacgtattagaagtagacacttatgctaaggaattacgtggtgcagcgaaagaaaaagaaaatgcgggtttagtacttcgtgtaattaaaaaattacgtaatcttggtcaaggttttgtaaattttggtgagccaattacgctttcaaactatttgagccaacatttccctgattggaaagagcaaaatcacgaagaaaaaccacaatggtttacacctgcggtaaataatatttctaaacaagtaatgattaatattaacaaagcagcggcagttaattcaatgaaccttgtgggtacagcactactttcatctcgtcagcgagcactttcacgtgagcaactgttagaacaacttagtagttatcaacaattgttacaaaatgtcccttattctacggacgtagtgctaccaaatgtgacaccgcaagcaatgttagaacacgtattagctttagatcgtataggtgtgttaattgaaaaagataattttggcgaaattgtacgcttagaacgttcatctgctgtactaatgacttattatcgtaataatattcagcatctattcgtattaccatctttagttgcgagtattattttgcattacgaagcgatccaaaaagatttattattagacgcgattagaaaaatttaccctttcttacaaggcgaattgttcttacatttcaatgaagatgaattgaatgtacaaatccatcaaatcattaatgaatttgcacgccaaagcgttattaattcaaatgataacttcttatctattaataaatcaaaagtacgaattttacagctttggtctgcgggaacgcgggaaatcttgcaacgttattacattactgtcactattttacaaaaacaacctgctatttctcgagctgaacttgaaaaagaaagccagcttgttgctcaacgtttatcagtattacacggcataaatgcaccagaattctttgataaagcggttttttcaagctttattgcaaacttgaaagagcaacgttactttgatgaatctggttatactgttcttgataaaatagaagaattagcttcaacgctttcccatttgatttcaacagaaatttgcttaacggtgaaaggaacaattgaaaaatccgaagatctttcttcataa

SEQ ID NO: 1581 - DNA, 630 bp, H. influenzae strain 86-028NP
gtgtatatgagaccattaaccgcacgccaacaagaagtgttggatttattaaaacgccatttggaaacaacaggtatgccaccaacacgagcagaaatatctcgagaattaggtttcaaatctgcaaatgccgcagaagaacatttgaaagcactttcacgtaaaggtgcaatcgaaatcattcccggcgcatctcgtggtattcgtattttagacaatagttcgaatgatgaatttgacggtttaccgcttgtagggcgcgtggctgctggagaaccgattcttgcagagcagcatattgaagcgacatatcgagtagatgcagatatgtttaaaccacaggctgacttcttacttaaagtttatggtttatcaatgaaaaatgttggtatcttagatggtgatttattagctgtgcatagtactaaggatgtacgtaacggacaaattgtggttgcacgtattgaagatgaagtaacagtaaaacgtcttgagaaaaaaggttctatcatttatctacacgcagaaaatgaagaatttgatcctatagtagtcaatcttgaagaacaaaaaaattttgaaattgaaggtattgcagtaggcattattcgcaataacgcttggatgtaa

SEQ ID NO: 1582 - DNA, 825 bp, H. influenzae strain 86-028NP
atgcagttttccaaaatgcacggattaggtaacgattttgttgtggttgatggagtcactcaaaatgtgttttttactccagaaacgatccgacgtttagccaatcgccattgtggaattgggtttgatcaacttttaattgttgaagctccttacgatcctgaactcgactttcattatagaatttttaatgctgatggaagcgaagtttcgcaatgcggaaatggtgctcgttgttttgctcggtttgtgacattaaaagggctaactaacaaaaaagacatctcggttagcacacaaaagggtaatatggttttgacggtaaaagatgataatcaaattcgtgtgaatatgggcgaaccaatttgggaaccagcaaaaattccatttaccgcaaataaatttgagaaaaattatattctgcgtacagatattcaaaccgtactatgtggtgcagtttcaatggggaatcctcattgtgttgtacaagtagatgatattcaaacagcaaatgttgaacagcttggtcctttgttagaaagccacgaacgttttcctgagcgtgtcaatgctggttttatgcaaatcatcaacaaagaacatattaagcttagagtttatgaacgtggtgctggcgaaactcaagcctgtggaagtggtgcttgtgcagctgttgcagttggaattatgcaaggcttattaaacaacaatgtccaagtagatttaccgggcggttcgctcatgatcgaatggaatggtgttggtcatccactttatatgacaggcgaggcgacccatatttatgatgggtttataactctttaa

SEQ ID NO: 1583 - DNA, 498 bp, H. influenzae strain 86-028NP
atgacagttacattagcaggaaaccctattgaagttggcggacatttccctcaagtgggcgaaatagtagaaaactttattttagtcggtaatgatttagccgatgttgcattaaacgattttgcaggtaaacgcaaagtcctaaatatttttccaagcatcgacacaggtgtgtgtgcgacttcagtacgtaaatttaaccaacaagcggtaaaattaagtaatactgttgtgctttgtatttcagcagacttgccctttgctcaagctcgtttttgtggagctgaagggattgaaaatgccaaaacagtttcgactttccgtaaccacgcattacactcacaattaggcgtagatattcaaactggcccgttggcaggtttaacttctcgtgcggttattgtgttagatgaacaaaacaatgttttacacagccagttagttgaagaaattaaagaagagccaaactatgaagctgcattggcagtgttagcgtag

SEQ ID NO: 1584 - DNA, 3963 bp, H. influenzae strain 86-028NP
atgcaaacgtttgctttgttcgttataatacgtctgtttttttatttttcttttatacggaactgcaatatgactgtcaaaacctttcgtggctcgcctgctctttctgaatttcgtttaactcaacttcaacaaaaatgccagcaatatcaattgcctattacgtcagtttatgcagagtatttgcattttgttgaacaaaaaacatcgcttgtagaagatgaaatcgttaaattacaagcattattgcattatgggtcaatgttttctgaactcaagcctgcaggatattgtttaattgtgactccacgagtggggacaatttcctcttggtcttcaaaagcgacagacatcgctcacaattgtggtttgtcgaaggtaaatcgtattgaacgtggtatagcctattacttcaatattgagcgtgatttaaccgaagcagaattggctacgctgaaagatttattacacgaccgtatgttagaaaccgtgttaaatcacgaaacagaagcagccttgctttttactcaacaagaacccaaagcattaactaccattgatattttaaatggtggccgtcaagcattagaacgggcgaatattgccttgggtttagcgttggcagatgatgagatggattatttagtggaaagttttactgccttaaagcgtaatccacaggatgtggagctttatatgtttgcacaagcgaattcagagcattgtcgccataaaatttttaatgccgattggattattgatggcaaaaaacaggataaatcgctgtttaaaatgatcaaaaatacctttgagcaaacgcctgattttgtgctttctgcttataaagataatgctgcagtaatggaaggttcgaaagtcggccgttggtttcctgatcctgatggacaatatcgtgttcatcaagaagatgcgcacattttaatgaaagtggaaacgcataaccatcccacagcaatttcgccatttcctggtgctgcaacaggctctggcggggagattcgtgatgaaggggcaacggggcgtggggcaaaacccaaagcaggtttaacaggtttctcggtgtctaacctcgttattccaaactttgaacaaccttgggaaaatccattgtctaaaccaaatcgcattgcttctgccttagatattatgatagatgcgcctttaggtagtgcggcatttaataatgaatttggtcgcccagcattattaggttatttccgtacttatgaagaaaaagtaaatagttttgcaggaaaagaagtacgcggttatcacaagccgattatgttagcgggaggaatcggtaatattcgtggcgaacaggttcaaaaaggcgaaattccaatcggtgctaaattgatcgtgttgggtggggcagcaatgaacatcggtttaggtggtggtgctgcttcttcgatggacagtggtaaatcaaaagaagatttagattttgcttctgttcaacgtgaaaatccggaaatggaacgccgctgccaagaagttattgaccgctgttggcaattaggcgaagaaaatccaatcctgtttattcacgatgtgggggcgggtggtttatctaatgcaatgcctgaattggtacatgatggcaggcgtggaggaaaattcgatctgcgttctattctttgtgatgaaaaaggtatgtcgccattggaaatttggtgtaatgaatcgcaagaacgttatgtattagccgttgcgccagaaaacctcgaattatttaccgcactttgtgagcgtgaacgtgccccttttgcagtgattggcgaagcaacacaagcagaacatttaatcttgcacgatagtcatttcgataataatccgattgatttaccaatgaatgtgttattaggcaaaacgccgaaaatgacgcgtgaggttttatcaaaaacagtggaaaatcaatcacttaaaacagaaggtattcaattaaaagaagcattccatcgtgtattacgtttacccgttgttgcagaaaaaactttcttaattactattggtgatcgctcggtaacaggaatggtagcccgtgatcaaatggtgggaccttggcaaattcctgtatctgatgtggctgttactactgcttcactggatagctaccacggcgaagcaatggcaatgggcgaacgctctccagttgccttgctaaatttctcggcttcggcacgcttagctgtggcggaggcgattactaacattgctggcacccacattggcgagatgaaacgtattaaactttctgccaactggatgagtgcagcaggtcacacaggcgaagatgcgggactttatgaagcagtaaaagctgtgggcgaagaactttgtcctgcgttaggtttaactattcctgtgggtaaagactcaatgtcgatgaaaaccacttggatcgataatggcgaacaaaaatcagtgactgccccactttcattagtaatttccgcttttgctcgtgtagaagatgtacgtaaaacgcttacgccacaacttcgtaccgacaaaggtttatcgagtttattgctaattgatttaggcgaagggcataatcgattaggtgcgactgcacttgctcaagtgtacaaacagttaggagacaagcctgccgatgtggtaaaggttcaacgcttaaaagatttttacaatgcaatgcaaactttagtggcagaagataaattgttggcttatcacgaccgttcggacggcggtttaatcacaactcttgcagaaatggcgtttgcagggcattgtggggtagaagttgatatttcagctttaggcgacaacgatttagcggtattatttaacgaagaactgggagcggttatccaagttgccgatagccaattagaaagtgtacgtgaggtgttgaaagctcacaatttgcttggtattacccaccaattaggtacggtaactgctgatgatcgctttgagatcagccgcggcagccataaattattcagcgaaaaacgctctgaattacgtagtatttgggcagaattaacttaccaaatgcaacgcttacgcgataatccagagtgtgctgagcaagagtttgaagctaagaaaaaccctgacgacaaaggcttatccgcatttttgacttacgatgtgaatgaagatattactgcgccatttatcaataaaggtgtaaaaccaaccattgcaattttacgtgaacaaggtgtaaatagtcattatgaaatggcagcagcgtttgatcgagcaggctttaatgcaattgacgtgcatatgtctgatttaatgattggtcgtcgtaatttagccgaattcaatgcaatggttgcttgtggcggtttctcttacggcgatgtgcttggcgcagggggcggttgggcaaaatccatcttatttaacccgaaattacacgagcaattcagccagttttttatcaatccaaacacactgaccttaggcgtatgtaacggttgtcaaatgatctctaacttggcggaaattatcccaggtacagaaaactggccgcattttgtacgcaacaaatctgaacgctttgaagcgcgtgtgagtttagtgaaaattaatgaagtggattcagtttggtttgcaggaatggctggctcacatatgcccattgcggtttctcacggggaaggacaagttaagtttaaatcagttgaacagtttgcaggcttaaaagcacaaggcatcattgctgcacaatatattgacaacaacggtagccccaccgaactatatcctgccaatccgaatggttctgcggagggcattactgcaattacaaatcttgatgggcgagttgctattatgatgccacaccctgaacgtgtgttccgtgctgtgagtaactcttggcacccagaaaactggacagaagacggtgcgtggatgagattattcagaaatgcaagaatggtattttag

SEQ ID NO: 1585 - DNA, 239 bp, H. influenzae strain 86-028NP
atgttaatcacattaacacatattaataataacttgataataagaaatgaaattttagatagtcttggcaagcaagcaagcaagcaagcaagcaagcaagcaagcaagcaagcaagcaagcaagtaagcaagcaaagagtgacttaaatagtacatcacaaagcaaacaaattattcttcaagaaataaataaggtaaaagaaaacaatattagaaaaaataataagattgtttactaa

SEQ ID NO: 1586 - DNA, 744 bp, H. influenzae strain 86-028NP
atgtttattacacctatcttcattattaatctagaaaaatctacagatcgaaaagcttatatgcaagcacagtttgaacagttattttcgaataatttaatacaagaaattcacttttttgatgctatttatggaaaatcaaatccgaatcacccattgtttcaacgttacaatgaaaataagcggttgaatgcaaaggggtatcctttaaccttgggtcaattaggctgttatgcgagccattattctatgtgggagaaatgtgtagaattagattaccctattattgtattagaagatgatgctaaatttaaaaataatttcttagaagtacttgattttattaatagcgataaaaatacgtttgaatttttctggttacaacctgatcgtttgaaaaataaaagaaaattgatctctaatttcggtaatctttcgatatatcaatttagtaaaggatttgctggtgctacaggttattatttaactccccaagcagcaaggaaatttttaacacaaagcaaggagtggtatttaaccgtggatgtgacaatggatcgtttttttgagaataaagtgccaccttatgcaatagtaccattttgcttagaagatgatggcgagatagaatcaactatttatgagaaacaaaagaaacagagatcattaaaaatagtgattatgagagagttgtttaatctaaaaactaatattaaaagacgtatttataacttattccattga

SEQ ID NO: 1587 - DNA, 843 bp, H. influenzae strain 86-028NP
atgaatattctgataaaaagtgcggtaaaaaatttcattgttttttctaccgcactttatacctctttttcttttgctcaaagtaaacttgctattgtgattgatgatgtaggctatcattccaaagaagatgcagcaatttttgcgatgccacgtgaaatttccgtagcaattattcctgctgcgccctatgctcgagcacgtaatcaagaagcaaaatctcaaggtagagatattttaatccatatgccgatgcaaccagtaagtgcagtgaaaatagaagacggtgggctgcatttaggaatgtctgcagcacaagtaaatgatcgcgttaatacggctaaaaatattgtgcgtgatgccatcggtatgaacaatcatatggggagtgcagctacggcagatccccaattaatgacttatttaatgaccgcacttcaagaaaaacatttattctttttagatagtcgaacaataggaaaatctgtagctgggaaaatagcaaaagaacaaggcgtgcgttcattagatcgccatatatttttagatgatagtaacgaattcgcagacgttcaacgtcaatttaaagcagcaattcactatgctagaaaacacggctccgccattgcaataggtcatcctcgccaaaatacgattgcagttttacaagcaggacttcgtaatttacccgaagatattcaattagtcggaatgggaaatttatggcgaaatgaaaaagttattccgcacaagccatttattttattattcagcgaagtgcccgcgccaacttctatagaaccttttgagcctgtaggattattgcgtggaattccaaaataa

SEQ ID NO: 1588 - DNA, 1233 bp, H. influenzae strain 86-028NP
atgttgcgttttggcgttaatcaaaaaacatcattattattaaccgcacttttaagctgcggtttattaatattttcgcctgtcagccaatcttccgatctcaatcaaattcaaaaacaaattaagcaacaagaatctaaaatagagaagcaaaaacgtgagcaagctaagttacaagcaaatttaaaaaaacacgagagtaaaattaacagtgttgagggcgaactgcttgaaacagaaataagtttaaaggaaattcgtaagcaaattgccgatgcagataagcaactcaaacaattagaaaaacaggaacgtgagcaaaaagcacgattaaccaaacaaatagatataatttatcgttcaggcattaatccatcgctgattgaacgaatgtttgcccaagatccgacaaaagcagagcgaatgaaagtttattatcagcatttaaatcaagttcggattgaaatgattaataatttaaaagcaacgcaagcacaaattgcagtacaaaaaaaggcgattttctctcaacaaaagaatcaccgaaatcaactttccacacaaaaaaaacaacaacaagcattgcaaaaagcacagcaagagcatcaatctacgctgaatgaactcaataaaaatttagccctagatcaagataaattgaatgcactaaaagcaaacgaacaagcacttcgtcaagaaattcaacgagctgaacaagcagcgcgcgaacaagaaaaacgtgaaagagaggcacttgctcaacgccaaaaagctgaagaaaaacgaacatcaaaaccttatcaaccaactgtacaagaacgccaattacttaatagtacaagcggtttaggggcggcaaaaaaacaatattccttaccagtttctggttcaattttgcatacttttggttctatccaagcaggcgaagtacgttggaaaggtatggtaattggcgcatcagcaggcacgcctgttaaagcaattgctgctggacgcgtcattttagcgggatatttaaatggttatggttatatggttattgttaaacacggcgaaactgatttaagtttatatggcttcaatcaagccgtatcagtgaaagttggtcagcttgtttcagcagggcaggttattgctcaagtaggaaatacaggggaaatatcacgttctgcgctttattttggtattagccgtaaaggaacgccagtaaatcctgcagggtgggttcgttga

SEQ ID NO: 1589 - DNA, 684 bp, H. influenzae strain 86-028NP
atggaattagtatttatccgtcacggttttagtgaatggaatgcgaaaaacttattcacaggctggcgtgatgtgaatttaactgaacgtggtgtggaagaagcaaaagctgcgggtaaaaaactgttagacaaaggttatgaatttgatatcgcatttacctctgttttaactcgagcaatcaaaacttgtaatatcgtgttagaagaatcccatcaattatggattccgcaagtaaaaaactggcgtttaaatgaacgtcattatggtgctttacaaggtttagataaaaaagcgactgcggagcaatacggtgacgaacaagttcatatttggcgtcgttcttatgacatttctccaccagatttagatccacaagatccaaattctgcacacaatgaccgtcgctacgcaaatattccatctgatgttgtgccaaacgcagaaaatttaaaattaacattagaacgcgcattaccattctgggaagatcaaattgcaccagcaatgctttctggcaaacgtgttttagtagttgctcacggtaattcacttcgtgcgttggcaaaacatattatcggtatttctgatgctgaaattatggattttgaaattccaacaggtcagcctttagttttaaaacttgatgataaattaaattacgtagaacattactatctttaa

SEQ ID NO: 1590 - DNA, 213 bp, H. influenzae strain 86-028NP
atgaaacaaggtattcatccagaatataaagaagttactgcgacttgttcttgcggtaatgtgatcaaaacacgttcaactttaggcaaagacatcaatcttgatgtgtgcggtaactgccacccattctacactggtaaacaacgtgttgttgatactggtggtcgtgtcgagcgtttcaacagccgtttcaaaattccaagcacaaaataa

SEQ ID NO: 1591 - DNA, 1137 bp, H. influenzae strain 86-028NP
atgttagcaaaatcttccatcaatgcgccatttgccaaatctgttttagcttggtacgacaagtttggacgcaagcatttaccttggcagcaaaataaaacgctttatggtgtatggctttctgaagtgatgttgcaacaaacgcaagttgcgacggtaattccttattttgagcggtttatcaaaacatttccaaatatcaccgcacttgccaatgcttcacaagatgaagtgttacatttatggacaggcttgggctattatgcacgagcgcgtaatttacataaagccgctcaaaaagtacgggatgaatttaatggaaatttcccgacaaattttgagcaagtttgggcgttatctggagtgggacgttcaactgctggtgccattttatcttctgttttaaatcagccttatccaattttagatggtaatgtgaaacgtgtgttggcgcgttattttgctgttgagggatggagtggcgagaaaaaagtagaaaatcgcttgtgggcattaacggagcaagttacacctacgatgcgtgtggcagattttaatcaagcaatgatggacattggtgcaatggtttgcacgcgaactaagcccaaatgcgatctttgtccgttaaatattgattgtttggcttataaaaatacaaactgggaaaaatttccagctaaaaaacctaaaaaagcgatgccagaaaaaactacctattttttaattttgtcgaaaaatggcaaagtatgtttggaacagcgagaaaactcaggattatggggcggattattttgttttccacaatttgaagataaatcctcgttgcttcattttttagcccaagaaaaagtcacgcattatcaagaatggccgagttttcgacatacatttagccattttcatttagatattcatccaatttatgctgaaatggagagcgctttatgcgtagagcaggctaatttagactggcgaaaagtgatggaaagcacaaaagaataccaatcaaacctatcaagtgcggtcaaatattggtatgatccacaaaatcctgaaccgatcgggctggctcagcctgtgaaaaatcttttaatacaatttgtaaggaatcattatggcaagaacagtattttgtga

SEQ ID NO: 1592 - DNA, 273 bp, H. influenzae strain 86-028NP
atggcaagaacagtattttgtgaatatctcaaaaaagaagcggaaggcttagattttcaactttatcctggagagttggggaagcgtatttttgattcagtaagtaaacaggcttggggtgaatggattaagaaacaaacgatgcttgtgaatgaaaaaaaacttaatatgatgaatgcagagcaccgtaaattattagaacaagaaatggttaattttttgtttgaaggtaaagatgttcatattgaaggttatgttccaccatcaaattag

SEQ ID NO: 1593 - DNA, 1074 bp, H. influenzae strain 86-028NP
atgaaaaaatatttattattggcattattgccttttttgtatgcttgtagtaattcatcgaatcaaggtattaactatgatgaagcctttgctaaagacacgcaagggttagatattctcacagggcagttctcgcataatattgaccgaatttggggcgtcaatgaattgttagtggcaagccgtaaagattatgtgaaatatacagattctttttatacgcgtagccatgtgagttttgatgaaggtaatatcgttattgaaacccagcaagatttaaatcgattacataatgctattgttcataccttgttaatgggagcggatgcaaaaggtattgatttatttacttctggcgatgtgccgattagctctcgtccatttcttttggggcaggttgtagatcatcaagggcaacaaattgctaatcaagttatcgcaagtaatttcgccacttatttgattcaaaataaattgcaaacacgtcgattacaaaacgggcataccgtgcaatttgtttctgttcctatgattgcaaaccacgtagaagtgcgtgcacgaaaatatttaccattgattcgtaaagctgcacaacgttatggcattgatgaaagtttgattttgggcattatgcaaacagaatcaagttttaacccatatgcgattagctacgcaaatgctattggattaatgcaagttgtgcctcatacagcaggtcgagatgtatttgcaatgaaaggcaaaggtgggcagccatcaacgcgttatttatatgatcctgcgaataatattgatgctggtgtgtcttatttatggattttacaaaatcaatatttagatggaattacgaatccaacctcaaaacgtttcgccatgatttctgcatataatagtggtgcaggcgcagtgttacgtgtttttgataatgataaggatacggcgatttacaaaatcaatcaaatgtatccagaacaagtttatcgcattctaacgacagttcacccatcatcacaagcacgcaattatttgttgaaagttgataaggcacagaaaaaattccgtgttagacgataa

SEQ ID NO: 1594 - DNA, 681 bp, H. influenzae strain 86-028NP
atgattttatttgctggtgatccgcacggaagctatgatcacatttacccttttataaaagaacaggaaaatgtcgcactgataattttaggcgatttacagctcacgacagcagatgagttggataaacttgcgcaacattgtgatatttggtttattcatggaaatcatgatagcaaaaccattagtgcttttaatgcaatttggggttctaagtggcaatcacgcaatttacacaatcgcatagttgatattcaaggaactcgcattgcgggattaggcggtgtattccgtgggcaaatttggatgccaccaaatcgccccatgttttttgatcctattcattattgccaatatagcccacaggagaagatttggcgaggcggtgtgcctttgcgtcatcgcacgtcaatttttccatcagatattgaaatcttagaaaaccaacaagcagatgtgttgatttgtcacgaagcccctaaaccacatccgatgggtttccaagtaattaatgatttggcaatgaagatgggggttaagctagtattccacggacatcatcacgaaaactttacttatcgaacaaagtatccctacaaaatcacgaatgtaggtttccgcagtcttgctgatgcagagggaaattatttgctgcaaaccatcgatgatcgtgaaaaataa

SEQ ID NO: 1595 - DNA, 1266 bp, H. influenzae strain 86-028NP
gtgggctttaccaccggtagggaatttcaccctgccctgagaatgcgagctaagtataacgcaaaatacctaggcactaaatcagaacgtgaaaaatattttcatttagcctacaataaacacactcaattcttacgctatcaagagcagattatgtcaaaaacaaaagagaaaaaagtcggtgtcattttcgggaaattttatcctgtacacacaggtcatataaatatgatttatgaagcgttcagtaaagtcgatgaactacacgttatcgtgtgtagtgacacggtgcgcgatttgaaattattttacgatagtaaaatgaaacgcatgccaaccgtgcaagatcgtttgcgttggatgcagcaaattttcaaatatcaaaaaaatcagatttttattcatcatttgattgaagacggtattccaagttatccaaacggctggcaatcttggagtgaagcagttaaaaccctatttcatgaaaaacattttgaaccttcaatcgtatttagtagcgagcctcaagataaagcgccttacgagaaatacttaggtttagaagtatcgttagtcgatcctgaccgcactttctttaatgtgtccgcaaccaaaattcgcaccactccattccaatattggaagtttattccgaaagaagctcgtcctttctttgccaaaacggtggcgattttagggggagaaagcagtggtaaaagcgtgctagttaataagttagccgccgtatttaataccacttctgcgtgggaatacgggcgtgaatttgtatttgaaaagctcggtggcgacgagcaagcgatgcaatattctgactatccgcaaatggcgcttggtcatcaacgatacattgattatgccgtgcgccattctcataaaattgcatttattgatacggatttcattaccacgcaagcgttctgcattcaatatgaaggaaaagctcatccatttttagactcaatgattaaagaatatcccttcgatgtcactattttacttaaaaataatactgaatgggtggatgatggcttgcgcagcttaggctcacaaaaacaacgccaacaatttcaacaactactcaaaaaactgttagataaatataaagttccttatatagagattgaatctccaagttatcttgatcgctataaccaagttaaagcagtcattgagaaagtgttaaatgaagaggaaatcagtgaattacaaaacacaacctttcctataaaagggacatctcaatga

SEQ ID NO: 1596 - DNA, 648 bp, H. influenzae strain 86-028NP; identical to SEQ ID NO: 623

SEQ ID NO: 1597 - DNA, 849 bp, H. influenzae strain 86-028NP
gtgaaaatttctatgatttttttaccgcactttttatattatactgttccaactttttatttatttgggttacttattatgcataatgcagctcagcacaattatgttatcagtttaactactgaacaaaaacgccgaaaacatattacagacgaattcggtaagcagaatattcctttcgaattttttgatgctattacgcccgacattattgaagaaaccgctaaaaaatttaatattgcattagatcgctctcctaaagccaagttgtcggatggggaaattggttgtgcattaagccatattgttttatgggatttagcattagaaaataatttaaactatatcaatatctttgaagatgatattcatttgggggaaaatgccaaagaattattagaaattgattatatttctgatgatattcatgtcttaaaattagaagcaaatggcaagatgttctttaaacaaccaaaatctgtaaaatgcgatagaaatgtttatcccatgacggtaaagcaatcaggatgtgctggatatactgttacagcaaaaggggctaaatatttgcttgaattagtaaaaaataaaccacttgacgtggcggttgattcacttgtttttgaggattttttacattttaaagattataaaatagtacaactttctcctggtatttgcgttcaagattttgtgttacatccagataatccttttgaaagcagtttacaagaaggacgagatagagtacacggaaatcaacgcaagttttctattttagaaaaaataaaaaatgaatttggacgagtaaaaataaaaatgtttggaaaacaagttccatttaaataa

SEQ ID NO: 1598 - DNA, 483 bp, H. influenzae strain 86-028NP
atgttagatattgttttatatgaaccagaaatcccacaaaatacggggaacattattcgcctttgtgccaatacaggatttcgcttgcacttaattgaacccctaggtttcacttgggatgataaacgcttacgccgctcaggtttggattatcacgaatttgcggaaatcaaacgccacaaaacctttgaagcctttttagaaagcgaaaaacccaaacgcctttttgcacttacaacaaaaggcagtccagcccatagccaagtgaaatttgaacttggggattatttaatgtttggcccagaaactcgtggcattccgatgtcaattttaaatgaaatgccgatggaacaaaaaatccgcattccaatgacagccaatagccgcagtatgaacttgtccaattctgtcgcagtaacggtttatgaagcgtggcgacaattaggctataaaggtgcggtaaatttaccagaagtagaataa

SEQ ID NO: 1599 - DNA, 582 bp, H. influenzae strain 86-028NP
atgaaaaaaatacaaacgccaaatgcaaagggcgaagttcgcattattgctggactatggcgagggcgaaaacttcctgtattaaattctgaaggcttacgcccaactggcgatagagtgaaagaaacgctttttaattggttaatgccttatatctatcaatctgaatgtttagatggctttgcggggagtgggtcgttaggttttgaagcactttctcgccaagcgaaaaaggtgacttttttagaattggataaaaccgttgccaatcaattaaaaaagaatttacaaacactcaaatgctcatcagaacaggctgaagtaattaatcaaagtagtttggattttctaaaacagccacaaaatcaaccgcactttgatgtggtgtttttagatccaccctttcattttaatttggcagaacaagcaattagtttgctttgtgaaaataactggctaaaacccaatgcgttaatttacgtagaaacagagaaagataaaccgcttattactcctgaaaactggacgttattgaaagaaaaaacgacgggaatggtgagctatcgtttatatcagaattag

SEQ ID NO: 1600 - DNA, 1245 bp, H. influenzae strain 86-028NP
atgaacgacatttttatcggattacagttaagagagcattttatggctgaagaaaataaaaaaggcggattttgggcatcattatttgggcgtaataaaaagcaagatgaacctaaaattgagccaataattgaagaagaaaagataaaagatatcgagccgtctattgaaaaatttgaaactcatgatttagtcgaagaagaaaaaatacaggaaatttcaaccgcacttgagccgattgaagaaatcatcgaagcgaaaaagttagaagatgagcttcagcctgttgctgaaattgaaactcgcgaaaagccaagtgaagggggcttttttagtcgtttggttaagggattactgaaaactaaacaaaatattggcgcgggttttcgtagttttttcttaggaaagaaaattgatgatgagttgtttgaagaattagaagaacaactgttgattgcggatattggcgtgccgacaacaagtaaaatcgtcaaaaatttgactgaacatgcaagtcgtaaagaattacaagatgccgagcttttatatcaacaattaaaagtagaaatggcggatattcttgagccagtagcacgaccgttagagattgatagcacgaaaaaaccttatgtgattttaatggtgggcgtaaatggcgtgggtaaaacgacgacaattggtaaacttgcacgtaaatttcaggctgaaggaaaatcggtgatgctcgcagcaggtgatactttccgcgcagcggctgttgagcagcttcaagtttggggagaacgcaatcatattccagttgttgcgcaaagcacgggttctgattctgcgtctgtgatttttgatgcgatgcaatcagcggctgcacgcaatattgatattcttattgcggatacggcgggtcgtttacaaaataaaaataacttaatggacgaactgaaaaaaattgttcgtgttatgaaaaaatatgacgaaactgcaccacatgaaattatgcttacgctggatgctggcacgggacaaaatgctattagccaagcgaaattatttaatgaggctgtgggtttaacagggatctctctaactaaattagatggcacggcaaaaggtggcgtgatttttgccatagccgatcagtttaagttgcctattcgctatatcggtgtaggcgagaaaattgaagatttacgtgagtttaatgcgaaagaatttattgaggcattattcgttcatgaagaagaataa

SEQ ID NO: 1601 - DNA, 657 bp, H. influenzae strain 86-028NP
gtgattaagttctcaaatgtttctaaagcctatcatggtgcaacgcagccagccttacaaggcttgaattttcatcttccagtgggaagtatgacttacttagttgggcattcaggcgcagggaaaagtacattactcaagcttattatggggatggaaaaagccaatgctggtcagatttggtttaacggacacgatattactcgcttgtcaaaatatgaaattccatttttgcgtcgccaaattggcatggttcaccaagattatcgtttattaacagatcgtacagtggcggaaaatgtggcattgccattgattattgcaggtatgcatccaaaagatgcgcatacacgtgcgatggcatctttagatcgtgtaggattgcgtaataaagcacactatttgccaccacaaatttctggcggtgagcagcaacgcgttgatatcgcgcgtgcgattgtgcataaacctcagctcttactagcagatgaaccaacgggtaatttagacgatgaactttctttaggcatttttaatttgtttgaagaatttaatcgtctaggaatgactgtgttaatcgctactcacgacattaatttaattcaacaaaaaccaaaaccttgtcttgtgcttgaacaaggttatttacgttattaa

SEQ ID NO: 1602 - DNA, 933 bp, H. influenzae strain 86-028NP
atgagccgatcaacggatgcatctgtttttgttcaaacagcctatactttgcgtgcagtatgggcggatttatggcaacgtaaatttggcacgctgctcacgattttagtgattgccgtttcgcttacgatcccgactgtgagctatttaatgtggaaaaatttgcatttagccaccactcaattttatcctgacagtgaattgactatttatcttcataaaaatttaagtgaggaaaacgcgaatttagtggtagaaaaaatccgccagcaaaaaggcgtagaatcactgaattatgtttctcgtcaagaaagtttaaaggaatttaaaagctggtctggctttggcgaagaattggaaattttagatgataatccattgcctgcggtcgtgatagtaaaaccgacgagcgaatttaatgtgtcagaaaaacgtgatgagttacgtaccaatttaaataaaatcaaaggggtacaagaagttcgcttggataatgattggatggaaaaattaaccgcactttcttggttaaccgcccatgtggcaattttctgtacggtattaatgacgatagcggtatttttagttattggtaacagtattcgctctgatgtgtacagtagccgctcaagtattgatgtgatgaaattgcttggtgcaacagatcagtttatccttcgtccttatctttatacggggatgatttatgccgtgttaggtgggttagttgcagcaatttttagtagttttattatcagctattttacttctgcagtgaaatacgtaacggatatttttgccgtccaattcagtttgaatggattaggcgttggcgagtttgtattcttattagtgtgctgtttaattatgggctatgttggggcgtggattgccgcgacaaggcatattgcgatgatggagaggaaagaataa

SEQ ID NO: 1603 - DNA, 1182 bp, H. influenzae strain 86-028NP
atggaaaatgttgttattgttagtgcagttagaacaccgatcggcagctttaatggtgcattatcttccgtaagtgcggttgatttaggcgcaattgtgatacaagaagccatcaaacgtgccaacattgaaagtgcattagttaatgaagtcatcatggggaacgtattacaagcaggactagggcaaaatccagcccgtcaagcagcattaaaagcaggaatagagaaagaaatcccttctttaacaatcaataaagtatgtggatctggtctaaaaagtgtcgcattaggtgcacagtctattatcagtggtgatgctgatattgttgttgtgggtggcatggaaaatatgagccaagcaccttatcttttagatagcaaagtacgacaaggcgtcaaaatgggtaatctcacattaagggacacaatgattgaagacggactaacttgtgctagcaatcactatcatatggggattactgccgaaaatattgcagaacaatatggtattagccgccaagcacaagatgaactcgcattacgttcacaaaccttagcatctcaagccgtgcaattaggtgtatttgataaggaaattatccctgttatggtaaaaactcgcaaaggtgacattattgtttcacgagacgagtatcctaaagcagatactacagctgaaggtttagctaaattaaaacctgctttcaaaaaagagggtactgtcaccgcaggtaacgcttctggcattaatgatggtgctgcagcacttattttagttagcgaaagcaaagctcatgcacttggattaaaagccattgcaaaaattagaagctatgccagcggtggggtagatccatctgttatgggattaggtccagttccagcaacgcaaaaagcattgaaaaaagcaggaataaatcttgatgatatcgatctgatagaagcaaatgaagcctttgcctcacagttcttaggtgttggcaaagatctcaatttggatatgaataaaaccaatattcatggtggagctatcgcacttgggcatccaatcggtgcgagtggtgcaaggattttagtaacgttattgcacaatcttatcgaaaaagataaaaaacttggacttgctacactttgtattggcggtggtcaaggtatttctatgattgtagaacgcttataa

SEQ ID NO: 1604 - DNA, 1344 bp, H. influenzae strain 86-028NP
atgattagtcgcgtttctcgttttatgacgacattcgtcagtaaatacctgccagacccacttatttttgccgtgttacgcacctttgtcacattcatttgtgcttggggattaaccgatagtacacctgttgatttagttaatatgtggggtaatggcttttggaatttacttggttttggtatgcaaatggcattaattgtcgtaactggtaatgctcttgcaacctcaccacaaattcgtaagtttctttctacaatcgcttcaatagcaaaaacaccagcacaaggtgttgtcttagttacgtttatgggttcaattgcctgtatcattaactggggcttcggtttggtcgttggtgcgatgtttgcaaaagaagtcgcgcggagaataaaaggcagtgactacgccttactgattgcctgcgcctatattgcatttatgacatggggtggaggtttttcaggctcaatgccacttttagccgcaacaccaggcaacccagttgctcatttaatggtgagcgaaagcaacccacaaggtattattcctgcagttagtacgcttttctctgggtacaatatttttatcacgttaagtttagtcatttgcttgcctttcattacctatatgatgatgcccaaaaatggcgaagcaaaaagtattgatccaaaacttattgcgcccgatccaacatttgataaaaaattggataaagatgcaacacttgctgaaaaaatggaagaaagccgcttcttagcctatacaatcggggcattaggatatagttacctcggtatgtatttctacaaaaacggattcaatctcacaattaataatgtaaaccttattttcttaatcacaggaattgtgcttcatggctcgccaatggcctatatgcgagcaattattaatgccacaagaagcacagcagggatcttagtgcaattcccattctatgcgggtgtgcaactaatgatggagcattcaggcttaggtggtttaatcacagaattctttatcaatgttgctaacaaagattctttcccattattaaccttctttagttctgcctttattaactttgcagtgccttctggtggcggtcactgggtcatccaaggaccatttgttatccctgctgctcaagcattaggtacagatctgggtaagtctacaatggcaattgcctatggtgagcaatggatgaacatggctcagccattttgggcattaccagcactgggtatcgcagggcttggcgtgagagatattatgggcttctgtatgaccgcacttatcttcaccgcaccaatttttattattggtttatatttcttatag

SEQ ID NO: 1605 - DNA, 666 bp, H. influenzae strain 86-028NP
atgaatgcaaaagaattaatcgctcgccgaattgcgatggaattacatgatggagatattgttaatctcggtattggtttaccaacacaggttgttaattatttacctgataatgtcaatattacacttcaatcagaaaatggctttcttggtttaactgcatttgacccagaaaatgctaattcaaacttagtaaatgctggtggtcagccttgtggaattaaaaaaggcggcgctacttttgatagtgctttttctttcgctttaattcgtggcggtcatgttgatgcctgtgtgctaggtggacttgaagttgatcaagaagcaaatctcgctaactggatggtgcctggcaaaatggtaccaggaatgggcggagcaatggacttagtgactggtgcaaaaaaagtgattattggcatggaacattgtgccaagtcaggttcctcaaaaattctaaagaaatgtacattaccgctcacagcaagtaaaaaagttgccatggtggttaccgaattggcagtatttaacttcattgaaggcagattagttctaaaagaacatgctcctcatgtggatttagaaacaattaaagccaaaacagaagccgatttcattgttgccgatgatttcaaagaaatgcaaatcagccagaaaggactttaa

SEQ ID NO: 1606 - DNA, 654 bp, H. influenzae strain 86-028NP
atgacacaaaaacatcttaagcttaataatctaaatcaacacctacatgatggtatgagcatcatgtttggtggatttatgggtatcggcactccagccaaacttgtccaacaaatcttagattctggcgtaaaggatctcacactcataggcaatgacacagcctttattgacactggcgtagggcctttaattgtaaataatcgagtcaaacgtttaattacatcccatattggtacaaatccagaaactggcaaaaaaatgattgctggtgaaatagatgtagaactcgttccacagggtaccttagctgaacggattcgtgcaggtggcgccggattaggtggtattttaacaccaacgggtgtcggcactgttgttgaagaaggaaaacaaaaaattcaaattgatggcaaagaatatttacttgaactcccactaaaagctgatattgccattatccatgctcaaaaaggtgacatgaatggcaatttagcttatgaattatctgctaggaactttaatccactagttgctttagcagccaaaactgtcattgcccaagttgataatctactagaggtcggtcagttacccccagatgaagtcatcacgccagccgcattaattgattacattgtttgttcagaataa

SEQ ID NO: 1607 - DNA, 948 bp, H. influenzae strain 86-028NP
gtgctatattttgtaaaaatggcagtccttaggggggtgaaaatgatggatattaggcatctaagatattttgtttcaatcgtagataatgattttaatttaagccgagcgtctcaaaatttatatgtgtctcaacctgcattaagtatgatgattacggagtttgagaatcgtgaaaatattcagatatttaaacgggcatcaggaaaaattattggactaacctttgcgggggaaaattattatcgtgatgcaaaagaagtgatcaagcgttacaatgatatgagaacaaatctttataaatcaaaagattgtaagaaaggcacgataacaattggtattcctcccttagttttatcagccgtgttctcttctgtattgcctcatcttattcttaagaatccagatattaattttattattaaagaaattggagcttatgctctaaagagtgaacttcttttagataaagttgatttagccgtgttgttatatcccgagcgaatatcaaaaaatattattgattcaattgaaattcatagttctgaattagccttatttctttcaccaaagcatgtcttagcaaaaaaacaacaaatcacatgggctgatttacatcagcagaaaatggcaatttttgatcaaacatttatgattcatcatcatttgaaggaagcttttgagcgcaataattgttatccagatattgttttggattcgagttgttgggattttctgctaagtgcggtcaaaacaaacaaagaattattaactattctaccgttacctatggctgagctttatcattcaaaagaatttttgtgtcgtaaaatcgaaagtcctgttccgtggaaagtgacactatgtcgtcaaagaaaaacggtttacacacaccttgaagaatatatttttgataaattattagaggcttttaggccaacaaaatag

SEQ ID NO: 1608 - DNA, 312 bp, H. influenzae strain 86-028NP
atgcagaaccaaagaatccgtatccgcttaaaagctttcgatcaccgtttgatcgatcaatctactgcggagatcgtagaaacagctaaacgtactggcgcacaagttcgtggtccaattcctttaccaactcgtaaagagcgtttcaccgtgttgatttctccacacgtaaacaaagacgcacgtgaccaatacgaaattcgtactcacaaacgtttagtagatatcgtagagccaacagaaaaaactgttgatgcattaatgcgtttagatttggctgccggcgtggacgtgcagatcagcctaggttaa

SEQ ID NO: 1609 - DNA, 627 bp, H. influenzae strain 86-028NP
atgattggtttagtcggtcgtaaagttggtatgacccgtatcttcaatgaagacggcgtgtcagtaccagttaccgttatcgaaattgaagccaaccgcgtaactcaagttaaaactcttgaaaacgatggctatactgcagttcaagttactactggttctaaaaaagcgaatcgtgtaactaaacctgaagcaggtcatttcgtgaaagcaggtgttgaagctggtcgcggtttatgggaatttcgtactgaaggtgaagaattcactttaggtcaagaaatcaatgtagacatcttcgcagatgttaaaaaagtagatgttactggtacttctaaaggtaaaggtttccaaggtggtgttaaacgttggaacttccgtactcaagatgctacacacggtaactctttatcacatcgtgtacttggttctattggtcaaaaccaaacaccaggtcgtgtgtttaaaggtaaaaaaatggcaggacatttaggtgctgaacgtgtaactgttcaatcacttgaagttgttcgtgtagatgctgagcgtaaattgctattagtaaaaggttctgtacctggtgctatcaatggcgatgttatcgttaagccggcagttaaagcataa

SEQ ID NO: 1610 - DNA, 603 bp, H. influenzae strain 86-028NP
atggaattacaagttgtaggtgcaaacgcactcactgtttctgaaactaccttcggacgtgagtttaacgaagcgttgatccaccaagttgttgttgcttatgcagcaggtgcgcgtcaaggtactcgtgcgcaaaaaactcgtgctgaagtgtctggttcgggtaaaaaaccttggcgtcaaaaaggtacaggtcgtgctcgtgctggtgatattaaatcaccaatctggcgttctggtggtacaaccttcgcggctaaaccacaagatcacagccaaaaagtgaacaagaaaatgtaccgtggtgctatcaaaagcattctttctgaattagttcgtcaagaccgtttggttgtggtggaaaaatttgaattagatgcaccaaaaactaaagttttagtacaaaaattaaaagatttagccgttgaagatgcgttaattatcacagcaagtttagatgaaaatctattcttagccgcacgtaacttatataaagttgatgtacgtgatgttcaaggtatcgatccagttagcttaatcgctttcgataaagtgattgttactgttgatgctgtgaaacaaattgaggagatcctagcatga

SEQ ID NO: 1611 - DNA, 300 bp, H. influenzae strain 86-028NP
atgagtcaagaacgtttgctaagtgtgctacgtgcaccgcacatctctgaaaaagcaactaacaatgctgaaaaatctaacactgttgtacttaaagttgctttagatgcgaacaaagctgaaattgctgctgcggttgctcaattatttgaagtaaaagtagattcagttcgtactgtggttgttaaaggtaaaactaaacgccgtggtaacaaaatgggtcgtcgcagcgactggaaaaaagcttatgtaactttagccgaaggccaaaacttggacttcgtggacagtgcagagtaa

SEQ ID NO: 1612 - DNA, 822 bp, H. influenzae strain 86-028NP
atggctatcgttaaatgtaagccgacctccgctggtcgtcgtcacgttgttaaaatcgtgaaccctgaattacacaagggtaaaccttacgcacctcttctagatactaaatctaaaactggtggtcgtaacaactatggtcgtattactactcgtcacattggtggcggtcacaaacaacactaccgtttaatagatttcaaacgtaacaagttagacattccagcggttgttgagcgtttagaatatgatccaaaccgttctgctaacattgctttagtgctttataaagatggtgaacgccgttatattttagcacctaaaggtttgtcagtaggcgatcaaatccaagctggcataaactcaccaattaaagtgggtaactcattaccaatgcgtaatatcccagttggttcaacagtacataacgttgaattaaaaccaggtaaaggcggtcaaatcgctcgttctgctggtgcttatgtacaaatcatcgcacgtgaaggcaactatgtaactttacgtttacgttctggcgaaatgcgtaaagtattagctgaatgtgttgctacaatcggtgaagttggtaactcagaacatatgcttcgcgtattgggtaaagctggtgctaaccgctggagaggcattcgccctacagttcgtggtactgcaatgaacccagtagatcacccacacggtggtggtgaaggtcgtaactttggtaaacacccagtaactccttggggcgttcaaactaaaggtaagaaaactcgtcacaacaaacgtactgataaatatatcgtacgtcgtcgtggcaaataa

SEQ ID NO: 1613 - DNA, 276 bp, H. influenzae strain 86-028NP
atgccacgttctctcaagaagggtcctttccttgacctacacttgttgaagaaggtagagaaggcggtggaaagcggggataaaaaaccaattaaaacttggtcccgtcgttcaatgatcattccatcaatgatcggattgaccatcgcagtccataatggtcgtcagcacgttcctgtttatgtatctgatgaaatgatcggtcataagcttggtgaatttgcaccgactcgtacataccgcggtcacgcggcagataagaaagctaagaaataa

SEQ ID NO: 1614 - DNA, 333 bp, H. influenzae strain 86-028NP
atggaaactatcgcaaaacatcgttacgctcgcacttctgcccaaaaagctcgcttagttgccgatttaattcgtggtaaaaaagttgcgcaagcattagaaattttaactttcactaacaaaaaagcagcagctttagtgaagaaagttttagaatcagctattgcaaatgcagagcacaatgacggtgcagatattgatgatcttaaagttgctaaaatcttcgttgatgaaggtcctagcatgaaacgtgttatgccacgtgctaaaggtcgtgcagatcgtattttaaaacgtactagccacattactgtggttgtgtcagatcgttaa

SEQ ID NO: 1615 - DNA, 708 bp, H. influenzae strain 86-028NP
atgggtcaaaaagtacatccacatggtattcgcctaggtattgttaaaccttggagctctacttggttcgcgaatacacaagacttcgctgacaatcttgaaggcgatttcaaagtacgcaaattcttaaataaagaattagcaaatgcttcagtttcacgtattactattgagcgtccagctaaaagtattcgtgtaactattcacacagctcgtcctggtatcgtaatcggtaaaaaaggcgaagatgttgaaaaattacgtaacgcagtgtctaaaatcgctggcgttcctgctcaaattaacattgctgaagtgaaaaaacctgaattagatgcgaaattagttgcagatagcatcgcttctcaattagaacgtcgtgtaatgttccgtcgtgcaatgaaacgtgcggtacaaagtgctatgcgtttaggtgctaaaggtatcaaagttgaggttagcggtcgtttaggtggtgcagaaatcgcacgttcagaatggtatcgtgaaggtcgcgtacctctacatactcttcgtgcggacatcgattataacactgcagaagctcatacaacttacggcgtaatcggcgttaaagtgtggatcttcaaaggtgaaattcttggtggaatggctgccgttgcgcaatcagaacaacaacctgccgacaagcctaaaaaggctcctcgcggtaaaggtcgtaagtaa

SEQ ID NO: 1616 - DNA, 411 bp, H. influenzae strain 86-028NP
atgttgcaaccaaaacgtacaaaattccgtaaagttcacaaaggccgcaaccgtggtatcgcgagcggtactgaagttagtttcggtacttacggtttaaaagcagttggtcgttgtcgtttaaccgctcgtcaaatcgaagcggcacgtcgtgcaatgtcacgtgcagtaaaacgtcaaggtaaaatctggattcgtgtattcccagataaaccaattactgaaaaaccattagaagtccgtatgggtaaaggtaaaggtaacgttgagtactgggtagccttaatccaaccgggtaaagtgctttatgaaatggatggtgtgtctgaagaagtagcaagaaacgcatttgcattagcagctgctaaattgccagttaagaccactttcgtaactaagacggtgatgtaa

SEQ ID NO: 1617 - DNA, 192 bp, H. influenzae strain 86-028NP
atgaaagctcaagatttacgtacaaaaagtgttgaagagctgaatgctgaattagtaaaccttttaggtgaacaattcaagttgcgtatgcagacagccaccggtcagcttcaacaaacccatcaggctaagcaagtgcgtcgtgatattgcacgtgtaaaaactgtattaaccgaaaaggcgggtgagtaa

SEQ ID NO: 1618 - DNA, 258 bp, H. influenzae strain 86-028NP
atgactgataaaattcgtagcgtacaaggtaaagttgttagcgacaaaatggaaaaatctttcgttgttgctattgaacgtaaggtaaaacaccctttatatggtaaatttatccgtcgtacaactaaattacacgtacacgatgagaacaatgaagccaaagttggtgataccgtagagattcgcgaatgtcgccctctatcaaaaaccaaatcttggactttagttcgtgttgttgagaaagcagttattgcttaa

SEQ ID NO: 1619 - DNA, 624 bp, H. influenzae strain 86-028NP
atgaagtatatattaatacatgatcttccttatcaagaagaggagattggcatcacagagttttatgatgaaaatgatttggatacagaagcagatatatatgatcgagagacttttagaatcttattaggagaatatgtaacaggattatatttgttagatgatacttttatagagccagtgcttgataatataaatattcctaacaatgtttatagtacaaatatatttgctattcatcatgttgcaaagcatattttgggtattaaagatctagataaacgtttaaaatctggtgatattgaattagttcgtgaattaggagaagtaacaattggtggtaaggagaagtatttttactcttttgcaactaaatattgtagtcatcataatccaattgctttcccaatttatgatagctatgtggagcaagatctcctctattttaataaagtagataaattttcagcctttaaaaggaaagatttaaaaaattacagaaaatttaaagagattttgatagattttcaaagattttataaattagaaagatttaacttaaaagagctcgatctgtatctttggcttttaggcaaggaaattttcccaaaatctgaaaactga

SEQ ID NO: 1620 - DNA, 372 bp, H. influenzae strain 86-028NP
atgatccaagaacagactatgctggatgttgctgataattcaggcgctcgcagcgtaatgtgtatcaaggttctaggtggatcgcaccgtcgttatgctgcgattggtgacatcatcaaaattactgtaaaagaagcaattccacgcggtaaagtaaaaaaaggtgatgtattaaaagcagttgttgtgcgcaccaagaagggtgttcgtcgcccagatggctcagttattcgtttcgatggtaacgcttgtgtaattttaaataataacactgagcaaccaatcggtactcgtatttttggaccagtgactcgtgaacttcgttctgagaaattcatgaagatcatttctttagctccagaagtactgtaa

SEQ ID NO: 1621 - DNA, 312 bp, H. influenzae strain 86-028NP
atggctgctaaaatccgtcaaaatgatgaagtaattgttcttactggtaaagataagggcaagcgtggcaaggtaactaaagtgttaccaaacggtaaagtgtttgttgaaggtatcaacatcattactaagcatgaaaaaccagttcctgcattaggaaaggctggtggtttggtgaaaaaagaagctgcaattgacgcttcaaatgttgcgattttcaatcctaaaacaaataaagctgaccgtgtaggttttagattcgaagacggcaaaaaagtacgtttcttcaaatctaacaatgaaattatctaa

SEQ ID NO: 1622 - DNA, 540 bp, H. influenzae strain 86-028NP
atggcgaaactgcatgattactacagagatcaagtagtaagcgaattaaaaaataaattcggctacaaatctgtcatgcaagtcccacgaatcgaaaagattaccctgaatatgggtgtgggtgaagcattgaccgacaaaaaattgctagacaacgcagtagcggacttagcagcaatcagcggtcaaaaacctttagtaactaaagctcgtaaatctgttgctggctttaaaatccgtcagggatatccaatcggttgtaaagtaacactacgcggtgagcgtatgtgggagttctttgaacgtttgattacaattgctgttccacgtattcgtgacttccgcggcttaagtgcgaaatcattcgatggtcgtggtaactatagcatgggtgtgcgtgaacaaatcatcttccctgaaatcgattacgataaagtagatcgtgtacgtggtttagatatcactatcacaactactgctaagaatgatgaagaaggtcaagcactacttgctgcctttaatttcccattccgtaaataa

SEQ ID NO: 1623 - DNA, 306 bp, H. influenzae strain 86-028NP
atggctaaacaatcaatgaaagcacgcgatgtaaaacgcgttaaattggctgaaaaattctacgcaaaacgtgttgaattaaagaaaatcatttctgatgtcaatgcctctgatgaagatcgttgggatgcagtgttaaagttacaaactttaccacgtgattctagcccatctcgtcaacgtaaccgttgccgccaaactggacgtcctcatggcgttttacgtaagtttggtttaagccgaattaaggttcgtgaagctgcaatgcgcggtgaaatcccaggccttaaaaaagcgagctggtaa

SEQ ID NO: 1624 - DNA, 393 bp, H. influenzae strain 86-028NP
atgagtatgcaagatccaatcgcagatatgctgacccgtattcgtaacggtcaagctgcgaacaaagttgcaatcaatatgccttcttccaagctaaaagtggcaattgccaacgtattagctgctgaaggttatatcgaaagcgtaaaagttttagaaggtgctaaacctgaattggaaattactttaaaatatttccaaggcaaaccagttgtagaaagcatccaacgtgtaagtcgtcctggtcttcgtatttacaaacgtaaagatgaattaccaaaagttatgggcggtttaggtgttgcagttatttctacatctaaaggtgttatgactgaccgtgctgctcgtcaagcaggtttaggcggtgagatcatctgttatgtagcttaa

SEQ ID NO: 1625 - DNA, 534 bp, H. influenzae strain 86-028NP
atgtctcgtgttgcaaaggcacctgttaatattcctgccggcgttgaagttaaactcgacggtcagctattaacagtaaaaggtaaaaatggcgagttatctcgcaaaattcatgaatcagttgaagtaaaacaagataacggacaatttacgttcactccacgtgaaggttttgttgaagcaaatgctcaatcgggtactgcacgtgcattagttaatgcaatggttatcggtgttactgaaggtttcactaaaaaattagtattggtgggtgtaggttacagagctcaacttaaaggtaacgcaattgcattaagtttaggctattctcacccagtagagcacactttgccggtaggtattactgcagaatgtccatctcaaaccgaaatcgtgttgaaaggtgcagacaaacagttgatcggtcaagttgcagcagatattcgtgcttatcgccgtcctgagccttataaaggtaaaggggtacgttacgctgatgaagtggtacgtatcaaagaggctaagaagaaataa

SEQ ID NO: 1626 - DNA, 354 bp, H. influenzae strain 86-028NP
atggataagaaatcagctcgtatccgtcgtgcagctcgtgcacgtcatatgatgagagagcaaggtgtaactcgtttagttattcaccgcactccacgtcatatttatgcacaagttattgcaccaaacggttcagaagtgcttgccgctgcttcaactgttgagaaagcaattcgtgagcaagtaaaatacaccggtaataaagatgctgctgcagcagtcggtaaagctgttgcagaacgcgcattagcaaaaggcgttcaagctgttgcttttgatcgttccggttttaaatatcatggtcgtgtccaaactttagcggacgctgcacgtgaagctggtctacagttctaa

SEQ ID NO: 1627 - DNA, 501 bp, H. influenzae strain 86-028NP
atgtcaaacatcgaaaaacaagttggtgaactgcaagagaagctaatcgcagtaaaccgtgtatcaaaaactgtaaaaggtggtcgtattatgagtttcactgcattaactgtggtgggcgatggtaatggccgagtaggttttggttatggtaaagctcgcgaagttccagcagcgatccaaaaagcgatggaaaaagcacgtcgcaatatgattaatgtcgctttaaatgaaggtacattacaacatccagttaaaggtgttcatactggttcacgtgtatttatgcagccagcaagtgaaggtacaggtatcatcgctggtggtgcaatgcgtgcggtattggaagttgcaggtgtacgtaacgttctttctaaagcgtatggttctaccaacccgattaacgttgttcgtgcaactattgatgcattagcaaatatgaaatcaccagaaatggttgctgcaaaacgcggtaaaactgttgatgaaatcttggggtaa

SEQ ID NO: 1628 - DNA, 180 bp, H. influenzae strain 86-028NP
atggctaaaactattaaagtaacacaagttcgtagctcaattgctcgtttaccgaagcataaagctaccttgcgtggtcttggtcttcgccatatgcaccacactgttgagttaattgatacgcctgcagtacgtggtatgattaaccaagtttcatacatggttaaagtggaggagtaa

SEQ ID NO: 1629 - DNA, 435 bp, H. influenzae strain 86-028NP
atgcgtttaaatactctatctccggctgaaggtgcaaagcatagtgctaaacgcctcggtcgtggtattggttcaggtttaggcaagactggtggccgcggtcataaaggtcaaaaatctcgtactggtagcggtgttcgtcgcggtttcgaaggtggtcaaatgccgttataccgtcgtttaccaaaatttggttttacttcaatgaaatctgcagtgactgcagaagttcgtttaaatgaattaaccaaagttgaaggtaatgtagtaactttagaaacattaaaagcagcaaatatcttaactaaagatatccaattcgctaaagtaattttagctggagaagtgaaatctgcagtaacggtacgcggtttacgtgtaactaaaggtgcaaaagcagcaattgaagctgctggcggttcaattgaggaataa

SEQ ID NO: 1630 - DNA, 1326 bp, H. influenzae strain 86-028NP
atggctaaacaaccaggttatcaagcaagaagtactaatagcggtaaaggtgaattaaaaagccgattacttttcgttttaggtgcacttatcgtttatcgaattggttcattcattccggttcctggtattgatgcgactgttctagctcaattagttgaacaacaaaaaggcactatcattgacatgtttaacatgttctctggtggtgctctaagccgtgcatccattttagcattaggaatcatgccatatatatcggcatctattgtaattcaattgcttgcaacggtttctcctgctttagcagaattaaagaaagaaggtgctgctggtcagcgtaaaatttctaaatatactcgttatgcgacagttgtttttgcaacgattcaggcagtagctatttcaacaggcttaccaaatatgttgtctggcttagtgccaaatgttggatttagtttttacttcacttcagttgttagtttagtcactgggacaatgttccttatgtggttgggtgagcaaataactgaaagaggtattggtaacggtatttcaattcttgtttttggcggtattgtagctggtttaccatcggccattcttcaaactattgagcaggctcgtcaaggacagatgcatccattagttcttcttctgatcgcagctattgtatttgcagtaacttattttgttgtttttgttgaaagaggacaacgtagaattcgcgttgaatatgcgaagcgtcagcaaggtcgtcaaattttaggtggtcattcaacacatttaccattgaaagtgaatatggcaaatgtaatgccagcaatttttgcttcaagtattattttattcccagctacattaacacaatggtttgggcaaaatgataaatttgaatggttaaataatttatcaatgttattgaatcctggtcaaccactttatttgcttgtttatgctgttgcaattattttcttcagttttttctatacagcaatgcaatataatcctcgtgatacagcagataatctaaaaaaatctggtgcatttattccaggaattagacccggtgaacaaacatcacgttatattgataaagtgatgactcgtcttacattaattggcggtctctatgtaacgtttgtatgtttagttccttatattatgacatcggcttgggatgttaaattttacttcggtggaacatctcttttaattgtagtcgttgtaattatggatttcatcgttcaggttcaaagtcatttaatgtcttctcaatatgaatctgcgttgaaaaaagcaaaccttaagggttttggacaataa

SEQ ID NO: 1631 - DNA, 357 bp, H. influenzae strain 86-028NP
gtggcccgtattgcaggcattaacattcctgatcataaacacgctgtaatcgctttaactgccatttacggtattggtaaaactcgttcacaagctatttgtgcagcagcgggtattgctgaagatgttaagatcagagaattgtctgaagagcagattgacaaactgcgtgacgaagttggtaaatttaccgttgaaggtgacttacgtcgtgaagtaacactaaacatcaaacgtcttttagacttaggatgctatcgtggtttacgtcatcgtcgtagtttaccagtacgtggtcaacgtactaaaactaatgcgcgtacccgtaagggtccacgtaagccgatcaaaaaatag

SEQ ID NO: 1632 - DNA, 390 bp, H. influenzae strain 86-028NP
atggctaaaacaccagttcgtgcacgtaaacgtgtaaaaaaacaagttgtagatggcgtagcacatattcacgcatctttcaataatacaatcgttactattactgaccgtcaaggtaatgctctagcttgggcaactgcaggtggttcaggtttccgtggttctcgtaaatcaactccgttcgcagcgcaagttgcggcagagcgttgtgctgaaatcgttaaagaatttggcttaaagaacttggaagttatggttaaaggtccgggtccaggtcgtgaatctacaattcgtgcgttaaacgcagcgggtttccgtatcacgaatattactgatgtgactccgattcctcataacggttgtcgtccaccgaaaaaacgtcgtgtttaa

SEQ ID NO: 1633 - DNA, 621 bp, H. influenzae strain 86-028NP
atggcaagatatttgggtcctaaactcaagctcagccgtcgtgaaggcactgatttattccttaaatcaggcgtgcgtgcgattgattcaaaatgtaaaattgatacagcaccaggtcagcacggtgctcgtaaaccgcgtttgtctgactatggtagtcagttacgtgaaaaacaaaaagttcgtcgtatctatggtattttagaacgtcaattccgtaactactataaagaagcaaaccgtttgaaaggtaacactggtgaaaatttattagtgttattagaaggtagattggataacgttgtttatcgcatgggatttgctgcaactcgtgcagaggctcgtcaattagtgagtcataaagcaattgttgtgaatggtcgtgttgttaatattccatctttccaagtttctgtaaatgatgtagttgctattcgtgaaaaatcgaaaaaacaagctcgtattaaagcatcattagaattagcagagcaaagagaaaaaccaacatggttagaagttgattctgcaaaaatggaaggtgtattcaaacgtgttcctgaacgttctgatttatcagcagatattaacgaacatctgatcgttgagctttactctaaataa

SEQ ID NO: 1634 - DNA, 987 bp, H. influenzae strain 86-028NP
atgcagggttctgttacagaatttttaaaaccacgtttagtagatattgaacaaattagttcaacacatgctaaagtgatcttagaaccgttagagcgtggttttggtcatactctaggtaatgcattgcgtcgtatccttctgtcttcaatgccaggttgtgctgtaactgaagtagaaattgatggcgtattgcatgaatatagtagtaaggaaggtgttcaagaagatattcttgaagtacttttgaaccttaaaggtctagcggttaaagtacagaataaagatgacgttattctgacattaaataaatctggaattggccctgttgttgcagcggacattacccatgatggtgatgttgaaattgtaaatccagatcatgtgatttgtcatttaactgatgaaaacgcttcaattagtatgcgtatacgtgttcagcgtggtagaggatatgttcctgcttcatctcgtacacatacgcaagaagaacgtccaattggtcgtttgcttgttgatgcttgttatagtccggttgaacgaattgcgtataatgtagaggcagctcgtgttgagcagcgtacagatttggataagctcgttattgagttagaaactaatggtgcacttgagccagaagaagcaattcgtcgtgcagcaacaatcttggcggagcaacttgatgcattcgttgatttacgtgatgttcgtcagcctgagattaaggaagaaaaaccggaatttgatccgattttattacgtcctgtagatgatttagagctgacagttcgttctgctaactgtttgaaagcagaaacaattcattatatcggtgatttagtgcaacgtactgaagtagaattattaaaaacccctaatcttggtaagaaatctcttactgaaattaaggatgttcttgcttctcgtggcttgtcacttggtatgcgccttgaaaattggccgccagcaagtattgctgaagactag

SEQ ID NO: 1635 - DNA, 387 bp, H. influenzae strain 86-028NP
atgcgccatcgtaagagtggtcgtcaactaaaccgtaatagtagtcatcgtcaagcgatgttccgtaacttagcaagtgctttagttagtcatgaaatcattaagactactttgcctaaagctaaagaattacgccgtgtagttgaaccgttaattacattagcaaaagtagatagcgttgctaaccgtcgtttagcattcgctcgtactcgcaacgttgaaactgttgcaaaattatttaatgaattaggtccacgttttgctcaacgtgcaggtggttacactcgcattttgaaatgtggtttccgtgcaggcgataatgcaccaatggcatacattgagttagttgatcgtccagaagttgctgaggcaacaactgaggaataa

SEQ ID NO: 1636 - DNA, 597 bp, H. influenzae strain 86-028NP
atgtttacattgtcctattatctaccacaaaacttaaataaatgtattatttctgagagtaaaactctagaaaaaaacagcttaatttatgcacaaggcgagaagcctaaagaattttattttttaaaacaagggctagttggtctgtatcatagtctggaaaatggcaaagaaacattgactcgactttatcacgctaatgaatattttggttttcgtactatttttagtgaaacatcttatcattgcagtgcaaaagtattaatggaagccgatatagttagaatatttcctggtaatcacgcaaattttattgcaaataaccctgatttttcttgttatcttatgaaacaactttctaatgaattatatgatgcagaacaccgaataagtaatacagcttataagcgtagttacgaacgtattattgatgccattgaaaatttaactgaaagttatcccgattatccttggacctaccgagaagtagcggaattttgtggatgtgaaactgaaaccgcaattcgtattagtagagagcttaaaaaacaaggaattttagataaaaatacacgacatctacgaatatgctcttaa

SEQ ID NO: 1637 - DNA, 701 bp, H. influenzae strain 86-028NP
atgaattcatttcaattaatggcaaaacctactggttcaatttgtaatttagattgtaaatattgcttttacttggaaaaacctcacttaaatcaacgggctatgactaatgaagtattagaagcctatatcaaatcctatattgaagcaacgcctcaacaacaagttactttcctatggcaaggcggcgagccaaccctagcaggtcttgatttctacaaaagagcggtcaatttttaattaatatttttgatgaatggtatgccaatgatgtcggcaaaattggtattcaatttattgaacaatggtttatggcttaccttggtttacaaccaagtttatgtatttttcgtgaaacctgcggcgatcaattggttattgaacaaaatggcgatatttatagttgcgatcattatgtttatcctgaatataaactcggaaatcttattgaaacccctctaatacagctccttgataataatactaaacaaaagaattttggtgcagcgaaatcttttctttccgaacagtgtaaaatctgtaagtttcgctttgcatgtcacggaggatgtccaaaacatcgtacaattcaaggatttggtaaaacacataatcaactttgtgaggcatattattcagcactttctcatatggatccatatttaaagtcatttgcaaaatcatttggcaaaataaaataa

SEQ ID NO: 1638 - DNA, 810 bp, H. influenzae strain 86-028NP
atggcgtttagtacaatttttatcttactgatttgcggtatttgtaccaatatggtttctgctatttttggtattggcggtggggtattgatggtgccaattttacgtacattgtttcctgcgttaccgattcaagttatttcagctacgtcactcaccattgtgatgtgtaccgcattgattaatttattatttttccataagcaaaaaattaaaattgattatatcaatatgattttatggtctattgctatggtgattggggtgcaaattggttttgaattaagtttttatttttctacagcgataattagtttaatttttacggttagtttaagtgcactagcgattaaaacatttttgaacagatcgagaatacaaatagaagtgtttaatatgtctcctatagaacgagctaaaggtagtattagtttttgtggaggaggcttaattgcgggtattacaggtattggaggcggttctattcttgcgccccttgtcgggcaattaaagggggtaaaaacgcaacaaattgccgtttatacgaactatatgatgattattggtggtattggtaatctatacggctatctcactagagcttttccctatgatatcagcctaagtggccaactaggatatgtaaactttcttgtagttggtgtcgttaccttgggttcatttggaatgagtttcttctcaatgaaattgcgtggattaatgaatccagttttaacaagaaaattattggcgattattttattttgtattgcagcctatatgtgcattttggaatttgtattccattaa

SEQ ID NO: 1639 - DNA, 1194 bp, H. influenzae strain 86-028NP
atgcaaaaacaaaacattgtcattcttggttcaacgggatcaatcggtaagagtaccctttctgttatcgaaaataaccctcagaaatatcatgcatttgcactcgtcggcggaaaaaatgtagaagcaatgtttgaacaatgtatcaaattccgaccgcactttgcggctcttgatgatgtaaatgcggctaaaattttacgtgaaaaattaattgcgcatcatattccaacgaaagtattagcaggacgacgagctatttgcgaactcgcagcacacccagatgccgatcagataatggcgtcgattgttggtgcagcaggattgttaccgactctttcagcggttaaagcaggtaaacgggtattactggcaaataaagaatcactggtaacctgcggacagctttttattgatgccgtaaaaaactatggctcgaagcttttaccagtagatagtgaacataatgctatctttcaatcattaccgccagaagcacaagaaaaaatcggtttttgcccactttctgaattaggtgtaagtaaaattatactcactggttctggcggaccattccgttacacgccacttgaacaattcaccaacataacaccagaacaagcagttgcgcaccctaattggtctatgggtaaaaaaatttctgtcgattcagctacaatgatgaataaaggcttagaatacattgaggctcgctggcttttcaatgcaagtgcggaagaaatggaagtcattattcatccacaatcaattattcattctatggtgcgttatgttgatggctcagtcatagctcaaatgggaaatccagatatgcgtacaccaattgcagaaactatggcatatcctcaccgcacttttgctggagtagaaccactcgatttctttaaaatcaaagaactgacttttattgaacctgattttaatcgctatccgaatttaaaactggctattgatgcctttgctgcgggtcaatatgcgacaacagcaatgaatgcagctaatgaaattgccgtacaagcatttttagatcgtcaaattagttttatggatattgcaaaaattaattcgaaaacaattgagagaatttcgccttataccattcaaaatattgatgatgtactcgaaattgatgcacaagcaagagagattgcgaaaacactaattagagaatag

SEQ ID NO: 1640 - DNA, 558 bp, H. influenzae strain 86-028NP
atgcttaaccaaattaaaaaagatgctcaagatcgtatggaaaaaagccttgaagcattaaaaggtcatatttcaaaaattcgtactggtcgtgctcaaccgagtttacttgatgcaattcaagttgaatattacggtgcggcgaccccacttcgccaattagcaaacgtagtggcagaagatgcgcgtactttagccgtaactgtttttgatcgttctttaatctctgcggtagaaaaagcaattttaacctcagatttaggtttaaacccatcttcagcgggtaccacaatccgtgttccgcttccgccattaacagaagaacgtcgtcgcgatttaatcaagatcgtaaaaggcgaaggtgaacaaggtaaagttgcgattcgtaatgtgcgtcgtgatgcgaatgataaaatcaaagcattattaaaagacaaagaaatcagcgaaaacgaacaacataaagcagaagaagaaatccaaaaaatcacagatatttacattaaaaaagtagatgaagtattagcggataaagaaaaagaattaatggatttctaa

SEQ ID NO: 1641 - DNA, 1617 bp, H. influenzae strain 86-028NP
atgacagacttaaataaagtggtaaaagaacttgaagctcttggcatttatgacgtaaaagaagttgtttacaatccaagctacgagcaattgttcgaagaagaaactaaaccaggcttagaaggctttgaaaaaggtactttaactacgactggtgcagtggcagtagatacaggtatcttcacaggtcgttctccaaaagataaatatatcgtgttagatgaaaaaaccaaagatactgtttggtggacatctgaaacagcaaaaaacgacaacaagccaatgaaccaagctacatggcaaagcttaaaagacttggtaaccaaccaactttctcgtaaacgcttatttgtagttgatggtttctgtggtgcgagcgaacacgaccgtattgcagtacgtattgtcactgaagtagcgtggcaagcacattttgtaaaaaatatgtttattcgcccaactgaagaacaactcaaaaattttgaaccagatttcgttgtaatgaacggttctaaagtaaccaatccaaactggaaagaacaaggtttaaattcagaaaactttgttgctttcaacttgactgaacgcattcaattaatcggcggtacttggtacggcggcgaaatgaaaaaaggtatgttctcaatgatgaactacttcctacctctcaaaggtgttggtgcaatgcactgctcagctaacgttggtaaagatggtgatgtagcaatcttcttcggcttatctggcacaggtaaaacaaccctttcaacggatccaaaacgtgaattaatcggtgacgatgaacacggttgggatgatgttggtatctttaactttgaaggtggttgttatgcgaaaaccattcatctttcagaagaaaatgaaccagatatttaccacgctatccgtcgcgacgcattattagaaaacgtggttgttcgttcagatggttctgttgatttcgatgatggttcaaaaacagaaaatactcgcgtgtcttacccaatttatcacatcgataacattgtaaaaccagtttctcgtgcaggtcacgcaactaaagtgattttcttaactgcagatgcgtttggtgtattacctccagtatctaaattgacaccagaacaaactaaatactacttcttatctggtttcacagcgaaattagcagggactgaacgtggtattactgaaccaacgccaactttctcagcatgtttcggtgcagcatttttaacgcttcatccaactcaatatgcagaagtgttagtaaaacgtatgcaagcagcaggtgctgaagcttacttagtgaatactggttggaatggcacaggcaaacgtatctcaatcaaagatactcgcggaatcattgatgcaatcttagatggctcaattgaaaaagctgaaatgggcgaattgccaatcttcaacttagcaattcctaaagcattaccaggtgtagattctgcaatcttagatcctcgcgatacttacgcagataaagcacaatggcaatcaaaagctgaagacttagcaggtcgttttgtgaaaaactttgttaaatatgcaactaacgaagaaggcaaagctttaattgcagctggtcctaaagcttaa

SEQ ID NO: 1642 - DNA, 882 bp, H. influenzae strain 86-028NP
atgaccaatcaacaagactatactcaagacaatgacaaactttaccgttatcttttccaacatcgtgcagttcgtggagaatgggttcgcttaaataaaacatttactgatacattaaatacccatcagtatcctaaagcagtacaggatttattgggagaaatgatggtagcgactaatttactcactgccacactaaaatttgccggcaatattaccgtacaaattcaaggcgatggcccattacgcttagcattagtaaatggtaatgatcaacaacaaatccgcgcccttgctcgagtggatggcaacatcactgaaaatatgagtctgcataatatgattggtaaaggcgtattggtcattactattgcaccaaaagaaggcgaacgctatcaaggtgtaattagcttggataaacccacgatcacggaatgcttagaagattattttgtacgctcagaacagcttcaaactcaattaattattcgtactggagaatatgaaggcaagccagtggcagcaggtatgttattacaaattatgcctgatggttctggtacaccagaagattttgagcatttaactacgctcgcagcaacagtaaaagatgaagaattatttggtctccctgcagaagagttactctatcgtttatatcacgaagaaaccgtcaatctttatccagcacaagatgtacaatttttctgtggctgctctgctgagcgttctagttctgcattactgctcatctctgatgaagaaattgacgaaatattagccgaacataaaggcagtattgatatgcaatgtgagtgttgtggtacacactacttctttaataaagaagcgattgaaaaattaaaatcaacaagagtttaa

SEQ ID NO: 1643 - DNA, 1374 bp, H. influenzae strain 86-028NP
atggcactttggggtgggcgttttacacaagccgcagataagcgttttaaagattttaatgactcattacgttttgactatcgtttggcagaacaggatattcaaggctcaattggctggtccaaggccttagtaaaagtgaatgtattaactgttgaagaacagcatcaacttgagcaagcactaaatgaattacttgttgaagtgcggtcaaatccgcaagcaattttacaagatgatgctgaagatattcatagttgggttgagagtaagctaattgataaagtaggcaaccttggtaaaaaattacatactggtcgtagccgcaacgatcaagtggcagtagatataaaactgtggtgcaaacagcgtgtggttgaattacaagaatccgtgcgtaatttgcaacgccacttagttcaaaccgcagaaaacacacaacaagcagtaatgcctggctacacccatttacaacgagctcaaccaatcacttttgcccattggtgtatggcatatgtggaaatgttcgaccgcgactattcacgtttaacagatgcgtataatcgtatgaatacttgtccacttggtagtggtgcgctggctggtacggcttatgctgtagatcgtgattcacttgcgcacgatcttagttttgctttcgcaactagaaatagcttagatagcgtctctgatcgcgatcatatcgtagaattactttctatcgcctctcttagtatggcacatctttcccgctttgctgaagatatgattatctttaacagcggagaagcaaatttcgtggaactatccgatcgtgtgacttctggttcatcattaatgccacaaaagaaaaatcctgatgcttgtgagttaattcggggcaaaacggggagagtaattggttcattaacatctatgttaatcaccttaaaaggcttgccacttgcgtataataaagatatgcaagaagacaaagagggcatttttgatgccttagatacttggcaaaactgtgtagatatggcaacgttcgtcttagatgaattgaaagtaaatgttgaacgtactcgtgaagctgcgttaaaaggatattcaaacgcaactgaattagcggattatttagtctctaaaggcgtacctttccgagattcccatcatatcgtgggcgaaacagtggtttatgcaatcgagaaaggcaaaggattagaagatctgactatccctgaattccgccaatttagtgaagtagtgggagatgacgtttacgagattctttctctccaatcttgcttagacaaacgttgtgcaaaaggtggcgtatcgccattgcgtgttgccgaagctattgcagaagccaaaacaagatttgcttaa

SEQ ID NO: 1644 - DNA, 888 bp, H. influenzae strain 86-028NP
atgaaagcaattattcctgtcgccggtcttggcacacgtatgttgcccgccacgaaggcgattccgaaggaaatgctcactttggtggataaaccgttaattcaatacgtggtaaatgaatgtgtagctgctggcataaaagaaattgtgctggtaacacattcatcaaaaaatgctatcgaaaaccattttgatacatcttttgaattagaaacaatgctggaaaaacgtgtgaagcgtcagcttctagaagaagttcgttctatctgtccaaaaaatgtaaccattatgcacgttcgtcaaggtaatgcgaaaggtttaggtcacgccgtgttatgcggtcgtcctttagtaggaaatgaatcttttgccgttatgttaccagatgtattattagctgaatttagtgcagatcagaaaaaagaaaatcttgctgcaatgattcaacgctttaatgaaactggcgcaagccaaattatggtaaccccagttccgcaagaaaatgtgagtagctatggtgttgcagattgtggtggcattgagcttaatggcggcgaaagtgcaaaaattaatagtattgttgaaaaaccttctattgaagacgcaccatcaaatcttgctgtggttgggcgttatgttttttcagcagcaatttgggatttgttagaaaaaacaccaattggtgttggcgatgaaatccaattaaccgatgctattgatatgctcattgaaaaagaaaccgttgaagcatttcatatgacaggggaaacttttgattgtggcgataaaattggttatatggaagctttcgtagaatatggtattcgtcacgaaaaattaggtaaagaatttaaatcctttatcaaaaatttggcaaaaacgctataa

SEQ ID NO: 1645 - DNA, 192 bp, H. influenzae strain 86-028NP
atgttaatcttaactcgtaaagttggcgaaagtgtacttattggagatgatatttctatcacggttttgagtgtacgtggaaaccaagttaaactcggtgttgaagcacctaaagaagtatccgttcaccgagaagaaatttaccaacgaattaaacaaacgaaagatgaaccctatttaggttcctcttag

SEQ ID NO: 1646 - DNA, 2625 bp, H. influenzae strain 86-028NP
atgaaaacaacagcagaaataagacaatcattccttgattttttccatagcaaaggtcaccaagtagttgagagtagctcacttgtgccggaaaatgatccgactttgcttttcacgaacgctgggatgaaccaatttaaggatgtattccttggaatggataaacgcccttattctcgagccaccaccgcacaacgttgcgtgcgtgctggtggtaagcataacgacttagaaaatgttggttataccgcgcgtcaccatactttctttgaaatgctcggtaacttcagttttggtgattactttaaacaggatgcgattaattttgcttgggaatatttaacttctccacaatggcttggtttacctaaagaaaaactctgggtaaccgtgtatgaaactgacgacgaagcctataatatttggaataaagatgttggtgttcctgctgaacgcattattcgcattggtgacaataaaggctcaccttacgcatcagacaacttctgggcaatgggcgacacaggtccttgcggtccttgtactgaaattttctacgatcacggcgatcatatttggggcggacctccaggctcaccagaagaagatggcgaccgttatattgaaatctggaacgttgtgtttatgcagttcaaccgtttagcagatggcacaatggaaaaattacctcgtccgtctgttgatacaggtatgggtttagagcgtatttctgctgtgttgcaacatgtgaactcaaactacgagattgatattttcaaaacattaatcgcaaaaacggcggaaattgtaggcgcaacagatttaactaacaaatcactacgtgttattgctgaccatattcgttcttgtgcatatttaatcgccgatggcgttatcccatcaaatgaagggcgtggttatgtcttacgtcgtattattcgccgcgcagttcgtcacggtcatctattaggtgccaaagaatcctttttctataaactcgtgccaactctaattgaagtaatggctgaagctggaaaagatgtaaaagcaaaacaaacaaatgttgaaaaactattacgtctagaagaagaacaatttgctcgtactctagagcgtggcttgagcttattagatgaagcactttctcaagtgaaagatggcattctttcaggtgaagttgcattcaaactttatgatacttatggtttcccattggatttaacggctgatgtatgccgtgagcgtaacattactattgatgaacaagcgtttgaccgtgaaatggaagcacaacgtactcgtgctcaagcagcgagccagtttggtgtggactacaacagcgttattcgtgtagatggcgaaactaagtttgaaggctatactgaagtagaatctcaggcaaaaattaccgcacttttctatgatggtaaatcagtggaaagtatcgaagtaggtcaaagtgcggtcgttattttagaaaatacgccattttatgcagaatcaggtggtcagattggcgatagcggatatttaagcacacaaggtgtaacctttaatgtgaaagatacccaaaaatatgggcaagtatttggacacattggggaattaacgcaaggaagtttaaaagttggacaatcagtgaatgcgattgtggacgctaaacgtcgccacaacacatcactcaatcactcagcgacacacttattgcacgctgccttacgtcaaattctaggtttacacgttgtgcaaaaaggttcgcttgtttcagataaagccttacgttttgactttgcgcaaccagaagccattaccaaagagcaattgagtgaaattgaaacattagtaaaccaaaaaatccgcgctaactttccagttcaaacggatattatggatattgattccgcaaaagcgaaaggagcaatggctctctttggcgaaaaatatggcgataaggttcgtgtattaacgatgggcgatttctcaattgagctgtgtggcggtattcacgcaaaacgcacaggcgatattggtttatttaaaattattactgaaaacgcagtggctgcaggcattcgtcgtattgaagctgtaacaggtcaaaatgccattgactggttacataatcaacaacgcattctgacccaaagcgcagacttattaaaatcagacgtaaataccttagtggaaaaaatccaacaacttcaagacaaaacgaagaaagtggaaaaagaattacaaggtctaaaagaaaaagccgcaatgcaggctggttctgattttgtaaaaagtgcggtcaaaatcaacggtgtttctgttattgcacaacaattagatggtatagaaacaaaatcattacgcgtaatggtcgatgatttaaaaaatcaactcggatcaggcgtaattgcatttgcatcaatattagatgaaaaagttaatctcgtcgttggagtgacaaatgatttaaccgccaaaataaaagctggagaacttgttaatttaatggctcaacaagttggaggaaaaggcggtggccgtccagatatggcaatggcaggaggttcccaaccagaaaatgtggcacaagcaattaaagtggcacaagactggttaaacaaaaatctgtag

SEQ ID NO: 1647 - DNA, 426 bp, H. influenzae strain 86-028NP
atgtacaaacacgttttagtagcagtagatctttctgaagaaagtccaattttacttaaaaaagcagttgggattgctaaacgccacgacgcaaaactttctatcatccacgttgatgtgaacttctcggatctttatactggattgattgatgtgaatatgtcttcaatgcaagacaggatttccacggaaacacaaaaagccttattagatttagctgaaagtgtggattatccaatttcagaaaaattgagtggcagcggcgatttaggacaagttttaagtgatgccatcgaacaatatgatgtggatttattagtgacgggacatcatcaggatttttggagtaagttaatgtcttcaacacgtcaagtgatgaatacgattaaaattgatatgttggttgttccgcttagagatgaataa

SEQ ID NO: 1648 - DNA, 1293 bp, H. influenzae strain 86-028NP
atggaattgacttatatggctaaattgcctaaagaagaatttgaggaacgtcgcacacgagtattcgctcaaatgcaacctaattcagcattattgcttttttctgaaatcgaaaaacgccgtaataatgattgtacctatcctttccgtcaagatagctatttttggtatttaacaggctttaatgaaccgaatgcagcactgttattactgaaaacagaacaagtagaaaaagccattatttttcttcgtccatgcgatccgttacttgaaacgtggaatggtcgccgattaggtgttgagcgtgcaccacagcaacttaatgtaaatgaagcctattctattgaagaattcgctaccgtactgccaaaaatactgaaaaatttgaccgcactttaccatgtgccagaaattcatacttggggtgatacattggtgtcagaaagtgcggtgaattttagcgagattttagattggcgaccaatgctcagcgaaatgcgccttataaaatcgccgaatgaaatccgcttaatacaacaagcgggacaaattacggcacttgggcatattaaagcgatgcaaacaacacgcccaaatcgctttgaatatgaaattgaaagcgatattttgcatgaatttaatcgccattgcgcaagatttccttcttacaattccattgttgcaggaggaagtaacgcctgtattttgcactacacagaaaatgatcgcccattaaatgatggggatttagtactgattgacgctggctgtgaatttgccatgtatgcaggcgatatcacccgcacttttcctgtaaatggaaaatttagcccgcctcaacgtgaaatttatgagttagttttaaaagcccaaaaacgtgcgattgaattacttgtaccgggcaattccattaagcaagccaatgatgaagttattcgtattaaaacccaaggattagtggatttaggcatcttaaaaggagatgtggatacacttattgaacaacaagcttatcgccaattttatatgcatggattagggcactggctagggttagatgtgcatgatgtgggtagttatggccaagataaacaacggatactcgaaatcggtatggtaattaccgttgagcctggtatttatatttcagaagatgcagatgtgccagagcaatacaaaggcattggcgtgcgcattgaggataatttactcatgactgaatatggtaataaaatcctaaccgctgctgtccctaaagaaattgcagacattgaaaatttaatgaatttttaa

SEQ ID NO: 1649 - DNA, 549 bp, H. influenzae strain 86-028NP
atgctcatttctcattctgaccttaaccaacaacttaaatctgctggaatcggctttaatgcaacagaactacacggctttttaagcggtttactttgtggtggattaaaagatcaaagttggctaccgctcttatatcaattcagcaatgataatcacgcttacccaacagcattagttcaacccgttacagaactttatgaaaaaattagtcaaaccttatcagatgttgaaggatttacctttggacttggtttaaccgaagatgaaaatgtctttgcacaagcggatagcctatctgactgggcaaaccaattcttacttggtcttggcttagcacaacctgaattagcaaaagaaaaaggtgaaattggcgaagcggtagatgatttacaagatatttgccaacttggttataatgaagatgataatgaagaagagcttgcggaagcactagaagaaatcattgaatatgttcgcaccattgcaatgttattctattctcatttcaacgaaggagaaattgagagcaaacctgtattacattaa

SEQ ID NO: 1650 - DNA, 1026 bp, H. influenzae strain 86-028NP
atgatgttagaacaaaccacttttaatgcgcctgatggtgcaccttatcagcttataaccctacaaaatgaaaatgggatgcgtgttcaatttctggattggggcgcaacttggctttcttgtaaagtgccagtaaatgacacattacgcgaggttttattgggttgtaaggtagagaattatcccactcatcaaagctatttaggcgcaagcgtagggcgttatgcaaatcgtattgcaaatgcacaatttgaattgaatggcgaacttattaaattaagtagtaatcaaggaaagcaccagcttcatggtggagagggttttgataaacgtcgttggaaaattcaagagtgcggtgagaattttgtgtgtttttcattacagtcagagcatggtgatcaaggttttcctggtaatgtggatgtgtctgtaacctatacgctaacagatgataatagcgtaaaaattgaatatgcagggatttgtgataaggatactgcattgaacctaacgaatcatgcttatttcaatttagaaaatgcagcgcaaggcagtgacgtgcgtgaacatacattacgtttaaatgctgatttttatctgcctgtagataatgaggggattcctaattctccattaaagcacgtggtgaatacaagttttgacttccgtattgctaaacccatcaagcaagattttttacaaggggatcagcaagcaacaaaaggttacgatcattcctttattgtcaataaagcttggcaaaagccttgtgtgttactaacctctccaactggcgatttaagtttggaagtaagaacctcgcaagctgcattgcaggtttatacgggtaattatcttgcaggtacaccaacgagaaatggcgaattatatgccgatttttctggcatagcactagaaacccaatgtttaccagatacgcctaatcatcctgaatggcaaaattacggcggaattcaaaaagcaagcgagcaatattatcaatggacagagtttaaatttaaataa

SEQ ID NO: 1651 - DNA, 1197 bp, H. influenzae strain 86-028NP
gtggtgcagatcgagtatagatttaatataaaggatagaaatatgaccccaatccaaaatgctcaacaaattttcaatagacagcataaaaatttgccagaaattaccgtctatgcccctggtcgagtaaatattatcggcgaacatactgactacaacgacggctttgttatgccttgcgcaattaattttggtacggccgtttctggtacaaaacgagatgatcatatttggaatgtttatgctgcagatcttgatgaaactgatgaattttctctcaatgttgaaattcctaagagtgaacacaaatgggctaattatgtgcgtggggtggtaaaatttatccaagaacgttacccgcactttcaacaaggtgcaaatttagtgatttctggtaatgtgccgctttcttctggattaagttcttctgcagcgttagaagttgcggtgggtaaattctgccaacaacttggcgatttaccgctttctcacacggatattgcattgaatgggcaaaaggctgaaaaccaatttgtcggtgctaattgtggcaatatggatcagttaatttctgcgcttgggcaggaaaatcacttactgatgatcgattgtcgtagtcttgaaactattccaacaccagtgccacaagatgtcgccgtgattattgtgaattcaaacgtaccgcacgatttagtaacaggcgaatacaatactcgccgtcagcaatgtgaagaggcagtaaaattttttggcgcgaaagcattacgagatgtttcagttgagcaattccaaaaaagagaagcagaattgaccgcactttctccgttagcagcaaaacgtgctcgtcatgtcgtaacagaaaatcaacgagtacttgatgcggtagaagcattgaagaacaatgatttgacttgtttaggtaaactaatggaagcatctcacgattcaatgcgtgatgattttgaaatcaccgtgccacaaattgattatttagttgaattggctcaacttgttattggcaaaagtggcggtgcacgtatgacgggcggcggttttggtggctgtattgtcgcacttacgccgcatgataaagtcgatgcagttcgtaaaattattgcggataattacgagaaaacgactggtttaaaagaaactttttatgtgtgtaccgcatcacaaggtgtgcgagtgatttaa

SEQ ID NO: 1652 - DNA, 1050 bp, H. influenzae strain 86-028NP
atgaccgcactttttgaacctacagaacatccacatcgtcgctacaatccgttaatcgatcaatgggttttagtttcgccacatcgtgccaaacgcccgtggcaagggcaacaggaaaaagtcaatgaagaacaaaaaccaagttatgatccaacttgttatctttgtccgagtaataagcgtattacaggggaattaaatccagattatcgtaaaccttatgtatttaaaaatgatttttccgcgcttttagaagatacgccagcccctgaaaaatcctccgatcctcttttccaaagttctcaagctcgtggggaaagtcgagtcatttgtttctctcccgatcatagtaaaacattgccattattgaccgcacttgagattgaagaagtgattaaagtatggcaggaacaacttcgtgaacttggtgcgaaataccaatgggtgcaaatttttgaaaacaaaggggctgcaatggggtgttctaaccctcatccgcatggtcaaatttgggcaaatagtttcttgccaaatgaagttgctcgtgaagatcgtacacaacgtgattatttgctaaaacatggctcagtaatgttggttgattatgtaaaacgagaattggcgttgaaagaacgtattgtcgttgaaactgaacattgggtcgctttagtaccttattgggctatttggccatttgaaacattgcttctaccaaaaactcatgtaaaacgtttaactgaattaagtgacgaacaatcaaaagatcttgcggttattttgaaaaaattgacgaccaaatacgacaatctctttgaaacctctttcccatattcaatgggatttcatgcggcaccgtttaatggcgaagataacgaacattggcagctacatgctcatttttaccctcctcttttgcgttcagcaactgtgcgtaaatttatggtggggtatgaaatgttaggcgaaaaccaacgcgatttaacggcagaacaggcagcggagcgattacgtgctttgagtgaagttcattataaagaaagaactaaataa

SEQ ID NO: 1653 - DNA, 999 bp, H. influenzae strain 86-028NP
atgagtactattcgagatgtcgctaaattagccaatgtatctgtcgctaccgtatcccgagtattaaatcactctctttctgttagtgaaaatacacgccttgcggtggaacaagctattgcacagttagcttatcaacctaatgcaaatgctcaagcccttgccgtgcagaacaccgatacaattggcgtggtggtaaccgatgtgacggatgctttttttgcgattttagtgaaagcggtggataaagtagcagaagcgcatcaaaaaacgattcttatcggtattggttatcatcatgcggaaaaagagcgggaagcaattaataccttattacgtaagcgttgtagttctcttgttgtacattctaaagccttatctgatgatgaattaagccattatttaaatactgtgcaaggaatggtaatcattaaccgtgttattaaaggttatgaacatcgttgtgtcagtttagataaccaaaaaggcacttatttagccacggaaatgcttattcgttatgggcatcaacatattgcatatatcggttcaaatcacgccatttttgatgaagttgaaagaagaaatggttatcttgccgcattaaaagatcacaattatcccatcattgaacaggcgataacactcaatagtccagactttgaaggcggcgaaaaagcaatgattgatttacttagttataacaaaaatcttacggctgtcgttgcttataacgattcaatggcggcgggagccatttcagttctcaatgaaaacaatatcagcgtaccaagccaattttcaattattggttttgatgatatgccgattgcccgttatttgatcccaaaactaaccacaattcgctatcctattgatttaatggcaacttatgcggctaaattagcattaagtctaactgacgagaaaataattacacctccagtagttcaatttaaccctactttggtacgccgtttttcggtggaatcgcgctaa

SEQ ID NO: 1654 - DNA, 1050 bp, H. influenzae strain 86-028NP
atgatgtacacaaccttatctatccacatcaaccttccaaataggagtgttattatgaaaaaaacagccgtgttaagtaccgtcgctttcgctattgcattaggttcagcatctgcaagttttgctgcagataatcgtattggggtaacgatttataaatatgatgataactttatgtctttaatgcgcaaagaaattgataaagaagctaaagtagtcggtggcattaaactcttaatgaatgactctcaaaatgcacaatctattcaaaatgaccaagttgatatcttactctctaaaggcgtgaaagcacttgcgattaacttggtggacccagcggcagctccaactattattggcaaggcaaaatcagataatattcctgtcgtattctttaacaaagaccctggtgcaaaagctatcggttcttatgaacaggcttactatgtaggtactgatccaaaagaatcaggcttaattcaaggggatttaattgcaaaacaatggaaagcgaatccagctcttgacttaaataaagatggcaaaatccaatttgtattattaaaaggcgaacctggtcatccagatgcggaagtgcgtacaaaatatgttgtagaagaacttaatgcgaaaggtatccaaactgaacaattatttattgatactggtatgtgggatgctgcaatggcgaaagataaagtagatgcttggttatctagctctaaagcgaacgacattgaagtcattatttctaacaacgatggtatggcattaggtgcgttagaagcaacaaaagcgcacggtaaaaaattacctatctttggtgtggatgcgttaccagaagcattacaattgattagtaaaggcgaacttgcgggtacagtattaaacgatagtgtaaaccaaggtaaagcagttgttcaattatctaacaatttagcacaaggtaaatctgcaactgaaggcacaaaatgggaattaaaagaccgtgttgtacgcattccttatgttggtgtggataaagacaacttaggtgactttttaaaataa

SEQ ID NO: 1655 - DNA, 1521 bp, H. influenzae strain 86-028NP
atgacagctcaaactcaatgtcaagacagccaagtgctgctcacaatgaccaatgtctgcaagtcctttccgggcgtaaaagccttagataacgcaaacttaacggttcgatcacattctgttcatgccttaatgggtgagaatggcgcgggcaaatctacattactaaaatgtttattcggtatttatgccaaagatgaaggcgaaattcttttcttaggcgaacccgtcaatttcaaaacatctaaagaagcccttgaaaatggtatttcaatggtgcaccaagaactcaatctcgtgcgccaaactagcgtaatggataatttatggcttggacgctatccacttaaaggtccttttgttgatcacgccaaaatgtaccgtgatactaaagcgatttttgatgaattggatattgatgtagatccgaaagaaaaagtcgccaaactttcagtttctcaaatgcagatgatcgaaattgcgaaggcgttctcgtataacgctaaaatcgtaatcatggatgaaccaacatcctcgctttctgaaaaagaagttgagcatctgtttaaaattatcgacaaattaaaacaacgcggttgcggcattatttatatttctcacaaaatggatgaaatcttcaagatctgtgatgaaattactattttacgcgacggtaaatggatcaacacggtaaacgtgaaagaatccacaatggaacaaattgttggaatgatggtagggcgtgaattaacacagcgtttccctgaaaaaaccaacgtgccaaaagaagttattttgcaggtggaaaatcttaccgctaaaaatcaaccatccattcaagacgtatcttttgaattacgcaaaggtgaaattctcggtattgcaggacttgtgggggctaaacgtaccgatatcgttgaagctatttttggcgtacgtgaattaatcgaaggaacgattaagttacacggaaaaactgtgaaaaatcataccgcacttgaagcgattaataatggctttgcattggttactgaagagcgtcgttcaacggggatttattctaatttaagtattgagtttaattcattgatttcaaatatgaaatcttatctcactccgtggaaattacttagcacgaagaagatgaaaagtgatacccagtgggtaattgattcaatgaatgttaaaacaccatcacacagaactacaattggttctctttctggtggtaaccaacaaaaagtcattattggtcgttggcttttaactcaacctgaaattttgatgctagatgagccgactcgtggtatcgatattggggcaaaatttgaaatttaccaacttattcaagaactcgctaaaaaagataaaggcattattatgatttcatcagaaatgccagaattactgggtgtgactgatcgcattttagtaatgagtaacggtaaattagcaggtatcgttgaaagcgcaaaaacatcgcaagaagaaattttgcaactcgcggcaaaatatttataa

SEQ ID NO: 1656 - DNA, 1011 bp, H. influenzae strain 86-028NP
atgagtgccttagaaaaaaacaaatcctttgatctcttaaaacaaaatgcgatttattttgtgttattgattttgctcggcatcatcattgcacaagatccgacattcttaaatttagtcaatttcagtaacatcttaacccaatcttctgtacgtttaattattgctttaggggttgcgggtttattgattacacaagggactgacttatctgcaggtcgtcaagttggtttgtctgcagttatctctgcaacaatgttgcaatcaatggaaaatattaaccgcgtgttccctgaaatgggacaaataccaattccagtggttattctcgcagtttgtgctatcggtgcagtaattggtttagtgaatggtttagttatcgcttacttaaatgtaactccattcatcgcaaccatgggtacaatgatcatcatatatggtttcaactcactatactatgatgctgtaggtggttctccaatcgcaggttttagtgaaaatttctcaacatttgctcaaggattcttccgagtcggcagctttaaactctcttacatcacgatttatgcagctattgcagcattattagtatggattatgtggaacaaaactcgtttcggtaaaaacgtatttgctattgggggtaacccagaagcagctaaagtttcaggcgtgaatgttgctcgtaacttagttgcaatctatatgattgcaggtatgttctatgcctttggtggtatgcttgaagcgggtcgtatcggttctgcaactaacaacttaggttttatgtatgaattagatgctatcgccgcttgcgtagtgggtggcgtatcttttgctggtggggtaggtacagtaattggtgttatcactggggttattatctttactgttatcaactacggtttaacttacatcggtgtaaacccttactggcaatacatcattaaaggtagcattatcattctagcggtagccattgactcgttaaaatatgcgaagaaaaaataa

SEQ ID NO: 1657 - DNA, 735 bp, H. influenzae strain 86-028NP
atgctaattaactttacacaagtattgcaagacagttggaatttcttccgtaatcagaaaaaaattatgctgcaatttgtcgcaattttatttattgtgcaaagcgcgagtgcacttttaagtttttcagttaatgatgaaaataaaaatgatgtattaaatctcgccaatacagatatcacaagttttatattttcagttgcaatcactcaaattttaacgagctttattgcagcttggggattaacctcaatccataaaattagcctacaaaattatcgcactttaggtgaaaccttctcacttaccttgcgccgttttgcaggcgtaattgtgttagatctattaatggttgcaccaatgttacttggtcttggtgaagcctttgctgcattactcacaaaaaaatcgccctctattatgtcacttatcgcgatgcttgttggcgtttggttctttgtccgtttaaatttaacggtagtacattatctttctactcaagaggcactttcgcaaactatccgaaaaatttggatgcgaggaaatactcgaaaaggcgtattgtttatttacaccctactggtttattttctcgtgccaattcttattttccaattaagcgcattttccaataatgctatatttgatatggtaataggcattttcaccgcattacttaatattttcatgctagtagtgacttatcgtttctacagcttatttatgaaggattaa

SEQ ID NO: 1658 - DNA, 558 bp, H. influenzae strain 86-028NP; identical to SEQ ID NO: 637

SEQ ID NO: 1659 - DNA, 465 bp, H. influenzae strain 86-028NP
atgtctgccaattttactgataaaaatggtcgccaatcaaaaggagttcttttactacgaactttggcgatgccttctgacaccaatgctaacggagatatttttggtggctggattatgtctcaaatggatatgggcggcgcgattttagcgaaagaaatcgcacacggacgcgtggttactgttgccgttgaaagtatgaattttatcaaaccaatctctgtgggcgatgttgtttgttgctacggtgaatgtctcaaagttgggcgttcttccattaaaattaaagtagaagtatgggtaaaaaaagtggcgagtgagccaattggcgaacgttattgtgtcaccgatgcggtatttacttttgttgcagttgataataatggtcgctctcgcacgattccccgtgaaaataaccaagagttagaaaaagcattagccttaatttcagaacaacccttgtaa

SEQ ID NO: 1660 - DNA, 297 bp, H. influenzae strain 86-028NP
atgtactatgttatttttgcccaagatattcccaatacgttagaaaagcgtcttgccgtacgcgagcaacacttggctcgtttaaaacaacttcaagcggaaaatcgcttactgacagcaggcccaaatcctgcaattgatgatgaaaatccgagtgaagctggttttacaggttcaaccgttattgctcaatttgaaaatctacaagcggcaaaagactgggctgcacaagatccttatgtagaagctggcgtatatgcggatgttattgtaaagccgtttaaaaaagtcttttaa

SEQ ID NO: 1661 - DNA, 1782 bp, H. influenzae strain 86-028NP
atgaaaaaagtcgccttaatttctctttgtatttttaccgcactttctgcttttgccgattcgcctaatacggcaacagcatcaatcaatcttgagcaagagaaacaaaactgggcgtcaatacagcatcaagactacttaaaacgtctaaaacaacgtgaagtctttttgcaagttgaaggtttgctaaaaagtgcggtaaaaaaacagcaattttctgaagcgattcaaaatatcacaaaaaccttaatagactcattgcaaggctaccctttgcaatatgatctgcttgctcgattttgggagacaaaaatcgcctttttgcagaatgatgatattcaaggaaaacaacaagcaataaatgaagtcaatgcgttagtgcaacaaaattacccttttgtgacaccagcatttcaagccttattacaaaaactatccacgttaaacgaacaacaaacatcagcaacttcagataatgctaaagaaaataacagggttcaaaaagaacaaaatcaagtagaaaatcctaaacaacttgctgaaattgtaagaaaaagtgatcctaacactttagataaaaccgtattaattgatgctttcccacgttatcttaaaacgctacctgaacaaatgaataacctaagttttgaatcctatcaaaaatgggcaaatacttggcagctctcagaagatgaaatcaaacagtggaaaatcgcctttttaaatcgcttttttgataatgaaaacactgattttcaaaaatggcgtgatgaacaaatccgacaattacagactgataatttaaccgaacgccgtttacgaatggctatttggcaaaaaactgaattaacctcttggctaaatttgctttctgccgaatcaaaaagtaagcaagaatggcgttattgggaagctaaacaagatatattaaaaaataccaaaaaactgaccgcactttcaaaagagcgtggcttttatccaatgttagcggctacacaattaaaacaagcatatcaactgaatgtccctattgcgtcaagttttactcaagctgaacaacttccttttaagcaagtttttgcaatgattacagaattaagagaacttggacgaaatggtttagcaaaacaacgctggcgaattttacttgataatgttgatttcacaactcagctaaaactttctgaatatgccaaaaatcagcaatggtttgaattagctgttgatgcttctattgtagcaaaagcgtggggttacctgtctcttcgtctgccaaatgcttattctgaatacttcaatgctgcattacagaatttgaatatcagcaaaacttttgctatggcaatcgctcgtcaagaaagtgcttggaatccaatggcacaatcttcagcaaatgcgaggggcttaatgcaacttttgccaagtacggcaaaattgacagcagagaataatcaactaccttatcaaggcgaacaagatttattcaaaccattgaataatattttgctaggtaccgcacatctgaatgaactcaatggaaaatatcctaataatcgaatattgattgcagccgcttataatgcaggagcaaatcgagtagaaaaatggttaagtcgcgcgagtggaaaattagcattagatgaatttgttgcatctattcctttttatgaaactcgtggttatgtgcaaaatgtagtcgcttatgatttttactatcaaattttgcaaaataaagaaaacccacaaatctttagccaagaagaattgaatcggctatactaa

SEQ ID NO: 1662 - DNA, 306 bp, H. influenzae strain 86-028NP
atgtatatcagccgtaatttagagcaatggaatgcatttcttcaaatgctaaaaatcgcctttgaagaaaacaaagcacaggaatttctaaccttattattaactgcagacgaacgagatgctgtaggattacgcttgcagattgtctctcagctgattgataaaaatatgcctcagcgtgaaattcaacaaaatctgaatacaagtgccgccacaatcactcgaggttccaatatgattaaaacgatggatcctgattttatgcaatggatgaaacaacatcttgatctcattgaaaaaaactaa

SEQ ID NO: 1663 - DNA, 585 bp, H. influenzae strain 86-028NP
atggtacaacaaaaaatcgctaatcttttacaaggcgattttcgatatcaaatccaatataactgggtcagcctagaaaatatctctccaaacattcaattagctgtgatttcatcagaagatcagcgtttttttgaacatttaggctttgattttgaggctatccaacgagcaattcggtataacgaaaaatctaacaaaggaatccgaggggcatcaactatttcccagcaaactgctaaaaacttaatgctttggcacggacaaaattggctacgaaaaggtttagaagttccagcgactatgttgcttgagctgacttggtcgaaaaaacgtattttagaagtgtatttaaatattgcggaatttggaaacggcatttttggtgtggaagcggcaagtcgctattactttaaaaaatcagctaaaaatttatctcaaaatgaagccgcacttttagctgctgtgttgcccaatccaatcatttataaagtaaataagccaagcttattagttcgtaaaaaacaaacttggattttgagacaaatgggaaatttaggcactgaatacttgagcgatttataa

SEQ ID NO: 1664 - DNA, 345 bp, H. influenzae strain 86-028NP
atggttgatcaaaatccaaaacgctccggcgaaccgccagtatggttaatgttcggtgcaggtggcacagtgagtgcaatttttcttcctgtcgttattctaatcatcggtttgttattaccatttggtttagtcgatgcgcataatttaattacttttgcttattcttggattggtaaattagttattttagtgcttactattttcccaatgtggtgtggtttacaccgtattcatcacggtatgcacgatcttaaagtacatgtgccagctggtggatttatcttttacggtttagccacaatttataccgtttgggtattatttgcggtaataaacctgtaa

SEQ ID NO: 1665 - DNA, 411 bp, H. influenzae strain 86-028NP
atgtcagtaacagtgagtaaacgtaaaaaatatgttcgtccaatgacagcgacttggtggcaaaaattggacttctacaaagcttatatgctacgtgaagcgacttcagtctttgctgtatggttttgtattgtattgctttatggtgttctttgtcttgcaagcaatccaatgccaggcttaggcatattgagctttattgagtttttaagaaaccctattgtggtgttcttaaatattattacgcttatcgcaacgctttatcatacggtgacatatttcttaatgacaccaaaagtgatgaatatcattgtgaaaaatgaacgcttaccacacactgttgtaagaaatgcactttgggcggtaaccacattagttagcgtgattgcgttagttttagtttatatttaa

SEQ ID NO: 1666 - DNA, 771 bp, H. influenzae strain 86-028NP
atggctaattcaccagtaatgaatgttgaagtattacgctacaatcctgaaatcgatcaagagccacatttaagcacctatcaagtaccttatgataatcaaacttcattgcttgatgcgttaggctatattaaggataaacttgaaccatctctttcttatcgttggtcttgccgtatggcgatctgcggttcttgcgggatgatggtaaataacaaaccaaaattggcttgtaaaacgttcttacgtgattacagcggccatatgcgtattgagccgttagcaaacttcccaattgaacgtgacttagtggttgatttaagccactttatcgaaagtttagaggcaattaagccttatattattggtaacgaagcaccagcattagatggtaaaccacatccatcgaaagaattgcaagttagccgtactaaacaaacgccagcacagcttgagaaatatcgtcaattctcaatgtgtatcaactgtggtttatgctatgccgcttgccctcaatttggtttaaatcctgaattcttaggccctgcagctattacgatggctcaccgttataatcttgataaccgtgaccatggtaaagcaaaacgtatgtcattattaaatggtaaaaacggggtttggagttgtactttcgttggctattgctcagaagtttgtccaaaacatgtggatcctgcttctgcaattaaccaaggcaaagtggaaagtgccaaagattatgttatctctatgctaaaaccaaaaggctaa

SEQ ID NO: 1667 - DNA, 1800 bp, H. influenzae strain 86-028NP
gtgcaaacagttaatgtcgatattgcgattgttggtgctggtggcggtggtttacgtgcagcgattgccgcagcagaagcaaatcctaacttaaaaattgcattagtttctaaagtatacccgatgcgtagccatactgtagcagcagaaggtggtgcagcggcagttatcaaagaagaagattcttacgataaacacttccaagataccgttgctggtggggactggctttgtgagcaagatgtagtggaatatttcgtgcaacattcccctgtagaaatgactcaattagaacgttggggatgtccttggagccgtaaagctgatggcgatgtaaacgtacgccgtttcggtggaatgaaaattgagcgcacttggttcgctgcagataaaacaggtttccacttattacacacgcttttccaaacttctattcaatatccacaaatccaacgttttgatgaacacttcgtattagatattcttgttgatgatgaccatgctcgtggtatggttgcaatgaacatgatggaaggttcgcttgtgcaaattaatgccaatgcggttgttattgcaactggtggtggttgtcgtgcatttaaatttaataccaatggcggcattgtaacaggtgacggcttatctatggcatatcgtcacggtgtaccacttcgtgatatggagtttgttcaatatcatccaacaggcttacctaatacgggtattttaatgaccgaaggttgtcgtggcgaaggcggtatcttagtgaataaagatggctatcgctatcttcaagattacggtctaggtcctgaaacgccaattggcaaaccgcaaaataaatatatggaacttggccctcgtgataaggtttctcaagcattctggcaagaatggaaaaaaggtaataccttaaaaactgcgaaaggcgtagatgtggtgcatttagatttacgtcatcttggtgaaaaatatttacatgagcgtctgccattcatttgtgaattagcaagtgcttatgaaggtgtaaatccagtaaatgaaccaattccagttcgtccagttgttcactacaccatgggcggtattgaagtcgatttcaatagcgaaacacgtatcaaaggtttatttgctgtaggagaatgcgcatcttcaggtttacatggtgcaaatcgtttaggatctaactctttagctgaacttgttgtgttaggtcgcgttgcaggggaatatgcggcacaacgtgcagttgaagctcaatcggtaaatcaaagtgcggttgatgctcaagcaaaagatgttgttgctcgcctagaagctcttcacaaacaagaaggtaatgaatcttggtctgaaatccgtgatgaaatgggtaccgtgatggaagaaggctgtggtatttaccgtgaccaagcaagtatgcaaaaagcagtagataaaattgcagagttaaaagaacgttacaaacgtattcgcgtatcagataattcaagcgtgttcaatacagatgtactttacaccgttgagttgggttacattctagatgttgcacaatctattgcaaattcagcgattgaacgtaaagaatctcgtggtgctcaccaacgcttagattacacagaacgtgacgatgtcaattatttaaaacacacacttgctttctacaatgagaatggtgcgccgcgcattgaatacagtccggtgaaaattactaaatctcaacctgcaaaacgtgtttacggtgcggaagcagaagctcaagaagcagctgcgaaagctaaggagcaagcaaatggctaa

SEQ ID NO: 1668 - DNA, 1002 bp, H. influenzae strain 86-028NP
atgtgcaaaatttttaaaacaggattaaaaatgaccgcacttaatcattggcaaccttctgccgatataaaaaatcttcttaaacgggcaaaaattattgctgaaattcgtcaattttttacagaacgcggtttgcttgaagtagagacccctgttctaagtgaatttggcgtcactgatttacatctctccacctttagcacggaatttcttgcgcctttcggtgaacaatccaaaacactttggctttctacaagccctgaatatcatatgaaacgcttgcttgcagcagggagtgggccgatattccaaatcagtaaagtgtttcgcaatgaagaagctggaaatcgccataatccagaatttactatgttggaatggtatcgaccgcactttcatatgcatcgtttaattaatgaagtagatgatttgctccaacaaattttagattgtccacctgcagaaagtttaagctaccaatttgttttccaagaatatgtaggcttagatcccttgtcagcagaacgttcagaattaattgaagcagcacgtaaacataattttatggctgaagataatgaagatcgcgatacgttattacagtttttatttagtgaagtcgttgagcctcaaattggaaaagaacgacctattgccgtgtatcatttcccttcaacacaagcagctctagcacaagtaagcccagaagatcagcgggtagcagaacgctttgagttctattataaaggtttagaattagccaatggttttcacgaacttgccgatgcgcaagaacaacgtcatcgctttgaattagataatcaacaaagacaaaaatgtgaattgcctactcgagaaattgatgaacgctttcttgctgccttagaagcgggtatgccagatgcttcaggtgtcgcattaggaatagatcgtttaatgatgatcgctttagattgtgaaaaaattaatgacgtcatttcttttgctgtggacaatgcttaa

SEQ ID NO: 1669 - DNA, 684 bp, H. influenzae strain 86-028NP
atgtcaaaactcttactcgttgatgatgatattgaattaactgaactactttctacacttttagaacttgagggttttgacgttgaaactgcaaataatggattagaagcattacaaaaactcaatgaaagctataaactggttttacttgatgtaatgatgccaaagttaaatggtatcgaaacattaaaagaaattcgtaaagtctctaacgtgccagtgatgatgctaacagcaagaggcgaagacattgatcgcgtattaggcttagaattgggagcggatgattgtttacccaagccttttaacgatcgtgagcttattgcaagaattaaggcgattttgcgtcgtagtgtatctccttcaaataataccgcaaatgtagaaatcctttcttttgacggaattactctccacttttctcacggaattgcaacctataatgaagaaaatctaaatttaacggattatgaatttaagattctttgtttattgcttaaatctaagggaaatgtggtaagtcgagaagaattaagtttagaagtgatggaaaaaccactcactccatttgaccgttctcttgatatgcacatctctaatttaagacgcaaattaccagaacgaaaaaacaagccctcttggtttaaaactttacgcggaaaaggatacgctttagtcacctaa

SEQ ID NO: 1670 - DNA, 414 bp, H. influenzae strain 86-028NP
atgcaagttaaaacacttttaggcgcaacctttttagcattaagcctcgcttcttgttccaccgttgaaaaagttgtatatcgaattgatgtaccgcaaggcaactatttagaggcgactaccgttgcgcaagttaaagaaggcatgacttctcaacaagtacaatatttgttgggaacaccaatattaatcgacccttataataactacacttggtactacgtattcttacaacaacgtgcctatgaaacgccagttcaacatactttcacagtaaaatttgatcaacgtgggattgtgacagaaacccatcttgataaacctttaccacaggtttcacaacaaggcgaaaataacaccattattgaaacaggtgagaaaccaaaatcaagctggtggaaattctggaaataa

SEQ ID NO: 1671 - DNA, 1026 bp, H. influenzae strain 86-028NP
gtgacaaaaatgagtattaccgttaatcaaattgttttgcatcagttagtcaaaaatgtggatggcgacagtataaaaatggaaagcgtattacgcgacgagttgctgtccattacaccagaagtagaacaaatgatgttgcaattgcatcaaggctatcaaaataaagctaaggcttttggcgtgtttcaggaaaagtctatatttgcacaacatttaaatcgtttattagagcaagaaattgaatttttaggttttagtcaatattcaacaaaattgcttgcagatgagctaggtaaatataactttgctgaaagtggcaccttgattttatgtcaatataatttcttagcgacagattatttgtttattgcattgcttgatagccgtcatagtatgttagtcgatgagcatttagatattcgccgtacagaatatttggatattactcagtttgatattgcggcacggataaatttgacggatttgcaagtaaacgcgaactctaatcgttatttaacctttataaaaggccgtgttggtcgcaaaattagtgatttttttatggattttttaggtgccgaagaaggattaaatccacaagttcaaaatcaatgtttattgcaagctgtgagtgattactgcgatcaaggcgaactcaacaaagagcaaactcaagcggtaaaaaaacaagtgtttgaatattgtaaaggtcagctttcaaatggtaacaatattgaattaagggaactttctgattcattacccactctaaacgaacagccttttgtcgtctttacggaagaacagaattatggtttggaagagagtattccaccaatacgttcaacattgaaatcgctaacaaaattctctgggtcaggaaagggcgttaccctaagttttgatgcggaattattgaatacacgtattcaatgggatcctatgacagataccctaaccatcaaaggcttaccaccaaatttaaaagatcaattacaaaaggctttacaatcagagaattaa

SEQ ID NO: 1672 - DNA, 219 bp, H. influenzae strain 86-028NP
atggctcaacattctaaatattctgatgctcaattaagtgcgattgtaaacgatatgatcgcagtattagaaaaacataaagcccctgtagatctatccttaatcgcattgggtaacatggcaagtaatttattaaccaccagcgtgccacaaactcaacgtgaggcattagctcaagcattttcgaattccttaattaatgcggtaaaaacacgttaa

SEQ ID NO: 1673 - DNA, 1758 bp, H. influenzae strain 86-028NP; identical to SEQ ID NO: 770

SEQ ID NO: 1674 - DNA, 993 bp, H. influenzae strain 86-028NP
atgaaaagccatgttcgtagttttaaaacctatattcgcgatgaaattatcaaaaaaggcgggtgggtaaatgcccatgctcatgctgaccgcgcttttacgatgacgccagagaaaattgggatttatcatagtagtaatttgcaacaaaaatgggatttagtggatgaagtaaaacgcacttccagtgttgatgattattacgcacgtttttgccaatctattgaattaatgatatcccaaggtgtaaccgcatttggtacttttgtcgatatagacccaatttgtgaagatcgtgcaattattgccgcacacaaagcccgcgaagtgtataaacatgacattattttaaaatttgccaatcaaactttaaaaggggtaatagaacccactgcgcgtaaatggtttgatattggtgcagaaatggtagatatgattggcggcttaccatatcgtgatgaattggattatggacgtggcttagaagcgatggatatcttgttagataaggccaaatctcttggaattatgtgtcatgtacatgtagaccaattcaacaatccaagtgaaaaagaaaccgagcaactttgcgacaaaaccattgaacacggaatggaggggcgagttgtaggtatccatggtatttccattggctcacattcaaaagaatatcgctacaaactttacgaaaaaatgcgtaaagccaaaatgatgatgatagcctgtcctatggcatggattgacagtaatcgcaaagaagatcttatgccattccataatgcactcacgccagcagatgaaatgattcccgaaggtatcactgttgccctaggcacagataatatttgtgattacatggttcctctatgtgaaggcgatttatggcaagaattaagcctattagctgcgggttgccgtttccctcacttagatgaaatggtcaatatcgcaagtattaacggtcgtaaagtgttaggactagagctaatttag

SEQ ID NO: 1675 - DNA, 579 bp, H. influenzae strain 86-028NP
atgacaattacaataagtgcggtaattttggcaggtggcaaagcacgcagaatgggcgggcaagataaaggattacagattttaggtaaacaatctttaattgaacatgttattaatcgcttacaaccacaaattcatcagatttcaattaacactaaccgaaatcaaacagaatatgcaaaatttggctttcctgttttctccgatgaactgcccgattttcaagggccattaagtggcatgctaacagctctagaaaagacaaaaagtgactttatcctttttacaccttgtgatacgcctttttttcctatgaatcttttagataaactcaaaagtgcggttaaaaatgaccgcactttaattgcgtatgcttgcgatgaagaacgtgaacatcccgttttttgtttaatgtccgttcagctaaaggaaaaattgcgacactatttagcatcgggtgaacgacgccttttacaatttatgaaagaaaatggcgggatttcagtaaaattcacgcaagaagaaggtaacttcgagaattttaatacgctagatgatttaaagaaaacagtcatctaa

SEQ ID NO: 1676 - DNA, 267 bp, H. influenzae strain 86-028NP
atgaaatgtaagcgtttaaatgaagttttggaacttttacagttttattggtctaaagactcggatttgagtttaatggaaattttgcaaaaaattgccaatgaatcaggtttccaaaaaccattaaatgaattaactgatgaagtgattatttatcagttaaaaatggatggtacagataaatatgagccaattcctggtctcaaaaaagattacgaagaagattttaaaaccgcattgctccgtgctcgcggtatcattaaataa

SEQ ID NO: 1677 - DNA, 618 bp, H. influenzae strain 86-028NP
atgaaaaaagtattacttgcgttaggtttaggtgtcagcacgcttatgtctgtaaatagttttgccgcagatttacaagaaggcaaacaatatgttcaagtgagtcaacaggcttcacagcaaaaagaagtgattgagtttttctcattctattgcccgcattgttacgcctttgaaatggaatacaaaattccacaacaagtcgtagatgctttaccaaaagatgtgaaatttaaacaatatcatgtaaatttcttaggtcatcaatctgaaaacttaacacgtgcttgggcgttagcaatggcattaggtgcagaaagtaaagtaaaatcaccattatttgaagcggctcaaaaggatgccttgaaatcaatggatgatattcgagctatcttcttatcgaatggcataaccgccgagcaatttgatggtggcattaatagttttgcagtaaatggtttagttaataaacaagtgaatgcagcagaacaatttaaagtgcgtggcgtacctgatttttatgtaaatggaaaattccgtgtaaaccctgaagggttaaattatgatgatttcgtgaaagattatgtgcaaaccgtaaaaggtttattgcaaaaataa

SEQ ID NO: 1678 - DNA, 336 bp, H. influenzae strain 86-028NP
atggctgcaagttttagcgtaacgcgtcgtttctttgacgacaaaaactaccctcgtggtttttcccgtcacggtgattacacaattaaagaatcacaggtgcttgagcaatatggtcaagcgttcaaagcattagacttaggggaacgtgagccagcgactaaagaagaaaaagatttcgtcgcattttgccgtggtgagcgcgcagcagagactttctttgaaaaaacttggaataaatatcgtactcgtattaacactaaaaaacgtgtttacaccttatctagtgatgtgagtgaagctgcctctggcggtgaagattattccggcgaataa

SEQ ID NO: 1679 - DNA, 1092 bp, H. influenzae strain 86-028NP
atgcaattaccgatttctcaatacaacgaactgctacaaaaaaaacttgaaaaattaaccgcacttttacacccttttaatgcaccagatattcaagtttttgactctccaacaagtcattatcgcatgcgtgcggagtttcgtatttggcacgagcaagatgatttttaccatattatgtttgatcaagcgacgctgcagcgttatcgcgtggatgaatttccaatcgccagcatgctaattaatcgtatgatgcaaaccttattacctttgttaaaacaacaagaagtgctacacaaaaaattattccaaattgattaccttagcaccttgagtaataagattattgtgagcttgctttatcataaaacactcactgaagaatgggaaagtgcggctaaaaatttgaaagatttactcgaaaagcaagattttgatgtgcaaataatcgggcgtgcaagtaaacaaaaaatctgttttgagcaagattatgtggacgaagttttacctgtgaatggcagaaattatgtctatcgccaagtcgagaatagttttacccagccaaacgcaacggtaaactgcaaaatgcttgaatgggcaattgattgtacccaaaatagcgaaggtgatttattagagctttactgcggaaacggtaatttttctatcgcacttgcacaaaatttccgtaaggtattggcaacagaaatcgccaaaccttccgtagccgccgcacaatttaatattgctgaaaataaagtggataatttacaaattatccgtatgtcggcagaggaatttacgcaggcaatgaatggggttagagcctttaaccgcttgaaagggattgatttaaaatcttatgaatgtaataccatttttgtcgatccgcctcgtgcggggcttgatcctgatacagtgaaacttgtacaaaattacgatcgcattttgtatatttcctgtaatccacatacgctgtgtgataatcttgttgaactatcaaaaacgcaccgcattgaaaaagcggcgttatttgaccaattcccttacactgaccacatggaaagcggcctatggctcattcgcaagtag

SEQ ID NO: 1680 - DNA, 567 bp, H. influenzae strain 86-028NP
atggctcaccgtcgtaaattcggtggtggacgtggagaagccgtagcgaaagcagtagggattaaaggttcggcattgccaacggttattgatgcaacagctggtctaggacgtgatgcctttgtgttagccgcaattggctgccaagttcgtttagtagaacgccatcctgttgtttttttacttctgcaagatggtttaaatcgtgcttatcaagatgaggaaatcggcgagatgttgcaacaaaatttgcacttgctgaatgttcagcatattaatgaacttgatcctaatagcgattatgccgatgtggtttatctcgatccaatgtatccgcataaacaaaaatctgcactagtaaaaaaggaaatgcgtgtattccagcatttagtcggggctgatttagatgctgatgaattgcttttacctgcactccaattagctaaaaaacgtgtggtcgtgaagcgtcctgactatgcggaatttctttgtggaaaacaaccgcactttagccgtgaaacgaaaaatcatcgctttgatatttatatgggagcatcccaatgctaa

SEQ ID NO: 1681 - DNA, 435 bp, H. influenzae strain 86-028NP
atgctaagagaaagtgccgttgttattagctatgaaaatggcattgccaaagtgaaatgccaatcccaaagtgcctgtggccaatgtgcagctaaaaacagttgtggaacatcaagcctttccgaattaaacggtaaacgtggcgagcatatttttaatgtggaaacattaatgccattacgcgaaggtcaaattgttgaaattggattagaagaaaagtcgatgttgttgtcggcattattgatgtatgttgtaccgcttttgaccttattgattgtgactatgttgtccgattacataagcgataatgaaattctgcgtgccattttaatctttggattaaccgcactttctttcatttttgtaaaatcttatagcagaaaattagggcaacaaacagaatttcagcctgttttattgcgcatattatcttaa

SEQ ID NO: 1682 - DNA, 537 bp, H. influenzae strain 86-028NP
gtgatttttaaggttatttttatgaacaatcagattcctttacttggaattaccggttatagcggtagtggtaaaacaacattattagaaaaacttattccagaactgatcgctcgtcacattcgcgtttcagtgattaaacatagccatcacaatatgcaagttgataaagaaggaaaagatagctggcgtatgaaagaggcgggttcttctcaagtcattgtagcgaatgatgaacgctgggcgattatgacggaaacgccaaaacctgtttcattggattatttagcgcaacaatttgaccgcactttaacggatttagtgttggtggaaggctttaaacaagagccaattccaaagattttgctccatcgtcaagaaatgacaaaacctttacccgaaattgacgaatatgtgctcgcagttgcaacgaattattcccttgaaattgaccgcactttgttggatattaaccgcattccgcaaattgccgattttattgaaaattggttgcaccattttcacggagcacgatga

SEQ ID NO: 1683 - DNA, 1392 bp, H. influenzae strain 86-028NP
atgactactgaatccaatgcctatcgcggtttagcttgggtagcagcaatggcactttttatgcaaagcctcgatgcgaccattctaaatacagctttacccgcgatatcttccgatttacataaacccgcctttgaaatgcaaatggcgatcatcgcttattctttagctgttgcattatttattcctcttaccgcttgggctgcggcaaaatttgggacattgactgtttttcgtggtgcagttttcacgtttattttaggttcagttgcttgtgccgcggcctctaatttagagagccttattttagcccgagtgattcaggggataggcggtgcctttatgatgcccgttgcgcgtttagctattattcaagctgtccccaaacaacaattagtgaatgcttggaatttaatggcaactgcaggtttgattgggccaattctagggcctattttaggtggatggttagtcattcacgccagttggcactggatttttttaattaatattccaattggtgtgctaggaattttggcatcgggcagcgtgatgaacaatatcaagggcaaggcagagaaattagattggacaggttttttactctttgcattggggttagttggtattacgcttggtttggatttactcggagaaagtcagcataattcaagtgtaacttatagcatattagttgttggtattctgttactcgtaacttattgtggctatgctaaaaacaatgaaaatgccattttacctttatcccttttccgaactcgtacattcagattaggtattattgctaatatttttatccgattatctgcatctggtgtgccctttttattgcctttgatgttccaattatctttcggttacagtgctgaaatgtctggctggctattagcaccgattgcgttaatttctgtgatgttgaaaatattaattggacgaattttaaatcgttggggttataaaaccacgttaatttcatccgcacttttgatggcaggttctgtgatttcaatggcttggttagataaacaaagctctctaacttggattatttgtaatcttatgtggtatggggcttgtatgtcgatcatttttacttcaattaatacgctggctgtaggcgatctttcaaaacaacagtctggcacaggctctaccgtattaagtattgtacagcaagttgggattggatttggtattgctgtgtcatcaataatcttaaatctttatcgacatttctttaacgcaagtgattgcttacaacaggcattcagctatacttttttaacttcatcactttttgtaatcgcccttgtttggtcgcttatgaaattacacaaaaatgatggcgatcatttacgaaaaatgccttag

SEQ ID NO: 1684 - DNA, 1650 bp, H. influenzae strain 86-028NP
atgcttatgaaactaaaagcaacattaactctcgccgctgcaactcttgttttggcagcttgtgatcaatctagctcggcaaataaatctactgctcaaactgaagcaaaatcctcgtcaaataatactttcgtttattgcacagcgaaagctccattgggatttagccctgcgttaataattgaaggtacttcttataatgcaagctcacaacaagtgtataaccgcttagttgaatttaaaaaaggctcaacggatattgaaccagctttagctgaaagctgggaaattagcgatgatggtttaagttatacttttcatttaagaaagggtgttaaattccatacaacaaaagaatttaccccgacacgtgattttaatgcagatgatgttgtattttcattccaacgtcagttagatccaaatcatccatatcacaatgtatctaaggggacttatccatattttaaagcaatgaaattccctgaattgttgaaatcagtggagaaagtagacgataacacaattcgtattaccttaaacaagacagatgcgactttcttggctagtcttggtatggattttatttctatttattctgcagaatatgctgattcaatgctgaaagcgggtaaaccagaaacacttgatagtcgcccagtggggacaggcccttttgtttttgtggattataaaacagatcaagccatacaatatgttgcgcatgaaaattattggaaaggtagaacacctttagatcgtttagtcattagcattgtgcctgatgcaacaacacgttatgcaaaattacaggcgggtacttgcgatttaattttattcccaaatgtagcggatttagccaaaatgaaaaccgatccaaaagtacaacttttggaacaaaaaggtttgaacgtagcgtatatcgcattcaataccgaaaaagcaccgtttgataatgtcaaagtgcgccaagcgttgaattacgcagtggataaaaaagcgattattgaagcggtttatcaaggcgcaggaatatcagctaaaaacccacttcctccaacaatttggagttataatgatgaaatccaagattatccgtacgatccagaaaaagcaaaacaacttttagcagaagcgggttatccaaatggttttgaaactgatttctggattcaacctattattcgtgcttctaatccaaatccaaaacgtatggctgaattaattatggcggattgggcgaaaattggtgtaaaaactaacccagtgacttatgaatgggctgattatagaaaacgagcaaaagagggagaattaactgcgggtatctttggttggtctggcgacaatggcgatcctgataatttcttatccccattattaggtagctcaaatataggtaattctaatatggcacgtttcaataattcagaatttgatgctttactcaatgaggctattggattaaccaataaggaagaacgtgcgaaactttataaacaagctcaagttattgtccataatcaagcaccttggattccagttgcccactctgttggttttgcgccacttagtcctcgtgtaaaaggttatgtacaaagcccatttggctatgacgctttttatggtgtgagtgttgatggtaaataa

SEQ ID NO: 1685 - DNA, 762 bp, H. influenzae strain 86-028NP
atggatttcaatcgaattatcactcatatgaatgatcatcatcaagatgatatggctgccctttgtaaaaaatttggtggcgaaaaggaaatcacagatgtgacgttagttaatgtagattttgctggtttagattttaaatataatggtggcaaaacattacgtgtggaatttccacaacaagctgacgcaggttcaattaagcaagctatcatcaatctttgtgtagaaaataaaccagtagcaaattacgatcgtattaaggctaaaattgatgaatttcgtcaagagtttaaaagctgtgtgctttctactttagataaagatggcttaccgatggcgtcttatgcaccaattattttctttgatggaaaatattatatttatatcagtgccattgcagagcattatgagaatttaaaacgcaatccaaatcaagtagaagtgatgtttttagaagatgaaaacaaagcgaagtcaattattgtgcgtactcgcttacgttataaagcaagtgcacgttttattcctcgtgaagatccaattgttgaaaaagtcttagataaattagccgaaactatgaatgatgtaggcggaattaaaacaattcgtgaatttactgattttgatttagttgaacttacatttggaacaggtcgttttgtaagaggttttggccaagcttatttgattgatgctaatggggaaatttctcatattggtgtcaaaggcaatccacatgaaaaagaaagtgataaataa

SEQ ID NO: 1686 - DNA, 348 bp, H. influenzae strain 86-028NP
atgaatttagaaagacttaacgaaattgaaaaaccattactccacatcgttaaacacgatgttgtgccagccctaggctgtaccgaacccatttctcttgcactcgcatctgctacagcggcgaaatatttaggcaaaacacctgaacgcattgaagtaaaagtttcgcctaatctgatgaaaaatggattgggcgttgcagtgccaggaacaggtatggttggattgcctattgctgcggcaatgaaggtattgtcgaacacgatcttgatcgaactattgataatctctgcgctattgcatcaaaaagtatgcagcatatcgacagacaggttatcgaaattatag

SEQ ID NO: 1687 - DNA, 2793 bp, H. influenzae strain 86-028NP
atggcccaaattgcaacaaatccgcttgtgctagtggatggttcttcttatttatatcgtgcatttcatgcctttccttctttaactaatgccgcaggtgagccaacaaacgcgatgtacggcgtgttaaatatgttaaaacgcctcatctcacaagtacagcccactcatatagccgttgtttttgatgcaaaagggaaaacatttcgcaatgaaatgtttgaacagtataaatctcatcgcccgccaatgcctgatgatttacgcaaacaaattcagcctttgcacgatatgattcgtgcattgggcattccgcttttagtggtggaagggattgaggcagatgatgtgatcggtactctcgcactacaagcatcaagtttgggtaaaaaagtgctcattagtactggcgataaagatatggcacagttggtggatgacaatattatgctcatcaacaccatgaataatagcctattggatcgtgagggtgtgattgaaaaatacggtattccacctgaactcattattgattatctcgcacttatgggcgatagtgcagataacattcctggcgttgctggcgtgggcgaaaaaaccgcacttggtttactacaaggcataggaagcatggctgaaatttatgccaatcttgaaaaagtagcggaactgccaattcgtggggcgaaaaaactaggtgaaaaattattggctgaaaaacccaatgccgatctttcttatacattagcaaccatcaaaacggatgttgaacttaacgtgacaacagatcaattgttgcttggagaaagccaaaaggatcaactcattgaatattttgctcgctacgaatttaaacgctggcttaatgaagtgatgaatggtgctgactccataacccaaaccactgaacagccagtgaaaatgaaccagtatcaggcgacctcacaagatcaaagtgcggtggaaaatacgcctaaaattcaaatcgatcgtacaaaatatgaaaccttactcactcaagcggatttaacgcgctggattgaaaaactcaatacagcaaaactcattgcagtggatactgaaacagatagcctcgattatatgtctgctaatttagtgggtatatcttttgctcttgaaaatggcgaagccgcttatttaccattgcaattggattatttggatgcgccaaaaacactcgaaaaatcgaccgcacttgcggctatcaaacccattttagaaaatcctgacattcacaaaattggacaaaatattaaatttgatgaaagcatttttgcccgtcatggcattgaattacaaggtgttgaatttgatacgatgttgctttcttatacgctaaatagtacgggtcgtcataatatggacgatttagccaaacgttatttaggtcatgaaactatcgcatttgaaagcatcgctggaaaaggaaaaaatcagcttacgtttaatcaaattccattagaacaagccactgaatacgcagcagaagatgcggatgtgacaatgaaattacaacaagcactgtggttgaaattgcaacaagaaccaacgcttgttgaattgtataaaacaatggaattaccattacttcatgtgctttctcgcatggaacgtacaggcgttttgattgatagtaatgccctctttatgcaatctaacgaaattgccacaagattaaccgcacttgaagaacaagcttacgaattagcaggtcagccatttaatttggcttccaccaaacaattacaagaaattttgttcgataaacttggcctacctattttacaaaaaacgccaaaaggtgcgccatcaacgaatgaagaagtattggaagaattagcctatagccacgaattacccaaaattttggtcgaacatcgtgggttgagcaaacttaaatccacttacacggataaactgcctcaaatggtcaactcacaaacgggacgagtgcatacctcttatcatcaagcggtgacagcgacaggacgtttatcatcaagtgatccaaacttacaaaatatcccgattcggaatgaagaaggtcgtcgtattcgacaagcatttatcgcacgtgaaggttattctattgtcgctgctgactattctcaaattgagctacgcattatggcacatctttctggcgatcaaggcttaattaacgccttctctcaaggcaaggatattcatcgctccacggctgctgaaatcttcggtgtatcattagatgaagtcaccagcgagcaacgtcgcaatgctaaagcgattaatttcggcttaatttatgggatgtccgcgtttggactttcacgccaacttgatatttctcgtcctgatgcaaaaaaatacatggatttatatttccaacgctatccgagtgtacagcaatttatgaccgatatccgtgaaaaagcgaaagcacaaggctatgtggaaacgttatttggtcgccgtttatatttacctgatatcaattctagcaacgcaatgcgtcgtaaaggggcagaacgcgtagcgataaatgcaccgatgcaaggcacagctgcggatattattaaacgagcgatgattaaacttgatgaagtaatctatcacgatcccgacattgaaatgattatgcaagtacacgatgaattagtgtttgaagtgcggtcagaaaaagtcgagtttttccgtgaacaaattaaacaacaaatggaagatgcatcggaattagttgttccgttgatcgtagaagtcggtgtaggtcaaaattgggatgaagcgcattaa

SEQ ID NO: 1688 - DNA, 303 bp, H. influenzae strain 86-028NP
atgtcgttaaaattggtcgaaattttagttttgggtcaggttttgcgtttaaatgtacccattgaacaagaagaattactgcgccaagctgcgcgtaatttagatatattggtttccgaaatgaaagaaaagacaggccttattcagcttgatcgtgtgctctctattgtggcactcaatttgagttttgaattaagccaagaaaaaaataaaacggctaaaattgaagaggtattgagaacgggtatccaacaattagatcattcattagaaaatattcgtgttacaaaagaaccgcattaa

SEQ ID NO: 1689 - DNA, 564 bp, H. influenzae strain 86-028NP
atgaatactcaaaaacgccagcaaatccgcgctgaaattcgaaaaatacgcgcaaatttaaccgcacttcaacagcaacaagcagcacaatcagtgacccaacaggcgttaaatcttatcgagcaacgacaagccaaaaatattgcattatatttttcttttgatggtgaaatttcaacaaaagccttaatccaatccctgtggatgcaaaataaaaatgtgtatttgcctgttttacatccttttactaaacactatttattgtttttacgctatttacctgatacgccaatgaaacaaaatcagtttggcatttgggagccaaagctaaatgttcaaaatgttttgccattaaatgaactggatattttatttacgccattggtggcttttgataaaaaaggaaatcgccttggtatgggcggtggattttatgatcgcacgttgcagaattggcaaaataagtcttttattccagttggtttagcgcaccaatgtcagcaagtagaaaatcttcccactgagcattgggatgtgccactgtttgatattttggtggattaa

SEQ ID NO: 1690 - DNA, 2571 bp, H. influenzae strain 86-028NP
atgaacattgaaaaatttacgacaaaattccaagaagcgttaagcgaagcacaatcacttgctatcggaaaagacaatcaatttattgaacccgtgcatttattgaccgcacttttaaatcaacagggcggctctattgcgccaattttgacagcaagtggcgtaaatgtggctttattgcgtaatgaattaaagacagaactaaataaattgccgcaagtgattggcaatggtggagatgtacaactttcacgccagcttattaatttacttaatctatgcgataaattcgcacagcaaaaccaagataaatttatttcgagcgaattgtttttgcttgcagctttagaagaacgaggaacgatcagcgatattttgaaaaagtgcggtgcgaaaaaagaacaaatttcgcaagctattcagcacattagagggggacaaaacgtgaacgatcaaaatgcagaagaaagcagacaagctcttgaaaaatatacgattgatttaaccgctcgtgcagaaagtggcaaacttgatcctgtaattgggcgtgatgaagaaattcgtcgagccattcaagtattacaacgtcgtaccaaaaataaccctgtgttaattggtgaaccaggtgtagggaaaacggcgattgtcgaaggcttggcacagcgtatcgtaaacggcgaagtgccagaaggtttgaaaaataaacgtgtgctttcattagatatgggcgcattgattgctggtgcaaaatatcgcggagaatttgaagaacgtttaaaagcggtgctcaatgaactttctaaagaagaaggtcgcgtgatcctctttattgatgaaattcatactatggtcggcgcgggtaaaaccgatggtgcgatggatgcgggtaacttattaaaaccaagtttagcgcgcggtgaattacattgcgtgggtgcaacaacgttagacgaatatcgtcaatatatcgaaaaagatgccgcacttgagcgccgtttccaaaaagtatttgtggacgaaccaagtgtagaagataccattgctatcttacgtggtttgaaagaacgctatgaaattcatcatcacgtggatattactgaccctgcgattgtcgctgccgcaacgctttcacatcgttatatttccgatcgtcaattgccggataaagccattgatttgatcgatgaagcggcgtctagcattcgtatggaaatagattctaaacctgaaccgcttgatcgccttgaacgtcgaattatccaattaaaattggaacaacaggcattacaaaaagaagaagacgaagcaagtcgcaaacgtttagaaatgttagagaaagaattggctgaaaaagaacgtgaatacgccgaacttgaagaagtatggaaatctgaaaaagcaacgctttctggctctcaacatattaaacaagaattagatactgcaaaaaccgaactagaacaagctcgtcgcgcgggtgatttagcgaaaatgtcagagttgcaatatggacgcatccctgctcttgaaaagcaactcgagcaagctgaaaccagcgaaggaaaagaaatgacgcttttacgctatcgtgtcacggatgaagaaatcgcagaagtgctttctaaagccacaggtattcctgtatccaaaatgatggaaggcgagaaagaaaaactcttgcgcatggaagatgaactacataaacgagtgattggtcaagaagaagcagttgatgcggtagcaaacgcgattcgtcgtagtcgtgctggtctttccgatcctaatcgcccaattggttcattcttgttcctagggccaacaggtgtgggtaaaacagagctttgcaaaactttggctaaattcttgtttgatagtgaagatgcgatggtgcgcattgatatgtcagagtttatggaaaagcacagtgtctctcgtttagtgggtgcgcctccaggctatgtcggctatgaagaaggcggttatttaactgaggctgttcgtcgtcgtccatattcagtgatcttattagatgaagttgaaaaagcccatgcggatgtattcaatatcttattacaagtattggatgatggtcgtttaactgacgggcaaggtcgtactgtggacttccgtaatacggtggtaattatgacctctaacttgggttctgatttaatccaaggtaacaaagacgaaagctatagcgaaatgaaagccttagtgatgtcagtggtaagccaacatttccgtcccgaattcatcaaccgtattgacgaaactgtggtattccatccgcttggtaaagagaatattcgtgcgattgcaagtatccaattagaacgcttagcaaaacgtatggaaactcgtggctatgaattagtgtttaccgacgctttattagatttcattggtgaagtggggtatgacccaatttatggtgcacgtccattgaaacgtgctattcaacaagagatcgaaaacagcttggcacaacaaattctatctggtgcgttattacctggtaaggttgttaccattgattacgccaacgcagaagttcaagctagacaatag

SEQ ID NO: 1691 - DNA, 741 bp, H. influenzae strain 86-028NP
atgtcagaacaaatctacggtattcacgcggttaatagtattttaacccattcgccagagcgtctaattgaagtcttcgtacttaaaagacgtgaagataaacgcctacagccactcttaaatgagctttattccctgggaattggtgtgcaatttgttaatcgacaaacacttgataaaaaagccgatggtgaggttcatcagggtgtcattgctcgagtacaagcggcaaaagaacttaatgaaaatgatcttgatgaaattcttgcgaataaacaaaatccgcttttattagttttggatggcgtgacggatccacacaacttgggtgcctgcctgcgaacagcggatgcagcgggcgcagtggcagtgatcgtaccgaaagataaatccgcacaattaacatctatcgcacgtaaagttgcttgtggcgcggcagaaaccgtgccgttaattcgtgtaaccaatctttctcgcacactgcgcgatttacagcaaaaccataatatttgggtggttggcactgctggcgaagccactgaaaccatttatcaaagcaaactgacaggaccactagcacttgttatgggagccgaaggcgaaggaatgcgtcgtttaacgcgtgaacattgcgatcaactgattagtattccaatggctggttcagtttcatcattaaatgtatctgtcgcaacaggggtatgtttatttgaaattgcacgtcagcgtttaggttcataa

SEQ ID NO: 1692 - DNA, 2349 bp, H. influenzae strain 86-028NP; identical to SEQ ID NO: 694

SEQ ID NO: 1693 - DNA, 708 bp, H. influenzae strain 86-028NP
atgaaattaacctctccgatctttaatgatcaacaaaaacgtcgtgcaatcatctggctcagctttttccacatattcatcattgcagcgagcaattactttgtacaaatcccttttgaaatcacgctaaaattaaccgcacttggtgcagcaaacgatttttctttccacagcacttggggaacgctcacattcccatttatctttttagctaccgatttaaccgtacgcattttcggtgcggaagatgcgagaaaaatcatcttcgtggtgatgtttcctgcacttattgtaagttacgtcatatctgttttattctctgaaagcaaattccaaggtttcgaatcattaacgcattttgatctgtttgtattccgtattgctattgcgagctttgccgcttacgtggtaggacaattgcttgatgtgatcgtatttaaccgcttacgccagttaaaaacttggtgggtggcgccaactagctcaatgacatttggctcaatggcggatacattcgttttcttcagtgtagccttctatcaaagtgcagatccgttcatggctgaacactgggcacaactcggttttgtagattacctatttaagctatttgtcggcattatattattcgtaccagcctatggcgtagtattaaatgttattttacgaaaactacaaatgctcgtaacagaacgcgttcctgcataa

SEQ ID NO: 1694 - DNA, 690 bp, H. influenzae strain 86-028NP
atgattttacagcctttattctatttgtgtttttcatcaaatttgaaaggagagaaaatggagttacacaatattcgtgatgaatatactaaacgcgtgctttcacaacatgattgccataaaaatccaatttcgcaatttgaacagtggcagaaagaggctattcatgctcaagtcaatgagccaaccgcaatgaatattgcgactgttgatgaacaaggtcgcccaaatagccgaatggttttgttaaaagaagtcaatgagcaaggatttgtcttttttaccaattatcttagtcgaaaaggcggctgtattgagcgcaatccttatgtcgcgctgactttcttttggcctgaattggaacgccaagtgcggattgaaggtaaggcggttaaaattccagcagaacaatccgataaatattttgctacccgaccttacaccagtcgtataggggcttgggcaagtgagcaaagtgcggtgatttctaattataaatctttgctagcaaaagccgcattggttgctgctaaacatccgttaaatgtgcctcgaccagattattggggcggctatttagtggtgccagaaaccgtggaattttggcaggggcgtccaagccgtttacatgatcgcattcgttatcgtaaagaaagtgataattggattagagaaagactttctccttag

SEQ ID NO: 1695 - DNA, 1851 bp, H. influenzae strain 86-028NP
atgaaaaacgaaattgatattaaaaaactccgtaacatcgccattattgcgcacgtagaccatggtaaaaccactcttgtagataaacttcttcaacaatctggtacttttgaatctgctcgtggtgatgtggatgaacgagttatggactcaaacgatcttgaaaaagaacgtggcattaccattcttgcaaaaaataccgcgattaactggaatgactaccgcattaacatcgtagatactccagggcacgcagacttcggtggcgaagttgaacgtgtactttctatggtggattctgttctattagttgttgatgcgtttgatggcccaatgccacaaacgcgtttcgtgacacaaaaagcattcgctcatggtttaaaacctattgtcgtaattaataaagttgatcgccctggtgcgcgtccagactgggttgtggatcaagtatttgacttatttgtcaatcttggtgcaagcgatgaacaattagacttcccaattatctatgcttcagcgctaaatggtgttgcaggtcttgaacacgaagatttagcggaagatatgacgccattatttgaagccattgtgaaatatgtagaatcgcccaaagtagaacttgatgcgccattccaaatgcaaatttcacaattagactacaacaactatgtaggcgttattggtattggtcgtattaagcgcggttcgattaaaccaaaccaacctgttactatcatcaatagtgaaggaaaaactcgtcaaggtcgtatcggtcaagtacttggacatcttggtttacaacgttatgaagaagacgttgcttatgctggcgatattgttgctatcactggtttaggagaattaaatatttctgatacgatttgtgatatcaacgcagttgaagcactgccatcattaacggttgatgaaccaacagtaaccatgttcttctgtgtaaatacctctccatttgcgggacaagaaggaaaatatgtcacatcacgtcaaattcttgaacgtttaaataaagaattggttcacaacgtggcattacgcgtagaagaaaccccaaacccagatgaattccgtgtatctggtcgtggcgaattacatctttccgtgttaatcgaaaatatgcgtcgtgaaggttatgagcttgccgtttctcgccctaaagtaatctatcgtgatattgatggtaaaaaacaagagccatacgaacaagtaactattgatgtggaagaacaacaccaaggttctgtgatggaagcattgggtatccgtaaaggtgaagttcgtgatatgttgcctgacggtaaaggtcgtgtgcgtttggaatacattatccctagtcgtggattgattggcttccgtggagactttatgacaatgacttctggtacaggcttactttactcaagctttagccactacgatgagatcaaaggtggggatatcggccaacgtaaaaacggcgtattaatttctaatgcgacaggcaaagcacttggctatgcattatttggcttacaagaacgtggtaagttaatgattgatgcaaacgtagaagtttatgaagggcaaattatcggtattcatagccgctcaaatgacttaaccgtaaactgcttgcaaggtaaaaaactaactaatatgcgtgcgtcaggtaaagacgatgcgattgtgctaactacacctgtaaaattcagtcttgaacaagcgattgaatttatcgatgatgatgaactagtggaagtaacacctgagtcgattcgtatccgtaaaaaacttttaacggaaaacgatcgtaaacgtgcaaatcgtacaacaacaagtactagcacgcattaa

SEQ ID NO: 1696 - DNA, 981 bp, H. influenzae strain 86-028NP
atgaacggtacaatatgtccaatcaatcaatcaatcaatcaatcaatcaatcaatcaatcaatcaatcaatcaatcaatcaatcaatcaatcaaagtctgtcattattgcaggtaatggaacaagtttaaaatcaattgactatagtttattacctaaagattatgatgttttccgttgcaatcaattttattttgaggatcattattttcttggtaagaaaataaaaaaggtattttttaattgttctgtaatttttgaacaatactatacgtttatgcaattaattaaaaataatgaatatgaatatgctgatattattttatcatcttttctaaatttaggggattcagaattaaagaaaatccagcgtttagaaaaattactaccacaaatcgatcttggtcatagctatttaaaaaaactacgagcttttgatgctcatttacaatatcacgaactatatgagaataagaggattacatcaggcgtctatatgtgtgcagtggcaactgcaatgggttataaagatctttatttgacaggcattgatttttatcaagaaaaagggaatccttacgcatttcatcatcaaacagaaaatattattaaattattaccttctttttcacaaaataaaagtcaaagcgatatccattctatggaatatgatttaaatgcactttattttttacaaaaacattatggagtaaatatttattgcatttcgccagaaagtcctctatgtaattatttccctttatcaccactgaataacccaattacttttattctcgaagaaaagaaaaattacacacaagatattttaattccgccgaagtttgtatataaaaaaattggtatatattccaaaccaagaatttaccaaaatctgatttttcggttgatctgggatatattacgtttacctaatgatataaaacacgctttgaaagcaaagaaaatgagactacgtaaataa

SEQ ID NO: 1697 - DNA, 1413 bp, H. influenzae strain 86-028NP
atgtcaaatgccattgcttccgtgtttaaattgatcgaagagaatgatattaggtttgtattgcttcgttttactgacattaaaggtaaagaacatggtgtttctatcccagttagccttgttgatgaagatatgtttgaagacggcaagatgtttgatggttcctctgttgaaggttggaaaaccattaataaagccgatatgttgcttatgccaatagctgaaaccgcagttgtcgatccattcgcgcaaattccgacactttctattcgttgtagtgtttatgaaccaacgacaatgcaaagctatgatcgcgatccgcgctctattgcaattcgtgcagaaaattatatgcgttcaacaggtattgcggatcaagctttttttggccctgaacctgaattcttcttatttgatgatgtgcgttttaatgtatcaatgaacaaagcgtctttttctattgatgatatagaagctgcttggaacacgaataaaaaatatgaagaaggcaataatgcttatcgcccattaaaaaaaggcggatattgtgccgttgcaccgattgatagtgcgcacgatattcgttctgaaatgtgcttgattttagaagaaatgggattagtcatcgaagcccatcatcatgaagtggctactgcagggcaaaacgaaattgcgactaaattcaatacgctcactttaaaagcggatgaaactcaaatctataaatatgtggtgcaaaatgtggcattggagcatggtaaaacggcgtgttttatgccaaaaccaattactggagataatggttcgggtatgcactgtaatatgtcgttaagtaaagacggaaaaaatattttccaaggcgataaatatgcaggcctttctgaaaccgcactttactacatcggcggtatcattaagcacgctaaagccttaaatgcgttcactaatccaagtactaattcatataaacgtttagtgcctggttatgaagcaccagtattgttggcttactctgcaagcaatcgttcagcctcaattcgtattcctgctgtaaccaatccgaaagcgattcgcgtagaagcgcgtttcccagatccattggcaaacccatatttagcatttgctgcattattaatggcaggtcttgatggcgtggtaaacaaaatccacccaggcgatgcgatggataaaaatctttacgatcttcctccagaagaattaaaagatattccagctgttgcaagctctttagaagaagcattgaattcattagaaaaagactatgaatttttaacccaaggtggcgtatttgctaaagattttattgatgcgtttatcagtatcaaacgtaaagaagtggaacgtttaaatatggcaccacatccagttgaatttgaaatgtattatgcgtaa

SEQ ID NO: 1698 - DNA, 1044 bp, H. influenzae strain 86-028NP
atgtcgaatacaaatagaacaattctagtgactggtggagcggggtttattggttctgcgcttgtccattatcttcttgaaaagacacataataaaatcgtaaatgttgataagctgacttatgcaggaaatttagcctcacttaaaaccgtagaaaaccatccacgttatgcttttgtacaagcagatatttgtgatactaaagcgttgtcttatattttttcacaatatcaacctgatgctgttatccatcttgccgctgaaagccatgttgatcgttctataaatgcttcttcggagtttatacaaaccaatattgtaggcacttactgcctacttgaatcaactctagattactggcatcgtttagataatcaaaaaaaatccagcttccgattcttacatatttccaccgatgaagtttatggggatttaaaaagtaatgagggtttatttactgaaacatcagcttataaacctagcagcccttattctgcttcaaaggcggcaagcgatcatctcgtgcaggcttggtatagaacatatgggttaccgacaattattacacatagttcaaataattatggcccgtatcagtaccctgaaaaattaattccattgatgattttaaatgcgatagagggaaaaacactgcctatttatggcgatggtttgcaaattagagattggttatttgttgaagatcatattgatgcactatataacgttttgatgaaaggaaatattggggaaacctataatattggcggaaataatgaaaagtccaatattgatgtagtgcgttctatttgttctttgctggaagaatttttacctaataaaccaaaacatattgataaatatgaagatttaatttgctatgtgcaagatagaccaggtcacgatcttcgttatgcgcttgatacaagtaaaatcaatcataaactaggctggatacctaaagaaacttttgaatcgggattaagaaaaacggtaatttggtatttaaatcatcaagaatggtgtcaaaaagtgagtgaataa

SEQ ID NO: 1699 - DNA, 1305 bp, H. influenzae strain 86-028NP
atgcaaattacactttcaaataacttagcgaatgatgcttggggaaaaaatgctattttgagctttgactctaataaagcaacaattcatttaaaaaataatgaaaaaactgaccgcactttagttcaacaagctgctcgtaaattgcgtgggcagggaattaaaaatgtggaattgctcggtgaagaatgggatttagaattttgctgggcgttttatcaaggtttttataccgcaaaacaagattacgggattgagtttcctcatttggatcatgatctacaagatgaattattagcgcgtatcgaatgtggcgattttgtgcgtgggattattaatgagccagcacaaagcctaacaccagtaaaattagcagaacgtgcggctgaatttatcttaaaccaagctgatatttataatgaaaaaagtgcggtaagttttaagattatttctggtgaggaacttgagcaacaaggttatcacggaatttggactgtgggtaaaggctctgctaacttgcccgctatgttgcaacttgattttaatccaacacaagatccgaatgcgcccgtgttagcttgtttagttggcaaggggattacctttgacagtggcggctacagcattaaaccaagtgacggaatgagtacaatgcgaactgatatgggcggggctgcattattaacgggggctttaggtttcgctatcgctcgtggattaaatcaacgcgttaaactgtatttatgttgcgcagagaatttgataagcaataatgcctttaaactaggcgatattattacttataaaaatggcgtgacagcagaagtgctgaatacggatgctgaagggcgtttggtgttggctgatggattgattgaagcggacagccaaaatccagattttattattgattgtgcaactttaactggcgcagcaaaaatggcagtaggaaatgactatcattcggtattatctatggatgatgatctcgtgaagaatcttttccaatcagcacaagaagaaaatgaacctttctggcgtttaccatttgaagattttcatcgctcacaaattaattcatcttttgcagatattgctaatattggttctgttccagttggggcgggggcaagtacagcaacagcatttttatcgtattttataaaaaattatcaacaaaattggttgcatattgattgttccgcaacttatcgtaaatctagtagtgatttatgggctgttggggcgacagggattggtgtgcaaactttagcaaatttaatgttatcaaaatcattgaagtaa

SEQ ID NO: 1700 - DNA, 426 bp, H. influenzae strain 86-028NP
atgatgacagaaagaactttttcgattattaaatctgatgcggtaaagcgtaatcttattggagcaatcttaactcgttttgagcaaaatggctttaaaatcatagcctctaaaatggtacgcttaactcgtgagcaggctgaaggcttttatgcagagcatcaaggcaaagaattttttgctcctttagttgaatatatgatgtcttcgccgatagtggtttctgttcttgaaaaagaaaatgcagtgaaagattaccgcactttgattggtacaacgaatccagaaactgcagaagaagggacaattcgtaaagattttgcattaagtcagcgtgagaattcggttcacggatcagatagtatagaaaatgcaaatcgtgaaattgcttatttctttactgattgtgaaatttttgagcgttaa

SEQ ID NO: 1701 - DNA, 1173 bp, H. influenzae strain 86-028NP
atgaaatttattgatgaatcccttattcgaattgaggctggggatggtggtaacggttgcgtaagtttccgtcgagagaaatttattccgaaaggcggccctgatggtggcgacggtggcgatggtggcgatgtctatttacaagccgatgaaaacctcaataccttaatcgattatcgctttaataaacgctttgccgcagagcgtggagagaatggacggagttcagattgtacaggacgtcgcggtaaagatattattttacctgttcccgtgggaactcgtgctattgataacgacaccaaagaaaccttgggggatttaacccaacatggtcaaaaaatgttggtagccaaaggtggttatcacggtttagggaatactcgtttcaaatcatcagtaaaccgtgcaccgcgtcaaaaaacaatgggtacgccgggcgaaaaacgcgatttattattggaattaatgctacttgctgatgtgggaatgctcggtttacctaatgctggtaaatccacttttattcgtgccgtttcagcagccaaaccaaaagttgcagattatccatttactactttagtaccaagtctcggtgttgtgaaagtagacgattcacacagtttcgtagtcgctgatattccaggattaattgaaggggctgcagatggtgctgggctaggaattcgctttttaaaacatttagaacgttgtagagtgcttattcatttagtcgatattgctccaattgatggatctaatccagcagataatgtcgctattattgaatctgaacttttccaatacagtgaaaaattatcagaaaagccacgttggttagtgttcaataaaattgatacgatgagcgatgaagaagctgaagagcgggttcgagaaatcactgaacaattaggttgggaagaagactattacctgatttcagctgcaacaaggaaaaatgttccaccactttgtcgtgatattatggactttatcatagcaaatccacgcgaagctgaaacacaacaagttgcacctgaagaagtaaaattcaaatgggaagattatcatcaggaacaactagcggggtatcaatttgatgatgacgaagattgggatgacgattggactgaagaagatgatgaaggaattgagttcatctataaaccttaa

SEQ ID NO: 1702 - DNA, 921 bp, H. influenzae strain 86-028NP
atgaaacaacaacctttattaggctttacctttgcgcttattaccgctatggcttgggggtcattgcctattgccttgaaacaagttttgtctgtaatgaatgcgcaaactatcgtatggtatcgtttcattattgctgcagtttcattattggctttacttgcttataaaaaacaattacctgaattaatgaaagttcgccaatatgcgtggattatgcttattggagtaattggtcttactggcaattttctattatttagtagctcgctgaattacattgaaccgtcagttgcacaaatttttattcatttatcctcttttggaatgctcatctgtggtgtactgattttcaaagaaaaattagggttgcaccaaaagatcgggcttttcttattgttaattggtctaagtttattctttaataatcgttttgctgtattttctggactaaatcagtattcaacaggtgtcattttaagtatagggggcgctcttatttgggtcgcttatggaatggcgcaaaaattaatgttacgtaaatttaattcacaacaaatcttgctaatgatgtatttaggttgtgccatagtctttatgccgatggctgaattctcgcaagtgcaagaactcacacctttagctctgatttgttttatttactgctgtttaaataccttaattggatacggctcttatgcggaggcacttaatcgttgggatgtatcaaaagtcagtgttgttatcacacttgtacctcttttcacgatcctattttcacatattgcccattattttagcccagtagattttgcagcaccagaattgaataatattagctatattggcgcatttgttgtagtatgcggggcaattttatccgcgattggacataaattattaccgcataaaaatcattaa

SEQ ID NO: 1703 - DNA, 258 bp, H. influenzae strain 86-028NP
atggcaactaaaaaagctggtggttcaactcgtaacggtcgcgattctgaagctaaacgccttggtgttaaacgtttcggtggcgaatctgtattagcaggtagcattattgttcgccaacgtggtactaaattccacgcaggtaacaacgtaggaatgggaagagatcacaccttattcgcaactgcagatggtaaagttaaatttgaagtaaaaggcgagaaaagccgtaaatacgtaagtattgttactgaataa

SEQ ID NO: 1704 - DNA, 312 bp, H. influenzae strain 86-028NP
atgtacgcagttttccaaagtggcggtaaacaacaccgtgtgagcgaaggtcaagttgttcgtttagaaaaacttgaacttgcaactggcgcaacagttgagttcgattctgtgttgatggtcgttaatggtgaagatgttaaaattggtgcaccagtagttgctggcgcaaaagtagtggctgaagtaattgcacaaggtcgtggcgagaaagttaaaatcgttaaattccgtcgtcgcaaacacagccgtaaacaacaaggtcatcgtcagtggttcacagaagtgaaaatcactgggattcaagcataa

SEQ ID NO: 1705 - DNA, 990 bp, H. influenzae strain 86-028NP
atgaagaaacaagatcttatgagcatagacgagatccagaaactagcagatccagatatgcaaaaagttaatcaaaatattcttgctcagcttaattcagatgtaccgctaataggacagttaggtttttatattgttcaaggtggtggtaagcggatccgcccgttgatcgcagttctcgcagcacgctctttagggtttgaaggatctaattcaattacttgtgctacttttgttgaatttattcataccgcttctttgttacacgatgatgtcgtagatgaatctgatatgcgtcgtgggcgtgctacggcgaatgctgaatttggtaatgcagcgagtgtgttggtaggcgattttatttatacgcgtgcatttcaattagttgcacagttagaatcattgaaaattttaagtattatggctgatgcgactaatgttttagcggaaggcgaagttcagcagttaatgaatgttaatgatcccgaaacgagcgaagctaattatatgcgtgtaatttatagcaaaactgcccgtttgtttgaagtggctggtcaggctgcggcaattgttgcgggcggaacagaagctcaagaaaaggcgttacaagattatgggcgttatcttggcactgcatttcagctcgtggatgatgtattggattatagtgcaaatgcgcaagctctaggcaaaaatgtaggcgatgatttagctgaaggaaaaccaacccttcctctgctacacgctatgcgtcatggaaatgctcaacaggcggctttaattcgcgaagcgattgagcaaggtggtaaacgtgaagcaattgatgaagtattagctattatgactgagcataagtctttagattatgcaatgaatcgtgcaaaagaagaggctcaaaaagcagtggatgcaatcgaaattttgccagaaagtgaatataaacaagcgttgatttcattggcatatttgtctgtagatagaaattattag

SEQ ID NO: 1706 - DNA, 738 bp, H. influenzae strain 86-028NP
atgaatacagaacttcaacctaaactagaaaaaagtgcggtcaattttcaagctaaaccgcgaaaacaaaaaatccgtaaggatcctaacgcaccttttattcgtgaaaaacttgagttgccagatggacacaataagctccttttgcattcttgttgtgcgccttgctctggcgaagtgatggaagcaattcttgcatcaggcattgaatttacgatttatttttacaatccaaacattcatccactcaaagaatatttgattcgtaaagaagaaaatatccgttttgcaaaaaaatttggtattccatttattgatgctgattacgatcgtcaaaattggtttgatcgtgctaagggtatggaatgggagcctgagagaggtattcgctgcacaatgtgttttgatatgcgctttgaaaaagctgctgaatatgctcatgaacatggtttccctgtatttactagttgcttgggaatttctcgctggaaggatatgaatcaaatcaatggctgtgggcatcgagctgcggaaaaatatgatgatgtagtttattgggattataactggcgcaaggaaggtggttcacagcgtatgattgaaattagtaagcgtgagcggttttatcaacaggaatattgcggttgtgtgtattctttacgtgatagtaataaatggcgagaagagacgggtcgtcaaaaaattgaaatcggaaaattatattatagtgctgattaa

SEQ ID NO: 1707 - DNA, 1371 bp, H. influenzae strain 86-028NP
atgacaattgagtcaattctttcagctattgatagctttatttggggcgcacctctacttatattattatctggtacaggactctatttaacgttacgcttaggctttattcaaattcgctacttaccgcgtgcgctaggttatttatttaaaaaagataaaggtggaaaaggagacgtttcctcttttgctgcactttgtactgcattagcagcaacaattggaacgggtaatattgtgggcgttgcaactgcggtacaagcaggtgggccaggggctattttttggatgtggctggttgctttgttaggaatggcaacaaaatatgctgaatgtttactcgctgttaaataccgtgttcgcgataaaaatggctttatggctggcggcccgatgtattacattgaacgcggactaggtatcaaatggctagcaaaattatttgcattatttggtgtgatggtggcctttttcgggatcggcacattcccacaggtcaatgcgattacccatgcaatgcaagatacttttaatattccagttttagttactgcaattattgtgacgcttttagtcggcttaattattcttggcggtgtaaaacgtattgcaaccgcatcatcggtaattgtgccgtttatggcgattttatacgtcacgacttcactggttattatccttttaaatatagaaaaagtaccagatgcgattttattaattattgatagtgcttttgatccgcaagcagcattaggcggtgccgtagggcttactgtgatgaaagcgattcaatcaggcgttgcgcgcggcattttctccaatgaatctggtttaggaagcgcaccaattgcagctgcagcggcacaaactcgtgaacctgtgcgacaaggcttaatttccatgacaggtacattcttagataccatcatcgtctgtacaatgacaggtattgtattggtattaacgggagcgtggaacaatcctgaattagcgggtgctaccgtcacaaactatgcctttgcacaaggtttaggcacatcaattggtgcaacgattgtaacagttggtttattattttttgcattcacgactattttaggttggtgttactacggggaacgttgctttgtttatctcgtcggtattcgtggcgtaaaactatatcgtctagcttatattatgttggttggtttaggggcattcttacacttaaatttaatatggattatcgccgatattgtaaatggtttgatggctttcccaaatcttattgcgcttattggattgcgaaaagtgatcattgaagaaacaaaagattattttcaacgtttaaaaattaatcattatgatcaagatgaagtgataaaatag

SEQ ID NO: 1708 - DNA, 711 bp, H. influenzae strain 86-028NP
atgactactccaaaaattctcgttgttgaagatgaaattgtcactcgaaatacgcttaaagggatttttgaagcggaaggatatgatgtgtttgaagcagaaaatggtgttgaaatgcatcatatattggcaaatcataatattaatttggttgtgatggatattaatttaccaggcaaaaacggcttattattggcaagagaactccgtgaagaattaagcttacctcttatttttttaactggtcgagataatgaagtggataaaattttaggtctggaaattggtgccgacgattatttaaccaaaccttttaaccctagagaactgactatccgcgcacgtaatctattgcatcgcacaatgtcgcatcaagaaaaagaaaatacatttggtcgagaattctatcgttttaatggttggaaattagacctaaatagccacagtttaattacaccagaaggacaagaattcaaacttcctcgcagtgaatttcgtgcaatgttacatttctgtgaaaatccaggaaaattgcaaacgcgcgaagaattgctgaaaaaaatgacgggacgagagttaaaacctcaggatcgtaccgtagatgtcacaattcgacgtatcagaaaacattttgaagatcatccaaatactccaaatatcattatgactatacatggagaaggctatcgcttttgcggagatattgaatga

SEQ ID NO: 1709 - DNA, 1740 bp, H. influenzae strain 86-028NP
atgaaaaaactctttcttttttttacgctgattttcaccgcttttgcggctaattcaggtttattcgataaaaaacaaacctttttaaaagtagatgatgcttttgctttttctgctactttatctacagataaaagccagttacaagcccattgggatattgccgatggctattatttgtatcaagataaaattagtgctgagttagtcggtaaatcaaatcctctctctttacatacccaacaggcggcggaattacatcaagatccttattttggcgaagtaaaagtttttactcactcaattgatggcatatttaggggcacatttaataatgctgatgataaggttgaaatcacttatcaaggatgtaccgaaggtttttgctatccgcctgaaactaaagtattacgaattggggatttagccgtttctcaagagcaaattgtcgaaaaaacagttgaaaaaaataccgcacttttatctgaacaagatcgtttagctgatggtttattccatagtaaatggacaatttttggtttctttttattaggattgggactggcttttacgccttgcgtattgccaatgttaccgttgctttctgctattgttatcggtcagcaacaacgtccaaatatgatgcgagcgtttagtttagcttttctttatgttcaaggcatggcactgacttacaccttgttagggctcgcggtagcggctatcggtttgccgtttcaaatcgccttgcaacatccttatgtgatgatagggctttctattttatttgttgctcttgccctttcaatgtttgggttatttactattcaattgccaaatagcttacaaaataaactcaatacatggagccaaaaacaaacctcgggtgcttttggcggagcctttgcaatgggaatgattgctgggctggtggcatcaccttgcacatctgcgccactttctggtgctttactttatgtggcgcaaagtggcgatttattcacaggcgcagcaaccctttatttgctcgcacttggtatgggcgtaccgctaatgttaatcacattgtttggtaataaaattttgccaaaatcaggtgagtggatgaacacagtgaaacaaacattcggctttgtgatgttagcgttacctgtatttttactttctcgtattttgcctgaagtatgggaacctcgcttatgggctgggttagcgacagtattttttatttggtttgcgttgcagatgtctaagaacggttttggttatgctattaaaattattagttttgcgttggctatggttactgtacaacccctgcaaaattggatttggcaaactcaaactacaacacaaagtgcggtagaaaatatgcctgtttctcaagttaaatttaagcaaattaaaaatactgaagaacttgaccgcactttagcggaaaatccgcattcaattgctatgttggatttatacgcggattggtgtgttgcttgtaaagaatttgaaaagctgacgttttcagatccacaagtgcaacagcaatttcaaaatatcttattgttacaagtgaatatgacaaagaatagcccagaaaataaagcattaatggaacgctttaatgtgatgggattgcctacgattttattttttgatcagcaaaataatgaaattcaaggaagtagagtaacgggctttatggatgctgatgctttttccaattggttaaaagccttgcattaa

SEQ ID NO: 1710 - DNA, 405 bp, H. influenzae strain 86-028NP
atgaacaatcttgaaaaatatcgcccttatttcttggcatttttacgtatcgttgccgcttatatgtttattttacatggcacagcaaaacttttggaatttccaatttctatgactggaggaaatggtgcagtaggcgatccaatgctactagtggcaggcgtaattgaaattgttggttccattttattaatcttaggtttatttacacgccaagctgcgtttattttgtcaggggaaatggcgtatgcctatttctttatgcacgtagcaggaaaaggaaacctatttttcccaattgcaaatggcggcgagcttgcattactttactcagttctctttctatattttgtattttctggcgcaggtgcttgtgctttagataataagttttttaaaaagtag

SEQ ID NO: 1711 - DNA, 1599 bp, H. influenzae strain 86-028NP
atgacagatcgtccaattcgtcaggctttactaagtgtgtctgataaaacgggtattgtagagtttgctcaaggtttagttaaacgtggtgtaaaactactttcaacaggtggaacggcaaaacttttagcacaaaatggtttacctgtaattgaagtgtctaattacacaggtttccctgaaatgatggacggtcgagtgaaaaccttacatccaaaaatacacggtgggattcttggtcgtcgtggtacggacgatgccattatgcaacaacatagtattgaaggcattgatatggttgttgtgaatttatatccctttgcagctaccgttgctaaaccagattgcaccttgactgatgcggtagaaaatatcgatattggggggccaaccatggttcgttctgcggcgaaaaaccataaagatgtagcgatcatagtgaataataatgattttaacgccattcttacagaaatggataaacaccaaaacagcctaacttttgaaactcgttttgatcttgcgattaaagcatttgaacataccgctcaatatgattctatgattgccaactatttcggtcagctagtaaaaccttatcatattgcagaggaagaagaggcgaatgcgaagtgcggtcaattcccacgaactttaaatcttaatttcgtgcgtaaacaaactatgcgttatggcgaaaattcccatcaaaatgccgccttctatgttgatttaaatgtgaaagaagcgagcgtggctacggctaatcaactgcaaggtaaggcattatcttacaataatattgccgacaccgatgctgcacttgaatgtgtgaaagaatttgatgagccagcttgtgttatcgttaaacacgctaatccgtgtggtgtggctttaggtaaggatattttagatgcttataatcgcgcttaccaaaccgatccaacgtctgcttttggcggcattattgcttttaaccgtgaattagacgaaaaaacggcgaatgaaattgtggaacgccaattcgttgaagtgattatcgcaccgaaagtttctgctgaagcgcaagaagtaatgaagcgtaagaaaaatgtgcgtttgcttgaatgtggtgaatggacttctcgttccgaacgtttggatttcaaacgtgtaaacggcggtttattagtacaagatgcggatttaggtatggttggcgtggatgatttaaaagtcgtgagtaaacgtcagccaactgaacaagaattaaaagacttattattctgctggaaagtggcaaaatttgtgaaatcgaatgccattgtttacgccaaagacaatcaaactatcggcattggtgcaggtcaaatgagccgtgtgtattcggccaaaattgcaggtatcaaagcacaggatgaaggcttgaccgtggcaggttgtgtgatggcatctgatgcgttcttcccattccgtgatggcattgatgctgcagcgaaagtgggaattcaatgtgtgatccatccaggtggttcaatgcgcgatcaagaagtcatcgatgcggcggatgaacataatatggtaatggtattgactggaatgcgacattttagacattaa

SEQ ID NO: 1712 - DNA, 1290 bp, H. influenzae strain 86-028NP
atgaacatcctcatcatcggaaacggcggtcgtgaacacgccttggcttggaaagttgcacaatctccattagcagataaagtttttgtcgcaccgggtaacgctggtactgcattggaacacaaagtagaaaacgtgaatatttctgcgacagatattccagcattagtgaaatttgctcaagataaacaaattggattaaccattgttggtcctgaagcccccttagtgattggggtagttgatgcatttcgtgaagctggattgaagatttttgggccagctaaagcggctgcgcaattggaaggttcaaaggcattcactaaagattttctcgctcgtcataaaattccaacagcggaatatcaaaacttcaccgaagtcgaacctgcattgacttacttgcgtgaaaaaggcacaccaattgtcgttaaagcggatggcttggcggcgggtaaaggcgtaatcgttgcgatgacattgcaagaagccgaagatgcagtacgcgatatgctttctggtaatgcctttggcgaagcgggcagccgagtagtgattgaagaatttctagatggcgaagaagcaagttttatcgtcatggtagatggtaaaaacgtagaacctatggctactagccaagatcataaacgcgtgggcgaaaatgatacggggttaaatacaggcggtatgggcgcgtattcgcctgcaccagtaataacacccgaaattcatagtcgcattatgaaggaagtgatttacccaaccgttaatggcatggcagcggaaggcagtgtttacacgggtttcctatatgcaggattaatgattatgccaaatgggcagccgaaagtgatcgaatttaattgtcgttttggtgatccagaaacgcagccaataatgctacgtctcaaatcagaccttgttgaactctgtcttaaagcatgtgacggcaaattagatgaagtaatatcacaatgggatccacgagcttctttaggtatcgtattggctgcagagggatatccaaaggattatcgcaaaggcgatgaaatcagcggattgcctaaaagtgcggtcaaaaacgagaaagttttcttagcgggtgtcgcagaacaagaaggcaagctagtcacaaacggcggtcgtgtactttgtgtgactgcgttaggcgaaagtgtatttgaagcacaacaaaaagcgttaaaattggctgagcaaattcaatggtctgggcgtttttatcgtcgagacattggttacagggctgtggaacgagaacaagcaaaatag

SEQ ID NO: 1713 - DNA, 1568 bp, H. influenzae strain 86-028NP
atgcgacaatttgtcatcgtagtattatattctgcaattcttctttcattagaagttatttatagaaaattatttaatatttctagtattgagagatacactgaaagttatttgtctgtctgtttgtctgtttgtttgttttttcaaaatatagaattacaagaatattagttggcgctttatttgcaataagtattgttgttaataatgtacattatgcagtataccaatcttggattggacctgttaattactcacttgcatttaaagaaattaatgagataacaaatgctggcttaacaatgatagataaattcatatatccattgttatttggtttatttgaagttgctgtgtttttaagtttaagtttcataaaaagaaaagtatataaactttcttggatttttgactttattttttatgctgtgatgatgtatgtttttgttcgagcgtatacaacaaaatcccatgagcgttttatttcacctaacactgtttattctcgattaaaatccaattatttatcgttgggttattttataggacgaattgttccttatgagatattttctttatctaatattcctctttatcataaatctaagcctatgaaatcgggctctccgaaaattaagaatataattttaattatgggggaaagtgcgacctcaagtcattttagtgcttttggttacgggagaaaaacatctccttttttagatagcttaaaatataaatcaggagctcttgttggtaaaacttattcaggaggaaagctaacagcaatttctttaccaatgttttttaatgcaattccttatccaaatggaatacaacagatagctaaaggagatacgaatttatttaatttagcgaaagagcaaggctttcagacatatttttattcagctcaagctagggatgatatgcatatgatcaattttttaggaggagcttggattgatgatattcgttttccagataatgaagggtattctttaagagattcaatgcctgataataaattacttcctgcttttaaaaatattaatttagataatggttatcattttgttgttttacatcatagagggagtcatattccctatggggcattattagatgaaaaagagaaggtgtttggaaaaaataacgcaacagataattatgataatactattctaaatactgataactttatctcagaggtttaccattacttatctaataaatcttctaaagattggataattgcctatacatcagatcatggtcaatatgtaaaaggcgacacttataagcaagggacatttgatgaagataattatattgtgccattagttctatatagtccaaatgaagaaatacagaaactagtgttggacaattttgaatcatgtaagatttcatttcataatcagttatctagctttattattaatataatgggatataactattcagttagcacttgcgataagggggttgttaatggaaatattctcacaggtgatgctggatacctaaaaatagaatctaatggtaaacaagagtatgttcattaa

SEQ ID NO: 1714 - DNA, 1266 bp, H. influenzae strain 86-028NP
atgtttacaagaaatatgactatcgctgattacgatccagtattgtggcaagcgatccaagatgaaaatcgtcgtcaagaagaacatatcgaactcattgcatctgaaaactatgcgagtccacgtgtgatggaagcgcaaggttcacaattcactaataaatatgcggaaggctatccaggtaaacgttattacggtggttgtgagtatgcggacattgtggaacagttagcaattgaccgtgcgaaagaattatttggtgcagattacgtgaatgttcaaccgcactctggatcacaagcgaatgctgcggtgtatggtgcattgattaatgcaggcgatactattttaggtatggatttggctcacggtggtcatttaactcacggtgcaaaagtcagtttctctggcaaaatttataactccgtactttatggaattactgcggatggcttaattgattatgaagatgttcgtcaaaaagcattagaatgtaaaccaaaacttatcgttgctggtttctcggcttattcacaagttgtggattgggcgaaaatgcgtgaaatcgcagatgaagttggtgcgtatttatttgtggatatggcgcatgtagcgggattaattgcagcgggtttatatctaaatccactccctcatgcacatgttgtgacaacaacaacccataaaacgttgggcggtccgcgtggtggtttaattctttcatcttgtggcgatgaagaaatctacaaaaaattacaatcatccgtattccctgcaaatcaaggtggtccattagttcatattattgcggcaaaagcagtttgctttaaagaagcattagagcctcaatataaagaataccaagcaaatgtaatcaaaaatgcgaaagcaatggttgaggtatttaaacaacgtggttatgacgttgtgtcaaatggcactgaaaaccacttgttcttagtaagttttattaaacaaggattaacaggtaaagcagctgatgcggcattaggcaaagcaaatattacagtgaataaaaatgctgtaccaaacgatccgcaaaaaccattcgtcacttctggcatccgtgtaggtacaccatctgtgactcgccgtggtttcaatgaaaatgatgtgcgtgaattagctggctggatgtgtgatgttttagatgctttaggcaaagaaaatgaagaacaagtgattgctgaaactaaagaaaaagtattagcaatttgtaaacgtcttccagtttatccgaaatga

SEQ ID NO: 1715 - DNA, 633 bp, H. influenzae strain 86-028NP
atgggaaattatatgacttatattgttggcttaactggtggcattggtagtggtaaaacaacgattgctaatttatttaccgatcttggcgtacctctagtggatgcggatgtggttgctagagaagtcgtcgcgaaagattcccccttattgtcaaaaattgttgaacattttggggctcaaattttaacggaacaaggcgagcttaatcgcgcggctttacgagagcgagtgtttaaccatgatgaagataaattgtggttaaataaccttctacatcccgctattcgtgaacgaatgaaacaaaaattagctgaacaaactgcgccttacacattatttgtcgtccctttattaatagaaaataaattgaccgcactttgtgatcgtattttggtggtggatgtgagtccacaaactcaacttgctcgttcatcacaacgagataacaataattttgagcaaattcaacgaattatgaattctcaagtttctcaacaagagcgtttaaaatgggcagatgatgtgattaacaatgattctgaactggcccaaaacttaccgcacttgcagcaaaaggtgctagaattgcaccagttttatttacaacaagcggaaaataaaaatgcctga

SEQ ID NO: 1716 - DNA, 207 bp, H. influenzae strain 86-028NP
atgcctgacgaaatgattgaagtaccttgtccgatttgccaaaaatcggtgccttggataaatgaaagtacttttcgacctttttgtagcaaacgttgccagttaattgatcttggcgaatgggcggctgaagaaaaagcgattccaagtgatactgctgattttgcaatggatccaaatgtgagtgacggatggagcattaaatag

SEQ ID NO: 1717 - DNA, 1257 bp, H. influenzae strain 86-028NP
gtgatttttatgcaacaagattatttaagccaacaacgattctccgctcttcctctacatccgattgtgcgaggtgctttggcaaaaaaaggctttgatttttgtaccccaattcaggctttatccttgcctatcagtttaaatggacgagatgttgcaggacaagctcaaacgggtacaggcaagacaatggcttttttaacggctacttttcaccatcttttaactcaccaagatcctaatcttgaatatcctcacccaagaactttgattttagcacctactcgagaattagcggtacagattagtaatgacgcagaatttcttgcaaaagcgagtggattaaagaccgcacttgcctatggtggcgatggttatgataaacaactacaagtgattgagcgtggcgtagatattttgattggtacgacggggcgagtcattgattatgtaaaacaaggcgtaattggtttagatgaaatccaagttgtcgtgctagatgaagcggatcgaatgtttgatcttgggtttatccgtgatattcgttatttattgcgtaaatgccccgctccgcaagcgcgtttaacgatgttattttcagcgacgctttcttataaagtgcgtgaattagcatttgaggatatgaatgatcctgaatatattgaaatagaaccggaacaaaaaacaggtcatcgtattaaagaagaacttttttatccatctaatcaggataaaatggcacttctcttaaccttaatggaagatgaatggcctgagcgctgtattgtgtttgcgaatacaaaacatcgttgtgaagaaatttggggttatttggcggctgatggacatcgtgttggtttactgactggcgatgtagcccagaaaaaacgtttatcgttattaaaacaatttaccgacggtgatttagatattttagtagcaacagatgtggctgctcgtggcttgcatatttctgatgtgacgcatgttttcaattatgatttacctgatgatagggaagattacgttcaccgaattggccgtactggacgagcaggggaaagtggcgtttcgattagttttgcttgcgaagaatatgcgatgaatttaccaggaattgaagaatatattggccattctatcccagtgagccaatatgaaacagaagccttgcttgaactgccgaaaccgtatcggttaaaacgtgcagtaccaccgcaagggcatacaagacatcgttcttatcacacaaaataa

SEQ ID NO: 1718 - DNA, 564 bp, H. influenzae strain 86-028NP
atgcgacaagctaaaactgatttagccgaacaaatttttcttgctaccgatcgtttaatggcaaaagaaggtttagatcggctttctatgcataaaatcgcaaaagaggcaaatgtagcagcaggaacgatttacctttatttcaaaaacaaagatgagttgcttgaacaatttgcacatagagtgttttcaatgtttatggcaacacttgaaaaagattttgatgaatctaagccttttttcgaacagtatcgacaaatgtggaaaaatatttggtatttcttacaagaaaatcccaccattctatccaatttaaagcaatatgaatctttgcctaatttcaaggatatttgtaaaaacgttaaaaattgtcgttgggatttattttgtgaccaagccaaaaaagctggcttattagcggaattatctgaagatattctctttttattaagtttgaaaacggcgataaatttagcctctgatgcaaaatttatcgatttcgatcttaagcctgaaattttagaatctgtgattgaacgctcttggcgtgcgattcagaaataa

SEQ ID NO: 1719 - DNA, 1197 bp, H. influenzae strain 86-028NP
atgagtcaaactcaacatcaaagaccaaaacgctcacatattttcttgatgaaaataattttagtggtatttgtcttaatttttgtcggtgtcatcggttttaatataataaaaggcgtaatgataagccgagccattgcagaaatgccagaatcttcaagcccagtaaccgcacttgaagttcaaccgcgtgaatggacgccagttattaacacaacaggtcttgtgcgtccaaatcaaggcgcattgctcagtacacaaaatgcaggtacgatttctcaagtacttgtgcaaaatggacaaaatgtgaaaaaaggtgaggtgcttgtggaacttgatagttctgttgaacgagctaatctacaagctgctcaggcacaattatcagcacttcgtcaaacttaccagcgttatgtgggtttattaaacagcaatgctgtatcacgtcaagaaatggataacgcaaaagcggcttatgacgctcaactagccaatatcgaatctttaaaagcagtaattgagcgccgtaaaattgttgcgccatttgatggcaaagcaggtattgtgaaaatcaatgttggacaatatgtgaatgttggaacagaaattgtgcgtgtagaagatactagctcaatgaaagtggattttgctctttcacaaaatgatttagataaattacatatcggtcagcgcgttacagcgacaacagatgctcgcttgggcgaaacattttcagctcgaattacggctattgaacctgccattaattcatcaacaggtttagttgatgttcaagctacatttaatcctgaagatgggcataaattgctttcaggtatgttctctcgtttacgcattgcgctaccaactgaaacaaatcaagttgtcgttccacaagtagctattagctacaatatgtatggcgaaattgcctatttacttgaaccattatctgaagaagaaaaaggaaaaatgtcaggtaatgaaaaattggatcgtctctatcgtgcgaaacagatcaccgtatttactaaagatcgtcaaggtgtttatgctcaattacagggaaatgaagttaaagcgggagataaaattattacaggcggtcagcaaggtattggtaatggaagtcttgtggaatggattaaaaaagacattgtgggtgcagtagagcctgcacataaaacaccactttaa

SEQ ID NO: 1720 - DNA, 3099 bp, H. influenzae strain 86-028NP
atgtatgaggaaatccgaatgaaatttaccgatatatttattcgccgtcctgttttagcagtttcaattagtttgttaatgattattttagggttgcaagcaatctcgaaattggcagtgcgtgaataccctaaaatgactactacagtcattacagtgagtaccgcatatccaggggcagatgcgaatttaatccaagcatttgttacgtcaaaattggaagaatctatcgcgcaagccgataatattgattatatgtcttcgactagtgcgcctagtagttcgactattacaataaaaatgaaattaaataccgatcctgcaggcgcgttagcagatgtgttagccaaagtgaatgcagtaaagtcagcattaccaaatggtattgaagatcctagtgtatcctcttcttcaggtgggagcggtattatgtatatcagtttccgatctaaaaaactagattctagtcaggtaactgattacatcaatcgtgtagtcaaacctcaattctttacgattgaaggcgtggcagaagtacaagtatttggtgcggctgagtatgcattacgtatttggctagatccacaaaaaatggcagctcaaaatctttctgtgccaacagtgatgtctgccctttctgcaaataatgtacaaacggctgcggggaacgataatggctattatgtgagttatcgtaataaagtagagactacaacgaaatcagtggaacaactcagcaacttaattatttcatcaaatggcgatgatttagtgcgtttgcgtgatattgcaaccgttgaattaaataaagaaaatgataattcgcgtgctacggcaaatggtgcagagtccgttgtgttagccatcaatccaacctcgacagcaaaccctttgactgtcgcagaaaaaattcgccctttatatgaaagtataaaaacacaactgccagacagtatggaaagcgatattctttatgaccgcactattgccattaatagctctattcacgaggtcataaaaactattggtgaagctactttgatcgttttagtggtaattttaatgtttatcggttcgttccgtgctattttaattccaatattggctattccaatttctcttattggcgtattaatgctgctacaaagtttcaacttttctattaatttaatgaccttgcttgctttaattcttgccataggtttagttgtagatgatgctattgtggtgctggagaatattgatcgtcatattaaagcgggagaaacgccattccgagcggcgattattggtacgcgtgaaattgccgtgcctgtaatttctatgactatcgcattgatcgcagtttactcaccaatggctttaatgggggggattactggcacattgtttaaagagtttgctttaacccttgctggtgcagtatttatttctggtgttgtggcattaacgttatcgccaatgatgagtagtaagttactcaaatccaatgctaaaccaacatggatggaagaacgcgtagaacataccttaggtaaagtaaatcgtgtttacgaatacatgcttgatctcgttatgctcaatcgtaaatcaatgctggcttttgcggtcgtgattttctcaacgctcccatttttgtttaattcactttctagtgaattaacgccaaatgaagataaaggcgcatttattgcaattggtaatgcgccatctagcgtaaatgtggattacattcaaaatgcaatgcaaccatatatgaaaaatgtaatggaaacacccgaagtctcttttggtatgagcattgctggtgcgccaacttctaatagctcgttaaatatcatcacattgaaagattggaaagaacgttcacgtaaacaatccgcaataatgaatgaaattaatgaaaaagcaaaatcaattccagaagtgtcagtatcagcatttaacattcctgaaattgatacaggggaacaaggcgctccagtctctattgtattgaaaactgcgcaagattataaatctttggcaaacaccgcagagaaattcctcagtgcgatgaaagcctctggcaaatttatttatacaaatttagatttgacctatgacacggcgcaaatgacaatttcagtagataaagagaaagctggtacttacggcatcacgatgcaacaaatcagtaatactttagggagtttcttatctggtgcgacagttacgcgtgtggatgtggatggacgcgcttataaagtcatttcgcaggtaaaacgagatgatcgcttatcgccagaaagtttccaaaattattatttaactgcatctaatggtcaatcagtgccattaagtagtgttattagtatgaaattagaaactcagccaacatcattaccgcgtttcagccaattaaattcggctgaaatcagtgctgtaccaatgccgggtatatcaagtggtgatgccattgcttggcttcaacaacaggcaaatgataatttgccacaaggatacacttatgatttcaaatccgaagctcgtcaattagtacaagagggtaatgcacttacgacgactttcattcttgctgttgtaattattttcttggtgcttgccattcagtttgaatctatacgtgacccaatggtaattatgatttccgtaccattagccgtaagtggtgcattggtgagcttaaatattttatccttctttagcatcgcaggaacaacattaaatatctactctcaagttgggttgattactctcgtgggattaatcactaaacacggtatcttaatgtgtgaagtggcaaaagaagaacagctaaactatggtaaaactcgaattgaggcaatcactcacgcggcaaaagtgcgtttgcgtccaattctaatgacaacggcggcaatggtagctggcttaattccattactctatgcaacaggtgcgggagcggtatctcgctttagtattgggatagtgattgtagcgggattatccattggtactattttcaccttgttcgtcttgcctgtggtatatagctatatcgcaactgaacacaaaccattaccggtttttgatgaaaataaaacaacccactaa

SEQ ID NO: 1721 - DNA, 471 bp, H. influenzae strain 86-028NP
atgcgtttaacagaagaacaacgtcaagttttaattcaaatagaaagagatcaaaaagcggctgatgaagctagaaaactggctgagcaacagagaatagaagatgcaacgagaactcaatccaaaaaaacggaagatatgaaaaatacagagtcagaaatcgtaaaattggaatcaattaaaaagcaagactcacagaaaattgaaagcgcaaaaaaagtagaacaaataaaaacggttaataatgtacgggatagcaagaaatttggtttacaatgcggtgcttttaaaaatcgagcgcaagctgaaaatttgcaaggtcgtttacagatgacaggattaaatgctcaaatacaaactaacggcgaatggaaccgtgttcgtgtagcaagttttgatactcgagagcttgcagtacaggcgcaaagtagagctaaaactgttaccgattgtgttgtgattggtatgtaa

SEQ ID NO: 1722 - DNA, 1533 bp, H. influenzae strain 86-028NP; identical to SEQ ID NO: 764

SEQ ID NO: 1723 - DNA, 1173 bp, H. influenzae strain 86-028NP
atgacgaaaactgcaattgaaactccatcaaataaatctgtatcaaataaaactaaccgtaaaaaaggcttaagcatttttattcttctcctgcttattattggtattgcttgtgctttgtattggtttttcttcttgaaggattttgaagaaacagaagatgcttatgtgggtggaaatcaagtaatggtatcatcacaagttgcaggtaatgtagcgaagattaatgcagacaatatggataaagtccatgcaggtgatattctagttgaattggatgataccaatgcgaaacttagttttgaacaggccaaaagcaatctcgccaatgctgtacgtcaggtagaacaactgggtttcactgtgcagcaattgcaatcagctgtgcacgccaatgaaatttctttagctcaagctcaaggcaatttggcgcgccgagttcaacttgaaaaaatgggtgcgattgataaagaatctttccaacacgcaaaagaagctgtcgagcttgccaaagcaaatttaaatgcctctaaaaatcaattggctgctaatcaggctttattgcgtaacgttccattacgtgaacaaccgcaaatacagaatgcgataaactcgcttaaacaggcttggttaaatttgcaacgtacaaaaattagaagtccaattgatggctatgtggcgcgtcgtaatgttcaagttgggcaagccgtttcagtgggtggcgcgttaatggcggtggtatctaatgaacaaatgtggttagaagctaacttcaaagaaacccaattaacgaatatgcgcattggtcagccagtaaaaatccattttgatttatacggtaaaaataaagaatttgatggcgtgataaatggcattgaaatggggactggcaatgcgttttctcttttaccttcgcaaaatgctacgggtaactggattaaagtggtacaacgtgtacctgtgcgaattaaattagatccacaacaatttacagaaacgccattgagaattggtctttctgcaacggcaaaagtaagaatttcagattcatcaggcgcaatgctacgagaaaaaacagaaccgaaaacgttattttctactgatacacttaaatatgatgaaagtgcggtagaaaatttgattgaatctatcattcagcaaaacagccattaa

SEQ ID NO: 1724 - DNA, 483 bp, H. influenzae strain 86-028NP
atgacatttagtttaattgtggcgataacattaaataatgtgattggtaaagataatcaaatgccttggcacttgcctgcagatttagcttggtttcgtcagaaaaccactggtaaacctgtcattatggggcgtaaaacctttgaaagtattggtcgtccactacctaaacgtaccaatatcgtactttctcgccagctttttgaacacgaaggtgtgatatggaaagatagctttgaaagtgcggtcaattttgtcagagattttgatgaaattatgttgattggtgggggcgagttattcaaacaatatttacccaaagcagataagttataccttactcaaattcaaacagaactagatggcgatacttttttccctcaattgaattgggaggagtgggaaattgaatttgatgaatatcgtaaggcagatgcacaaaatcgctatgattgccgatttttaattcttacccgaaaataa

SEQ ID NO: 1725 - DNA, 1107 bp, H. influenzae strain 86-028NP
atgaacaaaaaaacaatcgttgtgaaattcggtactagcacgctaactcagggttcgccaaaattgaattcgccacatatgatggaaatcgttcgtcaaattgcacaactgcataatgatggatttcgtatagtaatcgtgacttctggtgctattgcagcgggtcgccattatttaaatcatcctcaattaccacccactattgcctcaaagcaactgcttgcagcggttggtcagagccaattaattcaggcttgggaaaaattatttgctatttatgatattcatatcgggcaacttttattaactcgtgctgatattgaagatcgcgaacgttttttaaatgcacgagatactttacatgcacttttagataaccacattattcctgtgattaatgaaaatgatgcggtggcgactgcggaaataaaagtaggagacaatgacaatttatctgcactagtcgctattcttgtgcaagcggaacaactttatttattgactgatcaacaaggtttatttgatagtgatccgcgtaaaaatcctgaagcaaaattaattccagttgtagaacaaatcactgatcacattcgatcaattgcaggaggaagtggtacaaatcttggcacaggtggaatgatgactaaaatcattgctgccgatgttgccactcgctctggaattgaaacaattattgcaccaggtaatcgtccaaatgtaattgcagatcttgcttatgaacaaaatattggtacaaaatttattgcacaccaatctgatcgattagaaagtcgcaaacaatggcttttcgccgcgccatcggcaggcattatcactattgatgatggagcgaaaaatgccattcttgaacaaaataaatctttattacccgctggtattattaacgtggaagggcgtttttcgcgtggtgaagtagtcaaaatatgcactcaatctggtaaagacattgtactaggtatgccacgctataacagcgatgctctacaattaattaagggcagaaaatcagcagatattgaaaatgttttaggctatgaatatggtgcggtggcaatgcatcgtgatgatatgattattttgtcataa

SEQ ID NO: 1726 - DNA, 591 bp, H. influenzae strain 86-028NP
gtgatcgattttgatggctaccgtccaaatgtgggtattgtgatttgtaatcgcaaagggcaagtgctttgggcgaagcgttgtgggcaaaattcgtggcagtttccgcaaggtggcattaatgataatgaaagtgccgagcaagcgatgtatcgcgaactacacgaggaagttggtttacaacctaaagatgtgcgtttgttatatgtttctaaacattggttgcgttataaattgccaaagcgtttattgcgttatgatagcaagccgatgtgtattgggcagaaacaacgctggtttttgctacagcttgttggcgatgaaaaaaatatcaatatgaaaacgaccaaatcgccagaatttgatgggtggcgttgggtaagtttttggtatcctgttcgtcaagttgtgtcttttaagcgagatgtttatcgaaaggtaatgaaagagtttgcttcggtattatttacggataatccaccaatattttccgcatctcgtgaagcaaattcacagtctaattcggcaaataaaaaatattctcagacaaaatacacaaaacgccatttttacaaatcaaaaggtcaataa

SEQ ID NO: 1727 - DNA, 795 bp, H. influenzae strain 86-028NP
atgttcacttttattcttctttgtttacttgttggtgcattagcgggttttcttgcaggattatttggtatcggcggagggttagtaattgtgccaaccttagtgtatttactgcccattgtagatgtaccagaatctttgttgatgtctaccgcacttggcacatcatttgctaccattgtgattactggcattggatcggcacaacgtcatcataaattaggtaacatagtctggcaggcagttcgcattttagctccggttattatgctttctgtctttatttgtggtttatttattggaagacttgatcgtgaaatttctgccaaaatttttgcttgcttagtggtatatttagccacaaaaatggtactttcgattaaaaaagatcaagtgacaacaaaaccacttaccccccttgcttccgtaattggcggtattttgattggtatggcatctagtgctgcgggaattggcggtggtggatttattgtgccgtttttaactgctcgtggcattaatatcaaacaagctatcggttcttccgcattttgtgggatgttattgggcgtatcagggatgtttagttttatagtgagtggttggggaaatccattaatgcctgaatattcgctcggttacatttatcttcccgcagtgttaggtattactgccacttcattttttacttccaaattaggcgcaagtgcaaccgctaaattgcctgtttcaaccttaaaaaaaggtttcgcccttttcttaattgtggttgcgatcaatatgtttctgaaataa

SEQ ID NO: 1728 - DNA, 807 bp, H. influenzae strain 86-028NP
atgaattcaaattatttacttcttccccactttgatccgagtatttttacgcttggcgatagtaatatcggcttacgttggtatggtttgatgtaccttttaggttttgtttttgcacgttggcttgcggttcgccgtgctaatcgcccaaatagcggttggacagtagatcaagttgataccttacttttcaatggttttatgggggtgtttattggcggacgtgttggcgatgtatttttctataatctcgatcatttcttacaagaaccactttatttattccgcgtttgggaaggtggaatgtcgttccacggtggcttaattggtgtaattgttgctatgatttggacatcctattcacaaaaacgtaatttttggcaaacggctgattttgttgcgcctttgattccgtttggtttaggtttaggcagaattggtaatttcattaatcttgaactatggggacgcgaaacgaatgtgccttgggcaatgattttcccgaatgatcctcttttactgcctcgtcatccatcacaactttatgaagcctttttagaaggcctggtgttgtttgcgattctgaatatttttattaaaaagccacgtccaatggcttctgttgcaggtttattcttaattggttatggtgtcttccgttttattgtggaatatgtgcgtgaacctgaagttgaaaatttctttgggattattacacgagggcaagccctttgcttaccaatgattattggtggtgctttcattatggcttgggcttattcacgcaaaagtgcggtcataaaatag

SEQ ID NO: 1729 - DNA, 852 bp, H. influenzae strain 86-028NP
atgaagcaatatcttgatctttgtcgccgcattgttagtgaaggggagtgggttgctaatgaacgtacaggtaagcattgcctcacggtcattaatgcagatttagaatatgatgtggcgaataatcaatttccgctgattactacccgtaaaagttattggaaagcggccattgctgaatttctaggttatattcgtggatatgacaatgccgctgatttccgcgcacttggcacgaaaacttgggatgctaatgcgaatgtaaatgcagcttggcttgcaaatccgcatcgtagaggcgttgatgatatggggcgcgtatatggtgtgcaaggcagagcatggcgtaagcctaatggagaaaccatagatcagctacgtaaaattgttaataacttaacgaaaggtattgatgatagaggagagattttaactttttttaaccctggggaatttgatcttggttgtcttcgtccttgtatgcacacgcatactttttctcttgtgggcgatactttacatcttactagttatcaacgttcctgtgatgttccgcttggattgaatttcaatcaaattcaggtgtttaccttcttagcgcttatggctcagatcacgggcaaaaaagccggcaaggcatatcataaaattgtgaatgcgcatatttatgaagatcagcttgagttaatgcgtgacgtacaacttaaacgcgagcctttcccattgccaaaattagaaatcaatccagatataaaaacgcttgaagatttagaaacttgggtcacgatggatgattttaaagtcgttggctatcaatctcatgagccaattaaatatcctttttccgtctaa

SEQ ID NO: 1730 - DNA, 522 bp, H. influenzae strain 86-028NP
atggatgcagcaaaagtgcggtcagaatttgacgagaaaatgatgcgctacgcccttgagcttgccgataaagcggaagcgttaggtgagattcctgtgggggcggttttggttgatgacgctagaaatattattggagaaggttggaatctctccattgttcaaagcgatcctaccgcacatgctgaaattatcgctttgcgtaatggcgcgaaaaatattcaaaattatcgcctactgaatagcacgctttatgtgacattagagccttgcacaatgtgtgcaggggcaattttgcatagccgtattaaacgccttgtgttcggtgcatctgattataaaactggcgcgattggatcacgttttcatttttttgatgattacaagatgaatcatactttagagattacatctggcgtattggcagaagagtgtagtcaaaaattgagtacattttttcagaaaagacgcgaggagaaaaaaatagagaaagcattattaaaaagtctgagtgataattaa

SEQ ID NO: 1731 - DNA, 315 bp, H. influenzae strain 86-028NP
atggaaaacaaggctgatcgttatcaaaaagcagtcaatattatggatgtgcttgagcaatcgccctttgccaaaataatcaaaaaaggtcttgccatcaatgaacttaatcaaaaatttaaccgcatttttccacaggaatttcacggcaaatttcgtattggcaacataacagatcatttaatttttattgaagtgtctaatgctattgttcggcaggggattctatttaaacaaattgaattattaacactaattcaagaagaatttccgcaagtaacagggtttgagataacgatcaatcctggattttaa

SEQ ID NO: 1732 - DNA, 312 bp, H. influenzae strain 86-028NP
atgagacgaatgatttcaggcactgtcaaaccgaatttttggtcgcgattacttttaagtatcatcgcgatttttgctttgcctaacgcacaaagttttgaaaatcaaaataatacggaaaattattcctcaagtgtttccattcaacaagcgttagaaacggtaaaagttgctcgtgaagtgcaacgacaagccattcctcaaccttcaatttcccgtcaaactgaaaaacaacctaaaattcaaccgcactttttagcggatgtattgaatcttagtgcgccaattcgagcaggccccttacttatttaa

SEQ ID NO: 1733 - DNA, 2706 bp, H. influenzae strain 86-028NP
atgagcattttaacaagaatttttggtagtcgtaatgaacgcgttttacgtaaattaaaaaaacaagtcgtaaaaattaataaaatggagcctgcttttgaggcattaagtgatgatgaattaaaagcaaaaacacaagagtttcgtgatcgtttaagtggtggcgaaactttgcaacaaattttaccagaagcattcgcaacggtacgcgaagcaagtaagcgtgtgcttggtatgcgccattttgatgtgcagcttatcggtgggatggtattgactaaccgctgtatcgcagaaatgcgtactggtgaaggtaaaacattaacggcgactcttccttgttatttaatcgctcttgaaggtaaaggcgttcatgttgtcacggtgaatgattatcttgctcgccgagatgcagaaacaaaccgtccgttatttgaatttttgggtatgagcgtaggcgtcaatattcctggtttatcgccagaagaaaaacgtgcagcttatgcggcagatattacttatgcaaccaatagtgaacttggttttgattatttacgtgacaacttagcccactcaaaagaagagcgtttccaacgtactttaggctatgcgttggtggatgaagtggattctatcttaatcgatgaagcgcgtacgccattgattatttctggccaggcagaaaacagttcagagctttatattgcggtaaataaattgatcccaagtttaattaaacaagaaaaagaagatacggaagaatatcaaggagagggcgatttcactttagatttgaaatctaaacaggcgcatttaaccgaacgtggtcaagaaaaagtagaagattggttaattacgcaaggtttaatgcctgagggggactctttgtattctcctagtcgaattgtattgcttcatcacgttatggctgcattgcgtgcgcacacattgtttgaaaaagatgtcgattacattgtgaaggacggtgaaatcgtgattgttgatgaacacactggtcgtacaatggcggggcgtcgttggtcagatggtttgcaccaagccattgaggcaaaagaaggggtggatgttaagagcgaaaaccaaacggttgcgtcaatttcttatcaaaactacttccgtttatatgaacgtcttgcgggtatgacggggactgcggataccgaagcatttgagttccaacaaatttatggtttggaaactgttgtaattccaacaaatcgtccaatgattcgtgatgatcgcactgatgtgatgtttgaaaatgaacaatataaatttaatgcgattattgaagacattaaagattgtgtagaacgccagcaaccagtattagtggggacgatttcagtcgaaaaatcagaagaattatctaaagcgttagataaagcaggtataaaacacaatgtgttgaatgcgaaattccaccaacaagaagcggaaatcgtggcagaagcaggatttcctagtgcagtgactatcgcaacgaatatggcgggtcgaggtaccgatattattcttggcggtaactggaaagcgcaggctgccaaattagaaaatccaactcaagaacaaattgaagcccttaaagcagagtgggagaaaaaccacgaaattgtaatgaaagcgggtgggttgcatattatcggtacagagcgtcacgaatctcgtcgtattgataaccagttgcgcggtcgttctgggcgtcaaggtgaccccggttcttctcgtttctatctttctttagaagatggtttaatgcgcatttatttgaatgagggtaagctcaatttaatgcgtaaagcgttcacggtagcaggcgaggcaatggagtcgaaaatgttggcgaaagtgattgcatctgctcaagcaaaagttgaggcgttccattttgatggccgtaaaaacctacttgaatatgatgatgtggcaaatgaccaacgtcacgcgatttatgagcaacgcaatcatttgcttgataatgatgatatttctgaaactatcaacgctattcgccacgatgtgtttaatggtgtgattgatcaatatattccaccacaatctttggaagaacaatgggatattaaagggcttgaagaacgtttatctcaagaatttggtatggaattaccgatttctaattggttagaagaagataataatcttcacgaagaaagtttgtgcgaacgcattgtggaaattgcagaaaaggaatacaaagaaaaagaggctttggttggcgaagacgctatgcgccattttgaaaaaggtgttatgttgcaaaccttagatgaactttggaaagaacacttagcttcgatggattatttacgccaaggtattcatttacgcggctatgcgcaaaaagatccaaaacaagagtataaaaaagaatctttccgtatgtttacggaaatgttggattctttaaaacatcaggttatcacgactttaacccgtgtacgtgtgcgtactcaagaagaaatggaagaagctgaacgtgctcgtcaagaaatggcagcacgtatcaatcaaaataatttacctgtggatgaaaatagtcagacaactcaaaattcagagactgaagattattcagatcgtcgcattggtcgcaacgagccttgtccttgtgggtcgggtaaaaaatataagcattgtcacggcagtcgtgtggcacgccagtaa

SEQ ID NO: 1734 - DNA, 411 bp, H. influenzae strain 86-028NP
atggataaaaaaattatacaagttgctgcggggattattcgtaatgaatttggtcagatctatttaacgcagcgtttagaaggacaggattttgcccaatctttagaatttcccggtggaaaagtagatgcgggagaaaccccagaacaggctttaaaacgtgaactggaagaggaaataggcattgttgcgttaaatgcagaactttatgaacgttttcaatttgaatatccaacaaaaatcatttcttttttcttttatctggtaaatgaatggattggcgaaccttttgggcgagaggggcaagaaggtttttgggttgagcagcgcgcattggatgcaggacagtttccccccgcaaatgcaaaattaattcatcgattactaaatgaaactcacaatttcatataa

SEQ ID NO: 1735 - DNA, 1857 bp, H. influenzae strain 86-028NP
atgtctcaacttgccaatccagaactgatgaaagtcgttattttactcgcatctagcgtaacaattgtgccgttatttaaaagactcgggttggggagtgtgctaggttatttagtggcaggttgtttgattggtccatctgtctttggcatagtgcaagatccaacagctgtggtacatttagcggaattaggtgtggtaatgtttctttttattatcgggcttgaaatgtatccagaacgcctttgggcaatgcgtaaagctatttttggcagaggtttgttacaagttggattatgtggttgcttactcactttttcgggtatttatttattaggattaacaaaagaagtatcatttatcgctggtatgggtttcacgctttcctctactgctattgtaatgcaatcactagaagaaagggggcttacttctacgtcaaaaggacaacgcgtaatttcgacattaatttttgaagatattgctattgtaccacttttggcttctgtcgcttttcttgctccccattcgaaagaagcgacaccacatactgattgggtatcaattggtatagcattaagtgctgttgtggggttaattgtgactggaaaatggctaatgaacccactatttcgtttaatttctaaagcacgtattcgtgaaatgatgacagcgggcgcattattggtcgttttaggtgctgcattagcaatggaaattggcggactttcaatggcaatgggggcgtttgttgctggtgtgatgatgtctgaatcagcgtttcgccatcagcttgaagcggatatagaaccatttcgcggcttattactcggattattttttatgggcgtaggaatgtccttagatttgcatttagtgtttaatcattggatcttgctacttggaattgtttttctttatatacttggaaaagccagtgctgtttatattattgcccgaattacccgtcttgatcatcgagaagccataggacgaatgtctttgatggcacacggtggcgaatttgcctttgttcttttttcagccgcagcaactgcggaagtaatcagtaatgaagaacaagcgacattcactgctgcagtgattatttcgatgcttttttcgcctattattgctcaaattgctcgcaaacttatacagcgtacagagcctaaacatcttgatcaacttgatgaaaatgatctagacagcatcgtggatttggaagataacgttttagttattggttttggacgttttagtcaaattgtctgccaaacattattgattcgtggaattagcgtttcagtgattgatcgcaatatcgaaaatatccgtgctgccgcaaagtttggttttaaagtttattatggcgatggcattcgattagatgttttacgagccgcaggaattgaaaaggcgaaatgtgtcgtattaggtattaacgatacacaaagaattgaacatattgtcagtcaaatgaaagaggcttatccaaatttaccgattttaacccgaacttatgacagaaaaacaacagttagtttgattaagcaggatgtagattttattgtgcgtgaaacttttgaatcagcaattacacttagtcgagcaacattgatgaaattaggtattgataaaattgaagcggaagaaattattaaggaagtacgaacattggatcaagaacggttaaatgaagaagttttacacggtttttcgaatgaaatagtaaaaaaatattggacaccaagaccatttattaaaccgcatcttgatacaaaagcattaaataaagaaacagaagaaattctaagtgagaaaattgaagaagaaatatcaaatgatcattcataa

SEQ ID NO: 1736 - DNA, 765 bp, H. influenzae strain 86-028NP
atgaataataaaattagtgtttatgataaagataatttctttgagctttatcagaaactccgtgcaaatccaattagcctcaatgaaattatcgaaaagcccaccatgctttcattgttgcctaatttaaaagggaagaaattactcgatttaggctgtggtacgggagggcatttacaactttatttagaacgaggggcggctaaagtaattggaactgatctttccgaaaaaatgctcgaacaagctgaaaaagatcttcaaaagtgcggtcaattttcagggcgtttttccttatatcacttaccaatagaaaaattagctgagttaccagaaagtcatttcgatgtgattactagctcttttgcctttcattatattgaaaattttccgacattattatcaacgatccatgacaaactctcgtctaatggcacattaattttctcacaagaacatccgataactacctgccataaagagggagaacgctgggaaaaaaatgacaaaaaacagcaagtcgcttatcgtttaaatcattaccgagaagagggcgaacgcaatagaaattggttcaaacaaccttttcaaacctatcatcgaacaacagcaacaattatcaataatttaattcatgcaaggtttcaaattgagcaaatggaagaacccatgcttgctgaccaaccgcaatggcataatgaatttaaagatttatcacaccgaccaccattgttatttatcaaagcaagaaaagtggagaaataa

SEQ ID NO: 1737 - DNA, 756 bp, H. influenzae strain 86-028NP
gtggaggctcaaccccaacaaaaggaaaatattatggcacaagtttcaatgcgcgacatgatcaacgcaggcgtacacttcggacaccaaactcgttactggaacccacaaatgaaacctttcatttttggtgctcgtaacggtgttcacatcatcaatcttgaaaaaactttacctttattcaacgaagctttagcggaattaactcgcattgctagcaacaacggtaaagtattattcgttggtacaaaacgtgcagcgtctgaagcagttcaagcagcagcattagattgtcagcaatattacgtaaaccaccgttggttaggtggtatgttgactaactggaaaaccgttcgtcaatcaattaaacgtttaaaagatttagaaacccaatctcaagacggtacttttgataaattaaccaaaaaagaagcgttaatgcgtagccgtgagatggaaaaacttgaattaagccttggcggtatcaaagatatgggcggcttaccagatgcgttattcgttatcggtgcagaccacgaacatatcgctgttaaagaagcaaacaacctaggtattcctgtatttgctatcgttgatactaactcaacaccagctggcgtagatttcgttatccctggtaacgatgatgcgactcgtgctatccaactttacgtttctgcagctgcagcagcggttaaagaaggtcgtggtaacgaagctcaagttgctgaagaattagcagctgacgcagaataa

SEQ ID NO: 1738 - DNA, 852 bp, H. influenzae strain 86-028NP
atggctgaaatcacagcatcattagtaaaagaacttcgtgaccgtactggcgcaggtatgatggaatgtaaaaaagcattagttgaagcaaacggtgatattgagttagcaatcgacaatatgcgtaaatctggtcaagctaaagcagctaaaaaagcaggccgtgttgcagctgaaggtgttatccttgctcgtgtagaaaatggtttcggtgtattagttgaaatgaactgtgaaactgacttcgtagcaaaagatgcaggtttcttaggtttagcaaacgaagtagctgatttcgcagcagcaaacaaaggtaccactatcgaagcattacaagcgcaatttgaagaaaaacgtgctgcattagttgctaaaatcggtgagaacatgaatattcgtcgtgttgcttacctagatggtcaagtaattgcacaatacttacacggtgcaaaaattggcgtattagttgcgggcgaaggttctgctgatgaactgaaaaaagtagcaatgcacgtagctgcatctaaacctgaattcgtgaacccagaagatgtatctgctgaagtggttgaacacgaacgccaaatccaaatcgatattgcgatcaactctggtaaaccaaaagaaatcgcagagaaaatggttgaaggtcgtatgaagaaattcactggtgaagtttcattaacaggtcaagcatttgtaatggatccttctgtatctgtaggggatttcttaaaatcagtaaatacttctgtttctaacttcattcgtttagaagtaggcgaaggtattgagaaaaaagaagaagattttgctgctgaagttgcaaaaatcactggcggtaacgcgtaa

SEQ ID NO: 1739 - DNA, 1026 bp, H. influenzae strain 86-028NP
atgcaaaaatcctattctttacaagaattggcaactcaaatcggcgctaccgttcgcggtaacgccgatgttgttgttgagaatatcgcgcctctcgataaagcccaatcaaatcaactcacttttatttctaacgtaaaatttcgtgcattattgaaagattctaaagcagggattttggttgtctctgaagaggatgttgaacactgttctccagaaagcaatctacttattgttaaagatccttatgtggcttacgcaattttagcgcaatatatggatagcacgccaaaagcggcacaaggaatcgcaaaaagtgcggtcatttttgatggtgttttattgggcgaaaatgtatctattggtgcgaacgcagtgattgaagaaggtgttgtactaggtgataacgtgatcattggtgcaaattgctttgttggtaaaaatactaagataggttcaggcactcagctctgggctaatgtcactgtttaccataacgttgagattggagctaattgcttaattcaatcaggaacagttatcggtagtgatggttttggttatgcaaatgatcgtggtcgttggattaaaattccacaagtagggcaagtaataattggtaataacgttgagattggtgcgaatacctgtattgatagaggcgcattagatgccacgattattgaagataacgttattatcgataacctttgtcaaattgcacataatgttcatattggcactggtacagcggttgcgggtggcgttattatggcaggtagcttaactgttggtcgctattgcttaattggtggtgcaagtgtgattaatggtcatatggaaatttgcgataaagtaaccattactggaatgggaatggttatgcgcccaattacagagcctggcgtatattcctctggtattccattgcaaacgaataaagaatggcgtaaaacagcagcactaacgttaggtattgatggaataaataaacgtttaaaagcgttagaaaagaaaatttcttaa

SEQ ID NO: 1740 - DNA, 594 bp, H. influenzae strain 86-028NP
atgaaaaacatcgcaaaagtaaccgcacttgctttaggtattgcacttgcttcaggctatgcttccgctgaagaaaaaattgctttcattaatgcaggttatatttttcaacatcacccagatcgccaagcagtagcagataaacttgatgctgaatttaaacctgtagctgagaaattagcagcaagcaaaaaagaagttgatgataaaattgctgctgctcgtaaaaaagtagaagcaaaagttgcggctttagaaaaagatgcacctcgcttacgtcaagctgatattcaaaaacgccaacaggaaattaataaattaggtgcggctgaagatgctgaattacaaaaactaatgcaagaacaagataaaaaagttcaagaattccaagctcaaaatgaaaaacgtcaagctgaagaacgtggtaaattattagatagcattcaaactgcgacaaataatttagcaaaagcaaaaggttatacttatgtgcttgatgcaaattcagttgtatttgcggtagagggtaaagatattactgaagaagtattaaaatctatccctgcttctgaaaaagcacaagagaaaaaataa

SEQ ID NO: 1741 - DNA, 2403 bp, H. influenzae strain 86-028NP
atgaaaaaacttctaatcgcaagtttattattcggtacgacaacgactgtgtttgccgcaccttttgtggcaaaagatattcgtgtggatggtgttcaaggtgacttaaaacaacaaatccgagcaagtttacctgttcgtgccggtcagcgtgtgactgacaatgatgtggctaatattgtccgctctttattcgtaagtggtcgattcgatgatgtgaaagcgcatcaagaaggcgatgtgcttgttgttagcgttgtggctaaatcgatcatttcagatgttaaaatcaaaggtaactctattattcccactgaagcactaaaacaaaacttagatgctaacgggtttaaagttggcgatgttttaattcgagaaaaattaaatgaatttgccaaaagtgtaaaagaacactatgcaagtgtaggtcgctataacgcaaccgttgaacctattgtcaatacgctaccaaataatcgcgctgaaattttaattcaaatcaatgaagatgataaagcaaaattggcatcattaactttcaaggggaacgaatctgttagtagcagtacattacaagaacaaatggaattacaacctgattcttggtggaaattatggggaaataaatttgaaggtgcgcaattcgagaaagatttgcagtcaattcgtgattattatttaaataatggctatgccaaagcacaaattactaaaacggatgttcagctaaatgatgaaaaaacaaaagttaatgtaaccattgatgtaaatgaaggtttacagtatgaccttcgtagtgcacgcattataggtaatctgggaggtatgtctgccgagcttgaacctttactttcagcattacatttaaatgatactttccgccgtagtgatattgcagatgtagaaaatgcaattaaagcaaaacttggagaacgcggttacggtagcgcaacggtaaattcagtacctgattttgatgatgcaaataaaacattagcgataacccttgttgttgatgctggacgacgtttaactgttcgccaacttcgctttgaaggaaataccgtttctgctgatagcactttacgtcaggaaatgcgccaacaagaaggaacttggtataattcacaattagttgagttaggaaaaattcgcttagatcgtacaggtttcttcgaaacagtcgaaaaccgaattgatcctatcaatggtagcaatgatgaagtggatgtcgtatataaagtcaaagaacgtaacacgggtagtatcaactttggtattggttacggtacagagagtggtattagttatcaagcaagtgttaaacaagataatttcttaggaacaggggctgcagtaagtatagctggtacgaaaaatgattatggtacgagtgtcaatttgggttataccgagccctattttactaaagatggtgtaagtcttggtggaaatgttttctttgaaaactacgataactctaaaagtgatacatcctctaactataagcgtacgacttatggaagtaatgttactttaggtttccctgtaaatgaaaataactcctattatgtaggattaggccatacctataataaaattagtaactttgctctagaatataaccgtaatttatatattcaatcaatgaaatttaaaggtaatggcattaaaacaaatgactttgatttttcttttggttggaactataacagccttaatagaggctatttcccaactaaaggggttaaagcaagtcttggtggacgagttactattccaggttctgataacaaatactacaaactaagtgcagatgtacagggtttctacccattagacagagatcacctctgggttgtatctgcaaaagcatctgcaggatatgcaaatggttttggaaacaagcgtttaccgttctatcaaacttatacagcgggtggcatcggttcattacgtggttttgcttatggtagtattggacctaacgcaatttatgccgctcaaaatggtaatagtaatagtaatagtaatggtacttttaataagataagttctgatgtgattggtggtaatgcaatcacaactgcgagtgcagaacttattgtaccaacaccgtttgtgagcgataagagccaaaatacggtccgaacttccctatttgttgatgcggcaagtgtttggaatactaagtggaaatcggataagagtgggttagataacaatgtattaaaaagcttacccgattatggcaaatcaagccgtattcgcgcctctacaggtgtcggattccaatggcaatctcctattgggccattggtattctcttatgccaaaccaattaaaaaatatgaaaatgatgatgtcgaacagttccaatttagtattggaggttctttctaa

SEQ ID NO: 1742 - DNA, 1332 bp, H. influenzae strain 86-028NP
atgtcatttttgtggtcactaggttcttttatcattgcgattgctgtattagtatccgttcacgaatatggtcacttttgggcagcgagaaagtgcggtataaaagtccatcgtttttccattggttttggaaaagtaatttggaaacgcattgacaaatatggtacagaatttgcggtttcaatgattcctttaggcggctatgtaaaaatgcttgatggacgtaatgaagtagttcctgctgagcaaaaatcacaagcatttgacagtaaaagcgtattacaacgcgcatttgtaattattgcaggccctttagctaattttatttttgcaatttttgcttattggatcatctacctttatggaatgccaacggttaaaccagtgattcaatcaataacaccaagttccatcgcagcacaagctcacattgaacctaatacacaaattctagcggttgatggcgaagaaactcaagattgggaaaccatcaatatgctacttgccacaaaaatgggtgagcctaatgttgaaattaccctttctcctttcaattctaatattgaacaacaacggactttaaatcttacaaattggatattcgatcctgaaaaagaaagtgcttttgaggcattagggattatgcctatgcgccctaaaattgaaatggtgctttctaaagttgttcaaaattctcccgctgagaaagctggtttacaaatcggtgataaaattttaaaagaaaatttaaccgcacttccttggcaagattttataaaacaggtcgaacaaggcgaatctttttctattaaagttgaacgtaatggagaaacatttgacaaagtcctaactccagtgcgtaatcaaaatggcaaatggtttgttggggttagcccaaccttgacaaaattagcggatgaataccgtactgaattaaaatatggtattcttgaatctttacaaaaaggcattgaaaaaacagggcagctttcccttttaaccttgaaaatattagggaaattacttactggcgatttgtcattaaataatttaagtgggccaatttctattgcaaaaggtgctggtgcatcagcaaatattggattggtgtattttttaagttttatggcattgattagtgtaaatttagggattatgaatttatttccattaccagtattagatggcggtcatttagtttttttaacaatggaagctgttaaaggaaaacctgtttctgagcgggtgcaaagcatctgttatcgaattggcgcagcactgttattaagcttaacggtgtttgcattatttaatgattttttacgtctataa

SEQ ID NO: 1743 - DNA, 867 bp, H. influenzae strain 86-028NP
atgcttaaacaacgagttttatctgctattgtgttaattgctgcagttttatgtgcgctatttttattcacgcctttttattttgccctcgctttaggggcggtagcgattttaggcatttgggaatggactcaatttgctcgccttaaacaacctttgatacgtttttttgtggctacctttttaggcgtatttatcttcttatggctctatactgagggcaactatttagatgcagggcgtgtgtttgaacaacatcttcagcttttattgataaatgctgttagctggtggggtttagctttgttgcttgtgatcagttatcctaaatcagctaaattttggtctaaaaatccacttttacaacttttatttgccttttctacgttgattccatttgtcgcaggtgtattacgtttacgtttagaacactatacccatgatccttatcacggcttatttttattactttacgtatttatacttgtttgggcggctgattctggtgcttattttagcggacgcgcctttggcaaacgtaaacttgcccctaaagtatcgccaggtaaaagttgggaaggggtcattggtggattaattacagcattagtgctttcttttatctttattcatttctctaacaatactttagtaggcgatcgaaatattactggatttatcattctttctgtagcgacagttgcaatttcagtattgggcgatttaactgaaagtatgtttaaacgtgagtcaggagttaaagacagtagccaattgattcctggtcacggcggtgtgttagatcgcattgatagcttgactgccgcagtaccttttttcagctatttctatttctttgtcttataa

SEQ ID NO: 1744 - DNA, 720 bp, H. influenzae strain 86-028NP
atgatagagttggatcaaacaaatataccaaaacacgttgccattattatggatggtaatggccgttgggcaaaacagaaaaataaaatgcgaattttcggacacgccaatggcgttactgcggtacgcaaagcagtggcttatgcacgacaaatcggtgtggaagtactcacactttatgcctttagtagcgaaaattggagtcgcccagaacaagaaatcagcgcgttaatgtcgctttttatgcaagccttggatcgcgaagtgaaaaaattacataaaaataatatttgtctgaaaattataggcgatgtatctcgttttagtgaaactttacaagaaaaaatcaaaaaagcggaaaatttaacagaaaaaaataccgcacttacactcaatattgcggcaaattacggcggttgttgggatattattcaagccgctaaacaaattgcagaaaaagttaaaaaagaagaaatgtcagtttcagatattaataactcgacttttcaacatcatcttgcaacccaaaatgcaccacctgtggatttattaattcgcaccagtggagaacagcgcataagcaactttttattatggcaaattgcctatgcggaattatatttttccgatgtgctttggcctgattttaatcaattagaatttaatcacgcgattgcaagttatcaacaacgtcatcgccgttttggcgggactgaatag

SEQ ID NO: 1745 - DNA, 2586 bp, H. influenzae strain 86-028NP
atgcaagaacaatatcgccccgatatgatcgaaccaaaggttcaacaatattgggcagaaaataaagttttcaaagcaatcaaagacgaatctaaagaaaaatattactgtctttctatgttcccatatccttctggtcgcctgcatatggggcacgtgcgtaactacactattggtgatgtcatttctcgttatcaacgcatgctaggcaaaaacgtattgcaaccatttggttgggatgctttcggcttacctgcggaaggggcagcaattaaaaataaaaccgcaccagcaaaatggacttacgaaaatatcgcctacatgaagaaacaacttcaacttttaggctttggttttgactgggatcgtgaaatcgcaacctgtaaaccagaatactacaaatgggaacaatggttcttcactgagctttacaaaaaaggcttagtgtacaaaaaaacctcaaccgtaaactggtgtccgaatgatgaaacagtactcgcaaacgagcaagtacacgaaggttgttgctggcgttgtgatacaccagtggaacaaaaagaaatcccacaatggtttatcaaaattactgactatgccgagcaattattaggtggtttagatgcccttccacaatggcctgacatggtaaaaaccatgcaacgtaactggattggtcgctctgaaggggtagaaattacctttgatgttgcaaataccaacgaaaaagtagcagtttacaccacgcgtccagataccttttacggcgtgagttatttaggcattgcagcggcacatccattagcaagtttagcagctcaaaacaattccgaattagccgcctttatccaagaagcgaaaaacgccaaagtggcagaagctgatcttgcgacaatggagaaaaaaggaatggcaacgggcttatttgctattcatccattgacgggcgaaaaattaccgatttgggtcgctaatttcgtgttaatgcactacggtactggcgcagtaatggcagttcctgctcacgaccaacgtgactttgaatttgctcaaaaatacagtttacaaatcaagcaagttattgaacccattgcagatgaagaaattgatttaactaaacaagctttcgttgagcacggtaaattagtgaactcagctgaatttgatggtaaagactttgatggtgcattcaacggtatcgcggataaattagaaaaattaggtgttggaaaacgtcaagttaattaccgtttacgtgactggggcgtttctcgccaacgttattggggtgcgccaattccgatgctaacccttgaaaatggcgatgtagtacctgcaccaatggaagatttacctattattctgcctgaagatgtggtaatggatggcgtaaaaaacccaattaaagcagatcctaactgggcaaaaacaacccttaacggcgcaccagcgttaaaagaaacggatacctttgatacctttatggaatcctcttggtattacgcgcgctacacttgtccacaatatcaaaatggcatgcttgatgcggaagaagcaaactattggttaccagtggatcaatatatcggtggtattgaacacgcaacaatgcacttactctacttccgcttcttccacaaattattgcgtgatgcaggatttgtaaccagtgacgaaccagccgataaattattatgtcaaggtatggtgcttgcagatgccttctactacacaagtccaaccaatgagcgtatttgggtaagtccaacactggtgactcttgaacgtgatgaaaaaggcagaattattaaagccaccgatcctgaagggcgtgaattagtccacagtggcatgaccaaaatgtcgaaatccaaaaataacggtattgacccacaagaaatggtagaaaaatatggtgccgatactgttcgcctctttatgatgtttgcctctccagcagaaatgaccttggaatggcaagaatctggcgtagaaggggcgaaacgtttcttagggcgtgtttggaatttggtatatcaatatcaacaaaatccagcaaaaactagcctagatatcaccgcactttccgcagaacaaaaagtgcttcgtcgtgaagttcataaaaccattgcgaaagtgagcgatgatattggtcgtcgtcaaacatttaatactgcgattgctgcagtgatggaattgatgaataaactgactaaggcatcgcttgatagcgagcaagatcgtgcagttatggcggaggcattaagtgcagttgttcgtatgctttatccaattacgccacatatctgttttgaattatggcaagctcttggcaatgaaagtgctattgatactgcagaatgggtaaaagccgatgaagccgcaatggtagaagatgaaaaactgattgttgtgcaagtaaatggcaaggttcgtggcaaagttactgttgcggcagatgcagatgaagacacagtcaaaacgattgcttttgcggatgaaaatgtgaagaaatttattgataatcaacacattgtcaaagtgatttatgtcgtaggtaaattattaaacgtggtagtgaaaccataa

SEQ ID NO: 1746 - DNA, 549 bp, H. influenzae strain 86-028NP
gtgaaatatttacattttacacgtcctacaataaaggtaatttttatgatcaactcaatcaagactttactgcttatcgcaacattagcaattctttctgcttgcggttggcattttcagcagtcggttactatgccaaatgaatggcgaacattagcccttgaaagtgatgactcttataatgattttactgttattatgcgtcgcaaattgcaggaaaatcaggttaatgtcgtcaatttagaacaaaatattcccattttacgtattaataaacagattacttcagatcaagttgcgtctatttttaagcacggacgtgaggcagaaaaacttttaatgttggaagtagaagccactttccgccttgctaatggcgaaagctatccaatcaatgcgaaagtaaaccgtactttctttgataatgcacgtgcagcattagccaaatcagaagaacgagaggtaatttggaatgatatgcgcgagcaagtagcgcgtcaattaatcgtaaaaataattgcgttacaaaatcaaataaaaaggaaataa

SEQ ID NO: 1747 - DNA, 1035 bp, H. influenzae strain 86-028NP
atgaaccgcatttttccagagcaactaaatcatcatcttgcgcaaagcttggctagagtttatctcttgcaagggcaagatcctttattacttagtgaaactgaggatacactttgtcaagtggcaaaccagcaaggttttgatgaaaaaaatactattcaggttgatagccaaactgattgggcgcaacttatagaatcttgtcaatctatagggttgttttttagtaaacaaatactaagcttgaatttacctgaaaatttcaccgcacttttgcagaaaaatctgcaagaacttatatccgtattgcataaagatgtcttgcttattttacaggtagcaaaattggctaaagggattgaaaagcaaacgtggtttattacacttaatcaatatgaaccaaatacaatactgataaattgtcaaacaccgacggtagaaaacttaccacgttgggtaaaaaatcgtaccaaagcaatgggattagacgctgacaatgaagcaattcagcaactttgttatagttatgaaaataacctgctcgcactcaaacaagctctgcagcttttagatttgctctatcctgaccataaacttaactacaatcgtgttattagcgtggtggaacaatcctcaatttttacaccatttcaatggattgatgcgttgcttgttggaaaggcaaatcgtgctaaacgtattttaaaaggtttacaagctgaagatgtgcaacctgttattttattacgcacactacagcgagaattatttacgttgcttgaactaacaaaaccacagcaacgtattgtgacaacggaaaaacttccaattcaacaaattaagactgaatttgaccgtctaaaaatctggcaaaatcgccgaccgctctttttaagtgcgattcaacgtttaacttaccagactctctacgaaattatccaagaactcgctaatattgaacgtctaactaaacaagaatttagtgatgaagtgtggatcaaactcgctgatttatctgtaaaaatttgtttgtag

SEQ ID NO: 1748 - DNA, 2169 bp, H. influenzae strain 86-028NP
atgacaacccaaaacttccttgtagaaatcggcacagaagagctgccaccaaaagctctcaaaacattagcgacctcttttgcggataacgttgaggcggaattgaatcaagcaggtttatcattcgataaaatcgaatggtttgcggcaccgcgtcgtttagccgtaaaagtgttgaacttagcaacccaacaaccgagcaaagaaatcgaaaaacgagggcctgcagtatcagccgcctttgatgcggaaggtaaaccaactaaagcggcagaaggctgggcgcgtggttgtggcattactgttgagcaagcagaacgcattgcaactgataaaggcgaatggctcgttcaccgtacaaaaattaaaggtcagccgaccaaaaacttacttaacgatattgtggcaaatgcgttagcgaaattgccaattccaaaaccaatgcgttgggcagataaaaccgtgcaatttatccgcccagttcacactgtgactatgttgttaggtgatgagttaatcgaaggcgaaattttaggtgtggcaagtgctcgcaccattcgcggtcaccgcttcttaggcgagaaagaatttgacattcaacatgcagaccaatatccgcaattattgcgtgataaaggttctgtggtggcagatttcaatgagcgtaaagcagaaattttggcaaaatctcaagcaaaagcgaccgcacttggtggcgtggctgacattgaagaaagcctgcttgaagaagtcacttccttggtggaatatccaaatgttttagcggcaaaatttgaagaacgcttcttagcggtgcctgcggaagccttggtttacaccatgaaaggagaccaaaaatatttcccgatttatgataaagacggcagattattaccgcactttatctttgtctcgaacatcaacccagaagatccaaccgcgattatcgaagggaacgaaaaagtggttcgtccacgtttaaccgatgcggaattcttcttcaaaaccgacttaaaacaaaaactggttgatcgtttaccacgtttagaaaccgtgttgttccaacaacaacttggcacattgaaagacaaaactgaccgcattgaacaacttgcaggcgaaattgcaaaacaaatcggcgcagatgaagcgaaagcaaaacgtgcgggtttactgtcaaaatgtgatttgatgaccaacatggtattcgaattcactgatacgcaaggcgtaatgggtatgcattatgctcgtcacgacggtgaagatgaagaagtggcagtggcgttaaacgaacaatatatgccacgctttgcgggtgatgaattacctaagtctttagtggcaagtgcggtcgctttagcggataaatttgacaccttaacgggtatcttcggcatcggccaagcaccaaaaggtagcgcagacccatttgcattacgtcgtgcggcattaggtgcattacgtattatcgttgagaaaaatttgcctcttgatctgaatgacattattagcaaagcatttgatttatataaagaacttgataacgaaagactacgtaatgcacctattgccaaaacaagaggtggatttagtgaatacccagaaggttatgtttcattctttacacgtggtgatgatttagttccaaaacaaaaaatccttgatgaggtagtagacttcatgctcggtcgtttccgtgcatggtatcaagatgaaggcattgcggtggatgtaattcaagcggtattggcacgtcgtccaactcgccctgctgattttgatgcgcgcgtgcgtgcggtttcacacttccgtactttagattcagcggaagcgttagcagcagcaaataaacgtgttagcaacatcttagcgaaagcaggtgcggcaattggcgagatcaatttaaccgcttgcgtagagccagcagaaaaagcccttgctgaagcggtactggcattacgcactgaagtacaaccgcttatcgcacaaggcgattacaccgcagtattggataaattagcaaacttacgtgcgccagtagacagtttctttgataacgtgatggtaaatgctgaagatccagcactacgccaaaaccgattagcgattttaaatacgttacaagggttattcttacaagtagctgatatttcagtgcttcaataa

SEQ ID NO: 1749 - DNA, 417 bp, H. influenzae strain 86-028NP
atgacattacagaaatttttgttacccccattattatttttatcaataaatacctttgcagcaccagcatatttgctttttggtggagataatcatgataaatttttaggctgtttgaactgtagtaaacatgataactcatcaatttggaataaatatggtgaattcggctctaaatataatagcgatagtatttggaataaatacggaacttatggctctaagtataacagtgaaagtccttggaataagtattctacaagtgggccagtgattgttgataatgaaggtaacttttatggtaaattcacaactaataagtatgataatcagacaagaattaaatctcttctttggattttagaaaatcatgaatatattattgaaaatattaatgatgtgatagataaaatgtaa

SEQ ID NO: 1750 - DNA, 366 bp, H. influenzae strain 86-028NP
atgcaaccctatgaaaaatacttaaagctgaattcgcagaaactgcgagcggatcaaacggatacagaaagaaagctatggcaacgcatcaatcgagatcaattattaggatttcgatttaatcgacaaaagccacttttaagttatatcgttgatttttattgtgcaaagacaaagctgattattgaattagatggtagtcagcactataaacctgattatcaggaaaaagatgcattgcgagatgcagaattaaattcacttggttttacagtgatgcggtttagcaatgatgaagtcatgcgtgaaattgaagcggtagtagagcagatttatttgtttttagagaatgtaaggactgattga

SEQ ID NO: 1751 - DNA, 261 bp, H. influenzae strain 86-028NP
atgagcaaacccattcttttttatgcagaaacatgcccagataccgcgccatttgtcgcggagttggatcgcttaggtgtggattacgatgaagtagaaattatgacttcattacctaatctcaaacaattcattcgtttacgcgatagcagtgcagaatttgataactcgaaagcaaatggctatttaggcattcctgcattgttattaccaaatggcgatgttgttttagacctatcaaagttaaaagtaattttttaa

SEQ ID NO: 1752 - DNA, 909 bp, H. influenzae strain 86-028NP
atgagtacaaaatttaacgtaaaaacattccaaggtatgattttagccctgcaagaatattgggcaaaccaaggctgcaccattgtgcaaccttttgatatggaagtgggcgcaggtacttctcacccaatgaccgcattgcgcgcattaggcccagagccaatggcatttgcttatgttcaaccttcacgccgcccaacggacggtcgctacggtgaaaacccaaaccgtttacaacactactatcaattccaagtagtgatcaaaccttctccagataatattcaagaactttatttaggctcgcttgaaatgctcggtttcgatccaacacaaaacgacatccgtttcgtggaagataactgggaaaacccaacattaggtgcatggggcttgggttgggaagtatggctaaacggtatggaagtaacccagtttacctatttccaacaagtgggtggcttagaatgtaaacccgtaacaggtgaagtgacttacggtttagagcgtttagcgatgtacattcaaggcgtagattctgtgtatgacttagtttggtctgacggtccattaggcaaaaccacttatggcgatgttttccatcaaaatgaagttgagcaatcaacctataactttgaacacgcaaacaccgatttcttattctactgcttcgatcaatacgaaaaagaagcacaagagttattagccttagaaaaaccgttaccattgccagcttatgaacgtattttgaaagcagcacacagctttaacttattagatgcgcgtaaagcaatttcggtcaccgaacgccagcgctatattttacgcattcgtgccttaaccaaaggcgtggcggaagcctattatgcaagccgtgaagccttaggtttcccaggttgtaaaaaataa

SEQ ID NO: 1753 - DNA, 1527 bp, H. influenzae strain 86-028NP
atgagttctcaatgtcctttctcgcacttagctgcaacaaacttaacaatgggtaacggtgcacccgttgctgataaccaaaacagcttaacagctggtccgcgtggtccattacttgcacaagatttatggcttaatgaaaaattagctgatttcgtacgtgaagtgatcccagagcgtcgtatgcacgctaaaggttctggtgcatttggtacttttactgtcacacacgatattactaaatatactcgtgcaaaaatttttagtgaagtgggtaaaaaaacggaaatgttcgcacgttttactaccgtggcaggcgaacgtggtgcagcagatgctgagcgtgatattcgtggttttgcattaaaattctatactgaagaaggtaactgggatttagtaggtaacaatacgccagtattcttcttacgtgatccacgtaaattcccagatttaaataaagcagtaaaacgtgatcctcgcactaatatgcgttcagcaactaataactgggatttctggacattattaccagaagcattacaccaagtcactgttgtaatgagtgatcgtggtattccagcaagttatcgtcatatgcacggtttcggttctcacacttatagtttctggaacgaagcgggcgaacgtttttgggtaaaattccacttccatacacaacaaggcatcaaaaacttaactgatgcagaagcggctgcagtcatcgcaagtgatcgtgaaagccatcaacgtgatttatatgaagcgattgaacgtggtgatttccctaaatggacattatttgtacaaattatgccagaagcagatgcggaaaaagtgccttaccacccgttcgacctaaccaaagtgtggccgaaaaaagattatccgttaattgaagtcggcgagtttgaattaaaccgtaacccagaaaacttcttcgctgatgtagaacaatctgcatttgcaccaagtaacttggttccgggtattggcgcaagccctgacagaatgttacaagctcgtttatttaactatgcggatgcacaacgttaccgtttaggtgtgaactaccgtcaaattccagtaaaccgtccacgttgccctgttcatagcaaccaacgtgatggtcaaggtcgtgtagatggtaactacggtagcttgccacactacgagccaaacagcttcagccaatggcaacaacaaccagactttgctgaaccaccacttcgtatcaacggagatgcagcacactgggattatcgtaacgatgataacgattacttcagccaacctcgtgcattatttaacttaatgaatgcagatcaaaaacaatcattattcaacaacacggcagcagcaatgggcgatgcgcctgatttcatcaaatatcgtcatattcgtaactgccactggtgtgatgccgcatacggtgaaggcgttgcgaaagcattaggtttaaccgttgaagatgcattaaaagctcgtgatactgatcctgcattaggtcaaggtggattgttataa

SEQ ID NO: 1754 - DNA, 1182 bp, H. influenzae strain 86-028NP
atgaaacgtgtaactgggtttcctactcgaccaaatatggtgcaacagctacttaatgttggatttgattattataacttgccttccagtgatggatctcattattggtctgataatgttgcctatgaatttaccttagcggaaattgatcgcattgaggatacaactaatgaattgcattcaatatgtttagattttgcggcggatgaaattaaaaaaggcgattatgaaaattatcattttacggagttgcaaaaacagcttgttgaaacctcttggcgtaatcaagatccttatttatatggacgctttgattttggctatgatggcaacaacctaaaaatgtttgaatataacgccgatacaccaacatctttgttggaggcagcgattgtccaatggcagtggttggagcaaattgagggcttgaaacatcgtgatcaatttaactggattcatgaagaattaataaaacatttccaatttttgaaacaacaaagtggcaaaacagatttccatttgagtgccatgcaggatgctggccgtgaagattggggcaatgtggattatttagctgatgtggcttataacgcaggttggaatattcatcaattagcggtggaagatattggctataacagcgaaacaaaaaaatttgtagatttaaatgatcaacctattgaaatgttatttaaattgtatccgctagaatggctaagccacgctgagtttgctcgccatattacaacggctgaaacacgatttattgaaccagcgtggaaaatgttgttaagtaataaagcactattggcaaaactttgggcgcgttatcctaatcatccgaatttattgcctgcttattttacgccttttgaattaccaaaagatttattgatgtgggtgaaaaaaccattgttaggtcgagaaggtgccaatgttttctattatgagaaaaataatggtgtagaatttgcagcgaaaggaagcgaacactcaacgttttatgctaattcaggttatgtttatcaacaaaaatttgaattgccaagttttgatggaatgtatccaattatcggctcttgggttgtgggggatgtggcttgcggtatgggattacgcgaagattttactgcagtgacggggaatgatagccattttatacctcattattttgtgccatga

SEQ ID NO: 1755 - DNA, 582 bp, H. influenzae strain 86-028NP
atgaaaaagaaaaatcagattttagttagtttatctattgtggccttattaggaggctgttcagaagagcaagtacaacgtgatgtgtatcagtctttagacgattgtttagcggattggaaaaaaattgagctttgtgaggcagataaaaatactgaaagtactcagaaaactgaaactacaccacagcaggggcttggtttaaatattcgtgataatggtaatgcagaaagtgcggtaaaaaatccagctgaaaataatgtacaagctaatcaaagcgagaacaatgctgaatcaactgcaaaagctgaaagtaccgatccttctttaggagccgcaattgctggtggcgttatagggtatatggcggctcgtgcaattagtagtttccttggcccaagctatcatcctggaaatcgagctgtcaccacaccaacagggcaagttgtgcaacctcaaacgaatcgttctgttggaaaaccaatgctcgtgaaaggaaatgcaggaagcatgaatagcaaacctgtatctcgtggtggttttagtagcccaaataatactcatcgtagcagtgggggctaa

SEQ ID NO: 1756 - DNA, 453 bp, H. influenzae strain 86-028NP
gtgtttttatatctaatatttaaaggaaagagaatgttacatttaactttagaggacgaactctttttaggaacgccaaagcaagtgggaacacattcgacagtatttgagcattttgccgtaatgtttgaagatgacggcgaaactggctatttttatgcgctcgatatgcgtcaaaatgctcaaccgatagtggatatgttgcacgtgtataatgttgattcaacctctaatcatcatgaagcacgcaaacttgaaatttgttgggatgagagtggttatttagccttgttgcttattaatggctatcctcatgctgtatttgattttgcccgtttagtcggctataacagcaataaatatccacaaccagatttaatgagtatgtggactcgtgaagaaattactaataaacaggctgagcaatggctaggcgtgaaaaccattcgataa

SEQ ID NO: 1757 - DNA, 1311 bp, H. influenzae strain 86-028NP
atggcaaaaatcgttaaagtgattggtcgcgaaatcatcgactcacgcggtaatccaactgttgaagctgaagttcatcttgaaggtggttttgttggtttagcagcagctccatctggtgcatcaactggttctcgtgaagcattagaattacgtgacggcgacaaatctcgtttcttaggtaaaggcgtattaaaagctgtggcggcagtgaacaacgaaattgcacaagctatcgttggtaaagatgcaacaaaccaagctgaaatcgaccaaatcatgatcgatttagacggaaccgaaaacaaatctaactttggtgcaaatgcaatcttggcggtatctttagcaaacgcaaaagcagctgcagcatctaaaggtttaccactttacgcttacattgcagaattaaatggcactgctggtgtttattctatgccattaccaatgatgaacatcattaacggtggcgaacatgcagataacaacgttgatatccaagaattcatgattcaaccagttggtgcgaaaacattacgtgaagcacttcgtatcggtgctgaagtattccacaaccttgcaaaagtattaaaatctaaaggcatgagcactgcagttggtgacgaaggtggtttcgcaccaaacttagcctctaacgcagacgctttagcctgtatcaaagaagcagtagaaaaagcaggttatgtattaggtaaagacgttactttagcgatggactgcgcatcttctgagttctataacaaagaaaatggtatgtacgaaatgaaaggtgaaggtaaatcattcacttctcaagagttcacacactatcttgaagaattaactaaacaatacccaatcgtgtctatcgaagatggtcaagatgaatctgactgggaaggttttgcataccaaactaaagtgttaggcgaccgtgttcaattagtgggcgatgatttattcgtaactaacaccaaaatcttaaaagaaggtatcgaaaaaggtatcgcaaactctatcttaatcaaattcaatcaaatcggttctttaactgaaactttagcagcaattaaaatggcgaaagatgcaggttacaccgctgtaatctctcaccgttcaggcgaaactgaagatgcaactatcgctgatttagcggtgggtacagcagcaggtcaaatcaaaactggttctatgagccgttctgaccgtattgcgaaatacaaccaattaatccgtatcgaagaagcattagaacgcgctggtactccagcagcattcccaggcttaaaagcggttaaaggtcaagcgtaa

SEQ ID NO: 1758 - DNA, 1206 bp, H. influenzae strain 86-028NP
gtgagccaatattctgaaaatattattattggtgcgggtgcggcaggattattttgtgccgcacaattggctaagctaggcaagtcggtaacagttttcgacaacggcaaaaaaatcggacgtaagattttgatgtcgggcggtgggttttgtaatttcaccaatttagaggttacgccagctcattatctttcgcaaaatcctcatttcgtcaaatcggcactagctcgttataccaactgggattttatttctttagtggcggagcaagggattacttatcacgaaaaggaattggggcaattattttgcgatgagggtgcagaacaaatcgttgaaatgctgaaatctgaatgcgataaatatggtgctaagattttattgcgtagcgaagtttctcaagttgaacggattcaaaatgatgaaaaagtgcggtttgttttacaggtaaattcaacccaatggcaatgtaaaaatttgattgttgcgacaggtgggctttctatgcctgggcttggcgcaacgccatttggttatcaaattgcggaacaatttggcattcctgttattccgcctcgtgcgagtttagtgccttttacttatcgagaaacagataaatttttaaccgcactttcaggtattagcttgcctgtcactatcacggcactgtgcggaaaatctttttacaaccagcttttgtttactcatcgtggtatttcaggccctgcggtgttacaaatttctaattattggcagcccactgagtcagtggaaatcgatttattaccgaaccacaatgtggaagaggaaattaatcaagcaaaacaacattcaccaaaacaaatgttgaaaaccatcttggttcgattattgccgaaaaaattggtcgaactttggattgaacaaggcattgtgcaagatgaagttagcgctaacatcagcaaagtgcgggtaaaaaatctggtggattttattcatcactgggaatttactccaaatggcacagagggctatcgtacagctgaagtcacaatgggtggggtggatactaaagtaatttcttctaaaacaatggaaagcaaccaagtcagcggtttatattttattggtgaagtattggatgtgacgggctggctcggtggttataacttccagtgggcgtggagctcggcttatgcctgcgctctaagtatctcaagacaataa

SEQ ID NO: 1759 - DNA, 1143 bp, H. influenzae strain 86-028NP
atgaaaagcctattagatatttttactcgagttcaaaaaacatttgtttttgcaaccgcacttttattcgcattttccttgtttactcaagcggaaatggtggatacctatcaattccaaaatcaagatgatcgtactcgtgccgtagagttggcaaaatctttacgctgcccacaatgtcaaaaccaaaatttggtggaatctaattctccaattgcttatgacttgcgtcttgaagtgtacaaaatggtggatgagggcaaaagcaatcagcaaattatcgataaaatgacggctagatttggtgattttgtgaattacaaaccgccattcaaatggaatacggcgttgttatggttattgccagtcgcccttttaattctagctgcagtattgctttatttctcaaataggaaaaaacagttttcagaaaaagtggttgcacaacaactagagaatgatgaaataatttccctcccctcaacctttggcagctccccccgcaagcaaggggagccaagtaaactttctaagggaaaagtgaatagcaaaatttattttgtgctttttactttactcatcgctattccagctacttattatttttcccttgatcgttttagtcgtgttcaacaaggcgagcaatcgatgattgagcaacataatcaaaatgttgaaatgaatgatgaacacaaaaatgaaaatgtgattgagaagctccaaaataaactgcgaactgatccgaataatgcggaaacttggcttcaacttggggaagcctatgtgcagaataatgaatttgatagcgcgcttgtggcttattctaatgcggaaaaattgtcgggaagtaaacctaatattttaggcttggcagccaccgcactttattatcaagcaggtcagcaagtgaccccaaaagtcgagcaacttttgaatgaagctttggcaaaagataaaaatgaagtatctagtctttctttgttggcgacaattgccttagaaaatcgccaatatcaacaagccggtatgtatttacagcagttattagattcaggtaatgcggcagtggatcgtcgttcagttattcaacgaatgaagatgttggattttttacaacgtggtgaaaaaggacaaaatccgtga

SEQ ID NO: 1760 - DNA, 531 bp, H. influenzae strain 86-028NP
atgaacaaaaaacttctcttttttgcaccgctctttgtgcttttaggcgtgtgtgtattattaattgctgggttaaatcaagatccgaaaaaaattgcgtcggctttaattgataaacccgttccagagttttatcaggctaatttacatgatccatcacaaatcgtaagcccgaaagattttcctaaacagccatttttattaaatgtgtggggcagttggtgtggttattgcaaagaagaacatccgttgttaattgagattgcaaaaacgttgcctattgtgggtgtagattatcgcgacaatccgcaaaatggtattgaaatacttaagagaatgggcaatccgttcatcttaactattgatgatagtcagggagaacttgccctcaaattaggcgtggatggtgcgccagaaacttatcttgtggatgaaaatggtgtgattcgttatcgccattctggtttattggataaagaaacttggcaaacggtatttttgccaaaaattgaagcattgaagaataaatga

SEQ ID NO: 1761 - DNA, 1908 bp, H. influenzae strain 86-028NP
atgcttccagaacttggctttttccttcttttactcgcaacagctagcgcgttttttcttgcgttagtgcctcaatttgggttgttcaaaaaaaattcgactttaattaatgctgcttggccgcttagttatatttttacccttgcgacgacgttctcaattggtttgcttacttattcttttgcggtggatgatttcacccttgaatatgtagcggcacattccaactctcaattacctacattttttaaagtggctgccacttggggaggacatgaaggttcaatgttgttttggttattttcattgagtttatggcttgctgcttttgctttttttaatcgaaaaaatgaccgcactttttccgctcaatctttatctttattgggattgatttgctttggttttgcggtgtttattttattttattccaatccatttggacgcattttccctgctcccgcagaagggcgcgatctcaatccaatgttgcaagatgtgggattaattttccatccgcctttattatatgttggctatgtgggctttgcggtaaattttgcaatgagtttgagtgcgttgatttataaccaatctgcacgacaaattgcccgctcaatgcgtggatgggtgttggtttcttggttgtttttaaccattggcattgtgcttggtgcttggtgggcatattacgaacttggctggggcggttggtggttctgggatcccgtagaaaatgcgtctttaatgccttggttgcttgggttagcgttattacacagtttaatggcgacggaaaaacaaggcgtatttagttattggacaacgcttttttctctgcttgcttttgcctttagcgtattaggcacgtttattgttcgttctggcgcgctcacttctgtgcacgcctttgcattggataacacgcgcggttatgtgttgttattaattttctttgttttgacagcgttagcctttggtttattcgctttacgagcgggaagttcatcagaaagtgcggtgaaatttcagttcatttctaaatcgggtggcattttattactgaatattttgctgaccattgcgacggtttctacctttttaggtaccttttacccgatgttattccaagcgatgaattggggctcaatttcggtgggaagtccttattttaatagtattttcttccccattattacggcgattttaatcctaatggtaattgtgcttagcatacgtaaggggcaatttgatcgcacattattgatacgttgtgggtggttgcttattccgtctttaattcttgcaggcctaatgatttggcaacagctacgccataattctgcgttgaattttcacgctttcgcttttgtgttattaactcttgcgatttggcttttgttggtcactttatggcaaaattggcgacaaattcgtttgtctcaatttggtatgattttagcgcattgtggcgtggcgattgtaactattggtgcggtaatgagtggttattttggcagtgaaattggtgtgcgtttagcaccgcaacaaagtcaaacgctgggacaatatgaatttcactatcgccaattttctaatgaaatcggaccaaactttacggcagaagtcgccttttttgacgtaactgaaaatggtaaaccttatgcagaaattatccccgaacgccgttattacgatgttcgtacaatgacaatgagtgaagtggggcttaatggcggtttttggggcgatttatatattgtgatgggcgattctctcggcaaaggggaatttactttccgcttacattataaaccactgattcgttggctttgggcgggcggtattttaatggcctttggcgcactttttagcgtcttcggattacgcagaaaacaggaaaaataa

SEQ ID NO: 1762 - DNA, 813 bp, H. influenzae strain 86-028NP
atgaatccaatgttaaatatcgctattcgtgcggcacgaaaagcgggtaatgtgattgctaaaaattatgaacgccgtgatgctatcgaaagcacacaaaaaggtattaatgattatgtaacaaacgttgataaagcggcagaagcagaaatcattgaaattattcgtaaatcttatcctgatcacacaattattacggaagaaacaggcgcaattgaaggcaaagaaggcaaagatagcgatgtacaatggattattgatccgctagatggtactcgtaattttatgacagggcttccccacttttctgtgtctatcgcagttcgtgtaaaaaatcgcactgaagtcggggttgtttacgatccaatccgcaatgaattatttactgctgtgcgtggcgaaggtgcaaaattaaatgaagtacgtttacgtgtagatagtaaacgtgaacttcaaggttcaattttagccactggttttccattcaaacaaccaaaattaatgccagctcaatttgcaatgatgaatgccttaattgaagatgccgctgatttccgtcgtacgggttctgccgcattagatttatgctatgtggcgtcaaaccgtattgatggttattttgaaatgggcttaaaagcatgggattgtgctgctggcgatttaatcgtgcgtgaagcaggtggtttagtttgcgattttgatgctggtaacggctacttacgcagtggcaatatcattgctgcaccatcacgcgtaattaaagaaatgttaaataaaattcgcccttgtttaggtgctgaatttaatcattaa

SEQ ID NO: 1763 - DNA, 513 bp, H. influenzae strain 86-028NP
atgcagaaaggtgtgacattagtggaattattgattggattagcaatcatcagcattgtgctgagttttgtcgtgccattatggcaaaccgattcacctaaaacgattttagccaaagagcaacatcgcttgtatttatttctacgacaaattcaggttcgtgcagaaaattcatcggaagtgtggtttttacttatcaatcggaaccttgcgacacaacaatggtgcttaacggcacaagtaaaaaataaccaaacttgtgattgtttaaatccgataaattgcccgaaagaggtttatgcgcatttttactatccttattttcctaataaaacgatgattcaaagccatcatatttatccaaaagaaatcacgagatttgatggcattcgtaatactatcgttactcgttgctttattttgcaagcagaaaatgaacgtacgttatttttatttttcaatgttggcagtattcgtttaaaaaccaatcaatttgatagtgcttgtaattaa

SEQ ID NO: 1764 - DNA, 720 bp, H. influenzae strain 86-028NP
atgatgaaaacattattaaaagggcaaaccctattagcactgatgatttcactggctttgtcttctttattgctgctaagcatttcgcatttttatgtgcaaatacaaacacaaaaccaacaaatgttattacatttaaaattacaagctgaattacaacgaatattacagttaataggcaaagatcttcgccgattaggatttcgagcattaaatgcaaaactgacggaaagcaatttatttttatttgaattagatgaacaaggcacagccatttttattagccaagaagataatgcgccacctaatagctgcgtgttgttcttttatgatttaaataaaaatgggtgtattggtaaaggttcgccgaaaacctgtatgaaaaatgggaaaaatacatctaaaagtagtactgaagaattatttggctataaagtgagtaacaaaatgataaaaaccaaactgacttatcaaagtgttattcctactaattgcacggcagaaacgtgtaaacgtgcttttcaacaaaccgcttgcaacgctgggggaggttgggcagatttattagataacaacgaatatgaaattactaggctacaatttaattggttaattgaaggcaaaggattagaaatcaagttaaaaggaaatttaaaacaaaccccaaatatcagttatgaaacctcccttgtcgttgctctttggaatcaaaaacaatga

SEQ ID NO: 1765 - DNA, 684 bp, H. influenzae strain 86-028NP
atgacaatacaaaaaggtattattacgctgactattctgatttttatttcaggcttattaagcgtaatcttattgttagatgatagcaatttaagtttttttcgggcgcaacaaaatcaacgaaaactgtatgtggaaagaacattacaattacaaagaataacagccttgaaaaaacaaactgcctgccttgatttatcattaaataatgatgaaagtgtaaagcaaatcagcattacgcttgatggtgccacagattcaattcaatattttctttggtgtgaaagaatgagcctatttaaaaaatcgcctaaaaagggagataatcaaggcgcattgaaagattttgtgagtggcgaaaaacttgcctattttcgaccgcacttttcttctccgcccagaattttaaacgcgaataaaacgcctaaactttattggttttcagattcacaagcagaggttgaaattaatggcacggtgtctgccgtattaattgcagagggcgatttaaaattgactggcaaagggaggattagtggcgcagtgattaccaacgggaatttaactttagatggcgtaactttagcttatgggaaaaagacggtggtcgctttagtgcaacaatatagtcagtggaagttagcagaaaaaagttggagtgattttaatgttcaggatgaataa

SEQ ID NO: 1766 - DNA, 276 bp, H. influenzae strain 86-028NP
atgtctcttattacattgttattttctttagctttatttagcgttttatttcttgtttttaatcaatggacggcagaacagcgaaaaagtgcggtaaaaatttatcaagattttcaggcaacacaaattgcagagaatcaagctcaacgccaatttttagggttagcttgtgaacaattgatacaacaaaatggcttaacttttcgtattcgatgtgaaaatgaacgcattattgtgcgttatcctacgagtgaaattttgataaaaactcagtaa

SEQ ID NO: 1767 - DNA, 3366 bp, H. influenzae strain 86-028NP
gtgttcattatttattattccaatcagcttgaaaaacaaaaagaaattctttcttctttattcaaatctttaccacctgaagatccttttcaacaagatattattttggtgcaaagccctaatatggcacaatggctacaaattgaactcgccaaagaaacaggcatttcagcgaacctaaaatttcctatgccagcaagttttatttggcagctttatgctcaaaatttacccgcaacggcattggaaaacccttttgataaagattcaatgatgtggcgtttaatacgcttaatcccgacttttctcgagaaagaaaattttttgcctttacgaaattatttagcatcttcgccacattctgaacaatacaaactttatcaacttagcagtaaaatagccgacttatttgaccaatatttagtttaccgagctgaatggatttttgcttgggaaaaaggcgaagatgaacaaatcactgcgcaaatacgaaagcaacaacctaacctaaacgatacgttgtttgagcaaattcaaggcaatataaaatggcaaggggagctatggcgtgcgttggtcgtcgatgttaaatcagatgttgatgatgctacacatcgagcggctttgcataatcagttcttagccttgcttgcggataaaaaagcaccgaaaaaattaccttcacgcatatttatttttggtattccagcgcttccaactgcttatctcaatattttgcaagcgatatcctctgaagtggatattcatttattttttaataatccttgccaagaatattggggggatattagtgatctacgccttgattatttgcgttctcgtcagcgttatcaattcaataaacaaaatgaaaatcaaccgctcttttctgaggaacaactttctcaactagaaaacgctcagtttgacgtcacttatcaaaatgaaaaccttcaagtaggcaatccattgctggcggcttgggggaaaatgggacgagattttctctataccttagtgcgagatgaagaacatattccaacttatcccgtcaatgcttatcaagaaattaaatcgaacagtttacttggacaattgcaatctcaaattctgcatttagaaaataaaccgttaaatatcgcaaaaaatgaccgcactttaactctacattcttgccacagtgctatgcgggaagtggaagtcttgcacgattatttactcgatttattcaatcaagatcctaaccttacgccaaaagatgtagttgttatggtggcagatataaatcaatacacgccttatattcaggccgttttcgggcaaaaaaatagaaatgctccacaaattccattttcactttcagataataaactttcagaaagcgatgtgttggtctcaagttacttaactttattacgcttaaaagaaagcaattttagtgcggaagatgtgttagcgttgttggatattcctgcgacgcgagaacgatttaatatttctcttgctgatttaccattagtgcgagaatgggtggcggattcagggattcgtttcggtttgcaaaaaaatcaagatggcatcaattttaattcttggcaagctggattagaaagaatgattttaggctatgcgatgcgtgaagagcagggtatttggcaagatagtttggggttaaacagcagctatggcttaaaaggtgaacttgctggaaatttatcgtactttttcaccgcactttccttgctgcatgaaaccctgcaacaagcacattccatcgaaaaatggcaagaaattttaaccgcacttttatcagatttcttcgtacaaaatgaagacactagcgacacgattttctatattcaagagaaaattaatgaattagctgagcatctaaaaatgctccattttactgaaaaattacaagcagatgtgattgccgatgtcatcacaatgaaattggaagatgcgccaaatagcctcaaattccttgcagggaaagtaaacttctgcaccttattaccaatgcgttcagtgccattcaaagtggtttgtttacttggaatgaatgatgccgattacccaagaacacaaacaccaaacagttttgacttaatgcaatatcattatcaaaaaggcgaccgtgttcgccgtgatgatgatcgttatttgttcttagaggccttattagccgcacgtaattattgctatatcagctatattgggcgttccattaccgataatcaaccgaaagaaccctccgtattggtaagccaactcgtggattatattaatcaagggcaaaaggaaaatgtccttactgtcattgaacatccaatgaccgcatttagcccagataatttcaaatataacgagaaatttacccgctcttttgcgacaaaatggttgccaatggctcaatttgacgcaagtgcaagtaattcggaatttgccgtcactatgacagaaaacccagaaaaaatcgaagaagttgaactggattctttagtcagctttgtggaaaatccagtgaaatttttctttgaaaaacaacttggtgtttatttccgcgataaagatgaacgcattgctgacagtgaaaacttcactttaagtgggttagataattattctctcaataatgacttaatttaccttgatgaacaaaattttgctgattattttagacaagcagaagtaaaaggcgtgttaccgcgcgcagagtttggaaaggtttatgctgaaaatattcgcgataatgttttagaatttaaagagaaaatagccgatcttggcgagcctaaacaggcttctatagattttaatattgccgtagattggcaaaacgaaaatcaaaaaatccgtttatttggttatatggaggctttatttggcgataattcacaagtcattcactggcattttgcgaaatacaaagatcgttattgtattcgtccttggatttattatttaattcaatgtgttacacaagaaaatgcggtaccagcaaaattaattacgcaagataaggttctcgaattaccgcctattgagcgtgaagttgcgcttgctcaattacaaatttacgtaaaagattatttacaaagccaaatagaaatacaattggtgccaacagtaagaaatataagtgattttattgtaagtgatgaaaattccgtttctgaaaaacttcaggaattaactgaaagtaatggtttcgggtcaaaagccgatccatattggtcacgagtattagcgcagacctcaagatttaaacaacctgaaaatattgcgaaattattaaaacaaacaaaagcttggtttggcttattattcgcacaaaagaagacaagaaaggcacaaagctaa

SEQ ID NO: 1768 - DNA, 450 bp, H. influenzae strain 86-028NP
atgcactgtccattttgtgatacagaagaaactaaagtcattgatagccgtttagtatctgatggttatcaagttcgccgccgccgtgagtgcggtcattgtcacgaacgttttactacttttgaaatggcagaattaatcataccgaaaattatcaaaactgatggtacacgtgagccattcaatgaagataaattgcgcagcggtattcaacacgccttagaaaaacgtcctgtaagtgcagatgatgtagaaaaagcaattaatcacataattcttcaactgcgtgcaactggagaacgtgaagtgccaagtaagttagtgggtaaacttgcgatgaatgaattaaaaaaactcgataaagtggcttatattcgttttgcatcagtctatttaagttttgatgatattgatcaattcactatcgaaattgaaaaattaaaggattaa

SEQ ID NO: 1769 - DNA, 1119 bp, H. influenzae strain 86-028NP
atgcttgaattctcctcacaagattgcgtatttatgcaacgtgccttagatttagccgccaaaggtcaatataccactacaccgaacccatcggtgggatgcgtattggttaaaaatggtgaaattgtgggggagggctttcattttaaggcaggacaacctcatgctgaacgcgttgctttagctcaagctggtgaaaatgctaaaggagcaaccgcttacgtcaccttagagccttgttctcactatgggagaacaccaccttgtgcattaggattaattgaggcgggcgtagtgaaagtcattgcggctatgcaagatccgaatcctcaagtcgcaggaaaaggtttgaaaatgttgtctgatgctggtatcgaaagtgcagtgaatctattaaacgatcaagcggaaaaaataaataaaggctttttaaaacgaatgcgtcaaggtatgccttttgttcaactaaaacttgccatgagtttagatggacgaactgcaatggcaagtggagaaagtaaatggattacgggcccagatgctcgttcggacgtacaaaaaatgcgagcaaaatcatccgcacttttatctacttctgcgacagtacttgcagatgatccaagccttaatgtacgctgggacgaatttcctgaaaatcttaaaacagaatataaaaaagaatggcttcgccagcctgtgcgagtcattttagattcacaacatcgcattcagccgactcataaactttttttaacccattctcccgtttggttagtctctagtgaaacacgagatttaacaggctttcctgatttttgtgaacaaattattcttccgaaagaaaatttactaaaagaattaatgcgagagctgggaaaacgacaaatcaataccctttgggtagaagctggagcaaatttagcgggcagtttaattgatgcgaaattagtggatgaattgattatttacattgcgccaaaattacttggagacaatgctcgtggtctatgccaattaccgaatttaactaaacttgccgatgcaccattatggcaactcaatgaattagaacaaatcggtgacgatataaaattaacttacacaccgaaaggagtctaa

SEQ ID NO: 1770 - DNA, 1023 bp, H. influenzae strain 86-028NP
atgcttaaaaaacttttccattccgcactttggggcttggctgctgcgggcgtgattttgtttgcggttccaagactgaataacagcaatatcttcacttcagacgatattatatcgttcaaaaatgccgtgcgtattgcctctccagcagtagtgaatgtttataaccgctctttttcttccgccagcattaatgataatgatcagctacaagtgaataacttaggttctggtgtgattatgagtaaagatggctatattctgacgaataaacacgtcatccaaaatgcagatcaaattgtagtagcgttgcaaaacggaaatatttttgaggccagtcttgttggttcagatgatctcactgatctcgctgttcttaaaattcgtgcagataatctttcaactattccacaaaattcagcgcgtcaagctcacgtcggcgatgtggtattagcaatcggtaatccctacaacttaggacaaagcgtgtctcaaggaatcattagcgcaatcggtcgtaatgcggtaggcgattcggtgggcagacaaaattttattcaaactgatgcttcaattaaccgcggcaactcaggtggcgcattaattaattctgctggggaattggttggaattagcacgctaagtattggcaaaaccgccaatgaaatcgcagaaggactaaattttgccattccaatagatattgcaaatgatgtactacgtaaaattatgcgtgatggacgtgtgattcgaggttattttggtgtacaaagtgatattagttcaagtagtgaagaaggcatagttatcacagacgtaagcccgaacagcccagctgcgaaatcaggtattcaagttggcgatgtgattttgaaattaaataatcaagaggggatttcagccagagaaatgatgcaaattatcgcaaatacaaaacctaattcaaaagttctcgtcaccattctacgattaggcaaaatcttacaaattccagttgttattgaagaatttccagtaaattaa

SEQ ID NO: 1771 - DNA, 816 bp, H. influenzae strain 86-028NP
atgccagaacttcctgaagtcgaaactgcactacgtggtattagcccttatcttaagaattttacgattgagaaagttgtcgtgcgcaagcctaaattgcgctgggctgtatcagaagaattaataacgctaaaaaatgtaaaaattgtcgatctcactcgtcgagcaaaatatttgattattcacacggaaaaaggctatatcatcgggcatttaggtatgtctggatctgttcgaatcgtgccacaggatagtgcaatagataaacatgatcatattgatattgtagtgaataatggcaagttattacgctataacgatcctcgccgtttcggtgcttggttgtggacggagaatctagatgactttcatcttttcttaaagttaggccctgaaccactttctgatgaatttaatgcagaatatttattcaaaaaatctcgtcaaaaatctaccgcacttaaaactttcttgatggataacgctgtggtagtgggcgttggaaatatttatgcgaatgaaagtttgtttatttgtggcattcatccccttaaactcgctaaaaatttgacgcgcaatcaatgtttctctttagtgaacacgattaaagatgttttgagaaaagccattattcaaggtggaacaacacttaaagattttttacagcccgatggtcgcccaggttattttgcacaagaattattggtatatggcaataaagataaaccttgtccaaagtgcggtggaaaaattgaaagtttaattattggacagcgtaatagtttcttttgcccgaaatgtcagaaaaggggttag

SEQ ID NO: 1772 - DNA, 1536 bp, H. influenzae strain 86-028NP
atgtcaaacctcaaacaacacaaacaagctttgttttgcaacgataacgaagccattaacgattatgaaacagcgatgtataatgcggtgcaagcagtctctgcttggctgaaaaatgaaaaaatgtacacaggcggttcaatcaaacaaatgcgagccttaataagcggttttaatccgacgaaagagggtatgggtgtacagaaatcactcgatcatttggtaaaaattttccttaatccaagccttaaagtacatcatccacactcacttgcccatttacattgcccaacgatggtaacaagccaaattgcggaagtactgattaatgcgaccaaccaatcaatggattcatgggatcaaagcccagcaggttcaattatggaggagcatttgatcaactggctacgccaaaaagcaggctatggcgaaggcacatcaggcgtgttcacttctggtggtactcaatctaacttaatgggcgtattgttggcacgcgattgggcgattgcaaaccactggaaaaacgaagacggctctgaatggtcagtacaacgtgatggtattccagcagaagcaatgcaaaaagtgaaagtgatttgttcagaaaacgcacatttctctgtacaaaaaaatatggcaatgatgggcatggggttccaatcggtcgtgaccgtgccatcaaatgccaatgcacaaatggatcttattgcacttaaacaaacacttgcacagcttaaagctgatggcaaaattactgcctgtattgtcgctaccgcaggcacaacagatgctggcgcaattgatgatttaaaagcaatccgcaaacttgccgatgaatatcaagcgtggttacacgttgatgccgcttggggtggcgcattattgctttccaaagattatcgctatttcttagatggtattgaattaactgattccatcacgcttgatttccacaaacacttcttccaaacgatctcgtgtggggcgttcttgttgaaagatcctgagaactatcgctttatcaattacaaagcggattatctcaattcggaatatgatgaagctcacggcgtgccaaacttagtggcaaaatcgctacaaacaactcgtcgtttcgacgcattaaaattatggtttacccttgaagcattgggcgaagatctttacgcttcaatgatcgatcacggcgtaaaactgaccaaagaagtcgagcaatacatcaacgatactcctgccttagaaatgcttgtgccaagtcagtttgcatcggtgttattccgtgtcgtaccaaaagactatccagctgaatttattgatgcactaaaccaaaacgtggcagatgaactctttgctcgaggagaagcgaatattggcgtgactaaagtaggcgacaaacaatcactgaaaatgactaccctaagcccgattgcaacattggaaaatgttaaagcgttattaactcaagtactaacagaagcaaatcgcattaaagatgacatcaaaaatggcacttacacaccacccattgattaa

SEQ ID NO: 1773 - DNA, 399 bp, H. influenzae strain 86-028NP
gtgttgaaatatatgcttgatactaacattgtgatttacgtgattaagcgtaggccattggaaattctttctcgctttaatcaaaatgcaggaaaaatgtgcgtgagtagcattactgtggctgaactctattatggagctgaaaaaagcgaatatcccgaaagaaacattgcggttattgaagatttcttatcacgcctcaccattttagattaccaaccaaagcatgcagctcatttcggcaatattaaagctgaactctctaaacaagggaaattgattggcgaaaatgatattcatatagctgctcatgctcgtagtgaagggttaattctggttagtaacaatttaagagaatttgagcgagttatagcattacgtacagaaaattgggtgtaa

SEQ ID NO: 1774 - DNA, 234 bp, H. influenzae strain 86-028NP
atgattgaagcctctgtttttatgactaatcgaagtcaagctgtgcgtttgcccgctgaagttcgcttttctgaagaaatcaaaaaattatcggttcgtgtatcgggcagtgatcggattttatcgcctctcaaccaatcttgggatagttttttcttgaatgatcaagcagttagcgatgattttatgaatgaacgagaaattgcatttcaaccagagcgtgaggctttatag

SEQ ID NO: 1775 - DNA, 1365 bp, H. influenzae strain 86-028NP
atgacaatgattacccctgtacaagcaattcttgcttcaaaccaacattttttagatcgccaagatgtaatggaatccaacgtacgtagttatcctcgcaaattaccttttgcctatgcaaaagcacaaggctgttgggttactgatgttgaaggtaatgaatacctagactttttagcaggcgcaggaacccttgcattaggacataatcatcctatattaatgcaagccattaaagacgtattagatagcggattgccgttacacactttagatttaaccactccacttaaagatgcgtttagtgaagaattattgtcattcttcccgaaagataaatatatcttacaattcacaggcccttctggtgcagatgcaaatgaagcagccatcaaattagccaaaacttacacagggcgtggcaatatcattgctttctctggcggttttcacggtatgacccaaggggcattagccttaacgggtaatcttggtgcaaaaaatgccgttgaaaatttaatgcctggcgtacaatttatgccatatccacacgaataccgctgcccatttggcattggtggcgaagcaggcgcgaaagcagttgaacattactttgagaacttcatcgaagatgtagaaagtggcgtagtaaaaccagctgcagtaattttagaagcaatccaaggagaaggcggcgttgttccagcaccaataagcttcttacaaaaagtacgtgaagtaacccaaaaacacggcattttaatgatcgtcgatgaagtgcaagcgggtttctgccgttctggaagaatgttcgcctttgaacacgcaggcattgagcctgatattattgtgatgtcaaaagcagttggtggcagcttaccattagctgtattagctattcgtaaagaatttgatgcttggcaacctgcaggacatacaggtacatttcgtggcaatcaattagcgatggcgacaggttacgcttcacttaaaattatgcgtgatgaaaacctcgcacaaaatgcccaagagcgtggtgaatacttaaccaacgcattacgtgaattaagcaaagaatatccgtgcatcggcaacgtacgtggtcgtggcttaatgatggggatcgatattgtagacgaacgccaagcgaaagatgcgataggggcttacccgcgcgattgtgaattagcggcagcaatccaaaaagcttgcttcaaaaacaaactcttgctcgaacgtggcggacgcggtggcaacgtggttcgcgtgctttgtgcggtaaacatcaaccaaagtgaatgtgaagagttcatcaaacgcttcaaacaatctgttgtagacgcattgaaagtggtgcgtagttaa

SEQ ID NO: 1776 - DNA, 171 bp, H. influenzae strain 86-028NP
atggcagctaaaggtgctcgtgagaaaatccgtttagtttctactgcagagacaggtcacttctacacaactgataaaaacaaacgtaatatgcctgaaaaaatggaaatcaaaaaatttgatccagtagtgcgtaaacacgttatctataaagaagcaaaaatcaaataa

SEQ ID NO: 1777 - DNA, 237 bp, H. influenzae strain 86-028NP
atgtctagagtttgtcaagtaacaggcaagcgtccagctgtgggtaataaccgctcacacgcaatgaatgcgacacgtcgtcgttttcttccaaaccttcacactcaccgtttctgggttgaaagtgaaaaccgtttcgtaaccttacgtttaactgcgaaaggtatgcgtattattgataaaaaaggcattgatgcagtattagctgaaatccgtgctcgtggcgaaaaaatctaa

SEQ ID NO: 1778 - DNA, 705 bp, H. influenzae strain 86-028NP
gtgcggtcaaaatctttcttatttttcttttataaatatatggaaaacaatgatgaattaatgccacgggaaaaattgctggcattcggagcaaaagcattaagtgattatgaactacttgcgatttttttacgtactggtatcaaagattgtcctgttatgtcactttctaaaaatgtattaacgcattttggctccttgcacgctttactttccgcagataaaaaagctttctgttctgtaaaaggcttaggtattacgcaatttattcaactgcaagcgattacggaaatgaccaagcgttatttaaagcaagagatgttaagtacgccgattattaatgatcttgaaacggtaaaactttttttactcactgaattgcaacacgaggaaagagaagtatttatggttttatttttagataatcaacatcgtttgattaaaaaagagcggttatttttaggtacaattaatgtatcagcggtttatccgcgagaaattattaaagaagcactctattgtaatgcggcagctttaattttggcacataatcatccttcaggtataacggagccgagttattcggatcaacttattactaaaaaaattcaagatgcggctgaactaatggaaattcgcgtgcttgatcatttaattgtagggaaaagcgattgttattctttcgcggagaattgtttattataa

SEQ ID NO: 1779 - DNA, 1203 bp, H. influenzae strain 86-028NP
atgaatttaaacggaaaacgtgttgtcgtcggtattacgggcggcattgcagcctataaaacaatagagttgattcgtttattacgcaaagcagaagctgaagtacgtgtagtattaaccccagctgcagcagaatttgttactcctttgacacttcaagccatttctggcaatgctgtatcgcaatctttacttgatccacaagcagagctggcaatggggcatattgaacttgccaaatgggctgatgccattattattgcgccagctagtgcagactttattgcccgtcttactgtaggcatggcgaatgatttactttcaacaatttgtcttgcaactgatgcgccaatttttcttgtgccagcaatgaatcagcagatgtatcaccaatccattactcaacaaaatttaacgactcttcaaacacgtgggattgagcttatcggccccaatagtggttttcaagcttgcggcgatatggggaaagggcgtatgtcagaaccagaggaaatttttaccgcactttctgactttttctctcaaaaacaagatctacaaggattaaatgtcgccattacagcaggcccaacgcgtgaggcaatcgatcccgttcgttatatttctaaccatagttcagggaaaatgggatttgcgattgctgaagcatttgccaaacgtggggcaaacgtcacactgatttcaggcccagtgaatttaacaacaccaaaaaatgtaaatcgaattaatgtcatctcagcacaagaaatgtggcaagcctctcttgaaagtgcggtaaaaaatcaaatttttattggttgtgcggctgttgctgattacagagtagctgaagttgcagaacaaaaaatcaaaaaatctggcgatgaaatatctatcaagttaattaaaaatcccgatattatctcagatgtaggacatttaaaaacacatcgtccttttactgttggatttgcagccgaaacccaaaatattgatgattatgcaaaagataaacttgaacgcaaaaatcttgatatgatttgtgccaacgatgtatctggcggacaagtttttaacgcggatgaaaatgccttgcagcttttttggaaaaatggtcataaaaaattatcgctaaaatcaaaagtagaacttgccgctgatttagtcaatgaaatcatcgaacgctatcaaaaaaccttataa

SEQ ID NO: 1780 - DNA, 456 bp, H. influenzae strain 86-028NP
atgaaaaaaattgacgtaaaaattttagattctcgcattggaaatgaatttcctctgccaacttacgcaactgaaggttcagcaggtcttgatttacgtgcgttgatcgatgaaagctttgaaattcaaccaggcgaaaccaaattaattccgacagggctatcaatttatattgcggatcccaatttagctgccgtgattttgcctcgctcgggtcttggccataaacacggcattgtgttaggaaaccttgtgggattaattgactccgattatcaagggccattaatggtatcaatgtggaaccgtggaaatgaaccattcaaaattgaagtcggcgatcgtattgctcaacttgttttcgtgccagtagtacaagctgaatttaatattgtagaagattttcaacaaaccgaacgtggagaaggcggtttcggtcattcaggtaaacaataa

SEQ ID NO: 1781 - DNA, 657 bp, H. influenzae strain 86-028NP
atggtagaagaacaattatctttatcaggcgtagaagaaattgcgcctaaaattgaaacaccgaaaattgaaaaaagaacggtaaaagaacgtcgtcagcaagtgcttacagtattgatacatatgcttcattctgaacgtggaatggaaagaatgacaaccgctcgtctagcaaaagaagttggtgtgtcggaagctgcgttatatcgttactttccaagcaaaacaaaaatgtttgaagcactaattgaacatattgaaagtactttgctgagccgaattacagcgtcaatgcgtaacgaaactcaaacaatgaatcgcattcacgacattttacaaacaattttggattttgctcgaaaaaatcccggcttaacacgtgttctaacaggtcacgcgttaatgtttgaagaagcgcaattacaagcacgtgtggcacaatttttcgatcgtcttgagatgcagtttgtcaatattttgcaaatgcgtaaattacgtgaagggcgtgctttcaacgtggatgaacgtataattgcctcacatttagtgacactctgcgaaggacaatttatgcgctatgttcgtacaaatttccgtctgaattcaagtcagtcttttgaacaacaatggcgttttatcgagccactttttgcctaa

SEQ ID NO: 1782 - DNA, 252 bp, H. influenzae strain 86-028NP
atgattattccttggcaagaactggaagcagaaacattagataatatcgtagaaagcgtgattttacgcgaaggaaccgattacggtatagaagaactttcactcaaccagaaaaaacaacttttactgactcaaattcgcaatggaattgcgttgattgtatggtctgaattacatgaatccattgacatcaaaaataaaacggaatttttgaaacaggaatgtaaggagcaagaatgtcaaatgaattaa

SEQ ID NO: 1783 - DNA, 675 bp, H. influenzae strain 86-028NP
atgtcaaatgaattaaccgaaattgatgaagttgtaacctcctctcaagaagaagcaactcaacgagatcccgttttagattggtttcttactcactgccatttgcataagtatcctgcaaaatcaactttaattcatgctggggaagatgcgaccacgctgtattatgtaattaaaggttctgtaatggtatcttcaaaagatgatgaaggcaaagagatgatcctcacttacttaggtgcaggacaattttttggcgaagcgggattatttgatgaaggttcaaaacgatcagcttgggtaaaaacaaaaacaacatgtgaaattgctgaaatttcctataagaaatatcgccagttgattcaggcaaaccctgaaatcttaatgtttcttactgcacaattggcaagacgtttgcaaaatacatcacgtcaagtcacgaatttggcatttttagacgtcgcaggtcgcatcgctcaaactttaatgaacttagctaaacagcctgaagcaatgacgcatcctgatggtatgcaaatcaaaattacacgccaagaaatagggcaaatggtgggttgttcacgagaaactgtggggcgcattattaagatgttggaggatcagaatcttatccacgctcatggaaaaacaatcgttgtatatggcgcaagataa

SEQ ID NO: 1784 - DNA, 1179 bp, H. influenzae strain 86-028NP
atgattgattgtcgatactatcaacaaaatgaatgtcgttcttgtcaatggcttgaaataccttatagtcagcagcttgctgaaaaacaacatcatttaaaacagcaactgatttctattaattgcgataaagctcaatggttagctccttttcaatctaatgaacaatgctttcgtaataaagctaaaatgcttgttagtggtagtgtggaacgcccaatacttggtattttaaaaaatcctaatgatccacaaagtgcgattgatttgtgtgattgtcctctttatcctgcacgtttctcaataattttttcaatcctcaaagattttattggtcgcgcaggtttagtaccttataacattgctaaacaaaaaggcgagcttaaatatattttactgacagaaagtatcgcaacaggaaaattaatgttgcgttttgtgttacgtacagaaaataaattgccgttaatccgtcgagaattaccaaaattattagaaaaactaccgcacttagaagtggttagcgttaatttgcaaccactgcacgctgctattttggagggagaacaagaaatttttctgacagaacaacaatttttgccagaaaatttcaatagtattccgctttttattcgtccacaaggcttctttcaaactaatcctaaagtggcggagggattatatgcaacagctcaacaatgggtatctgaattacctatttataacctatgggatctattttgtggtgtaggtggatttggcttacattgtgccaaagcgttgcaggaaaaatggggaaaacccattaaattaacaggaattgaaatttcttcctctgctattttggcagccagtcattctgcgaaaatattaggtttagaacatgtaaatttccaatctctagatgcagcaagcgtgattgaaaataaaaatgaaaataagccagatcttgtgattgtaaatccgccgcgtcgtggaattggaaaggaattaagtgaatttctcaaccaaattcaaccgcactttatcttgtattccagctgtaatgccatgacaatgggtaaagatttacaacatctaacttgttataaaccattgaaaattcaactttttgatatgtttccgcaaacatctcactatgaagtattagttttactagaaagaaaaaagattaattaa

SEQ ID NO: 1785 - DNA, 1056 bp, H. influenzae strain 86-028NP
atgagcaccttgttaattgatttaaaaggaaaagagttggaacaagaggaagttgagttactttcgcaccctcttgttgcaggattgattttatttactcgaaattttgaagacagagaacaaattcaagaattaattcgttctgttcgccaacgagtaaaaaagcctttattaattacagtggatcaagaaggtggacgagttcaacgttttcgtgatggatttacaatgttgccttcaatgcaggcttttcaagaaacactatcagcaactgaacaagtaagttttgctaaagaagcaggttggcaaatggcagcagaaatgattgctttggatattgacttgagttttgcaccagtgctggatttggggcatgaatgtcgagcgattggtgatcgcagtttttcatctgatgtaaaaagtgcggtaaatttagccatcaattttattgatggtatgcatcaagcaggtatggcatctacgggtaaacattttcccggtcatggtcatgtattagccgattcccatttagaaacaccttatgatgatcgcgcaaaagacgaaatttttggttacgatctccaacctttccaacagttgatttcacaaaataaactcgatgcgattatgcctgctcacgtgatttatggacaatgtgatagtcagcctgcaagtggttcagaatattggttgaaagaaattttacgcaagaaattaaatttccaaggtacaattttttccgatgatctaggaatgaaaggcgcgggagtaatggggaattttgtagagcgtagcaaaaaagcactgaatgcaggttgtgatcttttgttactgtgcaatgaacgtgaaggtgtcattcaagtattagataatctaaaacttactgaaaatgaaccgcactttatggctcgtcaagctcgcttaaaaaatttatttaagcgtagcgtaatcgaatggaatgacttggttttagatcaacgttggaaactgaatcatcgaaatctcgcagatattcaaagccgttggctagatattcaggccgcaaaaaatgattga

SEQ ID NO: 1786 - DNA, 351 bp, H. influenzae strain 86-028NP
atgaaaaaatattttctaattttggcgagctttatgctcgcagcttgttcaatttcagagcaaaacttaacttattcaacaaagccgattttgaatattacgtcgtctctttcgcctttaattcaagttgaaacgactcaaaaatcagcggttataaaaaataaaagtcagcaacttttgaatgtaagttaccatttgtattggtatgatcatttaggagttacccaaatttgggaaaatcagcaagaaagctattccgctcaattttcgctaaaaccacaagaagagaaatcaatcgatttaattaaacctactgtagaaagtaaaaattaccgcctttatttaaaataa

SEQ ID NO: 1787 - DNA, 393 bp, H. influenzae strain 86-028NP
atggacaggttaattcgccgcactttttatagggagcaaacaatggcagaagaaacaatttttagtaaaattatccgtaaagaaattccggcaaatatcgtctatcaagatgaattagtcactgcatttcgtgatatttcccctcaagctaaaacacatattttgattattccaaataaagtcattcccacagtgaatgatgtgacggagcaagatgaagtagcgctaggtcgattatttagcgtagcggctaaactcgctaaagaagaaggcattgcggaagatggttatcgcctaattgtgaattgcaataaatatggtgggcaagaagtattccatttacatatgcatttagttggtggagaacctttaggtaaaatgttagcgaaataa

SEQ ID NO: 1788 - DNA, 2826 bp, H. influenzae strain 86-028NP
atgacagtcgattacaaaaacactcttaacctaccggaaaccagctttccaatgcgcggtgatttagctaagcgcgaacctgatatgttgaaaaattggtacgagaaaaatctttaccaaaaaattcgtaaagcgagtaagggcaaaaaatcttttattctgcacgatggccctccgtatgcgaatggtaacattcatattggtcacgctgtaaacaagattctgaaagatattattattaaatccaaaacggcgttaggttttgattcgccttatatcccgggttgggactgccacggcttgccaattgaattaaaagtagaaggtttagtgggcaaaccaaacgagaaaatttctgcggctgaatttcgtcaaaaatgtcgtgaatatgcctcggaacaagtagaaggtcagaaaaaagactttatccgtttaggtgtgttgggcgattgggataatccatatctcacgatgaatttcgataccgaagcgaatattatccgcactttaggtaaagtgattgaaaatggtcatttgtataaaggctcaaaaccagttcactggtgtttggattgcggttcttctttagcagaagcagaagtggaatatgaagacaaagtttctccgtcaatttacgttcgtttccctgcggaaagtgcggttgaaattgaagctaaattttctgcacaaggtagaggacaaggtaaattatcagccatcatttggactaccacaccttggacgatgccgtctaaccgtgcgattgcggtgaatgcagacttagaatacaacttagtccaacttggcgatgagcgcgtgattttagctgctgaattagttgagtcagtggcaaaagcggtgggcgtagaacaagttgaaattctgggttctgtaaaaggtgctgatcttgaattaagccgtttccatcatccattctatgattttactgtaccagtaattttaggcgatcacgtaaccactgatggcggcacgggtttagtacataccgcacctgatcacggtttagacgactttatcgtgggtaaacaatatgatttaccaatggcgggtcttgtatcgaatgatggtaaatttatttcaacgaccgaattctttgcaggcaaaggcgtatttgaagcaaatccgcttgtgatagaaaaattacaagaagtaggtaacttattaaaagttgagaaaatcaaacacagctatccacactgctggcgtcacaaaacgccaattattttccgtgcaacaccgcaatggtttatcggcatggaaacgcaaggtttacgccaacaagcattaggcgaaatcaaacaagttcgctggattccagattggggtcaagcacgtatcgagaaaatggttgaaaaccgcccagactggtgtatttcacgccaacgtacttggggtgtgccgatgaccttgttcgtgcataaagaaaccgaagaacttcatccgcgtaccttagagctacttgaagaagtggcgaaacgtgtagaaagagcgggtattcaagcgtggtgggatttagacgaaaaagaattattaggggcggatgcagaaacctatcgcaaagtgccagatacccttgacgtatggtttgactcaggatcaacctattcttctgttgttgcaaatcgcctagaatttaatggtcaagatattgatatgtatttagaaggttccgaccaacaccgtggctggtttatgtcttctttaatgctttctactgcaacaaacagcaaagcaccatacaagcaagtattaactcacggtttcactgtggatggtcaaggccgtaagatgtcaaaatctatcggtaacatagtgacgccacaagaagtcatggataaattcggtggtgatattttacgtttatgggttgcttcaacagactatacaggcgaaatgaccgtttctgatgagatcttaaaacgtgcagcggacagctatcgtcgtattcgtaacaccgctcgtttcttattagcaaacttgaatggttttgatccaaaacgtgatttagtcaaaccagaagaaatgattagcctagatcgttgggcggtagcttgtgcattagatgcacaaaatgaaattaaagatgcatacgataactatcaattccacactgtggtacaacgtttaatgcgtttctgttcggtagaaatggggtcattctatttagatattatcaaagatcgtcaatatacaaccaaagcagacagccttgcgcgtcgtagctgtcaaactgcgttatggcatattgctgaagcattagttcgttggatggcaccgatcttatctttcactgccgatgaaatttggcaacacttgccacaaactgaaagtgctcgtgcggaattcgtatttactgaagaattctatcaaggcttatttggtttaggcgaggatgaaaaattagatgatgcttactggcaacaactgattaaagttcgttcagaagtaaaccgtgtattagaaatttctcgtaacaataaagaaataggcggcggtttagaagcagaagtgaccgtttatgctaatgacgaatatcgtgcattgttagcacaattaggtaatgaattacgtttcgtattaattacctcaaaagtagatgtaaaatctttatcggaaaaacctgctgatttagcggacagcgaattagagggtattgcggtaagcgtaacacgttctaacgcagaaaaatgccctcgttgctggcattattctgacgaaattggggtaagcccaggacatccaacactttgtgcacgttgtgtagaaaatgtagtgggcaatggagaagttcgatactttgcataa

SEQ ID NO: 1789 - DNA, 939 bp, H. influenzae strain 86-028NP
atggataaggacatgcaattaattcgtgggcttcataatgcaaatcgtgttttacaaggttgtgcgctaacgatcggcaactttgatggtgtgcatttagggcatcaaaccgtcctccgccatttgcgccaaaaagctgacgaattaaatttacccatggcggtattgttatttgaatcacagccgcgtgaatattttatgggggaaaatgcacctgcacgtttaatgcgtttgcgtgacaaaatttattatctcgaaaaggctaaggtcgatgtcgtaattgtggcgaaatttgaccgcacttttgccgagcaaccagccgatgtttttattgaacaaacgcttgttaatcatctacatgtgaaatttttaagcattggcgatgatttcaaattcggctcaaaacgccaaggcaattttgccatgttgcaagcagctagtaagcgttttggttttattgttgaagataaccgtagtttttgtctagatgcacagcgaattagtagcactgcgattcgcgaagcgttagcgaatgatgatttacaacttgcagaaaatttactcggtaaaccttatcgtattttcgggcgtgtgattcatgggaataaattaggtagaacaataggatttccaacggcaaatattcgtttgcatagacaagtaaatccaatcaaaggcgtttatgccgtaaaagtgcggttaaaatcgggggagatttttaacggcgtggcaaacatgggaaaacgcccaactataaatggattaatgcaattattagaagtccatttatttgatttttctcagaatatttatggccaaatggtggaagtggaattctgccacaagattagaaacgagattaaattcccctcttttgatgatttgaaagtgcaaattgagaaagacgtagaaactgcgaaagcgttttttaacagttaa

SEQ ID NO: 1790 - DNA, 1533 bp, H. influenzae strain 86-028NP
atgacgttattatcaagagtgttaggtcttgtacgcgatgtagttatcgctcatctcattggggctggcgctgcggcggatgtttttttatttgctaatcgtatcccaaattttcttcgtcgtttatttgctgagggggctttttcacaggcttttgtccctgttctcgcagaatatcaaaaatctggcgatatgaataaaacccgtgaatttattggaaaagtttctggtacccttgggggattggtgagtattgttacgatccttgcgatggttggatcgcctgtcgttgccgctttatttgggatgggctggtttaccgattggatgaatgatggccctgatgcacataaatttgaacaagcctctcttcttcttaaaataacttttccttatttatggtttgttacttttgtcgcgctttttggagctgtacttaacacgattggaaaattcggcgtgatgtccttttcacccgtgttattaaatatagcgatgattgccaccgcacttttccttgcaccacaaatggataacccagatcttgcactggctatcgggatttttcttggcggattattacagttcttattccaaattccatttatgaaacaagcaggtttactggtgaaaccaaaatgggcttggcgggatgaaggcgtaaccaaaattcgtaaattaatgatccctgcgttatttggtgtatcggtaagtcaaattaatcttttgctggatacagtgattgcgagcttcttaatgacgggctctattagctggctgtattattccgaccgcttactggaatttcctctcggtttatttggcattgcgatttctaccgtaattttaccaacgcttgctcgccaccacgttaatcgtgaaggcgattcagctaaaagtgcggttgattttcgtaatacaatggattggggcgtgcgaatgattttcttacttggcgttcctgctgccattggtattgctgtattggctcaaccgatgttacttacgctctttatgcgtggaaatttcatgctaaatgatgtttatgccgcctcttattctttatgggcgtttaatgcgggtttgcttagctttatgttgattaaaatcctcgccaatggctattacgctcgccaagataccaaaaccccagtaaaaattggcattattgccatggtgagtaatatgggctttaatctattggcgattcctttcagctatgttggtttagctattgcttcagcaatgtccgcaactcttaacgcctatttgctctatcgcggcttagccaaagcggatgtgtaccatttttcacgtaaaagtgcggtcttttttgtcaaagttttattggctgcaatcgcaatgggtgcggcagtttggtattacgtgcctgaaatcaaccaatgggcaaaaatggatttctttatgcgtgtttattggcttgtttggttgattgtcttagccgcaatagtttatggcacaacgttgattttattaggcgttcgcaagcaccatttgctgacaaaaaactaa

SEQ ID NO: 1791 - DNA, 270 bp, H. influenzae strain 86-028NP
ttgaccttggctaatatcaagtcagcaaaaaaacgcgcggttcaatctgaaaaacgtcgccaacacaacgcaagccaacgctctatgatgcgtacttatatcaaaaaagtatatgctcaagtggcagcaggcgaaaaatcagcagctgaatcagcattcgttgaaatgcaaaaagttgtagaccgtatggcttctaaaggcttaatccacgctaataaagcagcaaaccacaaatctaaattagctgcacaaatcaaaaaattagcgtaa

SEQ ID NO: 1792 - DNA, 567 bp, H. influenzae strain 86-028NP
gtgaaattaattgcaaccttaggtatggcagcattgctgtctggctgttcaatgtttgatagtcaacaatccgcaattccagcggaatttgctggggctgattaccaactttccgatcaacatgcaaaacaatgggcgattgcaagtaagcaagtagaacaatgcgtttacccaaatttaactcgaattttgcaacagcatttttcaaaagaagatagctatattcactcacaatatgtctttttctatccgttggaaaaaattattggcgaacaatatgtgaagattatccaagccgatgaaaaatcaatgaattatgcaagctatcagtttaaaaaattccgtaccaaagtgagcaatgttgaacctttaactaaacagtcttgtttgaagttgcgtaacgaagcgcacgatgatttggctgtcgtgaaaggtcaatataaaaatggtatggtggaagtgcaaaaaaatgaagatggcacaccaaaaaattctgatggcattgcaaccaatcaaaataaattcttctttgatattatcaaatggggatcgatgttgttactttag

SEQ ID NO: 1793 - DNA, 858 bp, H. influenzae strain 86-028NP
atgcaaaatccaaaagatgatgtgttatatgcgcctgttgaatgggtcgatcacagtgaaggctatagcgatattcgctatcataaatccactgatggcattgcaaaaattaccattaaccgcccagaagttcgtaatgcgttccgcccacaaacagtgaaagaaatgatcactgcattttccgatgcacgtttcgatgaaaacattggtgtcattgtattaactggcgaaggcgaaaaagcattctgttctggtggtgaccaaaaagtgcgtggcaattacggtggttacaaagatgacagcggcgtacatcacttaaatgtattagatttccaacgcgatattcgttcttgtccaaaaccagttgtagcaatggtggctggttatgcaattggtggcggtcatgtattacatatgctttgcgacttaacgattgctgctgaaaatgccattttcgggcaaactgggccaaaagtcggttcattcgatggcggttggggcgcaagctatatggctcgtttagtggggcagaaaaaagcgcgtgaaatttggttcttatgccgtcaatataatgcacaagaagcattagacatgggcttagtcaatacggttgtgccttacgctgatcttgaaaaagaaaccgtgcgttggtgtcgtgaaatgttacgcaatagcccaatcgcaatccgttgtttgaaagcagcattaaatgcggattgtgatggtcaagctggtcttcaagaattagcgggtaacgcaacaatgttgttctatatgactgaagagggtcaagaaggtcgcaatgcgtttaacgaaaaacgcgccccagacttcagcaaattccgtcgtaatccttaa

SEQ ID NO: 1794 - DNA, 990 bp, H. influenzae strain 86-028NP
atggcacaaaaatccttcaatctttaccgttattccatccccgttgatagccaacttattctgcgtgatcgttttttaaaacgccgtgaaggcttaatcgtaagagtgagttgcagccgagacggttggggagaaatcgccccactacctggttttagcgaagaaaccctagaccaaactcaagaacaagcaattgaatggctaacgacatggtgcaatgcaagctgtgacgcacctcgcgtaccattagatggcacctatccctctgttgcttttggtatcagttgcgcaatggatgaaatgaaaggttatttacaagccgaaggcaattatcatacggcaccactttgttgtggcgatccagatgaactgtacgccaaacttgcgagcatggaaggcgaaaaagtagcaaagatgaaagtgggcatatacgaagccaatcgcgatggattaattgccgatatgtttttagaagccattcccgatttacaattacgactagatgcaaaccgacattggtcgttagaaaaagcgttacaatttgccgctaaagtcaaaccgcaacatagaaaacgtattcaatttttagaagaaccttgtaaaacacaagaactcagtcgtgaatttgcagctcaaaccgacattgcgattgcatgggatgaatccgtgcgagagcctaatttttgcctggaaaaagaaccgcacttatcggctgtcgtaatcaaacccactttaattggttcaattcaacgttgtactgagctcattaaccaagcacattcgttaggtctaaaagcggttattagttcaagtatcgaaagcagtttaggactctctcagctcgcgcgaatcgcacaacaatacaccccgaatgtaactccaggcttagacacgttagatttgatggaatatcaagtactacgcgcttggcctaattctaatttacctattgttaatttagaatctgaatttatcactaaaattatctga

SEQ ID NO: 1795 - DNA, 450 bp, H. influenzae strain 86-028NP
atgtcgcaaacacacagaattttgctgttaaatggcccgaacttaaatatgttaggggctcgcgagccaaaacattatggcagtatttctcttgcatccattgaagagaaaatacaaacattagccactcagcacaatgtaaaagtggaatgttttcaagccaatagtgaagaaaaattaattaataagatccacgaaagttttcagcaagtcgattttattttaatcaatcctgctgcctacacccataccagtgtggcattgcgcgatgcacttttagccgtttcaattccttttgtggagattcatttatccaacgtgcataaacgtgaaccatttcgtcatcattcttattttagcgatgtggctgaaggtgttatttgcggtttgggtgcaaaaggttacgagtttgcctttttatttgctattgattaccttgctaaaaaataa

SEQ ID NO: 1796 - DNA, 468 bp, H. influenzae strain 86-028NP
atggacattcgtaaaatcaaaaaattaatcgaattagtagaagaatctggcattactgaattagaagtgcaagaagaggaaggcacagtacgtattagccgtgccacaccagtcgttgctccagcagccgttcaatatgctgctgcaccagtagtagcaccgactcctgccgctgcgccagctcaagcaccagcagctgcgacaccagcaccagccgcatccgatgaattatcaggtcatcttgtacgttctccaatggtgggaacgttctatcgcagtccaagtcctgaagcaaaagcatttgttgaagtgggtcagtctgtgaaagttggcgacgcgctttgtatcgttgaagcaatgaaaatgatgaatcgcattgaagcggacaaggctggcgtagtaaaagcaattcttatcaacgacggtgacgctgttgaatttgacgaaccattaatcgttattgaataa

SEQ ID NO: 1797 - DNA, 1347 bp, H. influenzae strain 86-028NP
atgttagaaaaagttgtgattgctaatcgtggtgaaattgcactacgcattttacgtgcttgtaaagaattaggtattaaaactgtggcggttcactctaccgctgatcgtgatttaaaacacgttttacttgctgatgaaaccgtttgtatcggtccagcaccttccgcaaaaagttatttaaatattccagctatcattgctgccgccgaagtcacaggtgcggatgcaattcatccaggatatggttttttatctgaaaatgctgattttgctgaacaagttgaacgttcaggtttcactttcattggcccaacagcagatgtcatccgtttaatgggtgataaagtttcagctattaaagcgatgaaaaaagcaggcgtgccttgtgtacctggttctgatggccctgtaggtaatgatattgctaaaaataaagaaatcgccaaacgtattggctatccaatcatcatcaaagcatctggcggtggtggtggccgaggtatgcgtgttgtacgtagcgaagacgcattagaagaatctattgcgatgacaaaagcagaagcgaaagctgcattcaacaatgatatggtctatatggaaaaatacttagaaaacccacgtcacgtggaaattcaagtgttatcagatactcacggtaatgcagtttatttggctgaacgtgactgctcaatgcagcgtcgtcaccaaaaagtggtggaagaagcaccagctccaggtattacagaagaagtacgccgtgatattggctcacgctgtgcaaaagcttgcgtagaaatcggctatcgtggagctggaacctttgaattcttatatgaaaatggtgaattctatttcattgaaatgaatacgcgtatccaagtagaacaccctgtaactgaaatgattacaggtgtagatttagtgaaagagcaattacgtattgcagcaggcttaccgatttcctttaaacaagaagacatcaaagttaagggacacgcaatggaatgccgtattaacgcagaagatccaaaaacattcttaccgtctccaggtaaaataaatcacttacattctccgggtggtttgggcgttcgttgggattctcacgtgtacggtggttatactgtgcctccacattacgactctatgatcgcaaaacttatcacttatggcgatacgcgtgaaattgcaatccgtcgtatgcaaaatgccttatctgaaacaattattgatggtataaaaaccaatatcccacttcatgaattaattcttgaagatgaaaatttccaaaaaggcggaacaaacatccactatttggagaaaaaattaggtatgaatgaataa

SEQ ID NO: 1798 - DNA, 258 bp, H. influenzae strain 86-028NP
atgacattaaagcaacgttatcaacaagctggtaaagaagccagttgggcattaggcctatctattttatatgtgataggttggtgcttatgtgcttatttacccaaagaaacccaagggccgattggtttccctctctggtttgaactttcttgtatttacttacctattttattcatcgtgattggttattggattatcaaaattatttttcaggatatttctcttgaaattaacgatcaggagagtcagaaatga

SEQ ID NO: 1799 - DNA, 1455 bp, H. influenzae strain 86-028NP
atgaatctaggtattattcttcccttaattatttatctcacttttgtttttggtgcggcaatttttgcctatgtaaaacgtacaaaaggcgattttttaacagaatattatgtaggaaatcgctcaatgacggggtttgtacttgcaatgaccacagcctctacttatgccagtgcaagttcttttgtaggagggccaggggctgcttataaatacggcttaggctgggtattacttgcgatgattcaagtccctgctgtatggttagcattaggtgcgttgggtaaaaaattcgcactcttatcaagagaaaccaatgctttaaccattaatgatcttttcttttatcgctataaaaacaaatatttagtttggctatcaagccttgctcttcttctcgcattttttgctgcgatgaacgtgcaatttattggcggtgcgcgtttattagaaacaaccatcggcatttcttatactcaagcattactcttatttgctttaacggtaggtatctatacatttatcgggggcttccgtgctgtcgtactgacggataccattcaaggtaccgttatgatttttggaactataattctccttgttggcacgatttatgccctcggtggtgtagaaagtgcggtcaataaattgactgaaattgatcctgacttagtcacgccttacgggccaaatggaatgttagattttcaatttatggcttctttctggatactcgtttgtttcggggtggttggtcttccacataccgcagttcgatgtatggcatttaaagacagtaaagccttacatcgcggcatgctgattggaacaattgtactttctataattatgttaggtatgcatttagctggtgcgcttggcagagcggttattccaaatttaacggtatcggatcaagtaattccaactttaatgttaaaagtattgccgcctattgttgcagggattttcttagctgcgccgatgtctgcaattatgtctacaattgatgcgcaacttattcaatcatcttctatttttgtaaaagatttatacctttctacgaaaccagaagccgcaaaaaatgagaaaaaagtgagttatttttcatcaattattacgctaattttgaccgcacttttaatctttgccgcactcaatccaccagatatgattatttggttaaacctatttgcctttggcggactggaagccgcatttttgtgggtaattgtgcttggtatttactgggataaagcaaatgcttatggtgcgttaagctcaatgattatcggcttgggaagttatatcttactcactcaacttggcgtcaaattatttaacttccatcaaatcgtaccatcattagcatttggattgatcgcttttttagtaggtaataaattgggcgaacgtcgaatcgaaaaaactcaattaaaagctaccgcactttaa

SEQ ID NO: 1800 - DNA, 873 bp, H. influenzae strain 86-028NP
atgctctatcaaattctcgcgctacttatttggagcagttcattaatcgtcggtaagctcacttattcgatgatggatcctgtgcttgttgtgcaagtgcggttaattattgcaatgattttggtaatgccactttttttgcgtcgttggaaaaaaatcgataaaccaatgcgtaaacaactttggtggttggcattctttaactataccgcggtctttttattacaatttattggtctgaaatacacctctgcgtctagtgccgttacgatgattgggctagaaccgctacttgttatatttgttggacatttcttttttaaagacaaagcaaaatggtttcactggctattcggcgcaatggcatttattggcgttgcaattttaatcaatggtggaaaaaataatgaaggcattgataatgttagtttattaggttgcttattagtgctaagcgcagggattatttttgcgactgtattacgttggacgcggcgagttgttgccaaagtttcaacgcaagtttacacatccatcagtattgttcttggtgttataacaacattaccttttaccttattactgacagaaaactggcaaatatcattaaattccacgggaattgtaggtttattatatcttgcgcttggttgtagctggcttgcttattggttatggcataaaggactcaataccgttgatgctaatatctctggtattttacttgcacttgaaccattattcggaatcttatttgccgtatcattacttggcgaaacgctgtcattttcagccgtacttggcataacaattattatgttagccacacttggctcgattttactaccgaaacttttgaaaaaatcggtataa

SEQ ID NO: 1801 - DNA, 888 bp, H. influenzae strain 86-028NP
atggcttggattcaaattcgcctaaatagtaccaatgaaaaagcagaacaaataagtgattttttagaagaaatcggatccgtttctgtgacttttatggatagtcaagataccccgattttcgagcctttaccgggcgaaacgcgtttgtggggcaatacggatgtaattgcgctatttgatgcagaaacagatatggcagaaatcgtccgcttattaaaagaagcaaaacacttagatagcaatacggcatacaaaattgaacaaatagaagataaagactgggagcgagagtggatggataatttccacccaatgcaatttggtaaacgtttatggatttgtccaagttggcgtgatgtgcctgataaaaatgccgtcaatgttatgcttgacccaggcttagcgtttggtactggtacgcatcctacaaccgcattatgtttagaatggcttgatagcttggacttaaaaaataaaactgtcatcgattttggttgtggttcaggcattttagccattgctgcattaaaacttggtgcgaaaagtgcggtgggaattgatatcgatccacaagcaattctagccagtcgtgataatgccgagcaaaatggcgttgtagatcgcctacaactgttcttatctgatgaaaaaccttctgatttaaaagctgatgtcgtggtggcaaatattcttgctggcccactcaaagaactttacccaatcattagccaacttgttaaaccgaatggcaatcttggtttatcaggtattttagaaactcaagctcaatctgtctgtgatgcttatacgcaaacatttgcgttagaacccgtcgcggtaagagaagaatggtgccgaattacgggtaatctaaaaacgctttaa

SEQ ID NO: 1802 - DNA, 981 bp, H. influenzae strain 86-028NP
atgcgaatcggttcataccaattaaaaaatcgtgttttacttgcaccaatggcaggtattactgaccagcctttccgccgtctttgtgcatattatggtgcagggcttacattttcagaaatgatgtctacaaatccgcaagtttggcatactgaaaaatccaaattgcgtttggcgtacagcgatgatttaggtctcaatgccgtgcaaattgcaggtagtgatccactcgagatggcacaagctgcggctattaacgtggaatatggcgcgcaaatcatagacattaatatgggttgccccgcaaagaaggtaaatcgcaaacttgcaggctctgcattgttgcaatatcccgatttggtggaaaaaatcttgcgcgaagtggtggctgccgtgaatgtgccagtgaccttaaaaattcgtacaggctgggataaatctaatcgaaactgcgttcaaatcggcaaaattgcagaacaatgtggcatacaagcattaacggtacacggtcgtacaagagcttgtctttttgaagggaaagcggagtacgacaacatcaaagccgttaaacaagcgattgttataccagttatagctaatggcgatattgattctgctcggaaagcaaaattcgttcttgattatactggagcggatgccattatgattggtcgtgctgcgttaggtaacccttggttatttcaagcggtagaaaacctaattgagcataactcgataagtcaaatgccaagtttaaacgaaaagtgcggtcagattttgcgtcatattcaagaattacatcaattctatggcgaacaaaaaggctatcgcattacgcgtaaacacgtggcttggtatttacagggaattcaacctgattccgtttttaaacagacttttaatgcaattagtgatcctaaagagcagctgattgtattggaagattttttcaatttaattttggataaagaaaaatgttag

SEQ ID NO: 1803 - DNA, 300 bp, H. influenzae strain 86-028NP
atgttagaacaacaacgtaatcctgccgatgccttaacggtatcagtattaaatgcgcaatcacaagtgaccagcaaaccattacgcgattcagtcaaacaagcgttgcgtaattatttagcacaattagatggtcaagatgtgaatgatctttacgagctagtattagcggaagttgaacaccctatgttagatatgattatgcaatatactcgtggtaatcaaacccgtgcagcaaatatgcttggtatcaaccgtggtacattacgtaaaaaattaaaaaaatacggtatgggataa

SEQ ID NO: 1804 - DNA, 486 bp, H. influenzae strain 86-028NP
atgacaaagaaaaaagtaaaacccaattcaaatactatcgcactgaataaacgtgcaagacacgattattttattgaagatgaaattgaagcaggtcttgaattacaaggctgggaagtcaaatctatgcgcgcaggcaaggcaaatattagtgatagttatgttatttttaaaaatggcgaagcctttttattcggcgcaagcattcagccattaaatgttgcatcaacgcatattgtttgtgatccaactcgcactcgtaagttattgttaaataaacgcgaattagcatccctatttggcaaagcaaaccgagacggttttaccatagttgcactttctctttactggaaaagtgcgtgggcaaaagtcaaaatcggtttagccaaaggtaaaaaacaacaggataaacgtgatgatattaaagaacgtgaatggaaagtaacaaaagatcgcattatgaaaaatgcacatcgaagatcttaa

SEQ ID NO: 1805 - DNA, 966 bp, H. influenzae strain 86-028NP
atgattaaaaaaattgcagttttaacaagtggtggcgatgcgccgggtatgaatgccgcaattcgtggcgtagtacgctctgcacttgcagaaggcttagaagtgtttggtatctatgatggttaccaaggtttatacaataataaaatcaaacaattaaatcgctatagcgtatctgatgtaattaatcgtggcggtacttttttaggttctgcacgctttcctgaatttaaagatccaaatgttcgtgcaaaatgtgcagaaattttacgttctcacggcattgatgcacttgtggttatcggtggtgacggttcttatatgggagctaaattattaaccgaagaacacggtttcccttgtgttggcttacccggtactattgataatgatgttgcaggtactgactataccatcggctatcaaaccgcattacaaactgcagtggatgcaatcgaccgtttacgtgatacatcaagctcacaccaacgtatttctatcgttgaaattatgggtcgccattgtagtgacttaacgatttctgcgggcattgctggcggttgtgaatatatcgtcgcatcagaaattgaatttaatcgcgaagaattaattcaacaaattgaacgtagcattattcgcggtaaacgccacgctattattgctatcactgaacttttaactgatgttcattctctggcaaaagaaattgaagctcgcgtaggtcacgaaactcgcgcaaccgttttagggcatattcaacgtggtggttctccttgtgcttttgaccgtattcttgcctcacgtatgggcgcatacgcagtagatttattgctacaaggcaaaggcggctattgcgtaggtatccaaaatgaacaactcgttcatcacgatattattgatgccattaataatatgcagcgtgtatttaaggctgattggcttaaagtggcaaaacgtttggaataa

SEQ ID NO: 1806 - DNA, 582 bp, H. influenzae strain 86-028NP
atgaataaaatttttgttattttgaccgcacttatactttcaggctgtgcaactaagctgacccaattaaatgtgcctacgcagttagaatataatggcaaacattatgtacttactggcagccaagatttaggaaccattgcacgctatgcgtatatatctaagccagatacgctagaaaattggcaatctgaaattgaaattctctttgatcgcaatcaatccgaacgttctattaaagaacgtattgcattaagagaacgcatttatcgcaatacagacgtgaaagattttcattttgatactattccagaaaattcgaccaatccaaatgaattaaatggatatgtcatctattcgccaacaaaggaaaatccatcttggcaagtcaatgtgatgaaaggacgacaattgccccaatgtggctttgtgcaatttcaatattcgcagaaaatacagcaaccaacgcattctaaacatttatctgtcgataaagtacaacaacatttgcaaaaatacattgtggatatagaaagaaaacatttacaaaatttgaaatggcaactgttttgtgaaaaataa

SEQ ID NO: 1807 - DNA, 852 bp, H. influenzae strain 86-028NP
atggcttatataaacgcatttaacgtaaatttttatgctaagatacgcccattcttttttcataaaaggacgattatgttagccattatctcccctgccaaaacccttgattttgaaagtgcggtaaaaaattttcctgtttttcaaccgcactttactgattacagcgaacaacttattgaggtttgtcgtaaactttctccgcaagatctttcatcattaatgtctatcagcgataaattagcagggcttaatgttgcacgttttgctgaatggacaaaaattcacaatgaagacaattctcgccctgcactctttgcatttaaaggcgatgtttatacgggtttagatgctgattccctttcggaagatgatgtcatttttgcacaatcccatttacgtatgctttctgggctttatgggcttttaaaaccacttgatttaatgcaaccttaccgattagaaatggggacaaaattagccaatccgaaaggaaaagatctgtatgccttttggggaaatgtgattacccaagcagttcaacaagctattgatgcacaaggcgataatgtgttagtcaatctagcctctgatgaatattataaatctgttaaagaaaaccaacttaacgccaaaattatcaagccagttttcttagacaataaaaatggaaaatacaaagtaattagcttttatgctaaaaaagcgcgaggattaatgtgccgttatcttattcaaaatcgtttaaccgacattgaacagttaaaagaatttgatttaggtggttattggtttgattcagcatcctccactgaaactgaatttgtctttaagcgagatattaatgaataa

SEQ ID NO: 1808 - DNA, 1122 bp, H. influenzae strain 86-028NP
atgaatgacattacctacacattactccgtttaatgcaagtgcctaaacttggcggcgttggcattgataaaattttgtccaatattaccttaaatgaattacttaattatgatgatgttgctttccgacaaatgggatggggagccattcaaattcgccgttggttcaaacctgaagcaaaatttattgagccagcactcgcgtggtcacaaaaagagggaaatcatttagtaaattatttttcccctttttatccctttttattgaaacaaaccgcaaactttccgccactattatttgtaaaaggaaatttaaccgcactttcacaacgccaaatggcaatggttgggagccgttattgcacgacttatggagaatattgggcaaaacattttgcaacagaactttcattagcgggttttaccataacaagcggtttagcattaggaattgatggtcattgtcatcaggctgtcgtcaatattcaagggcaaactattgcggtcttaggcagtggattagaacaaatctatccctctaaacatcaaagattatcagcacaaatcatcgaaaataatggggcattagtctctgaatttttacctaaccaagcacctattgctgctaattttccacgccgtaatcggattattagtgggctttcagtcggcacgctcgttgttgaagccaccgaaaaaagtggatcacttattactgcacggtatgcgttggaacaaaaccgagaggtttttgctgtgccaggcaatattcaaaatgaatcaagtcaaggttgtcatcgcctgattaaacaaggcgcaatgttggtagaaaatgcaaaggacattttggaaacgctctaccaacattctatccacagccaaactgaaattgattttgaccagatcgccgtgcctaattacacgccaccacccgatcctcgccgattagtagaagcaccaagccacccgaaactttattcacgtattggctatactcctgtgagcattgatgatttagctgaagaatttaatttaagtgtcgatgttttacttgttcaattgctcgatcttgagctacaagatcttatcataagtgaaaatggcttatataaacgcatttaa

SEQ ID NO: 1809 - DNA, 1548 bp, H. influenzae strain 86-028NP
atgacagatcgcgttattatttttgataccaccttgcgtgatggggaacaggcgttaaaagcaagtttgacggtaaaagaaaaattacagatcgctttagcacttgaacgcttaggtgtggatgtaatggaagtggggtttcccgtttcttctcaaggggattttgaatcggtacaaaccattgcgcgccatatcaaaaacgctcgtgttgccgcgttatctcgagccgtagataaagacattgatgccgcataccaagcattgaaagtggcagaagcattccgtattcatacttttattgcaagctcggcattacacgttgaagcgaaattaaaacgttcttttgatgatgtggtaggaatggcagttgcagcagtgaaacgcgcacgtaattatacggatgatgttgagttctcttgcgaagatgcggggcgtacgggcattgacaatatctgtcgtattgtagaggcggcaattaatgcaggtgcaactacagtaaacattccagataccgttggtttctgcttaccaaatgaatacggcaatattattgctcaagtgcgtaatcgcgtgccgaatatcgacaaagccgtgatttccgtgcattgccacaatgacttaggtatggcaaccgctaattctttaaccgctgtacaaaatggtgcacgccaaattgaatgtactattaatggaattggggaacgtgcgggcaatacttcccttgaagaagtggtaatggcaatgaaagtgcgtcaagatttcatgggcgtggatactcgtattaatacccaagaaattcatcgcgtgagtcaaatggttagccagctttgcaatatgccaattcagccgaataaagccattgtaggctcaaatgcttttgcccattcttctggtattcatcaagatggtatgttgaaaaacaaaaatacctacgaaattatgtctccagaaaccattggtttgaaaaaagaaaaattgaatttaactgcacgttctggtcgtgcggctgtgaaaggtcatatggcggatatgggctacaacgaacaagattatgatttggataaattgtatgacgcgttcttaaaattggcggataaaaaaggtcaagtgtttgattatgatttggaagccttggcatttatcgatatgcaacaaggggatgaagatcgtttggtattagataaactttctgcgcattcaaccaaagaatatccagcaacagcctttgttcaattgaaattagatggcgaaaaattaagcacttcgtcaattggtggtaacggcccagtagatgcggtttataacgccatcttaaatttaacaggcttagaaatcaaaatgtctcactataacttaaccgctaaaggcgagggcgcagaagcattagggcaagtggatattgtggtggaacacaaagggcgtaaattccacggtgttggtttagcaacagacatcgttgaatcttccgcacttgctttagtccacgctatcaatgccatttatcgcgcacataaagtggcagacattaaaagccataaacatcactaa

SEQ ID NO: 1810 - DNA, 1077 bp, H. influenzae strain 86-028NP
atgcaatcatacaatgtagcagtattagcaggcgatggtattggccctgaagtaatggcggaagccatgaaagtattaaataaagttcaagaaaaatttggttttaaacttaacttcaacgagttttttgtcggcggtgctgccattgatcattgcggttatccattaccagcagaaaccttaaaaggctgtgatgaagcggatgccattttgtttggctctgtgggcggccctaaatggacaaatttaccgccagatcaacagccagaacgtggtgcattattgcctttacgtaaacactttaaattattctgtaatcttcgccctgctaccctttataaaggactcgaaaaattctgtccattacgtgcagatattgccgcaaaaggctttgatatggtagtggtgcgtgaattaacgggcgggatttatttcggtcagcctaaagggcgtgaaggcgaaggctcacaaaccaaagcatttgatacggaagtgtattacaaatatgaaattgaacgcattgcacgtgcggcttttgaggcagcaatgaaacgcaataaaaaagtcacttctgtagataaagcgaacgtattacagtcttctattttatggcgtgaaactgtgacagaaatggcaaaagactatcctgaagtgactttagagcatatctatatcgataacgccacaatgcaattaatcaaagcaccagaatcttttgatgttttactttgctctaatattttcggggacattatttctgacgaagcggcaatgatcacgggttctatgggaatgttgccatctgccagcttaaatgaagccggttttggtttatacgagcctgcaggcggttcagcaccagatattgcgggcaaaggcattgccaacccaatcgcacaaattctttctgctgcgatgatgttgcgttatagcttcaacttaaacgaagcagcagatgccattgaaagtgcggttcaaaaagtcttggcaagtggtcatcgcaccgctgatttagcagatgattccacaccagtttcaacggcagaaatgggtacattgattacacaagcaatttaa

SEQ ID NO: 1811 - DNA, 1410 bp, H. influenzae strain 86-028NP
atggcaaaaacactttacgaaaaattatttgattcccacattgtttatgaagcagagggcgaaacgccaattttgtatattaaccgtcatttgattcacgaagtaactagtccgcaggcttttgatgggttacgcgtcgcaaatcgccaagtacgccaagtaaacaaaacttttggcacaatggatcacagcatttctactcaagtacgagacgtcaataaacttgaaggtcaagcgaaaattcaagtgttagaattggataaaaataccaaagcaacaggtattaaattatttgatataacaaccaaagagcaaggcattgtacacgttatggggcctgaacaaggtttaaccttaccgggtatgacaattgtttgtggtgattcacacaccgcaacgcacggtgcatttggtgccttggcttttggtattggtacttctgaagtagaacacgtattagccactcaaactttaaaacaggctcgagcaaaaagtatgaaaattgaagtgcgtggtaaagttgcatcaggtattacggcaaaagatattattcttgccattatcggtaaaaccactatggcaggcggaacaggacacgttgtagaattctgcggcgaagcgatccgagacctttctatggaggggcgtatgactgtatgtaatatggcgattgaaatgggtgcaaaagcaggcttgattgcgccagacgaaaccacatttgcatatttgaaagatcgtccacacgcaccgaaaggcaaagattgggatgatgccgtagcttattggaaaaccttaaaatctgacgatgatgcacaatttgacactgtggtaacgctagaagcaaaagacatcgcaccacaagtcacttgggggacaaacccagggcaggtaatttctgtgaatgaaactataccaaatccgcaagaaatggcagatcctgtacaacgtgcttcggcagaaaaagccttacattatattggcttggaagctggcactaatttaaaagatattaaagttgatcaggtgttcatcggatcttgcaccaactcgcgtattgaagatttacgcgcagcagcggctgtaatgaaaggtcgtaaaaaagcggataatgtaaaacgtattttagtagtaccaggttctggcttagtgaaagaacaagcggaaaaagagggcttggataaaatctttattgccgcaggtgcagaatggcgtaatccaggttgttcaatgtgtttaggaatgaacgacgaccgtttaggcgaatgggaacgttgtgcttccacgtcaaaccgtaactttgaggggcgtcaaggtcgtaatgggcgtacccatttagtaagtcctgcaatggcggcagcagcaggaatgttcggtaaatttgttgatattcgtgaagtggcattaaattaa

SEQ ID NO: 1812 - DNA, 603 bp, H. influenzae strain 86-028NP
atggcaggatttaaacaactttcaggcttagtcgtaccattggatgcggcgaatgtagataccgatgcaattatcccaaaacaatttttacaagccattactcgcgtgggtttcggcaaacacttattccatgaatggcgttatttagatgtggacggcaccaagccaaatccagaatttgtcttaaattatccgcaatatcaaggtgcaaccattttgctcgcacgtaaaaatcttggttgtggttcttctcgtgaacacgccccttgggcattggcagactacggctttaaagtaatgatcgccccaagttttgcagatattttctataacaacagcttaaataatcatatgttaccgattcgtttaagcgaagaagaagtagaagaaatcttccaatgggtgtgggcaaatgatggcaaacaaatccacgtagatttagaagcgatgacggtcactgttggggataaagtttatcactttgaactggatgaattccgccgtcattgtttgttaaacggtttggacaatatcggtttaacccttcagcacgaagaaaaaatctcagcatacgaaaaaaatattccagcgtttttacgttaa

SEQ ID NO: 1813 - DNA, 5385 bp, H. influenzae strain 86-028NP; identical to SEQ ID NO: 762

SEQ ID NO: 1814 - DNA, 1080 bp, H. influenzae strain 86-028NP
atggcgatttctcgtttactggtcgaaaaatttcgtaatttaacagcagtggatcttgattttgatccctgctttaactttttaatcggcaacaacggcagcggaaaaaccagcttattagaagccattttttatcttggtcacggacgttcatttaaaagtgcggtcacaaaccgcatcatttcttacgacgaaccgcactttaccctatttggacaaatccaagaaagccaacatcaatggtctgtcggcttacaaaaacttcgtcaaggcaacaccttagtaaaaattaacggcgaagatggcaataaaatttccgatctagcccatcttttaccaatgcaattaatcacgccagagggcttaaccttactcaacggtgggccaagttatcgtcgtgcgtttttagattggggattattccaccaccaaacaagtttctattccgcttggagcaatctcaaccgattacttaaacaacgaaatgccgcactcgcacaaaatcagccttactctgccataaaaatttgggacgttgaacttgccaaacttgcccaccaagtaagtcaatggcgtgccgaatatgcagaagctctccgccctgaaattgaacaaacttgccaactttttctgcctgaattagaaattaatgtcagctttcatcaagggtgggaaaaaaatgctgattattatgaaattcttcaacaaaattttgaacgagatcgtgccttaaattacaccttttctggccctcaaaaagcggattttcgtttcaaagcacaaggattgcctgttgaagatgtgctttctcgtggacagcttaaacttttaatgtgtgtattaagactagcgcagggcgagcatttaatgaaagaaaagcaacgccattgtatttttttgatcgatgattttgcctcggaattagatcaatacaaacgtgccttgttggcagaacgattacaacaaagcggttcgcaagtatttgttaccgccatcactcaaagacaactaaaagaaatgcaagtggaaaacaaaaaaatgttttctgtccataatggcatcattaacgccttaaattaa

SEQ ID NO: 1815 - DNA, 1101 bp, H. influenzae strain 86-028NP
atgcaatttagcatttcaagagaaaatttattaaaaccgttgcaacaagtatgtggcgtattgagtaatcgtccaaatattcctgtattaaacaacgtattgttgcaaattgaagacaatcgtctgactatcactggtacagatttagaagtcgaattatcgagtcaaactcagctttcatcgtcttctgaaaatggcacttttaccattccagcaaaaaaattcttagatatttgccgcactttatctgatgattcagaaatcacggtgacttttgaacaagaccgtgctttagtgcagtctgggcgtagccgttttacgctgacaacccaacctgccgaagaatatccaaacctcacggattggcagtctgaagtggattttcaactaccgcaaaataccttacgccgtttaattgaagccactcaattttctatggcaaaccaagatgcgcgctatttcttaaatggtatgaagtttgaaacagaaggcaatttattgcgaacggtggcaacagatggtcatagacttgcggtgtgtaccatttcccttgaacaagaattacaaaatcattctgtgattttaccgcgtaaaggtgtgttagagctggttcgtttattagaaacaaacgatgaaccagcgcgtttacaaattggcaccaacaatttacgtgtccatttaaaaaacacggtatttacatcaaaattaattgatggtcgctttcctgactatcgccgagtattgcctcgtaatgccacaaaaactgtcgaaggcaattgggaaatgctgaaacaggcttttgttcgtgcgtccattttatctaatgaacgagcgcgcagcgtgcgtttaagcttaaaggaaaaccagcttaaaattactgcctcaaacacagaacacgaagaagcagaagaaattgtcgatgtcaattacaatggcgaagaattagaagtgggctttaatgtcacctatattcttgatgtgctgaatgcacttaaatgtaatcaagtgcgaatgcgcttaactgatgcgttctccagttgcttaattgaaaactgtgaagacagcagctgcgaatacgtcattatgccaatgcgtttataa

SEQ ID NO: 1816 - DNA, 1365 bp, H. influenzae strain 86-028NP
gtgaatctctcaaatctttggcaaagttgcctgttacaacttcaagatcaagtttcagccagcgatcttagcacttggcttcgtcctttacaggctgatgtggtggcggataaccacattgttttatatgcttctaatatgtttgtgaaaggttgggtggaaacccattatctcgcacaaatccagcaaatttgtcaaacacttacacaaaatcctgaactgcgtatttctttaaaagaaggggtcaagcctgcacctaaagtagtagaaaatacgccaaatatatcacttagatcagaaagtgcggtagattttcaagctgaatctagtgcttcagtaaaatttgaatctcatctcaatactaaacacttatttgataactttgttgaaggtaaatcgaaccaactcgcacgtgcagtcggtcaaaaacttgctcaagcaccaggcgaaccatcggctaatcctttctttttatatggcggcactggtttagggaaaactcacttgttacacgccattggcaacggcattttagccgataaaccgaatgcgcgagtgctttatattcacgcaaataactttatgcaacatatggtaaaagcagtgcgtgataataaaatggatcagttcaaaaaattctatcgttctcttgatgcgcttttagtggatgatattcaatttttcgctgaaaaagaaaaaactcaagaagaattcttccatatattcaataacttatttgaaacgggtcgccaaattatcttaacttcggatcgttaccctaaagaaattgaaaaaattgaagaacgtttaaaatcacgttttggctggggcttaacaacagccattgaaccgcccgatcttgaaactcgcgtagcgattttattgaaaaaggcggaagaacataatatgaacttgccagaagaagttgctttcttcattgctcaacgcttgcgtaccaacgtgcgtgaacttgagggtgcattaaatcgagtgaaagcaatgcaagacttcaaaggcggtgacattgatattgatttcgtgcgtgataccttaaaagatattttggctttacaagaacgcttggttactattgaaaatattcaaaaagtggtggctgaatattatcgaattaaggtttcagatttaaaatcaaaaagtcgtgcgcgttcagtcactcgccctcgccaaattgccatggcgttagcaaaagaattaacaaaccgcagtttgcctgaaatcggtcgtgcctttgaccgtgatcacacaaccgtattaaacgcttgccgtgaagtgccaaaattccgcgagcaagacaatagcattcaagaagattgggcgaatttaatccgcactttgtccgcataa

SEQ ID NO: 1817 - DNA, 2739 bp, H. influenzae strain 86-028NP; identical to SEQ ID NO: 746

SEQ ID NO: 1818 - DNA, 1893 bp, H. influenzae strain 86-028NP
atgaaatctgtacctcttatcactggtggactttcctttttattaagcgcttgtagcgggggaggtggttcttttgatgtagatgacgtctctaatccctcctcttctaaaccacgttatcaagacgatacttcaagttcaagaacaaaatctaatttggaaaagttgtccattccttctttaggaggagggatgaagttagtggctcagaatctgagtggtaataaagaacctagtttcttaaatgaaaatggctatatatcatatttttcctcaccttctacgattgaagatgatgttaaaaatgttaaaacagaaaataaaatacatacaaatccaattgggcttgaacctaatagagcattacaagaccccaatttacaaaaatacgtttattctggtttgtactatattgagaattggaaagacttttccaaattagcaacagaaaaaaaagcctatagtggccattatggttatgcgttttattatggtaataaaactgcaacagacttgccagtaagcggtgtagcaacgtataaaggaacttgggatttcatcactgcaactaaatatggccaaaattattctttgttcagtaatgctagaggtcaagcttattttcgacgtagtgctactcgaggagatattgatttagaaaataattcaaagaatggtgatataggcttaataagtgaatttagtgcagattttgggactaaaaaactgacaggacaactgtcttacaccaaaagaaaaactgatattcaacaatatgaaaaggaaaaactctatgatatagatgcccatatttatagtaatagattcaggggtaaagttactcctacgaaatccacatcggatgaacatccctttaccagcgagggaacattagaaggtggtttttatggacctaatgctgaagaactagggggtaaattcttagctagggataaacgagtttttggggtatttagtgccaaagaaacgccagaaacagaaaaggaaaaattatccaaagaaaccttaattgatggcaagctaattactttctctactaaaacagccgatgcaacaaccagtacaacagccagtacaacagccgatgtaaaaaccgatgaaaaaaactttacgacaaaagatatatcaagttttggtgaagctgattaccttttaattgataattaccctgttcctcttttccctgaaggggatactgatgacttcgtaacgagtaaacatcacgatattggaaataaaacctataaagtagaagcatgttgcaagaatctaagctatgtaaaatttggtatgtattatgaggataaagagaagaaaaacacaaatcaaacaggacaataccaccaatttttgttaggtctccgtactcccagttctcaaattcctgtaacgggaaacgtgaaatatctcggtagttggtttggttatattggtgatgacaagacatcttactccactacaggaaataaacaacaagataaaaatgctcccgccgagtttgatgtcaattttgacaataaaacattaacaggcaaattaaaacgagccgactcacaaaataccgtgtttaacattgaggcaacctttaaaaatggtagtaatgccttcgaaggtaaagcaaccgcaaatgtagtgattgatcccaaaaatacacaagccacatctaaagtcaatttcacgacaacagtaaacggggcattttatggtccgcacgctacagaattaggcggttatttcacctataacggaaacaatcctacagctacaaattctgaaagttcctcaaccgtaccttcaccacccaattcaccaaatgcaagagctgcagttgtctttggagctaaaagacaagtagaaaaaaccaacaagtag

SEQ ID NO: 1819 - DNA, 1461 bp, H. influenzae strain 86-028NP
atgaaaaatggcgtaaaacaaatttctttcttatcattaataggcttatcattaataggcttatcattaacgaatatagcttgggcaaaagttgcacgtcctaaaaatgatacactgacaaatacgattcaaagtgcggaattaaaaacctcctctttttcctctatgcctaagaaagaaataccaaataggcatattatttctctttccaaaagccaattagcacaacatccaagacttgttttgcgtgggttaattcttgctttatatcaaaataacactcaggcagttcaactgttattaccactatataaacaatttcctcagcacgataatttcttactcacttgggcaaaggctattgacgcgcgtgaacaaggtgatttaactcaatctattgcttattatcgtgaattattcgctctagacgcatctttactacctttgcgttatcaattagctcaagccctattttttaactatgaaaatgaatctgccaaaattcaatttgaaaaattacgtacagaggtagatgatgaaaaatttttaggtgttattgatcagtatcttttaacactaaatcagcggaatcaatggatatggcaagtaggcttaaattttttaaatgatgataatttgaataacgctccaaaaagtggcacaaaaattggtagttggaccgcttgggaaaaagaaagtgggaaggggggtagggtattctttatcagtagaaaaaaatggccatgggcagatcatttttttagtaaaactatgtttaatgggaatggaaaatattattgggataataaaaaatacaatgaggctactttgcgtataggtggtggtttaggttatcaaactgccttagttgaagtctcgttgtttccttttcaagaaaagcgttggtatgcaggcggtagctctggaacgaatacaatgaagcaatatgcggataaattgggtattcgtttagaaaacgtagattggctaagtaaaacttggcaaatttctaccgcacttgagtatggagaatctcgttataaaatccgaaaacatttagatggtaattattatttcatttcatcaacactattttatttacctaaaagcactcaattttggtttgttggcatggattttcatcgagaaaatacacaagcattagataatgcttatcaacaaaagacattgagacttggttgggggcaggattggtcttatggtatttcatcacgtcttacttttagttatgccaatcgagtgtatagagagaaagatttgattgggatacagcaaaaaaatcgtgaatacgcaaccacaattactttatggcatcgaaatatacattttatggggctaacacctaaattatcgtgggattatcaaaaatccactagtaatcatgctttttatcgttatgataaaaatagaatttatctcgaaattggaaaaatattttaa

SEQ ID NO: 1820 - DNA, 135 bp, H. influenzae strain 86-028NP
atgaaacgtacatttcaaccttctgtattaaaacgtagtcgtactcacggtttccgtgctcgtatggcaactaaaaatggccgtcaagttttagcacgtcgccgtgctaaaggtcgtaaaagtttatctgcataa

SEQ ID NO: 1821 - DNA, 360 bp, H. influenzae strain 86-028NP
gtggttaagctgaacttttcaagggagttacgtttattaactcccattcaattcaaaaatgttttcgaacagccattcagagctagtactcccgaaattacaatccttgctagaaaaaataatcttgaacatccgcgtttaggtttgaccgttgctaaaaaacatttaaaacgcgcccacgagcgtaatcgaattaaacgcttagtacgagaaagttttcgtttatcacagcatcgcttgcctgcttatgattttgtttttgtagctaaaaatggtattggaaaactcgacaatagcgcatttgcacaaatactcgaaaaattatggcagagacacattcgcttggcacaaaaatcttaa

SEQ ID NO: 1822 - DNA, 261 bp, H. influenzae strain 86-028NP
atggcagagacacattcgcttggcacaaaaatcttaattaagattattcgtctttatcaaattatgattagtccgtttattggggctcgttgtcggtttgtgcctacttgttcttgctatggtattgaagcattaaaaacacacggattattaaaaggtggttggcttacgctgaaacgtgtattaaaatgccatcctttaaacgcaggtggattcgatcctgttccaccaaaaaccaataataatgatgagaaaaaataa

SEQ ID NO: 1823 - DNA, 1626 bp, H. influenzae strain 86-028NP
atggactcaagacgtagcctattagtgcttgcactgatttttatttctttccttgtttatcagcaatggcagttggataaaaatccacctgtgcaaactgaacaaacaacttcaataactgccacttctgacgttccggcaagttccccttctaattcacaagccatagctgattctcaaactcgtggtcgtattattactcttgaaaacgatgtgttccgtttgaaaattgatacattgggtggcgatgtaattagctctgaattattaaaatatgatgcagaattggattcaaaaacaccgtttgaattattaaaagatactaaagagcatatttatattgcgcaaagtggtttaattggtaaaaacggtattgatactcgttctggtcgtgcgcaatatcaaattgaaggcgataattttaaattagcagaggggcaagaatctctttctgtaccgcttctttttgaaaaagatggcgtaacttatcaaaaaatctttgtgttaaaacgtggtagctatgatttaggcgtagattacaagattgataaccaaagtggtcaagccattgaagttgagccttatggtcaattgaagcattctattattgaaagctctggtaatgttgcaatgcctacttatactggcggtgcatattcttcttcagaaactaactataaaaaatatagttttgctgatatgcaagataataatctttctattgatactaaagctggttgggttgcagtgttacaacattatttcgtttctgcgtggatcccaaatcaagatgtaaataatcaactttataccattacagatagtaaaaataatgttgcatcaattggttatcgtggtcctgttgtcactattcctgctggtagccaagagacgattacaagttcattgtggactggccctaaacttcaaaatcaaatggcaactgtcgcaaataatttagatttaactgttgattatggttgggcttggtttattgctaaaccgttattctggttattaacctttattcaagggattgtatctaactggggtttagcgattatctgtgtaacaattgtagtgaaagcaattttgtatcctcttacaaaagcacaatatacttcaatggctaaaatgcgtattttgcaaccgaaaatgcaagaaatgcgtgaacgttttggagatgatcgccaacgtatgagccaagaaatgatgaagctttataaagaggaaaaagtaaatccacttggtggttgtttgccaattcttcttcaaatgccaattttcatcgcattatactggacgttcttagaagccgttgaattacgtcatgcaccattctttggttggatccaagacttatcggcacaagatccttattacattctccctattttaatgggtatctcaatgttcttgttgcaaaaaatgtctccaacaccagtaactgacccaacacaacaaaaagtaatgaattttatgccattagtttttatgttctttttcttgtggttcccatcaggcttggtattatactggttagtatctaacttgatcactatcgcccaacagcaattaatttatcgtggtttagagaaaaaagggttgcattctcgtaaaaaatag

SEQ ID NO: 1824 - DNA, 1359 bp, H. influenzae strain 86-028NP
atgaaagaaacaatcgttgctcaagctactgcaccaggtcgtggtggcattgggattttaagggtctcagggcctttagcaacaaaagttgctcaagctatattaggtaaatgccctaagccaagaatggcagattatcttccttttaaagatgctgatggcactattttagatcaagggattgcgctttatttcaaatcgccaaattcatttactggtgaagatgtgttggaattgcaaggtcacggtgggcaggttgtattagatttattactcaaacgtattttacaaattgacggaatccgtttggcgagaccaggcgagttttctgaacaagcttttttgaatgataaattggatcttgctcaagcagaggccattgcagatttaattgatgcaacatcagaacaagcggcacgctcagcattaaaatcattacaaggcgagttttctaaaaaagtaaatgaattggttgattctgtgatttatttacgtacttatgtagaagcaagcattgattttcctgatgaagaaattgatttcttggcagatggaaaaattgaagcaaatttacgcggtattattaatcagctagaaaatgttcgttctgaagctaaacaaggttctattttacgtgaggggatgaaagtcgtgattgctggtcgcccgaatgcaggcaaatcgagtttgcttaatgcacttgctggtcgcgaagcagctatcgtcacggatattgcaggtacaacccgtgatgtattgcgtgagcatattcatattgatggtatgccattgcatattattgataccgcaggtcttcgagatgcaaccgatgaagtagagcgaattgggatttctcgtgcttggacagagattgaacaagccgatcgtattattttgatgttagatagtagcgatcctgaaagtgcagatttaagcaaagtgcggtcagaatttttagcaaaattaccctcaaccttgccagttactattgttagaaacaaaattgatttaaatggcgaacaagcaagtgaaagcgaacagggcggttatcaaattattagtctttctgctcaaacgcatgatggtgtaaaacttttacgtgaccatttgaaacaagcaatgggttttcaaacaggtatcgaagggggatttttagctcgtcgtcgtcatttagatgcacttgagaaagccgcagagcatttacaaatcggtttggttcaacttacagaatttcatgcaggagaacttttagcggaagaattacgcttagttcaaagctatttaagtgaaattacgggtcaattcacatccgatgatttacttggtaatatttttagttctttctgcattggaaaatag

SEQ ID NO: 1825 - DNA, 1869 bp, H. influenzae strain 86-028NP
atgttaattgaaaaaatgcacaatttaacaaactcaaaggtttctaaatttatcttaggtttgattactgtatcgtttttagttggtggaatgtctggctatctttttagctcaaatgatacttatgcggcaaaagtgaacggcgaagtgatttctcaacaagattttttaaatcgctataatcaagaatttgaaatacgcgcacaacgtgagggagaggcgtttgtggctcagtcagattctcctgaatttgttaccgcacttcgtcaaaacatcgtcaatctaatgattgatcaagaattacttcgccaatatgttaaagaattaaaattaggcgtgagtgatgaaatgattaaacgtgcaatcgtgaccgatcctaattttcaagtaaagggtaaatttgataatgctgtttatcaacgaatattacaacaaaatcatttaacttcagatggttacgcttcaattttacgtgcttcgttacctcttgaacaaatacaaaatggcgttgctaacagtgaatttattgttcctgctcaagtaaaaaatagtgcagaagttttctttcaaaagcgtttagctcgtttagcaactttatctcttgaagatgaaatggcaaaacaatcagtctctgatgatgaaatcaaaacgtattatgaagctaatcaaaagtcttttgttcagccagagcaggttaaagttcagtatattgatctttctgcagataacatcagtagaaatcttcaagttacagatgtagaaattgcgcaatattatcaagataataaagcacaatttatgactcaacatttagcacatattcaatttgcaaatgaacaagatgcgaaagtggcttacgaggaattacagaaaggggcaaatttcgctgatgtcgctaaagcgaaatctttggataaaatttctggtgagaatggcggggatttaggctgggtaaatgagaatgaattaccaaaagcctttgaagatgccgcagctgcattgcaggtagggcaatatagccaaccaatcaatgtggatggcaattaccatattgtgttagtgcaagaacgtaaagcgcaaagtttggagaatgtgaaagctcaaattgcagatttagttcgtaaatctttaatggagagtcgttatttttctttagaaaaacaagcgagtgataaggcttttgaagacagtaagtctcttaatactgcagcacaagcagcaggtgttaaggttcaagagagtgattatttttctcgtcaaaatgtgccagctggattaaatttccctaatgttatttacacaatatttgaatcagatactacgaatgttggtatgaattctgaaccaattaatgtaggcgattatcacacaattattgtacgtgtgttggatcgcaaagcagagggcgtaaaaagtttagaagaggctaaaatcgatattgaaactttcttaaaacgtcagaaagctgagaatgcgcttaatgaaaaagcacaacaagcagtgaaaaaattaagtgaaaaccctgaatcaaaagtagatggcattaatttctcaagtgagcagacttttactttaagtgaaaataaagatcctattttaacaaatggtatattttcaattgctaaaccaaaatcaaatgaagctctttatcaagtggtgcataattcaaatggcgatgtggttgttgttgccttgaataaggttgaacaaggcagtttaagtgaaaaagaattgtcgcaatttggtatgcaattattgcgtagtcatcaatctgaattacaatttcagttaatacaaggattacgtgagagagcaaaaattgaggtaaatgactctttcatcaatcaagatgatgaagtgcaacaataa

SEQ ID NO: 1826 - DNA, 1560 bp, H. influenzae strain 86-028NP
atgatgtttgggaaagaaataattcattctaaaacaatatggttttattttttgttgtttctcttttccatatttaccaatatgggattaggcaatgtattaagtgagaatattcccgtttcagattacgcaattttatttgttatcacggcgatttctttttattttaccccttggcttgggcgaatattaattactgtattattcctcagtgcgctattttattgctctgctggttttttctatggaattccatctttggggattatcgcttctgtttatgaaacgaatattaatgaaaccttagaatattacacaaccattcctttttggatatttttatttcaagttagttatatcattttatttgttgctttaatgaaattaagtttttatgttaaacaacaagcatttaaatggctaaatatggttgttatcagcctattattagttttttcttataatcaattttctaattggaactacgcctataaattccgtttttatccagttcttttttattctgaatttgatcgaatgaatgatctatatttagaacaacgagattttctaaatcaatccgttaatgcgccgtctcaatgggatattcaatcttttacgccaaaatataaaaattatattttaattattggtgaaagtatgcgaaaagattatatgtcgttatatggctttccactgaaaaccacgccatttttagagcgtgtgaaaagcacagtttttgaaaattattattctgcagcaccgaatacgcaaccgtctttacaacacaccctatatcgagcagataaaggagaaacggtttatacggataatattatttctttagccaaaaaagcgggcgtgaaaacttattggatttctaatcaaggcaaaattggggaatttgatacgatggcctctcgtattggtcaaagtgcagatgaaacgatttttatgaagccgttaggttataactctaaaaaagtttatgacgatgaaatgttgcctgtattagataaagccttaaaagaaaatattacgaatccaaaattaattgtgattcatttaatgggctcacatccagccttttgtgagcgtcttccgtacgaagttaaaaattattttattaatcaatctatgtcttgttatttagaatcgattaaatatacggatcagtttttagaaaaattaaattcgcagttagtatcgcaaaatgaaccctattcggtgatttacttttctgatcatgggcttgctcattatgaggattctgaaggtttatcattgcatccaaataatctttataaacaaaattatgaaattcctttcgttatgttttcgagtgatagtaaaaagctagaaaaaataaaaacgccacaatcggcatttaattttgtttatggttttgctgattggatgggaattaaggaaaaacatttacaaggcgtggatttcttccatcctgaaaaacaggaaattaaagtatttgattggaataacgttgtaaatgttaaagagttggctgatgatccagcaaaattaccagaagccgttcagtaa

SEQ ID NO: 1827 - DNA, 516 bp, H. influenzae strain 86-028NP
atgtccaaaaaatcagggctttcatttttatggttaagtgcggtcgctttcgtggttgatttgcttacaaaatacattgtggtacaaaaatttgatttgtatgaaagtgttaatgtgctgcctgtttttaacctgacttatgttcgaaattatggcgcagcatttagtttcttagcggatcatagtggttggcaacaatatttctttattttgttggcattggctatttcaggaatgttggtctattttttagcaaaaaataatgccgaacaaaaaatccaaaattctgcttatgcactgattattggtggggcgttagcgaatatggtagatcgcacttacaatggtttcgtcgtggatttctttgatttctattgggatatttaccattatccagtatttaatatcgccgatattgccatttgtattggcgcagggttattagcattagatgcgtttaagagcgaaaagaaaaaagtacaagataaacaagtagaaaagtgcggtcaaaaatga

SEQ ID NO: 1828 - DNA, 945 bp, H. influenzae strain 86-028NP
atgaagataattttagccaatccacgaggattctgtgccggtgtagaccgtgctattagtattgttgaactcgccttagaaattcatggcgcaccgatttatgttcgtcatgaagtggtgcataaccgatttgttgtgaacggattgcgtgatcgtggtgcgatcttcgtggaagaattaagcgaggtacctgatggtgcgatcgtgattttttctgcgcacggcgtatctcaagccgttcgacaagaagcgaaagaccgcaatctcaaagtatttgatgcaacctgtcctttggtgaccaaagtgcatatgcaagttgctcgtgcaagtcgaaagggaacaaaagcgattttgattggacataaaggacaccctgaagttgaaggcacaatggggcagtatagtaatgaagatggcggaattttcttgattgaaaaagtagaagatattgcacgtttgccaatgcaagacaatgatgatttaacctttatgacgcaaaccactttatcgctagatgatacagcagaaactattgctgcattaaaggaaaaatatcccgctattcaagggccacataaaaacgatatttgttatgcgacaaccaatcgtcaagaagcggtgcgagaattggctaaattatcagatttagtgttggttgtggggtctaaaaactcatcaaattcaaatcgtttagctgaattggcgtctcgaatggggattaaatcacagcttcttgatgatccttccgatattcaagatgattggtttaatgatgtaaaaaccatagggattacagctggcgcgtctgcaccagaagaattagttcaatcgattatttcccgcttaaaagagtttggtgcggatactatagaagagctgcaaggtttagaagaaaatatgttctttgaagtgccaaaagagttgagaataaaagaagttaattaa

SEQ ID NO: 1829 - DNA, 348 bp, H. influenzae strain 86-028NP
atgaaattaatgaaaacattattcacttcgtttgtattgtgtgggtcacttgcagctggttccacttttgctgaagacaaggtggttgagcaaacaactcaagctgttgtgaccactcaaacggattcacaagtagcaccagctatgatgggagataaattgaatattaacatagcaactgccagtgaaattcaaaaatccctaactggcattggtgcgaaaaaagcggaagctattgtgcaatatcgtgaaaaacacggtaattttactaatgtagaacagcttttagaagtacaaggaattggcaaagcaacactagagaaaaatcgtgatcgtataatcttttaa

SEQ ID NO: 1830 - DNA, 999 bp, H. influenzae strain 86-028NP
atgaaacttcttaaattaaccttaatttctaccgcacttttttccactgctgcattagcacaatcacagcaaagtgtgaacgtatatagctacgattctttcacttctgaatggggtgctgggccaaaagtaaaacaagattttgaaaaagcacacccacaatgcactattaattttacgccttttgaaagcgttggagtgttgctcaaccgtgttcgcttggaaggaaagaaaacaaaagcggatattgtgctaggtttagataacttttttttggaacaagctgaaaaaacaggtatttttgcaccaaataacgtggatttaactcagcttgatttaccaacaaaatggacaaataagaccttcttacctttcgatttcggtaattatgcttttgtgtacgataaaaccaaattacaaaatccgccgaaaagtttgaaagaattagttgaacgccaagatcttcgtgtgatttatcaagatcctcgcaccagcagtgtgggacgtggtttattggtttggatgaatgtaatttatcctgaagataaaattcaatctgcttggaaaaatttagataagcatacggtaacagtgggtaaaggctggtcagatacttacggtgcattcttaaaaggcgaagcggatttagtattaagttacagcacatcgccactttatcatcaactttttgagaaaaaagataattatgcggcgacagattttgcggaagggcatattactcaagtggaattagcggcgcgagttgccaaccatccaaatcaatgtgcggatgattttatggcatttttaatttcgcctacagcacaaaaacatattgtgacagccaatattatgttgccagttattcaaggcgaaattgaaccgcactttgatgcgctgaaagttcaacaaaaaactcaaacgccaattaatccaacagtgaatgctgagcagttaaaaaattggatcagcacttggcaaactacattaacaaaataa

SEQ ID NO: 1831 - DNA, 1617 bp, H. influenzae strain 86-028NP
atgttgtcgttatttcatcatccacaacttcgccctcgtcattatgcgggcggggttgttgtcattagtttcattattcttttttatggtagtgccttaagttcgatctttacattgggcgatgaattgcaatggcgagcttggtttactgatgattacctacagcatctgattcttttcagttttgggcaagctttactttctaccgttttatctattttctttggtttacttctcgctcgggcattattttataagccattttttggaaaaaagtggttgttaaaattaatgtcgctaacttttgtcttacctgctttagtggcaatttttggtttgatcggtatttatggttcaagcggttggttagcttggtttgctaatctttttggaatgtcgtggcaggggcatatttacggactgtcgggtattttaattgcccatctttttttcaatatcccactggcagcacagcttttcttacaaagtttgcaaagtatcccttatcagcaacgtcagcttgcagcacagctcaatttgcaaggttggcaattcgttaaattggtggaatggcctgtttttcgtcagcaatgtttgcccacatttagcttgatttttatgctgtgctttaccagttttaccgttgttcttacgttaggtggtgggcctcaatatacaacattagaaacagcaatttaccaagcgattttatttgaatttgatctgccgaaagcggcactctttgctatgttgcaatttgtattttgcttgcttttatttagtttaacatctcgtttttcgccttctaatcaaaatggcttgagcaatagtaatatttggtttgtgaaacctaaaagtgcggtcaaaattttctatgtttttgttttaattgtttttgtctttttccttttttcgccagttttgaatattcttattagcgcattgagttcatcaagtttactcaaggtttggcataattctcaactttggcgtgcgttaggttattcactttctatcgcacccttgtccgcattacttgcattaacgatggcgattgccttattgcttttatcacgccgtttagaatggttacattatcagaaaatcgctcaatttattattaatgcaggaatggtaattttggcaatcccgattttagtactcgcaatggggttatttttattattacaagagcgtgatttttcgaatattgatttgtttattatcgttgtattttgcaatgcgttaagtgcaatgccttttgttttacgtattttgagcgcaccttttcataataatatgcgttattacgaaaatctgtgtaacagtttgggaattgtgggttggcaacgtttttatctgattgagtggaaaaccttgcgcgcaccgttgcgttatgcttttgctttaggtttggcgttatctctcggcgattttacggctattgcgttatttggcaatcaagagtttacttctttaccgcatttgttatatcagcagttaggtaattatcgtaatcaagatgccgctgtaaccgcagggattttattattgctttgtggcatattgtttgcctttattcacacatatagggatgctgatgatttatctaaataa

SEQ ID NO: 1832 - DNA, 654 bp, H. influenzae strain 86-028NP
atgctgatgatttatctaaataatgtgattttgaatgataaaaccttaccaatgtgctttaatttgaacgttaaggctggcgaacgtgtcgcaattattggcgaaagtggggcggggaaaagtaccttattgaatttaattgctgggtttgaatttcctgctcaaggagaaatttggttaaacgataaaaatcatacgcgtagtgcgccttacgagcgtcctgtttccatgctatttcaagaaaataacttatttccccatttgactgtacaacaaaatcttgccttaggaataaaaccctctttaaaattaaccgcacttgagcaggaaaaaattgaacaggccgcttgctccgtaggattgggcgattatttagagcgtttaccgaattctctttcgggggggcaaaaacaacgagtggcattggcgcgttgtttgttgcgagataagccaattttgttattagatgagcctttttctgcattagatcagaaacttcgggtagaaatgctggctttaatcgctaaactttgtgacgagaaagatttaacattgctacttgttacccaccaaccatcggaattaatcggttcgatagatcaagtgttagtggtggaaaatggtcagataagtcaattgcaaaaaggggtgtaa

SEQ ID NO: 1833 - DNA, 1002 bp, H. influenzae strain 86-028NP
atgttagcggaaaaattacaaattaactctattacacctcatccaagtgtagaatattggtctgtttgcaaagttgaggcgttatttgaaacgccatttttggaattagtttaccgagcaacgcaagttcatcgtaagcattttaatcctcgcgcgattcagttatccacgttaatgtctatcaaaacggggggatgcccagaagattgtagttattgccctcaatcagcccgttatcatactggcgtacaaaatcagcagttattagatgttgatgagatcgtcgctaaagcaaaaattgcgaaagcacgtggtgcgggacgtttctgtatgggggctgcttggcgaggccctaagccaaaagatattgagaaagtcacagaaattattaaagccgtgaaatcacttggtttagaaacttgcggtacctttggtttattgcaagacggtatggcggaagatttaaaagaagctggattagattattacaatcataatcttgataccgcaccagaacattatgcagaagtgattggtactcgccgttttgatgatcgtcttagtaccttaggaaaagtgcgcaaagctggattaaaagtgtgttgtggtggcattgtggggatgaatgaaacccgtaaagaacgggctggattaatcgcgagccttgcaaatcttgatccgcaacctgagtcagtgccgattaatcaactcgttaaggttgaaggtacaccgttagccgatgcggaagaattagattggacggagtttgtgcgaacgattgctgttgcacgtattactatgccaaaaagttatgttcgcctttctgcaggtcgtagtggtatgactgaagaaatgcaagcgatgtgttttatggcgggggcaaattcgattttctatggcgataaattacttgttacagataatccagaagaagatggcgatcagttattgatggcaaaattagatttagagccagaaactgcagaaaataaaaagttgtag

SEQ ID NO: 1834 - DNA, 1998 bp, H. influenzae strain 86-028NP
atggcaactcgtagacaattagccaatgcaattcgtgtcttagcaatggattctgtacaaaaagcgaaatctggtcaccctggtgcaccaatggggatggcggatattgctgaagtattatggcgcgactttttaaaacacaatccaaccaatcctaaatgggctgatcgtgaccgttttgtgctttcaaatggacacggttctatgttgatttatagtcttttacatttaactggctatgatctttctatcgaagatttaaaacaattccgtcaattacattctaaaaccccaggtcacccagaatatggttatgcacctggtgttgaaaccacgactggcccgttaggtcaaggtatcactaatgcggtgggtatggcaattgctgagaaaaccttagctggacaatttaaccgtgaaggccatgaaattgtcgatcaccacacttatgtgttcttaggcgatggctgtttaatggaagggatttctcacgaggcttgctctttagcaggaacattaggtctgggtaaactaatcgcattctacgatgacaacaatatttccattgatggtcatgttgatggctggttcagtgatgacaccgccgagcgttttgaagcttatggctggcaagtaatccgtaatgtaaatggtcacaatgcagagcaaattcgcgctgctgccgttcttgctcaagcagaaaaagaaaaaccaacgttaattatttgtaaaaccatcattggttttggttctccaaataaatcaggttctcatgattgccacggtgcgccattaggcgatgaagaaatcgctttaacccgcaaagcacttggttgggaatatgcgccatttgaaattccagctgaatactatgctgaatggtcggcaaaagagaaaggtgctgcagcagaaaaatcttgggaagaaaaatttgccgcttatgcaaaagcctatcctgaattggcagcagaatttaaacgtcgtgtttctggcgaattaccaacaaactgggcggcagaatctaaagcgttcatcgaaaaattacaagcaaatccagcgagtattgcaagccgtaaagcatcacaaaatgccattgaagcctatgcacacctattgccagaatttttaggtggttctgcagacttagcaagctccaacttaaccttatggagtggttcaaaaccgattcgtgcccacgaaaacgtaagtggtaactacattaactacggtgttcgtgaatttggtatgtctgccattatgaacggcattgccttacacggcggtttcattccttacggcgcaaccttcttaatgttctacgagtatgctcacaacgcagtacgtatggcagcattaatgaaacaacgcacattattcgtttatacccacgattccatcggtttaggcgaagatggacctacacaccaaccagtagaacaaacggcttcactacgcttaattccaaaccttgaaacatggcgtccatgtgaccaagttgaatcagccatcgcatggcaacaagcggttgaacgtcaagatggcccaagtgcgttaattttcactcgtcaaaatcttgctcaaatgaaccgcacttctgcacaattagatgcggttaaacgtggtgcttatgtattaaaagactgtgatggcacacctgagttaattttcattgcgacaggttctgaagtggaattagcagtgcaagcagccgaagcattaagtgctgaaggtaaaaaagtacgcgttgtttctatgccaagtactaaccgtttcgataaacaagacgaagcataccgtgaaagtgtattacctgcagcggtaaccaaacgtgttgcgattgaagcgggtattgctgacttctggtataaatacgttggattcaatggtcgtgttgtcggtatgaatagctttggcgaatccgcaccagcagatcaattatttaaactctttggtttcactgttgaaaacgtggtagcaaaagcgaaagaaattctttaa

SEQ ID NO: 1835 - DNA, 945 bp, H. influenzae strain 86-028NP
atgcaaattcaatgtttcgaaagtattacacaaaaatatccacaatttcctaccgcacttttggctaatgaggagcctatacagaacggagagccttttatcttatacggcacaaagttggacataactaagctagaaaaatttcaacaaaagtgcggtcaaaattttcagatttttgatgtttggatggtagcgaaaaatattatcgtcttattgaaaggtcaatggttttctgatttcattaaatttgctcacgatgttgaagtggatattgctaaattagatttcagccctaaattgtctcaagcagggttgttggtgatggatatggattctaccgctattcaaattgagtgtattgatgaaattgcgaaactagcgggtgttggcgaacttgtttctgcgattacggaaagtgcaatgaggggggaattagatttcgagcaaagtttgcgttgtcgagtgggtacattaaaaggtgcgccagaaagcattttgcagcaagttagagagaatttaccgctaatgtctggattagttgaaacgatccaaaccttacaaaaatatggctggaaaactgcaattgcttcaggcggatttacttattttgcggattatttgaaagccttattgcaacttgattttgctgcatcaaatcaatttgatattgaagatggaaaactcacaggcttagttaaaggcgatgtggttgatgcccaatataaagctaaaacattgcaacatttgttagaggaatacggtatttattcccaacattctattgctatcggcgacggtgcaaatgacttggcaatgatgaatgtggcgggactaggtgttgcgttccatgctaaacctaaagtgcaacaacaagcgcaaattgtggtaaacttcgccgacttaaccgcacttttatgccttctaagtgccaatgatcgaatttaa

SEQ ID NO: 1836 - DNA, 492 bp, H. influenzae strain 86-028NP
atgccatcttttgatattgtttctgaaattactttacacgaagttcgtaatgcagtggaaaatgcaaaccgtgtgcttagcacgcgttatgattttcgtggtgtcgaagcggtaattgaattaaatgaaaaaaatgaaacgattaaaatcaccacagaatctgatttccaacttgaacaattaattgagattttaattggatcttgcattaaacgtggtattgagcacagttctttagatattccagcagaaagcgaacaccacggtaaactttacagtaaagaaatcaagcttaaacagggtattgaaacagagatggcgaagaaaattactaaattagtaaaagattctaaaatcaaagttcaaactcaaattcagggcgaacaagtgcgtgtgacaggtaagtcacgcgatgacttacaagcagtgattcaacttgtaaaaagtgctgaattaggtcagccattccaatttaataattttagagattag

SEQ ID NO: 1837 - DNA, 948 bp, H. influenzae strain 86-028NP
atgatcaatgcgtttgctatcaatgattcccgcttggttcgtattgacgaagaccaaactgatctcaatactgccatttggcttgatttacttgagccgacaggcgaagaacgtgaaatactacaagaaggcttaggtcagagcctagcatcttttctagaactggaagatatcgaagcttccgcccgtttctttgaagatgaagatggtttacaccttcactcatttttttattgcgaagatgaagacaattatgctgatttagcgagcgttgcttttactattcgtgatggtcgtttatttacgttgcgtgatcgcgagctacccgcattccgtttataccgtatgcgttcacgtagccagcgtttgttagaatgcaattcctatgaagttttactggatttatttgaaacgaaaattgagcaattagcggacgtgattgaaaatatttatgcagatttggaagagttaagtcgcgttattttaaacggaaaacaagatgaagcctttgatgaagcattaaatacactcacggaacaagaagatacgagctcaaaagttcgtttgtgcttgatggatactcaacgtgcattaggtttcttggttcgcaaaactcgcttaccaactaatcagttagaacaagcacgagaaatcttacgagatattgaatctttgcaaccgcataatgaatcattattccaaaaagtaaactttttaatgcaagctgcaatgggttacatcaatattgaacagaacaaaattatgaaattcttctcggttgtttctgtgatgttccttcctgcaacattagtcgcgtctacttatggtatgaactttgattttatgcctgagttacattttaaatatggctatccaatggcaattggattaatgatcgcagccgcactgacaccatatatttattttagaagaaaaggatggttatga

SEQ ID NO: 1838 - DNA, 555 bp, H. influenzae strain 86-028NP
atggttatgatggaattatcccaaaccgcattatttatcggatcaattattaatctttacgcacttgtagtaatcttacgagcttggttgcagtttgctcgtgtggattattacagtcctgtttcaacatttgcagtcaaaatgactgatccaatattaaaacctctgcgtaaaattgcgcctactgtgaaaaatatcgatacttccgcattactgcttgtatttattattggtatgttaaaaggtattatttattttggcttatcagtaaatgtactcttagtattgggcgtattaactgtattgaaaagcattggtttagctattttctatgtgctttttattggggctgttttaagttggtttaatcgaggtaataattctataagttatgccttttatcaactctccgaaccacttttaaaacctatccgtcgattcttacctacattaggcatgattgatttttctccgatggtcgttgtatttatcttattatttttaaataattttatgcttgatcttctaggtggactttggattatcgctggttag

SEQ ID NO: 1839 - DNA, 885 bp, H. influenzae strain 86-028NP
atggtgttaaatcactcacatattgtgaggttatatctaattaaaattatgtgtcaattactcggaatgaattgtaatacgccgacggatattgttttttcttttgaaggtttccgtcgtcgcgcaggtttaacagattgccattcagatggctttggggtcgctttttttgaaggacgaggtgtacgtatttttcgtgataatcaaacagccagtctttcccccatcgcagattgtgtaaaacaatataatattaaatctcttaatgtcattgcgcatattcgtaaagcaacacaaggcgaagtcaatattgaaaacacccatccgttcattcgtgaaatttggggacaaaactgggtttttgcacataatggtaatttaaaaaacttaccagatatgacagatcattttttacagccaataggttctacagattctgaagctgctttctgttatatggctgagtatcttaaaaatactttccgcaaaaaaccaagtgaaatggaaatttttgaagcaattcaaaaagtaacacaagaacttgctcaacacggtacgtttaatttcattctttctaatggcgagtggatgattgcacattgctcaacaaacttacattatgttatgcgaaaagcaccttttggcaaagctcaccgtattgatgatgatggagtaattgattttagcaattatgcaaaagcaggagataaggtcaatatcatcacaacatttcctttaaccaaagatgaatcttggacaaaaatggaaaatggtggatttgtgttttttaaaaatggagagaaaatcgccgaagttattgggacgccaaaagaagcgattgatgatggtactttaggtaataggacaataaattctgctatttaa

SEQ ID NO: 1840 - DNA, 528 bp, H. influenzae strain 86-028NP
ttgcacagtccccaatttccgctatcatacgcgcctcttatttctccgaattttgtatttatgaataaattaaagatggcattgtttgttggggctcttgtgagtttatttgcttgtaccacaatacatcagccgaagaaaacggttaaatctcgatttttaaagaataatattagccaaactgagttaaataattctgttaattacaagccatatcattatcgttgtaataataaagaaactgggggaatttctcatttgacgacttatttccctctgtcgcgtgaaagccgtatgaaagaaaattttagtttttattttcagttagataatggcaaagcgataccttttgatcatttatatacgctaacactcaatacccgtggtacaaaatttgaagcgatttatcgttcgtatgatccaattcaaggaagttatgtagatttaatcgtgcgatctcaaagttcaatttactacaagaatcaacaaggcaagcaagtaacttggttaaattgcaaaggaggttaa

SEQ ID NO: 1841 - DNA, 1203 bp, H. influenzae strain 86-028NP
atgagtaaaactatgatctctcgtgaaaattatttacagcaactgattcaatttaaagatactgattttatcaaagtcatctcgggtgttcgtcgttccggtaaatcggtgctactcatgcaataccgtgattaccttcaacaacaaggcattgcttccgaaaatattctttatctcaattttgaatcttttgaatatcaatgggtgaaagacgctcaagattttcaacagctgattcaagaaaaaatgccgtcttctcaaaagaaaatctactttctgattgatgaaattcagtttgtggaaggttggcaaaaaatcgtcaatgggcttcgcgtgagttttaacgctgacattgtgattacaggttccaatgctaacttgctttccggcgagcttgcgacgttgttaagcggtcggtatgtagaaatcaaaatttatccgctttctttcaaagaatttttgcacgccaaaaatgtggatagccaatcaagattggtcgataaactctattcggaatatgaaaaatatggcggtttccccagcgttgtgatggctgatgagcctttaaaagaaacgattttatcgggtatttttgattccatcgtgctaaatgatattgcccaccgagctggagtgaaagacacgcatattcttaaaagtgtaattctctttttagcggataacgtagggcagttggtgaatccaagcaaaattagcaacacgctcacgtccgaacgtgttcccacttcaaatcacaccataagcaaatatcttgatttgttagaaaatgcctttcttttttataaagcaaaacaatacgatattcgcggaaaaggctatttaaaaaccaatgccaaatattttattgtggataacggtttaagacgacacgctatcggcaaaaaaggtgcgaattatgccaatcgcctagaaaatattgtctttattgaattgcttagacgaggttataccgttgatgtgggtaaactcgacagcaaagaaattgattttatcgcccgaaaagctgatgaaattttatatgtacaagtcgcttttgaaatccctgaaaatacccacgaaacagataatcttttgcatattaaagataactataaaaagattttaattacggggaaatattacgaacaaacagagattgatgggattgaagtgatttatgtggtggattggttgttgcaataa

SEQ ID NO: 1842 - DNA, 1350 bp, H. influenzae strain 86-028NP
atgggagaaaattttatgtccttaaataattcgctaacaacttttaatagtcagttacccgatttatcagttaatactattcccgcaattaatcaactagtttctgctcttcgcattccaagagacgttttagcaagtgatgaagaaattagatatgcttggaatgatttacctagagaattaagaaatataccagtccagaatgtgaatcctgagcttattgctcgtatgtgcattgcaattagctcaggattatttgatggtgcaatcaactatatatggaatgcttctattttgagattgcgtgataaagttagaacctttggtcttccaattgttgctcaagtattggaaagggattttgaagaaggccatttaatagcattacaggatagtcagttactagatttatgtttgcaattaaacattcttaacgaagaaggctttctttttctaggccaatgtagaaatatccgtaataatttttctgctgctcacccttcacttggcaatttgaatgatagagaattcattacattcttaaatcgttgtataaaatatgctttaggtgattcttcttcacctaaaggagtcaatattagtgattttattcaatcgattaaaggtggaagatttaatcaagaacaaagggaatattggattgataggctatctaaaactcacgaagcacagaaacaattattgattattatggcacacggtatttattgtgacccaaactcacaggaaacaactagattaaatgctttagatatttgtgctttctttcaaaatagtttttctgcttcactaaaatcttcattaattgataaacactctgaatatatcgcaaaaggagatgaacaaagattaagagcatctagtcaattttttgagaaattaagtttattagggttgctatcagctccacaacaacatgcgattttttcagcagcaattaacaggttgcaaatcgctcatgatgggctaaacaatttttataatgagcctccctatgctgaaagattagcagaattgtctcaaaatacagcagtccctgaaacagcccaaagtgattttgtagatacgatagtttcttgttatttgggaaacaaatatggagtttcatggggagcaattccattttatgaaaaaattattagaaacttttctccaaaagaaattaacctaatgattacccatgcaaaaattaatagttctaaaattggaagaaaaaccaacgatgaatatggaagaataagatttatagaagctttaaaattaattgattctggaagtattccaagtggagttcgcccagcatatgaccaattattaaataataagtag

SEQ ID NO: 1843 - DNA, 501 bp, H. influenzae strain 86-028NP
atgaaaaacgaagcctattatcaggcttatttaagccaccatcacatttctcgtagaggactattgcgtcatatatttccagctacaaaatcaacaatagaaaaaacgcaatctcgtcctcccttttcagcacgagaagatttattttccgccgtctgcaatggttgtggggaatgtgcttcagcttgccctaatggtttaattcaactaaaacagcaacaagccacccttgaaattgactacgcaccttgtgatttgtgtggtaaatgcgcagaagtttgtccgacaaatgcactacatcctaattttccagcggatacattacttcgtccacaattttcctcagcctgtttaatcctacaaaatcaaacctgtccagactgccaaaccgcttgcacacaacaagcaatctccagcactttagagattgataatgaacgttgcaatgggtgcggagaatgtaaaattacctgttttgtcgcagccattacacttaaataa

SEQ ID NO: 1844 - DNA, 612 bp, H. influenzae strain 86-028NP
atgcaaaatactcttcaacaaatttctatttatgggcgtttactcggtgcagtattttactatgagcctaatgatgcacgacttactgatattttgacattctttcgccaaccaaattggatgcaagaatgggaaatttcatttgatgtaaaaacacataaaaaaattaccgcacttattgaaaaagggctgcaacaaaatatcaatgaacaatatcagtatttatttattggtccaaatgaattacctacgccaccttggggatccgtatatcttgatcctgaatgtgttatttttggtaattctctcttagcattacgcgatttcttacaacaacatcaaatcgcatttcaaacacaacaagatgaaccagaagatcatattggcttaatgttaatgcttgctgcatatttagcagaaaatcgaccgcacttattaatcgaatttctacgtgaacacttcttaacttgggcgtatcatttccttgaacaactaagcaaaatagaaaattctgatttttatcaagctcttgcattacttaccctaaaaactttacaacaatggcaagtagatttacatattaatataccgacagtaagattttatcgataa

SEQ ID NO: 1845 - DNA, 840 bp, H. influenzae strain 86-028NP
atgaatacaggattatatgaactgccactagtattttttacagttttggcacaaagtgcggtcggtgcttggcttgttttcacatttgtactattaaatgagaaaaatacaaaaagtcgcacttatattcataaagtaatgtttgtgattttggctttgctaggtattggatttattgcttccattatgcatcttggcttacctatacgtgcatttaattcacttaatagagtcggctcatcaatgatgagtaatgaaattgccactggtgcaatatttttcgcattagcaggtttctactggctgattgcaattttaggtaaaatgccagcttcacttggaaatgtatggcgaattgtgaccgcccttatcggcatactatttatgtatgtaatgaatcaggtttaccatattacaagcataccaacttggaataatgcattaacctcttggtcattctatcttaccgttgtattaggtggattaacattaagctatgcgttattaatccctaataaacaacgtgaatatcagcttcagcatctgccaagtttatttgccattggagtattattggtcgcaatagtagccatatatcaaggcttcaatttacacaatattcacagtgctattcaaaatgccgctgacctcgtaccaaattatgccataatgaccgtaactcgcttatgtttactttccattgtagctttcctcttattccgagtgaaaaacataggactattaggtatttccgttctattaacgttagtagctgaaggcatcggtcgcgtattattttatggattacatatgacttacggcatggcgattggtggttaa

SEQ ID NO: 1846 - DNA, 618 bp, H. influenzae strain 86-028NP
atggaacaatatggtttttattttgattctgaacgctgcacaggctgtaaaacttgtgaattagcctgtaaggattacaaagatcttggcacagaagtcaattttcgtcgtatttatgaatatacaggtggtcagtggaatcaacaagcagatggatgctggcatcaaaatatatttgcttattatatgtctatttcttgtaatcattgtgcagatcctgcttgtacaaaagtttgcccaactggtgcaatgcacaaaaatgcagatggtttcgtgatcgtcaatgaagaaatttgtatcggttgtcgttattgccatatggcatgtccttatgatgcaccgcaatatgatgcacaaaaaggtcatatgacaaaatgtgatggatgttattctcgcgtaaaatcaggtcaaaaaccgatttgtgctgatgcctgcccactacgagcattggatttcgctcctattgatgaacttcgagcaaaatacggcactcaagcctccatcgcaccactaccaccggctgatatcactcaaccaaatttagttgtaaaacccaataaacacgctcgtttaagtggcgatacaagtgggttcttaggaaacccaagagaggtgtaa

SEQ ID NO: 1847 - DNA, 2421 bp, H. influenzae strain 86-028NP
atgagtaactttaatcaaataagtcgccgagattttgtcaaggcgtcatctgcgggagctgcactggcagtttcaaatcttactttacctttcaatgtaatggctaaagagacacaacacctcaatgaaaatagtcaggaacgtattgtttggagtgcttgtacagtaaactgtggtagccgttgtccattacgaatgcacgtaaaagataaccgaatcacttatgtggaaaccgataatacggggacagaaacatataatcttgatcatcaggttcgtgcttgtctacgtggacgttctatgcgtcgtcgagtgtataacccagaccgtttaaaatatccaatgaaacgtataggtaaacgcggagaaggtaaattcaaacgaatcagttgggatgaggctttaactgaaattgcagacgcattgaaacgcaatatcaaaaaatatggcaatgaatcaatttatttaaactatggtacgggaacactcggtggcacaatggctaaatcttggcctcctgcatccactatgatcgctcgttttatgaattgtattggtggatatttaaaccattatggtgattacagcaccgcacaaattgcagtcggtttagattatacctatggtggtggttgggcattgggaaatggaatggctgacattgaaaacaccaaattaatagtgttattcggtaataatcctgcagaaactcgtatgagtggaggtggtttaacttattgtattgaacaagccaaagctcgttccaatgccaaaatgattattatcgatcctcgttataatgatactggtgcagggcgtgaagatgagtggatcccaattcgtccaggcactgatgcagccctcgtttctgcccttgcttatgtaatgattcaagaaaatctcgtggatcaacctttcttagataaatattgtgttggttatgatgaaaaaacattacctgcggatgcccctaaaaatggtcattataaagcctatattttaggttatggtaatgatggtatcgctaaaaccccagaatgggcggctaaaatcacgggtattccggcggagagaattattaaactcgcacgtgaaattggcagcacaaaacctgcctttatttcccaaggttgggggcctcaacgtcgtagtaatggagaattaatctctcgtgccattgcgatgttgccaatcttaacaggtaatgttggaattcacggcggtaacactggtgcacgtgaaagtgcgtatagcattccatttgtgcggatgccaacgctaaaaaatcctgtgaaagcaagcattccaatgtttttatggacagatgcaattattcgtggcacagaaatgaccgcacttacagatggtattcgtggtgttgataaattatcgtccccaattaaagtaatttggaattacgcaagtaactgtttgattaatcaacacgcacaaatcaatcgtactcacgatattttacaagatgatacccaatgtgaaatgatcattactattgataatcatatgacatctactgccaaatacagtgatattttattaccagattgtacaacttcagaacaaatggatttcgctttagatgcctttgtatccaatatggcctatgtcatttttgcagatcaagtgatcaaaccatcttttgaatgtagacctatttacgatatgttgagtgatttagctgagaaaatgggcgtaaaagaaaaatttactgaaggaagaacacaagaggaatggttacgccatatttatgagcaatctcgagaaaaattacctgaattacctacttttgaagaatttagacaacaaggtatttttaaaaaggttgatcctaatggctttaaagttgcatacaaagatttccgtgataatccagaagcccatccacttaaaacgccatctggcaaaattgaaatttattcttctcgtctagctgaaatagcaaacacttggaaattagcagaagatgaaataattcatcctttaccaattcacgcccaaagttttgagcattacggcgatccattaatggaaaaatatccgctacaactaagtggttttcactacaaagcaagaacccattcaacttatggcaatgtggatgtattaaaagcagctaatccacaagaagtttggatgaatcctattgatgcagaacctcgtaatattaaaaatggcgatatgattcgtatctttaatgatcgaggcgaagtacgtattaatgtaaaaattaccccccgtattattccaggggttgtggcattaagcgagggggcttggtatgcaccagataaagatcgtatcgatcattcaggttgcattaatgtacttacgacacaacgcccatcaccgcttgcgaaaggtaatccgcaacattctaatttagttcaagtggaacgtttgtag

SEQ ID NO: 1848 - DNA, 1110 bp, H. influenzae strain 86-028NP
atgaagaaacttatcgcggttgcggtgttttctgcgtgtggctcgttagctcatgcaaacaccattattccaaactacaatacagacgcccatctttacgaattcacgcaaacctatgatttagttgtgccaaaaggctcgcaaggacaaaccaatttatgggttccattaccatttaatggggaataccaacaagtgaaatcgattcactttgaaggtaattacatgaatgcctatgtaacagaaaacaataaatacggagcgaaaaccttatttgccacttgggataaagatgcacaaaaacgtgatttaaaagtcacgatggtcattgaaacaaaagaccgtgaaccgatggtgaaaggtgctttagagaattatactccgccaaaagatattcagtattccgtggatgtacaagaatacttaaaagctactccacatattaaaactgatggcattgtgaaagaatttgctgacaaaatcctaggtaaagaaactaatccattgaagaaagcagaacttattcaccactggatcgtaaaaaatatggaacgtgataattctgtattaggttgtggtgacggcgatgtagaaaaaattcttaccactggcgtgttaaaaggtaaatgtaccgatattaactctgtatttgtggcacttgctcgtgctgcaggcatccctgctcgtgaaatttttggtattcgcttaggtacggcagagaaaatgggcaaatattcaaaaggtgccttcggtagtgcaaatgaacaaggcatcgtaaacgtaagtggcggtcagcactgccgcgctgaattctaccttgcaggatttggatgggtaccagttgattccgcagacgttgccaaaatgcgtttagcagagaaaaaatctgttgaagataaagatacacaagccgtagcaaaatatttgtttggtaactgggaagcaaactgggtgggatttaatcatgcccgtgacttcgatttatatccacaaccagaactggctccaatcaataacttcggctatccatatgcagaagtaggtggcgatccgttaaattcctttgacccaaaagaatttaaatatgactacgtatctaaaaaactctaa

SEQ ID NO: 1849 - DNA, 294 bp, H. influenzae strain 86-028NP
gtggcatcaaccttgtgctgcatcgcaccattaatttatttagtatttggtgtgtcgtccacttggttgattggcttaggcgaatatgattatttgcgtattcctatgcttatcatttcattatgtgcctttgcctatggattttggctgttgatgttttccaaaaaaatcatttgtagcaaatatatttcccgtaaaaaacttatcgttttatattggattgtatttatcgtgatgatttttttcttaacctatccaacaattttaccttggattttagaattagctaattag

SEQ ID NO: 1850 - DNA, 279 bp, H. influenzae strain 86-028NP
atgaagaaattatgtaccgcacttttgctttcgctgtttgcaatttctttcgctcatgcgaatgaaaccaaacaaattgtgctaaaagtaaaggaaatgaattgccagctttgtgcttacttagtcaataaagaactgcgtaatattgatggcgttatttcaacaaaagcatctattaaagatggtttagtgacggttgtggaagatccaaaagtcacaaaccaacaattattcgatgcaattcacaagctgaaatatactgctgaagtcgtgaattaa

SEQ ID NO: 1851 - DNA, 1845 bp, H. influenzae strain 86-028NP
atgtttaacaaaattttttcgtggtttgaaaatcgtttgaatccctatccagaaagcaatccaacaacacctaaaaaaggtttgttccgttttatttggtctagtattacaggaatgaaaggctggatttttttgctcgcaattttaaccgtaggtacaggtgtaatggaagctgtattattccaatttatgggaacgcttgtagattggttaggcacatttacacctgaaagattatggcaagaaaaaagtcatttattaattggaatggctgctctattacttattagtattgtgtggggatttttagcttcggccgtgcatttacaaaccttacaaggcgtatttccaatgcgattacgttggaatttccatcgtttaatgcttggacaaagtttaagtttttatcaagacgaatttgcaggtagagtatccgcaaaagtaatgcaaaccgcccttgcagtacgtgacacagtacttacacttgcagatatgttcgtttatgtattggtatattttattacctctggcgtagtgctagtggcattagattcttggttcttattaccatttattacttggattatactcttcggtttgatcctacgaaccctaattcctaaactatcaaaaaccgcacaacgacaagctgatgctcgttctttaatgacaggacgcattacagatgcttattctaatattgctacagtaaaattattttctcacggctcacgcgaagctacttatgccaagcgttctatgcaagattttatggtaacagtacacgcccaaatgcgcttagcaacatcactagatacactcacttacgctacaaatattctacttacgttaagtactgcaatacttggtattattttatggaaaaatggtcaagttggcgtgggtgcaatagcaacggcaacggccatggcattacgcgtaaatgggctttctcgctggattatgtgggaatctgcccgtttgtttgagaatatcggaaccgtaaacgacggaatgaatactttaactaaaccccacaccattgtggacaaaccacaagcgtcaccgttacaagtgaaacaaggggaaattaagtttaacgatattacctttgcttacgatccgacaaaaccattactcaatcatttcaatctcactatcaaaccaggggaaaaggttgggttaatcggtcgttctggtgcaggaaaatctacgattgtgaacttattacttcgcttttatgaagcacaacaaggcgaaattaccattgatggacaaaatgtactcaatgtgcaacaagaaagcttacgtcgccaaatcggtttagtcactcaagacacttcgttgctacatcgctctgtacgtgacaatattatttatggtcgcccgaatgctactgatgaagaaatggttttagctgctgaacgagcggaagccgctgatttcatcccatttctcagtgattctcaaggtagaaaaggctatgatgcccatgtgggagaacgcggggtaaaactttctggtggtcagcgtcagagaattgccattgctcgtgtaatgttaaaagacgcaccaattctattgttagatgaagccacaagtgcattggattcagaagtggaagtggcaatacaagaaagtctagataagatgatggaaaataaaactgtgattgccattgcccatcgtttatccaccatcgcagcgatggatcgcctgattgtgcttgataaaggacaaattgtcgaacaaggtacgcacgccgaattactagagctcaatggtctgtacgctaaactttggaatcatcaaagtggcggatttttaagcggaagtgctgaataa

SEQ ID NO: 1852 - DNA, 897 bp, H. influenzae strain 86-028NP
atggactatttagataaacttacccatttagcacaagtgcgtggagaaattaatattcgctgtgaatttcaaggcgaatggcaaatatctcatcaagaaaaggatgcaggaaaaggcatattccatcttattgaacaaggcgagtgccagcttacactaaatgaaaaacaatttcatttaaaagagggagatattttttttcttcctcaaaatcaaccgcactttatgcattattcagtaaataaaagggcagatattcctacaaaaaaaagtcatcaaggattatttgagttacatcagattggacgaggtacaccagatttaaaaatgttctgcggtaatttttattatcaacaagatgcacttcttacggcatcaatgcctgaatatttacatataaatttatgcgacacgcccattcatcctttagtgcagctttttttgcaagaagcacaaaaaaatgatgcgggtacgaaatcggtcgttgatgcactttcaaatgtacttttaatttatattttacgtcacgccattcaacaaaatttaattgaacaaggcatcttattcgccttacaagataagcgattaaatactgcactgatagcaatattacaacaacctcaaaatgattggcatattgaacaattagctgaacttgcaacaatgtctcgtgcaaactttattcgtgtttttcaacaacaacttggtatgtcgccaggacgttttctcacgaaagtgcggttacaatctgcggcgtttttattaaaacaatcacaacaatctgtgcttgccattgctttagaagtggggtatcaatcagaagcgcatttttgtaaagtttttaaaaattactaccaactttctccaagccaatacagaaaatctgtcagcctataa

SEQ ID NO: 1853 - DNA, 342 bp, H. influenzae strain 86-028NP
atgtttgcagattggaaagaacacacatctcacgttaaaaaatcatttggcgcattgggtaaacaacaccctaaaatgttacaagcttaccaagcattaggctcagccgcggaagagggcaatgtgcttgacgctaaaactcgcgaacttatcgcattagcagttgctgtaacaactcgttgtgaaagctgcattagcgtacacgcagaagaagcagtaaaagctggtgcaagtgaagctgaggttgctgctgcattagcaacagctatcgcattaaatgcaggtgcagcttatacttattctttacgtgcattagaagcatatagcgtacagaaaggttaa

SEQ ID NO: 1854 - DNA, 597 bp, H. influenzae strain 86-028NP
ttggaaatggttgaaaaacgtctcaatgaaagtgatatgccatttatcggtacaaaagaatttacgcctaaaaaattgtgggaaatttttggcacaccaaaacaaaaatgggtcaaaaaagatgatgtaaaaactgctattgccatgcaaaatgattggtatgtgatggataattttgctggaacgagtttggaagaagcgttaattcaatttatttcagagcgtttgggcgatttgaaatctaaatatgacgttcatttaatccgcaatgaagaagtgtttaaattgaataactttgccgatggtgaaggatttatgccggactttgttttattgctgaaagataaacaaaaatcttcttccaatggtgtgaacgactttttgcattaccaaattttcattgaacccaaaggcgaacatttagtggaaactgataggtggaaagaagcttttttaaaatcaatcacagtggaatatgggaaggataagatcctgcaaaaagatacaccgcattatcgtttgatcggtttgccgttttttactgatcatcagaaaaatggacaatttacggagttattccctttaggagagacatag

SEQ ID NO: 1855 - DNA, 2166 bp, H. influenzae strain 86-028NP
atggcgaataataaaacgttgtttgattgggtggaagaccgcaaatcaatgctggaagaaatggaacagacagattttttcgcactgcctgaatttgtttcaaataatttgaaatatccgttttttgaatggcagaaatcggctttagaaaactttgtaatttttgaccgcactccaaaattaaaggacttccccgatatcaaaaaccgccctacccatttgctatttaatatggcaacaggtgcaggcaaaacgatgatgatggcagcgttgattttgtattattttgaaaaagggtatcggcattttctgttttttgtgaatcaaaacaatatcgtggataaaacggaaaataattttaccgatccgacgcacgcaaaatttttatttaccgagaagattttgcagggcgatacggtaattcctattcgcaaagtggagacatttagcccacattcagacggcattgaaattaaatttaccagcattcaaaagctgtataacgatattcgcacccggcgggaaaatcaaaccacattggcggatttgcacaaattgaaccttgtgatgctgggtgatgaagcgcaccatttaaacgcgcaaaccaaaggcaaaaaacaaggcgaattagatttagaaaaggaaatgaacgaccgcaccagcaatgccgaaattgaacgtaaaggctgggagcatatggttttggaattgttactcaataaaaatggcaatcatagccaaaatgtgctgttggaatttaccgccacgctgcctgaaaatgctgacgtgcaacaaaagtacgctgataaaatcatcacaaaatttggcttaaaagaatttttgcaaaaaggttataccaaagaaatcaatttggtatccagtacgctgggtaagaaagagcgagtgttacacgctttattgtttgcttggtatcgacatcgaattgcgttgaaatatggcattgccaatttcaagcctgtgatgttgtttagaagtaagacgattgatgaatcaaaagcggattatctggcatttttaaattgggcagaaaatgtgcaggcggttgatttttcgtttttaactacattttcaacaagcttgaacgatagcgatagcgataacgccaacgaacaaggcaaaacccgcactgaacaagccctaaaatttatgcaggaaaaaggcgttgagtttgcacatttggcagattgggtaaaacaaaattatcaaaaacacaatgtgattattaccaactccgagagcaacaaaaccaaaaccgaaaaaaccgacagcgaaaccgaaaaattgctaaataatttggaagcggccgataatccgatccgtgccatttttacggtggacagattaaccgaaggttgggacgttctgaatttgtttgatattgtgcgtttatatgaagggcaaaacggcggcggttcaaataaaaaatcaggcaaaacggctgccgccaccgtatcggaaaagcagttgattggtcgtggcgtgcgttattttccatttgcgtttgaagataaacagccgaataaacgcaaatttgacaatgacatgcaacacgaattgcgtattttggaagaattgttttattacacgcacgatgagcaatctcgctatatttcagaattaaaagcagaacttcgcaaagatggctttattcccgaaaacgataaagacaaggttttaaccaccttcaaactaaaatctgaatttgcagatgatgaaacttttaaaaacctattgatttgggcaaatcaaaaagtaaaaaatcccaatgctaaagccaataatgcagacagcctaaaagccaatccgcaaacgctttcattccaaattcacggcaatcaattgttgcaggaaacgcaatttacagccgatgaaaatgatgaaaccgcccgacaaatcggcacacaaaataattttactcaaaccataaaaatgagtgaaatggagcggcacatttttaataaagccttgcatatcaaaggaaaaaatagtcaatctttatttcatttcgatcgcttgcaaagcaaactcaacattcaaaatcgcaatgaattgcaaaataacttgttaaaagattggcaaattgaatttttgggattagggcaagataaacagattagcccagatgacaacttgcaggctgcctaa

SEQ ID NO: 1856 - DNA, 2102 bp, H. influenzae strain 86-028NP
atgaagacagacattcaaaccgaattaacccaagccctactatcacacgaaaaagtatgggcgaacgaagaaaaaaccattttagccaaaaacattctgttggatttggtagaaaaaaccgacccgactattatcgggttgttattggggaatgatgagttaaaacgccatttttttgtggaagtgaatggtgttttggtgtttaaattgcaggattttcgttttttcttggacaaacacagaatcaataattcctacacaaaatacgccaatcgcattggcttgacggacggcaaccgctttttgaaagacagttcggatattgtgttggattttccgtttaaagattgtgtgctaaatggcggacaaagcaccgaagaaggcgaagaaatttattttaaacgcaataacagccagccagccaattatacactaaattaacccgaaaaagacaagaaatcttttttaatcaaacccttgcttttgatgaaattgaccgactttttgacgcaaaagcattctcaaaattctctcgctataccgcagatggcaagcaacccgttggcgaaatcaaacgccattttgacggcacgccagccgaaaatctcattatcaaaggcaataatctgatagccctgcattcgcttgccaagcagtttaaaggcaaaatcaagctgatttatattgatccgccatataacacgggcaatgacggtttcaaatacaacgacaaatttaatcattccacttggctcacttttatgaaaaatcggctggaaattgcgaaaacattgttggctgatgatggcgtgatttttgttcaatgtgatgacaatgaacaagcctatttgaaaattttaatggacgaagtttttggtcgtgaaaattttgttacaaccattcattgccaaatgtccacaacgcaaggaatgaaagttaaagcggcacaagatggaaatattgttaaaaatgctgaatatattatagttttttcaaaaaatggacataaaaatattgcaataaatcccttgtatgatttgcgttcagaatatgatgaacactattcgctatatttaaaaaacgatggggctattgggcaacttaaagaattatatgattatagatttccaaaagatttaaaaaatacaaccgcactttctttaaaagaagcatttaagaaaagtaatgaatttgccgagattgtgaaaacacatctttccaagattgtaagaagcgataaagttactggatttgatttatccgttgaattagaaaatagcaaatggaaagaagttgagagaaatggaagaaaatatattcttacattagataaaaatggcaaagtttgccaattattaagactacaagattcttggggaaaaactgataattacaataatgatgagggacttcgtaaaattcgtggtaattggtgggaaggtttttaccttgatatgggaaatgttggaaaagaagggagcgtagattttaaaaatggcaaaaaaggagagcgtttaatttcacaaattattaaaacagcaaccaacgaaaacgacatcgtcctagactaccatttaggcagtggcacaaccgccgccgtcgctcataaaatgaaccgccaatacatcggtattgaacaaatggattatattgaaacgcttgccgttgaacgcttgaaaaaagtgattgaaggcgagcaaggcggtatttccaaagccgtgaattggcaaggcggtggcgagtttgtttatgccgaacttgctccatttaacgaaacagcaaaacaacaaattttggcgtgcgaaaattcaaacgacatcaaaacgctgtttaatgaattatgcgaacgctatttcttgaaatacaatgtaagcgtgaatgaatttagtcaaatcattgaagaacctgaatttcaaaccttaccacttgacgaacaaaaacaaatgatgcttgaaatgttggatttaaatcaaatgtatgtttcattatccgaaatggacgatgaacaatttgcaggttgcttaaacgatgacgataaagcgttaagccgtgcgttctatcaatcagtaaaaaatcaagcggagaaaaaagatggcgaataa

SEQ ID NO: 1857 - DNA, 594 bp, H. influenzae strain 86-028NP
atgtttgaatatccacaaggctatgaattgatcgctggtgttgatgaagttgggcgaggccctttagttggggctgttgtcacggctgccgttattttggatccgaataatccaattgaaggactcgctgattctaaaaaactttctgagaaaaaacgtttagcccttgctgaagaaatcaaagaaaaagcccttgcttgggcattaggtcgagctgaagctaacgaaattgacgagataaatatcctgcaagcctccttgctggcaatgactcgagcagtaaaatctttaaaaattcaaccgcactttgtgttggttgatggcaataagatcccaaaagatttagctattccagcgcaagccgtcgtcaaaggcgataaccttgtggcagaaatcagtgcagcctctattttggcgaaagtggcacgagaccaagaaatggaagaattagacaagcaatatccagaatacgcttttgcccagcataaaggctatccgaccaaattacatttggaaaaattagctgaacttggtgcgttaccgcaacatcgtcgtagctttgccccagtgaaaaaagcactagaacagttttag

SEQ ID NO: 1858 - DNA, 1173 bp, H. influenzae strain 86-028NP
atgaacaaaacaaatccaaccattgctcttgttgcaggagaagtatctggtgatattctcggtgctggtttaattcgccagctcaaagcacattatcctaatgctcgctttattggtattgcaggcacaagaatgttggctgaaggctgtaaaacgctcgtcgatatggaagagctttctgttatgggtttggctgaaatcttgaaacatcttcctcgtttgctgaaaattcgtaaaaatgtcattcaaactatgttgcaagaaaaacctgatgtttacatcggcattgatgcgcctgattttaatttggatgtagaactcaagctcaaagctaacggaattaaaaccattcattacgtgagcccctctgtatgggcatggcgtcaaaatcgtatccataaaattgccaaagcgacccatcaagttcttgcctttttgccttttgagaaagccttttacgataaatttaatgtcccttgccgttttattggacacacaatggcagatgctattccgctcaaaccaaaccgtgccgaagcatgccaaatgctacagattgatcccgcacaacgctatttagctatcctagttggaagccgtggttcagaggtggaatttctggctgagcctttcttaaaaacagctttattgttaaaagaacaatttcctgatttacaattccttgttcctttggtgaacgaaaaacgacgaattcaatttgaagccattaaagctaaaattgcgccaaatctagacctgcatttaattgacggcaatgcacgacaagcaatgattgcagctgatgcaacacttcttgcttcaggaacagcagcacttgaagcaatgctttgtaaatccccaatggtggtaggctatcgaatgaaaccactgacctatttcttagcaaaacgtttagtgaaaaccgattatatttctttaccaaatttgcttgcgaatgaaatgctcgtgcctgaaatgattcaagaagaatgcacgccagaattgctcgctgaaaaattatctgcttatctttctgatgatgaaagtgcggtaaaaaatcgccatattttaattcagcacttcacggatttacaccaaaagattcaatgcaatgccgataagcaagcggctcaagcagtcattgatttattagaaggaacagaaaatgtttga

SEQ ID NO: 1859 - DNA, 789 bp, H. influenzae strain 86-028NP
atgatccacccaagtgcaaaaattcatccaactgccctcgttgaagaaggggctgtaattggcgaagacgtttttattgggcctttctgtattattgagggcagtgttgaaatcaaagctcgcactgtattgaaatctcacgttgtggtacgtggcgataccgtgattggcgaagataacgaaatctatcaatttgcgagcattggcgaagtaaaccaagatttgaaatataaaggcgaagctacaaaaaccattattggtaatagcaaccgaattcgtgaacacgtgacaattcatcgtggcacgattcaaggctgtggcgtaacctctattggcaataacaatttattaatggtgaatgttcacgttgcacacgattgccaaattaaaaataactgtattctggcaaacaatgcaacgcttgcaggtcacgtagaattagatgatttcgtgattgttggcggtatgtcagcgattcatcaatttgtgattgttggtgcacacgttatgttaggcggtggttctatggtaagccaagatgtaccaccttatgttatggcgcaaggcaaccacgcccgtccatttggcgtaaacttagagggtttgaaacgtcgtggttttgataaaccaaccatgcacacaatccgtaacatttataaaatgctctatcgtggcggtaaaacacttgaagaagtgttaccagaaattgagcaaattgcggaaaccgattcagcgatcagtttttttgttgaatttttcaaacgttcaactcgcggaattattcgttaa

SEQ ID NO: 1860 - DNA, 447 bp, H. influenzae strain 86-028NP
gtgtcagaacaacaaccaagagtgatcgaatcaaaagaaattatgactttattgccacatcgctacccatttttgttagtggatcgcgtattggattttaaagaaggcgaatggttaaaagcgattaaaaatatcagcgtgaatgagccttgtttcacaggtcacttcccaggcgaacccattttaccgggcgttttaattttagaagctttggcacaagcaatgggcattttagcctttaaaactctcgaattaaaaggcggcgaactattctactttgcaggtattgatgaagcgcgctttaaacgcccggtgttacctggagatcaaatggaattaaacgttcaagtgattaaagaacgccgtggtatcacttcatttactggcgttgctaccgtaaatggcgaaatcgcttgtgaagcaaaactaatgtgtgctcgtcgttaa

SEQ ID NO: 1861 - DNA, 1608 bp, H. influenzae strain 86-028NP
gtggataatagcgatattttcttttcagggaagacaatgatgaacacgaaaaaaacaagccaaattttgcccgcactttttgcggtgatttgtgccgcattcgcgggttattttattttaatcggttctgggatgtttacagaaccaactgtagatcttattctgcttgcgacaataactattctcttattaagcagcagtaaaaaatccttctattttattttgctacctcttacgttactgcatgctttttatacacctacggggctaaattttggccctccaagctatcaatatatcgcctcgcttttcgcgacagatatattggaaacgaaggaatttctattgcaaattccagtgagtagttacttaattgctttcgccattcctattttaatttttcttcagtacaaaagtgcggtgaaatttggcataaaattttatcgtaataaaacatttattgccttagcgaccttgctctttgcctacaatatgccacttgccgaacctattaaagaaaccataagttccacattaaaaattgtagatgaagtgcaaaaactaaaacaaatctctcaatctgataactggggaaaatcaacattagaaaattcacgctatgatgattatgtaattgtactcggggaaagtgcgcggaaagattaccaccatgcctacggttatccaatagaaaacaccccctttatgtctaacgctaaaggcacgttgattgatggttttcgttcagcaggaacaaataccgtcgcctcacttcgtctaatgctaacccttcctaacaaagaaaaatgggaaccaaattacagcttgagtttagtggatctaatcaaatctgcaggcgtgaaaacttattggctttctaatcaaggtatgctcggtaaattcgatacgcccgtttcatccctcgcttcaaaatctgatgaaacctttttcttgaaaaaaggcggaagctttaattcgactaactttagtgactttgatttattacccaaattcgcccaagtattagaaaattctgttcaaggaaaacgttttattgtgttgcatatttatggttcacacccaatggcttgcgatcgtatcgaagattatccaaaaatttttgatgataaagatcttaatccgaaatatggttatttaaattgctatgtgtcgtctattaagaaaaccgatgaatttttaaaacgtgtatatgatcagcttgaagaaaatgcgaagaaaaatcaccgcactttctcaatgatttatttctcagatcacggtttgtgccaccaacaagatgaaaaaaacaatatacttttgttcaatcaaaactgtttcagccgagagcaccataatattccgctattcaaaatttcatcagatgatatggaacgcaaagaatataaggtgtttaaatcaggtttaaatttcttagaagggattgcaaattggataggaattcaaaatcctcaattaacgcaaacagaagatttattttctaacgaatcggataaaaatgactttggattgcaaaaacgaattgatgaaaaatatcgtaaagatgacgatccagccattgatattcgtcctaaacacggagcatattga

SEQ ID NO: 1862 - DNA, 714 bp, H. influenzae strain 86-028NP
atgagccaaccaatttataaacgtattttattgaaattaagcggtgaagcattacaaggagaagatggtcttggtatcgatcctgcgattctcgatcgtatggctgttgaaattaaagaattagtggagatgggtgtggaagtcggtgtcgttcttggtggtggcaacttattccgtggcgcaaaactagcaaaagcggggatgaatcgcgtggtgggcgatcatatgggaatgcttgctactgtgatgaatggtttggcaatgcgtgattctttattccgtgctgatgtgaacgcaaaattaatgtccgctttccaattaaatggtatttgcgatacttataactggtctgaagcaatcaaaatgttacgcgaaaaacgcgtagtcattttctctgcgggaacgggaaatccattctttaccactgattctaccgcttgtttgcgtggtattgaaattgaagctgatgttgtgttgaaagcgactaaagttgatggtgtgtatgattgtgatccagcgaaaaatcctgatgcaaaactttataaaaatttaacttatgcagaagtgatcgataaagaattaaaagtgatggacttatcggcgtttactttagctcgcgatcatggcatgccgattagagtgttcaatatgggtaaacctggtgcattacgtcaagtagtgacaggcactgaagaaggcaccactatttgttag

SEQ ID NO: 1863 - DNA, 966 bp, H. influenzae strain 86-028NP
atgacgttagattatccagttccatttcatacgcctaatctagtatgggattataccattgcgatctacttgttcttattggggatctcatctggtgcagtacagttagcaattgcctataaacgcagtaataaactagaaaatctaagccaaaactggattattcgatctggggtaattttaggatctgtgccaacattaattggtttaacgctattaattttccacttgactcgaccttggacattctggaaattgatgtttaactatcaattcaactccgtaatgtcgatgggggtcatgctattccaaatctatatgttatttttagtaatttggggtgtagtgattttcaaaaaagaaatcgaagcattaattaatcgctttataccaaaactgcaatttgtgatgaaactcatcggtattgcagaacgtattgcaagtccagtcgaagttattcttttcatattggctgcagtgcttggtgcatacacagggttcttactttctgcattgattagctatccaatgttgaataacccagtattacccgcattatttttagcctctggcacatcatctggtattgctgcaaccttcttaattatcttaattgcaggaaaactaaaaggtgattctcacgaatcgcacttcatccacaaatttgaagtgccaattatggtgacagaacttggtttgattgtgtgtttcttcgttggattacattttggtggcggacaaaaaacagttgccttacataatgccttatctggtttttggggagcgatattctgggttggagtattgattatcggtatcttgatcccattaatcgccaatatgtttgtaaatgaccgtttaaaatacaatcgtaactttattatcttggtgtcaatttttgacttaattggggtattctgtttacgtttctttgttttatatgcgggacaactcactgtagcctaa

SEQ ID NO: 1864 - DNA, 678 bp, H. influenzae strain 86-028NP
atgacagtctgctcacgccgaaactttgtttctggcatgggggcagtgatccttatgacgggaacatctttaccttcttttgcaaaagaagacaaggcggataaacctaaacgttacgcaatgatacatgatgaaaatgcgtgtatcggttgtacagcctgtatggactcatgtcgtgatgtaaaccaagtgccagaaggcgtttctcgcttagagattctacgtagtgaaccttatggggaatttccaaatcaagaatacgagttctttcgtcaatcttgccaacattgtacaaatgcaccttgtgtagcagtttgtccaactggtgcatcttttattgataaagagactggcattgtagatgtacataaagatttatgcgtaggctgccaatactgtatagcagtttgcccatatcgtgtacgttttattcatccagtacatcgtaccgcagataaatgtaacttctgccgcgatacaaatttagccaatggtaaacaacctgcttgcgtagaggcttgcccaaccaaagcattaacctttggggatatgaatgatccaacaagtgcagtttcacgtaaagtgaaagaaaaaccggtttatcgcactaaagtggaattaggtacacaaccaaacttatatcacattccattccaacatggggagcctagaagatga

SEQ ID NO: 1865 - DNA, 684 bp, H. influenzae strain 86-028NP
gtgattttcaaggtcaaatttgaggtaacccaaatgaatttaacttctttaatcaacaaatctgcaaaagcgttagcgttaagtgcggcatttgtagcattgccatttttggcttatgcggatgatgcacaaaaacctgcggatcatgttacttatgaaccgcaattagataaccaacgcgatcctaatcaatattgtgctaaatgccataaattcgacaaaatagataaaaaccaaacgctagatcggtctggtggcgaactccactttggtaaattccatggtgcacatttagataagaaaaatccaaataacggtaaagctattacttgtgtaagctgtcacggcaatgtttccgaaaatcatcgtcgcggtgctaaagatgttatgcgttttgaaggagatattttcggtaataaaaaaccgatgtattcagttcaagaacaaaaccaagtttgttttgcttgccatcaacctgacaaacttcgtgaaaaattatgggctcatgatgtacacgcaatgaaattgccttgcgcaagttgccatacgcttcaccctaaagaagacgcaatgaaaggtattcaaccaaaacaacgcgttaaactttgcgtagattgccatggtaaacaacaaaaacgtaaagctgaacaagataaactaaccaaacaaaaggataaacaatga

SEQ ID NO: 1866 - DNA, 1617 bp, H. influenzae strain 86-028NP
atgaaaatatatctacgttttgtatggatattaataataattctcaactttctacttaacctttttattacaacaaatggagtaattatcgtgaacgcattcaaaaaaagccttattgtggcagcgtctttcgcgagtttaagcttatttaactcagccactgctgagcttgtatataagccattagaacaacctgttgaacccgcaaaacctgatttgaaaattgaatctgtaaatgaaaaatttgcagaaaaatatccaaatcaatataacagctggcgttctacagcaaacggcgatggcgaaaacattatttatgctgatgaagaaaatccgcgcctaatcgtactttggggtggttatgcatttgcaaaagaatataacgcaccacgcggtcacttttatgcggtaacagatgtgcgtaatattttacgtacaggtgcgccaaaaactgcaaatgatggccctcaagctatggcatgttggacatgtaaaggtcctgatgttccacgtttaatcgcggaatggggtgagaaagattatttcaatgcgaaatgggcaaagggagggcctgaaatcgtgaactcaattggctgtgctgactgtcacgacacaacctctaaagattttgctgaaggcaaacctgcattacgtattgctcgcccacacgtattacgcgcccttgatgctttagaaaaagccactgctgaaaaagataaagcagaaggtcgcccacacaacaatttaagtttcaacacggcggcgcgtactgaaaaacgtgcagaaatttgcgcaaactgccatgttgaatactattttgcaggggacatcaagcaagtaactttcccttgggataatggtcaaaccgcagatgatattgaaaaatattatgatgatattggtttcactgactggactcactcactttctaaagcaccaatgttaaaagcacaacaccctgactttgaaatttggtctttaggtatgcacggtaaaaatggggtaacttgtgtagattgccatatgccgaaagtacaaggcgcagatggtaaagtttatactgaccaccaaatccaaaatccattcgatgcatttgaccacacttgtgcaaattgtcacgatcaaagcaaagaaaaattacgcgatattgttacttcacgtaaaaaagaagtgaaagatgtaatgggtcgtttagaagaccaagttgttaaatctcactttgaagcaaaagcggcttgggacgcaggtgcaactaaagaagaaatggaagcagcattaatggatattcgtcatgctcaatggcgttgggattacactgctgcaagccatggtggtcatatgcatgcgcctgaagtagtacttcgtgtattagcttctggcttagataaagtagcagacgcgcgcactaaacttgctgtaatcttaactaaacacggtgtgaaaactccagttcaaatcccagatatttcaacagctgataaagcgtggaaagtaatgggtattgatattgaaaaagaacgtaaagcaaaagaagaattcttaaaaactgtggtaccgcaatgggagcaacaagctagagaaaaaggcttattagttgatccaccagcacaaaaataa

SEQ ID NO: 1867 - DNA, 3909 bp, H. influenzae strain 86-028NP
atgaaaaacagctcggtaaaacacacattaactcccttacaacaatctcttttttctcaattaaatgacatcatgcgggtggatcaacgtcgcttatccgcccgcattcatggtattggaaaaattaaaagccaagaggctcaacaagccgttgccgctgaaatccaacagcaaattgaacaagctagattacgtgtagaacaacggaaaagtgcggtacaaaatccgattatttttccagagagtttgcccgttagccaacgcaaagtcgaaattcaaaaactgctttctgaacatcaggtcatcgtggtggcaggggaaactggttcaggtaaaaccacccaattgccgaaaatgtgtttggaattaggtttcggcaatttaggcatgattggtcatactcaaccacgccgtattgctgctcgttcggtggcggcacgtattgcggaagaactggaaacagaacttggcgatttagtggggtataaagtccgttttaacgatcaaatcagcgataacacccaaatcaaattgatgactgacgggattctgctagcagaaattcaaaacgatcgttttctcaatcaatattcttgtttgattatcgatgaagcccacgaacgtagcctaaataacgattttattctcggttatctgaaacagttgttgccacgtcgtcgtgatttaaaacttattatcacttctgcaaccattgatgtggaacgcttttccaaacactttaataatgcaccgatcattgaagtctcaggcagaacctatcctgttgaagtgcgttatcgtcccgtagtggaggacgatcaagatcagctacaaggcattctcaatgcggtggatgaattgcaagcagaaggtcgaggcgatatcttgatctttatgaatggagagcgtgaaattcgtgataccgccgaagctttacaaaaacaaaatctaaaatacacggaaattctaccgctctttgcacgcttgtctgcgcaagaacaaaataaaattttccatccaagcggtttaaatcgcattgtattggcgaccaacgtcgcagaaacctcattgaccgtacctggcattaaatatgtgattgacccaggtacagcgcgcatttcccgttatagctatcgcaccaaagtacaacgtttaccgattgaacctatttcacaggcatctgctaatcagcgtaaaggtcgatgtggtcgtgtaagtgaagggatttgtattcgtttatattcggaagaggattttaattctcgtccagagtttaccgatcctgaaattctacgcaccaatttagcctccgttattttgcaaatgacggcattgggtttggatgatattgaagcgttcccatttgttgatgcgccagataaacgccatattcaagatgggataaaactgttggaagaattgggcgcgtttgaaactgttcaaactaaatcgggtgaaaaacgcctattaactagagttggtcgccaactcgctcaacttccagtcgatccgcgccttgccaaaatgatcctaagtgcggtcaattttggctgcgtttatgaaatgatgatcatcgtctctgcgttatccattcaagatccgcgcgagcgtccacaagaaaaacagcaagcttctgatgaaaaacatcgtcgttttgccgataaaaaatcagatttcttggctttcctcaatctttggtattatctacaagaacaacaaaaagaattgagtaaaaaccaattccgtcgtcagtgccaaaaggatttcttaaattatttacgcattcgtgaatggcaggatatttatcatcaaattcgtttaaccgtgcgtgaaatgggcttaccgattaattctgaaaaagcagaatatcagcaaattcataccgcacttttaagcggtttgctttctcatatcggtttaaaagaagcggagaaacaacaatatcttggcgcacgtaatgcccattttgcgattttccccaattctgtgcttttcaaaaaacaaccgaaatgggtgatggcggcagagttagtggaaacctccaaactttgggggcgtatggtggcagaaatcgagccagaatggattgagccacttgccgagcatctcattaaaaaatcctattcagaaccgcgttggtcgaaatcccgtggcgccgtgattgcagatgaaaaagtcacactttacggtgtgccgattgtggctgcgagaccagtgaattacggtgctattgatccaacggtaagccgtgagatttttattcaatctgccttggtggaagggggttggaataccaagcataaattcttcaaagaaaatcaaaggctcgttcaagaagtagaagaattggaacacaaaagccgccgccgcgatattttggtggatgatcgcacattgtttgaattttacgatcagcgtattggcacggaagtggtttcccagaagcattttgatacgtggtggaaaaaggtgcagcaaaaagatcctgaattgcttaattttgaacgttcatttttgatcaatgatgatgcggaacaagtgagcaaactggatttcccgaatttctggtatcaaggtaatttaaaactcaaattgacttatcaatttgaaccaggtaccgatgcggacggcgtgacagtacatattccattgccattgctcaaccaagtggaaatgacaggctttgactggcaaattccaggcttgcgtgaagagttggtgattgcgctgattaaatcgctgccgaaatcttatcgccgtaacttcgtgcctgcacctaattatactcaagcttttttaagtcgtgcggtgccgttggaaaagccattattagatacgctgatttatgaattgcgtcgtatgactggcgtcaccgtagaagcggaacattggaattgggaacaaattccaagccatctgaaaatgacgttccgtgtggtggatgaaaacggtaagaaaatcgcagaatccatgaatttggatgagctgaaattcaacttaaaagatcgtgtgcaggaaagtatttctgctgtggcagatgatggcattgagcaaagcaggctgcatatttggagctttgcagatttaccacaatgttatgaacaaaaacaacgtggtttcagcgtcaaagcgttcccagctattgtagatgaaaaagatgcggtgggtatcaaactgtttgaaacagagtttgagcaatcggtggcgatgcaacaaggtttacgtcgtttgttattgctcaatgtgccatcaccaattaaatatcttcatgaaaaattgccgaataaggctaaattgggtctgtattttactccgttcggtcgcgtattggatttgatcgatgactgtattgcttgtgccgtagataagctaattgccaattttggcggttttgtgtgggatgaagcaggatttgaaaaattgcgtgatttcgttcgagaaaaccttaacgaagtgaccgtggatattgcgcagaaagtggagcagattcttactctcacttaccaacttaaccaacgccttaaaggcaaaatggatttcacgatggcatttgcattatccgacatcaaatcgcaacttgcaggtttggtgtatcaaggttttgtgcaaaagagcggttatgatcgcctaccagatttacaacgttatctgcaagccattgataaacgtattgataagttggctcaagatgtaaaccgtgatcgtgctgcgatgctacgcgtggaacaagtgcaacaggcttaccaacaattactggctaaactgccaaaatctaaaccgatttctgatgaaattgcggaaattcgctatatgatcgaggaattgcgtgtgagtttatttgcccagcagttggggacaaaatatcaaatatcagataaaagaatagcaaatattattagtcaatactaa

SEQ ID NO: 1868 - DNA, 375 bp, H. influenzae strain 86-028NP
atgaaaaacaaataccttactattgccactttaagcggattcttctgtgtcgcactaggcgcatttgcagctcatggcctaagccatatattagaagccaaagcattatcatggattgatacggggttagaatatcaaatgttccataccattgcagtacttgccgttgcattatctgctttacgtgacaataaattcgcccgattatctatgtcttcttggttaattggaatcttattatttagtggaagtttatacgcacttgctttcgaagcaagcaatgtaattgtatggattacgcctattggcggcactttatttttaatcggatggattagcttagcttacggaagtttcaaaagtaaatcgctatga

SEQ ID NO: 1869 - DNA, 453 bp, H. influenzae strain 86-028NP
atgacattacaactcaataccattgctctattactagtgatacttcttattcttggcgtattaagcaacaacagcgcaattaccatttctgctgccgtattacttatcatgcagcaaacttttttatcttctcatattcctttgctcgaaaaatatggcgttaaaattggtatcattattttaaccattggggttttaagccccttagtttcaggaaaaattcagttgcctgatttatcaggttttcttagttggaaaatggctctttctattgcagttggagtgcttgtggcatggcttgcaggtaaaggtgtgcctttaatgggcgaacaaccgattttagtcactggcttgcttatcggcacaattattggtgtagcatttttaggtggaattcccgttggcccacttattgctgcaggtatattagctttacttttagggaaaatttaa

SEQ ID NO: 1870 - DNA, 1137 bp, H. influenzae strain 86-028NP
atgattgattatgaatttctacgttttatttggtgggtgttagttattgtattattgattggcttctctgtaactgatggatttgatatgggcgtgactgcacttttacctgtaataggtaaaaaagaagtggaacgccgtattatgatcaacactattgctccccattgggatggtaaccaagtttggttattaactgcaggtggtgcaatatttgcagcttggccaattgtatatgcagtatctttctcaggtttttacattgcattagtattagtcttggcagcgttattcttacgtccattgggttttgaatatcgtgcaaaaattgataatccaacttggcgttctgtttgggactggggattattcgcaggtggttttgtaccagcattagtatttggcgtggcttttggtaatttattacaaggcgttccattccattttaacgaattaactcaagtgacttatacaggttcattttttgagctattaaatccattcgcattattatgtggtgttattagcttatcaatgcttgtcactcacggcgcaaactggttacaaatgaaaaccactgaagtcttacgtgatcgtgctcgttcagtaagtcaaattggttctattgtgactttaattacattcgtattagctggcgtatggttatattctaaagatggttatgtagttactagcactatcgatcatttcgctccatcgtctccaatgaataaagaagttgctgtagaaactggcgcgtggtttagaaatttcaatgaaatgccaattctttggattttccctgctttagctgtagttgctgcattattaaatgctgcattttctaaagcgaatcgttgtggttttgcatttttcttctctgcattaacaatggctggtgtgattattactgcagcagtatcaatgttcccatttgtgatgccttcaagttcacatcctgaacaaagtttattaatgtgggattcgacttcaagtgaattaacattaacattaatgctgatttttgcagttgtttttgtggtcattgctttagcttatactatttggtcttactcaaaaatgtttggtcgtttagatgctaatttcattgataaaaataaacactcattatactaa

SEQ ID NO: 1871 - DNA, 1566 bp, H. influenzae strain 86-028NP
atgttagacgttgttgatctttctcgcttgcagtttgctttaactgcgttgtatcacttcattttcgtgccgctaacattgggtttatcctttattcttgtaattatggaaactatttatgtggcgacaggtaaagaagtttataaagatatgacaaaattttggggaaagttatttggtattaactttgcccttggggtgaccaccggtattattatggaattccaatttggtactaactggtcttattattctcattacgtgggggatatttttggtgcgccacttgctattgaagcgttacttgccttcttcttagaatccacttttgtggggttatttttcttcggttgggatcgtttatcaaaaggaaaacacttattagcaacttattgtgtggctttcggttctaatttatctgctatgtggattttggttgcaaatggctggatgcaagcaccaacaggttcaaaatttaattttgaaactgtacgtatggaaatgactaacttcttagatctttggttaaaccctgttgcacaaagtaaattcttacatactctttctgcaggttatgtgacaggcgcattttttgttttagccattagctcatactttttactaaaaggtcgtgattttgaatttgcaaaacgttctttctccgtagctgctacttttggatttatcgcctctatttcagtgctaattcttggtgatgaatctggttatgatattggtaaagcacaaccagtaaaattagccgcaatggaagctgaatttgaaactcatccagcacctgctccattccttccagtagcaattccaaatacggctgaaatgaaaaatgattttgcgattgaaattccttatcttggcggtgtaatagcaactcgttcaattgataaagaaattataggtctaaaagatcttcaagcattaaatgaaactcgtgtacgtagtggtatccgtgcttatgaattatttactcaactacgcgctgagaaaaaagcaaatggtcaagtaaatgaagaaaccaaagcacaattcaatgaagttaaaaaagatcttggtttcggtttattattaaaacgctatacaaacaatgttgttgatgcgacagaagaacaaattaaacaagccgctcgtgatactattccaaatgtaggccctaatttttgggcatttcgtgcaatgattgcagctggtggtttaattgctttacttacattcggcgcatttgttcaaaatttacgtaataaagtcactcaaattccattattgttaaaagttcttttatggggcttgccattaccttggattgccattgagtgcggttggttcttagcagaatatggtcgtcagccttgggctatttacgagatcttacctgttggcgtatccgcttctaatttaagtacaggcgatttatggttctccattggtttaatttgtgcgctttatcttgcgttcattattgttgagatgtatttgatgtttaaatatgcgcgtttgggtccaagtgcgttaaaaaccggcaaatactactttgaacaatcagctaaataa

SEQ ID NO: 1872 - DNA, 1638 bp, H. influenzae strain 86-028NP
atggctacaaattatattttcgtcactggcggtgtggtttcatcgttaggtaaaggcattgcggcagcatcattggcggcaattttagaagcacgtggtttaaacgtaaccattatgaagttagatccatatattaatgtggatcctggtacgatgagcccaacccaacacggggaagttttcgttactcaagatggtgcagaaacagatttagatttaggtcattatgagcgtttcatccgcacgaaaatgaccaaacgtaataacttcactacaggtaaaatttattctgaagtattacgtaaagagcgtcgtggcgattatcttggtgcaacaattcaagtgattccacatatcacgaatgaaattaaagatcgcgtcattgctggtgctcaaggtcacgacgttgtgattgttgaagtgggcggcactgttggggatattgaatcacttccattcttagaagcattacgtcaattagccgttcaagttggtcgtgaacatacgttatttatgcatttaaccttggtgccttacatcccaacggcgggtgaagtaaaaactaaaccaacccagcattcggtaaaagaattgctttctattggtattcaacctgatgtgttgatttgccgttcagatcgtatgattccaccaaatgaacgtgcgaaaattgctttattttgtaatgttgcagaacgtgcagtcatttcattaaaagatgtgaattcaatttatcaaatccccgcattattaaaatctcaaggtttagatgattttgtctgtgaacgtttccgtttaacttgccctgaagcagatcttactgaatgggagcaagtgctttacaagcaagccaatccagtgggagaagtaaccatcggtatggtaggtaaatacactgagttacccgatgcctataaatcagtaaatgaagccttaaaacacgcaggtttaacgaaccgtttaagtgtaagcattaaatatattgattcccaagatgttgaaaccaaaggtgttgaagtattaaaaggcgttgatggcattcttgttccagggggatttggttatcgtggtgtagagggtaaaattcgtaccgcacaatatgcacgagaaaacaaaattccttacttgggtatttgcttaggtatgcagatcgcattgattgaatatgcacgtaatgtagcgggtttaactaaagccaattcatctgaatttgataaagattgtgaacaacctgtggtggcattaatcacagaatggcaagatgcggagggtaatactgaagtgcgtaccgatgaatcagatcttggcggaacaatgcgtttaggcgcacaacaatgtcatttggtatcaggtagccacgctcgtgagctttatggcaaagaaaccattgaagaacgtcatcgtcatcgctatgaagtgaacaataccttgcttccacaaattgaaaaagcaggattgaaagtaactggattatctgcagataaaaaattggtagaaattatcgaagtgccaaatcatccttggtttgtcgcttgtcaattccatccagaatttacttctacgcctcgtgatggtcatccgttgtttgcaggctttgtaaaagcagcctatgaaaatcacaaaaaatctgtgaagtaa

SEQ ID NO: 1873 - DNA, 681 bp, H. influenzae strain 86-028NP
atgactttggcagcgcgtttaaaacgagaatttgtttctggttggaaaccttttgaggtggtttggcttgcgctttttatcattgcgcaaatttgggcttatgtacaaacacctgattcttggttagcaatgatttctggtatctcgggtattttgtgtgtggtattggtaagtaaaggtaaaattagtaattatttctttggattgatttttgcctatacttatttttatgttgcttggggatcgaatttcttaggcgaaatgaacaccgtactttacgtatatttgccctctcaatttattggttactttatgtggaaagccaatatgcaaaatagcgatggtggagaaagcgtgattgcaaaagcattaactgttaaaggatggatgacattaattgttatgactacggttggcactttgctttttgttcaagcattacaagctgctggtggtagttcaacaggtttagatggtctaactacaattattacggttgcggcacagattttaatgattttacgttatcgtgaacagtggttgttatggattggattaaatattctttctattttcttatgggcagagacacctgcaatatacttaatgtattcagcctacttacttaactcgttgtatggttattataactggacgaaattagttaagcgtactaactaa

SEQ ID NO: 1874 - DNA, 774 bp, H. influenzae strain 86-028NP
atgtctatgttaaaagtaagtaatattcagaaaaactttaatggcaatcatgtgttaaaaggcattgattttgaaattaataaaggtgaagtggtcgcaattttaggcccttctggttctggaaaaaccacctttttacgttgtttaaacttgcttgaacgaccagagcaaggcattttggaatttactgatggcagtctaaaaattgattttagccagaaaattagtaaagcagatgaattgaagttacgccgacgttcatcaatggtctttcagcaatacaatttattccctcatcgttctgcccttgaaaatgttatggagggaatggttgttgtgcaaaaacaagataaagctcaagctcgtgaaaaagcacttagtttgctagaaaaagtagggcttaaaaataaagcggatttatttccatcccaactttctggcggtcagcaacagcgagtggggattgctcgagcccttgcggtaaaacctgatattattttattagatgaacctacatcggcattagatcctgaattggtgggcgaagtgttacaaacactaaaaatgctcgcccaagaaggctggacaatgattattgttactcacgaaatgcagtttgcgaaagatgtcgcggatcgtgtgattttaatggcggatggatatattgtagaacaaaatacggcagataaattcttcacttgcccacaacacgagcgcactaaacagttcttgttacaagcaaaaataccacttgagcttgattattatatttaa

SEQ ID NO: 1875 - DNA, 678 bp, H. influenzae strain 86-028NP
atgagtgcagaacgagctgattatgtaatcagctcgttttggcctatgttggaagcagcaattttatacacattgccattggcagtcatttccttcttctgtggtttgcttattgcagtgattgttgcagttattcgtactttgcctagccctaatttacccttaaaattgttacaggctttatgtcgagtgtatatctctataattagaggtacaccgatgttagtacaaatttttattattttttatgggttacctgaagtcggtattactttagagccttttccgacagcgattattgcattttctattaatataggtgcttatgcagcagaaactgttcgtgcttcaattattgctatacctaaagggcagtgggaagcctcttatgcgataggtatgaattatcgacaagcatttattcgtacaattatgccacaggctttacgtatttcagtaccatcgctttctaatacttttattagtacagtgaaagacacttcattagcttctcttgttttagtgacagaattattccgtgtcgcacagaatattacggcagcgaactatgaatttattttaatttatagtgaggcagctttgatttattggattttctgttttgttttatctttcttacaagatcgtcttgaaattcgcttatctcgccatttataa

SEQ ID NO: 1876 - DNA, 774 bp, H. influenzae strain 86-028NP
atgaaaaaattactttttacgaccgcacttttaactggagctattgctttctcaacgttttctcacgcaggcgaaattgccgatcgtgttgaaaaaacgaaaactttattagttggaacagaagggacttatgcaccatttactttccatgataaaagtggaaaattaacaggctttgatgtagaggttattcgtaaagttgctgaaaagctcggtttgaaagtggaatttaaagaaacacaatgggatgcaatgtatgcggggttaaatgcaaaacgttttgatgtgattgcaaaccaaactaacccaagcccagagcgtttaaaaaaatacagtttcacaacgccttataattattctggtggggtgattgtaacaaaatcatcggataacagtattaaatcatttgaagatttgaaaggtcgtaaatctgcgcaatctgcaacaagtaactggggtaaagatgcaaaagctgcaggtgcgcagattcttgtagtggatggtttagcacagagcttagagcttattaaacaaggccgtgcagaagcaacaattaatgataaattggctgtattagattattttaaaaaacacccaaattctggtttaaaaattgcttatgatcgtggggataaaactccgactgcctttgcttttttacaaggtgaagatgcattgattacaaaatttaatcaagtacttgaagcacttcgccaagatggtacattaaaacagatttcaattgaatggtttggttatgatattactcaataa

SEQ ID NO: 1877 - DNA, 1275 bp, H. influenzae strain 86-028NP
atggataaatttcgtgtttatgggcaatctcgtttaagtggaagtgtgaatatttcaggcgcaaaaaacgccgcacttccaattctttttgcggctattttagctacagaacctgttaaattgacaaatgttcccgaacttaaagatattgaaacaactttaaatattttgcgtcaattaggcgtaattgcaaatcgtgatgaaactggtgcagttttattagatgcctctaatatcaatcatttcactgcaccttatgaattggttaaaactatgcgtgcttcaatttgggcattggcacctttagtcgctcgtttccatcaagctcaagtctcattacctggaggttgttctatcggagctagacctgttgatctccacattagcggtttagaaaaattaggtgcggacatcgttcttgaagaaggatatgtaaaagcacaagtatcagatcgtcttgttggaactcgaattgtaatagaaaaagtaagtgtaggcgcaactttatctattatgatggcagcaacccttgcgaaaggtacgactgttattgaaaacgccgctcgtgaacctgaaattgtagatactgcagatttccttaataaaatgggtgcgaaaataacaggtgcaggttctgatcacattacgactgaaggtgttgaacgtttaactggttgtgagcacagtattgtgccagatcgcattgaaacgggtacattcttaattgctgcagcaatttcgggcggtcgtgttgtttgtcaaaatactaaagcggatactttagatgccgtaattgataaactccgtgaagctggtgcgcaagttgatgtaactgaaaatagcattactttagatatgcttggtaatcgccctaaagcagtgaatattcgtactgcaccacatccagggttcccaactgatatgcaggctcaatttactttattaaatatggtggcagaaggtacaagcattatcactgaaacgatttttgaaaatcgttttatgcatattcctgaattaattcgtatgggtggtaaagctgaaattgaagggaatacagcggtatgtcacggggttgaacaattgtctggcacagaggtaatagcgacagatttacgcgcttcaatcagtttagtgcttgcaggttgtatcgcaacgggtgaaaccattgtagatcgtatttatcatatcgatcgtggttatgaacatatcgaagataaattacgtgctctaggtgcgaaaattgaacgtttttctagaagtgatgaagcgtaa

SEQ ID NO: 1878 - DNA, 258 bp, H. influenzae strain 86-028NP
atggaacttcaaaaaattgaacaaattttaaaagacacgctaaatatcgtagaagtctatgcacaaggtgaaaatgcacattttggtgtaattgtagtgagtgatgaaattgctgcactatctcgtgtaaaacaacaacaaacgatttatgcccctttaatgccttattttagcactggtgaaattcacgctctaaccatcaaaacttataccgtagaaaaatggaaacgcgatcgtgcattaaaccagtttaattaa

SEQ ID NO: 1879 - DNA, 318 bp, H. influenzae strain 86-028NP
atgctaaattgggatttgcaaaaaaataatgataaaataacgctctttttgtttggggaactatctcgcagcaccttgttaccaatgtggcagcaacgtggcgtttttttgtcagaaagtacacttgataaaactattgttgaatggaatttatctggtcttcagcatattgattcagctggttttacagctctttgtgattttttacgagagtgtcaaaagattaacaaaacagtacgattagtttatccaccaaaacaattattaaccctagcagatcttgttggtttatctgattggatcgcaaattttacatag

SEQ ID NO: 1880 - DNA, 645 bp, H. influenzae strain 86-028NP
atgtaccttactcaactaaaaaaatggtttactattttaactttcgtattaaccgcacttttggttacacgaacagctattgcagaaacaagtccttatgttttaatgcagcaagcgtcagataaactattttctgatatacaagctaatcaaagtaaaattaaacaagatccaaattatttacgtactattgttcgtaatgatttattgccttacgtaaacttagaatatgcaggttctaaagtattaggttcatactacaaatcaacctctacagaacaacgagaaaaatttttcaagacttttggtgagttgattgagcaaaagtacgcacaaacattaacaaattattctaatcaaaaaattcaaattgaatcagaaaaagaattaggcgataacaattttgtaaatattcgcgtaagtattattcaaactaatggcgttgctccgatcctattagattttaaatggcgtaaaggcaataaaagtggggaatggaaagcctacgatatggcagcagcaggcgtaagtatgctggaagatacgataaaaaattgggttggtattttaaacaaacaaggtattgatacattaatcacaaagatgcagcaatctgcctcacaacctataattttcaatcaataa

SEQ ID NO: 1881 - DNA, 501 bp, H. influenzae strain 86-028NP
atgagacaaacaattaaatatgaattttgggtcgggttatttttattacttggtattggtgccttagtttttttaggtttacgcgtagctaatgtacaaggttttgctgagacgaaatcttataccgtgacggcaatttttaataatattggcggacttaaagtgcgcgcaccactaaaaattggaggcgtagtaattgggcgtgtgagtgctattacgcttgatgaaaaaagctatttaccaaaagtaagtattgcgattaatcaagaatataatgaaatcccagaaaacagttctttatcaattaaaacatcaggtttattaggtgagcaatatattgccttgacaataggttttgatgatggagatacagcaatgcttaaaaatggtagtcaaattcaagacactacatcagctatagtattggaagatttaattgggcaattcttatacggaagtaaaaaatcagacggcaatgaaaaatcagaatccgcagaataa

SEQ ID NO: 1882 - DNA, 786 bp, H. influenzae strain 86-028NP; identical to SEQ ID NO: 696

SEQ ID NO: 1883 - DNA, 795 bp, H. influenzae strain 86-028NP
atgaatcaaaatctaattgaagttaagaatctcacctttaaacgcggtgatcgcgtgatttacgataacctgaatttgcaagtaaaaaagggaaaaatcactgcgatcatggggccgtcggggattggtaaaaccaccttacttaaattgataggtgggcaactaatgccagagcaaggtgaaattttgtttgatggacaagatatttgtcgtctatctaatcgtgaactgtacgaagtacgcaagcggatggggatgttattccaatcaggtgcgctttttacggatatttctacttttgataatgtcgcctttccaattcgtgaacatacgcatttgcctgaaagtttaattcgtcaaatcgtgttgatgaaattggaggcggttgggttgcgaggtgctgccgcattgatgccttcagaactttccggtggtatggctcgtcgagctgcattagcgcgcgctattgcgcttgaccctgatttaattatgtttgatgagccatttacggggcaagatccgattagtatgggcgtaattttaagcctgattaaacgattaaatgaagcgttaaatttgacttctatcgtagtgtcacacgatgtggaggaagtattgagtattgcagattatgcctatattattgcagaccaaaaagtcatcgcagaaggaacatctgagcagcttttacaaagccaagatccgcgcgtggtgcaattcttaaaaggtgaatctgatggtcctgtgcgctttaagtacccagcgcaagattatatgaaggaattgtttgaatga

SEQ ID NO: 1884 - DNA, 648 bp, H. influenzae strain 86-028NP
atgtcttacactctccctgaattaggctatgcctacaatgcgttagaaccacattttgatgcgcaaacaatggaaatccatcatagtaaacaccaccaagcttacgtaaacaatgcaaatgctgcattagaaggtttacctgctgaattagtagaaatgtatccgggtcatttaatttctaaccttgataaaattcctgcagaaaaacgtggagcattacgtaataatgctggaggccacacaaaccacagtttattttggaaaagtttgaaaaaaggcactactttacaaggcgcattaaaagatgcgattgaacgcgatttcggttctgtagatgcatttaaagcagagtttgaaaaagcagcagcaactcgtttcggttcaggttgggcatggttagtattaaccgctgaaggtaaattagccgttgtatcaacagcaaaccaagataacccattaatgggtaaagaagtggcaggttgtgagggtttcccacttttaggtttagacgtttgggaacacgcttactacttaaaattccaaaaccgccgtccagactacattaaagaattctggaatgtggtaaactgggatttcgttgcagaacgttttgaacaaaaaacagcacactgtaactgtgcaaaataa

SEQ ID NO: 1885 - DNA, 639 bp, H. influenzae strain 86-028NP
atgtttgagcaacacaagttatctctgcaaaatttatcctgccaacgtggtgagcgcgtactttttcgtgctttgacttgcgattttaatagcggtgattttgtacaaattgaagggcataacggcataggtaaaacgagcttgttacgtattcttgctggtttagcccaacctttagaaggcgaagtgcggtgggatgctgaagcaatttctaaacaacgtgaacagtatcatcagaatttgctttatttaggacatcttttaggcgttaaaccagagctaacggcgtgggaaaatttgcagttttatcaacgaattagtcaagctgaacaaaacaccgatatgttgtgggatttgcttgagaaagtgggattattagggcgtgaagatttgcctgccgcacaactttctgcaggacaacaaaaacgtatcgcgttaggtcgcttatggctgtctcaagcgcccttatggattttagatgagccctttactgcgattgataaaaaaggcgtggaaattctaaccgcactttttgatgagcatgctcaacgtggaggtattgtgttattgaccagccaccaagaagtgccaagttctcatctgcaaaaattgaatttagcggcttataaagcggaataa

SEQ ID NO: 1886 - DNA, 666 bp, H. influenzae strain 86-028NP
atgatttttttagagataattaaacgagaacttcaaattgcaatgcgcaaaaatgcggagattttaaatccgctatggttctttttgcttgtgattactttgtttccgcttgttattgggccagagcctaaattactttcccgtatcgcaccgggtatcgcatgggtagcagcattactttcagcattgctttcttttgaacgtttattccgtgatgattttattgatggctctcttgaacaattaatgctaactgcacagcctttgccaatgacagctttggctaaagtcgttgcacattggttgctcactggtttgccgcttattttgctatcacctattgccgctttgttgctttctcttgaggtcaatatttggtgggcattggttttgacattgttactgggcactcctgtattgagctgtatcggtgctattggcgtggctttaacggtgggattgcgaaaaggtggcgtgttgttgagtttgcttgttgttccgttgtttattcctgttttaatttttgcttcatcaatactagaagcagcaggattaaatgtgccttatgggggacaactggcgattttaggtgccatgatggttggtgcagtaacgctttcgccttttgccattgctgcagcgttgcgaattagtttagataattaa

SEQ ID NO: 1887 - DNA, 741 bp, H. influenzae strain 86-028NP
atgtggaagtggttacatccttatgcaaaacctgaaactcaatatcgtatctgcggtaaattgagtccgttatttgcatttttaacgcttatcttactcggtattggcattgtatggggcttagcattcgccccagcagattaccaacagggcaatagtttccgaattatgtatgtacatgtgccgacagcgatttggtcaatgggtgtgtacggttcaatggcgattgcagctgtggttgccctagtgtggcaaattaagcaagctcatctcgcaatgattgcaatggcgccaattggtgcattgtttactttcttatcgcttgttacgggggcaatttgggggaaaccaatgtggggtacttggtgggtgtgggatgctcgcttaactgcagaattgattttattctttctttatcttggtatcttagccctttattctgctttttcagatcgtaacataggtgcaaaagcggcggggattttatgcattacaacggtcgtgattttaccgattattcatttttcggtggagtggtggaacacattacatcaaggggcgagtattaccaaatttgaaaaaccatccattgcaattccaatgttggttccattaattttatgtatcttcggttttttgaccttgtatatttggcttactttagttcgttatcgcgtggaattattgaaagaagatgcaaaacgtccttgggttaaagcattagctcaaacactgaaataa

SEQ ID NO: 1888 - DNA, 204 bp, H. influenzae strain 86-028NP
atgtttttccaaacttggagtgatttttttaatatgggtggctacggtttttacgtatggttatcctatgcagtaagtttagtggcagttattgccttaattgttcaaagtgtaaaacaacgcaagacagtgttacaaaatgtattgcgtgagcaacaacgcgaagaacgtttacaacaagcaaataaggggaacacactatga

SEQ ID NO: 1889 - DNA, 522 bp, H. influenzae strain 86-028NP
atgaatccaagacgtaaatccagatttaaattagtcatttttgttgtgctcggcattgctattgcaagtggattgatgctgtatgcattacgtcaaaatatcgacttgttttatacgccatctgaagtgattcaaggtaaggataataatccgaatcaaaaacctgaagtggggcagcgtattcgtgttggcggtatggtggttgaaggcacggtagtgcgtgatccaaaaagcttaaaagtgcggttcgatttaaatgatattggtcctgcgatcactgttgaatatgaaggcattttgccagatcttttccgtgaagggcaggggattgtggctcaaggcgtattaactcagtcagcggttttaagcgcgacagaagtattggctaaacacgatgaaaattatgtgccgccagaattaggcgaaaaaatgcaaaaagtacataaaccaatggggattaaggcagcagatttaaaaggcgaaagtgagcgtgatcgtcaagaaaaagaaggcgcaaaatga

SEQ ID NO: 1890 - DNA, 1947 bp, H. influenzae strain 86-028NP
atgattgctgaattaggaaattatgtgctggctttaagtttagctgtatcgcttatgttggcgattttccctttgtggggggcggaaaagggcaatgtacaattaatggcattagctcgcccaatgacttatggtttatttgcaagcctaagcattgcttttgctgcgctattttatttattcgcagtcaatgattttagcgtgcaatatattgtaaataattctaatactactttacccatttattatcgtttatctgcggtatggggttcccatgaaggctctttgttactgtggatttggttactggcggtttggtcatttgccgttgctttattgagtaaacatttaccccaagaagcggttgctcgcgtgcttggtattatggggattattagcgtcggttttgtattgttcgtcttgtttacctcaaatcctttcacgcgtactttccctgatttcccagtagatggaaaagaacttaatccaatgttgcaagatgtaggcttgattttccaccctccattactttatatgggctatgtgggtttttcggtggcatttgcgtttgcgatagcatccttaatgactggaaaattagattcagcttgggcgcgttggtcacgtccttggacgcttgctgcttgggtgtttttaactttaggtatcgtactaggttcttggtgggcttattatgagcttggctgggggggctggtggttctgggatccagtagaaaactcatcgtttatgccgtggcttgctggtactgcattgattcactctctttctgtgacagaaaaacgaggttctttcaaagcttggacggtattacttgcgattttagccttttcactttgtctgctcggcaccttcttagttcgttctggtatcttagtttcagttcacgcatttgcatcggatccaactcgtggtttgtatattttggcttacctcgttgtggtaattggcggttcgcttgcactctatgcgtataaaggcagtcaaattcgttctcgtgataatgcagaacgctattcacgtgaaagtatgttgttattgaataatatcttattaatgaccgcactttgcgttgtattcttaggaacgttgttaccactcgttcacaaacaacttggtttaggctctatttctattggtgcgccgttctttgatcaaatgttcttaattattatgacaccatttgcattattgcttggtattggacctttagtgaaatggcgtagagaccaattttctgcaattcgtacgcctgttgttatcagcgtatttgttatgctgattgcaggttttgcgttaccttatttcttgcaagataaaattaccgtgagttcagtgcttggttcaatgatgactgtgattattgtgttacttgtgctttatgaattgcaacaacgtgcgacgcatcgtgaatcattctttgttggcgtacgcaaactatctcgttctcattggggaatgatgttagctcacttaggcgtagctatgactgtttgggggatcgcatttagccaaaactttagcgtagaacgtgatgtgagaatgaaagttggcgagaacgcacaaattggtcgttacgattttaaattcgctggtgtgacggatgaaaatggtccaaactatattggtggaaaagctcaaattgatatttcgaaagatgggcaaccagagacaagtttattcgcagaaaaacgtttttacacagtaagtcggatgtctatgacagaagccgcaattgctggtggtttaactcgtgacctttatgtggcacttggcgaaaaacttgaggacaattcttgggcgttacgcttatattacaagccatttattcgctggatttggattggcggcttatttatggcgttaggtggattgttgtgcatgttcgatcgacgctatcggtttaatgtgttgttgaagaaatag

SEQ ID NO: 1891 - DNA, 546 bp, H. influenzae strain 86-028NP
atgaaaaaaaaattactcgttcctcttattctctttttatcgataacaattgcctttttagtgcaattaaaacgtaatgcacaaggcgaagatattaaagcattagagtcagctttggttggaaagcctgtgccagaaaaaaatttgacggagttgtttgaaaataaagcttacacgaacgaattgtttcaacaaggtaagccagttttgcttaacgtatgggcgacttggtgtccgacttgttatgccgaacatcaatatttaaacaaacttgctaaagagggtgtgagaattatcggtttagattataaagatgaatcacctaaagcaatgaagtggttaaaagatcttggcaatccttatcaagttgttttaaaagatgaaaaaggttctttcggtttggatttaggggtatatggtgcgccagaaacgttcattgtagatggaaaaggcgtgattcattatcgttatgctggagatgtaaacgaaaaagtttggactcagactttaaaaccaatttatgacaaactttcggagcaacaataa

SEQ ID NO: 1892 - DNA, 1380 bp, H. influenzae strain 86-028NP
atgaaaaaaacatggttatttttgaccgcatttttgtttagctcagtggcgttttcagctattgacgcattaaattttagttctccacagcaagagagtgattaccaccaattaacacaatctttgcgttgtcctcaatgtcaaaataacaatattgcggattccaatgcgactatcgctgtggatatgcgtggcaaagtatttgagcttttacaagaaggcaaatcgaaaaatgacgtagtggattatatggtggcacgttacggcaattttgtaacctatgatcctcctataacagcgagtacattagtgctatggattgcgccattattgcttgtgttgttaggcgtggtgtttttattaagacgcaaacctaaaacccaaagtgcggtgaaatcccaagaggttttaacggatgaagataatgcgcgtttggcagaattattaaacaaggataaatagatgaattttacattaatttttatcttaaccactttagttgtggcgttaatttgtttttatcctttattacgtcaatttaaagcgaaacatgggcaaaaacgtgatgatttaaataaggcgttatatttctcacgcttggaagaaattgagcaagataattcccaaggtttagttgaaaatgttgagcaactcaaacaagaattacagaaaaccttgcttgatgatgtaccgagcaaggttcaagagaatgtggattattctggcaaatcttatggaaaaatttggtttgtctctggtgtattagcgttaggaattatcgcaggttcttcttattttatggtgggatcttggcaagccgaatcaatgttagagcaaacttatgcgaaattgccctatttctttgaccgaatgaaagatgaagataaaaatccattttctgatgcagaaatgcagcaattttctaccgcacttcgaatcgatttgcaaaaaaatccaactgatgctaaaaaatggtggatgctcggtcaaattgggatgaatttaggtgatgcacgtttggcattcgatagctatcaaaaggctaataaacttgaaccagataatgtgcaatataaattaggctatgctcgtatattgatgttttctgaagatgcgactgataaacttaaaggtggcaatttattgcgtgaagtgattcgtcaagaacacactaacattgaagcattgagtttactcgcattccgttattttgaaacagaagattataaaatggcggcagtgacttgggcgatgatgctacgcttaatgccgaaagatgatgagcgagttccattaattgaaaaaagtattcgtaccgcgcgtgatgctttagaagcgcaaaatgaagaaaaatcaaaaagtatcactcccgaaaaataa

SEQ ID NO: 1893 - DNA, 492 bp, H. influenzae strain 86-028NP
ttgttctgcgtcattattggaagtttatttacttcacaattttcgattgcagaaaatgattctagtgcagttgattctgaagataaaaaagcatttaattccgatgtttcaaataatgatgctcaaaaactagctcaaagtattgaatttaaagtttataaaatagatgaaaccacttcatcagaaagtatttatgaatctccagctggaatttgtcagggatttaagattacaagaggtgtagattacacaaattcgacttaccattatctttatccagacaatagaggagaattctatggcagtgtggttggtgcaaccatttataaccaaaaagatcctcaaaatttaagttatgtgcctgtttattcaattacagacaaagatttgtctaagtgtattcaggcacaagaaaataaaaaattaaaggaaaaagcagcgaattatgtatcagaaggtagggctgtattaactgacgtaatttgtaaatag

SEQ ID NO: 1894 - DNA, 309 bp, H. influenzae strain 86-028NP
atgtatttaatgagaaaaatagtttttgttagttgtgtaattttaggtttagcagcatgttcatctcaaccagaacaaattggtggcggtgtttacgatatgaaaactgtgcaagaatataatgctcgagttattagtggtaatactgttacacaaactcaaaaggataaaataacgcaacaaattgatacaagtttaaaattaaaccaaagtgacaataaagttaaaacgagaacaagacgtgtattgcctgttcttccagttacaccaagcgtcgggtatcattataattatcactattttagataa

SEQ ID NO: 1895 - DNA, 2040 bp, H. influenzae strain 86-028NP
gtgcggtcatttttctccgagaattttatgacaaatattcaaactcaactagacaatctacgcaaaaccttgcgccaatatgaatacgaataccacgttttagataatccgagcgtgcctgatagcgaatacgatcgtttatttcatcagctcaaagccctagaattagagcatcctgaatttctgacgtcagattcgcccactcaacgtgttggtgcaaaaccactttctgggtttagccaaattcgtcacgaaattcctatgctctctttggataatgctttttccgatgcagaatttaatgcttttgtaaaacgcattgaagatcgtttaatcctattaccgaaaccacttactttctgttgcgaacctaaacttgatggcttggctgtgagtattttgtatgttaatggtgaacttacacaagccgccactcgtggtgatggcaccacaggcgaagatattacagccaatatccgcacgattcgtaatgttccattacaacttttaacagataatcctccagcacgtttagaagtgcggggcgaagtttttatgccgcacgcaggctttgagcgtttaaataaatatgcgttagaacataatgaaaaaacctttgctaatcctcgcaatgcagcggcaggctctttacgccagcttgatcctaatattaccagcaaacgtccgctggtattaaatgcttatggtattggaattgctgaggggattgatctgccgactacgcattatgatcgtttgcaatggctaaaatctatcgggattccagtaaatcctgaaattcgtttatgcaatggtgcagatgaagttttaggtttttatcgagatattcaaaacaaacgtagctcgttaggttatgatattgacggaacggtattaaaaatcaatgatatagccttacaaaatgaactaggatttatttctaaagcacctcgctgggcgattgcttataaattccccgcccaagaagaattaaccctgttgaatgatgttgaattccaagtgggtcgaactggcgcaatcacaccagttgccaaattagagccagtgtttgttgcaggcgttacagtaagtaatgccaccttacataatggcgatgaaattgaacgtttaaatatcgctattggcgatactgttgttattcgtcgagcaggcgatgtaattccacaaattattggcgtattacacgaacgtcgccctgataatgctaaaccaatcattttcccaacaaattgccctgtgtgcgattctcaaattattcgtattgaaggcgaagcagtagcacgttgcacgggaggattattctgtgcggcacagcgtaaagaggcgttaaaacatttcgtctctcgtaaagcaatggatattgatggtgtaggcggaaaattaatagagcaattagtcgatcgagagctaattcatacacctgcggacttatttaaacttgatttaaccacgctcacacgcttagaaagaatgggtgcaaaatctgcagaaaacgcactcaatagtcttgaaaatgcaaaaagcacgacgcttgatcgctttatttttgctttaggcattcgtgaagtgggcgaagccactgcattaaatcttgctaatcatttcaaaactttagatgcgcttaaagacgcaaatcttgaagaacttcaacaagtgcctgatgtaggggaagttgtagcgaaccgaatttttatattttggcgtgaagcgcataatgttgcagtcgtggaggatttaatcgcacaaggtgtgcattgggaaactgtagaagtgaaagaagcgagtgaaaacttgttcaaagataaaactgtagtactgacaggcactcttacacaaatggggcgtaatgaagcaaaagccttattacaacagcttggtgcaaaagtaagtggttcggtatccagtaaaacagatttcgttatcgcaggtgatggggcaggctctaaacttgcaaaagctcaagaactaaatattacagtattaacagaagaagaatttttagcacagataacaagataa

SEQ ID NO: 1896 - DNA, 987 bp, H. influenzae strain 86-028NP
atggatttaaatacaattttgattattgtgggtatcgtagcacttgtcgccttaatcgtacacggattatggtcaaatcgtcgtgagaaatcaaaatattttgataaagccaataaatttgaccgcacttctccaacatctagatcccatacgcaagaagaaatggtacagccaaacaatatttcgccgaatacctatgtggaaaatgggcatacaccaatttctcaaccgaccacagaaaaattaccatcagaagctgaattgatcgattatcgccaaagcgataaaagtgtggatgacatcaaaatttctattcctaacacgcaacctatttatgatatggggaatcatcgttccgagccaatacaaccaacgcaacctcaatacgatatgccaaccgcaaataatgtcgcaagtatgaccttagaacaacttgaagcacaaagtcaaaatgttggttttaatggcattaattcatcatcgccagaattaagagtgcagcttgcagaattatctcacgaagaacatcaagtagactacaacctctcgttcaatgaaccaaaagcagaaacgacagctcagccaaaacaaacaactggctatattcaactttatcttattccaaaatctagcgaagaatttaatggtgctaaattggtgcaggctcttgaaaacttgggttttatcttgggtaaagatgaaatgtatcatcgtcacttagatttaagtgtggcaagtcccgtgctttttagtgtggcaaatttagaacaacccggcacattcaatgcttataacttagcggaatttaacaccataggaattgtattatttatgcaattgccctctccaggtaataatcttgctaatttacgtatgatgatgcgtgctgcccatacattagccgaagatttacaaggtgttatactgactgaagaacaagaaatttttgatgcaaatgcagagcaagcctatcttgctcgagtgtaa

SEQ ID NO: 1897 - DNA, 819 bp, H. influenzae strain 86-028NP
atgttaaatcttaatgaattaaaatctggtttccactattttgtgatgggctggcatttcatcacacaaaaaggtttgcgtcggtttgttattattccaattttgctcaataccattttgctttgtggtttattttggctttttattagccaaatcagcagtgctattgattgggtgatgaattttattccagattggcttagttttctcagtgtcattttactgacactttcgattttaacgattttattgctcttttattttacttttaccacgttttctggctttatcgcagccccctttaatggtttgttggcggaaaaagtagaaaaaatgctgacggaggaaaatattaatgatgatagtctcgtggatataatgagggatgtgcctcgtatgcttgctcgagagtggcaaaaattacgttatagcctacccaaaattatcgccttatttttactgagttttattcctctggttgggcaaaccatcgtgccagtacttactttcttgttcacttgttggatgatggcaattcaatattgtgattatccttttgataatcacaaagtctcttttgatatcatgaaaactgcacttggcaatcaacgaactcaaagtttaacttttggtggattggttacttgttgcacatttgtgccagtgattaatttattaattatgcctgttgcagtatgtggtgcgacgctgatgtgggtggaaaattatcgtaatgacttaggttttaatatgaatagatctttttcctctcaaacggggcttgatgttcgttcagaaaatacagggattgttaaatag

SEQ ID NO: 1898 - DNA, 951 bp, H. influenzae strain 86-028NP
atgacaatttatgcagacaattcttattctatcggaaatacgccgcttgtgcgtttaaaacactttggccataacggcaatgtggtggtaaaaattgaaggtcgtaacccaagctacagcgtaaaatgccgtattggggcgaatatggtgtggcaagcagaaaaagatggcacgctcacaaaagggaaagagattgtagatgcaacgagtggtaacacgggcattgctttggcttatgttgcggcggctagaggttataaaatcacgctcactatgccagaaacaatgagtcttgaaagaaaacgcttattgtgcggattgggtgtaaatttagtgcttaccgaaggtgcaaaaggaatgaaaggtgctattgcgaaagcagaagaaattgttgcttctgatccaagccgctatgtcatgcttaaacaatttgaaaatccagccaacccacaaattcatcgagaaacaacagggcctgaaatttggaaagatacggatggcaaagtcgatgttgttgttgctggcgtaggaacaggtggttcgattacgggtatttctcgcgcgattaaattagattttggtaaacaaatcacttctgttgccgttgagccagtggaatctccggtcattagtcaaactttagcgggtgaagaagtaaaaccaggtccacacaaaattcaaggtatcggtgcgggtttcattcccaaaaatttagatttatctattattgatcgcgtagaaactgttgatagtgataccgcacttgccacagctcgtcgcttaatggcggaagaaggcattcttgcaggtatttcatctggtgcagctgtcgcggctgcagatcgcttagctaaattaccagaatttgccgataaactcattgttgttattttgccttcagcttctgaacgctacttaagcacagcactgtttgaagggattgagggataa

SEQ ID NO: 1899 - DNA, 1225 bp, H. influenzae strain 86-028NP
atgacaaacaaagtaaacagttatggctggaaagccttaattggctctgccgtaggctatgcaatggacggtttcgatcttctcattttaggtttcatgcttagtgcaatttccgcagacttaaatctaacacccgcccaaggtggatctctcgtaacttggactctgattggtgccgtatttggcggcattttatttggtgcattaagcgataaatacggtcgtgtacgcgtactgacttggactattcttctttttgcggtgtttactggtttatgtgcgattgcacaaggttattgggatttactgatttatcgcacaattgctggtattggcttaggcggtgaatttggaattgggatggctctagcagcagaagcatggcctgcacgccaccgagcgaaagcagcatcttatgttgcattgggttggcaagttggtgtgttaggtgctgcgttgcttacaccattattgctcccgcatattggctggcgtggaatgttcttagtgggtatcttccctgcatttgtcgcttggttcttacgttctcatctgcacgaacctgaaattttcactaaaaaacaaaccgcactttcaacgcaatccagctttactgataaattacgttcattccagcttctgattaaagacaaagccacgagcaaaattagtcttggtatcgtcgtactcacttcctgtacaaaacttcggttattacggcattatgatttggttacctaatttcttatcaaaacaacttggattcagtttaactaaatctgggctttggaccgccgttaccgtctgcggcatgatggctggcatttggattttcggacaactcgccgaccgaatcggacgcaaaccaagtttcttacttttccaattaggcgcagtgataagtatcgtggtttactcacaacttaccgatcctgacatcatgcttcttgctggggcatttttaggtatgtttgtgaacggaatgctgggcggttacggtgcattgatggcggaagcctacccaacagaagctcgagcaacggcacaaaacgtacttttcaatattggtcgtgccgtagggggatttggacctgtagttgtgggcgcagttgtacttgcttactctttccaaacggccatcgctctacttgcgattatctacgtaattgatatgttagcgacaattttcttaatccctgaattaaaaggtaaagccttagactaa

SEQ ID NO: 1900 - DNA, 1041 bp, H. influenzae strain 86-028NP
atgaatattctaattattggcccatcttgggttggcgatatgatgatgtcgcacagtttgtaccagcaactgaaaattcaatatccaaactgcaatattgatgtgatggcaccgaattggtgtaagcctttgcttgcgcgtatgccagaagtgcgtaaggcgattgaaatgccattagggcacggagcctttgaattgggaacgcgttatcgtttaggtaaggcattgcgcaatcaatatgatatggcgatcgtattaccaaactccttgaagtcagcttttattcccgcttttgcaaaaattgcggtgcgtcgtggctggaaaggggaaagccgttatttcttgcttaacgatttacgcaataataaacgtgattatcctatgatggtgcaacgttatgtcgcgttagcttttgagcaaaatgcggtaccgaaagcggctgatattcctgttctaaaaccttatttaaccgttgatcccactcaacaagctgaaaccttaaaaaactttaaaaaacaaaccgcacttttaggcgagcgtccaattattggtttttgtcctggtgcggaatttggcccggcaaaacgttggccacattatcattatgcaaaattagcagaaatgttaattacccaaggctatgctgtggcgctatttggttcagctaaagatgaaccagtgggagaagaaattcgtcaagcactgccagaagcgttgcgtgagttttgtgtcaatttagcaggaaaaaccaacttaaatgaagcagtggatttaattgcaaattgtacggcggtcgtgaccaatgacagtggtttaatgcatattgcggcagcagtaaatcgtccattgattgcactttatggaccaactagcccacaatatacgccgccgctttcagataaagcaacgattattcgtttaattgaaggtggattgattaaagtccgtaaaggcgacaaagagggggggtatcatcaaagtttgattgatattacgccagaaatggcattagaaaaactgaacgaactgttagcaaaataa

SEQ ID NO: 1901 - DNA, 1164 bp, H. influenzae strain 86-028NP
atgacggaacaatactacaaaattgccctcttatttaatgcaaacaaagtatatgatcggcaggtggtggagggtattggacaatatattcaggcatcgcaatgtatgtgggatatttttgtagaagatgaatttatctatcatactgatactattaatcaactttctattgatggcattattgcagactttgatgatccaaaaactgttgaattattgcaacacactcttattcctactatagcagttggtggatcttataaacaagctgatttttatccgcactttccttatgtagcaacagataatatggcattggttgaaatggctttatctcatttacaggagaaaggactgtcacagtttgcattttatggtttgcaagtaaatactcataagcattggtctatagaacgaagagatgcttttgtagagttgatggagaaaaatcattaccctatttacctatatgagggtgtgcaggttcatgctcaaaattggttggaagagcaacaaaagctaattgtctggttaaaatctcttccttctcatactggtattattgctgttacggatgcgcgtgctcgtcatttattgcaggcttgtgaatacagtaaaattgctgtacctgaagagctttgtgtggttggtattgataatgaagaattgatccaatatttatcgcgtatgtccctttcctccgtagaacaaggcacgagagagattggttatcaagctgcgaaattattacacaaattactcaatggtcaaaaagtttcacatacccctattttaattccaccgattaccgttcactctcgaaattctacagattatcgatcattaacagatccgcttgtcattcaagcaatgcattatattcgtcatcgtgcctgtcatcgaattaaagtagaacaagttttagatcatcttgaaacctcacgttctaatcttgaacaacgttttaagaatgaaatgaataaaacaattcaccaagtcatccacgaagaaaaaatttcccgagcaaagaatttattacaacaaacagatatttctattcaagaaattgctgagatttgcggctatccatcaattcaatatttttactctgtttttaagaaagaatttgaaatgactcctaaagagtttcgactaaattgttaa

SEQ ID NO: 1902 - DNA, 1407 bp, H. influenzae strain 86-028NP
atgaaaaccactcatcgcacaagaatgccaacaacattagaagctttttcaccaatcattgtgatgctattactgttagggcttgggtatgctttatttgatttgccagcagagccattaatgattatttcaacggtatttgctggttttttagttattaaattaggtcattgctatttagatattttagacgccatttcagaaaaaatagctaaaacaatgcctgcgctattaattttaattactgtaggattattaattggaacttggattagtggaggaacaattcctatgatgatctactacggactaaaagcaatatcaccagaatatctttatgtgacagccttattccttactgctattgtttccatttgtactggaacctcttgggggtcagcagggactgtcggtgtggcatttatgggagttgcgattggattagacgccaatttggctgctacggcaggtgctgtggtcgctggtgcgtattttggagataaattatcgccattatctgatacaaccaatattgcatccgcagctgctggcgtagatttatatgagcatatagttcacttactttatacaacattaccatcttttattctttcggctactgtctatgtggtatatggtttaaactacgatttttctaatgtagcgactccagaaaaagtaaatacaatgattcatgagttagagcaagtttatcattttaactttctattacttattccagtcgctattgtattatggggatctattactaagaaaccgactattccagtgatgttattatcagcatttatcgcaattattaatgctatcttaattcaaaaattctctctatctgatgtgattaatagcgcagttaatggatttgatacctcaatgattcaccatacttcagttagctctgatttaagtcgtttgttgaatcgtggtggaatgaactcaatgatgggaacactattaatttgtttctgtgcattatcatttgcaggtgtattacaattgagcggtgcattaaccgtgattattcaaaaattactcacctttgttcattcaactctttctttgattattacaacgattctttgcggtctaacaatgattggggttacttgtaatgggcaaatttctattctaattccaggagaaatgcttaaaaatgcgtatgtagaaaaaggattacatccaaaaaatctaagtcgaacagcagaagactccgcaacaattattgaacctattttgccatggactgccgcaggtgcatatatggcaggcacattaggtgttgcaacattgtcttatttaccttgggcaattttatgttggagcggtattatctttgctattatttatggtgcaagtggaataggtattgcgaagctaaaaaaataa

SEQ ID NO: 1903 - DNA, 1173 bp, H. influenzae strain 86-028NP
atgaataatttttataattttgatgtgattattgatcgtctaaatacatttagtgctaaatggaatgtagataatgatattattccaatgtctgttgcggatatggatattccagcccctcagataatgatagatgaattagaaaaatttaatcgtttaggaatttatggttatactgaattaccagccgactattacaagataatcagtgattatattttcgaacaatatcattattctgttctctctgaaaaaattgtattttgcccaagaataatccaagccgtatctatttatatacgagcatttacaaaagaaaatgatggaatatgtattctatcaccttcatatagtccaatattaaacacgataaaattaaatgacagaaaattatatcaatgtcctttggtttatgaaaatagaaagtatcatattgattttcatttattagaggaatgttttaaacattctaaagtatttgttttaatttctcctcataatccaactggaacgatttggaataaagaagtccttattaaaattataaacttagctaaaaaacataatgtatttatcatttccgatgatgtccacgcagactttacactaacaaatgactcccactatttaatatcatcattagatgaatgggtagcaaatcactcaatgatctgtttatccccagcaaaaacttttaatattcctggattggaaatagctaacctaattattgagaataaagaaattcgagaaaaatttataaaagaaatgatggcattaggtatacataatccaaattatttctctataccagctattatttcgttatataaatattgtactgattgggtaatctatctaaaagaatacataaagaataataagaagatagtaaaagaatttttcaatgagtatattccattattagatattactgaaagtgatggaacttatttactttggataaactataaaaagctaagtataaatgaaaatgaattagcttattggattaataatttatcaagagtaaaagtatctttggggagtgaatttggcaaagagggagatggtttctttcgtatgaatgtcgctatgcctagaaaaaaattattagaagcattgaatcgaatcaaaaatgggttttgtttattaaacaatagggagatttaa

SEQ ID NO: 1904 - DNA, 1320 bp, H. influenzae strain 86-028NP
atgacaacctatttcgataaaattgaaaaaatctcctttgagggagaaaaatccacaaatccttttgctttcaaacattatgatgctaatcaagtaattttaggtaaaactatggctgaacatttacgcttggcggtgtgttattggcataccttttgctggaatgggaatgatatgtttgggctaggttctttggagcgaagttggcagaaaaatccaaatgtgcttgctggcgcagaacaaaaagccgatattgcttttgagtttttgaataagttaggcgtgccttattattgttttcatgatgttgatattgcacctgaaggtaattcagtgcgggaatatgtacaaaattttcatcatattgttgatattttagaacgcaaacaagtagaaacgggtgtaaaactcttatggggaactgcaaattgttttactaatcctcgttatatgtctggtgcagcaaccaatcctaatcctgaggtttttgcttgggctgcaacacaagtgtttaatgcgatgaatgccactcaacgtttaggtggagaaaattacgtattatggggtggacgtgaggggtatgaaactttattgaataccgatttgaaacgtgaacgtgaacaaattggtcgttttatgcaaatggtggtagaacataagcataaaattgggtttaaaggtacattattaattgagccaaaaccgcaagaaccaactaaacatcaatatgattatgatgtggcaacagtgtatggtttcctaaaacaatttggtttagaaaaagaaattaaagttaatattgaagctaaccacgcgacgcttgctggccatacctttcaacatgaaattgcaacagcttgtgcattagatatttttggctcaattgatgctaatcgtggcgatccacaattaggctgggataccgaccaattcccaaatagtgttgaagaaaatacgttagttatgtatgaaattttaaaacatggcggttttactactggaggctttaattttgatgcgaaaattcgccgacaaagtattgatccttatgatttattttacgctcatatcggtgcaattgatgtattggcattatccttaaaacgtgcagcaaaaatgttacaagagaaaaccttacaaaaaattgttaatgcacgctatgcaggttggaatagtgaacttggtcagcatattttgcaaggtaaaacttcacttgaaacacttgcgcaacttgtccaacaaaaagatttagcaccaaaaccagtttcaggtcagcaagaatatttggaaaatttggtaaaccaagttatttatagctaa

SEQ ID NO: 1905 - DNA, 1536 bp, H. influenzae strain 86-028NP
atgaagcaaaagtgcggttgtatttcaccgcacttttttattttaggagacattatgtatataggaattgattgtggcacacaaggaacaaaggcaatagtgcttgattctgtccaaaaaaaagtgattggagttggttacgcaaaacatgaattaattacacaatccaatggaagacgtgaacaacaaccaaattggtggattgaggcattacaacaagcattacaaattgcattgaaacaagcaaaaaattcaccgcacttttcacctaatttagtgaagggaataggcatttcaggacaacaacatggactggtaatgttagataaaaacgatcgtcctctatataaggctaagctttggtgtgatacagaaaccgctacggaaaatgatatactgatcgaaaaattaggcggacaaacagccgtatttgaaaaattaggcatcatttgccaaactggttacacagcttcaaaactaagttggtttcgtcaaaattatcctgacaaatttgccaatattcgcaaaatcatgctgccacacgattatctaaattattggctaacaggaaaattctgcactgaatttggtgatgcttctggtagtggttatttcgatgttgtgaaaagagaatggaaaagagaagtcttcaaatatcttgcaccagaattaaatatggatgaagtgttaccaaaattactttctgctgaacaaaaaatcggtgtgattaaacctgaaattgcgactttatttggttttaatgagaatgtcatcgtctccacaggtggaggcgataatatgatgggagcaattggtacaggaaatattcgagaagggattgctacgatgagtctcggtacttctggtaccttgtatgcttatacgcaaaagccattgcttaatttaccaccaatgatcgcaaatttttgttcaagtaataatggctggttaccactggtttgtgtaatgaatataacctcctcaaataaacagctaatgaatttgctcaatattgatattgaagaattaaatcaacttgctcaacaagcacctattggcgcgaatggcatcactattttgccattctttaatggtgaaagagttccacctttacccaatgcaaaagcgagcattttaggattagattcaagtaatttcacacgagaaaatctttgtcgagcaatgatggaaagtgctacttttacgcttcgctatggcttagatttatttcgtcaagctggcctcgaaacctcacaaattcgcctaattggaggtggcgcgaaaagctcattttggcggcaaatgattgctgatgtgatgaattctgaagtggtatgtttgcaggaagaagaagctgctgcattaggaggagcaattcaagctatgtgggcaaatggagaaggagaactggaatttttatgcgaaaccttcattcacttagatgaaaactcaaaagcttatcccaacttatcacaggtgaaaaattatcaaagtgcttatgagcgttatttaatacatttatcacaattatattaa

SEQ ID NO: 1906 - DNA, 927 bp, H. influenzae strain 86-028NP
atgattattgtaacaggcggcgctggttttattggcagtaatattgtcaaagcattgaatgatttagggcgcaaagatattttagtggtggataacttaaaagatggcacgaaatttgcaaatttagttgatttagacatcgcagattattgcgataaagaagatttcattgcttctattattgcgggcgatgaatttggcgatattgatgcggtattccacgagggggcatgttctgcgactacggaatgggatggtaaatacattatgcacaacaactacgaatattctaaagagttgttgcattattgccttgaccgtgaaattccttttttctatgcctcaagcgcagcaacttatggagacaccaaagtattccgtgaagaacgtgaatttgaaggcccattaaatgtgtatggctattctaaattcttgttcgatcaatatgtgcgtaacattttgccagaagcaaaatcgccagtatgtggtttccgttatttcaatgtttacgggccgcgtgaaaatcataaaggttcaatggcgagtgtggcattccacttgaataaccaaatcttaaaaggcgaaaatccaaaattatttgcaggcagcgaaggattccgccgtgattttgtttatgtaggcgatgtggctgcagtgaatatttggtgttggcaaaatggtatttcgggtatttacaaccttggtacaggaaatgcagaaagtttccgtgcggtggctgatgcggtagtgaaattccacggaaaaggcgagattgaaaccattccattcccagagcatttgaaatctcgttatcaagaatatactcaagcagatttaactaaacttcgctcaacaggctacgataaaccattcaaaacagtcgcggaaggcgtgactgaatatatggcgtggttgaatagaaaataa

SEQ ID NO: 1907 - DNA, 504 bp, H. influenzae strain 86-028NP
atgaagattaaaaaattactcaagaatggattatccctctttttaacttttattgtgataactagcatactggattttgttcgtcgccctgtagtgccaaaggaaataaataaaatcacgttacaagatcttcaagggagtacgttctctcttgatagtcttgatcaaaacaaacccacattactttatttttggggaacttggtgtggttattgtcgttatacttcgccagcaattaattctttagcaaacgaaggctatcaagttgtatcggtggcattacgctcaggcaatgaggcggacgtaaatgattatttaagtaagcatgactaccacttcactacggttaatgatcctaaaggggaatttgcagaacgatggcaaattaatgtgacacccacaattgtgttgttgagtaaaggcaaaatggatcttgttacgacaggccttacgagttattggggattaaaagtgcggttgtttttcgcagagttttttggctaa

SEQ ID NO: 1908 - DNA, 672 bp, H. influenzae strain 86-028NP
atgacatcaaatcaacttgctcaatatatcgaccacaccgcacttaccgcagaaaaaaatgaacaagatatttcgacactctgtaatgaagcgattgaacatggattttattctgtatgtatcaattctggttatattccactcgctaaagaaaaacttgctggctcaaatgtaaaaatttgtaccgtagttggcttccctttgggggcgaatttaacctctgtcaaagcatttgaaacgcaagaagctattaaagcgggtgcaaatgagattgatatggtaattaatgtaggttggataaaatcgcaaaaatgggatgcagtaaaacaagatattcaagctgtatttaatgcttgtaatggcacgccattaaaagtaattttagaaacttgtttgctcactaaagatgaaatagtgaaagcctgcgaaatttgtaaagaaatcggtgtagcttttgttaaaacatcaacgggtttcaataaaggcggcgcaactgtagaagatgttgcattgatgaaacaaacggtcggcaatattggtgttaaagcatcaggtggtgtgcgtgatactgaaactgcacttgcaatgattaaggcgggtgcgactcgcattggtgcaagcgctggcattgcaattattagcggtacgcaagacactcaaagcacttactaa

SEQ ID NO: 1909 - DNA, 1530 bp, H. influenzae strain 86-028NP
atgtcccttgctattgtttacagccgtgcttctatgggtgtgcaagcaccgctagtcaccattgaggtgcatttaagcaacggaaaaccaggatttacacttgttggtttgccagaaaaaaccgtgaaagaggcacaagatcgggtgcgtagtgcgttgatgaatgcacaatttaaatacccagccaagcgtatcacagtgaatctcgcccctgcggatttaccgaaagaaggcggaagatttgatttgcctattgctatcgggattttagctgcatcagatcagcttgatgcaagccgtttaaagcaatttgaatttgtggcagagcttgcgctgacgggccaattgcgtggcgtacatggtgtgattcccgctattcttgcagcgcaaaagtcaaagcgagagttaattatcgcgaaacaaaatgctaatgaagcctcgctcgtgtctgatcaaaatacttattttgctcaaacgcttttagatgtagtgcaatttctcaatggtcaggaaaaattacccctcgccactgaaattgtgaaagaaagtgcggtaaatttttcaggtaaaaatacgttagatttaacggatattatcggacaacagcacgctaaacgagcattgaccattgccgcagcggggcagcataatttgctctttcttggcccaccgggtacagggaaaaccatgttagccagccgtttgacagggattttacctgaaatgacagatttagaagcgatagaaacagcatctgtaacgagtttagttcaaaacgagttaaattttcataattggaagcaacgtccttttcgcgcaccacaccatagtgcatcaatgccggctttagttggtggcggaacgatccctaaacctggcgaaatatccttagcaacaaatggggcgctttttcttgatgaacttccagaatttgagcgaaaagtgttagatgcactacgccagcctttggaaagtggtgagattattatttctcgtgccaatgcaaaaattcaattcccagctcgttttcaattagtggcagcgatgaatccaagccctacaggccattatactgggacacataaccgcacttcaccacagcaaattatgcgttatttgaatcgactttcagggccatttttagatcgttttgatttatctattgaagtgcctttactgccacaaggtagcttgcaaaatacgggcgatcgtggcgaaaccagcgtgcaagttcgtgaaaaagtgttaaaagtacgtgagattcaaatggaaagagcggggaaaatcaacgcttatttgaacagtaaagagattgagcgtgattgcaagttaaatgataaagatgcctttttccttgaaaaagcactgaataaacttgggctttctgtacgggcttatcatcgtattttgaaagtttctcgaaccattgccgatctacaaggagaacaacaaatttctcaaccgcacttggcggaggccttgggctatcgagcaatggatcgtttgctgcagaaattgtcgaatatgtaa

SEQ ID NO: 1910 - DNA, 618 bp, H. influenzae strain 86-028NP
atgtctgaaattaaacttaattaccacaaaacccactttttaacgagcgcgccgaatattcgttccattcctgaagatacgggcattgaaattgcgtttgcgggtcgttcaaatgcgggaaaatcgaccgcacttaatgcactaaccaatcaaaaaaatttagcgcgcacctcaaaaacaccggggcgcacgcaattgattaacttatttgaagtggaaccaaattgtaaattggtagatttaccgggctatggctatgccgccgtgccagagcaaatgaaaatccaatggcaaaaatccttgggcgaatatttgcaaaaacgcgaatgtttggcaggattggttgtgttgatggatattcgtcaccctcttaaagatcttgaccaacaaatgattgaatgggcggtttcagcaaatttaccggtacttttattgcttactaaagccgataaattgagccaaagcgcacgtagtaaacaagtaaaaatggtgcgtgaagcaattcttccatttcaaggcgatatacaagttgaggctttttctgcacaaaataaaattggtattgataaattggcggcgaaattagatttttggttttcgccactttttgcgaaataa

SEQ ID NO: 1911 - DNA, 879 bp, H. influenzae strain 86-028NP
atggcaatccagatgacaacaaaaacaacttaccaatggcctcaatctaaggatatttatccatatcgaccagggcgttttgatgcaccaaaacattggcgttataacttacgtagctttttaaatcgtggttcaattcgtcgctttgaacaatttatcaatcaatatccttttctcgtcgatatttttaatacgcacttggattatagttatcctgttgcttgtcgttttttagataagcgttttaacgcatcacaacgttttcatgccgtttgtgagaatcttttatttttacccgaaaaacttaccgcactttctacgccgttatgggaaaaacctctaagttttggcgaagtcattcctgattttgaaatgacattaagcatgacaacccatcaaccgatggaaggatattgggtattggagctatggcataaaccaagaaacgaattagtctatttgcttacctttgccaaattaggcgatgcgttgcttattgctgttgtacaagggccaaattttgaaggctcaaaggaaatggtgaaacaactaaccaaattatgccacggtttacgccctgcctatttaatggttgaaaccatgaaatcactcacaaaaatactaggctacgataaattgcttggcattccgcaaaaataccaaaataaatctcgcttcattcaaagtaaacaatatactgtggattatgatgcaatttttggcgaatcaggcggagaattaaaagattactgggaattgcctttagaaatggatagaaatctggatgatattccaagtaaaaaacgttccatgtatcgtaaacgttatgcgatgctagatgatttggctaaggtaattgaagaaaagttaggattgtaa

SEQ ID NO: 1912 - DNA, 999 bp, H. influenzae strain 86-028NP
atgacagtctcaaacaacaaagaattactccttgaagtcaatcacttaggcgtcagttttaaaattaaaaatgataaatcccttttcttcgccaaaccgcaaaccttaaaagcggtgaaggatgtgtcttttaaactttacgcaggtgaaactctcggcgtagtaggtgaatctggttgtggtaaatccacacttgcacgcgctattatcggtttagtcgaagcgagtgaaggggaaatcttgtggcttggtaaacatttacgaaaacaatcagcgaaacaatggaaagaaacgcgtaaagatattcaaatgattttccaagatccgctcgcctctctcaatccgcgaatgaatattggcgaaatcattgctgagccattaaagatctaccaaccgcacttaagtgccgccgaagtgaaagaaaaagtgcaagctatgatgttgaaagttgggcttttaccgaacttgattaaccgctacccacatgaattttctggtggtcaatgtcagcgtatcggtattgctcgtgcgttaatcattgagcccaaaatgatcatttgtgatgagcccgtttcagcgttagatgtgtcgattcaggctcaagtggtgaatttattgaaatccctgcaaaaagaaatggggctttccttaatttttatcgcccatgatttagcggtggtaaaacatatttctgaccgcgtattagtgatgtatttaggcaatgcaatggaattaggcagcgatgtggaagtatataacgataccaaacatccttataccaaagccttaatgtctgctgttccgatccccgatccaaaattggaacgcaataaatccatcgaattacttgaaggtgatttgccttcgccaattaatccaccgtctggttgcgtatttcgtactcgctgtctaaaggctgatgagaattgtgcgaaacaaaaaccacctttcaccagccaaaacaacagccattttgtggcttgcttgaaagtcttataa
